United States Patent 7,709,616 (MICRORNAS AND USES THEREOF) - sequence listing, part 6

SEQ ID NO: 141414 - RNA, 64 nt, hsa
uacaaaaacauuuugccuauuucgcuaacaguuugguuuuuaauggcugugguauuugagugag

SEQ ID NO: 141415 - RNA, 64 nt, hsa
ugcaacaauuucucuuguaaauggaaugguuugggguuuuuaaauaagcauuaacuaacaaccu

SEQ ID NO: 141416 - RNA, 64 nt, hsa
guacuugaugcucacagaggaagaaaaugaugaugguuuuuauuccuggcauccagagugacag

SEQ ID NO: 141417 - RNA, 64 nt, hsa
ucuuuagaaaauggggaucugccauauuuguguugguuuuuauuuucauauccagccuaaaggu

SEQ ID NO: 141418 - RNA, 64 nt, hsa
uagcauccugcuuagagaccaaucaacggacacugguuuuuagaccucuaucaaucaguaguua

SEQ ID NO: 141419 - RNA, 64 nt, hsa
cugacccccuagcaacguaguugacacagcuccagguuuuuaaauuacuaaaauaaguucaagu

SEQ ID NO: 141420 - RNA, 64 nt, hsa
uauugagggaaauguuuucauauuuuucaaaauagguuuuuauuguugaauguacaucuacccc

SEQ ID NO: 141421 - RNA, 64 nt, hsa
ucugucuccucuucuuugucaucagccaaaacgugguuuuuaaagagagucaugcagguuagaa

SEQ ID NO: 141422 - RNA, 64 nt, hsa
ccaacuucuuucaucaggaaaccuuauucaggaggguuuuuaaaaaguguuuaaaugucaaaug

SEQ ID NO: 141423 - RNA, 64 nt, hsa
gcuaugauguuaguuuuccuuagcugauuuugaggguuuuuaaaaauaaagcaagguugacuaa

SEQ ID NO: 141424 - RNA, 64 nt, hsa
aguucaagcuucaggcuuuaguagagaaauuagagguuuuuaaaauuuguuuucaauuucagug

SEQ ID NO: 141425 - RNA, 64 nt, hsa
uccuuauuuccacaaauauuuugcauuuuuaggagguuuuuagaauguuuccauugcuuuuaua

SEQ ID NO: 141426 - RNA, 64 nt, hsa
aaaagcacuaauuaguuuaaaaugucacuuuuuugguuuuuauuauacaaaaaccaugaaguac

SEQ ID NO: 141427 - RNA, 64 nt, hsa
cuuauuuauagaaaguacagugauucugguuuuugguuuuuagaaauauuuuuuauuuuucccc

SEQ ID NO: 141428 - RNA, 64 nt, hsa
aauaaggaaugaaucaacugaccuugggccagcagguuuuuaacuaaauuguuacuugccuuuc

SEQ ID NO: 141429 - RNA, 64 nt, hsa
ugcaguuagcuuaaauuacaauuugaagucuugugguuuuuauauagcuaggcacuuuauuacu

SEQ ID NO: 141430 - RNA, 64 nt, hsa
uccauuaucuauauaaaauagugacuaagccucagguuuuuaauuuugugauaacaaaauaacg

SEQ ID NO: 141431 - RNA, 64 nt, hsa
guuguuuguuucauaaagcauaucacuuuaaaaugguuuuuacuccugugauuauguuggaaua

SEQ ID NO: 141432 - RNA, 64 nt, hsa
uugauuucccucugcagcacagcgucucuguaaagguuuuuaugcuuucaccagccaugucuua

SEQ ID NO: 141433 - RNA, 64 nt, hsa
gagcaacugaugauuaaauguugcuuuuuaauaagguuuuuaacuugaaaauuugaaaauauuu

SEQ ID NO: 141434 - RNA, 64 nt, hsa
uauagugauauauuguguuaauuuggacaguagcgguuuuuaaaaaccauauacugacugaaac

SEQ ID NO: 141435 - RNA, 64 nt, hsa
acccuuuccguuggggaugggggcaagggugggagguuuuuagaagaguauauaucucuuuaaa

SEQ ID NO: 141436 - RNA, 64 nt, hsa
uaacuguaaguuuugugcuuccaaaucacuuuuugguuuuuaagaauuucuugauacucuuaua

SEQ ID NO: 141437 - RNA, 64 nt, hsa
guuacuucuauuugaauuucuauauuucccaugugguuuuuauguuuaauauuaggggaguaga

SEQ ID NO: 141438 - RNA, 64 nt, hsa
aagugcuuggaugaaaggacagcguggauaaaaagguuuuuaaaacauggauguuaaggcuguu

SEQ ID NO: 141439 - RNA, 64 nt, hsa
uauuuuuauuuugaauaaacagaaagaaauuuuggguuuuuaauuuuuuucuccccgacucaaa

SEQ ID NO: 141440 - RNA, 64 nt, hsa
aggcacagaagguugucaugggcuguuccuuggggguuuuuauccugcucaccguggagauaag

SEQ ID NO: 141441 - RNA, 64 nt, hsa
ugaggcccaggcaggugaagaggaaguggcuuuggguuuuuaaaguaggugagcgugagccucu

SEQ ID NO: 141442 - RNA, 64 nt, hsa
gucauucuguaauguaaauguuguuaauaagaaugguuuuuacauaaauuaugcaaagguuaac

SEQ ID NO: 141443 - RNA, 64 nt, hsa
gucuucaagaaagaagccaaaaauauuuccgugagguuuuuaacuaccucugaaucuguccuac

SEQ ID NO: 141444 - RNA, 64 nt, hsa
ggaguugaguuuugguuugguccugcucaguuuugguuuuuaguuguccauccucacaguccua

SEQ ID NO: 141445 - RNA, 64 nt, hsa
acaccagugaaggugucucuguuuuaaugaucaggguuuuuauuccaucuuuugcauuucuucu

SEQ ID NO: 141446 - RNA, 64 nt, hsa
gaaauuuccaagccaaugguuucuuuuggguuuugguuuuuauguuuguuuuuugggguuugga

SEQ ID NO: 141447 - RNA, 64 nt, hsa
gguuuuccuuuucuuugggacugugaggggaaaugguuuuuagaggugaggguugguccaugug

SEQ ID NO: 141448 - RNA, 64 nt, hsa
guagggaccucagagguuuaccuagagaacaggugguuuuuaaggguuaucuuagauguuucac

SEQ ID NO: 141449 - RNA, 64 nt, hsa
uuuuaaggguuaucuuagauguuucacaccggaagguuuuuaaacacuaaaauauauaauuuau

SEQ ID NO: 141450 - RNA, 64 nt, hsa
ucagcucuggauuacuucaguugaccuuugugaagguuuuuaucuguguagaauggguguuuga

SEQ ID NO: 141451 - RNA, 54 nt, hsa
ucuccacucaggaguggugacugagguuuuuauguagaaggggaacaaaaaaaa

SEQ ID NO: 141452 - RNA, 64 nt, hsa
aacucaaaguuuugaagucagugggaaaaaaggagguuuuuagacuuucuuaaaagacguuaaa

SEQ ID NO: 141453 - RNA, 64 nt, hsa
uauugaaauauguuguuucuaaugacauuucugugguuuuuaacuuuuuaaugaauuucacaga

SEQ ID NO: 141454 - RNA, 64 nt, hsa
uauuguguauuauguuguucaaaugcauuuuggggguuuuuaaucuuugugacaggaaagcccu

SEQ ID NO: 141455 - RNA, 64 nt, hsa
gagaggcggccucgugccaugaucuguauuuaaugguuuuuauuucucgggugcauuugagaga

SEQ ID NO: 141456 - RNA, 64 nt, hsa
uucuguucuuuaagaucccuguaagaauguuuaagguuuuuauuuauuuauauauauuuuuuga

SEQ ID NO: 141457 - RNA, 64 nt, hsa
uaaaguaccgcuuaaaauugauauaaauuacugagguuuuuaacauguauucuguucuuuaaga

SEQ ID NO: 141458 - RNA, 64 nt, hsa
uuugaauuguaaaugucaaguauucuguuuuugggguuuuuauguuuuauuauacuuuguuaaa

SEQ ID NO: 141459 - RNA, 64 nt, hsa
uccuucccuccuccaagcacuuguagcaguuucagguuuuuaauuuuuuucugcaaauaaaucu

SEQ ID NO: 141460 - RNA, 64 nt, hsa
aaagaacauguguccauuuggaccaaacguuguugguuuuuaaaaaauuuuauuuuguuuuuuu

SEQ ID NO: 141461 - RNA, 64 nt, hsa
acacuugacaccuugaggguagaauuuagcguuugguuuuuaccuccuagcauaugcuguuugg

SEQ ID NO: 141462 - RNA, 64 nt, hsa
cuuauucuaaggucaaaaguggaaagacacuguugguuuuuauuuugauuucacuauacucauu

SEQ ID NO: 141463 - RNA, 64 nt, hsa
guuuuaagauugucaauucugacuuuuuuauagugguuuuuaagaguauaaauagaagggagag

SEQ ID NO: 141464 - RNA, 64 nt, hsa
cgccacagccacacuugaagaaacacagcucuuggguuuuuaguccugcuguguguugggaaga

SEQ ID NO: 141465 - RNA, 64 nt, hsa
aaucacuguauuuuauagcuuuuuuuuucauguagguuuuuaguuaaaacaucuccugccuaaa

SEQ ID NO: 141466 - RNA, 64 nt, hsa
ggcaaaaugaugguaaccuaagucuuggauacaugguuuuuauuuguuuuguuuuugcuauucu

SEQ ID NO: 141467 - RNA, 64 nt, hsa
gacuugagacaucagucaaaugcaaugaaacagugguuuuuacuuagaucaugaguugaacaaa

SEQ ID NO: 141468 - RNA, 64 nt, hsa
auuucuuacuuuaagcucuuuagcaaauggaagugguuuuuaauuuuauuuuaaaauuauuuaa

SEQ ID NO: 141469 - RNA, 64 nt, hsa
gagagaaacuuuacaaguguaaugaauguggcaagguuuuuaaucaaaaaacaacccuugcacg

SEQ ID NO: 141470 - RNA, 64 nt, hsa
auuucuuacuuuaaguucuuuagcaaauggaauugguuuuuaauuuucuuuuaaaauuauuuau

SEQ ID NO: 141471 - RNA, 64 nt, hsa
gagagaaaccuuacaagcacaaugaaugugacaugguuuuuaaucaacaaucacaccuugcaag

SEQ ID NO: 141472 - RNA, 64 nt, hsa
gagagaaaccuuacaagcauaaugaauguggcaagguuuuuaaucaaaaagcaaccuuugcaca

SEQ ID NO: 141473 - RNA, 64 nt, hsa
cuuaaaagagcuaacguucuuauuaaggcuuugugguuuuuagaguugcaucuaugaaccuggg

SEQ ID NO: 141474 - RNA, 64 nt, hsa
uuucaauuaaaaagcacacuucuacaaaagauuugguuuuuaaauuaugguuacacauuucagu

SEQ ID NO: 141475 - RNA, 64 nt, hsa
uucaauguuuuacagaauuacauuuucaaaaaaagguuuuuauaaugaaguuguuuauuaaaaa

SEQ ID NO: 141476 - RNA, 64 nt, hsa
ccucuuggaguauuuuuggcuuuauauaaaacaagguuuuuaauuguaaaguauaagugccauu

SEQ ID NO: 141477 - RNA, 64 nt, hsa
cuguuuuguuuugggugggagggugggaaauuuggguuuuuaaguccucuaaacacacuugggc

SEQ ID NO: 141478 - RNA, 64 nt, hsa
cugacuaggucaauuuuuuuucugaacaaaagcagguuuuuauauguaaacagugagaaaagaa

SEQ ID NO: 141479 - RNA, 64 nt, hsa
gggacauuccguccugaugauuuuuauuuuuguugguuuuuauuuuuggggggaaugacauguu

SEQ ID NO: 141480 - RNA, 64 nt, hsa
uuaucaauugcaaaaugcguauuugcauuugggugguuuuuauuuuuauauacguuuauauaaa

SEQ ID NO: 141481 - RNA, 64 nt, hsa
acuuaagacuuuaugggagagauuagacacuggagguuuuuaacagaacguguauuuauuaaug

SEQ ID NO: 141482 - RNA, 64 nt, hsa
aacguuugccccuggcguuuccuaaguacgaaaagguuuuuaagucuucgaacagucuccuuuc

SEQ ID NO: 141483 - RNA, 64 nt, hsa
ccauagcuugaaggcagugagggagccaugaaaugguuuuuaauagggggacuccagaucagau

SEQ ID NO: 141484 - RNA, 64 nt, hsa
guggaauugcaaagucauaggauauuuauauauugguuuuuaauaauacuuccaaauugcccuc

SEQ ID NO: 141485 - RNA, 64 nt, hsa
uuacaauucacuuauuuuaaggguacaauuuagugguuuuuaguguauucacaaaguuguguaa

SEQ ID NO: 141486 - RNA, 64 nt, hsa
acauagccccaaagcaugagauuauuuuucauuggguuuuuauuguuguuuaguuuugguuugu

SEQ ID NO: 141487 - RNA, 64 nt, hsa
auauauucucaguauuuggaacuaauguuuuuaagguuuuuaggaaaaucaggucauuuaagaa

SEQ ID NO: 141488 - RNA, 64 nt, hsa
uugucacugagaagauguuuauuuuggucaguuggguuuuuauguauuauacuuagucaaaugu

SEQ ID NO: 141489 - RNA, 64 nt, hsa
ugguguaggggcuuagaggcaugggcuugcuguggguuuuuaauugaucaguuuucauguggga

SEQ ID NO: 141490 - RNA, 65 nt, hsa
augcuuuuuguaucacacaguauaugauggggcaugugccauagugcaggcuuggggagcuuuaa

SEQ ID NO: 141491 - RNA, 65 nt, hsa
acaaaugguauuuugauagauacuggauuguguuugugccauauuugugccauucuuuuaagaac

SEQ ID NO: 141492 - RNA, 65 nt, hsa
ggcagcugggccuccugggugccaguccaucucaagugccauauucugugaucacggauguuggc

SEQ ID NO: 141493 - RNA, 65 nt, hsa
ggccgacagucuggaaaugaauccaucauacauuagugccauagaguuuaguaaccguccagcaa

SEQ ID NO: 141494 - RNA, 65 nt, hsa
aaacaauuguaaugauauuauuuauugggcauuuugugccauacauggugaugagcaguuugcau

SEQ ID NO: 141495 - RNA, 65 nt, hsa
cauaaagcuuccgugacuucuaaaccaucaggucggugccauaagagaugcucaaaaaagcaugg

SEQ ID NO: 141496 - RNA, 64 nt, hsa
ucagaaagagcucuccagaagccaauauugagauguaauucagauuaggacacagugugugacg

SEQ ID NO: 141497 - RNA, 64 nt, hsa
ccaguguuuuugcaggugaggaaacaggggcagaguaauucaggcacauguguucagaguucca

SEQ ID NO: 141498 - RNA, 64 nt, hsa
cuuuaacugauccucaacuuuuacuaaacauaagguaauucauacuggagaaaagccauacaaa

SEQ ID NO: 141499 - RNA, 64 nt, hsa
uucuugaaaaauuaguuuuugaaaagcaaaugauguaauucaacucaaauucaugcucuucauu

SEQ ID NO: 141500 - RNA, 64 nt, hsa
auauuauuauaauaaacuuauuacugcuuguaggguaauucacaguuacuuacccuauucuugc

SEQ ID NO: 141501 - RNA, 64 nt, hsa
gugacucuuuuucuacaacugccuugucaguuugguaauucacuuaugauuuucuaauguucuc

SEQ ID NO: 141502 - RNA, 64 nt, hsa
aaaagugaaccagaacaaaucacucauuuaaaaaguaauucagaagaacaguguggcaugauca

SEQ ID NO: 141503 - RNA, 64 nt, hsa
cucuuuucacuaggguauaaguagcugccaauuuguaauucaucuguuaaaaaaaaucuagauu

SEQ ID NO: 141504 - RNA, 64 nt, hsa
aaaacauugccuucuguuuuguauaucccuuauaguaauucauaaaugcuucccauggaguuuu

SEQ ID NO: 141505 - RNA, 64 nt, hsa
ucuuuuguuagaaauuguuagagaauagagagugguaauucagauuuggucaacgauucuaguc

SEQ ID NO: 141506 - RNA, 64 nt, hsa
aauugagcuugccaggcugucucauuccuaacauguaauucaugauuuagccacuaaauuucua

SEQ ID NO: 141507 - RNA, 64 nt, hsa
gccaacugcuaauggaucgaaugugcuuuuuauuguaauucaacagcuauagagagaaagauaa

SEQ ID NO: 141508 - RNA, 64 nt, hsa
ucauauuuuguuauguguaggauacucuuaaaauguaauucauuaaacuuuuacaaucugaaag

SEQ ID NO: 141509 - RNA, 64 nt, hsa
cuuccccuccucccuguugcccauacucagcaucucggaugaaagggcucccuuguccucaggc

SEQ ID NO: 141510 - RNA, 64 nt, hsa
ucuuuccucccccugcaacuuccgcugaggggucucggaugacacccuggccugaacugaggag

SEQ ID NO: 141511 - RNA, 64 nt, hsa
ucugccaaaaagugggggcuguacuggggacugcucggaugaucuuucuuagugcuacuucuuu

SEQ ID NO: 141512 - RNA, 64 nt, hsa
ucugacccaugggagauuuggagcugucuacucuucggaugaggcccucauucccauucgggag

SEQ ID NO: 141513 - RNA, 64 nt, hsa
uacauauuguuagggucagccauuuuuaaugaucucggaugaccaaaccagccuucggagcguu

SEQ ID NO: 141514 - RNA, 64 nt, hsa
uaaagaagccuagugguuuguguggccaacuccaucggaugaaugcacacgcagacagacccuc

SEQ ID NO: 141515 - RNA, 64 nt, hsa
gagucuuguuaaaaugauggauucaacuucugccucggaugagagguuggaaauguagcugcuu

SEQ ID NO: 141516 - RNA, 64 nt, hsa
ccccuuaauggauuguggcaguugaaauaauccaucggaugacccaccuguagugagauguacu

SEQ ID NO: 141517 - RNA, 64 nt, hsa
uucagacuguugaugacauugacauuucauggauucggaugaugcaaggagacacaugccaccc

SEQ ID NO: 141518 - RNA, 64 nt, hsa
cauucagaggcaucacaaguaauggcacaauucuucggaugacugcagaaaauaguguuuugua

SEQ ID NO: 141519 - RNA, 64 nt, hsa
aagugggacauucaaaaaacucucucccaggaccucggaugaccauacucagacgugugaccuc

SEQ ID NO: 141520 - RNA, 64 nt, hsa
ugccggacuugagucugaguucauggagacucugucggaugaagaaguacuucugugucucacc

SEQ ID NO: 141521 - RNA, 64 nt, hsa
gugucauuuggguguuuuggcaacucaggggccuucggaugaucuuaaaccuuuguguucagcc

SEQ ID NO: 141522 - RNA, 64 nt, hsa
gggcagugccgagggucaccuuggugcacuuucuucggaugaagaguuuaaugcaagaguaggu

SEQ ID NO: 141523 - RNA, 64 nt, hsa
gaaagcugcucgugcucguuccaaagggaaaaacucggaugaagaagcccccaagacugcccag

SEQ ID NO: 141524 - RNA, 64 nt, hsa
uauauuguucuaauguaaaauuguacugggcuggucggaugagcugaggccauugacuucucua

SEQ ID NO: 141525 - RNA, 64 nt, hsa
uucaaacuguucuuuuuccuaauuaauguagcuuucggaugacauaaauccaguaucucugcuu

SEQ ID NO: 141526 - RNA, 64 nt, hsa
agggacuuaccuggggcuggcaugugugacugucucggaugaagugacugacccagugcacacu

SEQ ID NO: 141527 - RNA, 64 nt, hsa
caguggugccucucaagaaaccccgaacgaauguucggaugacuuuggagaguuucaaagugaa

SEQ ID NO: 141528 - RNA, 64 nt, hsa
ccacggagcaacuggaaaaccaucagccaagcguucggaugagucugguuauugguccaccccc

SEQ ID NO: 141529 - RNA, 64 nt, hsa
ucuuggauucaucucaucucauggaaugauccugucggaugacgcugacgugauugcuucagac

SEQ ID NO: 141530 - RNA, 64 nt, hsa
ggaagccugaagcaggcagggccgguggacuucgucggaugaagagugauccuccuuccuuccc

SEQ ID NO: 141531 - RNA, 64 nt, hsa
gagggaggaauuacacagcugaccgaauccggcuucggaugaggugagggaggagcaggucagg

SEQ ID NO: 141532 - RNA, 64 nt, hsa
cugacucaggucuccgccaugcacgcguggacucucggaugagcucagcagaaccgcacagcca

SEQ ID NO: 141533 - RNA, 64 nt, hsa
cuucccgcccuccugcagcaaagggcaaccacccucggaugauggguugcagccggccugcugc

SEQ ID NO: 141534 - RNA, 64 nt, hsa
agaugaugauguaauagugaauaaaccucauguuucggaugaagaggaagaagaaccuccuuuu

SEQ ID NO: 141535 - RNA, 64 nt, hsa
uucaauuuuaauuuucuucuuucucagaccucagucggaugaacauauuccaguauuugaagcc

SEQ ID NO: 141536 - RNA, 64 nt, hsa
uuuacuuuuauaaccuuuuggugaaccugcuauuucggaugacauugggcauuuuaguucuaua

SEQ ID NO: 141537 - RNA, 64 nt, hsa
ccgggacgcugagggggaucugguucggcugcugucggaugaggacguagcgcucauggugcgg

SEQ ID NO: 141538 - RNA, 64 nt, hsa
ucccuuggccuggaccagugagcuggggagggacucggaugaacugaggcgcagccuacgccau

SEQ ID NO: 141539 - RNA, 64 nt, hsa
agccccaaacuggugcauaaugcaugguacaagaaauauuuauguauuuuuuggaauuuuguaa

SEQ ID NO: 141540 - RNA, 64 nt, hsa
acaagaaauauuuauguauuuuuuggaauuuuguaauauuuaguaagaguauaugaaaggauug

SEQ ID NO: 141541 - RNA, 64 nt, hsa
acuauuaugcguaaugcucagcuuuuuguaaagaaauauuuaauuguauuuuguguuuauacag

SEQ ID NO: 141542 - RNA, 64 nt, hsa
acaaguuuguugagcuuuaaaauguauuugaaguaauauuuaaauaggcauuuaaaauuucaaa

SEQ ID NO: 141543 - RNA, 64 nt, hsa
uguuuccuccuacaguggagcagcauucaaaucaaauauuuacauauugcuuaucacuuuuucu

SEQ ID NO: 141544 - RNA, 64 nt, hsa
acagauauuuuauguuuuuuuaauuuucuccaagaauauuuauagaauuccaaagaaucagaau

SEQ ID NO: 141545 - RNA, 64 nt, hsa
gguuuaaauuauuggacaauuuaaauuguggguaaauauuuaaaacuccugaacaauguuucug

SEQ ID NO: 141546 - RNA, 64 nt, hsa
gucgcaacagaaucucuguggcccacaaggcuaaaauauuuacauucucacccauuacagaaaa

SEQ ID NO: 141547 - RNA, 64 nt, hsa
uaccuuuguaacuaaagucugucuagucauuguaaauauuuaucugucaguuuugacagauugg

SEQ ID NO: 141548 - RNA, 64 nt, hsa
agguauauauucaauuuuuuaccauuuuauggaaaauauuuaaaaucuguuuuuacaggguuuu

SEQ ID NO: 141549 - RNA, 64 nt, hsa
uuuguagaaggguuauauuuuacuacuguggaaaaauauuuaagauaguuuugccagaacaguu

SEQ ID NO: 141550 - RNA, 64 nt, hsa
uuuucaauuuugcaugcucgauuauucccuguacaauauuuaaaauuuauugcuugauacuuuu

SEQ ID NO: 141551 - RNA, 64 nt, hsa
guauaaaaauagaagaauacaaacauauuuguuaaauauuuacauaugaaauuuaauauagcua

SEQ ID NO: 141552 - RNA, 64 nt, hsa
ugaauuuucacucaugaguauguucugaauauuuaauauuuauuucuauuauuuucauauguua

SEQ ID NO: 141553 - RNA, 64 nt, hsa
aauuaauugaauuuucacucaugaguauguucugaauauuuaauauuuauuucuauuauuuuca

SEQ ID NO: 141554 - RNA, 64 nt, hsa
auuuaaaaaaacagcauaaaaugcuuaaaaauguaauauuuacuaaaaucagauuaugggauaa

SEQ ID NO: 141555 - RNA, 64 nt, hsa
cucugugagacaggccauaacugaaaaacucuuaaauauuuagcaaucaaauaggaaaugaaug

SEQ ID NO: 141556 - RNA, 64 nt, hsa
accuuuuggcucuuaagauauccuaaauauuuaaaauauuuagauauccuaaauauaggauaua

SEQ ID NO: 141557 - RNA, 64 nt, hsa
ucugugaggaccuuuuggcucuuaagauauccuaaauauuuaaaauauuuagauauccuaaaua

SEQ ID NO: 141558 - RNA, 64 nt, hsa
gagaguugaagauaguauauuucugguaguacugaauauuuacuuacaguuucuaucaaaaaua

SEQ ID NO: 141559 - RNA, 64 nt, hsa
aucuuuucuuauuugugugauuagaacuuagaaaaauauuuacuaguugaaguuauuaucaguu

SEQ ID NO: 141560 - RNA, 64 nt, hsa
auauccgaaaaaguaaacguuuaugacuauagguaauauuuaagaaaaugcaugguucauuuuu

SEQ ID NO: 141561 - RNA, 64 nt, hsa
ugccaaggcacucacagaaucauaaucauggcuaaauauuuauggagggccuacuguggaccag

SEQ ID NO: 141562 - RNA, 64 nt, hsa
caaacaaaaacagguaucagugcauuauuaaaugaauauuuaaauuagacauuaccaguaauuu

SEQ ID NO: 141563 - RNA, 64 nt, hsa
auaugaaccaugucuauuaauuuaauuauuuaauaauauuuauauuaaacuccuuauguuacuu

SEQ ID NO: 141564 - RNA, 64 nt, hsa
auuuagaaagaagcccaauauuauaauuuuuuucaauauuuauuauuuucaccuguuuuuaagc

SEQ ID NO: 141565 - RNA, 64 nt, hsa
ccccuugagaaaccuuauuguaccucucuuauagaauauuuauuaccucugauaccucaacccc

SEQ ID NO: 141566 - RNA, 64 nt, hsa
cauuuucuaaaucugggauuuaaaaucuuuagacaauauuuaaaaucuugauuuuuuuuaaaug

SEQ ID NO: 141567 - RNA, 64 nt, hsa
uugucaguuacuuuuagaaagaaaacacugcagaaauauuuaacagauuacuucuugauaaaau

SEQ ID NO: 141568 - RNA, 64 nt, hsa
gaacuauuaaauagaaaauuuaaaugcucacuugaauauuuaugauucuuaauagauuauuauc

SEQ ID NO: 141569 - RNA, 64 nt, hsa
aaggcuauguacuuauuauuuuagcucuuucuguaauauuuacauuuuuuaccauauguacauu

SEQ ID NO: 141570 - RNA, 64 nt, hsa
uguaguuucuuuguagagagauaauaaaaaucaaaauauuuaaugaaaauggacuuacuguuac

SEQ ID NO: 141571 - RNA, 64 nt, hsa
acuccgacuuuuauagaagcuacuuuuaaaucagaauauuuaauuuuugauauucauauaauua

SEQ ID NO: 141572 - RNA, 64 nt, hsa
ugaaauuuuuacuauuucuguuuccacaauuccaaauauuuaucuugguguauauauuguuacu

SEQ ID NO: 141573 - RNA, 64 nt, hsa
aaaaaggucagugacaauugauaaaugacaaggaaauauuuaauuagguaaaacuaaaucauug

SEQ ID NO: 141574 - RNA, 64 nt, hsa
aucagggagacauggguaauaauagguacuaauaaauauuuauagaugagugaaugaggaaaua

SEQ ID NO: 141575 - RNA, 64 nt, hsa
auauauuucaugaauacauuguacauauuauguuaauauuuacacaauuuaaaauauagaugug

SEQ ID NO: 141576 - RNA, 64 nt, hsa
aaagagagucaugcagguuagaaauaaugucaaaaauauuuaggaauuuaauaaccuuuaaguc

SEQ ID NO: 141577 - RNA, 64 nt, hsa
uugcaaauugcccacucgugauaagucaacagccaauauuuaaaacuuuguucguuacuggcuu

SEQ ID NO: 141578 - RNA, 64 nt, hsa
auuucagugcaaauauauuuugaaguuacuuuuaaauauuuauuuaaaaccucuguuucuguaa

SEQ ID NO: 141579 - RNA, 64 nt, hsa
uguaaugagaauagacuggaacaugugagggaaaaauauuuaaaaaaagauggcagucaucuag

SEQ ID NO: 141580 - RNA, 64 nt, hsa
aggaucaggauugcaugaaagaagaaaauccuucaauauuuaaaauguuucuuacaauacccac

SEQ ID NO: 141581 - RNA, 64 nt, hsa
ucuggguuggauguuagacuaaaggaaacccaggaauauuuaccugguguuacauuuaauauuu

SEQ ID NO: 141582 - RNA, 64 nt, hsa
ggaaacccaggaauauuuaccugguguuacauuuaauauuuaauguaacuggucuagcaacauu

SEQ ID NO: 141583 - RNA, 64 nt, hsa
gaagguguuuuucauucacuuuaauagaagggcaaauauuuauaagcuauuucuguaccaaagu

SEQ ID NO: 141584 - RNA, 64 nt, hsa
guggaaacaaacauguaagcauaacuuauuuuaaaauauuuauuuauauaacuugguaaucaug

SEQ ID NO: 141585 - RNA, 64 nt, hsa
auuuaauagcuuguuaccugugauuuuauuuuaaaauauuuauuuugauaugaugcuuaaauau

SEQ ID NO: 141586 - RNA, 64 nt, hsa
cuuugaagugagguacaugguucuuaacuauucaaauauuuauucuguuagaaaaaaaaauuuu

SEQ ID NO: 141587 - RNA, 64 nt, hsa
cccucagaaggaaaguccuuacuuuucacauauuaauauuuaguaauuuuuccugcuucuaaaa

SEQ ID NO: 141588 - RNA, 64 nt, hsa
caguuuagaaaguaucuggacucagaauaaauguaauauuuauacuuguuuccagaauguuauu

SEQ ID NO: 141589 - RNA, 64 nt, hsa
ccccucuccuuauuuuucuaauauuuagacuuugaauauuuagaacuagaguuccuauuuucag

SEQ ID NO: 141590 - RNA, 64 nt, hsa
agcauuuugucauauccccucuccuuauuuuucuaauauuuagacuuugaauauuuagaacuag

SEQ ID NO: 141591 - RNA, 64 nt, hsa
aauacuacauugucacuguaagcuauacuuuuaaaauauuuauuuuuuuuaaaguauuuucuag

SEQ ID NO: 141592 - RNA, 64 nt, hsa
uuauuuggcaauaaugggggugggaaccaagaaaaauauuuauuuuguggaucuuugaaaaggu

SEQ ID NO: 141593 - RNA, 64 nt, hsa
ugacaauuuaugaauuuguguuucaaauugauaaaauauuuagguacaaauaacaagacuaaua

SEQ ID NO: 141594 - RNA, 64 nt, hsa
cacagauugaagaagaaaagaaagaaaaaacuuaaauauuuauuucuaugcuuuguugccucug

SEQ ID NO: 141595 - RNA, 64 nt, hsa
acgucuuugaaguuguggcugagaagaugagaggaauauuuaaauaacaucaacagaacaacuu

SEQ ID NO: 141596 - RNA, 64 nt, hsa
uucacauaagucaauagauguuucucuagaacaaaauauuuaguaaagcuuuauaaauuauauu

SEQ ID NO: 141597 - RNA, 64 nt, hsa
aaugcuuguuuuccaacuauguugaauaaauaguaauauuuaucaguaaauacuccuuuccaac

SEQ ID NO: 141598 - RNA, 64 nt, hsa
cugggugucauguggaccagacuucugaauagagaauauuuauaacuuuuguaugagagagaau

SEQ ID NO: 141599 - RNA, 64 nt, hsa
guuauugaaaaaaugucuuuucauggugaaugacaauauuuauguugccuuuagcuucuugaag

SEQ ID NO: 141600 - RNA, 64 nt, hsa
gccugguuaauauuaauauucccauuuuauuaauaauauuuauguugggucaaguguuagguca

SEQ ID NO: 141601 - RNA, 64 nt, hsa
ugacagacuauuugcuaauguauaaugugcagaaaauauuuaauaucaaaagaaaauugauauu

SEQ ID NO: 141602 - RNA, 64 nt, hsa
cacacacguccucuccucccaggaaccucauucaaauauuuacccgggacacacaccccccccc

SEQ ID NO: 141603 - RNA, 64 nt, hsa
gucugaauaguuauguguuucuuuuaucccuggaaauauuuauuaaacuuuauaguuuauccga

SEQ ID NO: 141604 - RNA, 64 nt, hsa
uuuuggagauauguuucucucugaaauuacugugaauauuuaacaaacacuuacuugaucuaug

SEQ ID NO: 141605 - RNA, 64 nt, hsa
uaagauugcaccuggcagugugccuuuuugcacaaauauuuacuuuugcacuuggagcugcuuu

SEQ ID NO: 141606 - RNA, 64 nt, hsa
ggaaaauuaaaauuacuaauuaauuuuuagauucaauauuuauauggaguuuugaaaaauaaua

SEQ ID NO: 141607 - RNA, 64 nt, hsa
ggcagagcacuuuauucuucuggugagcucccugaauauuuauuuuucugauuauaaauuuucu

SEQ ID NO: 141608 - RNA, 64 nt, hsa
uacaguucugugaaaggacuuauuuuuuaacuguaauauuuauuaguuuuaaaauauuuguauc

SEQ ID NO: 141609 - RNA, 64 nt, hsa
caguugaaugggguuaaagcuuucaauaucuuaaaauauuuauaaaacauuucacuguugcaaa

SEQ ID NO: 141610 - RNA, 64 nt, hsa
agaaaaacuaaucuuaaacauacuauuucuaauaaauauuuauauuuuuaugaaauaaagaggu

SEQ ID NO: 141611 - RNA, 64 nt, hsa
acagauguaaauaauagcacuagccacucuuauuaauauuuauaguguuagaaaaccagccaca

SEQ ID NO: 141612 - RNA, 64 nt, hsa
cugguguuucauuaacuugguuuuaaauguugacaauauuuacaaguggaaauaaaauuuguaa

SEQ ID NO: 141613 - RNA, 64 nt, hsa
ucuauaauuguuuuguaauguaagacuaauuacuaauauuuauguagcaacuuuugugccagaa

SEQ ID NO: 141614 - RNA, 64 nt, hsa
auacauuuuguuuugguaaaugaacuguguauaaaauauuuaugccguuaaaacuguuuuuaga

SEQ ID NO: 141615 - RNA, 64 nt, hsa
uuuguuuuugcuaugaauauaauuacaguauuuuaauauuuaguuauuuaauuuguucuacuag

SEQ ID NO: 141616 - RNA, 64 nt, hsa
uuucuccauccuaaaaaaaguggcaaccaaggaaaauauuuagaugcaacuuacuagagugaug

SEQ ID NO: 141617 - RNA, 64 nt, hsa
uaaaaucaagucuugguuguggcuugcugaauuaaauauuuaugaguggugcauuuuuaaguau

SEQ ID NO: 141618 - RNA, 64 nt, hsa
auuauuguuauugaauccaaacaauguguuaaguaauauuuagggccagaaaaaucuuguacag

SEQ ID NO: 141619 - RNA, 64 nt, hsa
caguucucuuugucuauauucagcaucuaagacaaauauuuaaacauuuuaaagaaccacugug

SEQ ID NO: 141620 - RNA, 64 nt, hsa
ggggcucuaaaaugguuucacuuauuuaucccaaaauauuuauuauuauguugaauguuaaaua

SEQ ID NO: 141621 - RNA, 64 nt, hsa
ccacuuaaaacauaucaggccuucuauuuauuuaaauauuuaaauuuuauauuuauuguugaau

SEQ ID NO: 141622 - RNA, 64 nt, hsa
uuucauaauguaauucaaugaaaacuguuggagaaauauuuaaacaccucaauguagguacauu

SEQ ID NO: 141623 - RNA, 64 nt, hsa
uguguugaguuuuuucuuucuuucuuuuaaauuaaauauuuauuaguaccuggcuugaagccua

SEQ ID NO: 141624 - RNA, 64 nt, hsa
ugucugcaguucucgaugaccgaaaguuaucaaaaauauuuaaaauauuuaaauugugaaccua

SEQ ID NO: 141625 - RNA, 64 nt, hsa
uucucgaugaccgaaaguuaucaaaaauauuuaaaauauuuaaauugugaaccuauugauaaag

SEQ ID NO: 141626 - RNA, 64 nt, hsa
uuaaaauauuuaaauugugaaccuauugauaaagaauauuuauaaaaacugaucuguaggccug

SEQ ID NO: 141627 - RNA, 64 nt, hsa
uacaaauauguuuauguauuaaaucaccauccaaaauauuuaaggaauauauaaaaagauuuuu

SEQ ID NO: 141628 - RNA, 64 nt, hsa
ccaagaagucacugcuuuuuagguguguugcaucaauauuuaaauaaaaucccagaaauguauu

SEQ ID NO: 141629 - RNA, 64 nt, hsa
uuaggcaggaaugaucuuuucaaaucauuagcacaauauuuaaauaucuaaaaauuuaagagau

SEQ ID NO: 141630 - RNA, 64 nt, hsa
aagaaauuauguuaaauagcccuguuuuaagaaaaauauuuaugaagcaucucaacuugaagau

SEQ ID NO: 141631 - RNA, 64 nt, hsa
uuugccaaaauauuuuauuauaaaauaugaccaaaauauuuaaaaugcacaaugcuuuuaacuu

SEQ ID NO: 141632 - RNA, 64 nt, hsa
auucaaacagcuuuaaacacuuccaaugagauaaaauauuuacuauuaugcuuauuagaacaaa

SEQ ID NO: 141633 - RNA, 64 nt, hsa
agaaugggaauauuuuauacugacagaaaucaguaauauuuauauauuuauauuuuuaaaauau

SEQ ID NO: 141634 - RNA, 64 nt, hsa
gaaaucaguaauauuuauauauuuauauuuuuaaaauauuuauuuauuuauuuauuuaaguuca

SEQ ID NO: 141635 - RNA, 64 nt, hsa
acauuaguagauauaaacauaauucaaauauuuaaauauuuaagaggagaaaaguaacuagaaa

SEQ ID NO: 141636 - RNA, 64 nt, hsa
uaucuccuacauuaguagauauaaacauaauucaaauauuuaaauauuuaagaggagaaaagua

SEQ ID NO: 141637 - RNA, 64 nt, hsa
gacugcaagcuuuccugccaauuugggauuuucaaauauuuaauucuaaauuccagauuuuaag

SEQ ID NO: 141638 - RNA, 64 nt, hsa
uuacccacuggugguuuguguguguaugaagguaaauauuuauauauuuuuauaaauaaaugug

SEQ ID NO: 141639 - RNA, 64 nt, hsa
gagaagauggggagggggugggagugggaaauaaaauauuuagcccuuccuugguagguagcuu

SEQ ID NO: 141640 - RNA, 64 nt, hsa
uaaaauugcaacuucuaaacacaaauaaaaagaaaauauuuauaggaggaaaugauuaauuuga

SEQ ID NO: 141641 - RNA, 64 nt, hsa
caagaaauguaauaaauauuuguaauuuuacacaaauauuuaagaggaaagaguauuaagagca

SEQ ID NO: 141642 - RNA, 64 nt, hsa
uguacguccuccuaggugauggagauguguacguaauauuuauuuuaacuuaugcaagggugug

SEQ ID NO: 141643 - RNA, 64 nt, hsa
agcgucguuaauuuauuucuuauugcuccuaauuaauauuuauauguauuuauguacguccucc

SEQ ID NO: 141644 - RNA, 64 nt, hsa
cuuuuuuuugguguguauuucauuaaaaaauauaaauauuuaugaaaauugcacgcauauuaga

SEQ ID NO: 141645 - RNA, 64 nt, hsa
aauuccuucaucagaacgacuucaaguggauaacaauauuuauaagaaaugaauggaaggaaau

SEQ ID NO: 141646 - RNA, 64 nt, hsa
auaugucauuuaaaauauuuugaaagcccucauaaauauuuauauuuacuaaacuaauagcaua

SEQ ID NO: 141647 - RNA, 64 nt, hsa
guaacaucaacucaguuguaugaaucuggaguguaauauuuauauuagaauguauaugucauuu

SEQ ID NO: 141648 - RNA, 64 nt, hsa
ccuuucucaagugugugauaaggucugcugauaaaauauuuaaccccaagaaagugaaaacuaa

SEQ ID NO: 141649 - RNA, 64 nt, hsa
aagcacauaccuauuuuguagacuuacauuguuuaauauuuauuuuaaucuuaauauuuuuaca

SEQ ID NO: 141650 - RNA, 64 nt, hsa
ggaguaagauuagucauaguaaagucucagucugaauauuuagcaagagaaacaggcagcagag

SEQ ID NO: 141651 - RNA, 64 nt, hsa
ucucucaccccuuaaugcauuuuucucaaugcagaauauuuagaugcuaaucaaaaaaaugauc

SEQ ID NO: 141652 - RNA, 64 nt, hsa
ugaugaaacgucauguguuuugccaaagacuguaaauauuuauuuauguguucacauggucaaa

SEQ ID NO: 141653 - RNA, 64 nt, hsa
auuucauuaagguuccaguuauaaauauuuuguuaauauuuauuaagugacuauagaaugcaac

SEQ ID NO: 141654 - RNA, 64 nt, hsa
cggacacuaauuuauauaggagugaaguuuuauaaauauuuaauauuuauuuuggauucaaauu

SEQ ID NO: 141655 - RNA, 64 nt, hsa
uaauuuauauaggagugaaguuuuauaaauauuuaauauuuauuuuggauucaaauuguauuua

SEQ ID NO: 141656 - RNA, 64 nt, hsa
aauguauuaagacaggacauauuguuggugagauaauauuuaauagguauaaaaugguaaaaua

SEQ ID NO: 141657 - RNA, 64 nt, hsa
guuaggacacuauuuuaauuauuuuuaauuuauuaauauuuaaauaugugaagcugaguuaauu

SEQ ID NO: 141658 - RNA, 64 nt, hsa
aaauaaauggcuaacuuauacauauuuuuaaagaaauauuuauauuguauuuauauaauguaua

SEQ ID NO: 141659 - RNA, 64 nt, hsa
uuucaguuuuaucuaauaacuuacuuuuuaaaucaauauuuaucaacaaucuuuccuuguaugc

SEQ ID NO: 141660 - RNA, 64 nt, hsa
gguuuaguuuacuucuguuccaccuuuugauugaaauauuuaguuguuaggcugaaagccucgg

SEQ ID NO: 141661 - RNA, 64 nt, hsa
uugucuacauauaagguuuuuauuugaauuguaaaauauuuaaaaguaugaauaaaauauauuu

SEQ ID NO: 141662 - RNA, 64 nt, hsa
acaguuuccccccaaaaaagagauuuauuuaugaaauauuuaaaguuucuaaugugguauuuua

SEQ ID NO: 141663 - RNA, 64 nt, hsa
uauuuuaaauaaaguaucauaaauguaauaaguaaauauuuauuuaggaauacugugaacacug

SEQ ID NO: 141664 - RNA, 64 nt, hsa
aaucuuuauacuauuuuacaguaaccacaaucuaaauauuuacauauacccaaaauuaacuuau

SEQ ID NO: 141665 - RNA, 64 nt, hsa
uauaugcaaaguuuuucaaccaagugguuugucuaauauuuaaacauguacuggcacaauuugu

SEQ ID NO: 141666 - RNA, 64 nt, hsa
uaaauuuuuguauagacauuccuuugguuggaagaauauuuauaggcaauacagucaaaguuuc

SEQ ID NO: 141667 - RNA, 64 nt, hsa
agaaaauuuguaugaaauaauuuagucaucaugaaauauuuaguugucauauaaaaacccacug

SEQ ID NO: 141668 - RNA, 64 nt, hsa
gcuuaacaaacaugaaguaugguguaauaggaauaauauuuauccaaaagauuuuuaaaaauag

SEQ ID NO: 141669 - RNA, 64 nt, hsa
uauaugaaaaccaaucugagccuuguaucucuuaaauauuuauuuuuuuuaacgugugagaugu

SEQ ID NO: 141670 - RNA, 64 nt, hsa
uaugaccugcagaaaauauuuacacauauuuccaaauauuuauuucaugagcaguacagcuaau

SEQ ID NO: 141671 - RNA, 64 nt, hsa
gugcccuaaaaugguguucuuaugaccugcagaaaauauuuacacauauuuccaaauauuuauu

SEQ ID NO: 141672 - RNA, 64 nt, hsa
uuggcacacuuuuuuuagaaugggccagaugguaaauauuuaugcuucacgguccauacagucu

SEQ ID NO: 141673 - RNA, 64 nt, hsa
uugaaaacuuauaaaccuaacagaaaagccacauaauauuuagugucauuaugcaauaaucaca

SEQ ID NO: 141674 - RNA, 64 nt, hsa
ugauuuuuaucauguuuuaaauaggaauuuauaaaauauuuaugauaguaauaaaguaguauuu

SEQ ID NO: 141675 - RNA, 64 nt, hsa
augaaagauguacaauucaguguuuaaaaauaaaaauauuuauuguguacucuguucguugauu

SEQ ID NO: 141676 - RNA, 64 nt, hsa
acuagcauuggaaaauacauaucacuauucuuggaauauuuauggucagucuacuuuuuaguaa

SEQ ID NO: 141677 - RNA, 64 nt, hsa
gaucuaaaaaagagaggagauucccccaaacaacaauauuuaauuuucuuaguaaaaagaauaa

SEQ ID NO: 141678 - RNA, 64 nt, hsa
uuuaggauaaugaagaguacauaauguccuacuuaauauuuauguuaauaggacuuaauucuua

SEQ ID NO: 141679 - RNA, 64 nt, hsa
gaauaucuuuccuaguaaaaauaggauguguugaaauauuuauauguacuuugaucucuccaca

SEQ ID NO: 141680 - RNA, 64 nt, hsa
uguacauuuauuaugucuuuuuuuaaagaauggaaauauuuauuucagaggccuuauuuuugga

SEQ ID NO: 141681 - RNA, 64 nt, hsa
gcaugaacuguaaagcuguguguauuagguguaaaauauuuauaagauauauggacuggggaau

SEQ ID NO: 141682 - RNA, 64 nt, hsa
aucuguaagcuaguauauuuguuucacuguuuguaauauuuaagaaaugcucauucuuuguaga

SEQ ID NO: 141683 - RNA, 64 nt, hsa
ggcauagcaguuuuugacccaggcagaauaaguuaauauuuaauuaaauauugcuuugaagaug

SEQ ID NO: 141684 - RNA, 64 nt, hsa
aacaugguaagccugguauuuuuuaaucaaacaaaauauuuaugaaauggguuuucucuuaauu

SEQ ID NO: 141685 - RNA, 64 nt, hsa
ucuggauucaucauggcuuucuaauaccaauuguaauauuuacaauauucaccaaaacuuagaa

SEQ ID NO: 141686 - RNA, 64 nt, hsa
uauagaaccacuuuuuguagauuaguauaagaaaaauauuuacccuguuuuggggcaaaugcua

SEQ ID NO: 141687 - RNA, 64 nt, hsa
uggguauuuuauuauguguuuuguauaaaucccuaauauuuaaaaaaaaaaacaaaacaaaaaa

SEQ ID NO: 141688 - RNA, 64 nt, hsa
uggacccauugaggauaacuauaaaauuacagaaaauauuuaaaugcaacuuauugcuauagaa

SEQ ID NO: 141689 - RNA, 64 nt, hsa
ucuaggaacagauggcuucacugaaguuauuccaaauauuuaagaaauaauaccaggcuuuuau

SEQ ID NO: 141690 - RNA, 64 nt, hsa
aaaaaaugcuacaaugacuuccuauuaaagguucaauauuuacacauucuuauugguugauauu

SEQ ID NO: 141691 - RNA, 64 nt, hsa
aacacacccgagaaaucuuaaauagacacuuugcaauauuuaagaaccuaaugcuguuuaauuu

SEQ ID NO: 141692 - RNA, 64 nt, hsa
uaggaaaauguucuggugauugucagggucuccuaauauuuaucucaauucuuuuauaagucua

SEQ ID NO: 141693 - RNA, 64 nt, hsa
auacuuaaaaauucaagaugcuucccauuuguguaauauuuaccuggaggacucguacuuaggu

SEQ ID NO: 141694 - RNA, 64 nt, hsa
gaccagccuaaauauucugggggaagugggguauaauauuuaacgaaucaugauucagauugua

SEQ ID NO: 141695 - RNA, 64 nt, hsa
caggguuuuaauuuucucagagaaccugcugucaaauauuuacagcacaucacuguguauauau

SEQ ID NO: 141696 - RNA, 64 nt, hsa
gugauaccaaaauuuuguugcaaauauaauggacaauauuuauuuauacccauauucacagugg

SEQ ID NO: 141697 - RNA, 64 nt, hsa
aggggaauucuauucaucuaaguaauauggugaaaauauuuaucuggaauuuauguuguuuagu

SEQ ID NO: 141698 - RNA, 64 nt, hsa
gauauguucccucacugaaaaaucacucauucaaaauauuuaaguaucaagcacuuuguuaugc

SEQ ID NO: 141699 - RNA, 64 nt, hsa
ggucuucacagcgcucauacuguaaaaacuguuaaauauuuaguaucacucuuacuuuauauuc

SEQ ID NO: 141700 - RNA, 64 nt, hsa
uugcucuauaguagaauauuuaaguagacugugaaauauuuauuaauauagaugugaauaucaa

SEQ ID NO: 141701 - RNA, 64 nt, hsa
auuuguuuuuguuagaugauuugcucuauaguagaauauuuaaguagacugugaaauauuuauu

SEQ ID NO: 141702 - RNA, 64 nt, hsa
gauauuuaacuguauaaaaauguucauuuuacacaauauuuaauuaaaguauuucuugucugug

SEQ ID NO: 141703 - RNA, 64 nt, hsa
acacuugucuugaauuuuuuucagauccacuuaaaauauuuagaaaaacaaguuuuauuccuua

SEQ ID NO: 141704 - RNA, 64 nt, hsa
guagacuuuugugauuuugccaaaguuguagcuaaauauuuauacacuugucuugaauuuuuuu

SEQ ID NO: 141705 - RNA, 64 nt, hsa
ucauauauauggcauaauuuugaauaucauggacaauauuuagaacccaaauuuuggagugcuu

SEQ ID NO: 141706 - RNA, 64 nt, hsa
uguguuuacuaacacacuuaauguuuauauaccuaauauuuauuaugccauaucugaauuuauu

SEQ ID NO: 141707 - RNA, 64 nt, hsa
agacuaagcaauaaucuuaacaaccucuuuccugaauauuuaaauguguuuguaugguguuaug

SEQ ID NO: 141708 - RNA, 64 nt, hsa
uuuuucauggauuuguguucuuacaguacuugaaaauauuuaaggaagagaugaagcucugcag

SEQ ID NO: 141709 - RNA, 64 nt, hsa
aauaaaugcacaaaagauauaaacaggaacagcaaauauuuauauuuuuuccauuuugcucuuu

SEQ ID NO: 141710 - RNA, 64 nt, hsa
gggaauucuuacuuuuugcuuuauaccuuucuauaauauuuagauuuuuuuuuacuguaaguau

SEQ ID NO: 141711 - RNA, 64 nt, hsa
aaauaaaaauaaaaauauguauucuccuaacugaaauauuuacuuaaucuggaaaacaauguaa

SEQ ID NO: 141712 - RNA, 64 nt, hsa
ucccacuuuuuacuguuuggaaacuccucuuugaaauauuuauugcuacauaacuauauauaau

SEQ ID NO: 141713 - RNA, 64 nt, hsa
gaccaucucaaaagaugccaacguugucuuugauaauauuuaauauauuuuuuaaaaaacaauu

SEQ ID NO: 141714 - RNA, 64 nt, hsa
ucgcugcuaaauuauucuucacuugagugaagcaaauauuuagcuuccaaauaaaguauauuuu

SEQ ID NO: 141715 - RNA, 64 nt, hsa
ugggucucuauguuuuggaaguuggggguuuaauaauauuuaaugucuuuuuaggaucauaaac

SEQ ID NO: 141716 - RNA, 64 nt, hsa
uuuuuuuuuuuuuuuuaaauccaguauuuaggauaauauuuaugcuuaguguaaacauucugug

SEQ ID NO: 141717 - RNA, 64 nt, hsa
ugacaguguuuauugauuugaagucauauuaggaaauauuuagacaaugaaaauuaucaagaga

SEQ ID NO: 141718 - RNA, 64 nt, hsa
aggacuagggcuuucucauggaguacaguauguuaauauuuaccuauauaacuaaucuguuaac

SEQ ID NO: 141719 - RNA, 64 nt, hsa
cacuuuuaaucuguaauuuuaaaauacaagucugaauauuuauaguugauucuuaacugcauaa

SEQ ID NO: 141720 - RNA, 64 nt, hsa
cccagggagcaugcuguuuugucaaucaauauaaaauauuuaugaggucucccccacccccagg

SEQ ID NO: 141721 - RNA, 64 nt, hsa
ggguccccauuuuagugggaacaaguauuuaaacaauauuuagagcaaguguccucaugugaua

SEQ ID NO: 141722 - RNA, 64 nt, hsa
ugaagacagaaauauguaugaggaugaucacugaaauauuuaugacagugcauaauuugcaaaa

SEQ ID NO: 141723 - RNA, 64 nt, hsa
gauuuuucuuauguuagcacuaagggcaaaaaccaauauuuauaauguaagcacuauccaggua

SEQ ID NO: 141724 - RNA, 64 nt, hsa
ugagugugaaguguaugugagaacuuuuguuugcaauauuuauuuuugugggugucgacuuccu

SEQ ID NO: 141725 - RNA, 64 nt, hsa
caguucagugaacugguacaauguggucccucucaauauuuaaaaauauaauuuguaacagugc

SEQ ID NO: 141726 - RNA, 64 nt, hsa
auaaaaugcagaacauuucuauccuauccuaccaaauauuuauccuucucuguccucuauucuc

SEQ ID NO: 141727 - RNA, 64 nt, hsa
guuugauacucuaguauguaagcuguauuuauguaauauuuagaacgacauguuaauaaacaaa

SEQ ID NO: 141728 - RNA, 64 nt, hsa
aauucauauccauagauaguucauucauucaacaaauauuuaccaaguuccuaauauaagugaa

SEQ ID NO: 141729 - RNA, 64 nt, hsa
uauuuauuugaaguuuuauuauuuuauaaaaaagaauauuuauuuuaagaggcaucuuacaaau

SEQ ID NO: 141730 - RNA, 64 nt, hsa
uucuaauuuuuucaacauauuguuuaguguaaagaauauuuauuugaaguuuuauuauuuuaua

SEQ ID NO: 141731 - RNA, 64 nt, hsa
ucuucacuguuucaccaucuagcuugcuaagucaaauauuuaugaugauaaugagguacugaac

SEQ ID NO: 141732 - RNA, 64 nt, hsa
uauugaccuauauucaugaaagcauauaaauuaaaauauuuaaaauuagauaugauucacacua

SEQ ID NO: 141733 - RNA, 64 nt, hsa
ggacuguuauuucauuuagaguucucuaucucuaaauauuuauuuagagaaugauuuuaaaagg

SEQ ID NO: 141734 - RNA, 64 nt, hsa
caaaaagcaauauaguugcauaaaagcacuguaaaauauuuaaaagguuaaaacuguggaaaau

SEQ ID NO: 141735 - RNA, 64 nt, hsa
gguauucauuuugaguagguugaagaagaaaaaaaauauuuaaaugaauugaauuccugauggg

SEQ ID NO: 141736 - RNA, 64 nt, hsa
uauauuggccauucuguauguuuuuguaaaacagaauauuuaauccuuauuuauuaaucucuug

SEQ ID NO: 141737 - RNA, 64 nt, hsa
uuaaaucuagcccaguauaaacauuagccugcuuaauauuuagacauuuauagguagaauucug

SEQ ID NO: 141738 - RNA, 64 nt, hsa
uccaauaaaagugguguagugccgaaagugcuaaaauauuuagugcgguauugcucugugaauu

SEQ ID NO: 141739 - RNA, 64 nt, hsa
aacuauuaaaacaauagggcuuuuuaaaauuaaaaauauuuaaaauucaaaaguaauuaauagu

SEQ ID NO: 141740 - RNA, 64 nt, hsa
uaaauugagacucaaagugaaauacaaaaaugaaaauauuuauaauaggacucgacuuggagaa

SEQ ID NO: 141741 - RNA, 64 nt, hsa
ucgagggaaauauguacaaagaagcuucaaauggaauauuuaccgacauuccuuauacaugaca

SEQ ID NO: 141742 - RNA, 64 nt, hsa
acuguccucacuuagaacaaagccugaguccgagaauauuuauauuuuaccaauauaugccugu

SEQ ID NO: 141743 - RNA, 64 nt, hsa
gugauuugugaucaaguuuaaucacaaaucucuuaauauuuauaaacuaccugaugccaggagc

SEQ ID NO: 141744 - RNA, 64 nt, hsa
gaguuuuugagcaaauuaggugacuuguuuuaaaaauauuuaauuccgauuuggaaccuuagau

SEQ ID NO: 141745 - RNA, 64 nt, hsa
aaaaguaggacauuauugccauauuguaugucuuaauauuuaacuuauucggaaauauauucca

SEQ ID NO: 141746 - RNA, 64 nt, hsa
aauggucuucaauuuaauuuaaaaauauuuugacaauauuuaauuugugcuuaugugguguuug

SEQ ID NO: 141747 - RNA, 64 nt, hsa
agucaucauauguauaugucauaugacuuuauaaaauauuuaaugugacaaaaaguggaaagaa

SEQ ID NO: 141748 - RNA, 64 nt, hsa
cuuuuacucuuugguuuuaucauuccauuuugcuaauauuuacuagcuuuauaaauuacaguaa

SEQ ID NO: 141749 - RNA, 64 nt, hsa
cuuuuuacuuuuaugcauuuuaauaagauuuaaaaauauuuagauuaaagcccccuuuaaugag

SEQ ID NO: 141750 - RNA, 64 nt, hsa
aaugucaaagcacauaucuuuaauaugcugaaugaauauuuauuuuuguauccauuaaaacagu

SEQ ID NO: 141751 - RNA, 64 nt, hsa
ucauuccuuccgaaaccccugauauuuaauauuuaauauuuaaaaacccaaauuaucaaaccau

SEQ ID NO: 141752 - RNA, 64 nt, hsa
gaauucaucauuccuuccgaaaccccugauauuuaauauuuaauauuuaaaaacccaaauuauc

SEQ ID NO: 141753 - RNA, 64 nt, hsa
uacuucaguugguuuuggaaucugccuuauaccuaauauuuauuuauucacacucauaagcauc

SEQ ID NO: 141754 - RNA, 64 nt, hsa
ccuaauauuuauuuauucacacucauaagcaucaaauauuuaaugcccucagugggaaauuugu

SEQ ID NO: 141755 - RNA, 64 nt, hsa
aagcccuccccaucccauguauuuaucucuauuuaauauuuaugucuauuuaagccucauauuu

SEQ ID NO: 141756 - RNA, 64 nt, hsa
ggucucccacgugggagacaagaaaucccuguuuaauauuuaaacagcaguguuccccaucugg

SEQ ID NO: 141757 - RNA, 64 nt, hsa
uaugauaaaggcuuaggacuucaaaaggugauuaaauauuuaaugaugugucauaugaguccuc

SEQ ID NO: 141758 - RNA, 64 nt, hsa
aaguagauuuguaguuugucccauuuauuauuuuaauauuuauguuuaagugcuugguugaaaa

SEQ ID NO: 141759 - RNA, 64 nt, hsa
gagauucaaaaaaaaaauauaagguuggguuagcaauauuuauagggcuuuuauuuuuuaaguu

SEQ ID NO: 141760 - RNA, 64 nt, hsa
uggcaauauuuauuauaauuuaauuuuauauaaaaauauuuaauuuccucuggauagucaaacc

SEQ ID NO: 141761 - RNA, 64 nt, hsa
agacuuggaacaaugcuaaaggaaagcauuuggcaauauuuauuauaauuuaauuuuauauaaa

SEQ ID NO: 141762 - RNA, 64 nt, hsa
ucuaaaaugaaucaguuucuaaagugaaacaugcaauauuuaugcucugacugacuccugaauu

SEQ ID NO: 141763 - RNA, 64 nt, hsa
cuuuuugucuacuucgcaagucucaaaacgugauaauauuuaagcccauuuguagaagaaaucu

SEQ ID NO: 141764 - RNA, 64 nt, hsa
caugauauucaguacaacucugucauuucuuuguaauauuuaaaaaauauuaguaaaggaguga

SEQ ID NO: 141765 - RNA, 64 nt, hsa
ccuguaaaguucugaccuugauaacaaagcuauaaauauuuaaguuugcuaauaugcguaagua

SEQ ID NO: 141766 - RNA, 64 nt, hsa
uauaaauaauuuucuuuuaaucuuuauuuugcucaauauuuaauaggaaguaugauuucaagga

SEQ ID NO: 141767 - RNA, 64 nt, hsa
cuacuggaauauugguauagucaauucuuauuugaauauuuauucuauuaaacugaguuuaaca

SEQ ID NO: 141768 - RNA, 64 nt, hsa
ugcuuaaaauaagcaaaaauuggaugcguaaaguaauauuuacagauguggggagauguaauaa

SEQ ID NO: 141769 - RNA, 64 nt, hsa
aaauguguguguguauauuauuauuaaucaaugcaauauuuaaaaugaaaugagaacaaagagg

SEQ ID NO: 141770 - RNA, 64 nt, hsa
agauccuugcuuuugcagaauuuggugcucagacaauauuuaaggacauuucagcgagacaaag

SEQ ID NO: 141771 - RNA, 64 nt, hsa
uauucugugacaaaaaguuaagauucuugggcagaauauuuaaauuggucagucagguagaaga

SEQ ID NO: 141772 - RNA, 64 nt, hsa
gaguuuuauugaccccucuaauucucuuacccagaauauuuauccuucaccagcaacucugacu

SEQ ID NO: 141773 - RNA, 64 nt, hsa
agaaucaauugucuauauggaauuuaggauaaagaauauuuacaauaaagaauauuuacaauaa

SEQ ID NO: 141774 - RNA, 64 nt, hsa
auggaauuuaggauaaagaauauuuacaauaaagaauauuuacaauaaagaguuuauuauuauu

SEQ ID NO: 141775 - RNA, 64 nt, hsa
uaagaauuaauuggcuauauggaauuuaggauagaauauuuacaauaaagaguauuuacaauaa

SEQ ID NO: 141776 - RNA, 64 nt, hsa
acaacaacucauuuuuacagaguuugugaagcuaaauauuuaacauuguugauuucaguaagcu

SEQ ID NO: 141777 - RNA, 64 nt, hsa
auauauggaguuucgaagaauaaaauaugagagcaauauuuaaauucucaggaauugacuuaua

SEQ ID NO: 141778 - RNA, 64 nt, hsa
uguagaaugauuucaugcuaucucugugugcacaaauauuuauuuucuuucuguaaccauaaca

SEQ ID NO: 141779 - RNA, 64 nt, hsa
gcagaccuugaccucgugggcuagggaugacuaaaauauuuauuuuuuuuaaguauuuagguuu

SEQ ID NO: 141780 - RNA, 64 nt, hsa
uauauguaagaauuuuauugcuuauguggcauacaauauuuauaacuauaaacuuuauagaagu

SEQ ID NO: 141781 - RNA, 64 nt, hsa
ugcaaauaacuagccauuauucuauguauuauuaaauauuuacuaguucuguuaaaagcagagc

SEQ ID NO: 141782 - RNA, 64 nt, hsa
cagcuguauacauuuuugggcaacgguuaugcauaauauuuaccaggagaauuuuuuucuuaac

SEQ ID NO: 141783 - RNA, 64 nt, hsa
caaauaccuuccaaugaaaccaagaauuucucaaaauauuuaaugucacauauuauaagaaguu

SEQ ID NO: 141784 - RNA, 64 nt, hsa
gauuucuagauacuuuuugcugcuaguuuuauguaauauuuauugaacauuuugacaaauauuu

SEQ ID NO: 141785 - RNA, 64 nt, hsa
uaguuuuauguaauauuuauugaacauuuugacaaauauuuauuuuuguaagccuaaaagugau

SEQ ID NO: 141786 - RNA, 64 nt, hsa
gucuagauauagccccauuacuacaaaaugcuaaaauauuuaaugaaaauugaugguggccaca

SEQ ID NO: 141787 - RNA, 64 nt, hsa
auuucauauacacagucuauacaaugaaauaaugaauauuuaucauauugauacaaacugugac

SEQ ID NO: 141788 - RNA, 64 nt, hsa
aaucaagucuuuuaauaauucauuuuuucuucauaauauuuacucaaaguuaagcuuaaaaaua

SEQ ID NO: 141789 - RNA, 64 nt, hsa
cgaaauguuagguaaucauuuagaaaggacagaaaauauuuaaaguggcucauagguaaugaau

SEQ ID NO: 141790 - RNA, 64 nt, hsa
gaauucaugucccuuacaguggucauuuaaagucaauauuuauuuauguauguaauaaaaaaag

SEQ ID NO: 141791 - RNA, 64 nt, hsa
uaauagauauugaaacccauuuccuguguguuaaaauauuuaaaaaguggauauuccaggaaug

SEQ ID NO: 141792 - RNA, 64 nt, hsa
uaaaaguucagacagcucuguaaaauguauugauaauauuuacaucuuugaaauaaucaguaaa

SEQ ID NO: 141793 - RNA, 64 nt, hsa
ccuuuuaauauacucuuggauuagguuaaugaccaauauuuauaaauggaauuuuucauuugcc

SEQ ID NO: 141794 - RNA, 64 nt, hsa
accauugcaacaaaauacauucuuuuugcucuaaaauauuuaugaagaaaauacuuaaauguua

SEQ ID NO: 141795 - RNA, 64 nt, hsa
auuagccuaagauauacuuguuuuuguaaagaaaaauauuuaauguugaacaaaauaaauugga

SEQ ID NO: 141796 - RNA, 64 nt, hsa
acagauuuuagauacuuuuugcugcuaguuguguaauauuuauugaacauuuugacaaauauuu

SEQ ID NO: 141797 - RNA, 64 nt, hsa
gcuaguuguguaauauuuauugaacauuuugacaaauauuuauuuuuguaagccuaaaaaugau

SEQ ID NO: 141798 - RNA, 64 nt, hsa
gagugcaauagcacgaucuuggcucaccgcaaccucugccuaccggguucaagugauucuugug

SEQ ID NO: 141799 - RNA, 64 nt, hsa
gagugcacuggcgugaucucggcucacugcaccuucugccuaccgaguucaagcgauucuugug

SEQ ID NO: 141800 - RNA, 64 nt, hsa
cuggagacuggaccugccacauguuccaagucugucugccuaggucacugcugccacuucuccu

SEQ ID NO: 141801 - RNA, 64 nt, hsa
auuuugccuuuugugcugacuugacagcuucacuucugccuaagaugcgccuccacugucaccu

SEQ ID NO: 141802 - RNA, 64 nt, hsa
uccccaauuacccuuagaaaaugaucacaccaacucugccuacacacuuccagugauaguggcu

SEQ ID NO: 141803 - RNA, 64 nt, hsa
cuuuguuagaaaguucuuucuuagguugcuaaaaucugccuaguaccccgcuacccuguucugu

SEQ ID NO: 141804 - RNA, 64 nt, hsa
uccuccuucucuccccagagcccccuugagccccucugccuaugucccucugccuccuccccau

SEQ ID NO: 141805 - RNA, 64 nt, hsa
guuuuguuuuccaaaucaagguaacuugcucccuucugccuacaggccuuggucuuggcuuguc

SEQ ID NO: 141806 - RNA, 64 nt, hsa
agaaugcaggcugcuguagucucagguaaugaaggcacagcacagcaguacuccacauuguuuc

SEQ ID NO: 141807 - RNA, 64 nt, hsa
gcaggcugcuguagucucagguaaugaaggcacagcacagcaguacuccacauuguuuccuauu

SEQ ID NO: 141808 - RNA, 64 nt, hsa
gcuccccaccacagccccagcugccucagagcaggcacagcacaaggcaggcccagccccaugg

SEQ ID NO: 141809 - RNA, 64 nt, hsa
agacccuugacugugacuggcaggcaggugaggggcacagcaccccuccccggcaucugccagc

SEQ ID NO: 141810 - RNA, 64 nt, hsa
uucucccucuccuucccugacacuucucugggcugcacagcagaaacguugguaaaagggcagu

SEQ ID NO: 141811 - RNA, 64 nt, hsa
uauaugauuccaguucugcauguaccaucuugaggcacagcagccacugcucguuguaaaugcc

SEQ ID NO: 141812 - RNA, 64 nt, hsa
auggccuguggcccgagggccaaccaccgagcaggcacagcacagcagugacucggugagggga

SEQ ID NO: 141813 - RNA, 64 nt, hsa
cuguggcccgagggccaaccaccgagcaggcacagcacagcagugacucggugaggggaggaca

SEQ ID NO: 141814 - RNA, 64 nt, hsa
uugggagagagcuggggcagagcggggagcugcagcacagcaacagugauggcgaggacuuccc

SEQ ID NO: 141815 - RNA, 55 nt, hsa
cggcuagggcuugggggugaugcaggcacagcagauggccgaggcaggacacugc

SEQ ID NO: 141816 - RNA, 64 nt, hsa
ucuacugcccaugccgggcggccuuccagucauugcacagcaaagccaugugcagggcgucccc

SEQ ID NO: 141817 - RNA, 64 nt, hsa
gcaacugccaaucccgcugaagaggccucccugggcacagcacaggcugcacggugcacgcauu

SEQ ID NO: 141818 - RNA, 64 nt, hsa
auucagggaucacacaguucugccuguucucagggcacagcaacugccaaucccgcugaagagg

SEQ ID NO: 141819 - RNA, 64 nt, hsa
ugcuggguggcccauccccccucaccaggggcaggcacagcacagggauccgacuugaauuuuc

SEQ ID NO: 141820 - RNA, 64 nt, hsa
cugcccaggacggggccggccaggugggcgggcagcacagcaaggaggcuggcuggggccuauc

SEQ ID NO: 141821 - RNA, 64 nt, hsa
agcaccucccaccaaccaaccacacccggugggggcacagcacagaccccagagccaggaaccu

SEQ ID NO: 141822 - RNA, 64 nt, hsa
agcaccucccaccaaccagccacacccggugggggcacagcacagaccccagaggcaggaaccu

SEQ ID NO: 141823 - RNA, 64 nt, hsa
agcaccucccaccaaccagccacacccagugggggcacagcacagaccccagagccaggaaccu

SEQ ID NO: 141824 - RNA, 64 nt, hsa
guuggaaaggaaaaaagaaaaaagcaauuagguagcacagcacuuugguuuugcugagaucgaa

SEQ ID NO: 141825 - RNA, 64 nt, hsa
guuugagagcccgcgugcuggagaauugacugaagcacagcaccgggggagagggacacuccuc

SEQ ID NO: 141826 - RNA, 64 nt, hsa
auuccacccgcccgcccugcugcagauacaugcggcacagcaggcacgugccuggagagaacag

SEQ ID NO: 141827 - RNA, 64 nt, hsa
cagcaggcacgugccuggagagaacagcuccugagcacagcacccuuggagcccucaccccgcu

SEQ ID NO: 141828 - RNA, 64 nt, hsa
acagcugcccagccuguucacaugcuggggaccagcacagcaccugaagccaugugggacaguu

SEQ ID NO: 141829 - RNA, 64 nt, hsa
uugccuuaaugccagguggcccaggaguacccaugcacagcagcuguggggugugggcaucuuc

SEQ ID NO: 141830 - RNA, 64 nt, hsa
aaaguucuuuccugccagauagaaauugugcacagcacagcaucaaguaauucguuagaugcuu

SEQ ID NO: 141831 - RNA, 64 nt, hsa
uuuccaaaguucuuuccugccagauagaaauugugcacagcacagcaucaaguaauucguuaga

SEQ ID NO: 141832 - RNA, 64 nt, hsa
acuugaauagcaauaaaagcguguuaacuuuuugauugaugaaagaaguacaaaaagccuuuag

SEQ ID NO: 141833 - RNA, 64 nt, hsa
auuuuuuuaugccaaauuuuuuuuaguucuaaucauugaugauagcuuggaaauaaauaauuau

SEQ ID NO: 141834 - RNA, 64 nt, hsa
ugggcccuaauaauccuaaaaagaauggagcugcauugaugaauuggcucaguauuuaaaggga

SEQ ID NO: 141835 - RNA, 64 nt, hsa
agggagaaaugucaugagacguuggacaggcaggauugaugauagcaugaccauagcuuugcug

SEQ ID NO: 141836 - RNA, 64 nt, hsa
aucacuaaugcuguuacuaacuuuucaguuauaaauugaugaauaucuuugugcacaggcuguu

SEQ ID NO: 141837 - RNA, 64 nt, hsa
cccuggcggcuccccaccugguugcccaguuccuauugaugagcucuggacagaaagaugcccg

SEQ ID NO: 141838 - RNA, 64 nt, hsa
accacuuccaaacuuuucagcguuggauaaaaugauugaugaggcaggcagaaggaauguaggu

SEQ ID NO: 141839 - RNA, 64 nt, hsa
uuguguuugcuucauuuuuaaugaugacuucaagauugaugaugugauccaauaacuguggagg

SEQ ID NO: 141840 - RNA, 64 nt, hsa
gcaauucugguauccucuaaauuuguaagcauucauaaaacaggaaaaaguaaacuaucauucg

SEQ ID NO: 141841 - RNA, 64 nt, hsa
guuggugcucaaugcaguguagacauguuuucaaauaaaacaaaugauuguguacaacaaugag

SEQ ID NO: 141842 - RNA, 64 nt, hsa
aagaugacugaaccuugcaguucugugaauuuuuauaaaacauacaaaaacuuuguauauacac

SEQ ID NO: 141843 - RNA, 64 nt, hsa
acaaaaggugccuauucuuuuuuaaaaaaauaaaauaaaacauaaauauuacucuuccauauuc

SEQ ID NO: 141844 - RNA, 64 nt, hsa
uuuugcuuccagcaaguauguuagacuagauauuauaaaacaacuagauccugaauaaaaucug

SEQ ID NO: 141845 - RNA, 64 nt, hsa
ugauaaacauaaguaaauuuaaacuguuguuuguauaaaacaauuauaaugaaguguuuauaag

SEQ ID NO: 141846 - RNA, 64 nt, hsa
cauucuggcugauuuuaagccauuuaaaauuuauauaaaacaaccuuccauaaaaauuugacag

SEQ ID NO: 141847 - RNA, 64 nt, hsa
aaaauguaauuuuccagaaaaacaccuaaagaaaauaaaacauggacaugccuaguaaauucug

SEQ ID NO: 141848 - RNA, 64 nt, hsa
aaugguggaugcuacggacacauucagucuguucauaaaacauggacugaugggucugcuccag

SEQ ID NO: 141849 - RNA, 64 nt, hsa
aagaauaggggcaagacgacaaaaguaccuuugaauaaaacaauuuaagaaauugguuuaagau

SEQ ID NO: 141850 - RNA, 64 nt, hsa
ucuuuagcacacuaggugguaugccuuuauuagcauaaaacaaaaaaaacuuuaacaggagcuu

SEQ ID NO: 141851 - RNA, 64 nt, hsa
caaauuauucuuuuauauaacugaccagugcuuaauaaaacaagcagguacuuacaaauaauua

SEQ ID NO: 141852 - RNA, 64 nt, hsa
auaaaacuaaugaaggguuuuuuaaaagaacuaaauaaaacaaauaaaacuaggcuacagguau

SEQ ID NO: 141853 - RNA, 64 nt, hsa
gcauguuuuacaguacuccagaugucuacacucaauaaaacauuugacaaaaccagccuuggug

SEQ ID NO: 141854 - RNA, 64 nt, hsa
uuucugagaauuuguuugaauuaguucuuuguaaauaaaacaggauuuugaaugcauucaggaa

SEQ ID NO: 141855 - RNA, 64 nt, hsa
uuaaugcuuuuauagacuacucauagucugagucauaaaacaucauuugccuuucaauuuauac

SEQ ID NO: 141856 - RNA, 64 nt, hsa
gccagaaaugcccucccuagguccaggaccaaagauaaaacaaacacgaggaacauguagcguc

SEQ ID NO: 141857 - RNA, 64 nt, hsa
gaauuaacuaauucuacuugaaaucaggaguuuuauaaaacaacauuuuuagacguggucaucu

SEQ ID NO: 141858 - RNA, 64 nt, hsa
gcuuggauacauaugaaugaugcuuuccccucaaauaaaacaucugcauuauucugaaacucaa

SEQ ID NO: 141859 - RNA, 64 nt, hsa
uuguaacuuccugugaauuuauaauaauuucaaaauaaaacaaguuaaaaaaaaacccacuaug

SEQ ID NO: 141860 - RNA, 64 nt, hsa
auuacuugcaguucugaguuucagauaaaacauuauaaaacauuaaauucaauacauacugcuc

SEQ ID NO: 141861 - RNA, 64 nt, hsa
caaccugcaaauuacuugcaguucugaguuucagauaaaacauuauaaaacauuaaauucaaua

SEQ ID NO: 141862 - RNA, 64 nt, hsa
ggccugagauuuuauuuuagaaaaagguuguuacauaaaacacccuggccaguucauuucagca

SEQ ID NO: 141863 - RNA, 64 nt, hsa
auagauaaauauguaucuacacagaguaauaauaauaaaacacaguaaacauucuauuucucua

SEQ ID NO: 141864 - RNA, 64 nt, hsa
aagguuucaaugggaaauuugauuuuauuacaaaauaaaacauuuuuuaauguuaaaguuuaua

SEQ ID NO: 141865 - RNA, 64 nt, hsa
aucccaaaguuauuaccacauaaucuuuuaaacaauaaaacaaauaccccuuagaaagucuucu

SEQ ID NO: 141866 - RNA, 64 nt, hsa
aaaucuucagcaugaacaaauauuaaugucgauaauaaaacauuggacucuuugaaauguaugu

SEQ ID NO: 141867 - RNA, 64 nt, hsa
ucgaaauuaaccuugauuuauaacuauuuuuguaauaaaacaaugacagcuguaguaacuauga

SEQ ID NO: 141868 - RNA, 64 nt, hsa
augggguuaaagcuuucaauaucuuaaaauauuuauaaaacauuucacuguugcaaaaucacuu

SEQ ID NO: 141869 - RNA, 64 nt, hsa
gccaauauuuucuuauguuaacuuuugcugauguauaaaacagacuaugccuuauaauugaaau

SEQ ID NO: 141870 - RNA, 64 nt, hsa
aauaaaauuauaaucugccugaaaaugaauaaaaauaaaacauuuugaaaugugugguugagau

SEQ ID NO: 141871 - RNA, 64 nt, hsa
ucaauaacuuuuuuucuuaugcaaacgucaugcaauaaaacaaacucuaauguuuggcauccuu

SEQ ID NO: 141872 - RNA, 64 nt, hsa
ugcauaacuugaauucaauagacuuuugcugguuauaaaacagauguuuuuuagauuauuaaua

SEQ ID NO: 141873 - RNA, 64 nt, hsa
agcaaaucuucaaaaucaguagacauuucuggacauaaaacacagaugaggaaagggcuucaau

SEQ ID NO: 141874 - RNA, 64 nt, hsa
cuccagugucaagguaguucagcucuuacaggauauaaaacaguccauacuugagagaaaaacu

SEQ ID NO: 141875 - RNA, 64 nt, hsa
auuuugcuuuaaaaaaauuucuaauuuuuuucacauaaaacaauuauccuaaagguuaauaguu

SEQ ID NO: 141876 - RNA, 64 nt, hsa
auguugaugggacaagaagaauaguauuuauuuaauaaaacauauauuauauugaacuaugugu

SEQ ID NO: 141877 - RNA, 64 nt, hsa
uuuauaugcaauucuucugguaaauagcaauagaauaaaacauauuucaauguuuguguauagg

SEQ ID NO: 141878 - RNA, 64 nt, hsa
ucacauacuauagaaagauauuaguaugcauuuaauaaaacauauucacuugaauauauggaau

SEQ ID NO: 141879 - RNA, 64 nt, hsa
uaucagagcaauuuugcuugcagaaagcuaugaaauaaaacacgucccuuaacugcauugcuau

SEQ ID NO: 141880 - RNA, 64 nt, hsa
acuuuggaauauugcauugaacucagcuauacacauaaaacauuuucuuugguaaaucaagauc

SEQ ID NO: 141881 - RNA, 64 nt, hsa
guguuguauuugaaaguuuuacaguaaguuuaaaauaaaacauucugugacugacgguguuuuu

SEQ ID NO: 141882 - RNA, 64 nt, hsa
gcaauaaaaaaugcuuugagauagcuaacugcccauaaaacaaacucaaauugcuuauaaaguu

SEQ ID NO: 141883 - RNA, 64 nt, hsa
ucugcauucucauuggaaaugucuguuuagcuuuauaaaacaaacacuuugcugaaauaggaaa

SEQ ID NO: 141884 - RNA, 64 nt, hsa
auucaacugaacaacuaguugucaacuaaugaaaauaaaacauuuucucuaagcaucuuuagcc

SEQ ID NO: 141885 - RNA, 64 nt, hsa
acuuagguaaaugacauagacgcacuugggugaaauaaaacaacaaaaaagguaauccaguaau

SEQ ID NO: 141886 - RNA, 64 nt, hsa
uaaauuacauugccuuuuguccauuaaucagcaaauaaaacauggccuuaacaaaguuguuugu

SEQ ID NO: 141887 - RNA, 64 nt, hsa
aacugagaaacuuuuauauauaacugaugaucacauaaaacagauuugcauaaaauuaccauga

SEQ ID NO: 141888 - RNA, 64 nt, hsa
uuugguugguucuuuuuucauaggaaauuccuucauaaaacauguaacacugaucuucagauag

SEQ ID NO: 141889 - RNA, 64 nt, hsa
aguauauauuuuccccuacgguuuuaaaaaacagauaaaacauggacaauggcagaggacuuuu

SEQ ID NO: 141890 - RNA, 64 nt, hsa
aauugauauuuuuucuggaacugaauucuuaaacauaaaacagauaaaaugcaucuuguuacua

SEQ ID NO: 141891 - RNA, 64 nt, hsa
uaauuuugaaaagaaauagaaauuaagcuacuauauaaaacaauuguuuacguguacuuuuaac

SEQ ID NO: 141892 - RNA, 64 nt, hsa
uuucuagccacuguuuuuuuuuucuuguuuccuuauaaaacagguaauaaccaaucauuuugug

SEQ ID NO: 141893 - RNA, 64 nt, hsa
gaaauuuagcaauaguuaauauuaggugacauaaauaaaacaucccagacuagugaguuaagua

SEQ ID NO: 141894 - RNA, 64 nt, hsa
acgugaccggcaaauaaaucucauagcaguuaauauaaaacaucuuuggaggaugggagagaac

SEQ ID NO: 141895 - RNA, 64 nt, hsa
cugcccccugagaaaacacuugaauugacgcaauauaaaacaaaaugugaaaaccaaaguggau

SEQ ID NO: 141896 - RNA, 64 nt, hsa
uuuggacagcacaugaagucugccaauguacuuaauaaaacaugacuuuguuuauuuaaaguuu

SEQ ID NO: 141897 - RNA, 64 nt, hsa
gaagaaagauaucuaucuaaucuauuaaaucuuuauaaaacauuacauugcagagggggagcua

SEQ ID NO: 141898 - RNA, 64 nt, hsa
agaacaguuuuaaaaaucuaauuagaauuuccaaauaaaacaguuuccauaaggugucagcaac

SEQ ID NO: 141899 - RNA, 63 nt, hsa
ggcugcaggcacaaguauagaaaacucuuaaugauaaaacauuuaacaaaaucuauaacugug

SEQ ID NO: 141900 - RNA, 64 nt, hsa
uauugaauaccagggucauaucuuagaauuguauauaaaacaacauguaacccauucaugaaaa

SEQ ID NO: 141901 - RNA, 64 nt, hsa
ugcuuauuuuucagccuuuaaagucugaaauacuauaaaacacugagaguaucuaugucuuucu

SEQ ID NO: 141902 - RNA, 64 nt, hsa
acucuacagguagcuauugauauaauuaguuuuaauaaaacaugcugcaaccaugguauacaac

SEQ ID NO: 141903 - RNA, 64 nt, hsa
uagcuucuggcuuuuaauuuugccagcuaaggacauaaaacaaaaauaaacaaacaaaaacaaa

SEQ ID NO: 141904 - RNA, 64 nt, hsa
uuuauuuuaugaaguaauguuaauuuuacuaagaauaaaacauccaaauuuuaaguauuaugaa

SEQ ID NO: 141905 - RNA, 64 nt, hsa
cuguauguauuuaaaauucugauguuuacugaacauaaaacaauaguggcaacacuccuauugg

SEQ ID NO: 141906 - RNA, 64 nt, hsa
ggcauuucuuaagcuuuauccaaauuucagcuacauaaaacauuucaggauuuaaauuaguacc

SEQ ID NO: 141907 - RNA, 64 nt, hsa
augauagguaaaaagaucuauacaucuuaaugaaauaaaacauuccugcuuuuaguuauuaugu

SEQ ID NO: 141908 - RNA, 64 nt, hsa
auaguuugccccuuuuggaaugaucucugaauauauaaaacacacacacaaagagcaauaguuu

SEQ ID NO: 141909 - RNA, 64 nt, hsa
auaguuugccccuuuuggaacgaccccugaauauauaaaacacacacacaccccgcgcacucuc

SEQ ID NO: 141910 - RNA, 64 nt, hsa
augguggaaguauaaauaagccuaugaacuuauaauaaaacaaacuguagguagaaaaaaugag

SEQ ID NO: 141911 - RNA, 64 nt, hsa
gaaaaaauacuuguucagguaauucuaauucuuaauaaaacaaaugaguaucauacagguagag

SEQ ID NO: 141912 - RNA, 64 nt, hsa
gcuauuuaaacaauuuuuuucuaacgugaaaaggauaaaacauuaaaaacucuugagaacuaua

SEQ ID NO: 141913 - RNA, 64 nt, hsa
aaugaaagccaccuuuuguuaaaaauuugcucuaauaaaacauaccaaauccugguugcagagu

SEQ ID NO: 141914 - RNA, 64 nt, hsa
augagcuuaaauuacccaagcuuacuuuccaucuauaaaacagggcuaauaaugguaaucacau

SEQ ID NO: 141915 - RNA, 64 nt, hsa
uauugucauugaacacugguauuuucuguaucauauaaaacauuaaaauucaaauaauuauaag

SEQ ID NO: 141916 - RNA, 64 nt, hsa
uuuauuguaauguuuacuagcggacuaguaaacaauaaaacauugauuauuuagcuuuauaauu

SEQ ID NO: 141917 - RNA, 64 nt, hsa
ugagaaaauaaaauauuucuuaauuguaaucauaauaaaacaauugcagauugcuaaguagcug

SEQ ID NO: 141918 - RNA, 64 nt, hsa
cacagccugcauuaauuugcuuuucuuuuaauuaauaaaacagacacagaguuaagauaguuua

SEQ ID NO: 141919 - RNA, 64 nt, hsa
cuugugaaauuucuguacuuuguauauaaaauacauaaaacaauagauuagaaaucaaaagaua

SEQ ID NO: 141920 - RNA, 64 nt, hsa
auuugcauguuauguuuaauaagcuacuagcaaaauaaaacauagcaaauggcaucacuguguu

SEQ ID NO: 141921 - RNA, 64 nt, hsa
ccagaaauguuuauggaaauauuaagaacauuuuauaaaacauacgaaaaagugauugugaagg

SEQ ID NO: 141922 - RNA, 64 nt, hsa
agagccacauacuuuacaguaaaauuaaguguguauaaaacauuaauugcuaacaauuguuagc

SEQ ID NO: 141923 - RNA, 64 nt, hsa
gacuccuuguucucuagaagggcuuuuuacuugaauaaaacaaugcaacuuagcaaaccaauuu

SEQ ID NO: 141924 - RNA, 64 nt, hsa
agaaaagacaugcuccaaaaaaaaaacaaaacugauaaaacaguuuuucgaaacuuacuuuuaa

SEQ ID NO: 141925 - RNA, 64 nt, hsa
gcaaaguuuacagacuuuugauauggaaaaccagauaaaacaauguuacaaaaggcaaauauaa

SEQ ID NO: 141926 - RNA, 64 nt, hsa
auuaguuugaaagauaucuggagaaaucgcauucauaaaacaauuggaagugaaacuauuaaaa

SEQ ID NO: 141927 - RNA, 64 nt, hsa
ggacuuuuuagaaggaaauacuugguaaaacuuaauaaaacaggugguuggcugcauuuuuuaa

SEQ ID NO: 141928 - RNA, 64 nt, hsa
uaagagagaagcuuuuaaaacaguacauuccugaauaaaacaacaauauuguaucuuaaucaag

SEQ ID NO: 141929 - RNA, 64 nt, hsa
uaguagcugaguguuccugaguugccuaguagcaauaaaacaagugaauaggaaaauaauuaau

SEQ ID NO: 141930 - RNA, 64 nt, hsa
uaggcuggaaaguuuuuuucaucacuaugauuuuauaaaacaauuuuuucuaugaaccuuuacu

SEQ ID NO: 141931 - RNA, 64 nt, hsa
cuuauuuuaaguuccaaaggugaagucuuuaagaauaaaacauuaccaacuccugcuuuuauau

SEQ ID NO: 141932 - RNA, 64 nt, hsa
cugguauuuugacauguuauaauacgcaaguaaaauaaaacaauaguuuacucagcucauguua

SEQ ID NO: 141933 - RNA, 64 nt, hsa
aaaacauaaauuaaaacucaaaugccaggacaaaauaaaacaauauaccagauggagaggaugc

SEQ ID NO: 141934 - RNA, 64 nt, hsa
aagggauuauaggacugucuuugauuaucauuuuauaaaacaugcuuagugcauuagugucaca

SEQ ID NO: 141935 - RNA, 64 nt, hsa
agaacuugcuuccaaaguaagugaauagaauacaauaaaacaaaacaaugacacaaaaccacaa

SEQ ID NO: 141936 - RNA, 64 nt, hsa
uuaauucaaggauaaaacagaagaagcuugugguauaaaacaauaguucaagauccagcugaaa

SEQ ID NO: 141937 - RNA, 64 nt, hsa
ggggcauaaaaggcuaucuauucuuaauucaaggauaaaacagaagaagcuugugguauaaaac

SEQ ID NO: 141938 - RNA, 64 nt, hsa
uucucuuuguaaguagauucaaauuagauagucaauaaaacaucuugaaaaucccacaagccaa

SEQ ID NO: 141939 - RNA, 64 nt, hsa
augccuuugauuccuuagaggucgguaauuuaacauaaaacagggaugucacuuugaggggcag

SEQ ID NO: 141940 - RNA, 64 nt, hsa
uugccuggaaagauguuuucaaggaauuugaaccauaaaacacuaucugaugcacagaacaccu

SEQ ID NO: 141941 - RNA, 64 nt, hsa
uaguguccagaauguucagacauucggaguguacauaaaacagaaaaaaucuucauguauuuuu

SEQ ID NO: 141942 - RNA, 64 nt, hsa
agaaaaaagaaauugguuaugaauaaaagugacaauaaaacaugagauauaaaucaagcuuaaa

SEQ ID NO: 141943 - RNA, 64 nt, hsa
cuuacguucugguugucauguuucccuguauuugauaaaacacauaauuuugagaaaaauaaag

SEQ ID NO: 141944 - RNA, 64 nt, hsa
cuucaaaacagaagggcaaauggaaaaggggaauauaaaacaaaccaauaaaaauaccaucuga

SEQ ID NO: 141945 - RNA, 64 nt, hsa
ggaauacauucauaaguacauacauucuuuugguauaaaacaauauuuugacaguuuaggcuuc

SEQ ID NO: 141946 - RNA, 64 nt, hsa
aucacauaugugcauagauacacaaucguauuacauaaaacacccuugaaaauauaugacuuug

SEQ ID NO: 141947 - RNA, 64 nt, hsa
aguucacacugcagagcuagguuguccuauuggcauaaaacaaaccagcaacuuuucucaugug

SEQ ID NO: 141948 - RNA, 64 nt, hsa
uuaaguuuuuaaaggugauucugugcaguaagguauaaaacagauauauaauaaauagccuagc

SEQ ID NO: 141949 - RNA, 64 nt, hsa
cuaaaaaggaaaaaaaacaccaaaauaagauaaaauaaaacaaauuuaaacaccaaaauaagau

SEQ ID NO: 141950 - RNA, 64 nt, hsa
aauaaaacaaauuuaaacaccaaaauaagauauaauaaaacauuuguuuuugcaaaauaaggcc

SEQ ID NO: 141951 - RNA, 64 nt, hsa
uucuaaaagccccaacacaugacgccaucugaagacccgcaacggaguggggguggcggccgcc

SEQ ID NO: 141952 - RNA, 64 nt, hsa
cccguuuguucucagauaaaaagcaguuuuauaaacccgcaaucugcuccagauucaagcagua

SEQ ID NO: 141953 - RNA, 64 nt, hsa
ccauaaugcagacuuucccauuccuucucuuuccacccgcaacuguggggcuaagaauucuuaa

SEQ ID NO: 141954 - RNA, 64 nt, hsa
aauacaugcaaagcaauaucuuguucagguuaguacccgcaaaacgggacauaguaugugacaa

SEQ ID NO: 141955 - RNA, 64 nt, hsa
uugucauuggauugaauuuacuuuuuuguuucucacccgcaacuugagccaggacagcuggucc

SEQ ID NO: 141956 - RNA, 64 nt, hsa
accuucacucuccaggguacaugcuuuaaaaccgacccgcaacaaguauuggaaaaauguaucc

SEQ ID NO: 141957 - RNA, 64 nt, hsa
cacauuuccuguucauaaguuugggauuuacauaacccgcaaccaccauguuccuuuguauaug

SEQ ID NO: 141958 - RNA, 64 nt, hsa
ucugccacugucagggaccagccggccaacgcccacccgcaaaggugucuaaaaacuucagcuu

SEQ ID NO: 141959 - RNA, 64 nt, hsa
cccaagugccuucccucaugccugggccggccugacccgcaaugggcagagggugggugggacc

SEQ ID NO: 141960 - RNA, 64 nt, hsa
acacaaaggaccuuagaugagaucuggcauaugcacccgcaauagaagggcaccacuuggauga

SEQ ID NO: 141961 - RNA, 64 nt, hsa
gcucaaagcucagacucaggucugaaacccacccacccgcaagccuaccagccuuguggccacg

SEQ ID NO: 141962 - RNA, 64 nt, hsa
ggcccaggcgcgguugaccugccccugcuguaacacccgcaagaaggaugcaguccuuaccaag

SEQ ID NO: 141963 - RNA, 64 nt, hsa
uaaguugaagcccuuacugguguaccgcucagaaacccgcaaggcucugaaggguucuugaagc

SEQ ID NO: 141964 - RNA, 64 nt, hsa
ugaaaucaacucucuucggucguauccaccuugcacccgcaagucaagccgccccuuguagaaa

SEQ ID NO: 141965 - RNA, 64 nt, hsa
cccucgugugagcccagccuguggucuucuccguacccgcaacguggucaucugugcccgugac

SEQ ID NO: 141966 - RNA, 50 nt, hsa
uguaccuggugagcugcugaacccgcaaaugcugcugccccagcucuaca

SEQ ID NO: 141967 - RNA, 64 nt, hsa
cccccuccugggaagugcccccucaccucagggcacccgcaaccugggcuccucccugagcgca

SEQ ID NO: 141968 - RNA, 64 nt, hsa
accugucacuaauacagcugccugugacccugggacccgcaaccuuccagcugcuucccuuugu

SEQ ID NO: 141969 - RNA, 64 nt, hsa
gugccauuucuccuuuugccugccaguuuguccuacccgcaagcugguugauauggggcagagg

SEQ ID NO: 141970 - RNA, 64 nt, hsa
cagggccuagagagccugguguugggucaugcugggaagggagcggcagcccagccaggccugg

SEQ ID NO: 141971 - RNA, 64 nt, hsa
cagccaggcaccugcuccucuugcccuuccugggggaagggagcugccuucugucccuguaacu

SEQ ID NO: 141972 - RNA, 64 nt, hsa
gccacuuagggcacugcuagcagggcuucaaccaggaagggaucaacccaggaagggaugauca

SEQ ID NO: 141973 - RNA, 64 nt, hsa
cuagcagggcuucaaccaggaagggaucaacccaggaagggaugaucaggagaggcuucccuga

SEQ ID NO: 141974 - RNA, 64 nt, hsa
ucccuaucuccuuuuagaccugggacggcaaaagggaagggaaggaaacuuagcagagugcuau

SEQ ID NO: 141975 - RNA, 64 nt, hsa
uguuaucucuguagggcucaggaagcuggaaggaggaagggaggguaaguggccuggugagugg

SEQ ID NO: 141976 - RNA, 64 nt, hsa
gggccagccuccccacuuacaaggcugcuuuccaggaagggaggucugguguaucucaugggag

SEQ ID NO: 141977 - RNA, 64 nt, hsa
cuggcaggaccaagacugcggcuggggugggcagggaagggaagccgggggcugcugugaggga

SEQ ID NO: 141978 - RNA, 64 nt, hsa
gggcuggagaccaggccaugggcccucacggagaggaagggaaggaaggagagggagggggagg

SEQ ID NO: 141979 - RNA, 64 nt, hsa
agaccuuccagacuucggcugagcuuggagggugggaagggagccuucucaguccucucucccu

SEQ ID NO: 141980 - RNA, 64 nt, hsa
uuuaaauuuaaaaucacuuuuuuaacgaauggggggaagggaucuaugagaaaggugguaucua

SEQ ID NO: 141981 - RNA, 64 nt, hsa
ugaaucucacaaugcgucguagaugucgcguguuggaagggagcaggaggaaggacugauacug

SEQ ID NO: 141982 - RNA, 64 nt, hsa
gaguucuggcugagcccaggguggggagauccugggaagggaggcacuggaggaagacggcacc

SEQ ID NO: 141983 - RNA, 64 nt, hsa
gauaggaagaaucagucuaaacuggccaugcuuuggaagggacaagacuaugugcuccgcugcc

SEQ ID NO: 141984 - RNA, 64 nt, hsa
aaaaaaaaaaucaugggggugggguggggggaagggaagggaugguuuauuugcaaaaaccaug

SEQ ID NO: 141985 - RNA, 64 nt, hsa
uuaaaaaaaaaaaaaucaugggggugggguggggggaagggaagggaugguuuauuugcaaaaa

SEQ ID NO: 141986 - RNA, 64 nt, hsa
gggggaacaguauggaaaagacuggaaggggaaaggaagggaagggagggagggucuguucuau

SEQ ID NO: 141987 - RNA, 64 nt, hsa
aacaguauggaaaagacuggaaggggaaaggaagggaagggagggagggucuguucuaucuguu

SEQ ID NO: 141988 - RNA, 64 nt, hsa
cucagcucugcccagggccagccagguucugcugggaagggaagggaauggggagaagggagaa

SEQ ID NO: 141989 - RNA, 64 nt, hsa
cucugcccagggccagccagguucugcugggaagggaagggaauggggagaagggagaagcaag

SEQ ID NO: 141990 - RNA, 64 nt, hsa
cuuuuccuuuuggaucauagcuuaacaaggcacaggaagggaagggaucuugacuaagauucau

SEQ ID NO: 141991 - RNA, 64 nt, hsa
ccuuuuggaucauagcuuaacaaggcacaggaagggaagggaucuugacuaagauucaugagac

SEQ ID NO: 141992 - RNA, 64 nt, hsa
ucacagagacccugcacagcccugauuuacagagggaagggaagcgcgggugaggugguggccc

SEQ ID NO: 141993 - RNA, 64 nt, hsa
cggaccugagucgggcagccgcucucccggaacuggaagggaaagccaggcggcucucaggggc

SEQ ID NO: 141994 - RNA, 64 nt, hsa
caggggacaagaggcaaguuggagugaugcagccggaagggaagggacaccaaggaucuccggc

SEQ ID NO: 141995 - RNA, 64 nt, hsa
gacaagaggcaaguuggagugaugcagccggaagggaagggacaccaaggaucuccggccacca

SEQ ID NO: 141996 - RNA, 64 nt, hsa
agcacacugaguuuguacaauuguguuaacugcuggaagggacagaugcacugauauauaugca

SEQ ID NO: 141997 - RNA, 64 nt, hsa
gcacgaagccaccagucucccccagggagcaucaggaagggacauggaugugcuccugccacag

SEQ ID NO: 141998 - RNA, 64 nt, hsa
ucagugcuagaauaaaguccuguagguuuauuuuggaagggacuguggccaggguaguucucag

SEQ ID NO: 141999 - RNA, 64 nt, hsa
ggagucucaguaaucaagccaauggccuuugucaggaagggaaggggcucaacacagugaugga

SEQ ID NO: 142000 - RNA, 64 nt, hsa
ucuauaggcagcuucuaagagcgaacuucacauaggaagggaucugagaacacguugccagggg

SEQ ID NO: 142001 - RNA, 64 nt, hsa
ccaaacacucaguccacuguugagccccagugcuggaagggaggaaggccuuucuucuguguua

SEQ ID NO: 142002 - RNA, 64 nt, hsa
gggaggggccuuugucuagggaagggacugguagggaagggacgagucuaggcugagggcaaga

SEQ ID NO: 142003 - RNA, 64 nt, hsa
cugggacccagggaggggaggggccuuugucuagggaagggacugguagggaagggacgagucu

SEQ ID NO: 142004 - RNA, 64 nt, hsa
ugauuucuggugaggugaccacagcugcaguuagggaagggagccauugagcacagacuuugga

SEQ ID NO: 142005 - RNA, 64 nt, hsa
acauuuauuuauuaauucaugccuuaaaaaaauaggaagggaagcuuuuuuuuuucuuuuuuuu

SEQ ID NO: 142006 - RNA, 64 nt, hsa
gggaagaugaagagauucuagaaucugugcccugggaagggagaaacagcagggaagaggggca

SEQ ID NO: 142007 - RNA, 64 nt, hsa
gugggguuuccaccuggcuuuuggcuacagagagggaagggaaagccugaggccggcauaaggg

SEQ ID NO: 142008 - RNA, 64 nt, hsa
gcccgcucccacagcuuccugagggcuaauucugggaagggagaguucuuugcugccccugucu

SEQ ID NO: 142009 - RNA, 64 nt, hsa
ccccuggggacgccaaggaggugggccacacccaggaagggaaagcgggcagccccguuuuggg

SEQ ID NO: 142010 - RNA, 64 nt, hsa
cccacaccacaccuguaggggaccugucugacugggaagggaguuccgagagggagggggcaau

SEQ ID NO: 142011 - RNA, 64 nt, hsa
cuccacgaccaagccgagaaaggaccuaggguggggaagggagggucucuugauuccuaaccgc

SEQ ID NO: 142012 - RNA, 64 nt, hsa
ggcuagaguauccaugcaaggugucuuguugcauggaagggauaguuuggcucccuuggaggcu

SEQ ID NO: 142013 - RNA, 64 nt, hsa
caugauggaugauuauuauuuuaaggucuguuuaggaagggaaauggcuacuuggccagccauu

SEQ ID NO: 142014 - RNA, 64 nt, hsa
gccaugagcacagggcagggcuggggcagagaaaggaagggaacuggagcuggcccagggcugu

SEQ ID NO: 142015 - RNA, 64 nt, hsa
uauuugcuuaccuucccguuucuccucugccccuggaagggaaugugggggcccacuuuuuugu

SEQ ID NO: 142016 - RNA, 64 nt, hsa
ccgcagcugagcaggugucacaagcuguaaaggaggaagggagucugcaggcccuucacauuuu

SEQ ID NO: 142017 - RNA, 64 nt, hsa
ucucuccccugugcugggagcuccgucugccuugggaagggagacgaggugugcuguuccuucc

SEQ ID NO: 142018 - RNA, 64 nt, hsa
gaugaguacauguggacucaccugaggaagggaaggaagggaauaaucuuuuauguuucauuua

SEQ ID NO: 142019 - RNA, 64 nt, hsa
uugucuccugaugaguacauguggacucaccugaggaagggaaggaagggaauaaucuuuuaug

SEQ ID NO: 142020 - RNA, 64 nt, hsa
ccuguuacuaugguaacacuuugcuuucugaauuggaagggaaaaaaaauguagcgacagcauu

SEQ ID NO: 142021 - RNA, 64 nt, hsa
gacggguauuguugggaaaggaacaggcuuggagggaagggagaaaguaggccgcugaugauau

SEQ ID NO: 142022 - RNA, 64 nt, hsa
ugggccuagaauacccugaugagaaaagagaagaggaagggaggccauaucuacaacacagccu

SEQ ID NO: 142023 - RNA, 64 nt, hsa
agaggaaggcucaaaggagucaacauuuauaucuggaagggacaagucaugccuugggccuaga

SEQ ID NO: 142024 - RNA, 64 nt, hsa
ugggcgagggugcguggggccugccccuuggaagggaagggaaggacgguguccuguggagacc

SEQ ID NO: 142025 - RNA, 64 nt, hsa
uuuuuugggcgagggugcguggggccugccccuuggaagggaagggaaggacgguguccugugg

SEQ ID NO: 142026 - RNA, 64 nt, hsa
gaaugaggugggaggugucugguaaggucaugggggaagggagaugagagaggagauaggcaga

SEQ ID NO: 142027 - RNA, 64 nt, hsa
agguggauugagcaggaucucaggguuaugucgaggaagggaagaaagaaacagaagucaggca

SEQ ID NO: 142028 - RNA, 64 nt, hsa
uuuguuuccuugguacuaauuuuaauuuuuauuuggaagggagcaguauaaagcuuauuuguau

SEQ ID NO: 142029 - RNA, 64 nt, hsa
ucacugguucccaacuagaugcuuguuggccacgggaagggaaaugacuuguucuaauucuagg

SEQ ID NO: 142030 - RNA, 64 nt, hsa
cugucugaggcucugagcguacauagggaagggaggaagggaaaacagaaagcagacaaagaaa

SEQ ID NO: 142031 - RNA, 64 nt, hsa
cagacggucugucugaggcucugagcguacauagggaagggaggaagggaaaacagaaagcaga

SEQ ID NO: 142032 - RNA, 64 nt, hsa
aucuggagggggcgcuggaggagugcgaaacgggggaagggagccggcagaauagagggcaucc

SEQ ID NO: 142033 - RNA, 64 nt, hsa
ggggcgccuggccagagccgggguuccaggacagggaagggagcaggagccugcagucacuggc

SEQ ID NO: 142034 - RNA, 64 nt, hsa
aggugggggcuggggaaugaggggcugaggucccggaagggauuuuauuuuuuugaauuuuaau

SEQ ID NO: 142035 - RNA, 64 nt, hsa
gggagcuguucacuuuaggauacgggggugguauggaagggagcguucacaccgccagccucgg

SEQ ID NO: 142036 - RNA, 64 nt, hsa
ccagcugcgacguacugucacugaugagagacugggaagggaaaagcauauauauauagauaua

SEQ ID NO: 142037 - RNA, 64 nt, hsa
agaaaagaaagcaagaacagaaaacgaagccacaggaagggaaguagacauuguaugcuuaugg

SEQ ID NO: 142038 - RNA, 64 nt, hsa
agagaacuucaaagaaaaucccucccugugcuuuggaagggaagggaggugggcagcagugggu

SEQ ID NO: 142039 - RNA, 64 nt, hsa
acuucaaagaaaaucccucccugugcuuuggaagggaagggaggugggcagcagugggucagag

SEQ ID NO: 142040 - RNA, 64 nt, hsa
cccagaagcagcaguggcagcuugggaaaugugaggaagggaaggagggagagacgggagggag

SEQ ID NO: 142041 - RNA, 64 nt, hsa
ucaggcuucccacccugugcggggcacacccccaggaagggacccuggacacggcucccacguc

SEQ ID NO: 142042 - RNA, 64 nt, hsa
uuuuccuuugggggaggcggagaggggagaagaaggaagggaagggcagaaggaaggagggaag

SEQ ID NO: 142043 - RNA, 64 nt, hsa
cgaggcuggggcuggggguggcugggaggggaagggaagggagaggcaagcuggcugugaacug

SEQ ID NO: 142044 - RNA, 64 nt, hsa
uuucccgaggcuggggcuggggguggcugggaggggaagggaagggagaggcaagcuggcugug

SEQ ID NO: 142045 - RNA, 64 nt, hsa
agguggccguccaaagacagccaacggagcugccucgcagaaucagccagugggcagguggacg

SEQ ID NO: 142046 - RNA, 64 nt, hsa
uguuauacuagguuugauuugaaacuggugcuugucgcagaacugucagagcaugaggagcgcu

SEQ ID NO: 142047 - RNA, 64 nt, hsa
ggguccucaaggaacaaagaagauaaagcacaaaucgcagaacuugaauccaggcugcugcuca

SEQ ID NO: 142048 - RNA, 64 nt, hsa
gucuucgccaaucacagugcagcaaggccaauucucgcagaaacccccacgugugcacgagugg

SEQ ID NO: 142049 - RNA, 64 nt, hsa
uguucucuugcccucuggaccuaagcguucccacucgcagaaagaguaagguggacugacuuuu

SEQ ID NO: 142050 - RNA, 64 nt, hsa
acacacaucaauggcaauaacuucuuccaacuccucgcagaagugggagaggccggcagccugc

SEQ ID NO: 142051 - RNA, 57 nt, hsa
gacugggccaggaucuguaaucauccuucgcagaacaugaguuuaugggaaugccuu

SEQ ID NO: 142052 - RNA, 64 nt, hsa
uuuuucuuuuuagucguuccccaucaggaaguccucgcagaagugcaaguccugaaagaaugga

SEQ ID NO: 142053 - RNA, 64 nt, hsa
cugccacuugguguggcucaccagggcaccagccucgcagaaggcaucuuccuccucucuguga

SEQ ID NO: 142054 - RNA, 64 nt, hsa
ggaucagaaugcuuugggauuaauugggcagccaucgcagaauuguuugugggcaaagggcugc

SEQ ID NO: 142055 - RNA, 64 nt, hsa
cagggggcuggacuucaggcggggacccauugccucgcagaagaaaguucucacuuauaaaccu

SEQ ID NO: 142056 - RNA, 64 nt, hsa
ccagucagguauguucugagugaacccacagcagucgcagaaugagcaccuggcaggguggguu

SEQ ID NO: 142057 - RNA, 64 nt, hsa
gagaaaaaaccuccgucugccuaaaucacuuuucucgcagaagccaugcgacucccacacgaca

SEQ ID NO: 142058 - RNA, 64 nt, hsa
acuugucacgccagaagcacacuugaggcugcagucgcagaaauaauuaaugagauucgcuccu

SEQ ID NO: 142059 - RNA, 64 nt, hsa
gcauggaaccuggaccaaggcaaaugucuuuucuucgcagaauuguuuuccaggaugccagugg

SEQ ID NO: 142060 - RNA, 64 nt, hsa
agggauguuugcaauuucccagucagcuguucugucgcagaauguuuaaugcacaauuuuuugc

SEQ ID NO: 142061 - RNA, 64 nt, hsa
gaguagacaacuuuaauaauccauauuuauacuaucgcagaaguaagcauuuggcaaacguuca

SEQ ID NO: 142062 - RNA, 64 nt, hsa
ucgggacaaaacaaugacucaaggacagcacuucucgcagaaggucuggaagugcccagaaugg

SEQ ID NO: 142063 - RNA, 64 nt, hsa
caugacuguucccacuuuuaaugaauccuaccuuucgcagaaggcugaaagcagggcagaaaag

SEQ ID NO: 142064 - RNA, 64 nt, hsa
cccuugcaggaccuuuguagguugugggaaaaagucgcagaaagauacucaaaguggagcaggg

SEQ ID NO: 142065 - RNA, 64 nt, hsa
uaaauguguuaauuuuaguagaaucaggcacugcucgcagaaggaacacagauuguagagauua

SEQ ID NO: 142066 - RNA, 64 nt, hsa
ucaccgcggcacacguucuagcucauucuuggccucgcagaaaacucucggauggcaacauuaa

SEQ ID NO: 142067 - RNA, 64 nt, hsa
gagcagcaaacauagauggagaguuugagggcuuucgcagaaaugcugugauucuguuuuaagu

SEQ ID NO: 142068 - RNA, 64 nt, hsa
cucaaaaguuuguuuuauuaauuguacucaacccucgcagaacaguaaaacugaagauuauugu

SEQ ID NO: 142069 - RNA, 64 nt, hsa
agcacagccagcuccgugcccucugaauuauguuucgcagaaaaguguccccaaggaagugcca

SEQ ID NO: 142070 - RNA, 64 nt, hsa
cgauuuugcaagcuucaagauucuguuccccucuucgcagaagugaggaaggcaaauacucagg

SEQ ID NO: 142071 - RNA, 64 nt, hsa
gugggugguagugguuaauuuauacaguacugauucgcagaauguuuaagcuuuuuaaacauag

SEQ ID NO: 142072 - RNA, 64 nt, hsa
aaaacuccaaacccuucaguggaugaggacaaggucgcagaaaggcauucuguugacagaugaa

SEQ ID NO: 142073 - RNA, 64 nt, hsa
aaaaccuugacauuucaaagacugccuugaaaggucgcagaaauugauuucuauuuuuaauuuc

SEQ ID NO: 142074 - RNA, 64 nt, hsa
gggcgccgagugcccucuccuggacgaucgcgggucgcagaagcccaggccagcgagcccuaca

SEQ ID NO: 142075 - RNA, 64 nt, hsa
ggggaagaagagucucagacugugggacacggacucgcagaauaaacauauauguggcugugga

SEQ ID NO: 142076 - RNA, 64 nt, hsa
ccuuaagccacuguuauucugaucucuguuaaggucgcagaaucaaugcccuuacugauacacc

SEQ ID NO: 142077 - RNA, 64 nt, hsa
uuuuuuuuuuuuuuuggccaaaucucgugguguuucgcagaaaaaaauccagaaaauuucaaau

SEQ ID NO: 142078 - RNA, 64 nt, hsa; identical to SEQ ID NO: 61460

SEQ ID NO: 142079 - RNA, 64 nt, hsa; identical to SEQ ID NO: 61461

SEQ ID NO: 142080 - RNA, 64 nt, hsa; identical to SEQ ID NO: 61462

SEQ ID NO: 142081 - RNA, 64 nt, hsa; identical to SEQ ID NO: 61463

SEQ ID NO: 142082 - RNA, 64 nt, hsa; identical to SEQ ID NO: 61464

SEQ ID NO: 142083 - RNA, 64 nt, hsa; identical to SEQ ID NO: 61465

SEQ ID NO: 142084 - RNA, 64 nt, hsa; identical to SEQ ID NO: 61466

SEQ ID NO: 142085 - RNA, 64 nt, hsa; identical to SEQ ID NO: 61467

SEQ ID NO: 142086 - RNA, 64 nt, hsa; identical to SEQ ID NO: 61468

SEQ ID NO: 142087 - RNA, 64 nt, hsa; identical to SEQ ID NO: 61469

SEQ ID NO: 142088 - RNA, 64 nt, hsa; identical to SEQ ID NO: 61470

SEQ ID NO: 142089 - RNA, 64 nt, hsa; identical to SEQ ID NO: 61471

SEQ ID NO: 142090 - RNA, 64 nt, hsa; identical to SEQ ID NO: 61472

SEQ ID NO: 142091 - RNA, 64 nt, hsa; identical to SEQ ID NO: 61473

SEQ ID NO: 142092 - RNA, 64 nt, hsa; identical to SEQ ID NO: 61474

SEQ ID NO: 142093 - RNA, 64 nt, hsa; identical to SEQ ID NO: 61475

SEQ ID NO: 142094 - RNA, 64 nt, hsa; identical to SEQ ID NO: 61476

SEQ ID NO: 142095 - RNA, 64 nt, hsa; identical to SEQ ID NO: 61477

SEQ ID NO: 142096 - RNA, 64 nt, hsa; identical to SEQ ID NO: 61478

SEQ ID NO: 142097 - RNA, 64 nt, hsa; identical to SEQ ID NO: 61479

SEQ ID NO: 142098 - RNA, 64 nt, hsa; identical to SEQ ID NO: 61480

SEQ ID NO: 142099 - RNA, 64 nt, hsa; identical to SEQ ID NO: 61481

SEQ ID NO: 142100 - RNA, 64 nt, hsa; identical to SEQ ID NO: 61482

SEQ ID NO: 142101 - RNA, 64 nt, hsa; identical to SEQ ID NO: 61483

SEQ ID NO: 142102 - RNA, 64 nt, hsa; identical to SEQ ID NO: 61484

SEQ ID NO: 142103 - RNA, 64 nt, hsa; identical to SEQ ID NO: 61485

SEQ ID NO: 142104 - RNA, 64 nt, hsa; identical to SEQ ID NO: 61486

SEQ ID NO: 142105 - RNA, 64 nt, hsa; identical to SEQ ID NO: 61487

SEQ ID NO: 142106 - RNA, 64 nt, hsa; identical to SEQ ID NO: 61488

SEQ ID NO: 142107 - RNA, 64 nt, hsa; identical to SEQ ID NO: 61489

SEQ ID NO: 142108 - RNA, 64 nt, hsa; identical to SEQ ID NO: 61490

SEQ ID NO: 142109 - RNA, 64 nt, hsa; identical to SEQ ID NO: 61491

SEQ ID NO: 142110 - RNA, 64 nt, hsa; identical to SEQ ID NO: 61492

SEQ ID NO: 142111 - RNA, 64 nt, hsa; identical to SEQ ID NO: 61493

SEQ ID NO: 142112 - RNA, 64 nt, hsa; identical to SEQ ID NO: 61494

SEQ ID NO: 142113 - RNA, 64 nt, hsa
ucaaugcagguuuguuuuuuggugcuaauaugacauaugacaauaagccacgaggugcaguaag

SEQ ID NO: 142114 - RNA, 64 nt, hsa
aucaaaaucaaugcagguuuguuuuuuggugcuaauaugacauaugacaauaagccacgaggug

SEQ ID NO: 142115 - RNA, 64 nt, hsa
ugagauagcucugcagauaagaaaauauuuaaauauaugacaaaaaguaaaauuguacauguga

SEQ ID NO: 142116 - RNA, 64 nt, hsa
uccacuccagugagauuaugauuuguagcuucauauaugacauguuuauauuguaaaugcacuu

SEQ ID NO: 142117 - RNA, 64 nt, hsa
gagucacuaaacuuucuucaaaagguugugugaaauaugacagcuuucuaaauuaauuuguaua

SEQ ID NO: 142118 - RNA, 64 nt, hsa
cagucagucaucaaacauuauugagcaccuaacuauaugacaggcacuuuuuuagagacugcgg

SEQ ID NO: 142119 - RNA, 64 nt, hsa
cugaaaaggcuuucuauguuguaugauugcaauuauaugacauucugggagaggcaaaacuauc

SEQ ID NO: 142120 - RNA, 64 nt, hsa
gaaaucuaaagugaaaauuuugcuuagaaauaaaauaugacaaguucuguuuugaguuugaugc

SEQ ID NO: 142121 - RNA, 64 nt, hsa
auuugcugcugcugcugugcucuguaaauucugaauaugacauuuaaacucugugccuacuaaa

SEQ ID NO: 142122 - RNA, 64 nt, hsa
auaggaacuacuugaaauaguaauuuguuaaaagauaugacaaaaugaaaaugcuuaaacuaca

SEQ ID NO: 142123 - RNA, 64 nt, hsa
aguugagcaggcgccagggcugucaucaacauggauaugacauuucacaacagugacuaguuga

SEQ ID NO: 142124 - RNA, 64 nt, hsa
gcaggaucaccuacuuacuguauucuacauuauuauaugacauaguauaaugagacaauaucaa

SEQ ID NO: 142125 - RNA, 64 nt, hsa
cuguacugcuauucuauauuuauuauuuuuaaauauaugacauguuuacuacuuaaacaugaau

SEQ ID NO: 142126 - RNA, 64 nt, hsa
aucucgagucuuaucaaguuuucauucucugucaauaugacaagcucaaagugacagaauaugu

SEQ ID NO: 142127 - RNA, 64 nt, hsa
guucauaucguuuuucuugacaaaugaagggucuauaugacagcaaccauugugagaaacuagu

SEQ ID NO: 142128 - RNA, 64 nt, hsa
cucggggaccugcuucacaaguuacaguucguccugacuacaaggcgaguggauaauuccaaca

SEQ ID NO: 142129 - RNA, 64 nt, hsa
uuaacuugagcuucacugucaucuuuuuccacuuugacuacaaagauauuucagagagcuucuu

SEQ ID NO: 142130 - RNA, 64 nt, hsa
cucauccguauucuuuguguugauaagcugcacaugacuacauaguaaguacagaacaguaaag

SEQ ID NO: 142131 - RNA, 64 nt, hsa
uuugugcacauguacauauggaaauguuacugucugacuacaacaugcaucaugcucaugggga

SEQ ID NO: 142132 - RNA, 64 nt, hsa
agacucugucauuuugauuuggucuguggucacgugacuacaauggauaaauaauuuguuugcu

SEQ ID NO: 142133 - RNA, 64 nt, hsa
ggcagggggugcauuaugucugccauuucucaaaugacuacagcugugacacuuaagauugauu

SEQ ID NO: 142134 - RNA, 64 nt, hsa
uucauucccuucagaaguauauagauacuuccggugacuacauaugaauguacuuucaauauua

SEQ ID NO: 142135 - RNA, 64 nt, hsa
aaaauuugcuagugguuugaaaauaauaauguacugacuacauguaugcuguuauugucagugu

SEQ ID NO: 142136 - RNA, 64 nt, hsa
gaccucaauugacuacaaaauuuguaguuaaauuugacuacaauuggaaaugccaaaaacucac

SEQ ID NO: 142137 - RNA, 64 nt, hsa
caaugcaaaauuuguaguuaaauuugaccucaauugacuacaaaauuuguaguuaaauuugacu

SEQ ID NO: 142138 - RNA, 64 nt, hsa; identical to SEQ ID NO: 50739

SEQ ID NO: 142139 - RNA, 64 nt, hsa; identical to SEQ ID NO: 50740

SEQ ID NO: 142140 - RNA, 64 nt, hsa; identical to SEQ ID NO: 50741

SEQ ID NO: 142141 - RNA, 64 nt, hsa; identical to SEQ ID NO: 50742

SEQ ID NO: 142142 - RNA, 64 nt, hsa; identical to SEQ ID NO: 50743

SEQ ID NO: 142143 - RNA, 64 nt, hsa; identical to SEQ ID NO: 50744

SEQ ID NO: 142144 - RNA, 64 nt, hsa; identical to SEQ ID NO: 50745

SEQ ID NO: 142145 - RNA, 64 nt, hsa; identical to SEQ ID NO: 50746

SEQ ID NO: 142146 - RNA, 64 nt, hsa; identical to SEQ ID NO: 50747

SEQ ID NO: 142147 - RNA, 64 nt, hsa; identical to SEQ ID NO: 50748

SEQ ID NO: 142148 - RNA, 58 nt, hsa
cuagcuggcaggacacaucccggccucuuccacccauucccccauguggcugaagaca

SEQ ID NO: 142149 - RNA, 58 nt, hsa
cccaggccguuccccuuggcuuccuccguccacccaggcugcacugcagugauggcgc

SEQ ID NO: 142150 - RNA, 58 nt, hsa
ccgcaccagcugcucugccccuugggcauccacccagugcugccaugccacugccagg

SEQ ID NO: 142151 - RNA, 58 nt, hsa
gucuucuuccucucaagccaaauucgccuccacccacucccucugaagaacugggcau

SEQ ID NO: 142152 - RNA, 58 nt, hsa
aaggucucucccuccagggaccucugcuuccacccacauauguccacuuagucaccca

SEQ ID NO: 142153 - RNA, 58 nt, hsa
uaaccuggggcccuggcagauugggguauccacccagucauguaaaggcaggagaccu

SEQ ID NO: 142154 - RNA, 58 nt, hsa
gaccucacccuggcagggugggcuucuauccacccaugaggcaccuggggcuucucag

SEQ ID NO: 142155 - RNA, 58 nt, hsa
cuggucucgaacuccugaccucaagcgauccacccaccucggccucccaaagugcugg

SEQ ID NO: 142156 - RNA, 58 nt, hsa
uuccguuggaaccacccagacaucugcuuccacccagccaagcccacaucacaucucc

SEQ ID NO: 142157 - RNA, 58 nt, hsa
ccuuugcugaagucuccccgcagcccucuccacccagaggucucccuauaccgagacc

SEQ ID NO: 142158 - RNA, 58 nt, hsa
cagccuccuaggcucccugagguaccuuuccacccagacccuccuuccccaccccaua

SEQ ID NO: 142159 - RNA, 58 nt, hsa
cuugauaaaucauggggaacagauguguuccacccaacaaaugugauaagugaucaug

SEQ ID NO: 142160 - RNA, 58 nt, hsa
ggauggucucgaucucuugaccucaugauccacccaccucggucucccaaagugcugg

SEQ ID NO: 142161 - RNA, 58 nt, hsa
gccuguaaacgcucuguaaauacucccuuccacccaucccagccccugggcagccggg

SEQ ID NO: 142162 - RNA, 58 nt, hsa
uuuuuugcaaguacauuuuugucccuccuccacccagguaucugccuauuuucuugcu

SEQ ID NO: 142163 - RNA, 58 nt, hsa
gaugcagaaccagaaugagggggacaauuccacccacucgagggcugcccccucuucc

SEQ ID NO: 142164 - RNA, 58 nt, hsa
ggauggucucgaucuccugaccucgugauccacccaccucggccucccaaagugcugg

SEQ ID NO: 142165 - RNA, 58 nt, hsa
cucuccccgccccuguauccugcauuccuccacccacccucuaucccccaccgcucca

SEQ ID NO: 142166 - RNA, 58 nt, hsa
guaccucccaccccuguauccccaccccuccacccaccccucucccaaccucucuccc

SEQ ID NO: 142167 - RNA, 58 nt, hsa
aguggcaugaucucagcucacugcaaccuccacccacuggguucaagcgauucuucug

SEQ ID NO: 142168 - RNA, 58 nt, hsa
acaggacuauucuagcauaccugcuucguccacccaggcaggguuugggguggucucu

SEQ ID NO: 142169 - RNA, 58 nt, hsa
accagccguaucuagcauauccccacccuccacccacuaccuccuccaacaaaggagu

SEQ ID NO: 142170 - RNA, 58 nt, hsa
ugugauuuuuaucaguaauggccaugccuccacccaccuuaguuaggagcuacuucca

SEQ ID NO: 142171 - RNA, 58 nt, hsa
guccuccuuuaauuguuugcccaaaucuuccacccaucuuuuuucuucccucauuuuc

SEQ ID NO: 142172 - RNA, 58 nt, hsa
gacaaaaggaguaauuauuugguauagauccacccaucccaaccuuucucuccucagu

SEQ ID NO: 142173 - RNA, 58 nt, hsa
guaagguccuagcaucuuccccucaccuuccacccaugagaacagcgugagcuggugg

SEQ ID NO: 142174 - RNA, 58 nt, hsa
cugagcauaaaaccauggcagccuugucuccacccaugacucacuacaaccuugugcu

SEQ ID NO: 142175 - RNA, 58 nt, hsa
uuggguggaugccugguggcagcugcgguccacccaggagccccgaggccuucucuga

SEQ ID NO: 142176 - RNA, 58 nt, hsa
cuggucucaaacucuugaccucaggugauccacccaccucagccucccaaagugcugg

SEQ ID NO: 142177 - RNA, 58 nt, hsa
aacuaauucuggugcucaggcugggcucuccacccaaguuaggccugcucuggccuaa

SEQ ID NO: 142178 - RNA, 58 nt, hsa
aggcagucucccuuccugaccauucuucuccacccagucacagauaagggaauaaccu

SEQ ID NO: 142179 - RNA, 58 nt, hsa
gaucauggagcuaagaagcagagccaaguccacccauguccuuggcagagaugacagg

SEQ ID NO: 142180 - RNA, 58 nt, hsa
ggauggucucgaucuccugaccucgugauccacccaacucggccucccaaagugcugg

SEQ ID NO: 142181 - RNA, 58 nt, hsa
gccucgggcacuccacuaccaacccagcuccacccagcaguguccuggggagaaggaa

SEQ ID NO: 142182 - RNA, 58 nt, hsa
caccggagagacuacugaccuucucaccuccacccauaccuucuccccacagccucug

SEQ ID NO: 142183 - RNA, 58 nt, hsa
ggauggucucaaucuccugaccuugugauccacccaccucggucuccccaaagugcug

SEQ ID NO: 142184 - RNA, 58 nt, hsa
cugaucuuaaacucuugaccucaaaugauccacccaccuuggccucccaaauuguucg

SEQ ID NO: 142185 - RNA, 58 nt, hsa
cuggucucgaacuccugggcucaagugauccacccaucuccaccucccaaagugcuag

SEQ ID NO: 142186 - RNA, 58 nt, hsa
cuggucucaaacuccugcccucaggugauccacccaccucagccucucaaagugcugg

SEQ ID NO: 142187 - RNA, 58 nt, hsa
ccuggggacagccccaccuccgggucccuccacccacaucccccugguccuaccccug

SEQ ID NO: 142188 - RNA, 58 nt, hsa
gggagagcgcugggggcccaucccccuguccacccaguguccacuggccuguccuuca

SEQ ID NO: 142189 - RNA, 58 nt, hsa
uucugucuauuguaccgacuuaaccucuuccacccaaguccgcaucuguguguaucau

SEQ ID NO: 142190 - RNA, 58 nt, hsa
cggcccucucgaacacaaugggacggaauccacccacaacgcgcuugguuugcagaug

SEQ ID NO: 142191 - RNA, 58 nt, hsa
augcugcugcccugaucucagugggaaauccacccagcaaccuaauacagccccuuuu

SEQ ID NO: 142192 - RNA, 58 nt, hsa
uaaacuucaggccagaacccccaaugacuccacccauagucucacuuuaggucucauu

SEQ ID NO: 142193 - RNA, 64 nt, hsa
uccagaaccaucaccuuugggaaccugcugugagagugcugagguaccagaagugugagaacga

SEQ ID NO: 142194 - RNA, 64 nt, hsa
gggcaccucccuggccacacgccuguucccagcaagugcugaaacucacuagaccgucugccug

SEQ ID NO: 142195 - RNA, 64 nt, hsa
uagaacuuuuccuaacacagguaucuaggaaguaagugcugaguugauuuucuagguucuuacg

SEQ ID NO: 142196 - RNA, 64 nt, hsa
gaccucaggucauccuccugccucggccucccaaagugcugagacuacaggugugagccaccgu

SEQ ID NO: 142197 - RNA, 64 nt, hsa
ggaccgugagggggcucuugaugggaguggaagaagugcugagggucugagaggggagaugcau

SEQ ID NO: 142198 - RNA, 64 nt, hsa
gacccuguccuggagggggcagaggccaggccccagugcugacgaggagcccagauuugggccu

SEQ ID NO: 142199 - RNA, 64 nt, hsa
acaaggaggugagaaguggugguaaaaggagcggagugcugaagcagagagcagauuuaauaua

SEQ ID NO: 142200 - RNA, 64 nt, hsa
ggaaauggauguuucauuuguaugaguuuggagcagugcugaaggccaaagccgccuacugguu

SEQ ID NO: 142201 - RNA, 64 nt, hsa
ucuugggguccugauacucauucccauuugucccagugcugacaacccaaucuucccaauacuu

SEQ ID NO: 142202 - RNA, 64 nt, hsa
uuguauaaacauuuauguugacccacuuauguucagugcugaaaacuaaaaugaacaugcuauu

SEQ ID NO: 142203 - RNA, 64 nt, hsa
uugcaaacucuugugaaggggucaccccagcaugagugcugagauauggacucucuaaggaagg

SEQ ID NO: 142204 - RNA, 64 nt, hsa
agguagaccuugaauacaggagcccucuccucauagugcugaaaagauacugaugcauugaccu

SEQ ID NO: 142205 - RNA, 64 nt, hsa
cugaccuugugauccacucgccucagccucucgaagugcugagauuacacacgugagcaacugu

SEQ ID NO: 142206 - RNA, 64 nt, hsa
aaggaaagaaaacaucuuuaaggggaggaaccagagugcugaaggaauggaaguccaucugcgu

SEQ ID NO: 142207 - RNA, 64 nt, hsa
ugggucugggugugaauuccaccuucccuccugcagugcugagaggcagcgaggacggagagga

SEQ ID NO: 142208 - RNA, 64 nt, hsa
ugaccucaucguccaccugccucggccuccccaaagugcugagauuaggcguuagccaccgcgc

SEQ ID NO: 142209 - RNA, 64 nt, hsa
uccagcagcuugucuggcgucaacuggcuuucagagugcugaccccucaucacuguggggauca

SEQ ID NO: 142210 - RNA, 64 nt, hsa
ugggacugcgaugcggcgugaggcugggacugcgagugcugacgccaccuuccugcugaggugg

SEQ ID NO: 142211 - RNA, 64 nt, hsa
gaccucaggugauccaccugccucugccucccaaagugcugagauuacaggcauaagccagugc

SEQ ID NO: 142212 - RNA, 64 nt, hsa
auucaaacagaagugccucauuuuagaaaugaguagugcugauggcacuggcacauuacagugg

SEQ ID NO: 142213 - RNA, 64 nt, hsa
gaacguccccgagaaccacacgagcgugcugcucagugcugacugcagaaugaaauagaagcaa

SEQ ID NO: 142214 - RNA, 64 nt, hsa
ucuuuuauuucugaaacacucaaacaccuuacaaagugcugaguagguaauagugacccaacuu

SEQ ID NO: 142215 - RNA, 64 nt, hsa
gaaaguacgucacaucauaccagagccagaggucagugcugaagacguggaccgggagaaugag

SEQ ID NO: 142216 - RNA, 64 nt, hsa
cgcgcgcucucccagaaacacgaacugaagaaccagugcugaggucuucugcagcaguacuauc

SEQ ID NO: 142217 - RNA, 64 nt, hsa
gagugagaaggaauucagggagagcaaaggagccagugcugagaugcugcuguguugguugagg

SEQ ID NO: 142218 - RNA, 64 nt, hsa
gcuuccagagugugcacuuccagcccacccgggcagugcugagagggaggaggagaacaaggau

SEQ ID NO: 142219 - RNA, 64 nt, hsa
auguuuuaauaucuuuaugggcucuguucaaggcagugcugagagggagggguuauagcuucag

SEQ ID NO: 142220 - RNA, 64 nt, hsa
aaaaagcaguaaugaaaccuguccugcucacugcagugcugauguauuucaagucucucacccu

SEQ ID NO: 142221 - RNA, 64 nt, hsa
cuccucaucucuaagggagaaaaauagucuguagaugaauaauguaagguaaagaguugcaugu

SEQ ID NO: 142222 - RNA, 64 nt, hsa
ggucacugucauauuuugaaccaucucaucagagaugaauaauaucuuuuuaccagagagagaa

SEQ ID NO: 142223 - RNA, 64 nt, hsa
cagcccucccaugaagaauuucuaggucauaaacaugaauaauacucaguauauguauaauauc

SEQ ID NO: 142224 - RNA, 64 nt, hsa
cagaagggcacaaaaugaaugaauaaauaaauaaaugaauaaagacaaaagccaagguguaugc

SEQ ID NO: 142225 - RNA, 64 nt, hsa
aguccugguucauucccagaagggcacaaaaugaaugaauaaauaaauaaaugaauaaagacaa

SEQ ID NO: 142226 - RNA, 64 nt, hsa
aaaaaaaaaucacaaauaaaacagugaaguuuuaaugaauaaaguuuaaucaauuaguaauggc

SEQ ID NO: 142227 - RNA, 64 nt, hsa
cagauaauugguuuuugccuauacuucaauuguuaugaauaagaaaggcaaacauaggucuggg

SEQ ID NO: 142228 - RNA, 64 nt, hsa
ugauuucugcacuaucuuuuucucaguuaccugcaugaauaaauaaugagaaauauuuugugac

SEQ ID NO: 142229 - RNA, 64 nt, hsa
ucagguuuguucuuccuaucauguuugauauuccaugaauaauugagaucagcccuauguaagu

SEQ ID NO: 142230 - RNA, 64 nt, hsa
auuauaccuggaugauucaggagaguguauaugaaugaauaaagcauccaaguauauaugaaug

SEQ ID NO: 142231 - RNA, 64 nt, hsa
uauaugaaugaauaaagcauccaaguauauaugaaugaauaaaguauguaaguaucaccagaaa

SEQ ID NO: 142232 - RNA, 64 nt, hsa
aguaauuuugugauuugucuauauuguugcauuuaugaauaaaucauuuaucugcugcugagua

SEQ ID NO: 142233 - RNA, 64 nt, hsa
uuuugaugauggacauuaauaguucuaggcuauuaugaauaaaguuuccaugaacaucuaugua

SEQ ID NO: 142234 - RNA, 64 nt, hsa
ugaaaaaucauaaucugacuaauuuugggacugaaugaauaaguacaagagguuggauuuucua

SEQ ID NO: 142235 - RNA, 64 nt, hsa
uuuuagguuaggcaaauucacaaauacggaauccaugaauaacgaggaucaacuguacuuaacu

SEQ ID NO: 142236 - RNA, 64 nt, hsa
cuuaccauguaccagaauuuuacuaggcacaaccaugaauaaaaauacaauucucuugcaccau

SEQ ID NO: 142237 - RNA, 64 nt, hsa
auucuccauuauuaauguguucugaaaauauauuaugaauaaauacaucaccacacccaaacca

SEQ ID NO: 142238 - RNA, 64 nt, hsa
ucuagagugcuccaggaaaaguuauauucaguauaugaauaaguguuauucuccauuauuaaug

SEQ ID NO: 142239 - RNA, 64 nt, hsa
gggcacccaaaguucugguuaucuaugaauaauaaugaauaauuuuggcugagaaugguaccuu

SEQ ID NO: 142240 - RNA, 64 nt, hsa
gaaugauuaggggcacccaaaguucugguuaucuaugaauaauaaugaauaauuuuggcugaga

SEQ ID NO: 142241 - RNA, 64 nt, hsa
uaaauauaauggaaaacagauuuuucaucauaucaugaauaaaauauagagguaacuauguugu

SEQ ID NO: 142242 - RNA, 64 nt, hsa
aagccaacacuugauagcacuacuuggaguuuccaugaauaagauggagaaagcucauuguauu

SEQ ID NO: 142243 - RNA, 64 nt, hsa
ggcuggcacauuguuggcacucaacaaugguugaaugaauaaaacaauaaaugaaugaauaacu

SEQ ID NO: 142244 - RNA, 64 nt, hsa
ucaacaaugguugaaugaauaaaacaauaaaugaaugaauaacuaagauauagaaacucucauu

SEQ ID NO: 142245 - RNA, 64 nt, hsa
auaaugagcucaauucaaagcaaucaccacuggcaugaauaaguacugcaugaaaagggaguau

SEQ ID NO: 142246 - RNA, 64 nt, hsa
uguucaaagcaggggagaagaauuauucaauuucaugaauaacucuuguuugcacuccagaaaa

SEQ ID NO: 142247 - RNA, 64 nt, hsa
acauagugcuggucucacagcuuaauauuugguaaugaauaaauucugcuagugguauauguug

SEQ ID NO: 142248 - RNA, 64 nt, hsa
uucaguuuuuaaaagaucgaucuacauacaauagaugaauaaauguuuucagugauaugaaaag

SEQ ID NO: 142249 - RNA, 64 nt, hsa
uuaacugguauucaaaaaugaauaacagccaaaaaugaauaacagccauuugauuuauguuucc

SEQ ID NO: 142250 - RNA, 64 nt, hsa
cuuugaaagcaguaauauuaacugguauucaaaaaugaauaacagccaaaaaugaauaacagcc

SEQ ID NO: 142251 - RNA, 64 nt, hsa
acuaauuauccugcuguucuuuaauuaaugcuuaaugaauaauauggcacuguaaaauagcuuc

SEQ ID NO: 142252 - RNA, 64 nt, hsa
cagcagcucaaauuaaaccuuugugcauuggguuaugaauaaucuuuucuuccaaagauggcaa

SEQ ID NO: 142253 - RNA, 64 nt, hsa
ucuaaauaaaaugguuuagaguuuuacuguaacuaugaauaauuaugcuauaauuauaguaucc

SEQ ID NO: 142254 - RNA, 64 nt, hsa
gugcauguaguagcuaaacuaaucaaaaucuuauaugaauaauuuugaaauaacucugaaagau

SEQ ID NO: 142255 - RNA, 64 nt, hsa
gacacaccauuauauuuaauucuaguuucucucaaugaauaauuguauuuuuguaggaaaugua

SEQ ID NO: 142256 - RNA, 64 nt, hsa
auggaucuuugguuuguuuccagguuugguuauuaugaauaaaguugcugugaauacuuacgug

SEQ ID NO: 142257 - RNA, 64 nt, hsa
ucaggaaaugaauauaaaauagguucacaguuaaaugaauaagcuuuuguuuauuugugggugg

SEQ ID NO: 142258 - RNA, 64 nt, hsa
ugcccaaggauacuuaaucaggauuaaauuuucuaugaauaauugaaaaacaaaacacucacug

SEQ ID NO: 142259 - RNA, 64 nt, hsa
uuggcaaaaacagccuucuagcacacuuuuuuaaaugaauaaugguagccuaaacuuaauauuu

SEQ ID NO: 142260 - RNA, 64 nt, hsa
uuagugguuugagugucuagcaaaggaaaaauugaugaauaaaaugaaggucugguguauaugu

SEQ ID NO: 142261 - RNA, 64 nt, hsa
uuuagauauauugguucaaauaaaauacauuaaaaugaauaacacuuuuuuguuuuuaaaauug

SEQ ID NO: 142262 - RNA, 64 nt, hsa
aauguccuuuuguucauacaaaagaaaaaugaggaugaauaacaaguuuggcaaaaugauggua

SEQ ID NO: 142263 - RNA, 64 nt, hsa
ugacacuuagaggggagagaugaaagccaaacaaaugaauaaacauaaaugauaccaucagugc

SEQ ID NO: 142264 - RNA, 64 nt, hsa
aaauaaggaaaaggagagaaaaaagaaauugguuaugaauaaaagugacaauaaaacaugagau

SEQ ID NO: 142265 - RNA, 64 nt, hsa
aacuaaaggaaaucuugaggucauauacugaaauaugaauaaauuaaaauaaugaauucagauc

SEQ ID NO: 142266 - RNA, 64 nt, hsa
agaaaaccagcaugguuugacaccacaugggaacaugaauaaaucugucucaugauuugaaaag

SEQ ID NO: 142267 - RNA, 64 nt, hsa
gguauugcaggaauuuuucaaaaacauuacuguaaugaauaacugaguuuccuauagaagaacc

SEQ ID NO: 142268 - RNA, 64 nt, hsa
auuuauuugaagugauuucaaauauuucaaauucaugaauaagaauauuccgucaaaaauaguu

SEQ ID NO: 142269 - RNA, 64 nt, hsa
uccagccugggcgacagagcgagagucugucucaaaagaaaaaaaaaagcaccgccuccaaaug

SEQ ID NO: 142270 - RNA, 64 nt, hsa
ccagccugagcaacagagugagacccugucucuuaaagaaaaaaaaagucagacugcugggacu

SEQ ID NO: 142271 - RNA, 64 nt, hsa
aaagacauaggacuuaacuggaaaaugaaaaaaaaaagaaaaagaaaaaacuaaacaaaaaauc

SEQ ID NO: 142272 - RNA, 64 nt, hsa
auaggacuuaacuggaaaaugaaaaaaaaaagaaaaagaaaaaacuaaacaaaaaaucccucua

SEQ ID NO: 142273 - RNA, 64 nt, hsa
cccagagaagcccccuacauccccccgggaaaaaaaagaaaacuagacagaaacucaucuauau

SEQ ID NO: 142274 - RNA, 64 nt, hsa
ggccaccauauuuagaacuaguuaccuuauuaaaaaagaaaaaacagucuguuggcuucucagu

SEQ ID NO: 142275 - RNA, 64 nt, hsa
aauuuaaagacaucuauuaucugcuuugugcuuaaaagaaaaauucaaccuuuuuuuuuuuuuu

SEQ ID NO: 142276 - RNA, 64 nt, hsa
cucugugaaaucgucugauggucuguguggaagaaaagaaaaaucugucugccgccuauuuccc

SEQ ID NO: 142277 - RNA, 64 nt, hsa
aguguuuuuguccuaauguugcuacucccauggcaaagaaaaaaaaaagaaugaaaaaaagaaa

SEQ ID NO: 142278 - RNA, 64 nt, hsa
acucccauggcaaagaaaaaaaaaagaaugaaaaaaagaaaaaaauuuggaaaaaaaaaucagg

SEQ ID NO: 142279 - RNA, 64 nt, hsa
cucuaguaugguguauuuaaauaauaaaaacuuaaaagaaaaaauauuuaaugguguuuggguu

SEQ ID NO: 142280 - RNA, 64 nt, hsa
aauuauucaaaugccuagaaauccauaguuuggaaaagaaaaaucaugucaucuucuauuugua

SEQ ID NO: 142281 - RNA, 64 nt, hsa
aaauggaaauugucggucauauuucuagaacuuuaaagaaaaaagaauguuauauuaguuuucu

SEQ ID NO: 142282 - RNA, 64 nt, hsa
ugcugauagaaggaguugaaaucugaugacaaaaaaagaaaaauuacuuuuuguuuguuuauaa

SEQ ID NO: 142283 - RNA, 64 nt, hsa
agauuuguuguuuuuguaagaaaugagaugcaggaaagaaaaccaaaucccauuccugcacccc

SEQ ID NO: 142284 - RNA, 64 nt, hsa
acuagggaagauaauauuaaggaagacaaugugaaaagaaaaaugagccuggcaagaauguguu

SEQ ID NO: 142285 - RNA, 64 nt, hsa
ugggugacagagcaagugagacccugucucaaaaaaagaaaaagaaaaagaaaaaauauuuucc

SEQ ID NO: 142286 - RNA, 64 nt, hsa
acagagcaagugagacccugucucaaaaaaagaaaaagaaaaagaaaaaauauuuucccuauua

SEQ ID NO: 142287 - RNA, 64 nt, hsa
caagugagacccugucucaaaaaaagaaaaagaaaaagaaaaaauauuuucccuauuagagaag

SEQ ID NO: 142288 - RNA, 64 nt, hsa
agucucugcucaaaaaaaaaacaauucucggcccaaagaaaacaaucagaagaauucacugauu

SEQ ID NO: 142289 - RNA, 64 nt, hsa
uccagccaggcuucauuuaugcacuugugcugcaaaagaaaagucuagguuuuaaggcugugcc

SEQ ID NO: 142290 - RNA, 64 nt, hsa
auuucuuuuuaggcucugagacuaaaugagaggaaaagaaaagaaaaaaaaaaugauugucuaa

SEQ ID NO: 142291 - RNA, 64 nt, hsa
uuuuuaggcucugagacuaaaugagaggaaaagaaaagaaaaaaaaaaugauugucuaaccaau

SEQ ID NO: 142292 - RNA, 64 nt, hsa
uagcaacaaaauauuuauucuacuguaaaugacaaaagaaaaagaaaaauugagccuugggacg

SEQ ID NO: 142293 - RNA, 64 nt, hsa
caaaauauuuauucuacuguaaaugacaaaagaaaaagaaaaauugagccuugggacgugccca

SEQ ID NO: 142294 - RNA, 64 nt, hsa
aaaaauguagaaugauuuuugcuauuucuaguagaaagaaaaugucuguuuuccaaagauaaug

SEQ ID NO: 142295 - RNA, 64 nt, hsa
aguaggaaggaaaaaauaagagauagcagaggaaaaagaaaaacauuuccucuuauaacuucug

SEQ ID NO: 142296 - RNA, 64 nt, hsa
ucugacccacugcuaacuguagcaacaaaauuuaaaagaaaaaaaacauacuuuaucuggcuau

SEQ ID NO: 142297 - RNA, 64 nt, hsa
aaaaacagaaaguguauucaaauuuuaucaguuuaaagaaaauaaagcugugauaaauacugua

SEQ ID NO: 142298 - RNA, 64 nt, hsa
uaacagagcaagacuccaucucaaaaaaagaaagaaagaaaaaagaaaguacaaguuuauaaag

SEQ ID NO: 142299 - RNA, 64 nt, hsa
uuccuugaaaauguaauuuuccagaaaaacaccuaaagaaaauaaaacauggacaugccuagua

SEQ ID NO: 142300 - RNA, 64 nt, hsa
uaaauucauacucagacaaaaaaaggaauucuggaaagaaaaccauucuggacacugucauaac

SEQ ID NO: 142301 - RNA, 64 nt, hsa
gugggggaggguaagaaaagcaguuugcacuuaaaaagaaaaaaaaaaaacggguggugugucu

SEQ ID NO: 142302 - RNA, 64 nt, hsa
uugaguucuaauaauccauguucaguuuguagggaaagaaaaaauaauuuuuccuucuacccac

SEQ ID NO: 142303 - RNA, 64 nt, hsa
aaagaacaguaaauuuuuagagaaacaacaaaacaaagaaaaagagcuuugagucuguaggggc

SEQ ID NO: 142304 - RNA, 64 nt, hsa
aaaaaacccugggcugaaguuggcauuucaguuaaaagaaaaaaagaaacuagucccagauuug

SEQ ID NO: 142305 - RNA, 64 nt, hsa
uucagggauacaaaugggcuucucucauucauuaaaagaaaacgcgacaucuuucuaagauucu

SEQ ID NO: 142306 - RNA, 64 nt, hsa
uaaauguucuuuauacagccuaguuaauguuuaaaaagaaaaaaauagcuugguuuuauuuguc

SEQ ID NO: 142307 - RNA, 64 nt, hsa
guugguuuaacaaaaaaaaaaagcuuuaaaaaaaaaagaaaaaaaggaaaagguuuuuagcuca

SEQ ID NO: 142308 - RNA, 64 nt, hsa
gcuuacagcuaggaaagcucuaguucugggggugaaagaaaaauauuaguuuaccugagcacuu

SEQ ID NO: 142309 - RNA, 64 nt, hsa
uuguuugaaaccuuuguaacuuguuuguaugaguaaagaaaaggugcaaugcagugcuuuuaga

SEQ ID NO: 142310 - RNA, 64 nt, hsa
aaaacacuucuacuagggccaaaaagagaaaagaaaagaaaauuucuacuaauuucagaccucu

SEQ ID NO: 142311 - RNA, 64 nt, hsa
aagcuaaaacacuucuacuagggccaaaaagagaaaagaaaagaaaauuucuacuaauuucaga

SEQ ID NO: 142312 - RNA, 64 nt, hsa
aauuauacauggcuacuuuacugugucuguagcuaaagaaaaauuauuuuacaaaaauuacuuc

SEQ ID NO: 142313 - RNA, 64 nt, hsa
auuuaaccauuagcaucuuuggccaaaccaaaauaaagaaaagcaucuucuccuaguugugugu

SEQ ID NO: 142314 - RNA, 64 nt, hsa
aagaauucagaacuacuuuccucugugacaccaaaaagaaaagucuauaaccugaaaauguuuc

SEQ ID NO: 142315 - RNA, 64 nt, hsa
gaauuuagcaaauuaaguuauuuuccuaaaaaaaaaagaaaaaaagaauucagaacuacuuucc

SEQ ID NO: 142316 - RNA, 64 nt, hsa
uguggagaaacuaaaaauguuguacaacugaccgaaagaaaacccuuggggauaaguuuaguga

SEQ ID NO: 142317 - RNA, 64 nt, hsa
ugacaacaucuaagacaauauuagugggaugaagaaagaaaagcaggggugcuuuuggaagcag

SEQ ID NO: 142318 - RNA, 64 nt, hsa
caugaaucuuuauuuuucacugccagcuucaaggaaagaaaauuuuuucuacaauuugcaugag

SEQ ID NO: 142319 - RNA, 64 nt, hsa
aaucugacaggaagaagcgcacaggggugugcacaaagaaaaugacaugaaucuuuauuuuuca

SEQ ID NO: 142320 - RNA, 64 nt, hsa
acuguguuugguauuuuucugacaaaauuaagaaaaagaaaaaaaauuauuugugggcaaaugu

SEQ ID NO: 142321 - RNA, 64 nt, hsa
uuacuuuuaaagaguuggucuuuucugucuaaauaaagaaaaaaguuuaaaagcaucaaauaag

SEQ ID NO: 142322 - RNA, 64 nt, hsa
ccugaucauuuucuuuaggaagagguuuuagggaaaagaaaaugggguggggguggggguggua

SEQ ID NO: 142323 - RNA, 64 nt, hsa
ugcagucagagagcaagccccccaaaaaaaagaaaaagaaaaggaggcagaaagaggaggaaga

SEQ ID NO: 142324 - RNA, 64 nt, hsa
cucaacugcagucagagagcaagccccccaaaaaaaagaaaaagaaaaggaggcagaaagagga

SEQ ID NO: 142325 - RNA, 64 nt, hsa
auuugucacauguaucacccccaaaaaaagagaaaaagaaaaauagaagacauauaaauuaaau

SEQ ID NO: 142326 - RNA, 64 nt, hsa
aaaugaagaaaaguaauuagaauauuuucaacauaaagaaaagacgaauauuuaaggugacaga

SEQ ID NO: 142327 - RNA, 64 nt, hsa
aagaagagagggaggaagaaagggagagagaagaaaagaaaaaugaagaaaaguaauuagaaua

SEQ ID NO: 142328 - RNA, 64 nt, hsa
gagaggaaugucaaaaauacauuuuacuuuauucaaagaaaaauauauugguuacugggaaaag

SEQ ID NO: 142329 - RNA, 64 nt, hsa
cauuaaaggaaugaaacaaugaaaggaacauuugaaagaaaauguggguagacaauuucuugca

SEQ ID NO: 142330 - RNA, 64 nt, hsa
ccuaacagaauugaguuuucuauuaaggauccaaaaagaaaaacaaaaugcuaaugaagccauc

SEQ ID NO: 142331 - RNA, 64 nt, hsa
aacaagagcaaaacuccagcucaaaaaaaaaaagaaagaaaagaaagcuggagcugguggcuua

SEQ ID NO: 142332 - RNA, 64 nt, hsa
aagccaaaaggauuuaaaaccgcugcucuaaagaaaagaaaacuggaggcugggcgcaguggcu

SEQ ID NO: 142333 - RNA, 64 nt, hsa
acuugaagccaaaaggauuuaaaaccgcugcucuaaagaaaagaaaacuggaggcugggcgcag

SEQ ID NO: 142334 - RNA, 64 nt, hsa
uuaaagauagcucaugaaacuuuugcuuaagcaaaaagaaaaccucgaauugaaaugugugagg

SEQ ID NO: 142335 - RNA, 64 nt, hsa
uacuuuuuuucuaauuuacugaucuuacuacuacaaagaaaaaaaaacccaaccaaucugcaau

SEQ ID NO: 142336 - RNA, 64 nt, hsa
aaacugcaaaucagaaagaaugauuugcagaaagaaagaaaaacuaugguguaauuuaaacucu

SEQ ID NO: 142337 - RNA, 64 nt, hsa
ucucagcuuugccuucuugcuuuuucauaucuguaaagaaaaaaauuacauaucaguuguccuu

SEQ ID NO: 142338 - RNA, 64 nt, hsa
auggauagucuucuuggauuauuuuuauauuugaaaagaaaauguuuuauuugcacuacugagu

SEQ ID NO: 142339 - RNA, 64 nt, hsa
uaaauugcagagaaaccuguaaguaauggaagguaaagaaaaauuacagaauggaaaauaauau

SEQ ID NO: 142340 - RNA, 64 nt, hsa
uaaaauagcaugcauucucccagaagcccauaguaaagaaaaugacagaucguggucagcagac

SEQ ID NO: 142341 - RNA, 64 nt, hsa
ugggagaaagggaaaagucagggaaggggagaagaaagaaaaacacauuuggccuuaaaauagc

SEQ ID NO: 142342 - RNA, 64 nt, hsa
cuccucccaccacacacacaugcuccaaaagaggaaagaaaaaaagauaauuuuuaggacuuga

SEQ ID NO: 142343 - RNA, 64 nt, hsa
auauucuuaaaauuuuuucccaccaagguauuccaaagaaaauauuaaggucuccccuuuuucu

SEQ ID NO: 142344 - RNA, 64 nt, hsa
aucucuguuguggugggcauagguggcaccaucuaaagaaaagaggucuuguuuuuuguuuaaa

SEQ ID NO: 142345 - RNA, 64 nt, hsa
cuucacugcuggaaaaauccacuggcucccaagaaaagaaaauggucugaagccucuguugugg

SEQ ID NO: 142346 - RNA, 64 nt, hsa
acacagacugacaugaaaccugggugcuacaguaaaagaaaacaaaaguccaguuugugucucu

SEQ ID NO: 142347 - RNA, 64 nt, hsa
cagaugcauuacugcuaucuuaguuuaaagggggaaagaaaagggaagaagaaaggaaaagaga

SEQ ID NO: 142348 - RNA, 64 nt, hsa
ugaccuguacaagugaugcagaaaggaggguuucaaagaaaaaggauuuuguuuaaaauacuuu

SEQ ID NO: 142349 - RNA, 64 nt, hsa
cagcagaaugagccaggaguagcaggagaugggcaaagaaaacuggggugcacucagcucucac

SEQ ID NO: 142350 - RNA, 64 nt, hsa
ugaaagacacagauacccaguaugcuuaacgugaaaagaaaauguguucuguuuuguaaaggaa

SEQ ID NO: 142351 - RNA, 64 nt, hsa
gaagauuaaccauuuuuuugucuuagaauaucaaaaagaaaaagaaaaagguguucuagcuguu

SEQ ID NO: 142352 - RNA, 64 nt, hsa
uaaccauuuuuuugucuuagaauaucaaaaagaaaaagaaaaagguguucuagcuguuugcauc

SEQ ID NO: 142353 - RNA, 64 nt, hsa
acucuuuuacuuugguuccuguugugcucuuguaaaagaaaaauauaauuuccugaagaauaaa

SEQ ID NO: 142354 - RNA, 64 nt, hsa
uuauaauguaccuggaaaauaaaccucuugagaaaaagaaaaguucauacugauuauuggaaaa

SEQ ID NO: 142355 - RNA, 64 nt, hsa
uuugucuuaaaauauuaguggcuuacauuuuaaaaaagaaaaaucaccagcaugaacuugcacc

SEQ ID NO: 142356 - RNA, 64 nt, hsa
aaguguugcuagagaaaauuagggaaaaggugaaaaagaaaaaaugguaguaauugagcagaaa

SEQ ID NO: 142357 - RNA, 64 nt, hsa
gauuuaucuaaguagaacugaauuggcuaggaaaaaagaaaaacugcauguuaaucauuuuccu

SEQ ID NO: 142358 - RNA, 64 nt, hsa
acaugacucauugaguaguaaugauucagaagaaaaagaaaaaggagacuuuauuggucaauau

SEQ ID NO: 142359 - RNA, 64 nt, hsa
gagcaauuuaaacucccaguuguuuauuuucacaaaagaaaauaaaauugcaguugcaagaccu

SEQ ID NO: 142360 - RNA, 64 nt, hsa
cagcccaggcaacaagagugaaacccugucucaaaaagaaaaaaaaaguugaccuugagaauuu

SEQ ID NO: 142361 - RNA, 64 nt, hsa
cuccagaacugugaaaaauaaauuuguuauuuaaaaagaaaaaaaaaaaaacaaaaaccugagu

SEQ ID NO: 142362 - RNA, 64 nt, hsa
aaaaaaaaaaaaaaaaaaaaaaaaggaaaaaaaaaaagaaaaagaaaacgugugcauuuuguau

SEQ ID NO: 142363 - RNA, 64 nt, hsa
aaaaaaaaaaaaaaaaaaggaaaaaaaaaaagaaaaagaaaacgugugcauuuuguauaauggc

SEQ ID NO: 142364 - RNA, 64 nt, hsa
acaaaaguuuuaccacagucugcacuugcagaagaaagaaaaaaauucaaaccacauguuuauu

SEQ ID NO: 142365 - RNA, 64 nt, hsa
uuuauuaauggcauguaauauucugagcacgggcaaagaaaacacacaaaagauuauguauugg

SEQ ID NO: 142366 - RNA, 64 nt, hsa
gauugaaaaaagagaaaggggcaagaaauucauuaaagaaaaaccacagauacugaaacauuug

SEQ ID NO: 142367 - RNA, 64 nt, hsa
cuucucccugaaaaagagaaaaaaaaaaggaaaaaaagaaaagaaaagugaaaagaaaaacucu

SEQ ID NO: 142368 - RNA, 64 nt, hsa
cccugaaaaagagaaaaaaaaaaggaaaaaaagaaaagaaaagugaaaagaaaaacucuuauug

SEQ ID NO: 142369 - RNA, 64 nt, hsa
gaaaaaaaaaaggaaaaaaagaaaagaaaagugaaaagaaaaacucuuauuggccuaaguucua

SEQ ID NO: 142370 - RNA, 64 nt, hsa
auaugaaugguuuuaugucauuuuuuuaauuaaaaaagaaaaauucauauaaucguguuuaaaa

SEQ ID NO: 142371 - RNA, 64 nt, hsa
aaaacaguauaaacauuaauuuacuuuguguucaaaagaaaauuccaacugcuguuggggaagg

SEQ ID NO: 142372 - RNA, 64 nt, hsa
gaaaauuccaacugcuguuggggaaggacacagaaaagaaaaauaaccacccaagaaaaacaaa

SEQ ID NO: 142373 - RNA, 64 nt, hsa
uauacauagaauuugugaauuacuuucugacuacaaagaaaagcagaugccaaaauacucuucu

SEQ ID NO: 142374 - RNA, 64 nt, hsa
cucuuuguuuacuuagcuuucucuuaguuguaagaaagaaaaagacgucuugcaugaaaauagu

SEQ ID NO: 142375 - RNA, 64 nt, hsa
cucucaauucuuuuauauucuaacaauaaauaaaaaagaaaagauuacugacugugcauuguac

SEQ ID NO: 142376 - RNA, 64 nt, hsa
uuuauaguuuaugguuaucaggaagcucuguaagaaagaaaaggucagccucccaggcaaacca

SEQ ID NO: 142377 - RNA, 64 nt, hsa
gacuauuaaacuacguauaguguugcugaaauagaaagaaaacagcauuggaauuggauucaug

SEQ ID NO: 142378 - RNA, 64 nt, hsa
uaccaaguaagacucaaaauugcaaauauaaacaaaagaaaaauccaacugaaaauaacacuaa

SEQ ID NO: 142379 - RNA, 64 nt, hsa
cauaguuaauucucauuaacacuuacauuuccauaaagaaaacucaaguauuaauaaaagagac

SEQ ID NO: 142380 - RNA, 64 nt, hsa
uagcuuguauauguaguaguuugaugaauaauuuaaagaaaaacaccuaaaauuugaaaaauga

SEQ ID NO: 142381 - RNA, 64 nt, hsa
auuuccaaaauguuuggaaacaguauaauuugacaaagaaaaaugauacuucucuuuuuuugcu

SEQ ID NO: 142382 - RNA, 64 nt, hsa
uuucauugauuaaucuccuggaagauugguuuaaaaagaaaaguguaaugcaagaauuuaaaga

SEQ ID NO: 142383 - RNA, 64 nt, hsa
aauaaguagcaacuauacuuuccaaugacuaaagaaagaaaaucucaguauauucguucucaug

SEQ ID NO: 142384 - RNA, 64 nt, hsa
uauaauagcuguggaugagcacaggagagagaggaaagaaaagaacagucgaaaugagcaacuc

SEQ ID NO: 142385 - RNA, 64 nt, hsa
uuucuuuuuucuagaaaacacuuuccuggauaaaaaagaaaacauuccagaugcaugauccagc

SEQ ID NO: 142386 - RNA, 64 nt, hsa
ugacauuuaauaacuuugcuggaaaaucuguaaaaaagaaaaacaaguuugcuagugacuaagc

SEQ ID NO: 142387 - RNA, 64 nt, hsa
uucacacuuaagauucaaaauuuuucccaaauauaaagaaaacuaagacagacuguagaugcau

SEQ ID NO: 142388 - RNA, 64 nt, hsa
caaugcacacaaggauugagaagaguuaaaggcuaaagaaaacaucuuuucuagcuucaacaga

SEQ ID NO: 142389 - RNA, 64 nt, hsa
agccacugcaagcucugaaucaguuuuuuaaaaaaaagaaaaaaaaaaaaaaggagcugugccc

SEQ ID NO: 142390 - RNA, 64 nt, hsa
caaaaaagaauaaaaaguuugaauagcuauuauuaaagaaaagccaugucuucaacaucugagu

SEQ ID NO: 142391 - RNA, 64 nt, hsa
cccaccugggcaacauaguaagaucuugucucuuaaagaaaaaaaaaaaagguacuuagagguc

SEQ ID NO: 142392 - RNA, 64 nt, hsa
auuuaauaugcuuauaaccuaguuaaagaaaggaaaagaaaacaaaaaacgaaugaaaauaacu

SEQ ID NO: 142393 - RNA, 64 nt, hsa
uugcuugccaaaguacagaauuugaauuaucagcaaagaaaaaaaaaaaagccagccaagcuuu

SEQ ID NO: 142394 - RNA, 64 nt, hsa
gguagauaagaauuaaaaggguuuaauuuccuagaaagaaaauggaaaaauggucauuuuuaaa

SEQ ID NO: 142395 - RNA, 61 nt, hsa
auacauugcagcacaacugaauuccuucccuaaagaaaaaguccugccauuguaacaucau

SEQ ID NO: 142396 - RNA, 64 nt, hsa
uuuccuagaaauucuuaaauauauacagaauuuuaaagaaaacauuucaucugauuuaguuagc

SEQ ID NO: 142397 - RNA, 64 nt, hsa
uuuuagauuuauuuuucuuacuccacuaaacuauaaagaaaauaauuacuuagaaacuccauuu

SEQ ID NO: 142398 - RNA, 64 nt, hsa
acaaauucuaaaagauaaguguguuugcaaaaaaaaagaaaauaaauacauaaaaaagggacaa

SEQ ID NO: 142399 - RNA, 64 nt, hsa
cauuucuguaacccuccuagcccccuugaucccuaaagaaaacaaacaaacaaacaaaaacugu

SEQ ID NO: 142400 - RNA, 64 nt, hsa
augaugcaaaaaaagaaaaagaaaaaaaaaaagaaaagaaaacuucaauuuucuggguaugcac

SEQ ID NO: 142401 - RNA, 64 nt, hsa
auguuaugaugcaaaaaaagaaaaagaaaaaaaaaaagaaaagaaaacuucaauuuucugggua

SEQ ID NO: 142402 - RNA, 64 nt, hsa
gauuuuuaucaaauguuaugaugcaaaaaaagaaaaagaaaaaaaaaaagaaaagaaaacuuca

SEQ ID NO: 142403 - RNA, 64 nt, hsa
acaaaagauuuuuaucaaauguuaugaugcaaaaaaagaaaaagaaaaaaaaaaagaaaagaaa

SEQ ID NO: 142404 - RNA, 64 nt, hsa
acaauaaagaaaaaaaaauacaaaggaagaaaagaaagaaaaacaaguguucagggcauaacaa

SEQ ID NO: 142405 - RNA, 64 nt, hsa
uucagaaagcaguagugagagugagaguaacaauaaagaaaaaaaaauacaaaggaagaaaaga

SEQ ID NO: 142406 - RNA, 64 nt, hsa
gacuggagaagaaaaaaaagaaaaaagauagaaaaaagaaaaaguuucagaagagcagaaguaa

SEQ ID NO: 142407 - RNA, 64 nt, hsa
auuacaggaaauuagaucgacuggagaagaaaaaaaagaaaaaagauagaaaaaagaaaaaguu

SEQ ID NO: 142408 - RNA, 64 nt, hsa
ggucuguacuaaaaaaaaaaaaaaagaaaaagaaaaagaaaaaagaauacccaggugugguagu

SEQ ID NO: 142409 - RNA, 64 nt, hsa
aaacccggucuguacuaaaaaaaaaaaaaaagaaaaagaaaaagaaaaaagaauacccaggugu

SEQ ID NO: 142410 - RNA, 64 nt, hsa
guggugaaacccggucuguacuaaaaaaaaaaaaaaagaaaaagaaaaagaaaaaagaauaccc

SEQ ID NO: 142411 - RNA, 64 nt, hsa
agacaucugcaucuuuguaaguuagccagacaauaaagaaaagcagaaugauauggugucaacu

SEQ ID NO: 142412 - RNA, 64 nt, hsa
guauuacugggagaugcuaccaagaaaccaacccaaagaaaauucugaaaaauacauuucuauu

SEQ ID NO: 142413 - RNA, 64 nt, hsa
auuucuugagcauguauuggucagaaagaaaaagaaagaaaaccauucucuauuuuuccauggg

SEQ ID NO: 142414 - RNA, 64 nt, hsa
cagauauuugauuucuugagcauguauuggucagaaagaaaaagaaagaaaaccauucucuauu

SEQ ID NO: 142415 - RNA, 64 nt, hsa
gaagcgauuucaguagaaucacuuacucauccuaaaagaaaacauuaucccaguuaccuacauc

SEQ ID NO: 142416 - RNA, 64 nt, hsa
caauccgaaagaauagacugugaaaugaguucuuaaagaaaagacuuguuuauguauuaaaaaa

SEQ ID NO: 142417 - RNA, 64 nt, hsa
cuuguaguuuuacuguacauuuauuuuuaaagaaaaagaaaacaaaagccagacaaacccaagu

SEQ ID NO: 142418 - RNA, 64 nt, hsa
cuuuugcuuguaguuuuacuguacauuuauuuuuaaagaaaaagaaaacaaaagccagacaaac

SEQ ID NO: 142419 - RNA, 64 nt, hsa
aagcuucaauauuggauacugaagaguauacaugaaagaaaauuccuuuugaagcuauuaaacc

SEQ ID NO: 142420 - RNA, 64 nt, hsa
ggugauugcugcuauucuggaauguguccauugaaaagaaaauaggcgcuuugucuccuacaau

SEQ ID NO: 142421 - RNA, 64 nt, hsa
gcuauuuuuucucaguuuuuaaugcuuuaauuugaaagaaaaaugcauccuaaccauuccaucc

SEQ ID NO: 142422 - RNA, 64 nt, hsa
gguggcaauuuauuuuaagaguauuuucugguaaaaagaaaaauguguauuuuaagaugaaaua

SEQ ID NO: 142423 - RNA, 64 nt, hsa
aaaaaauuuuuaggaaacucaccuuccucaucuaaaagaaaaaggcauuuuagagaaaacuaaa

SEQ ID NO: 142424 - RNA, 64 nt, hsa
agucucucugggauggagaggaccccaacucgccaaagaaaagauucaccauugcccgccugaa

SEQ ID NO: 142425 - RNA, 64 nt, hsa
ggaaaaggaaauaaaagaaagagaaaaaggcaaaaaagaaaaaguaaugccuuucugaagaacc

SEQ ID NO: 142426 - RNA, 64 nt, hsa
gcgugacugcaaagaaaaagacuuuuguuuugcaaaagaaaagcagcucggugacuccguccac

SEQ ID NO: 142427 - RNA, 64 nt, hsa
uuucuccagcagccucgucuuacagcgugacugcaaagaaaaagacuuuuguuuugcaaaagaa

SEQ ID NO: 142428 - RNA, 64 nt, hsa
gagcaacagaauccuuccaggaccguucacauacaaagaaaaguagugguauuuugguaugugc

SEQ ID NO: 142429 - RNA, 64 nt, hsa
aaaaaaagguuuuauaaugucagagacuaguauuaaagaaaacugaaagaaccugagagaauag

SEQ ID NO: 142430 - RNA, 64 nt, hsa
cuagacuacuguuguccagggucaauuugaguguaaagaaaauguagacaaggaauugcccaau

SEQ ID NO: 142431 - RNA, 64 nt, hsa
uaaaaguucuugagaccuaaauuucuucacaaaaaaagaaaagaucuuaagucauacauuuuaa

SEQ ID NO: 142432 - RNA, 64 nt, hsa
ucagggcuggggccaagaggaaaaacagggaaaaaaagaaaaaaaaaagaaaaaggaaaaggaa

SEQ ID NO: 142433 - RNA, 64 nt, hsa
gccaagaggaaaaacagggaaaaaaagaaaaaaaaaagaaaaaggaaaaggaagcggugugugg

SEQ ID NO: 142434 - RNA, 64 nt, hsa
guaaaguuuaauugaaagaauguaaagcaaccaaaaagaaaaaaaaaaagaaagaaagaggaaa

SEQ ID NO: 142435 - RNA, 64 nt, hsa
acugcaaacuauuuaaagaaauauguauucuguaaaagaaaaaaaaaaugcggccuuuucauga

SEQ ID NO: 142436 - RNA, 64 nt, hsa
acuggugguuuuccgcauucuuuguacacccaugaaagaaaacuuuuaugcaaggucuugcauu

SEQ ID NO: 142437 - RNA, 64 nt, hsa
cuuaacucuuucuugucaggaguauauaaaaaagaaagaaaacaaaacucgcccuacaggaaga

SEQ ID NO: 142438 - RNA, 64 nt, hsa
aauacguuugacccauuuugaauaaggaaauugaaaagaaaaauuuaaaaggagaaaaaaaugc

SEQ ID NO: 142439 - RNA, 64 nt, hsa
ccuuaaugggucuugucuaucuucauuagucuucaaagaaaaaccauuugcuaccaaaguaaau

SEQ ID NO: 142440 - RNA, 64 nt, hsa
ugaaaaagcacauuuuagauacugaaauugaaggaaagaaaaugcaucuucaaacauuuuuugg

SEQ ID NO: 142441 - RNA, 64 nt, hsa
uauuuaguucacuauuauauaguggguuauauuaaaagaaaagaagaaaaauaucuaauuucuc

SEQ ID NO: 142442 - RNA, 64 nt, hsa
ucauuaaaaaccuuuuuuuuuuaaaaaaaaaaaaaaagaaaaucucauuagugaacuuaucuuu

SEQ ID NO: 142443 - RNA, 64 nt, hsa
auucuuccugauucaaagacugucaaauaggaaaaaagaaaacaguaaaugaacaaaaacauca

SEQ ID NO: 142444 - RNA, 64 nt, hsa
uaacagacaaggucaaaaaauagaugcaggcugaaaagaaaaggaagugggcuaagaugggaaa

SEQ ID NO: 142445 - RNA, 64 nt, hsa
caguuuggguaaaggaugagcagacaagucaacuaaagaaaaaagaaaagcaaggaggaggguu

SEQ ID NO: 142446 - RNA, 64 nt, hsa
gguaaaggaugagcagacaagucaacuaaagaaaaaagaaaagcaaggaggaggguugagcaau

SEQ ID NO: 142447 - RNA, 56 nt, hsa
uuauucuuuuauacaguugagguacuaaagaaaauugacauuccaucugucuuuau

SEQ ID NO: 142448 - RNA, 64 nt, hsa
uguccuuaaggguucuguaguguuaucaaagcaaaaagaaaaugcugcauaaaaauaccaaacu

SEQ ID NO: 142449 - RNA, 64 nt, hsa
ggaaaagguuaaacuggauuuuuuuuuuuaaaaaaaagaaaaaaaaagaagaaaaguauaccag

SEQ ID NO: 142450 - RNA, 64 nt, hsa
caaacugcccuuuguccucaaagaaauuguugaaaaagaaaacuuuuuaaagagauuuuuugca

SEQ ID NO: 142451 - RNA, 64 nt, hsa
gacauacauuccaagcuuuucaacucuaggagaaaaagaaaaucauguuuuccuguauuguaaa

SEQ ID NO: 142452 - RNA, 64 nt, hsa
guuuauugcuguuuugucuuucuuuuuucuaaaaaaagaaaaaaaagaaaaaaaggaaaagaag

SEQ ID NO: 142453 - RNA, 64 nt, hsa
uguuuugucuuucuuuuuucuaaaaaaagaaaaaaaagaaaaaaaggaaaagaagaacaaagaa

SEQ ID NO: 142454 - RNA, 64 nt, hsa
gccggacagcgaacuggaggggggagaaauuuucaaagaaaaacgagggaaaugggaggggugc

SEQ ID NO: 142455 - RNA, 64 nt, hsa
aagaaacagcauggagaaaacccgguacgcucaaaaagaaaaaggaaaaaaaaaaaucccauca

SEQ ID NO: 142456 - RNA, 64 nt, hsa
ugaccaugauaauucaguuuauauucaccacaugaaagaaaaauggguaacagaagaacccuua

SEQ ID NO: 142457 - RNA, 64 nt, hsa
aaaguaauguugaccaucccccucucagcugaauaaagaaaaauuuaguucaauuuauugcaau

SEQ ID NO: 142458 - RNA, 64 nt, hsa
aaagcuagguauuuaucaacugcagauguuauugaaagaaaauaaaauucagucucaagaguaa

SEQ ID NO: 142459 - RNA, 64 nt, hsa
auuuuugucuuguuaagaaaauuuagcauuucuaaaagaaaaaagcaacccucuuucaaacugu

SEQ ID NO: 142460 - RNA, 64 nt, hsa
cuccacuuuaucccacgauaucuaaaugaaaaagaaagaaaacccacacacaaagcaaaaacuc

SEQ ID NO: 142461 - RNA, 64 nt, hsa
auucucauuguuacaugauuuuuuaaaaaaaggaaaagaaaaugugaaacacaauuuaguccuc

SEQ ID NO: 142462 - RNA, 64 nt, hsa
aucuuuggaaacuugccccuuauuuaaaaaaaaaaaagaaaaaaaagaguuuguuacucuauug

SEQ ID NO: 142463 - RNA, 64 nt, hsa
agucuuguuuguaaaaaaaaaaaaaaaaaaagaaaaagaaaaaaguguauuuuacuguuuucug

SEQ ID NO: 142464 - RNA, 64 nt, hsa
uaagcuagucuuguuuguaaaaaaaaaaaaaaaaaaagaaaaagaaaaaaguguauuuuacugu

SEQ ID NO: 142465 - RNA, 64 nt, hsa
cuggugacagagugagacucuguuucaaaaaagaaaagaaaagaaacaugguucaaauuauauc

SEQ ID NO: 142466 - RNA, 64 nt, hsa
ccagccuggugacagagugagacucuguuucaaaaaagaaaagaaaagaaacaugguucaaauu

SEQ ID NO: 142467 - RNA, 64 nt, hsa
gagccagacucugucucaaaaaaaaaaaaaaagaaaagaaaaagauaaagggauugugaaaaga

SEQ ID NO: 142468 - RNA, 64 nt, hsa
ugacagagccagacucugucucaaaaaaaaaaaaaaagaaaagaaaaagauaaagggauuguga

SEQ ID NO: 142469 - RNA, 64 nt, hsa
cagguggggaaaggggggcuugcaccccugcuggaaagaaaagguuuguguauauuucugaugc

SEQ ID NO: 142470 - RNA, 64 nt, hsa
uuuaugaaugacuuucuacagaguuucuauuucuaaagaaaaaacaauuguucacaucccaucu

SEQ ID NO: 142471 - RNA, 64 nt, hsa
agagccuguugugggagguagggaggaaauauguaaagaaaaacaggaagauaccugcacuaau

SEQ ID NO: 142472 - RNA, 64 nt, hsa
cuuaauauugaauauacuguuuaccucacacuaaaaagaaaaccagaagccuuauuugugauuu

SEQ ID NO: 142473 - RNA, 64 nt, hsa
gaauuuuggugggcaucuaauccuacauaaugaaaaagaaaaacagaccauuuaaaaacucaga

SEQ ID NO: 142474 - RNA, 64 nt, hsa
uuccuggcuaucuuaaacaaguucauacauuugaaaagaaaaaaaaauguuguuuaaaaaaugu

SEQ ID NO: 142475 - RNA, 64 nt, hsa
gcuuagucuaaagacuguagcaaaaaaaaaaaaaaaagaaaaauuagauuuuacauaucuuugc

SEQ ID NO: 142476 - RNA, 64 nt, hsa
uuuccgauuaggcuuuggucagcauuuuucauuuaaagaaaaguaacacucccauccacucaua

SEQ ID NO: 142477 - RNA, 64 nt, hsa
gaaaaaagaggaaaaaaaggcaaaaaauauugugaaagaaaaaaaacaacuuaauauauuuugg

SEQ ID NO: 142478 - RNA, 64 nt, hsa
uacauuugguucaugugcauuguuuacaaagcaaaaagaaaaaagaggaaaaaaaggcaaaaaa

SEQ ID NO: 142479 - RNA, 64 nt, hsa
gccuggagagcagagcaagacucugucucaaaaaaaagaaaaaaguuuuauuauccuuacuuuu

SEQ ID NO: 142480 - RNA, 64 nt, hsa
uuguuuuuaaaggaaacaucuauuaugguaauacaaagaaaaguuaaauugugacaguaauguu

SEQ ID NO: 142481 - RNA, 64 nt, hsa
aaauuucuauucaggcuacuggaauugguuauuaaaagaaaaaggaaaaagaagaaucuugcug

SEQ ID NO: 142482 - RNA, 64 nt, hsa
aucauaacuuuaauucaagaaugcaguuuuaccaaaagaaaaauuugaaaauuucuauucaggc

SEQ ID NO: 142483 - RNA, 64 nt, hsa
cugugacaaaaaaaaaaaaaaaaaaaagaaaaaaaaagaaaaaacagaaauauauccagcuaac

SEQ ID NO: 142484 - RNA, 64 nt, hsa
aaacaguguucugugacaaaaaaaaaaaaaaaaaaaagaaaaaaaaagaaaaaacagaaauaua

SEQ ID NO: 142485 - RNA, 64 nt, hsa
uugaaaauguuuauuuaaaaaaaaaaaagaugacaaagaaaaacagagagagagaauauuggag

SEQ ID NO: 142486 - RNA, 64 nt, hsa
acaggaacccaccaaaccaaccaaucaaccaaacaaagaaaaaauuccacaaugaaagaaugua

SEQ ID NO: 142487 - RNA, 64 nt, hsa
uaugaacuuugguucuucaugagugcauuuugaaaaagaaaaaaaguacacauucagaaucugg

SEQ ID NO: 142488 - RNA, 64 nt, hsa
caagaagcucaaagaaaagaaguacguuaaagaaaaagaaaaaaccucacuuuuccuuuauagu

SEQ ID NO: 142489 - RNA, 64 nt, hsa
uuugaccaagaagcucaaagaaaagaaguacguuaaagaaaaagaaaaaaccucacuuuuccuu

SEQ ID NO: 142490 - RNA, 64 nt, hsa
gcauguaccuugaaauuauuugaccaagaagcucaaagaaaagaaguacguuaaagaaaaagaa

SEQ ID NO: 142491 - RNA, 64 nt, hsa
ccuuuuaaagauaguuuugcuguugcuccuagugaaagaaaaaucucuguacaaaggagaaaaa

SEQ ID NO: 142492 - RNA, 64 nt, hsa
gcaacuuuuuuugccuuggugacuuuugaaaaaaaaagaaaagaaaaagcagcauccuuauauu

SEQ ID NO: 142493 - RNA, 64 nt, hsa
uuuuuuugccuuggugacuuuugaaaaaaaaagaaaagaaaaagcagcauccuuauauuucuuu

SEQ ID NO: 142494 - RNA, 64 nt, hsa
cuaauguauaaugugcagaaaauauuuaauaucaaaagaaaauugauauuuuuauacaaguaau

SEQ ID NO: 142495 - RNA, 64 nt, hsa
gcuaaccauuuauauaaaacuuaaaaacaagagaaaagaaaaaucaauuagaucuaaacaguua

SEQ ID NO: 142496 - RNA, 64 nt, hsa
agccagaacuuucuuucacgguuacuguuccugaaaagaaaaagccaccuagcccuaucaagcc

SEQ ID NO: 142497 - RNA, 64 nt, hsa
uuaauuucaaaauuuaaagccaugcuaaaauuaaaaagaaaauauuaaauuacacaauuacacu

SEQ ID NO: 142498 - RNA, 64 nt, hsa
uaaaaaugaaauauuucaaagacugaauauuuucaaagaaaaugaauaauucauugcccuugug

SEQ ID NO: 142499 - RNA, 64 nt, hsa
guauuuccuucugcuucaaaagaacaaaauugggaaagaaaacucacuugagucuugaucaaac

SEQ ID NO: 142500 - RNA, 64 nt, hsa
uuucaucuccugcuugucugacugcaaguuuuuuaaagaaaagaggaacuggagaaacgacuuc

SEQ ID NO: 142501 - RNA, 64 nt, hsa
uuuggaaggcuuuccacaaacuaaccuuggaugaaaagaaaaaauuccucuguaaguacugugg

SEQ ID NO: 142502 - RNA, 64 nt, hsa
agaaguauauuuuagaaauuuguuaaugagaguaaaagaaaauaaauguguauagcucaguuug

SEQ ID NO: 142503 - RNA, 64 nt, hsa
auccaguaguaaaauauguaaccauugucccaguaaagaaaaauaacaaaaguuguaaaaugua

SEQ ID NO: 142504 - RNA, 64 nt, hsa
agguuaaacaugguuagaaacaacugaaagcauaaaagaaaaaucuaggccgggugcaguggcu

SEQ ID NO: 142505 - RNA, 64 nt, hsa
uguugugacaaccacaagcacuuuuuuuuuuuuuaaagaaaaaaagguagugaauuuuuaauca

SEQ ID NO: 142506 - RNA, 64 nt, hsa
agaagauuuuuguccaugcuugauuuuuuuuuuuaaagaaaaacuuucauggguuagcauuacc

SEQ ID NO: 142507 - RNA, 64 nt, hsa
auaaauggauacacauucaaaauacuuuuaaaaaaaagaaaauguuaccaguuuuuuuaucuga

SEQ ID NO: 142508 - RNA, 64 nt, hsa
aaagagaauuuagaugagagaugcaauuuuuuaaaaagaaaauuaauuugcaucccucguuuaa

SEQ ID NO: 142509 - RNA, 64 nt, hsa
uaaggaugaucagagacuuuugccagcuacacuaaaagaaaauggccuucuugacugugaagag

SEQ ID NO: 142510 - RNA, 64 nt, hsa
acuuugaacauuaauguugaaaaagaaaacaaccaaagaaaauugguacuuacccuucuacaaa

SEQ ID NO: 142511 - RNA, 64 nt, hsa
ccuggcuacaauuacuuugaacauuaauguugaaaaagaaaacaaccaaagaaaauugguacuu

SEQ ID NO: 142512 - RNA, 64 nt, hsa
agaggacaaguguaauaaaucaaaauugaccucaaaagaaaauguguaacagaguugagguugu

SEQ ID NO: 142513 - RNA, 64 nt, hsa
aaauauuugcucaauaugaucuugauauuccuacaaagaaaaaagaagggguagggauuuggcu

SEQ ID NO: 142514 - RNA, 64 nt, hsa
guugaaucaacaaugugauacguaaauuauagaaaaagaaaagaaacacaaaagcuauagauau

SEQ ID NO: 142515 - RNA, 64 nt, hsa
aauucauuggaagaaaucaccaaagauuauuacaaaagaaaaauauguugcuaagauuguguug

SEQ ID NO: 142516 - RNA, 64 nt, hsa
uuuuuguauuugugaacucaucugugggaggaguaaagaaaauccaaaagcauuuaauguuuug

SEQ ID NO: 142517 - RNA, 64 nt, hsa
caucaaaucugaaauagucaccucacagcucuucaaagaaaaccuuugaaagauuuauaucuaa

SEQ ID NO: 142518 - RNA, 64 nt, hsa
uuccuuaagaaugaaaccgaccacauggagggaaaaagaaaacaauucuuucuuggauugguuu

SEQ ID NO: 142519 - RNA, 64 nt, hsa
aaaagccagugccuauugaguauaucaaaccaaaaaagaaaaaaaaaaguuuuaagagggguca

SEQ ID NO: 142520 - RNA, 64 nt, hsa
gccaccaacaauuuagucauaucugauagguacaaaagaaaaccaagauuuugauaugaccacc

SEQ ID NO: 142521 - RNA, 64 nt, hsa
guuggcaaucaaagcaugcacuuguaacaaugaaaaagaaaaagcauuuuauauuacuacucaa

SEQ ID NO: 142522 - RNA, 64 nt, hsa
aauuaggcagucuuaaaaaaaaaaaaaaacagaaaaagaaaaaaaagaacguugcaaauuuguu

SEQ ID NO: 142523 - RNA, 64 nt, hsa
uugugaagcagcuauacguggcauacauguauuuaaagaaaaaaaaauagauguagaguguuuu

SEQ ID NO: 142524 - RNA, 64 nt, hsa
guccucagaagccuauuuuuaaagcagaagcaaaaaagaaaaacaaaauaacaaaaacaacccu

SEQ ID NO: 142525 - RNA, 64 nt, hsa
acaaaaugacucuuuuuccugucaauugaaauuuaaagaaaaguuuuaauuauauaaauagcaa

SEQ ID NO: 142526 - RNA, 64 nt, hsa
gaaacaaauggaaaguccuaugaaacuguauuguaaagaaaacauuauuuaauugauaugcugu

SEQ ID NO: 142527 - RNA, 64 nt, hsa
aguggccaaacuuauuuaugcugcuaaaugaaagaaagaaaaaagcaaauuauuuuuuuuuauu

SEQ ID NO: 142528 - RNA, 64 nt, hsa
cccuucccccugcaaaaagaaaaaaagaaaagaaaaagaaaaaaaucccuuguucucaguggug

SEQ ID NO: 142529 - RNA, 64 nt, hsa
ucccugcccuucccccugcaaaaagaaaaaaagaaaagaaaaagaaaaaaaucccuuguucuca

SEQ ID NO: 142530 - RNA, 64 nt, hsa
uauacucccugcccuucccccugcaaaaagaaaaaaagaaaagaaaaagaaaaaaaucccuugu

SEQ ID NO: 142531 - RNA, 64 nt, hsa
guagacgauauacucccugcccuucccccugcaaaaagaaaaaaagaaaagaaaaagaaaaaaa

SEQ ID NO: 142532 - RNA, 64 nt, hsa
uuaaccaguucacuuauuguacucuggcaauuuaaaagaaaaucaguaaaauauuuugcuugua

SEQ ID NO: 142533 - RNA, 64 nt, hsa
ccuaaaggacaggagaaaaggucuucaaucguggaaagaaaauuaaauguuguauuaaauagau

SEQ ID NO: 142534 - RNA, 64 nt, hsa
caagaccccauccuccaccccccccaaaaaauagaaagaaaaaaaaaguuugcacuaauugagg

SEQ ID NO: 142535 - RNA, 64 nt, hsa
gcucaacaacagucuuugaguggcauagaauuccaaagaaaauggugcuggguggagaauggag

SEQ ID NO: 142536 - RNA, 64 nt, hsa
cuaaagcugguuuaauguuuuggccaaugcaccuaaagaaaaacaaacucguuuuuuacaaagc

SEQ ID NO: 142537 - RNA, 64 nt, hsa
caacuuaccaggcaccaaaagaaguaaaagcaaaaaagaaaaccuuucuucaccaaaucuuggu

SEQ ID NO: 142538 - RNA, 64 nt, hsa
aaccccgcaaacaagaauuaagaugaucccaauaaaagaaaaauugcucaggaaacugaaccuu

SEQ ID NO: 142539 - RNA, 64 nt, hsa
gacaguuggagccaaugccucauaguguaaacugaaagaaaaauaguugcuuuuuaaaauguca

SEQ ID NO: 142540 - RNA, 64 nt, hsa
agauaacgcaggagagagagagagaaagaaugagaaagaaaaggaaugcaagagaaggagaugu

SEQ ID NO: 142541 - RNA, 64 nt, hsa
uuuuuaacaaauguuuucauuuacaggaaauugcaaagaaaauucucaagugauagucuuuuuu

SEQ ID NO: 142542 - RNA, 59 nt, hsa
ugucaaagccagacuucuaaggaguagugaaagaaaacccugaaauaaucgaacaggaa

SEQ ID NO: 142543 - RNA, 64 nt, hsa
uaaugauuuauacaaugacuccaaaggcaaucccaaagaaaagauguaaagaauguuuugagca

SEQ ID NO: 142544 - RNA, 64 nt, hsa
cagcuugggcaacagagcaagacuccaucucaaaaaagaaaaaagaaaagaaauagaauuauca

SEQ ID NO: 142545 - RNA, 64 nt, hsa
ggcaacagagcaagacuccaucucaaaaaagaaaaaagaaaagaaauagaauuaucaagcuuuu

SEQ ID NO: 142546 - RNA, 64 nt, hsa
aggcaauguagugagacccugucucuaauuuaaaaaagaaaaagaaaaaaacauucccaguggc

SEQ ID NO: 142547 - RNA, 64 nt, hsa
uguagugagacccugucucuaauuuaaaaaagaaaaagaaaaaaacauucccaguggcagccug

SEQ ID NO: 142548 - RNA, 64 nt, hsa
aaagcuugcuguacaaaggcaacagcaacuuaaaaaagaaaaucuggacaauagauguggacuc

SEQ ID NO: 142549 - RNA, 64 nt, hsa
uuugauaugacugaauugcaaucuauauuuuuaaaaagaaaaaucaaaauacauuaggguuuac

SEQ ID NO: 142550 - RNA, 64 nt, hsa
gacucuugugaaguuuucuuaaauuguucacuuuaaagaaaaugacguaccaacaaugauuugg

SEQ ID NO: 142551 - RNA, 64 nt, hsa
augugaaacugcugucuuuuauauuaaaguaauuaaagaaaauguauugugauugaaauuauuu

SEQ ID NO: 142552 - RNA, 64 nt, hsa
guugaauuguucuuaaggcaucauaucuagaagcaaagaaaaaagaaaaauaacaauuuaaguu

SEQ ID NO: 142553 - RNA, 64 nt, hsa
uguucuuaaggcaucauaucuagaagcaaagaaaaaagaaaaauaacaauuuaaguuguguaaa

SEQ ID NO: 142554 - RNA, 64 nt, hsa
guuacuuauauuaauaauauucagaaaaaaaaaaaaagaaaaggaaaaagaaaaauauauauuc

SEQ ID NO: 142555 - RNA, 64 nt, hsa
acucugucucagaaaaaaaaaaaaagaaaaggaaaaagaaaaauauauauucuauauuuuuuua

SEQ ID NO: 142556 - RNA, 64 nt, hsa
aaacuuaagaugugcaaggagauuuaaugauuucaaagaaaauaaugguucuuuguuuuuaaug

SEQ ID NO: 142557 - RNA, 64 nt, hsa
uguggauucaaguuacugaagugaauaccaauaaaaagaaaacccuaggccauguuaauugguu

SEQ ID NO: 142558 - RNA, 64 nt, hsa
uugucguuuuaacaucuccacgucccuagcauaaaaagaaaaagaaaaaaauuuaaacugcuuu

SEQ ID NO: 142559 - RNA, 64 nt, hsa
uuuuaacaucuccacgucccuagcauaaaaagaaaaagaaaaaaauuuaaacugcuuuuucgga

SEQ ID NO: 142560 - RNA, 64 nt, hsa
gagucacaggacccugcccaccugaguucccaauaaagaaaaaccuccccuucugaggcugcuu

SEQ ID NO: 142561 - RNA, 64 nt, hsa
gagcaggcuuuuggaagaaccuguuugaugcaaaaaagaaaaugaaaaacaaaacaaaaaaucc

SEQ ID NO: 142562 - RNA, 64 nt, hsa
augaguggaauuuacauuuuagauacuauaggggaaagaaaagucucaaaaagaaguauugcau

SEQ ID NO: 142563 - RNA, 64 nt, hsa
gaauaagaaauagccaacuaguuaaaauguaugaaaagaaaacuuuccccugcuguauuuguug

SEQ ID NO: 142564 - RNA, 64 nt, hsa
auaagcccagcauuaccugauaccaaaaccaggcaaagaaaacagaagaagaggaaggaaaacu

SEQ ID NO: 142565 - RNA, 64 nt, hsa
caaccaguguaauucagcacauuaauaaaguaaaaaagaaaaccauaugaucauuucaacgaug

SEQ ID NO: 142566 - RNA, 64 nt, hsa
aacguguucuuacaaaugaaccuucggaucuaugaaagaaaauauaguagggggacuaaggaac

SEQ ID NO: 142567 - RNA, 64 nt, hsa
guuuggauagacuccaugccuucucucucccugcaaagaaaaaucuugaacauuuaugauguca

SEQ ID NO: 142568 - RNA, 64 nt, hsa
uaguuaaaaaaaaauucccuaaagacuaacuugaaaagaaaaccacagcaggaugcuaauggaa

SEQ ID NO: 142569 - RNA, 64 nt, hsa
aauugucaaaauuguuuaccauagaaagaugacaaaagaaaauuuuccacauaggaaaaugcca

SEQ ID NO: 142570 - RNA, 64 nt, hsa
uuucagcuuccuugauuuagaaauaugauauaauaaagaaaaacuccauuuaucaucuguuaca

SEQ ID NO: 142571 - RNA, 64 nt, hsa
auggaucuguguucugacuggcaccuuuggaaugaaagaaaagugugugcuguccaaauuuuuu

SEQ ID NO: 142572 - RNA, 64 nt, hsa
acucaagcacuucuagaaucaugcacugaauucaaaagaaaaaucuugcugcuuuuuguccagg

SEQ ID NO: 142573 - RNA, 64 nt, hsa
uaauugugugcccauaaacacugauuuuuuuuaaaaagaaaacuuaguaauuauuugauggaua

SEQ ID NO: 142574 - RNA, 64 nt, hsa
uagaaaguagcacuugaugcaagggauguuuugaaaagaaaaaauugguaaugcgaauguauag

SEQ ID NO: 142575 - RNA, 64 nt, hsa
aaugaaaaaagaaaagaaaagcauaauaaauuuaaaagaaaaggcugagaaaugaaacuuggua

SEQ ID NO: 142576 - RNA, 64 nt, hsa
caaagucucaauccuuauuuuaaaugaaaaaagaaaagaaaagcauaauaaauuuaaaagaaaa

SEQ ID NO: 142577 - RNA, 64 nt, hsa
ggggacaaagucucaauccuuauuuuaaaugaaaaaagaaaagaaaagcauaauaaauuuaaaa

SEQ ID NO: 142578 - RNA, 64 nt, hsa
cauggauaaaaacuaagcgcuugccuucuuuuaaaaagaaaaacugaugauuagauuagguuag

SEQ ID NO: 142579 - RNA, 64 nt, hsa
ugagauugaaauuuuuuaugaucucuaaaccauaaaagaaaacaccgacagcuguaaaauguuc

SEQ ID NO: 142580 - RNA, 64 nt, hsa
uugaauaagaguuggcuuaaauuuuaaaaaagaaaaagaaaauugagguuuuaggauuuucaug

SEQ ID NO: 142581 - RNA, 64 nt, hsa
gaaaaguugaauaagaguuggcuuaaauuuuaaaaaagaaaaagaaaauugagguuuuaggauu

SEQ ID NO: 142582 - RNA, 64 nt, hsa
ggaccuugguuuucuucuagauagcagcugucccaaagaaaauauuucuucuuugucuguuaag

SEQ ID NO: 142583 - RNA, 64 nt, hsa
ccugcugagcaacagagugagaccccaucucaaaaaagaaaaaaaaaggcauucuaguaaaucg

SEQ ID NO: 142584 - RNA, 55 nt, hsa
agucucaggcguggggaugaaccacaaagaaaaucaacuugcuacuacaugaaau

SEQ ID NO: 142585 - RNA, 64 nt, hsa
uaagaaaagaaaaaagaaaagaaaaaaagggaaaaaagaaaagcaaggaaaaggcucuuuauua

SEQ ID NO: 142586 - RNA, 64 nt, hsa
cgacuuaauguauguuguaagaaaagaaaaaagaaaagaaaaaaagggaaaaaagaaaagcaag

SEQ ID NO: 142587 - RNA, 64 nt, hsa
auucacgacuuaauguauguuguaagaaaagaaaaaagaaaagaaaaaaagggaaaaaagaaaa

SEQ ID NO: 142588 - RNA, 64 nt, hsa
acaucugauucacgacuuaauguauguuguaagaaaagaaaaaagaaaagaaaaaaagggaaaa

SEQ ID NO: 142589 - RNA, 64 nt, hsa
gcuguguauguauucaagagacuuccaacuagacaaagaaaaaauuguuguuuuaauggaaugu

SEQ ID NO: 142590 - RNA, 64 nt, hsa
acuauuuucaucauaauuucaucauugauuaaaaaaagaaaaccacuuguuuauucaguuauua

SEQ ID NO: 142591 - RNA, 64 nt, hsa
aucacgacauuguaaaaucucacuuuagaucaucaaagaaaaccauuguuacuaucuccuuuga

SEQ ID NO: 142592 - RNA, 64 nt, hsa
aagugcuucucuuguguccuguagauguugugaaaaagaaaaaaacaaaaaauacaccacacug

SEQ ID NO: 142593 - RNA, 64 nt, hsa
ggaaaaccugguagugaauguguaguuggggaauaaagaaaagcacuaaauccugcccuuuuug

SEQ ID NO: 142594 - RNA, 64 nt, hsa
guugccuuuuucuuacagaaugacugaaaauuugaaagaaaagccuauaaaagugcacauacgc

SEQ ID NO: 142595 - RNA, 64 nt, hsa
ugaacaaaacuguguuuugaguuuagcugacauuaaagaaaaaaguucaucacgugacuguuaa

SEQ ID NO: 142596 - RNA, 64 nt, hsa
acacaucaaacaggccuauacaaaagguuuaggaaaagaaaacaauggugagucccggcccucu

SEQ ID NO: 142597 - RNA, 64 nt, hsa
aagauugaccaaaccauccaaaugccaaaaagaaaaagaaaaaaaaaagccucucuguccuaug

SEQ ID NO: 142598 - RNA, 64 nt, hsa
gaagagaagauugaccaaaccauccaaaugccaaaaagaaaaagaaaaaaaaaagccucucugu

SEQ ID NO: 142599 - RNA, 64 nt, hsa
ggugacagagcaagacuccgucucaaaaaaaagaaaagaaaaaagaaagcauuguuuuaauuga

SEQ ID NO: 142600 - RNA, 64 nt, hsa
gcccgggugacagagcaagacuccgucucaaaaaaaagaaaagaaaaaagaaagcauuguuuua

SEQ ID NO: 142601 - RNA, 64 nt, hsa
aaauugcaguauuuaaagcuuaagcuuucaggaaaaagaaaauaagaauucagugugugcauga

SEQ ID NO: 142602 - RNA, 64 nt, hsa
aucaguuuagcuuuguguuguaugcuaguuuaaaaaagaaaauauguaauauaauguaaaaaaa

SEQ ID NO: 142603 - RNA, 64 nt, hsa
cagacgaagaguuuaaagagaaaagggaaaaaagaaagaaaaaguaagcagggcuggcuucgcc

SEQ ID NO: 142604 - RNA, 64 nt, hsa
agucaguggagggcgagugguuucggaaaaaaaaaaagaaaaaaagaaaaaaaaagaaaaaaaa

SEQ ID NO: 142605 - RNA, 64 nt, hsa
gagggcgagugguuucggaaaaaaaaaaagaaaaaaagaaaaaaaaagaaaaaaaaaagauuuu

SEQ ID NO: 142606 - RNA, 64 nt, hsa
gguuucggaaaaaaaaaaagaaaaaaagaaaaaaaaagaaaaaaaaaagauuuuuuucuucucu

SEQ ID NO: 142607 - RNA, 64 nt, hsa
uucaaggccacaaaaacaauguuugggggaaaaaaaagaaaaaaucaugccagcuaaucauguc

SEQ ID NO: 142608 - RNA, 64 nt, hsa
ggacagaaacaagguuuuaaagcauugccaaaaaaaagaaaacagaaagaaaaaauguaucauc

SEQ ID NO: 142609 - RNA, 64 nt, hsa
agguuuuaaagcauugccaaaaaaaagaaaacagaaagaaaaaauguaucaucuaaaggacuag

SEQ ID NO: 142610 - RNA, 64 nt, hsa
aauuuuuaaaaauagcuuucguuuugaguucuggaaagaaaacugucaaaaucaguauauacua

SEQ ID NO: 142611 - RNA, 64 nt, hsa
uuguguguauauuugggauaucuauugaagaaaaaaagaaaaccccuuaaagauaauguacaug

SEQ ID NO: 142612 - RNA, 64 nt, hsa
augucuuuaaaucagauaccaaauauuuuuuaggaaagaaaaauguuauuacugucauuagguu

SEQ ID NO: 142613 - RNA, 64 nt, hsa
caguguuucugggggagguuauggagggaagaaaaaagaaaaaucgauagugagugacugauug

SEQ ID NO: 142614 - RNA, 64 nt, hsa
uaaauaccauuaaacugugaucaguuaaaauuuaaaagaaaaaucagcacaaaagggcgcuaaa

SEQ ID NO: 142615 - RNA, 64 nt, hsa
guggaguaucccauucugaugaguacagaaaaaaaaagaaaaagaaaagaagagaaaaaauuaa

SEQ ID NO: 142616 - RNA, 64 nt, hsa
uaucccauucugaugaguacagaaaaaaaaagaaaaagaaaagaagagaaaaaauuaagaaaaa

SEQ ID NO: 142617 - RNA, 64 nt, hsa
cgcaagcccggggagagauuuauaaaaguaaacaaaagaaaaccuuccagcaacaaauuaaaaa

SEQ ID NO: 142618 - RNA, 64 nt, hsa
uuaaccguccuuccccuagcaaauuuaaaaacagaaagaaaauguuguaccaguuaccauuccg

SEQ ID NO: 142619 - RNA, 64 nt, hsa
gccaaaugucacuaaaggguuuaguuuuaaggagaaagaaaaggaaaaaaaaaaaaaacaaaaa

SEQ ID NO: 142620 - RNA, 64 nt, hsa
aaugguguaaaggcugucuuuuuuuuuuuuuuuuaaagaaaaguuauuaccauguauuuuguga

SEQ ID NO: 142621 - RNA, 64 nt, hsa
acuacaagucuugaguuaagaaggaaagaggaaaaaagaaaaaacaccaauacccagauuuaaa

SEQ ID NO: 142622 - RNA, 64 nt, hsa
aaaaguaaaauacuucugacuguuaaaacuauauaaagaaaaucucauuugucuaauugcaauu

SEQ ID NO: 142623 - RNA, 64 nt, hsa
uauaaagaaaaucucauuugucuaauugcaauuaaaagaaaaauguuaaaauauuaaaaugaaa

SEQ ID NO: 142624 - RNA, 64 nt, hsa
ccaacuguuuagcugaaguucauauuauuuaaguaaagaaaauauuucaguuuuauaacagacu

SEQ ID NO: 142625 - RNA, 64 nt, hsa
cuggggaguucuugaguuccucauuuguugguaaaaagaaaaagaaugugaaaaugucucuuuu

SEQ ID NO: 142626 - RNA, 64 nt, hsa
uucuguucuuguuuauccagcguaggaagaaggaaaagaaaaucuuugcuccucugccccauuc

SEQ ID NO: 142627 - RNA, 64 nt, hsa
uguauugcauuuuugggggaagcaaauugacuuuaaagaaaaaaguuguggcaaaagaugcuaa

SEQ ID NO: 142628 - RNA, 64 nt, hsa
uauuuuuucauuagggccauaucuccaaaaaaagaaagaaaaaauacaaaaaacaaaaacaaaa

SEQ ID NO: 142629 - RNA, 64 nt, hsa
uguauuucaagauaauguaguuuaaaaaaaaaaaaaagaaaaaaacuugauguaaauuccuccu

SEQ ID NO: 142630 - RNA, 64 nt, hsa
uuuuuccuuucauuuuuagaugccagcucuuuuuaaagaaaauagaaaugauuuagauuaaaca

SEQ ID NO: 142631 - RNA, 64 nt, hsa
auagaucacaaaacugggacaucuccuagagucaaaagaaaaccacugcaacagacucauugaa

SEQ ID NO: 142632 - RNA, 64 nt, hsa
ggaaguaaaugcaaauuacuuuuaagugugcuuuaaagaaaaauauuuuccccacaagagaaau

SEQ ID NO: 142633 - RNA, 64 nt, hsa
caccgaaauaguuaauauuugaaauaagucuucaaaagaaaacauaagagauuauugaguucuu

SEQ ID NO: 142634 - RNA, 64 nt, hsa
aaagcuaauggaaauaaagcuaaugcucuaguugaaagaaaaggaaaacuccugaaauccuaga

SEQ ID NO: 142635 - RNA, 64 nt, hsa
aaacauuuuagacaaaaaguuucauuguacauucaaagaaaauguaaguuuggaaguacuaaaa

SEQ ID NO: 142636 - RNA, 64 nt, hsa
gagacuccaacucaaaaaaaaaaaaagaauaaagaaagaaaagugcgaugcccagucaaucaca

SEQ ID NO: 142637 - RNA, 64 nt, hsa
gcacagaggaauauuggcuggcaugcaaccugcaaaagaaaaaugcgaagcggccgggcacggu

SEQ ID NO: 142638 - RNA, 64 nt, hsa
gaacaguuuagucccaagagaauagcguuuuaaaaaagaaaaacaagauuuggagucauugugg

SEQ ID NO: 142639 - RNA, 64 nt, hsa
gaugcauuuuacauaauuaugaguuuguucauauaaagaaaagcuguggaaaagagucuuagag

SEQ ID NO: 142640 - RNA, 64 nt, hsa
aaaugaugcuguuuucucugcuaaagguaaaagaaaagaaaaaaauaguuggaaaauaagacau

SEQ ID NO: 142641 - RNA, 64 nt, hsa
cucuaaaaugaugcuguuuucucugcuaaagguaaaagaaaagaaaaaaauaguuggaaaauaa

SEQ ID NO: 142642 - RNA, 64 nt, hsa
ccuucaggaagauccuuuuccacaggaagcuaucaaagaaaaguaaacuagacaccaaguaaua

SEQ ID NO: 142643 - RNA, 64 nt, hsa
gaaauucacuucauuguaccccaugaccugagguaaagaaaauaauuuucaaauugcagacuuc

SEQ ID NO: 142644 - RNA, 64 nt, hsa
aagagugagaaagaauaaauuguuauuaagagcaaaagaaaaauaaagugauugaugauaguuc

SEQ ID NO: 142645 - RNA, 64 nt, hsa
uaguaggggcuuauugucucucaaaacuaaccuaaaagaaaaugacacauuuuauaauagaaua

SEQ ID NO: 142646 - RNA, 64 nt, hsa
acugcaccauguuaguaauaaacagaucugccuuaaagaaaagaaaauuuuagaaagaaauauu

SEQ ID NO: 142647 - RNA, 64 nt, hsa
accauguuaguaauaaacagaucugccuuaaagaaaagaaaauuuuagaaagaaauauuguugc

SEQ ID NO: 142648 - RNA, 64 nt, hsa
uuuagcauugcaugugaauaagaaaauaauguuuaaagaaaaaaaaaaaaaagcaaaccuccaa

SEQ ID NO: 142649 - RNA, 64 nt, hsa
gaaaauagacuaacuacuggagaaacaaagagagaaagaaaacccaguguuuccauaggggcac

SEQ ID NO: 142650 - RNA, 64 nt, hsa
cucacuauaguauaagaaucuauuuuggagaaaaaaagaaaauaugagggucucgaagcaugau

SEQ ID NO: 142651 - RNA, 64 nt, hsa
agaaucaaaacaaaagcaaaaaaaaaaagcaaaaaaagaaaagagaaaaaaagaaaaaaugcaa

SEQ ID NO: 142652 - RNA, 64 nt, hsa
gcaaaaaaaaaaagcaaaaaaagaaaagagaaaaaaagaaaaaaugcaaauggaauaauuuucu

SEQ ID NO: 142653 - RNA, 64 nt, hsa
cacacaccacuuaauggggaaauaguuaauuguuaaagaaaacuucuuguagccucacauuccc

SEQ ID NO: 142654 - RNA, 64 nt, hsa
uguauuuuucuuuuucuauaauaccuuuaacugcaaagaaaaggcaguuucaaauauaagaaau

SEQ ID NO: 142655 - RNA, 64 nt, hsa
uccagccugggugauagagcaagacugucucaaaaaagaaaaaaaagaaaaaauuuuaauuuaa

SEQ ID NO: 142656 - RNA, 64 nt, hsa
ggugauagagcaagacugucucaaaaaagaaaaaaaagaaaaaauuuuaauuuaauccuucugu

SEQ ID NO: 142657 - RNA, 64 nt, hsa
ugaaauuguaaaaccugucaaugauacagucccuaaagaaaaaaaaucauugcuuugaagcagu

SEQ ID NO: 142658 - RNA, 64 nt, hsa
guaugauguguugugauagcuaacauuuuaaauaaaagaaaaaauaucuugaagauuuuuguca

SEQ ID NO: 142659 - RNA, 64 nt, hsa
cuggcaacagagcaagagucugucucaaaaaaaaaaagaaaaaaagaaaaaaagaaaaaagaaa

SEQ ID NO: 142660 - RNA, 64 nt, hsa
agagcaagagucugucucaaaaaaaaaaagaaaaaaagaaaaaaagaaaaaagaaaaaucucau

SEQ ID NO: 142661 - RNA, 64 nt, hsa
agucugucucaaaaaaaaaaagaaaaaaagaaaaaaagaaaaaagaaaaaucucauuauuucaa

SEQ ID NO: 142662 - RNA, 64 nt, hsa
cucaaaaaaaaaaagaaaaaaagaaaaaaagaaaaaagaaaaaucucauuauuucaaaaugaua

SEQ ID NO: 142663 - RNA, 64 nt, hsa
cugggccacagugcaagacuccaucucaaaaaaaaaagaaaagaaaaagccuguuuaaugcaca

SEQ ID NO: 142664 - RNA, 64 nt, hsa
ccacagugcaagacuccaucucaaaaaaaaaagaaaagaaaaagccuguuuaaugcacaggugu

SEQ ID NO: 142665 - RNA, 64 nt, hsa
uaagaaagaaaggaaagaaggagaugaauagaagaaagaaaauggaaagaaggaaaaaaggagg

SEQ ID NO: 142666 - RNA, 64 nt, hsa
uuaauaguacaucauguaagauggcaacuguauuaaagaaaaauccggaaaacaaauguuugau

SEQ ID NO: 142667 - RNA, 64 nt, hsa
aaaacuugaauauaggugggagacauaagaaaggaaagaaaagacuuaaaacuggagugacagg

SEQ ID NO: 142668 - RNA, 64 nt, hsa
cacacauuuaauuccuauuaaguacagccgcaagaaagaaaaaaugaugaaguugcaaauggca

SEQ ID NO: 142669 - RNA, 64 nt, hsa
caugcauaaaagggucaaaccuguagaugcagaaaaagaaaaaaacuauaaauacaaaucugua

SEQ ID NO: 142670 - RNA, 64 nt, hsa
uuuuuccuuccucuguaagauaucccagcuuuaaaaagaaaaaaaaagaauuaccaagagaagg

SEQ ID NO: 142671 - RNA, 64 nt, hsa
auugacaauuaagugcuucuugcagcagguggucaaagaaaagcaugacuaauacgaccuauua

SEQ ID NO: 142672 - RNA, 64 nt, hsa
accuuuuuucaggggaagcauucagcaacccuuuaaagaaaaagaauuaaaugcaugcuuuaaa

SEQ ID NO: 142673 - RNA, 64 nt, hsa
aaaaugcuauuggcagggaauaauaauaaaaaaaaaagaaaaucauucuguuuccugcaguggg

SEQ ID NO: 142674 - RNA, 64 nt, hsa
cccacagaguagugaaucucucagccaaggagggaaagaaaaggaagaacucuugacuauuuag

SEQ ID NO: 142675 - RNA, 64 nt, hsa
aaauuauccuaguuaccaaguccuauuuggacauaaagaaaauccuacuuauagaaaaggagaa

SEQ ID NO: 142676 - RNA, 64 nt, hsa
acaagagcaaaacuccgucucaaaaaagaaaagaaaagaaaagaaaucauagggccaaguucaa

SEQ ID NO: 142677 - RNA, 64 nt, hsa
gggcaacaagagcaaaacuccgucucaaaaaagaaaagaaaagaaaagaaaucauagggccaag

SEQ ID NO: 142678 - RNA, 64 nt, hsa
agccugggcaacaagagcaaaacuccgucucaaaaaagaaaagaaaagaaaagaaaucauaggg

SEQ ID NO: 142679 - RNA, 64 nt, hsa
gaaauucuucaugaacauaacucugcugaauguaaaagaaaauuuuuuuucaaaaaugcuguua

SEQ ID NO: 142680 - RNA, 64 nt, hsa
uauuagacuucuaaauaaggugugaaaucaucaaaaagaaaaaucaaaguagaaacuacuaauu

SEQ ID NO: 142681 - RNA, 64 nt, hsa
gacuauuuuaucaaauuugccuuaaaauaaugaaaaagaaaaguauaguuaaugguuucaaaua

SEQ ID NO: 142682 - RNA, 64 nt, hsa
cauugcucguuucucaugcauucuacauaucuugaaagaaaagucugugagaaaacccugugau

SEQ ID NO: 142683 - RNA, 64 nt, hsa
uagagcuguagccacguaguuuucuacuuaauuuaaagaaaagaauuccuuaccuauaaaaaca

SEQ ID NO: 142684 - RNA, 64 nt, hsa
gaccucccgucucucucggaaaaaaaaaaagaaaaaagaaaaagccgggugaggugguguguac

SEQ ID NO: 142685 - RNA, 64 nt, hsa
acauggugaccucccgucucucucggaaaaaaaaaaagaaaaaagaaaaagccgggugaggugg

SEQ ID NO: 142686 - RNA, 64 nt, hsa
uuauuaaugggccaaugcaaaaaaucauuuuuucaaagaaaaauuuguccauguaaagcuuaaa

SEQ ID NO: 142687 - RNA, 64 nt, hsa
aaacagaaaaauaaaugauuuaaaaucaaaucaaaaagaaaaaacuaaacauuuaaacaaaaau

SEQ ID NO: 142688 - RNA, 64 nt, hsa
uuucuaaaaggaaaaauaauuuuaaguaaagaaaaaagaaaaaaaaggaagacuaaacagaaac

SEQ ID NO: 142689 - RNA, 64 nt, hsa
ggugaacuuucuaaaaggaaaaauaauuuuaaguaaagaaaaaagaaaaaaaaggaagacuaaa

SEQ ID NO: 142690 - RNA, 64 nt, hsa
cuggacguuugugcaguauugaaaagacaggagaaaagaaaacagaaaccugguuauaaccuga

SEQ ID NO: 142691 - RNA, 64 nt, hsa
uuggcuuuagauuuaaaguaaauugaaauguuuuaaagaaaaaaguauucacagauuuaauacc

SEQ ID NO: 142692 - RNA, 64 nt, hsa
uuucaauacaagccauaggcucacagaaaaagaaaaagaaaauaaaaauuaaauuaaaaaaaaa

SEQ ID NO: 142693 - RNA, 64 nt, hsa
cuaaaguuucaauacaagccauaggcucacagaaaaagaaaaagaaaauaaaaauuaaauuaaa

SEQ ID NO: 142694 - RNA, 64 nt, hsa
gcugccaguauccagcaguaucuggaccacaggcaaagaaaaccacuaggaccaccaggagcac

SEQ ID NO: 142695 - RNA, 64 nt, hsa
auguccuaguucaauguugacuuuuuuuuuuuuuaaagaaaagcauuaagacauaaaauucuuu

SEQ ID NO: 142696 - RNA, 64 nt, hsa
auagcuaaguacacaauaagcaaaaacaaaaagaaaagaaaauuuuuguaguagcguuuuuuaa

SEQ ID NO: 142697 - RNA, 64 nt, hsa
uaucuauagcuaaguacacaauaagcaaaaacaaaaagaaaagaaaauuuuuguaguagcguuu

SEQ ID NO: 142698 - RNA, 64 nt, hsa
ugucucagaucccagauucuaugaucccugcuuaaaagaaaauguucacugcauguagguugau

SEQ ID NO: 142699 - RNA, 64 nt, hsa
cagaagauaagccauguuucuguauuguacauguaaagaaaaauaaaacuguuuaugauacuug

SEQ ID NO: 142700 - RNA, 64 nt, hsa
aaaauauaauuaccuguaagguuaucugguuuuaaaagaaaaaaaaaaagccuacaaacucagu

SEQ ID NO: 142701 - RNA, 64 nt, hsa
ggcaacaagagugaaacuccaucuccaaaaaaaaaaagaaaaaguaacaaaaggaaauuauuug

SEQ ID NO: 142702 - RNA, 64 nt, hsa
guucaacuuuguggauuauuuuuccucugaaggaaaagaaaaggcuuaaugguuaggauuuuua

SEQ ID NO: 142703 - RNA, 64 nt, hsa
cuaguuuugaauuuacaccaagaacuucucaauaaaagaaaaucaugaaugcuccacaauuuca

SEQ ID NO: 142704 - RNA, 64 nt, hsa
auguuuucuuuaaguguuuaugguaaacucuuuuaaagaaaauuuaauauguuauagcugaauc

SEQ ID NO: 142705 - RNA, 64 nt, hsa
gcaugacauacuuuugcuuucaguaguuucauguaaagaaaaaaacuugaaaauaguaauaccu

SEQ ID NO: 142706 - RNA, 64 nt, hsa
aaucuaaaauaaaaaucgaaauaauuuuuuuaaaaaagaaaaagacaauaguauuacccauggg

SEQ ID NO: 142707 - RNA, 64 nt, hsa
ggaaugcauuuguuuccaugagugaaaagaggaaaaagaaaauggcugugcugcauugcaggaa

SEQ ID NO: 142708 - RNA, 64 nt, hsa
auuuaugagaauuuuggacaauuggaaagguagaaaagaaaagccaagaucauacuaaggacug

SEQ ID NO: 142709 - RNA, 64 nt, hsa
auaggaaacauuuuaguaugagcuucagugucacaaagaaaaccagaucucucucucuuuuuuu

SEQ ID NO: 142710 - RNA, 64 nt, hsa
ucauauuuuaauuuaaauuggauucaaccacaauaaagaaaaugagaaaagcuuucaacugugu

SEQ ID NO: 142711 - RNA, 64 nt, hsa
uuagguauaaaaccuacugcaacuuagaaaaaggaaagaaaaaagaaaacuuuuccaacugcug

SEQ ID NO: 142712 - RNA, 64 nt, hsa
uaaaaccuacugcaacuuagaaaaaggaaagaaaaaagaaaacuuuuccaacugcugcauuaag

SEQ ID NO: 142713 - RNA, 64 nt, hsa
gaugacacaucauuuugacauuaucaauaggagaaaagaaaacuaacccuucuucugauuguuu

SEQ ID NO: 142714 - RNA, 64 nt, hsa
ucauuuaagugcuguuuguucuuaaaaugcauuuaaagaaaaauuacccauauugacuuucaca

SEQ ID NO: 142715 - RNA, 64 nt, hsa
aggaauaauauugugaaaaugaaucuguuaugauaaagaaaaaauaaaguggaaacuuuuagag

SEQ ID NO: 142716 - RNA, 64 nt, hsa
uaguagaaaaggaaacuaguagggccaaaaaaaaaaagaaaaagaaaaagaaaaaagaaaaaaa

SEQ ID NO: 142717 - RNA, 64 nt, hsa
aaaaggaaacuaguagggccaaaaaaaaaaagaaaaagaaaaagaaaaaagaaaaaaaaagaaa

SEQ ID NO: 142718 - RNA, 64 nt, hsa
aaacuaguagggccaaaaaaaaaaagaaaaagaaaaagaaaaaagaaaaaaaaagaaaaaacug

SEQ ID NO: 142719 - RNA, 64 nt, hsa
uagggccaaaaaaaaaaagaaaaagaaaaagaaaaaagaaaaaaaaagaaaaaacugggaccua

SEQ ID NO: 142720 - RNA, 64 nt, hsa
aaaaaaaagaaaaagaaaaagaaaaaagaaaaaaaaagaaaaaacugggaccuaaguauaaaua

SEQ ID NO: 142721 - RNA, 64 nt, hsa
cuacuuaaaacuuugguuguuuuccuguaauauaaaagaaaaaguuaauuuaucaauugauuga

SEQ ID NO: 142722 - RNA, 64 nt, hsa
auuucuugcaauuugaagguacgaguagagguuuaaagaaaaaucaguuuuuguucuuaaaaau

SEQ ID NO: 142723 - RNA, 64 nt, hsa
agaauaacaacugcugggaauauccgugccaggaaaagaaaaauuucuggcaaauauuuuguca

SEQ ID NO: 142724 - RNA, 64 nt, hsa
uaauugaacccauccacucugggcagguaagagaaaagaaaaagauaaggaaagaagagagaag

SEQ ID NO: 142725 - RNA, 64 nt, hsa
aucacuacagaccaaaacagaagaagaagaaaaaaaagaaaaagaaaucuaagcaacaugguaa

SEQ ID NO: 142726 - RNA, 64 nt, hsa
gaauaaugggagaaugugcggguuaucauuuuucaaagaaaauuauucucaucucaaugccaaa

SEQ ID NO: 142727 - RNA, 64 nt, hsa
acugauuugugaugucaauaggauggcaccuuggaaagaaaaaugaagaacaacuuuaucaagg

SEQ ID NO: 142728 - RNA, 64 nt, hsa
auaggguggagaaggaggaguuaucuccacuccaaaagaaaaaaaaaaaguuuuuuaccuuaca

SEQ ID NO: 142729 - RNA, 64 nt, hsa
aaagauauucucuauguuuuguaaguaaaaacaaaaagaaaaccuuucuuuuguuuuuuacaca

SEQ ID NO: 142730 - RNA, 64 nt, hsa
uauuuucgaagaggagcaacugaacacuggaggaaaagaaaaugacacuuucugcuuuacagaa

SEQ ID NO: 142731 - RNA, 64 nt, hsa
agugaguacauuaaguaaaauaaaauggaccagaaaagaaaagaaaccauaaauaucgugucau

SEQ ID NO: 142732 - RNA, 64 nt, hsa
gaccaucucuguaggaucguaaaaaaauagaaaaaaagaaaaaaaaaagaaagaaagagggaaa

SEQ ID NO: 142733 - RNA, 64 nt, hsa
uuuuuuaaaguaguuccuauuuucuaucccccuuaaagaaaauugcaugaaacuaggcuucugu

SEQ ID NO: 142734 - RNA, 64 nt, hsa
aauuagguuugaauugcuuuuuaaaaaaaaaagaaaagaaaaagacagcaucucacuauguugc

SEQ ID NO: 142735 - RNA, 64 nt, hsa
ggaagaauuagguuugaauugcuuuuuaaaaaaaaaagaaaagaaaaagacagcaucucacuau

SEQ ID NO: 142736 - RNA, 64 nt, hsa
caacgggcgagacucugucucaaaaaaaagaaagaaagaaaagguacauguauauauuuguccu

SEQ ID NO: 142737 - RNA, 64 nt, hsa
uuuguagugcuaugaaauuuauuuacauacuuauaaagaaaacuguauguucacuugaacucug

SEQ ID NO: 142738 - RNA, 64 nt, hsa
aauuuuuuuaagacucugucuuaaaaaaaacuaaaaagaaaaaaagaagccccuucacucuaca

SEQ ID NO: 142739 - RNA, 64 nt, hsa
auccaugugggcuuccuggaaagaaaaaaaaaaaaaagaaaacuaggcaugaaaucaguuuaac

SEQ ID NO: 142740 - RNA, 64 nt, hsa
ccucaucugucagaaauccaugugggcuuccuggaaagaaaaaaaaaaaaaagaaaacuaggca

SEQ ID NO: 142741 - RNA, 64 nt, hsa
ucaauaccaaauacaguaaaaacaaauguaaauaaaagaaaacacaucaucaauaaaacuguua

SEQ ID NO: 142742 - RNA, 64 nt, hsa
cugccugagggcuugcauagcuuucacauuaaaaaaagaaaaagcuagcagauuuacuccuuuu

SEQ ID NO: 142743 - RNA, 64 nt, hsa
caucuaaaaaugaaaggugaguaaccagauagcaaaagaaaagggaaagccauccaaauuugaa

SEQ ID NO: 142744 - RNA, 64 nt, hsa
auuauucucuuguaaaagaaaaggaaaaauuaguaaagaaaaaaguuuuaguugauguuaccug

SEQ ID NO: 142745 - RNA, 64 nt, hsa
uuuguaguauaauauuaaugauuauucucuuguaaaagaaaaggaaaaauuaguaaagaaaaaa

SEQ ID NO: 142746 - RNA, 64 nt, hsa
uuguguaaucuuuuaaaaauauuaucuugcagauaaagaaaaaaauuaagaguguguuuacaac

SEQ ID NO: 142747 - RNA, 64 nt, hsa
uaaaacugauaauaucuguaaugacaucagaaugaaagaaaaaaaauuguacaguguauauucc

SEQ ID NO: 142748 - RNA, 64 nt, hsa
uuuuauuccugggggggaucaugcuacacucucaaaagaaaauuaagaaaucauucagaucauc

SEQ ID NO: 142749 - RNA, 64 nt, hsa
uuguaacuuuacaguuaaacuaguuuuaguuuaaaaagaaaaaaugcagggugauuucuuauua

SEQ ID NO: 142750 - RNA, 64 nt, hsa
uucuaaaaacuucucaacuguuuucauuuaagggaaagaaaaugaguauuuuguccuuuugugu

SEQ ID NO: 142751 - RNA, 64 nt, hsa
gcaaaacuauuauauguaagggaaauauauacaaaaagaaaauuaaucauagucaccugacuaa

SEQ ID NO: 142752 - RNA, 64 nt, hsa
acauuuccauucauggauauuugucaacagauuuaaagaaaaccacaguuauuaauuaaagaaa

SEQ ID NO: 142753 - RNA, 64 nt, hsa
ucaacagauuuaaagaaaaccacaguuauuaauuaaagaaaauuaauuauguguaguuauaaac

SEQ ID NO: 142754 - RNA, 64 nt, hsa
uguagucaaaaugcuacaauaaaacaaaaaagagaaagaaaaugaagagcauuugacucccgca

SEQ ID NO: 142755 - RNA, 64 nt, hsa
ugacaaaagccuuuaguuguguuucuugaacuauaaagaaaacaaauuuuggcagucuuuaagu

SEQ ID NO: 142756 - RNA, 64 nt, hsa
ucucuguucaucccuuccuauaaccucuagguaaaaagaaaagaaaaaaagaaauuucgagaua

SEQ ID NO: 142757 - RNA, 64 nt, hsa
guucaucccuuccuauaaccucuagguaaaaagaaaagaaaaaaagaaauuucgagauauuuuc

SEQ ID NO: 142758 - RNA, 64 nt, hsa
cuacuuucaaguaaauauagcauuccuuuggcaaaaagaaaaaaaaaguaaaagaaaagaaaaa

SEQ ID NO: 142759 - RNA, 64 nt, hsa
auagcauuccuuuggcaaaaagaaaaaaaaaguaaaagaaaagaaaaaaaauguauuaccaccc

SEQ ID NO: 142760 - RNA, 64 nt, hsa
auuccuuuggcaaaaagaaaaaaaaaguaaaagaaaagaaaaaaaauguauuaccacccgauga

SEQ ID NO: 142761 - RNA, 64 nt, hsa
ggauuccuuuuggaucaaucagaaaggaaacacgaaagaaaagucaggaagguagagagagaaa

SEQ ID NO: 142762 - RNA, 64 nt, hsa
uuugcugagcaaccaguguguuucaggaugauacaaagaaaaauauagaauagaaauaagugca

SEQ ID NO: 142763 - RNA, 64 nt, hsa
ucuggaugagaaaauuuucaauucuggccaugagaaagaaaaaaaaauaaacagccuucuuuuu

SEQ ID NO: 142764 - RNA, 64 nt, hsa
cugggugacaagagugaaacuccaucucaaaaaaaaagaaaagaagguccagcuuuuggauuca

SEQ ID NO: 142765 - RNA, 64 nt, hsa
cccgggugacaaagcaagacccugucucagaaaaaaagaaaauucaaggccaguuaagacaaaa

SEQ ID NO: 142766 - RNA, 64 nt, hsa
guauggaaucaacaccaccgagcucugugggaaaaaagaaaaaccugcucccuucgcucugcug

SEQ ID NO: 142767 - RNA, 64 nt, hsa
caacauguaucugucuacuuucucuuguuuaaaaaaagaaaaaaaaacuuaaaaaaaugggguu

SEQ ID NO: 142768 - RNA, 64 nt, hsa
cuccagccugggugacagagcgagacuguguuucaaagaaaaaaaaaaacaagcagccuuuugc

SEQ ID NO: 142769 - RNA, 64 nt, hsa
uccauguacucagauaaacaugaagaaaauaagcaaagaaaaauggagacugggaaagcaaagc

SEQ ID NO: 142770 - RNA, 64 nt, hsa
cuuaaaaaaagaaaaaaugaaaaaaaaaggaaaaaaagaaaaaaggaaaaaaacaguuugaaca

SEQ ID NO: 142771 - RNA, 64 nt, hsa
uuuccaguguguaacccaguuugaaaucuuaaaaaaagaaaaaaugaaaaaaaaaggaaaaaaa

SEQ ID NO: 142772 - RNA, 64 nt, hsa
acacaaaacugccaacuuugcacaaguuuccagaaaagaaaauacaauuagucacucaacauaa

SEQ ID NO: 142773 - RNA, 64 nt, hsa
ucauuuauguuagcauuaaugcacauuuuuaaaaaaagaaaaaaacauggucuuguuuuuacua

SEQ ID NO: 142774 - RNA, 64 nt, hsa
caugacuguugccugcaaaaauaaaagggaaaaaaaagaaaaaagaaacaaaaaggaacuucuu

SEQ ID NO: 142775 - RNA, 64 nt, hsa
aauuuuugaaagacuauugcagguguuuaaaaagaaagaaaaguuguuuuaucuaauacuguaa

SEQ ID NO: 142776 - RNA, 64 nt, hsa
ugaaggagaaggaggguaguguuuugcaaaagaaaaagaaaagaaccaacagaauuuuaacucu

SEQ ID NO: 142777 - RNA, 64 nt, hsa
agaugcugaaggagaaggaggguaguguuuugcaaaagaaaaagaaaagaaccaacagaauuuu

SEQ ID NO: 142778 - RNA, 64 nt, hsa
auuucuaaguuaaaucauuuucauuaaaaggaaaaaagaaaaaaaauuuuguaugucaauaacu

SEQ ID NO: 142779 - RNA, 64 nt, hsa
aaauuuacagaauauuauauaacccacugcugaaaaagaaaaaaaugauuguuuuagaaguuaa

SEQ ID NO: 142780 - RNA, 64 nt, hsa
uucacuaauacuuacuguuaacugucuugagagaaaagaaaaauaugagagaacuauuguuugg

SEQ ID NO: 142781 - RNA, 64 nt, hsa
uuauuugucaaguaauaugaucuuggaaaauuuuaaagaaaaauaauccuacuuauaaacuacu

SEQ ID NO: 142782 - RNA, 64 nt, hsa
uuaccaugguuucuacaaaaauaaccuucaggaaaaagaaaaucaggaaaaaaauuuuuuuuca

SEQ ID NO: 142783 - RNA, 64 nt, hsa
auuacaggcugcauucuugccuuacuguauagaaaaagaaaaaaggcuggguuuacuauugcac

SEQ ID NO: 142784 - RNA, 64 nt, hsa
ucuucuguacaucuuacuggguuuaauuaaaaaaaaagaaaaaacucuguuguaaaaacaguuu

SEQ ID NO: 142785 - RNA, 64 nt, hsa
cccaugaaauggcuugauguauucuagacuacugaaagaaaaccacuucaaagauuuuguugaa

SEQ ID NO: 142786 - RNA, 64 nt, hsa
aaaugcaagagggaaggugauugguagugaguuaaaagaaaaagagaggaaaagagaguaguuu

SEQ ID NO: 142787 - RNA, 64 nt, hsa
uuccuuucacuggccacaguuguuugaugcauuaaaagaaaauaaaaaaaagaaaaaagagaaa

SEQ ID NO: 142788 - RNA, 64 nt, hsa
cacaguuguuugaugcauuaaaagaaaauaaaaaaaagaaaaaagagaaaagaaaaaaaaagaa

SEQ ID NO: 142789 - RNA, 64 nt, hsa
gcauuaaaagaaaauaaaaaaaagaaaaaagagaaaagaaaaaaaaagaaaaaaguuguaggcg

SEQ ID NO: 142790 - RNA, 64 nt, hsa
aaaauaaaaaaaagaaaaaagagaaaagaaaaaaaaagaaaaaaguuguaggcgaaucauuugu

SEQ ID NO: 142791 - RNA, 64 nt, hsa
uuguguucagcaaaaugugauguuuuuuucuuuuaaagaaaaaaagugaaaauauauagugcca

SEQ ID NO: 142792 - RNA, 64 nt, hsa
cgguuugacuacuuuguucuuugguuaagauccaaaagaaaacagaaaacaauuccacgaggcc

SEQ ID NO: 142793 - RNA, 64 nt, hsa
uugaaggugugaugguagaaauaggaaaacaacaaaagaaaaacaauaacaaaaaaagaaagug

SEQ ID NO: 142794 - RNA, 64 nt, hsa
aauaaauaaauagaaagagagagagaggaaaaaaaaagaaaagaacacuucuuuauuugaggga

SEQ ID NO: 142795 - RNA, 64 nt, hsa
caaauauuuugccucauuauucuuguuuuaaaagaaagaaaacaggccgggcacaguggcucau

SEQ ID NO: 142796 - RNA, 64 nt, hsa
gggugacagagggagacucugucucgaaagaaagaaagaaaaaaaggaaggaaggagaaggaag

SEQ ID NO: 142797 - RNA, 64 nt, hsa
guaccugaucaggaucugggagaauuugaaaaaaaaagaaaaacuagaaaaauaaacaaaauua

SEQ ID NO: 142798 - RNA, 64 nt, hsa
aaaaaagaaaaacuagaaaaauaaacaaaauuaaaaagaaaaaaaaauaccugagacugaguaa

SEQ ID NO: 142799 - RNA, 64 nt, hsa
aauaccugaguggaguauucaaaaacuugcuuagaaagaaaacucuaggaacagauggcuucac

SEQ ID NO: 142800 - RNA, 64 nt, hsa
ccuggaagacagagugagaccccaucucaggaaaaaagaaaaaaaaaaagaugucauucagcag

SEQ ID NO: 142801 - RNA, 64 nt, hsa
guuaaaucuaagaccucaaacuaugaaacagcuaaaagaaaacaucggggaaucucuccaggac

SEQ ID NO: 142802 - RNA, 64 nt, hsa
caaagaagaagaaaaacaccaaaaccacaagggaaaagaaaaacccaguuucuuaggaaacgca

SEQ ID NO: 142803 - RNA, 64 nt, hsa
cagauuauuuggauaaguccuuuuuaagaaaaaaaaagaaaaugaaaaacaacacaaaaaaaau

SEQ ID NO: 142804 - RNA, 64 nt, hsa
acauguuagaauaguuuaccauaauuaccaaggaaaagaaaaguaaaauuaccuuagaagaaaa

SEQ ID NO: 142805 - RNA, 64 nt, hsa
aauuuuuuaaacguguucucgggaaguuagggcuaaagaaaauuuugauaaaacaauuuuccca

SEQ ID NO: 142806 - RNA, 64 nt, hsa
ucaucuacgauucaacuaaucgaaggauuaaacuaaagaaaaaacuaagaagaacaaugaaccu

SEQ ID NO: 142807 - RNA, 64 nt, hsa
aguggucccuuuugaauuucaugagccucucaaaaaagaaaaacuuaaaaaaaaaaaaaaaaaa

SEQ ID NO: 142808 - RNA, 64 nt, hsa
ccccgcaaaaaaaaaaaagaaagaaagaaagagaaaagaaaagaaaagcaaccacagccagccu

SEQ ID NO: 142809 - RNA, 64 nt, hsa
caaaaaaaaaaaagaaagaaagaaagagaaaagaaaagaaaagcaaccacagccagccuuaggg

SEQ ID NO: 142810 - RNA, 64 nt, hsa
agacugaucauuccucuggguuaucugcaucucaaaagaaaaugcuuacccacaggaacuguua

SEQ ID NO: 142811 - RNA, 64 nt, hsa
gugucccugaugcugcuggaggcugcuguggcacaaagaaaagcugcuaaaucuauagccaacc

SEQ ID NO: 142812 - RNA, 64 nt, hsa
aaauguuuuuuucuuuuuucuuuuuuuuugcaauaaagaaaacaaauuaaucauaaacaucuuu

SEQ ID NO: 142813 - RNA, 64 nt, hsa
aacuggacuuuaagaacuggaaagagguuuuacaaaagaaaaacuuucagauucaucucucauu

SEQ ID NO: 142814 - RNA, 64 nt, hsa
aaacuguauuuuucucuuaguauugcuaaugaguaaagaaaagucucauaagguagccaaauga

SEQ ID NO: 142815 - RNA, 64 nt, hsa
uuccccuuccauucccaacucucucucucuuuuuaaagaaaaaugcuaagggcagcccugccug

SEQ ID NO: 142816 - RNA, 64 nt, hsa
agagacaauuuaaggccugcacucuuauuucacuaaagaaaaacuaaugucagcacauguugcu

SEQ ID NO: 142817 - RNA, 64 nt, hsa
augggguaaauacccgauagcugucuuuuuggugaaagaaaaggugcauuucaagaacuugggg

SEQ ID NO: 142818 - RNA, 64 nt, hsa
ccagccugagcaacagagcgacucugucuccaaaaaagaaaaaaaguaccccauguucagcccc

SEQ ID NO: 142819 - RNA, 64 nt, hsa
uaaaauuauaucacaaauauauaugcuuccagacaaagaaaaguuuguuaguccugauuuucua

SEQ ID NO: 142820 - RNA, 64 nt, hsa
auaauggccagaaaauauuguauugcuuggcagaaaagaaaauaaggucuaaaggaaaguagca

SEQ ID NO: 142821 - RNA, 64 nt, hsa
ccagagcuucauucuccuggcuuuuagguuuguaaaagaaaaagggauaucuuuuuuauauuuu

SEQ ID NO: 142822 - RNA, 64 nt, hsa
aauggcaugauuuuuuuuaugcaaaaagaaaagaaaagaaaaccacccacauuuuaauuuagca

SEQ ID NO: 142823 - RNA, 64 nt, hsa
acauuaauggcaugauuuuuuuuaugcaaaaagaaaagaaaagaaaaccacccacauuuuaauu

SEQ ID NO: 142824 - RNA, 64 nt, hsa
uccacacauuaauggcaugauuuuuuuuaugcaaaaagaaaagaaaagaaaaccacccacauuu

SEQ ID NO: 142825 - RNA, 64 nt, hsa
cacuacaguccagccugggugacagagaaaagaaaaagaaaacauuacauaauuuggcuagagc

SEQ ID NO: 142826 - RNA, 64 nt, hsa
uuguuccacuacaguccagccugggugacagagaaaagaaaaagaaaacauuacauaauuuggc

SEQ ID NO: 142827 - RNA, 64 nt, hsa
gccucuagcauuuuaaauuauuuuuauuuauuagaaagaaaauauauuuuuucuuuucauuguc

SEQ ID NO: 142828 - RNA, 64 nt, hsa
gucugccuugaauauugcuuccauguauuuuggaaaagaaaaugauuucauuuauaaaugaaca

SEQ ID NO: 142829 - RNA, 64 nt, hsa
guacuguuuguauaaaaaauagaaaaaaaaaagaaaagaaaaaaggcauaaaucuuuauugcag

SEQ ID NO: 142830 - RNA, 64 nt, hsa
uguuuguacuguuuguauaaaaaauagaaaaaaaaaagaaaagaaaaaaggcauaaaucuuuau

SEQ ID NO: 142831 - RNA, 64 nt, hsa
gaucuuuugcaauaccucaauuuugaaauauaggaaagaaaaugauauuuucuaaguaaguuua

SEQ ID NO: 142832 - RNA, 64 nt, hsa
uagaauagguuacuacaaaaaagguuauauucugaaagaaaaauaacugacauuauauauaacc

SEQ ID NO: 142833 - RNA, 64 nt, hsa
cuccuuaucuuuugcagucucucugggaucaguaaaagaaaaaaaaaauaaugugcuuaagaag

SEQ ID NO: 142834 - RNA, 64 nt, hsa
gcaagacccugucucuaaagaaaaaaaaaaaguaaaagaaaaauaaagcacgucuuggcucagc

SEQ ID NO: 142835 - RNA, 64 nt, hsa
accagccugggcaacauagcaagacccugucucuaaagaaaaaaaaaaaguaaaagaaaaauaa

SEQ ID NO: 142836 - RNA, 64 nt, hsa
gggcuuuuuuuuccucucaaaaaaaaaaaaagaaaaagaaaaagaggaagaagcagcuuugcug

SEQ ID NO: 142837 - RNA, 64 nt, hsa
uccagugggcuuuuuuuuccucucaaaaaaaaaaaaagaaaaagaaaaagaggaagaagcagcu

SEQ ID NO: 142838 - RNA, 64 nt, hsa
gcacaaagcaaccgccaaauuguuucagagcagaaaagaaaaagggagaaaaccucuuagcaaa

SEQ ID NO: 142839 - RNA, 64 nt, hsa
aggaagggagaagguggcauaacuuuuuggaacaaaagaaaacacaaaauccuagcuugggauu

SEQ ID NO: 142840 - RNA, 64 nt, hsa
aagaaaauuuaaauaaaggggaaguccacauuaaaaagaaaacaaaacaaacccuaacuaacuu

SEQ ID NO: 142841 - RNA, 64 nt, hsa
auuuuuguagccaguuuugugaauuuguacacugaaagaaaauuuaaauaaaggggaaguccac

SEQ ID NO: 142842 - RNA, 64 nt, hsa
gcauuaauuuuguguguuuagaguucuguugucaaaagaaaacuaaugaauaaauuaguuuguc

SEQ ID NO: 142843 - RNA, 64 nt, hsa
uugcgcaaaaauuguuaaauccuuugucuuuauuaaagaaaaauuugaguaacauuaaguuuga

SEQ ID NO: 142844 - RNA, 64 nt, hsa
aagacucauuuguguggaugcgugaccaugggaaaaagaaaaaaaaaaagauccauuuuuuagg

SEQ ID NO: 142845 - RNA, 64 nt, hsa
ucacauuggaugacaccauguucuuccucuuugaaaagaaaaggggaaugugucccacuaguga

SEQ ID NO: 142846 - RNA, 64 nt, hsa
augcaugaauauaaaucuauauuauuugcuaaaaaaagaaaaaacauuuguguuuuaguuucuu

SEQ ID NO: 142847 - RNA, 64 nt, hsa
cccguuaggguuuaaaaccauauugaucaacuagaaagaaaaauaugaaaagagaaaaauauuu

SEQ ID NO: 142848 - RNA, 64 nt, hsa
ucugauacuuuugaaacagaugugaaaaacagaaaaagaaaaaauugucugaaauguuuauuuu

SEQ ID NO: 142849 - RNA, 64 nt, hsa
gcucugaguuuucagcaccaguagauuuguauuaaaagaaaaaaaaauggggccuuagcuucug

SEQ ID NO: 142850 - RNA, 64 nt, hsa
acaaauagccaucugcuaucagcaucauuauguaaaagaaaauauauuuuagccccuaaaauua

SEQ ID NO: 142851 - RNA, 64 nt, hsa
ugggggacuggacgcugcuauugauucauuaaaaaaagaaaagaaaaauacaccaaggcuccau

SEQ ID NO: 142852 - RNA, 64 nt, hsa
gacuggacgcugcuauugauucauuaaaaaaagaaaagaaaaauacaccaaggcuccauguucc

SEQ ID NO: 142853 - RNA, 64 nt, hsa
gggagagacugaauuguuaguaggucuaaacaucaaagaaaacauuuuuauuaguuacuuaugg

SEQ ID NO: 142854 - RNA, 64 nt, hsa
ucuggucauuugucuaaauaggaauggaaaauuaaaagaaaagcaacaauccaaucuuuuuucu

SEQ ID NO: 142855 - RNA, 64 nt, hsa
auaugcuauauacagcuuaacucacagaacuguaaaagaaaauuauaaaauaauucaacauguc

SEQ ID NO: 142856 - RNA, 64 nt, hsa
gcaugguauuaaacuaucauagaaguagacagaaaaagaaaaaaggacucauggcauuauuaau

SEQ ID NO: 142857 - RNA, 64 nt, hsa
acuuuuuaaaaaguaacuuuuuuaauaauauaagaaagaaaaaugcccuuucacacugaaucuu

SEQ ID NO: 142858 - RNA, 64 nt, hsa
auauggcaagagcccaacucuacuaaaaauacaaaaagaaaagaaaacagccaagcuugguggu

SEQ ID NO: 142859 - RNA, 64 nt, hsa
gcaagagcccaacucuacuaaaaauacaaaaagaaaagaaaacagccaagcuuggugguaugug

SEQ ID NO: 142860 - RNA, 64 nt, hsa
uccaaccugagugacagagcaacacucugucuuaaaagaaaaaaaaaaaagagagagauaguaa

SEQ ID NO: 142861 - RNA, 64 nt, hsa
aguaaucucuugggcaaaagguaucaaauaauugaaagaaaaguuuaaacacauuuccgagagg

SEQ ID NO: 142862 - RNA, 64 nt, hsa
gaccaaaccaugcacauaaagcuuguaguuuaaaaaagaaaagcaaaaaaauaauuaugccuga

SEQ ID NO: 142863 - RNA, 64 nt, hsa
uuuaccuggaaauuccaugaccaauacaugugcaaaagaaaaugauggguugaauuuacugauu

SEQ ID NO: 142864 - RNA, 64 nt, hsa
uaaauuuuugcuaaggauguauuuugauuauugaaaagaaaauuucuauuuaaacuguaaauau

SEQ ID NO: 142865 - RNA, 64 nt, hsa
gaaaucaagucugucaaguacaauaacauuuuuaaaagaaaauggaucccacuguuccucuuug

SEQ ID NO: 142866 - RNA, 64 nt, hsa
cugggugacagagcaagacucccucucaaaagaaaaagaaaaaagauguaaaaaccauucuuag

SEQ ID NO: 142867 - RNA, 64 nt, hsa
uccagccugggugacagagcaagacucccucucaaaagaaaaagaaaaaagauguaaaaaccau

SEQ ID NO: 142868 - RNA, 64 nt, hsa
uggaaaacaccccaaccccggaaaugugugggaaaaagaaaacaaaaacuuuccaaauuccaac

SEQ ID NO: 142869 - RNA, 64 nt, hsa
ccucaggcuucucuuacgaagaggaaacgcaaaaaaagaaaaggaaaaaccccgugcucgcccc

SEQ ID NO: 142870 - RNA, 64 nt, hsa
uuuuuuacuguaaguauggaucaaauugcaaaauaaagaaaaaugccaaccuuagaaaagacaa

SEQ ID NO: 142871 - RNA, 64 nt, hsa
aaaacugcuauuaucagcaucauaguuucucuaaaaagaaaacuuggggaucauagccgauaga

SEQ ID NO: 142872 - RNA, 64 nt, hsa
agaggugguuuuugaaagagcaagaggaaagaaaaaagaaaagaaggaaagaagaauaaagaag

SEQ ID NO: 142873 - RNA, 64 nt, hsa
aguuccaagaggugguuuuugaaagagcaagaggaaagaaaaaagaaaagaaggaaagaagaau

SEQ ID NO: 142874 - RNA, 64 nt, hsa
aauucccaucucuauacuucuccuuuggacauggaaagaaaaguuauugcuggugcaaagauag

SEQ ID NO: 142875 - RNA, 64 nt, hsa
gcuauuuguuaaaauauuugccuuuuuaaguaaaaaagaaaaaucagaacagggcuauuugaag

SEQ ID NO: 142876 - RNA, 64 nt, hsa
acagaguaauguuuuuuuucuuauuuucccaaagaaagaaaagggggaaaauauauuuguaugu

SEQ ID NO: 142877 - RNA, 64 nt, hsa
cagguuuaaacuggacuuagcuugaguuaaaggcaaagaaaaucuaaaaacauaaauguuauau

SEQ ID NO: 142878 - RNA, 64 nt, hsa
ucuucccuuuagugauuucaguaguuuauauuggaaagaaaaacaauuacaacaugugcccuua

SEQ ID NO: 142879 - RNA, 64 nt, hsa
cauuugaucuauagcaaugugauuuuauuuuuaaaaagaaaagcaguguguuuucuuuuuuugu

SEQ ID NO: 142880 - RNA, 64 nt, hsa
gcgacagugcaagacucugucuccaaaaaaaaaaaaagaaaaaagaaaaucccccuucaucccc

SEQ ID NO: 142881 - RNA, 64 nt, hsa
ugcaagacucugucuccaaaaaaaaaaaaagaaaaaagaaaaucccccuucaucccccaggacu

SEQ ID NO: 142882 - RNA, 64 nt, hsa
caaaauaccccaacacaggcgggggagagacgaaaaagaaaaggaaagagcaagauagacaaaa

SEQ ID NO: 142883 - RNA, 64 nt, hsa
aaagagcaagauagacaaaagccaaucagcuuaaaaagaaaaacaaggaaggggaaaagaaaac

SEQ ID NO: 142884 - RNA, 64 nt, hsa
ccaaucagcuuaaaaagaaaaacaaggaaggggaaaagaaaacucuugcgauuugggaggguuc

SEQ ID NO: 142885 - RNA, 64 nt, hsa
auacuaccuaaagggaaccugcaauaaucuugaaaaagaaaaagagaaaaauuuuaaaauccug

SEQ ID NO: 142886 - RNA, 64 nt, hsa
cugucuugaauucucuguuuaugcaaugugcucgaaagaaaaaaauguuaaaaauauaucuaua

SEQ ID NO: 142887 - RNA, 64 nt, hsa
cuacuauaaaaauauuugcauauauaaguuugacaaagaaaagaaaaucaauguuaaaccauua

SEQ ID NO: 142888 - RNA, 64 nt, hsa
auaaaaauauuugcauauauaaguuugacaaagaaaagaaaaucaauguuaaaccauuaaaucu

SEQ ID NO: 142889 - RNA, 64 nt, hsa
acaaagauuauauaugacaaucaguauugcaaugaaagaaaaacuaaaaacagaaaugauauuc

SEQ ID NO: 142890 - RNA, 64 nt, hsa
uacacugcacauguacaaagaaugucuucagaucaaagaaaauuuaucucuuuuuauaaacuua

SEQ ID NO: 142891 - RNA, 64 nt, hsa
ggagcaugaucuaaguacauagcacaugugaauaaaagaaaagcugacaguauauucugguuuc

SEQ ID NO: 142892 - RNA, 64 nt, hsa
uuuuaaagcugcucauuucauuuuguccaaccaaaaagaaaagggagauaacuaaugagcuucu

SEQ ID NO: 142893 - RNA, 64 nt, hsa
guauuauuuugcuacuuaccguguuauucuguggaaagaaaaaccuguaaaguguuuaauaaau

SEQ ID NO: 142894 - RNA, 64 nt, hsa
gucaacauuuaugaaauauugccugacuauuuaaaaagaaaaaaguagcucuccauuaucaccu

SEQ ID NO: 142895 - RNA, 64 nt, hsa
uaaacagacaguauuguaaucccaucaaaagaugaaagaaaaacaaaaacaaaaaccaacaaca

SEQ ID NO: 142896 - RNA, 64 nt, hsa
ucaaagacuacaucagagauucaaauagguuuuuaaagaaaagcuaagcaagagagccaaauuu

SEQ ID NO: 142897 - RNA, 64 nt, hsa
uaucuuuuaacauuuugggggacuuuccaguugaaaagaaaacaugcuaugucauuuuuaucca

SEQ ID NO: 142898 - RNA, 64 nt, hsa
aaagaaccaucaucuuguggcacaaaaaaagaagaaagaaaagaaaacuucaagguuuugugag

SEQ ID NO: 142899 - RNA, 64 nt, hsa
accaucaucuuguggcacaaaaaaagaagaaagaaaagaaaacuucaagguuuugugagaagca

SEQ ID NO: 142900 - RNA, 64 nt, hsa
uuccuuugcuccaauaagcuuugcaaucaaggccaaagaaaaugaucugcuuccccuggaaaaa

SEQ ID NO: 142901 - RNA, 64 nt, hsa
gagcaaaagcaaagauccaccgagagaagaagagaaagaaaagaaaaagaaaaagcacaaaaaa

SEQ ID NO: 142902 - RNA, 64 nt, hsa
aaagcaaagauccaccgagagaagaagagaaagaaaagaaaaagaaaaagcacaaaaaaagauc

SEQ ID NO: 142903 - RNA, 64 nt, hsa
aagauccaccgagagaagaagagaaagaaaagaaaaagaaaaagcacaaaaaaagaucucgaac

SEQ ID NO: 142904 - RNA, 64 nt, hsa
auuuuuuuucuuuguaaugcaccugacagaaaaaaaagaaaaaugaauuucucuuuacuucucu

SEQ ID NO: 142905 - RNA, 64 nt, hsa
aauguguuuuguuguuuugugcuacaauuuuuaaaaagaaaaaaguuuuguuuuguuuuuuggg

SEQ ID NO: 142906 - RNA, 64 nt, hsa
gcugacuaauagaccucagccucaaaaggcuuggaaagaaaaaacaaauacaacaagcaaacaa

SEQ ID NO: 142907 - RNA, 64 nt, hsa
ucacucuccccaaaauauuauauuuuuucuauaaaaagaaaaaaauggaaaaaaauuacaaggc

SEQ ID NO: 142908 - RNA, 64 nt, hsa
cuucuauacauuaguucgagaaauucgaaaacauaaagaaaagaugagcaaagaugguaaaaag

SEQ ID NO: 142909 - RNA, 64 nt, hsa
aacacaaauaagcagaaaacauacuuauuuuaaaaaagaaaaaaaaggauaaaaaaacccaaac

SEQ ID NO: 142910 - RNA, 64 nt, hsa
uuaauaauaaaauauugugcaauauauucaaagaaaagaaaacacaaauaagcagaaaacauac

SEQ ID NO: 142911 - RNA, 64 nt, hsa
uuuuuuuaauaauaaaauauugugcaauauauucaaagaaaagaaaacacaaauaagcagaaaa

SEQ ID NO: 142912 - RNA, 64 nt, hsa
gacuuugcuaacuuacuaguaccagaguuauuuuaaagaaaaacacuaguguccaauuucauuu

SEQ ID NO: 142913 - RNA, 64 nt, hsa
uaugacucccauugucccuuuauuuaggauauugaaagaaaaaauaaacuuuauguauuagugu

SEQ ID NO: 142914 - RNA, 64 nt, hsa
uuuuuaggaccaaucucauuuuuaauaagguuaaaaagaaaaaaaaagucuagcgaaaaaacuc

SEQ ID NO: 142915 - RNA, 64 nt, hsa
gaugagguccuucuggacuaaaagccaaaaaaagaaagaaaaaaauaauuuuucuuuucuguuu

SEQ ID NO: 142916 - RNA, 64 nt, hsa
cucugucucaaaaaaaaaaaaagaaaaaagaaagaaagaaaaaaggcagaagcccuggauucaa

SEQ ID NO: 142917 - RNA, 64 nt, hsa
ggugacagagcgaaccucugucucaaaaaaaaaaaaagaaaaaagaaagaaagaaaaaaggcag

SEQ ID NO: 142918 - RNA, 64 nt, hsa
ccuauaagaauuaagggguaaagcacuaaacagaaaagaaaaaaaaaauagcaacucuggugag

SEQ ID NO: 142919 - RNA, 64 nt, hsa
uaaaacuguuuuacaguaucaaaauuuuucacuuaaagaaaaaaaaugccaugaaacauuugaa

SEQ ID NO: 142920 - RNA, 64 nt, hsa
gcaaagcacucagcucaauuaucuucuuagaaagaaagaaaaaguaugaauggucaaaaugaau

SEQ ID NO: 142921 - RNA, 64 nt, hsa
gaggaucccuaugacucaaaauaacuuguuuguaaaagaaaauuuguuuacuuacccauuagua

SEQ ID NO: 142922 - RNA, 64 nt, hsa
auuuuauuuuuuaaucuaauuuuuuucuaaucaaaaagaaaauugagcuuaaggcaaaaggccu

SEQ ID NO: 142923 - RNA, 64 nt, hsa
uuuaagaaaguacuugacuaaaaaaaaaagaaaaaaagaaaaaaaagaaagcauagacauauuu

SEQ ID NO: 142924 - RNA, 64 nt, hsa
auuguuucuuuaagaaaguacuugacuaaaaaaaaaagaaaaaaagaaaaaaaagaaagcauag

SEQ ID NO: 142925 - RNA, 64 nt, hsa
augaauacaaagauaagugaaaagagagaaaggaaaagaaaaaggagaaaaacaaagagauuuc

SEQ ID NO: 142926 - RNA, 64 nt, hsa
ugcuguugaucuuuuaucaauaauguucuauagaaaagaaaaaaaaaauauauauauauauaua

SEQ ID NO: 142927 - RNA, 64 nt, hsa
uugacuucauuguuggacuucauacucugaugggaaagaaaauggacauucugaaugugucagg

SEQ ID NO: 142928 - RNA, 64 nt, hsa
uucugacuugagaaucuuuuucaugaaugauuuuaaagaaaaauuuggauuuuaaagguauuaa

SEQ ID NO: 142929 - RNA, 64 nt, hsa
caaagcaaccccaaaagaguugauguguguuuuaaaagaaaaaacccaaugaggaacaauugga

SEQ ID NO: 142930 - RNA, 64 nt, hsa
aacaaaagcgaaacucugucucaaaaaagaaaaaaaagaaaaaaaagcacgugaccuuaugagg

SEQ ID NO: 142931 - RNA, 64 nt, hsa
agccugggcaacaaaagcgaaacucugucucaaaaaagaaaaaaaagaaaaaaaagcacgugac

SEQ ID NO: 142932 - RNA, 64 nt, hsa
uccuuguccugguugaagguaacguguuccuagaaaagaaaaugcugcauaggaaaacugagau

SEQ ID NO: 142933 - RNA, 64 nt, hsa
ucauaaaacauuuucuugagagaguucaguuaaaaaagaaaaaaucagcgucauuuguucccug

SEQ ID NO: 142934 - RNA, 64 nt, hsa
aaagaaacauuuaaugacgguuuaaaacuuuuuaaaagaaaacucaguauuauuuuugcauguu

SEQ ID NO: 142935 - RNA, 64 nt, hsa
caacguuaauaauucuggauuuucuuaucacaaaaaagaaaaugaaggaccucaaagcaccuga

SEQ ID NO: 142936 - RNA, 64 nt, hsa
ugugucuuucuuuuuggacauuuaccuuuuugaaaaagaaaacacuuaaaaugaucauuaggac

SEQ ID NO: 142937 - RNA, 64 nt, hsa
uuaguuugcuuaccuuaagaauugcccaaaaaugaaagaaaauaugagcuuuucaguuaaacau

SEQ ID NO: 142938 - RNA, 64 nt, hsa
cgcugcacuccagccugggagacugcaucucaaaaaagaaaaauaaacgaaguaaaagauauuu

SEQ ID NO: 142939 - RNA, 64 nt, hsa
auugugucacugcacucuagccugggcgacagaaaaagaaaauuuagguggggaaaaaaaucag

SEQ ID NO: 142940 - RNA, 64 nt, hsa
uuaauuuggaauagagaaaccaguauauuuuaaaaaagaaaaauauucuuuguagcaacuguaa

SEQ ID NO: 142941 - RNA, 64 nt, hsa
acuacauuaguauuagugacaucagguggauauaaaagaaaacccuuggaaagagaacugccuu

SEQ ID NO: 142942 - RNA, 64 nt, hsa
agccugggcaacauagggagacccccaucuuuacaaagaaaaaaaaaaggggaaaagaaaaucu

SEQ ID NO: 142943 - RNA, 64 nt, hsa
gacccccaucuuuacaaagaaaaaaaaaaggggaaaagaaaaucuuuuaaaucuuuggauuuga

SEQ ID NO: 142944 - RNA, 64 nt, hsa
uaagccauuauuugccauuuuggguacuuuauacaaagaaaauucagcccuacccugcauaauu

SEQ ID NO: 142945 - RNA, 64 nt, hsa
aauaugccagaugugugugaguuggaaaucaaaaaaagaaaaauaaaauaugcaaagaauucac

SEQ ID NO: 142946 - RNA, 64 nt, hsa
acuucagcuuuccaaaagcuaguaaacauguuucaaagaaaaauaaggucaggagaaaaagaau

SEQ ID NO: 142947 - RNA, 64 nt, hsa
uugacuuggaagccaauuugguccuuuaauaaguaaagaaaauaauauguuuaaaaauguaaau

SEQ ID NO: 142948 - RNA, 64 nt, hsa
ugggugacacagcgagacuucaucucaaaaaaaaaaagaaaagaaaagcaauuguacuucacua

SEQ ID NO: 142949 - RNA, 64 nt, hsa
gacacagcgagacuucaucucaaaaaaaaaaagaaaagaaaagcaauuguacuucacuaugcca

SEQ ID NO: 142950 - RNA, 64 nt, hsa
cacauugcauguaguugagccacauuuuuuaaaaaaagaaaauggaugaccauuaauugacuag

SEQ ID NO: 142951 - RNA, 64 nt, hsa
caugaggucagcaguugagaccagccaaaaggaaaaagaaaauuaugagaguuacuuaaaggua

SEQ ID NO: 142952 - RNA, 64 nt, hsa
ggggaaacgacccuguggcugugagaaagugaaaaaagaaaaaaaaaaaggcauuggcauuuuc

SEQ ID NO: 142953 - RNA, 64 nt, hsa
uguauuaggacagaauuaaugaugcuuaaagagaaaagaaaaaaagagagaagaaaaaggagag

SEQ ID NO: 142954 - RNA, 64 nt, hsa
gagacuccaucgcaaaaaaaaaaaaaaaaaaagaaaagaaaauuagccaggugugguggcaagu

SEQ ID NO: 142955 - RNA, 64 nt, hsa
agagugagacuccaucgcaaaaaaaaaaaaaaaaaaagaaaagaaaauuagccagguguggugg

SEQ ID NO: 142956 - RNA, 64 nt, hsa
caacaaaaaucuucaaagacugguuucuuuuuuaaaagaaaaaacuugaaagaacacuucuaag

SEQ ID NO: 142957 - RNA, 64 nt, hsa
ugugccagcugaauuuaaaauauaauacuuuuaaaaagaaaauuauuacauccuuuacauucag

SEQ ID NO: 142958 - RNA, 64 nt, hsa
acauaugacauuuuaugagcuguuuacggcauggaaagaaaaucagugggaauuaagaaagccu

SEQ ID NO: 142959 - RNA, 64 nt, hsa
ccacugaaaacauuuuugucauauucuuguauucaaagaaaaaggaaaaaagauuauuguaaau

SEQ ID NO: 142960 - RNA, 64 nt, hsa
cauaacuaaaacauugaaaacagaacaaaugagaaaagaaaaaaaaccugccgauuaacaagac

SEQ ID NO: 142961 - RNA, 64 nt, hsa
aagaggcauuccagccccuauguuauugauggaaaaagaaaaagaagaaaagcaaucucgcagu

SEQ ID NO: 142962 - RNA, 64 nt, hsa
caaccagugaggcugcccugaacaaaaaaaacaaaaagaaaaaaaaaaaaggaaagaaagaaac

SEQ ID NO: 142963 - RNA, 64 nt, hsa
caauauaccacuuccuaaauauccaucuuuggugaaagaaaauagugugguaagaguacccaug

SEQ ID NO: 142964 - RNA, 64 nt, hsa
agcuuacaaauauucuguuaagggguaguuuuauaaagaaaaaugauauauaguuauguugucu

SEQ ID NO: 142965 - RNA, 64 nt, hsa
acauaaagacuugagaagggaauuguuuaagggaaaagaaaagaguaauaauuuuuuuuaaaac

SEQ ID NO: 142966 - RNA, 64 nt, hsa
uaauuauguaaaaaacaaaacuacaacaacaaaaaaagaaaaaaguuaaaaaagaaaaaaacac

SEQ ID NO: 142967 - RNA, 64 nt, hsa
aaaacuacaacaacaaaaaaagaaaaaaguuaaaaaagaaaaaaacaccaaaaaacaaaaacaa

SEQ ID NO: 142968 - RNA, 64 nt, hsa
uaaagucuuaaaauggaaugagaauguuguuuuaaaagaaaauagcaaaacaacaaaaaagcaa

SEQ ID NO: 142969 - RNA, 64 nt, hsa
cccuuuguuuacuuagcuuucucuuaguuauaagaaagaaaaagaccucuugcaugaaaauagu

SEQ ID NO: 142970 - RNA, 64 nt, hsa
uauacauagaauuugccaguuacuuucugacuacaaagaaaaacagauacuaaaagucucuucu

SEQ ID NO: 142971 - RNA, 64 nt, hsa
aaacagugggguuuaguacuccaaaugaacucuuaaagaaaaaaacuaaucuuggcauccuauc

SEQ ID NO: 142972 - RNA, 64 nt, hsa
aaacuuauuuugcuuuaaaaaaaaaaaaaaagaaaaagaaaauuuaacuuaaaauauuuuagca

SEQ ID NO: 142973 - RNA, 64 nt, hsa
ccuuuuaaacuuauuuugcuuuaaaaaaaaaaaaaaagaaaaagaaaauuuaacuuaaaauauu

SEQ ID NO: 142974 - RNA, 64 nt, hsa
uuaaguuaacuguaauuacuguauuuugugggacaaagaaaaaaggacuccaguauuuguggcc

SEQ ID NO: 142975 - RNA, 64 nt, hsa
ccuaguuuuuaguaaucuguacauuuuguuguaaaaagaaaaaccacucccaguccccagcccu

SEQ ID NO: 142976 - RNA, 64 nt, hsa
ccccccuaaaauuuguggguuuuuuuuuuuaaaaaaagaaaaugaaaaacaaccaagcgcaucc

SEQ ID NO: 142977 - RNA, 64 nt, hsa
acuuaaagguucacuuguaaaacaauaaaguacuaaagaaaaugugauaauacuuucgugauuu

SEQ ID NO: 142978 - RNA, 64 nt, hsa
aaauaaaaacuauaaaaauguacuuuaggacauuaaagaaaacucaaguuagaagcauaccauu

SEQ ID NO: 142979 - RNA, 64 nt, hsa
gaccaaaauggugaaacccugucucuacuaaaaaaaagaaaaauuagccagacgugguggcaug

SEQ ID NO: 142980 - RNA, 64 nt, hsa
uuaguuuaaugugcucuuuguaaaaugaaauuguaaagaaaauaccaguguuucucaucccauu

SEQ ID NO: 142981 - RNA, 64 nt, hsa
aagaaaagguguagcacuuucagaagaggcuaucaaagaaaagagaugaacuuggaagcaagag

SEQ ID NO: 142982 - RNA, 64 nt, hsa
aacaacaaucagccauaacaaguuuacuuguggaaaagaaaagguguagcacuuucagaagagg

SEQ ID NO: 142983 - RNA, 64 nt, hsa
uauucaguguucuuccucuuuucucccuuaugaaaaagaaaagauagcacaaaacuuaagacuu

SEQ ID NO: 142984 - RNA, 64 nt, hsa
uugauuauacaggcuaugaaaaccauuuuaaaggaaagaaaauauguaaauucuauugagcaaa

SEQ ID NO: 142985 - RNA, 64 nt, hsa
agcucacuuguccaugaaaauauuuuaugauauuaaagaaaaucuuuugaaauggcuguuuuuu

SEQ ID NO: 142986 - RNA, 64 nt, hsa
cgaagugacaguuuacaaaauuauuuucugcaaaaaagaaaaaaaaguuacguuaaaaaccaaa

SEQ ID NO: 142987 - RNA, 64 nt, hsa
uaugacuagaaguauguaagaaaugaucagaacaaaagaaaauuucuauuuucaugcaaauauu

SEQ ID NO: 142988 - RNA, 64 nt, hsa
agguaaggcuuauuuuugauuagcagucaauggcaaagaaaaaguaaaucaaagaugacuucuu

SEQ ID NO: 142989 - RNA, 64 nt, hsa
ucaaagcuacacuuuugaguaaaaacccuuauuaaaagaaaaacaugauuaauauuuuugucua

SEQ ID NO: 142990 - RNA, 64 nt, hsa
uuuuucucuuaaaaaaaauaacaccccauuaccaaaagaaaagguaagguggcaaccuuauuuu

SEQ ID NO: 142991 - RNA, 64 nt, hsa
gacugcacaguugugaaaaaggaagagaaucauuaaagaaaaagaaaaaagauuuuaagaccgu

SEQ ID NO: 142992 - RNA, 64 nt, hsa
acaguugugaaaaaggaagagaaucauuaaagaaaaagaaaaaagauuuuaagaccguugaaau

SEQ ID NO: 142993 - RNA, 64 nt, hsa
uucaaaucuagacacuaaaugugugugaauguacaaagaaaacaaaccauugcuuaugcuguua

SEQ ID NO: 142994 - RNA, 64 nt, hsa
agauuaauaauccaacuuuaauaguauacauuuaaaagaaaaaaaacaaaagcccuggaaguug

SEQ ID NO: 142995 - RNA, 64 nt, hsa
cccagggcuugucuggaucagcaccaacgauuuuaaagaaaaaaggaagaguuucuuagaugag

SEQ ID NO: 142996 - RNA, 64 nt, hsa
gauguuagacauagccauaucuccuuucccuacaaaagaaaagcauacuguuaaaaugugcuua

SEQ ID NO: 142997 - RNA, 64 nt, hsa
ucuaguuuccagccauugaagugaacugcuaaaaaaagaaaaauaauugaaauguugagagaga

SEQ ID NO: 142998 - RNA, 64 nt, hsa
agggaccucaggguguggcauuauagggccaggaaaagaaaaucgguguauccuaucugcccca

SEQ ID NO: 142999 - RNA, 64 nt, hsa
guaguaggacaaugaaaauuguucuaagcaaaggaaagaaaacugacuuuguugcacuuuuagu

SEQ ID NO: 143000 - RNA, 64 nt, hsa
uccaggaacuacaagaugccaucugccguuugcaaaagaaaaaucuuuucccauauaauccaac

SEQ ID NO: 143001 - RNA, 64 nt, hsa
gagagagagagagagaggagaagacagagagauuaaagaaaaauauguucacucccacuuaugu

SEQ ID NO: 143002 - RNA, 64 nt, hsa
aggggcuuaggggauuggaacugggguuuggcugaaagaaaaaaaaaaaaauguaacugaugaa

SEQ ID NO: 143003 - RNA, 64 nt, hsa
caaggcccaggacacuugucagaaggaugcaaaaaaagaaaaaaguacauccacccucuuaauc

SEQ ID NO: 143004 - RNA, 64 nt, hsa
ggguuuuguuucuguuguuguucaaaugcaaaaaaaagaaaaaaaaagaaaaaaaaaggugacu

SEQ ID NO: 143005 - RNA, 64 nt, hsa
ucuguuguuguucaaaugcaaaaaaaagaaaaaaaaagaaaaaaaaaggugacucacauuguua

SEQ ID NO: 143006 - RNA, 64 nt, hsa
aauuucgaaagaaauaauuggcaagauaaugagaaaagaaaaaagucaugguaggugagguggu

SEQ ID NO: 143007 - RNA, 64 nt, hsa
uuuuguagccaagcagaguuguagagggggauaaaaagaaaagaaauuggauguauuuacagcu

SEQ ID NO: 143008 - RNA, 64 nt, hsa
ccaaaaaaaaaaaaaaaaaaaaaaaaaaaagaaaaaagaaaaaaaaaauccaaaagagagaaga

SEQ ID NO: 143009 - RNA, 64 nt, hsa
uuaaaagccaaaaaaaaaaaaaaaaaaaaaaaaaaaagaaaaaagaaaaaaaaaauccaaaaga

SEQ ID NO: 143010 - RNA, 64 nt, hsa
aacuuccucucaaaaaaaaaaaaaaaaagaaagaaaagaaaacucugucucaaaaaaaaaaaaa

SEQ ID NO: 143011 - RNA, 64 nt, hsa
agcaaaacuuccucucaaaaaaaaaaaaaaaaagaaagaaaagaaaacucugucucaaaaaaaa

SEQ ID NO: 143012 - RNA, 64 nt, hsa
ggggggguucucccccuccugauuaaaaagggagaaagaaaacugcgauuuuauagcuggagau

SEQ ID NO: 143013 - RNA, 64 nt, hsa
uguguguuggcaaaagagcuacucagaaauggacaaagaaaacggggggguucucccccuccug

SEQ ID NO: 143014 - RNA, 64 nt, hsa
gugaaaggugauggguuuuauucguugggcuuuaaaagaaaagguuuggcagaacuaaaaacaa

SEQ ID NO: 143015 - RNA, 64 nt, hsa
aucaaacuaaauguccaucagugguagaaaggauaaagaaaaugugguggcagggagugguggc

SEQ ID NO: 143016 - RNA, 64 nt, hsa
gcaaccaagcgagacucugccuuaaaaaaaaaaaaaagaaaauguggcacauauacaccaugga

SEQ ID NO: 143017 - RNA, 64 nt, hsa
uacacaugugccccugaaccuaaaaaaaaaguuaaaagaaaaacguuuggauuauuuucccucu

SEQ ID NO: 143018 - RNA, 64 nt, hsa
ccagccugggugacagagcgagacuccguaucagaaagaaaaagaggaacugaaugaaaucuca

SEQ ID NO: 143019 - RNA, 64 nt, hsa
gagccugggcaacauagugagaccccaucucuacaaagaaaaaaaaauuagcuggacaugguaa

SEQ ID NO: 143020 - RNA, 64 nt, hsa
gcccaacuugggaguggggaaauugcuuaaaaaaaaagaaaaagaaaaaaaaaaagauuauucu

SEQ ID NO: 143021 - RNA, 64 nt, hsa
cuugggaguggggaaauugcuuaaaaaaaaagaaaaagaaaaaaaaaaagauuauucuaaauaa

SEQ ID NO: 143022 - RNA, 64 nt, hsa
cugugaauguagaagugggggggaggggggagaaaaagaaaacucuggcguuagaggauauaga

SEQ ID NO: 143023 - RNA, 64 nt, hsa
aaaccaaaauuuaaaugaucagaauuggcagcacaaagaaaacgcccucuccugacuuguauug

SEQ ID NO: 143024 - RNA, 64 nt, hsa
uguuuuuuugcagcuugcugauauuuuauauaaaaaagaaaagcaaagcaaaagagaagcugau

SEQ ID NO: 143025 - RNA, 64 nt, hsa
gcugauagucuugaauauuuuauuuuuuuaaugaaaagaaaaaacaagaaaguuauguuucaua

SEQ ID NO: 143026 - RNA, 64 nt, hsa
accuuccuuauauuuuuuuccucaacaguuuuaaaaagaaaaaaaggucuauuuuuuuuucucc

SEQ ID NO: 143027 - RNA, 64 nt, hsa
auuugauggccuuuugaugaaugucuuccacaguaaagaaaacuuaguggcuuaauuuaggaaa

SEQ ID NO: 143028 - RNA, 64 nt, hsa
aaugcauauuuuugcacaguggagcuuacacuuaaaagaaaacaaagccccaugggcugccuug

SEQ ID NO: 143029 - RNA, 64 nt, hsa
uuuaaagaguuggaggaauuggggauugaguuguaaagaaaacuuacagaagaggcaacaauuu

SEQ ID NO: 143030 - RNA, 64 nt, hsa
ucauauuuaaagccaaauguaaauagaggucuguaaagaaaaauaauugccauagaaaguauaa

SEQ ID NO: 143031 - RNA, 64 nt, hsa
uuuggacuuuguaauuauuuuuuuagcaguaauuaaagaaaaaaguccucugugaggaauauuc

SEQ ID NO: 143032 - RNA, 64 nt, hsa
gaguauuuuuguacagauuugcuuucucuuacaaaaagaaaaaaaaaauccuguuguauuaaca

SEQ ID NO: 143033 - RNA, 64 nt, hsa
cuauugaaauaaaauaaaauauaaaaagaaagagaaagaaaagaaaauaguuccaauuuaucau

SEQ ID NO: 143034 - RNA, 64 nt, hsa
gaaauaaaauaaaauauaaaaagaaagagaaagaaaagaaaauaguuccaauuuaucaugccaa

SEQ ID NO: 143035 - RNA, 64 nt, hsa
ggcucgccgugagccaggucuaaaguuugaagaaaaagaaaaaucuuaaaaaaaaaaaaaaaaa

SEQ ID NO: 143036 - RNA, 64 nt, hsa
aaaagaaaaaucuuaaaaaaaaaaaaaaaaaaaaaaagaaaaaaagaaaaacaggaaaaaggac

SEQ ID NO: 143037 - RNA, 64 nt, hsa
aaucuuaaaaaaaaaaaaaaaaaaaaaaagaaaaaaagaaaaacaggaaaaaggacuuuuuuuu

SEQ ID NO: 143038 - RNA, 64 nt, hsa
cccccagucugacauauuucauacagaauguuuaaaagaaaaacucugcuagucuuggcaaaca

SEQ ID NO: 143039 - RNA, 64 nt, hsa
uucuaugugaauauaagcuugugcacaauguuuaaaagaaaaacaaugaauuagaagagauccc

SEQ ID NO: 143040 - RNA, 64 nt, hsa
guuuucccuugaggaaacaacagcuuuaaaagaaaaagaaaaaaaaagucuuugguaaauggca

SEQ ID NO: 143041 - RNA, 64 nt, hsa
gauaaaguuuucccuugaggaaacaacagcuuuaaaagaaaaagaaaaaaaaagucuuugguaa

SEQ ID NO: 143042 - RNA, 64 nt, hsa
aaaaaaagaaaaagaaaaagcaagaagaaggaagaaagaaaaagacagaaagagaaauaggagg

SEQ ID NO: 143043 - RNA, 64 nt, hsa
ucaaaucucuugcuuucuuucuuaaaaaaaagaaaaagaaaaagcaagaagaaggaagaaagaa

SEQ ID NO: 143044 - RNA, 64 nt, hsa
caagauucaaaucucuugcuuucuuucuuaaaaaaaagaaaaagaaaaagcaagaagaaggaag

SEQ ID NO: 143045 - RNA, 64 nt, hsa
uuuuuguucuaagaugcauggaacuaaaauguggaaagaaaagaaugcgaaaagauccuguuuu

SEQ ID NO: 143046 - RNA, 64 nt, hsa
ucacauccccgaugcuaaauuaaaaacagaaaacaaagaaaagcuuguauauacuuugccacug

SEQ ID NO: 143047 - RNA, 64 nt, hsa
caugucggcguucuuggccaauggauacaaagauaaagaaaauguugccuuuuucuaggaacug

SEQ ID NO: 143048 - RNA, 64 nt, hsa
uggagcaucauguccaccccugcagauccuuggaaaagaaaauguuuauguugcaggguauugc

SEQ ID NO: 143049 - RNA, 64 nt, hsa
uagaaacuuugcuaguuaaaaaaaaaagaaaaaaaaagaaaaaaaaucccuuucuuguaaacuu

SEQ ID NO: 143050 - RNA, 64 nt, hsa
gaaaguauaauagaaacuuugcuaguuaaaaaaaaaagaaaaaaaaagaaaaaaaaucccuuuc

SEQ ID NO: 143051 - RNA, 64 nt, hsa
caaaguuauuaaauuaauuauauguuuaaaaguuaaagaaaaaagagcugcagaguauuuauaa

SEQ ID NO: 143052 - RNA, 64 nt, hsa
uuuuauaaagagacucaaagcuaaugauagcuuaaaagaaaaguuaaugccuucucauuggaaa

SEQ ID NO: 143053 - RNA, 64 nt, hsa
auggaguauaugccugaaaagguuuuggauucagaaagaaaaaggaugguuaguuuaaucagug

SEQ ID NO: 143054 - RNA, 64 nt, hsa
aacauuuuaacuuaaugguacuuaaaauaauuuaaaagaaaaauguuaacuuagacauucuuau

SEQ ID NO: 143055 - RNA, 64 nt, hsa
uacaacuacaucccauuuuauauuuccaauuguuaaagaaaaauauuucaagaacaaaucuucu

SEQ ID NO: 143056 - RNA, 64 nt, hsa
aaaaauacugaauuaguaauuuuaaaagucucacaaagaaaaucccaggccuagauggcugcau

SEQ ID NO: 143057 - RNA, 64 nt, hsa
guuuguucaacaucuaaaaaucaaauaagcuaauaaagaaaagagguuuauacugcaaaagaag

SEQ ID NO: 143058 - RNA, 64 nt, hsa
aaacugcuuuguguauuguauauuuuuuuaagaaaaagaaaagccuuauuugacuuaugcuugu

SEQ ID NO: 143059 - RNA, 64 nt, hsa
acaggugaaucuagagccuacuuuuauuuugguuaaagaaaaagaaaauaucaauaauucaauu

SEQ ID NO: 143060 - RNA, 64 nt, hsa
gaaucuagagccuacuuuuauuuugguuaaagaaaaagaaaauaucaauaauucaauuuugugu

SEQ ID NO: 143061 - RNA, 64 nt, hsa
uuucuuuuauguuuuacaguuuuccccauuuuaaaaagaaaagcaaacaaagaaacaaaaguuu

SEQ ID NO: 143062 - RNA, 64 nt, hsa
gcaauaaauauugugguuuuaucuacguuauuggaaagaaaaugacauuuaaauaaugugugua

SEQ ID NO: 143063 - RNA, 64 nt, hsa
uauguauugugcaauguguauaaacaagaaaaauaaagaaaagaugcacuuugcuuuaauauaa

SEQ ID NO: 143064 - RNA, 64 nt, hsa
gaaaggacuccugaaaaaaaaccugagauuuauuaaagaaaaaaauguauuuuauguuauauau

SEQ ID NO: 143065 - RNA, 64 nt, hsa
cuuuugaauaauugcuuauaauaugccuuaccauaaagaaaauugaugcuacauugugugaauu

SEQ ID NO: 143066 - RNA, 64 nt, hsa
gaggugggucugaaauucauacaugaagucaggaaaagaaaagaaacuuaguucuaccuugauu

SEQ ID NO: 143067 - RNA, 64 nt, hsa
gaguaauagggaaagaagaguuacagaaaaugaaaaagaaaaugaguuacacugagaaugaaua

SEQ ID NO: 143068 - RNA, 64 nt, hsa
gacagagcgagacuccgccucaaaaaaaaaaaaaaaagaaaaaaagaaauguaccuguuggcag

SEQ ID NO: 143069 - RNA, 64 nt, hsa
aaggucuucugacacacuuaucuugcacaaagaaaaagaaaauuucuuuuacuguguuuaaugu

SEQ ID NO: 143070 - RNA, 64 nt, hsa
uuugaaaaggucuucugacacacuuaucuugcacaaagaaaaagaaaauuucuuuuacuguguu

SEQ ID NO: 143071 - RNA, 64 nt, hsa
aagauauccagaaaggagccacagcugacgccaaaaagaaaagaaaaaagauauauauauauau

SEQ ID NO: 143072 - RNA, 64 nt, hsa
auccagaaaggagccacagcugacgccaaaaagaaaagaaaaaagauauauauauauauauaua

SEQ ID NO: 143073 - RNA, 64 nt, hsa
ugggcaacaagagcaaaacuccgucucaaaauaaaaagaaaagaaaagaauggacaguguuugc

SEQ ID NO: 143074 - RNA, 64 nt, hsa
aacaagagcaaaacuccgucucaaaauaaaaagaaaagaaaagaauggacaguguuugcagaga

SEQ ID NO: 143075 - RNA, 64 nt, hsa
caaagacucuuguccucuugucccuccugagaaaaaagaaaacgaaaagugggguuuuuuucug

SEQ ID NO: 143076 - RNA, 64 nt, hsa
uuuuaauuguaacauuuuuagaaaaagaacaaaaaaagaaaaaaaaaagaaagaaacacagcaa

SEQ ID NO: 143077 - RNA, 64 nt, hsa
ggaagggaccuugcagggaccucucccuccaaaaaaagaaaaaaagaaaaagaaagaaaaaaua

SEQ ID NO: 143078 - RNA, 64 nt, hsa
ccuugcagggaccucucccuccaaaaaaagaaaaaaagaaaaagaaagaaaaaauaaaugagga

SEQ ID NO: 143079 - RNA, 64 nt, hsa
accucucccuccaaaaaaagaaaaaaagaaaaagaaagaaaaaauaaaugaggaaacguguugc

SEQ ID NO: 143080 - RNA, 64 nt, hsa
auaaacaaacuaauaaaaagcaaaaaaaaaaaaaaaagaaaagaaaaaacacugcauuugggca

SEQ ID NO: 143081 - RNA, 64 nt, hsa
caaacuaauaaaaagcaaaaaaaaaaaaaaaagaaaagaaaaaacacugcauuugggcaccauc

SEQ ID NO: 143082 - RNA, 64 nt, hsa
ucucaaaaaaaaaaaaaaaaaaaaggaaagaaagaaagaaaagaaaagaaaauccuuuuugcuu

SEQ ID NO: 143083 - RNA, 64 nt, hsa
aaaaaaaaaaaaaaaaaaaggaaagaaagaaagaaaagaaaagaaaauccuuuuugcuuuaacu

SEQ ID NO: 143084 - RNA, 64 nt, hsa
aaaaaaaaaaaaaaggaaagaaagaaagaaaagaaaagaaaauccuuuuugcuuuaacuugccu

SEQ ID NO: 143085 - RNA, 64 nt, hsa
ggaaggaaaaagaaagagaaagagagagagagagaaagaaaaagaaagaaaaguaagaaagaaa

SEQ ID NO: 143086 - RNA, 64 nt, hsa
agaaagagaaagagagagagagagaaagaaaaagaaagaaaaguaagaaagaaaaaagaaaaag

SEQ ID NO: 143087 - RNA, 64 nt, hsa
gagagagagagaaagaaaaagaaagaaaaguaagaaagaaaaaagaaaaagaaagaaaaguaag

SEQ ID NO: 143088 - RNA, 64 nt, hsa
agagaaagaaaaagaaagaaaaguaagaaagaaaaaagaaaaagaaagaaaaguaagaaagaaa

SEQ ID NO: 143089 - RNA, 64 nt, hsa
aaagaaagaaaaguaagaaagaaaaaagaaaaagaaagaaaaguaagaaagaaaaaaagaaaaa

SEQ ID NO: 143090 - RNA, 64 nt, hsa
uuaggcagcaagaauuggagaacucacacugcgaaaagaaaaccuuggguggcagugauuugaa

SEQ ID NO: 143091 - RNA, 64 nt, hsa
gagacuccaucuuaaaaaaaaaaaaaaaaaaaagaaagaaaagaaaauggaguucugagagcua

SEQ ID NO: 143092 - RNA, 64 nt, hsa
uccaucuuaaaaaaaaaaaaaaaaaaaagaaagaaaagaaaauggaguucugagagcuaggaaa

SEQ ID NO: 143093 - RNA, 64 nt, hsa
uccagucuggcaacagagcaagacuccaucucaaaaagaaaagaaaagaagacucugaccugua

SEQ ID NO: 143094 - RNA, 64 nt, hsa
ucuggcaacagagcaagacuccaucucaaaaagaaaagaaaagaagacucugaccuguacucuu

SEQ ID NO: 143095 - RNA, 64 nt, hsa
agacagauuuauaguugaagccuacgagauguauaaagaaaagcuguuaccaaucuuacugaaa

SEQ ID NO: 143096 - RNA, 64 nt, hsa
auucuaauaccaaaaccugacaggcacaaugaaaaaagaaaacuucaggcugguacuccugacg

SEQ ID NO: 143097 - RNA, 64 nt, hsa
aucaacguaaaugcccaucagcaguagaccagauaaagaaaauuugguacauauacaccaugga

SEQ ID NO: 143098 - RNA, 64 nt, hsa
uuuuaaaugaaaaggugaaaguucucaacuuaaaaaagaaaagaaaaaaaucauauacugaggu

SEQ ID NO: 143099 - RNA, 64 nt, hsa
aaugaaaaggugaaaguucucaacuuaaaaaagaaaagaaaaaaaucauauacugagguugcua

SEQ ID NO: 143100 - RNA, 64 nt, hsa
aaaaaaagaaacaaaccaccucuacauauuauggaaagaaaauauuuuugucgauucuuauucu

SEQ ID NO: 143101 - RNA, 64 nt, hsa
cugccaggggcgggcaaaaaaaaaaguaaaaagaaaagaaaaaaaaaaaaaagaaacaaaccac

SEQ ID NO: 143102 - RNA, 64 nt, hsa
gagcucugccaggggcgggcaaaaaaaaaaguaaaaagaaaagaaaaaaaaaaaaaagaaacaa

SEQ ID NO: 143103 - RNA, 64 nt, hsa
cuccccgggacuccagaauuucucuccucaaaggaaagaaaacagggcaugcgcuuguuggcaa

SEQ ID NO: 143104 - RNA, 64 nt, hsa
ugggcgacacagcgagacccugucucaagaaagaaaagaaaaagagacaaauuacccagaaacc

SEQ ID NO: 143105 - RNA, 64 nt, hsa
cagccugggcgacacagcgagacccugucucaagaaagaaaagaaaaagagacaaauuacccag

SEQ ID NO: 143106 - RNA, 64 nt, hsa
aacacaaacagaagaggaaaaaaaagcaacaaaaaaagaaaacacacagaagagauuuaaaaaa

SEQ ID NO: 143107 - RNA, 64 nt, hsa
aaacgucuguggagcuucugcugcaaggaacaaaaaagaaaaaaaucaaaaaagcgacaaaaaa

SEQ ID NO: 143108 - RNA, 64 nt, hsa
aaaaaaaaaaacacaaaaaaagacaaaaaaaaaaaaagaaaauauuuuggcagguuauguuuac

SEQ ID NO: 143109 - RNA, 64 nt, hsa
aaagaaaaaaaaaagacaaaaaaaaaaaaaaagaaaagaaaaaaaaucucaucacuugaagcca

SEQ ID NO: 143110 - RNA, 64 nt, hsa
auggaaaagaaaaaaaaaagacaaaaaaaaaaaaaaagaaaagaaaaaaaaucucaucacuuga

SEQ ID NO: 143111 - RNA, 64 nt, hsa
uuccccauugcuguaaauauuucaacgaaauggaaaagaaaaaaaaaagacaaaaaaaaaaaaa

SEQ ID NO: 143112 - RNA, 64 nt, hsa
gggcaacaagagcaaaacucuaucucaaagaaaaaaagaaaauuucuacauauuaaaacuugug

SEQ ID NO: 143113 - RNA, 64 nt, hsa
uccagccugggcaacaagagcaaaacucuaucucaaagaaaaaaagaaaauuucuacauauuaa

SEQ ID NO: 143114 - RNA, 64 nt, hsa
gaugauauaucuggaauguccuuuuguucauacaaaagaaaaaugaggaugaauaacaaguuug

SEQ ID NO: 143115 - RNA, 64 nt, hsa
agcaacacucugucucaaaaaaaaaaagaaaagaaaagaaaaagccagaaaaaguuggugcccc

SEQ ID NO: 143116 - RNA, 64 nt, hsa
agcagagcaacacucugucucaaaaaaaaaaagaaaagaaaagaaaaagccagaaaaaguuggu

SEQ ID NO: 143117 - RNA, 64 nt, hsa
ugggcagcagagcaacacucugucucaaaaaaaaaaagaaaagaaaagaaaaagccagaaaaag

SEQ ID NO: 143118 - RNA, 64 nt, hsa
aaacugaucaaaagcauaauugaaaguucugaaaaaagaaaaauaauaauauguagaaaaaugu

SEQ ID NO: 143119 - RNA, 64 nt, hsa
aauaauauuaauauuacuugaaauagacuaagauaaagaaaaggggucuguaugaugugcaguu

SEQ ID NO: 143120 - RNA, 64 nt, hsa
cugcgaguaauaaauuaguuaaaacugcaaauagaaagaaaacaccaaaaauaaagaaaagagc

SEQ ID NO: 143121 - RNA, 64 nt, hsa
uuaaaacugcaaauagaaagaaaacaccaaaaauaaagaaaagagcaaaaguggccaaaaaaug

SEQ ID NO: 143122 - RNA, 64 nt, hsa
caaaaaaaaaaaaaaaaaaaaaaaaaacagaaagaaagaaaaagaaaacugcagauaacccuau

SEQ ID NO: 143123 - RNA, 64 nt, hsa
aaaaaaaaaaaaaaaaaaaaacagaaagaaagaaaaagaaaacugcagauaacccuauacauua

SEQ ID NO: 143124 - RNA, 64 nt, hsa
uuguacucagcuguguucaugugguggucuguggaaagaaaagaagacucauuuggaaaugaag

SEQ ID NO: 143125 - RNA, 64 nt, hsa
caagacacgcacagucaaccauuuuccgagaaaaaaagaaaauuccccacuuggaaagaaagag

SEQ ID NO: 143126 - RNA, 64 nt, hsa
ggccacugcagaugacucuccuuugaaaugagaaaaagaaaagaaagcaagaacagaaaacgaa

SEQ ID NO: 143127 - RNA, 64 nt, hsa
uaguggaaucuacuuucauuguuaacacugagcuaaagaaaaaaagccguguguuuuaugaaug

SEQ ID NO: 143128 - RNA, 64 nt, hsa
agccugggcaacauagcgagaccucaucuccaaaaaagaaaacaaaaaacaaaaaaaggaauga

SEQ ID NO: 143129 - RNA, 64 nt, hsa
gaguccaucuguuuguccaucugcugaaaugagaaaagaaaaauuuaugcacugauuuaaaaca

SEQ ID NO: 143130 - RNA, 64 nt, hsa
aaauuuaugcacugauuuaaaacaaaccaaaaaaaaagaaaaaaacaaaaaaaaaaaucccucc

SEQ ID NO: 143131 - RNA, 64 nt, hsa
agcacacccgugguugugaaaauaguauagcaaaaaagaaaaauccccgguuauugauguacua

SEQ ID NO: 143132 - RNA, 64 nt, hsa
uaaccaggacuauguagaaguagaaagaaaagaaaaagaaaaucuuuuuuaaaccagaauaaac

SEQ ID NO: 143133 - RNA, 64 nt, hsa
uuaauuuaaccaggacuauguagaaguagaaagaaaagaaaaagaaaaucuuuuuuaaaccaga

SEQ ID NO: 143134 - RNA, 64 nt, hsa
uuguauuaauuuaaccaggacuauguagaaguagaaagaaaagaaaaagaaaaucuuuuuuaaa

SEQ ID NO: 143135 - RNA, 64 nt, hsa
aaauaagaauuuuaauaaaaauccuguguuuaaaaaagaaaaaaagaaaaaaucccugcccucc

SEQ ID NO: 143136 - RNA, 64 nt, hsa
uuauuuuauugugcaaacauuucucaaauauggaaaagaaaacccuguaggcagggagcccucu

SEQ ID NO: 143137 - RNA, 64 nt, hsa
gguauuuuuguuuguaaguuaaaaagaaaaaaaaaaagaaaaaguuccgggcauuuugcaucag

SEQ ID NO: 143138 - RNA, 64 nt, hsa
guuuauuauuacgguauuuuuguuuguaaguuaaaaagaaaaaaaaaaagaaaaaguuccgggc

SEQ ID NO: 143139 - RNA, 64 nt, hsa
uauuaacuuuaacuuauuaaaaaaaaaaaaagaaaaagaaaaacgauuuaaaaaaaaaaaaaaa

SEQ ID NO: 143140 - RNA, 64 nt, hsa
uauuuguauuaacuuuaacuuauuaaaaaaaaaaaaagaaaaagaaaaacgauuuaaaaaaaaa

SEQ ID NO: 143141 - RNA, 64 nt, hsa
cguuauuuuucucuuuaaaaaaaauagaagcuauaaagaaaagagggagagaugaguggguuag

SEQ ID NO: 143142 - RNA, 64 nt, hsa
ggguccaggggagggaaaagcuaagagggugaacaaagaaaagacauugaaagcucuauggauu

SEQ ID NO: 143143 - RNA, 64 nt, hsa
gcuuccagaaccauaaaauaucccgucgauaaggaaagaaaaugucguuguuguuguuuuucug

SEQ ID NO: 143144 - RNA, 64 nt, hsa
ugagugccaagucagaaaguguguauuaccuuguaaagaaaaaaauuacaaagcagggguuuag

SEQ ID NO: 143145 - RNA, 64 nt, hsa
ccacguuucuuuguugagcugugucuugaaggcaaaagaaaaaaaauuucuacaguagucuuuc

SEQ ID NO: 143146 - RNA, 64 nt, hsa
acaagcuaagagagcuugcaaaaaaaaaaagaaaaaagaaaaaaaaaaaccacguuucuuuguu

SEQ ID NO: 143147 - RNA, 64 nt, hsa
ugaaugcacaagcuaagagagcuugcaaaaaaaaaaagaaaaaagaaaaaaaaaaaccacguuu

SEQ ID NO: 143148 - RNA, 64 nt, hsa
aaguuuuuaauugcuauuguuuuauauaggauugaaagaaaauuaacuccuuuauuaaaaacaa

SEQ ID NO: 143149 - RNA, 64 nt, hsa
uauauuccuguuucuaaaucagcucuucagugugaaagaaaacacguuucuguaacagagagaa

SEQ ID NO: 143150 - RNA, 64 nt, hsa
aguaacuacagagaggacguuucccuguuuagggaaagaaaaaacaucuucagaucauaggucc

SEQ ID NO: 143151 - RNA, 64 nt, hsa
uguucucacagcaccguuccgacagggaccagugaaagaaaagagacaaaguuagaacgugcug

SEQ ID NO: 143152 - RNA, 64 nt, hsa
guagauguaguugcuuaguagcauuuuggaaaaaaaagaaaaaaagguuugguuugguuuugug

SEQ ID NO: 143153 - RNA, 64 nt, hsa
aaacuccgucucaaaaaaaaaaaaaaaaaaaaagaaagaaaagaguaacagaaagauagggauu

SEQ ID NO: 143154 - RNA, 64 nt, hsa
caaaaucuccauauauaggaucagcuuaaaacauaaagaaaaccuugaauuucucaaauguuug

SEQ ID NO: 143155 - RNA, 64 nt, hsa
uuuguuuccuuuaagaaaaaccacagggaccaagaaagaaaauauaacaguuugauuucuguca

SEQ ID NO: 143156 - RNA, 64 nt, hsa
uauaauuguaaagcuuguuaacuguuuauauacuaaagaaaaagcuuuacaagauaagacugaa

SEQ ID NO: 143157 - RNA, 64 nt, hsa
uacaucuuggcuucuggcccaaaccccaagcagaaaagaaaauggaauaauggagcauuguuuu

SEQ ID NO: 143158 - RNA, 64 nt, hsa
agacacucuuugcauuuugucuaagcgaaauaaaaaagaaaagguugucugccuuuauuuccau

SEQ ID NO: 143159 - RNA, 64 nt, hsa
uucugacuggaaguucuaucacacaagaggcaagaaagaaaacagggugggugggaaaucagcc

SEQ ID NO: 143160 - RNA, 64 nt, hsa
accuuuuuuuuacggaauuccaauauuuauaauuaaagaaaauugccaaaauauauuaaaaaaa

SEQ ID NO: 143161 - RNA, 64 nt, hsa
auagcagauaucauguaggaaagagaggauaaacaaagaaaaaagaaaaaaaaauaagcucaua

SEQ ID NO: 143162 - RNA, 64 nt, hsa
auaucauguaggaaagagaggauaaacaaagaaaaaagaaaaaaaaauaagcucauacccaaau

SEQ ID NO: 143163 - RNA, 64 nt, hsa
guuuagauucuugauaaagauggaaauggaagagaaagaaaauuauauauguauauacuaaaga

SEQ ID NO: 143164 - RNA, 64 nt, hsa
uugauuucuuaaugaugacuucaaaaauuaauaaaaagaaaagaaaaaaaugauuucuggccgg

SEQ ID NO: 143165 - RNA, 64 nt, hsa
uucuuaaugaugacuucaaaaauuaauaaaaagaaaagaaaaaaaugauuucuggccgggcgug

SEQ ID NO: 143166 - RNA, 64 nt, hsa
ugccucaucgauaccccauuuagcuccagaaagcaaagaaaacucgaguaacacuuguuugaaa

SEQ ID NO: 143167 - RNA, 64 nt, hsa
aauuuuguguugauucagcuaaauuaugaaaaauaaagaaaaacuccuuugauaagcauggcuu

SEQ ID NO: 143168 - RNA, 64 nt, hsa
auuucucuuuccagcugcuguuuuguaaaaagaaaaagaaaaaagaagcccaaacuagugagag

SEQ ID NO: 143169 - RNA, 64 nt, hsa
accuacauuucucuuuccagcugcuguuuuguaaaaagaaaaagaaaaaagaagcccaaacuag

SEQ ID NO: 143170 - RNA, 64 nt, hsa
gaucugcggaaguaaccacaaaauauuaucgaaaaaagaaaagaauucuaaugaccagccguga

SEQ ID NO: 143171 - RNA, 64 nt, hsa
ucuguuuuuuaaccuuuuguuccgccauuuaaaaaaagaaaaaaaaaaagcuuauguuucuugu

SEQ ID NO: 143172 - RNA, 64 nt, hsa
uauacuauguauauagaagaacauguauauugagaaagaaaacauacuuauauagaggaauuua

SEQ ID NO: 143173 - RNA, 64 nt, hsa
uuggaauuucuuugaauucuguuaguaaugcccaaaagaaaagucucaagcagucccccuaucc

SEQ ID NO: 143174 - RNA, 64 nt, hsa
cuauguugguucacauguacaucuacuuuauaugaaagaaaaaacaguugucugccuguaaaau

SEQ ID NO: 143175 - RNA, 64 nt, hsa
agauaaucugauugcuguuguuuuguuuguuuggaaagaaaaaaaaugucuggcuucuucuacu

SEQ ID NO: 143176 - RNA, 64 nt, hsa
uuugaacauuuacaaaaugucacacuuuuucuuaaaagaaaaauauuuugggguuugaauaaaa

SEQ ID NO: 143177 - RNA, 64 nt, hsa
gcaugacccuccaaguagaccuguggcuuaaaauaaagaaaaugcagcaaaaagaaugcuauag

SEQ ID NO: 143178 - RNA, 64 nt, hsa
agccaacauuuaaaauuuauguuuuaugucaauaaaagaaaauauacuuuauugugacuucaac

SEQ ID NO: 143179 - RNA, 64 nt, hsa
uuuuguuaacuugauaauucuucaucuaccuuaaaaagaaaaaaauuacacauagucauucuug

SEQ ID NO: 143180 - RNA, 64 nt, hsa
aaauggguugccaacauaagcuggcugagaaauaaaagaaaacaagacaguuguucauaaaguu

SEQ ID NO: 143181 - RNA, 64 nt, hsa
guguaucaucaauaaaauuguauguuaaugcuggaaagaaaaaaagaagaaagaaagaaaccau

SEQ ID NO: 143182 - RNA, 64 nt, hsa
uaaaauggguauugauuuuuaggacgguuuugaaaaagaaaaguguugggaaugaagcaaguga

SEQ ID NO: 143183 - RNA, 64 nt, hsa
agcaaaucaauaacucuaaauucugggcugauauaaagaaaaaaacaauauuggauuuggauuu

SEQ ID NO: 143184 - RNA, 64 nt, hsa
uuugaguugcaaaaaguuuauaaaugcaaagcaaaaagaaaacauuuauuuucugagucugcag

SEQ ID NO: 143185 - RNA, 64 nt, hsa
uuggacgagaaaacaauaacgauaaaagacagugaaagaaaauaacgauaaaagacagugaaag

SEQ ID NO: 143186 - RNA, 64 nt, hsa
agacagugaaagaaaauaacgauaaaagacagugaaagaaaauaacaauaaaagacaaggaaaa

SEQ ID NO: 143187 - RNA, 64 nt, hsa
aaaaaauauacuugcuaucuauaaaaaagagaaaaaagaaaaaaaaugagaaaaaaguaagaaa

SEQ ID NO: 143188 - RNA, 64 nt, hsa
ugauauaucaguguuugagagugaccucuagaaaaaagaaaaguguuuuuagaaaugcguacaa

SEQ ID NO: 143189 - RNA, 64 nt, hsa
gccagccugaacuauauuuaagagacuuuguaaaaaagaaaaauguauauagcugugaguuuaa

SEQ ID NO: 143190 - RNA, 64 nt, hsa
uuguaauauauauaaggacuggaauuguguuuuuaaagaaaagcauucaaguaugacaauauac

SEQ ID NO: 143191 - RNA, 64 nt, hsa
uuaagaauuccaaaaaaaaaaaaaaaaaaaaaaaaaagaaaacuggguuugggcuuugcuuuag

SEQ ID NO: 143192 - RNA, 64 nt, hsa
uuauucauguacaauuuugguuacuugaauuguuaaagaaaacauuguuuuugacuaugggagu

SEQ ID NO: 143193 - RNA, 64 nt, hsa
aaaguaagaaagaaaaggacucccuuagaaugggaaagaaaaaucauaaaauauugagcugaug

SEQ ID NO: 143194 - RNA, 64 nt, hsa
gagacuccaucucaaaaaaaaaaaaaaaaguaagaaagaaaaggacucccuuagaaugggaaag

SEQ ID NO: 143195 - RNA, 64 nt, hsa
uuuuccucaaguuacuuuccuucauuuucuuaaaaaagaaaaaaaauuauuaaauguuucucac

SEQ ID NO: 143196 - RNA, 64 nt, hsa
ucaaggucaguucaggaaagcuuaagcaucgaaaaaagaaaaaaagccaugauguacccuccga

SEQ ID NO: 143197 - RNA, 64 nt, hsa
uuuaaaaauuagccuaagauauacuuguuuuuguaaagaaaaauauuuaauguugaacaaaaua

SEQ ID NO: 143198 - RNA, 64 nt, hsa
gaauguaagguauaucauucuaaagauagaguaaaaagaaaacaaaaccaaaaguuauuaaaau

SEQ ID NO: 143199 - RNA, 64 nt, hsa
aaauauuuuuuuccuaaaggaauaaagggugaggaaagaaaaauauuaaaaaagcuaauauuug

SEQ ID NO: 143200 - RNA, 64 nt, hsa
agaacauuaaaucuguuuccauuuuagucacagaaaagaaaagcagagucagcuacugagagcu

SEQ ID NO: 143201 - RNA, 64 nt, hsa
ucuucuuucccauuuuaaaaaagaaaagaaggaaaaagaaaaaaggggcaaggagccccgcggc

SEQ ID NO: 143202 - RNA, 64 nt, hsa
cuucuacccucccccucuucuuucccauuuuaaaaaagaaaagaaggaaaaagaaaaaaggggc

SEQ ID NO: 143203 - RNA, 64 nt, hsa
ccagggcaaauggaaaacaggagauccuaauaugaaagaaaaauggaucccaaucugagaaaag

SEQ ID NO: 143204 - RNA, 64 nt, hsa
uaacaaugucuucuugaaauuugugauggccaagaaagaaaaugaugaugacauuaggcuucua

SEQ ID NO: 143205 - RNA, 64 nt, hsa
acugcucagcaauguaaaagagacaaauaaggagaaagaaaaucuccaaaccaggaauguuuuu

SEQ ID NO: 143206 - RNA, 64 nt, hsa
ugauauaucaguguuugggagugaccucuagaaaaaagaaaacuguuuuuagaaauacauaaaa

SEQ ID NO: 143207 - RNA, 64 nt, hsa
gaggggguggggagguaaauuccucugacuugccaaagaaaaagaagggaaccacaguggauau

SEQ ID NO: 143208 - RNA, 64 nt, hsa
gcauuccugaauaauuuccaaauguuuuuaauccaaagaaaaagguuuaaagcuuauuucccuu

SEQ ID NO: 143209 - RNA, 62 nt, hsa
aaagugucuguacagcagccauccaaguugccccuacuuaguggcuugcccucugccugccu

SEQ ID NO: 143210 - RNA, 62 nt, hsa
acacaaguauaagacuuuuuguauuacugcucccuacuuaacauacuugaauucucaaauuu

SEQ ID NO: 143211 - RNA, 62 nt, hsa
acuggauguugacuguuaacuagaagcucuguccuacuuacagcacuuuggaucaucaaaaa

SEQ ID NO: 143212 - RNA, 62 nt, hsa
uauuuuccuguuacuacuguauaaagcuuaaaccuacuuaaacaacuacaagcuuuaagguu

SEQ ID NO: 143213 - RNA, 62 nt, hsa
acucucucauuuggagggaucaugugaguuggccuacuuacaaguagugaaaguucccuuuu

SEQ ID NO: 143214 - RNA, 62 nt, hsa
gcuuccuuauggcuuugcuucccacugggauuccuacuuaggugucugcccucaggggucca

SEQ ID NO: 143215 - RNA, 62 nt, hsa
ucucacaccagccucauuuccaacuccgacuuccuacuuagaauguggcaguggcuuuguga

SEQ ID NO: 143216 - RNA, 62 nt, hsa
ccucugcaagcuucuugcugaucagaguuccuccuacuuacaacccagggugugaacauguu

SEQ ID NO: 143217 - RNA, 62 nt, hsa
gugagacaaacaguuguaaagaugaguuuccaccuacuuauaccagagugcuaagaggaaau

SEQ ID NO: 143218 - RNA, 62 nt, hsa
ugaaugccugaggacgugugggaaccccguucccuacuuagcaugauccuugagucuccucu

SEQ ID NO: 143219 - RNA, 62 nt, hsa
auaagacugcucaguuuccaaggguuuucaagccuacuuaccuuuauaaagguucucuaguc

SEQ ID NO: 143220 - RNA, 62 nt, hsa
ugccguuuccacaguaaccuuuccagaugguuccuacuuaaaugauuucauaaggaaaacca

SEQ ID NO: 143221 - RNA, 62 nt, hsa
cuccaaggaaugggcuugugcuagaccgcugcccuacuuaacagcugccucauugcaagggc

SEQ ID NO: 143222 - RNA, 62 nt, hsa
aaguaaaauuucaaaauugauuuuguucauuaccuacuuaauauuuccuuuaaauauauacu

SEQ ID NO: 143223 - RNA, 62 nt, hsa
aauuuacauucgauaguguuacugauaacaaaccuacuuaagagauauguugcuuuuuacuu

SEQ ID NO: 143224 - RNA, 62 nt, hsa
acacacaaugcacacaacuccuaugacuggcuccuacuuacauucaaguuaaaaaggcugau

SEQ ID NO: 143225 - RNA, 62 nt, hsa
gccgaaaguaaaaacacaaaaacagauaccccccuacuuaauguaauucaggacuccaacca

SEQ ID NO: 143226 - RNA, 62 nt, hsa
aaaaaagaaaaaagagggaggaaaaaaaagaaccuacuuaagauagaacaugguuuuggcua

SEQ ID NO: 143227 - RNA, 62 nt, hsa
uugugacuuuguuucucaggaaaaaaaauauuccuacuuaaauuuuaagucuauaauucaau

SEQ ID NO: 143228 - RNA, 62 nt, hsa
acacauuucaaaguugcccuauggaaaugaauccuacuuagugacaagucaucaaauguuug

SEQ ID NO: 143229 - RNA, 62 nt, hsa
cuggccacugauuccuuugagucucacaaaacccuacuuaggucaucagggcaggaguucuc

SEQ ID NO: 143230 - RNA, 62 nt, hsa
caugaaaaagugcucaugacauauugagaagaccuacuuacaaaguggcauauauugcaauu

SEQ ID NO: 143231 - RNA, 62 nt, hsa
accuucaacuuugcuguaaaccuuuugguuuuccuacuuacucuucuucuguggaguuaucc

SEQ ID NO: 143232 - RNA, 62 nt, hsa
caaaaaauucuuaccguaauauuauaucuugcccuacuuauuuacaaaauaauauguuucug

SEQ ID NO: 143233 - RNA, 62 nt, hsa
uguuuuggauccaaggaccuguggacagucggccuacuuacucugagcugagggaacacuga

SEQ ID NO: 143234 - RNA, 55 nt, hsa
guguuacaucuucugcauaaaauuaccuacuuaaucaagauaagcacgcauuuuu

SEQ ID NO: 143235 - RNA, 62 nt, hsa
caaauguauauaaaauucucuguuggaauuugccuacuuaccuauaaacagcucacuacacu

SEQ ID NO: 143236 - RNA, 62 nt, hsa
agugucauauguaaaauggaauagaaucccugccuacuuaaguaacuguuggacaaaugaua

SEQ ID NO: 143237 - RNA, 62 nt, hsa
aagcuucauucucuucagugucuucuagaugcccuacuuaaagagaacauuuucuuaugucu

SEQ ID NO: 143238 - RNA, 62 nt, hsa
uuacuuuuuauaaaguuuuuuuuccuuagucuccuacuuagagauauucuagaaaaugucac

SEQ ID NO: 143239 - RNA, 62 nt, hsa
cuuucaucauucauucauguauuuauugagcaccuacuuauuauggugcucaacacuuguua

SEQ ID NO: 143240 - RNA, 62 nt, hsa
uaaaauuugauuguuaagauacaguaguggacccuacuuauucagucaauuaagaguaaguu

SEQ ID NO: 143241 - RNA, 62 nt, hsa
ucuaccucugccguuuuccugcaauuccgcuuccuacuuaggcaguucagagagaacaauuc

SEQ ID NO: 143242 - RNA, 62 nt, hsa
auucauaauuauuuuacauuuaaauuacuguuccuacuuaaguggugagcuugguaaccauu

SEQ ID NO: 143243 - RNA, 62 nt, hsa
ugucaauaacugugcauggucugagauuuuacccuacuuauaagcuaacaaguuagccuguu

SEQ ID NO: 143244 - RNA, 62 nt, hsa
acugacggguuaacagaaaugcuuugguaauaccuacuuaguuaauuggaggaaguaguaaa

SEQ ID NO: 143245 - RNA, 62 nt, hsa
cacagaaguuuuuauuuuauuaaaaaguauagccuacuuaaacgcgagaugacauauauaga

SEQ ID NO: 143246 - RNA, 62 nt, hsa
uauaaaucaauuguuuugcaaagaaguuauggccuacuuagaaucuaaaauuuguuauucaa

SEQ ID NO: 143247 - RNA, 62 nt, hsa
gauauuuuugggagugacaaacauucucucauccuacuuagccuaccuagauuucucaugac

SEQ ID NO: 143248 - RNA, 62 nt, hsa
gcaucuccaggcaaugaguuuuucaaagaaugccuacuuaguaguaagaugaagcucaggau

SEQ ID NO: 143249 - RNA, 62 nt, hsa
gcuucaaucacugucauuauucuaauccuacuccuacuuaaauuuuaaguuaugagguuuau

SEQ ID NO: 143250 - RNA, 62 nt, hsa
agcuaaaauggucagucuuuuuuagauguuuuccuacuuaguaucuccuaauaacguuuugc

SEQ ID NO: 143251 - RNA, 62 nt, hsa
gagauacugaacauuuugcaaaacuuaucacgccuacuuaagagugcuguguaacccccagu

SEQ ID NO: 143252 - RNA, 62 nt, hsa
uuauguucaaauuuuaguugggaguuuuguuuccuacuuaagcucaggacuugauacccucu

SEQ ID NO: 143253 - RNA, 62 nt, hsa
augaaugcaaaucagaaccaaugaucccuuggccuacuuaguuaaaaccaguucauacaucc

SEQ ID NO: 143254 - RNA, 62 nt, hsa
uuugugaguuuccaguugauuuguagcaaaugccuacuuaguucuuuguggauuguucuaga

SEQ ID NO: 143255 - RNA, 62 nt, hsa
agcacuuacuucguguccgacucuucugagcaccuacuuacaugcauuacugcaugcacuuc

SEQ ID NO: 143256 - RNA, 62 nt, hsa
cugcagcucccuggcuucuguggggccccucaccuacuuacccaggugggucccggcucugu

SEQ ID NO: 143257 - RNA, 62 nt, hsa
aacuuaagaauuuuuauaccaucuacaucuauccuacuuaugcagaaaaauaggcaauaaga

SEQ ID NO: 143258 - RNA, 62 nt, hsa
gaauuuugcaguaacugguauucuuggguuuuccuacuuaauacacaguaauucagaacuug

SEQ ID NO: 143259 - RNA, 62 nt, hsa
cccaaauauagaucuuauuucugcucauuuccccuacuuauuaaaaucacaccaaacacuua

SEQ ID NO: 143260 - RNA, 62 nt, hsa
gcauaaacaguuacuuggggauuugcgaaaauccuacuuaguuacugcguuuacaguucuuu

SEQ ID NO: 143261 - RNA, 62 nt, hsa
uuaauuggacgggagacagagugaagcaucaaccuacuuagaagcugaaacguggguaagga

SEQ ID NO: 143262 - RNA, 62 nt, hsa
uaauuuaucguguuaggagaagaacgaugauaccuacuuaacaccucagcaucugcgucgug

SEQ ID NO: 143263 - RNA, 62 nt, hsa
auuuuuuuaaaagccaccuggguugacaccuuccuacuuauccacuagaugucaucagaggu

SEQ ID NO: 143264 - RNA, 62 nt, hsa
gugguguaaucaaacccgaugcuuucagaugaccuacuuacaucuucaauguggauaagaua

SEQ ID NO: 143265 - RNA, 62 nt, hsa
acgguaccaauccuaggaacuguauacuaguuccuacuuagaacaaaaguaucaaguuugca

SEQ ID NO: 143266 - RNA, 62 nt, hsa
auguuagaauaagacuaccauucuaaauaucaccuacuuaugaauaacauguaauaauuuuu

SEQ ID NO: 143267 - RNA, 62 nt, hsa
uauuaaugcuaucaucucgaccaagcucaaagccuacuuauuagaaacaaugaaguucacaa

SEQ ID NO: 143268 - RNA, 62 nt, hsa
ccgcauuuccaguuguauuagccaauagauuuccuacuuauuuaagcuauuugagcuccggg

SEQ ID NO: 143269 - RNA, 62 nt, hsa
aauucuaucuuugauaaauuuuauuuuuaugcccuacuuaauauuugcaucaguauaauaua

SEQ ID NO: 143270 - RNA, 62 nt, hsa
guuaccaaguccuauuuggacauaaagaaaauccuacuuauagaaaaggagaaaauaauuaa

SEQ ID NO: 143271 - RNA, 62 nt, hsa
gacaaauaaacuauuuuguagaagaucagacuccuacuuaacuggaagagaaaugucuauua

SEQ ID NO: 143272 - RNA, 62 nt, hsa
ugaagucgcugcauaugugacugucaugagauccuacuuaguaugauccuggcuagaaugau

SEQ ID NO: 143273 - RNA, 62 nt, hsa
ucagauccuagcucaucaucagugaaguccagccuacuuacuuguaacuauuaaccuuucua

SEQ ID NO: 143274 - RNA, 62 nt, hsa
guaucuucucagcccugcuacugucugcugcuccuacuuagaaguugcaggcaauauccugu

SEQ ID NO: 143275 - RNA, 62 nt, hsa
ucuguuuugagcuuauuuagaguccuaguuuuccuacuuauaaaguagaaauggugagauug

SEQ ID NO: 143276 - RNA, 62 nt, hsa
ucucccaauacaggcaugaaccacugcacccaccuacuuagauauuucaugugcuauagaca

SEQ ID NO: 143277 - RNA, 62 nt, hsa
aagaaaauuuaguuguuaguugcuuugggaagccuacuuauggaguggaaaccaggagguua

SEQ ID NO: 143278 - RNA, 62 nt, hsa
gaaaacaagaaggaaaugaaaauauuuuuaugccuacuuaggaaaaaaaggguagcacuuau

SEQ ID NO: 143279 - RNA, 62 nt, hsa
aaaauuuuaggauaaugaagaguacauaauguccuacuuaauauuuauguuaauaggacuua

SEQ ID NO: 143280 - RNA, 62 nt, hsa
ggcugccccagaggacaguggguggagugguaccuacuuauuaaaugucucagaccccucuc

SEQ ID NO: 143281 - RNA, 62 nt, hsa
uaugaucuuggaaaauuuuaaagaaaaauaauccuacuuauaaacuacuuuuuuauaauugu

SEQ ID NO: 143282 - RNA, 62 nt, hsa
uuuacucuaaucaaggcaggagaugcagcaguccuacuuauugccauguggacuugugggaa

SEQ ID NO: 143283 - RNA, 62 nt, hsa
cagagaaaaaaaucguauugaauggccauuucccuacuuauaagaugucucaaucugaauuu

SEQ ID NO: 143284 - RNA, 62 nt, hsa
gcccugcaaauguuuacagaaaugaaauucuuccuacuuauauaagaaaucucacacugaga

SEQ ID NO: 143285 - RNA, 62 nt, hsa
uguguguguguguguccacacuggccagccucccuacuuaccaagguucuccacugcuuacc

SEQ ID NO: 143286 - RNA, 62 nt, hsa
cuuaaaccaggugaaagagcaaaguucaagugccuacuuaugugucauucgcucauguaaga

SEQ ID NO: 143287 - RNA, 62 nt, hsa
agaugaauuauugaucuuccuaauaucaggcgccuacuuaaccuaugguguguacuuuuugu

SEQ ID NO: 143288 - RNA, 62 nt, hsa
aguucgauauuuuacuuuagaaccuggaaucuccuacuuaauauaugaccaugacuuugaaa

SEQ ID NO: 143289 - RNA, 62 nt, hsa
auuuuuaggagaaaguaaguugcuuugcaccgccuacuuaauucuuuuccauauauugugau

SEQ ID NO: 143290 - RNA, 62 nt, hsa
uaucuaugauugaguguccguguaaauaaauuccuacuuagacuuaccacuuugugugugcu

SEQ ID NO: 143291 - RNA, 62 nt, hsa
gccaccauacaguggccucaaagcaaccauggccuacuuaaaaaccaaaccaaaaauaaaga

SEQ ID NO: 143292 - RNA, 62 nt, hsa
gagcaugccauuuugaggggaggguaguugugccuacuuauccccuggcagaggggaugcca

SEQ ID NO: 143293 - RNA, 62 nt, hsa
uacucuuccaaaagccugcaucggggauuccaccuacuuauuucagauucaccuccauuaac

SEQ ID NO: 143294 - RNA, 62 nt, hsa
uuucuuuagaaugcuguuuaaacaccauuuacccuacuuaucccucaaugcacaugauugau

SEQ ID NO: 143295 - RNA, 62 nt, hsa
guuaacgggugaugaagcaagaaaucuuccuuccuacuuaugucuuaaagauggacagccug

SEQ ID NO: 143296 - RNA, 62 nt, hsa
uacugccccacuuuaauauauguaagcaacuuccuacuuauacacgacguguuccuaaaaca

SEQ ID NO: 143297 - RNA, 62 nt, hsa
aagguguggugcuggaacaucgaugaaggagcccuacuuacugagcuuaguuauggacuuuu

SEQ ID NO: 143298 - RNA, 62 nt, hsa
uuuaaugaggaauaauaugcauguagaaaagaccuacuuaaagucuucauuuauauucuuuc

SEQ ID NO: 143299 - RNA, 62 nt, hsa
uuacuuaaacguacuuucaggagugagcaaguccuacuuauaaaccuauauuaacuuuauuu

SEQ ID NO: 143300 - RNA, 62 nt, hsa
guaagagaaaugcagucaggagcacagcauccccuacuuacuaucacuacaagaaaacugag

SEQ ID NO: 143301 - RNA, 62 nt, hsa
guugcucauuugcccuuuuccauguauuuuuuccuacuuaggauuuuccacucuaucuuugu

SEQ ID NO: 143302 - RNA, 62 nt, hsa
gugaaaaacuguguugggggggagacacuacuccuacuuaucuugcucauaaagccuuuucu

SEQ ID NO: 143303 - RNA, 62 nt, hsa
uuucagaggcauucccagcccuucacuuaacuccuacuuagcuccaaaauaccuguauccaa

SEQ ID NO: 143304 - RNA, 62 nt, hsa
ugaaauguggcaguccucucagggguaccccaccuacuuagggaucugaguucuucaguucc

SEQ ID NO: 143305 - RNA, 62 nt, hsa
ucaauguaucuacaggcuuguuauugaaacuuccuacuuauuugaugugauuuauuaauaua

SEQ ID NO: 143306 - RNA, 62 nt, hsa
uuagggaacuucaaauagugcguagacuuuucccuacuuaccauuggguucaauugauguag

SEQ ID NO: 143307 - RNA, 50 nt, hsa
gugcauugaaacugcugugaccuacuuacaccaugucuguagcuauuuuc

SEQ ID NO: 143308 - RNA, 62 nt, hsa
agguuaaaugaaccccugggcuuaauuuucccccuacuuaguucuguggcagcaaagaaaag

SEQ ID NO: 143309 - RNA, 62 nt, hsa
ugugaggaacaggccucaggcccuugccacgaccuacuuaggcuacaauuuccuuuaaggca

SEQ ID NO: 143310 - RNA, 62 nt, hsa
guuaaaugcaguuuuaaauuuauaucguaacaccuacuuaagugccugacacaguagguauu

SEQ ID NO: 143311 - RNA, 62 nt, hsa
gaagaugaacacuugaggacuucagcuucucaccuacuuaguacaguugggaaccauacacu

SEQ ID NO: 143312 - RNA, 62 nt, hsa
acuccaucucaaaacaaaacaaaaaaaauuagccuacuuaaaggcacaacuaaaugcuuuau

SEQ ID NO: 143313 - RNA, 62 nt, hsa
cauacauacauuucauuuaauuauccaauaauccuacuuacuauuguuuauucucaauuuac

SEQ ID NO: 143314 - RNA, 62 nt, hsa
uggacagagcagcuuggcuuuucaugugcccaccuacuuaccuacuaccugcgacuuucuuu

SEQ ID NO: 143315 - RNA, 62 nt, hsa
cuguccagcggccucuuuggcugcauucagccccuacuuaccuggggaccccggcuggggca

SEQ ID NO: 143316 - RNA, 62 nt, hsa
gagggugccaucgagggcuccggaucccuuauccuacuuagcaguguuggucucuggggcug

SEQ ID NO: 143317 - RNA, 62 nt, hsa
uucaaggaaggaagugggaacaagguuggaugccuacuuaugagcuugaccaucacagcuau

SEQ ID NO: 143318 - RNA, 62 nt, hsa
cggccaccacugcagccgggggcuggccuucuccuacuuagggaagaaaaagcaaguguuca

SEQ ID NO: 143319 - RNA, 62 nt, hsa
ggaaaugcuuuucugaaaguaugaguguugugccuacuuaauucugauaaaccugucuaagc

SEQ ID NO: 143320 - RNA, 62 nt, hsa
agaagauuaauuaauuuccuauccuaaucccuccuacuuauacuuccccaaaaaacaagcuu

SEQ ID NO: 143321 - RNA, 62 nt, hsa
gaggucagcccguuacccccauaacugauuuaccuacuuaccauacugggagguagaagaga

SEQ ID NO: 143322 - RNA, 62 nt, hsa
uuguuuuccaguaggggauuagaauguuuaguccuacuuaguaagaaaaauauuguauuuuu

SEQ ID NO: 143323 - RNA, 62 nt, hsa
ugauccuaaccuuuuagccugcucucuagaacccuacuuacaguugaccaagcugcuuaaag

SEQ ID NO: 143324 - RNA, 62 nt, hsa
ccauaauccccaccgcuuccugucucagcggaccuacuuaaguuguucacuuuacuugccug

SEQ ID NO: 143325 - RNA, 62 nt, hsa
gguccugcugggagcucccccugccucuuuccccuacuuagcuccuuagcaaagagacccug

SEQ ID NO: 143326 - RNA, 62 nt, hsa
cccccaggacugcugcuggagccuggacacguccuacuuaagaaaaugccuuuuacucaggg

SEQ ID NO: 143327 - RNA, 62 nt, hsa
uggauucugcagacugaaacgaguaaagcuugccuacuuaauacacucaaguguggggaguc

SEQ ID NO: 143328 - RNA, 62 nt, hsa
cuugauucuuuuagcaaaucaaugcacguuauccuacuuaauccuuaaauaaguuuagauuu

SEQ ID NO: 143329 - RNA, 62 nt, hsa
cucuccaccucucacccacucucuccuaauccccuacuuaaguagggcuugccccacuucag

SEQ ID NO: 143330 - RNA, 62 nt, hsa
uaacacaucacaucuaagaauaaaggcugccuccuacuuaauugcuauauaacaauugucca

SEQ ID NO: 143331 - RNA, 62 nt, hsa
guuguccuaguuucuggaaucaccgaauaauuccuacuuacugauauaccuuguauauuuac

SEQ ID NO: 143332 - RNA, 62 nt, hsa
uuaugcaugagaacuaaauagauuuuuagauuccuacuuaaacaaaaacuuuccaugacagu

SEQ ID NO: 143333 - RNA, 62 nt, hsa
cagaaugagcccaccuggcuuugaaucugggcccuacuuaacuuaucagcuaugugguuuug

SEQ ID NO: 143334 - RNA, 62 nt, hsa
gcugccagccuucuguccugggcaaacuacucccuacuuaagggaauaggccaggcuccauc

SEQ ID NO: 143335 - RNA, 62 nt, hsa
cuccuuguuugcacauuauuauggaacacuuuccuacuuaggcaguuacucuuccauguuua

SEQ ID NO: 143336 - RNA, 62 nt, hsa
aagcagcaccugugggccauacuaaaagauccccuacuuacguucugguugucauguuuccc

SEQ ID NO: 143337 - RNA, 62 nt, hsa
gaauucuuccuagauagucgcccacuccaccuccuacuuaaccugagacucauuauuuagcu

SEQ ID NO: 143338 - RNA, 62 nt, hsa
ugguaccuaugaaccuagaacuugaagugacuccuacuuaucacguaaauuuuuaugucuga

SEQ ID NO: 143339 - RNA, 62 nt, hsa
gagaauguacuuauauuuuguuuugcuauuaaccuacuuacgggguuagggauuugcggggg

SEQ ID NO: 143340 - RNA, 62 nt, hsa
uauccuucaaaagaaccacacuagggucuccaccuacuuauacaaugcggaugcccaacugu

SEQ ID NO: 143341 - RNA, 62 nt, hsa
accaguccacgccgggucgccugcccugucucccuacuuagacccagucauucuagagggau

SEQ ID NO: 143342 - RNA, 62 nt, hsa
uguuuuuaguuacacacacacacacacacacaccuacuuaaauggaaucuaaacauuuuuag

SEQ ID NO: 143343 - RNA, 62 nt, hsa
uccauuuuaauugauaugaggguguuaaaguaccuacuuaauggguugauuacuaucaaaau

SEQ ID NO: 143344 - RNA, 62 nt, hsa
uccaccuaccgcuuaccugaaaugcaggaucaccuacuuacuguauucuacauuauuauaug

SEQ ID NO: 143345 - RNA, 62 nt, hsa
ucaucgagcucuaucaacacugguaacuaagaccuacuuaugccacauaagagaugcauuuu

SEQ ID NO: 143346 - RNA, 62 nt, hsa
agggagacauuuuagucaguaagacgauauaaccuacuuacuccguaaggggaaaugaaggc

SEQ ID NO: 143347 - RNA, 62 nt, hsa
ggaaauuauauaccgugacugaaaacuagaguccuacuuacauaguugaaauaucaaggagg

SEQ ID NO: 143348 - RNA, 64 nt, hsa
gaggcuaaacuguugaugaaugagagacucccugacugcucagaugacccuagccacacugaaa

SEQ ID NO: 143349 - RNA, 64 nt, hsa
uacacaucacuacacuaaacacugcucuagauaaacugcucaaguucauuuaacucauuugaug

SEQ ID NO: 143350 - RNA, 64 nt, hsa
uucacucuaccugcaugaguauaacaauuuugauacugcucauuuagaaauaaaucaucugguu

SEQ ID NO: 143351 - RNA, 64 nt, hsa
gcacuguuuuagaagcuuacuuaguuuuauaaacacugcucauuuuuggauguuuguagauaac

SEQ ID NO: 143352 - RNA, 64 nt, hsa
caauuuggccgggauggacuaaugaggcucuaacacugcucaggagaccccugcccucuaguug

SEQ ID NO: 143353 - RNA, 64 nt, hsa
ugugucuacacaggauaaacccaauacauauuguacugcucagugauuaaauggguucacuucc

SEQ ID NO: 143354 - RNA, 64 nt, hsa
caugggaaagaaaauucuggcuucacuacugcucacugcucacuuucugaucacucugauacuu

SEQ ID NO: 143355 - RNA, 64 nt, hsa
caggagucaugggaaagaaaauucuggcuucacuacugcucacugcucacuuucugaucacucu

SEQ ID NO: 143356 - RNA, 64 nt, hsa
ggaaugcuaagcuugugggagucauuuacauccuacugcucaaagucauugccaaggucugauu

SEQ ID NO: 143357 - RNA, 64 nt, hsa
aaggccacuggcaguaggauuuaaaaagcagcccacugcucaguuuccaggaucagcuuccucc

SEQ ID NO: 143358 - RNA, 64 nt, hsa
ucuccucugcagccagauucacuggcugaugcucacugcucacugucuauccccacgaaauuua

SEQ ID NO: 143359 - RNA, 64 nt, hsa
cucaauuugugucuguuuacagcucucucuccucacugcucacagcaagggguucuguaucagu

SEQ ID NO: 143360 - RNA, 64 nt, hsa
gagugagccugguguucuugccuucuuggaaauuacugcucaccugguaucuguacguuaaugu

SEQ ID NO: 143361 - RNA, 64 nt, hsa
ccaugcuguugggcaaagcaacucuuuuucaaccacugcucaucaguuucuguagagacaaaaa

SEQ ID NO: 143362 - RNA, 64 nt, hsa
aaguuuuuauauagccugaauacucacuugacuuacugcucauuuuacuuuuugcauggaauac

SEQ ID NO: 143363 - RNA, 64 nt, hsa
acauuuuuuaaaugucgaguaaaacuucgugaaaacugcucauaaagacuaaaaguugaccugu

SEQ ID NO: 143364 - RNA, 64 nt, hsa
gcaccauuuggaggguuuugcugacacagcggggacugcucagcacucccuaaaaacacaccau

SEQ ID NO: 143365 - RNA, 64 nt, hsa
caccugccccccgcccuccccauccccuacucccacugcucagcgcgggccauugcaagggugc

SEQ ID NO: 143366 - RNA, 64 nt, hsa
aguggccagcauucugccugcagacccugagcacugagucaacaagguuugugaugaugucugu

SEQ ID NO: 143367 - RNA, 64 nt, hsa
gaaggcaagagcuguuuccuuuccauuucuacaaugagucaauugcagaugaugcuauaacacu

SEQ ID NO: 143368 - RNA, 64 nt, hsa
aguuuccugaggccucccccgccauguggaacugugagucaauuacaccucuuucauuuauaaa

SEQ ID NO: 143369 - RNA, 64 nt, hsa
guccgauucugaggucucuucucucaucuagcacugagucaagcaaucagcaggcugggcaccc

SEQ ID NO: 143370 - RNA, 64 nt, hsa
gugcgugcguguguguucacguguucucgugcgggcgcgugaguggucuucaaacgaggguccc

SEQ ID NO: 143371 - RNA, 64 nt, hsa
cugugcaguaaucgagauugggagaauuugggcagcgcgugagaagugcuaagcuacuuguuuu

SEQ ID NO: 143372 - RNA, 64 nt, hsa
agucugaacuaaggccugagcuguggauaccauggcgcgugaguuagauguggucccugcccuc

SEQ ID NO: 143373 - RNA, 64 nt, hsa
gacagcugcgggugcccaagcccuugcugggccugcgcgugaggagucccacugcuucuaaagg

SEQ ID NO: 143374 - RNA, 64 nt, hsa
cggcugccugcguccauggucuaguggcagccgggcgcgugaggagcggcaggccuugaggcug

SEQ ID NO: 143375 - RNA, 64 nt, hsa
gcaucagcagggaccccggcggacgugggcgggcgcgcgugagcucgggcugcccggccgggcg

SEQ ID NO: 143376 - RNA, 64 nt, hsa
cuauaaccuagguaaagcauaaucugucagagaagcgcgugagaaauuugaaaugaaggcauuu

SEQ ID NO: 143377 - RNA, 64 nt, hsa
cugugcuugcuccuaagcaaaagggaaaaggagcgcgcgugauagaagaaaagcacugggagaa

SEQ ID NO: 143378 - RNA, 64 nt, hsa
cagagcuuuaaagaagugggacucagccauguuggcgcgugauugacauuacagcacagaaaac

SEQ ID NO: 143379 - RNA, 64 nt, hsa
aggacagagugugugcgugcgugugggugugugcgcgcgugagcacacacgcguguguuggggg

SEQ ID NO: 143380 - RNA, 64 nt, hsa
uaaauauauuauauauggaugugugugugugcgugcgcgugagugugugagcgcuucugcagcc

SEQ ID NO: 143381 - RNA, 64 nt, hsa
caagaagccuguuugguggucucuucacacggacgcgcgugacacaaugcugggugguuuuccc

SEQ ID NO: 143382 - RNA, 64 nt, hsa
cuggacucggccuggaccaggggaccucgggacugcgcgugaggccccggcccuccaaauccaa

SEQ ID NO: 143383 - RNA, 64 nt, hsa
cccuccgcggcgggcccugcccacaccuccuggggcgcgugaggcccguggggccggggcuucu

SEQ ID NO: 143384 - RNA, 63 nt, hsa
ccucccaaagcagccugaccugcgugggagaggcguagcgaggucggaggggaaagggagauc

SEQ ID NO: 143385 - RNA, 63 nt, hsa
cucuaaaauucuguucccaagaugcaguccuagcguagcgaacguuccuggaguggggugaag

SEQ ID NO: 143386 - RNA, 63 nt, hsa
ccagccccaaggaugaagcaagacauguggggccguagcgaggugucacauggggcagggaag

SEQ ID NO: 143387 - RNA, 63 nt, hsa
caaauacauuccuuuuagaguuaagaacuaugacguagcgaguuagugagacuagacauagua

SEQ ID NO: 143388 - RNA, 64 nt, hsa
uggcugacuucgggcuggcgcgucucaugguggacgagaagacucagccugagggccugcggag

SEQ ID NO: 143389 - RNA, 64 nt, hsa
uccccaucaccgugcgcuguugcgaucuggaccccgagaagaggccauccuuugugaagcugga

SEQ ID NO: 143390 - RNA, 64 nt, hsa
cagaaucucuggacggagcugcuggcagcuucugcgagaagagagagauguggaaggcaccuuc

SEQ ID NO: 143391 - RNA, 64 nt, hsa
cuuccugacccuggcaccugugucuacuugcucccgagaagaggagcgcucaugucuuuuuugc

SEQ ID NO: 143392 - RNA, 64 nt, hsa; identical to SEQ ID NO: 94932

SEQ ID NO: 143393 - RNA, 64 nt, hsa; identical to SEQ ID NO: 94933

SEQ ID NO: 143394 - RNA, 64 nt, hsa; identical to SEQ ID NO: 94934

SEQ ID NO: 143395 - RNA, 64 nt, hsa; identical to SEQ ID NO: 94935

SEQ ID NO: 143396 - RNA, 64 nt, hsa; identical to SEQ ID NO: 94936

SEQ ID NO: 143397 - RNA, 64 nt, hsa; identical to SEQ ID NO: 94937

SEQ ID NO: 143398 - RNA, 64 nt, hsa; identical to SEQ ID NO: 94938

SEQ ID NO: 143399 - RNA, 64 nt, hsa; identical to SEQ ID NO: 94939

SEQ ID NO: 143400 - RNA, 64 nt, hsa; identical to SEQ ID NO: 94940

SEQ ID NO: 143401 - RNA, 64 nt, hsa; identical to SEQ ID NO: 94941

SEQ ID NO: 143402 - RNA, 64 nt, hsa; identical to SEQ ID NO: 94942

SEQ ID NO: 143403 - RNA, 64 nt, hsa; identical to SEQ ID NO: 94943

SEQ ID NO: 143404 - RNA, 64 nt, hsa
ggaggauggcuugaagccaguaguucaagaccagccugggcaacauaguaagaccccaucucua

SEQ ID NO: 143405 - RNA, 64 nt, hsa
ugcagugagcugugauugugccacuguuuuccagccugggcaauacagugagacccugucucaa

SEQ ID NO: 143406 - RNA, 64 nt, hsa
ggagaauugcuugaguccaggaguuugagaugcgccugggcaacauagaaaccugugucuacaa

SEQ ID NO: 143407 - RNA, 64 nt, hsa
ugcagugagcugagaucgcaccauuacacuccagccugggcaacagagccagacucugucucaa

SEQ ID NO: 143408 - RNA, 64 nt, hsa
cccaugggaauccuguccugccucgaaggagcagccugggcagccaucacaccacgaggacagg

SEQ ID NO: 143409 - RNA, 64 nt, hsa
cccuguccaaggaccuucccucuucuccccaguuccugggcaaucacuucaccuuggacaaagg

SEQ ID NO: 143410 - RNA, 64 nt, hsa
ugggcagccggccuggcuugaaguccgccaugacccugggcacaggggaagcccagccgugggc

SEQ ID NO: 143411 - RNA, 64 nt, hsa
cccgugaggagcuucccgcagccgccuggcccagccugggcacguucuccgaggcaugugucuc

SEQ ID NO: 143412 - RNA, 64 nt, hsa
ucuuuacacugacuucaggauagaugcugggaugccugggcauggccacauguuacauguacag

SEQ ID NO: 143413 - RNA, 64 nt, hsa
gcgcgugaggagucccacugcuucuaaaggaaguccugggcaggagguggcuuuggugguuggu

SEQ ID NO: 143414 - RNA, 64 nt, hsa
ugcagugagccaagauggcaccauugcacucuagccugggcagcagagcgagacccugucucaa

SEQ ID NO: 143415 - RNA, 64 nt, hsa
ggcagauggcuugaguccaggaguucaagacuagccugggcaauguggcaaaaccgcguguuua

SEQ ID NO: 143416 - RNA, 64 nt, hsa
gugugaagguuucagugaacugagaucacuccaaccugggcaauaaagccagacucugucucaa

SEQ ID NO: 143417 - RNA, 64 nt, hsa
uuggcgggggugcugggccuguuguuuuccuuugccugggcauucuccucauguuucccaccug

SEQ ID NO: 143418 - RNA, 64 nt, hsa
gcaguaagccaagaucacaccacuggcacuccagccugggcaacagagugagacccugucucaa

SEQ ID NO: 143419 - RNA, 64 nt, hsa
gaccccaucucuauuuaaaaaaugaacaaaauuaccugggcauagugguguauaccuguagucc

SEQ ID NO: 143420 - RNA, 64 nt, hsa
agcuaagcauuuuuuaaauugaguuugagacuagccugggcaacauagugagaccccaucucua

SEQ ID NO: 143421 - RNA, 64 nt, hsa
aguguuauuaaaaaauuacaaaggccuagaccagccugggcaacauggugaaaccccaucucua

SEQ ID NO: 143422 - RNA, 64 nt, hsa
ugcagugaaucaugaucaugccacuguacuccagccugggcaacagagaccaucuuaaaaaaaa

SEQ ID NO: 143423 - RNA, 64 nt, hsa
ugcagugagcagagaucgcaccacugcacuccagccugggcaagagugagacugugucucaaaa

SEQ ID NO: 143424 - RNA, 64 nt, hsa
ggaggaucacuuagguccaggaguucgagacuagccugggcaacauagugagacaccggaucua

SEQ ID NO: 143425 - RNA, 64 nt, hsa
ugcagugagccgugauugcaccacugcacuccagccugggcaacagagcaagacccugucuugg

SEQ ID NO: 143426 - RNA, 64 nt, hsa
agccuguggccucugcgccuccugccacugaggcccugggcagaugcugcagcccgcccccuuc

SEQ ID NO: 143427 - RNA, 64 nt, hsa
gcugugggccagggaauccagcggcgucuggccuccugggcacugcuugccuggccucgugcuu

SEQ ID NO: 143428 - RNA, 64 nt, hsa
ugaaaagaacuuaaggccacaauucacgucucguccugggcauugugauggauugacccuccau

SEQ ID NO: 143429 - RNA, 64 nt, hsa
ccaguggcucucaacccaugcgcuaccaaauacgccugggcagccgggacgggccggcgggcac

SEQ ID NO: 143430 - RNA, 64 nt, hsa
aaccugugagucucuucugcaugcaggaguuucuccugggcagcuggucacuccccagagaagc

SEQ ID NO: 143431 - RNA, 64 nt, hsa
ggacagcuggaccccugaacuuccucuccucuuaccugggcagaguguugucucuccccaaauu

SEQ ID NO: 143432 - RNA, 64 nt, hsa
ugcaguaagcugagaucccaccauugcacuccagccugggcaacagagugagacuccaucucaa

SEQ ID NO: 143433 - RNA, 64 nt, hsa
ccuugugaugggcagugagacaagggauguucuaccugggcauguccccagcgaggggguuggg

SEQ ID NO: 143434 - RNA, 64 nt, hsa
augccccugaguucuuuuggucccagagaggcagccugggcagucuguuuacagcuggcaaaca

SEQ ID NO: 143435 - RNA, 64 nt, hsa
ugaggaagggagaaggcagaacccauaggcagucccugggcaagggaggauuuucccggccgca

SEQ ID NO: 143436 - RNA, 64 nt, hsa
ccaggaacuagagccccaaccacagcagaugcuuccugggcagccacuggccaggccguuguau

SEQ ID NO: 143437 - RNA, 64 nt, hsa
acguacgcacacacgcacaugcacagauaugccgccugggcacacagauaagcugcccaaaugc

SEQ ID NO: 143438 - RNA, 64 nt, hsa
ggauacacacgcacgcacacaugcagauaugcugccugggcacacacuuccggacacacaugca

SEQ ID NO: 143439 - RNA, 64 nt, hsa
ggcaguucgcuugggcccaagaguucgagaccagccugggcaacauggugaaacccuaucuccg

SEQ ID NO: 143440 - RNA, 64 nt, hsa
ugagccgaggucaugccacugcacuccagccuggccugggcaacagagcaagacccugucucaa

SEQ ID NO: 143441 - RNA, 64 nt, hsa
gaggaugauggauggucgggauugaggcuguugaccugggcaguagcuccucccauggccagug

SEQ ID NO: 143442 - RNA, 64 nt, hsa
ugagaaaccugcccugaacucaccgccuccccugccugggcacucccuccucccugcgcccaca

SEQ ID NO: 143443 - RNA, 64 nt, hsa
agccccaugggccgucacaaaggcuugaucacugccugggcaguggcacaaccaucccccaugu

SEQ ID NO: 143444 - RNA, 64 nt, hsa
agcuaugguugaguaacuaaaggucuggcaagacccugggcacacagggagcugccuagcaucu

SEQ ID NO: 143445 - RNA, 64 nt, hsa
uaucucuccagguggcccuaugcacccagguagcccugggcauggagcaccuguccaacaaccg

SEQ ID NO: 143446 - RNA, 64 nt, hsa
agcaagccgugaggagggagcccgcucaggauggccugggcaggggaggacaucucuagaggga

SEQ ID NO: 143447 - RNA, 64 nt, hsa
ugcauugagcugagaucaugcuagugcgcuccagccugggcaacagagcgagacuucaucucag

SEQ ID NO: 143448 - RNA, 64 nt, hsa
uggagugagcugagaucgcgccaccgcacuccagccugggcaacagagcgagacuccaucucaa

SEQ ID NO: 143449 - RNA, 64 nt, hsa
ugcaaugagcuaugauuucaccacugcauucuagccugggcaacagagugagauccugacucaa

SEQ ID NO: 143450 - RNA, 64 nt, hsa
ggaggauugcuugaggccgaggguucaagacuagccugggcaacauagcgagacugcaucucua

SEQ ID NO: 143451 - RNA, 64 nt, hsa
ugcagugagcacagaucacaccacugcacuccagccugggcaacagagugagacccuauuucaa

SEQ ID NO: 143452 - RNA, 64 nt, hsa
gguggauugcuuaagcccaggaguucaagaccagccugggcaacauggcuaaaccccaucucua

SEQ ID NO: 143453 - RNA, 64 nt, hsa
ugcagugagccaaggucacgucacugcacucuagccugggcaacagaguaagacaaaaaaauau

SEQ ID NO: 143454 - RNA, 64 nt, hsa
gguagauuacuugagcccaggaauucaagaccagccugggcaacauggugaaacccuguuucua

SEQ ID NO: 143455 - RNA, 64 nt, hsa
ggaggauugcuugaagcuaggaguuugagaccagccugggcaacaggguaagguccugucucua

SEQ ID NO: 143456 - RNA, 64 nt, hsa
cugcagugagcugugaugugcccuuaugcuauagccugggcaagagcgugagacccugucucaa

SEQ ID NO: 143457 - RNA, 64 nt, hsa
ggcggaucacuugaggccaggaauuugaaaccagccugggcaaaacccugucucuacuaaaaau

SEQ ID NO: 143458 - RNA, 64 nt, hsa
ugggcagaugggcacaggugcuggugaugccucuccugggcaaaacgccccauuuguggcacuu

SEQ ID NO: 143459 - RNA, 64 nt, hsa
cucuguggcgcggggcauccuaugaggcaggcacccugggcagagagaugcagugggugcgggg

SEQ ID NO: 143460 - RNA, 59 nt, hsa
uggacgaggaccagcugugaggcgggcgcccugggcagagagacucuguggcgcggggc

SEQ ID NO: 143461 - RNA, 64 nt, hsa
ugagcaccucggcuucggagcacccugccaggccccugggcaucgccggacguccuacucaggc

SEQ ID NO: 143462 - RNA, 64 nt, hsa
cugagcggagcgguggagagggagaggcuggaggccugggcagaacagcgccgcccgggcagac

SEQ ID NO: 143463 - RNA, 64 nt, hsa
gcuagagugagccgugaucaccagugcacucuagccugggcaacagagaaagacccugucucaa

SEQ ID NO: 143464 - RNA, 64 nt, hsa
ggaggaucgcuugaggccaggaguucgagaccacccugggcaacagagcgagaucccaucacua

SEQ ID NO: 143465 - RNA, 64 nt, hsa
ggagaaucgcuugagcucaggaguucgagaccagccugggcaacguggcgaaauccccgucuuu

SEQ ID NO: 143466 - RNA, 64 nt, hsa
aaggaucaccuugaggccaggaguuuaaggccagccugggcaacauagcaaaaccuagucccua

SEQ ID NO: 143467 - RNA, 64 nt, hsa
cgccuucugaacccgucucagcagguccacagcaccugggcagaggucagagaccaggggaggc

SEQ ID NO: 143468 - RNA, 64 nt, hsa
cucacagcgggacuacacaguugcuggcuuugcuccugggcaaggaggagcaggccagagccuc

SEQ ID NO: 143469 - RNA, 64 nt, hsa
ugcagugagccgagaucgcaccauugcacuccugccugggcaacaagagugaaacuccaucucc

SEQ ID NO: 143470 - RNA, 64 nt, hsa
ggcagauuauuugagcucaggaguuugagaccauccugggcaacauggcgaaacccuaucucua

SEQ ID NO: 143471 - RNA, 64 nt, hsa
ugcagugagcugagaucacaucauugcacuccagccugggcaacgggcgagacucugucucaaa

SEQ ID NO: 143472 - RNA, 64 nt, hsa
ggcaagaguuuuuuuaagacucuuaaaaaaagagccugggcaauuuuuuuaagacucugucuua

SEQ ID NO: 143473 - RNA, 64 nt, hsa
ugcagcgagccaagaucgugccacugcacuccagccugggcaagaguuuuuuuaagacucuuaa

SEQ ID NO: 143474 - RNA, 64 nt, hsa
ugcagugggcugugaucacaccacugcacuccagccugggcaacagagugagacccugucucug

SEQ ID NO: 143475 - RNA, 64 nt, hsa
ggaggaucacuugagcccaggaguucaagaccagccugggcaacauagugagacuccugucucu

SEQ ID NO: 143476 - RNA, 64 nt, hsa
ucccggagcuuggaggggcagccucaggugugugccugggcaccgcucacagccucuugcaccc

SEQ ID NO: 143477 - RNA, 64 nt, hsa
gguuagugguagagguggugagaagacaucagauccugggcacauucuuuucuucugcuucccu

SEQ ID NO: 143478 - RNA, 64 nt, hsa
caacagucaugacccugauaguuucccauaacaaccugggcauuccuugggacucaggagcugc

SEQ ID NO: 143479 - RNA, 64 nt, hsa
agugagccaucaucauggcaucauugcauuccagccugggcaacagagcaagaccucgucucaa

SEQ ID NO: 143480 - RNA, 64 nt, hsa
ggaacccaggcugggccugguggugaagagcaguccugggcacaggcugugagccagggugcug

SEQ ID NO: 143481 - RNA, 64 nt, hsa
cuugcagccguaugcugcacaagcguguacacccccugggcagccucaaaaccccgcuuacagc

SEQ ID NO: 143482 - RNA, 64 nt, hsa
cguggccgagggggccuugacggcguuggcggggccugggcacaggggcagccgcagggaggca

SEQ ID NO: 143483 - RNA, 64 nt, hsa
ccucccccucuuguugccuucgauuucggcaaagccugggcaggugccaccgggaaggaauggc

SEQ ID NO: 143484 - RNA, 64 nt, hsa
uguagugagccgagaucaugacacugcacuccagccugggcaacagagcgagaccaucucuuaa

SEQ ID NO: 143485 - RNA, 64 nt, hsa
cuuagguguuucagcauagauuccaguuucgcacccugggcagacccccaggccccauccggga

SEQ ID NO: 143486 - RNA, 64 nt, hsa
ggagccgugucacuccugggccaugggggcaccuccugggcacuuagguguuucagcauagauu

SEQ ID NO: 143487 - RNA, 64 nt, hsa
ccagugcagauggagcccaaggcccccucggccuccugggcaacuugggguacacaggauacug

SEQ ID NO: 143488 - RNA, 64 nt, hsa
gugacccggccacgucccccugccgcaucuuugaccugggcagcgacaacgaggaggugguggc

SEQ ID NO: 143489 - RNA, 64 nt, hsa
cccuugagcaguguacagccugcucaacaaccgcccugggcaggccgcuccugagcugcugucu

SEQ ID NO: 143490 - RNA, 64 nt, hsa
agcugggggugagaggcuggugguugccucccguccugggcaggcugcagccucaugccauguc

SEQ ID NO: 143491 - RNA, 64 nt, hsa
ugcagucagucaugauggcaccacugcacuccagccugggcaacagagcaagauccugucuuua

SEQ ID NO: 143492 - RNA, 64 nt, hsa
ggagcaucucuugaggccaggaguuugagaccagccugggcagcauagcaagacacaucccuac

SEQ ID NO: 143493 - RNA, 64 nt, hsa
ugcagugagcugagaucaugccacugcacuccagccugggcaacagagcaagacucugccucaa

SEQ ID NO: 143494 - RNA, 64 nt, hsa
ugaaaccccaucucuacuaaacaugcaaaaauuaccugggcaugguggcaggugcuuauaaucc

SEQ ID NO: 143495 - RNA, 64 nt, hsa
agcccauagacggcacaggccaccuggcccauucccugggcauucccugcuuugcauugcugcu

SEQ ID NO: 143496 - RNA, 64 nt, hsa
gggggccccagguacuguggagagcauaguccagccugggcauuugucuccuagcagccuacac

SEQ ID NO: 143497 - RNA, 64 nt, hsa
uguagugagccaagaucgugccacuacacuccagccugggcaacaaagcaagaccuugucucaa

SEQ ID NO: 143498 - RNA, 64 nt, hsa
ggcagaucacuugagcccaggaguucgagagcagccugggcaacaugacgaaaccccgucucua

SEQ ID NO: 143499 - RNA, 64 nt, hsa
cccuaccccaccacaccccaucccagaggccuugccugggcaacccuaagccccugucccucgc

SEQ ID NO: 143500 - RNA, 64 nt, hsa
uguccuaagcuguauuugugaauugugcugguuuccugggcauugccacgccuaccacaggugg

SEQ ID NO: 143501 - RNA, 64 nt, hsa
gccuggacggcuggaugggccugggcugggugggccugggcagcugggugggccugggcagcug

SEQ ID NO: 143502 - RNA, 64 nt, hsa
gccugggcugggugggccugggcagcugggugggccugggcagcugggugggccugagcuaggg

SEQ ID NO: 143503 - RNA, 64 nt, hsa
ggaaagauggggaaggguguggaguggggaggagccugggcagccugcugggugggccacacuc

SEQ ID NO: 143504 - RNA, 64 nt, hsa
ugugccucucaugcugccuccucugcccauggguccugggcacccaggccugcccugccugcug

SEQ ID NO: 143505 - RNA, 64 nt, hsa
accccuguuccccucagcuuucccuccucgcuggccugggcacccuccugggagcaggccuucc

SEQ ID NO: 143506 - RNA, 64 nt, hsa
ucaggcuuggggcuggggcaggcuugggcucaauccugggcacccaggggcagcccaccccuaa

SEQ ID NO: 143507 - RNA, 61 nt, hsa
ggcagaggcagggucgcugaguccuccagguccugggcagccuucauauuugccauugugu

SEQ ID NO: 143508 - RNA, 64 nt, hsa
uauccagcugggccagccucgugcugggcucugcccugggcagacaggcagagggccagagcag

SEQ ID NO: 143509 - RNA, 64 nt, hsa
ggaggaaugcuugagcccaagaguuuuagaccagccugggcaacacaguaagacccuguuucua

SEQ ID NO: 143510 - RNA, 64 nt, hsa
gacagauggcuugagcucaggaguucgugaccagccugggcaacccugucucuacaaaaaauac

SEQ ID NO: 143511 - RNA, 64 nt, hsa
ggaggacugcuugagcccaggaguuugagaccagccugggcaauguagcaagaccccaucucua

SEQ ID NO: 143512 - RNA, 64 nt, hsa
caugucccuccacuguuccuaucagcagguggccccugggcaucagaacagccugcccugggca

SEQ ID NO: 143513 - RNA, 64 nt, hsa
cagcagguggccccugggcaucagaacagccugcccugggcaccagguggcagacacacucaga

SEQ ID NO: 143514 - RNA, 64 nt, hsa
cauccuucucugcuugaccugaagaagggccagaccugggcagaaagacuccagcaggugagcu

SEQ ID NO: 143515 - RNA, 64 nt, hsa
accccuuggccaaccacaucucccugcuguguccccugggcauuucucuaccucccagguggaa

SEQ ID NO: 143516 - RNA, 64 nt, hsa
ugggaggaucacuugaguccagguucaagacuagccugggcaacauggcaagacccugucccua

SEQ ID NO: 143517 - RNA, 64 nt, hsa
ugcagugaacugagaucacgacacugcacuccagccugggcaacaguaaaaccuggucuccaaa

SEQ ID NO: 143518 - RNA, 64 nt, hsa
uuacaguagccgagaucgcgccacugcauuccagccugggcaacaaaagcgaaacucugucuca

SEQ ID NO: 143519 - RNA, 64 nt, hsa
ugcagugagcugagaucgcaccauugcacuccagccugggcaacaagagcgaaacucugucuca

SEQ ID NO: 143520 - RNA, 64 nt, hsa
aggcaucguacuaguugggcgagaccuaaaauucccugggcacagguugcaccugggugugagc

SEQ ID NO: 143521 - RNA, 64 nt, hsa
agcaaagcuauagagacaggugcauucagaacauccugggcaccagucaugagucuuacugugu

SEQ ID NO: 143522 - RNA, 64 nt, hsa
uucaguggcagugcuguaccccugggcagugcuaccugggcacacacguagacaagggcagcua

SEQ ID NO: 143523 - RNA, 64 nt, hsa
cauguuaagggcauuucaguggcagugcuguaccccugggcagugcuaccugggcacacacgua

SEQ ID NO: 143524 - RNA, 64 nt, hsa
ugcagugagccaagauugcaccacugugcucccaccugggcaacagugagacccugucucaaaa

SEQ ID NO: 143525 - RNA, 64 nt, hsa
ggcagaucacugaagcucaggaguucaagaccagccugggcaacauggcgaaacuccauuucua

SEQ ID NO: 143526 - RNA, 64 nt, hsa
gaaggaucgcugcagcccaggaguucgagacuagccugggcaacauagcgagaccucgucucua

SEQ ID NO: 143527 - RNA, 64 nt, hsa
ggaggauugcuugagcccaggaguuugagaccagccugggcaacacagcgagaccuugucucuu

SEQ ID NO: 143528 - RNA, 64 nt, hsa
cccuucccuguuccuuucuugcacgcgcucccugccugggcacaccaaacugguugaaacacag

SEQ ID NO: 143529 - RNA, 64 nt, hsa
uguucugcacugugggcuggcucucugccccaacccugggcacuggccccuggcugggccauuu

SEQ ID NO: 143530 - RNA, 64 nt, hsa
uggcggggggucagcagcaugucccugggcaggcccugggcacccugucuccccuggucucacu

SEQ ID NO: 143531 - RNA, 64 nt, hsa
ggggugcaggguggcggggggucagcagcaugucccugggcaggcccugggcacccugucuccc

SEQ ID NO: 143532 - RNA, 64 nt, hsa
gguggauugcuugagcccaggaguucaagagcagccugggcaauauagaaagaccucuucccua

SEQ ID NO: 143533 - RNA, 64 nt, hsa
ccaggccugaaacucccuuuccaggacucucaucccugggcacagaauucaggaaacugcuaga

SEQ ID NO: 143534 - RNA, 64 nt, hsa
ugcaaugagcuauaauugcaucauugcacuccagccugggcaacagagacccugucucaaccac

SEQ ID NO: 143535 - RNA, 64 nt, hsa
ucacacaaggaauauaaaaaccaccacccuccagccugggcaacguaguaaaaccucaucuaua

SEQ ID NO: 143536 - RNA, 64 nt, hsa
cucagcaagugcccaguggagccugccgcccccgccugggcaccgggacccccucaccauccag

SEQ ID NO: 143537 - RNA, 64 nt, hsa
gagccuuccuuucuccugccccaagggcccagacccugggcaaacagagcuacugagacuugga

SEQ ID NO: 143538 - RNA, 64 nt, hsa
ugcagugagucaagaucacgccauugcacuccagccugggcaacaagagcgaaacuccaucuca

SEQ ID NO: 143539 - RNA, 64 nt, hsa
ggaggauuacuugaaacccacaguuugagaccagccugggcaacauagugagacccugucucua

SEQ ID NO: 143540 - RNA, 64 nt, hsa
aggcggggaggauccauugagcccagcaguccaaccugggcaaaauagugagagacccuguauc

SEQ ID NO: 143541 - RNA, 64 nt, hsa
ugcagugagcugagauugugccacugcacuccagccugggcaacaaagcaagacucugucucaa

SEQ ID NO: 143542 - RNA, 64 nt, hsa
ugcagugagccaagaucaugucacugcauuccagccugggcaacagaggaagacuccgucucaa

SEQ ID NO: 143543 - RNA, 64 nt, hsa
ccccuggcagugcucccggaggggcccaggaaggccugggcagagacccuguaggaugggguca

SEQ ID NO: 143544 - RNA, 64 nt, hsa
gaagacugggggagagcaguggguucugggggggccugggcaggaucccagcucccuccccucu

SEQ ID NO: 143545 - RNA, 64 nt, hsa
ugcccuugauugugccagcccaugccacccccauccugggcacaguuacacccucccaugcagu

SEQ ID NO: 143546 - RNA, 64 nt, hsa
uucagugagccgagauugcaccauugcaccccagccugggcaacagagcgagacuccgucucaa

SEQ ID NO: 143547 - RNA, 64 nt, hsa
agaccagccccaaggccagaccaaggcauguaggccugggcagguggcucggggccacuggcgg

SEQ ID NO: 143548 - RNA, 64 nt, hsa
gagaagagggugaaggagcuggggcaggccccauccugggcauuggagaugaugaaaccgagca

SEQ ID NO: 143549 - RNA, 64 nt, hsa
cgggccucuagcuucagccagggcggguacacacccugggcacaggguccucagcccccgggaa

SEQ ID NO: 143550 - RNA, 64 nt, hsa
acaagggaggggaaacuccaucaggaagugcuccccugggcagaggcgcccacugggugcugug

SEQ ID NO: 143551 - RNA, 64 nt, hsa
ugucgugagcuaugauuaugccacugcuuuccagccugggcaacauaguaagaccccaucucuu

SEQ ID NO: 143552 - RNA, 64 nt, hsa
ugcagugagccaugaucgagccacugcacuccagccugggcaacagaugaagacccuauuucag

SEQ ID NO: 143553 - RNA, 64 nt, hsa
ggaggauugcuugaagccaggaguuugggaccagccugggcaacauagggggaucccaucucua

SEQ ID NO: 143554 - RNA, 64 nt, hsa
ugcagugagcuaugauuguaccacugcacuccagccugggcaacagagcaagaccuugucucaa

SEQ ID NO: 143555 - RNA, 64 nt, hsa
cuguagaagagauagcuauuaaaauaaucaguagccugggcauaguggcucacaccuguaaucc

SEQ ID NO: 143556 - RNA, 64 nt, hsa
ggaggacugcuugaguccagaaguuuaagaccagccugggcaacacggggagacccugucucua

SEQ ID NO: 143557 - RNA, 64 nt, hsa
gcauggguacacgcgcguuuccagugcacaucugccugggcaggacacgguuuccucuugcugg

SEQ ID NO: 143558 - RNA, 64 nt, hsa
uugcaaugagcaagauugugccacugcacuccagccugggcaacagagcaagacucugucucaa

SEQ ID NO: 143559 - RNA, 64 nt, hsa
acggcucccacuaaggccugcccaccaccgcccgccugggcagccaugaauguagcgccccagg

SEQ ID NO: 143560 - RNA, 64 nt, hsa
gccccagcccgccaugccacaaggugggggaggcccugggcaggauguucacucuauuuauugg

SEQ ID NO: 143561 - RNA, 64 nt, hsa
ggaggaucacuuaaggccaggaguucgagaccagccugggcaacagcaagaccucaucucuaca

SEQ ID NO: 143562 - RNA, 64 nt, hsa
ggcaggaggaucacucgagcucaagaauucaagaccugggcaagagagagagacuuugucucua

SEQ ID NO: 143563 - RNA, 64 nt, hsa
ugcggugagccaagaucgcgccacugcacuccagccugggcagcaagagcaaaacaaccucugu

SEQ ID NO: 143564 - RNA, 64 nt, hsa
cccuaauauuugcaggagcgugguucuaccacccccugggcauacauaaaucgacacaugccaa

SEQ ID NO: 143565 - RNA, 64 nt, hsa
ggcaaauugcuugaccucaggaauuugaggccugccugggcaaaauggugaaaccaugucucua

SEQ ID NO: 143566 - RNA, 64 nt, hsa
ucuacccugugaagggaaaugagggcuuuaguuuccugggcagggaggggcagcuucugagguu

SEQ ID NO: 143567 - RNA, 64 nt, hsa
accaggggcugguggcccaggccagggagggaacccugggcagggcucuggugggagagggaga

SEQ ID NO: 143568 - RNA, 64 nt, hsa
ugaagagagcuaugacugcaucacugcacuccagccugggcaacacagcaagauccugucuaaa

SEQ ID NO: 143569 - RNA, 64 nt, hsa
ggaggacugcuuaagcucaggaguuugagaccagccugggcaacauagcaagacccccaccauc

SEQ ID NO: 143570 - RNA, 64 nt, hsa
auuuccccguucaacucccuguugucccuuccauccugggcaaaacugaaagggacccggagcu

SEQ ID NO: 143571 - RNA, 64 nt, hsa
gugguggccuagcauugcuuacauccacccugugccugggcagccacuucuguucuuggacaga

SEQ ID NO: 143572 - RNA, 64 nt, hsa
ggaggaucaguugagccccagaguucaagaccagccugggcaauguaguaagacccccaucgcu

SEQ ID NO: 143573 - RNA, 64 nt, hsa
ugcagugaaccaagaucaugccacugcacuccagccugggcaacacagcgagacuccgucucaa

SEQ ID NO: 143574 - RNA, 64 nt, hsa
ugcagugagccgagauugcgccacugcacuccagccugggcagcagagcaacacucugucucaa

SEQ ID NO: 143575 - RNA, 64 nt, hsa
ugcauugagccaugauugcaccacugcacuccagccugggcaacagagggagcccccgucucaa

SEQ ID NO: 143576 - RNA, 64 nt, hsa
gggggauugauugaggccaggaguucaagaccagccugggcaacauggugagaccccaucucua

SEQ ID NO: 143577 - RNA, 64 nt, hsa
ugcagugagccgagaucgucccacugcacuccagccugggcaacagagugagacucuguuucua

SEQ ID NO: 143578 - RNA, 64 nt, hsa
guggguggaucacaagucaggaguucaagaccagccugggcaagauggugaaaccccaucucua

SEQ ID NO: 143579 - RNA, 64 nt, hsa
uucuauuaauggagaucauuccauuacacuccagccugggcaccaggaacgaaacucguucuca

SEQ ID NO: 143580 - RNA, 64 nt, hsa
uguggugagccaagaucaugccacugcacuccagccugggcaacaagaacaaaacuccaucuaa

SEQ ID NO: 143581 - RNA, 64 nt, hsa
gaggaucacuugagaccaggaguugugaggucaaccugggcaauauagggagauccugucucua

SEQ ID NO: 143582 - RNA, 64 nt, hsa
gaaggauugcuugaggccaggaguuccagaucaaccugggcaacaugaugagaccccaucucua

SEQ ID NO: 143583 - RNA, 64 nt, hsa
caucugugcucuuccaggaugcugccucuuacucccugggcaccucggccuggucccagcaggu

SEQ ID NO: 143584 - RNA, 64 nt, hsa
auccuccugccucagccucccaaguagcugggagccugggcaugcaucgccacgucuggcuaau

SEQ ID NO: 143585 - RNA, 64 nt, hsa
uuuuuuguuguuguggugguuuuuuaacacaaagccugggcaacagagcaaaacucugucucaa

SEQ ID NO: 143586 - RNA, 64 nt, hsa
cccugcucgugcugcccagaggcugaucugcaaaccugggcaguauuccacacugaagcucagu

SEQ ID NO: 143587 - RNA, 64 nt, hsa
ggaggaucccuuuagcccaggaguuaaagaccagccugggcaacauagggagacccugucuuuu

SEQ ID NO: 143588 - RNA, 64 nt, hsa
cugaggugggaggaucccaggaguucaaauccugccugggcaacauagcaagacccugucucuu

SEQ ID NO: 143589 - RNA, 64 nt, hsa
ccagaccucucucccuccuacagugcucucccucccugggcagauuggcaggacaagugggagc

SEQ ID NO: 143590 - RNA, 54 nt, hsa
uugaguccacagaaaucugaucgaccugggcacucggcauuuugacacaugucc

SEQ ID NO: 143591 - RNA, 64 nt, hsa
gguggaucacuugagcucaggagcuugagaccagccugggcaacauggugaaacccaguuucua

SEQ ID NO: 143592 - RNA, 64 nt, hsa
aaauguuucuaguagcugcauuacaaaaaagaagccugggcacuguggcucacuccuguaaucu

SEQ ID NO: 143593 - RNA, 64 nt, hsa
ucccucuccugagaggggaggccugguggcuuagccugggcaggucgugucuccuccugacccc

SEQ ID NO: 143594 - RNA, 64 nt, hsa
cuguucauuccuuugugcagaguguauaucucugccugggcaagaguguggaggugccgaggug

SEQ ID NO: 143595 - RNA, 64 nt, hsa
cccuccguccagccagcaaggcuuucccaagcguccugggcaggaggguugggcccugcuuucc

SEQ ID NO: 143596 - RNA, 64 nt, hsa
guaaaugcacuagcgcgaggucagaaaucacaagccugggcauggccugggucgcacccccucc

SEQ ID NO: 143597 - RNA, 64 nt, hsa
acguccaggugggcccagccuagggcaucccgggccugggcaucaggcagggugcagguggggc

SEQ ID NO: 143598 - RNA, 64 nt, hsa
ugcagugagcugagaucacgccacugcacuccagccugggcaacagagugagacucugucucaa

SEQ ID NO: 143599 - RNA, 64 nt, hsa
agcagugagcugaagucccgccacugcacuccagccugggcaacagagcgagacucagucucaa

SEQ ID NO: 143600 - RNA, 64 nt, hsa
acgccccaggggaccagccaggccuggaaugcccccugggcaggacccugggcaggaccagagg

SEQ ID NO: 143601 - RNA, 64 nt, hsa
accagccaggccuggaaugcccccugggcaggacccugggcaggaccagaggcccacauggaug

SEQ ID NO: 143602 - RNA, 64 nt, hsa
gccaagcugcuguuccuaugacaggcccacucaaccugggcagaccgagaggcccgugcacuuu

SEQ ID NO: 143603 - RNA, 64 nt, hsa
gggaggcuggaagcauauuccccaagagcacugcccugggcaucaucucccuccugcgaggagc

SEQ ID NO: 143604 - RNA, 64 nt, hsa
uagcucagauggcagaugagaguguagucaagggccugggcacaggagggagagcugcagagug

SEQ ID NO: 143605 - RNA, 64 nt, hsa
cacauccccaucuguuaggccuuggugaggaggcccugggcaaagaagggucuuucgcaaagcg

SEQ ID NO: 143606 - RNA, 64 nt, hsa
ccagccaaaacccucccagacgucuccucuccugccugggcaaaguccagcuuggcaccccguc

SEQ ID NO: 143607 - RNA, 64 nt, hsa
ugcagugagcugagauugcgccauugcacuccagccugggcaacaagagcaaaauucugccuca

SEQ ID NO: 143608 - RNA, 64 nt, hsa
uggcuggggccggggcugccgcaucugccuggagccugggcagcaccuccgggacugaccuucg

SEQ ID NO: 143609 - RNA, 64 nt, hsa
accacgguguggggggugccccacaaggcccagcccugggcaaggaagcuuuggaagcagcaag

SEQ ID NO: 143610 - RNA, 64 nt, hsa
gaaagaacuuggacuucuaaaggcggagggucucccugggcacccugcaggcaggcagaccacg

SEQ ID NO: 143611 - RNA, 64 nt, hsa
uccuuuuggcuggggucugagucugcgguucucgccugggcagucuugacgaggagcaaacccc

SEQ ID NO: 143612 - RNA, 64 nt, hsa
cuccuccaccucucccauuccauccccaguccagccugggcaaccccaccccugggagggauga

SEQ ID NO: 143613 - RNA, 64 nt, hsa
uguagugagcugagaucgugccacugcacuccagccugggcaacagagccagacuccgucucua

SEQ ID NO: 143614 - RNA, 64 nt, hsa
ggcagaucaccugagaucaggaguucgggaccagccugggcaacauggugaaacccugucucua

SEQ ID NO: 143615 - RNA, 64 nt, hsa
caaaaaagaaaaggaagcugagcaucucccgaguccugggcagggaaggggagggaaauugcug

SEQ ID NO: 143616 - RNA, 64 nt, hsa
ugcagugagccgagaucacgccauugcacuccagccugggcaacagagcaagacuccaucucaa

SEQ ID NO: 143617 - RNA, 64 nt, hsa
gcuuccaccugggcuacacggagaccgggcacugccugggcaaaccgaacccugcgcucgcacc

SEQ ID NO: 143618 - RNA, 64 nt, hsa
augcucccaucauugggcaccucugggaguuuguccugggcacagacagcuuccaccugggcua

SEQ ID NO: 143619 - RNA, 64 nt, hsa
guggucaugugagucugggauauucuuuagcuuaccugggcacaaacagaauuuuccauuuauu

SEQ ID NO: 143620 - RNA, 64 nt, hsa
cacagccuucuaaauucccaaauccuagacugcuccugggcauuagcaaggcagagccuuuuua

SEQ ID NO: 143621 - RNA, 64 nt, hsa
ugcagugagccaagaucuugccauugcacuccagccugggcaacaagagugaaauucugucuca

SEQ ID NO: 143622 - RNA, 64 nt, hsa
ugcaaugagccgagaucacaccacugcacuccagccugggcaacagugaaacuccaucucaaaa

SEQ ID NO: 143623 - RNA, 64 nt, hsa; identical to SEQ ID NO: 23628

SEQ ID NO: 143624 - RNA, 64 nt, hsa; identical to SEQ ID NO: 23629

SEQ ID NO: 143625 - RNA, 64 nt, hsa; identical to SEQ ID NO: 23630

SEQ ID NO: 143626 - RNA, 64 nt, hsa; identical to SEQ ID NO: 23631

SEQ ID NO: 143627 - RNA, 64 nt, hsa; identical to SEQ ID NO: 23632

SEQ ID NO: 143628 - RNA, 64 nt, hsa; identical to SEQ ID NO: 23633

SEQ ID NO: 143629 - RNA, 64 nt, hsa; identical to SEQ ID NO: 23634

SEQ ID NO: 143630 - RNA, 64 nt, hsa; identical to SEQ ID NO: 23635

SEQ ID NO: 143631 - RNA, 64 nt, hsa; identical to SEQ ID NO: 23636

SEQ ID NO: 143632 - RNA, 64 nt, hsa; identical to SEQ ID NO: 23637

SEQ ID NO: 143633 - RNA, 64 nt, hsa; identical to SEQ ID NO: 23638

SEQ ID NO: 143634 - RNA, 64 nt, hsa; identical to SEQ ID NO: 23639

SEQ ID NO: 143635 - RNA, 64 nt, hsa; identical to SEQ ID NO: 73772

SEQ ID NO: 143636 - RNA, 64 nt, hsa; identical to SEQ ID NO: 73773

SEQ ID NO: 143637 - RNA, 64 nt, hsa; identical to SEQ ID NO: 73774

SEQ ID NO: 143638 - RNA, 64 nt, hsa; identical to SEQ ID NO: 73775

SEQ ID NO: 143639 - RNA, 64 nt, hsa; identical to SEQ ID NO: 73776

SEQ ID NO: 143640 - RNA, 64 nt, hsa; identical to SEQ ID NO: 73777

SEQ ID NO: 143641 - RNA, 64 nt, hsa; identical to SEQ ID NO: 73778

SEQ ID NO: 143642 - RNA, 64 nt, hsa; identical to SEQ ID NO: 73779

SEQ ID NO: 143643 - RNA, 64 nt, hsa; identical to SEQ ID NO: 73780

SEQ ID NO: 143644 - RNA, 64 nt, hsa; identical to SEQ ID NO: 73781

SEQ ID NO: 143645 - RNA, 64 nt, hsa; identical to SEQ ID NO: 73782

SEQ ID NO: 143646 - RNA, 64 nt, hsa; identical to SEQ ID NO: 73783

SEQ ID NO: 143647 - RNA, 64 nt, hsa; identical to SEQ ID NO: 73784

SEQ ID NO: 143648 - RNA, 64 nt, hsa; identical to SEQ ID NO: 73785

SEQ ID NO: 143649 - RNA, 64 nt, hsa; identical to SEQ ID NO: 73786

SEQ ID NO: 143650 - RNA, 64 nt, hsa; identical to SEQ ID NO: 73787

SEQ ID NO: 143651 - RNA, 64 nt, hsa; identical to SEQ ID NO: 73788

SEQ ID NO: 143652 - RNA, 64 nt, hsa; identical to SEQ ID NO: 73789

SEQ ID NO: 143653 - RNA, 64 nt, hsa; identical to SEQ ID NO: 73790

SEQ ID NO: 143654 - RNA, 64 nt, hsa; identical to SEQ ID NO: 73791

SEQ ID NO: 143655 - RNA, 64 nt, hsa; identical to SEQ ID NO: 73792

SEQ ID NO: 143656 - RNA, 64 nt, hsa; identical to SEQ ID NO: 73793

SEQ ID NO: 143657 - RNA, 64 nt, hsa; identical to SEQ ID NO: 73794

SEQ ID NO: 143658 - RNA, 64 nt, hsa; identical to SEQ ID NO: 73795

SEQ ID NO: 143659 - RNA, 64 nt, hsa; identical to SEQ ID NO: 73796

SEQ ID NO: 143660 - RNA, 64 nt, hsa; identical to SEQ ID NO: 73797

SEQ ID NO: 143661 - RNA, 64 nt, hsa; identical to SEQ ID NO: 73798

SEQ ID NO: 143662 - RNA, 64 nt, hsa; identical to SEQ ID NO: 73799

SEQ ID NO: 143663 - RNA, 64 nt, hsa; identical to SEQ ID NO: 73800

SEQ ID NO: 143664 - RNA, 64 nt, hsa; identical to SEQ ID NO: 73801

SEQ ID NO: 143665 - RNA, 64 nt, hsa; identical to SEQ ID NO: 73802

SEQ ID NO: 143666 - RNA, 64 nt, hsa; identical to SEQ ID NO: 73803

SEQ ID NO: 143667 - RNA, 64 nt, hsa; identical to SEQ ID NO: 73804

SEQ ID NO: 143668 - RNA, 64 nt, hsa; identical to SEQ ID NO: 73805

SEQ ID NO: 143669 - RNA, 64 nt, hsa; identical to SEQ ID NO: 73806

SEQ ID NO: 143670 - RNA, 64 nt, hsa; identical to SEQ ID NO: 73807

SEQ ID NO: 143671 - RNA, 64 nt, hsa; identical to SEQ ID NO: 73808

SEQ ID NO: 143672 - RNA, 64 nt, hsa; identical to SEQ ID NO: 73809

SEQ ID NO: 143673 - RNA, 64 nt, hsa; identical to SEQ ID NO: 73810

SEQ ID NO: 143674 - RNA, 64 nt, hsa; identical to SEQ ID NO: 73811

SEQ ID NO: 143675 - RNA, 64 nt, hsa; identical to SEQ ID NO: 73812

SEQ ID NO: 143676 - RNA, 64 nt, hsa; identical to SEQ ID NO: 73813

SEQ ID NO: 143677 - RNA, 64 nt, hsa; identical to SEQ ID NO: 73814

SEQ ID NO: 143678 - RNA, 64 nt, hsa; identical to SEQ ID NO: 73815

SEQ ID NO: 143679 - RNA, 64 nt, hsa; identical to SEQ ID NO: 73816

SEQ ID NO: 143680 - RNA, 64 nt, hsa; identical to SEQ ID NO: 73817

SEQ ID NO: 143681 - RNA, 64 nt, hsa; identical to SEQ ID NO: 73818

SEQ ID NO: 143682 - RNA, 64 nt, hsa; identical to SEQ ID NO: 73819

SEQ ID NO: 143683 - RNA, 64 nt, hsa; identical to SEQ ID NO: 73820

SEQ ID NO: 143684 - RNA, 64 nt, hsa; identical to SEQ ID NO: 73821

SEQ ID NO: 143685 - RNA, 64 nt, hsa; identical to SEQ ID NO: 73822

SEQ ID NO: 143686 - RNA, 64 nt, hsa; identical to SEQ ID NO: 73823

SEQ ID NO: 143687 - RNA, 64 nt, hsa; identical to SEQ ID NO: 73824

SEQ ID NO: 143688 - RNA, 64 nt, hsa; identical to SEQ ID NO: 73825

SEQ ID NO: 143689 - RNA, 64 nt, hsa; identical to SEQ ID NO: 73826

SEQ ID NO: 143690 - RNA, 64 nt, hsa; identical to SEQ ID NO: 73827

SEQ ID NO: 143691 - RNA, 64 nt, hsa; identical to SEQ ID NO: 73828

SEQ ID NO: 143692 - RNA, 64 nt, hsa; identical to SEQ ID NO: 73829

SEQ ID NO: 143693 - RNA, 64 nt, hsa; identical to SEQ ID NO: 73830

SEQ ID NO: 143694 - RNA, 64 nt, hsa
ugacuuuuagaaacaaaauucuaaaaauuugcaagucaaguaaguguggguagcaaaaacaauu

SEQ ID NO: 143695 - RNA, 64 nt, hsa
cuaaguguguaugauaaugaaacucaucauuuuagucaaguagaggcaaugcaaagauucacau

SEQ ID NO: 143696 - RNA, 64 nt, hsa
acauuguuuucuagagcaagauaauaaaggagaugggccauacaaauguuuucuacuuucguug

SEQ ID NO: 143697 - RNA, 64 nt, hsa
cuuuaccugaggguaugucuuuagcuauguuuuagggccauacauuuacucuaucaaaugaucu

SEQ ID NO: 143698 - RNA, 62 nt, hsa
gguccccuaguuaggcccagauaaaaauccaguuggcugaggguuuuggaugggaagggaag

SEQ ID NO: 143699 - RNA, 62 nt, hsa
ccuccugggacagggcuggguccucuggcuauuuggcugagaaggggccaggccaagggccg

SEQ ID NO: 143700 - RNA, 62 nt, hsa
aaauacaggggugcauaccaucuugcaguggcuuggcugacauugccucuuuguccuggccu

SEQ ID NO: 143701 - RNA, 62 nt, hsa
gaaagcaguguguaauuuuggauugccugcccuuggcugaaauacaggggugcauaccaucu

SEQ ID NO: 143702 - RNA, 62 nt, hsa
uagaacaucuggucucgcugguuagugccucguuggcugaggacuaggugugcauuucuccu

SEQ ID NO: 143703 - RNA, 62 nt, hsa
aaaaccaauucauuauuuguccagaaggaagcuuggcugagcuggccuuuuaacauaggaau

SEQ ID NO: 143704 - RNA, 62 nt, hsa
aaggcuaaaaauaacuggugcgcucccuuguguuggcugacacgcgcguucaaagcacuuuu

SEQ ID NO: 143705 - RNA, 62 nt, hsa
cucccguguuggguagaaauuugguggaucuguuggcugaaaagacggacuugcuugccucu

SEQ ID NO: 143706 - RNA, 62 nt, hsa
auaucaggaagggcuuugggauggcaccuauauuggcugauaauugaggaugcaaacauucc

SEQ ID NO: 143707 - RNA, 62 nt, hsa
uuauauaagaauugcuaaagcugaaguucaacuuggcugagugaagauaaucauagguugug

SEQ ID NO: 143708 - RNA, 62 nt, hsa
cugcugucucagaggccuuggucaggaugaaguuggcugacacagcuuagcuugguuuugcu

SEQ ID NO: 143709 - RNA, 60 nt, hsa
gauaaaaacugauuaaaccuuuguggcugugguuggcugacauggggucuguguuucacu

SEQ ID NO: 143710 - RNA, 62 nt, hsa
ccaggaucccgcagggcaacagccccaucugcuuggcugaccccacacccaggaccacuguc

SEQ ID NO: 143711 - RNA, 62 nt, hsa
uggcaggacaagugggagcagauggccugccuuuggcugagagggcuaccugcccagccccu

SEQ ID NO: 143712 - RNA, 64 nt, hsa
cugcucccuguguucccacccuccaguguuggcacaggcccaccccuggcuccaccagagccag

SEQ ID NO: 143713 - RNA, 64 nt, hsa
gggccucggcaccuggcccuggcagcacagcucucaggcccagcccugggcgaccuccuuggcc

SEQ ID NO: 143714 - RNA, 64 nt, hsa
cccuaacugcccccugccugcuccggcacugccccaggcccagcuccuggcccuaggucccucc

SEQ ID NO: 143715 - RNA, 64 nt, hsa
cagggugugggggcagcugugccaaucuaccucacaggcccacccccugccgggcaugccgugg

SEQ ID NO: 143716 - RNA, 64 nt, hsa
acacccuggugcccugcaccagacaggccguggucaggcccaggccaccggccggguucugcca

SEQ ID NO: 143717 - RNA, 64 nt, hsa
uaggcccuuccaccagcuggggagcuagagggagcaggcccaagggcagagcagaggcugaggc

SEQ ID NO: 143718 - RNA, 64 nt, hsa
cucccuucuucaguaagcaaggagccccgccccucaggcccagccucuggcaagagguggugga

SEQ ID NO: 143719 - RNA, 64 nt, hsa
ugugccggguaguagaggaggauaagggcaaaaccaggcccaggccagugccuggcuuggucug

SEQ ID NO: 143720 - RNA, 64 nt, hsa
aaggauauucccuuggcuaugguccugccaggugcaggcccaggcccaugaccccaccuuuacu

SEQ ID NO: 143721 - RNA, 64 nt, hsa
auucccuuggcuaugguccugccaggugcaggcccaggcccaugaccccaccuuuacuaagcac

SEQ ID NO: 143722 - RNA, 64 nt, hsa
cucccaaaguguugagaugacaggcacgagccaccaggcccagccugagugguauuuucuuuag

SEQ ID NO: 143723 - RNA, 64 nt, hsa
agguuguucuaguuuuuagugagaccucugcagacaggcccaucacuguccauguuccagggca

SEQ ID NO: 143724 - RNA, 64 nt, hsa
aauccaagagaaguuugugaggauccuacaaacccaggcccacucacuuugcucuaauucuuuc

SEQ ID NO: 143725 - RNA, 64 nt, hsa
agggcuaucagaaggucuccuuuuuagcccagcacaggcccaggccacuuugucguguuuguuu

SEQ ID NO: 143726 - RNA, 64 nt, hsa
aggccaccccccucuucaggcugcugcaggaggccaggcccaggccagagaccccaggcagccu

SEQ ID NO: 143727 - RNA, 64 nt, hsa
cucacugcuggagcggggaaaccgcagcucagcccaggcccagcuggggagaaggcgcuaccug

SEQ ID NO: 143728 - RNA, 64 nt, hsa
ugacugcgucucggcucuggccaugagcucugcccaggcccacaagccccuccccugggcucuc

SEQ ID NO: 143729 - RNA, 64 nt, hsa
cagggaaagugggagguggugcuggugcucucuccaggcccaccaugcugggagaggcggccag

SEQ ID NO: 143730 - RNA, 64 nt, hsa
uucccagagcucccucugccccagccagcgccuccaggcccagcugaggagcugugagaagcag

SEQ ID NO: 143731 - RNA, 64 nt, hsa
ucuugccccaccuggcugaggcgccacccuucuucaggcccaggcuccagaggaagacuccuga

SEQ ID NO: 143732 - RNA, 64 nt, hsa
aggugcucauggggugcggugcuugggagacagccaggcccaggguggcugcugcuuccugcua

SEQ ID NO: 143733 - RNA, 64 nt, hsa
cgggucugaaccugagcccucccgugacagccggcaggcccagcccauccccucccucauccuc

SEQ ID NO: 143734 - RNA, 64 nt, hsa
ugucagcaucaggaaggccuuugcuucuugcacccaggcccagcugagacaggccccugagucc

SEQ ID NO: 143735 - RNA, 64 nt, hsa
cagcucccugaggaccaccuccuacacuauugaccaggcccagaaggaaccagccaugaggugc

SEQ ID NO: 143736 - RNA, 64 nt, hsa
agggacuugccuuccccacccacucugcugccagcaggcccagggaucccugaccugcaccagg

SEQ ID NO: 143737 - RNA, 64 nt, hsa
auaaacgaagcacuuuauucuguacagauuugggcaggcccaaggugcccgagugaucugagga

SEQ ID NO: 143738 - RNA, 64 nt, hsa
ggucagagacggcagaaaacagagccugccuaaccaggcccagccaguugguggggccaggcca

SEQ ID NO: 143739 - RNA, 64 nt, hsa
uuugacucagaggcugggagcauagcagaggggccaggcccaggcagagcugacgggaggcccc

SEQ ID NO: 143740 - RNA, 64 nt, hsa
ccuggcuucccugauggucucucccuccuggccucaggcccauuccugaggaagggccuuggcg

SEQ ID NO: 143741 - RNA, 64 nt, hsa
ccagggcagccaguggcucuagcucagggaaagccaggcccaccugcccuauccccucccuugc

SEQ ID NO: 143742 - RNA, 64 nt, hsa
accauggcaccuuugagagagggggcacuguggucaggcccagccucucuggcucagcccggga

SEQ ID NO: 143743 - RNA, 64 nt, hsa
uuggcccugcgcccugugcagggaaagggauggucaggcccaguucucgugcccuuagagggga

SEQ ID NO: 143744 - RNA, 64 nt, hsa
cagacagauccccuaggccuaucugagacccauacaggcccacaccugagcuccugucugccug

SEQ ID NO: 143745 - RNA, 64 nt, hsa
accaaaacuuggcagcugugccagaaaccaaagccaggcccagauguagggggagggcacgaga

SEQ ID NO: 143746 - RNA, 64 nt, hsa
ugcccaggcccaggggcaggcucuuggccugccccaggcccagagggcuucccaguaaggccca

SEQ ID NO: 143747 - RNA, 64 nt, hsa
acuggccucuguccuuggcagagaccuugcugcccaggcccaggggcaggcucuuggccugccc

SEQ ID NO: 143748 - RNA, 64 nt, hsa
ugucugcuggguucuuuucucaaguccugcugcccaggcccaggugagacaggcaacgccaggu

SEQ ID NO: 143749 - RNA, 64 nt, hsa
gacugucugugugcccuguggggguccgugugagcaggcccaccuggcuccagacccgccccca

SEQ ID NO: 143750 - RNA, 64 nt, hsa
uggagacauccacacccauucccagguguccuuccaggcccauuguccacgucuucaagggggc

SEQ ID NO: 143751 - RNA, 64 nt, hsa
acaagugacuguaggggggaccgucuagaaacaccaggcccagacacacggucccucaggucag

SEQ ID NO: 143752 - RNA, 64 nt, hsa
guuuucaugaauagaaaacaagagcagcagcugucaggcccagcugacaagcguggggcuggug

SEQ ID NO: 143753 - RNA, 64 nt, hsa
aaaguggcccaaagcgucccaaaguaggccucgccaggcccaccuccugcccggcguaggcccu

SEQ ID NO: 143754 - RNA, 64 nt, hsa
ccccucaccuugccucaccucgcagcagccuuuccaggcccagcucccgccucccggcggccuu

SEQ ID NO: 143755 - RNA, 64 nt, hsa
uugaggcccagcuuuucccuugugguggccucuccaggcccagaacuuccucaagucggccucc

SEQ ID NO: 143756 - RNA, 64 nt, hsa
cccugacuaguggccaaggugcuuuucuuccucccaggcccaguggguggaaucuguccccacc

SEQ ID NO: 143757 - RNA, 64 nt, hsa
gagcacccgccagaggcugcagcagcagcugacccaggcccaagagacccugaagagccugggu

SEQ ID NO: 143758 - RNA, 64 nt, hsa
ccaacuuuuugaugucccuguagggcuggccagucaggcccagccaaagcccccuccucagucu

SEQ ID NO: 143759 - RNA, 64 nt, hsa
uccucagucuccacagacccacaugugagcagcccaggcccaucggugcuccucagagguaggu

SEQ ID NO: 143760 - RNA, 64 nt, hsa
agacagagggccacggcugcgugcgauccaggcccaggcccacacacucugcccgugucacacg

SEQ ID NO: 143761 - RNA, 64 nt, hsa
cuuuguagacagagggccacggcugcgugcgauccaggcccaggcccacacacucugcccgugu

SEQ ID NO: 143762 - RNA, 64 nt, hsa
gccuuggucuccccccugggcacacgugcucacucaggcccagcaaugaccucugcucauuuuu

SEQ ID NO: 143763 - RNA, 64 nt, hsa
auggguagugucuacacguccccgggcucaggcucaggcccagcccugggcugaccugagagga

SEQ ID NO: 143764 - RNA, 64 nt, hsa
ucagccagggagaacugggcggguuuaguggccccaggcccacuccucaugcagcagugugcug

SEQ ID NO: 143765 - RNA, 64 nt, hsa
gagcuccgaagcggucaaagugagcugagcaggacaggcccagccuuucuccacugccacgucc

SEQ ID NO: 143766 - RNA, 64 nt, hsa
agacccagguccuugugcucaguccugcgcaaaccaggcccagacccugcaagcauuuguugau

SEQ ID NO: 143767 - RNA, 64 nt, hsa
gcccagacccugcaagcauuuguugaugcccuugcaggcccacugggagaaagaugccucaggc

SEQ ID NO: 143768 - RNA, 64 nt, hsa
ggcaagucugggcccugggguagggagggagacucaggcccacacuuggguauuuucuaauuuc

SEQ ID NO: 143769 - RNA, 64 nt, hsa
guggcaccugguucuccgaugccugggcuggugucaggcccaggacuguagugcugggagcagu

SEQ ID NO: 143770 - RNA, 64 nt, hsa
gcacagcguggaggucagcggcucccagcucugccaggcccauucccagcugcugcaguacgug

SEQ ID NO: 143771 - RNA, 64 nt, hsa
cguccugcccaccuucuuaagaggcgagauggagcaggcccaucugccucugcccuuucuagcc

SEQ ID NO: 143772 - RNA, 64 nt, hsa
ugggccugggcuuccacagugugaagacacugugcaggcccaggcaggcccagccucugcccca

SEQ ID NO: 143773 - RNA, 64 nt, hsa
cuuccacagugugaagacacugugcaggcccaggcaggcccagccucugccccacccaucagug

SEQ ID NO: 143774 - RNA, 64 nt, hsa
ccugccugggcuggcugugaggccaccuuugucccaggcccagccucaaggcaaggagggcgcu

SEQ ID NO: 143775 - RNA, 64 nt, hsa
cuuccuguuccaguucaccuaaaggcugauugugcaggcccagcacuguggcuggacugccgcg

SEQ ID NO: 143776 - RNA, 64 nt, hsa
acggcagagcaggugggcaaggccagggcuaccccaggcccauguggccuccuccuugcuugga

SEQ ID NO: 143777 - RNA, 64 nt, hsa
ggcuccuucccguggcugcuucaacccaguuccccaggcccagcuucuggaauagacaguuccu

SEQ ID NO: 143778 - RNA, 64 nt, hsa
gaccagaugcuccuguaaacauccaggggugugccaggcccacccucacaacugcuuguucagg

SEQ ID NO: 143779 - RNA, 64 nt, hsa
cccagcccuucuucuagugguagcucuggcuuugcaggcccagcuccaggcccugcuccucaga

SEQ ID NO: 143780 - RNA, 64 nt, hsa
ggggcuaugugcacuccagaccccugcccaggcucaggcccaugagguauggagacacccuggc

SEQ ID NO: 143781 - RNA, 64 nt, hsa
ggugugucaccugcccaccaccuggcucaucccucaggcccacccugacccuacauuacauagg

SEQ ID NO: 143782 - RNA, 64 nt, hsa
caggcagagccgagaguucgccccaacccuuccccaggcccagugugaaaaacagacucacaag

SEQ ID NO: 143783 - RNA, 64 nt, hsa
aguccugccagcagccgcaaagagccgaggcugccaggcccauuuaugucccucaugucucuag

SEQ ID NO: 143784 - RNA, 64 nt, hsa
agcccccagggugggauuucucaggcugccagggcaggcccaggccucaggaagaaggggaggc

SEQ ID NO: 143785 - RNA, 64 nt, hsa
cccagcugggccucucuggccuauuccuaccuuccaggcccacugcacuccugucugggaggcc

SEQ ID NO: 143786 - RNA, 64 nt, hsa
acagguggaucccauggcauccccauggaggaaccaggcccaucugggcagcagcaucugguug

SEQ ID NO: 143787 - RNA, 64 nt, hsa
ugcagaagcuuagcauaugcccuuguguucggaucaggcccacagggcugcucaaagaguagag

SEQ ID NO: 143788 - RNA, 64 nt, hsa
gugcacuccccggccugcauccggcuuggguacacaggcccagaggacuggggugacucacggg

SEQ ID NO: 143789 - RNA, 64 nt, hsa
gggcaguggucuccccccuuggcgccuccuugcgcaggcccagccuccacucuccucgucuagg

SEQ ID NO: 143790 - RNA, 57 nt, hsa
acauucucggggggcccuagcugagcgcaggcccaggccccacuugcuuccugcggg

SEQ ID NO: 143791 - RNA, 64 nt, hsa
aggccccacuugcuuccugcgggugggaaagcugcaggcccaggccuugcuucccuaucaggcu

SEQ ID NO: 143792 - RNA, 64 nt, hsa
ccagugugcggggagccucugccugagugugcaccaggcccauguuuauugaccacagucugag

SEQ ID NO: 143793 - RNA, 64 nt, hsa
cggggcccugauguggaguagacagugcgcaccucaggcccacacacggccccgcccuggggcc

SEQ ID NO: 143794 - RNA, 64 nt, hsa
ggcagauaccguuaagcgcugugcuaccgggccccaggcccagccacccgguaccucccgagag

SEQ ID NO: 143795 - RNA, 64 nt, hsa
augccgcgggcagcagcuggagcuaaaggaagggcaggcccacaggggccaccgcagagccgag

SEQ ID NO: 143796 - RNA, 64 nt, hsa
accccauccucagugcccaaugcuguggccccaccaggcccagagccugguuggccauucucau

SEQ ID NO: 143797 - RNA, 64 nt, hsa
ucgacccgggccaggaggcccggggcgcugagcucaggcccagaacuggcugauuucagggaua

SEQ ID NO: 143798 - RNA, 64 nt, hsa
gcauggcugcaggguggaccagcugccuggcauucaggcccagaugccugcagggcuggggcuc

SEQ ID NO: 143799 - RNA, 64 nt, hsa
aggaguccuugcagaccugcugccucccccacgacaggcccaaagauggacccccccuggccuu

SEQ ID NO: 143800 - RNA, 64 nt, hsa
gcagguguccuggcagggggacaggagacuguaacaggcccagguccuugugcagcccgugaau

SEQ ID NO: 143801 - RNA, 64 nt, hsa
ugaccacggcugcuggaccccuucccuguucaggcaggcccagccccucucagaaccugcugcc

SEQ ID NO: 143802 - RNA, 64 nt, hsa
ugcucaggaccccccgcacugucccaaucccacucaggcccaccuccagcuggccucacuccgc

SEQ ID NO: 143803 - RNA, 64 nt, hsa
ccugcucaggagcccccacugucccagucccacucaggcccaucucuggcuggccucacugcgc

SEQ ID NO: 143804 - RNA, 64 nt, hsa
ccugauaaaguuaguagcugcccucaucagaaaccaggcccaggcaguggggacacauccagag

SEQ ID NO: 143805 - RNA, 64 nt, hsa
gccuccccggcagcaagaccccggcacuccccgccaggcccagggugggguggaugggcccaaa

SEQ ID NO: 143806 - RNA, 64 nt, hsa
caggaacacgcagacauaugcccauagcaucccacaggcccaggcaggaggucccaccccagac

SEQ ID NO: 143807 - RNA, 64 nt, hsa
accugcauuuauuuauugagcagcagugcugugucaggcccagggaccgagccccucucccugu

SEQ ID NO: 143808 - RNA, 64 nt, hsa
ggccuggagaccacccagcccugaccugggaccccaggcccaggggcacauugaacaggaggac

SEQ ID NO: 143809 - RNA, 64 nt, hsa
ccccgcgggcagugacgugaguggggaggagacucaggcccacauugcccacaccugccucuga

SEQ ID NO: 143810 - RNA, 64 nt, hsa
cucaugggagucagggagcccugggguuuccacacaggcccaugcccuccguccuggcagggca

SEQ ID NO: 143811 - RNA, 64 nt, hsa
ugggugggcaguggccaagcugcuguuccuaugacaggcccacucaaccugggcagaccgagag

SEQ ID NO: 143812 - RNA, 64 nt, hsa
uuuuuuuuuuuuuugauggaagaccaaggguugccaggcccacuguaacugccgagcugccugc

SEQ ID NO: 143813 - RNA, 62 nt, hsa
uaccugccucacuccuguccaguggucagguuuccccugaccuucccucacccccagaaaca

SEQ ID NO: 143814 - RNA, 62 nt, hsa
cacaggcucagacuaaaucagaggucaaggcuuccccugaguaagguccauuucuucccagg

SEQ ID NO: 143815 - RNA, 62 nt, hsa
gguuguugugcugaggccagucagaggaugcuuccccugagguuugcuauaacuaagcaacc

SEQ ID NO: 143816 - RNA, 62 nt, hsa
uggggcuuggaggaccgagccacugacagguauccccugaaacugagcugagcccaguaucc

SEQ ID NO: 143817 - RNA, 62 nt, hsa
ucccccacugucccgguccucuuccccugagguccccugauauccccuggcucaguccuaac

SEQ ID NO: 143818 - RNA, 62 nt, hsa
cuggccaccuucccccacugucccgguccucuuccccugagguccccugauauccccuggcu

SEQ ID NO: 143819 - RNA, 62 nt, hsa
ccugccccggcauugcaucuucccuagauagguccccugagggcugagugggagggcggccc

SEQ ID NO: 143820 - RNA, 62 nt, hsa
aaggucaaauggggucaucugcuccuuuuccauccccugacauaccuuaaccucugaacucu

SEQ ID NO: 143821 - RNA, 62 nt, hsa
cugugagagcuauccacucuccugccugcauauccccugagaguuauaggaagugcccacug

SEQ ID NO: 143822 - RNA, 62 nt, hsa
caucggcuggcuuugggacuauuccaccuccuuccccugagcccagaucugcccccaccauc

SEQ ID NO: 143823 - RNA, 62 nt, hsa
acugguugcuuguccauggccaacaccagaaauccccugagcacuaccugggucucauucca

SEQ ID NO: 143824 - RNA, 62 nt, hsa
uugggaauucaaauuguccugcagagguucauuccccugacccuuuccccacauugguaaga

SEQ ID NO: 143825 - RNA, 64 nt, hsa
gacuguuuucauuucuguuuuuagcagagacaugcaacaacaacacacacgcacacacgcacac

SEQ ID NO: 143826 - RNA, 64 nt, hsa
uguuuucauuucuguuuuuagcagagacaugcaacaacaacacacacgcacacacgcacacaca

SEQ ID NO: 143827 - RNA, 64 nt, hsa
aaguuuugaaaugcugcacuuacauuuaaaaaaacaacaacaacauuuuuucaacaauuucaac

SEQ ID NO: 143828 - RNA, 64 nt, hsa
uuuugaaaugcugcacuuacauuuaaaaaaacaacaacaacauuuuuucaacaauuucaacaau

SEQ ID NO: 143829 - RNA, 64 nt, hsa
augaugcuaauggagaugaugguaaugauaaagacaacaacaaugauuaucaaguuccuguaca

SEQ ID NO: 143830 - RNA, 64 nt, hsa
uaaccaaaggguuugcuaacucugcuucaacauccaacaacacaaaacuauaugauuuuuaaaa

SEQ ID NO: 143831 - RNA, 64 nt, hsa
acuuaggaggcccauagaaacauucucguuuaaacaacaacaacaaaauaaauuuaucagcacu

SEQ ID NO: 143832 - RNA, 64 nt, hsa
uaggaggcccauagaaacauucucguuuaaacaacaacaacaaaauaaauuuaucagcacuaga

SEQ ID NO: 143833 - RNA, 64 nt, hsa
cagcccuaagucuccuucuuuauuauuaggaaaacaacaacaacaacaaacaaaaaaauggcgu

SEQ ID NO: 143834 - RNA, 64 nt, hsa
cccuaagucuccuucuuuauuauuaggaaaacaacaacaacaacaaacaaaaaaauggcgucau

SEQ ID NO: 143835 - RNA, 64 nt, hsa
uaagucuccuucuuuauuauuaggaaaacaacaacaacaacaaacaaaaaaauggcgucaugaa

SEQ ID NO: 143836 - RNA, 64 nt, hsa
cugggucagaaugaucuacucaguuaaaaaacaacaacaacaaaaaacuaagcgauugggaaaa

SEQ ID NO: 143837 - RNA, 64 nt, hsa
guucugggucagaaugaucuacucaguuaaaaaacaacaacaacaaaaaacuaagcgauuggga

SEQ ID NO: 143838 - RNA, 64 nt, hsa
auugcagaaguagcuuaucauuaaaaaacaacaacaacaacaauaacaauaaauccuaagugua

SEQ ID NO: 143839 - RNA, 64 nt, hsa
aaaauugcagaaguagcuuaucauuaaaaaacaacaacaacaacaauaacaauaaauccuaagu

SEQ ID NO: 143840 - RNA, 64 nt, hsa
guuaaaauugcagaaguagcuuaucauuaaaaaacaacaacaacaacaauaacaauaaauccua

SEQ ID NO: 143841 - RNA, 64 nt, hsa
guuccaaaucccaucaacaaaaugcugugaacaacaacaacaaaaaauaaaucaagaaggcaua

SEQ ID NO: 143842 - RNA, 64 nt, hsa
aguguuccaaaucccaucaacaaaaugcugugaacaacaacaacaaaaaauaaaucaagaaggc

SEQ ID NO: 143843 - RNA, 64 nt, hsa
ugaaguaauaguuucaguggaugauugaaaacaacaacaacaaaaacaaaaugaaacuaaucug

SEQ ID NO: 143844 - RNA, 64 nt, hsa
uggugaaguaauaguuucaguggaugauugaaaacaacaacaacaaaaacaaaaugaaacuaau

SEQ ID NO: 143845 - RNA, 57 nt, hsa
aaagagcuuauaugugguaaaaaacaacaacaacaaaacaccucugucaauguaaga

SEQ ID NO: 143846 - RNA, 54 nt, hsa
aaagagcuuauaugugguaaaaaacaacaacaacaaaacaccucugucaaugua

SEQ ID NO: 143847 - RNA, 64 nt, hsa
ucgcagguguucaugauuucuuuuauucuuugcacaacaacaacaacaacaaauucacggaauc

SEQ ID NO: 143848 - RNA, 64 nt, hsa
cagguguucaugauuucuuuuauucuuugcacaacaacaacaacaacaaauucacggaaucuuu

SEQ ID NO: 143849 - RNA, 64 nt, hsa
guguucaugauuucuuuuauucuuugcacaacaacaacaacaacaaauucacggaaucuuuuaa

SEQ ID NO: 143850 - RNA, 64 nt, hsa
uucaugauuucuuuuauucuuugcacaacaacaacaacaacaaauucacggaaucuuuuaagug

SEQ ID NO: 143851 - RNA, 64 nt, hsa
cagccugggcgacagagugagacuccaucucaaacaacaacaacaacaacaacaacaacaacaa

SEQ ID NO: 143852 - RNA, 64 nt, hsa
ccugggcgacagagugagacuccaucucaaacaacaacaacaacaacaacaacaacaacaaacc

SEQ ID NO: 143853 - RNA, 64 nt, hsa
gggcgacagagugagacuccaucucaaacaacaacaacaacaacaacaacaacaacaaaccaca

SEQ ID NO: 143854 - RNA, 64 nt, hsa
cgacagagugagacuccaucucaaacaacaacaacaacaacaacaacaacaacaaaccacaaaa

SEQ ID NO: 143855 - RNA, 64 nt, hsa
cagagugagacuccaucucaaacaacaacaacaacaacaacaacaacaacaaaccacaaaauua

SEQ ID NO: 143856 - RNA, 64 nt, hsa
agugagacuccaucucaaacaacaacaacaacaacaacaacaacaacaaaccacaaaauuauuu

SEQ ID NO: 143857 - RNA, 64 nt, hsa
gagacuccaucucaaacaacaacaacaacaacaacaacaacaacaaaccacaaaauuauuugag

SEQ ID NO: 143858 - RNA, 64 nt, hsa
acuccaucucaaacaacaacaacaacaacaacaacaacaacaaaccacaaaauuauuugaguac

SEQ ID NO: 143859 - RNA, 64 nt, hsa
ucucaaaaaaaacccaaaaaacaaaaacaaacaacaacaacaaaauuauaaagguagaaaauaa

SEQ ID NO: 143860 - RNA, 64 nt, hsa
gcaucucaaaaaaaacccaaaaaacaaaaacaaacaacaacaacaaaauuauaaagguagaaaa

SEQ ID NO: 143861 - RNA, 64 nt, hsa
cucuccacaacaacaaugaaaaccaacaccaacucaacaacaaagugcaauacaggcugaaccu

SEQ ID NO: 143862 - RNA, 64 nt, hsa
ucugcuauuuccaaucagucaaugccacucuccacaacaacaaugaaaaccaacaccaacucaa

SEQ ID NO: 143863 - RNA, 64 nt, hsa
ccaaccaaggacggaaaaugcuuaaaaaauaauacaacaacaacaaaaaauacauuauaacaac

SEQ ID NO: 143864 - RNA, 64 nt, hsa
accaaggacggaaaaugcuuaaaaaauaauacaacaacaacaaaaaauacauuauaacaacuau

SEQ ID NO: 143865 - RNA, 64 nt, hsa
uguguuccuaacaggaauuuucauuguucuauaacaacaacaacaaaagcgauuauuauuuuag

SEQ ID NO: 143866 - RNA, 64 nt, hsa
guuccuaacaggaauuuucauuguucuauaacaacaacaacaaaagcgauuauuauuuuagagc

SEQ ID NO: 143867 - RNA, 64 nt, hsa
uggaaagaauggaggaagcacuucaaguagccaucaacaacaacagaggauuugucucacccau

SEQ ID NO: 143868 - RNA, 64 nt, hsa
aaagaauggaggaagcacuucaaguagccaucaacaacaacagaggauuugucucacccaugcu

SEQ ID NO: 143869 - RNA, 64 nt, hsa
acaaaacaaaacaacaacaauacaacaagaacaacaacaacaauaacaacaaugguuuacauga

SEQ ID NO: 143870 - RNA, 64 nt, hsa
aaaacaaaacaaaacaacaacaauacaacaagaacaacaacaacaauaacaacaaugguuuaca

SEQ ID NO: 143871 - RNA, 64 nt, hsa
uacuuuacacucucuguacaaaaacaaaacaaaacaacaacaauacaacaagaacaacaacaac

SEQ ID NO: 143872 - RNA, 64 nt, hsa
uuugaauguguagaagaggaaaaagcaacaacagcaacaacacgaagaugauaccaaaacaagg

SEQ ID NO: 143873 - RNA, 64 nt, hsa
gaaaguuuguuugaauguguagaagaggaaaaagcaacaacagcaacaacacgaagaugauacc

SEQ ID NO: 143874 - RNA, 64 nt, hsa
guuacggguuacaacugguucauucugaaaacaacaacaacaaaaguccauucauauuuuuuaa

SEQ ID NO: 143875 - RNA, 64 nt, hsa
ucaguuacggguuacaacugguucauucugaaaacaacaacaacaaaaguccauucauauuuuu

SEQ ID NO: 143876 - RNA, 64 nt, hsa
uuguuuccauguauauggaaauagggaacaacaacaacaacaaaaaacccugaaagaacuggca

SEQ ID NO: 143877 - RNA, 64 nt, hsa
uuuuuguuuccauguauauggaaauagggaacaacaacaacaacaaaaaacccugaaagaacug

SEQ ID NO: 143878 - RNA, 64 nt, hsa
gcauuuuuguuuccauguauauggaaauagggaacaacaacaacaacaaaaaacccugaaagaa

SEQ ID NO: 143879 - RNA, 64 nt, hsa
auacgucaacaccuaugaaaagaagcggggaaaacaacaacaaggacaacaacaaaaaaccagu

SEQ ID NO: 143880 - RNA, 64 nt, hsa
cuaugaaaagaagcggggaaaacaacaacaaggacaacaacaaaaaaccagugaaauucuacaa

SEQ ID NO: 143881 - RNA, 64 nt, hsa
gcaaaaauuaaaacaacaacaacaacaacaacaacaacaacaaacagaaggauaaacuggcuug

SEQ ID NO: 143882 - RNA, 64 nt, hsa
uuggcaaaaauuaaaacaacaacaacaacaacaacaacaacaacaaacagaaggauaaacuggc

SEQ ID NO: 143883 - RNA, 64 nt, hsa
uucuuggcaaaaauuaaaacaacaacaacaacaacaacaacaacaacaaacagaaggauaaacu

SEQ ID NO: 143884 - RNA, 64 nt, hsa
agcuucuuggcaaaaauuaaaacaacaacaacaacaacaacaacaacaacaaacagaaggauaa

SEQ ID NO: 143885 - RNA, 64 nt, hsa
cucagcuucuuggcaaaaauuaaaacaacaacaacaacaacaacaacaacaacaaacagaagga

SEQ ID NO: 143886 - RNA, 64 nt, hsa
uuucucagcuucuuggcaaaaauuaaaacaacaacaacaacaacaacaacaacaacaaacagaa

SEQ ID NO: 143887 - RNA, 64 nt, hsa
guuuuucucagcuucuuggcaaaaauuaaaacaacaacaacaacaacaacaacaacaacaaaca

SEQ ID NO: 143888 - RNA, 64 nt, hsa
auuguuuuucucagcuucuuggcaaaaauuaaaacaacaacaacaacaacaacaacaacaacaa

SEQ ID NO: 143889 - RNA, 64 nt, hsa
ccugggcaacagagagagaccuugucucaaaaaacaacaacaacaaaaagucaaagucauaaua

SEQ ID NO: 143890 - RNA, 64 nt, hsa
gggcaacagagagagaccuugucucaaaaaacaacaacaacaaaaagucaaagucauaauaagc

SEQ ID NO: 143891 - RNA, 64 nt, hsa
uucacagaaacuaaacuccacccuugggacuccacaacaacaacaacaacaaaauuuaauuuaa

SEQ ID NO: 143892 - RNA, 64 nt, hsa
acagaaacuaaacuccacccuugggacuccacaacaacaacaacaacaaaauuuaauuuaauuu

SEQ ID NO: 143893 - RNA, 64 nt, hsa
gaaacuaaacuccacccuugggacuccacaacaacaacaacaacaaaauuuaauuuaauuuaaa

SEQ ID NO: 143894 - RNA, 64 nt, hsa
acuaaacuccacccuugggacuccacaacaacaacaacaacaaaauuuaauuuaauuuaaaaau

SEQ ID NO: 143895 - RNA, 64 nt, hsa
uauauagcuuuucccaaugcuaauuuccaaacaacaacaacaaaauaacauguuugccuguuaa

SEQ ID NO: 143896 - RNA, 64 nt, hsa
uguuauauagcuuuucccaaugcuaauuuccaaacaacaacaacaaaauaacauguuugccugu

SEQ ID NO: 143897 - RNA, 64 nt, hsa
gacaguaaaacguuaaaguacuggauuaagaaaacaacaacaggcugggcgcaguggcucacac

SEQ ID NO: 143898 - RNA, 64 nt, hsa
cugucucaaaaaauaauaauaauaauaaauaaaacaacaacaaaaugcaucagagagccaaaac

SEQ ID NO: 143899 - RNA, 64 nt, hsa
cauugcuguucucuguaucgugaucuauccucaacaacaacagaaaaaaggaauaaaauauccu

SEQ ID NO: 143900 - RNA, 64 nt, hsa
acccauugcuguucucuguaucgugaucuauccucaacaacaacagaaaaaaggaauaaaauau

SEQ ID NO: 143901 - RNA, 64 nt, hsa
uaaauuuuuuaaaaagacaaaaacaaaacaacaacaacaacacacaaaccugacaagagaaaaa

SEQ ID NO: 143902 - RNA, 64 nt, hsa
cccuaaauuuuuuaaaaagacaaaaacaaaacaacaacaacaacacacaaaccugacaagagaa

SEQ ID NO: 143903 - RNA, 64 nt, hsa
gcucccuaaauuuuuuaaaaagacaaaaacaaaacaacaacaacaacacacaaaccugacaaga

SEQ ID NO: 143904 - RNA, 64 nt, hsa
agugcacugaacuucaaaacaaaacaaaaaacaacaacaacaaaaaacaaguccaaacugauau

SEQ ID NO: 143905 - RNA, 64 nt, hsa
aaaagugcacugaacuucaaaacaaaacaaaaaacaacaacaacaaaaaacaaguccaaacuga

SEQ ID NO: 143906 - RNA, 64 nt, hsa
ucaucauugugacuuccugguagcccaagaagaacaacaacaaaacaaucugcucugaccuucu

SEQ ID NO: 143907 - RNA, 60 nt, hsa
acauuguugaguggcacugaacaagcagaccaacaacacugaggaagauagaguggugac

SEQ ID NO: 143908 - RNA, 64 nt, hsa
uauuggacuucuugaaaauaaaaguuacaaaauccaacaacaacaacaacaaaacaauguucuu

SEQ ID NO: 143909 - RNA, 64 nt, hsa
uggacuucuugaaaauaaaaguuacaaaauccaacaacaacaacaacaaaacaauguucuuggu

SEQ ID NO: 143910 - RNA, 64 nt, hsa
acuucuugaaaauaaaaguuacaaaauccaacaacaacaacaacaaaacaauguucuugguuuu

SEQ ID NO: 143911 - RNA, 64 nt, hsa
ucuugaaaauaaaaguuacaaaauccaacaacaacaacaacaaaacaauguucuugguuuuaau

SEQ ID NO: 143912 - RNA, 64 nt, hsa
aguugucaauuggauuuucuuccuaaacaaacaacaacaacaaacuacuagaagucucccugag

SEQ ID NO: 143913 - RNA, 64 nt, hsa
gaaaguugucaauuggauuuucuuccuaaacaaacaacaacaacaaacuacuagaagucucccu

SEQ ID NO: 143914 - RNA, 64 nt, hsa
aagguugaaaauaugcagguuauacauguuaaaacaacaacaacacuauccuauaaacuagaaa

SEQ ID NO: 143915 - RNA, 64 nt, hsa
guugaaaauaugcagguuauacauguuaaaacaacaacaacacuauccuauaaacuagaaagac

SEQ ID NO: 143916 - RNA, 64 nt, hsa
aucaucuucuaagagcugaucaagaaauuuaaaacaacaacaacaacaaaaaguuacgggguuc

SEQ ID NO: 143917 - RNA, 64 nt, hsa
aucuucuaagagcugaucaagaaauuuaaaacaacaacaacaacaaaaaguuacgggguucauc

SEQ ID NO: 143918 - RNA, 64 nt, hsa
uucuaagagcugaucaagaaauuuaaaacaacaacaacaacaaaaaguuacgggguucaucucc

SEQ ID NO: 143919 - RNA, 64 nt, hsa
caagcaaacgggcuaggaggaaagauuaaaaaaacaacaacaacaacuuauuuaguuuggggag

SEQ ID NO: 143920 - RNA, 64 nt, hsa
gcaaacgggcuaggaggaaagauuaaaaaaacaacaacaacaacuuauuuaguuuggggagggg

SEQ ID NO: 143921 - RNA, 64 nt, hsa
uccagucaugugugcauuuaauuuggcauagcaacaacaacacauuucucaggcaaaauggauu

SEQ ID NO: 143922 - RNA, 64 nt, hsa
aaauccagucaugugugcauuuaauuuggcauagcaacaacaacacauuucucaggcaaaaugg

SEQ ID NO: 143923 - RNA, 64 nt, hsa
gccugggugacaaagugagacuccgucacaacaacaacaacaaaaagcuuccccaacuaaagcc

SEQ ID NO: 143924 - RNA, 64 nt, hsa
ccagccugggugacaaagugagacuccgucacaacaacaacaacaaaaagcuuccccaacuaaa

SEQ ID NO: 143925 - RNA, 64 nt, hsa
acuccagccugggugacaaagugagacuccgucacaacaacaacaacaaaaagcuuccccaacu

SEQ ID NO: 143926 - RNA, 64 nt, hsa
cuugagcccagggguuugagaccagcuugggcaacaacaacaaaaaugccaggugugguggggu

SEQ ID NO: 143927 - RNA, 64 nt, hsa
uugcuugagcccagggguuugagaccagcuugggcaacaacaacaaaaaugccagguguggugg

SEQ ID NO: 143928 - RNA, 64 nt, hsa
augaugaugauaauaauaauaauaauaacaacaacaacaacaauaauaaagaugugaaaacucg

SEQ ID NO: 143929 - RNA, 64 nt, hsa
augaugaugaugauaauaauaauaauaauaacaacaacaacaacaauaauaaagaugugaaaac

SEQ ID NO: 143930 - RNA, 64 nt, hsa
augaugaugaugaugauaauaauaauaauaauaacaacaacaacaacaauaauaaagaugugaa

SEQ ID NO: 143931 - RNA, 64 nt, hsa
ggaagccacaccucuacaugucuaaaacaaaaaacaacaacaacagauaccccacucgccacua

SEQ ID NO: 143932 - RNA, 64 nt, hsa
agccacaccucuacaugucuaaaacaaaaaacaacaacaacagauaccccacucgccacuaugc

SEQ ID NO: 143933 - RNA, 64 nt, hsa
acuccagccugggcaacagagcgagacucugucucaacaacaacaacaaaaaguccugaacaug

SEQ ID NO: 143934 - RNA, 64 nt, hsa
ccagccugggcaacagagcgagacucugucucaacaacaacaacaaaaaguccugaacaugauu

SEQ ID NO: 143935 - RNA, 64 nt, hsa
gccugggcaacagagcgagacucugucucaacaacaacaacaaaaaguccugaacaugauugug

SEQ ID NO: 143936 - RNA, 64 nt, hsa
gcucuauuuuuuuuuuuuuuuuuuuuaagaaaaacaacaacaacaaaaaaagacaaugaaaaaa

SEQ ID NO: 143937 - RNA, 64 nt, hsa
cuauuuuuuuuuuuuuuuuuuuuaagaaaaacaacaacaacaaaaaaagacaaugaaaaaaaaa

SEQ ID NO: 143938 - RNA, 64 nt, hsa
ugaugagacaacacacacacacacaaaacaacagcaacaacaacagaacaacaacaaagcaugc

SEQ ID NO: 143939 - RNA, 64 nt, hsa
ugagacaacacacacacacacaaaacaacagcaacaacaacagaacaacaacaaagcaugcuca

SEQ ID NO: 143940 - RNA, 64 nt, hsa
acacacacacaaaacaacagcaacaacaacagaacaacaacaaagcaugcucaguauugagaca

SEQ ID NO: 143941 - RNA, 64 nt, hsa
acuguuucucguguaauauccuucuaaugcuuagcaacaacaacaaaaaauugcucucucagau

SEQ ID NO: 143942 - RNA, 64 nt, hsa
guuucucguguaauauccuucuaaugcuuagcaacaacaacaaaaaauugcucucucagaucca

SEQ ID NO: 143943 - RNA, 64 nt, hsa
gcuucuuagacggucuucacuguguguuuuaaaacaacaacaacaacaacaacaacaacauaaa

SEQ ID NO: 143944 - RNA, 64 nt, hsa
ucuuagacggucuucacuguguguuuuaaaacaacaacaacaacaacaacaacaacauaaaacu

SEQ ID NO: 143945 - RNA, 64 nt, hsa
uagacggucuucacuguguguuuuaaaacaacaacaacaacaacaacaacaacauaaaacucuu

SEQ ID NO: 143946 - RNA, 64 nt, hsa
acggucuucacuguguguuuuaaaacaacaacaacaacaacaacaacaacauaaaacucuuuug

SEQ ID NO: 143947 - RNA, 64 nt, hsa
gucuucacuguguguuuuaaaacaacaacaacaacaacaacaacaacauaaaacucuuuugacc

SEQ ID NO: 143948 - RNA, 64 nt, hsa
uucacuguguguuuuaaaacaacaacaacaacaacaacaacaacauaaaacucuuuugaccugu

SEQ ID NO: 143949 - RNA, 64 nt, hsa
acuguguguuuuaaaacaacaacaacaacaacaacaacaacauaaaacucuuuugaccuguaac

SEQ ID NO: 143950 - RNA, 64 nt, hsa
auaacuccuccauugaaauaacuccuccccaccccaacaacaacauucccagcagaccaacucc

SEQ ID NO: 143951 - RNA, 64 nt, hsa
acuccuccauugaaauaacuccuccccaccccaacaacaacauucccagcagaccaacucccac

SEQ ID NO: 143952 - RNA, 64 nt, hsa
gagaugguacaguuuuauuguacaggugcuaaaacaacaacaacaaaaaagaaaauggaaaaaa

SEQ ID NO: 143953 - RNA, 64 nt, hsa
augguacaguuuuauuguacaggugcuaaaacaacaacaacaaaaaagaaaauggaaaaaaaaa

SEQ ID NO: 143954 - RNA, 64 nt, hsa
guccaacaaggaauucacaccucugccuccuuugcaacaacaacauuuacacaguugguaagug

SEQ ID NO: 143955 - RNA, 64 nt, hsa
caacaaggaauucacaccucugccuccuuugcaacaacaacauuuacacaguugguaagugggu

SEQ ID NO: 143956 - RNA, 64 nt, hsa
ccacugugguugagcuuuauguuuacagucucagcaacaacacuuaugcauccaaacacucaca

SEQ ID NO: 143957 - RNA, 64 nt, hsa
ucuaauucauuuucucuuuaguguuaguagacuccaacaacagaaguggcaucuguguauucau

SEQ ID NO: 143958 - RNA, 64 nt, hsa
agggcagcaggagcagcagcagcagcagcagcagcaacaacaacaacuacugugccuugggcug

SEQ ID NO: 143959 - RNA, 64 nt, hsa
gcagcaggagcagcagcagcagcagcagcagcaacaacaacaacuacugugccuugggcugcua

SEQ ID NO: 143960 - RNA, 64 nt, hsa
auaagaagaagauaaaaacaaaauauuuuggaguguuuuccaacuuaaaguaugaagacauacu

SEQ ID NO: 143961 - RNA, 64 nt, hsa
auaaaguacuguguuuaaaaaaauguuaugcaauguuuuccaaacugauaaaguuuguaaagug

SEQ ID NO: 143962 - RNA, 64 nt, hsa
cccucauaugguuuuuggccaagugacuaaaacaguuuuccacaacuguaaacaaacugcuaag

SEQ ID NO: 143963 - RNA, 64 nt, hsa
ugcuugauuaugucagcaacacccaacacugucuguuuuccauuuguugguuuuaaucauaaaa

SEQ ID NO: 143964 - RNA, 64 nt, hsa
ucuuuggaugugaacgcgggaaugaacaguggcuguuuuccacccaaaggggcguggagaccuu

SEQ ID NO: 143965 - RNA, 54 nt, hsa
uccuuugcuaggcacuuugauccgguuuuccaguucuugcacaagcaaguuugu

SEQ ID NO: 143966 - RNA, 64 nt, hsa
agggcggccgccacccucgcguagcuuuccugugguuuuccaggacuguccgguacagcccggg

SEQ ID NO: 143967 - RNA, 64 nt, hsa
gucucacuguuggccagggcuuuguggcguggguguuuuccagucugccuggagcagcgagaag

SEQ ID NO: 143968 - RNA, 64 nt, hsa
uaugaaggugcuugagaaaagagaugauguugaaguuuuccaauauucuguugaaguuuuccaa

SEQ ID NO: 143969 - RNA, 64 nt, hsa
agaugauguugaaguuuuccaauauucuguugaaguuuuccaauauuaaguauuagcuuaggga

SEQ ID NO: 143970 - RNA, 64 nt, hsa
uuuaccgacagccgucuuuuguucuuucuuuccuguuuuccauuuuuaaacuaguaacagcagg

SEQ ID NO: 143971 - RNA, 64 nt, hsa
aacucugagaauuuucuucagauucauugagagaguuuuccauaaagacauuuauauaugugag

SEQ ID NO: 143972 - RNA, 64 nt, hsa
gguuuacugcuuuaccacugagcugaaaugccguguuuuccauuuauuaaaaucacacauggcu

SEQ ID NO: 143973 - RNA, 64 nt, hsa
aacuuugcuugguaauuuaaaauuaauaaugccaguuuuccaagagugagaaaaucauugcacu

SEQ ID NO: 143974 - RNA, 64 nt, hsa
acaccuuuuuuuucuaguuuuuuuguucgguuuuguuuuccaucaggaauuugaguucucucua

SEQ ID NO: 143975 - RNA, 64 nt, hsa
cugaaaaugcaacauuagcaaagagguggguucuguuuuccaggugaaacuuuuagcuccauga

SEQ ID NO: 143976 - RNA, 64 nt, hsa
uucuacuggggagaguguaauauuuuggacugcuguuuuccauuaaugaggagagcaacaggcc

SEQ ID NO: 143977 - RNA, 64 nt, hsa
uuauuuggcuacacuaaagaaugcaguauauuuaguuuuccauuugcaugauguuugugugcua

SEQ ID NO: 143978 - RNA, 64 nt, hsa
aaauguuuguugaaugaaugcaugucuucuaaaaguuuuccaacacaaauuagcagugguuucu

SEQ ID NO: 143979 - RNA, 64 nt, hsa
caccccuaauuaauaugugagagacaacagcuggguuuuccaucccuaacacauuuauuucauu

SEQ ID NO: 143980 - RNA, 64 nt, hsa
uugagagcaguggggugcuuggcagcuguucuguguuuuccaggaauccaacugagcauugaaa

SEQ ID NO: 143981 - RNA, 64 nt, hsa
gauucagggcaagcuaaaaauccgauacugcaacguuuuccaaaaucccagaaggcaaacugug

SEQ ID NO: 143982 - RNA, 64 nt, hsa
guuuuuuguuuuuuuuuuuugacacuguccaaagguuuuccauccuguccuggaaucagaguug

SEQ ID NO: 143983 - RNA, 64 nt, hsa
agggguagugauacaagucucauagccagagaugguuuuccacuccuucuagauauucccaaaa

SEQ ID NO: 143984 - RNA, 64 nt, hsa
gggggaagaccuagaacccuuuccccagcacuugguuuuccaacaugauauuuaugaguaauuu

SEQ ID NO: 143985 - RNA, 64 nt, hsa
aggaagaaacaucuagaaguuguacauauucagaguuuuccauuggcagugccaguuucuagcc

SEQ ID NO: 143986 - RNA, 64 nt, hsa
guaugcgcacaguuccugugggacugggccgugaguuuuccauuggaaagaaguucaguggucc

SEQ ID NO: 143987 - RNA, 64 nt, hsa
uuacugaugcacuuuaguuuuuggucuguuaccuguuuuccagaaauuuguggccuuuuaggcg

SEQ ID NO: 143988 - RNA, 64 nt, hsa
ucauuagucauggcagaaggaggggaaaagacuuguuuuccagacagaaaaucuacuccccugu

SEQ ID NO: 143989 - RNA, 64 nt, hsa
cugugugugcauguuggucuuugugugcauaucuguuuuccaggucuaugugaguccuugugcu

SEQ ID NO: 143990 - RNA, 64 nt, hsa
uugcccucuccuauccucuugccauaugaauagcguuuuccaugaaauaggaaaauauuacuug

SEQ ID NO: 143991 - RNA, 64 nt, hsa
acaagggaagaaucuacuuuuuagaaaucgcuuuguuuuccaagcaguaaguacuacauacagu

SEQ ID NO: 143992 - RNA, 64 nt, hsa
ugaaaaguuuuccaguuuuuguuuuuuguuuuuuguuuuccaguaggggauuagaauguuuagu

SEQ ID NO: 143993 - RNA, 64 nt, hsa
uacugacuuguuaccacugcugacuuucugaaaaguuuuccaguuuuuguuuuuuguuuuuugu

SEQ ID NO: 143994 - RNA, 64 nt, hsa
uauuugaacuugccuuguaggccuccaccaucauguuuuccaucacuuuaaucaaucauuuuga

SEQ ID NO: 143995 - RNA, 64 nt, hsa
uuuucaguuguguguaauaccaagagauugcacuguuuuccaauucuuaugaauauuaucagca

SEQ ID NO: 143996 - RNA, 64 nt, hsa
uauguacacaaaaauauuuuccuuguagaaaauaguuuuccagacacuuagccuucugaagugc

SEQ ID NO: 143997 - RNA, 64 nt, hsa
uagcuagagaaauguaagguaaaaggcucacuuuguuuuccaguggguccagagucuucucuau

SEQ ID NO: 143998 - RNA, 64 nt, hsa
guuugugguuuaggaaugccugagcaguuuuccaguuuuccaccgugggugggccagguguucc

SEQ ID NO: 143999 - RNA, 64 nt, hsa
augguauuguuugugguuuaggaaugccugagcaguuuuccaguuuuccaccgugggugggcca

SEQ ID NO: 144000 - RNA, 64 nt, hsa
uugaacuuacaguaaaaguugugaacuucuguauguuuuccacaguuuaugauugagguaaaac

SEQ ID NO: 144001 - RNA, 64 nt, hsa
ggaccuaggccccaguuugucccaaagcaggaguguuuuccaugggauaaaggacacccuaggu

SEQ ID NO: 144002 - RNA, 64 nt, hsa
caaaauaacauuucuacccaggauaauagucacaguuuuccagggagggaaugauauaauuuuc

SEQ ID NO: 144003 - RNA, 64 nt, hsa
auguuauugacuauagcagauuuuggaaaucaguguuuuccaugugacccucuuuccuugcauc

SEQ ID NO: 144004 - RNA, 64 nt, hsa
ugccuggcccacuccugagagcucuaguuuucuaguuuuccauuuccagauugcgccagcauua

SEQ ID NO: 144005 - RNA, 64 nt, hsa
ugauguucuuccaacucaguugagugauuuuaagguuuuccaaaucuucuauggcucucuuuuu

SEQ ID NO: 144006 - RNA, 64 nt, hsa
gaaacugcauuguaaaaagagaagaaaguggcagguuuuccagguccacggaaagguuuggccu

SEQ ID NO: 144007 - RNA, 64 nt, hsa
ugagaaaugggcuguauugauacugugaauguuuguuuuccaagcuguuuuauacagguuuguu

SEQ ID NO: 144008 - RNA, 64 nt, hsa
cuugggagccucgccuuacaacuaauuccugccuuucguccaguaccaagucccccguugcuuc

SEQ ID NO: 144009 - RNA, 64 nt, hsa
gugacuuuccgguugcccuggaucucagaauauauucguccacccccucggcaccccauuaccc

SEQ ID NO: 144010 - RNA, 64 nt, hsa
uagagagagccguagcccuuuguaaaggcuuucguucguccaaacaacacuugauccaaccaaa

SEQ ID NO: 144011 - RNA, 64 nt, hsa
aggcaguaccugccugacccuucaaggccugaccuucguccagagugcucugguuugcaccaug

SEQ ID NO: 144012 - RNA, 64 nt, hsa
ggauagugugagcuucauuuuguacacgugugacuucguccaguuacaaacccaauaaacucug

SEQ ID NO: 144013 - RNA, 64 nt, hsa
uauugaaauaggcagcacucugaaagacagaagcuucguccagccacucuucagcacauuccuu

SEQ ID NO: 144014 - RNA, 64 nt, hsa
uaucuugacaggcgccgccucgcccccgggcccuuucguccacaucaaaaaugcaucaagucuc

SEQ ID NO: 144015 - RNA, 64 nt, hsa
caggggaagaccaaaguuugcaacucgaacugcuuucguccauguuucucacauugcuguauuu

SEQ ID NO: 144016 - RNA, 64 nt, hsa
ccucucucuacucucaggcaugucuuuuguccuuuucguccaucuauuucugucugucgcucac

SEQ ID NO: 144017 - RNA, 64 nt, hsa
auagcauuucaacauuuuucaaaaucaggagauuuucguccauuuaaaaaauguauaggugcag

SEQ ID NO: 144018 - RNA, 64 nt, hsa
ucuucauguauuuuuuuucuauucuaacaaauuuuucguccaccaucuuaacagagaucaagug

SEQ ID NO: 144019 - RNA, 64 nt, hsa
ucugucagcaggaagcaguuaaagaagacugaccuucguccauuuucccagauaauugggucuu

SEQ ID NO: 144020 - RNA, 64 nt, hsa
uuacagguuaaugacuccagagaguaagaucagauucguccacaaagagaugggcauaauacca

SEQ ID NO: 144021 - RNA, 64 nt, hsa
uuucugcaaaauaaacgcaauaugcaaaaugugauucguccaguuauuagugaagccccuccuu

SEQ ID NO: 144022 - RNA, 64 nt, hsa
ggaaauacagagagaaccucuuccacuuuuacuuuucguccaaauaaaaugcaugguguaccag

SEQ ID NO: 144023 - RNA, 64 nt, hsa
uaucuuaauagcaauuuuaggagaaaaugacucuuucguccagaagagcucugcagaaccaggg

SEQ ID NO: 144024 - RNA, 64 nt, hsa
ggcucugggcugauucagagguuacugcuuuauauucguccaaacuguguuagucuaggcuuag

SEQ ID NO: 144025 - RNA, 64 nt, hsa
auuaguaauuuauuuuugauucuuuguuuucuuuuucguccaacuaaaacaacuguaauguacu

SEQ ID NO: 144026 - RNA, 64 nt, hsa
agccaggaaugaguuacaaacaguguaugaagcauucguccagcagcaccaggcugaaaaaaca

SEQ ID NO: 144027 - RNA, 64 nt, hsa
ucgcggcagguucucuuugagucaauagcuugucuucguccaucuguugacaaaugacagaucu

SEQ ID NO: 144028 - RNA, 64 nt, hsa
aggaagcuuaggacccgugggaauggcaaaacaguucguccauccucuguuuauagaaauggaa

SEQ ID NO: 144029 - RNA, 64 nt, hsa
uugccuuuaggcuugaguccucaagccucuccuuuucguccauaauaaaauguuuaaguuauua

SEQ ID NO: 144030 - RNA, 64 nt, hsa
auucugcaggacaggacuauucuagcauaccugcuucguccacccaggcaggguuugggguggu

SEQ ID NO: 144031 - RNA, 64 nt, hsa
caugagcauuguggaauauccuuuccuaggcacauucguccacuaagggaacagccucagaaac

SEQ ID NO: 144032 - RNA, 64 nt, hsa
guggcaacugaaaugcauuucagaaauaggagguuucguccagcacccucugcagccuuggugc

SEQ ID NO: 144033 - RNA, 64 nt, hsa
ccuggaacuauacagauagguaaagaguuccaaguucguccagcccaugugcaaagucaacagu

SEQ ID NO: 144034 - RNA, 64 nt, hsa
uaaaaacuuguuuuuuguaguuauuucuaaucuguucguccaggauuuuccgugucuuugggga

SEQ ID NO: 144035 - RNA, 64 nt, hsa
uuuacccuucaguagucaagauuacguuagagacuucguccacgaauccacaccaccuuuccca

SEQ ID NO: 144036 - RNA, 64 nt, hsa
aaagaacaaugagugugaugcuccaugucugaauuucguccagccucucucugaacugugaucu

SEQ ID NO: 144037 - RNA, 64 nt, hsa
guucuuuucauggugucugacaccgagggcguuguucguccaucaggcgggauuggauggaguc

SEQ ID NO: 144038 - RNA, 64 nt, hsa
gucaagggcccgcccacugacccagccguaccuauucguccacggugccccguagcagcagguc

SEQ ID NO: 144039 - RNA, 64 nt, hsa
gcacuuggaaguuacaucugugaaguuucugucauucguccagaucuguguguguagcaugugc

SEQ ID NO: 144040 - RNA, 64 nt, hsa
cggguucguguacucucuguaucuccucuuaagcuucguccaggguucuuuauuuuugucugcu

SEQ ID NO: 144041 - RNA, 64 nt, hsa
cgaccagcacaagcuuugcccaaggacuaagcuguucguccacacgccaccaucuaccaguggg

SEQ ID NO: 144042 - RNA, 64 nt, hsa
aguccccucccagcuccgcucacagggcucucauuucguccauccccuugucgcagauccuggc

SEQ ID NO: 144043 - RNA, 64 nt, hsa
agcagcuuuguacacgaagaccauccauccucccuucguccaccacucuacucccuccacccuc

SEQ ID NO: 144044 - RNA, 64 nt, hsa
auugcagaaagugaaagaggaaaucauugaagccuucguccaggagcugaggaagcgggguucu

SEQ ID NO: 144045 - RNA, 64 nt, hsa
ugcugcugucaccucucccacgggaccuggggcuuucguccacagcuuccuguccccaucuguc

SEQ ID NO: 144046 - RNA, 64 nt, hsa
cagggagggcggcaggcuccacuucggcgagagguucguccaugcagaggugggcaagaacugg

SEQ ID NO: 144047 - RNA, 64 nt, hsa
uguaucuaucuuacgagaacaaucaucaugcagauucguccacaggggaucugucaguuugggu

SEQ ID NO: 144048 - RNA, 64 nt, hsa
ccauucaagucaccugaggcaaagugucugcaucuucguccagcgacccuuugcuuuucggcuc

SEQ ID NO: 144049 - RNA, 64 nt, hsa
gacugguuaggaucugaggugagucccaggauguuucguccaccagggcccagauucugggagg

SEQ ID NO: 144050 - RNA, 64 nt, hsa
ugcaggggccagggaagcccagcgcucggugcccuucguccaggguuaaaaucggccugugggg

SEQ ID NO: 144051 - RNA, 64 nt, hsa
cucaguguagaaacccacgucuguaaggucggucuucguccaucugcuuuuuucugaaauacac

SEQ ID NO: 144052 - RNA, 64 nt, hsa
ucuuccuuugucuaaugugggauuccugacucccuucguccaaggcaccggugugugugugucu

SEQ ID NO: 144053 - RNA, 64 nt, hsa
cuuuaccucaggagccaggagcagacagcaauacuucguccacaccugggaucgcgcagggccc

SEQ ID NO: 144054 - RNA, 64 nt, hsa
uaaagaaguggugccggguaggaaccacgguuccuucguccauuaguuggaaaaaguaacagac

SEQ ID NO: 144055 - RNA, 64 nt, hsa
gaagaggaggacaaaaagggggaggagaagguucuucguccaaaggaggaaggagaagaaguag

SEQ ID NO: 144056 - RNA, 64 nt, hsa; identical to SEQ ID NO: 50725

SEQ ID NO: 144057 - RNA, 64 nt, hsa; identical to SEQ ID NO: 50726

SEQ ID NO: 144058 - RNA, 64 nt, hsa; identical to SEQ ID NO: 50727

SEQ ID NO: 144059 - RNA, 64 nt, hsa; identical to SEQ ID NO: 50728

SEQ ID NO: 144060 - RNA, 64 nt, hsa; identical to SEQ ID NO: 50729

SEQ ID NO: 144061 - RNA, 64 nt, hsa; identical to SEQ ID NO: 50730

SEQ ID NO: 144062 - RNA, 64 nt, hsa; identical to SEQ ID NO: 50731

SEQ ID NO: 144063 - RNA, 64 nt, hsa; identical to SEQ ID NO: 50732

SEQ ID NO: 144064 - RNA, 64 nt, hsa; identical to SEQ ID NO: 50733

SEQ ID NO: 144065 - RNA, 64 nt, hsa; identical to SEQ ID NO: 50734

SEQ ID NO: 144066 - RNA, 51 nt, hsa; identical to SEQ ID NO: 50735

SEQ ID NO: 144067 - RNA, 64 nt, hsa; identical to SEQ ID NO: 50736

SEQ ID NO: 144068 - RNA, 64 nt, hsa; identical to SEQ ID NO: 50737

SEQ ID NO: 144069 - RNA, 64 nt, hsa; identical to SEQ ID NO: 50738

SEQ ID NO: 144070 - RNA, 64 nt, hsa
agggcuggggacagagggugucaaacauucgugagcuggggacucagggaccggugcugcagga

SEQ ID NO: 144071 - RNA, 64 nt, hsa
agaauguguguguguggcagggggccccgccagggcuggggacagagggugucaaacauucgug

SEQ ID NO: 144072 - RNA, 64 nt, hsa
cuauccucuugcucaugaccagccauauggugaggcuggggaguucacauccucaggcaggaac

SEQ ID NO: 144073 - RNA, 64 nt, hsa
ggagguagcaaggccacuggguugcuauccucuugcuggggauagcaaccacugguuugcaacc

SEQ ID NO: 144074 - RNA, 64 nt, hsa
ugggaagcaugaucuggcaggggccgcccuguaggcuggggaugggcugcugugugaauguuga

SEQ ID NO: 144075 - RNA, 64 nt, hsa
aagaggggccucagagaagcucugacgcagugcugcuggggaagggaagugacuaaccccgggu

SEQ ID NO: 144076 - RNA, 64 nt, hsa
uggccuuccucugccugcaagugagcagggaugggcuggggaguugcuugugccaccaagacgu

SEQ ID NO: 144077 - RNA, 64 nt, hsa
uggagcggggaaaccgcagcucagcccaggcccagcuggggagaaggcgcuaccugcgugggac

SEQ ID NO: 144078 - RNA, 64 nt, hsa
aaaagugguuuaauuggacuuaaaguuccacauggcuggggaggccucagaaucauggugggag

SEQ ID NO: 144079 - RNA, 64 nt, hsa
aaaagagguuuacuuggacuuacaguuccacauggcuggggaggccucagaaucauggcgggag

SEQ ID NO: 144080 - RNA, 64 nt, hsa
ugaccuuaugaggcccauggcacuggggcagggagcuggggacauuuuaaucaucaauaaacga

SEQ ID NO: 144081 - RNA, 64 nt, hsa
gaagaaggcuucuggucaggacccccaccccaaggcuggggacuccaggcuccugcuuuacugu

SEQ ID NO: 144082 - RNA, 64 nt, hsa
aggggagguguuuuugccaucaccaguuucucaggcuggggagcacagaggggaggaggaggac

SEQ ID NO: 144083 - RNA, 64 nt, hsa
ccuugugucuguggacuagagauagggugggggagcuggggaagggugcaggcgggaagagugg

SEQ ID NO: 144084 - RNA, 64 nt, hsa
ugccagcugcuauggggcuuaggccaugcucagugcuggggacaggaguuuugcccaacgcagu

SEQ ID NO: 144085 - RNA, 64 nt, hsa
agagcagugcuuccagaguuccuccugcaccugugcuggggaguaggaggcccacucacaagcc

SEQ ID NO: 144086 - RNA, 64 nt, hsa
aaauuauuucuggguugauucaaagggaggacuugcuggggaccagaauccaaacggccucaag

SEQ ID NO: 144087 - RNA, 64 nt, hsa
ucucacugagcagcccgagggccacuccagcccggcuggggaagagaguccugaacgguuugau

SEQ ID NO: 144088 - RNA, 64 nt, hsa
gguuuaguuauaagugaagcaugguugaauaccagcuggggagacacuagggaagggagcuuug

SEQ ID NO: 144089 - RNA, 64 nt, hsa
ucauaaaccagcugcgguaacagacaagccuuuggcuggggaguuuuaagccucgguaacugcu

SEQ ID NO: 144090 - RNA, 64 nt, hsa
ucuuugugcugcuccuugccaccuugggguuccugcuggggaccaugugugguuguggcaugug

SEQ ID NO: 144091 - RNA, 64 nt, hsa
gagcugggcgagcugggcgagcugggcgagcugggcuggggagagccugugaggaccgagagga

SEQ ID NO: 144092 - RNA, 64 nt, hsa
ugaacuuggugcucuaaguccaggcagccugcaggcuggggacccugggugcaggugccaggcu

SEQ ID NO: 144093 - RNA, 64 nt, hsa
cugcgaacgcaaaagugaaugagggcuuuuuguggcuggggauggguuuugguuuugggguuuu

SEQ ID NO: 144094 - RNA, 64 nt, hsa
acugcucgccagucucugugagccuaggcccugagcuggggagguggggaagauucgggcaugu

SEQ ID NO: 144095 - RNA, 64 nt, hsa
ccucagcugaagccuggccuaguugcugagaggggcuggggagauggggcgggagggccagacu

SEQ ID NO: 144096 - RNA, 64 nt, hsa
uagcaaggcauuguggaaagaggggaccaggguggcuggggaagaggccgaugcauaaagucag

SEQ ID NO: 144097 - RNA, 64 nt, hsa
agaaaacuaagacaggaugauacagguuugaggggcuggggagugggaggggggagaaaaggaa

SEQ ID NO: 144098 - RNA, 64 nt, hsa
cuauggaaacaagggugucauugaugugggcugagcuggggaacaugucggugcacagcugaaa

SEQ ID NO: 144099 - RNA, 64 nt, hsa
ggugugggaugcuccuggauggagaggguuugcugcuggggaggacaugggugugugugugacu

SEQ ID NO: 144100 - RNA, 64 nt, hsa
uaccaaagacacagcugggucuggaccccacggggcuggggagggccaugugcaauauuuggag

SEQ ID NO: 144101 - RNA, 64 nt, hsa
auauuuggaggguuuucuggagggcagcaggaaggcuggggaauuccccauguacaguauuuau

SEQ ID NO: 144102 - RNA, 64 nt, hsa
cucccccucaugaccuaaacucugggcuuuucuugcuggggaggcagcaagcaugcugguggga

SEQ ID NO: 144103 - RNA, 64 nt, hsa
ccccacgauugaccagccacacucugggccgguggcuggggaagaacaauccccgagggcugcu

SEQ ID NO: 144104 - RNA, 64 nt, hsa
aguucccaggcuggggaugcuuugccuuguggaagcuggggaggauuuguuacuucguaugugu

SEQ ID NO: 144105 - RNA, 64 nt, hsa
auggugacggcaacaagaacuccacaguucccaggcuggggaugcuuugccuuguggaagcugg

SEQ ID NO: 144106 - RNA, 64 nt, hsa
ugcccccuuucccaggguaucuguggguugccaggcuggggagggcaaccauagccacaccaca

SEQ ID NO: 144107 - RNA, 64 nt, hsa
ccugucuccuccccaccucccaaaggucuaccgagcuggggaggagguacaguaggcccugucc

SEQ ID NO: 144108 - RNA, 64 nt, hsa
ccuuuuucagggaacugggaacuuaggggacugagcuggggagggaggcaggugggugguaaga

SEQ ID NO: 144109 - RNA, 64 nt, hsa
aacagguuugccuacguuggugcaagugugcauggcuggggacuucucacuuccccuugcaccc

SEQ ID NO: 144110 - RNA, 64 nt, hsa
auggagacagguagacagaccuccaggucccuaagcuggggacagagaagguucugagcugucc

SEQ ID NO: 144111 - RNA, 64 nt, hsa
agagccccuuuaacccugauucauacuccuuuuggcuggggagucccuauaguuucaccacucc

SEQ ID NO: 144112 - RNA, 64 nt, hsa
aauguguguaagugagggucagccuuaccuuggggcuggggaagaggacugugugagaggggcg

SEQ ID NO: 144113 - RNA, 64 nt, hsa
aucacagccauuugagaaauggcuucuuugcagagcuggggaagccgggcagaagaugccgcag

SEQ ID NO: 144114 - RNA, 64 nt, hsa
aagggccugcccuggggcucccagggaagugggagcuggggagccaauccacccagacccgcgu

SEQ ID NO: 144115 - RNA, 64 nt, hsa
cagaucacuccuggaggcuggggaugguaggauugcuggggauuuuuuuuuuuuuaaacagggu

SEQ ID NO: 144116 - RNA, 64 nt, hsa
uucucaaugcuuaggagacagaucacuccuggaggcuggggaugguaggauugcuggggauuuu

SEQ ID NO: 144117 - RNA, 64 nt, hsa
ugucuagagugugggcuggcuguugugcuggaaagcuggggacagguugaugguaauaaacugc

SEQ ID NO: 144118 - RNA, 64 nt, hsa
acauugcaucccaaagagcuucucaguggaggaggcuggggaaggcaugagggggcucagaggc

SEQ ID NO: 144119 - RNA, 64 nt, hsa
cuuccagugccacauggagugaggcccugcccaugcuggggacuuuggggaggaauuugguauu

SEQ ID NO: 144120 - RNA, 64 nt, hsa
gcuggcaggaccaugccaucucuguggagaaggugcuggggagggaaguccuuccagugccaca

SEQ ID NO: 144121 - RNA, 64 nt, hsa
aaagccagugcccagggaugggcaucuccagggagcuggggauuagugccaggcagcccugcca

SEQ ID NO: 144122 - RNA, 64 nt, hsa
ucugccugggccaacucugcauggagaggccagggcuggggacaguccgcacucugccacccuc

SEQ ID NO: 144123 - RNA, 64 nt, hsa
cuagcacggcucagccuccugcuauccccugacugcuggggacccucgccuucccuccucucac

SEQ ID NO: 144124 - RNA, 64 nt, hsa
ggagagcacggaaccgcacgcacgucaggcaccggcuggggaucuguggggcagcggcgggcgc

SEQ ID NO: 144125 - RNA, 64 nt, hsa
cuucccugcucacacccacacuggcugcugauuggcuggggaggcccccgcccuuuucucccuu

SEQ ID NO: 144126 - RNA, 64 nt, hsa
uccccucugccauccccuuggggccggucccucugcuggggaugcaccaaugaaccccacagga

SEQ ID NO: 144127 - RNA, 64 nt, hsa
uuccugcggguggccagccugucuguguggcugggcuggggaggccacgucugguaucugaaug

SEQ ID NO: 144128 - RNA, 64 nt, hsa
cuggaaggcugccaagcccaaaguugugcagagcgcuggggacuccagacuccccacagcagca

SEQ ID NO: 144129 - RNA, 64 nt, hsa
uuuugccaugaggguaaccagcucuucccagcuggcuggggacugucuuggguuuaaaacugca

SEQ ID NO: 144130 - RNA, 64 nt, hsa
caggaugccaggggccuggccagccucccccaaugcuggggagcaucccugggccuggggccac

SEQ ID NO: 144131 - RNA, 64 nt, hsa
ccccuggcauggggaccacacccuggagcccggugcuggggaccuccuggacacccuguccuuc

SEQ ID NO: 144132 - RNA, 64 nt, hsa
ggcugcuggcccauccugccugggcaucccuggugcuggggacugugccaggccaugcuugcug

SEQ ID NO: 144133 - RNA, 64 nt, hsa
ccuccucuucucucauccuuccuccgacaccucggcuggggaaaccgaggccaccgcccccccc

SEQ ID NO: 144134 - RNA, 64 nt, hsa
ccacacugaaucucaccugcuaggagccucaccugcuggggaccucacccuggagggcacuggg

SEQ ID NO: 144135 - RNA, 64 nt, hsa
gcuuccaggagcguccccugcggaagccuggccugcuggggaugucuccuggggacuuugccua

SEQ ID NO: 144136 - RNA, 64 nt, hsa
gcucccagagaccuugccacacugaaucucaccugcuggggaccucacccuggagggcccuggg

SEQ ID NO: 144137 - RNA, 64 nt, hsa
cuguuggggaccucaccugcuggggaccucaccugcuggggaccuuggcugcuggaggcugcac

SEQ ID NO: 144138 - RNA, 64 nt, hsa
cugcuggggaccucgccuguuggggaccucaccugcuggggaccucaccugcuggggaccuugg

SEQ ID NO: 144139 - RNA, 64 nt, hsa
ccuccagaagacuugccugcuagggaccucgccugcuggggaccucgccuguuggggaccucac

SEQ ID NO: 144140 - RNA, 64 nt, hsa
ggagccuccccugcuggggaccuugccagcuggggcuggggauggugccuacuggggaccuugc

SEQ ID NO: 144141 - RNA, 64 nt, hsa
cacuugccgggcuucacugccaggagccuccccugcuggggaccuugccagcuggggcugggga

SEQ ID NO: 144142 - RNA, 64 nt, hsa
gcuuuuuucucucguaauagaaaaguggggagccgcuggggagccaccccauucauccccguau

SEQ ID NO: 144143 - RNA, 64 nt, hsa
cccaagccacggcccgggguucaaggcuagagcugcuggggaggggcugccuguuuuacucacc

SEQ ID NO: 144144 - RNA, 64 nt, hsa
ggcuccuggaauccaggccagcccaacagcccuggcuggggaggugucagggcagcuggggaga

SEQ ID NO: 144145 - RNA, 64 nt, hsa
gcccaacagcccuggcuggggaggugucagggcagcuggggagaggugggcucugcuuuucaga

SEQ ID NO: 144146 - RNA, 64 nt, hsa
agcccugcaguuucauagucccagccuuccuggugcuggggagggaggacugugaauggcuguu

SEQ ID NO: 144147 - RNA, 64 nt, hsa
ggguguggccugcaaaggaaccaacagacccuaugcuggggacucuaacaugugagcucauuaa

SEQ ID NO: 144148 - RNA, 64 nt, hsa
agguacagcuuuggcccucaagagcccacuguaugcuggggaaauggaaccauggugcaguagu

SEQ ID NO: 144149 - RNA, 64 nt, hsa
uuuguggaucucuuggcaagccaacugugcaggugcuggggagugggaggcuccccugcccucc

SEQ ID NO: 144150 - RNA, 64 nt, hsa
cccagcuucgguaugccuucagggaaaggucacagcuggggaggaagcggggggacgccuguca

SEQ ID NO: 144151 - RNA, 64 nt, hsa
aucaccagccagagcacaggaagccacccugccugcuggggaggagggacccacacaagccccc

SEQ ID NO: 144152 - RNA, 64 nt, hsa
ucugucugcuccuaaugggggcccaaagcucagggcuggggagccugggguccccacuugaauc

SEQ ID NO: 144153 - RNA, 64 nt, hsa
gugcagcuggggucccaggcagcgcugccugggggcuggggaggggaggcccagaggagggcug

SEQ ID NO: 144154 - RNA, 64 nt, hsa
ugccacuugaagccuggacucagggugcuccagcgcuggggaguggugagggccuuccagagau

SEQ ID NO: 144155 - RNA, 64 nt, hsa
aucagcaccguggucugaugaauggagagagugagcuggggaacaggaaagucuggggagccac

SEQ ID NO: 144156 - RNA, 64 nt, hsa
ccauuccaguccucugcacuguacacugcagcagugugcaaacuaugggacuuagaggguuucu

SEQ ID NO: 144157 - RNA, 64 nt, hsa
ccucuccccagauaccuccuauauuuccauauugugugcaaaggaugggcagaaaagaaagugc

SEQ ID NO: 144158 - RNA, 64 nt, hsa
accagccucuaggcuagcggcugcauucguggucugugcaaacacuucgugguucuauauauca

SEQ ID NO: 144159 - RNA, 64 nt, hsa
caaacacuucgugguucuauauaucagcagcaagugugcaaaauaaaggaccuguuaacucaga

SEQ ID NO: 144160 - RNA, 64 nt, hsa
ccuugccuguguaauuuuaaaaaauuaauagagcugugcaaacccuguuauuuuuguaaaaaaa

SEQ ID NO: 144161 - RNA, 64 nt, hsa
aggcaaauuaaaagcagcuuugugaacuuuuaugugugcaaaggaucaaguucacauguuccaa

SEQ ID NO: 144162 - RNA, 64 nt, hsa
gaaacccaauggcuaccuagacuauagggauaguugugcaaagugaacauuguaacuacaccaa

SEQ ID NO: 144163 - RNA, 64 nt, hsa
ccgacucugagcugcuaggaaccucauuuguccaugugcaaacgcuguauuccaaggccuguga

SEQ ID NO: 144164 - RNA, 64 nt, hsa
cuuuuucuaagcuguuucuugaugggagagguucugugcaaaacuaccacauucuguccccaaa

SEQ ID NO: 144165 - RNA, 64 nt, hsa
gucacugggcugauuugaccuccgacucauugguugugcaaaugccaugugcagccuuuccuga

SEQ ID NO: 144166 - RNA, 64 nt, hsa
uccacaccaagaggguguugugaugaggugccggugugcaaagggaacuuuaguuuuuccacug

SEQ ID NO: 144167 - RNA, 64 nt, hsa
uugggcuaacauuuaggagaaguuggucuuacuuugugcaaaagcaggcuugugcuuuauaccc

SEQ ID NO: 144168 - RNA, 64 nt, hsa
gcugggacucauucacauuucaagauccaaaugcugugcaaacaguguaagcuuagauuuucug

SEQ ID NO: 144169 - RNA, 64 nt, hsa
ucuccuucaggugaucacacacaguggacgaguaugugcaaacauggacauaauaguucacuua

SEQ ID NO: 144170 - RNA, 64 nt, hsa
ucaaaguaaaucugcaaauuccuucuaaauuucaugugcaaauaauuauauauaaauauauuua

SEQ ID NO: 144171 - RNA, 64 nt, hsa
uugcuuuagcuauuaauggggcauugugaggaacugugcaaagacauuuuuguuacaaaccugu

SEQ ID NO: 144172 - RNA, 64 nt, hsa
cuugacucaaaguagaucguuauuuugaucaaacugugcaaacaguaguaccacguguagcauu

SEQ ID NO: 144173 - RNA, 64 nt, hsa
ggacaaccagaaguacacauuuacaauagauagaugugcaaaagaccuuuuuguagccaaacaa

SEQ ID NO: 144174 - RNA, 64 nt, hsa
cauauauuuaaacuuacagauggaaauugcccaaugugcaaauuguuaaguaccacacuuuaca

SEQ ID NO: 144175 - RNA, 64 nt, hsa
gucuguacuuugggaagucacagaaauacauuuuugugcaaaauggaaaacagagcgucuuuuu

SEQ ID NO: 144176 - RNA, 64 nt, hsa
guuaggaagugugaaguuuuguguguaugauuucugugcaaaaacaaaagcaacacuccugagu

SEQ ID NO: 144177 - RNA, 64 nt, hsa
acuauagucaaauguacuguaaagugaaaagggaugugcaaaaaaauaaaaaaaaacaacaaaa

SEQ ID NO: 144178 - RNA, 64 nt, hsa
ucaaacaggaugcucauagcuuaauaauaaaagcugugcaaaggccaugaaugaaugaauuuuc

SEQ ID NO: 144179 - RNA, 64 nt, hsa
ggagacugaaacucaaacaacccugggcaaguaaugugcaaaagauggcaggguggggauuuga

SEQ ID NO: 144180 - RNA, 64 nt, hsa
aggacuccucugcagggagcgccaucugugugcgugugcaaauaugacucaauucacguaaaga

SEQ ID NO: 144181 - RNA, 64 nt, hsa
guuuugcauaguugcacuacaagaagaauguaguugugcaaaucuaugcaaaacugaugguggc

SEQ ID NO: 144182 - RNA, 64 nt, hsa
uugcagguuugcauccagcugugugauauucugcugugcaaauccaugcaaaacugacuguggu

SEQ ID NO: 144183 - RNA, 64 nt, hsa
uugcauauagcauaugugucauuacaugugaugcugugcaaaacuuuguauaauucuguguuau

SEQ ID NO: 144184 - RNA, 64 nt, hsa
gugauuuaaaauuuucaaaaugaaauuccauauaugugcaaacagauaugggcaccacgaaaua

SEQ ID NO: 144185 - RNA, 64 nt, hsa
agcuuguuuuuuaaaacaauucuguagaaauguuugugcaaauucaguaauucaacuuaaaaua

SEQ ID NO: 144186 - RNA, 64 nt, hsa
gaggguaauaugccucugcccuuuagucagacucugugcaaauugugaaauauuauuuuauuau

SEQ ID NO: 144187 - RNA, 64 nt, hsa
aaaacuauuuuauaaacaaacuacagagccuaaaugugcaaauuacaggcaagacaacaaagcc

SEQ ID NO: 144188 - RNA, 64 nt, hsa
ggggcagggaugagacaauauugugcccugggucugugcaaacguugggaccagaauccacuau

SEQ ID NO: 144189 - RNA, 64 nt, hsa
aaucuucuccuuauucaccggggaggcugugucuugugcaaacaagucauagaaacuugauggg

SEQ ID NO: 144190 - RNA, 64 nt, hsa
ugggaagcgcacccugucguucagugacgucauucuucuccaggcuggcccgcccccucugacu

SEQ ID NO: 144191 - RNA, 64 nt, hsa
aucugcgcuuuccagauaagcccaaagacagcaacuucuccacucaugacaaaucaacugugac

SEQ ID NO: 144192 - RNA, 64 nt, hsa
cuuuaacccaagacccugccucuuccacuccacccuucuccagggacccuuagaucacaucacu

SEQ ID NO: 144193 - RNA, 64 nt, hsa
gagaggcaugcaggcaggguccuaggagccccugcuucuccaggccucuugccuuugagucuuu

SEQ ID NO: 144194 - RNA, 64 nt, hsa
agacucccuucccuuguuuuuuaaagauaccgugcuucuccacauccucauccuucaaggagca

SEQ ID NO: 144195 - RNA, 64 nt, hsa
cauauuuaugccacuaccuccaccagggagaguccuucuccacaggcuugauaaauucaaucac

SEQ ID NO: 144196 - RNA, 64 nt, hsa
ggucccacguuuguuaucucugccuaaauguuagcuucuccauccucaccacaugaugaccugc

SEQ ID NO: 144197 - RNA, 64 nt, hsa
cuuugacccccagacuuugcuccaucuauuauugcuucuccauccuggauccuugacauuuguc

SEQ ID NO: 144198 - RNA, 64 nt, hsa
ucuguccccaggaccuaugcucccugcucacccccuucuccaaagcccaagcgucccgcugcuc

SEQ ID NO: 144199 - RNA, 64 nt, hsa
aaugggcaaggagucucuagcaugcagcccaggccuucuccauaccccucuccccagcaucaug

SEQ ID NO: 144200 - RNA, 64 nt, hsa
ccacagccaggcccugggcccaagccccuugucccuucuccacugccccucuuuccagacagua

SEQ ID NO: 144201 - RNA, 64 nt, hsa
cuggacaaggcagucaucacauaagaacagcuaccuucuccacuugguggcacaagagguaggg

SEQ ID NO: 144202 - RNA, 64 nt, hsa
auccuugucuuuuuaugacaggauguuugcucagcuucuccaacaauaagaagcacgugguaaa

SEQ ID NO: 144203 - RNA, 64 nt, hsa
cuuuuuguuccccuuugcuucauucaagucagcucuucuccauccuaccacaaugcagugccuu

SEQ ID NO: 144204 - RNA, 64 nt, hsa
guagaaaucuggaaaguucauuuccugggauucacuucuccagggauuuuuuaaaguuaauuug

SEQ ID NO: 144205 - RNA, 64 nt, hsa
ccuucugauucguaaggguuacgaaacucauguucuucuccaguccccugugguuucuguugga

SEQ ID NO: 144206 - RNA, 64 nt, hsa
cauuuucuucucguguguggcccacaucccuccacuucuccaacuucuguuuaaucugaucacg

SEQ ID NO: 144207 - RNA, 64 nt, hsa
ggaaucauuguuuacacauggggaucagagcagacuucuccacuacugugcaauagagauacag

SEQ ID NO: 144208 - RNA, 64 nt, hsa
aguaguagaaaugaaugcauuuauucauuccuuccuucuccaauaguguuuaaguacaaucuuu

SEQ ID NO: 144209 - RNA, 64 nt, hsa
ccauccagggcaaggacagacuaaaagagcauaucuucuccagaaguccuagaaacaucucauc

SEQ ID NO: 144210 - RNA, 64 nt, hsa
ugaugcccgagggcugggcccuugagucucuccucuucuccaucuucacuggcuuccccagcca

SEQ ID NO: 144211 - RNA, 64 nt, hsa
guuaacuguaaacagucacacucccauuaccccccuucuccacuaaaaacaauaaucccaaagu

SEQ ID NO: 144212 - RNA, 64 nt, hsa
auguuagccaggucugcccuccccauucaagccccuucuccacuguagcaaaauaagcaccccc

SEQ ID NO: 144213 - RNA, 64 nt, hsa
uggagagcgccucuucccaccaguccucagccaccuucuccacggcagcgaccuccgucucaag

SEQ ID NO: 144214 - RNA, 64 nt, hsa
cauuuccacagaagcccauccgcugccuccguggcuucuccagccauugaacuggucccacacg

SEQ ID NO: 144215 - RNA, 64 nt, hsa
gucccagcucaggcucucugccuuccagaggccgcuucuccagugacuaaccuccuccucuggc

SEQ ID NO: 144216 - RNA, 64 nt, hsa
auucugcagaguggugaaguucacuuccccaacucuucuccaagucuagcuuuccuuuccuucu

SEQ ID NO: 144217 - RNA, 64 nt, hsa
uuaacucaggaugccaaguggcccucagauuacacuucuccagauagcugaaugagucugcuuu

SEQ ID NO: 144218 - RNA, 64 nt, hsa
ggcacacguggccuccgugguauggaccugguggcuucuccaucccacuguggccucuguggua

SEQ ID NO: 144219 - RNA, 64 nt, hsa
ucccacuguggccucugugguauggaccugguggcuucuccauccuacccaagguaacaguguc

SEQ ID NO: 144220 - RNA, 64 nt, hsa
ggugggaagucuugagcggaggaggggaucugcccuucuccacuccucucuuggauccgccucg

SEQ ID NO: 144221 - RNA, 64 nt, hsa
aucgugcguggucucugaucguccaucaccugaccuucuccaggacugucuucucacccuuccc

SEQ ID NO: 144222 - RNA, 64 nt, hsa
agugucagugacacaguuuccucugaugcagcugcuucuccaauggcuuuggggaagaacuuca

SEQ ID NO: 144223 - RNA, 64 nt, hsa
gauaagaaauccuagguccucugagcaacgccugcuucuccauaucacagacuuuaaucuacac

SEQ ID NO: 144224 - RNA, 64 nt, hsa
cagaaccagaaugacuggacaaucuuuuucauagcuucuccaucacauucaagcugguuuaugu

SEQ ID NO: 144225 - RNA, 64 nt, hsa
gcaauuucaggggagucaaaaaccuugcaacuuccuucuccacuaacccaggacuaaaaaugga

SEQ ID NO: 144226 - RNA, 64 nt, hsa
ccccugcccugaggcugugagcagcuagugguggcuucuccagccuuuuucagggaacugggaa

SEQ ID NO: 144227 - RNA, 64 nt, hsa
gccugcugcucucaggaccagagaagggaaaugacuucuccaggcagaggcagaucugagucua

SEQ ID NO: 144228 - RNA, 64 nt, hsa
caguauuuugcuagugcauuucaaggaauggaaucuucuccaguaugaaauuaccagauauaaa

SEQ ID NO: 144229 - RNA, 64 nt, hsa
caguagcuuuggggaaagggaggaagauauggcacuucuccaaccccggaaaacauugcuuuug

SEQ ID NO: 144230 - RNA, 64 nt, hsa
aaguugaggagaguucuuuuuugcuuaaagcccccuucuccauggaguguuggcuucucaauag

SEQ ID NO: 144231 - RNA, 64 nt, hsa
auguccuuguggucuuugcugcugcucucaggcgcuucuccaaugcucuggagugugcauuuca

SEQ ID NO: 144232 - RNA, 64 nt, hsa
uuucuaaggaacccugagugagggggguauuaagcuucuccaguguuuuuuguugucuccaauc

SEQ ID NO: 144233 - RNA, 64 nt, hsa
uaaaccuccagcagucccuaggaugauguagauucuucuccaucucuccgugugugcaguagug

SEQ ID NO: 144234 - RNA, 64 nt, hsa
cuggaccuugaacuggguacuuguggacacagcucuucuccaggcuguaucccaugagccucag

SEQ ID NO: 144235 - RNA, 64 nt, hsa
gcgugagccacugcaccgggccacagagaaaguacuucuccacccugcucuccgaccagacacc

SEQ ID NO: 144236 - RNA, 64 nt, hsa
augaguuuccagcuaagccugaugauggaagggccuucuccacagggacacagucuggugccca

SEQ ID NO: 144237 - RNA, 64 nt, hsa
augcuguguaacacacucaccgagaggaaaaaggcuucuccacaaccuccuccuccaguucuga

SEQ ID NO: 144238 - RNA, 64 nt, hsa
ugcauaacuggcguguagcacaaagaaaaagccccuucuccaccagauauuugcuuccuaagaa

SEQ ID NO: 144239 - RNA, 64 nt, hsa
agugagucgguggcuucuggacugaagcuauuuucuucuccaaacugcugucucuaauuuggcc

SEQ ID NO: 144240 - RNA, 64 nt, hsa
cagagauaaaugcuguuaauuuaacaaguagauucuucuccaaagaaugaugagugauucuugg

SEQ ID NO: 144241 - RNA, 64 nt, hsa
cauccgguguaaaaaaaagagaucagccaguuaccuucuccauugucuuaguucugucacccau

SEQ ID NO: 144242 - RNA, 64 nt, hsa
caggcugaaggcacacgcucaaugccccacgugccuucuccaggaggaacgaagcaggguuuga

SEQ ID NO: 144243 - RNA, 64 nt, hsa
ccacccccaccccgaguccugagcucacuuucgccuucuccauccccugccgugggggccacag

SEQ ID NO: 144244 - RNA, 64 nt, hsa
cucccucugcugucaccuugcucagccaucccgucuucuccaacaccaccucuccagaggccaa

SEQ ID NO: 144245 - RNA, 64 nt, hsa
agaacaggagcucuuaacuacaguggcugaauagcuucuccaaaggcucccuguguucucaccg

SEQ ID NO: 144246 - RNA, 64 nt, hsa
uugcaagucaacauuauuuucucuucuuccucagcuucuccauguuuaggaacugagaaagaaa

SEQ ID NO: 144247 - RNA, 64 nt, hsa
gugccacccuuuauaauacagcuaugaaaaguuacuucuccauuaauuucuccauucuguuuau

SEQ ID NO: 144248 - RNA, 64 nt, hsa
agccucgguuuuucagcaaaacgcggccaguccccuucuccacugcugccucccagcagagggc

SEQ ID NO: 144249 - RNA, 64 nt, hsa
aucuuaacaauauuuuguaaaaugaugcuucccccuucuccauggucuagucaauuuuguacaa

SEQ ID NO: 144250 - RNA, 64 nt, hsa
ucuccuuauccccccaaauggaaauuguauuugccuucuccacuuugggaggcucccacuucuu

SEQ ID NO: 144251 - RNA, 64 nt, hsa
ugcugaggacacucaguguccaguugcagcuggacuucuccacccggauggcccccacccaguc

SEQ ID NO: 144252 - RNA, 64 nt, hsa
uguuccauugaaucuguauggcuagaauauccuacuucuccagccuagagguacuuuccacuug

SEQ ID NO: 144253 - RNA, 64 nt, hsa
ugcggucuagggaaugagacaggaccuaggauaucuucuccaggaugucaacugaccuaaaauu

SEQ ID NO: 144254 - RNA, 64 nt, hsa
cccuuccccacuuucacuagagcauccugccugccuucuccacugaggagcagguaaaugggag

SEQ ID NO: 144255 - RNA, 64 nt, hsa
ugugucccaccccucaccccuuuacccccauugccuucuccauugucaacucuuggggcacucc

SEQ ID NO: 144256 - RNA, 64 nt, hsa
guagccaaggugggcugagcccuggcaggaugacccugcgaaggggcccugguccuuccaggcc

SEQ ID NO: 144257 - RNA, 53 nt, hsa
ggaagaaaauggaaaugugaguuccugcgaacgcugaaucuaggugggacgcu

SEQ ID NO: 144258 - RNA, 64 nt, hsa
uagucucuaucuucauguuauuaucacuuaaaaaccugcgaaagcugucaacuuuugugguugu

SEQ ID NO: 144259 - RNA, 64 nt, hsa
aucuuugaccuagaagagauucuuuuuggaccaaccugcgaaauugguaguuaggucuauggaa

SEQ ID NO: 144260 - RNA, 64 nt, hsa
cagucguggugaaaccggucagcuguggaccugcccugcgaaucggcagaggccuccgugguga

SEQ ID NO: 144261 - RNA, 64 nt, hsa
uuuauuuuaauguauuuuuuagacccucuauuuaccugcgaacuuguguuuauaauaaaugagg

SEQ ID NO: 144262 - RNA, 64 nt, hsa
aaugaggcuggacagauggcggaagcagagguucccugcgaagacuugagauuuagugucugug

SEQ ID NO: 144263 - RNA, 64 nt, hsa
gcagggucacccacggacagagaccaagagagguccugcgaaggcugggcacugcugugggaca

SEQ ID NO: 144264 - RNA, 64 nt, hsa
gucauugugggagaagggguggggggagggggagccugcgaauuugaacggggugaguuguuuc

SEQ ID NO: 144265 - RNA, 64 nt, hsa
gugcgccagacucuuccgguuuccaaaguucgugccugcgaacccaaaccugugagucucuucu

SEQ ID NO: 144266 - RNA, 64 nt, hsa
aucacacacguauacacaacauuacugaaagaacccugcgaaucaaaacaacccccacacagac

SEQ ID NO: 144267 - RNA, 64 nt, hsa
agagguguucagaauuuaggcaacacucaauuuaccugcgaagcaauacacccagacacaccag

SEQ ID NO: 144268 - RNA, 64 nt, hsa
gagcucgaggcuguaaugugccaugaugauugcaccugcgaauagccacugcacuccagccugg

SEQ ID NO: 144269 - RNA, 64 nt, hsa
gaccccuggguuguugcaggugacuagccgccugccugcgaaacccagcguucuucaggagaug

SEQ ID NO: 144270 - RNA, 64 nt, hsa
acgccaacuggaaagguccccuuccccaggggagccugcgaaggagagguucuguagaauccaa

SEQ ID NO: 144271 - RNA, 64 nt, hsa
gacggacucccuccccuggcggggaaauuaccuuccugcgaagaaaggugacauccccgccaca

SEQ ID NO: 144272 - RNA, 64 nt, hsa
gcucccaggaaggggguggcgugacaggcaggaaccugcgaaguccagaguccaggguggagcg

SEQ ID NO: 144273 - RNA, 64 nt, hsa
ggagagagagggauagaaaacaagcgcaggagagccugcgaacgcaaaagugaaugagggcuuu

SEQ ID NO: 144274 - RNA, 64 nt, hsa
cuccucugucaguuucagcaacuacaagggauacccugcgaaaguaccaugagaaauaucagag

SEQ ID NO: 144275 - RNA, 64 nt, hsa
gauugcuuuccaguuuaaugaaagcuuaaaugucccugcgaacccacaaucucugccagcagaa

SEQ ID NO: 144276 - RNA, 64 nt, hsa
cuugugcccucccuguccuuagccuaggccuaguccugcgaaaacccccaaaccagauacggac

SEQ ID NO: 144277 - RNA, 64 nt, hsa
cgaguuugguuuuagcuggggauugugcuggcauccugcgaagcuccucccagccggucucucu

SEQ ID NO: 144278 - RNA, 64 nt, hsa
ggguugcugagggaacgguuggaguggggaucggccugcgaaaggauacugugaaaucacuaau

SEQ ID NO: 144279 - RNA, 64 nt, hsa
agaucuuccuccagcggcgcccuggacggcugcuccugcgaacagcccauggcaucuucugcuc

SEQ ID NO: 144280 - RNA, 64 nt, hsa
uacugacagcagaggucuuggugggcugcacgugccugcgaagaugugguggacaaggaggcuc

SEQ ID NO: 144281 - RNA, 64 nt, hsa
auuacuacaaagacaaccccaaaccaauuuuuuuccugcgaaguuuaaugauccacaaguguau

SEQ ID NO: 144282 - RNA, 64 nt, hsa
ucccucaugugccaugggccugccuccccagugaccugcgaaaguggagcaucgagguaggagg

SEQ ID NO: 144283 - RNA, 64 nt, hsa
agagggagugaggagaggauugcagggacuuuucccugcgaaacaaaugagacaaugacauaaa

SEQ ID NO: 144284 - RNA, 64 nt, hsa
aggccagagccacagcugggagaccugcacugucccugcgaaauacuaagaacaccuagggugu

SEQ ID NO: 144285 - RNA, 64 nt, hsa
accuuccaguaacauacuucuagucaccccuccuccugcgaagugaucugcaguggcuguuuga

SEQ ID NO: 144286 - RNA, 64 nt, hsa
aaccucauggucauggacagauagacagugcugcccugcgaaguggcucucaggggccagugag

SEQ ID NO: 144287 - RNA, 64 nt, hsa
uugagaugcaacagagaacguaugccacauagccccugcgaagaaaaggcauuauguaucuguc

SEQ ID NO: 144288 - RNA, 64 nt, hsa
cagaggcuauuuggggucggaggagcccucgauaccugcgaauacaucugcuuuccaggcugcu

SEQ ID NO: 144289 - RNA, 64 nt, hsa
aaacaaagaugcucuguagacaaguagaauuaaaccugcgaauccguguaaaaauucagugaag

SEQ ID NO: 144290 - RNA, 64 nt, hsa
gcccgugccgugugacucgaagccuagcgcccucccugcgaagcaucagacgccacccagcccu

SEQ ID NO: 144291 - RNA, 64 nt, hsa
uagggggcucugggcggcccguggacaccccagaccugcgaaggaugaucgcccgauaaagacg

SEQ ID NO: 144292 - RNA, 64 nt, hsa
gcgggccaccaaguucuggaaaccacguggugucccugcgaauggggcgaucaaguccagagcc

SEQ ID NO: 144293 - RNA, 64 nt, hsa
aaauguauucugugaaacuacucauaccucucuuccugcgaauuuucuccuaagaacuagguuu

SEQ ID NO: 144294 - RNA, 64 nt, hsa
cucauucauucauggagccaagggugggguuucaccugcgaacaucagacugacuugcuggcgu

SEQ ID NO: 144295 - RNA, 64 nt, hsa
aagcaaaccaaguugcaccuggcuucugcacacuccugcgaaagucggugaacauucacuccac

SEQ ID NO: 144296 - RNA, 64 nt, hsa
ggacuucagauacguuaagcaagcaacagcagacccugcgaaugcacaucgacauacccagggc

SEQ ID NO: 144297 - RNA, 64 nt, hsa
ugcuuucucaggaaccuuucaagcggccagaaccccugcgaaucacacaugaccuuugcgggaa

SEQ ID NO: 144298 - RNA, 64 nt, hsa
uacuuucucaggaaccuuucaagcggccagaaccccugcgaaucacacaugaccuuugcgggaa

SEQ ID NO: 144299 - RNA, 64 nt, hsa
guguucuuugauauuacaguucuuuguaaaaugaccugcgaauuacccuaauucucaaaagcaa

SEQ ID NO: 144300 - RNA, 64 nt, hsa
gggaccccaauucauucuuaucugccaaagaauuaucuagaagcacaucaaauaccagcacccc

SEQ ID NO: 144301 - RNA, 64 nt, hsa
uuagaaagaaacuaacaaaagagaacccagagcaaucuagaaucuuugagugcuuggcuuucca

SEQ ID NO: 144302 - RNA, 64 nt, hsa
auggaggguaaauauuaaagugcguauuauguacaucuagaauccaugugacuugcagccuacc

SEQ ID NO: 144303 - RNA, 64 nt, hsa
ucaccaaauuguaaccuggauguuauagcccagcaucuagaaauccuaugaaacguauuagcac

SEQ ID NO: 144304 - RNA, 64 nt, hsa
ugacgagugaaacugucuccaaaaaaaaaaaaaaaucuagaauucuuggaaguacauuauauug

SEQ ID NO: 144305 - RNA, 64 nt, hsa
cuguaacaaaaguacuuucucuuuacucuauuaaaucuagaauuagccgggcauggucgcucau

SEQ ID NO: 144306 - RNA, 64 nt, hsa
ugauguguaggcauuguauuagauauuauaagaaaucuagaaaugauuuaaagcauacaggagg

SEQ ID NO: 144307 - RNA, 64 nt, hsa
guaugguuucaacgcaguuauguuuccagagaacaucuagaaguggcuggaaaccagaagcugg

SEQ ID NO: 144308 - RNA, 64 nt, hsa
acucugugguguucuguucauguucuaucaguauaucuagaaagggaauagccauauaaauuau

SEQ ID NO: 144309 - RNA, 64 nt, hsa
cagagaaaaaccuuugauuuugguuaaccuuuauaucuagaaccaaaacagcuaaaucccaaag

SEQ ID NO: 144310 - RNA, 64 nt, hsa
aauauuucaguauugagcuuugcauuuaugauuuaucuagaaauuuaccucaaaagcagaauuu

SEQ ID NO: 144311 - RNA, 64 nt, hsa
agucauaauguuuauucaaaguauuuuaucuuuuaucuagaauccacauauguauguccaauuu

SEQ ID NO: 144312 - RNA, 64 nt, hsa; identical to SEQ ID NO: 144310

SEQ ID NO: 144313 - RNA, 64 nt, hsa; identical to SEQ ID NO: 144311

SEQ ID NO: 144314 - RNA, 64 nt, hsa
aaaaucuggauucacagaaccguggucacauuuccccaucaaaauccccaaggcgggucccaag

SEQ ID NO: 144315 - RNA, 64 nt, hsa
cuuuguagcuuugaaauacgacaguguuccaaaucccaucaacaaaaugcugugaacaacaaca

SEQ ID NO: 144316 - RNA, 64 nt, hsa
aauaauggagaguauacuguagauuacauguuuacccaucaaaucugacuuaaaagguuaaaug

SEQ ID NO: 144317 - RNA, 64 nt, hsa
guuguaaaauguguuaaauccuguucauugaacucccaucaacucuuauaaaauucaugcugau

SEQ ID NO: 144318 - RNA, 64 nt, hsa
uagaauaucuaagaaucuuuguuagauauuaggucccaucaauucuuagaauaucuaaacaucu

SEQ ID NO: 144319 - RNA, 64 nt, hsa
ucuuaaugacauuucacugaugcuucuaucaggucccaucaauucuuagaauaucuaagaaucu

SEQ ID NO: 144320 - RNA, 64 nt, hsa
acugcccaagguaauuuauagauucaaugccauccccaucaagcuaccaaugacuuucuucaca

SEQ ID NO: 144321 - RNA, 64 nt, hsa
aaugaacucaaacaaauuuacaggaacaaacaaccccaucaaaaagucggcaaaggacaugaac

SEQ ID NO: 144322 - RNA, 64 nt, hsa; identical to SEQ ID NO: 44480

SEQ ID NO: 144323 - RNA, 64 nt, hsa; identical to SEQ ID NO: 44481

SEQ ID NO: 144324 - RNA, 64 nt, hsa; identical to SEQ ID NO: 44482

SEQ ID NO: 144325 - RNA, 64 nt, hsa; identical to SEQ ID NO: 44483

SEQ ID NO: 144326 - RNA, 64 nt, hsa; identical to SEQ ID NO: 44484

SEQ ID NO: 144327 - RNA, 64 nt, hsa; identical to SEQ ID NO: 44485

SEQ ID NO: 144328 - RNA, 64 nt, hsa; identical to SEQ ID NO: 44486

SEQ ID NO: 144329 - RNA, 64 nt, hsa; identical to SEQ ID NO: 44487

SEQ ID NO: 144330 - RNA, 64 nt, hsa; identical to SEQ ID NO: 44488

SEQ ID NO: 144331 - RNA, 64 nt, hsa; identical to SEQ ID NO: 44489

SEQ ID NO: 144332 - RNA, 64 nt, hsa; identical to SEQ ID NO: 44490

SEQ ID NO: 144333 - RNA, 64 nt, hsa; identical to SEQ ID NO: 44491

SEQ ID NO: 144334 - RNA, 64 nt, hsa; identical to SEQ ID NO: 44492

SEQ ID NO: 144335 - RNA, 64 nt, hsa; identical to SEQ ID NO: 44493

SEQ ID NO: 144336 - RNA, 64 nt, hsa; identical to SEQ ID NO: 44494

SEQ ID NO: 144337 - RNA, 64 nt, hsa; identical to SEQ ID NO: 44495

SEQ ID NO: 144338 - RNA, 64 nt, hsa; identical to SEQ ID NO: 44496

SEQ ID NO: 144339 - RNA, 64 nt, hsa; identical to SEQ ID NO: 44497

SEQ ID NO: 144340 - RNA, 64 nt, hsa; identical to SEQ ID NO: 44498

SEQ ID NO: 144341 - RNA, 64 nt, hsa; identical to SEQ ID NO: 44499

SEQ ID NO: 144342 - RNA, 64 nt, hsa
gauauguaugaauuuuuacagguucguuuuugaauugugagaggcaguucauuagcaaagaugu

SEQ ID NO: 144343 - RNA, 64 nt, hsa
auguaauuuauauauuccuagaauuuaaguuacuuugugagauuugggccugucccucaaugcc

SEQ ID NO: 144344 - RNA, 64 nt, hsa
gucuuaugagugacaaucguuaguuugaggaauuuugugagacaguugucaaauuguugcuagc

SEQ ID NO: 144345 - RNA, 64 nt, hsa
ucugguuucagaauuaaaagaauucagaguuaccuugugagauaaauguucuuugcuucauauu

SEQ ID NO: 144346 - RNA, 64 nt, hsa
gguccagcuuuauuuacaggcauauaaaaugaaauugugagauguuuugcaagcuucuuuuuac

SEQ ID NO: 144347 - RNA, 64 nt, hsa
cagcuguuugguuuuucguuuuucauuguuauuauugugagaaugcuguuauugggguugugug

SEQ ID NO: 144348 - RNA, 64 nt, hsa
ugugucagauuaugccuugcacuugggaaagcucuugugagacucucccaaggugcuguauuuu

SEQ ID NO: 144349 - RNA, 64 nt, hsa
agaaacuggcugcucauuguuagaaagugaugcuuugugagacuauugucuuggggccaaaaau

SEQ ID NO: 144350 - RNA, 64 nt, hsa
aaaaaaagaagaaagaaaagaaaacuucaagguuuugugagaagcaaugggucugugacucaaa

SEQ ID NO: 144351 - RNA, 64 nt, hsa
agggcaaaguucgaccucuguuaaguggagggauuugugagauaaaaauucaaaauguuggccu

SEQ ID NO: 144352 - RNA, 64 nt, hsa
aagauugccccagcuaaaaguggacaaguccgcuuugugagaugaauacuuccugagaaacuug

SEQ ID NO: 144353 - RNA, 64 nt, hsa
cucaaauauccuugauuuuggauguucaguauguuugugagagagguuucugggaagacucucu

SEQ ID NO: 144354 - RNA, 64 nt, hsa
gccugaggaccaggagccaccacccacugggguguugugagagauacacuuugguaggcugagg

SEQ ID NO: 144355 - RNA, 64 nt, hsa
cccaagaacuuugggagugugugucuguuuugguuugugagaaaguagcugccccucauucugg

SEQ ID NO: 144356 - RNA, 64 nt, hsa
agagucucgcucugucgcccaggcuggaaugcaguugugagaucucggcucacugcaagcuccg

SEQ ID NO: 144357 - RNA, 64 nt, hsa
ucuuuuuaauucuccccacccuugagaauguacuuugugagauccaccccugcccgcaaaacau

SEQ ID NO: 144358 - RNA, 64 nt, hsa
gcucccagaagccaagaguguuuaaaugugacacuugugagaaggcauuugccaaaccaagcca

SEQ ID NO: 144359 - RNA, 64 nt, hsa
ucuguacaggggagcggccguuccauugcacgcuuugugagaaagccuucaaccagaagagugc

SEQ ID NO: 144360 - RNA, 64 nt, hsa
ccuuuuauaucacuaaaauaagaucauguuuuaauugugagaaacagggccgagcacaguggcu

SEQ ID NO: 144361 - RNA, 64 nt, hsa
ugagacuccaucucaaaaaaaaaaaaaaaaaaaauugugagaaacagaaauacuuaaaaugagg

SEQ ID NO: 144362 - RNA, 64 nt, hsa
agacaccuaguuugaaaaauguuauucuguuuuuuugugagaacuuaguaaacaagaaaauacu

SEQ ID NO: 144363 - RNA, 64 nt, hsa
guuucagcuucaguccuccuugggagacggggcauugugagaauguaacuuaaagccuggcuuu

SEQ ID NO: 144364 - RNA, 64 nt, hsa
gcugaggcgggcagaucgcuugaggucaggaguucaagaccagcccgggcaacguggugaaacc

SEQ ID NO: 144365 - RNA, 64 nt, hsa
gccgagucagguggaucaccugaggucaggaguucaagaccagccuggccaacauggcgaaacc

SEQ ID NO: 144366 - RNA, 64 nt, hsa
ggagcugagggagggccacacacuggcaagauuucaagaccacucucugcacugaagagguaaa

SEQ ID NO: 144367 - RNA, 64 nt, hsa
uguuggccuuacugacacaccuuugcuccauguucaagaccagaaguagcugggauuuguuugc

SEQ ID NO: 144368 - RNA, 64 nt, hsa
ggcccaaaguaacuggugguaggaaucuuagaaacaagaccacuuauacugucugucugaggca

SEQ ID NO: 144369 - RNA, 64 nt, hsa
uucuaauguaugaagaaugggaugcauuugaucucaagaccaaagacagaugucagugggcugc

SEQ ID NO: 144370 - RNA, 64 nt, hsa
gaaagauuccaguuguauuugucaccuggggugacaagaccagacaggcuuucccaggccuggg

SEQ ID NO: 144371 - RNA, 64 nt, hsa
augucuauuaaaugucucuccucuuucucugggucaagaccauguaauuuuaugcuucagagau

SEQ ID NO: 144372 - RNA, 64 nt, hsa
gcugagguggguguaucacuugaggucaggaguucaagaccaaucuggccaacauggugaaacc

SEQ ID NO: 144373 - RNA, 64 nt, hsa
gccacuguaggaggaucaauugagccuagaaguucaagaccagccugggcaaaguagggagacc

SEQ ID NO: 144374 - RNA, 64 nt, hsa
gcugaggcagguggaucacuugagcucaggaguucaagaccagcuugggaaacauggcaaaacc

SEQ ID NO: 144375 - RNA, 64 nt, hsa
uucccugcuacuccaugcugguggccucacccaucaagaccacugucuccugguacuggacuau

SEQ ID NO: 144376 - RNA, 64 nt, hsa
aggguggucuaggacugggcuucuacccucagugcaagaccagugccagaugugcccccacuuc

SEQ ID NO: 144377 - RNA, 64 nt, hsa
cugcuguauccuuucggcuucccaguugagcucccaagaccaggacccacuggggcauauaaaa

SEQ ID NO: 144378 - RNA, 64 nt, hsa
cugcuguguccuuucggcuucccaguugagcucccaagaccaggacccacuggggcauauaaaa

SEQ ID NO: 144379 - RNA, 64 nt, hsa
uccuccaccccuuccagaccaagcucaacgccuccaagaccagcaggccaaggccaagcccugc

SEQ ID NO: 144380 - RNA, 64 nt, hsa
ggccugagccucgggacucaguggacaccaaagucaagaccagcacccaccacgggcccugcca

SEQ ID NO: 144381 - RNA, 64 nt, hsa
aggccaaggcaggcagaucaugaggucaagagaucaagaccauccuggccaacauggugaaacc

SEQ ID NO: 144382 - RNA, 64 nt, hsa
gccgaggcagguggaucauuugagcucaggaauucaagaccagccuggguaauauggcaagagc

SEQ ID NO: 144383 - RNA, 64 nt, hsa
gccgucccaaauacaguuuccgucgccuugacgacaagaccaccaacguguccuuguacccugg

SEQ ID NO: 144384 - RNA, 64 nt, hsa
accaaggcgggcggaucacuuaaagucaggaguccaagaccagacucgccaacauggugaaacc

SEQ ID NO: 144385 - RNA, 64 nt, hsa
uccaaggcgggcggaucacuugaggucaggaguucaagaccagcuuggccaaggugauaaaacc

SEQ ID NO: 144386 - RNA, 64 nt, hsa
gcugaggcgggcagaucacuugaggccaggaguucaagaccagcccaaccaacauggugaaacc

SEQ ID NO: 144387 - RNA, 64 nt, hsa
gcuaaggcagcuggaucacuugaggccaggaguucaagaccagccuggcaaacauggugaaacc

SEQ ID NO: 144388 - RNA, 64 nt, hsa
gccaaggugagaggauaacuugaaacuaggaguucaagaccagccaaggcaacauagugaggcc

SEQ ID NO: 144389 - RNA, 64 nt, hsa
aggccgaggugggcggaucacgagguagggagaucaagaccauccuggcuaacacggugaaacc

SEQ ID NO: 144390 - RNA, 64 nt, hsa
cccgaggcggguggaucagcugaggucaggaguucaagaccagccuggccaaccuggugaaaug

SEQ ID NO: 144391 - RNA, 64 nt, hsa
gcacugagaggccgaucacuugaggucaggaguucaagaccagccuggccaacauggugaaacc

SEQ ID NO: 144392 - RNA, 64 nt, hsa
gccaagguggguggaucacuugaggccaggaguucaagaccagccuggccaacaugaugagacc

SEQ ID NO: 144393 - RNA, 64 nt, hsa
gcugaagugggaggaucgcuugagccugggaguucaagaccagccugggcaacauggcaagacc

SEQ ID NO: 144394 - RNA, 64 nt, hsa
cuccaaacugcugucucuaauuuggccucuguggcaagaccacgcccagcaaaaguggucggcu

SEQ ID NO: 144395 - RNA, 64 nt, hsa
gccgaggugggaggaucacuggagcucgggaguucaagaccagccugggcaacauagugaaacc

SEQ ID NO: 144396 - RNA, 64 nt, hsa
ccuagcgacuggacuacugccugacguugucagucaagaccagccuugcagccaggugcagugg

SEQ ID NO: 144397 - RNA, 64 nt, hsa
gccaaggugggaggaucaguugagccccagaguucaagaccagccugggcaauguaguaagacc

SEQ ID NO: 144398 - RNA, 64 nt, hsa
gcugaggcaggcggaucaccugaggucaggaguucaagaccagccuggccaacauggugaaacc

SEQ ID NO: 144399 - RNA, 64 nt, hsa
gccucagugagggaucagggcagcaaacaagggccaagaccaucugagccagccccacaucuag

SEQ ID NO: 144400 - RNA, 64 nt, hsa
gucgaggcaggcggaucacuugaggucaggaguucaagaccagccuggccaauauggugaaacc

SEQ ID NO: 144401 - RNA, 64 nt, hsa
cucucaagagcuccgugccuguccacaaugaccuagagugcauccugcucauugucaguguagc

SEQ ID NO: 144402 - RNA, 64 nt, hsa
aacugccccuccccucauugagggucacugcucaagagugcaggaguggacucuccacugaugg

SEQ ID NO: 144403 - RNA, 64 nt, hsa
uggaggaugucaucuuuucauagaugcuggaacuagagugcacuuguuagaugcuaaagguuug

SEQ ID NO: 144404 - RNA, 64 nt, hsa
ugggacaggguuguaacucagccuuccaaagggaagagugcagggggacggggccaugauaugg

SEQ ID NO: 144405 - RNA, 64 nt, hsa
agaacaguauuuuacaaaagguguagcuuuuauaagagugcagaaaagggaaggauguguuuuu

SEQ ID NO: 144406 - RNA, 64 nt, hsa
uaugugucuccccuccccuccacaaaaaggagaaagagugcauuaaaauguuuaguuggguuuu

SEQ ID NO: 144407 - RNA, 64 nt, hsa
uuugggggaugauggaggugacaucaggcagaggagagugcagccucacagugacuuucucaga

SEQ ID NO: 144408 - RNA, 64 nt, hsa
uccuuccauaccccagcauaccuucuccuugcuuagagugcaggggucugagacagcagccacu

SEQ ID NO: 144409 - RNA, 64 nt, hsa
uuuugagacagauucucacucugucucccaggcuagagugcaguggugcaaucucagcucacug

SEQ ID NO: 144410 - RNA, 64 nt, hsa
aaagaucugugacucugaaauauccuccaaaaggagagugcaucugagacugauauuuaaacua

SEQ ID NO: 144411 - RNA, 64 nt, hsa
guuugagauggagucucacucugucaccuaggcuagagugcaguggugugaucucggcucacug

SEQ ID NO: 144412 - RNA, 64 nt, hsa
cgauggaauaacagauuugccggcaaucacugaaagagugcaaauaucggguccuugugacuuc

SEQ ID NO: 144413 - RNA, 64 nt, hsa
aauuucuguaggaagaaucaaaucaccgauuuaaagagugcaauauauaauaaucauuuuuaaa

SEQ ID NO: 144414 - RNA, 64 nt, hsa
gggcucugggggaaugcugggaaaaugggcaagcagagugcacagcccucguucugccagcugg

SEQ ID NO: 144415 - RNA, 64 nt, hsa
gcccgacuggaggaacagcagcucugggaggcacagagugcaggucucaggggcagaagacaug

SEQ ID NO: 144416 - RNA, 58 nt, hsa
aacacucaacagaauuauagauucuaaucugagugaguuacugagcuuugguccacua

SEQ ID NO: 144417 - RNA, 64 nt, hsa
uguuuguaucccuacccaucuccuggcagcccuacugagugaaauugggauacauuuggcuguc

SEQ ID NO: 144418 - RNA, 64 nt, hsa
acaucaacguuauccuucuuuuucauauuucuaccugagugaaguucauccuuaguauugagua

SEQ ID NO: 144419 - RNA, 64 nt, hsa
ccuggcaacaaaaaguaaugaagaaaauugagaccugagugaagauaagaaaugaucuuuacgu

SEQ ID NO: 144420 - RNA, 64 nt, hsa
cucucuaccuucuggcccccaucccggaacauuccugagugaauucgcaagcgcacuagcaugu

SEQ ID NO: 144421 - RNA, 64 nt, hsa
gaaccuccccacaccucccucaccgcgcaggacccugagugaggaggaggagcuggaaaccugg

SEQ ID NO: 144422 - RNA, 64 nt, hsa
auguaggagcugcaguucuuguggaagacacuugcugagugaaggaaaugaaucuuugacugaa

SEQ ID NO: 144423 - RNA, 64 nt, hsa
uuuacaucuauguguauguugacuuuuuaaaauucugagugauccaggguaugaccuagggaau

SEQ ID NO: 144424 - RNA, 64 nt, hsa
caaguuauuuucuccuucuucuaggaaaucccuucugagugaugucacaucuuggcaggggugg

SEQ ID NO: 144425 - RNA, 64 nt, hsa
ggaagaggaagagugcaaaacauugaagagagagcugagugagcugaagagugaggauaugagu

SEQ ID NO: 144426 - RNA, 64 nt, hsa
uggugcuacacggacuucggagcauagaguggcgcugagugaguggcugagaccgaccacgguu

SEQ ID NO: 144427 - RNA, 64 nt, hsa
ugacguugcgcuguccgaggagcuccaugcggcacugagugaguggcugacagcgauccgggcu

SEQ ID NO: 144428 - RNA, 64 nt, hsa
cugcccuugggagcacagacaggcuccuagggugcugagugaagccugaagaccaagcccccuc

SEQ ID NO: 144429 - RNA, 64 nt, hsa
auguccguguacgucagcguguguguccaccuuccugagugauguguucgcuuguagggugcug

SEQ ID NO: 144430 - RNA, 64 nt, hsa
ugggaguauuuuggugacaaccuacuuugcuuggcugagugaaggaaugauauucauauauuca

SEQ ID NO: 144431 - RNA, 64 nt, hsa
uuuaguuagugcuuuuuauauaccaggcaugaugcugagugacacucuuguguauauuuccaaa

SEQ ID NO: 144432 - RNA, 64 nt, hsa
ugcaaugagccaugauuucccacugcacuccagccugagugacagagcgagacuccaucucuuu

SEQ ID NO: 144433 - RNA, 64 nt, hsa
cacccaguccaugcuccagggucaggcggagcugcugagugacagcuuuccucaaaaagcagaa

SEQ ID NO: 144434 - RNA, 64 nt, hsa
cuuuuuuuuccucugaugugaauccagccucagacugagugaacuguaauaauuaugaauucau

SEQ ID NO: 144435 - RNA, 64 nt, hsa
ugcauaucucauuagauaugcaauauaaauuuaucugagugaacaaagugcuaaauaaauagau

SEQ ID NO: 144436 - RNA, 64 nt, hsa
ccugggggaugcugggagugagugagugagauggcugagugaggguuauggggagccugagguu

SEQ ID NO: 144437 - RNA, 64 nt, hsa
cccagaacgugcaggucugcggaggggaaguguccugagugaaggaggggacccccauccuggg

SEQ ID NO: 144438 - RNA, 64 nt, hsa
caauucaaggauguuuaucggccucucuuagauccugagugagacaaauacagaaaugacccau

SEQ ID NO: 144439 - RNA, 64 nt, hsa
gcagauggccaagcagauagguuaugucuguuuucugagugaugaagucaggaagcccuguggc

SEQ ID NO: 144440 - RNA, 64 nt, hsa
ccaggacagcagaggcugaggggccgggguguggcugagugaccagggugucacccacugcauc

SEQ ID NO: 144441 - RNA, 64 nt, hsa
gaccucgggaaggcgcugggccgagccaguguggcugagugaccggggugugcccggcagacac

SEQ ID NO: 144442 - RNA, 64 nt, hsa
uguuucugcuuucaguuucuuggcuugguagccucugagugaaucugaugcucugcugaauaau

SEQ ID NO: 144443 - RNA, 64 nt, hsa
agcccugcuccuuuaguuuccugacaccuguguccugagugagccgcaggaguucuuagcuccu

SEQ ID NO: 144444 - RNA, 64 nt, hsa
gccuggcacgucaaagaggcuccagaaauguuugcugagugagugaugaaucagcaauuucuga

SEQ ID NO: 144445 - RNA, 64 nt, hsa
agugagccaggaaagcagcaaaggaaagagaaaccugagugacgacgugguggaggaacagggc

SEQ ID NO: 144446 - RNA, 64 nt, hsa
ugcagccucgaacuccugggcucaagcaauccuccugagugaucccauuucuuaaucaguguag

SEQ ID NO: 144447 - RNA, 64 nt, hsa
gaggaggugaacuguuuccacauucaagauuaaacugagugaaucugcauuuucuggguucugg

SEQ ID NO: 144448 - RNA, 64 nt, hsa
gaaugaacuaaaauaaacaagaacaaaagaauaguauaauuauaucaguaacaagaagacucaa

SEQ ID NO: 144449 - RNA, 64 nt, hsa
aucuuccauugacauuaauaaaacuuagaaacaguauaauuaguauaacauuuacucugaauuu

SEQ ID NO: 144450 - RNA, 64 nt, hsa
uauuugauucacuaguggaagauaguguucugcuuauaauuaaacugaauguagaguaucucug

SEQ ID NO: 144451 - RNA, 64 nt, hsa
ucagugggcaucuacuaggugacagccacugugcuauaauuagagacuuuuuacuauaagcauc

SEQ ID NO: 144452 - RNA, 64 nt, hsa
agcagauauagacauuaucaaauuauaaugauaguauaauuaucccuuuuuaauauuggggaaa

SEQ ID NO: 144453 - RNA, 64 nt, hsa
gucuuggacuaagucuuuguacuaaagcauuugcuauaauuauuuuuaaaaaaacaaacagaug

SEQ ID NO: 144454 - RNA, 64 nt, hsa
aaccaggauuuuuuuuaauuauuguuauuauaauuauaauuauuauuauuauugacaugaggaa

SEQ ID NO: 144455 - RNA, 64 nt, hsa
acagagaaccaggauuuuuuuuaauuauuguuauuauaauuauaauuauuauuauuauugacau

SEQ ID NO: 144456 - RNA, 64 nt, hsa
caugaagggaaucauaggaaaaauguacugaucauauaauuaacauuauguacuguauauauca

SEQ ID NO: 144457 - RNA, 64 nt, hsa
uuuaaaauucuguuuauaguuuuugauaugcauauauaauuauguguauaucuaaauacaaaug

SEQ ID NO: 144458 - RNA, 64 nt, hsa
ccuuuauuauuauuguuauaauuauuauaauuauuauaauuauuuuauccccucccccaccgcc

SEQ ID NO: 144459 - RNA, 64 nt, hsa
uauuaaucuccuuuauuauuauuguuauaauuauuauaauuauuauaauuauuuuauccccucc

SEQ ID NO: 144460 - RNA, 64 nt, hsa
ggacauuuuuauuaaucuccuuuauuauuauuguuauaauuauuauaauuauuauaauuauuuu

SEQ ID NO: 144461 - RNA, 64 nt, hsa
uaccaauuucaauuuccugguuuugacauuauaguauaauuauguaagauggaaccauugggga

SEQ ID NO: 144462 - RNA, 64 nt, hsa
cagauuauuaaagagguucauguuaaaaggcauuuauaauuauuuuuaauuaucuaaguuuuaa

SEQ ID NO: 144463 - RNA, 64 nt, hsa
aauuucacaauacaguuccaauuuuuauggcuuuuauaauuacaaugauauuuucuucuauaau

SEQ ID NO: 144464 - RNA, 64 nt, hsa
aaauuuuaugaaauuccaaugcucccuuuaaccauauaauuaaauuacaaagguauacauaauu

SEQ ID NO: 144465 - RNA, 64 nt, hsa
uguaauuauaaacaaaaauacauaaagcuuugaauauaauuauguagcauaaaaguuaagguug

SEQ ID NO: 144466 - RNA, 64 nt, hsa
aauaguguuugucaucagguugguacuaaacauuuauaauuacuguguaauuauaaacaaaaau

SEQ ID NO: 144467 - RNA, 64 nt, hsa
aagaaaaaaaaaaauaaaacugauguaaugaauauauaauuacaacaaaagaggucuaacacua

SEQ ID NO: 144468 - RNA, 64 nt, hsa
agaguauauuuuguugaaugcuauggaauauuaauauaauuaauucuaaaauaucaccuaaaau

SEQ ID NO: 144469 - RNA, 64 nt, hsa
uagaacuguacuauaagaaaacauuuccccuauguauaauuauaugaaugugauguuuauugcu

SEQ ID NO: 144470 - RNA, 64 nt, hsa
uugguuucuguaaauguugcaggguuuuaaacuuuauaauuacuuuaauauuuuugauaacuag

SEQ ID NO: 144471 - RNA, 64 nt, hsa
gcacaagauggaaagagcgauuggagcauccugguauaauuacccccauugugcucuuaaugga

SEQ ID NO: 144472 - RNA, 64 nt, hsa
cucucuuugcauuaaaauuucaaaguuuaauuaauauaauuaaaagcaacagcaagcagcagcc

SEQ ID NO: 144473 - RNA, 64 nt, hsa
uagaauuuacaacuuauaauuacaaugcacaauuuauaauuacaauauguauuuaugucuuuug

SEQ ID NO: 144474 - RNA, 64 nt, hsa
accauagcugaccuuuguaguagaauuuacaacuuauaauuacaaugcacaauuuauaauuaca

SEQ ID NO: 144475 - RNA, 64 nt, hsa
agcaaacaaaugcauaagcaagacugagcagcauuauaauuaauuuucaggguuuugaggcuga

SEQ ID NO: 144476 - RNA, 64 nt, hsa
acuguuuuauuuuuuauauuuuuaaaauuuaaaguauaauuaguuuuuauaauuuucaucagau

SEQ ID NO: 144477 - RNA, 64 nt, hsa
uaggaacgacucuaauuaauaggcuuucuguguauauaauuaaauuuagcugcugcaaccauug

SEQ ID NO: 144478 - RNA, 64 nt, hsa
gcacuuaauggaaagguaaauggucagauaaaaauauaauuaccuguaagguuaucugguuuua

SEQ ID NO: 144479 - RNA, 64 nt, hsa
agaaaacaagaugcugccauauauuaagauagaauauaauuaacuccaugagaaugguuacuca

SEQ ID NO: 144480 - RNA, 64 nt, hsa
aacuacgaauuacaaauaucacuucacuaaccacuauaauuauuuuuggcuuuuucagccacug

SEQ ID NO: 144481 - RNA, 64 nt, hsa
auauuaaguaugugugauacuaagguuugacugcuauaauuauuuguacuguugaucacaugua

SEQ ID NO: 144482 - RNA, 64 nt, hsa
ggaaaaacauuucucuuuaguuucaaaaaccauauauaauuaaauuuguaaggauauacugagu

SEQ ID NO: 144483 - RNA, 64 nt, hsa
gcguucuagaugucauccuaaaaaacacuucauauauaauuaaucacuauuuuguauaauuaca

SEQ ID NO: 144484 - RNA, 64 nt, hsa
aaaaacacuucauauauaauuaaucacuauuuuguauaauuacauauugcugcuuguguguuuu

SEQ ID NO: 144485 - RNA, 64 nt, hsa
aaaguuccuuuugcaugaaacaauuaugcaaacuuauaauuauuagugcugaaaaagaguuuau

SEQ ID NO: 144486 - RNA, 64 nt, hsa
caacugguuuaucuacaaucucaaauccuaaguguauaauuaugugcaauguucaauaccucau

SEQ ID NO: 144487 - RNA, 62 nt, hsa
uuauuguaaaaaguccaagcagaucaauaaacuauauaauuaauggguuuggaaaaucauca

SEQ ID NO: 144488 - RNA, 64 nt, hsa
auuuuaaauguuauuaaaauuauguacuuaaaucuauaauuauuuaauuauuguaaaaagucca

SEQ ID NO: 144489 - RNA, 64 nt, hsa
acgcuuaaaugaucaaauuagaaaaaccaauuccuauaauuaauaugcagaacuuuuauagaau

SEQ ID NO: 144490 - RNA, 64 nt, hsa
acgauggugaugauaauuuuaguauuacugucauuauaauuauuauuauauucauucuacagau

SEQ ID NO: 144491 - RNA, 64 nt, hsa
cuuugauuugcuagauugacaaaacugauacuaauauaauuaaguucaucuuugaaauacaucu

SEQ ID NO: 144492 - RNA, 64 nt, hsa
aaaauuuuuuuugaauguguggaaguaauuuuaguauaauuagauuuuuuccauauuuuugaaa

SEQ ID NO: 144493 - RNA, 64 nt, hsa
ugaauggauuaccuguagugacucauuggaaugauauaauuauacaaguaaugccaaaaaccaa

SEQ ID NO: 144494 - RNA, 64 nt, hsa
cccccuggauaaagaguuaauuuuaauccuucccuauaauuauacuucaaaauauuugacaucu

SEQ ID NO: 144495 - RNA, 64 nt, hsa
cauaaaccuuuucuuccuggauuuggcagauauguauaauuauauuaaaaugguucuagcacaa

SEQ ID NO: 144496 - RNA, 64 nt, hsa
accucugcagggguucuucugugauuaaauagguuauaauuauaagcaaaauucagagcaacug

SEQ ID NO: 144497 - RNA, 64 nt, hsa
uaagaauaaucuaguuauauuuuuugaaaucacauauaauuagacuuuauaauauauauacuuu

SEQ ID NO: 144498 - RNA, 64 nt, hsa
uaauuagacuuuauaauauauauacuuuuucauauauaauuagaucuuucuuuguaauuucaua

SEQ ID NO: 144499 - RNA, 64 nt, hsa
uaauuuaaaguaaaauucagaagguuuuaguuauuauaauuaaaggaagacuguguguagaauc

SEQ ID NO: 144500 - RNA, 64 nt, hsa
uguguguuuugcuuuucuuuaaauaaaacguauguauaauuaagugaagcugcauguuuguauu

SEQ ID NO: 144501 - RNA, 64 nt, hsa
ucagauucuuggugaaacacuauaauuaaguaguuauaauuaaauaacuguucuucauacuuag

SEQ ID NO: 144502 - RNA, 64 nt, hsa
uuaguauuagggcaucagauucuuggugaaacacuauaauuaaguaguuauaauuaaauaacug

SEQ ID NO: 144503 - RNA, 64 nt, hsa
cagauauaccuagaguauaccugugguuugguuuuauaauuaaucagcucguuacuucagccca

SEQ ID NO: 144504 - RNA, 64 nt, hsa
ugaaaagggaugaugugguuuuuugccagguguuuauaauuaauccuuuaauauuaugguuauu

SEQ ID NO: 144505 - RNA, 64 nt, hsa
cgcccaguuugagaauugguguaagacaucacaaucccauuauucagagcgcguauggagugga

SEQ ID NO: 144506 - RNA, 64 nt, hsa; identical to SEQ ID NO: 144505

SEQ ID NO: 144507 - RNA, 64 nt, hsa
ccccuuuuaauuuguuuuuccuuuugacuccugcucccauuaggagcaggaauggcaguaauaa

SEQ ID NO: 144508 - RNA, 64 nt, hsa
ucccauccacucugacaccuaagccccacucuuuucccauuagauauauguaaguaguuguagu

SEQ ID NO: 144509 - RNA, 64 nt, hsa
uuuuaaacaacuguuuccuugggcuucaguuauuuaaaguaaauuuagguguaauauagaaaac

SEQ ID NO: 144510 - RNA, 64 nt, hsa
auuuacaauguaguauguuuucaaugaaaaaccauaaaguaacauccaaguguuucaugguuug

SEQ ID NO: 144511 - RNA, 64 nt, hsa
ccuaauaugagucauguuauuucuagauugaauuuaaaguaaguauggauuauggaagucuagu

SEQ ID NO: 144512 - RNA, 64 nt, hsa
gguguacuuugcaagaaauaagcacucuaauuuuuaaaguaaaucucuuauuuuagcaaauauu

SEQ ID NO: 144513 - RNA, 64 nt, hsa
ccaacccaauuacaggggauaaauguaagcuuguuaaaguaagcaccacaccauguuucugucu

SEQ ID NO: 144514 - RNA, 64 nt, hsa
gauaauauguguacagacugagaaggcaggaauauaaaguaauugaaaucucucauugccggua

SEQ ID NO: 144515 - RNA, 64 nt, hsa
gcgauuguaugaauauuuaaaaugccuggaacacuaaaguaaaguaaugauauuucaaguguuu

SEQ ID NO: 144516 - RNA, 64 nt, hsa
uguaugaauauuuaaaaugccuggaacacuaaaguaaaguaaugauauuucaaguguuuuugug

SEQ ID NO: 144517 - RNA, 64 nt, hsa
cuuucaaaguaaacagugaugacacagcauuugcuaaaguaacaucuguagguuuugguuucca

SEQ ID NO: 144518 - RNA, 64 nt, hsa
aagguggcaggaaauaauauuggaaauaacauuuuaaaguaaaaauuuuaaaguuuaaagaaga

SEQ ID NO: 144519 - RNA, 64 nt, hsa
agauacacuuccgcaagauaucuucauuuuaaaguaaaguaauauacuguauggaaaguuacaa

SEQ ID NO: 144520 - RNA, 64 nt, hsa
acagaagauacacuuccgcaagauaucuucauuuuaaaguaaaguaauauacuguauggaaagu

SEQ ID NO: 144521 - RNA, 64 nt, hsa
aaguaaaaauaaaaauaaaaaaguaaucagaagcuaaaguaaaguuccuuuccuggugcuaacu

SEQ ID NO: 144522 - RNA, 64 nt, hsa
ugagacuccaucucaaaaauaauaauaauaauaauaaaguaaaaauaaaaauaaaaaaguaauc

SEQ ID NO: 144523 - RNA, 64 nt, hsa
aaagagugagaaaacauaaauugagaaagggugauaaaguaauagauaacuuuuaguuuaauaa

SEQ ID NO: 144524 - RNA, 64 nt, hsa
gcaaaugucaaguuaaaauguauuguguuguuuguaaaguaagaaguuacuggccaggagcggc

SEQ ID NO: 144525 - RNA, 64 nt, hsa
acauucuauuucauauuaugaaagaccuuagacauaaaguaaaauaguuuaucauuuacugugu

SEQ ID NO: 144526 - RNA, 64 nt, hsa
aaaugauuauuuagaugaugacugaaaauguguauaaaguaauuaaaaguaauaugguggcuuu

SEQ ID NO: 144527 - RNA, 64 nt, hsa
gguuuauuaaaauaagcagauaauuauccaggcuuaaaguaauagcuuacauguuuugaaaauc

SEQ ID NO: 144528 - RNA, 64 nt, hsa
ucgguuuuaaaaaagaaacauuacuuuugucugcuaaaguaaaccauauauagggaaauuaaca

SEQ ID NO: 144529 - RNA, 64 nt, hsa
uuugggugaguuuuauagauuuauuaaauuuugauaaaguaaauauuuugaccacuauuuucaa

SEQ ID NO: 144530 - RNA, 55 nt, hsa
auuucuuacaguaucgauaaaacaguaaaguaauucuaaauaccuugaaaaucaa

SEQ ID NO: 144531 - RNA, 64 nt, hsa
cuuugaggcuuuuguuauaccaaggaauacuauauaaaguaaugagacugguuuaaaguaacau

SEQ ID NO: 144532 - RNA, 64 nt, hsa
ccaaggaauacuauauaaaguaaugagacugguuuaaaguaacaugccagaacuuacgcaucca

SEQ ID NO: 144533 - RNA, 64 nt, hsa
uagugaugguggccacgugccucguugcuauuuuuaaaguaauauucagaugugguuuuaaauu

SEQ ID NO: 144534 - RNA, 64 nt, hsa
caucuguaaauauuaugugugugauaguauucaauaaaguaaaaucaaauugucuuuggguugu

SEQ ID NO: 144535 - RNA, 64 nt, hsa
uccaguagcagaaucaucuuccacaacaaggaauuaaaguaauuaaagugcaaguucaaugauc

SEQ ID NO: 144536 - RNA, 64 nt, hsa
uaaauaaguauuugugagauuugcuauuuuuuaauaaaguaauuguuuuaaauuaaucucuguu

SEQ ID NO: 144537 - RNA, 64 nt, hsa
uaacauuuuggggagccaccugaagguugauguauaaaguaaggauuagagaaagaggucguug

SEQ ID NO: 144538 - RNA, 64 nt, hsa
cugaaaaagacauuaccauagugcuuuacauuuuuaaaguaauguuacaaggucuggaauccau

SEQ ID NO: 144539 - RNA, 64 nt, hsa
uucauuguacauguuuucuguuuaaaucauuguauaaaguaauugcaggucagaauuauaccac

SEQ ID NO: 144540 - RNA, 64 nt, hsa
ucagugacuuacuugcacuuuuugcacauagauauaaaguaaaauuauguuauuaauuugguuu

SEQ ID NO: 144541 - RNA, 64 nt, hsa
aaaaaacugggaccuaaguauaaauaucucauccuaaaguaaacaauaaguuuauaguuaacga

SEQ ID NO: 144542 - RNA, 64 nt, hsa
uacagauuuaaaugcauguuaccauagaaacuauuaaaguaacuagaacugucaaauaacaaaa

SEQ ID NO: 144543 - RNA, 64 nt, hsa
auuuguuauggauuagucuuuuugaaaguaccauuaaaguaaauuuauuucuuuaaacaugauu

SEQ ID NO: 144544 - RNA, 64 nt, hsa
auguuuacuuuuuaggacagaacaguagcuaaauuaaaguaauauccaguucuuacugauugag

SEQ ID NO: 144545 - RNA, 64 nt, hsa
ugcaaauaaguugaguuuguagaggguaacaaaguaaaguaaaacaaaccuaucuugguuaaca

SEQ ID NO: 144546 - RNA, 64 nt, hsa
uguagccaggguuaaaaacuggacuuuuuagaaguaaaguaaaagcauaucgcuuauaucauuu

SEQ ID NO: 144547 - RNA, 64 nt, hsa
aauuaacuaaugucuuuuauuuauuauauuaugauaaaguaaaaauuucacuugcauuaagucu

SEQ ID NO: 144548 - RNA, 64 nt, hsa
uaaagccaaaccugcuuuucauuuagcagcaaauuaaaguaaccaguccuuauuucugcauuuc

SEQ ID NO: 144549 - RNA, 64 nt, hsa
uuguuuugagggagaaaaucccuuuguuuuaaaguaaaguaaacauuaucgcuaaguguacuug

SEQ ID NO: 144550 - RNA, 64 nt, hsa
aaaacuuguuuugagggagaaaaucccuuuguuuuaaaguaaaguaaacauuaucgcuaagugu

SEQ ID NO: 144551 - RNA, 64 nt, hsa
cuuuuucugcuuucauuuuaauuuugggaaauuuuaaaguaaaaguuucaaaguugaaagauua

SEQ ID NO: 144552 - RNA, 64 nt, hsa
ggagggaaguagauaagaauguauuaguguauuuuaaaguaauaaugauuaaagaauaacuaaa

SEQ ID NO: 144553 - RNA, 64 nt, hsa
aacaauugucucuauugucacacaugguuauauuuaaaguaauuucugaacuguguaauguguc

SEQ ID NO: 144554 - RNA, 64 nt, hsa
gcuuuuuguguggcgcuauaagugacuaugguuguaaaguaauaaaauugauguuaacaugccc

SEQ ID NO: 144555 - RNA, 64 nt, hsa
gaaaaugcagucugguguauucaguaauauauaguaaaguaauaaugauaaaauaucuuuucau

SEQ ID NO: 144556 - RNA, 64 nt, hsa
uaucuuuucauauauuagaauguguacuuuuauauaaaguaauucuggauuugacauucucauu

SEQ ID NO: 144557 - RNA, 64 nt, hsa
caauugugucugguaugcuuguuccugcugcuaauaaaguaaggcccauuacuguaucgggaau

SEQ ID NO: 144558 - RNA, 64 nt, hsa
guuuugcugaaucuccuaguaaaagucauuuuuuuaaaguaauauuguaugcuuacaaaagcug

SEQ ID NO: 144559 - RNA, 64 nt, hsa
auggcacaaauuguaaaccuuuguuuuucuaaaauaaaguaauugaaaaccugcaauuguuucu

SEQ ID NO: 144560 - RNA, 64 nt, hsa
ucuuuccaaagcaaugucuaaaaacucuuuuuuuuaaaguaacaguuugguauguuuauuguag

SEQ ID NO: 144561 - RNA, 64 nt, hsa
aaugcauguaaauugcucagcagcgugccuagcauaaaguaauuacucaaaccauaauguaaag

SEQ ID NO: 144562 - RNA, 64 nt, hsa
ugccuagcauaaaguaauuacucaaaccauaauguaaaguaaaaagauaaccauacuauacaua

SEQ ID NO: 144563 - RNA, 64 nt, hsa
cuaauuucaauuauagugucaugcagaguauuucuaaaguaauugguuaucaugggaaaguauu

SEQ ID NO: 144564 - RNA, 64 nt, hsa
auuuuacagagaaagaaauuauggcccagggggcuaaaguaaacaacucaagggcacauagaaa

SEQ ID NO: 144565 - RNA, 64 nt, hsa
cuguaaccugauucauccugggauguaaaccauucgaagucagcuaauuggacuuuuauggcuc

SEQ ID NO: 144566 - RNA, 64 nt, hsa
accugaaccaaggcgucucuuuaaguggggcgcccgaagucauuuuggacggccaccugauuuu

SEQ ID NO: 144567 - RNA, 64 nt, hsa
uugcauuuacuaccucagagcucagaagaaacuccgaagucagcauuugcuuuacucuuucuuu

SEQ ID NO: 144568 - RNA, 64 nt, hsa
ccuuccccuacucucuucucaucuucguauaugacgaagucagaaaacucaucaucaggcgacg

SEQ ID NO: 144569 - RNA, 64 nt, hsa
acuuauauuucuuuguaaucaagacuugagauaucgaagucaguuauuggucuccagagugcag

SEQ ID NO: 144570 - RNA, 64 nt, hsa
ccguacucagaacguccaggagagacgcauggcccgaagucaaagugcuggaauuuuccaaaac

SEQ ID NO: 144571 - RNA, 64 nt, hsa
cuuugguugccauauggaauggccauggaaugcacgaagucacaaugcaccauccaugagaaga

SEQ ID NO: 144572 - RNA, 64 nt, hsa
agugguccuacaaagguagauggugggcggacaccgaagucaacuugacuguaaaaguacccca

SEQ ID NO: 144573 - RNA, 64 nt, hsa
ccgugaguuaaugaaaacugauucaaccaaauggcgaagucagagacuaucgggggccauggag

SEQ ID NO: 144574 - RNA, 64 nt, hsa
guugagcccugccugggcugaaggacugucuucacgaagucaguccugaggaaaaauauugggg

SEQ ID NO: 144575 - RNA, 64 nt, hsa
ucucacugccaucaaacuguaaaagauuaaacugcgaagucaagcucaacagauuauuuuggaa

SEQ ID NO: 144576 - RNA, 64 nt, hsa
uguuucuaacauuuaaauaagaaaaaaaucaaaucgaagucagccugcuggaaaagugaucaca

SEQ ID NO: 144577 - RNA, 64 nt, hsa
ucguccccuuucuuugcaaauauuaguucuuuuacgaagucauccucaagcuucaauuuauuua

SEQ ID NO: 144578 - RNA, 64 nt, hsa
agcuauugucacugcagugcauuauaccaaagagcgaagucagugccacugaaaauacagaacc

SEQ ID NO: 144579 - RNA, 64 nt, hsa
agaaggcagagccugugucccagggggacccacacgaagucaccagcccauagguccagggagg

SEQ ID NO: 144580 - RNA, 64 nt, hsa
caucccaccaggagcagcgccugugcagaaugaacgaagucacauaggcuccuuaauuuuuuuu

SEQ ID NO: 144581 - RNA, 64 nt, hsa
accccaggagucuaaaauccaggucuuucaucuccgaagucaaugcucuuuccaccaugcugcc

SEQ ID NO: 144582 - RNA, 64 nt, hsa
auccuacauggcuaaaagaagcagaagcaaguuucgaagucacagucaaggaaaucaauaccua

SEQ ID NO: 144583 - RNA, 64 nt, hsa
cacugccagcaggacagacagggauggaguaaaccgaagucaauuucagggcucuuggcguguu

SEQ ID NO: 144584 - RNA, 51 nt, hsa
uggcagggacuugcgguuaaucgaagucacugagaccauuugcaagaggcu

SEQ ID NO: 144585 - RNA, 64 nt, hsa
acuaaccucuccccuccuggcucaagaauuacuccgaagucagucugcagaaaauaaauauuua

SEQ ID NO: 144586 - RNA, 64 nt, hsa
acagucacuguuuguuuaccuugagcaguaaacccgaagucagccugcucuacuacuaacaaac

SEQ ID NO: 144587 - RNA, 64 nt, hsa
aaaccaaaugaccgcacugugaugugaauggcaccgaagucagaugaguaucccuguaggucac

SEQ ID NO: 144588 - RNA, 64 nt, hsa
gggugcuagugaguacugacagcaugccagcuaccgaagucacccagccauucccaugagcagc

SEQ ID NO: 144589 - RNA, 64 nt, hsa
agugcagcuguggguggaggcuggggugucugcacgaagucaggccagcguccuccuccacagc

SEQ ID NO: 144590 - RNA, 64 nt, hsa
cuucuuuuccuuauagaauggacauggugguggucgaagucagcagacacuagacaguaaguau

SEQ ID NO: 144591 - RNA, 64 nt, hsa
aaaaugacaagcauugcaucccagucuuguguuccgaagucagucggaguacuugaagaaggcc

SEQ ID NO: 144592 - RNA, 64 nt, hsa
ggcugggaggaccgggaugcuggauucuguuuuccgaagucacugcagcggaugauggaacuga

SEQ ID NO: 144593 - RNA, 64 nt, hsa
ccaguacuuuauagauucaacucuaaguugcaagcgaagucaaaacugaugaaaauuuauuuag

SEQ ID NO: 144594 - RNA, 64 nt, hsa
aggugacauuucucuggucauuuauuugagaguucgaagucaaagucgaggggcaccggcuuug

SEQ ID NO: 144595 - RNA, 64 nt, hsa
gggguaaaaguguauuuugaauauucccaauuuucgaagucaguaaaaaaacacaaaaacugua

SEQ ID NO: 144596 - RNA, 64 nt, hsa
cccagcccuuugggaggccgaggugggcagaucacgaagucaguaguuugagaccagccuggcc

SEQ ID NO: 144597 - RNA, 64 nt, hsa
uuaguggccgaagguuaguguuauuccacauccacgaagucaaguauucuuggcucuucuuucu

SEQ ID NO: 144598 - RNA, 64 nt, hsa
cccagcacuuugggaggcugaggcgggcagaucacgaagucaggagaucgagaccauccuggcu

SEQ ID NO: 144599 - RNA, 64 nt, hsa
caucucuuggggcuccccugacagagaagacagccgaagucaaagccacauccucuugcugaug

SEQ ID NO: 144600 - RNA, 64 nt, hsa
ccuuggggccuugcaugggacacauucaagaccucgaagucauucuuggccaagcagaugacaa

SEQ ID NO: 144601 - RNA, 64 nt, hsa
ccuagcacuuugggaggccgaggugggcagaucacgaagucaggagaucaagaccaucuggcua

SEQ ID NO: 144602 - RNA, 64 nt, hsa
cugcaugaacagcuucaccugggggggcccagcacgaagucacaucccagccccagagucacug

SEQ ID NO: 144603 - RNA, 64 nt, hsa
cacauuacacauaaauauauguuuuguaauuaaucgaagucacauuuccugaccuaagaauuua

SEQ ID NO: 144604 - RNA, 64 nt, hsa
cuauucacuguauuucauuuucuuuauauuggaccgaagucauuaaaacaaaaugaaacauuug

SEQ ID NO: 144605 - RNA, 61 nt, hsa
uuuuacagugguggaaaugagcacaaagacacgaagucaugggccuggggcccagggccag

SEQ ID NO: 144606 - RNA, 64 nt, hsa
ccuagugcuccauaguuuggcauuugcacgguuucgaagucauuaaacugguuagacgugucuc

SEQ ID NO: 144607 - RNA, 64 nt, hsa
cugcagaugccucuaaggaguccgaaaccaaguccgaagucaacaacaagcaaugauggcgaug

SEQ ID NO: 144608 - RNA, 64 nt, hsa
uggaagugugugugacgcccauugagcuguuacccgaagucagauuaaaaaucagggaguguuu

SEQ ID NO: 144609 - RNA, 64 nt, hsa
ucaaggacccggaugugaauggcaugcugaaacucgaagucauggccaccuccagggacaaaga

SEQ ID NO: 144610 - RNA, 64 nt, hsa
cugcacagucucugauaaugaagggcugccuucccgaagucagccgcugcccaucggccugagg

SEQ ID NO: 144611 - RNA, 64 nt, hsa
cauuuggaccucaguaugagguaguguuaaaaggcgaagucauuucuucaggaaguaaaccucu

SEQ ID NO: 144612 - RNA, 64 nt, hsa
gggucccugacaaagaagagcuacgcucugugcacgaagucaagaaccaaacagcucagggacc

SEQ ID NO: 144613 - RNA, 64 nt, hsa
ccgacgaaggcggccacggacggacgccagcacacgaagucacgugcaagugccuuugauucgu

SEQ ID NO: 144614 - RNA, 64 nt, hsa
cuagagaacaccucuauuuuuaaaaggacuuuaacgaagucaaacaacuuauaagacuagugau

SEQ ID NO: 144615 - RNA, 64 nt, hsa
gcugucgcacagccucuggggugcuuggucucugcgaagucaaaggccugacagcucuguggcc

SEQ ID NO: 144616 - RNA, 64 nt, hsa
gcugagacaggcagaucacuugaggucaggaguucgaagucagccuggccaacguggugaaacc

SEQ ID NO: 144617 - RNA, 64 nt, hsa
accaaggaggggggcuugggggggcccuccugcccgaagucauacucuugcucccaccccaccc

SEQ ID NO: 144618 - RNA, 64 nt, hsa
ucagcacaugcgcacacgcacacucggacucacacgaagucacacgcacacaugcacgcacaca

SEQ ID NO: 144619 - RNA, 64 nt, hsa
ugaaaaauuaggguacacagcuggccaccaaaugcgaagucaaucugcuacuuaacccugaaaa

SEQ ID NO: 144620 - RNA, 64 nt, hsa
gauucggcugcagcuggccgcccaguuugagaauugguguaagacaucacaaucccauuauuca

SEQ ID NO: 144621 - RNA, 54 nt, hsa
cagcuggccgcccaguuugagaauugguguaagacaucacaaucccauuauuca

SEQ ID NO: 144622 - RNA, 64 nt, hsa
uuaaauaguugaugcaauuuuuaacguuaauugauauaaaaaaaaaaacaacaaaauuaggcuu

SEQ ID NO: 144623 - RNA, 64 nt, hsa
caaguuagucaaguaugucucaacacuagcaugauauaaaaagggacacugcagcugaaugaaa

SEQ ID NO: 144624 - RNA, 64 nt, hsa
ucaaggaaggguuauauugcauucucacgugaaauauaaaaagcaagucuugcccaauaaaaac

SEQ ID NO: 144625 - RNA, 64 nt, hsa
aaccaguguuuuuaccuuucacuugaaaaagaaguauaaaaacaacuguauugaguugaggcug

SEQ ID NO: 144626 - RNA, 64 nt, hsa
auaaagaauauugacaugaguauaccaguuuauauauaaaaauguuuuuaaacuugacaaucau

SEQ ID NO: 144627 - RNA, 64 nt, hsa
uucaaaacuaguguauucacuuacccuaguucauuauaaaaaauaucuaggcauuguggauaua

SEQ ID NO: 144628 - RNA, 64 nt, hsa
agcuaaaacauaaucacaaagcuuuaucguguuguauaaaaaaauuaacaauauaauggcaaua

SEQ ID NO: 144629 - RNA, 64 nt, hsa
gaucuuaaaccuaugauucaguaacuucuuaccauauaaaaacgauaauugcuuuauuuggaaa

SEQ ID NO: 144630 - RNA, 64 nt, hsa
aaccagagagugauuucauuuacacucauaguaguauaaaaagagauacauuucccucuuaggc

SEQ ID NO: 144631 - RNA, 64 nt, hsa
uucuacaucacuggcugcucuucaucaaaccuacuauaaaaaacauucaaguucaacuguuucu

SEQ ID NO: 144632 - RNA, 64 nt, hsa
auaaagcacauuuuaaggaacaagaauugcuaaauauaaaaacauaaauaauaccauaauacau

SEQ ID NO: 144633 - RNA, 64 nt, hsa
aaaccaaaucaguucucaaaaaaugaccggugcuuauaaaaaguuauaaauaucgaguagcucu

SEQ ID NO: 144634 - RNA, 64 nt, hsa
uuuccuagcucauugcuagucaggaaaugauauuuauaaaaaauaugagagacuggcagcuauu

SEQ ID NO: 144635 - RNA, 64 nt, hsa
uuugaauacugagauugauuauuguguuuauauguauaaaaauaggagcaaaagaaaauacucu

SEQ ID NO: 144636 - RNA, 64 nt, hsa
cuuacauauaagcuaauguagaaaaguuuagacuuauaaaaaggcagauaguauauauauauuu

SEQ ID NO: 144637 - RNA, 64 nt, hsa
aauccagauagccuggauuuaacaaaaccaauaguauaaaaauguguguguguguucugugugu

SEQ ID NO: 144638 - RNA, 64 nt, hsa
auaguagcugcccuauaguuacaaaaauaaaaacuauaaaaacccauccccuaucuacuuaauc

SEQ ID NO: 144639 - RNA, 64 nt, hsa
uagccauccacacccaggcauagccuggauacaguauaaaaauagauaauuaaaaagaugguug

SEQ ID NO: 144640 - RNA, 64 nt, hsa
ccagccugggcaacaaagugagacuccaucucuauauaaaaacaaaaaccacgaaagcacacac

SEQ ID NO: 144641 - RNA, 64 nt, hsa
aucgaguagaauuuggccucaggucaauaaaugauauaaaaacauguguucuauuuauguauau

SEQ ID NO: 144642 - RNA, 64 nt, hsa
ugccugaacauugggcgguuuucuuaauuugaaguauaaaaauuauaaagaguaauuccaaagg

SEQ ID NO: 144643 - RNA, 64 nt, hsa
uaauggaauaauuauuaaugaaagauuuuugaaauauaaaaaauaaauuaggcccaauccaaga

SEQ ID NO: 144644 - RNA, 64 nt, hsa
caagagaaaacuaugucaguaacauguugcuuuguauaaaaaucuuauuuauaaaugugaagcu

SEQ ID NO: 144645 - RNA, 64 nt, hsa
auuaaguuggacuaacauucacguaucaaacuaauauaaaaagaaauaaaaccaagaggugauu

SEQ ID NO: 144646 - RNA, 64 nt, hsa
gauaaaucugaaaaauccauaaugaaauaggaguuauaaaaaauuuauagugauauuaaucuuu

SEQ ID NO: 144647 - RNA, 64 nt, hsa
ugccuauguuucuacaaugaaguguuaaauacuuuauaaaaaauuguugacugacuuauuuaaa

SEQ ID NO: 144648 - RNA, 64 nt, hsa
ugaguugaaacgagugcgauuuauuuaaguuguauauaaaaauaaaaggauagcauuuuuauac

SEQ ID NO: 144649 - RNA, 64 nt, hsa
acauuuuauguuauguguauuuuaccacaauuuuuauaaaaagaggauuaaaucuaaaggaaag

SEQ ID NO: 144650 - RNA, 64 nt, hsa
caggguugcagauguuuaguuuuaaaaauucaauuauaaaaauaauaaaugcucaugauagaaa

SEQ ID NO: 144651 - RNA, 64 nt, hsa
uauagaguuggcuugcauuuuaggggccauuuuguauaaaaagugcauaugauuaaaauuagac

SEQ ID NO: 144652 - RNA, 64 nt, hsa
ugaauaagggaaagauuaauuuuggcuggaccaauauaaaaaauuguauuugaagaauugauac

SEQ ID NO: 144653 - RNA, 64 nt, hsa
cuuauuuuugcuccuuacagcaagauuaguagguuauaaaaauuuaaauuuaaacaaaauuauu

SEQ ID NO: 144654 - RNA, 64 nt, hsa
uuuuuguuugccuuucaggcaucauauuagcuuuuauaaaaaauggucuugcugcugaaauugu

SEQ ID NO: 144655 - RNA, 64 nt, hsa
ugacucucucaucugucuaaagaguacuggacgauauaaaaauauauauuuuuuaaacaaugug

SEQ ID NO: 144656 - RNA, 64 nt, hsa
auuuauaauuggaugugcuccugaaucuacuuuuuauaaaaaaaaaaaaaucugcugugcacaa

SEQ ID NO: 144657 - RNA, 64 nt, hsa
aaaauucauuuucuaacaccauguguuagaaaauuauaaaaaauaaaauaauuuuagaaaguuu

SEQ ID NO: 144658 - RNA, 64 nt, hsa
cugagugucuauguuaacuucccucuaucccgcuuauaaaaaaauucuccaacaaaaauacuug

SEQ ID NO: 144659 - RNA, 64 nt, hsa
acuucacuuugggccaaacauuugaaaaacuuuuuauaaaaaauuguuugauauuucuuaaugu

SEQ ID NO: 144660 - RNA, 64 nt, hsa
uuuuuuucuaacacaauaaccaaaagcuuuuauuuauaaaaaggcuugaaaaauauagacaauc

SEQ ID NO: 144661 - RNA, 64 nt, hsa
auuuaaaugccuggaacugacuucuugauaaaaauauaaaaaauaauuuccauguaaguuacca

SEQ ID NO: 144662 - RNA, 64 nt, hsa
cacguugugcacauguacccuagaacuuaaaguauauaaaaaaaagaaaccuugcacugauuuu

SEQ ID NO: 144663 - RNA, 64 nt, hsa
uuuaaaucuuucagugauguuuuagaauuuuuuuuauaaaaaccuucacuauaagaacagaaaa

SEQ ID NO: 144664 - RNA, 64 nt, hsa
uauguacuuuuaccugaaaauuaaaaccaauauuuauaaaaaguguauaugcaguaugauacca

SEQ ID NO: 144665 - RNA, 64 nt, hsa
aauaaauuuuaaugagcacuacaaauuuagaauauauaaaaauaucaguaaccuaugaauucau

SEQ ID NO: 144666 - RNA, 64 nt, hsa
uuucucauaggggcaugccagugagcaauuacuuuauaaaaauauuuuccuugguguuaaguau

SEQ ID NO: 144667 - RNA, 64 nt, hsa
cugcuccuuauugccauacccacgaacuguuaaauauaaaaaaauucaaaguauuugacaucuu

SEQ ID NO: 144668 - RNA, 64 nt, hsa
ugccaaacauguuggcaucaauuuuauacagggauauaaaaaaguauauguggauaaauuuuuu

SEQ ID NO: 144669 - RNA, 64 nt, hsa
uauauguggauaaauuuuuuguaaucuuuagggauauaaaaaaguguauguggauaaauuuuuu

SEQ ID NO: 144670 - RNA, 64 nt, hsa
acagagcaagaccaccaucuccaaaaauuauauauauaaaaauaauuaauauuauagaagagaa

SEQ ID NO: 144671 - RNA, 64 nt, hsa
gagaauauacacaacucagagaugcaauggauaauauaaaaagaguaccugagauguauuuuuu

SEQ ID NO: 144672 - RNA, 64 nt, hsa
cuauaaauuaauguaauacugugugaauucagacuauaaaaaacaucauucagaaaacuuuaua

SEQ ID NO: 144673 - RNA, 64 nt, hsa
aauuuauuuuuacagaaaaauauuuuguuguuuuuauaaaaaguuaugcaaaugacuuuauuuu

SEQ ID NO: 144674 - RNA, 64 nt, hsa
auuuucuaaacacuuuacuagaagaacauuucaguauaaaaaaccuaauuuauuuuuacagaaa

SEQ ID NO: 144675 - RNA, 64 nt, hsa
uguaacaaaacuauacuuguacuccuuaaauuuauauaaaaauaccuuaaaucuauguucauuu

SEQ ID NO: 144676 - RNA, 64 nt, hsa
uuuucuggcacugguuguaaguaauaucuauuauuauaaaaauaauauaugcucaaccagaaaa

SEQ ID NO: 144677 - RNA, 64 nt, hsa
ucauauuccggggaucaucacaucaguccaaggauauaaaaaaauggaagauuaaaaacucaaa

SEQ ID NO: 144678 - RNA, 64 nt, hsa
aaauuucuauuucuuuugcuuaaggaauaguucauauaaaaauaugcuaaagauaggauaaaag

SEQ ID NO: 144679 - RNA, 64 nt, hsa
agucuugcuuauuuuguugcgaaggccaguggaauauaaaaaucaauggcauuaaugaggagca

SEQ ID NO: 144680 - RNA, 64 nt, hsa
gauugaaaagacuaaugagaagauaacaugacaauauaaaaagacagaaacucaaaaaguauau

SEQ ID NO: 144681 - RNA, 64 nt, hsa
caguaacaccagugaaaccccacacugucgggcuuauaaaaaucugugccaucauggugauuuu

SEQ ID NO: 144682 - RNA, 64 nt, hsa
caaaaagaaaucuuuacuuuccuuguuuuaucauuauaaaaauaaaguauuuugcuaguaugga

SEQ ID NO: 144683 - RNA, 64 nt, hsa
ucucagauguuaaaauaaaugguuuggugcuuuuuauaaaaagauaaucucagugcuuuccucc

SEQ ID NO: 144684 - RNA, 64 nt, hsa
aguaaaaugucuuuccaaauuauuucuuaauuauuauaaaaauauuaagacaauagcacuuaaa

SEQ ID NO: 144685 - RNA, 64 nt, hsa
uuauuucuuuuacuuuuuuuaguaaguuaauguauauaaaaauggcuucggacaaaauaucucu

SEQ ID NO: 144686 - RNA, 64 nt, hsa
aagguacuuuuuaaagcuuguacaugaaccuuuguauaaaaaacaccagugcucuuucguugua

SEQ ID NO: 144687 - RNA, 64 nt, hsa
ccugucagcagcaguucugugaaugcaucuuagguauaaaaaugcaauacagauuuuuauauuu

SEQ ID NO: 144688 - RNA, 64 nt, hsa
agacaaaugaaauaauaaagagauuuucaugguuuauaaaaaucuuuuuugauaugauaauaau

SEQ ID NO: 144689 - RNA, 64 nt, hsa
auuuuuaaagacaaagcauucuaaaugaacucaauauaaaaacauucauuuggaauguacauac

SEQ ID NO: 144690 - RNA, 64 nt, hsa
aauaauuuagucaucaugaaauauuuaguugucauauaaaaacccacuguuugagaaugaugcu

SEQ ID NO: 144691 - RNA, 64 nt, hsa
uugucgacguaaacauuuaaaguguuauauuuuuuauaaaaauguuuauuuuuaaugauaugag

SEQ ID NO: 144692 - RNA, 64 nt, hsa
accagccugggcaaaacccugucucuacuaaaaauauaaaaauuagccaggcaugauggcacau

SEQ ID NO: 144693 - RNA, 64 nt, hsa
ggccaacauggcaaaaccccgucucuaugaaaaauauaaaaauuagcugggcaugguggcaggc

SEQ ID NO: 144694 - RNA, 64 nt, hsa
uuaaaauuauuuagccuccauuauuacaaaaaauuauaaaaauaaguuuucagucagucaggau

SEQ ID NO: 144695 - RNA, 64 nt, hsa
cuaauaauuaucaggacuuuuuucaggaguggguuauaaaaacauucaaguuggucugacagua

SEQ ID NO: 144696 - RNA, 64 nt, hsa
cucauuaaaaaauuuagcaauagaauguaaauuguauaaaaaguuugugaauaacucaaggguu

SEQ ID NO: 144697 - RNA, 64 nt, hsa
gaccauuuuuauuuuagugccuacuuuaaaacaguauaaaaauuucugcuuuuguauaauacaa

SEQ ID NO: 144698 - RNA, 64 nt, hsa
gaaauucuguucuaacuuuccacauuauuugccuuauaaaaaucuaaugaauucaucagcuaga

SEQ ID NO: 144699 - RNA, 64 nt, hsa
ugauuuggaaauaugaaaaucaguccauccuuguuauaaaaaauuuuuuuacaauuguaauuau

SEQ ID NO: 144700 - RNA, 64 nt, hsa
cauucagaucuuaagagaugaaaucacuuuuaccuauaaaaaccacuuuuauugcgguuugacu

SEQ ID NO: 144701 - RNA, 52 nt, hsa
agaauuuugguuuuguguagaguauaaaaaguguguauugcuguguaauauu

SEQ ID NO: 144702 - RNA, 57 nt, hsa
agaugaaugccagacugugaaggaaaauauaaaaaaaaagucgacugcuaugcucaa

SEQ ID NO: 144703 - RNA, 64 nt, hsa
aaagaaaaucuuauauaguacauuuuacaaaaauuauaaaaaaugaauuaguacuggcgaggac

SEQ ID NO: 144704 - RNA, 64 nt, hsa
caacaauauggagaauaaccccccccaacacaccuauaaaaacccaaauuuuuggaacaaagau

SEQ ID NO: 144705 - RNA, 64 nt, hsa
aguucccaaaagauugcugaaaaaguagauugaguauaaaaacuugaaaauauaugauggcucg

SEQ ID NO: 144706 - RNA, 64 nt, hsa
aauacuugcaguauaaaugaagauuugguuuuuguauaaaaaaauaaugcuguuaaacaggagu

SEQ ID NO: 144707 - RNA, 64 nt, hsa
auuacaguggacgugaucuuuuagcaugugcuuuuauaaaaagugguagcuacagaugauauag

SEQ ID NO: 144708 - RNA, 64 nt, hsa
cuguauuuuaaaauguaauauacuuuguaccauuuauaaaaauugugugaugaaugaaucacau

SEQ ID NO: 144709 - RNA, 64 nt, hsa
ucuagguaauugauuuaaguauaaaauccaaucauauaaaaacuuuaaugaauuaggauaacaa

SEQ ID NO: 144710 - RNA, 64 nt, hsa
caaaaagccguugacaaggcucugcuauacagucuauaaaaauuguuauuaugggauuggaaga

SEQ ID NO: 144711 - RNA, 64 nt, hsa
ugcaaaagaaaaaacauuuuagaaacggacagcuuauaaaaauaaagggaagaaaggaggcagc

SEQ ID NO: 144712 - RNA, 64 nt, hsa
auaaagauggcacuuucccguuuuauuccaguuuuauaaaaaguggagacagacugauguguau

SEQ ID NO: 144713 - RNA, 64 nt, hsa
uucugcaacaucuuaagauccacaaaugaagggauauaaaaauaaugucauagguaagaaacac

SEQ ID NO: 144714 - RNA, 64 nt, hsa
uggaggcuaucaacaaagaaugggcuugaaacauuauaaaaauugacaaugauuuauuaaauau

SEQ ID NO: 144715 - RNA, 64 nt, hsa
uuguuguuaugugcaauacuguuuguacuguuuguauaaaaaauagaaaaaaaaaagaaaagaa

SEQ ID NO: 144716 - RNA, 64 nt, hsa
ucccacaaugcacaaauuaagaaucuauauaagcuauaaaaauacucauuuuuuaaaaaaaguu

SEQ ID NO: 144717 - RNA, 64 nt, hsa
uauauguucaaagauguuuuauuuuuagaauaguuauaaaaaguauuagucuuaacauaaugug

SEQ ID NO: 144718 - RNA, 64 nt, hsa
auucauaagaaguguugaacauuacaagggcuuuuauaaaaaacccuuuguucauauuucuucc

SEQ ID NO: 144719 - RNA, 64 nt, hsa
agagcuuuauauauuaaagagagguauuggugcauauaaaaacaguaauauuauuguuaugcuu

SEQ ID NO: 144720 - RNA, 64 nt, hsa
ugaaaaauauaaguaauuuggcauauugacccuauauaaaaaagugggcauuuuguaacauucc

SEQ ID NO: 144721 - RNA, 64 nt, hsa
cuguuacuuuugugcuuuuauucuuuuuagacuuuauaaaaaaaaaaaaaagcuccuguaauuu

SEQ ID NO: 144722 - RNA, 64 nt, hsa
ggugucugcgcacauuuuaaguuaauucacauaauauaaaaauuacucaaugugacuguugauu

SEQ ID NO: 144723 - RNA, 64 nt, hsa
cauauguauguauuuauaaaugcauagauauauguauaaaaauuuguaagcguuagcggcauua

SEQ ID NO: 144724 - RNA, 64 nt, hsa
uccugcugggccuuuuuucaucaagucagggugauauaaaaacauuggaagucuuuucaccaaa

SEQ ID NO: 144725 - RNA, 64 nt, hsa
aaauuuuuauaauaauugaaaagauuuuaacaaguauaaaaaauucucauaggaauuaaaugua

SEQ ID NO: 144726 - RNA, 64 nt, hsa
cauggucacucuccccaaaauauuauauuuuuucuauaaaaagaaaaaaauggaaaaaaauuac

SEQ ID NO: 144727 - RNA, 64 nt, hsa
uuuagacuccaguguguucagugaauaaguagaauauaaaaaaauauaaccaguauuuuacuuc

SEQ ID NO: 144728 - RNA, 64 nt, hsa
ugcagguaaauauauauacuuacguguauaucaguauaaaaacacuggugugcaauuaauugga

SEQ ID NO: 144729 - RNA, 64 nt, hsa
ucaaucuggauuugucuuucauuuuaacuuuuaauauaaaaagggguuucaauguaucuacagg

SEQ ID NO: 144730 - RNA, 64 nt, hsa
caccagaaacaucuuuucaggggagcggggggucuauaaaaacagcaauagaaauuaagcauaa

SEQ ID NO: 144731 - RNA, 64 nt, hsa
gagagaugugacugucuacaguucuauuuguauauauaaaaagaagacugaaagucuuuugaca

SEQ ID NO: 144732 - RNA, 64 nt, hsa
aauauauaguaauguaacauauucaguauuaauguauaaaaagcacucuaauuauauaauucag

SEQ ID NO: 144733 - RNA, 64 nt, hsa
uuuuuuuuacaagacuaguucuaaauuaacagcuuauaaaaaauuugucuaaauuuaauaauua

SEQ ID NO: 144734 - RNA, 64 nt, hsa
ugucagcaaaaaaaaacuuaauuucuaguaaaucuauaaaaauggguaagucccuaaauuacaa

SEQ ID NO: 144735 - RNA, 64 nt, hsa
ggccgacauggugaaacgcugucucuacuaaaaauauaaaaaauuagccgggugcaguggcgug

SEQ ID NO: 144736 - RNA, 64 nt, hsa
gcuaacaugccaacaaaaagccauguaaguauuguauaaaaagauucacauuguuaauuuagcc

SEQ ID NO: 144737 - RNA, 64 nt, hsa
gucuuuuaucauugcaggauuguacauacuacuuuauaaaaauucucaccuuugauuuuaaauc

SEQ ID NO: 144738 - RNA, 64 nt, hsa
gaaugauuggggggaaaaacuggugaaaaagaaauauaaaaaggacccuaaaaagaauucugca

SEQ ID NO: 144739 - RNA, 64 nt, hsa
auucaagugaauuuauuuguguguucuuuacuuauauaaaaaaagauaacuuuaaggaugugca

SEQ ID NO: 144740 - RNA, 64 nt, hsa
ccuagaucugauaaaaaaauuuucuugucuuaguuauaaaaauucaaagaaauguguuacaaag

SEQ ID NO: 144741 - RNA, 64 nt, hsa
cauggcaacaucagcuuucuaauguucuaaauucuauaaaaaccacccacaaagaaacaaagca

SEQ ID NO: 144742 - RNA, 64 nt, hsa
ggagcucaacuaaaaguggcauagagaauacacauauaaaaacaauauauuugucauaugcucc

SEQ ID NO: 144743 - RNA, 64 nt, hsa
auauuugggauccucuuuucuauguauguauauauauaaaaaacuaugaaucacucacacucac

SEQ ID NO: 144744 - RNA, 64 nt, hsa
gaccagccugggcaacauggcgaaacuccauuucuauaaaaaauacaaaaaaaaaaaaaucuag

SEQ ID NO: 144745 - RNA, 64 nt, hsa
uuuuaauaguuugaaaugaugauaauccuaauuauauaaaaauauauauauaaacacacauaua

SEQ ID NO: 144746 - RNA, 64 nt, hsa
ucugcagagaggaagauauguuuuugcugcuuuauauaaaaaugguuuuuuuaaguuauuuuaa

SEQ ID NO: 144747 - RNA, 64 nt, hsa
auuugcagaaggaaaccauuucugguuauuuggcuauaaaaagucagcauaaaauaugauccaa

SEQ ID NO: 144748 - RNA, 64 nt, hsa
uaauguucugaugggaacguaacacuuauuuuuauauaaaaagagacugaguaaacaaacauua

SEQ ID NO: 144749 - RNA, 64 nt, hsa
gggaaguaauuuuauaaaguuacacaaagguaguuauaaaaaaagcccaguuugucuuucagaa

SEQ ID NO: 144750 - RNA, 64 nt, hsa
caauaugguuuacauuuugcucacuuuugacuuauauaaaaauagaauaauacuauaugucgug

SEQ ID NO: 144751 - RNA, 57 nt, hsa
ccuuauuaaaaguuuauuaaacaauaauauaaaaauuuuaaaccuacuugauauucc

SEQ ID NO: 144752 - RNA, 64 nt, hsa
ggagaaauaaucauauucguaauuucaaaaguuguauaaaaauauuuucuauuguaguucaaau

SEQ ID NO: 144753 - RNA, 64 nt, hsa
uguacauuuauaaaaacagaucauauacuguauauauaaaaaucuugagaugguagaaacaugu

SEQ ID NO: 144754 - RNA, 64 nt, hsa
acuacaagaaggaucuuuuuucaagcuguacauuuauaaaaacagaucauauacuguauauaua

SEQ ID NO: 144755 - RNA, 64 nt, hsa
ccaugagaauuauuacuuuaaaaacaaaacaaaauauaaaaaacuguguuugaguaaacugaua

SEQ ID NO: 144756 - RNA, 64 nt, hsa
ugguugaaauuucagacaaagcaaacccagcagguauaaaaaguaguauaaauacaaaucugua

SEQ ID NO: 144757 - RNA, 64 nt, hsa
uacaaguuucugaauauuuuaaaucuuaacaucauauaaaaagcagcagaggugagaacucaga

SEQ ID NO: 144758 - RNA, 64 nt, hsa
uccccgaauucuauuuuuguccuugcagacagaauauaaaaacuccugggcuuaaggccuaagg

SEQ ID NO: 144759 - RNA, 64 nt, hsa
aaugcaaaccaaagcaacuuaguaaaauaauagguauaaaaaguuauucuguaagucuguuggu

SEQ ID NO: 144760 - RNA, 64 nt, hsa
gaguagauauuugauauaccacucugauaacucauauaaaaauaucaucauaaaaagcuuaauu

SEQ ID NO: 144761 - RNA, 64 nt, hsa
ggaauaccucuuuauacgucuacauauuuuaguauauaaaaauagauaaugcucuuggacacau

SEQ ID NO: 144762 - RNA, 64 nt, hsa
uaaauaaaaucuauucuguguuuauguagggugguauaaaaaagaggucuucauuuagacaugu

SEQ ID NO: 144763 - RNA, 64 nt, hsa
uuuucauugcugguacaaugacucaguauuucuuuauaaaaaucuguuguucugaaaaucaaca

SEQ ID NO: 144764 - RNA, 64 nt, hsa
guguaacacuauggcauugcuucuauagccaaaguauaaaaauuucuggaauacugacauguaa

SEQ ID NO: 144765 - RNA, 64 nt, hsa
auauacaaaaauaaaauccaacuaaagaccagaauauaaaaagcaaaauuuuaaaacuaugaug

SEQ ID NO: 144766 - RNA, 64 nt, hsa
uauuaaguaaggaaaacaaguaucaacgaagaacuauaaaaauaacuuuuauacaagaaauaau

SEQ ID NO: 144767 - RNA, 64 nt, hsa
auuugaagcuccauuauuuuuuaaaaagaaauuauauaaaaauacuuuauugcuaaaaauacua

SEQ ID NO: 144768 - RNA, 64 nt, hsa
gccuggacaacauauagcaagacucugccucuauuauaaaaaaacaaaauaaaugaaaaggacu

SEQ ID NO: 144769 - RNA, 64 nt, hsa
auguauuugcccuaaauccuuaaaauacaaaugcuauaaaaauuccuguaucuugaaagccuua

SEQ ID NO: 144770 - RNA, 64 nt, hsa
aacuaaugguugaaaauacauauauucauuucuuuauaaaaaacaaaaaccuuaccgguaguaa

SEQ ID NO: 144771 - RNA, 64 nt, hsa
uucagauuucucuuuuuaaccacauuucugaauguauaaaaauaccaauuauuuuccuacagcc

SEQ ID NO: 144772 - RNA, 64 nt, hsa
auucaguggcggggggguuuugccuaaauuaguauauaaaaacaaaaaugcuaaauuauaucug

SEQ ID NO: 144773 - RNA, 64 nt, hsa
uuuguugugaaacacugcaaagccaauuuuucuuuauaaaaauucauaguaauccugccaaaug

SEQ ID NO: 144774 - RNA, 64 nt, hsa
ccccugguucuauuaaaauauccauauauauuucuauaaaaaaaguguuugaccaaaguagguc

SEQ ID NO: 144775 - RNA, 64 nt, hsa
uuauaggauuuuuuucuuuuuuaguaaaaaccuguauaaaaaccaaaauuauaggauuuuuuuu

SEQ ID NO: 144776 - RNA, 64 nt, hsa
uuauaggauuuuuuucuuuuuuaguaaaaaccuauauaaaaaccaaaauuauaggauuuuuucu

SEQ ID NO: 144777 - RNA, 64 nt, hsa
ggggguaauagagccacuggugaguaaaaaccuauauaaaaaccaaaauuauaggauuuuuucu

SEQ ID NO: 144778 - RNA, 64 nt, hsa
gugugauuuuuuucacauuuaagcaggaaugcaauauaaaaaugugaaucucuuaauucucagc

SEQ ID NO: 144779 - RNA, 64 nt, hsa
uguuuucuauaugaacuuagucauuaauguucuuuauaaaaagugaaauaagauggaaaaauaa

SEQ ID NO: 144780 - RNA, 64 nt, hsa
uguucucucaagauccuuaaaaccucuuggaaauuauaaaaauauuggcaagaaaagaagaaua

SEQ ID NO: 144781 - RNA, 64 nt, hsa
uuggagacuuaacagcauuugucuguguuugaacuauaaaaagcaccggaucuuuuccaucuaa

SEQ ID NO: 144782 - RNA, 64 nt, hsa
auuuuaagaaaagauaaacaccauuuuauuuauuuauaaaaacaaaauuaguuucaaauauuuu

SEQ ID NO: 144783 - RNA, 64 nt, hsa
cuuuuuuauucaugauaaaaccuuauaggaauaguauaaaaaaucccuguggaaagcuacuagu

SEQ ID NO: 144784 - RNA, 64 nt, hsa
gaaggaaaagcuuuuaagucucauguuugcugacuauaaaaauaaaucauaguaauaauauuga

SEQ ID NO: 144785 - RNA, 64 nt, hsa
ccgaccugggcagcauagcgagaccccaucucuauauaaaaaaaaagauguuaaaacagugaaa

SEQ ID NO: 144786 - RNA, 64 nt, hsa
uaaacuaaagugugcuuuauaaaaaaaaguuguuuauaaaaaccccuaaaaacaaaacaaacac

SEQ ID NO: 144787 - RNA, 64 nt, hsa
guuauaaagaaagauuguaaacuaaagugugcuuuauaaaaaaaaguuguuuauaaaaaccccu

SEQ ID NO: 144788 - RNA, 64 nt, hsa
ggccaacauggugaaaccccgucucuacuaaaaauauaaaaauuagcugggugugguggcagga

SEQ ID NO: 144789 - RNA, 64 nt, hsa
uauggaacauuuaauuuaguacaauuaaguauauuauaaaaauuguaaaacuacuacuuuguuu

SEQ ID NO: 144790 - RNA, 64 nt, hsa
auuagggaaagguaauauaaaaacagguaaaauguauaaaaauagaccugaucaacaucauagg

SEQ ID NO: 144791 - RNA, 64 nt, hsa
aguuuuaguguuuuucaguauuagggaaagguaauauaaaaacagguaaaauguauaaaaauag

SEQ ID NO: 144792 - RNA, 64 nt, hsa
agugaaacccugucuguauggaauuuacacaaauuauaaaaauuagucgggugucauugugcau

SEQ ID NO: 144793 - RNA, 64 nt, hsa
cuggccugggcagcauagcgagaccccaucucuauauaaaaaaaaagauguuaaaacagugaaa

SEQ ID NO: 144794 - RNA, 64 nt, hsa
agaaggaaaagcaugaagucucauguuugcugacuauaaaaauaaaucauaguaauaauauuau

SEQ ID NO: 144795 - RNA, 64 nt, hsa
caacuuuaacaggagucaucaauucauccauaaauauaaaaagggaaaaaaacuuaaggcagua

SEQ ID NO: 144796 - RNA, 64 nt, hsa
ugggggagauuuaaucaguuuuuuuaaugccugcuauaaaaauuugaaauauuagaauggccga

SEQ ID NO: 144797 - RNA, 64 nt, hsa
uauauaaccuucucaaugaguuaccauucuuuuuuauaaaaaaaauuguuccuugaaaugcuaa

SEQ ID NO: 144798 - RNA, 64 nt, hsa
aagguuaaucggaguaucugaaaggaauuguuuuuauaaaaacauugaaguauuaguuacuugc

SEQ ID NO: 144799 - RNA, 64 nt, hsa; identical to SEQ ID NO: 144797

SEQ ID NO: 144800 - RNA, 64 nt, hsa; identical to SEQ ID NO: 144798

SEQ ID NO: 144801 - RNA, 64 nt, hsa
gucuccagggagagaggguggucgucugugcauuccagguuacugcacuugucugaugugacgu

SEQ ID NO: 144802 - RNA, 64 nt, hsa
cccaggucuucuuaaaacaaagucaucagcuuugccagguuacauacuuuauuuaaaaguauag

SEQ ID NO: 144803 - RNA, 64 nt, hsa; identical to SEQ ID NO: 114759

SEQ ID NO: 144804 - RNA, 64 nt, hsa; identical to SEQ ID NO: 114760

SEQ ID NO: 144805 - RNA, 64 nt, hsa; identical to SEQ ID NO: 114761

SEQ ID NO: 144806 - RNA, 64 nt, hsa; identical to SEQ ID NO: 114762

SEQ ID NO: 144807 - RNA, 64 nt, hsa; identical to SEQ ID NO: 114763

SEQ ID NO: 144808 - RNA, 64 nt, hsa; identical to SEQ ID NO: 114764

SEQ ID NO: 144809 - RNA, 64 nt, hsa; identical to SEQ ID NO: 114765

SEQ ID NO: 144810 - RNA, 64 nt, hsa; identical to SEQ ID NO: 114766

SEQ ID NO: 144811 - RNA, 64 nt, hsa; identical to SEQ ID NO: 114767

SEQ ID NO: 144812 - RNA, 64 nt, hsa; identical to SEQ ID NO: 114768

SEQ ID NO: 144813 - RNA, 64 nt, hsa; identical to SEQ ID NO: 114769

SEQ ID NO: 144814 - RNA, 64 nt, hsa; identical to SEQ ID NO: 114770

SEQ ID NO: 144815 - RNA, 64 nt, hsa; identical to SEQ ID NO: 114771

SEQ ID NO: 144816 - RNA, 64 nt, hsa; identical to SEQ ID NO: 114772

SEQ ID NO: 144817 - RNA, 64 nt, hsa; identical to SEQ ID NO: 114773

SEQ ID NO: 144818 - RNA, 64 nt, hsa; identical to SEQ ID NO: 114774

SEQ ID NO: 144819 - RNA, 64 nt, hsa; identical to SEQ ID NO: 114775

SEQ ID NO: 144820 - RNA, 64 nt, hsa; identical to SEQ ID NO: 114776

SEQ ID NO: 144821 - RNA, 64 nt, hsa; identical to SEQ ID NO: 114777

SEQ ID NO: 144822 - RNA, 64 nt, hsa; identical to SEQ ID NO: 114778

SEQ ID NO: 144823 - RNA, 64 nt, hsa; identical to SEQ ID NO: 114779

SEQ ID NO: 144824 - RNA, 64 nt, hsa; identical to SEQ ID NO: 114780

SEQ ID NO: 144825 - RNA, 64 nt, hsa; identical to SEQ ID NO: 114781

SEQ ID NO: 144826 - RNA, 64 nt, hsa; identical to SEQ ID NO: 114782

SEQ ID NO: 144827 - RNA, 64 nt, hsa; identical to SEQ ID NO: 114783

SEQ ID NO: 144828 - RNA, 64 nt, hsa; identical to SEQ ID NO: 114784

SEQ ID NO: 144829 - RNA, 64 nt, hsa; identical to SEQ ID NO: 114785

SEQ ID NO: 144830 - RNA, 64 nt, hsa; identical to SEQ ID NO: 114786

SEQ ID NO: 144831 - RNA, 64 nt, hsa; identical to SEQ ID NO: 114787

SEQ ID NO: 144832 - RNA, 64 nt, hsa; identical to SEQ ID NO: 114788

SEQ ID NO: 144833 - RNA, 64 nt, hsa; identical to SEQ ID NO: 114789

SEQ ID NO: 144834 - RNA, 64 nt, hsa; identical to SEQ ID NO: 114790

SEQ ID NO: 144835 - RNA, 64 nt, hsa; identical to SEQ ID NO: 114791

SEQ ID NO: 144836 - RNA, 64 nt, hsa; identical to SEQ ID NO: 114792

SEQ ID NO: 144837 - RNA, 64 nt, hsa; identical to SEQ ID NO: 114793

SEQ ID NO: 144838 - RNA, 64 nt, hsa; identical to SEQ ID NO: 114794

SEQ ID NO: 144839 - RNA, 64 nt, hsa; identical to SEQ ID NO: 114795

SEQ ID NO: 144840 - RNA, 64 nt, hsa; identical to SEQ ID NO: 114796

SEQ ID NO: 144841 - RNA, 64 nt, hsa; identical to SEQ ID NO: 114797

SEQ ID NO: 144842 - RNA, 64 nt, hsa; identical to SEQ ID NO: 114798

SEQ ID NO: 144843 - RNA, 64 nt, hsa; identical to SEQ ID NO: 114799

SEQ ID NO: 144844 - RNA, 64 nt, hsa; identical to SEQ ID NO: 114800

SEQ ID NO: 144845 - RNA, 64 nt, hsa; identical to SEQ ID NO: 114801

SEQ ID NO: 144846 - RNA, 64 nt, hsa; identical to SEQ ID NO: 114802

SEQ ID NO: 144847 - RNA, 64 nt, hsa; identical to SEQ ID NO: 114803

SEQ ID NO: 144848 - RNA, 64 nt, hsa; identical to SEQ ID NO: 114804

SEQ ID NO: 144849 - RNA, 64 nt, hsa; identical to SEQ ID NO: 114805

SEQ ID NO: 144850 - RNA, 64 nt, hsa; identical to SEQ ID NO: 114806

SEQ ID NO: 144851 - RNA, 64 nt, hsa; identical to SEQ ID NO: 114807

SEQ ID NO: 144852 - RNA, 64 nt, hsa
uucccauuauuuagagcacaguuuuuuaaagcaacuguacaauuucucagccuuaugagcuugc

SEQ ID NO: 144853 - RNA, 64 nt, hsa
uuccuacuuuaaagugugaaauguuucaccucagcuguacaaacuccagcauugagaauuugcc

SEQ ID NO: 144854 - RNA, 64 nt, hsa
cugggacuauuccaguagagugaaauauuugucccuguacaaaguggccugaaugacuguugga

SEQ ID NO: 144855 - RNA, 64 nt, hsa
guuaaauuguagcauugccagguagugaggcucacuguacaauuuuccagguaaaugaaauuuc

SEQ ID NO: 144856 - RNA, 64 nt, hsa
aaaguuuucuauguaaaaaauucuguacaacuuucuguacaauauugauucccaucuggcauau

SEQ ID NO: 144857 - RNA, 64 nt, hsa
ugguacagauguaaaguuuucuauguaaaaaauucuguacaacuuucuguacaauauugauucc

SEQ ID NO: 144858 - RNA, 64 nt, hsa
uuguuuuuuucuauguuuguggguuuuuuuucaucuguacaagaaauuuuguuaugcacuacua

SEQ ID NO: 144859 - RNA, 64 nt, hsa
agaaaguuguguaauggugaugcuaaagaaaugucuguacaaaauaagauggccugggcagagu

SEQ ID NO: 144860 - RNA, 64 nt, hsa
ugucccauacuucccagcucucuaaaguguuaugcuguacaauuaaaauaccccugacccauca

SEQ ID NO: 144861 - RNA, 64 nt, hsa
cagcaggaaaauaauacaaaacuuaaguuugggucuguacaaaggaaugaaguucugaaaaugg

SEQ ID NO: 144862 - RNA, 64 nt, hsa; identical to SEQ ID NO: 97809

SEQ ID NO: 144863 - RNA, 64 nt, hsa; identical to SEQ ID NO: 97810

SEQ ID NO: 144864 - RNA, 64 nt, hsa; identical to SEQ ID NO: 97811

SEQ ID NO: 144865 - RNA, 64 nt, hsa; identical to SEQ ID NO: 97812

SEQ ID NO: 144866 - RNA, 64 nt, hsa; identical to SEQ ID NO: 97813

SEQ ID NO: 144867 - RNA, 64 nt, hsa; identical to SEQ ID NO: 97814

SEQ ID NO: 144868 - RNA, 64 nt, hsa
ugcaaaaugaccuggugacauggcaagucaguggggacaggaaggaccacucccuaaguaaucc

SEQ ID NO: 144869 - RNA, 64 nt, hsa
cauaguaauuacccacagaaggaggaaguggaagggacaggagcacauagguagaugccaaguu

SEQ ID NO: 144870 - RNA, 64 nt, hsa
aguccugcuguccacacccacaagcuaccuggagggacaggacccaccuccauccuucggaagg

SEQ ID NO: 144871 - RNA, 64 nt, hsa
ccugugcccacagcuuccgcccacagaccuccagggacaggagcaaauugcaccacagcucccc

SEQ ID NO: 144872 - RNA, 64 nt, hsa
aucuccuaugccccuggacaggacaguuggcuggggacaggagaagugcucaaucuucaugaga

SEQ ID NO: 144873 - RNA, 64 nt, hsa
gcuauagaacuugggggcuaucuccuaugccccuggacaggacaguuggcuggggacaggagaa

SEQ ID NO: 144874 - RNA, 64 nt, hsa
uguauguauguuuuguuguuuuguuuuggaaacuggacaggagucaaaacagggauguuuguuu

SEQ ID NO: 144875 - RNA, 64 nt, hsa
gucuccaacgaacagaaaacuauaaacuuacuggggacaggaugugugcuaaagggcacagcaa

SEQ ID NO: 144876 - RNA, 64 nt, hsa
cauaaaaucaaggagacugcugaaaaucucuaagggacaggauuuuccagauccuaauuggaaa

SEQ ID NO: 144877 - RNA, 64 nt, hsa
cugucuccgcggaagucagggcggcuggauuccaggacaggagugaauguaaaaauaaauaucg

SEQ ID NO: 144878 - RNA, 64 nt, hsa
auuccuguaaucccagcacuuugggaggccaaggggacaggacugcuugaggccaagaggugga

SEQ ID NO: 144879 - RNA, 64 nt, hsa
cccccucagcuaacaacaguucugaagggugcugggacaggacaggcucauggggacuccacuc

SEQ ID NO: 144880 - RNA, 64 nt, hsa
agacaggcuaagcguuucuuaucugaaaugcuugggacaggaguguuacagauuuuggauuuuu

SEQ ID NO: 144881 - RNA, 64 nt, hsa
agcaguauuaucugcgguggggggaggagauauaggacaggaaaaccacgugcuccacuccagc

SEQ ID NO: 144882 - RNA, 64 nt, hsa
uucacaccagacagccccucaugucuccaggacaggacaggacuacagacaacucuuucuuuaa

SEQ ID NO: 144883 - RNA, 64 nt, hsa
uuuccuucacaccagacagccccucaugucuccaggacaggacaggacuacagacaacucuuuc

SEQ ID NO: 144884 - RNA, 64 nt, hsa
acagaucgaccaagcugccguucccuauucugcaggacaggacuauucuagcauaccugcuucg

SEQ ID NO: 144885 - RNA, 64 nt, hsa
cccuucccaagacuagcugcucaggguggugcagggacaggaccagacccugcgccuauuuccu

SEQ ID NO: 144886 - RNA, 64 nt, hsa
cccccuccccugagaagcccgccuucucccucguggacaggagucagccaguugguugcugugg

SEQ ID NO: 144887 - RNA, 64 nt, hsa
cagcagggagcacuuggcuccuggcagagggagaggacaggaggaggagccuuccccaggagga

SEQ ID NO: 144888 - RNA, 64 nt, hsa
ugcgcccucagaacgugugggaaggagggggcguggacaggacacgggaccuugccaggccugg

SEQ ID NO: 144889 - RNA, 64 nt, hsa
caggacacgggaccuugccaggccuggugucugaggacaggagccugggagaggcggguggagc

SEQ ID NO: 144890 - RNA, 64 nt, hsa
cccuugagucuggggcacccuucagcugcccuggggacaggaaggacaggagcuaagcaggguc

SEQ ID NO: 144891 - RNA, 64 nt, hsa
cuggggcacccuucagcugcccuggggacaggaaggacaggagcuaagcaggguccaagccugg

SEQ ID NO: 144892 - RNA, 64 nt, hsa
cagacucccagugguacuacuaugcuuagguguuggacaggauagggguaggaggagaggaggc

SEQ ID NO: 144893 - RNA, 64 nt, hsa
agagaagagagaaccugaagaucugaggcaagcuggacaggagagguggauauuuguugaugga

SEQ ID NO: 144894 - RNA, 64 nt, hsa
guucugggcuggggccaccuuugugcagcuucgaggacaggaaaggccccaaucuugcccacug

SEQ ID NO: 144895 - RNA, 64 nt, hsa
ggcccuacuuccaggauggaugcaucacacucaaggacaggagccugguccuucccugauggcc

SEQ ID NO: 144896 - RNA, 64 nt, hsa
gacaggaacugcauaaagguucuugaauucugcaggacaggaaauaacuguauuaccugcuuug

SEQ ID NO: 144897 - RNA, 64 nt, hsa
agaguagcggagucacugaccucuuuaaaucauaggacaggaacugcauaaagguucuugaauu

SEQ ID NO: 144898 - RNA, 64 nt, hsa
caaugcccucguaucaauaagaccgggguaagggggacaggauacuugucacauauuugaagaa

SEQ ID NO: 144899 - RNA, 64 nt, hsa
acccugaagccccuccuccuucccccacagauggggacaggaggugauggggugcucagaaccc

SEQ ID NO: 144900 - RNA, 64 nt, hsa
ggagucaccgucuacugccagccgggagcugggcggacaggaccgucccucgcagggucccagg

SEQ ID NO: 144901 - RNA, 64 nt, hsa
acggagaggagggcucccagggggacaugcggugggacaggagcguggcggcugcugacugugg

SEQ ID NO: 144902 - RNA, 64 nt, hsa
ggagccauggcucagaggugauucgggcagccagggacaggagccacccuccccaggcccaacu

SEQ ID NO: 144903 - RNA, 64 nt, hsa
gagagagugggaggcagagugugauggggaggagggacaggaagacccuuuuaaugaugagggu

SEQ ID NO: 144904 - RNA, 64 nt, hsa
gccaccacuuugcaucaccugggaccacagauuuggacaggaagggcucugagaagaggccaaa

SEQ ID NO: 144905 - RNA, 64 nt, hsa
cacugguauagucaucgcucucccuccaugccaaggacaggacuuggaccgcuucagccugggc

SEQ ID NO: 144906 - RNA, 64 nt, hsa
uccccgccgccucacugcagccagcguggcccuaggacaggaggagcuucgggcccagcuucac

SEQ ID NO: 144907 - RNA, 64 nt, hsa
auaucgacauacauauauauuuuugggggggggcggacaggagaugggugcaacucccucccau

SEQ ID NO: 144908 - RNA, 64 nt, hsa
auucaauccuacuuuucgaacaccaaaaaugaugcgcaucaauguauuuuaucuuauuuucuca

SEQ ID NO: 144909 - RNA, 64 nt, hsa
aauagaaugaaacugugugaaggauaagauuguucgcaucaagauccaaaucuugauuucauau

SEQ ID NO: 144910 - RNA, 64 nt, hsa
cugaguuuuuugggaauaucuucguggagaauuacgcaucaaauuugauucucagagcaauaaa

SEQ ID NO: 144911 - RNA, 64 nt, hsa
ugaguuaagugaccuaauuccccugggagacauacgcaucaacuguggagguccgaggggauga

SEQ ID NO: 144912 - RNA, 64 nt, hsa
aucaugccuuccaaauuguggguggcucugugggcgcaucaauaaaagccguccuugauuuuau

SEQ ID NO: 144913 - RNA, 64 nt, hsa
aaagaacugucucuaccagggucaagagcaugaacgcaucaauagaaagaacucggggaaacau

SEQ ID NO: 144914 - RNA, 64 nt, hsa
gaagucccacguguccggugugcuugggcggcaucgcaucaacgcgcagaccuaaacugauccu

SEQ ID NO: 144915 - RNA, 64 nt, hsa
cagauaauucacacaagagguacaccuuaugaaucgcaucaauagagggaaauuuucagcuaca

SEQ ID NO: 144916 - RNA, 64 nt, hsa
uaacuuuuaugagaaaaaaaugguaauuauuucacgcaucaaccuuuggcacuuacaaaguuuu

SEQ ID NO: 144917 - RNA, 64 nt, hsa
ccaccguggaggcagggggcaagaaacucaagaacgcaucaagagcaccagcccugggccaggg

SEQ ID NO: 144918 - RNA, 64 nt, hsa
uugggaugaagaggguagagugggcugcuggugucgcaucaagauuuggcaggaucggcuuccu

SEQ ID NO: 144919 - RNA, 64 nt, hsa
cugggccuggauugcagacagugccgcugcugaucgcaucaaaaacaaagucaaaggccaucuc

SEQ ID NO: 144920 - RNA, 64 nt, hsa
guguggucccaacaggaggacaauucaugaacuucgcaucaaaagacaauucuuuauacaacag

SEQ ID NO: 144921 - RNA, 64 nt, hsa
gcugagcgccuccuaguugccaggcacuggagggcgcaucaaagaagaguccuacccaggaggg

SEQ ID NO: 144922 - RNA, 64 nt, hsa
ggaaacuaagacaccugaacccuccagggccucccgcaucaaggucagcaugaggacagaccac

SEQ ID NO: 144923 - RNA, 64 nt, hsa
acccauguguccaauagcaaguuaaggaaccuagcgcaucaaauuuuguuuucuucauucauuu

SEQ ID NO: 144924 - RNA, 64 nt, hsa
uuaaacuugccugguuuguacauuuuuugccggacgcaucaagaagcaaucugugacaaagucu

SEQ ID NO: 144925 - RNA, 64 nt, hsa
cuggggggcggggcuggaggggaaggaguguccacgcaucaauaaagauuuaacgaacugaacg

SEQ ID NO: 144926 - RNA, 64 nt, hsa
uucagcuguccacacgggcuggcgacacacuuaccgcaucaaucuguguucagguccaggguua

SEQ ID NO: 144927 - RNA, 64 nt, hsa
gacagaagcuuuauccaggucucagagcucaauacgcaucaaaagauacaucuuugaugaaguc

SEQ ID NO: 144928 - RNA, 64 nt, hsa
ccaagcccaguucucuggguugugcuuuacuccacgcaucaauaaauaauuuugaaggccucac

SEQ ID NO: 144929 - RNA, 64 nt, hsa
agacuggucuggccugcuggccugggcgucagggcgcaucaauaaaguacuuggaccaguuuug

SEQ ID NO: 144930 - RNA, 64 nt, hsa
ccagaaggccgcagaggcugagcaggaaaugcagcgcaucaaggccacagcgauucgcacggag

SEQ ID NO: 144931 - RNA, 64 nt, hsa
cggcuaccagccccaccuggaggacuuucugcugcgcaucaacuucaacaacuacuaccaggac

SEQ ID NO: 144932 - RNA, 64 nt, hsa
gucugggaucaacuccuggaagaaacgccugauccgcaucaagaauggcauccucaggggcgug

SEQ ID NO: 144933 - RNA, 64 nt, hsa
uauccuaauuuaaaagcugugaaauuaguuuucacgcaucaaaccggauuguuuauauguuuaa

SEQ ID NO: 144934 - RNA, 63 nt, hsa
cuuuuuccuuccccuggacuguccucugacccuuuggcucauccuagauugcaguguguccug

SEQ ID NO: 144935 - RNA, 63 nt, hsa
augcagauggagaagugguguuggcagcaagcuuuggcucauguggauuugguuuaaguggug

SEQ ID NO: 144936 - RNA, 63 nt, hsa
cugucacccaggcuagagugcgguggugugaucuuggcucacugcaaccucccccuccugggu

SEQ ID NO: 144937 - RNA, 63 nt, hsa
cuguugcucaggcuggagugcaguggugcaaucuuggcucacugcaaccuacaccucccgggu

SEQ ID NO: 144938 - RNA, 63 nt, hsa
cugucacccaggcuggaaugcaguggugugaucuuggcucacugcaaccuccacuucccgggu

SEQ ID NO: 144939 - RNA, 63 nt, hsa
gagacuggguaauugauaaagaaaaagguuuguuuggcucacaauuuugcuggcuagaagguu

SEQ ID NO: 144940 - RNA, 63 nt, hsa
ccaucguccaggcuggagugcgcuggcuugaucuuggcucacugcagccucaauguccccagg

SEQ ID NO: 144941 - RNA, 63 nt, hsa
uuguugccagggcuggagugcaauggcgugaucuuggcucacugcaaccuccgccucccgggu

SEQ ID NO: 144942 - RNA, 63 nt, hsa
ugguggaggcaaagggcagaauuucugaccccuuuggcucagcugcccuuccccacaaauaaa

SEQ ID NO: 144943 - RNA, 63 nt, hsa
cugccacccaggcuggaguacaguggcaugaucuuggcucacugcaacgucugccuccugggu

SEQ ID NO: 144944 - RNA, 63 nt, hsa
cuguugcccaggcuggagugcaguggugccaucuuggcucacuccaagcucccccucccgugu

SEQ ID NO: 144945 - RNA, 63 nt, hsa
aaaaaaucuuuuuauaaaaugaacuuuuaacacuuggcucaaaccucuaggucauacugccaa

SEQ ID NO: 144946 - RNA, 63 nt, hsa
caggggaaacugcuguggauuugagaggcaaaguuggcucagcugugugcccaguuccuccug

SEQ ID NO: 144947 - RNA, 63 nt, hsa
uuguguuuuuauuggagguggggugucacuauguuggcucagcugauuucaaauuccugaccu

SEQ ID NO: 144948 - RNA, 63 nt, hsa
ucugucaccaggcuggagugcaguggugcgaucuuggcucauggcaaccucugccucccaggu

SEQ ID NO: 144949 - RNA, 63 nt, hsa
ccacugaccuacugaauaucuagcauccuuagauuggcucaacuguuacuuuccuaaggaguc

SEQ ID NO: 144950 - RNA, 63 nt, hsa
uguauguaagugaaaagcaucaccaucuacccauuggcucaagcagaaaucuggaagucaucu

SEQ ID NO: 144951 - RNA, 63 nt, hsa
cucucgcccaggcuggagugcaacgguacgaucuuggcucagugcaaccuccgccuccugggu

SEQ ID NO: 144952 - RNA, 63 nt, hsa
cugucucccaggcuggagugcaauggugcaaucuuggcucacuauagccuugaccucucaggc

SEQ ID NO: 144953 - RNA, 63 nt, hsa
cugucgcccaggcuggagugcaguggugugaucuuggcucacugcaaccuccgccucuugggu

SEQ ID NO: 144954 - RNA, 63 nt, hsa
aagagguacaggcgguguccgccucguuucugguuggcucagcggguuucuagggcugugacg

SEQ ID NO: 144955 - RNA, 63 nt, hsa
uuccugcagggaggggugccaugagucuugcuuuuggcucauacaggagagagggaaggcugc

SEQ ID NO: 144956 - RNA, 63 nt, hsa
cuuuuuggcucuggcuuuuaaacauuguccugguuggcucauuuaauuuuuuuuuuuuuuuuu

SEQ ID NO: 144957 - RNA, 63 nt, hsa
gagugcaguggugugaucuuggcucacuugaucuuggcucacuguaaccuccaccucccaggc

SEQ ID NO: 144958 - RNA, 63 nt, hsa
cugucacccaggcuggagugcaguggugugaucuuggcucacuugaucuuggcucacuguaac

SEQ ID NO: 144959 - RNA, 63 nt, hsa
cccucccagguaccuagcagaggcugucaguccuuggcucaccuggaacagggcuggggcugg

SEQ ID NO: 144960 - RNA, 63 nt, hsa
cagcuggguguacugagccuguucaccuggucuuuggcucacucuguguugaaacccagaacc

SEQ ID NO: 144961 - RNA, 63 nt, hsa
aacugcauggccuuggagagagacucugggcucuuggcucagauguguucaucaaauacuccu

SEQ ID NO: 144962 - RNA, 63 nt, hsa
cucagcaaguggagguuucaauguauuuuucaguuggcucaucagccagcauuggugaauauu

SEQ ID NO: 144963 - RNA, 63 nt, hsa
uguugcccaggcugggagggcaauggcaccgucuuggcucacugcaaccuccgccucccgggu

SEQ ID NO: 144964 - RNA, 63 nt, hsa
accaucaaaucucugucucugcuugguuaaaaauuggcucacuauugcuuuguaguaaccccu

SEQ ID NO: 144965 - RNA, 63 nt, hsa
aaucagcuauaugaagaaucucagcuggguguuuuggcucaggccuguaaucccagcacuuug

SEQ ID NO: 144966 - RNA, 63 nt, hsa
cugucacccaggcuggagugcaguggugcaaucuuggcucacugcaacuugggccucccaggu

SEQ ID NO: 144967 - RNA, 63 nt, hsa
ugaaaaauccguauccucugcuucuggugaacauuggcucagggguuagcaucuuagcaguau

SEQ ID NO: 144968 - RNA, 63 nt, hsa
ccagagcgacuuugaucaccaucaccaacaacauuggcucaauagcaagaaugugugcccuua

SEQ ID NO: 144969 - RNA, 63 nt, hsa
uuguugcccaggcuggagugcaacggcaugauuuuggcucacugcagccucugccucccaggc

SEQ ID NO: 144970 - RNA, 63 nt, hsa
cuguugcccaggcuggagugcaguggcgugaucuuggcucacuacaaccuccaccuuccaggc

SEQ ID NO: 144971 - RNA, 63 nt, hsa
uuaaucuuagucugaaaucaaaauauagauuaauuggcucagcuuuaauaccuuucuaggagg

SEQ ID NO: 144972 - RNA, 63 nt, hsa
cagucacuggaugcacaaaaucacuguguaacauuggcucacuuggugagcauaggguugacu

SEQ ID NO: 144973 - RNA, 63 nt, hsa
uugccugcuggugacaagcagagcgccugugauuuggcucaagacuccuauaugaugcaggug

SEQ ID NO: 144974 - RNA, 63 nt, hsa
cuuaagccugauuuuccugaugcuuauuguaacuuggcucauugccugcagguaaagaauaac

SEQ ID NO: 144975 - RNA, 63 nt, hsa
cuguugugcaggcuggagugcaguggcacagucuuggcucacugcaaccuccaccuccugggu

SEQ ID NO: 144976 - RNA, 63 nt, hsa
cuguugugcaggcuguagugcaguggcacgaucuuggcucacugcaaccuccaccucccgggu

SEQ ID NO: 144977 - RNA, 63 nt, hsa
ucuguugccaggcuggagugcaguggcgcaaucuuggcucacugcaaccuccgccucccaggu

SEQ ID NO: 144978 - RNA, 64 nt, hsa
uuugccaucuucugcucucagcaaagcugauagucuaugucaauuaaauacccuauguuaugua

SEQ ID NO: 144979 - RNA, 64 nt, hsa
uccaugguccccaauucauaguuuauucauaaugcuaugucacuauuuuuguaaaugagguuua

SEQ ID NO: 144980 - RNA, 64 nt, hsa; identical to SEQ ID NO: 52440

SEQ ID NO: 144981 - RNA, 64 nt, hsa; identical to SEQ ID NO: 52441

SEQ ID NO: 144982 - RNA, 64 nt, hsa; identical to SEQ ID NO: 52442

SEQ ID NO: 144983 - RNA, 50 nt, hsa; identical to SEQ ID NO: 52443

SEQ ID NO: 144984 - RNA, 64 nt, hsa; identical to SEQ ID NO: 52444

SEQ ID NO: 144985 - RNA, 64 nt, hsa; identical to SEQ ID NO: 52445

SEQ ID NO: 144986 - RNA, 64 nt, hsa; identical to SEQ ID NO: 52446

SEQ ID NO: 144987 - RNA, 64 nt, hsa; identical to SEQ ID NO: 52447

SEQ ID NO: 144988 - RNA, 64 nt, hsa; identical to SEQ ID NO: 52448

SEQ ID NO: 144989 - RNA, 64 nt, hsa; identical to SEQ ID NO: 52449

SEQ ID NO: 144990 - RNA, 64 nt, hsa; identical to SEQ ID NO: 52450

SEQ ID NO: 144991 - RNA, 64 nt, hsa; identical to SEQ ID NO: 52451

SEQ ID NO: 144992 - RNA, 64 nt, hsa; identical to SEQ ID NO: 52452

SEQ ID NO: 144993 - RNA, 64 nt, hsa; identical to SEQ ID NO: 52453

SEQ ID NO: 144994 - RNA, 64 nt, hsa; identical to SEQ ID NO: 52454

SEQ ID NO: 144995 - RNA, 64 nt, hsa; identical to SEQ ID NO: 52455

SEQ ID NO: 144996 - RNA, 64 nt, hsa; identical to SEQ ID NO: 52456

SEQ ID NO: 144997 - RNA, 64 nt, hsa; identical to SEQ ID NO: 52457

SEQ ID NO: 144998 - RNA, 64 nt, hsa; identical to SEQ ID NO: 52458

SEQ ID NO: 144999 - RNA, 64 nt, hsa; identical to SEQ ID NO: 52459

SEQ ID NO: 145000 - RNA, 64 nt, hsa; identical to SEQ ID NO: 52460

SEQ ID NO: 145001 - RNA, 64 nt, hsa; identical to SEQ ID NO: 52461

SEQ ID NO: 145002 - RNA, 64 nt, hsa; identical to SEQ ID NO: 52462

SEQ ID NO: 145003 - RNA, 64 nt, hsa; identical to SEQ ID NO: 52463

SEQ ID NO: 145004 - RNA, 64 nt, hsa; identical to SEQ ID NO: 52464

SEQ ID NO: 145005 - RNA, 64 nt, hsa; identical to SEQ ID NO: 52465

SEQ ID NO: 145006 - RNA, 64 nt, hsa; identical to SEQ ID NO: 52466

SEQ ID NO: 145007 - RNA, 64 nt, hsa; identical to SEQ ID NO: 52467

SEQ ID NO: 145008 - RNA, 64 nt, hsa; identical to SEQ ID NO: 52468

SEQ ID NO: 145009 - RNA, 64 nt, hsa; identical to SEQ ID NO: 52469

SEQ ID NO: 145010 - RNA, 64 nt, hsa; identical to SEQ ID NO: 52470

SEQ ID NO: 145011 - RNA, 64 nt, hsa; identical to SEQ ID NO: 52471

SEQ ID NO: 145012 - RNA, 64 nt, hsa; identical to SEQ ID NO: 52472

SEQ ID NO: 145013 - RNA, 64 nt, hsa; identical to SEQ ID NO: 52473

SEQ ID NO: 145014 - RNA, 64 nt, hsa; identical to SEQ ID NO: 52474

SEQ ID NO: 145015 - RNA, 64 nt, hsa; identical to SEQ ID NO: 52475

SEQ ID NO: 145016 - RNA, 64 nt, hsa; identical to SEQ ID NO: 52476

SEQ ID NO: 145017 - RNA, 64 nt, hsa; identical to SEQ ID NO: 52477

SEQ ID NO: 145018 - RNA, 64 nt, hsa; identical to SEQ ID NO: 52478

SEQ ID NO: 145019 - RNA, 64 nt, hsa; identical to SEQ ID NO: 52479

SEQ ID NO: 145020 - RNA, 64 nt, hsa; identical to SEQ ID NO: 52480

SEQ ID NO: 145021 - RNA, 64 nt, hsa; identical to SEQ ID NO: 52481

SEQ ID NO: 145022 - RNA, 64 nt, hsa; identical to SEQ ID NO: 52482

SEQ ID NO: 145023 - RNA, 64 nt, hsa; identical to SEQ ID NO: 52483

SEQ ID NO: 145024 - RNA, 64 nt, hsa; identical to SEQ ID NO: 52484

SEQ ID NO: 145025 - RNA, 64 nt, hsa; identical to SEQ ID NO: 52485

SEQ ID NO: 145026 - RNA, 64 nt, hsa; identical to SEQ ID NO: 52486

SEQ ID NO: 145027 - RNA, 64 nt, hsa; identical to SEQ ID NO: 52487

SEQ ID NO: 145028 - RNA, 64 nt, hsa; identical to SEQ ID NO: 52488

SEQ ID NO: 145029 - RNA, 64 nt, hsa; identical to SEQ ID NO: 52489

SEQ ID NO: 145030 - RNA, 64 nt, hsa; identical to SEQ ID NO: 52490

SEQ ID NO: 145031 - RNA, 64 nt, hsa; identical to SEQ ID NO: 52491

SEQ ID NO: 145032 - RNA, 64 nt, hsa; identical to SEQ ID NO: 52492

SEQ ID NO: 145033 - RNA, 64 nt, hsa; identical to SEQ ID NO: 52493

SEQ ID NO: 145034 - RNA, 64 nt, hsa; identical to SEQ ID NO: 52494

SEQ ID NO: 145035 - RNA, 64 nt, hsa; identical to SEQ ID NO: 52495

SEQ ID NO: 145036 - RNA, 64 nt, hsa; identical to SEQ ID NO: 52496

SEQ ID NO: 145037 - RNA, 64 nt, hsa; identical to SEQ ID NO: 52497

SEQ ID NO: 145038 - RNA, 64 nt, hsa; identical to SEQ ID NO: 52498

SEQ ID NO: 145039 - RNA, 64 nt, hsa; identical to SEQ ID NO: 52499

SEQ ID NO: 145040 - RNA, 64 nt, hsa; identical to SEQ ID NO: 52500

SEQ ID NO: 145041 - RNA, 64 nt, hsa; identical to SEQ ID NO: 52501

SEQ ID NO: 145042 - RNA, 64 nt, hsa; identical to SEQ ID NO: 52502

SEQ ID NO: 145043 - RNA, 64 nt, hsa; identical to SEQ ID NO: 52503

SEQ ID NO: 145044 - RNA, 64 nt, hsa; identical to SEQ ID NO: 52504

SEQ ID NO: 145045 - RNA, 64 nt, hsa; identical to SEQ ID NO: 53719

SEQ ID NO: 145046 - RNA, 64 nt, hsa; identical to SEQ ID NO: 53720

SEQ ID NO: 145047 - RNA, 64 nt, hsa; identical to SEQ ID NO: 53721

SEQ ID NO: 145048 - RNA, 64 nt, hsa; identical to SEQ ID NO: 53722

SEQ ID NO: 145049 - RNA, 64 nt, hsa; identical to SEQ ID NO: 53723

SEQ ID NO: 145050 - RNA, 64 nt, hsa; identical to SEQ ID NO: 53724

SEQ ID NO: 145051 - RNA, 64 nt, hsa; identical to SEQ ID NO: 53725

SEQ ID NO: 145052 - RNA, 64 nt, hsa; identical to SEQ ID NO: 53726

SEQ ID NO: 145053 - RNA, 64 nt, hsa; identical to SEQ ID NO: 53727

SEQ ID NO: 145054 - RNA, 64 nt, hsa; identical to SEQ ID NO: 53728

SEQ ID NO: 145055 - RNA, 64 nt, hsa; identical to SEQ ID NO: 53729

SEQ ID NO: 145056 - RNA, 64 nt, hsa; identical to SEQ ID NO: 53730

SEQ ID NO: 145057 - RNA, 64 nt, hsa; identical to SEQ ID NO: 53731

SEQ ID NO: 145058 - RNA, 64 nt, hsa; identical to SEQ ID NO: 53732

SEQ ID NO: 145059 - RNA, 64 nt, hsa; identical to SEQ ID NO: 53733

SEQ ID NO: 145060 - RNA, 64 nt, hsa; identical to SEQ ID NO: 53734

SEQ ID NO: 145061 - RNA, 64 nt, hsa; identical to SEQ ID NO: 53735

SEQ ID NO: 145062 - RNA, 64 nt, hsa; identical to SEQ ID NO: 53736

SEQ ID NO: 145063 - RNA, 64 nt, hsa; identical to SEQ ID NO: 53737

SEQ ID NO: 145064 - RNA, 64 nt, hsa; identical to SEQ ID NO: 53738

SEQ ID NO: 145065 - RNA, 64 nt, hsa; identical to SEQ ID NO: 53739

SEQ ID NO: 145066 - RNA, 64 nt, hsa; identical to SEQ ID NO: 53740

SEQ ID NO: 145067 - RNA, 64 nt, hsa; identical to SEQ ID NO: 53741

SEQ ID NO: 145068 - RNA, 64 nt, hsa; identical to SEQ ID NO: 53742

SEQ ID NO: 145069 - RNA, 64 nt, hsa; identical to SEQ ID NO: 53743

SEQ ID NO: 145070 - RNA, 64 nt, hsa; identical to SEQ ID NO: 53744

SEQ ID NO: 145071 - RNA, 64 nt, hsa; identical to SEQ ID NO: 53745

SEQ ID NO: 145072 - RNA, 64 nt, hsa; identical to SEQ ID NO: 53746

SEQ ID NO: 145073 - RNA, 64 nt, hsa; identical to SEQ ID NO: 53747

SEQ ID NO: 145074 - RNA, 64 nt, hsa; identical to SEQ ID NO: 53748

SEQ ID NO: 145075 - RNA, 64 nt, hsa; identical to SEQ ID NO: 53749

SEQ ID NO: 145076 - RNA, 64 nt, hsa; identical to SEQ ID NO: 53750

SEQ ID NO: 145077 - RNA, 64 nt, hsa; identical to SEQ ID NO: 53751

SEQ ID NO: 145078 - RNA, 64 nt, hsa; identical to SEQ ID NO: 53752

SEQ ID NO: 145079 - RNA, 64 nt, hsa; identical to SEQ ID NO: 53753

SEQ ID NO: 145080 - RNA, 64 nt, hsa; identical to SEQ ID NO: 53754

SEQ ID NO: 145081 - RNA, 64 nt, hsa; identical to SEQ ID NO: 53755

SEQ ID NO: 145082 - RNA, 64 nt, hsa; identical to SEQ ID NO: 53756

SEQ ID NO: 145083 - RNA, 64 nt, hsa; identical to SEQ ID NO: 53757

SEQ ID NO: 145084 - RNA, 64 nt, hsa; identical to SEQ ID NO: 53758

SEQ ID NO: 145085 - RNA, 64 nt, hsa; identical to SEQ ID NO: 53759

SEQ ID NO: 145086 - RNA, 64 nt, hsa; identical to SEQ ID NO: 53760

SEQ ID NO: 145087 - RNA, 64 nt, hsa; identical to SEQ ID NO: 53761

SEQ ID NO: 145088 - RNA, 64 nt, hsa; identical to SEQ ID NO: 53762

SEQ ID NO: 145089 - RNA, 64 nt, hsa; identical to SEQ ID NO: 53763

SEQ ID NO: 145090 - RNA, 64 nt, hsa; identical to SEQ ID NO: 53764

SEQ ID NO: 145091 - RNA, 64 nt, hsa
aacuaaccuaccccaacucugcccuucucccauccaagagaaaccagcaaaaugauaaagaagc

SEQ ID NO: 145092 - RNA, 64 nt, hsa
cgggcagcagucacuggggcucaagggcagugagcaagagaaaugucuaaagcugcuucuccca

SEQ ID NO: 145093 - RNA, 64 nt, hsa
ugugguagccacuccaggauccugauuggggugccaagagaaacagcaggauguugaauugauc

SEQ ID NO: 145094 - RNA, 64 nt, hsa
uauaaaauucugucuuucauuuccaaccauuuuucaagagaagcugcuacuaucuugagacuuc

SEQ ID NO: 145095 - RNA, 64 nt, hsa
ccucagggcugcauucagcuuaccagcuaccuagcaagagaaggaauuauuugacaugccuaaa

SEQ ID NO: 145096 - RNA, 64 nt, hsa
gcccacgugaagaguuugguagaaauagccuugucaagagaacuagcaagccccugacauuuuu

SEQ ID NO: 145097 - RNA, 64 nt, hsa
ucugaaucuuaggaagaagguaaaagaaaggaggcaagagaauaguuaugaugaauauguguua

SEQ ID NO: 145098 - RNA, 64 nt, hsa
uucauguuauaugcacauugccaagaauuacugucaagagaaaugauaaguaaaagucauuuau

SEQ ID NO: 145099 - RNA, 64 nt, hsa
augccuguagucccagcuacuugagaggcugaggcaagagaauuguuugaacccgggaggcaga

SEQ ID NO: 145100 - RNA, 64 nt, hsa
aacacacacuguucugaaagugacucacuuaucccaagagaaugaaauugcugaaagaucuuuc

SEQ ID NO: 145101 - RNA, 64 nt, hsa
aaauuuguucuuccugauaugauaacuaggucuccaagagaaaauagaaaggcugcuuuagugc

SEQ ID NO: 145102 - RNA, 64 nt, hsa
accuccaguucucccugaugacaguagcugucuccaagagaaaaauccucacuuauuaacucuc

SEQ ID NO: 145103 - RNA, 64 nt, hsa
uaaucuuacggauaauccacgugagauuuccacacaagagaaaagcacacgcauagugaaaugu

SEQ ID NO: 145104 - RNA, 64 nt, hsa
aaaccucaagacuaucagugugaccuccccauaacaagagaaccccauauauaguuugagacuu

SEQ ID NO: 145105 - RNA, 64 nt, hsa
uaucccagcuuuaaaaagaaaaaaaaagaauuaccaagagaaggggacuucucuuccaguuucu

SEQ ID NO: 145106 - RNA, 64 nt, hsa
gguuucuuuuuucuuucuuccuuucuuccuuggccaagagaagggcuuacaggcauggacaugc

SEQ ID NO: 145107 - RNA, 64 nt, hsa
ugggaggcaaaaagcacuucuuacauggcggcagcaagagaaaaugagaaagaagcaaaagugg

SEQ ID NO: 145108 - RNA, 64 nt, hsa
cgggaggugaaaagcacuucguacauggugguggcaagagaaaaugaagaagaagcaaaagugg

SEQ ID NO: 145109 - RNA, 64 nt, hsa
ugccuauaaguagcaggccuuugugccucagugucaagagaaaucaagagaugcuaaaagcuuu

SEQ ID NO: 145110 - RNA, 64 nt, hsa
gcgccuguaguuccagcuacucgggaggcugaggcaagagaauggcaugaacccgguaggggag

SEQ ID NO: 145111 - RNA, 64 nt, hsa
gagaguccuuugggauucuaggaaacccaaggaacaagagaaaaaacuagagccugugcuaaag

SEQ ID NO: 145112 - RNA, 64 nt, hsa
uuuugaaacccauuaggcaugccuaauauuuaggcaagagaaaauaaaccaagauagauccauu

SEQ ID NO: 145113 - RNA, 64 nt, hsa
gaaguuaugaaugaagauaacauucacccauaaccaagagaacucagguagcugcaucaccagg

SEQ ID NO: 145114 - RNA, 64 nt, hsa
uauuauauaacauguaaaguugauuuucuugugacaagagaacuucuuuuuuuaacaagaggac

SEQ ID NO: 145115 - RNA, 64 nt, hsa
cucuucagcuguaaauaacaggauacagaauuaacaagagaaaaugucuaacuuuuuaagaaaa

SEQ ID NO: 145116 - RNA, 64 nt, hsa
cacaaaaugacacucuucuaaaacuaaaugggcacaagagaauuuuccugggaaaguucacauc

SEQ ID NO: 145117 - RNA, 64 nt, hsa
aaccuugucaauagguucuugaaaacuuguacuucaagagaaaugauguauaacaaaaccauac

SEQ ID NO: 145118 - RNA, 64 nt, hsa
ucuccauaccauuuggcucccaaauuuaaauaaacaagagaaaacgguguucaucuauuaagga

SEQ ID NO: 145119 - RNA, 64 nt, hsa
acgccugaagucccagcuacucaggaggcugaggcaagagaaucacuugaacccaggaggcaga

SEQ ID NO: 145120 - RNA, 64 nt, hsa
cuaguaccaauuuucccuuuuuauuuuucagcaucaagagaaaaccaaucagcuucaucaaaac

SEQ ID NO: 145121 - RNA, 64 nt, hsa
ggugggagugugguggggcguagugguggcaggacaagagaaggcauugagcuuuuucuuucau

SEQ ID NO: 145122 - RNA, 64 nt, hsa
gguuuuuuaaauuuuauuuuauuuuauuuaaguucaagagaaaaaguguacacacaggggccac

SEQ ID NO: 145123 - RNA, 64 nt, hsa
ggguaagguaaagugcgauaguucaaguggaaagcaagagaaugaccagugaccuugcuuccuu

SEQ ID NO: 145124 - RNA, 64 nt, hsa
guuggucauuaggugaauauuacucauuuucccucaagagaagcucauaagugugugugggugu

SEQ ID NO: 145125 - RNA, 64 nt, hsa
cagggucuucugcuccagucaccccggccucuugcaagagaaaguccagggacuggcaagaaga

SEQ ID NO: 145126 - RNA, 64 nt, hsa
cugagaaacuguugagucaggcuagaggacuggacaagagaagaggcauugagagcccccuugg

SEQ ID NO: 145127 - RNA, 64 nt, hsa
ucauuuuucaacucaaggcaauggcuuucuacaccaacucuaauccauaaacgggucuuaugac

SEQ ID NO: 145128 - RNA, 64 nt, hsa
aauaagggugguggacuaucuugaagaacccuuucaacucuaaaaauugacccuaucaacugga

SEQ ID NO: 145129 - RNA, 64 nt, hsa
agaaauugcaucacacuaauuacaaaauacaaguucuggaaaaaauauuuuucuucauuuuaaa

SEQ ID NO: 145130 - RNA, 64 nt, hsa
guuaacuuuuacacaguucugaguacuguuaauaucuggaaaguaucuugagauaucaguggaa

SEQ ID NO: 145131 - RNA, 64 nt, hsa
caugauuuauauauggcauauuuauauuguauauucuggaaaaaaaauauauauauauauuuaa

SEQ ID NO: 145132 - RNA, 64 nt, hsa
uuugagaauuauuccuuuccuagacuaauuaaaaucuggaaaucuguuuuguauaugaucuaau

SEQ ID NO: 145133 - RNA, 64 nt, hsa
aaacugaguaaauuggaaacauuuucuuucuuuuucuggaaauuuuguccauuuuaaaaaccaa

SEQ ID NO: 145134 - RNA, 64 nt, hsa
uucuacauucauugccaucaagucgucagcuuguucuggaaacucuuuaugcuuugacaucgag

SEQ ID NO: 145135 - RNA, 64 nt, hsa
agcuccuagagaagaacaauccucauggagaaacucuggaaaccuugacaauggcaacagugug

SEQ ID NO: 145136 - RNA, 64 nt, hsa
cuuauuagcuccccgcuccacaagacaccugugaucuggaaaucuaccaccaaucccgaucggc

SEQ ID NO: 145137 - RNA, 64 nt, hsa
gcccaggaaagaacuucagcugacuccacggggaucuggaaauccacgaccaaucccgaucggc

SEQ ID NO: 145138 - RNA, 64 nt, hsa
agagccgucaucagugucucacuugugauuuuuaucuggaaaaggaagaaacaccccagcacag

SEQ ID NO: 145139 - RNA, 64 nt, hsa
gaguccaugaagggggugugagggggaggguauuucuggaaaguggaccagcaugugcaaaaau

SEQ ID NO: 145140 - RNA, 64 nt, hsa
ggacuccaguugccucagguugguucugcugugcucuggaaaguaacugcagccaccagguaug

SEQ ID NO: 145141 - RNA, 64 nt, hsa
agccuuuuaauacuaaguaugaaacaaccuauggucuggaaauuuguaucgcaaagcuauaugu

SEQ ID NO: 145142 - RNA, 64 nt, hsa
aauuugguauugcacaggugauuagucaaggaagucuggaaaagcuuuggucccacagccuugc

SEQ ID NO: 145143 - RNA, 64 nt, hsa
aaggaagaagccugagauuugauccuugacaauuucuggaaagcacuggucagucacacugucc

SEQ ID NO: 145144 - RNA, 64 nt, hsa
cuaagaugauauuucagaagaguuggcugccuucucuggaaacaaggaaaacccaauaauuccg

SEQ ID NO: 145145 - RNA, 64 nt, hsa
aaugagggacuggaaccagggagaccgagcgcuuucuggaaaagaggaguuucgagguagaguu

SEQ ID NO: 145146 - RNA, 64 nt, hsa
aagaggcuggugcuguggccagggugagagcugcucuggaaaaugugacccagauccucacaac

SEQ ID NO: 145147 - RNA, 64 nt, hsa
uuuucaugacaauguaauuuguguaacuguugaaucuggaaauugaucagcauuaaagggcaca

SEQ ID NO: 145148 - RNA, 64 nt, hsa
ugauacagcucuggcuuucugagcacacuacggaucuggaaaauacuggaaaaugugauacuua

SEQ ID NO: 145149 - RNA, 64 nt, hsa
aauucagaauucuuaggcaaccuucauaccuuuaucuggaaaaugccuucucuccagacaauaa

SEQ ID NO: 145150 - RNA, 64 nt, hsa
agcaggaauuuauacauuggguaccagagcuaaaucuggaaaacacauuuggaaugagcuucca

SEQ ID NO: 145151 - RNA, 64 nt, hsa
cauauuuuucuaaguuuccccccuaguuucacuuucuggaaagugaacaguuuuuuaaauccua

SEQ ID NO: 145152 - RNA, 64 nt, hsa
uuguuuuaucuaauacuguaaguaguugucauauucuggaaaauuuaauaguuuuagaguuaag

SEQ ID NO: 145153 - RNA, 64 nt, hsa
guuuuauuugaaugugugcauaacaguaaugagaucuggaaacaccuauuuuuuggggaaaaag

SEQ ID NO: 145154 - RNA, 64 nt, hsa
cccuugcauacaaguuucuaguugccagugauguucuggaaauaaugggagauauuacaauaaa

SEQ ID NO: 145155 - RNA, 64 nt, hsa
caaaauuuguaauguguugcuucuacauaaguucucuggaaauaucuacaacuaauaggacaca

SEQ ID NO: 145156 - RNA, 64 nt, hsa
ucccuacagccuagggcagacaauaguauagaagucuggaaaaaaacaaaaacagaauuugaga

SEQ ID NO: 145157 - RNA, 64 nt, hsa
aucacgauuugcaggauucccuucugggcuucauucuggaaacuuuuguuagggcugcuuuucu

SEQ ID NO: 145158 - RNA, 64 nt, hsa
uggcagggaguggggauugguccuacuuucuuucucuggaaaggaaagccuccaagacuccaug

SEQ ID NO: 145159 - RNA, 64 nt, hsa
auccaucccuuauuaaaacucuuaguaaauuaagucuggaaagaaacacccuaaucuagauaaa

SEQ ID NO: 145160 - RNA, 64 nt, hsa
guugagcaacauggggcuagugggaucacagaaaucuggaaaaaaaaaaaaaaggcuuuggcuu

SEQ ID NO: 145161 - RNA, 64 nt, hsa
ccugccuggcugauucuuccuuaaaacuaaaaucucuggaaaauggauuugcuucuuacccugu

SEQ ID NO: 145162 - RNA, 64 nt, hsa
cgugugaaggaagcguucuuggugcuacacacagucuggaaaagcagccugggcuucacuggca

SEQ ID NO: 145163 - RNA, 64 nt, hsa
uucucuguguggauagacuccccagcguuuuuccucuggaaaugcccacagggcuugccgcgug

SEQ ID NO: 145164 - RNA, 64 nt, hsa
cauggggcacugacagagaaaugaaauaguuuuaucuggaaaauuccagagcuauuauuuacuc

SEQ ID NO: 145165 - RNA, 64 nt, hsa
agaggccaugaagaagugcuuccguggccgacagucuggaaaugaauccaucauacauuagugc

SEQ ID NO: 145166 - RNA, 64 nt, hsa
caagagaaagaaagaacguucccuuuggggauagucuggaaaguugggauuugcaaauaaaggc

SEQ ID NO: 145167 - RNA, 64 nt, hsa
ugccugcugcugccaaguuagcuauugggagcaaucuggaaaaacuugcucccaggagggcuuu

SEQ ID NO: 145168 - RNA, 64 nt, hsa
gcaagauggguuuuuaaggaaaauaaugugaaauucuggaaauuuucuuuggggcagagaagag

SEQ ID NO: 145169 - RNA, 64 nt, hsa
aguugcagaacaagcaauuggcuuagauauacaaucuggaaaaauauuccugugcccauauuuu

SEQ ID NO: 145170 - RNA, 64 nt, hsa
ucuaguuggccagcgucuugcucuguucacagucucuggaaaagcugggguaguuggugagcag

SEQ ID NO: 145171 - RNA, 64 nt, hsa
gaacccugcagggcccuuauggacaggaugggguucuggaaauccagauaacuaaggugaagaa

SEQ ID NO: 145172 - RNA, 64 nt, hsa
cucaaauuguagucucugucggcuucugcagaauucuggaaaaugccaguuuuccucccccgcc

SEQ ID NO: 145173 - RNA, 64 nt, hsa
ggcuucagugauuccucugugucccuuuuugguuucuggaaagauucuuugucaacauuaguaa

SEQ ID NO: 145174 - RNA, 64 nt, hsa
cgauaaggaaagaaaaugucguuguuguuguuuuucuggaaacugcuugaaaucuugcuguacu

SEQ ID NO: 145175 - RNA, 64 nt, hsa
gcugggcgcaucccaagacagccagcagguugucucuggaaacgaccagaguuaagcucucggc

SEQ ID NO: 145176 - RNA, 64 nt, hsa
gagagaauacuguaauaauaucaaaagcacuuuuucuggaaacacauuuauggcuuuuauaaug

SEQ ID NO: 145177 - RNA, 64 nt, hsa
auauugucauagugguuuuuauuccugcuuuguuucuggaaaggaaauccugaauuacuuaagu

SEQ ID NO: 145178 - RNA, 64 nt, hsa
acaacaguaucuuaaguuuaacugggcacuucccucuggaaaucacaguguugugcaccaggaa

SEQ ID NO: 145179 - RNA, 64 nt, hsa
gagcucuuuaaaaauaaauugcucuggucccaccucuggaaaucugauucagccagcauggaua

SEQ ID NO: 145180 - RNA, 64 nt, hsa
caaaggugggaagagagccuggaaaagaaccaggccuggaaaagaaccagaaggaggcugggca

SEQ ID NO: 145181 - RNA, 64 nt, hsa
ccucuucugucauuguucaaaggugggaagagagccuggaaaagaaccaggccuggaaaagaac

SEQ ID NO: 145182 - RNA, 64 nt, hsa
uuaaucuucacacaucucuggguucugagaaaagccuggaaaaaucacacuucuuugucauugu

SEQ ID NO: 145183 - RNA, 64 nt, hsa
guuuuauaauuucucauaucaaugucagaaguauccuggaaacauaugucacaugcgggaacug

SEQ ID NO: 145184 - RNA, 64 nt, hsa
aaauggccucaggcaauuucacauucccuaauuaccuggaaaguucuacaguaauuaauaugca

SEQ ID NO: 145185 - RNA, 64 nt, hsa
caagccgccugguggauuccuaugacacagggggccuggaaagaaagggaaaguggauuuaaaa

SEQ ID NO: 145186 - RNA, 64 nt, hsa
aaugaacaugagaaaauuuauacuguagagaaacccuggaaaugugaagaacguggcaaaguuc

SEQ ID NO: 145187 - RNA, 64 nt, hsa
uacuguauauauauaauuccuacugaagaaauccccuggaaaugcaaaaaauguggcaggauuu

SEQ ID NO: 145188 - RNA, 64 nt, hsa
auagacacaagaaagauggcaaauuuaugcuauuccuggaaaaauacauuguggcuuagcaaau

SEQ ID NO: 145189 - RNA, 64 nt, hsa
uugauuacaauugagauucaugugacuauugagcccuggaaauguagcuuguccaaauugagau

SEQ ID NO: 145190 - RNA, 64 nt, hsa
ccuauaauucagagcauacgucauuggaagacuuccuggaaaucaguguaaaucuugcaacaua

SEQ ID NO: 145191 - RNA, 64 nt, hsa
aucaucuuuaugauuagaacaauuugcucaaagcccuggaaaaugccugguaacccagugccua

SEQ ID NO: 145192 - RNA, 64 nt, hsa
uuaguaacauauuuuucucccauaaccuagugaaccuggaaauacaacuuugcuucuuuaugaa

SEQ ID NO: 145193 - RNA, 64 nt, hsa
aggcuagagaguugauuuuuuuuuuuuuuggcauccuggaaaugauacaggaaacauauuaaga

SEQ ID NO: 145194 - RNA, 64 nt, hsa
agucugaguucugguggggaauuuaaaaaugcauccuggaaauccuuuaaagauuucagacuuu

SEQ ID NO: 145195 - RNA, 64 nt, hsa
aauuauguuaguauagaaacuacagaauauuuacccuggaaagaaaauauuggaauguuauuau

SEQ ID NO: 145196 - RNA, 64 nt, hsa
auuuguuuguuuguuugucuguuuguuucaagaaccuggaaaaauuccagaagaagagaagcug

SEQ ID NO: 145197 - RNA, 64 nt, hsa
auuguccuuuuucuuucuagcuguuaaccuacuuccuggaaaaaguaguagcucucuguagcau

SEQ ID NO: 145198 - RNA, 64 nt, hsa
ucucuaauuuuuuggaauuuuuguagacuuuacaccuggaaaaaaagauuuguaaaaucaccgg

SEQ ID NO: 145199 - RNA, 64 nt, hsa
acacccggcccacgcgugcugcagauguggggagccuggaaacacccggcccacgcgugcugca

SEQ ID NO: 145200 - RNA, 64 nt, hsa; identical to SEQ ID NO: 145199

SEQ ID NO: 145201 - RNA, 64 nt, hsa
ugcgaggcagaguuaagaccugugacguggggagccuggaaacacccggcccacgcgugcugca

SEQ ID NO: 145202 - RNA, 64 nt, hsa
cuagaaaaagaagagcaaauuaaauccaaaguaaccuggaaaaaaauuagaguaaaaaucagug

SEQ ID NO: 145203 - RNA, 64 nt, hsa
auuuucuuuaagcagcugcucuccaagacagggcccuggaaagaggcccacacauacagcccag

SEQ ID NO: 145204 - RNA, 64 nt, hsa
augaagcccuuggugaugaggacauagcaucugcccuggaaaucguuauuccaacauaauauua

SEQ ID NO: 145205 - RNA, 64 nt, hsa
gccccaagagaauaccaagacaagcaggcuguucccuggaaaaaaucuaaugcaaggagggcua

SEQ ID NO: 145206 - RNA, 64 nt, hsa
cagcagaauccagaguuggauuguaguuuaccuuccuggaaagcucauuaucucuguuugaauu

SEQ ID NO: 145207 - RNA, 64 nt, hsa
gaauaugaauggauuaaauguuaaagcuuuggugccuggaaacaauaucaaguaacaauaugau

SEQ ID NO: 145208 - RNA, 64 nt, hsa
ccgucgcuguggggguuuuuuucucugggguuccccuggaaaggcugcaggaacuaggcacaag

SEQ ID NO: 145209 - RNA, 64 nt, hsa
uuuguuugcauaggaauucaugaaggcgacccaaccuggaaaaagaacuauucacuuuggccau

SEQ ID NO: 145210 - RNA, 64 nt, hsa
gauauuaauaccagaccaaagacauuuucuguuuccuggaaaaaaaaaaugaaucauguuaggc

SEQ ID NO: 145211 - RNA, 64 nt, hsa
gagcgaggggcagauucuagucgggagcccaugcccuggaaauccaucuuucuucaucuuuccc

SEQ ID NO: 145212 - RNA, 64 nt, hsa
cugcaccuccuuucccucucuccaucuuccaaucccuggaaaagucuggucugagugugacuug

SEQ ID NO: 145213 - RNA, 64 nt, hsa
gugucauguuagcugagucaccauuuggcuucggccuggaaauagugugauuagaacacugauc

SEQ ID NO: 145214 - RNA, 64 nt, hsa
ggccaggggaaacugggggggccucagggacaggccuggaaaggccacgauggcugcugaauuc

SEQ ID NO: 145215 - RNA, 64 nt, hsa
cacuuagggaucucccagcuggguuagggcagggccuggaaaugugcauuuugcagaaacuuuu

SEQ ID NO: 145216 - RNA, 64 nt, hsa
aaggguuucgacugguccagcucugacaucccuuccuggaaacagcaugaauaaaacacucauc

SEQ ID NO: 145217 - RNA, 64 nt, hsa
ggucccaguccaucuccuggaggcggacagauggccuggaaaccucuggcuaaucgggccaucc

SEQ ID NO: 145218 - RNA, 64 nt, hsa
aagagacagcgacccaaagccgaaggacagguggccuggaaagaucccgcccaggucugggagc

SEQ ID NO: 145219 - RNA, 64 nt, hsa
uuuggugacaugauucauacagaccucuugagcuccuggaaauaguagaauuaagaccugagga

SEQ ID NO: 145220 - RNA, 61 nt, hsa
gcuauaaagccagugacugagaaagucuucaccuggaaaucacaacuggguaugcaucagg

SEQ ID NO: 145221 - RNA, 64 nt, hsa
acaaacaagcacucagcccagcuccucaauacuaccuggaaaaagcauuggcauuauuuucaau

SEQ ID NO: 145222 - RNA, 64 nt, hsa
ccuacagacuaccaccuuucgagaucaggaccaaccuggaaaaugccagaguuggcuaugccuu

SEQ ID NO: 145223 - RNA, 64 nt, hsa
ucucaaauguaugucucuuacguaacauacucuaagaaugaaacugucaccacagguaaauccu

SEQ ID NO: 145224 - RNA, 64 nt, hsa
gucauuacaugucaaauucaauuuuucugccuuaagaaugaauguccuucauaaaauauuggau

SEQ ID NO: 145225 - RNA, 64 nt, hsa
uaggcaauaacaguaauagggaauucacuuauugagaaugaaagugaaggggaugauccuaaug

SEQ ID NO: 145226 - RNA, 64 nt, hsa
aaagcucugcuguauuuuaaauguuuauguuuuaagaaugaacacuuuucaaauauaaaacuau

SEQ ID NO: 145227 - RNA, 64 nt, hsa
uuauugccuuucccuauauaaauauuaauugucuagaaugaaagcuaauauaggaacaagacuc

SEQ ID NO: 145228 - RNA, 64 nt, hsa
uacuaauaaauucauuguauguuagaauugcaauagaaugaagagaaacauuuagcuaguaacg

SEQ ID NO: 145229 - RNA, 64 nt, hsa
gucaauucaaguacaaaacuacaugaguacuauaagaaugaauuuugcaaauauuuguaaguaa

SEQ ID NO: 145230 - RNA, 64 nt, hsa
acccaggagguacacauacuaaagugacacaaagagaaugaagcagaaguagagaagaaagacu

SEQ ID NO: 145231 - RNA, 64 nt, hsa
ucuaaacauucuaaucaaauuuuaaaaugugcaaagaaugaagugaaaaacugaauuuuuuuuu

SEQ ID NO: 145232 - RNA, 64 nt, hsa
gcgugagccacugugccugaccugucauuuuuauagaaugaaaugugcuuauuucuaaacauuc

SEQ ID NO: 145233 - RNA, 64 nt, hsa
gcaguuuuuauaaaaagaaagcccgggucugcagagaaugaaaacugguuggaaacuaaagguu

SEQ ID NO: 145234 - RNA, 64 nt, hsa
uuuagagcguguugcuguuguaacaucccagagaagaaugaaaaggcacaugcuuuuauccgug

SEQ ID NO: 145235 - RNA, 64 nt, hsa
ugaaaagguaauacaagacuucuuuugauaguauagaaugaaggggaaauaacacauacccuaa

SEQ ID NO: 145236 - RNA, 64 nt, hsa
ggaaagccaagaacagccuuuauuggugaagaaaagaaugaaugauucuuuguaggcgccauca

SEQ ID NO: 145237 - RNA, 64 nt, hsa
uguuucaucugccuaggccuacucauuauuuuagagaaugaaugaagcaacaaggaagagagac

SEQ ID NO: 145238 - RNA, 64 nt, hsa
cccucucacacagacgugacguccugccagaaagagaaugaaugacagaaaaaaaaaagagaga

SEQ ID NO: 145239 - RNA, 64 nt, hsa
gacauggagugacuaucggggcgggccaaccccgagaaugaagauuggaaaaaggaaaaaaaaa

SEQ ID NO: 145240 - RNA, 64 nt, hsa
acuauaaccaguuguugagggguauacuagaagcagaaugaaaccacauuuuuugguuugauaa

SEQ ID NO: 145241 - RNA, 64 nt, hsa
uaucgguauuuuaacugaauuuacccauugacuaagaaugaaccagauuugguggugguuuugu

SEQ ID NO: 145242 - RNA, 64 nt, hsa
ccucaauuuaauuguguggguuuuuaauuuuccuagaaugaagugacugaaacaaugagaaaga

SEQ ID NO: 145243 - RNA, 64 nt, hsa
acucugaugccccagcacaguuaccccagcgagcagaaugaagaagauguuuguguggguuuug

SEQ ID NO: 145244 - RNA, 64 nt, hsa
aggagcugucaaauggacacuuaauuaugacaugagaaugaagaaauuauuuuggaaaaaaaaa

SEQ ID NO: 145245 - RNA, 64 nt, hsa
auugcaaccaguuugguaaugcaaacagcagaauagaaugaaaucucaguaaugaauuaaagca

SEQ ID NO: 145246 - RNA, 64 nt, hsa
augccuuauuugaaacugggcuuaaacugcaaaaagaaugaaguuggauuuaggaagcuguuag

SEQ ID NO: 145247 - RNA, 64 nt, hsa
cugaaugcaaucauuaacuugguugcuaauuacaagaaugaaaauuauaauggaaaaggacaaa

SEQ ID NO: 145248 - RNA, 64 nt, hsa
uucccauaaauaaaaguacaguuuucuugguggcagaaugaaaaucagcaacuucuagcauaua

SEQ ID NO: 145249 - RNA, 64 nt, hsa
aaugacgacaccuagcucuaagagcaauucugggagaaugaaaggaaguauaaaguaacccaua

SEQ ID NO: 145250 - RNA, 64 nt, hsa
caaggaggguguaaguuuaggggacaaagaagaaagaaugaauaauacgagcagacauucucug

SEQ ID NO: 145251 - RNA, 64 nt, hsa
cgagcagacauucucuguagaagguaauggucugagaaugaaaagguguuugauggacauguug

SEQ ID NO: 145252 - RNA, 64 nt, hsa
acuaagacauaugcauuuaugggaagacaaaacaagaaugaaacacuuauacugacuuucaucu

SEQ ID NO: 145253 - RNA, 64 nt, hsa
cacauuguauuuuugucuucaaauauuuucuaagagaaugaauuaucccccaaaaugcauuuag

SEQ ID NO: 145254 - RNA, 64 nt, hsa
aaauguaaauuaaaauuuccacaagcauugcuucagaaugaauuuguaccuauaaagcauaagg

SEQ ID NO: 145255 - RNA, 64 nt, hsa
ggauaaagguuuugguauuugcccacuucuagauagaaugaaugaaaacaacacaagcguuuua

SEQ ID NO: 145256 - RNA, 64 nt, hsa
gauccucuguucuggaagcuuugaaauuuaucagagaaugaagucauucaguacaucugauaaa

SEQ ID NO: 145257 - RNA, 64 nt, hsa
uugguucuuuaaaauauaucugaaaguaguagucagaaugaauuaugguuggaaaacugaggaa

SEQ ID NO: 145258 - RNA, 64 nt, hsa
accuuuucugugaggaggaggggaucgugauuucagaaugaauuauguaucccuucucuuuugg

SEQ ID NO: 145259 - RNA, 64 nt, hsa
aacuaacccuuccuuguaucugucuucccaggagagaaugaagcaaaacaggaauuugguuuuc

SEQ ID NO: 145260 - RNA, 64 nt, hsa
aaaaauccaggauccaaaauguggcguuuuucuaagaaugaaaauuauauguaagcuuuuaagc

SEQ ID NO: 145261 - RNA, 64 nt, hsa
guagaaugaaggccugcuagcacuagcguggucuagaaugaaggccugcuagcacuagcgugga

SEQ ID NO: 145262 - RNA, 64 nt, hsa
uuaauucccuggauuuauccuguuaagcuugaguagaaugaaggccugcuagcacuagcguggu

SEQ ID NO: 145263 - RNA, 64 nt, hsa
agaaagcaccaagucuuaauggaacaaagaccauagaaugaauuauuuuaucuccucccaugau

SEQ ID NO: 145264 - RNA, 64 nt, hsa
ccagucugaauagaucuuguaaauauuugugaauagaaugaauaccuuucaugccacugcagcc

SEQ ID NO: 145265 - RNA, 64 nt, hsa
aaugucccuggaacacgcauacaggcucuagucaagaaugaauuagagugaaggaaagcugugu

SEQ ID NO: 145266 - RNA, 64 nt, hsa
uuccaguccaaagcuuuauuugccaaguuuucuuagaaugaauuuuaccaauuuaugaauucuu

SEQ ID NO: 145267 - RNA, 64 nt, hsa; identical to SEQ ID NO: 145266

SEQ ID NO: 145268 - RNA, 64 nt, hsa
aaugucccuggaacaggcauacaggcucuagucaagaaugaauuagagugaaggaaagcugugu

SEQ ID NO: 145269 - RNA, 64 nt, hsa
uuccaggccaaagcguuauuugccaaguuuucuuagaaugaauuuuaccaauguaugaguucuu

SEQ ID NO: 145270 - RNA, 64 nt, hsa
aaugucucugaaacaggcauacaggcucuagucaagaaugaauuagagugaaggaaagcugugu

SEQ ID NO: 145271 - RNA, 64 nt, hsa
cacgccuagaauguauuuuaaauacuuacuaagaagaaugaaaauucuuugguuguuuuauaua

SEQ ID NO: 145272 - RNA, 64 nt, hsa
ggucagacccuugaagaaacgucacuucaaacucagaaugaaauuuucauuaauauuaaaauug

SEQ ID NO: 145273 - RNA, 64 nt, hsa
uuuuggcaauucuuccacgugggacuuguccacaagaaugaaaguagugguuuuuaaagaguua

SEQ ID NO: 145274 - RNA, 64 nt, hsa
ugggcagaggugagagagagagagagaaagagagagaaugaaugcaguugcauugauucagugc

SEQ ID NO: 145275 - RNA, 64 nt, hsa
uuacagaaaaugaaaaagaaaaugaguuacacugagaaugaauaugggaacacgucauugauag

SEQ ID NO: 145276 - RNA, 64 nt, hsa
uaggauuucuucugggaaauacagauggaaauacagaaugaauauguuuuuuugaggucggaaa

SEQ ID NO: 145277 - RNA, 64 nt, hsa
guugagcugauauauguuaagcagauauucaaucagaaugaacagguuccggugguuauuuugc

SEQ ID NO: 145278 - RNA, 64 nt, hsa
auaaacaaaauuacagacugucugaaauugaagaagaaugaacuaauaauagcauucauaacca

SEQ ID NO: 145279 - RNA, 64 nt, hsa
caaggcaagagaaguggcuuuaaccaugccagccagaaugaagcaucauggguccugaugguuu

SEQ ID NO: 145280 - RNA, 64 nt, hsa
uaggaagugguucuccuacuggaaaauaugcuacagaaugaaaguuuguaauugaaagaaaaag

SEQ ID NO: 145281 - RNA, 64 nt, hsa
guaauaacucuuccugcuauucagaauaaguaggagaaugaaaacugcagcauaucagacagca

SEQ ID NO: 145282 - RNA, 64 nt, hsa
cauguaauaaacuauucuuugaaacuuguuggguagaaugaaaauuaaagccauaaugguagaa

SEQ ID NO: 145283 - RNA, 64 nt, hsa
aaguuuuaaaaacuuucucgcuccccacgaccccagaaugaaacagcuuuaaaaauagccuuaa

SEQ ID NO: 145284 - RNA, 64 nt, hsa
gacuccugagggcuagaggacagagaaagagaauagaaugaaaugacuuugauuccugcgccuu

SEQ ID NO: 145285 - RNA, 64 nt, hsa
gcaaaaugugaaaagacacaagacucucagguauagaaugaacugagcaauuuggagaauguau

SEQ ID NO: 145286 - RNA, 64 nt, hsa
aaccgguauugacuggauugacagcuaaaguaucagaaugaaagcaagguuuuuuugauguuac

SEQ ID NO: 145287 - RNA, 64 nt, hsa
gguuuccaugccugcugggaauaggcugagcaugcaaugacaugagggccaaggcuugugggaa

SEQ ID NO: 145288 - RNA, 64 nt, hsa
aauccgagaccuguuuugcguagcuaauuaccagcaaugacaaacucccaggcucugaggccca

SEQ ID NO: 145289 - RNA, 64 nt, hsa
cauccuucaggaggaucuuagccaagaauauuugcaaugacacaugaauuuaauuuuauaaaua

SEQ ID NO: 145290 - RNA, 64 nt, hsa
cuaacguuuaauaguccgggucuacagggaagaacaaugacacagcuugagcguuacuuccucc

SEQ ID NO: 145291 - RNA, 64 nt, hsa
uuaaaauaagcuauaaucagcaacaacacaaugacaaugacaucuuccccuuaccuuagccacu

SEQ ID NO: 145292 - RNA, 64 nt, hsa
acaaauuuaaaauaagcuauaaucagcaacaacacaaugacaaugacaucuuccccuuaccuua

SEQ ID NO: 145293 - RNA, 64 nt, hsa
uccuggcuccacccuccagcauguucucacccaacaaugacaguugaguggagugggaagggaa

SEQ ID NO: 145294 - RNA, 64 nt, hsa
aauuacaaaagggaaauuccaagaaugcauaacacaaugacaacauggugagaaaagugcagua

SEQ ID NO: 145295 - RNA, 64 nt, hsa
uucuuuauuucccaauagcauguuccucauuccccaaugacaccucaccaggaucacccuuacc

SEQ ID NO: 145296 - RNA, 64 nt, hsa
auuuagcccaucgguugccaucuuuaauuauuggcaaugacaccaaagauuaucagauuugucc

SEQ ID NO: 145297 - RNA, 64 nt, hsa
ggucguaaauuauuucuacuuauccaguaaauaacaaugacaaaauaaacaccaaugacagaaa

SEQ ID NO: 145298 - RNA, 64 nt, hsa
cuuauccaguaaauaacaaugacaaaauaaacaccaaugacagaaaaauuucuacuuuacuguc

SEQ ID NO: 145299 - RNA, 63 nt, hsa
cacuucuuacauuguggcaagaaaaaaugaggaagaagcaaaagcagaaaccccugauaaacu

SEQ ID NO: 145300 - RNA, 63 nt, hsa
cacuucuuacauggcagcaagagaaaaugaggaagaagcaaaaguggaaaccccugauaagcc

SEQ ID NO: 145301 - RNA, 63 nt, hsa
guuuaaagaaauggucugcauaaccugaaugaaagaagcaaaugacuauucucugaagacaac

SEQ ID NO: 145302 - RNA, 63 nt, hsa
augcugugguggaugagguuggaguucgaaagaagaagcaagcgcuggccuggccuugaaaga

SEQ ID NO: 145303 - RNA, 63 nt, hsa
aauaggaauccggcagaagaccuucauuaauuaagaagcaaacaaaaagagagcaacccaacc

SEQ ID NO: 145304 - RNA, 63 nt, hsa
uccaaacaaugugaauuuaaaaggucacacaaaagaagcaaucgggcuccgccaccacaaaau

SEQ ID NO: 145305 - RNA, 63 nt, hsa
aauucacaguccucagaagccuauuuuuaaagcagaagcaaaaaagaaaaacaaaauaacaaa

SEQ ID NO: 145306 - RNA, 63 nt, hsa
ggaugauaugugggcaaaaucacuuaugaaaguagaagcaagaaucaguugguuugcuaccac

SEQ ID NO: 145307 - RNA, 63 nt, hsa
uucuuacauggcggcagcaagagaaaaugagaaagaagcaaaaguggaaaccccuaauaaacc

SEQ ID NO: 145308 - RNA, 63 nt, hsa
uucguacauggugguggcaagagaaaaugaagaagaagcaaaaguggaaaccccugauaaacc

SEQ ID NO: 145309 - RNA, 63 nt, hsa
uugacuguucuugacuaaauuuucaagaguuucagaagcaacaggacagaccagacguuucau

SEQ ID NO: 145310 - RNA, 63 nt, hsa
ggacuuuuucauuccuguuuuucuuggcaggagagaagcaaggccacuaaaagaggagauggu

SEQ ID NO: 145311 - RNA, 63 nt, hsa
aucaucuuugaaggacacucaaauuuauaagguagaagcaauuucccagauauaggcugaaca

SEQ ID NO: 145312 - RNA, 63 nt, hsa
uuuuaaaaaauguaauugaauaagugugaaugcagaagcaaauauugucugcccuguuaaacu

SEQ ID NO: 145313 - RNA, 63 nt, hsa
uaccugccagcacuucugcaagcugaaauuuacagaagcaaauucaccagaagggaaacaucu

SEQ ID NO: 145314 - RNA, 63 nt, hsa
gcauggcaugcacguauguaaguaaucuggggaagaagcaaagaucuguuucauucuuagccu

SEQ ID NO: 145315 - RNA, 63 nt, hsa
ggaaaacauauauauguuagcaucaaagggggcagaagcaaagaagauacagaucugcacuga

SEQ ID NO: 145316 - RNA, 63 nt, hsa
auaaaggcuucauccacgaaccauccagcgcacagaagcaagugcaaaaaugacacaagcaca

SEQ ID NO: 145317 - RNA, 63 nt, hsa
caggugagccacucacccuccugcuggccuuggagaagcaaaaagccagggugugccaggaga

SEQ ID NO: 145318 - RNA, 63 nt, hsa
ucccuuccccucugccccaguguccugcugguuagaagcaaguucaaguccuucccauacuca

SEQ ID NO: 145319 - RNA, 63 nt, hsa
ugccuggaacaaagaacugcaccuaagcagaccagaagcaaaaugucuucuucacggccugag

SEQ ID NO: 145320 - RNA, 63 nt, hsa
cagccuccagccauacagaacaaaugagaaauuagaagcaauuccaagaacgugugauggugu

SEQ ID NO: 145321 - RNA, 64 nt, hsa
uacaucaagccagcuucauucacucacuuuacuuagaacagagauauaagggccugggaugcau

SEQ ID NO: 145322 - RNA, 64 nt, hsa
agugagacacaagaucucucuuuuaccaaaguugagaacagagcugguggauuaauuaauaguc

SEQ ID NO: 145323 - RNA, 64 nt, hsa
aggcaacuuaaauaacuccugagcaguuggcacuagaacagaauacuuggaaugacaccaaagu

SEQ ID NO: 145324 - RNA, 64 nt, hsa
ugcaaagaucaugauuaacugucaagacacugguagaacagaacaagcaaaagauuaagaguuc

SEQ ID NO: 145325 - RNA, 64 nt, hsa
ugggauuucagugaggccuuuugaucuguccaggagaacagaagggaaaaaaagauacuugaaa

SEQ ID NO: 145326 - RNA, 64 nt, hsa
aacuaaaggccgaaagaaucucuugcugcugcaaagaacagauuuuauauuucuuccucuaauc

SEQ ID NO: 145327 - RNA, 64 nt, hsa
ggauuacaggugugagccacugugcccggccaaaagaacagaaauuauuuuauccugaaguaag

SEQ ID NO: 145328 - RNA, 64 nt, hsa
cgcugguguguuugccagagacccagcagggaccagaacagaugaaaauccugccaucuuggau

SEQ ID NO: 145329 - RNA, 64 nt, hsa
ccuuuuguaacuuacuguggcuuuaaacauauucagaacagaugcuugaaauaugcacuuagca

SEQ ID NO: 145330 - RNA, 64 nt, hsa
ccagggaagccugugcagaugcagucaccuggaaagaacagagauuacccuuucaccuaccuca

SEQ ID NO: 145331 - RNA, 62 nt, hsa
aauaaaauuuuuauuuauucaauaaaauaugcacagaacagaugcaaauguguuauauacaa

SEQ ID NO: 145332 - RNA, 64 nt, hsa
guuuuuugaucaguguagcucaauugugacuuaaagaacagaaucuguccuucacuguaagagc

SEQ ID NO: 145333 - RNA, 64 nt, hsa
uggcuuucaaugaguuccuauguggauuuuuaaaagaacagaacaguaaugaaauauuugaagu

SEQ ID NO: 145334 - RNA, 64 nt, hsa
uaaaagcuauaugcagaguuuuguauaaaacaauagaacagaaauuugggacauuuuucuagga

SEQ ID NO: 145335 - RNA, 64 nt, hsa
aucucacaccuccuuagcuguaagagucuggcuuagaacagaccucucugugcaauaacuugug

SEQ ID NO: 145336 - RNA, 64 nt, hsa
agcugucugagucuaaagcaccguaucuuggugcagaacagauaauuauacagagauggaaugg

SEQ ID NO: 145337 - RNA, 64 nt, hsa
ugaccagaaacagggacaaagaaauccccccuucagaacagaggcauuuaaaauggaaaagaga

SEQ ID NO: 145338 - RNA, 64 nt, hsa
cuucuuugcagagccuuuuaccccugcacaguuuagaacagagggaccaaauugcuucuaggag

SEQ ID NO: 145339 - RNA, 64 nt, hsa
uaaaauuccaugauuuuguauuuaauucuuccugagaacagaagaggggaaagcaagagaggac

SEQ ID NO: 145340 - RNA, 64 nt, hsa
gguaaaaacacuauuaccuguuucuagucacuuuagaacagauggcacuaaaaaaauuuuuuuu

SEQ ID NO: 145341 - RNA, 64 nt, hsa
agaauaauuauugcauaguagaauuuauuacuccagaacagaaagaccuuacuucauuucaaau

SEQ ID NO: 145342 - RNA, 64 nt, hsa
caaauugacucuucaaacccucgguuuuugccacagaacagagaucuuucaggggaaaguagau

SEQ ID NO: 145343 - RNA, 64 nt, hsa
agagaauucagcagcucaacaguaaugaaagugaagaacagaguccauuuuccuuccuggggcc

SEQ ID NO: 145344 - RNA, 64 nt, hsa
uugccagucucuccagugugggcaccagccggccagaacagaugcgagcaguccaugacucugg

SEQ ID NO: 145345 - RNA, 64 nt, hsa
gcuagguguggcugggggccaggagagcaggaacagaacagagaaaugcccuuggaagaagugg

SEQ ID NO: 145346 - RNA, 64 nt, hsa
acacuauuuuacuuuuuuaaaaucauaaaacggcagaacagauuugguuaguuuagaagaaaag

SEQ ID NO: 145347 - RNA, 64 nt, hsa
uacagguuauauguggcauagcauaaccacaguaagaacagaacagauauucagcagaaaacuu

SEQ ID NO: 145348 - RNA, 64 nt, hsa
guuauauguggcauagcauaaccacaguaagaacagaacagauauucagcagaaaacuuuuuau

SEQ ID NO: 145349 - RNA, 64 nt, hsa
ggcagaaguguggcaaaugcaucaggaaccgguuagaacagaacagagaaacccugacugucua

SEQ ID NO: 145350 - RNA, 64 nt, hsa
aaguguggcaaaugcaucaggaaccgguuagaacagaacagagaaacccugacugucuacagau

SEQ ID NO: 145351 - RNA, 64 nt, hsa
uccugauuggaaauagaagacauuuccgguugagagaacagauucguuggaagcuuaacuuuug

SEQ ID NO: 145352 - RNA, 64 nt, hsa
gugcuaacugcuuuuugucucgguugcuauuccaagaacagaaggaggaaguuggccaauuaca

SEQ ID NO: 145353 - RNA, 64 nt, hsa
ugguacugguaccaaaacagagauauagaucaauagaacagaacagagcccucagaaauaaugc

SEQ ID NO: 145354 - RNA, 64 nt, hsa
cugguaccaaaacagagauauagaucaauagaacagaacagagcccucagaaauaaugccacau

SEQ ID NO: 145355 - RNA, 64 nt, hsa
cuuuauuccuguaaauauuucugugaaaacuaggagaacagagaugagauuugacaaaaaaaaa

SEQ ID NO: 145356 - RNA, 64 nt, hsa
gucuccugugggcuuuuuaccaccacugugcaggagaacagacagaggaaaugugucucccucc

SEQ ID NO: 145357 - RNA, 64 nt, hsa
gccaaaacccuuacucacaugaggauggaggaacagaacagaggacuugggaaaagucucaacu

SEQ ID NO: 145358 - RNA, 64 nt, hsa
uauguacuuagaauagguuuugaaugggagagguagaacagagagagaauuaagaagggaucug

SEQ ID NO: 145359 - RNA, 64 nt, hsa
uuccaggggggugaguucaugccucuccuguauuuuccagcaagugggguauguguggugguuu

SEQ ID NO: 145360 - RNA, 64 nt, hsa
guagagcagaagggagggcuugggacuccugucuuuccagcaugcccuggggugcaguggucag

SEQ ID NO: 145361 - RNA, 64 nt, hsa
ccagaacgauaugucuguccaucuuucuccuuucuuccagcacacacagcuaagagauaagaag

SEQ ID NO: 145362 - RNA, 64 nt, hsa
ccccuguguuguuacaggcugugcagugcaacaauuccagcaaaaauacccuauccccgcacuu

SEQ ID NO: 145363 - RNA, 64 nt, hsa
auaauccguagaacagagagacuguagaaaaauauuccagcacuugaguuguguguggcagcag

SEQ ID NO: 145364 - RNA, 64 nt, hsa
caauuuaaggccugucuguaauggcaucugaauguuccagcagccuaacugugcucugcuccag

SEQ ID NO: 145365 - RNA, 64 nt, hsa
agauuauuagauuccagcaaucugaaaucuauuauuccagcagucugaaaccuaaauauguuau

SEQ ID NO: 145366 - RNA, 64 nt, hsa
gugugucagucaucuucaaaggcagauuauuagauuccagcaaucugaaaucuauuauuccagc

SEQ ID NO: 145367 - RNA, 64 nt, hsa
aacagcugggguuccaggcaugguuuaggcccuguuccagcaauaagaaccaaucugcuguaca

SEQ ID NO: 145368 - RNA, 64 nt, hsa
gggacagugucuucguuugauuacugccaguuauuuccagcaugcuaaaucccuacccacguuc

SEQ ID NO: 145369 - RNA, 64 nt, hsa
cuucagggugggguggucucugauagguagcauuuuccagcacuuugcaaggaauguuuuguag

SEQ ID NO: 145370 - RNA, 64 nt, hsa
uugcucacagcugugcucugagugccuagcggaguuccagcaaacaaaauggacucaagagaga

SEQ ID NO: 145371 - RNA, 64 nt, hsa
uccuucccuccguggcguagggagcacuguuucuuuccagcaagccuguucagguuuggccagg

SEQ ID NO: 145372 - RNA, 64 nt, hsa
acaccuucuugcagagugauuuugaccaaugccuuuccagcaccuuccccugguuaugacaggg

SEQ ID NO: 145373 - RNA, 64 nt, hsa
acacacacaaaaaaaaauaccuguagaaauauuauuccagcauagcaggaaaacaaacaaaagu

SEQ ID NO: 145374 - RNA, 64 nt, hsa
ccucccuacagccggggguguggcccagagaagcuuccagcacagcccucuacccagaacaucc

SEQ ID NO: 145375 - RNA, 64 nt, hsa
gucuuggaacucccuggcauugggaacagagcauuuccagcauuuguuguuguuuuacucaccu

SEQ ID NO: 145376 - RNA, 64 nt, hsa
gaggugcugcuuuucugccccaccugccggcugguuccagcagcgcuggggcccagcugggggg

SEQ ID NO: 145377 - RNA, 64 nt, hsa
aacuguuagugacugguuuccuguuagauaaggguuccagcagccuggggcaguaugucucagc

SEQ ID NO: 145378 - RNA, 64 nt, hsa
guggaaguaaagacuuuggagcuagagaagccuuuuccagcaaugauuauugacuucaccacac

SEQ ID NO: 145379 - RNA, 64 nt, hsa
guggcccagugcgugaggucagucaacagccaaauuccagcagcaaaauacauuuucaucaaua

SEQ ID NO: 145380 - RNA, 64 nt, hsa
agaagucaccacggaagguuguuuaagaugcagauuccagcauccccuccucagagaucaauuu

SEQ ID NO: 145381 - RNA, 64 nt, hsa
uuuccacuuuaggccaauuuuucucucuuagaucuuccagcagccccagggguaggaagcuccu

SEQ ID NO: 145382 - RNA, 64 nt, hsa
acgggcacgugcccuucaccccauuccacccuuguuccagcaagacugggauggguacaacuga

SEQ ID NO: 145383 - RNA, 64 nt, hsa
aaaucuuuucuccucucccguuguaccgcauucuuuccagcauugugcuuuuucccugggcuua

SEQ ID NO: 145384 - RNA, 64 nt, hsa
cauuuagccuguagauuuauuuccauuuuccaaauuccagcacacagagaucccagccccuaug

SEQ ID NO: 145385 - RNA, 64 nt, hsa
ugugaagguagugagugccccaucacuggagguauuccagcagagucuaggcagucgucugcca

SEQ ID NO: 145386 - RNA, 64 nt, hsa
caauuggguucauuuaugcccuauacaaagggcauuccagcagcugaaacucuucaauguuuga

SEQ ID NO: 145387 - RNA, 64 nt, hsa
cuuuuggauggaagauaagauagggaagauuaaguuccagcauuucugacuuguuauuuugagu

SEQ ID NO: 145388 - RNA, 64 nt, hsa
aggcaaucaaugauagguuuauaaucuuagauuauuccagcaaaguguggauugcauuguuagg

SEQ ID NO: 145389 - RNA, 64 nt, hsa
aggcaucuugaaucccaucuauaagaacacaaucuuccagcauacguuugcuuuuucagaaacu

SEQ ID NO: 145390 - RNA, 64 nt, hsa
uaaaaucaaaaucugagucugagacauacacacuuuccagcaagauggguccugacucaaaacc

SEQ ID NO: 145391 - RNA, 64 nt, hsa
gaacgugucucucuccaagucugugacgcugacuuuccagcacgugaaggugggucacagguau

SEQ ID NO: 145392 - RNA, 64 nt, hsa
uuucucauuugauuuugcuugugcagaaaauaguuuccagcacauggauugaucugagagagaa

SEQ ID NO: 145393 - RNA, 64 nt, hsa
ccaaacggaagaauagccagcggagcauggacuguuccagcacgggccagauggccagcugucg

SEQ ID NO: 145394 - RNA, 64 nt, hsa
cucacucagcacgcucacuaacccagcaugccacuuccagcaggcaugcaguccuggcccagcu

SEQ ID NO: 145395 - RNA, 64 nt, hsa
cuuggguucuugcaagagcgcguggggacaguucuuccagcaggcacugguuuuguugccccag

SEQ ID NO: 145396 - RNA, 64 nt, hsa
gcucaaccuccucaucgccauguucaacuacaccuuccagcaggugcaggagcacacggaccag

SEQ ID NO: 145397 - RNA, 64 nt, hsa
cuaccugaaggagaacuaccuccagaaccgacaguuccagcaaaagcagcggcccgagcagaag

SEQ ID NO: 145398 - RNA, 64 nt, hsa
uuaaguugucuuuguagaaaaugaagagccuuucuuccagcaaaaaucccugcuguaugcaaua

SEQ ID NO: 145399 - RNA, 64 nt, hsa
ggaucuagggcagacacacaaccuccuccuccucuuccagcaaggaacgcaccgaaaagucaca

SEQ ID NO: 145400 - RNA, 64 nt, hsa
aaccguuuuucaagaaaacuggaaaucuggauuuucagcgaacaugccugauuuuaaaagguug

SEQ ID NO: 145401 - RNA, 64 nt, hsa
ccccaguugaaaucuuugcaaaggucgguucuauucagcgaacagcacuauagcaaaagaagau

SEQ ID NO: 145402 - RNA, 64 nt, hsa
caacugccuugggugaaaaucagaagcaagcaacucagcgaaaaacucagaagguuuggguaca

SEQ ID NO: 145403 - RNA, 64 nt, hsa
ccuuuacaauuuccuaugggugucagaaguacucucagcgaaaacugauggcuaaaacaguauc

SEQ ID NO: 145404 - RNA, 64 nt, hsa
gagcaagaggaggccguugauucacuucacgcuuucagcgaaugacaaaaucaucuuugugaag

SEQ ID NO: 145405 - RNA, 64 nt, hsa
cccuuucuugccaguacauccaaguuuaaaauuaucagcgaaaugguccauguuuuuccaauua

SEQ ID NO: 145406 - RNA, 64 nt, hsa
gcauuuaaagggacucaaggugccugccacuuccucagcgaagaagucuguguuccuccccguc

SEQ ID NO: 145407 - RNA, 64 nt, hsa
gggccaagcaccuagccucgcucuuggcagguacucagcgaaugaaugcuguauauguugggug

SEQ ID NO: 145408 - RNA, 64 nt, hsa
cuauacuaagacuuggaaauuauucucuccagugucagcgaauccagaaggguaucagauuaaa

SEQ ID NO: 145409 - RNA, 64 nt, hsa
caggauaacagcuugcacccuccucagaauguuuucagcgaaagagugggguggcuguucucug

SEQ ID NO: 145410 - RNA, 64 nt, hsa
aaaaagaacacacauuuagagucucucuuccuccucagcgaaccacuaggcccccuuuuuaaaa

SEQ ID NO: 145411 - RNA, 64 nt, hsa
ucauaagcucuguuucccccucuccccaaagccuucagcgaacgugaaaugugcgcuaaacggg

SEQ ID NO: 145412 - RNA, 64 nt, hsa
ccauuuccuaccccugccauuucccaccccugcuucagcgaaagggacucucuaacagggcagu

SEQ ID NO: 145413 - RNA, 64 nt, hsa
guauauagagugguuucagauuguaaauagcgcgucagcgaacuugucuaaaucauauauuuuu

SEQ ID NO: 145414 - RNA, 64 nt, hsa
caucugcagugcuuaaguacuuagcaaaaucuauucagcgaaaccacaccacuuaguuucuccc

SEQ ID NO: 145415 - RNA, 64 nt, hsa
agacacuuacuuauuauuaaaaccccaaaugcaaucagcgaaacauauuuuuacuauucuugga

SEQ ID NO: 145416 - RNA, 64 nt, hsa
cuguuccuuuauguaaacauguaaagaaaauaagucagcgaaaaaaaugaaacccaaaacucuc

SEQ ID NO: 145417 - RNA, 64 nt, hsa
agcauacccagcucggaccuccuaggacagagacucagcgaacccuugcugggaaccgcugagc

SEQ ID NO: 145418 - RNA, 64 nt, hsa
ccacagaauauagcacguugugcaaacugucgauucagcgaaacuuaaaaaagacaagaaacua

SEQ ID NO: 145419 - RNA, 64 nt, hsa
guaguggcuugaugcagggaacccugggggacuuucagcgaagagcugugcucuuuucugacua

SEQ ID NO: 145420 - RNA, 64 nt, hsa
uuguaggugacacaugcucugcccucugaggcagucagcgaaggcaaauggucugacuucuuua

SEQ ID NO: 145421 - RNA, 64 nt, hsa
gaaaaggaggcucagcacugucucaggcuggaggucagcgaaccucgugggcuguaggaaagca

SEQ ID NO: 145422 - RNA, 64 nt, hsa
acugaacgcaucugggcuucgugguuuccuguuuucagcgaaauuuacucugagcucccaguuc

SEQ ID NO: 145423 - RNA, 64 nt, hsa
ggcaaguuuuuuucuucaccuucaauaugagaauucagcgaacuugaaagaaaaaucaucugug

SEQ ID NO: 145424 - RNA, 64 nt, hsa
ugguuccugcuguuuauucucuggucaugccuuuucagcgaaagccugucuccucacccacccc

SEQ ID NO: 145425 - RNA, 64 nt, hsa
gcuggcuucuguagccaccugucccuucuauuuuucagcgaaggucaguguauuuaguguaauu

SEQ ID NO: 145426 - RNA, 64 nt, hsa
uacaagcugacauucaaccaagguggacagccuuucagcgaaguaggagaagugaaagacuucc

SEQ ID NO: 145427 - RNA, 64 nt, hsa
ggggguggcugcucuuccuggcaggccugggccaucagcgaacugggccccgugaggagggcgg

SEQ ID NO: 145428 - RNA, 64 nt, hsa
cagcugugccccucccccaggggcgugaggcugaucagcgaagacgggaggaaagauuucgauu

SEQ ID NO: 145429 - RNA, 64 nt, hsa
ccacacacuugcacaccccagcucugagguggcuucagcgaaagucugcuaaccccuuacauuc

SEQ ID NO: 145430 - RNA, 64 nt, hsa
ccucagccuuaaacuuuuguuccuacucccacccucagcgaacugggcagcacggggaggguuu

SEQ ID NO: 145431 - RNA, 64 nt, hsa
gguaagucuguuguucugauuaaucugcauucauucagcgaaugcucaagacaagccaggcaug

SEQ ID NO: 145432 - RNA, 64 nt, hsa
gcugggaaggggugaaguguguggcugggcggauucagcgaagucucaugggaagcaggaccua

SEQ ID NO: 145433 - RNA, 64 nt, hsa
guccaguucaggcuucuagacauuuuacucaugcucagcgaaggcugguuccugguccccuggg

SEQ ID NO: 145434 - RNA, 64 nt, hsa
ugccuuuuuguccuguccucagcucuccguguggucagcgaaaccauuguuuucuguuaggacu

SEQ ID NO: 145435 - RNA, 64 nt, hsa
uuguggguggggagcaagggaagagagaaacucuucagcgaauccuucuaguacuaguugagag

SEQ ID NO: 145436 - RNA, 64 nt, hsa
uacaacacccacguuguuuauuucaaagaacuuuucagcgaagggagaggagcuuucagaaaaa

SEQ ID NO: 145437 - RNA, 64 nt, hsa
gaaggcuggcacaaggagaaaaaaaaagcaagcaucagcgaauaguauagugucucaggguccg

SEQ ID NO: 145438 - RNA, 52 nt, hsa; identical to SEQ ID NO: 119717

SEQ ID NO: 145439 - RNA, 64 nt, hsa; identical to SEQ ID NO: 119718

SEQ ID NO: 145440 - RNA, 64 nt, hsa; identical to SEQ ID NO: 119719

SEQ ID NO: 145441 - RNA, 64 nt, hsa; identical to SEQ ID NO: 119720

SEQ ID NO: 145442 - RNA, 64 nt, hsa; identical to SEQ ID NO: 119721

SEQ ID NO: 145443 - RNA, 64 nt, hsa; identical to SEQ ID NO: 119722

SEQ ID NO: 145444 - RNA, 64 nt, hsa; identical to SEQ ID NO: 119723

SEQ ID NO: 145445 - RNA, 64 nt, hsa; identical to SEQ ID NO: 119724

SEQ ID NO: 145446 - RNA, 64 nt, hsa
guggguaaccagugccuucccuguaacgguaaugcugcagaacugcaaccuuuuguaccuuucu

SEQ ID NO: 145447 - RNA, 64 nt, hsa
cuguuagcuggcagggucaggcuuagcuccuugacugcagaagaccaagaaccuguuccccaag

SEQ ID NO: 145448 - RNA, 64 nt, hsa
ucugcaggaagccacuaugccagaaagcugcugacugcagaacuaggcucccucugccacgguc

SEQ ID NO: 145449 - RNA, 64 nt, hsa
gucagacuuggcaucuaucucaguuaggauccugcugcagaaaacaagagccacuuguagcugg

SEQ ID NO: 145450 - RNA, 64 nt, hsa
aaaaaaacugaguaugaagaaaaacacuuuacuacugcagaaggaagaaagaauauaauaugac

SEQ ID NO: 145451 - RNA, 64 nt, hsa
acaucgaaaccagggagaaagugauccuugcucccugcagaacuucuucaguaugauguucucc

SEQ ID NO: 145452 - RNA, 64 nt, hsa
uuuuuuugucguguaagaaggaugcuggucagagcugcagaaaauaugaggcaauuaaaagucu

SEQ ID NO: 145453 - RNA, 64 nt, hsa
guuagaaauauauuggcagccaagacucugaacucugcagaaacauuuguuucacccagacuuc

SEQ ID NO: 145454 - RNA, 64 nt, hsa
cgauuuuuacugagaagagauaugccuguuguuacugcagaaccugaaccguaaguaggaugac

SEQ ID NO: 145455 - RNA, 64 nt, hsa
uuaagcauaaaaagaaagggaaaaagcagaaacacugcagaagacacaaacaaacaaagaagag

SEQ ID NO: 145456 - RNA, 64 nt, hsa
uuaggagaaaaugacucuuucguccagaagagcucugcagaaccagggcucccguuuaucuugu

SEQ ID NO: 145457 - RNA, 64 nt, hsa
ugcuauauaauucagcaaguaccaacuuguguagcugcagaauaaccaaguggcuauccaguca

SEQ ID NO: 145458 - RNA, 64 nt, hsa
ccuguggucugugauacccauccugcuugauguucugcagaauggcacuugacugcugggcaug

SEQ ID NO: 145459 - RNA, 64 nt, hsa
augcaugucaucuaugcaagcguuuccauugccacugcagaaugaagccagugcacaugguauu

SEQ ID NO: 145460 - RNA, 64 nt, hsa
gccuuuuagagauagguucuugauauucagacaucugcagaaauguucugguucccaaagucau

SEQ ID NO: 145461 - RNA, 64 nt, hsa
caauggcuaauuagaauguguuauuugauuucugcugcagaaggcagugugauuguaacaaaaa

SEQ ID NO: 145462 - RNA, 64 nt, hsa
aagggauaucuuuuuuauauuuuuuuccaugaaucugcagaaaauuacugagcuguuguuaccc

SEQ ID NO: 145463 - RNA, 64 nt, hsa
aagggucuagggagagacccuuguuugauuuuagcugcagaacguauugguccagcuugcucuu

SEQ ID NO: 145464 - RNA, 64 nt, hsa
cagguggaaaaacaucugaaagccacguuccuuacugcagaauagcauauauaucgcuuaaucu

SEQ ID NO: 145465 - RNA, 64 nt, hsa
aaugucguaggugauagaaaacucgccuacuccacugcagaacuugcagaaugcgugguguuaa

SEQ ID NO: 145466 - RNA, 64 nt, hsa
agucagagauaauugccuauacuaagaaucuauacugcagaauauaguguaucaaaaacuuuuu

SEQ ID NO: 145467 - RNA, 64 nt, hsa
ugcagaaaagaaacauguuaaaaucauggcacaccugcagaauuucagaugacaguguggucag

SEQ ID NO: 145468 - RNA, 64 nt, hsa
gauguaccaugaacuaacaauucuuugaaaggaccugcagaagcauuuuuaauaccucauucug

SEQ ID NO: 145469 - RNA, 64 nt, hsa
auuauguuaagagucuuuaacccauuugcauuaucugcagaagagaaacucaugucauguuuau

SEQ ID NO: 145470 - RNA, 64 nt, hsa
uaaaggacuggggaggcgugucuugaaaaagcaacugcagaaauuccuuaugaugauugugugc

SEQ ID NO: 145471 - RNA, 64 nt, hsa
ccccaucucucagaugcacgggaacaagcagcaccugcagaaggacuucuuccuguacaacgcc

SEQ ID NO: 145472 - RNA, 64 nt, hsa
agcgagugcuccugcuuaccuugcucuaggcugucugcagaagcaccugccgguggcacucagc

SEQ ID NO: 145473 - RNA, 64 nt, hsa
aggucacguggaggguacguucauaugaaacaaucugcagaaagugggguaagaaagggcacau

SEQ ID NO: 145474 - RNA, 64 nt, hsa
uugugacaguguacaguggcagcuguuggccacgcugcagaaaugagcuggagcucauggguuu

SEQ ID NO: 145475 - RNA, 64 nt, hsa
acaccuggucuuuucuagaaaucccugcuuggagcugcagaaggguugccuucuguaggucgga

SEQ ID NO: 145476 - RNA, 64 nt, hsa
ccagguaagccuucuaugcauccacaccaaaauccugcagaauguaaguaagcucugcuuuaua

SEQ ID NO: 145477 - RNA, 64 nt, hsa
ggcgccaugcugcagacuccagugggccugguuucugcagaauguccaugguggccgcugcaga

SEQ ID NO: 145478 - RNA, 64 nt, hsa
ggagcaggucuggagguuuguggaacccaguccccugcagaaucuguaaaaccuaauaaaucau

SEQ ID NO: 145479 - RNA, 64 nt, hsa
gcugcugcagaacgcacaggugcaccaguugguccugcagaacuggaugcucaaggcccugccc

SEQ ID NO: 145480 - RNA, 64 nt, hsa
cuucuucccugcagacaugguggagcugcugcugcugcagaacgcacaggugcaccaguugguc

SEQ ID NO: 145481 - RNA, 64 nt, hsa
ccacagacaucuuacacuugcucgacacugccaccugcagaagccuggcgggcucuggucacca

SEQ ID NO: 145482 - RNA, 64 nt, hsa
ccuggacuguguggcugaagggggaccugcagcacugcagaaaugccucugcguggugccauga

SEQ ID NO: 145483 - RNA, 58 nt, hsa
ucuuuuuuuuuuucugaaaaaaggaaaaagcacacagcacacaauuucaagccauuuu

SEQ ID NO: 145484 - RNA, 58 nt, hsa
uuuuuucugaaaaaaggaaaaagcacacagcacacaauuucaagccauuuucagauca

SEQ ID NO: 145485 - RNA, 58 nt, hsa
agagaaucagacuggccugaggugaaggagcacacagcccugagggcuuggaacccug

SEQ ID NO: 145486 - RNA, 58 nt, hsa
ucugugcuuaaccagaauccagcaagucagcacacaagugauuuuauuguuauuuugu

SEQ ID NO: 145487 - RNA, 58 nt, hsa
auggcggggcuagggaagcagagagcagagcacacacuggcucaagcagcagagguaa

SEQ ID NO: 145488 - RNA, 58 nt, hsa
ugcugcuccaagccugugaggggcgaacagcacacaaggcugcccgucuugggaucac

SEQ ID NO: 145489 - RNA, 58 nt, hsa
uguccagccacugcccuuuaacaugcccagcacacaugggaggccuguggcccugugu

SEQ ID NO: 145490 - RNA, 58 nt, hsa
ugaacccugcuugauguaaaauggaaauagcacacaggcagauggcccuggguuugga

SEQ ID NO: 145491 - RNA, 58 nt, hsa
aggaacccagggccagcuggaaguguggagcacacaugcuguggagcacacaugcugu

SEQ ID NO: 145492 - RNA, 58 nt, hsa
cuggaaguguggagcacacaugcuguggagcacacaugcuguggagauugcagugugu

SEQ ID NO: 145493 - RNA, 58 nt, hsa
gccucaaaacacagcacacacacacacgagcacacacacacacacacacacgaacaca

SEQ ID NO: 145494 - RNA, 58 nt, hsa
ucaaagcccacguaaagccucaaaacacagcacacacacacacgagcacacacacaca

SEQ ID NO: 145495 - RNA, 58 nt, hsa
uuuucuccucuugguuuucauuugcucaagcacacaaaagggacuuuuguuuacucua

SEQ ID NO: 145496 - RNA, 58 nt, hsa
cugggaggagucuccaagccaugugcacagcacacacgugcagugcacacaaagaaau

SEQ ID NO: 145497 - RNA, 58 nt, hsa
agcuuggucacaacacaacuguguccugagcacacaagauuccaucagcccugaagga

SEQ ID NO: 145498 - RNA, 58 nt, hsa
aauccugacaugcucccuccaauuuaaaagcacacacacacacacacacacacacaca

SEQ ID NO: 145499 - RNA, 58 nt, hsa
ccuguauucucaugauuuucucucaggaagcacacacugugaauggcagacuuuucau

SEQ ID NO: 145500 - RNA, 58 nt, hsa
gaguaggaucuuguuuuguuuuaucaccagcacacagauugcuauaaacuguuacuuu

SEQ ID NO: 145501 - RNA, 58 nt, hsa
gauaauuagcugauauucaugguuguuuagcacacaguucaggaccuuugagaucaug

SEQ ID NO: 145502 - RNA, 58 nt, hsa
uccuuuguuacacacucaagaauuugucagcacacaauuaauugcagccauaguaccu

SEQ ID NO: 145503 - RNA, 58 nt, hsa
agggccugcucuuuccauuguggaucacagcacacacauacauacacccuccaccucc

SEQ ID NO: 145504 - RNA, 58 nt, hsa
gccccuuagcagggugagcuguuaaaacagcacacaucucucauccccucuuccuuua

SEQ ID NO: 145505 - RNA, 58 nt, hsa
uucauuuuuuggcacuaggucauuaaguagcacacagucugaaugcccuuuucuggag

SEQ ID NO: 145506 - RNA, 58 nt, hsa
caagcuggcuguguacaggaaaauuggaagcacacaguggacugugccucuuaaagau

SEQ ID NO: 145507 - RNA, 58 nt, hsa
auauauauauauauauauaugguaaacaagcacacacaauuuuauccaaugcaaacaa

SEQ ID NO: 145508 - RNA, 58 nt, hsa
uuccucuacgacccgaccucucuauguaagcacacaugcgcacacacacuugcauuca

SEQ ID NO: 145509 - RNA, 58 nt, hsa
ggcaaaaacuguacuguguuucgcauuaagcacacacaucuggcccugacuucuggag

SEQ ID NO: 145510 - RNA, 58 nt, hsa
aaggugccucauagcauagccagcauucagcacacacaaaccuacugcccacauuugg

SEQ ID NO: 145511 - RNA, 58 nt, hsa
cacaugcacacaggugcacagaccacacagcacacacaagugcacagagcacacugca

SEQ ID NO: 145512 - RNA, 58 nt, hsa
cgcuugcacacaugcacacagaccacauagcacacaugugcacugaccacaccuguau

SEQ ID NO: 145513 - RNA, 58 nt, hsa
aacuguguguuuccaacaucaugguagcagcacacacuuccaaagcucagccagggac

SEQ ID NO: 145514 - RNA, 58 nt, hsa
aauaugugaaauauuaugaucugaacuuagcacacaugaagcaacauuucuuugcuac

SEQ ID NO: 145515 - RNA, 64 nt, hsa
ucccagcacuuugggaggccgaggugggcagaucacuugagaucaggaccagccuggucaagau

SEQ ID NO: 145516 - RNA, 64 nt, hsa
gacuggaaaaauaggccuacuaaagaugaaucacacuugagauguuucuuacucacucugcaca

SEQ ID NO: 145517 - RNA, 64 nt, hsa
aaauucacuugaugcucuuuuuauuuuacaagagacuugagaaaugucgguuguuccuaauggc

SEQ ID NO: 145518 - RNA, 64 nt, hsa
cagagugagacccugucuccaaagagaaagagaaacuugagaaggcuugugcccaaagcuugaa

SEQ ID NO: 145519 - RNA, 64 nt, hsa
cauaugagaggguauagggagguguuuauaaaacacuugagaacuuuuuuccuuaauaucagaa

SEQ ID NO: 145520 - RNA, 64 nt, hsa
aauuugagcucguauuuaccccugcugauaagugacuugagaguucccgguuuuuuccucuugu

SEQ ID NO: 145521 - RNA, 64 nt, hsa
uggcuaaguaauagaggaccauuuugguuuuuguacuugagaauauuuuuggugaauuacuuug

SEQ ID NO: 145522 - RNA, 64 nt, hsa
aaaauucccuucuguuucuuacaugggaucaaauacuugagauuaguacuucagaguacuggcc

SEQ ID NO: 145523 - RNA, 64 nt, hsa
cuucugcccaucugagauugagggagcaucguccacuugagaucagggaugggguggagaaugg

SEQ ID NO: 145524 - RNA, 64 nt, hsa
ggcucuuguuuuguaaaccaaaugauuaaucuucacuugagaaagcaguuucuaggaaauguuu

SEQ ID NO: 145525 - RNA, 64 nt, hsa
cagucauucuuugauagucaacucuuaaauggagacuugagaugcuuaaauauuguacuacugu

SEQ ID NO: 145526 - RNA, 64 nt, hsa
aaauaaaaauguacuuuggauuauuuauuguugaacuugagagauagaaauaacaucagauaua

SEQ ID NO: 145527 - RNA, 64 nt, hsa
uggguggaggcagccagggcuuaccuguacacugacuugagaccaguugaauaaaagugcacac

SEQ ID NO: 145528 - RNA, 64 nt, hsa
uucgugcccccccuucccccuuuuuugucccccaacuugagauguaugaaggcuuuuggucucc

SEQ ID NO: 145529 - RNA, 64 nt, hsa
uucauuguaucacauagaaauauggccaggaaggacuugagaagacaguuugauccauugcuuu

SEQ ID NO: 145530 - RNA, 64 nt, hsa
gccauaacuuuauuuguuagauacacugucagaaacuugagaucuuuuggccuaugauaauacc

SEQ ID NO: 145531 - RNA, 64 nt, hsa
uggaagauucuguuuuccuguggggaaaaugcucacuugagauuuugcagggacccgggucugu

SEQ ID NO: 145532 - RNA, 64 nt, hsa
uccucugggaccagaugugccuuccacaguugaaacuugagaagcagagcucgccaccuucugg

SEQ ID NO: 145533 - RNA, 64 nt, hsa
ggcaggccccuucccucucuuuccccagacaccuacuugagacucaccaauuucuggccuguuc

SEQ ID NO: 145534 - RNA, 64 nt, hsa
cuggccuguucaggagccucagauaaguauuuguacuugagaccaccucacacaaucuguaugg

SEQ ID NO: 145535 - RNA, 64 nt, hsa
cuuuuuuuccccuagauuaaggauacuuuccuugacuugagacuuguggucuucaggaaaacua

SEQ ID NO: 145536 - RNA, 64 nt, hsa
auuuacaguauugggcagcaauucuggauucuagacuugagaccacagaaucaaccauuucaug

SEQ ID NO: 145537 - RNA, 64 nt, hsa
gaucucuguucuuucauacuacauuugaacagggcaaaaugaacuaacugccauguaggcuaag

SEQ ID NO: 145538 - RNA, 64 nt, hsa
accuuucuggcuuuuaagccaauauaaugggcugcaaaaugaagacaccagaguguaugcauac

SEQ ID NO: 145539 - RNA, 64 nt, hsa
guaacaaaucauuauuaucuauuuuuaaaagcuucaaaaugaugggauaugaucauagauuuua

SEQ ID NO: 145540 - RNA, 64 nt, hsa
cuaugaucacaucacuguacuccagccugggugacaaaaugagacauugucucuaaaauacaua

SEQ ID NO: 145541 - RNA, 64 nt, hsa
aaacugaguugaauagagaagugugacccugugacaaaaugauacugugagaaauggggcauuu

SEQ ID NO: 145542 - RNA, 64 nt, hsa
ccuagaaacucacccgugcauauguugaccuuugcaaaaugaccuggugacauggcaagucagu

SEQ ID NO: 145543 - RNA, 64 nt, hsa
cuaugauuuuaccacugcacuccagcuugggcaacaaaaugagacccugucucaaaaaaaaaaa

SEQ ID NO: 145544 - RNA, 64 nt, hsa
auucaaauaguccugguucauucccagaagggcacaaaaugaaugaauaaauaaauaaaugaau

SEQ ID NO: 145545 - RNA, 64 nt, hsa
uuuuuuucuuuuuuaauguuaugauaauguacuucaaaaugauggaaaucucaacaguaugagu

SEQ ID NO: 145546 - RNA, 64 nt, hsa
gugcuugaaugagaaaagccuccuggugcaucuucaaaaugaguccuaaagaacauacugagua

SEQ ID NO: 145547 - RNA, 64 nt, hsa
auucgcuccuaagggaggcucugaggggaugcaacaaaaugauccuuaugauguccaacaagga

SEQ ID NO: 145548 - RNA, 64 nt, hsa
cacauacacgguauucccaagagugguggcagcucaaaaugauauguuugaguagacgaacagc

SEQ ID NO: 145549 - RNA, 64 nt, hsa
cccagcagggcugcuagcuugcuuucugcauuuucaaaaugauaauuuacaauggaaggacaag

SEQ ID NO: 145550 - RNA, 64 nt, hsa
gguagaaaucuauucacaauucagcuucuaugaccaaaaugaguuguaaauucucuggugcaag

SEQ ID NO: 145551 - RNA, 64 nt, hsa
uaagcaaaaauggcuaagauugcucuaaaauuugcaaaaugaggaguggauugcaaauaauuga

SEQ ID NO: 145552 - RNA, 64 nt, hsa
auccugucauucucuggcucuucuuuuuucacaucaaaaugaugcuguuggacuuagaggcuuc

SEQ ID NO: 145553 - RNA, 64 nt, hsa
aguuuuuguaguaaaggcgucacaugcaaacaaacaaaaugaaugaaacagucaaaugguuugc

SEQ ID NO: 145554 - RNA, 64 nt, hsa
uaaaaggcuucacuuuugacugagggcagcuuugcaaaaugagacuuucuaaaucaaaccaggu

SEQ ID NO: 145555 - RNA, 64 nt, hsa
uucacgagaacaaacuuuguaaaucuuccauaagcaaaaugacagcuagugcuugggaucguac

SEQ ID NO: 145556 - RNA, 64 nt, hsa
auagccuauuuaaaauuaucuucuuccccaauaacaaaaugauucuaaaccucacauauauuuu

SEQ ID NO: 145557 - RNA, 64 nt, hsa
guaaucaaucuaaauaauagacuuuuuuuacaggcaaaaugaaagaggaggaagucuggguuuu

SEQ ID NO: 145558 - RNA, 64 nt, hsa
gaaugaggagugaggcuuuuuauuagaaaaauuacaaaaugagucccggaaggucaguaagugc

SEQ ID NO: 145559 - RNA, 64 nt, hsa
agacaauagaauugucuuuacaauaaaggacuuccaaaaugacagaugagaaacuguauauuaa

SEQ ID NO: 145560 - RNA, 64 nt, hsa
aaagucaaaaaguguaaaauggaaaauaagagaucaaaaugaauauagcauaggaauaaagauu

SEQ ID NO: 145561 - RNA, 64 nt, hsa
guaaagccaaccuuuuuuuuaaggcugagauucccaaaaugagaauacuacuuuauaccauuug

SEQ ID NO: 145562 - RNA, 64 nt, hsa
uugaaaaagccaaaguguacgguagaaauuucuacaaaaugaauauuaucaagaguuucaugug

SEQ ID NO: 145563 - RNA, 64 nt, hsa
ugguuugcuuaaaauuaacuuauuuuguagaagacaaaaugaauugcacuucacuuaaugugug

SEQ ID NO: 145564 - RNA, 64 nt, hsa
ucacauuuaaucacaucccccuucuagagugcuucaaaaugauguagucccucaacuuggcuaa

SEQ ID NO: 145565 - RNA, 64 nt, hsa
augcuuaucagccccuucagugguguuauucuaacaaaaugaauacauuacaaauuauuaaguu

SEQ ID NO: 145566 - RNA, 64 nt, hsa
uuacuagcacugacacacugauuuugaaauguuucaaaaugaguagauaugauuagauccuuua

SEQ ID NO: 145567 - RNA, 64 nt, hsa
gcugucagucccacauacagaaucauuucuuuuacaaaaugauuuaauauguaaucauguguca

SEQ ID NO: 145568 - RNA, 64 nt, hsa
auuuucaaaugauaaacucuagacauauauuuugcaaaaugagcuuggguuuaaaaagugcuuu

SEQ ID NO: 145569 - RNA, 64 nt, hsa
cagaaucuuuaaagaggagccuuuccagaacuaccaaaaugaagacacgcccgacucucuccau

SEQ ID NO: 145570 - RNA, 64 nt, hsa
gugccuauaaaggaaacacguuuagaaaugauuucaaaaugauauucaaucuuaacaaaaguga

SEQ ID NO: 145571 - RNA, 64 nt, hsa
uggagucuucuagucccaagggauugggagaugacaaaaugaauuuuuuuuuucuuuuuugaga

SEQ ID NO: 145572 - RNA, 64 nt, hsa
gggauuacaggcaugaaccacugugcccagcugacaaaaugaguucuuaaacuuuuuuuuuuuu

SEQ ID NO: 145573 - RNA, 64 nt, hsa
gaacuuuauaaaagacacuugcaauauacugugucaaaaugauaauuuuguuauguuagccucu

SEQ ID NO: 145574 - RNA, 64 nt, hsa
gccaugcuagccuaggccucuauuuccuugucuccaaaaugagaauaauaaaauuuaggucagg

SEQ ID NO: 145575 - RNA, 64 nt, hsa
aagaaaaaaagaaaaaagaaaaaucucauuauuucaaaaugauagacauauaccaaaaacaagu

SEQ ID NO: 145576 - RNA, 64 nt, hsa
gacuuccuuauuucugaacaguacugguuacuuucaaaaugaauuuuuauugagauuuuccauu

SEQ ID NO: 145577 - RNA, 64 nt, hsa; identical to SEQ ID NO: 145572

SEQ ID NO: 145578 - RNA, 64 nt, hsa
uggagucuucuagucccaagggauugggagaugacaaaaugaauuuuuuuuucuuuuuugagau

SEQ ID NO: 145579 - RNA, 64 nt, hsa
gauuuacuagacgaaaaccauaccucucuucaaucaaaaugaaaacaaagcaaaugaauacugg

SEQ ID NO: 145580 - RNA, 64 nt, hsa
uuguagucauuuuaaaguacacaaagggcacaaucaaaaugagaugcacucauuuaaaucugca

SEQ ID NO: 145581 - RNA, 64 nt, hsa
cagauuuugauaacuguuuauauguguugaaaaccaaaaugacaucuuuuuaaagcuuauccau

SEQ ID NO: 145582 - RNA, 64 nt, hsa
auaaaacaccucacaccucacucuuuauagugcacaaaaugaaugaggucugggcuagguagaa

SEQ ID NO: 145583 - RNA, 64 nt, hsa
cugggaccuugaacaagucagcaucucugccuuucaaaaugaaggaacauuguucucuauccuc

SEQ ID NO: 145584 - RNA, 64 nt, hsa
cuugagcauuuauaaaccagggcgaggguuguuccaaaaugaguaauugaaugagaugaagaaa

SEQ ID NO: 145585 - RNA, 64 nt, hsa
ucuaugacaauaugacacuuguaaauuguuguuucaaaaugaacagcgaagccuuaacuuuaaa

SEQ ID NO: 145586 - RNA, 64 nt, hsa
agugacaguaucuuuuuuccuuaucuauucuauucaaaaugaccuuugauagaaauguuggcau

SEQ ID NO: 145587 - RNA, 64 nt, hsa
ucagcccccuacugagaaguuaauuaauucaguccaaaaugaaauuauagggcaguuuggugca

SEQ ID NO: 145588 - RNA, 64 nt, hsa
acucuauuuggaucagaacuacauuauuacaaaacaaaaugaacacuugaccaaaaaaccacau

SEQ ID NO: 145589 - RNA, 64 nt, hsa
ccguuguaauaaugaauuguucuggacuagaaaacaaaaugaggcauuuuguuaaggggguagg

SEQ ID NO: 145590 - RNA, 64 nt, hsa
uauguccacuaaguacuccaauuaccagcguaggcaaaaugagcuuccaccucuguccacuccc

SEQ ID NO: 145591 - RNA, 64 nt, hsa
ugucucagcugcugcaagacugcuccucucgucucaaaaugacccacccagcuagagcacugua

SEQ ID NO: 145592 - RNA, 64 nt, hsa
acagaauuuuggcugaucuagauaccaugagacacaaaaugagacaguuaaaaggucaguauga

SEQ ID NO: 145593 - RNA, 64 nt, hsa
gugcuugaaugagaaaaggcuccuggugcaucuucaaaaugaguccuaaagaacauacugagua

SEQ ID NO: 145594 - RNA, 64 nt, hsa; identical to SEQ ID NO: 145545

SEQ ID NO: 145595 - RNA, 64 nt, hsa
agggacgucaguguuuaugccauuuuuccaguuccaaaaugauuccauuccauucuagaaauuu

SEQ ID NO: 145596 - RNA, 64 nt, hsa
uuaaccaauuauaauagcuuuuuuucuuuauuuucaaaaugauuuccuuugcuuugauuagaca

SEQ ID NO: 145597 - RNA, 64 nt, hsa
uaauauauuuagaagagccacgugaaacccaugacaaaaugaaugugaauauucuuucuaaaaa

SEQ ID NO: 145598 - RNA, 64 nt, hsa
uaaauaaauacauugauugguaaauuaugagaaucaaaaugauaaaaagagccugcuuuuuucc

SEQ ID NO: 145599 - RNA, 64 nt, hsa
aucuucuuagaaagaaagaaaaaguaugaauggucaaaaugaauacaucgagagagauaaaugg

SEQ ID NO: 145600 - RNA, 64 nt, hsa
agguuucauuccuucagagcuccauuaauguaaucaaaaugaaauauagauuaguuuaaaugug

SEQ ID NO: 145601 - RNA, 64 nt, hsa
auucugccaugacauacacuuaaccaaaacuauucaaaaugaaaaccggauuucaaauaaccag

SEQ ID NO: 145602 - RNA, 64 nt, hsa
aaaaaagagaaggagaauacuggaagauaaugcacaaaaugaagggacuaguuaaggauuaacu

SEQ ID NO: 145603 - RNA, 64 nt, hsa
agaagacugcagcagacuacacaguacuucuugucaaaaugauucuccuucaagguuuucaaaa

SEQ ID NO: 145604 - RNA, 64 nt, hsa
guauuacuugaaugcauccagaggauauuuaaaccaaaaugaaaaaccagaaggccauuuggug

SEQ ID NO: 145605 - RNA, 64 nt, hsa
aaauguuuauauaaauaccaaauugcagcauccccaaaaugaauaaagccuuuuuacuuguggg

SEQ ID NO: 145606 - RNA, 64 nt, hsa
ccagaggcugggugacauguguuggcagccucuucaaaaugagcccuguccugccuaaggcuga

SEQ ID NO: 145607 - RNA, 64 nt, hsa
cguuccuucaaagcaaaugucuuccuggauuauucaaaaugauguauguugaagccuuuguaaa

SEQ ID NO: 145608 - RNA, 64 nt, hsa
agcccgccuuuagaguuaaauauaauagaaaaaccaaaaugauauuuuuauuuuaggaggguuu

SEQ ID NO: 145609 - RNA, 64 nt, hsa
aguguuucguucuaaaucuaugagguuuaggguucaaaaugauggaaggccgaagagcaaggcu

SEQ ID NO: 145610 - RNA, 64 nt, hsa
uuuuucuucucuaaaacauuaguuuaauuuucuucaaaaugaaaauacugcuuuguaauuacaa

SEQ ID NO: 145611 - RNA, 64 nt, hsa
uuuucuucaaaaugaaaauacugcuuuguaauuacaaaaugagacacaccuaucuugauauuuu

SEQ ID NO: 145612 - RNA, 64 nt, hsa
aagacuuugguauggauuaagcgcuguccaguaacaaaaugaaaucucaaaacagagcucagcu

SEQ ID NO: 145613 - RNA, 64 nt, hsa
acuguguuuuaugauuuuaccucaaaucagaaaacaaaaugaugugcuuuggucaguuaauaaa

SEQ ID NO: 145614 - RNA, 64 nt, hsa
gguguuccuccaaagaauaggguaaaggagagcugggagggagcccucuccguugggugacucu

SEQ ID NO: 145615 - RNA, 64 nt, hsa
cagggugcccuggaacacugguaguucuggggcugggagggagaggggcuccggcuuucucuga

SEQ ID NO: 145616 - RNA, 64 nt, hsa
ucugugguuccugguugguggcuaaugaagugaggggagggagggaugucaccccaaaaguagg

SEQ ID NO: 145617 - RNA, 64 nt, hsa
ugguuccugguugguggcuaaugaagugaggggagggagggaugucaccccaaaaguaggcccu

SEQ ID NO: 145618 - RNA, 64 nt, hsa
agccccagacauacuguguugagagauacuuagagggagggaguagguuuugaagagguugaug

SEQ ID NO: 145619 - RNA, 64 nt, hsa
gagggaguagguuuugaagagguugauggugguggggagggaaggccuccugaauugaguuuga

SEQ ID NO: 145620 - RNA, 64 nt, hsa
gaaaaaagauccaccagaggacaucuuggggagggggagggagcugggggggagggaaaugacu

SEQ ID NO: 145621 - RNA, 64 nt, hsa
agaggacaucuuggggagggggagggagcugggggggagggaaaugacuaaugaagcuaauuaa

SEQ ID NO: 145622 - RNA, 64 nt, hsa
ugaccagugcucuguggggcagaggagcugaccagggagggagguacccaugagcagaggguag

SEQ ID NO: 145623 - RNA, 64 nt, hsa
uauauauuauuuuuugguucucucucguuuuuuagggagggaagaaaguaccaaguugcauuga

SEQ ID NO: 145624 - RNA, 50 nt, hsa
ugaaaaggauggaagcaugagggagggagggaggagggagaaaaacagaa

SEQ ID NO: 145625 - RNA, 54 nt, hsa
ugaaaaggauggaagcaugagggagggagggaggagggagaaaaacagaaucca

SEQ ID NO: 145626 - RNA, 64 nt, hsa
caucucaccagagcaacagcccaguccugaggaugggagggacgugacuuagccuugggauucc

SEQ ID NO: 145627 - RNA, 64 nt, hsa
gaaggucagggugccgcugggggagcagggagcggggagggaggaagaggggaaugcacaucuu

SEQ ID NO: 145628 - RNA, 64 nt, hsa
gguuugggccggggaguuccccauucguucuccggggagggagggacuuuacaccuaccccuca

SEQ ID NO: 145629 - RNA, 64 nt, hsa
ugggccggggaguuccccauucguucuccggggagggagggacuuuacaccuaccccucaccgg

SEQ ID NO: 145630 - RNA, 64 nt, hsa
cugggcacaccuugcugaggccccaguagggguggggagggagggagaggccgccacccccgcc

SEQ ID NO: 145631 - RNA, 64 nt, hsa
gcacaccuugcugaggccccaguagggguggggagggagggagaggccgccacccccgccggug

SEQ ID NO: 145632 - RNA, 64 nt, hsa
gggucaaggggccccgaugugcacagcugccacagggagggaggucuuggggagaugggcaguc

SEQ ID NO: 145633 - RNA, 64 nt, hsa
uggacauccugcccaccgugucccagccagggcagggagggaccauggcccgcagggucaaggg

SEQ ID NO: 145634 - RNA, 64 nt, hsa
gcuguuggauucugaggguggggagggagagagagggagggagagggagugaagagccugcccu

SEQ ID NO: 145635 - RNA, 64 nt, hsa
uguugcaaacgacugcuguuggauucugaggguggggagggagagagagggagggagagggagu

SEQ ID NO: 145636 - RNA, 64 nt, hsa
ggggacaaaccagggguaccaggcacauggcugggggagggacugcugacccaccaaggucuca

SEQ ID NO: 145637 - RNA, 64 nt, hsa
gagucucuggcucagcuguggucccacccaggaagggagggagcugaggccucccuugaguagg

SEQ ID NO: 145638 - RNA, 64 nt, hsa
aaucuggauucucuccucuuccccauucuccagagggagggagguggugaggaagaggaaggga

SEQ ID NO: 145639 - RNA, 64 nt, hsa
aagcaguugguagaaggaaugguauuuguauggggggagggaggcuggaauggagaaucuggau

SEQ ID NO: 145640 - RNA, 64 nt, hsa
cauaggauuucucuuaauucagcuugaauugauggggagggagguaagaguagggucagaguua

SEQ ID NO: 145641 - RNA, 64 nt, hsa
uuugccaccacgcaacucagggcucaagaugaaugggagggagagauuugaguccaagcauaca

SEQ ID NO: 145642 - RNA, 64 nt, hsa
gggcgcggggcgcggcgggacccaggcuacgagcgggagggaggcgggagucgggggaagacgc

SEQ ID NO: 145643 - RNA, 64 nt, hsa
gacaccagcgcuggcuucccgggcccgcgggccggggagggaagccucggggcugcggggugag

SEQ ID NO: 145644 - RNA, 64 nt, hsa
cucaaagaagcauuugcugaggauggagaggcaggggagggaggcgggaggccgucacuggagu

SEQ ID NO: 145645 - RNA, 64 nt, hsa
ugugaugccccucucccgauuucccaggggcucugggagggacccuucuaagaagauugggcag

SEQ ID NO: 145646 - RNA, 64 nt, hsa
gacaugacuuauguguguguguguuuuugggguggggagggagggagagaagagggggcuaaau

SEQ ID NO: 145647 - RNA, 64 nt, hsa
ugacuuauguguguguguguuuuugggguggggagggagggagagaagagggggcuaaauuuga

SEQ ID NO: 145648 - RNA, 64 nt, hsa
ugaggagcgucuccgcccggcagccacccaguccgggagggaggugggggggucagucccccgu

SEQ ID NO: 145649 - RNA, 64 nt, hsa
gaggagccccucugccccgccagccaccccguccgggagggaggugggggggucagccccccgc

SEQ ID NO: 145650 - RNA, 64 nt, hsa
gggucagccccccgcccggccagccgccccguccgggagggaggugggggaucagccccccgcc

SEQ ID NO: 145651 - RNA, 64 nt, hsa
gggucagccccccgcccggccagccgcccgguccgggagggaggugggggggucagccccccgc

SEQ ID NO: 145652 - RNA, 64 nt, hsa
cucccuugccccuuuccugggcccagaaguuggggggagggagggaaaggauuuuuacauuuuu

SEQ ID NO: 145653 - RNA, 64 nt, hsa
cuugccccuuuccugggcccagaaguuggggggagggagggaaaggauuuuuacauuuuuuaaa

SEQ ID NO: 145654 - RNA, 64 nt, hsa
gauggugggguggauggucagggagggaugcucagggagggauaugcuggugugagcagccaga

SEQ ID NO: 145655 - RNA, 64 nt, hsa
caaauggcuguggggauggugggguggauggucagggagggaugcucagggagggauaugcugg

SEQ ID NO: 145656 - RNA, 64 nt, hsa
gacuuauuuuuucucuccuaugccaccccagguggggagggagggagguuucagacuccaguuu

SEQ ID NO: 145657 - RNA, 64 nt, hsa
uauuuuuucucuccuaugccaccccagguggggagggagggagguuucagacuccaguuucucc

SEQ ID NO: 145658 - RNA, 64 nt, hsa
uuucaggacuuuuauuucccccuggaugguuguugggagggagggaaaguguuuucugaauggc

SEQ ID NO: 145659 - RNA, 64 nt, hsa
aggacuuuuauuucccccuggaugguuguugggagggagggaaaguguuuucugaauggcuauu

SEQ ID NO: 145660 - RNA, 64 nt, hsa
acccaugaaaacugagaugaggaccuugguacuagggagggagggaaggacgugggaauguuuu

SEQ ID NO: 145661 - RNA, 64 nt, hsa
augaaaacugagaugaggaccuugguacuagggagggagggaaggacgugggaauguuuucuua

SEQ ID NO: 145662 - RNA, 64 nt, hsa
ccaagaaauuggaauugaaaacaggaggugacuagggagggauuaggaaauuagaggucuugac

SEQ ID NO: 145663 - RNA, 64 nt, hsa
uuuguuuguuucuuuguguugggagggauuauuugggagggaaaagggaaguaguccuuggcau

SEQ ID NO: 145664 - RNA, 64 nt, hsa
uugccuagcucuuuuuuguuuguuucuuuguguugggagggauuauuugggagggaaaagggaa

SEQ ID NO: 145665 - RNA, 64 nt, hsa
agguggggcuguuaccuuccucagggcuuagggagggagggaggacauggacagggccuuccac

SEQ ID NO: 145666 - RNA, 64 nt, hsa
ucacagguggggcuguuaccuuccucagggcuuagggagggagggaggacauggacagggccuu

SEQ ID NO: 145667 - RNA, 64 nt, hsa
cuuuucucucugucuuuaggaguagggugggauggggagggaggcugggcaucagggaucacau

SEQ ID NO: 145668 - RNA, 64 nt, hsa
uuguguugcuuccuauuggcuagcuuccuaaggggggagggaaccgaguuaucaagaugggagg

SEQ ID NO: 145669 - RNA, 64 nt, hsa
uucuucaguuaacaacuuuguguucucugugggagggagggaguccuguguguuuguggggaga

SEQ ID NO: 145670 - RNA, 64 nt, hsa
cuuguucuucaguuaacaacuuuguguucucugugggagggagggaguccuguguguuuguggg

SEQ ID NO: 145671 - RNA, 64 nt, hsa
uuuuacuuuugcgggggggaggggggaggaguuggggagggagggaaugugggaggaauuaaga

SEQ ID NO: 145672 - RNA, 64 nt, hsa
acuuuugcgggggggaggggggaggaguuggggagggagggaaugugggaggaauuaagacaaa

SEQ ID NO: 145673 - RNA, 64 nt, hsa
cuucucuuagauucuuaauucaugaggagggugggggagggagguggagggagggaaggguuuc

SEQ ID NO: 145674 - RNA, 64 nt, hsa
uuaauucaugaggagggugggggagggagguggagggagggaaggguuucucuauuaaaaugca

SEQ ID NO: 145675 - RNA, 64 nt, hsa
gaugcuggcagaucucaaggccaucaauuauugggggagggagggacaaacacucccaaucauc

SEQ ID NO: 145676 - RNA, 64 nt, hsa
cuggcagaucucaaggccaucaauuauugggggagggagggacaaacacucccaaucauccacc

SEQ ID NO: 145677 - RNA, 64 nt, hsa
uuaaaugcuucccuggacugcggggaggggcggggggagggagggauuucuuaucccguuuguu

SEQ ID NO: 145678 - RNA, 64 nt, hsa
augcuucccuggacugcggggaggggcggggggagggagggauuucuuaucccguuuguuacau

SEQ ID NO: 145679 - RNA, 64 nt, hsa
ucagcacagagagcggcuuccccauugccuucuggggagggacacagaggacagcuuccccauc

SEQ ID NO: 145680 - RNA, 64 nt, hsa
uuagcacagaggauggcuuccccauugccuucuggggagggacacagaggacggcuuccccauc

SEQ ID NO: 145681 - RNA, 64 nt, hsa
aaugucuuguuuuaauuuguguuuuuuggggggagggagggagugaacuugcugauucuguagc

SEQ ID NO: 145682 - RNA, 64 nt, hsa
gcaaaaugucuuguuuuaauuuguguuuuuuggggggagggagggagugaacuugcugauucug

SEQ ID NO: 145683 - RNA, 64 nt, hsa
ccgccccccucuaggagagcuggcucugcagugggggagggaugcagggacauuuacugaagga

SEQ ID NO: 145684 - RNA, 64 nt, hsa
ggaggguggggccgugguccccucagccuccauggggagggaagaagggggagcucuuuuuuua

SEQ ID NO: 145685 - RNA, 64 nt, hsa
cugguggggucacccucccuguccucccgccugugggagggagggagggcuggcucaggcaucg

SEQ ID NO: 145686 - RNA, 64 nt, hsa
uggggucacccucccuguccucccgccugugggagggagggagggcuggcucaggcaucgucuc

SEQ ID NO: 145687 - RNA, 64 nt, hsa
ccucugagucacugaaugucaccaggagaggugggggagggaaagugggccaguggggaggggg

SEQ ID NO: 145688 - RNA, 51 nt, hsa
agaaugagauucaccaguaaggggagggaggggcccuggaggccacauccu

SEQ ID NO: 145689 - RNA, 64 nt, hsa
acuuggggguuucacugcucucccccaugauggagggagggagccccccaaccucagugaggag

SEQ ID NO: 145690 - RNA, 64 nt, hsa
aguuugucugggccacacuggggcagaggggggagggagggauacagagauggaugccacuuac

SEQ ID NO: 145691 - RNA, 64 nt, hsa
uuucaguuugucugggccacacuggggcagaggggggagggagggauacagagauggaugccac

SEQ ID NO: 145692 - RNA, 64 nt, hsa
caaacaaacaaacaaacaaaaaaagggugggggagggagggaaagagaagagcucugcacuucc

SEQ ID NO: 145693 - RNA, 64 nt, hsa
aaaacaaacaaacaaacaaacaaaaaaagggugggggagggagggaaagagaagagcucugcac

SEQ ID NO: 145694 - RNA, 64 nt, hsa
ucccaugaguugggggucgggugggggagggaaagggagggaugaccuucccagggagaaaccc

SEQ ID NO: 145695 - RNA, 64 nt, hsa
uuuauuuuuuucccaugaguugggggucgggugggggagggaaagggagggaugaccuucccag

SEQ ID NO: 145696 - RNA, 64 nt, hsa
uguucccuugaggugccuccucuccucugcccaggggagggaguguggacaguaucuggaaguu

SEQ ID NO: 145697 - RNA, 64 nt, hsa
gcuucaggacggggcgucagagggagcccccucugggagggaaccaacccccacccucccuccu

SEQ ID NO: 145698 - RNA, 64 nt, hsa
uacauauaaacacuggaggggagggagggagggagggagggagagaauggcccgagggaggagg

SEQ ID NO: 145699 - RNA, 64 nt, hsa
cccuuacauauaaacacuggaggggagggagggagggagggagggagagaauggcccgagggag

SEQ ID NO: 145700 - RNA, 64 nt, hsa
aguacccuuacauauaaacacuggaggggagggagggagggagggagggagagaauggcccgag

SEQ ID NO: 145701 - RNA, 63 nt, hsa
accaguacccuuacauauaaacacuggaggggagggagggagggagggagggagagaauggcc

SEQ ID NO: 145702 - RNA, 59 nt, hsa
accaguacccuuacauauaaacacuggaggggagggagggagggagggagggagagaau

SEQ ID NO: 145703 - RNA, 64 nt, hsa
cacuggagagcuuuuugcaauaugcuggggaaaggggagggagggaaugaaagugccaaagaaa

SEQ ID NO: 145704 - RNA, 64 nt, hsa
ggagagcuuuuugcaauaugcuggggaaaggggagggagggaaugaaagugccaaagaaaacau

SEQ ID NO: 145705 - RNA, 64 nt, hsa
ccuugacauccccagaaucucggucuuugggguggggagggagggaggagggagguggaguugg

SEQ ID NO: 145706 - RNA, 64 nt, hsa
gacauccccagaaucucggucuuugggguggggagggagggaggagggagguggaguugggaug

SEQ ID NO: 145707 - RNA, 64 nt, hsa
ccaucccauuggagucucuucuuuuuuugauagcgggagggaggaaguacgacuaauguuggag

SEQ ID NO: 145708 - RNA, 64 nt, hsa
ugugcuuugacauucuagcacuucagggaugagagggagggagaauccuggaugcuggauggag

SEQ ID NO: 145709 - RNA, 64 nt, hsa
aaagaaauauauauaaccuuguuauuguauuugggggagggauacugggauaauuuuuauuuuc

SEQ ID NO: 145710 - RNA, 64 nt, hsa
uugaauuguaguucccauaauccccacauguugugggagggacccagugggagguaauuaaauc

SEQ ID NO: 145711 - RNA, 64 nt, hsa
auacuugguauaagguaguagauuguuggggguggggagggagggaucuaggauacagggcagg

SEQ ID NO: 145712 - RNA, 64 nt, hsa
uugguauaagguaguagauuguuggggguggggagggagggaucuaggauacagggcagggaua

SEQ ID NO: 145713 - RNA, 64 nt, hsa
aucccccagcccuggcuccuagguccucccaacugggagggaguccuccgugccucacuuagag

SEQ ID NO: 145714 - RNA, 64 nt, hsa
aagcuuugagccuccugccccugcuuucugcccagggagggagaaggaagagggggagcugguu

SEQ ID NO: 145715 - RNA, 64 nt, hsa
uguccuucccuggccuucucuuggcucaaaggcugggagggagggaaggagagaagaguuccag

SEQ ID NO: 145716 - RNA, 64 nt, hsa
cuucccuggccuucucuuggcucaaaggcugggagggagggaaggagagaagaguuccaggcaa

SEQ ID NO: 145717 - RNA, 64 nt, hsa
accacggggagcaaaccagcuuguucugggcucagggagggagggcgguggacaauaaacaucu

SEQ ID NO: 145718 - RNA, 64 nt, hsa
ggugggcacuggagcaugcagaggaggugagagugggagggagguaacgggugccugcugcggc

SEQ ID NO: 145719 - RNA, 64 nt, hsa
cugccucucacaccuccagguucucuaaguucuggggagggagcgccccaccugcugaggucgg

SEQ ID NO: 145720 - RNA, 64 nt, hsa
cccagucacugacccugggagaccccuucugugugggagggagcgggggcuggcuagcgggccc

SEQ ID NO: 145721 - RNA, 64 nt, hsa
gaguuuggugggcuuaaggucagaggaguguguagggagggauguauguggaagguaagauuca

SEQ ID NO: 145722 - RNA, 64 nt, hsa
cucaaacagaaggcaguaaugagagccuacaaaugggagggaccuaagugccuaccuacucgcu

SEQ ID NO: 145723 - RNA, 64 nt, hsa
aacaccacuucuacacaacccuccuugguacugggggagggagagaucugacaaauacugccca

SEQ ID NO: 145724 - RNA, 64 nt, hsa
ccaugaucguaagggagaaugacauucugcuugagggagggaauagaaaggggcagggagggga

SEQ ID NO: 145725 - RNA, 64 nt, hsa
acuauaugaugaggagaaacugggguggcagggagggagggaggguuuaucacugcuuaacuuc

SEQ ID NO: 145726 - RNA, 64 nt, hsa
gaugacuauaugaugaggagaaacugggguggcagggagggagggaggguuuaucacugcuuaa

SEQ ID NO: 145727 - RNA, 64 nt, hsa
accagccucggugcucugccccaugcugggaggagggagggagggacaggugccuggagccccc

SEQ ID NO: 145728 - RNA, 64 nt, hsa
gccucggugcucugccccaugcugggaggagggagggagggacaggugccuggagcccccggaa

SEQ ID NO: 145729 - RNA, 64 nt, hsa
cccugacugucagggagggccagggaggcagagcgggagggagucucaggaggaggcugcccug

SEQ ID NO: 145730 - RNA, 64 nt, hsa
ggugcugguagcugaggggacgggcaagugagaggggagggagggaaguccugggaggauccug

SEQ ID NO: 145731 - RNA, 64 nt, hsa
cugguagcugaggggacgggcaagugagaggggagggagggaaguccugggaggauccugagcu

SEQ ID NO: 145732 - RNA, 64 nt, hsa
cgcauguagggccauccugggauggggcaccacagggagggagggagaaaagagguggguaggg

SEQ ID NO: 145733 - RNA, 64 nt, hsa
uguagggccauccugggauggggcaccacagggagggagggagaaaagagguggguaggguuac

SEQ ID NO: 145734 - RNA, 64 nt, hsa
guguggcugaguguauucugcgcguguguguggagggagggagggaggggagcauggugucucc

SEQ ID NO: 145735 - RNA, 64 nt, hsa
ggcugaguguauucugcgcguguguguggagggagggagggaggggagcauggugucucccgcu

SEQ ID NO: 145736 - RNA, 64 nt, hsa
cugggguuuauuuaaacuguucugugugggucuggggagggagagcaccuuaauauuauugggg

SEQ ID NO: 145737 - RNA, 64 nt, hsa
ugcccugcucuggggaugcacggcggcagggugggggagggagguuccucgcaggucucagccc

SEQ ID NO: 145738 - RNA, 64 nt, hsa
acccagcagcagguuaccaagggcugucuggaaagggagggacaaaaggacccagaaguagaag

SEQ ID NO: 145739 - RNA, 64 nt, hsa
uugguacuuuauaguaauaaaucugaccagcagagggagggaucaggcagcaguguuuagagca

SEQ ID NO: 145740 - RNA, 64 nt, hsa
caagaggcgccauagacccuagcggggagggcaggggagggacggaaggcuggcaccucuucca

SEQ ID NO: 145741 - RNA, 64 nt, hsa
uugcuggaaaaggugugggaagguucaggauggugggagggacugaggucccugaggugaagag

SEQ ID NO: 145742 - RNA, 64 nt, hsa
gggcauuuaauauauaccacuggugugugugggagggagggaggaggaauacuagcccuuuuua

SEQ ID NO: 145743 - RNA, 64 nt, hsa
acuugggcauuuaauauauaccacuggugugugugggagggagggaggaggaauacuagcccuu

SEQ ID NO: 145744 - RNA, 64 nt, hsa
gccaggacugaggaggaguggagggaagcagggagggagggagcaagugugaagggcacagcug

SEQ ID NO: 145745 - RNA, 64 nt, hsa
ucuggccaggacugaggaggaguggagggaagcagggagggagggagcaagugugaagggcaca

SEQ ID NO: 145746 - RNA, 64 nt, hsa
uuggccuggcaguggcuucagagaggaccugguggggagggagggcuuuccugugcugacagcg

SEQ ID NO: 145747 - RNA, 64 nt, hsa
ggcucuggaaggaugggccagcuugcagggguuggggagggagacauccagcuugggcuuuccc

SEQ ID NO: 145748 - RNA, 64 nt, hsa
cucuugccuucuaagcuacugugcuugucugggugggagggagccugguccugcaccugcccuc

SEQ ID NO: 145749 - RNA, 64 nt, hsa
gugcuggggugacaaagccccgagcuguggugaugggagggaggaagcgccgguuuaugucugu

SEQ ID NO: 145750 - RNA, 64 nt, hsa
agaggcugaacaaaggacgcauguggagcgcauggggagggaaggcuggggugcagggcuccgg

SEQ ID NO: 145751 - RNA, 64 nt, hsa
cucggcugcuaggccccucgccuggacuggacuggggagggaaagcgccuuuuccugcagcucu

SEQ ID NO: 145752 - RNA, 64 nt, hsa
gggcgcccacacuggcccugcagugaugcagggcgggagggagauaagaagaccccgcagucaa

SEQ ID NO: 145753 - RNA, 64 nt, hsa
agacuuuauauaaauguuuaaaacauagggguaagggagggagggagaauuuuuguauagaaug

SEQ ID NO: 145754 - RNA, 64 nt, hsa
uuuauauaaauguuuaaaacauagggguaagggagggagggagaauuuuuguauagaaugaaac

SEQ ID NO: 145755 - RNA, 64 nt, hsa
aguugcagggccuccgcagcuggacagagagugggggagggagggacagacagaaggccaaggc

SEQ ID NO: 145756 - RNA, 64 nt, hsa
gcagggccuccgcagcuggacagagagugggggagggagggacagacagaaggccaaggcccga

SEQ ID NO: 145757 - RNA, 64 nt, hsa
uugggguggggaagggaagggcgggcaaggaguggggagggagucuggggugggagggaggcau

SEQ ID NO: 145758 - RNA, 64 nt, hsa
agggcgggcaaggaguggggagggagucuggggugggagggaggcaucugcaugggucuucuuu

SEQ ID NO: 145759 - RNA, 64 nt, hsa
ugcccuaaguccugugagaagaugucagggacuagggagggagggagggaaggcagagaaaaau

SEQ ID NO: 145760 - RNA, 64 nt, hsa
cuaaguccugugagaagaugucagggacuagggagggagggagggaaggcagagaaaaauuacu

SEQ ID NO: 145761 - RNA, 64 nt, hsa
guccugugagaagaugucagggacuagggagggagggagggaaggcagagaaaaauuacuuagc

SEQ ID NO: 145762 - RNA, 64 nt, hsa
agacgaugccgacuggaagggagggagagggagggggagggagaaaauggggcuaugccuggcu

SEQ ID NO: 145763 - RNA, 64 nt, hsa
uggggcugugggcagcagacgaugccgacuggaagggagggagagggagggggagggagaaaau

SEQ ID NO: 145764 - RNA, 64 nt, hsa
ucaaauuccuuaaaauauaacugagauugcuguggggagggaggagggcagaggcugcgguuug

SEQ ID NO: 145765 - RNA, 64 nt, hsa
cgguucucaauaaauuacugagcagcuuuguuuggggagggaagucccuaccauccuuguuuag

SEQ ID NO: 145766 - RNA, 64 nt, hsa
uuuaagucuagccucugcgugguagacagguauggggagggagaaugcuuuuccccucccagua

SEQ ID NO: 145767 - RNA, 64 nt, hsa
gaaugaguagucaggaacuggucacuuugaaugugggagggaagauauucacgacaagguuuuc

SEQ ID NO: 145768 - RNA, 64 nt, hsa
auucuucugcaguuaaugggguagaggagggcaugggagggagggagagguggggagggagaca

SEQ ID NO: 145769 - RNA, 64 nt, hsa
uucugcaguuaaugggguagaggagggcaugggagggagggagagguggggagggagacagaga

SEQ ID NO: 145770 - RNA, 64 nt, hsa
ggguagaggagggcaugggagggagggagagguggggagggagacagagacagaaacagagaga

SEQ ID NO: 145771 - RNA, 64 nt, hsa
cggagggccaggcaacaggcuagcaaggcccacagggagggagcagaauggagagggcaucuca

SEQ ID NO: 145772 - RNA, 64 nt, hsa
cuguaagaaaucagagggagaaagggagagaagggggagggagacaacccaaacguuggagggu

SEQ ID NO: 145773 - RNA, 64 nt, hsa
gggggaugauggagagcuguccaaccaagagagcgggagggagggaaggagggagggagagaga

SEQ ID NO: 145774 - RNA, 64 nt, hsa
gaugauggagagcuguccaaccaagagagcgggagggagggaaggagggagggagagagauaga

SEQ ID NO: 145775 - RNA, 64 nt, hsa
cuguccaaccaagagagcgggagggagggaaggagggagggagagagauagagagagagagaga

SEQ ID NO: 145776 - RNA, 64 nt, hsa
ggccugcacuuuggagauuucuggauccuucccugggagggagaggucuccuaacucgauugga

SEQ ID NO: 145777 - RNA, 64 nt, hsa
ccgugaccguguccugaguggccaccuccuccuugggagggaggccgcggcagguacucucccu

SEQ ID NO: 145778 - RNA, 64 nt, hsa
ugcuuuccuggaccgggagagucccgguccccucgggagggacuccaccgccucucacacuccg

SEQ ID NO: 145779 - RNA, 64 nt, hsa
gagggcaggggccccuguggguucugggcuccaggggagggagcuggggaggccaggguauaag

SEQ ID NO: 145780 - RNA, 64 nt, hsa
aaguuaacugaugauugugggguuugucauaucugggagggaagaugggugcugggagaggguu

SEQ ID NO: 145781 - RNA, 64 nt, hsa
cuuugggguugagggagaugggagcuagggggaggggagggagaugucuuguuguggggacuug

SEQ ID NO: 145782 - RNA, 64 nt, hsa
accucuuuaucucaaucuauuuauuuggcauccugggagggauuuccaauaguaauuuauguga

SEQ ID NO: 145783 - RNA, 64 nt, hsa
ccuugccccuugugagcuggauagacuugggauggggagggagggaguuuugucugucucccuc

SEQ ID NO: 145784 - RNA, 64 nt, hsa
gccccuugugagcuggauagacuugggauggggagggagggaguuuugucugucucccuccccu

SEQ ID NO: 145785 - RNA, 64 nt, hsa
acuauuuuaauacucagcacuagagggagggagggggagggaggagggagcaggcaggucccaa

SEQ ID NO: 145786 - RNA, 64 nt, hsa
gcuuuuauagacuauuuuaauacucagcacuagagggagggagggggagggaggagggagcagg

SEQ ID NO: 145787 - RNA, 64 nt, hsa
ucagaggugaaugcacagugaagggugauuuguggggagggagcauuuuugguggucuuggggg

SEQ ID NO: 145788 - RNA, 64 nt, hsa
agggagcauuuuugguggucuugggggaggggaggggagggaagggcugguguugauuuuccuc

SEQ ID NO: 145789 - RNA, 64 nt, hsa
cccccaagcagagcggguaaagugcaauggguaagggagggaaggggaauggaagagaaaagac

SEQ ID NO: 145790 - RNA, 64 nt, hsa
ggagggaaggggaauggaagagaaaagacagggugggagggaggagggagugcuguguuuuagu

SEQ ID NO: 145791 - RNA, 64 nt, hsa
uggucuucggugcuucccgggcccggggucugucgggagggaagagaacugggccugaccuacc

SEQ ID NO: 145792 - RNA, 64 nt, hsa
cuguuuuaguauuuggauuugcauuccaucccuugggagggaguccucagggccacuagugaug

SEQ ID NO: 145793 - RNA, 64 nt, hsa
cucuucccaaaacugugccuguccccagcuucuggggagggacacagcuuccccuucccaggaa

SEQ ID NO: 145794 - RNA, 64 nt, hsa
ucuccucuucuagcccaugcccuuccccgguggagggagggagcagggagcccucacucuccac

SEQ ID NO: 145795 - RNA, 64 nt, hsa
gaggagcgucuacgcccgggcagcugccccguccgggagggaggugggggggucagccccccgc

SEQ ID NO: 145796 - RNA, 64 nt, hsa
gggucagccccccgcccggccagccgccccguccgggagggaggugggggggaucagccccccg

SEQ ID NO: 145797 - RNA, 64 nt, hsa
ggaucagccccccgcccggccagccgccccguccgggagggagguggggggcgccucugcccgg

SEQ ID NO: 145798 - RNA, 64 nt, hsa
cccgggcaguacuggggaccuucccugggggacggggagggaggaggcagcgacuccuuggaca

SEQ ID NO: 145799 - RNA, 64 nt, hsa
gagcuggauccagagcuggaggggguggguccgggggagggaguggcucggaaggggcccccac

SEQ ID NO: 145800 - RNA, 64 nt, hsa
ccugccaucauguuuacagaggacaguauuuguggggagggauuuggggcucagagugggguag

SEQ ID NO: 145801 - RNA, 64 nt, hsa
aauggcaguaugguagagggauaaauagggggcggggagggauagucauggauccaagaagucc

SEQ ID NO: 145802 - RNA, 64 nt, hsa
ggaauccaagaacaggaagccaagagagugagcagggagggauugggggugggggaggccucaa

SEQ ID NO: 145803 - RNA, 64 nt, hsa
ccuucagccugugacuguugcugacuccaggggugggagggauggggagacuccccucuugcug

SEQ ID NO: 145804 - RNA, 64 nt, hsa
aaagggagggaugggucuagggagugggaaaugcgggagggaggguggggggcaggggucgggg

SEQ ID NO: 145805 - RNA, 64 nt, hsa
uuuuuuuuuuuccugggaauuuuuuuggggaaaagggagggaugggucuagggagugggaaaug

SEQ ID NO: 145806 - RNA, 64 nt, hsa
uccccaugaggggccaagacacugccuaaggugugggagggacuggcugagauugcagcccaug

SEQ ID NO: 145807 - RNA, 55 nt, hsa
ugggggcgucuagagacugagcugcgggagggagagggacuugugggucugaucc

SEQ ID NO: 145808 - RNA, 64 nt, hsa
guuccggcaaagacagagccagcagcugcgcugggggagggaagcgugccuccccaccccuccc

SEQ ID NO: 145809 - RNA, 64 nt, hsa
gaggagugagauagaacuugggagcccggggguugggagggacagggauaaauaaaggcaaaga

SEQ ID NO: 145810 - RNA, 64 nt, hsa
gcaccugagugguugggacacaggcagcuggcaugggagggacuuuuuuugagacagggucuca

SEQ ID NO: 145811 - RNA, 64 nt, hsa
auaguggcucucagcccuuggggcauguuaucaugggagggaagucaaauaagaggagagaaaa

SEQ ID NO: 145812 - RNA, 64 nt, hsa
uaauguuuggugucuguuucuuaggagugacugggggagggaagauuauuuuagcuauuuauuu

SEQ ID NO: 145813 - RNA, 64 nt, hsa
gggaggggggugggagggguguagggagagggaagggagggaaacaguuuugugggaaauauuc

SEQ ID NO: 145814 - RNA, 64 nt, hsa
ggguuaauuuacccacagaaugugauaguaauaggggagggaggcugcuguggguuuaacuccu

SEQ ID NO: 145815 - RNA, 64 nt, hsa
gaagcuagacccaaucuccuuugggaugugggcagggagggaagcaggcuuggaggguuaauuu

SEQ ID NO: 145816 - RNA, 64 nt, hsa
aauggggccacauagcagcagaggacugguguaagggagggagggguagggacagaagcuagac

SEQ ID NO: 145817 - RNA, 64 nt, hsa
auugggguagaaaaggagaggguccgaggguggugggagggauagaaaucacauccgccccaac

SEQ ID NO: 145818 - RNA, 64 nt, hsa
cucagcccgccagcugaggggucccacggggcaggggagggaauugagagucacagacacugag

SEQ ID NO: 145819 - RNA, 64 nt, hsa
guuuuuggcuauuacugguguauuauuugggggagggagggauggggaggggagaaagggagau

SEQ ID NO: 145820 - RNA, 64 nt, hsa
uguaguuuuuggcuauuacugguguauuauuugggggagggagggauggggaggggagaaaggg

SEQ ID NO: 145821 - RNA, 64 nt, hsa
ggaagaaaaacaggccgagugaaggugcuggaaagggagggaggacgcgaggggaaaggccugu

SEQ ID NO: 145822 - RNA, 64 nt, hsa
ggaugacggggggugggaacaagauggauggaaagggagggaaagacaagaugcaacuaggaag

SEQ ID NO: 145823 - RNA, 64 nt, hsa
ugaaggggagggaggaaaauggaugaaugagagagggagggaacagugcccaagcgcuuggccu

SEQ ID NO: 145824 - RNA, 64 nt, hsa
gugaauccuccaggcccuucucuacacccugaaggggagggaggaaaauggaugaaugagagag

SEQ ID NO: 145825 - RNA, 64 nt, hsa
cuccaggggugcaguggggugggugaggacgggugggagggacagggagggaccaauaaaucau

SEQ ID NO: 145826 - RNA, 64 nt, hsa
gcaguggggugggugaggacgggugggagggacagggagggaccaauaaaucauaaugaagaaa

SEQ ID NO: 145827 - RNA, 64 nt, hsa
cucugucucaugcucccaggcugcacagcaggcagggagggaggcaaggcaggggaguggggcc

SEQ ID NO: 145828 - RNA, 64 nt, hsa
guuccagggaggaggugcucgguugacaccaucagggagggagggugggcacugcugggcugag

SEQ ID NO: 145829 - RNA, 64 nt, hsa
gggaaucacacugggcugaccuggcauugggagagggagggaggaaggaagggagggaggggcu

SEQ ID NO: 145830 - RNA, 64 nt, hsa
ugaccuggcauugggagagggagggaggaaggaagggagggaggggcuggaagauacugaagga

SEQ ID NO: 145831 - RNA, 64 nt, hsa
ggggccuguccagagggucuucagaagccccccugggagggaggggaggaugagcacgcccagc

SEQ ID NO: 145832 - RNA, 64 nt, hsa
cuaguuugugaggcuguggccccgagcuggcggagggagggaagaggagggagugacgggaggg

SEQ ID NO: 145833 - RNA, 64 nt, hsa
caccugaggagacuuuggggacagggcaggggcagggagggaaacugaggaaaucuuccauucc

SEQ ID NO: 145834 - RNA, 64 nt, hsa
agaugggcggguuugugcuaugugcaggguggaagggagggaaguugacaggucagaagaucag

SEQ ID NO: 145835 - RNA, 64 nt, hsa
gaccucaagauuccacucugugcccgccucugccgggagggagggaggcacacagguggagcug

SEQ ID NO: 145836 - RNA, 64 nt, hsa
ucaagauuccacucugugcccgccucugccgggagggagggaggcacacagguggagcugaccc

SEQ ID NO: 145837 - RNA, 63 nt, hsa
acgggaccccucugcccugaccccacggggccggggagggaggggaccccccuccaccccccu

SEQ ID NO: 145838 - RNA, 64 nt, hsa
auuuauugaucaaucucucugcgggguggggugggggagggacgggagcugguugggguggcuu

SEQ ID NO: 145839 - RNA, 64 nt, hsa
cuuugcugaguuccggggugcaaugggggagggagggagggaaagcuuccuccuaaaucaagca

SEQ ID NO: 145840 - RNA, 64 nt, hsa
ucaccuuugcugaguuccggggugcaaugggggagggagggagggaaagcuuccuccuaaauca

SEQ ID NO: 145841 - RNA, 64 nt, hsa
uggcucaccuuugcugaguuccggggugcaaugggggagggagggagggaaagcuuccuccuaa

SEQ ID NO: 145842 - RNA, 64 nt, hsa
uuccaggcccaucccuggcccagagcaggagggagggagggacgauggcgguggguuuuuguau

SEQ ID NO: 145843 - RNA, 64 nt, hsa
cuccuuccaggcccaucccuggcccagagcaggagggagggagggacgauggcgguggguuuuu

SEQ ID NO: 145844 - RNA, 64 nt, hsa
ccccaccuaccucagcugggucaggcacagggaggggagggaucagccaaauugggcggccacc

SEQ ID NO: 145845 - RNA, 64 nt, hsa
gguuucucauaccccacaaggucacagcaggggagggagggacaauuuuauaaugaaccaaaaa

SEQ ID NO: 145846 - RNA, 64 nt, hsa
ccuagguuucucauaccccacaaggucacagcaggggagggagggacaauuuuauaaugaacca

SEQ ID NO: 145847 - RNA, 64 nt, hsa
uggguuucuaagcucugggcaaaguggugguagggggagggagggggaaguuaagggggucacc

SEQ ID NO: 145848 - RNA, 64 nt, hsa
ucucaacaaacaaacaaaaagagccagugggggagggagggacagagacccagagggcagcguc

SEQ ID NO: 145849 - RNA, 64 nt, hsa
cccgucucaacaaacaaacaaaaagagccagugggggagggagggacagagacccagagggcag

SEQ ID NO: 145850 - RNA, 64 nt, hsa
gaggucugcaggaccucacaccucccuagagggagggagggagggcaggguggagggcaaggcu

SEQ ID NO: 145851 - RNA, 64 nt, hsa
aguugaggucugcaggaccucacaccucccuagagggagggagggagggcaggguggagggcaa

SEQ ID NO: 145852 - RNA, 64 nt, hsa
uagcacauccuccaguuacauggcagaagagggagggagggagggccaaaaagaaaagggagag

SEQ ID NO: 145853 - RNA, 64 nt, hsa
cucauagcacauccuccaguuacauggcagaagagggagggagggagggccaaaaagaaaaggg

SEQ ID NO: 145854 - RNA, 64 nt, hsa
caggagguacaccagcuggacaaauugcagggaggggagggagcgagggccaacccggccccuc

SEQ ID NO: 145855 - RNA, 64 nt, hsa
gaagaauucaggggaugugggaaguggggaggcggggagggaucuugacucuugucuccuuugu

SEQ ID NO: 145856 - RNA, 64 nt, hsa
uuuaaaaauuccuuuagucuguaaaacuccuagagggagggagguaacugaauucacuucuuuu

SEQ ID NO: 145857 - RNA, 64 nt, hsa
cugcaguuucauagucccagccuuccuggugcuggggagggaggacugugaauggcuguucucc

SEQ ID NO: 145858 - RNA, 64 nt, hsa
gaacagcuuuuuugggacaagcuuuacauggguggggagggaaaaugugaaacacauuagcaau

SEQ ID NO: 145859 - RNA, 64 nt, hsa
aaguuccagagaugugucagcccuuaucaggcaugggagggacacguucaggagaggagccuua

SEQ ID NO: 145860 - RNA, 64 nt, hsa
uggacauggucccgggcaucugaaugaucuguaggggagggaguucaaauaaagcuuuauuuug

SEQ ID NO: 145861 - RNA, 64 nt, hsa
aggggaaggaggcccagugagccgggucccuuaggggagggagaguuuguccucuuugccccac

SEQ ID NO: 145862 - RNA, 64 nt, hsa
gagggggcccacccuuaaaggcggcgggaggggagggagggagaguggaggguuugacgggccu

SEQ ID NO: 145863 - RNA, 64 nt, hsa
gggggagggggcccacccuuaaaggcggcgggaggggagggagggagaguggaggguuugacgg

SEQ ID NO: 145864 - RNA, 64 nt, hsa
uuaugucacuuuagaaucaagggugggggagggagggagggaguuggcaguuucaaaucgccca

SEQ ID NO: 145865 - RNA, 64 nt, hsa
auucuuaugucacuuuagaaucaagggugggggagggagggagggaguuggcaguuucaaaucg

SEQ ID NO: 145866 - RNA, 64 nt, hsa
caccauucuuaugucacuuuagaaucaagggugggggagggagggagggaguuggcaguuucaa

SEQ ID NO: 145867 - RNA, 64 nt, hsa
gcagggagugauguggccgggccaaggacaggcagggagggaggccaggccucgcuugcaccgc

SEQ ID NO: 145868 - RNA, 64 nt, hsa
ucaggaccguggcuccagaacuccugugccaggcgggagggaagggcggcacuggagagauggg

SEQ ID NO: 145869 - RNA, 64 nt, hsa
ucuagaauaacacccuucuaggggaggcgggugggggagggagggaucauaaccccuucugugc

SEQ ID NO: 145870 - RNA, 64 nt, hsa
gaauaacacccuucuaggggaggcgggugggggagggagggaucauaaccccuucugugccuug

SEQ ID NO: 145871 - RNA, 64 nt, hsa
gcgaguggagaaacgcccuccagucugagagcaggggagggaaggaggcagcagaguuggggca

SEQ ID NO: 145872 - RNA, 64 nt, hsa
ugugaugaagcugagcagaguggaaacuuccauagggagggagcuagaagaaggugccccuucc

SEQ ID NO: 145873 - RNA, 64 nt, hsa
agccccauguuuuguuuuucugaguugguggggagggagggagggggagggcugaauuguuuug

SEQ ID NO: 145874 - RNA, 64 nt, hsa
ugggagccccauguuuuguuuuucugaguugguggggagggagggagggggagggcugaauugu

SEQ ID NO: 145875 - RNA, 64 nt, hsa
caacucagccaacccaggugugggcagucagggagggagggagugucccaccacguucucaggg

SEQ ID NO: 145876 - RNA, 64 nt, hsa
ccuccaacucagccaacccaggugugggcagucagggagggagggagugucccaccacguucuc

SEQ ID NO: 145877 - RNA, 64 nt, hsa
gaguguugacaacccaaagcuguucuccagucuggggagggagaggcaggguccccaauguccg

SEQ ID NO: 145878 - RNA, 64 nt, hsa
ccucucccaucccuuggccuggaccagugagcuggggagggacucggaugaacugaggcgcagc

SEQ ID NO: 145879 - RNA, 64 nt, hsa
ccagagcuggcagugugagcuguaggcagggacggggagggacugucgcugugaucagaguggg

SEQ ID NO: 145880 - RNA, 64 nt, hsa
ugggaugauggggaaaggguggggggaauuaaaagggagggauaaauauauauauauaaaucua

SEQ ID NO: 145881 - RNA, 64 nt, hsa
auacacaccaucaccuuugaaagugcuuguuugggggagggaaggacauacggguaacuagaac

SEQ ID NO: 145882 - RNA, 64 nt, hsa
acccagccugugccccacaaggaucucucuaaaugggagggauugaggcuacuuuucugccaag

SEQ ID NO: 145883 - RNA, 64 nt, hsa
ggccacaccucagugccaaagaccccaugggagugggagggaugacaagcggcccccgccucca

SEQ ID NO: 145884 - RNA, 64 nt, hsa
cugacaugcugcagucggaaguuuccuuuuccgugggagggaggcauucaucuacagacuccaa

SEQ ID NO: 145885 - RNA, 64 nt, hsa
ugggagggagggcuggggauggaugggagggaaggggagggaaaggugggaggaaugggaagca

SEQ ID NO: 145886 - RNA, 64 nt, hsa
ggaggaagagugggagggagggcuggggauggaugggagggaaggggagggaaaggugggagga

SEQ ID NO: 145887 - RNA, 64 nt, hsa
cugauggcugggaagggaguuggggaggaagagugggagggagggcuggggauggaugggaggg

SEQ ID NO: 145888 - RNA, 64 nt, hsa
cugggucucacuccugaguggggccagggugggagggagggacaagggggaggaaaggggcgag

SEQ ID NO: 145889 - RNA, 64 nt, hsa
gccacugggucucacuccugaguggggccagggugggagggagggacaagggggaggaaagggg

SEQ ID NO: 145890 - RNA, 64 nt, hsa
gaccaaagggugcagugaugggcuggguggcgggcccagggaaaugggguggggaugggcuggg

SEQ ID NO: 145891 - RNA, 64 nt, hsa
cucccuccagaauuuccuccagaugggggcagugcccagggagggguuauuugucuucccugcc

SEQ ID NO: 145892 - RNA, 64 nt, hsa
uggaaggcguuucugagucuuguacugggaccuucccagggaaggugccuuggggugcagaauc

SEQ ID NO: 145893 - RNA, 64 nt, hsa
ccccggcucuucacagcaggcagaagcguaugaucccagggagggugggcuggggggggggcag

SEQ ID NO: 145894 - RNA, 64 nt, hsa
caccagcagccccccuaaaaaaaucacucguguccccagggacuucuaaagcuuggggcuccag

SEQ ID NO: 145895 - RNA, 64 nt, hsa
uuggcuuccuggucgccucugucccagagauggucccagggagccauccuagggcagguagcac

SEQ ID NO: 145896 - RNA, 64 nt, hsa
auguggaauucccuacccugacuccuuccccaaacccagggaaaagagcucucaauuuuuuauu

SEQ ID NO: 145897 - RNA, 64 nt, hsa
ugcccagcucuaccccucccagggaccuaccccucccagggaccgaccccuggcccaagcuccc

SEQ ID NO: 145898 - RNA, 64 nt, hsa
gccacuggccaugcugcugcccagcucuaccccucccagggaccuaccccucccagggaccgac

SEQ ID NO: 145899 - RNA, 64 nt, hsa
guucuuagugauacugaccugugauaauauaauucccagggaggacugggaaccuuaucucuug

SEQ ID NO: 145900 - RNA, 64 nt, hsa
cagcugccucaacucugucucuggcagcucugcacccagggaccaugugcucuccacacccagg

SEQ ID NO: 145901 - RNA, 64 nt, hsa
uauauacauuauucuauguggcccucacugaugccccagggaaguaugcauuagccuucccauu

SEQ ID NO: 145902 - RNA, 64 nt, hsa
uugagagguuuggggccuuguuccccagaggguccccagggacucugcaguguccuuggcaaau

SEQ ID NO: 145903 - RNA, 64 nt, hsa
cccgagauagccaccuggaaacacuaggugccugcccagggaggaacggaggaggacucgcgcu

SEQ ID NO: 145904 - RNA, 64 nt, hsa
gaacggaggaggacucgcgcuacaagaggccacucccagggacccagggaggcgauggccaccc

SEQ ID NO: 145905 - RNA, 64 nt, hsa
gaggacucgcgcuacaagaggccacucccagggacccagggaggcgauggccaccccagaggcc

SEQ ID NO: 145906 - RNA, 64 nt, hsa
gaccuggggcuugagcugaggaugggacgaugugcccagggagggacccaccagagcacaagag

SEQ ID NO: 145907 - RNA, 64 nt, hsa
cagagcacaagagaagguggcuaccugggggugucccagggacucugucagugccuucagccca

SEQ ID NO: 145908 - RNA, 62 nt, hsa
ccaggccccgguggcgguaacugccccaaggccccagggacagaggccaaggacugacuuug

SEQ ID NO: 145909 - RNA, 64 nt, hsa
cuucugcuggaggaggggaagcugggcccaaaggcccagggaggcagcgugggcucugccaaug

SEQ ID NO: 145910 - RNA, 64 nt, hsa
caaccuuagccccucagaacagggagucccaggacccagggagaguguggggacaggacagccu

SEQ ID NO: 145911 - RNA, 64 nt, hsa
uccuggggugggaggcacaggggcaaagcaauaccccagggaaagugggagguggugcuggugc

SEQ ID NO: 145912 - RNA, 64 nt, hsa
cauccccuuggcagcugccgucagccaggccagccccagggagcuuaaaacagacauuccacag

SEQ ID NO: 145913 - RNA, 64 nt, hsa
cacagccuggugccgaggcucuccucaccagccacccagggagucaccucccucagccucccgc

SEQ ID NO: 145914 - RNA, 64 nt, hsa
uguccuccaagacuccuuaaugaggggcaggagucccagggaaagagaaccaugccaugcugaa

SEQ ID NO: 145915 - RNA, 64 nt, hsa
agcccuggauuuuggagccuguggcugcaaggaacccagggacccuuguugccuggugaaccug

SEQ ID NO: 145916 - RNA, 64 nt, hsa
cgccugcgucccaccguggggcucucuuggagcacccagggacacccagcgugcaacagccacg

SEQ ID NO: 145917 - RNA, 64 nt, hsa
uagaaaccagucuccauguguagauuaagcuguccccagggaagcagagugcaagagcagaaga

SEQ ID NO: 145918 - RNA, 64 nt, hsa
ugcaccucccaugauguccuggcuuuguggcaaccccagggaggugcagcaguuucacuccuuc

SEQ ID NO: 145919 - RNA, 64 nt, hsa
ucacuguguggaguggggcaggcaggggcuggaccccagggacuugccuuccccacccacucug

SEQ ID NO: 145920 - RNA, 64 nt, hsa
acuugccuuccccacccacucugcugccagcaggcccagggaucccugaccugcaccagguggc

SEQ ID NO: 145921 - RNA, 64 nt, hsa
aaauuuaugggacaggaaaugcaggaugggacuccccagggaacgcagggugaagggaacaaag

SEQ ID NO: 145922 - RNA, 64 nt, hsa
caaccucagcgucaugccagaaugcacagggcagcccagggagaucacaccuuuggcaaagucc

SEQ ID NO: 145923 - RNA, 64 nt, hsa
ccggcucagugcuggaauguugcaguguagguuucccagggaagggggguggggguaggugggc

SEQ ID NO: 145924 - RNA, 64 nt, hsa
ugaaauacugccauucuagguaggguuuuauuaucccagggacuaccucggcuuuuaauuuaaa

SEQ ID NO: 145925 - RNA, 64 nt, hsa
uguucaugaaauaaggcaucucugagaaaguggccccagggagagaauggaggacugggaggag

SEQ ID NO: 145926 - RNA, 64 nt, hsa
guuagauuuuggcacccguuuucucagcauucagcccagggaaugugguuuucacuucuucguc

SEQ ID NO: 145927 - RNA, 64 nt, hsa
auccuucauuauccaccccaucccagacucccaccccagggauugcccgugaagacuuuggccu

SEQ ID NO: 145928 - RNA, 64 nt, hsa
ccaucgcuggcccccaccuccuguggacugaugccccagggauucccaccccacuucugcaacc

SEQ ID NO: 145929 - RNA, 64 nt, hsa
gaaggcaggaguugggggcaggucaggaccaggacccagggagaggcugugucccugcuggggu

SEQ ID NO: 145930 - RNA, 64 nt, hsa
aggcugggcugagccaaagccagaguggccacggcccagggagggugagcuggugccugcuuug

SEQ ID NO: 145931 - RNA, 64 nt, hsa
ccuuucuauguggcauauuuauuuauuuaaacaccccagggaguuacgugguaacaagguuguc

SEQ ID NO: 145932 - RNA, 64 nt, hsa
gaggacggcgugggcagccugggccugggcuuggcccagggaaacagacggcagacacaccugu

SEQ ID NO: 145933 - RNA, 64 nt, hsa
acagccgguguccuggaaagcccccagcagcugccccagggacaugggaagaccacgggaccuc

SEQ ID NO: 145934 - RNA, 64 nt, hsa
ccagggaggccaacugacucugagccaggguucccccagggaacucaguuuucccauauguaaa

SEQ ID NO: 145935 - RNA, 64 nt, hsa
gagagggagcccuguguucccggugguugucccucccagggaugcagccagacccgugcccaau

SEQ ID NO: 145936 - RNA, 64 nt, hsa
cccugccugaagcucuggaaacuuguggguggggcccagggaggauggggagggaguggcccag

SEQ ID NO: 145937 - RNA, 64 nt, hsa
acaaaaacacguaggggcagggacgguccccacccccagggacacaaccccuggucuuggacca

SEQ ID NO: 145938 - RNA, 64 nt, hsa
gaaaggagucccaggccugucccuagggacaaggcccagggaagaguguauuuggggagcaggg

SEQ ID NO: 145939 - RNA, 64 nt, hsa
uggguuugcaggaaggccugaacaugugcacccucccagggacacuggaugcgcugggagcccc

SEQ ID NO: 145940 - RNA, 64 nt, hsa
cuccucaauuucuuggccucacuuauugcccaaacccagggaguuagggggguacgggugaaag

SEQ ID NO: 145941 - RNA, 64 nt, hsa
uuaucuucccacugugguaaccccccauguggcacccagggacugaaggacacagugcguggag

SEQ ID NO: 145942 - RNA, 64 nt, hsa
ggggugcaggacccuaaguagacuggguagaaaccccagggaugauucuucaaagcccccuccu

SEQ ID NO: 145943 - RNA, 64 nt, hsa
agcagccuuaaggaugcuagacacucauuuagugcccagggaguccagcgaaugacgucugugg

SEQ ID NO: 145944 - RNA, 64 nt, hsa
uaaaguuuucuuuuauuuggguggccgggagagacccagggagguucuggagguuccuuucugu

SEQ ID NO: 145945 - RNA, 64 nt, hsa
ccauccgggauagggcagaggaggugcuggcggccccagggaaggaggguguguaccccaaggc

SEQ ID NO: 145946 - RNA, 64 nt, hsa
ugucugggggacaagggggucucuggagaugucacccagggagcccccucuaugucugagaggc

SEQ ID NO: 145947 - RNA, 64 nt, hsa
gccaaagcugaccucugaguggccaacugcagcucccagggacuccgagaccuccgguccgaga

SEQ ID NO: 145948 - RNA, 64 nt, hsa
ggggucccugagagugcccccacccaucucaugccccagggaccgccacugcccaccgccucca

SEQ ID NO: 145949 - RNA, 64 nt, hsa
acucuguaaggaccuggggcaggauaucuucucccccagggaucuucuauuuaaguggcuucug

SEQ ID NO: 145950 - RNA, 64 nt, hsa
ccagggcagccuggccacugccaugagcuuucuacccagggacugugcucagguaaguggggcc

SEQ ID NO: 145951 - RNA, 64 nt, hsa
augguccccagcagugccugguucugagcaaacucccagggaagaaaacggcccugucuccaug

SEQ ID NO: 145952 - RNA, 64 nt, hsa
guugaagcucuucagaggagcuggaacugucuaccccagggacacacccauuucguugcuaccc

SEQ ID NO: 145953 - RNA, 64 nt, hsa
ucuacucccagggaccugcuggaaggcuggagugcccagggagagguauagaggugucauaggc

SEQ ID NO: 145954 - RNA, 64 nt, hsa
accaggcuuugcagcccugggcucugucucuacucccagggaccugcuggaaggcuggagugcc

SEQ ID NO: 145955 - RNA, 64 nt, hsa
ggccccagccacggcugcagagccugggcucagccccagggagggcagggagagcaaggggcaa

SEQ ID NO: 145956 - RNA, 64 nt, hsa
uagaggaagggagguuugagccagacaggccuuucccagggaagccuccucccaggugcuugcc

SEQ ID NO: 145957 - RNA, 64 nt, hsa
ccugggguaccuagucaccaggaucuccaggacucccagggagcagagucuucucaucuuuuca

SEQ ID NO: 145958 - RNA, 64 nt, hsa
gcuggcaucuguagcucgguggcuugacauucuccccagggacuucccgguuccuaguucuuug

SEQ ID NO: 145959 - RNA, 64 nt, hsa
aaggcagaagccacaagaggccuugagugccacccccagggaagaacauaaaggguugcacaau

SEQ ID NO: 145960 - RNA, 64 nt, hsa
cucaauccaccccugacccaucugucagcuuuuucccagggagccguuucagggguucugggca

SEQ ID NO: 145961 - RNA, 64 nt, hsa
agccaaaugcaguuccaaauaguggacauaaucucccagggaaaucugggcucgaggccuacaa

SEQ ID NO: 145962 - RNA, 64 nt, hsa
aguuccuggugugggccagcugguguuggguggccccagggagucacacagucuguacccggcc

SEQ ID NO: 145963 - RNA, 64 nt, hsa
ugccuaggggagcugggccaggcacuagccuuugcccagggaggugggccucaggcugcccagg

SEQ ID NO: 145964 - RNA, 64 nt, hsa
cuauccugucuguccccaccccagcuguccccugcccagggagcuggcauaaaagcacgaggcc

SEQ ID NO: 145965 - RNA, 64 nt, hsa
gggauuccugagugucagugacuugggauucccacccagggacucaagccagccacccccuucu

SEQ ID NO: 145966 - RNA, 64 nt, hsa
ucuuucaucgucauggaaacuuguaucccauuugcccagggaacugccacuccugguugccaug

SEQ ID NO: 145967 - RNA, 64 nt, hsa
cacggaccaaagggagucugccagggccccucuccccagggaagcagcagccucgccccuggca

SEQ ID NO: 145968 - RNA, 64 nt, hsa
gcuccuuugggcuucagcugccaguguccugagccccagggagagggggcuggugggugccuag

SEQ ID NO: 145969 - RNA, 64 nt, hsa
cguggcacgggccccccgcccccgagaucuggagcccagggacuuucuuccuggcagaucugug

SEQ ID NO: 145970 - RNA, 64 nt, hsa
ggggcacagugugaaacccgcacccuagccaggccccagggagccuccgcugggcccagacagc

SEQ ID NO: 145971 - RNA, 64 nt, hsa
cugggucggcuucugucccugucacacccccaaccccagggaggggcugucauagucccagagg

SEQ ID NO: 145972 - RNA, 64 nt, hsa
aauaccuauuucugacugagucucccagcccagacccagggacccuuggccccaagcucagcuc

SEQ ID NO: 145973 - RNA, 64 nt, hsa
ugcacuccccgugcgguacaggggcacuucguaacccagggaaagggcggggggcauauuugca

SEQ ID NO: 145974 - RNA, 64 nt, hsa
caagcgcgcucggugcgggcaggcucgcauugcacccagggagcuggaguugagcuguuccccu

SEQ ID NO: 145975 - RNA, 64 nt, hsa
gcucugacccuggaaugggguugguuuggacacccccagggaucugagcccugacccuuuguga

SEQ ID NO: 145976 - RNA, 64 nt, hsa
gcaggagccauccgccccccucagccccuuccuccccagggagcaaagccauaaggggcagggg

SEQ ID NO: 145977 - RNA, 64 nt, hsa
cccugagcuguccagaccccaccaucucccggaccccagggagguggccauugccagaagccug

SEQ ID NO: 145978 - RNA, 64 nt, hsa
cccucugugccagaaauggguuuucgggacuugccccagggaagccgucaccggcccggcccau

SEQ ID NO: 145979 - RNA, 64 nt, hsa
aaugaaacugcaaaccucgugugucuuaacuccccccagggaugccacuccauuccuccgcccc

SEQ ID NO: 145980 - RNA, 64 nt, hsa
caaaggcccaacccccagaggccacaccaguccucccagggaguccucgagucgcccugcccag

SEQ ID NO: 145981 - RNA, 64 nt, hsa
guggugggggguggauggcggcugugacucagggcccagggaucacaugggggucacugcugcc

SEQ ID NO: 145982 - RNA, 64 nt, hsa
gauggagggcugggcgccauggggucagggaggccccagggacccaugggcagagcuggggagc

SEQ ID NO: 145983 - RNA, 64 nt, hsa
gcaggaagcugcuaccacccuuagggcuggagaacccagggaagcuaagaggagggugcaacga

SEQ ID NO: 145984 - RNA, 64 nt, hsa
ggccugucuggggacauguaggaugggcucuuaccccagggagggcggcaggcuccacuucggc

SEQ ID NO: 145985 - RNA, 64 nt, hsa
ucaagggauuucccugucucagagcagccuuugccccagggaaaugggcucugggcuggcugcc

SEQ ID NO: 145986 - RNA, 64 nt, hsa
caggcagcccucccagugcccaagggccaccaaccccagggaaacagggccagcacagaggggc

SEQ ID NO: 145987 - RNA, 64 nt, hsa
cgaaagcucaggggagcacagaagcccauggaagcccagggagaugucccuggggcagacacua

SEQ ID NO: 145988 - RNA, 64 nt, hsa
uuugauuuaauccuuuggcugugggcugaggccucccagggaagcugggugggguggguguuga

SEQ ID NO: 145989 - RNA, 64 nt, hsa
aaggaugcugccaggugacccgaggugcacucgccccagggagauggaguagacagccuggccu

SEQ ID NO: 145990 - RNA, 64 nt, hsa
cuuggggcagcccccagaaggaccacugcuggaucccagggagaaccugcuggcguuggcugug

SEQ ID NO: 145991 - RNA, 64 nt, hsa
caguccccuccgggaugaccugauucaccuccagcccagggaauggaaucuagaggaauacgug

SEQ ID NO: 145992 - RNA, 64 nt, hsa
gagucccuuccccuucagagaggcuucuauccuucccagggaggaggcgccgcugagacccuuc

SEQ ID NO: 145993 - RNA, 64 nt, hsa
ccccaccgugugggcugccccaaccccaaaugugcccagggaggggggggaacccaaggcacag

SEQ ID NO: 145994 - RNA, 64 nt, hsa
accaaaggacuugaucugaguugggaguaaggcccccagggacaccccaucauuucacccucac

SEQ ID NO: 145995 - RNA, 64 nt, hsa
gcuggauaugcccaccccugccaaaagcccugaccccagggaaggaggcugcucacccagccuu

SEQ ID NO: 145996 - RNA, 64 nt, hsa
aaagggacugggaaguaaagggaaaccauauggccccagggaauggacccuuggagacucccau

SEQ ID NO: 145997 - RNA, 64 nt, hsa
agacagaggcagacuggagugaugcggccacaagcccagggacaccuggagcccccaggagcug

SEQ ID NO: 145998 - RNA, 64 nt, hsa
acagaggcagagacugaagugaugcugccccaagcccagggaugccuggaguccccaggagcug

SEQ ID NO: 145999 - RNA, 64 nt, hsa; identical to SEQ ID NO: 96836

SEQ ID NO: 146000 - RNA, 64 nt, hsa; identical to SEQ ID NO: 96837

SEQ ID NO: 146001 - RNA, 64 nt, hsa; identical to SEQ ID NO: 96838

SEQ ID NO: 146002 - RNA, 64 nt, hsa; identical to SEQ ID NO: 96839

SEQ ID NO: 146003 - RNA, 64 nt, hsa; identical to SEQ ID NO: 96840

SEQ ID NO: 146004 - RNA, 64 nt, hsa; identical to SEQ ID NO: 96841

SEQ ID NO: 146005 - RNA, 64 nt, hsa; identical to SEQ ID NO: 96842

SEQ ID NO: 146006 - RNA, 64 nt, hsa; identical to SEQ ID NO: 96843

SEQ ID NO: 146007 - RNA, 64 nt, hsa; identical to SEQ ID NO: 96844

SEQ ID NO: 146008 - RNA, 64 nt, hsa; identical to SEQ ID NO: 96845

SEQ ID NO: 146009 - RNA, 64 nt, hsa; identical to SEQ ID NO: 96846

SEQ ID NO: 146010 - RNA, 64 nt, hsa; identical to SEQ ID NO: 96847

SEQ ID NO: 146011 - RNA, 64 nt, hsa; identical to SEQ ID NO: 96848

SEQ ID NO: 146012 - RNA, 64 nt, hsa; identical to SEQ ID NO: 96849

SEQ ID NO: 146013 - RNA, 64 nt, hsa; identical to SEQ ID NO: 96850

SEQ ID NO: 146014 - RNA, 64 nt, hsa; identical to SEQ ID NO: 96851

SEQ ID NO: 146015 - RNA, 64 nt, hsa; identical to SEQ ID NO: 96852

SEQ ID NO: 146016 - RNA, 64 nt, hsa; identical to SEQ ID NO: 96853

SEQ ID NO: 146017 - RNA, 64 nt, hsa; identical to SEQ ID NO: 96854

SEQ ID NO: 146018 - RNA, 64 nt, hsa; identical to SEQ ID NO: 96855

SEQ ID NO: 146019 - RNA, 64 nt, hsa; identical to SEQ ID NO: 96856

SEQ ID NO: 146020 - RNA, 64 nt, hsa; identical to SEQ ID NO: 96857

SEQ ID NO: 146021 - RNA, 64 nt, hsa; identical to SEQ ID NO: 96858

SEQ ID NO: 146022 - RNA, 64 nt, hsa; identical to SEQ ID NO: 96859

SEQ ID NO: 146023 - RNA, 64 nt, hsa; identical to SEQ ID NO: 96860

SEQ ID NO: 146024 - RNA, 64 nt, hsa; identical to SEQ ID NO: 96861

SEQ ID NO: 146025 - RNA, 64 nt, hsa; identical to SEQ ID NO: 96862

SEQ ID NO: 146026 - RNA, 64 nt, hsa; identical to SEQ ID NO: 96863

SEQ ID NO: 146027 - RNA, 64 nt, hsa; identical to SEQ ID NO: 96864

SEQ ID NO: 146028 - RNA, 64 nt, hsa; identical to SEQ ID NO: 96865

SEQ ID NO: 146029 - RNA, 64 nt, hsa; identical to SEQ ID NO: 96866

SEQ ID NO: 146030 - RNA, 64 nt, hsa; identical to SEQ ID NO: 96867

SEQ ID NO: 146031 - RNA, 64 nt, hsa; identical to SEQ ID NO: 96868

SEQ ID NO: 146032 - RNA, 64 nt, hsa; identical to SEQ ID NO: 96869

SEQ ID NO: 146033 - RNA, 64 nt, hsa; identical to SEQ ID NO: 96870

SEQ ID NO: 146034 - RNA, 64 nt, hsa; identical to SEQ ID NO: 96871

SEQ ID NO: 146035 - RNA, 64 nt, hsa; identical to SEQ ID NO: 96872

SEQ ID NO: 146036 - RNA, 64 nt, hsa; identical to SEQ ID NO: 96873

SEQ ID NO: 146037 - RNA, 64 nt, hsa; identical to SEQ ID NO: 96874

SEQ ID NO: 146038 - RNA, 64 nt, hsa; identical to SEQ ID NO: 96875

SEQ ID NO: 146039 - RNA, 62 nt, hsa
uggcuuggucuggaugggacacugucagaguuuggccacagccuguccuuuacuucauccac

SEQ ID NO: 146040 - RNA, 62 nt, hsa
gagaggggaagucuuggcagggaaaucccuuuuggccacacaguuuacaaacccaguaucau

SEQ ID NO: 146041 - RNA, 62 nt, hsa
guguaggguugugagcaaagcuccccuguuuguggccacaccuucccuuuccaaaaaggcua

SEQ ID NO: 146042 - RNA, 62 nt, hsa
cccaggaaggaguuugagguucauugucauuauggccacaguuuggugcuugugcacgggac

SEQ ID NO: 146043 - RNA, 62 nt, hsa
cugcagcaagcagggcuucaggaggugcccgcuggccacagccagguuuucccuaagaagau

SEQ ID NO: 146044 - RNA, 62 nt, hsa
cgcacugggcugccgucuguccccagcucccguggccacacagcuaucuggaggcuuugcag

SEQ ID NO: 146045 - RNA, 62 nt, hsa
ggugggucauuugagaggaguuccagcuguucuggccacacugggcugguggggaaggagcg

SEQ ID NO: 146046 - RNA, 62 nt, hsa
cccauugacagaugagaggucugaagccuuccuggccacaggcaucacuuucuccuccuccu

SEQ ID NO: 146047 - RNA, 62 nt, hsa
gacacaaugccucacucaggccccgggcucccuggccacaagcuuuuucuauccuguuuuca

SEQ ID NO: 146048 - RNA, 62 nt, hsa
gauggcucuuguucagucaagaccccagacucuggccacaaaaaugccauaaugccuguugg

SEQ ID NO: 146049 - RNA, 62 nt, hsa
gagccaaugcucaccagccccagagucagagcuggccacaggcuggcagccuccaggggcuu

SEQ ID NO: 146050 - RNA, 62 nt, hsa
uaagccauguggcagggaccgucuugcccugcuggccacacucuggagaagcacuucucagc

SEQ ID NO: 146051 - RNA, 61 nt, hsa; identical to SEQ ID NO: 110929

SEQ ID NO: 146052 - RNA, 62 nt, hsa
gccucucagugcccuccagccccgcgaccauguggccacaauccacgcuucuccggaucgcg

SEQ ID NO: 146053 - RNA, 62 nt, hsa
aguggccacaaggcugcuuucugcacucucuguggccacaggaacaaagaugcgaguugaag

SEQ ID NO: 146054 - RNA, 62 nt, hsa
aaguuagcuuugguagcucuguuggucagcaguggccacaaggcugcuuucugcacucucug

SEQ ID NO: 146055 - RNA, 62 nt, hsa
ccagcaacuugaacuucaccugcaaagcucuguggccacauuuucagccaaagggaaauaug

SEQ ID NO: 146056 - RNA, 62 nt, hsa
cauccuggcuggagaauguggagaacuaaagguggccacaaauucuuugacacucaaguccc

SEQ ID NO: 146057 - RNA, 62 nt, hsa
ggaaggucaauauaugccuaacauuucuaaacuggccacauaaccuuagauuuuuaaaggaa

SEQ ID NO: 146058 - RNA, 62 nt, hsa
uuccuacaugaucuuuaccuguuguuagacuguggccacagccaguaaaucaggccagagug

SEQ ID NO: 146059 - RNA, 62 nt, hsa
cacuggaaggaagagccaucguggucuuugucuggccacaggccaggcugcugggcauccuc

SEQ ID NO: 146060 - RNA, 62 nt, hsa
ccaucaccccucccaggccagccucuguaaguuggccacacuuggggagugaguguggguau

SEQ ID NO: 146061 - RNA, 62 nt, hsa
ccucucuuuggaaaguuuagccuggaagcaguuggccacacuguguggagggcaccucucug

SEQ ID NO: 146062 - RNA, 62 nt, hsa
gccugcgucccugcacacugcgaggacugccuuggccacaggcccacucccuacgacacgug

SEQ ID NO: 146063 - RNA, 62 nt, hsa
ucaggcacccagguuccuacugucuugccauguggccacaguuagcaacaaaggaggcugua

SEQ ID NO: 146064 - RNA, 62 nt, hsa
cucuuggaucagucacuguggccaugcauguuuggccacaugauuaauccagucugggucau

SEQ ID NO: 146065 - RNA, 62 nt, hsa
acagaugugcuguugguccaggugucccagucuggccacagcccugccuccgcccucaccua

SEQ ID NO: 146066 - RNA, 62 nt, hsa
agggggugggagcagagccucggugagggucuuggccacagggcagugccuuccugaacgug

SEQ ID NO: 146067 - RNA, 62 nt, hsa
uugaaggcuggaggagucagagugagagcuaguggccacagcugcagagcacugcagcuccc

SEQ ID NO: 146068 - RNA, 62 nt, hsa
accccuccccagucaccaguucuccucuggacuggccacacccaccccauuccuggacuccu

SEQ ID NO: 146069 - RNA, 62 nt, hsa
uggcauuacagggaugagggagucacuguggguggccacagggcuauggccaagcguucccu

SEQ ID NO: 146070 - RNA, 62 nt, hsa
gugagggucccaguguucccuccacucccgaguggccacaggcucgcgggcugggaaggauu

SEQ ID NO: 146071 - RNA, 62 nt, hsa
auguccagcuucucuugaaaacuugguauaucuggccacacugggcucacauucccaagggu

SEQ ID NO: 146072 - RNA, 62 nt, hsa
uggcccgggccuuauccagucaaagcggaugcuggccacagaaaggccacucaggauguccu

SEQ ID NO: 146073 - RNA, 62 nt, hsa
cagcucaccuguggguuuucccuuugagccuuuggccacauccaccucgaggggacccuggc

SEQ ID NO: 146074 - RNA, 62 nt, hsa
cagcuagccuacgcggggauggccgucaguucuggccacaggacccgagucugggcuugggu

SEQ ID NO: 146075 - RNA, 62 nt, hsa
uggagaagggcugcuacuuaacaaggaaguccuggccacaggaguccccuacuggcugcaga

SEQ ID NO: 146076 - RNA, 62 nt, hsa
gaggcagggaaugaagaagguacugugggccauggccacaccugaugcguuuuuggugggcu

SEQ ID NO: 146077 - RNA, 62 nt, hsa
ccccccagccaaguggcagacgcugguuuugguggccacaggggguggcccgugcgacagag

SEQ ID NO: 146078 - RNA, 62 nt, hsa
agguaguaccuuugaagaugcuguugaccaccuggccacagccagucaggggccugguggug

SEQ ID NO: 146079 - RNA, 62 nt, hsa
gauaauguuggaaagaaagguucugaauccuuuggccacauuuugcccugcuucucucaggg

SEQ ID NO: 146080 - RNA, 62 nt, hsa
uuggacugcacagagcagcugccgugagcgucuggccacauggagcugcuuucuggggaaca

SEQ ID NO: 146081 - RNA, 64 nt, hsa
aggggugucccaugacacuauuucauauucuacagaaguaaaucagguuucaccaacugaaaug

SEQ ID NO: 146082 - RNA, 64 nt, hsa
agaaggaauuaccuuugacaauauuuuucgguaagaaguaaaaccucuggagaccuaucuuuaa

SEQ ID NO: 146083 - RNA, 64 nt, hsa
aguugauauacauagucauuuuuccucuaugguagaaguaaaaaaaaaaaaaaaggacauagca

SEQ ID NO: 146084 - RNA, 64 nt, hsa
cuauaugacagauguauuuuaaaaguuucaucuugaaguaaaaguacaacagcuugaaguguug

SEQ ID NO: 146085 - RNA, 64 nt, hsa
cuuuguugguaaaagugacauguuaaggggcuaugaaguaaauaugcugcaguuaauuaugcua

SEQ ID NO: 146086 - RNA, 64 nt, hsa
cuuuguugguaaaagugacauguuaaggggcuaugaaguaaauaugcugcaguuaauugugcua

SEQ ID NO: 146087 - RNA, 64 nt, hsa
cuguaugacagauguauuuuaaaaguuucaacuugaaguaaaaguacaacagcuugaaguguug

SEQ ID NO: 146088 - RNA, 64 nt, hsa
gaauagugaaguuuugaaaauacuuugaaaaagagaaguaaaaguuuaacuuuuuaacuaaagu

SEQ ID NO: 146089 - RNA, 64 nt, hsa
agaucucuugggaucagaauuauauaauaucuuugaaguaaauuauuaaaauauccuauuuaau

SEQ ID NO: 146090 - RNA, 64 nt, hsa
acaaauaaucucuagagagguccacuuuguugcugaaguaaacguuacuuguugcaacccgagg

SEQ ID NO: 146091 - RNA, 64 nt, hsa
aggaccagaugcccauagaagcacaguacagacugaaguaaacccaaacuuggcuggggcucag

SEQ ID NO: 146092 - RNA, 64 nt, hsa
uuccuaaagauuugaauuuuuuguucccauggaagaaguaaagaagaggucacuagauguugca

SEQ ID NO: 146093 - RNA, 64 nt, hsa
gauuaugcagaagaaaauagaagagcuuugccgggaaguaaagcuuuggaggaaaaucaauauc

SEQ ID NO: 146094 - RNA, 64 nt, hsa
ucaguuuguuuauuuuguucacccuucaagacaagaaguaaaagaaguauaauuucuguaguaa

SEQ ID NO: 146095 - RNA, 64 nt, hsa
ccgggauuuuacuacuaaaauuggacauuuaagcgaaguaaaagaggccgggugcgguggcuca

SEQ ID NO: 146096 - RNA, 64 nt, hsa
cugggagacugcaucucaaaaaagaaaaauaaacgaaguaaaagauauuuaucagagcuguuac

SEQ ID NO: 146097 - RNA, 64 nt, hsa
acugaguggugcuuuaucugaauaggccuggaucgaaguaaaauagaaaugggacuggcuuucc

SEQ ID NO: 146098 - RNA, 64 nt, hsa
gaaguaaaauagaaaugggacuggcuuuccacaggaaguaaacugcuucagagcccacaguccc

SEQ ID NO: 146099 - RNA, 64 nt, hsa
uuguugaucacacuguugccuuggaacccacgcagaaguaaacucagccacuuugcucagagaa

SEQ ID NO: 146100 - RNA, 60 nt, hsa
gguuucugccaucuggaugaccagaauagcgaaguaaaacgggccaggauaaacccugac

SEQ ID NO: 146101 - RNA, 64 nt, hsa
acacaauuuuuuucauucuuccuccucuccauucgaaguaaagauccccaguuaguuuuuauau

SEQ ID NO: 146102 - RNA, 64 nt, hsa
cuguuuaacucuucauguuccaucuuucucuucugaaguaaacuauuuugaaaguucucuuuuu

SEQ ID NO: 146103 - RNA, 64 nt, hsa
ugggauuacaggcgcgagccaccacacccggcuggaaguaaacauuuuuaaagcuacuuuuacu

SEQ ID NO: 146104 - RNA, 64 nt, hsa
ucacuuuuuucccccuucaaaguauguuacugaggaaguaaacuuuuuuuuuuuuuuuugguuu

SEQ ID NO: 146105 - RNA, 64 nt, hsa
cauguguguauacaacuguaaucuggaacuucaggaaguaaaauuauuugaaguuucuuaguaa

SEQ ID NO: 146106 - RNA, 64 nt, hsa
augcuuccacucauguaacuauuuuaaauguuaagaaguaaaauaaugaaagauauguuaauua

SEQ ID NO: 146107 - RNA, 64 nt, hsa
ucauacuaaaagcaauguuuaaaucaaacuaaagauuaaaaauuaaaauucguuuuugcaauaa

SEQ ID NO: 146108 - RNA, 64 nt, hsa
accuuugaaaugcaccaaaugaauugaguuuguaauuaaaaaaauuuuuuucccuuucagucau

SEQ ID NO: 146109 - RNA, 64 nt, hsa
aaaaacaagugaaaaggucaagauacaaauguguauuaaaaaaaaaaaagccuauuaauagggu

SEQ ID NO: 146110 - RNA, 64 nt, hsa
aaacuugacuugcuaucucagcaagauaaauuauauuaaaaaaauaagaauccugcaguguuua

SEQ ID NO: 146111 - RNA, 64 nt, hsa
acaagauggcaauaaauacuaugggauuguuuguauuaaaaaauuuacauugcuucuuacuauu

SEQ ID NO: 146112 - RNA, 64 nt, hsa
gauauagggaaagaaugaagugccuuucaaguacauuaaaaaucaguuaagaguuuacaggaaa

SEQ ID NO: 146113 - RNA, 64 nt, hsa
aucaccacuuauuaaaacacacauagaaugaugaauuaaaaaaguuuucuaggauugucuuuua

SEQ ID NO: 146114 - RNA, 64 nt, hsa
uuuugcaugcuuaaggauuccaaacgacuaagaaauuaaaaaaaaaaagacugucauucauacc

SEQ ID NO: 146115 - RNA, 64 nt, hsa
aaugauaguauuccauuuaacauuacugauuuuuauuaaaaaccuggacagaaaauuauaaauu

SEQ ID NO: 146116 - RNA, 58 nt, hsa
aguuccguagucuaagauaacuaacugaauuaaaaauuauguaauacuuguggaacuu

SEQ ID NO: 146117 - RNA, 64 nt, hsa
cucacccuguuuguggcuauuuuaaauucauauuauuaaaaaacaaaaaaaacccaccuauuug

SEQ ID NO: 146118 - RNA, 64 nt, hsa
acaaaagcacuagacugaguuuccucuuauagguauuaaaaauagcacuuuuaggaaacugauu

SEQ ID NO: 146119 - RNA, 64 nt, hsa
aacgccacauuuuuuaaauagacaaaaauaugagauuaaaaauguugaauuuuacuaacaauaa

SEQ ID NO: 146120 - RNA, 64 nt, hsa
guguuauagcaguuucauucaagaaaaguuuaaaauuaaaaagugauuaucaaagaauaucagg

SEQ ID NO: 146121 - RNA, 64 nt, hsa
uaacuuaguaaaguagaauaauuucaugguauucauuaaaaagcauaaaagucuuccucuugcc

SEQ ID NO: 146122 - RNA, 64 nt, hsa
uguaucuguuauuuaaagcccaguggauauuucaauuaaaaaaaaaaucuaaagaugaauaguc

SEQ ID NO: 146123 - RNA, 64 nt, hsa
agugaugggaauggguuugagagucguaauuuauauuaaaaaguuguuggacuuuuaaauacau

SEQ ID NO: 146124 - RNA, 64 nt, hsa
uaccagcuucccagcaacuuuccuuuuuuaaaauauuaaaaauuuaauucagguucucuuaauu

SEQ ID NO: 146125 - RNA, 64 nt, hsa
uugcaaaugagcagaauaaaugagguuuuuuucaauuaaaaauuacuauaaauccaggaggcaa

SEQ ID NO: 146126 - RNA, 64 nt, hsa
auaggugaagugcaagcuaguuucuauaaugaccauuaaaaaaauucugcuguguaauucuugc

SEQ ID NO: 146127 - RNA, 64 nt, hsa
acugaaauccugaagaggagagauuugguuauaaauuaaaaagguugggugaucuuaagugccu

SEQ ID NO: 146128 - RNA, 64 nt, hsa
aacaauguucuuacaggucauaauguauuucacaauuaaaaaacuaaaauauguacccauuuuu

SEQ ID NO: 146129 - RNA, 64 nt, hsa
gaacaaauggugccugaauauuaacaguguucugauuaaaaacaaaaaaaagauacauaugccu

SEQ ID NO: 146130 - RNA, 64 nt, hsa
gcauaguacauaguuggaaaagcuuuguggggggauuaaaaaaaaaaaaaagcacuguuguguu

SEQ ID NO: 146131 - RNA, 64 nt, hsa
auucauauucuuucuauaccacugucauuaauauauuaaaaagauguauguguuagacuaucga

SEQ ID NO: 146132 - RNA, 64 nt, hsa
acggaugugcaugugcagauucccuuuugcagguauuaaaaauaauuaaaaauaguccugccug

SEQ ID NO: 146133 - RNA, 64 nt, hsa
augugcagauucccuuuugcagguauuaaaaauaauuaaaaauaguccugccugagguugcagu

SEQ ID NO: 146134 - RNA, 64 nt, hsa
gauguagaguagggcaaaucuguguguguaugucauuaaaaaaauucuaccaucuuucuuuauc

SEQ ID NO: 146135 - RNA, 64 nt, hsa
aauauuuuguagauuacauauugauuuuucaaaaauuaaaaauguauuucaaacuauucuuacu

SEQ ID NO: 146136 - RNA, 64 nt, hsa
uucuggagagaugguaugcagcauacaaaaauauauuaaaaauauaaacaauguucaggagagu

SEQ ID NO: 146137 - RNA, 64 nt, hsa
ucaugaacaaaaugaaguuaacuuaguguuuagcauuaaaaauaaaaguuguaccuugacccua

SEQ ID NO: 146138 - RNA, 64 nt, hsa
caggcauagccuggauacaguauaaaaauagauaauuaaaaagaugguugccaagcaaggaaaa

SEQ ID NO: 146139 - RNA, 64 nt, hsa
ucugauguugccuuaauauucugcuauugcagcaauuaaaaauugucuucauguacauuuggaa

SEQ ID NO: 146140 - RNA, 64 nt, hsa
acauuuugugacaugcauacagauagcauguguuauuaaaaagaguugccuauugaaaugauca

SEQ ID NO: 146141 - RNA, 64 nt, hsa
ucuggagaaauuaagcuuauagacagcauguguuauuaaaaagaguuaccuauugaaaugauag

SEQ ID NO: 146142 - RNA, 64 nt, hsa
aagacagauggaugaucugugaacauaaguguuuauuaaaaauggcaauuaaauauaaauuacu

SEQ ID NO: 146143 - RNA, 64 nt, hsa
cauuuugauaaucauuugcuuccaguguuuaaaaauuaaaaaaagaauggggagaagguuauga

SEQ ID NO: 146144 - RNA, 64 nt, hsa
gagaaucaaggcaguaguuugguauuuggugcuuauuaaaaaugugguuuguuuugaacuggaa

SEQ ID NO: 146145 - RNA, 64 nt, hsa
auaaaugugaagcuuuuugaugccaucaaaacuuauuaaaaaauaggauuuacuuuuuucuaau

SEQ ID NO: 146146 - RNA, 63 nt, hsa
acugucaauauacaaaacuuuaaagauuaaaaacauuaaaaauaaaaccauguccauuuaaaa

SEQ ID NO: 146147 - RNA, 64 nt, hsa
uuuuaaaggacugucaauauacaaaacuuuaaagauuaaaaacauuaaaaauaaaaccaugucc

SEQ ID NO: 146148 - RNA, 64 nt, hsa
auuuaauuuuuuucaaagucucagcccugucuguauuaaaaaacaaaaaaagcguuuaccagcu

SEQ ID NO: 146149 - RNA, 64 nt, hsa
gaaaacaagacugaaauaugauggcccaaaauuuauuaaaaagcuauauuuuccugagagacug

SEQ ID NO: 146150 - RNA, 64 nt, hsa
auuuauauguagccuuuacuguuugauauaccaaauuaaaaaaaaauuguaucucauuacuuau

SEQ ID NO: 146151 - RNA, 64 nt, hsa
uacaacauagcagaucuguuuugugguuuggaauauuaaaaaacuucauguaauuuuauuuuaa

SEQ ID NO: 146152 - RNA, 64 nt, hsa
guuuggcguagcagaguuaaaucucaaauaggcuauuaaaaaagucuacaacauagcagaucug

SEQ ID NO: 146153 - RNA, 64 nt, hsa
uaaaaggaaacuguauaagcaauugcccuuaaaaauuaaaaagaauaaaagauuuucuauaaaa

SEQ ID NO: 146154 - RNA, 64 nt, hsa
cccaaaagaaaugauauguauucuuguuaaacuuauuaaaaaauaagugauacaaauauuuaua

SEQ ID NO: 146155 - RNA, 64 nt, hsa
uuccaggguaaaaauaauaagguugaaucauuuuauuaaaaauacuuuuuaagaaaauaacuau

SEQ ID NO: 146156 - RNA, 64 nt, hsa
agagcacagaaggucaucaucacaagcaaacuuuauuaaaaaaaaacuagaagugugcuuugau

SEQ ID NO: 146157 - RNA, 64 nt, hsa
aauaugugguugcucuuuaucccuuuguacaagcauuaaaaaaacugcuguuuuauaagaagac

SEQ ID NO: 146158 - RNA, 64 nt, hsa
ugccaaccaauagaugagaauuuugaggaaaaaaauuaaaaauauguaaaauuaauaauuugca

SEQ ID NO: 146159 - RNA, 64 nt, hsa
gcugcugauaugacacaccuuugaauuuguuaaaauuaaaaacaacguauuccuuuguagugug

SEQ ID NO: 146160 - RNA, 64 nt, hsa
cagucugaugguucuguucuucauugugauugucauuaaaaagugguaaauugcucaauguaau

SEQ ID NO: 146161 - RNA, 64 nt, hsa
uagaggaugugaucuaauuucuuucuagcucaucauuaaaaaggaaauuguaucaggacccaug

SEQ ID NO: 146162 - RNA, 64 nt, hsa
ucaucucuacaaaaaguaaaaauuaaaaaaugaaauuaaaaauaaaauuaccuagguguggugg

SEQ ID NO: 146163 - RNA, 64 nt, hsa
acauagcaaaaucucaucucuacaaaaaguaaaaauuaaaaaaugaaauuaaaaauaaaauuac

SEQ ID NO: 146164 - RNA, 64 nt, hsa
ucuucucauuguuuguuuguaaguuugaauuuguauuaaaaagccugcauucugagcuggacau

SEQ ID NO: 146165 - RNA, 64 nt, hsa
agaguuauguuuauuuuugaaggguauuaggauaauuaaaaauaauguaaugugccuagcacac

SEQ ID NO: 146166 - RNA, 64 nt, hsa
cuguuacggccuccuuuuaucucucuucuccaauauuaaaaaaaauggaaaucaaauuauuaug

SEQ ID NO: 146167 - RNA, 64 nt, hsa
aaugaaacuugguuaagauuuugacuacuucauuauuaaaaauugauagaauuuuagcuccuga

SEQ ID NO: 146168 - RNA, 64 nt, hsa
accauccucgccaacaaggugaaaccccaccucuauuaaaaauacaaaaauuagccgggagugg

SEQ ID NO: 146169 - RNA, 64 nt, hsa
uuuaacauauuuauaauuacuaugugucuguauuauuaaaaaaaauuaugugucuguguuauac

SEQ ID NO: 146170 - RNA, 64 nt, hsa
auauuccauguuacaaauugacaugauuuuccauauuaaaaaauuuucauuuauuuuguaccuc

SEQ ID NO: 146171 - RNA, 64 nt, hsa
auggucaaguuacaacaacugaauucuaauauggauuaaaaacuccacauaaauauuuuucccc

SEQ ID NO: 146172 - RNA, 64 nt, hsa
cuggucccaucaucugaagauucuguauagaauuauuaaaaaaaaaauccaucuuucuuuauuu

SEQ ID NO: 146173 - RNA, 64 nt, hsa
ugguucauuguggccuaucugguuuaagucuuucauuaaaaaugucucguuagaguauuugaug

SEQ ID NO: 146174 - RNA, 64 nt, hsa
uggcaggcuguggucuccucugcaaagcauuuuaauuaaaaaccucaauaaagauggcccugcc

SEQ ID NO: 146175 - RNA, 64 nt, hsa
gugaacauaauaucuaaugauguggagcaaguacauuaaaaacaggaaggaagagaucugugau

SEQ ID NO: 146176 - RNA, 64 nt, hsa
caaaaaaaaaaaaaaaaaaaauccauauccauucauuaaaaaaaugagauauaaagcaacaacu

SEQ ID NO: 146177 - RNA, 64 nt, hsa
gcugugaagcuuauagcauuuuuaaaguauggcuauuaaaaacacuaaguugauucuggaaugc

SEQ ID NO: 146178 - RNA, 64 nt, hsa
uauuuguaaagcuaauaugcuccucaauguaauuauuaaaaauucucaagucacagcuaaacuu

SEQ ID NO: 146179 - RNA, 64 nt, hsa
aacuuacuaauucugauuuuaguguagccccuaaauuaaaaauggcuuccauaugccacucugu

SEQ ID NO: 146180 - RNA, 64 nt, hsa
cuccuuggaucauuauauugagugguuuuuauacauuaaaaaauguaugcagaguuuuuuuccc

SEQ ID NO: 146181 - RNA, 64 nt, hsa
augcuuuggaaacauauguccuagaaaacauaaaauuaaaaaaaaacacuauaguguaguuuuu

SEQ ID NO: 146182 - RNA, 64 nt, hsa
aauuuuguucagaguuucauccuaauccagauguauuaaaaauauauaaaaguguaaguuaaag

SEQ ID NO: 146183 - RNA, 64 nt, hsa
uuuaauuuuauuuguaugaauuuuccaggauuucauuaaaaauuauuauuguauuuuuuaccuu

SEQ ID NO: 146184 - RNA, 64 nt, hsa
uuuggcccuauugaauuuucagggaccagaaaacauuaaaaaguucugcaucuuauaaugguaa

SEQ ID NO: 146185 - RNA, 64 nt, hsa
caaacuggccauuugacuucagagauuuguuuucauuaaaaaauaagccugccgccaaaauaaa

SEQ ID NO: 146186 - RNA, 64 nt, hsa
gaccucuguuauuguuuaaaaaaaauaaauaaaaauuaaaaaaaucugugcaauaauuuuaaaa

SEQ ID NO: 146187 - RNA, 64 nt, hsa
gaagcuuaaauauguaauguaaccaaacuccaguauuaaaaaucucucauguuguuuucuuuau

SEQ ID NO: 146188 - RNA, 64 nt, hsa
acaacuuuuuuuuuaauuaccauagagaagauacauuaaaaaaaaucuucugauguuuuguagc

SEQ ID NO: 146189 - RNA, 64 nt, hsa
uugcaagugaagguuuacaauuuacaaaguguguauuaaaaaaaacaaaaagaacaaaaaaauc

SEQ ID NO: 146190 - RNA, 64 nt, hsa
auaaaauaaauauauauaaaccuaaaaaagauauauuaaaaauauaaaacugcguuaaaggcuc

SEQ ID NO: 146191 - RNA, 64 nt, hsa
uuaacuguacugaauagguuccccaauccaucguauuaaaaaacaauuaacugcccucugaaau

SEQ ID NO: 146192 - RNA, 64 nt, hsa
cauaguaagugcgaagacugagccagauuggccaauuaaaaacgaaaaccugacuagguucugu

SEQ ID NO: 146193 - RNA, 64 nt, hsa
gaugugcccuuuuauaaggaaacuucugauguuuauuaaaaaaacuggccuuuugauagaggua

SEQ ID NO: 146194 - RNA, 64 nt, hsa
aaaauaguacacacauauauauaacaaauaauauauuaaaaaacccauccaucaacuaaaacau

SEQ ID NO: 146195 - RNA, 64 nt, hsa
aaucauuaauuucaaaauuuaaagccaugcuaaaauuaaaaagaaaauauuaaauuacacaauu

SEQ ID NO: 146196 - RNA, 64 nt, hsa
auuuuuacaguugcagagaauuguuucugggcucauuaaaaaaaguaguauugcagacauugcu

SEQ ID NO: 146197 - RNA, 64 nt, hsa
uuuuaucuaguucucacacuuccuuuugaaagcuauuaaaaaucuauggcagaaaaauggucaa

SEQ ID NO: 146198 - RNA, 64 nt, hsa
agccuucauagacuuuuccaauccuuaguuaaauauuaaaaacugaguauuguaguuauuugcu

SEQ ID NO: 146199 - RNA, 64 nt, hsa
cucuuauaaucaugguaucuuucacagaauaaaaauuaaaaauaaugccagggugcaagugacc

SEQ ID NO: 146200 - RNA, 64 nt, hsa
cacauagguagaaagaguuugaguuuuacuguggauuaaaaagccuucccuaaaaagagagcau

SEQ ID NO: 146201 - RNA, 64 nt, hsa
ucuauuccaaugggcauuuauuuuuuauccugucauuaaaaaaaaaagacuguuauccugcuac

SEQ ID NO: 146202 - RNA, 64 nt, hsa
uuuugaaacaguacugugcaauccgauggaucuaauuaaaaaaaaggcaauauuuuuauauuaa

SEQ ID NO: 146203 - RNA, 64 nt, hsa
guguaguaacucauuucaagggaauaaaugcuggauuaaaaaguguaaauuuuucaugagaauu

SEQ ID NO: 146204 - RNA, 64 nt, hsa
aaaaauguauuuauuuuaucuuugggguucaaacauuaaaaaaauuuacauagguguaguaacu

SEQ ID NO: 146205 - RNA, 64 nt, hsa
agaaugcuuuugcauggacuauccucuuguuuuuauuaaaaacaaaugauuuuuuuaaaaguca

SEQ ID NO: 146206 - RNA, 64 nt, hsa
aagcuuuauuucacauuuuuucaguccugauaauauuaaaaacauugguuuggcacuagcagca

SEQ ID NO: 146207 - RNA, 58 nt, hsa
caaccacuacaaccgugugauguaugccauuaaaaaaauuguuuuuuuaauuuucuau

SEQ ID NO: 146208 - RNA, 64 nt, hsa
uauccuggguaugcauuauuuuaaauguuguaucauuaaaaaccucagaaugaugaaaaauaug

SEQ ID NO: 146209 - RNA, 64 nt, hsa
uacuaaaugugaucuccuguggauuaccacaugcauuaaaaaauuuuucaagcugggccuagug

SEQ ID NO: 146210 - RNA, 64 nt, hsa
accauccuggccaacauggugaaacccugucucuauuaaaaauacaaaaauuagcugggcgugg

SEQ ID NO: 146211 - RNA, 64 nt, hsa
ggaaguuuccuugagccuaaaauaaaaagaaaaaauuaaaaagaaucaguuuuuuuaauuaaaa

SEQ ID NO: 146212 - RNA, 64 nt, hsa
aaaaagaaaaaauuaaaaagaaucaguuuuuuuaauuaaaaaaauagaaagcuguuaggcuccu

SEQ ID NO: 146213 - RNA, 64 nt, hsa
ccugaauucuugggggccggcggggagcuuuuacauuaaaaaucuacuaacgccuacuuuuuaa

SEQ ID NO: 146214 - RNA, 64 nt, hsa
uaguagguuaauauuguucagaagauuuuuacaaauuaaaaacugauuuccaaauauguucaac

SEQ ID NO: 146215 - RNA, 64 nt, hsa
gaaccgacuuuuuaguuuggguccuacuguuguuauuaaaaacagaacaaaaacaaaacacaca

SEQ ID NO: 146216 - RNA, 64 nt, hsa
gcuaauuuuuccuaguuaacauauuuuguacaauauuaaaaaaaugcacagaaaccauuggggg

SEQ ID NO: 146217 - RNA, 64 nt, hsa
agacagucuugauauuauacauuuucagaaauauauuaaaaauaauaaacuaaaacccaugauu

SEQ ID NO: 146218 - RNA, 64 nt, hsa
augcaugacaggaauguuggcagaacuggaaaguauuaaaaaagcauuaucagacagucuugau

SEQ ID NO: 146219 - RNA, 64 nt, hsa
ccaccaaaacagugccccaccuguauacauuuuuauuaaaaaaauguaaugcuuauguauaaac

SEQ ID NO: 146220 - RNA, 64 nt, hsa
uuuaacucagugguuaucuaauagcucuaaacucauuaaaaaaacuccaagccuuccaccaaaa

SEQ ID NO: 146221 - RNA, 64 nt, hsa
agaauuaaaaauuuuaaaaauuuaaauuaaaaaaauuaaaaauuuauagaaccauaucaacacu

SEQ ID NO: 146222 - RNA, 64 nt, hsa
aaauuuuaaagaauuaaaaauuuuaaaaauuuaaauuaaaaaaauuaaaaauuuauagaaccau

SEQ ID NO: 146223 - RNA, 64 nt, hsa
aacaggacaauuuaaaaauuuuaaauuuuaaagaauuaaaaauuuuaaaaauuuaaauuaaaaa

SEQ ID NO: 146224 - RNA, 64 nt, hsa
uuacaaauguugacugaagauagauaaaacucuaauuaaaaauuuaaaagguuaaacacuguau

SEQ ID NO: 146225 - RNA, 64 nt, hsa
auauuuaacaaucuccauguaguccaaauuugucauuaaaaaaaaaucaaagaaagaaggccac

SEQ ID NO: 146226 - RNA, 64 nt, hsa
aaggaucagagaccauuaaaagaggaccauaccuauuaaaaaaaaauguggaguuggagggcua

SEQ ID NO: 146227 - RNA, 64 nt, hsa
aaaccugcaggcauaucauuggcguauggcacucauuaaaaaggaucagagaccauuaaaagag

SEQ ID NO: 146228 - RNA, 63 nt, hsa
uguuuagcuguguuucuuucauuuuuaauaaaaaauuaaaaagaauucauguguaauuauuca

SEQ ID NO: 146229 - RNA, 64 nt, hsa
aaguggaaaauuauguauuuuaaaguguguaacuauuaaaaauauauugccuggaaaaggaaua

SEQ ID NO: 146230 - RNA, 64 nt, hsa
uuuuauaccugccuuaaauaauuuggcaaucagaauuaaaaaguuuuuuuuuuuuuaaauaaug

SEQ ID NO: 146231 - RNA, 64 nt, hsa
cugcugccacgucgcaaaccacucaguaaaggaaauuaaaaauguauuugucauguuaaaaagu

SEQ ID NO: 146232 - RNA, 64 nt, hsa
ucuaugagucaaucuuuuuggcagaauucagaauauuaaaaaguucauacauuugcgggccauu

SEQ ID NO: 146233 - RNA, 64 nt, hsa
uucauugacuauuuucaucauaauuucaucauugauuaaaaaaagaaaaccacuuguuuauuca

SEQ ID NO: 146234 - RNA, 64 nt, hsa
cauauucacuaauuuaacauaaaugaaaauuaggauuaaaaauugcaccaaagcaucggcaaaa

SEQ ID NO: 146235 - RNA, 64 nt, hsa
ggugcuuaauugcaauaaaauuacuaugaaguauauuaaaaaucacgacauuguaaaaucucac

SEQ ID NO: 146236 - RNA, 64 nt, hsa
auucagucaagacucccuuuggggaauucauuuuauuaaaaauuggugucuggauacuucccug

SEQ ID NO: 146237 - RNA, 64 nt, hsa
uuucccccugcccccguuacugccggugauuauuauuaaaaauuaguuuuuuucacaucauuau

SEQ ID NO: 146238 - RNA, 64 nt, hsa
auuuugaaaugggagcuuuuuuguuuacaaguucauuaaaaacuaaaaacuguuucuguaagga

SEQ ID NO: 146239 - RNA, 64 nt, hsa
uaggacucugcauuaacucuauaauguucuugguauuaaaaaaaaagcauauuugucacagaaa

SEQ ID NO: 146240 - RNA, 64 nt, hsa
guuaacuuugaauuuauauauuuagauuuaaaggauuaaaaaaaaggaaagcucuugacaguug

SEQ ID NO: 146241 - RNA, 64 nt, hsa
aauugucacugaucguauuucuacuuguuaaauaauuaaaaaucaucuuaaaauucauacuuug

SEQ ID NO: 146242 - RNA, 64 nt, hsa
uauccuuagaaagagaaguguacauugauuuccaauuaaaaauuugcuggcauuaaaaauaagc

SEQ ID NO: 146243 - RNA, 64 nt, hsa
guguacauugauuuccaauuaaaaauuugcuggcauuaaaaauaagcacacuuacauaagcccc

SEQ ID NO: 146244 - RNA, 64 nt, hsa
uaaaacuauugaaaaauuaauauuucuauaaucuauuaaaaaaaauggagaauguuuucucuca

SEQ ID NO: 146245 - RNA, 64 nt, hsa
aaaacacuuauagccuuaaaccauucaagggcuaauuaaaaaaauaguuaugaaaucuuagcca

SEQ ID NO: 146246 - RNA, 64 nt, hsa
gauuuaaaaaacaagaaugcaugaucucagagugauuaaaaaaaaaucaguggaaauaaaugau

SEQ ID NO: 146247 - RNA, 64 nt, hsa
auguuuguuuguagauguuugucugaugcauuucauuaaaaaaaaaaccaugaauuacgaagca

SEQ ID NO: 146248 - RNA, 64 nt, hsa
gugauugaaucauaagauauaagggggguaaaguauuaaaaauaacuuuuuuguuugauaacuu

SEQ ID NO: 146249 - RNA, 64 nt, hsa
cuuuacugcaguuaaaucauauaauguuuguaugauuaaaaauaaauuucucagaauugugauu

SEQ ID NO: 146250 - RNA, 64 nt, hsa
uucuuuucauuugaauauuuaaauuuuaugguuuauuaaaaaauuaaauaaauguuguguccgu

SEQ ID NO: 146251 - RNA, 64 nt, hsa
gucucagaagcugucauagaauuucuugcugccaauuaaaaaaccuguguucuuuacacacuac

SEQ ID NO: 146252 - RNA, 64 nt, hsa
aaacaaacaacaaaaaacaaacaacaaaaaaaaaauuaaaaaaaaaaacagaaauagagcucua

SEQ ID NO: 146253 - RNA, 64 nt, hsa
agcaaucuuaaggcucuuuaagguuuucuccaauauuaaaaaauaucaccaaagaaguccugcu

SEQ ID NO: 146254 - RNA, 64 nt, hsa
aaaaagcuuugccaauagcuaaaaaguacaagcuauuaaaaaucagauugaaaaguuuugagaa

SEQ ID NO: 146255 - RNA, 64 nt, hsa
cuaguuuaacacuugagcaaaugcuuaagaaggaauuaaaaaaaaaaagcuuugccaauagcua

SEQ ID NO: 146256 - RNA, 64 nt, hsa
cauagaaaacaaucaaauauuugcugaauaaaugauuaaaaaaucagagaacuuucccauucug

SEQ ID NO: 146257 - RNA, 64 nt, hsa
ucucaauuuaguuuguuauuuauccuagugggccauuaaaaacuaccacauguguuucugucuc

SEQ ID NO: 146258 - RNA, 64 nt, hsa
ucauuuucacuaagaguuuaaaagcuauuguauuauuaaaaagucuuuacaaugcuuguuucaa

SEQ ID NO: 146259 - RNA, 64 nt, hsa
acagaaaaaaaagcuaagaaaacugagaacuaacauuaaaaaaauuaaauuuagaauaagaaug

SEQ ID NO: 146260 - RNA, 64 nt, hsa
ccaucgcuucucagccuuuuggcuaagauuaaguauuaaaaaaaaaccaggcucugccaggcgc

SEQ ID NO: 146261 - RNA, 64 nt, hsa
ugggcaacauagcgagaccccaucucuacaaaagauuaaaaauuagcugcguguaguagcauau

SEQ ID NO: 146262 - RNA, 64 nt, hsa
gaccagacuuugugaaugguucagauauuuuuucauuaaaaaacaagguauggcagauggacuu

SEQ ID NO: 146263 - RNA, 64 nt, hsa
guccaugucuaauaaguaaaaacugauagaauacauuaaaaagucacugguuuaucauagaaaa

SEQ ID NO: 146264 - RNA, 64 nt, hsa
uugcaauguauauucuaaauaaagucaucuaacuauuaaaaaaaaaacacccuuccuaacccuu

SEQ ID NO: 146265 - RNA, 64 nt, hsa
gcuugauuucaugacugaugcacaaauuuuaaugauuaaaaagugcaggagcccuaaaugucag

SEQ ID NO: 146266 - RNA, 64 nt, hsa
uuuaaaauuaugugugaucacaagacuaaagauaauuaaaaagaaaaccacagaucaugacuuu

SEQ ID NO: 146267 - RNA, 64 nt, hsa
aaacaaaaaaaaaaacaaaaaaaaacaaaaguaaauuaaaaacaaaaccugaugaaacagauga

SEQ ID NO: 146268 - RNA, 64 nt, hsa
uuuuaagguuucugaguuaaccagaaaaauagaaauuaaaaacaaaacaaaaaaaaaaacaaaa

SEQ ID NO: 146269 - RNA, 64 nt, hsa
uucagagcaaagcuaucaacuuggagaaacagggauuaaaaauaaggauaaacacuaauaagag

SEQ ID NO: 146270 - RNA, 64 nt, hsa
agaaucuguugugagaaaugcccaggcuuuaaaaauuaaaaauggauggaucuucucugaacuc

SEQ ID NO: 146271 - RNA, 64 nt, hsa
aaagcaggauuuucuccuguaucugaauuuuaaaauuaaaaaggcagauaagacauaaauaguu

SEQ ID NO: 146272 - RNA, 64 nt, hsa
uuuuaaaagaaauguagucuuguaguaugaaauaauuaaaaauuguuaaauguauauuuugguu

SEQ ID NO: 146273 - RNA, 64 nt, hsa
aauacucuugauuuaugauaauuaguuaaaauauauuaaaaauauuauuaguaaaauaaaauuu

SEQ ID NO: 146274 - RNA, 64 nt, hsa
ucaauggcugccaaaaccauuaaguggaaagcugauuaaaaaacaaaaauuucuaauggauuua

SEQ ID NO: 146275 - RNA, 64 nt, hsa
cuaauuagcuuaucaacuccccuccaaacaaacaauuaaaaaaaaaacauacagacacucaaau

SEQ ID NO: 146276 - RNA, 64 nt, hsa
uucguugcagcacugcccaucagugacagacuggauuaaaaaaaugugguacauacacaccagg

SEQ ID NO: 146277 - RNA, 64 nt, hsa
uaauuuaaacaaauuuagaagaaaaaaccaccccauuaaaaagugggcaaaggacaugaacaga

SEQ ID NO: 146278 - RNA, 64 nt, hsa
gugguuaagcugugucuacacugguugggaauaaauuaaaaacaguauuugggggagaaacgug

SEQ ID NO: 146279 - RNA, 64 nt, hsa
uuaacaaaguaauauuuuuguauugcauuuuucuauuaaaaaauuaacaguuaauguuucaguc

SEQ ID NO: 146280 - RNA, 64 nt, hsa
aacaauuugauaauacuuaauagaaaucuguucaauuaaaaaugcuuaguuuauacaaagauac

SEQ ID NO: 146281 - RNA, 64 nt, hsa
uauguugcguacauggcaaauccugcaaauauagauuaaaaauuaaauuagcccauugaaaucc

SEQ ID NO: 146282 - RNA, 64 nt, hsa
agagaggcacugugauauacuugggacccuuuaaauuaaaaagugaagauagucaccagggcca

SEQ ID NO: 146283 - RNA, 64 nt, hsa
ggucuuccaagaaaugagcuauuuuauugaugccauuaaaaagcaaguugcgaugguuuuguau

SEQ ID NO: 146284 - RNA, 64 nt, hsa
guagcuuccuacucaacuauuuauaaucucauuaauuaaaaaguuauaauuuuagauaaaaauu

SEQ ID NO: 146285 - RNA, 64 nt, hsa
agacagcauguuauuuuaacaaucaaguauacauauuaaaaauugugagcaaucucaaaugaag

SEQ ID NO: 146286 - RNA, 64 nt, hsa
ucauccuuaaauuuugaagcaagugagagacuuuauuaaaaauacauauauaucuauauaaaca

SEQ ID NO: 146287 - RNA, 64 nt, hsa
uacauguuacuuugagaugcuagguauuuguggaauuaaaaagaaucaggcucuuuuguacuuu

SEQ ID NO: 146288 - RNA, 64 nt, hsa
gaacaaaguaguaaaauaaaaaaaaauuuaaaaaauuaaaaaauaaaaaaaagaggucacuaaa

SEQ ID NO: 146289 - RNA, 64 nt, hsa
uagagaccaaucauauaucugaaaagaaauacccauuaaaaauucugccuccuguuuauugaga

SEQ ID NO: 146290 - RNA, 64 nt, hsa
caaauaauuggaauauauugcaggcauuaagcucauuaaaaacaaacuggcuugcagaaggguc

SEQ ID NO: 146291 - RNA, 64 nt, hsa
ugaaauguuaccuuuuaacagacuguuuuuaaaaauuaaaaauguauguauagguuuugaaauu

SEQ ID NO: 146292 - RNA, 64 nt, hsa
aaaagauuguuuguuucuaugucaacuagauaugauuaaaaauaaguauugccaaugcuguuuu

SEQ ID NO: 146293 - RNA, 64 nt, hsa
auguauuuaaauuuuauuaugaaaaauuacauuuauuaaaaaaguguguuccaaaggcauuaaa

SEQ ID NO: 146294 - RNA, 64 nt, hsa
aauaacaguggcucuaccuuuugacaucuggcucauuaaaaaauuuagcaauagaauguaaauu

SEQ ID NO: 146295 - RNA, 64 nt, hsa
aaaauuggauuaaauuccaccuaucuuaaugugaauuaaaaaccaccauuuauaauaauaauag

SEQ ID NO: 146296 - RNA, 64 nt, hsa
uauuuguuggcugggccacguaacuugauuagucauuaaaaaucuuguacguauauaauucaaa

SEQ ID NO: 146297 - RNA, 64 nt, hsa
auaaaaacuugcaguucuaugauagauugcauuuauuaaaaauguuucauuguaucacauagaa

SEQ ID NO: 146298 - RNA, 64 nt, hsa
uugaccuuauaagaaaaaugauucuucuucagaaauuaaaaacauaacuauugccagauuuagc

SEQ ID NO: 146299 - RNA, 64 nt, hsa
ugucauuuucauuuuugcauuuuuuuguuugcauauuaaaaaaagagaaaagagaaagcaagag

SEQ ID NO: 146300 - RNA, 64 nt, hsa
uguuauucuuucuuuugaugaguagguuaccaagauuaaaaagugagauaaauggucaaugaga

SEQ ID NO: 146301 - RNA, 64 nt, hsa
gaauucaauagcuuguaaugucuuaugaagaccuauuaaaaaaauacuucauagagccugccuu

SEQ ID NO: 146302 - RNA, 64 nt, hsa
uacuuucugcaugguauuucagugucugucauacauuaaaaauacuugucacuguuuuaagauc

SEQ ID NO: 146303 - RNA, 64 nt, hsa
acuuacuuggaaaaugaugcuguuagguccugguauuaaaaaucuagaaaagacuuguugguuu

SEQ ID NO: 146304 - RNA, 64 nt, hsa
ucacaauuuaauaauuuaucaaugcaaacaguacauuaaaaacuguagcacaaucuauaauuuu

SEQ ID NO: 146305 - RNA, 64 nt, hsa
gcuaaacugcucucugauuauucaagagcaaaguauuaaaaauuucucaaacuuacuugacaac

SEQ ID NO: 146306 - RNA, 64 nt, hsa
ugaacacuaaaacuaugaaacaauuacuuuuuauauuaaaaagaccauggauuuaacuuaugaa

SEQ ID NO: 146307 - RNA, 64 nt, hsa
aaaaccacucucuugaaucacguuaacuuuugagauuaaaaaaaaaaacgccauagcacagcug

SEQ ID NO: 146308 - RNA, 64 nt, hsa
aaguugauugcauuacuucuguauguugcuugcuauuaaaaagguuaagaggccagguuaccca

SEQ ID NO: 146309 - RNA, 64 nt, hsa
uagccuaugguaguaauuuauguagaauaaaagcauuaaaaagaagcaaaucauuugcacucua

SEQ ID NO: 146310 - RNA, 64 nt, hsa
cacaugguuguuugcuguacaguccuuugcaaauauuaaaaaauuuuuuuugcuauaaggcuuu

SEQ ID NO: 146311 - RNA, 64 nt, hsa
auuagguugaaaaugccccuuacugaaaaucuguauuaaaaauaaaauuaauaaaaguaaaaaa

SEQ ID NO: 146312 - RNA, 64 nt, hsa
gcugccacacacacauuuuguauuaauuuuaaugauuaaaaagagcauaggguaaaaaccugau

SEQ ID NO: 146313 - RNA, 64 nt, hsa
gccacuaaauuaaaaaaaaauuaaaaguuaugggauuaaaaaaaguuaugggauaaaaaagguu

SEQ ID NO: 146314 - RNA, 64 nt, hsa
ugaagaucacugucaucuaaaagcuggccacuaaauuaaaaaaaaauuaaaaguuaugggauua

SEQ ID NO: 146315 - RNA, 64 nt, hsa
auuuuacuguuuguuuuuauuaucuuaagugcuaauuaaaaaaaaaauaaaauuuuaaaaaaac

SEQ ID NO: 146316 - RNA, 64 nt, hsa
gcauuuuguaccaguggaacuuuuuauacuggagauuaaaaaaaaaauggaaauuuuuguggcu

SEQ ID NO: 146317 - RNA, 64 nt, hsa
gauugauagaaagaaaguugcuuuucuuuugagaauuaaaaacuuuggcuugauuucuuuuuuc

SEQ ID NO: 146318 - RNA, 64 nt, hsa
cuaaaacgcuaauauugauuuuccugauagcuguauuaaaaauagcaaagcaucggacugaacc

SEQ ID NO: 146319 - RNA, 64 nt, hsa
caccaaugaauacaaauguuuaaauaaaauauugauuaaaaaaacauuaaaagugcaucaugac

SEQ ID NO: 146320 - RNA, 64 nt, hsa
gccggcccacugugcacugcuugugagaaaauggauuaaaaacuauucuuacauuuguuuugcc

SEQ ID NO: 146321 - RNA, 64 nt, hsa
cuaaacucucuaguuagauaucugacuugggaguauuaaaaauugggucuaugacauauugucc

SEQ ID NO: 146322 - RNA, 64 nt, hsa
ugaaaaagauguacguuguagacaaaguugcagaauuaaaaaaagaaaucugcuuuuaauuuau

SEQ ID NO: 146323 - RNA, 64 nt, hsa
ucggaggaccacaaucaguucuaugcugccaaagauuaaaaauaaauaaaaacauaaaaaauua

SEQ ID NO: 146324 - RNA, 64 nt, hsa
aauuuuuauuuuuuaauaugggucagacuuuuggauuaaaaaguauuauaucauggacauacau

SEQ ID NO: 146325 - RNA, 64 nt, hsa
gaucuuacuaaaugcauuuuaccugcuacuauuuauuaaaaauggaagcugucuugaauuagag

SEQ ID NO: 146326 - RNA, 64 nt, hsa
aguuucuguuaugauugccauuucaauaaaugacauuaaaaaucuaaaggauauuauuguuuga

SEQ ID NO: 146327 - RNA, 64 nt, hsa
cucucauuugccgacuuauuuuuauaggaagccaauuaaaaaaaaaaaaaguuuucuuauagua

SEQ ID NO: 146328 - RNA, 64 nt, hsa
gaaagacauagggaagaaugggcuguaaauccuaauuaaaaauagaggucgacaugagauaccu

SEQ ID NO: 146329 - RNA, 64 nt, hsa
acugcuuuugauucacauuaagcugcuuucagaaauuaaaaaaacacuuuuuaaagggugcauu

SEQ ID NO: 146330 - RNA, 64 nt, hsa
uuuuaagaguuuaaaaaucuuaugagugagaaauauuaaaaaaaucuuauuuucaccucuuuag

SEQ ID NO: 146331 - RNA, 64 nt, hsa
aucaacuuaauguuuaagacuuuagaugucuuguauuaaaaauuacacaaaaaaaguaaaacuu

SEQ ID NO: 146332 - RNA, 64 nt, hsa
cuacuucuaacgggaagaagaaacacuacggucgauuaaaaaaauuauuuuguuacuucgaagu

SEQ ID NO: 146333 - RNA, 64 nt, hsa
uuguaauauauucaugaggcuggaaguaagaagaauuaaaaauuuguccuaauuacaaugagaa

SEQ ID NO: 146334 - RNA, 64 nt, hsa
acgaaaguuuuuuuaaagaacagaaacuuuuccaauuaaaaaaaaaaagcagacuucugguuca

SEQ ID NO: 146335 - RNA, 64 nt, hsa
agguauucuuuuugguuuaauuuuugccaauguaauuaaaaaaugguaugucauuuuuaaaauu

SEQ ID NO: 146336 - RNA, 64 nt, hsa
aauuaugcagaguuauuuuccuauaucucacaguauuaaaaauaaauaauuaaaaauuaagaau

SEQ ID NO: 146337 - RNA, 64 nt, hsa
auuuuccuauaucucacaguauuaaaaauaaauaauuaaaaauuaagaauaaauaaacgaguug

SEQ ID NO: 146338 - RNA, 64 nt, hsa
uuacaaaaaaacaaaaaagaaaagaaauuuauuuauuaaaaauucuauugugaucuaaagcaga

SEQ ID NO: 146339 - RNA, 64 nt, hsa
acaaaaaacaaacaaucaaaaaaaaagacaguuuauuaaaaaugacacaaaugacugggcuaaa

SEQ ID NO: 146340 - RNA, 64 nt, hsa
aagugcuauuuguuuccuaaaaacagugauuucuauuaaaaaggugucagaacuggagaaaaug

SEQ ID NO: 146341 - RNA, 64 nt, hsa
ucuuuguaucuggggaaaaaaaacuuuuuuuuaaauuaaaaaggaaaauaaaagauauugaggu

SEQ ID NO: 146342 - RNA, 64 nt, hsa
uuuucuguugcacuuguaaaaugcuacaaggaauauuaaaaaaaucuauucacuuuaacuuaua

SEQ ID NO: 146343 - RNA, 64 nt, hsa
guucgauacagcguauuuauugcuugucauguaaauuaaaaaccuuguauuuaacucuuuucaa

SEQ ID NO: 146344 - RNA, 64 nt, hsa
caauaucuuaaaguguccgauucacuacuuguuaauuaaaaaaguuaugauuaaugugaaacug

SEQ ID NO: 146345 - RNA, 64 nt, hsa
gcuucugcuguuuuuuauuuuuaacauguucauaauuaaaaaguauuuuccagcaguccaaaga

SEQ ID NO: 146346 - RNA, 64 nt, hsa
augaggcuuucuuacauauacaucuuaguugauuauuaaaaaaggaaaaauaugguuuccagag

SEQ ID NO: 146347 - RNA, 64 nt, hsa
ugaaucuugcucucuuaaagaaagcaucuuguauauuaaaaaucaaaagaugaggcuuucuuac

SEQ ID NO: 146348 - RNA, 64 nt, hsa
gccugauuucauauuguauuuuaaacugugugaaauuaaaaacaaagaauuucauucauaaugc

SEQ ID NO: 146349 - RNA, 64 nt, hsa
uacaggggaauuaugugugugaaugucaucuacaauuaaaaaaaauuagcacaucccuuuacuu

SEQ ID NO: 146350 - RNA, 64 nt, hsa
gucuggauuuuuugaguauuuaggaaagagagcuauuaaaaacuggggauuucucaaugugacu

SEQ ID NO: 146351 - RNA, 64 nt, hsa
aauuuccugauuuaauguagacuuugacuuuuuuauuaaaaaccuuuguauuaaagcaaguuau

SEQ ID NO: 146352 - RNA, 64 nt, hsa
aagcuaguuagugaauggaaaauaaguguggaguauuaaaaauguucuuugguugguaaggccu

SEQ ID NO: 146353 - RNA, 64 nt, hsa
aauuuuccaguuucaaguaccuauucaaaauuuuauuaaaaaccagcaaauuaauuuuaaucuc

SEQ ID NO: 146354 - RNA, 64 nt, hsa
cuuaagaacauacuaauggcauauauuuguuacaauuaaaaaauaaauuuacuacuuaauccua

SEQ ID NO: 146355 - RNA, 64 nt, hsa
aaaaccaucaccuuuuguacaaaaacucuuaaugauuaaaaaacaaacaaaacauauuggccuu

SEQ ID NO: 146356 - RNA, 64 nt, hsa
uuuucacaaguuuuugagacacuggauuucuuuaauuaaaaaaaaaaugccaagaaacauuauu

SEQ ID NO: 146357 - RNA, 64 nt, hsa
aacagguuguggcuccuguugaauaagaugauccauuaaaaacugaacaagguugaggagaaau

SEQ ID NO: 146358 - RNA, 64 nt, hsa
aaacaauuuuuuucuaacgugaaaaggauaaaacauuaaaaacucuugagaacuauaaagugaa

SEQ ID NO: 146359 - RNA, 64 nt, hsa
gacuugcauaaccaaaauaaacaaagcaagacaaauuaaaaauaugugggggagagaucaguga

SEQ ID NO: 146360 - RNA, 64 nt, hsa
augauacacagauagauaaagcaagucuaucaacauuaaaaauacuaaaaaauaaagacacaca

SEQ ID NO: 146361 - RNA, 64 nt, hsa
gggcaacaugacaagaccccaucucuacaaaaaaauuaaaaaauuagccaggcaugguggcaca

SEQ ID NO: 146362 - RNA, 64 nt, hsa
ucaacuuauuccauuaaauagauacauuaaaaaaauuaaaaacugauucuucugcagagcacug

SEQ ID NO: 146363 - RNA, 64 nt, hsa
aaucuaugaucaacuuauuccauuaaauagauacauuaaaaaaauuaaaaacugauucuucugc

SEQ ID NO: 146364 - RNA, 64 nt, hsa
guaauauuauuauugucaucccaagaaaaaauauauuaaaaagauauuugaaauuucauuauaa

SEQ ID NO: 146365 - RNA, 64 nt, hsa
cuccuaccuuccucaauauucccaauguggcuguauuaaaaauuugggggaauccauauauauc

SEQ ID NO: 146366 - RNA, 64 nt, hsa
aggcuaaacuggauuagcaauuuauuaaaaacugauuaaaaagugaguuccauuaauaaacaga

SEQ ID NO: 146367 - RNA, 64 nt, hsa
gaacugauuugaggcuaaacuggauuagcaauuuauuaaaaacugauuaaaaagugaguuccau

SEQ ID NO: 146368 - RNA, 64 nt, hsa
uggcacacaguaggcacucaauaaauauguauugauuaaaaacaaagacgucuucaauaugcca

SEQ ID NO: 146369 - RNA, 64 nt, hsa
uauaacucuggccuaugauuguguugugucuugcauuaaaaaaaaaaauuugagagugguagaa

SEQ ID NO: 146370 - RNA, 64 nt, hsa
uuuuuccucuuucgaaugugcuuugcuuuuuuugauuaaaaagaauuuuuuuuuuccuuuuuua

SEQ ID NO: 146371 - RNA, 64 nt, hsa
cacaaaacuguguuuacugaaagccgaaaacaguauuaaaaaaaguguguaaguaaaguguuau

SEQ ID NO: 146372 - RNA, 64 nt, hsa
uguggacaaaaagccaaaauaaauauucuuccugauuaaaaaaauuuuuuuugaaaaaaacaag

SEQ ID NO: 146373 - RNA, 64 nt, hsa
uuuuuaaucgguucuucaaauauuucauguuuacauuaaaaauuuccagagaagcauaaaagua

SEQ ID NO: 146374 - RNA, 64 nt, hsa
ggccuugaaauaagaaaauauugaacauuuuaauauuaaaaauauuucaguguuaacaaaugug

SEQ ID NO: 146375 - RNA, 64 nt, hsa
uaauugugcugaaaucuauuuccuuuuauaauagauuaaaaauuuuauauuuuuauaaguaaac

SEQ ID NO: 146376 - RNA, 64 nt, hsa
aaaaucccucauaauaaccuaauagggcauugcuauuaaaaaugcuaaaauaaaaauucagcuu

SEQ ID NO: 146377 - RNA, 64 nt, hsa
cucuuuauguuggccccaggccaguacuaagcaaauuaaaaagaccgacaugggcuuccucccu

SEQ ID NO: 146378 - RNA, 64 nt, hsa
uguuagacaacagugaggcauaucauguguuuuuauuaaaaaugauaaagauguguuucuucuc

SEQ ID NO: 146379 - RNA, 64 nt, hsa
caggauagaccuagcaaggagauaagaauagaucauuaaaaaauaaauauaaauggauuggaua

SEQ ID NO: 146380 - RNA, 64 nt, hsa
ugcuuacuccuuagaguucagaugaauucuuaaaauuaaaaaaaaacuccauaguacuaauuuu

SEQ ID NO: 146381 - RNA, 64 nt, hsa
aacuaauaaaucaaguguuccaaauacaauuugcauuaaaaagauuggcauuauuuuccucauc

SEQ ID NO: 146382 - RNA, 64 nt, hsa
uuauuugaagcugucugaagaaugcacuuuaugaauuaaaaaacugaauugccugaccucguua

SEQ ID NO: 146383 - RNA, 64 nt, hsa
uucggucauuggaauuuauauuaaaagacaaguuauuaaaaaggaaagguucuauucauaauca

SEQ ID NO: 146384 - RNA, 64 nt, hsa
uaaaauucgaagugauuauuaucagcuuaauuggauuaaaaaaguacuucaagaaauuauuuua

SEQ ID NO: 146385 - RNA, 64 nt, hsa
caaaaguaauuauucuugggugccuuucaagaaaauuaaaaauacuacucacuacaauaaaacu

SEQ ID NO: 146386 - RNA, 64 nt, hsa
gagcuuaaacaaaugccacucucaugcauucuaaauuaaaaaguuaaaaugauuaauaguucag

SEQ ID NO: 146387 - RNA, 64 nt, hsa
uuuaguuuugucacaguuaacugugucaaagagaauuaaaaaaaaaaacuucagauuuuguuua

SEQ ID NO: 146388 - RNA, 64 nt, hsa
uucaauguguuaagaguuuaauuuuuuuguuaucauuaaaaaagacaggauuauaaagagauau

SEQ ID NO: 146389 - RNA, 64 nt, hsa
uaaauagaaggaaauaaauguaaaaaugcugcaaauuaaaaaccucaaagaagggaaauaauug

SEQ ID NO: 146390 - RNA, 64 nt, hsa
ucgcaaauucauaaagcuuuccauaaauauauuuauuaaaaaccaauaggaggagcacuucgag

SEQ ID NO: 146391 - RNA, 64 nt, hsa
ugggacuauaggugcaugccaccacacccagcuaauuaaaaaaauuuuuuguguggagucuaug

SEQ ID NO: 146392 - RNA, 64 nt, hsa
gacaaagaguaguuuuaucagguaaauccugguaauuaaaaacgcauguuuuuaaaaauuagcc

SEQ ID NO: 146393 - RNA, 64 nt, hsa
guuaauuuuaaacacauuuuuuaagaaaaaaauaauuaaaaaagaaacagugcucaugucauaa

SEQ ID NO: 146394 - RNA, 64 nt, hsa
cauaaauacauuuucuaagggggggggggaagaaauuaaaaaacaccuguuaauuuuaaacaca

SEQ ID NO: 146395 - RNA, 64 nt, hsa
uuuuuuacuuuuuuuuaugaucaaggaaaagaucauuaaaaaaaaacacaaagaaguuuuucuu

SEQ ID NO: 146396 - RNA, 64 nt, hsa
ugucuucuuaaaaucaaauguaaaucaauuacagauuaaaaaaaaaagccuguauuuaacucau

SEQ ID NO: 146397 - RNA, 64 nt, hsa
ucuacauugaaacagaaaauaccugggaaugaagauuaaaaauguagcugcuguuauuugcuug

SEQ ID NO: 146398 - RNA, 64 nt, hsa
guaaguuaacuaugaaagcuuucuuauuuuuauuauuaaaaauguaacaauuuaacccacagga

SEQ ID NO: 146399 - RNA, 64 nt, hsa
cgcgggcugcgucggucccggacuuuucuaauuuauuaaaaacauggccuuggcaguuauuuuu

SEQ ID NO: 146400 - RNA, 64 nt, hsa
aaaaaaaaaaugucuuaaccaaccgaaaagaaaaauuaaaaaaggauuuguauuaaaucuuauu

SEQ ID NO: 146401 - RNA, 64 nt, hsa
uguccaggcaccauguuuucuuugaguccaacucauuaaaaaagaagaaucucugucaccucag

SEQ ID NO: 146402 - RNA, 64 nt, hsa
augagauuauauauauauauauaaaaauauauauauuaaaaaaaaagacaguauuuaucguagc

SEQ ID NO: 146403 - RNA, 64 nt, hsa
gugcuguguuuucuaacacauuuuucuguuuuuaauuaaaaaaaaaaaaaaaagguuuucaguu

SEQ ID NO: 146404 - RNA, 64 nt, hsa
aucccccucugcgagaaacacccaagaaugaucaauuaaaaaaaaaauaauauaauaauaauuc

SEQ ID NO: 146405 - RNA, 64 nt, hsa
gcguugguguugugagcggcccaugaaaagccaaauuaaaaaucaaggauucagucaaacuaag

SEQ ID NO: 146406 - RNA, 64 nt, hsa
acauggcuuuaagaaccacacugaugccuugauaauuaaaaagaauacaagcauuccauguaca

SEQ ID NO: 146407 - RNA, 64 nt, hsa
acuuuguguuuagcuaccuuuuuauauuuaaaaaauuaaaaaugaaaauuacguucuuacaagc

SEQ ID NO: 146408 - RNA, 64 nt, hsa
uuggcuugcuguuuacucccuucuguaguuuuuaauuaaaaacuuuaaagauaagucuacauua

SEQ ID NO: 146409 - RNA, 64 nt, hsa
ucaacucucuuaugguauuauaucucuguaugccauuaaaaaacagcuuguucuagaaucaugu

SEQ ID NO: 146410 - RNA, 64 nt, hsa
auuaugucuuauuuuauuauuucuaaauaaaaaaauuaaaaauugaaaacaaauucuuggaaga

SEQ ID NO: 146411 - RNA, 64 nt, hsa
cuauaaauuaaaaauuuuuuacuuaaauuuaagaauuaaaaaaauacaaaaaagaaaaaaugaa

SEQ ID NO: 146412 - RNA, 64 nt, hsa
aggcuuuccaguuuuuaccagaaaaccccuauaaauuaaaaauuuuuuacuuaaauuuaagaau

SEQ ID NO: 146413 - RNA, 64 nt, hsa
auggcuuaagauaaaguauuuuuaaggaagaaagauuaaaaacaacuguuauacaugagacuau

SEQ ID NO: 146414 - RNA, 64 nt, hsa
aaagacaaguggacuugggcccuauucaggcaagauuaaaaaaaaaaaaagacuaugaccaaaa

SEQ ID NO: 146415 - RNA, 64 nt, hsa
caaccucuuuuuugugcuuuaaaaugacuuugggauuaaaaaagcauauuucccaaucauuguc

SEQ ID NO: 146416 - RNA, 64 nt, hsa
uaaagaaaauguauuacauucuguauguacaaagauuaaaaaucaaccucuuuuuugugcuuua

SEQ ID NO: 146417 - RNA, 64 nt, hsa
acaucagagaaugacuguucuucuuaguucugggauuaaaaauugguuucuagagguaaccugu

SEQ ID NO: 146418 - RNA, 64 nt, hsa
gccuucucaugauggaagacagauucugcuuuaaauuaaaaaaaaaaaaaaaucugaaucuugu

SEQ ID NO: 146419 - RNA, 64 nt, hsa
gcuuuaugaagcuuuagaaaugagcucaugacucauuaaaaaauaauaaacgaugcuauuuuaa

SEQ ID NO: 146420 - RNA, 64 nt, hsa
uaaacaucauucuuaucaauguaaaauuuacguuauuaaaaaauuacaaaugauagaaucuuua

SEQ ID NO: 146421 - RNA, 64 nt, hsa
cagaccaauaaugaguuccaaaauuuaaucacuaauuaaaaaucuaucaaacaaaacucuggac

SEQ ID NO: 146422 - RNA, 64 nt, hsa
acucaaacaaaucaacaaugagaaaaacaaccccauuaaaaacugggcaaaggccaugaauaga

SEQ ID NO: 146423 - RNA, 64 nt, hsa
accugucugaauggguauuaucagaauggguauuauuaaaaaaucaaaacauagaugcuaguga

SEQ ID NO: 146424 - RNA, 64 nt, hsa
uggagccaccacgcccuuccucaaggggucacuuauuaaaaaguccacggccugaggccaggcc

SEQ ID NO: 146425 - RNA, 64 nt, hsa
ccagaagccuguggguuucuuucuagcuugggggauuaaaaaaaaaauucuccacuuuuuuuuu

SEQ ID NO: 146426 - RNA, 64 nt, hsa
gcaaagcagaacuuauaaaauuauauauauauauauuaaaaagucucuauucuucaccccccag

SEQ ID NO: 146427 - RNA, 64 nt, hsa
uaaaucucugccaaaaaaaaaaaaaaacuuaaaaauuaaaaacacaaagagcaaagcagaacuu

SEQ ID NO: 146428 - RNA, 64 nt, hsa
aauugucucuugucuccuucaguuaauuuucagaauuaaaaacauaccaugggaaaaaagcuug

SEQ ID NO: 146429 - RNA, 64 nt, hsa
ggguguuucaugggaaaaucuacacaaacuauucauuaaaaaccauagagccauggacugucau

SEQ ID NO: 146430 - RNA, 64 nt, hsa
gaaccugucucuuaaaaaaaaaaauuuuuuuuuaauuaaaaaaacccacccuuuuucauuuccc

SEQ ID NO: 146431 - RNA, 64 nt, hsa
agaacagagaugagauuugacaaaaaaaaauugaauuaaaaauaacacagucuuuuuaaaacua

SEQ ID NO: 146432 - RNA, 64 nt, hsa
ugccaucuucccugcgaucaggcaaaaaaguggaauuaaaaagucaaaccuuuauaugcaugug

SEQ ID NO: 146433 - RNA, 64 nt, hsa
ucuuuaacauaaagguuugauaaagaacuuagggauuaaaaaaaagauggaguuuucuaacgug

SEQ ID NO: 146434 - RNA, 64 nt, hsa
guuuucuaacgugaggaugaagucuacacuucagauuaaaaaggguuauguuguauccugcugu

SEQ ID NO: 146435 - RNA, 64 nt, hsa
ugucucuaaagaaaaacuauagaaaauuuaaaaaauuaaaaaacggguaacaugguaaauuuua

SEQ ID NO: 146436 - RNA, 64 nt, hsa
gcauuugaugcauuauaacuuaaagguacuacaaauuaaaaauuaaaguauaaaguauuuuaag

SEQ ID NO: 146437 - RNA, 64 nt, hsa
agccuaugauaguaauuuaauguagaaugaagauauuaaaaacagaagcaaauuauuugaagcu

SEQ ID NO: 146438 - RNA, 64 nt, hsa
aucaguuauuucucuugugcacagagaaaaaugcauuaaaaaugacuaaaaaaaauaaaaaauu

SEQ ID NO: 146439 - RNA, 64 nt, hsa
aaaaugcauuaaaaaugacuaaaaaaaauaaaaaauuaaaaaauggauaaaucuuuucuuuuug

SEQ ID NO: 146440 - RNA, 64 nt, hsa
uacuauggcaacuuaaguguaucugcagcucuacauuaaaaaggagaaagagaaauaaccuguc

SEQ ID NO: 146441 - RNA, 64 nt, hsa
agaauauguaccuuuuugaugcuauauuacugcgauuaaaaaguucuugcagguaauguuuaug

SEQ ID NO: 146442 - RNA, 64 nt, hsa
ucucacuguggugugauuggcuaaacaaucucgcauuaaaaauucaaauguaaauugaauucac

SEQ ID NO: 146443 - RNA, 64 nt, hsa
gggcagggggugaauuuuacuuucaucucaaguuauuaaaaacccacaacugaaguaaauuuua

SEQ ID NO: 146444 - RNA, 64 nt, hsa
aacaaaaacaccaaaucauuugaaaucacuguccauuaaaaaaaaucaccaguggaacuaaaca

SEQ ID NO: 146445 - RNA, 64 nt, hsa
cucggggacaacaucugaaggguauguugcaugcauuaaaaaaaaucaucucacaugcauuuua

SEQ ID NO: 146446 - RNA, 64 nt, hsa
gugaugcagcuaccaugauucaaaaaaauuaaaaauuaaaaaaaaaaaaucugccacuuaucca

SEQ ID NO: 146447 - RNA, 64 nt, hsa
agcuuuugugaugcagcuaccaugauucaaaaaaauuaaaaauuaaaaaaaaaaaaucugccac

SEQ ID NO: 146448 - RNA, 64 nt, hsa
ucaguacuuuuccaaugcacuguuguaugaaugcauuaaaaauuguaaaguaccaugcuuagaa

SEQ ID NO: 146449 - RNA, 64 nt, hsa
uauaguuuaauugagauauuuaucuuguggaaauauuaaaaagccuaugcuuguguaagugaaa

SEQ ID NO: 146450 - RNA, 64 nt, hsa
gaguuuagcugacuuuucccuguagcccuaucauauuaaaaacaaaaagugguccacuugaagc

SEQ ID NO: 146451 - RNA, 64 nt, hsa
uauuucucuuugcaagugacuauuugauuaacacauuaaaaauuuuuuaaaaauuuccccuuua

SEQ ID NO: 146452 - RNA, 64 nt, hsa
uugaacucaucuuuuuaugacuaauaguuuuuugauuaaaaaugugaacaagaaaauacuaaaa

SEQ ID NO: 146453 - RNA, 64 nt, hsa
guagaaauuugacagcauuacaaauuaagugaccauuaaaaacacagcaaucauucauacugcu

SEQ ID NO: 146454 - RNA, 64 nt, hsa
uugcacuuguuaccucuuaauauggaugcaacuuauuaaaaauguuggccuggguauuucaaag

SEQ ID NO: 146455 - RNA, 64 nt, hsa
cauggagugaagugcaauauuauaaauauuauagauuaaaaaaaaaauagccgugcacucuuga

SEQ ID NO: 146456 - RNA, 64 nt, hsa
ugccucauucauccauuuuucuuaaaagcuggaaauuaaaaaaaaaaaagagagagagaggcuu

SEQ ID NO: 146457 - RNA, 64 nt, hsa
gggaggagagaggcuuucgguggacacguuugacauuaaaaaaaaaaaaaaaaaaaaaaaaaaa

SEQ ID NO: 146458 - RNA, 64 nt, hsa
acuuguuauucaguuacuaaauuugaggugaauaauuaaaaagaaaaggacauuaggagaguga

SEQ ID NO: 146459 - RNA, 64 nt, hsa
uauguauggauauaauauaaaaugaauucauauaauuaaaaagaauuugguuaauaagaauuug

SEQ ID NO: 146460 - RNA, 64 nt, hsa
gagcaaugcauuguauucagaaaaccugugucacauuaaaaaauuucaucuaggcuaggugcag

SEQ ID NO: 146461 - RNA, 64 nt, hsa
gcacuccagccuggacgacagagcaagacccuguauuaaaaaaaaaauucauccugcacaggga

SEQ ID NO: 146462 - RNA, 64 nt, hsa
ccagccuggccaacaugaugaaacccuugucucuauuaaaaacacaaaaauuagccagaugugg

SEQ ID NO: 146463 - RNA, 64 nt, hsa
auggaugaaucuggcucguuuuaaaaucacguuuucugacgaauccuuugccccuucaccuuua

SEQ ID NO: 146464 - RNA, 64 nt, hsa
auaaugugauauuaguaaguaaaggucuuaaaagucugacgacuggaauagauauaaaguccug

SEQ ID NO: 146465 - RNA, 64 nt, hsa
uuuuguagugaaaauagauauaaucugguuucuaucugacgaguuuuucauaucucaugaaugg

SEQ ID NO: 146466 - RNA, 64 nt, hsa
ucauugggaagcuuaucuacagaugccuucagaaucugacgagauugacucucaguuucauauu

SEQ ID NO: 146467 - RNA, 64 nt, hsa
gcuggcagcaguagcaggacagggauucaggaguucugacgacacgacucucagauccacgccc

SEQ ID NO: 146468 - RNA, 64 nt, hsa
ucaugggaaucgaaccuagggauagugcuccacuucugacgauggagugaagacacuuggcaga

SEQ ID NO: 146469 - RNA, 64 nt, hsa
ugcuuccuagaaaccuaaauaagaucuauuaauuucugacgagagguguucuucuagaauuaau

SEQ ID NO: 146470 - RNA, 64 nt, hsa
uugauuuuggggacacacauugcaacuucccacuucugacgaaaggucuccaugcuuuugcugu

SEQ ID NO: 146471 - RNA, 64 nt, hsa
guccuccucccucaucucaaaggguccucaaagcucugacgaucuaagauacaaugaagccauu

SEQ ID NO: 146472 - RNA, 64 nt, hsa
gacaccaggcaagaaaagcgcagagaaaucggugucugacgauuuuggaaaugagaacaaucuc

SEQ ID NO: 146473 - RNA, 64 nt, hsa
auuuucuaaguugggucaucgugucggcugguugucugacgagcaucguuacaaacaccaugau

SEQ ID NO: 146474 - RNA, 64 nt, hsa
ucagagugaaggaagguugugcugguaagacaucucugacgaagagccauggaugcuuuccaca

SEQ ID NO: 146475 - RNA, 64 nt, hsa
ugagcagggggccugccaccagacccacccacgcucugacgagaggcuuuuccaccuccagcaa

SEQ ID NO: 146476 - RNA, 64 nt, hsa
agagaggaaggagauuccacacagggguggaguuucugacgaagguccuaagggaguguuugug

SEQ ID NO: 146477 - RNA, 64 nt, hsa
uggugcacuaauuagugaauauauaggaaaauuaucugacgaguaucugaaggcauuuucagcu

SEQ ID NO: 146478 - RNA, 64 nt, hsa
ggcuaggcugggagacgacgaaggaacaggcguuucugacgagcgggacgcaguucucggacgc

SEQ ID NO: 146479 - RNA, 64 nt, hsa
cuucuauuuauagcuauugguaguuccccuaaauucugacgauagaaauuuuuauuugcuguuu

SEQ ID NO: 146480 - RNA, 64 nt, hsa
accccaucucuucuuuuaaccuugagaguggauuucugacgaauugauaauaaauuuuuucucu

SEQ ID NO: 146481 - RNA, 64 nt, hsa
aaggagggcagggcuacauccuggcucggugggaucugacgaccugaaaguccagcucccaagu

SEQ ID NO: 146482 - RNA, 64 nt, hsa
ugaccccaacaccgcagcuggcuggcucuccgugucugacgaccucaccagcgucaccaaccau

SEQ ID NO: 146483 - RNA, 64 nt, hsa
gucuccaagccaaguucaggcucacugaccuggcucugacgaggaccccaggccacucugagaa

SEQ ID NO: 146484 - RNA, 64 nt, hsa
uggcgaugucucccuccagguuccaagcccugcgucugacgaugcugcagcgccuggagcagcu

SEQ ID NO: 146485 - RNA, 64 nt, hsa
agucaaaaaucuagaauuucuuuaauuuugcuucucugacgaguugugaagcaaaauaccugaa

SEQ ID NO: 146486 - RNA, 64 nt, hsa
ucauuaaaaauuucuuguauuucuugugcauuaaucugacgauaauuucccuguauauuauguu

SEQ ID NO: 146487 - RNA, 64 nt, hsa
acgagguccacaaacuguuucugcaucccagggcucugacgaaggcguuaagaaacagaugcug

SEQ ID NO: 146488 - RNA, 64 nt, hsa
auaccaucccauagcuccugccaaaucgagacccucugacgacuugccgacuaacuggccacca

SEQ ID NO: 146489 - RNA, 64 nt, hsa
aagccgauccacauccugacuuaagagaucugauucugacgaacugccuggaggaggggaauau

SEQ ID NO: 146490 - RNA, 64 nt, hsa
uuucagccagugcuguuacugcauuuagcauggcucugacgaggcaguggagaguuccugacag

SEQ ID NO: 146491 - RNA, 64 nt, hsa
ccgggccucucaaagucugguagauuacgacagcucugacgauucugacguggaauccacagag

SEQ ID NO: 146492 - RNA, 64 nt, hsa
gggacuacagaccauuaguacccaagugaagucuucugacgauccagaauuccuaagguggcuc

SEQ ID NO: 146493 - RNA, 51 nt, hsa
ugaaaacaaucuuccaguaguucugacgauacuuggagccugguccacgug

SEQ ID NO: 146494 - RNA, 64 nt, hsa
cuugcaacacccugauugcuccugucugauucuuucugacgaucacuuacauuuguguuaugcu

SEQ ID NO: 146495 - RNA, 64 nt, hsa
cagcacccccagccccacgaccaucguucugaauucugacgacaccgugagccugccuuuguac

SEQ ID NO: 146496 - RNA, 64 nt, hsa; identical to SEQ ID NO: 146495

SEQ ID NO: 146497 - RNA, 64 nt, hsa; identical to SEQ ID NO: 146495

SEQ ID NO: 146498 - RNA, 64 nt, hsa
uccuuguaaaugauuugagugaguagguuugguuucugacgaaaguagacuggaggguagcauu

SEQ ID NO: 146499 - RNA, 64 nt, hsa
cuuuggcaccaaaggccuagccaucacuuuugugucugacgagaaugaugccaaaauccucaau

SEQ ID NO: 146500 - RNA, 64 nt, hsa
aaauugcuucuucuucaagauuuauggaaaauacucugacgaguacucuugaacacaaguuccu

SEQ ID NO: 146501 - RNA, 64 nt, hsa
ccucaugacccagccucacagacccucucaggccucugacgagugagcgggugaagugccacug

SEQ ID NO: 146502 - RNA, 64 nt, hsa
agcuauaggaaacccaguaccaccccuggucuguucugacgagacaucguucauaaggcacagc

SEQ ID NO: 146503 - RNA, 64 nt, hsa
ggguuacacugaucuuguuccacugauuacucucucugacgaguccaucaccugcaacuuaaau

SEQ ID NO: 146504 - RNA, 64 nt, hsa
uccucuggugugguaaauugaccuaaaggugaccucugacgauuuccugaaauaaauaugcaau

SEQ ID NO: 146505 - RNA, 64 nt, hsa
cuguuugccccaccuucaccguguggaacaagugucugacgauuaucacugggcucccuauccc

SEQ ID NO: 146506 - RNA, 64 nt, hsa
cucuggaggaaacuuucuuucuuaauuccuauucucugacgaauaaagacuuacugccuacaag

SEQ ID NO: 146507 - RNA, 64 nt, hsa
acaaauuuuacuggauuuaucuuaauaaaaagacucugacgaugauuguguuuuguuauaucuu

SEQ ID NO: 146508 - RNA, 64 nt, hsa
uaaggcauucuguauaaaugcaaaugugcauuuuucugacgaguguccauagauauaaagccau

SEQ ID NO: 146509 - RNA, 64 nt, hsa
gacucuuugugagauucuucugagcaguuaaccucuaggauaauguggcuugaacacauuacag

SEQ ID NO: 146510 - RNA, 64 nt, hsa
ugacuaugauugaauuuuauuuauuaauacuucccuaggauauccuguguuugagugugaaguu

SEQ ID NO: 146511 - RNA, 64 nt, hsa
cucuggccacaauccuccccaccagucucacccacuaggauaggaacugggccuugugugcugg

SEQ ID NO: 146512 - RNA, 64 nt, hsa
ucacccagcaaggcacaggcuccuguauuugagacuaggauagcuucaucuugagccugagccu

SEQ ID NO: 146513 - RNA, 64 nt, hsa
auuaugaccucaaaaaaaaaaagccaacuuugagcuaggauaaaaauuggguaaaggacauuug

SEQ ID NO: 146514 - RNA, 64 nt, hsa
ccauguauauuuuccgcuuugacuuuaacgcuuucuaggauaggguaagcacccuuaauucagg

SEQ ID NO: 146515 - RNA, 64 nt, hsa
aaccucuuuaaaaaaauuuuuaaagaacuauggcuaugaccaaagcuucuauuuugccaaaaag

SEQ ID NO: 146516 - RNA, 64 nt, hsa
gaaaccugacaccuagauuuauuuggaaauauucuaugaccacuuuacagaugaggaaacaggc

SEQ ID NO: 146517 - RNA, 64 nt, hsa
uuuuaaguguauuaugaaggcaguuuucaaaggauaugaccaguugggguaauucaaauuaaaa

SEQ ID NO: 146518 - RNA, 64 nt, hsa
guaaugguggauucauuuacauuguuuacacuucuaugaccaggccuuaagggaaggucaguuu

SEQ ID NO: 146519 - RNA, 64 nt, hsa
cuucauagcauacuccuucccccucaggugauacuaugaccaugaguagcaucagccagaacau

SEQ ID NO: 146520 - RNA, 64 nt, hsa
acauagcaauuuucuguggcacugagaaaccauguaugaccacaauaaaaauccauuuugugaa

SEQ ID NO: 146521 - RNA, 64 nt, hsa
cggacaugcuuuucugccacuccauauuaaaacauaugaccauugagucccugcuaagugcgag

SEQ ID NO: 146522 - RNA, 64 nt, hsa
uucuuacaaaacaaauuccacaaagaacacccuauaugaccacagcugcagaucaguucuuagc

SEQ ID NO: 146523 - RNA, 64 nt, hsa
ccuuuacauagaaaacagcauucuuuuugccaaauaugaccaaauuacuuuuauuuauaauuuu

SEQ ID NO: 146524 - RNA, 64 nt, hsa
guuuugauucugggcugaguuauuacaguuaugguaugaccagugagagggauuuguguccuuu

SEQ ID NO: 146525 - RNA, 64 nt, hsa
aaguguuuacuaugugcaacgguauugaaguucuuaugaccacagaucaucaguacuguugucu

SEQ ID NO: 146526 - RNA, 64 nt, hsa
uuuuuugacuguugggcuuugggaagauguuauuuaugaccaauaucugccaguaacgcuguuu

SEQ ID NO: 146527 - RNA, 64 nt, hsa
guuaggaagucuuguccuagaacgcccuggcugguaugaccacaguucauggcggcucuucucg

SEQ ID NO: 146528 - RNA, 64 nt, hsa
gggcauggcucuggacucagcugguuuauaccuauaugaccauuacaauugucuacagaucaca

SEQ ID NO: 146529 - RNA, 64 nt, hsa
cacuugagcacaggaguuugaggcugcagugaccuaugaccacaucacuguacgccagcccggg

SEQ ID NO: 146530 - RNA, 64 nt, hsa
uuaacuagcaaaagccuuggcaccuguuggagacuaugaccaagccaauaaaaagggcauuuaa

SEQ ID NO: 146531 - RNA, 64 nt, hsa
gaaauugaggaugccccuggggcuagaucgaugauaugaccagaaaucaaaaagggaaugcauu

SEQ ID NO: 146532 - RNA, 64 nt, hsa
cucccuucgccccagcuagcuugagcuucugcccuaugaccacugagugcauuuaaauaaaaac

SEQ ID NO: 146533 - RNA, 64 nt, hsa
acuacacugugcuaggcgcauucuaggacaugaauaugaccacacccucuuucaccggguguuu

SEQ ID NO: 146534 - RNA, 64 nt, hsa
cacuuuacuacugcagaaggaagaaagaauauaauaugaccaucuucagguauaacaguguugu

SEQ ID NO: 146535 - RNA, 64 nt, hsa
guagaaaaacauaugcaaaucucaguguucucacuaugaccacucugagcagagauuugguuuu

SEQ ID NO: 146536 - RNA, 64 nt, hsa
uauaaauuggaguuaggaauuucaugaaccucacuaugaccaaaauuaauuuuuugauucaguu

SEQ ID NO: 146537 - RNA, 64 nt, hsa
ccauuuaauauguucugaaaacauuacucaccuguaugaccagguugccaguguacuggucuag

SEQ ID NO: 146538 - RNA, 64 nt, hsa
uuuguuuagucucgcuaaaguuauauuugucuguuaugaccacagaguuauauguguguguauc

SEQ ID NO: 146539 - RNA, 64 nt, hsa
uuuugaaagauuuauauaugaugaauucuggauauaugaccaauaaaacugaugaagcaaaacc

SEQ ID NO: 146540 - RNA, 64 nt, hsa
ggcaagagaccucuaccuaguagaaaguguagucuaugaccacugccacacuaaaaacuauuug

SEQ ID NO: 146541 - RNA, 64 nt, hsa
aaaacuuguugguuauccaugucuugucuguacauaugaccauguuucuugacauggaaauacc

SEQ ID NO: 146542 - RNA, 64 nt, hsa
ugcuuugagcagaguuggagugccuucauccaaguaugaccacuuuuaauacacuuuuuugagu

SEQ ID NO: 146543 - RNA, 64 nt, hsa
uaguucuuaacuuuuuuuuaugguuucuaauauguaugaccaauguagccauugcuuuaaaaug

SEQ ID NO: 146544 - RNA, 64 nt, hsa
gacagaaugucaaauaaaaaggaauuagcuagaauaugaccauuaaaugugcuucugaaauaua

SEQ ID NO: 146545 - RNA, 64 nt, hsa
ugagggugaguggagggguauauggaaacacggcuaugaccaaagggagaucccagccugggca

SEQ ID NO: 146546 - RNA, 64 nt, hsa
uauaauauaauuuagcuugaaagaugcucuacauuaugaccaauaaaaagggaauguauguuuu

SEQ ID NO: 146547 - RNA, 64 nt, hsa
ugcagccaaccaagaugcaaauguuuugaaaugauaugaccaaaauuuuaaguaggaaagucac

SEQ ID NO: 146548 - RNA, 64 nt, hsa
auucuaccacuugcacuuacucaucuucuagccuuaugaccaggaaccuuuguuuugggcucaa

SEQ ID NO: 146549 - RNA, 64 nt, hsa
gagcuuuaaaaacagaaaaaaaaccccauauacuuaugaccaucuuaaaucaagaaaauugcau

SEQ ID NO: 146550 - RNA, 64 nt, hsa
ugguauuuucauuuuucucaagcucuccaauaaauaugaccaccaagaugcagaacucuuucag

SEQ ID NO: 146551 - RNA, 64 nt, hsa
ucacccccuuauuuaaaugugugcuaugacccacuaugaccacagcaucugcauuuucuaaaaa

SEQ ID NO: 146552 - RNA, 64 nt, hsa
uuuggcaguucacuccauuaggggguaaauaauuuaugaccauucaucuguuuuuaugaauuuu

SEQ ID NO: 146553 - RNA, 64 nt, hsa
gagggugguagaaaucuauucacaauucagcuucuaugaccaaaaugaguuguaaauucucugg

SEQ ID NO: 146554 - RNA, 64 nt, hsa
caaacuaaaaucuaauauuuuaucuuucuuuuuuuaugaccaacaaccaaauaaagcccaucau

SEQ ID NO: 146555 - RNA, 64 nt, hsa
cucuguuguuacuagauuuaguuuaaaaauuguguaugaccauuaauguaugucauaaacaugu

SEQ ID NO: 146556 - RNA, 64 nt, hsa
uuuucauuuaaaacaagacaaagaaacaaauuccuaugaccaaauugcuugccuacaguucccu

SEQ ID NO: 146557 - RNA, 64 nt, hsa
uagacuacugaaaugucauuuuaguuauuuuucuuaugaccacauuguacaaaugaaucugugu

SEQ ID NO: 146558 - RNA, 64 nt, hsa
cauggagcacuccauagucucaaacugucccccuuaugaccaacagcacauuugugaagagguu

SEQ ID NO: 146559 - RNA, 64 nt, hsa
aauguaacauagauaacaauauaaauaaaagugguaugaccagugcuuguuuuuccuugugugu

SEQ ID NO: 146560 - RNA, 64 nt, hsa
aaccaagagaaaaauuuuuaugcuaggaugccuuuaugaccacuuaauuuuuuaaucuuaguuu

SEQ ID NO: 146561 - RNA, 64 nt, hsa
gcuggcaagaagaggaaaaauaacacagaggaguuaugaccaguguuguaaggaucuggccuag

SEQ ID NO: 146562 - RNA, 64 nt, hsa
acugacugaaggaacagaaagugagacagacagauaugaccaaauuuauacaaaccauguacca

SEQ ID NO: 146563 - RNA, 64 nt, hsa
cgugcuuucauguacuuccagugcuggagcaugguaugaccagauuuuaucacagugccauuug

SEQ ID NO: 146564 - RNA, 64 nt, hsa
aucugauagguacaaaagaaaaccaagauuuugauaugaccaccuuucaacacuuuuuacugca

SEQ ID NO: 146565 - RNA, 64 nt, hsa
ccauagauugaagaaauuuauaccacauaucgcauaugaccaucuuuccaucaaaucaauguag

SEQ ID NO: 146566 - RNA, 64 nt, hsa
cagccuaucuuugugugacaugugagcauaaaauuaugaccaugguauauuccuauuggaaaca

SEQ ID NO: 146567 - RNA, 64 nt, hsa
acuguucuuacuguaacuacuuccugauuaggaauaugaccauuugacuguucaaugauuauuu

SEQ ID NO: 146568 - RNA, 64 nt, hsa
uauuuuauuuuugccaaaauauuuuauuauaaaauaugaccaaaauauuuaaaaugcacaaugc

SEQ ID NO: 146569 - RNA, 64 nt, hsa
cugcaucauagcuaugccuguauggagucuaacauaugaccaauaccaacccauaauccagcug

SEQ ID NO: 146570 - RNA, 64 nt, hsa
uuuauuccgaaggagcuacgucuuaggugaaaguuaugaccaaccagauuaaacucuacccaca

SEQ ID NO: 146571 - RNA, 64 nt, hsa
gucugaacaaggcaccuguaaauaaaucagcauuuaugaccagaagaaaaauaaucuggucuug

SEQ ID NO: 146572 - RNA, 64 nt, hsa
uuuaaugucuacuuuuagagagcacuagccaguauaugaccaugugauuaauuucuuuucacac

SEQ ID NO: 146573 - RNA, 64 nt, hsa
ugcuugaacucuuuuucugugaaacucauuaagguaugaccaaauccugccucauuaauucaag

SEQ ID NO: 146574 - RNA, 64 nt, hsa
uuucucauuagcaugaaugaaccugauacacaauuaugaccagaaaauauggcuccaugaaggu

SEQ ID NO: 146575 - RNA, 64 nt, hsa
uaucccauuuugguaauuauucauacauagcacauaugaccaugauguucagggcuuuauagaa

SEQ ID NO: 146576 - RNA, 64 nt, hsa
cacaggcacacuaugacuucugcucccaaauacauaugaccauauguaaauaccaccuugcauu

SEQ ID NO: 146577 - RNA, 64 nt, hsa
aauacagggagggacuuucucuggaauuuccugauaugaccaagaaagcuucuuaucaaaagaa

SEQ ID NO: 146578 - RNA, 64 nt, hsa
uguaaaaaugccaaauuugggaaaggaaauuuuguaugaccacuguucuauuuuucagugauuc

SEQ ID NO: 146579 - RNA, 64 nt, hsa
aaaaggaauuuaugcuguacauuucaguucaguguaugaccaaaagcaauauguuuauaagaag

SEQ ID NO: 146580 - RNA, 64 nt, hsa
guauaauaauuauggguaugaaaaugacucuucauaugaccacauaugugaaaguauauauaug

SEQ ID NO: 146581 - RNA, 64 nt, hsa
ugucuccauuuuauagauuaguuucuuucuaaauuaugaccaaaaauauuuugcuauuucuuuc

SEQ ID NO: 146582 - RNA, 64 nt, hsa
ucuuuaaguauuuugugaauauuuauuuuaauuuuaugaccaacaugucauuugguuguaaccu

SEQ ID NO: 146583 - RNA, 64 nt, hsa
ccuaguuauucagacaaaauuuggaaacuuauuuuaugaccacaucuaauauucuggcugcuuu

SEQ ID NO: 146584 - RNA, 64 nt, hsa
agugccuggggaugaccuaugcaaucacaccgcuuaugaccauccuagagagggcccugagcac

SEQ ID NO: 146585 - RNA, 64 nt, hsa
auauuuucaauuuauauauuguauuucuuaauauuaugaccaagaauuuuaucggcauuaauuu

SEQ ID NO: 146586 - RNA, 64 nt, hsa
uauguuaaauaaaaaaucaguaucauggaaaagauaugaccauaauuuagucuccucaagugaa

SEQ ID NO: 146587 - RNA, 64 nt, hsa
aucaucgauccucucugugguguuaauuuuuuuauaugaccaguagaaaaauuuuaauauucuc

SEQ ID NO: 146588 - RNA, 64 nt, hsa
uucucuaguucuauaguuuauuuguugaagguacuaugaccaaagaaucagcugcucuacagga

SEQ ID NO: 146589 - RNA, 64 nt, hsa
cauuggaaugccuuggaaauagaaagaagccauauaugaccagaagccuuggaaccagccccau

SEQ ID NO: 146590 - RNA, 64 nt, hsa
uaacaccugguuauauaugaaauacucauauguuuaugaccaaaauaaauaugaaaccucauau

SEQ ID NO: 146591 - RNA, 64 nt, hsa
ccuuuugaaugggguagggggguuuaccugguuuuaugaccaggcauaguaucuauuauauuug

SEQ ID NO: 146592 - RNA, 64 nt, hsa
uacacaguucucaggaggcugugguuucuuagaauaugaccaugagccauuucacagaaaaacc

SEQ ID NO: 146593 - RNA, 64 nt, hsa
cugucauuucaaagacucucaccccugcuauaacuaugaccaugcugauaaacugauuuaucua

SEQ ID NO: 146594 - RNA, 64 nt, hsa
ccuugucuauuccugucuguauaaaguguuucauuaugaccagaucucugauuguauggucacu

SEQ ID NO: 146595 - RNA, 64 nt, hsa
aacaaaucugaaaauaugucaaauuacguguuuuuaugaccauguaauguuuuaaaggcaccua

SEQ ID NO: 146596 - RNA, 64 nt, hsa
aaaagcaaauacuuccuaacggcaguaaugugacuaugaccaugauauauuauauaugugacag

SEQ ID NO: 146597 - RNA, 64 nt, hsa
uucauuuuucucucccucuuuuucucuguauauuuaugaccagagcaaaaauguaaaaaacaaa

SEQ ID NO: 146598 - RNA, 64 nt, hsa
uaugaucugccauuucaaagacucauguuucugcuaugaccaugacacgauuuaaaucuuuuca

SEQ ID NO: 146599 - RNA, 64 nt, hsa
gaauucugcuaguccaguagcaaugucuuccucuuaugaccagaguucugugcauaacaggauc

SEQ ID NO: 146600 - RNA, 64 nt, hsa; identical to SEQ ID NO: 146595

SEQ ID NO: 146601 - RNA, 64 nt, hsa
caaugugcacauuaaaauauggaaauuuuaaaauuaugaccaagggcuugaaacauauuggauu

SEQ ID NO: 146602 - RNA, 64 nt, hsa
uauuuccuuguguguaaaauguucauucauuucuuaugaccacuuguuaagaggaacugaucuc

SEQ ID NO: 146603 - RNA, 64 nt, hsa
cuaaaauuacuugauguaaguaauuuaaaucacuuaugaccaaguuauuaaccuuaugaaucag

SEQ ID NO: 146604 - RNA, 64 nt, hsa
uagaugauuucagacuugacccuaauugaccauauaugaccaggaaacacuucugaguuuacag

SEQ ID NO: 146605 - RNA, 64 nt, hsa
uuuccagucggagagcgaggagaagguugucaccuaugaccacauugggcccaacgucugcaug

SEQ ID NO: 146606 - RNA, 64 nt, hsa
uaugcuuauguacuuacuuacacauuuuuaacuuuaugaccagccuaaauauucugggggaagu

SEQ ID NO: 146607 - RNA, 64 nt, hsa
gaggcauccuucucugaugugcacaaacacaauguaugaccagagccuugcaacucaaagugug

SEQ ID NO: 146608 - RNA, 64 nt, hsa
cagacuucacacaguauucucccccacgccguccuaugaccaaaggccccugccaggugugggc

SEQ ID NO: 146609 - RNA, 64 nt, hsa
uuuuacuuuagaaccuggaaucuccuacuuaauauaugaccaugacuuugaaaggcaaaagagg

SEQ ID NO: 146610 - RNA, 64 nt, hsa
agggaagccccauccucucccaggaccaggaguuuaugaccaggcgagcacaaauggcuaaaag

SEQ ID NO: 146611 - RNA, 64 nt, hsa
acuuggaaggcugccuuaaaguauaucucuuaucuaugaccaaauaucugggguacuuuuagaa

SEQ ID NO: 146612 - RNA, 64 nt, hsa
caucauuggaaucuuaucaccagauaggcaaguuuaugaccaaacaagagaguacuggcuuuau

SEQ ID NO: 146613 - RNA, 64 nt, hsa
gauaugauagacuccuauuuuucuuguuuuauauuaugaccacacacaucucugcuggaaaguc

SEQ ID NO: 146614 - RNA, 64 nt, hsa
ggaaugaacuugccagccuucaggcucguucagcuaugaccaucugugcggucaggguacacuc

SEQ ID NO: 146615 - RNA, 64 nt, hsa
cacauuaugauauuguccuuuuaugaaacugucauaugaccagaauucuucuguaauucugccc

SEQ ID NO: 146616 - RNA, 64 nt, hsa
cugagaaagaagcuguacguuuucuuuauguuuuuaugaccaaagcaguuucuugucaauacac

SEQ ID NO: 146617 - RNA, 64 nt, hsa
ccacacaaccagagggugcacaugacuugaucccuaugaccaagucaaguugguguugcccaaa

SEQ ID NO: 146618 - RNA, 64 nt, hsa
uuuuuuuuuggcuggggugggggcauuggucacauaugaccaguaauugaaagacgucaucacu

SEQ ID NO: 146619 - RNA, 64 nt, hsa
uuggguucugagaggguuuugccauguuugcuuguaugaccaagucaccaaggaaauaaacagg

SEQ ID NO: 146620 - RNA, 64 nt, hsa
uuuuggauaaugaagucagcagaggaaaaaaaaauaugaccaucucaaaagaugccaacguugu

SEQ ID NO: 146621 - RNA, 64 nt, hsa
cauguacuuggguguuucccuccauccuuucugauaugaccaaaaaucaaguuguuuuguuuuu

SEQ ID NO: 146622 - RNA, 64 nt, hsa
ggaaucccgaauggccccaauucuugccucauccuaugaccaggcuuuuagaggaccuucccua

SEQ ID NO: 146623 - RNA, 64 nt, hsa
aguuagauguuuguucaccauggggaccauuacauaugaccauacaaugcacugaauugacagg

SEQ ID NO: 146624 - RNA, 64 nt, hsa
uguuaauacagaaaagagacauuucagcugugauuaugaccauuguuucauauuccaauuaaaa

SEQ ID NO: 146625 - RNA, 64 nt, hsa
cuguguggaaaccuaacuguccaggagguaaguuuaugaccaguaacaugaguuuuauauuaaa

SEQ ID NO: 146626 - RNA, 64 nt, hsa
cuauguuuugaaacuguaucccacaaguugccgguaugaccaucuuauuuguaaugagucugug

SEQ ID NO: 146627 - RNA, 64 nt, hsa
ggguaaaucuuuuaauaaaacuaccuaucugguuuaugaccacuuagaucgaaaugucaauaua

SEQ ID NO: 146628 - RNA, 64 nt, hsa
uccaaauuguguauggauucacgugucagucauuuaugaccaacuguguagugugcccucauau

SEQ ID NO: 146629 - RNA, 64 nt, hsa
auuuugaucuauuuuccuauggaguuguuucuauuaugaccauuuaauuuuguuuuuauuuaau

SEQ ID NO: 146630 - RNA, 64 nt, hsa
guguucaaaacauugagacacucuucaccuauuguaugaccaaauaaagguuaugcugcuuguu

SEQ ID NO: 146631 - RNA, 64 nt, hsa
uccccugccuccccuccuuuuuccuguccaccuauaugaccaaucccuaauugcuguccugaug

SEQ ID NO: 146632 - RNA, 64 nt, hsa
gagaguuuuauuuuaaaaagcuaagucuuauaauuaugaccauuaacuugcuuuggcuuuauug

SEQ ID NO: 146633 - RNA, 64 nt, hsa
uuggcaagacaacuauaugguuaagaauuuccaguaugaccacacccaauaacuguuauuagag

SEQ ID NO: 146634 - RNA, 64 nt, hsa
agagccucaugaggguuucuaggauuuaugaccuuaugaccaguuuuuuucauuuaccaagauu

SEQ ID NO: 146635 - RNA, 64 nt, hsa
uuuuugcuaucuuuuuuuauuauucugaucaugauaugaccauuuaaccucagaauucauaauu

SEQ ID NO: 146636 - RNA, 64 nt, hsa
acaaguuuucaaauaggugaagacagcauagaauuaugaccaggguggcucaacccacaaauca

SEQ ID NO: 146637 - RNA, 64 nt, hsa
guucuuuguaauuuaaugaauaggucugaaaacuuaugaccaauacuuguuauaacuuagagga

SEQ ID NO: 146638 - RNA, 64 nt, hsa
agcucugaugaaugagauuagugcccuuauaaauuaugaccaaaagagcucuucacuccuccua

SEQ ID NO: 146639 - RNA, 64 nt, hsa
auuaugauguuccucagagaagugaggugggaaauaugaccaggucaggcaguuggaggggcuu

SEQ ID NO: 146640 - RNA, 64 nt, hsa
cuguaucaagauaaaggaauucaaauagcauauauaugaccaugucugaaaugucaguucucua

SEQ ID NO: 146641 - RNA, 64 nt, hsa
ugaccaauggcuuuuaaggaaggacuaagugacuuaugaccagaacaagggagcagccugaguc

SEQ ID NO: 146642 - RNA, 64 nt, hsa
gucuuaugcuuauggacauuguauauuuguauuuuaugaccaaguagaccaagucagaaagauc

SEQ ID NO: 146643 - RNA, 64 nt, hsa
ucacuuggcucucuagauccacugugguuggcaguaugaccagaaucauggaauuugcuagaac

SEQ ID NO: 146644 - RNA, 64 nt, hsa
auuguaaguagcacauugcaacaacaaucaugcuuaugaccaauacagucacuagguuguaguu

SEQ ID NO: 146645 - RNA, 64 nt, hsa
cugaugguuuggaaaauaacuuuaauuaggaucauaugaccauugaaaaaggaaaaauguagac

SEQ ID NO: 146646 - RNA, 64 nt, hsa
ucuauuugauuuuuuaaaaaaccuuaauguaagauaugaccaguuaaaacaaagcaauucuuga

SEQ ID NO: 146647 - RNA, 64 nt, hsa
gcagcaauugcugacauauuaaaugacucuugccuaugaccaaggccauuugaugccaggggag

SEQ ID NO: 146648 - RNA, 64 nt, hsa
aaauaucucaucugccggcccccaggacaagugguaugaccagugauaaugccccaaggacaag

SEQ ID NO: 146649 - RNA, 64 nt, hsa
acuauaaauaagauagguuugagggcauaaaauguaugaccacuggggccggaguaucuauuuc

SEQ ID NO: 146650 - RNA, 64 nt, hsa
uguuccccaagacauucuagguuugcaagaaaaauaugaccacacuccagcugggaucacaugu

SEQ ID NO: 146651 - RNA, 64 nt, hsa
ggccgagagcugagcaagaauuuggaauggaaguuaugaccaagggaauuaugcuguucauuua

SEQ ID NO: 146652 - RNA, 64 nt, hsa
ggggugugggguguucccggccaucagcacagccuaugaccauugcaacaaccucucaccaucu

SEQ ID NO: 146653 - RNA, 64 nt, hsa
uauucaaagaaaagcuaaagcaaaaacacuggcauaugaccaugcaagacugucagugccaaca

SEQ ID NO: 146654 - RNA, 64 nt, hsa
agcaccguccgaauccccgcaggacccauggagcuaugaccacaccaggccauucaaauggcuc

SEQ ID NO: 146655 - RNA, 64 nt, hsa
gugucagcucuguacagggucagaucccagguucuaugaccaaauaaguaacuuaaguuuugug

SEQ ID NO: 146656 - RNA, 64 nt, hsa
aucccucccugccucuccuagaauugcaagauauuaugaccagugugucuggccgcauuccccc

SEQ ID NO: 146657 - RNA, 64 nt, hsa
gacccgccugguggugaaggaacggaaucgcaaguaugaccagaagccaggacaaagcuggcag

SEQ ID NO: 146658 - RNA, 64 nt, hsa
uugccacaucccaagauguaaaacggcaguaauuuaugaccacguauggaagaaauucuucaaa

SEQ ID NO: 146659 - RNA, 64 nt, hsa
uguccuuauggggaugggugccacaaauagaaaauaugaccagaucagggacuugaaugcacuu

SEQ ID NO: 146660 - RNA, 64 nt, hsa
cccuauucaggcaagauuaaaaaaaaaaaaagacuaugaccaaaauggcuuaagauaaaguauu

SEQ ID NO: 146661 - RNA, 64 nt, hsa
ugucaaagaggauguaauaaauuguaguaauaaauaugaccacaagccauaaaugacugcagga

SEQ ID NO: 146662 - RNA, 64 nt, hsa
ugucagcaaggguguaauauaccauagugauaaauaugaccaaaagccauaaaugacugugaga

SEQ ID NO: 146663 - RNA, 64 nt, hsa
ugucagcaaguguguaauauaccauagugauaaauaugaccaaaagccauaaaugacugugaga

SEQ ID NO: 146664 - RNA, 64 nt, hsa
gaauuccauugaagaaaaccuauuuuuguaugaauaugaccaguuucaagcagagcccaaaaug

SEQ ID NO: 146665 - RNA, 64 nt, hsa
aagcacucggagaauugugcaggugucauuuaucuaugaccaauaggaagagcaaccaguuacu

SEQ ID NO: 146666 - RNA, 64 nt, hsa
cuucuuuaauaaauauuuauuucccauacacccuuaugaccauuuccagagacugaauuguguu

SEQ ID NO: 146667 - RNA, 64 nt, hsa
uuugagcuuucuaggucacauuggguuaaguuuguaugaccaaaugaaucuuguaggguucugu

SEQ ID NO: 146668 - RNA, 64 nt, hsa
cagcccggccuacgcccaguacccaccggccaccuaugaccaguacccauacgccgccucgccu

SEQ ID NO: 146669 - RNA, 64 nt, hsa
uguguguauacuuuauuuacccauacguauauuuuaugaccaugagcuaaguuguuauuucuuu

SEQ ID NO: 146670 - RNA, 64 nt, hsa
uggucugucaaaacugcaaccaugggguauguaguaugaccaacugcauuuaacaaaacuccuc

SEQ ID NO: 146671 - RNA, 64 nt, hsa
caugcccccgugaccugccugcugugguaugagcuaugaccaagagcaggcuuccugcuccaug

SEQ ID NO: 146672 - RNA, 64 nt, hsa
uuccuguuugucuugugucuugagagcuuggccuuaugaccagugagaacucucucccuggucu

SEQ ID NO: 146673 - RNA, 64 nt, hsa
caacacuacgaagaguauuuggauugcgugacccuaugaccaaaacuauuccauugaccuuaau

SEQ ID NO: 146674 - RNA, 64 nt, hsa
cuccugaaguuuuggcagcgucuugaaagccuaauaugaccaucuguugcucaacaauacuguu

SEQ ID NO: 146675 - RNA, 64 nt, hsa
uaauucucaccauuccugugguaccugcgaguguuaugaccaggauuccuuaaaccugaacuca

SEQ ID NO: 146676 - RNA, 64 nt, hsa
uucaagucugaguucaaaaccagcccugaucccuuaugaccaacugcuacucgaccagucgcca

SEQ ID NO: 146677 - RNA, 64 nt, hsa
aagaagaagccauucccaacguugcucaucaaauuaugaccauaaauuuccaggaucagacuaa

SEQ ID NO: 146678 - RNA, 64 nt, hsa
cuggucguacugcagucagcacccguaacccggcuaugaccagggaucuguaagcccuguggcu

SEQ ID NO: 146679 - RNA, 64 nt, hsa
gaggaggguggcucuguuuccccaaggcaaagcuuaugaccaaugggccaucggacuggagacc

SEQ ID NO: 146680 - RNA, 64 nt, hsa
cagaggcaaugacaugaguuuguuuucucauuaauaugaccaguuugggucuauguugguucac

SEQ ID NO: 146681 - RNA, 64 nt, hsa
uucaggaaagcagcaguuuucuuuuaauuuuuccuaugaccauaaaauuagacauaccucucaa

SEQ ID NO: 146682 - RNA, 64 nt, hsa
ccaaauuuauaguuaguuuagguaaacuuuuuauuaugaccauuagaaacuauuuugaaugcuu

SEQ ID NO: 146683 - RNA, 64 nt, hsa
aauaugcuggguuaucaaauucuguucacugaguuaugaccagauaaauaauagauaugcacau

SEQ ID NO: 146684 - RNA, 64 nt, hsa
ugcuuuuuguacuuggaaguguuucaaaaaauuauaugaccauauuuacucuuucuaacuuucu

SEQ ID NO: 146685 - RNA, 64 nt, hsa
aggagagacaguuggauucuuuagagaagauggauaugaccaguggcuauggccugugcgaucc

SEQ ID NO: 146686 - RNA, 64 nt, hsa
aauuggucauagaacagcauuugacgccuagaacuaugaccaccucauggucagagaugagaau

SEQ ID NO: 146687 - RNA, 64 nt, hsa
ccaaauuuauaguuaguuuagguaaacuuuuuauuaugaccauuagaaacuauuuugaauguuu

SEQ ID NO: 146688 - RNA, 64 nt, hsa; identical to SEQ ID NO: 104783

SEQ ID NO: 146689 - RNA, 64 nt, hsa; identical to SEQ ID NO: 104784

SEQ ID NO: 146690 - RNA, 64 nt, hsa; identical to SEQ ID NO: 104785

SEQ ID NO: 146691 - RNA, 64 nt, hsa; identical to SEQ ID NO: 104786

SEQ ID NO: 146692 - RNA, 64 nt, hsa; identical to SEQ ID NO: 104787

SEQ ID NO: 146693 - RNA, 64 nt, hsa; identical to SEQ ID NO: 104788

SEQ ID NO: 146694 - RNA, 64 nt, hsa; identical to SEQ ID NO: 104789

SEQ ID NO: 146695 - RNA, 64 nt, hsa; identical to SEQ ID NO: 104790

SEQ ID NO: 146696 - RNA, 64 nt, hsa; identical to SEQ ID NO: 104791

SEQ ID NO: 146697 - RNA, 64 nt, hsa; identical to SEQ ID NO: 104792

SEQ ID NO: 146698 - RNA, 64 nt, hsa; identical to SEQ ID NO: 104793

SEQ ID NO: 146699 - RNA, 64 nt, hsa; identical to SEQ ID NO: 104794

SEQ ID NO: 146700 - RNA, 64 nt, hsa; identical to SEQ ID NO: 104795

SEQ ID NO: 146701 - RNA, 64 nt, hsa; identical to SEQ ID NO: 104796

SEQ ID NO: 146702 - RNA, 64 nt, hsa; identical to SEQ ID NO: 104797

SEQ ID NO: 146703 - RNA, 64 nt, hsa; identical to SEQ ID NO: 104798

SEQ ID NO: 146704 - RNA, 64 nt, hsa; identical to SEQ ID NO: 104799

SEQ ID NO: 146705 - RNA, 64 nt, hsa; identical to SEQ ID NO: 104800

SEQ ID NO: 146706 - RNA, 64 nt, hsa; identical to SEQ ID NO: 104801

SEQ ID NO: 146707 - RNA, 64 nt, hsa; identical to SEQ ID NO: 104802

SEQ ID NO: 146708 - RNA, 64 nt, hsa; identical to SEQ ID NO: 104803

SEQ ID NO: 146709 - RNA, 64 nt, hsa; identical to SEQ ID NO: 104804

SEQ ID NO: 146710 - RNA, 64 nt, hsa; identical to SEQ ID NO: 104805

SEQ ID NO: 146711 - RNA, 64 nt, hsa; identical to SEQ ID NO: 104806

SEQ ID NO: 146712 - RNA, 64 nt, hsa; identical to SEQ ID NO: 104807

SEQ ID NO: 146713 - RNA, 64 nt, hsa; identical to SEQ ID NO: 104808

SEQ ID NO: 146714 - RNA, 64 nt, hsa; identical to SEQ ID NO: 104809

SEQ ID NO: 146715 - RNA, 64 nt, hsa; identical to SEQ ID NO: 104810

SEQ ID NO: 146716 - RNA, 64 nt, hsa; identical to SEQ ID NO: 104811

SEQ ID NO: 146717 - RNA, 64 nt, hsa; identical to SEQ ID NO: 104812

SEQ ID NO: 146718 - RNA, 64 nt, hsa; identical to SEQ ID NO: 104813

SEQ ID NO: 146719 - RNA, 64 nt, hsa; identical to SEQ ID NO: 104814

SEQ ID NO: 146720 - RNA, 64 nt, hsa; identical to SEQ ID NO: 104815

SEQ ID NO: 146721 - RNA, 64 nt, hsa; identical to SEQ ID NO: 104816

SEQ ID NO: 146722 - RNA, 64 nt, hsa; identical to SEQ ID NO: 104817

SEQ ID NO: 146723 - RNA, 64 nt, hsa; identical to SEQ ID NO: 104818

SEQ ID NO: 146724 - RNA, 64 nt, hsa; identical to SEQ ID NO: 104819

SEQ ID NO: 146725 - RNA, 64 nt, hsa; identical to SEQ ID NO: 104820

SEQ ID NO: 146726 - RNA, 64 nt, hsa; identical to SEQ ID NO: 104821

SEQ ID NO: 146727 - RNA, 64 nt, hsa; identical to SEQ ID NO: 104822

SEQ ID NO: 146728 - RNA, 64 nt, hsa; identical to SEQ ID NO: 104823

SEQ ID NO: 146729 - RNA, 64 nt, hsa; identical to SEQ ID NO: 104824

SEQ ID NO: 146730 - RNA, 64 nt, hsa; identical to SEQ ID NO: 104825

SEQ ID NO: 146731 - RNA, 64 nt, hsa; identical to SEQ ID NO: 104826

SEQ ID NO: 146732 - RNA, 64 nt, hsa; identical to SEQ ID NO: 104827

SEQ ID NO: 146733 - RNA, 64 nt, hsa; identical to SEQ ID NO: 104828

SEQ ID NO: 146734 - RNA, 64 nt, hsa; identical to SEQ ID NO: 104829

SEQ ID NO: 146735 - RNA, 64 nt, hsa; identical to SEQ ID NO: 104830

SEQ ID NO: 146736 - RNA, 64 nt, hsa; identical to SEQ ID NO: 104831

SEQ ID NO: 146737 - RNA, 64 nt, hsa; identical to SEQ ID NO: 104832

SEQ ID NO: 146738 - RNA, 64 nt, hsa; identical to SEQ ID NO: 104833

SEQ ID NO: 146739 - RNA, 64 nt, hsa; identical to SEQ ID NO: 104834

SEQ ID NO: 146740 - RNA, 64 nt, hsa; identical to SEQ ID NO: 104835

SEQ ID NO: 146741 - RNA, 64 nt, hsa; identical to SEQ ID NO: 104836

SEQ ID NO: 146742 - RNA, 64 nt, hsa; identical to SEQ ID NO: 104837

SEQ ID NO: 146743 - RNA, 64 nt, hsa; identical to SEQ ID NO: 104838

SEQ ID NO: 146744 - RNA, 64 nt, hsa; identical to SEQ ID NO: 104839

SEQ ID NO: 146745 - RNA, 64 nt, hsa; identical to SEQ ID NO: 104840

SEQ ID NO: 146746 - RNA, 64 nt, hsa; identical to SEQ ID NO: 104841

SEQ ID NO: 146747 - RNA, 64 nt, hsa; identical to SEQ ID NO: 104842

SEQ ID NO: 146748 - RNA, 64 nt, hsa; identical to SEQ ID NO: 104843

SEQ ID NO: 146749 - RNA, 64 nt, hsa; identical to SEQ ID NO: 104844

SEQ ID NO: 146750 - RNA, 64 nt, hsa; identical to SEQ ID NO: 104845

SEQ ID NO: 146751 - RNA, 64 nt, hsa; identical to SEQ ID NO: 104846

SEQ ID NO: 146752 - RNA, 64 nt, hsa; identical to SEQ ID NO: 104847

SEQ ID NO: 146753 - RNA, 64 nt, hsa; identical to SEQ ID NO: 104848

SEQ ID NO: 146754 - RNA, 64 nt, hsa; identical to SEQ ID NO: 104849

SEQ ID NO: 146755 - RNA, 64 nt, hsa; identical to SEQ ID NO: 104850

SEQ ID NO: 146756 - RNA, 64 nt, hsa; identical to SEQ ID NO: 104851

SEQ ID NO: 146757 - RNA, 64 nt, hsa; identical to SEQ ID NO: 104852

SEQ ID NO: 146758 - RNA, 64 nt, hsa; identical to SEQ ID NO: 104853

SEQ ID NO: 146759 - RNA, 64 nt, hsa; identical to SEQ ID NO: 104854

SEQ ID NO: 146760 - RNA, 64 nt, hsa; identical to SEQ ID NO: 104855

SEQ ID NO: 146761 - RNA, 64 nt, hsa; identical to SEQ ID NO: 104856

SEQ ID NO: 146762 - RNA, 64 nt, hsa; identical to SEQ ID NO: 104857

SEQ ID NO: 146763 - RNA, 64 nt, hsa; identical to SEQ ID NO: 104858

SEQ ID NO: 146764 - RNA, 64 nt, hsa; identical to SEQ ID NO: 104859

SEQ ID NO: 146765 - RNA, 64 nt, hsa; identical to SEQ ID NO: 104860

SEQ ID NO: 146766 - RNA, 64 nt, hsa; identical to SEQ ID NO: 104861

SEQ ID NO: 146767 - RNA, 64 nt, hsa; identical to SEQ ID NO: 104862

SEQ ID NO: 146768 - RNA, 64 nt, hsa; identical to SEQ ID NO: 104863

SEQ ID NO: 146769 - RNA, 64 nt, hsa; identical to SEQ ID NO: 104864

SEQ ID NO: 146770 - RNA, 64 nt, hsa; identical to SEQ ID NO: 104865

SEQ ID NO: 146771 - RNA, 64 nt, hsa; identical to SEQ ID NO: 104866

SEQ ID NO: 146772 - RNA, 64 nt, hsa; identical to SEQ ID NO: 104867

SEQ ID NO: 146773 - RNA, 64 nt, hsa; identical to SEQ ID NO: 104868

SEQ ID NO: 146774 - RNA, 64 nt, hsa; identical to SEQ ID NO: 104869

SEQ ID NO: 146775 - RNA, 64 nt, hsa; identical to SEQ ID NO: 104870

SEQ ID NO: 146776 - RNA, 64 nt, hsa; identical to SEQ ID NO: 104871

SEQ ID NO: 146777 - RNA, 64 nt, hsa; identical to SEQ ID NO: 104872

SEQ ID NO: 146778 - RNA, 64 nt, hsa; identical to SEQ ID NO: 104873

SEQ ID NO: 146779 - RNA, 64 nt, hsa; identical to SEQ ID NO: 104874

SEQ ID NO: 146780 - RNA, 64 nt, hsa; identical to SEQ ID NO: 104875

SEQ ID NO: 146781 - RNA, 64 nt, hsa; identical to SEQ ID NO: 104876

SEQ ID NO: 146782 - RNA, 64 nt, hsa; identical to SEQ ID NO: 104877

SEQ ID NO: 146783 - RNA, 61 nt, hsa; identical to SEQ ID NO: 104878

SEQ ID NO: 146784 - RNA, 64 nt, hsa; identical to SEQ ID NO: 104879

SEQ ID NO: 146785 - RNA, 64 nt, hsa
ugccauaggcagugcuguggacaguagaggcugccaaaggcaagggcuggucuucaggauggag

SEQ ID NO: 146786 - RNA, 64 nt, hsa
ccccuccccacugugcuuuugaugccuuuggagucaaaggcagguggggucaccugaugagcua

SEQ ID NO: 146787 - RNA, 64 nt, hsa
gcucuggcccuggcccacauugcacauggaaacccaaaggcauauaucugcguaugugugguac

SEQ ID NO: 146788 - RNA, 64 nt, hsa
ucgucguaugaacugugcauagucuccagagcuucaaaggcaacacaagcucgcaacucuaaga

SEQ ID NO: 146789 - RNA, 64 nt, hsa
uuauuuggcucacaguucuggaaccugggaaauccaaaggcaugaugcuagcaucuggugaggg

SEQ ID NO: 146790 - RNA, 64 nt, hsa
uuucuuuuugaugucuuuuauuuuacaacugggccaaaggcacauuauguauauaauuaguuua

SEQ ID NO: 146791 - RNA, 64 nt, hsa
aaaucuggauuugccuuguguccuucugaguuuucaaaggcaaguauucaacagucccugugug

SEQ ID NO: 146792 - RNA, 64 nt, hsa
uaugaaaguaacaguuauugauacugcuggacuucaaaggcaaaguucauuucuuccauuaacu

SEQ ID NO: 146793 - RNA, 64 nt, hsa
guguguguaagaugucuuccuaucaaaaagauaucaaaggcacauggaauauauuuuaauaaaa

SEQ ID NO: 146794 - RNA, 64 nt, hsa
uuuaucuggugggaaauugcuugacccagguagucaaaggcaguugacuagaaucgacaaauug

SEQ ID NO: 146795 - RNA, 64 nt, hsa
ccuuuuugcuaaaacacuuauuacccuucugcagcaaaggcauuaaaagcgcuaagcauauauu

SEQ ID NO: 146796 - RNA, 64 nt, hsa
auucaggaaacauggcacugcuuuuuucucuaagcaaaggcaaauauccucauaauucuaagcu

SEQ ID NO: 146797 - RNA, 64 nt, hsa
gcuggugauagucaucucauccuacucaauuuuucaaaggcagaaaccaacccuggagcaauug

SEQ ID NO: 146798 - RNA, 64 nt, hsa
guucagauucuuugccccaguucuaaucuagugacaaaggcauagaauucuccucccacaggaa

SEQ ID NO: 146799 - RNA, 64 nt, hsa
gacgggucaaaggcaaaggccuuugugaugugagcaaaggcaaccaaaacuuagccucacucca

SEQ ID NO: 146800 - RNA, 64 nt, hsa
agaagggccucacagugauggguucaggacgggucaaaggcaaaggccuuugugaugugagcaa

SEQ ID NO: 146801 - RNA, 64 nt, hsa
uuaccaugccagauggacaccagcuucuuugugacaaaggcaugaaugauuugacaguguccaa

SEQ ID NO: 146802 - RNA, 64 nt, hsa
ucaacacuaacguugaguaccgguagcuugugaucaaaggcauauacuuccuuaugagauuucu

SEQ ID NO: 146803 - RNA, 64 nt, hsa
uuucucuuuagguacaauagaagaaaagaucuaucaaaggcagaucaguaagcaaggucuuugu

SEQ ID NO: 146804 - RNA, 64 nt, hsa
uuauacaagacuugauggacaaacaccaaucucucaaaggcagcagauuguugauggcuuuaac

SEQ ID NO: 146805 - RNA, 64 nt, hsa
ccaaagccugucccaggacucacccuccacaaagcaaaggcagucccgggagaaaagacggaug

SEQ ID NO: 146806 - RNA, 64 nt, hsa
aggaugccuuagcaugugacuccugaagggaaggcaaaggcagaggaauuuggcugcuucuacg

SEQ ID NO: 146807 - RNA, 64 nt, hsa
auguggcauauuuaccaaugucauguauucugaacaaaggcaaaaaauacaaauuccuaccauu

SEQ ID NO: 146808 - RNA, 64 nt, hsa
uuguauagaguaauaacaacaguuguacuuccaccaaaggcauguggcauauuuaccaauguca

SEQ ID NO: 146809 - RNA, 64 nt, hsa
uccuuccuuggcucaaacaauauuuucccuauaacaaaggcaauaggacacaaaauucacaucc

SEQ ID NO: 146810 - RNA, 64 nt, hsa
ucuucaccuugcuuuaaguagguugaaguuuuugcaaaggcauuuaaaaauucaauuucuuguc

SEQ ID NO: 146811 - RNA, 64 nt, hsa
uuguuuuuguguguagaaacguacaauaacaacucaaaggcacaggagauuucuaaacauugug

SEQ ID NO: 146812 - RNA, 64 nt, hsa
cuggacaauggaggcgaaagaguggaauuucauucaaaggcauaauagcaaugacagucuuaag

SEQ ID NO: 146813 - RNA, 64 nt, hsa
gggagcaugcuucccugcagcugaccgggucacacaaaggcaugcuggaguacccagccuauca

SEQ ID NO: 146814 - RNA, 64 nt, hsa
gcuggaguacccagccuaucaggugccccucuuccaaaggcagcgugccgagccagcaagagga

SEQ ID NO: 146815 - RNA, 64 nt, hsa
cacgcuaccaaaucucaaaauauccuaagacuaacaaaggcagcugugucugagcccaacccuu

SEQ ID NO: 146816 - RNA, 64 nt, hsa
acggccggagccaggcccaagacacagcagaggucaaaggcaguggagagccuuggccaguuca

SEQ ID NO: 146817 - RNA, 64 nt, hsa
acuggagcccucugcucacuggcacuuccugacucaaaggcacuaacagugcucaugugccuuc

SEQ ID NO: 146818 - RNA, 64 nt, hsa
cuuuuuggcuuucagugcuguuuagaaacaguggcaaaggcaggguggugcugccugcaagcug

SEQ ID NO: 146819 - RNA, 64 nt, hsa
auuucuauauuuugucuuuuuuuaguucagacagcaaaggcauguacuacuauaaaauacaaag

SEQ ID NO: 146820 - RNA, 64 nt, hsa
guuucaaaucaaauuaucuaagaaaacaagaaaacaaaggcagcagacuauugguacacauuau

SEQ ID NO: 146821 - RNA, 64 nt, hsa
ugugaugggaucacaugagcaaauuuucagcucucaaaggcaaaggacacuccuuucuaauugc

SEQ ID NO: 146822 - RNA, 64 nt, hsa
cacgucuugucccccgcugcauauuauuuaacagcaaaggcaucauaggggcuggcacaggagc

SEQ ID NO: 146823 - RNA, 64 nt, hsa
gucagagaugcugugcuucuuggaagcaaggacucaaaggcaaggugcacgcagaggacguuug

SEQ ID NO: 146824 - RNA, 64 nt, hsa
agaaaaacccagacgccaggaaaagaagaaacaacaaaggcaggagaacagccacuuucagacu

SEQ ID NO: 146825 - RNA, 64 nt, hsa
acaccaacaugggagggaguuuaugaagcaaaggcaaaggcaacacgucggcuagcuucagggu

SEQ ID NO: 146826 - RNA, 64 nt, hsa
cagaaaacaccaacaugggagggaguuuaugaagcaaaggcaaaggcaacacgucggcuagcuu

SEQ ID NO: 146827 - RNA, 64 nt, hsa
cccuuuuguccauuaacaccccuucuugaucuuucaaaggcagcuaauugcuagcaaauccccc

SEQ ID NO: 146828 - RNA, 64 nt, hsa
cccaggggccaagcaguucuccaucuagucacaccaaaggcaaaaagccuggcuaccucccccc

SEQ ID NO: 146829 - RNA, 64 nt, hsa
cugaggugcauuguccugcuuucuugggacuuaccaaaggcacggaccccuccaccgacuccuu

SEQ ID NO: 146830 - RNA, 64 nt, hsa
uuuuuaguuuucaguuuaaguaacucucagcauuacaaaagaguaaguaucucacaaauaggaa

SEQ ID NO: 146831 - RNA, 64 nt, hsa
uacacagauguaauuaaaauuguaauccuaacaaacaaaagaaauguaguucagcuuuucaaug

SEQ ID NO: 146832 - RNA, 64 nt, hsa
cauguaauauucugagcacgggcaaagaaaacacacaaaagauuauguauuggcauuuauuuau

SEQ ID NO: 146833 - RNA, 64 nt, hsa
cccauuauuccucaccuacccucaaaguagguauacaaaagacuaguuuguuauuaauccacaa

SEQ ID NO: 146834 - RNA, 64 nt, hsa
ucuacccuucccuucaaggaguaugucauauaucacaaaagaaauugccuuacacugguucaug

SEQ ID NO: 146835 - RNA, 64 nt, hsa
gaucugaucuuagcaauuuuggagcaguuccccaacaaaagaagcuacaggaggaacuuucuga

SEQ ID NO: 146836 - RNA, 64 nt, hsa
ugacuauuuucguucauuacuugauuaagauuuuacaaaagaggagcacuuccaaaauucuuau

SEQ ID NO: 146837 - RNA, 64 nt, hsa
aagaggagcacuuccaaaauucuuauuuuuccuaacaaaagaugaaagcagggaauuucuaucu

SEQ ID NO: 146838 - RNA, 64 nt, hsa
aaaauaaaacugauguaaugaauauauaauuacaacaaaagaggucuaacacuauaguagaaaa

SEQ ID NO: 146839 - RNA, 64 nt, hsa
ccaacugaaguggcauguuauguuuuuggcaugaacaaaagaaacaagagagaaaaaaaucaaa

SEQ ID NO: 146840 - RNA, 64 nt, hsa
uuauuggcaauaccuagugauacggauuuagcuaacaaaagauaugaagaacuauuauauugag

SEQ ID NO: 146841 - RNA, 64 nt, hsa
aaaacaaccaaagaaaauugguacuuacccuucuacaaaagaagugugacuagauaucaaucag

SEQ ID NO: 146842 - RNA, 64 nt, hsa
auuuuaugguacuaaugaaauuuacagugauagaacaaaagaggauuaguagaaaauacauuau

SEQ ID NO: 146843 - RNA, 64 nt, hsa
acauucuauagguuaauuuucaaagcagaguauuacaaaagagaaguuagaauuacagcuacug

SEQ ID NO: 146844 - RNA, 64 nt, hsa
cagaauucauuggaagaaaucaccaaagauuauuacaaaagaaaaauauguugcuaagauugug

SEQ ID NO: 146845 - RNA, 64 nt, hsa
agacaagacaagcacuuauuuuuauuuucagaagacaaaagaaccaagaugccaacuggcugcg

SEQ ID NO: 146846 - RNA, 64 nt, hsa
ugaguaauggugaaaauuguugucuuuggaaagcacaaaagaaaccuggaaaggcaguucggcu

SEQ ID NO: 146847 - RNA, 64 nt, hsa
aaaagcacuuaccagccgaacguggaacaguaucacaaaagauuccaucucccaacgauuucag

SEQ ID NO: 146848 - RNA, 64 nt, hsa
uuagauauguccagagauggaaacucacuccccuacaaaagauggagcuuaauggagaaauugc

SEQ ID NO: 146849 - RNA, 64 nt, hsa
uuuaaaaaaguccaaaagcagcuaugggcaguugacaaaagaaaauguaaugacuacguaacuu

SEQ ID NO: 146850 - RNA, 64 nt, hsa
cauauugauagaggaauaggucaauagagaagauacaaaagagugguuaggugcauagauuuuu

SEQ ID NO: 146851 - RNA, 64 nt, hsa
cuguguuuugguucaaagacaagggaaauggcaaacaaaagacuguaggagagccaaaccucau

SEQ ID NO: 146852 - RNA, 64 nt, hsa
aaaggaaggccaaaguauccaucauuagucagccacaaaagacaaucaaaguggcagaacugcc

SEQ ID NO: 146853 - RNA, 64 nt, hsa
aaauaaucauugaugaaguaugucaguuacaagcacaaaagaauauaacugcuuuuauaaaucu

SEQ ID NO: 146854 - RNA, 64 nt, hsa
aucagcuuuuuaauguagguuaccacuuauaagcacaaaagaaacauguauaagaaaccagauu

SEQ ID NO: 146855 - RNA, 64 nt, hsa
gcaaacuggacuuuaagaacuggaaagagguuuuacaaaagaaaaacuuucagauucaucucuc

SEQ ID NO: 146856 - RNA, 64 nt, hsa
aaaagaaugaaagggaaagugaaaaauuaaggggacaaaagaugggaugugaaaagaagaauuc

SEQ ID NO: 146857 - RNA, 64 nt, hsa
uccauuuuauuuuguacgaguaaggguuugaucuacaaaagagcucacauggacgcacugagaa

SEQ ID NO: 146858 - RNA, 64 nt, hsa
uaucuucaaaaaaaucagcagcaauugaaaugcuacaaaagacuuuguuuaaagauuuuauuua

SEQ ID NO: 146859 - RNA, 64 nt, hsa
ggaggagaaggagaagaagaagaagaagaagaccacaaaagacaugacuauccaacuuuuuaug

SEQ ID NO: 146860 - RNA, 64 nt, hsa
ggccaacauggcaaaaccccgucucuacaaaaauacaaaagaaauuagccagacaugauggcgg

SEQ ID NO: 146861 - RNA, 64 nt, hsa
auggguguaauuuuccuaauacagguauguaacaacaaaagaaguugccugcaugccgguccaa

SEQ ID NO: 146862 - RNA, 64 nt, hsa
uucuuuaaacuguuucaacgccaauauguauucuacaaaagagaaugguuuuaggcuccagugu

SEQ ID NO: 146863 - RNA, 64 nt, hsa
aagagaaacaaguauuuugcuauauauaaagacaacaaaagaaaucuccuaacaaaagaacuaa

SEQ ID NO: 146864 - RNA, 64 nt, hsa
ugcuauauauaaagacaacaaaagaaaucuccuaacaaaagaacuaagaggcccagcccucaga

SEQ ID NO: 146865 - RNA, 64 nt, hsa
uugcugagaauuaagaaaugauacaguuaaugcaacaaaagauggaaaauaauauuucagucaa

SEQ ID NO: 146866 - RNA, 64 nt, hsa
ccagucuucagauucucugguaaguuaauaacccacaaaagauucaggaagaggaucuauuuua

SEQ ID NO: 146867 - RNA, 64 nt, hsa
cugccagugagaaauuuuccuguuugauauucuuacaaaagauguuuauguccaccauuaucuc

SEQ ID NO: 146868 - RNA, 64 nt, hsa
cacgauguuagacauagccauaucuccuuucccuacaaaagaaaagcauacuguuaaaaugugc

SEQ ID NO: 146869 - RNA, 64 nt, hsa
uaagcaauguucuuuauguagccaaugcuacgaaacaaaagaggugaaagagacccuuuuuuau

SEQ ID NO: 146870 - RNA, 64 nt, hsa
aauaaauucauaaaaaagacucauaucuuugcaaacaaaagaagggcagauacugggcuucuac

SEQ ID NO: 146871 - RNA, 64 nt, hsa
ucauuuaguuacugggcauaacuuacugcuuuuuacaaaagaaacaaacauugucuguacaggu

SEQ ID NO: 146872 - RNA, 64 nt, hsa
uuuuuuucuccccucccaaauuuaguuccucaucacaaaagaacaaagauaaaccagccucaau

SEQ ID NO: 146873 - RNA, 64 nt, hsa
ggguggggauuaucuuggggagaggcugaaaagcacaaaagauagucuucccuguacguauugg

SEQ ID NO: 146874 - RNA, 64 nt, hsa
aauugcgugcaaugaaccugaaauuguguaaaggacaaaagaccaguuuauaggguuggguuuu

SEQ ID NO: 146875 - RNA, 64 nt, hsa
aaaaccaacuccaccaaaaagccagguaacauuaacaaaagaauucccuguaucaucuggaucu

SEQ ID NO: 146876 - RNA, 64 nt, hsa
uuuuuaaaggucuuguugcaguaggagaaagagcacaaaagaggucugggaacuucucugcugc

SEQ ID NO: 146877 - RNA, 64 nt, hsa
uuuugaauacauuuguauuuauguggcuguaaugacaaaagauacaaaagcuuuuuaaaauuua

SEQ ID NO: 146878 - RNA, 64 nt, hsa
acucuguaacacuaaucaauacgugaucucuguuacaaaagaaaaaagcaaguacaaguuccaa

SEQ ID NO: 146879 - RNA, 64 nt, hsa
uauaacuacauagagauaaauuaagaaagaugccuaaauagaagcaaguuuaaagagcuauauu

SEQ ID NO: 146880 - RNA, 64 nt, hsa
aaccugagauuacagauacuuauaaaacccucuauaaauagauuacccaagguuuuucagugag

SEQ ID NO: 146881 - RNA, 64 nt, hsa
ugaguaaugcacucuugcaaguguauacaaaaacuaaauagacuucugcccuccaacaucuuuu

SEQ ID NO: 146882 - RNA, 64 nt, hsa
uguuuuugagcuggcuguauauauuuuaaaauuauaaauagauaauauauuauuuuuugcacau

SEQ ID NO: 146883 - RNA, 64 nt, hsa
uaucagaaaaaggcuuucuuucauaagacuauuuuaaauagaaauuauuucaacaauuaaagua

SEQ ID NO: 146884 - RNA, 64 nt, hsa
uggacaaagcucuguauggaagacugaacaacuguaaauagaugauauccaaacuuaauuuggc

SEQ ID NO: 146885 - RNA, 64 nt, hsa
ggaaaguauauauguuagaguuuugaaugagggauaaauagaaagcagaaugaauuaauggaaa

SEQ ID NO: 146886 - RNA, 64 nt, hsa
ugaaguagacccuagaaaauugucucguuuauuuuaaauagaaucuaugcuuccaccaauaaac

SEQ ID NO: 146887 - RNA, 64 nt, hsa
uuuaaauuauggaacugcuaaauagauauuucuauaaauagauaauuuuuauuuauguagcuuu

SEQ ID NO: 146888 - RNA, 64 nt, hsa
aauuugauuugaauauuuuaaauuauggaacugcuaaauagauauuucuauaaauagauaauuu

SEQ ID NO: 146889 - RNA, 64 nt, hsa
ggccucucauaguuuucucucucuuuaaagagaauaaauagagggccaggugugguggcucacg

SEQ ID NO: 146890 - RNA, 64 nt, hsa
aaaaaaaaaaaaaaaaaaaaagagagagagagaauaaauagaaaagaauguggcugggaauugu

SEQ ID NO: 146891 - RNA, 64 nt, hsa
aaccaggguuggcuuuauuuaaaagcuagugaccuaaauagaaagcgaacuucaagagaaguug

SEQ ID NO: 146892 - RNA, 64 nt, hsa
aauuaaauuucuaauugagcagauuagauugaauuaaauagaaacuuauugaauauacauucuu

SEQ ID NO: 146893 - RNA, 64 nt, hsa
auauaaaaugugugagacaaaaacuuauuaagguuaaauagaauuguuucuucugaauaaucua

SEQ ID NO: 146894 - RNA, 64 nt, hsa
ggaaaagagucuuagagauuuuguaauaucauucuaaauagauuaagaaaagauauaauuucuu

SEQ ID NO: 146895 - RNA, 64 nt, hsa
uagcagauagucuuugcucuaaaugauaucugaguaaauagacuugaggaauccucuaccacag

SEQ ID NO: 146896 - RNA, 64 nt, hsa
uuuuuuuagauguuugauacauuuuaaguauuuuuaaauagaugaaaauucuaaaugauuuucc

SEQ ID NO: 146897 - RNA, 64 nt, hsa
cugaaucaaaucaugauucuagaacuugagaucuuaaauagaauuucgguuuguaucuuccaua

SEQ ID NO: 146898 - RNA, 64 nt, hsa
auaguauuuuggcuuuugaaguuauuuguguugcuaaauagaugcagagguuuuacagcaguuu

SEQ ID NO: 146899 - RNA, 64 nt, hsa
uucuaaguuuauggugaacuuuuaacucaauguguaaauagaucuggagaauauucagcauaau

SEQ ID NO: 146900 - RNA, 64 nt, hsa
ugaguacuuuaguguuuguauauguuuuuucuuuuaaauagaacuuguuuuuauaauugauuua

SEQ ID NO: 146901 - RNA, 64 nt, hsa
gacacuuguaagucaaucaguguuaaaguauuuguaaauagaagcaagcuauuauuaacaacuu

SEQ ID NO: 146902 - RNA, 64 nt, hsa
cucuaagaaaaggcuauaugggaccuaauaacuuuaaauagacaugcuaauaccgugugcguca

SEQ ID NO: 146903 - RNA, 64 nt, hsa
aauaauauuauaaaauacaggauuuaaaccuuucuaaauagauccugaaacugucucucacauu

SEQ ID NO: 146904 - RNA, 64 nt, hsa
cccagcuacuugggagguggaggugggaggauuauaaauagagacuuuccuuaagacuuuaaaa

SEQ ID NO: 146905 - RNA, 64 nt, hsa
uuagguucuauaugcuauucuccuuacguaacguuaaauagauccuuuaguuugauagguucau

SEQ ID NO: 146906 - RNA, 64 nt, hsa
gguaaaacuuaaaaguuuacuauuucuuauuugguaaauagauuuuaagccaauucuaguaaga

SEQ ID NO: 146907 - RNA, 64 nt, hsa
caauuuguaauauuuugcaacccuaggauuuuuuuaaauagaugcugcuugcuauguuuucaaa

SEQ ID NO: 146908 - RNA, 64 nt, hsa
ugacuguauuauuugauuucggauugaaugaauguaaauagaaauuaaaugcaaauuugaauga

SEQ ID NO: 146909 - RNA, 64 nt, hsa
cccgucuccucuucccuucccuggcccccggguguaaauagauuguuauaauuuuuuucuuaaa

SEQ ID NO: 146910 - RNA, 64 nt, hsa
cuccuccagacccccuccccuccugugucccuuguaaauagaaccagcccagcccgucuccucu

SEQ ID NO: 146911 - RNA, 64 nt, hsa
aaaaauauaaauaugcauauauauauauaaauuauaaauagauuccccacgcagugugguggca

SEQ ID NO: 146912 - RNA, 64 nt, hsa
gaugaguggaugaguggaucgauggauguauugauaaauagauagaaccagucaucugaagcaa

SEQ ID NO: 146913 - RNA, 64 nt, hsa
guugcaucaacaaaguuaauuguauuuauguauguaaauagauuuuaagcuucauuauaaaaua

SEQ ID NO: 146914 - RNA, 64 nt, hsa
agcaaacuuuccugggcaaaucacaaucagugaguaaauagacagccuuucugcugccuugggu

SEQ ID NO: 146915 - RNA, 64 nt, hsa
gcugagggggaagauuuagaagccuugcacucacuaaauagauuaaacagagcaggcuuguuug

SEQ ID NO: 146916 - RNA, 64 nt, hsa
agguguuuuacacucacauucccuuuuugccccuuaaauagaaagugcagguaaagguuuauac

SEQ ID NO: 146917 - RNA, 58 nt, hsa
uucgagaaauuaaaucuuaaaaucuguguaaauagaaaacuugaaccauuaguaauaa

SEQ ID NO: 146918 - RNA, 64 nt, hsa
uuaauauaaaguuugaagcuucauccaccaaaguuaaauagagcuauuuaaaaaugcacuuuau

SEQ ID NO: 146919 - RNA, 63 nt, hsa
auuuucaaaacgaaguucuuacuuuuaaagagaauuaccuauauucuccugauacugauuacc

SEQ ID NO: 146920 - RNA, 63 nt, hsa
ugauuugaccaauuuaucaaauaugucauuuuaauuaccuagcuggaaguuagagacaugaaa

SEQ ID NO: 146921 - RNA, 63 nt, hsa
caguuagacaauccaugguuuaaugcacaugaaauuaccuauauuuuauacuguuucaaugua

SEQ ID NO: 146922 - RNA, 63 nt, hsa
ucuaagaccauuucauucugaaacuucuuaucaauuaccuaaaucucaacgaaaaacaauuua

SEQ ID NO: 146923 - RNA, 63 nt, hsa
gugaaguuggucagggacauguggccacuuauuauuaccuaaagaaaacauuuguucccuguu

SEQ ID NO: 146924 - RNA, 63 nt, hsa
uagggucaaagacauucuauuugaacacuugcaauuaccuagaucuaguuggccuuugguuga

SEQ ID NO: 146925 - RNA, 63 nt, hsa
aaaauuacauaguauuaccuagacauagacaguauuaccuagguagaugcacugcucaccugc

SEQ ID NO: 146926 - RNA, 63 nt, hsa
uccacacgcaguaugaagauaaaauuacauaguauuaccuagacauagacaguauuaccuagg

SEQ ID NO: 146927 - RNA, 63 nt, hsa
aaaaucucaaauaacaaguacaaacauugaacaauuaccuauaaagauuuguaaaaguaaaau

SEQ ID NO: 146928 - RNA, 63 nt, hsa
ucgacuuguauuuauuaaauacucaaacucaguauuaccuacucaaugccuuuuaaaagaaag

SEQ ID NO: 146929 - RNA, 64 nt, hsa
agugucaaugcagcccccauuguggucacaggaaguagaggaggccacguucuuacuaguuucc

SEQ ID NO: 146930 - RNA, 64 nt, hsa
gcgacagugagacucugucucaguccaugaagauguagaggagaaacuggaacucucgagcguu

SEQ ID NO: 146931 - RNA, 64 nt, hsa
ucuaguuugcacugccuuggagcaagcacacuuuguagaggagggauuugcaguuacuugggca

SEQ ID NO: 146932 - RNA, 64 nt, hsa
ugucauccgcuugcugugcuguggggaaaaaaaaguagaggaaaaagugugugguuaagccagu

SEQ ID NO: 146933 - RNA, 64 nt, hsa
ugcugacaccaaugaggcacuucucuugguccuaguagaggaugcaguguacuguuaaaccaau

SEQ ID NO: 146934 - RNA, 64 nt, hsa
agcgauagauuuauauaaauaucuaaaugucucaguagaggaguagaauucaucugguuaucac

SEQ ID NO: 146935 - RNA, 64 nt, hsa
gaaagcuuuguaaaaccagacagugaagcaaaauguugccaacugcuuaaccuaggcuauguga

SEQ ID NO: 146936 - RNA, 64 nt, hsa
uuuguguggggaggugggggcaggaugggguuugguugccaaaagaguuugggaaaugcuggcu

SEQ ID NO: 146937 - RNA, 64 nt, hsa
uucuauagcgagacauagaauaguauucugaucaguugccaaagaaucuaggaaauuaguugua

SEQ ID NO: 146938 - RNA, 64 nt, hsa
auuucaucacuaguaugugugcgugagcuggucaguugccaaaggaggaaauaagguuagaagc

SEQ ID NO: 146939 - RNA, 64 nt, hsa
uuugcuuuuguuuagcuucacagcauagcugaaaguugccaaacuggacauugugcaauaaagu

SEQ ID NO: 146940 - RNA, 64 nt, hsa
aguaguauguggcauauacaccuuccuaguggcaguugccaauguuaaugauuauucuuuuuau

SEQ ID NO: 146941 - RNA, 64 nt, hsa
uaugugaguuuuccuuuuggugcauggaacugugguugccaagguauuuaaaagggcuuuccug

SEQ ID NO: 146942 - RNA, 64 nt, hsa
aggggaaaguuuaaaaucccagcugggcuggacuguugccaacaucaccuuaaagucgucagua

SEQ ID NO: 146943 - RNA, 64 nt, hsa
augccugccucuuuaauuugguaagauaaugcuguaacuagaauuucacaaucagcgccuugug

SEQ ID NO: 146944 - RNA, 64 nt, hsa
ggccacucagagcuaaccaaaauguucaacaccauaacuagagacacucaaauugccaaccagg

SEQ ID NO: 146945 - RNA, 64 nt, hsa
agggcccauuuccuccccucucuaccugcagugaguuccagaccugcccguccccucaccagcg

SEQ ID NO: 146946 - RNA, 64 nt, hsa
ccccucaccagcgccuccccacccuguugguacuguuccagaaaaacuguuacucccccucacc

SEQ ID NO: 146947 - RNA, 64 nt, hsa
gcuuaucaaaaguuuguggaagauacauuguuggguuccagaggcuggagucaugcugcccaca

SEQ ID NO: 146948 - RNA, 64 nt, hsa
gcugggaggagagucuaacuguaaccuuuagguuguuccagaaaagauucaggccguuuggcac

SEQ ID NO: 146949 - RNA, 64 nt, hsa
ccuaccaugggcacccaugugcuggcacagaacaguuccagaucuagacuggagagguccacag

SEQ ID NO: 146950 - RNA, 64 nt, hsa
gcauuauauauucuaguuagaucagcucugguagguuccagagaacagucaauguuggaaggau

SEQ ID NO: 146951 - RNA, 64 nt, hsa
ugguucaacuguugacagaggacacaaauacguuguuccagagcucagccuucucacucuaaaa

SEQ ID NO: 146952 - RNA, 64 nt, hsa
ccacacuguaggcagcagugacuaagcacuggcaguuccagaacauuuacccagguauauguua

SEQ ID NO: 146953 - RNA, 64 nt, hsa
auuauaaguuacuguucuaagaaaaguaaauacaguuccagauggguuauugcagauuaacaga

SEQ ID NO: 146954 - RNA, 64 nt, hsa
caagggcuggguuugccucugaugaguacaaucaguuccagaagacuggguaagucucuugcua

SEQ ID NO: 146955 - RNA, 64 nt, hsa
uauuuuagacugacugaacgaaacccagaggcugguuccagagcucugucccugagaacacauc

SEQ ID NO: 146956 - RNA, 64 nt, hsa
gaggccaaggcagggggauuacuucagcccaggaguuccagacugccuggcuaacauggcaaua

SEQ ID NO: 146957 - RNA, 64 nt, hsa
aucagaggagccggcaggcgaagguagaggauguguuccagaaacauuagaaggcaggauuaau

SEQ ID NO: 146958 - RNA, 64 nt, hsa
ugugugugugugugugugucagagguuccagaaaguuccagauuuggaaucaaacaguccugaa

SEQ ID NO: 146959 - RNA, 64 nt, hsa
ugugugugugugugugugugugugugugucagagguuccagaaaguuccagauuuggaaucaaa

SEQ ID NO: 146960 - RNA, 64 nt, hsa
ccgccccuggggaaauagccucacgggguuggcuguuccagacucagguuccagaacagcccuc

SEQ ID NO: 146961 - RNA, 64 nt, hsa
aauagccucacgggguuggcuguuccagacucagguuccagaacagcccucggccuccgaggcu

SEQ ID NO: 146962 - RNA, 64 nt, hsa
caagaagugggauucaggaaugggccaagccaggguuccagacaggguggggcuuagaaugggg

SEQ ID NO: 146963 - RNA, 64 nt, hsa
agguguggaguggaggggucagcagggggguuggguuccagacagaguggaucuggagucugaa

SEQ ID NO: 146964 - RNA, 64 nt, hsa
uuguguuugugcugcccacaggacagugggaguuacaguucauaucaggaugacccuacauacc

SEQ ID NO: 146965 - RNA, 64 nt, hsa
caaucuuaauauguagguucauuuaaauuuuaagacaguucagugcauauauaguagaagccuu

SEQ ID NO: 146966 - RNA, 64 nt, hsa
gaaaugaacuucaguaagcuuucaauuuugauacacaguucauuauucauaacuugaggcagua

SEQ ID NO: 146967 - RNA, 64 nt, hsa
guuuccaggugggcaugguuuauuucccaguuuaacaguucagaauaggggcauuuauuuuauc

SEQ ID NO: 146968 - RNA, 64 nt, hsa
uuccaaguucucacugcuggaaagagcuagaagcacaguucaaaguucuggcuucuggacucug

SEQ ID NO: 146969 - RNA, 64 nt, hsa
gaaguggcccauaacuugaaggaaaaguuuaaagacaguucaauuuaaucaucagaaugcauuc

SEQ ID NO: 146970 - RNA, 64 nt, hsa
aucauguguuuaaacaaaucccauauguugggcaacaguucaaauaagcacggagaaguguugc

SEQ ID NO: 146971 - RNA, 64 nt, hsa
aagacaauguugcaauguugaaugacaaaaauaaacaguucaagugaagcacaaggauuaaguu

SEQ ID NO: 146972 - RNA, 64 nt, hsa
ugcuggugcaccucgcccaacucauucuuacugcacaguucacuuuauuuaacaauuuucaugu

SEQ ID NO: 146973 - RNA, 64 nt, hsa
ugucccgucaccaggcucuugcuucacugcagauacaguucacucugaaagcugguugaaggag

SEQ ID NO: 146974 - RNA, 64 nt, hsa
uuuaacauuuggguggagaggggccuuaagaaggacaguucauuguaggaaagcaauucuguac

SEQ ID NO: 146975 - RNA, 64 nt, hsa
auagucaauucugugccuaggauuuugccagggaacaguucacugacuaggaaaagcacuacau

SEQ ID NO: 146976 - RNA, 64 nt, hsa
gcuccccccauccugggcugggcugccuucuucuacaguucaauauggggcagacuagggaaac

SEQ ID NO: 146977 - RNA, 64 nt, hsa
uccucccagaauauuuagaaauguagaagggauaacaguucacagccagguaaaauuuaacugg

SEQ ID NO: 146978 - RNA, 64 nt, hsa
ccuggucucgggaggcuucugucauugcucacacacaguucagauuuccaccucuuuauagaca

SEQ ID NO: 146979 - RNA, 64 nt, hsa
guuuauauaaauuggcaacaacuuauaccgucugacaguucaaaaucucuuucagcugcgcucu

SEQ ID NO: 146980 - RNA, 64 nt, hsa
accucugaguguugaaggggcaacccaaggcaucacaguucacagguaaccauguuguguucuu

SEQ ID NO: 146981 - RNA, 64 nt, hsa
uuuaaauuauuuauauuacugaauuggcaaaauuacaguucacacugcagagcuagguuguccu

SEQ ID NO: 146982 - RNA, 64 nt, hsa; identical to SEQ ID NO: 113583

SEQ ID NO: 146983 - RNA, 64 nt, hsa; identical to SEQ ID NO: 113584

SEQ ID NO: 146984 - RNA, 64 nt, hsa; identical to SEQ ID NO: 113585

SEQ ID NO: 146985 - RNA, 64 nt, hsa; identical to SEQ ID NO: 113586

SEQ ID NO: 146986 - RNA, 64 nt, hsa; identical to SEQ ID NO: 113587

SEQ ID NO: 146987 - RNA, 64 nt, hsa; identical to SEQ ID NO: 113588

SEQ ID NO: 146988 - RNA, 64 nt, hsa; identical to SEQ ID NO: 113589

SEQ ID NO: 146989 - RNA, 64 nt, hsa; identical to SEQ ID NO: 113590

SEQ ID NO: 146990 - RNA, 64 nt, hsa; identical to SEQ ID NO: 113591

SEQ ID NO: 146991 - RNA, 64 nt, hsa; identical to SEQ ID NO: 113592

SEQ ID NO: 146992 - RNA, 64 nt, hsa; identical to SEQ ID NO: 113593

SEQ ID NO: 146993 - RNA, 64 nt, hsa; identical to SEQ ID NO: 113594

SEQ ID NO: 146994 - RNA, 64 nt, hsa; identical to SEQ ID NO: 113595

SEQ ID NO: 146995 - RNA, 64 nt, hsa; identical to SEQ ID NO: 113596

SEQ ID NO: 146996 - RNA, 64 nt, hsa; identical to SEQ ID NO: 113597

SEQ ID NO: 146997 - RNA, 64 nt, hsa; identical to SEQ ID NO: 113598

SEQ ID NO: 146998 - RNA, 64 nt, hsa; identical to SEQ ID NO: 113599

SEQ ID NO: 146999 - RNA, 64 nt, hsa; identical to SEQ ID NO: 113600

SEQ ID NO: 147000 - RNA, 64 nt, hsa; identical to SEQ ID NO: 113601

SEQ ID NO: 147001 - RNA, 64 nt, hsa; identical to SEQ ID NO: 113602

SEQ ID NO: 147002 - RNA, 64 nt, hsa; identical to SEQ ID NO: 113603

SEQ ID NO: 147003 - RNA, 64 nt, hsa; identical to SEQ ID NO: 113604

SEQ ID NO: 147004 - RNA, 64 nt, hsa; identical to SEQ ID NO: 113605

SEQ ID NO: 147005 - RNA, 64 nt, hsa; identical to SEQ ID NO: 113606

SEQ ID NO: 147006 - RNA, 64 nt, hsa; identical to SEQ ID NO: 113607

SEQ ID NO: 147007 - RNA, 64 nt, hsa; identical to SEQ ID NO: 113608

SEQ ID NO: 147008 - RNA, 64 nt, hsa; identical to SEQ ID NO: 113609

SEQ ID NO: 147009 - RNA, 64 nt, hsa; identical to SEQ ID NO: 113610

SEQ ID NO: 147010 - RNA, 64 nt, hsa; identical to SEQ ID NO: 113611

SEQ ID NO: 147011 - RNA, 64 nt, hsa; identical to SEQ ID NO: 113612

SEQ ID NO: 147012 - RNA, 64 nt, hsa; identical to SEQ ID NO: 113613

SEQ ID NO: 147013 - RNA, 64 nt, hsa; identical to SEQ ID NO: 113614

SEQ ID NO: 147014 - RNA, 64 nt, hsa; identical to SEQ ID NO: 113615

SEQ ID NO: 147015 - RNA, 64 nt, hsa; identical to SEQ ID NO: 113616

SEQ ID NO: 147016 - RNA, 64 nt, hsa; identical to SEQ ID NO: 113617

SEQ ID NO: 147017 - RNA, 64 nt, hsa; identical to SEQ ID NO: 113618

SEQ ID NO: 147018 - RNA, 64 nt, hsa; identical to SEQ ID NO: 113619

SEQ ID NO: 147019 - RNA, 64 nt, hsa; identical to SEQ ID NO: 113620

SEQ ID NO: 147020 - RNA, 64 nt, hsa; identical to SEQ ID NO: 113621

SEQ ID NO: 147021 - RNA, 64 nt, hsa; identical to SEQ ID NO: 113622

SEQ ID NO: 147022 - RNA, 64 nt, hsa; identical to SEQ ID NO: 113623

SEQ ID NO: 147023 - RNA, 64 nt, hsa; identical to SEQ ID NO: 113624

SEQ ID NO: 147024 - RNA, 64 nt, hsa; identical to SEQ ID NO: 113625

SEQ ID NO: 147025 - RNA, 64 nt, hsa; identical to SEQ ID NO: 113626

SEQ ID NO: 147026 - RNA, 64 nt, hsa; identical to SEQ ID NO: 113627

SEQ ID NO: 147027 - RNA, 64 nt, hsa; identical to SEQ ID NO: 113628

SEQ ID NO: 147028 - RNA, 64 nt, hsa; identical to SEQ ID NO: 113629

SEQ ID NO: 147029 - RNA, 64 nt, hsa; identical to SEQ ID NO: 113630

SEQ ID NO: 147030 - RNA, 64 nt, hsa; identical to SEQ ID NO: 113631

SEQ ID NO: 147031 - RNA, 64 nt, hsa; identical to SEQ ID NO: 113632

SEQ ID NO: 147032 - RNA, 64 nt, hsa; identical to SEQ ID NO: 113633

SEQ ID NO: 147033 - RNA, 64 nt, hsa; identical to SEQ ID NO: 113634

SEQ ID NO: 147034 - RNA, 64 nt, hsa; identical to SEQ ID NO: 113635

SEQ ID NO: 147035 - RNA, 64 nt, hsa; identical to SEQ ID NO: 113636

SEQ ID NO: 147036 - RNA, 64 nt, hsa; identical to SEQ ID NO: 113637

SEQ ID NO: 147037 - RNA, 64 nt, hsa; identical to SEQ ID NO: 113638

SEQ ID NO: 147038 - RNA, 64 nt, hsa
aacucaaggcuuguugugaagccuaaaaauauucacaaauaagcuuuuaaacuggugucuuugg

SEQ ID NO: 147039 - RNA, 64 nt, hsa
ugaauuuagauaucuuuauuccauuuauuaugguacaaauaacugauguuuuaaccagaguaau

SEQ ID NO: 147040 - RNA, 64 nt, hsa
uuuagguggggguggcagguguauuucuuuuuuaacaaauaaaaggcauuuaaguaaaacuaaa

SEQ ID NO: 147041 - RNA, 64 nt, hsa
aacuucuuacuccauaccuuguucgauauggaggacaaauaauuggauugucugauaagucugc

SEQ ID NO: 147042 - RNA, 64 nt, hsa
uuacaaauuccuuucagaguuuuacuaagaucacacaaauaacagcuuucuuauucagugaaaa

SEQ ID NO: 147043 - RNA, 64 nt, hsa
uuuuguggcaaaauauucuucuuugauaguguaaacaaauaauaaagcaaucuagguccuuuag

SEQ ID NO: 147044 - RNA, 64 nt, hsa
uacuaagauguucacuguggcauugucuguaaugacaaauaaguggaaaccguguaaauaccug

SEQ ID NO: 147045 - RNA, 64 nt, hsa
aggaucaaauucuacaacuuuuccuaaggcacccacaaauaaaugacaagugagacaaaaagca

SEQ ID NO: 147046 - RNA, 64 nt, hsa
guguuuuguuugaaugugcaauaguuuauaggccacaaauaagcuuucuuguaagcucucuucc

SEQ ID NO: 147047 - RNA, 64 nt, hsa
gaauaguuuacuauuucauucaagcauguuuaaaacaaauaauuuccuuucaccaguuuuucuu

SEQ ID NO: 147048 - RNA, 64 nt, hsa
acuaaugaaggguuuuuuaaaagaacuaaauaaaacaaauaaaacuaggcuacagguauagcug

SEQ ID NO: 147049 - RNA, 64 nt, hsa
uuuuaaaaaauuaaaauuucugaaaaccaaugcgacaaauaaaguuggggagaugggaaucuuu

SEQ ID NO: 147050 - RNA, 64 nt, hsa
uuagaacauagaguggcauggccgugcuggaaugacaaauaacuggcgugcuuuuuuuuugugu

SEQ ID NO: 147051 - RNA, 64 nt, hsa
aaggcuaacuccugaucguuucuguagaaagaugacaaauaaagaaaaaguuauaauuauuaau

SEQ ID NO: 147052 - RNA, 64 nt, hsa
uauauaauuauuucauguuacauaauaacccaaaacaaauaauuacuugaauauguuuguagag

SEQ ID NO: 147053 - RNA, 64 nt, hsa
uguggcugaugguguugaagauaaauaagcuuaaacaaauaacuuuggccgggcacgguggcuc

SEQ ID NO: 147054 - RNA, 64 nt, hsa
guaaaguauuauuuauuugaaucuacaaaaaacaacaaauaauuuuuaaauauaaggauuuucc

SEQ ID NO: 147055 - RNA, 64 nt, hsa
ggguacccaguuaaauuuucauuucagauaaacaacaaauaauuuuuuaguauaaguacauuau

SEQ ID NO: 147056 - RNA, 64 nt, hsa
uaauggccaguuguuuaggaaggccuuuaggaagacaaauaaauaacaaacaaacagccacaaa

SEQ ID NO: 147057 - RNA, 64 nt, hsa
aggagagguuuccuucagauugcugauugcuuauacaaauaaccuacaugccagauuucuauuc

SEQ ID NO: 147058 - RNA, 64 nt, hsa
aauaaauaaauaaaagcauacuauaguuguaaaaacaaauaauuuuaauaguauauucaguggc

SEQ ID NO: 147059 - RNA, 64 nt, hsa
gaagaaaacagacaaaagacauguaacaacagaaacaaauaaaccacuuacuguaaaauuucag

SEQ ID NO: 147060 - RNA, 64 nt, hsa
ugaaggaauauauuuaauuauauucauauauuuaacaaauaaaaauauguugaauuuucguauu

SEQ ID NO: 147061 - RNA, 64 nt, hsa
auuuuauugggauacagaaaaauauaaauucuggacaaauaagucauauaccuguuuucagucc

SEQ ID NO: 147062 - RNA, 64 nt, hsa
uacuuugguacaaauaaaaacuguauaucuauauacaaauaauauauagauauauauguccacc

SEQ ID NO: 147063 - RNA, 64 nt, hsa
agaauuaggcaguuggugauaguuuuacuuugguacaaauaaaaacuguauaucuauauacaaa

SEQ ID NO: 147064 - RNA, 64 nt, hsa
cacaacgauuauaguaacuauaagauacaauaaaacaaauaaauaugaaaguagauucaugaaa

SEQ ID NO: 147065 - RNA, 64 nt, hsa
ucaauugacauuccuuugaauacgcuaauaagugacaaauaagauuaauaagauuuuucaaaau

SEQ ID NO: 147066 - RNA, 64 nt, hsa
acuauaaaauaaaucuucacugcccuaucaaaauacaaauaaaucaaucuaugcuguucugucc

SEQ ID NO: 147067 - RNA, 64 nt, hsa
cagaucacaggggccuuacaaaguuuaugucugaacaaauaagucaauuaaguacacuuuauug

SEQ ID NO: 147068 - RNA, 64 nt, hsa
uagguacauggauacaucaaguucauuugcagaaacaaauaacugaaauaaaaaacauguuaau

SEQ ID NO: 147069 - RNA, 64 nt, hsa
acagguucuaaauuuaaaacaaauaauaauuggaacaaauaaagguucuuguacccagagugau

SEQ ID NO: 147070 - RNA, 64 nt, hsa
guauuuuagacccaacacagguucuaaauuuaaaacaaauaauaauuggaacaaauaaagguuc

SEQ ID NO: 147071 - RNA, 64 nt, hsa
aaugugacaagagaauugguuuggcugaaucacaacaaauaacuagcaaagcuucagugcuuuu

SEQ ID NO: 147072 - RNA, 64 nt, hsa
ggaaauauaaaucauaugguccuuuguaaaauauacaaauaaucuaacacauaucauauaggac

SEQ ID NO: 147073 - RNA, 64 nt, hsa
ucauaucuaagauagaguuaugcauugcacauacacaaauaaacuuuuauuagauagauaccua

SEQ ID NO: 147074 - RNA, 64 nt, hsa
uguaucaucuuuuuuuuucucauauuacaaauggacaaauaacggacuuucuauuuucauauuu

SEQ ID NO: 147075 - RNA, 64 nt, hsa
aaaauacaacagggggaugugucccaguacacuuacaaauaaaacauaacugaaagaagagcag

SEQ ID NO: 147076 - RNA, 64 nt, hsa
uacaaaaacaaaccuaccaaccaccaaaaacuagacaaauaaagacaaacuaaaacaaaacaga

SEQ ID NO: 147077 - RNA, 64 nt, hsa
uacaugugaauucuacugcuuuaagagaaauaaaacaaauaagccuagggaaauauuagagucu

SEQ ID NO: 147078 - RNA, 64 nt, hsa
auuaaaggugccagaucaaaauaguaauaaaucaacaaauaauuuuugauugacugguggaauu

SEQ ID NO: 147079 - RNA, 64 nt, hsa
gcagaucaaaaauauuagaaaaaauaaaaauaauacaaauaaaaauacaguauaacaguuauuu

SEQ ID NO: 147080 - RNA, 64 nt, hsa
gcuguauugaaaaauauaaauccaugauggcuguacaaauaauuuagccucauucauuuuuuaa

SEQ ID NO: 147081 - RNA, 64 nt, hsa
aaaguguaaaaucauuuuuuaaaaucuugaauccacaaauaaaguucuauucugauuuuaaaaa

SEQ ID NO: 147082 - RNA, 53 nt, hsa
gcuuugauggaguugauuagauuacaaauaacaaucuguaguguuuuuacugc

SEQ ID NO: 147083 - RNA, 64 nt, hsa
gacugucucaaaaaaauuaaaauuaaaauuaaaaacaaauaauccugccuuuuacaggugaaac

SEQ ID NO: 147084 - RNA, 64 nt, hsa
guggggggucugguagaacacugcaacccgcuuaacaaauaauccugccuuuggccgggugcgg

SEQ ID NO: 147085 - RNA, 64 nt, hsa
aaauaacuaagaguauaauuggauuguuuguaacacaaauaaauacuugaguggauggauaccc

SEQ ID NO: 147086 - RNA, 64 nt, hsa
accgggugaguauagucaauaauagcuuaauuguacaaauaacuaagaguauaauuggauuguu

SEQ ID NO: 147087 - RNA, 64 nt, hsa
cuguaacaaaaguguacuauguuaugcacacauuacaaauaauauaaggggaaguuuuauuagc

SEQ ID NO: 147088 - RNA, 64 nt, hsa
cacucgcccagucuucagucuccugacuuagagauacaaucacgucacaggucucuuggccuca

SEQ ID NO: 147089 - RNA, 64 nt, hsa
cccagucaguacaaggaggcccacaaauauuuauuacaaucaguauuuuggucccuuccagcuu

SEQ ID NO: 147090 - RNA, 64 nt, hsa
gugucagaaccaguccugcccugugaauuacugcuacaaucaaggccacugcuacaucucccag

SEQ ID NO: 147091 - RNA, 64 nt, hsa
ggucugccauugcaaugcagagagccaguguuuguacaaucagaccagcagggugggcaacucc

SEQ ID NO: 147092 - RNA, 51 nt, hsa
guccuaacgagaagagauaauuacaaucaggcuaccagaggaagccuuugg

SEQ ID NO: 147093 - RNA, 64 nt, hsa
gaggaagccuuugguccuaacgagaagagauaauuacaaucaggcuaccaaaggaagcacuaac

SEQ ID NO: 147094 - RNA, 64 nt, hsa
aaacaugaauucauaaauucaggaagcacaauauauaccaaacauauauuuaaauaaaauccag

SEQ ID NO: 147095 - RNA, 64 nt, hsa
ccaggccuagacucaagguauuguaaaugacaagauaccaaauacaagauuuuaaaagcaacca

SEQ ID NO: 147096 - RNA, 64 nt, hsa
uaauaacuuugaacuuaaauauacuuaacaacauauaccaaaaauauaugaggcaaauuuuagc

SEQ ID NO: 147097 - RNA, 64 nt, hsa
aaaugaaauggacaaauuccuaggaagacacagaauaccaaaucugacuccacaagaaauagau

SEQ ID NO: 147098 - RNA, 64 nt, hsa
aaaaaaagaaaaaaaaagaagaaaaguauaccagauaccaaaagcuagcuuucuuauguuuucc

SEQ ID NO: 147099 - RNA, 64 nt, hsa
gaugcaguauccuguacuagcuuauaauauucccauaccaaagucauggggaaacaaacauuau

SEQ ID NO: 147100 - RNA, 64 nt, hsa
gaaguuuugauguuagaauaauugcuuuuggaaaauaccaaaugaacguacaguacaacauuuc

SEQ ID NO: 147101 - RNA, 64 nt, hsa
uugguuugcaucuuuuuuccauauuguuaauuuuauaccaaaauguuaaauauuuguauuacuu

SEQ ID NO: 147102 - RNA, 64 nt, hsa
uguuugcuuauuccacauuaauuuacuuuucucuauaccaaaucacccauggaauaguuauuga

SEQ ID NO: 147103 - RNA, 64 nt, hsa
uuuuucacugauucuauaagcccagcauuaccugauaccaaaaccaggcaaagaaaacagaaga

SEQ ID NO: 147104 - RNA, 64 nt, hsa
uucauaauguauaccuagaaaagugaaauugaaaauaccaaaagauguaucauuuuuauuugaa

SEQ ID NO: 147105 - RNA, 64 nt, hsa
uuuuuuuccccuccuauuuuaaucagcaaaauccauaccaaaacaacgacaacaacgcccucuu

SEQ ID NO: 147106 - RNA, 64 nt, hsa
uguuacuauuguguuauucaugucuuuaaaucagauaccaaauauuuuuuaggaaagaaaaaug

SEQ ID NO: 147107 - RNA, 64 nt, hsa
gucugugggggauugguuccaguuaccccuauagauaccaaaaucugcagaugcucaagucccu

SEQ ID NO: 147108 - RNA, 64 nt, hsa
aguucauuuuauguuuuauauagcuuucuuagacauaccaaaccaucauucauaaaucagauaa

SEQ ID NO: 147109 - RNA, 64 nt, hsa
ccuaaauuuuauuauuuguugcucccccaaucugauaccaaauguuuaaaguuguuugaaaucc

SEQ ID NO: 147110 - RNA, 64 nt, hsa
aaauaaaauuucuauauaccaaaaaugugaaguuauaccaaauaaaguuucuaagugauuaaug

SEQ ID NO: 147111 - RNA, 64 nt, hsa
cuacugugcugcauuaagaaaauaaaauuucuauauaccaaaaaugugaaguuauaccaaauaa

SEQ ID NO: 147112 - RNA, 64 nt, hsa
cagcauuguacuggaagugcuaucuaaugcagugauaccaaaaaaaaaggaaauaaaaugcaca

SEQ ID NO: 147113 - RNA, 64 nt, hsa
ucccaaaucauuuugugaggccaggauuacccuaauaccaaagccaggcaaaaacauuacaaga

SEQ ID NO: 147114 - RNA, 64 nt, hsa
uagauuaagaaaaaacagaagacaaauacugcuaauaccaaaagugaaagaggccaucauagcu

SEQ ID NO: 147115 - RNA, 64 nt, hsa
uccaguuaaauuggagcacugaacguucagaugcauaccaaauuaugcauggguccuaaucaca

SEQ ID NO: 147116 - RNA, 64 nt, hsa
cuucagcuugaaagcuuuuuuuuaaaaggaaaagauaccaaaugccugcugcuaccacccuuuu

SEQ ID NO: 147117 - RNA, 64 nt, hsa
uucaaugaucauguguuuuguccuccuaaacaguauaccaaaguuuguuuuuauaguugaggau

SEQ ID NO: 147118 - RNA, 64 nt, hsa
cuuuugaauaauuuccagauggauuucuguagccauaccaaagccaggguguuuucauucaugc

SEQ ID NO: 147119 - RNA, 64 nt, hsa
aaacagaagaaauuaaucuuuuaguuaguugaacauaccaaagcagaggacuggaaucuguuug

SEQ ID NO: 147120 - RNA, 64 nt, hsa
cuugaauaguaggauuuuaaagggcauugauagcauaccaaacaaaaggcaaaauaaagugacc

SEQ ID NO: 147121 - RNA, 64 nt, hsa
ugccaauagcaaaugaaguuaugggugacuugaaauaccaaaaccugaggagugggcaauggug

SEQ ID NO: 147122 - RNA, 64 nt, hsa
aucuccaggaaaaaaaaaaaaaaacccaauuuggauaccaaauuaaucaacuaauuugagcuau

SEQ ID NO: 147123 - RNA, 60 nt, hsa
cauccuauugcaaagguuccaacuguauauauucccaauagcaacguagcuucuaccaug

SEQ ID NO: 147124 - RNA, 60 nt, hsa
auugaaauguagcaauaaugucuuuugaauauucccaagcccaugaguccuugaaaauau

SEQ ID NO: 147125 - RNA, 60 nt, hsa
uuacgcauccaauguggguugucacuuguuauucccaaguacuauuauuccauacuacua

SEQ ID NO: 147126 - RNA, 60 nt, hsa
gcaaggugcagugcuagaauauggugguugauucccaaacagagcaguuaacuuuacucu

SEQ ID NO: 147127 - RNA, 60 nt, hsa
auuuaaauaugcuaacaucacugucauagaauucccaaauuucauuuguagauacugaac

SEQ ID NO: 147128 - RNA, 60 nt, hsa
ucuguauaccccuucaagcaguuguuucccauucccaacaaacuguacuuuauacaauuc

SEQ ID NO: 147129 - RNA, 60 nt, hsa
agugguacauaaauuuaucucgcccugcauauucccaacauacuuaacacagauguuuuu

SEQ ID NO: 147130 - RNA, 60 nt, hsa
guuauggucaaucccaaaagucaccacuccauucccaacuagacauuaccaaagugaccu

SEQ ID NO: 147131 - RNA, 60 nt, hsa
gcuucucauccccagucccaaugcacauccauucccaagaaaugcuuugucuucagccuc

SEQ ID NO: 147132 - RNA, 64 nt, hsa
agaggcgcugggaagauggcuggugaggagcuuaacagaggaaccucaagaagauucugaaaau

SEQ ID NO: 147133 - RNA, 64 nt, hsa
cgcgagaggcaucccuggcgcugucucccacuggacagaggaggcuggccauggggcccagggg

SEQ ID NO: 147134 - RNA, 64 nt, hsa
gaacucacacaugcucccaggauuggggacagggacagaggagguaacagaaggcaaaggccag

SEQ ID NO: 147135 - RNA, 64 nt, hsa
cauuccccggcuccacccuaggccacuuuuucuaacagaggaaacaaaugguccagcagucguu

SEQ ID NO: 147136 - RNA, 64 nt, hsa
gcuaaaauugugccacugcacuccagccugggugacagaggaagacuccgucucacaaaaaaaa

SEQ ID NO: 147137 - RNA, 64 nt, hsa
uugccuuggauuacuaagcaucuccugcgaucccacagaggacugugguggccacaggagcuga

SEQ ID NO: 147138 - RNA, 64 nt, hsa
uagcagaggagccggacacagaggaagcucaggcacagaggacgaggagcaagcuggcgccgac

SEQ ID NO: 147139 - RNA, 64 nt, hsa
cccaugcugccacagguuagcagaggagccggacacagaggaagcucaggugaguacaaagagu

SEQ ID NO: 147140 - RNA, 64 nt, hsa
gccacaaaagaaaagacuuguaauauuuuuauauacagaggaaaucuguaacagguauuuuguu

SEQ ID NO: 147141 - RNA, 64 nt, hsa
uaacagguauuuuguuucuuuuaaagcaagcaacacagaggaauuuauaccucaaacuaucugg

SEQ ID NO: 147142 - RNA, 64 nt, hsa
agagcggcuuccccauugccuucuggggagggacacagaggacagcuuccccaucgccuucugg

SEQ ID NO: 147143 - RNA, 64 nt, hsa
aggauggcuuccccauugccuucuggggagggacacagaggacggcuuccccaucgccuucugg

SEQ ID NO: 147144 - RNA, 64 nt, hsa
ucagccugugaacugccaggcagcugcaguuagcacagaggauggcuuccccauugccuucugg

SEQ ID NO: 147145 - RNA, 64 nt, hsa
uugaccugggggcaaacuuuccucuugaaugggaacagaggaggcauuauauauucuaguuaga

SEQ ID NO: 147146 - RNA, 64 nt, hsa
aucuucagaaaagcagaauuugguucaacuguugacagaggacacaaauacguuguuccagagc

SEQ ID NO: 147147 - RNA, 64 nt, hsa
uggaagucaaagccgucgguuacagaggagacugacagaggaauuccagaauguaaggaucauc

SEQ ID NO: 147148 - RNA, 64 nt, hsa
guaaaaccugggcuggaagucaaagccgucgguuacagaggagacugacagaggaauuccagaa

SEQ ID NO: 147149 - RNA, 64 nt, hsa
caaacugucccaaauccugauaaauauuaacaucacagaggaagaccagacauuaugggccugg

SEQ ID NO: 147150 - RNA, 64 nt, hsa
guaucaugugcuuggcacucaaggaucuuccaaaacagaggaccaaccagucuucugaagguca

SEQ ID NO: 147151 - RNA, 64 nt, hsa
gugcuccgccauggugucccgguaccuuccauacacagaggagugcagccuucuccauaucucc

SEQ ID NO: 147152 - RNA, 64 nt, hsa
gaguuuuuccucccagugagacugccccacggagacagaggaaagggcuggcucccccucccca

SEQ ID NO: 147153 - RNA, 64 nt, hsa
gguuaaacggugcccauccugccauccucaaacgacagaggagcuuuucuggaauuucaaacca

SEQ ID NO: 147154 - RNA, 64 nt, hsa
gccccacagaccccacagaggaugaagccaccccacagaggaugcagcccccagcugcauggaa

SEQ ID NO: 147155 - RNA, 64 nt, hsa
augcugaugacuuggagcaggccccacagaccccacagaggaugaagccaccccacagaggaug

SEQ ID NO: 147156 - RNA, 64 nt, hsa
uggucagaggaagccagcagggaagaucugggggacagaggaaggccuccugagggaggggcag

SEQ ID NO: 147157 - RNA, 64 nt, hsa
caagccuguuccggugauguagacaauaauuaacacagaggacuuucccccacacccagaucac

SEQ ID NO: 147158 - RNA, 64 nt, hsa
ggggaggaaagagcuuccagggggcgaacgcagcacagaggaagaggccugcuccacuugucug

SEQ ID NO: 147159 - RNA, 64 nt, hsa
cugcuccacuugucugggaaccugggcaggaggcacagaggaagccaaggccuggagcugcagg

SEQ ID NO: 147160 - RNA, 64 nt, hsa
uuucucugaggacaagagaaaaaagccagguuccacagaggacacagagaagguuugggugucc

SEQ ID NO: 147161 - RNA, 64 nt, hsa
gggguuauugguguaagguacuuucauauuuuaaacagaggauaucggcauuuguuucuuucuc

SEQ ID NO: 147162 - RNA, 64 nt, hsa
gagagagagacagaggaggcagagagggagagaaacagaggagacagagagggagagagagaca

SEQ ID NO: 147163 - RNA, 64 nt, hsa
uggggagaggggagagagauaugaggagagagagacagaggaggcagagagggagagaaacaga

SEQ ID NO: 147164 - RNA, 64 nt, hsa
gugggcuuuuuaccaccacugugcaggagaacagacagaggaaaugugucucccuccaaggccc

SEQ ID NO: 147165 - RNA, 64 nt, hsa
cauccugcccggaaugccagugcuccgagcucagacagaggaagcccugcagaaaguuccauca

SEQ ID NO: 147166 - RNA, 64 nt, hsa
cauguacucauugucagauguucccucugagagcacagaggaggcaaaagcuucugugggaugu

SEQ ID NO: 147167 - RNA, 64 nt, hsa
gcuucugugggaugugcuagucggcuaaagcuucacagaggagguggcaauugaaaaugagucc

SEQ ID NO: 147168 - RNA, 64 nt, hsa
guguguaugaguuucuaugugagcaugcauauauacuucacaaagagaugaccuauauaaauca

SEQ ID NO: 147169 - RNA, 64 nt, hsa
ugguccuugaauaaaauugucuuacuucauuaauacuucacaauacuauuugcauaagacaaaa

SEQ ID NO: 147170 - RNA, 64 nt, hsa
ugcagaccagaaugaguucaacucauucugugcaacuucacaggggguuuauuagaaugcucag

SEQ ID NO: 147171 - RNA, 64 nt, hsa
uucugaauuauggcagaaaggaaaaauaaaacauacuucacauuagaacacagaaucauuuaca

SEQ ID NO: 147172 - RNA, 64 nt, hsa
gaccugcaacgggguggcauucacuuagggucugacuucacagcuaugacaaaaccgaaaaagc

SEQ ID NO: 147173 - RNA, 64 nt, hsa
uaugcucaguuccacagaaugucaggaccaaauaacuucacagcuacucugcaaagggcaaauu

SEQ ID NO: 147174 - RNA, 64 nt, hsa
gcagacaauguguuuggaagaaacaagguguacaacuucacaaagcaaguuuuuucuggucuga

SEQ ID NO: 147175 - RNA, 64 nt, hsa
acaaugacauggcaacaaaggauggcucuguacaacuucacagauggaaucuuguuuaaggcug

SEQ ID NO: 147176 - RNA, 64 nt, hsa
ggaaccaaaauguauaaauguuauguuugcuaaaacuucacaauguauauugggucuuuguaca

SEQ ID NO: 147177 - RNA, 64 nt, hsa
guuuaaucuucucgauguagauguuuauguagguacuucacauugcaaacgccuuuuauucuau

SEQ ID NO: 147178 - RNA, 64 nt, hsa
auugacuuauuuuauuggacucuuaccgcauaccacuucacacuuguuuuauuuucuuuaguuu

SEQ ID NO: 147179 - RNA, 64 nt, hsa
guagcuuuuuagacuguuggucaaagaacauucuacuucacaguaauagcucuaucagccacag

SEQ ID NO: 147180 - RNA, 64 nt, hsa
gaagagugugaaaugaaaauauugccuugccauuucugaacaaaagaaaacugaauuguaaaga

SEQ ID NO: 147181 - RNA, 64 nt, hsa
caagcaauuuagacuuaaguggugcuuugugguaucugaacaauucauaacauguaaauaaugu

SEQ ID NO: 147182 - RNA, 64 nt, hsa
uagagaugucauagccugaagauuuacugaagcuucugaacaugccaccaugccaaagcuaugu

SEQ ID NO: 147183 - RNA, 64 nt, hsa
aagcagugggucucaacuggggaugauucgcuuaucugaacagcaucugcagacauuuuugguu

SEQ ID NO: 147184 - RNA, 64 nt, hsa
gagcuuaaacucuaauagcuguuucccuuucuauucugaacaacugucuccauuuuucaagugu

SEQ ID NO: 147185 - RNA, 64 nt, hsa
uaugugacugaauguaagauuaacuuuauuuuggucugaacaaaccuuguaaaguuccauugua

SEQ ID NO: 147186 - RNA, 64 nt, hsa
ggccuugcccuaagcuaccugaggguuuaggaggucugaacacacacaguggagagguuaaucu

SEQ ID NO: 147187 - RNA, 64 nt, hsa
uuaggcauuuccucuuuuccccgccugcacccacucugaacaugacaaaaguugccagaguugg

SEQ ID NO: 147188 - RNA, 64 nt, hsa
uuuccuaaauggaaaaugggaaggagauacugucucugaacaaaaauagcuggaaaaacacaua

SEQ ID NO: 147189 - RNA, 64 nt, hsa
uucuuaccaaugacuucgcuuuguuccucgugccucugaacagacugcugagauacccaaucaa

SEQ ID NO: 147190 - RNA, 64 nt, hsa
acccacaaagcaucaaaagacucacucacaaacuucugaacacaaacuccauggaugaaagcug

SEQ ID NO: 147191 - RNA, 64 nt, hsa
guauaugcuuguaaaaauugauucuguguguuccucugaacaaagcggagaaaaugaugauacc

SEQ ID NO: 147192 - RNA, 64 nt, hsa
gaggguaggcccuuaggaaauuuauuuaggaaagucugaacacguuaucacuugguuuucugga

SEQ ID NO: 147193 - RNA, 64 nt, hsa
aguauaugcuuagcuguaagugacaaguauuuuuucugaacagaaguuuacuuagaaauaccau

SEQ ID NO: 147194 - RNA, 64 nt, hsa
gaauaacugauauaucuuuauuacaaacugaaagagagaagauuaucaaacaaaugaaacaagu

SEQ ID NO: 147195 - RNA, 64 nt, hsa
aguaaaggaagaaagaagguaucuggaaagaaauagagaagaacuaguaaaaacgguugaaaag

SEQ ID NO: 147196 - RNA, 64 nt, hsa
caaggucaagucuggcugucaacugacaaagagaagagaagacaagucuguggcccagacagga

SEQ ID NO: 147197 - RNA, 64 nt, hsa
gagcccaaggucaagucuggcugucaacugacaaagagaagagaagacaagucuguggcccaga

SEQ ID NO: 147198 - RNA, 64 nt, hsa
gcaugaaggaugcuucaugcccuguuccccacacagagaagagaugaagagggggagguacggu

SEQ ID NO: 147199 - RNA, 64 nt, hsa
gaaauaaaaagaagagagggaggaagaaagggagagagaagaaaagaaaaaugaagaaaaguaa

SEQ ID NO: 147200 - RNA, 64 nt, hsa
aagacuucacuaaaaugaccaggauccacaguuaagagaagacccuguaguauuugcugugggc

SEQ ID NO: 147201 - RNA, 64 nt, hsa
uccagcagaaaccagauuggauguuccagcucccagagaagacucuaucacagugcacauaagg

SEQ ID NO: 147202 - RNA, 64 nt, hsa
ccuauuuaaucuuaaguguaggaaugggcuccagagagaagacauuuauauuaugaaauaugua

SEQ ID NO: 147203 - RNA, 64 nt, hsa
guuuguacaucguuuuuuuccauuaaacuuuucuagagaagacaaaagcuuacacuggugacau

SEQ ID NO: 147204 - RNA, 64 nt, hsa
cuuucacuuuuucuuuuuuacggaauucaucaucagagaagaaaauaacaaaaauggaagcaaa

SEQ ID NO: 147205 - RNA, 64 nt, hsa
auauuuuugaccaguuccuuuuagagauucuuucagagaagaaaccagaucugaccuguuuauu

SEQ ID NO: 147206 - RNA, 64 nt, hsa
guuuauuucacuuuucauuaaaugaacauugaugagagaagaugccacuuacccaagcuuuaga

SEQ ID NO: 147207 - RNA, 64 nt, hsa
uacuaaagugacacaaagagaaugaagcagaaguagagaagaaagacuguaugugacaauuacc

SEQ ID NO: 147208 - RNA, 64 nt, hsa
cugacaaaaaguccagaacccauaaacauagcccagagaagagaggcucugaaagaaaggaggg

SEQ ID NO: 147209 - RNA, 64 nt, hsa
uuguacagauagggauuaaggaauacagacuauuagagaagauccuuauauuuacaucuaguau

SEQ ID NO: 147210 - RNA, 64 nt, hsa
uaaagcuuuugggcacuguguaccaggaugaggaagagaagaaaugaggagccugucuuuuaau

SEQ ID NO: 147211 - RNA, 64 nt, hsa
gagcaccugcuucaugaaggaagauagguagcccagagaagaaguuuuggacuuaacaacauac

SEQ ID NO: 147212 - RNA, 64 nt, hsa
ggagccaucacugcuuggaagagauucuuggcagagagaagaggggacaaauuugguugugaag

SEQ ID NO: 147213 - RNA, 64 nt, hsa
aaaagagugucauauuccagcauuugaauuggaaagagaagagugaagauccaaguugcauuau

SEQ ID NO: 147214 - RNA, 64 nt, hsa
uuggacuuuguuaaauauuuuacugugguaauauagagaagaauuaaagcaagaaaaucugaag

SEQ ID NO: 147215 - RNA, 64 nt, hsa
uuuuuuuaaacaugauucuaguuaaauguagaagagagaagaaagaggaaguguucacuuuuuu

SEQ ID NO: 147216 - RNA, 64 nt, hsa
acuagaagggcacaacuuuuuuuuuaauuaccauagagaagauacauuaaaaaaaaucuucuga

SEQ ID NO: 147217 - RNA, 64 nt, hsa
cuacgauccaucucccuuugugagucaaauguuaagagaagaaacuuguauuugcagcuagagg

SEQ ID NO: 147218 - RNA, 64 nt, hsa
ggguccaggagaacugagacgcaggauggaagacagagaagaccccccggagcuccucgcucug

SEQ ID NO: 147219 - RNA, 64 nt, hsa
gucuuucaauuuacagaucaagaaacugaagaccagagaagagaaaugauuugguuaaagucac

SEQ ID NO: 147220 - RNA, 64 nt, hsa
gagacccugucucaaaaaaaaaaaaaaaaaaaggagagaagaaaauaaagaaggcuaauauaua

SEQ ID NO: 147221 - RNA, 64 nt, hsa
gcaggguccucuguaugagugugcacccagcugaagagaagaaauggagagcagcaauuggagc

SEQ ID NO: 147222 - RNA, 64 nt, hsa
caaaagguuagucuucaauagacugaaauguauaagagaagaaccaagucuuacauagaaaaaa

SEQ ID NO: 147223 - RNA, 64 nt, hsa
uuacagccauuucuaaaauggcagcuucaguucuagagaagaaagaacaacaucagcaguaaag

SEQ ID NO: 147224 - RNA, 64 nt, hsa
ucaugcagcaauuaugagaggcuaggucauccaaagagaagacccuaucaauguagguugcaaa

SEQ ID NO: 147225 - RNA, 64 nt, hsa
aaaugguacuguccacagugcacugcugcaaugaagagaagaggcagcagacacaaauaaaggu

SEQ ID NO: 147226 - RNA, 64 nt, hsa
ucagcugaagauuuuauauaggacuuuaaaaagaagagaagagaaagaagaaacaaugcauuuc

SEQ ID NO: 147227 - RNA, 64 nt, hsa
ggugggagauuuagacaccugaaacugggcguggagagaagagccguugcuguuuguuuuuugg

SEQ ID NO: 147228 - RNA, 64 nt, hsa
uccugagaccacgggcaaagcucuucauuuugagagagaagaaaaacuguuuggaaccacacca

SEQ ID NO: 147229 - RNA, 64 nt, hsa
ugaacaccaaauuuaaagauuuuuaacaugucagagagaagagaguuaaaauuuaaaaaugcau

SEQ ID NO: 147230 - RNA, 64 nt, hsa
aagacaaauuguccgaagugcuaagaacuccaugagagaagaugccauaaaauaaacaccuccc

SEQ ID NO: 147231 - RNA, 64 nt, hsa
auauguauuuaagauguacauuuaauaauaucaaagagaagaugccuguuaauuuauaauguau

SEQ ID NO: 147232 - RNA, 64 nt, hsa
uuuugggcguaagaccaaauguaguuuuguauacagagaagaaaaccucaaguaauaggcauuu

SEQ ID NO: 147233 - RNA, 64 nt, hsa
ggcccuuaauccaauaugacugguguuccuuauaagagaagauagggcgggcaugguggcucac

SEQ ID NO: 147234 - RNA, 64 nt, hsa
acucugucucaaaaaaaaaaaaaaaaaggaagaaagagaagauagagacacaggggagaaugcc

SEQ ID NO: 147235 - RNA, 64 nt, hsa
ggagccauacucugauaugacagaugagaaagggagagaagacuuuucucuggcagacuaucag

SEQ ID NO: 147236 - RNA, 64 nt, hsa
aaauauguuucucaagcaaccugcaucuuuuaugagagaagaaagagugagagaagaauugccu

SEQ ID NO: 147237 - RNA, 64 nt, hsa
gcaaccugcaucuuuuaugagagaagaaagagugagagaagaauugccucuggacuaucaucaa

SEQ ID NO: 147238 - RNA, 64 nt, hsa
aaacaagcuccaucccuuuucuauauuuauaagaagagaagaucuugagugaagcagcacgcga

SEQ ID NO: 147239 - RNA, 64 nt, hsa
ucagauccuuacuugccgagccguuuguuuagguagagaagacaaguccaaagagugugugggc

SEQ ID NO: 147240 - RNA, 64 nt, hsa
ugcagaauucuuuugguucuuugguuccagagagagagaagaugcuugugccagguggcaccag

SEQ ID NO: 147241 - RNA, 64 nt, hsa
guuaccuuggcgugugucccugugguacccuggcagagaagagaccaagcuuguuucccugcug

SEQ ID NO: 147242 - RNA, 64 nt, hsa
ggguuccagggacuguaccuguaggaaacagaaaagagaagaaagaagcacucugcuggcggga

SEQ ID NO: 147243 - RNA, 64 nt, hsa
cugaaacagucuugagccugggguugacuggguuagagaagaaccgggaugcaaggagcugccu

SEQ ID NO: 147244 - RNA, 64 nt, hsa
ucaggagacagaggcuuuuuugaauucacugugaagagaagaacccgaaccuuaagacgccaga

SEQ ID NO: 147245 - RNA, 64 nt, hsa
gugauccguguaucuucuccccagugacagaaguagagaagagaauggaaagcagcacacuccg

SEQ ID NO: 147246 - RNA, 64 nt, hsa
caugaaaucuuuggugauaaaguauuuuggauucagagaagagcucccuuaccagucccacccu

SEQ ID NO: 147247 - RNA, 64 nt, hsa
aaaaacugccuacaggccauaguuaaccugcaauagagaagaaagggaaguagggcagugcaug

SEQ ID NO: 147248 - RNA, 64 nt, hsa
ggugacagaacaagacugucucaaaaaaaaaaaaagagaagaaaaacugccuacaggccauagu

SEQ ID NO: 147249 - RNA, 64 nt, hsa
cccacugcaguuccuuccgugcucugugacuuuaagagaagaaggggggaggggucccggauuu

SEQ ID NO: 147250 - RNA, 64 nt, hsa
ucaugccuugggccuagaauacccugaugagaaaagagaagaggaagggaggccauaucuacaa

SEQ ID NO: 147251 - RNA, 64 nt, hsa
uuuuguuuuaacuauugucaggagauugggcuaaagagaagacgacgagaguaaggaaauaaag

SEQ ID NO: 147252 - RNA, 64 nt, hsa
cacacaaaugcuaaggcagaauuuugagggugggagagaagaaaagggaaagaagcugaaaaug

SEQ ID NO: 147253 - RNA, 64 nt, hsa
aauguugugacugauuauaacccuguuuccccucagagaagagcuauggcucagggaucugugu

SEQ ID NO: 147254 - RNA, 64 nt, hsa
acuagugagauuuacaugaugcuuaauggagaacagagaagaucuuguugcaaaagguguauua

SEQ ID NO: 147255 - RNA, 64 nt, hsa
cuagcacuguuaaucuagaagaaagugguugcauagagaagaguaagaauguagaccagcuuau

SEQ ID NO: 147256 - RNA, 64 nt, hsa
cgugggccauggggaggacuucacucagcagcaaagagaagagcauuggggcuggaguguuccg

SEQ ID NO: 147257 - RNA, 64 nt, hsa
ucaauuaaagagaggagagaauugaauggcguuuagagaagauagaaaagaaucacagucauau

SEQ ID NO: 147258 - RNA, 64 nt, hsa
gaaagaucaacucaccugcaguuaaaccaucuaaagagaagaaagaccacuggagaccuagaaa

SEQ ID NO: 147259 - RNA, 64 nt, hsa
ccugggcgaaagagcgacucugucuccaaaaaaaagagaagaggagaggacacagagacacaca

SEQ ID NO: 147260 - RNA, 64 nt, hsa
aaaaaagagaagaggagaggacacagagacacacagagaagaaagccauguggcggcagaggca

SEQ ID NO: 147261 - RNA, 64 nt, hsa
ccucucccagggcggaaacagcauuugccuucugagagaagagacuagcaaaaagcugcagaga

SEQ ID NO: 147262 - RNA, 64 nt, hsa
caagggugguuaagugacacauagaacuuuucuaagagaagacagacaaguugacaggcaugcc

SEQ ID NO: 147263 - RNA, 64 nt, hsa
ugcuucucuuucuaaaaaaaaaaaaaaaaaagaaagagaagaaagaagugauuccuacccccua

SEQ ID NO: 147264 - RNA, 64 nt, hsa
acuuucuuagcucaagagagaggcugagaaaugcagagaagaauaagacauaaaauagcuccga

SEQ ID NO: 147265 - RNA, 64 nt, hsa
cuuaaauguguaagucacccccaccaaaaacaaaagagaagaaaaagaauagaaagaauuaucc

SEQ ID NO: 147266 - RNA, 64 nt, hsa
uucuacucauucaaagcacauuguagauauucagagagaagaacaaauggcuggcuuggcaaau

SEQ ID NO: 147267 - RNA, 64 nt, hsa
cuggggcucuccgugguguucuggacccagccccuggagacaccauucacuuuuacugcuuugu

SEQ ID NO: 147268 - RNA, 64 nt, hsa
ccauggcuggucaugagagcaaaccguaguccccuggagacagcgacuccagagaaccucuugg

SEQ ID NO: 147269 - RNA, 64 nt, hsa
ccacucaacacacguccucaccagucaccccaaauggagacacucgcagaccugcaguucucag

SEQ ID NO: 147270 - RNA, 64 nt, hsa
ccaaaccagcacccuccuuugugcucugagagguuggagacaucugguccaccccauugccccu

SEQ ID NO: 147271 - RNA, 64 nt, hsa
aguugcaguuuuuuccuagucuguuuucccuccuuggagacagggcccugucgguuuauucacu

SEQ ID NO: 147272 - RNA, 64 nt, hsa
gguuuucccaucucagguguguugcagugucugcuggagacauugaggcaggcacugccaaaac

SEQ ID NO: 147273 - RNA, 64 nt, hsa
cuggaggucccaaguagcucuaugccugcaaucauggagacacaggcagacagauaagcuucau

SEQ ID NO: 147274 - RNA, 64 nt, hsa
ugucugccugggaacacucaguagggagacacuuuggagacaggaggugaugaaccuuuuuaug

SEQ ID NO: 147275 - RNA, 64 nt, hsa
gugagguggacagcccagacccugaaaggacguguggagacagcagcaguccuguggugcaguu

SEQ ID NO: 147276 - RNA, 64 nt, hsa
uaggccauggaggaaaugaggagacaccaccuaguggagacauuggggcccugcuggggggaug

SEQ ID NO: 147277 - RNA, 64 nt, hsa
cugcaccuugcuuuuuucccuuaacaaucuaucuuggagacauuucauaucaauucauaugcca

SEQ ID NO: 147278 - RNA, 64 nt, hsa
caccaccacacccagcuauuuuuuguauuuuuacuggagacaggguuucaccauguuggccagg

SEQ ID NO: 147279 - RNA, 64 nt, hsa
gaaaaagugaaggcuggguuuuuccccucuaaucuggagacaagcugcugcucucguacuaacu

SEQ ID NO: 147280 - RNA, 64 nt, hsa
caugaaugacaaugagauaacauacagaugucaguggagacaaaguuguggguuccuccuccca

SEQ ID NO: 147281 - RNA, 64 nt, hsa
gaaauucccaacucgguucucauggaggaguggguggagacaaggagggaguaagucguaggag

SEQ ID NO: 147282 - RNA, 64 nt, hsa
uagucugugccugaagucuguguuuguguugucguggagacaaggccuuugagccccacccuug

SEQ ID NO: 147283 - RNA, 64 nt, hsa
cauacaaggugugaauuugagcacaguccagaaauggagacaucccacccccaguugaauaaug

SEQ ID NO: 147284 - RNA, 64 nt, hsa
ucaucagcuuuuccucuuugccacuggaucuucauggagacaugggcaagcauuaguggcuuca

SEQ ID NO: 147285 - RNA, 64 nt, hsa
uauugggucuuucauaaauaacaugagugguuucuggagacauuuaagauugucagcaaacuug

SEQ ID NO: 147286 - RNA, 64 nt, hsa
ugccuucucuccagacaauaagacaguucacaucuggagacaucagccuuugguaccuaauucu

SEQ ID NO: 147287 - RNA, 64 nt, hsa
guguuuuuuuucuucugcuaugugacuugcaucguggagacagggcauuugaguuuauaucucu

SEQ ID NO: 147288 - RNA, 64 nt, hsa
agaauuuuacuguguuucuuuugguuccauuguuuggagacauuccugggcacaguuugguccg

SEQ ID NO: 147289 - RNA, 64 nt, hsa
gaucauccagagccucaguucuguacuuguaaaguggagacagcaguucucauccuccauccuu

SEQ ID NO: 147290 - RNA, 64 nt, hsa
uggcagaaagaaaaaucaagaggacccaaggggauggagacaggaccacaggaaugggccaagg

SEQ ID NO: 147291 - RNA, 64 nt, hsa
ugagguagcuacgugauuaaaugguauugcaguguggagacauggaauuuuaugauugguuuau

SEQ ID NO: 147292 - RNA, 64 nt, hsa
ugaggcagccacuugauugaacgguguugcaauguggagacauggaguuuuauugagguagcua

SEQ ID NO: 147293 - RNA, 64 nt, hsa
uuuagcaggcccccccaccuuuuuuuuuuguuuuuggagacagagucuugcuuuguugccaggc

SEQ ID NO: 147294 - RNA, 64 nt, hsa
gccaccgugccuggccaggccccuucucuuuuaauggagacagggucuugcacuaucacccagg

SEQ ID NO: 147295 - RNA, 64 nt, hsa
gugacucaaaaauugagcccuggccaggaaaauguggagacaguucuucuccuccacugcucac

SEQ ID NO: 147296 - RNA, 64 nt, hsa
ccaggaacccagacuggacuucagucucccuccauggagacaaaggcuucccagagccaccaaa

SEQ ID NO: 147297 - RNA, 64 nt, hsa
ucccuugugaaugucccuuagggaggcaccagauuggagacagaugugcuaucuccuaacagag

SEQ ID NO: 147298 - RNA, 64 nt, hsa
cuuugaaccacagcuuuauuaugguccuuuacacuggagacagacacagagacacuguucagaa

SEQ ID NO: 147299 - RNA, 64 nt, hsa
ccauaauguucuuuuuuauguaaaaagaagaacuuggagacauuaacaugaaaaagucuuuuau

SEQ ID NO: 147300 - RNA, 64 nt, hsa
guaccauacugacccaggcugggggcagguguguuggagacaggcuggucaaagaggugacaau

SEQ ID NO: 147301 - RNA, 64 nt, hsa
ccucaccuucucuggcccuuaggaucuccccauuuggagacagagccauuuggauauuuucccc

SEQ ID NO: 147302 - RNA, 64 nt, hsa
aagaggcaucgcauggacguucucuggucuguaguggagacaagcaguuaaccuagcaccaucc

SEQ ID NO: 147303 - RNA, 64 nt, hsa
cauuaccagcagggagcagacuuaccuccgaagauggagacaggugacugagagcugcaggccu

SEQ ID NO: 147304 - RNA, 64 nt, hsa
guagaaagggaaaccccaacccuuucuugauuuuuggagacacccaggacuaauggauacugua

SEQ ID NO: 147305 - RNA, 64 nt, hsa
uguccacguuacugaggauugacugaguauagacuggagacagguuuuuggcuuaucacagcac

SEQ ID NO: 147306 - RNA, 64 nt, hsa
ggaccugguuugaacaaaacauaaaaagccauuuuggagacagugagggaaguguggacaugga

SEQ ID NO: 147307 - RNA, 64 nt, hsa
gagaacgggaugauacaagagugugaauaaguccuggagacaggaccacuggggggccuguuua

SEQ ID NO: 147308 - RNA, 64 nt, hsa
guccuggaggaggagaggaccccucccaaaggacuggagacaaaacccucugcuuccuuggguc

SEQ ID NO: 147309 - RNA, 64 nt, hsa
agaaugggcaagaaggaucaggucagccacucccuggagacacagccuucuggcugggacugac

SEQ ID NO: 147310 - RNA, 64 nt, hsa
agagagcagaagaguagcuaggcagaugcagagauggagacaugagacucagugcagugggcag

SEQ ID NO: 147311 - RNA, 64 nt, hsa
ugccucacauuucccacuugagguugaggcguacuggagacaacaccucagaccaucugaaccc

SEQ ID NO: 147312 - RNA, 64 nt, hsa
uuuuuuggcauuccaccuccuagggauauaauucuggagacauggaguguuacugaucauaaaa

SEQ ID NO: 147313 - RNA, 64 nt, hsa
ggccugugcuuuucagauaguauacucuccuguuuggagacagaggaagaaccaggucagucug

SEQ ID NO: 147314 - RNA, 64 nt, hsa
uucaggucaugccaaaagcucucugguuguaaccuggagacauguggaggggaauggcgauggg

SEQ ID NO: 147315 - RNA, 64 nt, hsa
ccaccaacccaaagacagcugguggguuuccccuuggagacaauccugcguuugccugggccgg

SEQ ID NO: 147316 - RNA, 64 nt, hsa
cuuucuuuuguaaauaucuauaaauggagacagauggagacaccaaauucacuuucugccguuu

SEQ ID NO: 147317 - RNA, 64 nt, hsa
uugcucaugacuuucuuuuguaaauaucuauaaauggagacagauggagacaccaaauucacuu

SEQ ID NO: 147318 - RNA, 64 nt, hsa
gcggcagccuggauccaggggcccccggaaggcguggagacacccacggaccagggaggccaag

SEQ ID NO: 147319 - RNA, 64 nt, hsa
gcggauccaaagacccaggaaugacagguuccucuggagacauuuuugaaagcagcucccuaag

SEQ ID NO: 147320 - RNA, 64 nt, hsa; identical to SEQ ID NO: 88665

SEQ ID NO: 147321 - RNA, 64 nt, hsa; identical to SEQ ID NO: 88666

SEQ ID NO: 147322 - RNA, 64 nt, hsa; identical to SEQ ID NO: 88667

SEQ ID NO: 147323 - RNA, 64 nt, hsa; identical to SEQ ID NO: 88668

SEQ ID NO: 147324 - RNA, 64 nt, hsa; identical to SEQ ID NO: 88669

SEQ ID NO: 147325 - RNA, 64 nt, hsa; identical to SEQ ID NO: 88670

SEQ ID NO: 147326 - RNA, 64 nt, hsa; identical to SEQ ID NO: 88671

SEQ ID NO: 147327 - RNA, 64 nt, hsa; identical to SEQ ID NO: 88672

SEQ ID NO: 147328 - RNA, 64 nt, hsa; identical to SEQ ID NO: 88673

SEQ ID NO: 147329 - RNA, 64 nt, hsa; identical to SEQ ID NO: 88674

SEQ ID NO: 147330 - RNA, 64 nt, hsa; identical to SEQ ID NO: 88675

SEQ ID NO: 147331 - RNA, 64 nt, hsa; identical to SEQ ID NO: 88676

SEQ ID NO: 147332 - RNA, 64 nt, hsa; identical to SEQ ID NO: 88677

SEQ ID NO: 147333 - RNA, 64 nt, hsa; identical to SEQ ID NO: 88678

SEQ ID NO: 147334 - RNA, 64 nt, hsa; identical to SEQ ID NO: 88679

SEQ ID NO: 147335 - RNA, 64 nt, hsa; identical to SEQ ID NO: 88680

SEQ ID NO: 147336 - RNA, 64 nt, hsa; identical to SEQ ID NO: 88681

SEQ ID NO: 147337 - RNA, 64 nt, hsa; identical to SEQ ID NO: 88682

SEQ ID NO: 147338 - RNA, 64 nt, hsa; identical to SEQ ID NO: 88683

SEQ ID NO: 147339 - RNA, 64 nt, hsa; identical to SEQ ID NO: 88684

SEQ ID NO: 147340 - RNA, 64 nt, hsa; identical to SEQ ID NO: 88685

SEQ ID NO: 147341 - RNA, 64 nt, hsa; identical to SEQ ID NO: 88686

SEQ ID NO: 147342 - RNA, 64 nt, hsa; identical to SEQ ID NO: 88687

SEQ ID NO: 147343 - RNA, 64 nt, hsa; identical to SEQ ID NO: 88688

SEQ ID NO: 147344 - RNA, 64 nt, hsa; identical to SEQ ID NO: 88689

SEQ ID NO: 147345 - RNA, 64 nt, hsa; identical to SEQ ID NO: 88690

SEQ ID NO: 147346 - RNA, 64 nt, hsa; identical to SEQ ID NO: 88691

SEQ ID NO: 147347 - RNA, 50 nt, hsa; identical to SEQ ID NO: 88692

SEQ ID NO: 147348 - RNA, 64 nt, hsa; identical to SEQ ID NO: 88693

SEQ ID NO: 147349 - RNA, 64 nt, hsa; identical to SEQ ID NO: 88694

SEQ ID NO: 147350 - RNA, 64 nt, hsa; identical to SEQ ID NO: 88695

SEQ ID NO: 147351 - RNA, 64 nt, hsa; identical to SEQ ID NO: 88696

SEQ ID NO: 147352 - RNA, 64 nt, hsa; identical to SEQ ID NO: 88697

SEQ ID NO: 147353 - RNA, 64 nt, hsa; identical to SEQ ID NO: 88698

SEQ ID NO: 147354 - RNA, 64 nt, hsa; identical to SEQ ID NO: 88699

SEQ ID NO: 147355 - RNA, 64 nt, hsa; identical to SEQ ID NO: 88700

SEQ ID NO: 147356 - RNA, 64 nt, hsa; identical to SEQ ID NO: 88701

SEQ ID NO: 147357 - RNA, 64 nt, hsa; identical to SEQ ID NO: 88702

SEQ ID NO: 147358 - RNA, 64 nt, hsa; identical to SEQ ID NO: 88703

SEQ ID NO: 147359 - RNA, 64 nt, hsa; identical to SEQ ID NO: 88704

SEQ ID NO: 147360 - RNA, 64 nt, hsa; identical to SEQ ID NO: 88705

SEQ ID NO: 147361 - RNA, 64 nt, hsa; identical to SEQ ID NO: 88706

SEQ ID NO: 147362 - RNA, 64 nt, hsa; identical to SEQ ID NO: 88707

SEQ ID NO: 147363 - RNA, 64 nt, hsa; identical to SEQ ID NO: 88708

SEQ ID NO: 147364 - RNA, 64 nt, hsa; identical to SEQ ID NO: 88709

SEQ ID NO: 147365 - RNA, 64 nt, hsa; identical to SEQ ID NO: 88710

SEQ ID NO: 147366 - RNA, 64 nt, hsa; identical to SEQ ID NO: 88711

SEQ ID NO: 147367 - RNA, 64 nt, hsa; identical to SEQ ID NO: 88712

SEQ ID NO: 147368 - RNA, 64 nt, hsa; identical to SEQ ID NO: 88713

SEQ ID NO: 147369 - RNA, 64 nt, hsa; identical to SEQ ID NO: 88714

SEQ ID NO: 147370 - RNA, 64 nt, hsa; identical to SEQ ID NO: 88715

SEQ ID NO: 147371 - RNA, 64 nt, hsa; identical to SEQ ID NO: 88716

SEQ ID NO: 147372 - RNA, 64 nt, hsa; identical to SEQ ID NO: 88717

SEQ ID NO: 147373 - RNA, 64 nt, hsa; identical to SEQ ID NO: 88718

SEQ ID NO: 147374 - RNA, 64 nt, hsa; identical to SEQ ID NO: 88719

SEQ ID NO: 147375 - RNA, 64 nt, hsa; identical to SEQ ID NO: 88720

SEQ ID NO: 147376 - RNA, 64 nt, hsa; identical to SEQ ID NO: 88721

SEQ ID NO: 147377 - RNA, 64 nt, hsa; identical to SEQ ID NO: 88722

SEQ ID NO: 147378 - RNA, 64 nt, hsa; identical to SEQ ID NO: 88723

SEQ ID NO: 147379 - RNA, 64 nt, hsa; identical to SEQ ID NO: 88724

SEQ ID NO: 147380 - RNA, 64 nt, hsa; identical to SEQ ID NO: 88725

SEQ ID NO: 147381 - RNA, 64 nt, hsa; identical to SEQ ID NO: 88726

SEQ ID NO: 147382 - RNA, 64 nt, hsa; identical to SEQ ID NO: 88727

SEQ ID NO: 147383 - RNA, 64 nt, hsa; identical to SEQ ID NO: 88728

SEQ ID NO: 147384 - RNA, 64 nt, hsa; identical to SEQ ID NO: 88729

SEQ ID NO: 147385 - RNA, 64 nt, hsa; identical to SEQ ID NO: 88730

SEQ ID NO: 147386 - RNA, 64 nt, hsa; identical to SEQ ID NO: 88731

SEQ ID NO: 147387 - RNA, 64 nt, hsa; identical to SEQ ID NO: 88732

SEQ ID NO: 147388 - RNA, 64 nt, hsa; identical to SEQ ID NO: 88733

SEQ ID NO: 147389 - RNA, 64 nt, hsa; identical to SEQ ID NO: 88734

SEQ ID NO: 147390 - RNA, 64 nt, hsa; identical to SEQ ID NO: 88735

SEQ ID NO: 147391 - RNA, 64 nt, hsa; identical to SEQ ID NO: 88736

SEQ ID NO: 147392 - RNA, 64 nt, hsa; identical to SEQ ID NO: 88737

SEQ ID NO: 147393 - RNA, 64 nt, hsa; identical to SEQ ID NO: 88738

SEQ ID NO: 147394 - RNA, 64 nt, hsa; identical to SEQ ID NO: 88739

SEQ ID NO: 147395 - RNA, 64 nt, hsa; identical to SEQ ID NO: 88740

SEQ ID NO: 147396 - RNA, 64 nt, hsa; identical to SEQ ID NO: 88741

SEQ ID NO: 147397 - RNA, 64 nt, hsa; identical to SEQ ID NO: 88742

SEQ ID NO: 147398 - RNA, 64 nt, hsa; identical to SEQ ID NO: 88743

SEQ ID NO: 147399 - RNA, 64 nt, hsa; identical to SEQ ID NO: 88744

SEQ ID NO: 147400 - RNA, 64 nt, hsa; identical to SEQ ID NO: 88745

SEQ ID NO: 147401 - RNA, 64 nt, hsa; identical to SEQ ID NO: 88746

SEQ ID NO: 147402 - RNA, 64 nt, hsa; identical to SEQ ID NO: 88747

SEQ ID NO: 147403 - RNA, 64 nt, hsa; identical to SEQ ID NO: 88748

SEQ ID NO: 147404 - RNA, 64 nt, hsa; identical to SEQ ID NO: 88749

SEQ ID NO: 147405 - RNA, 64 nt, hsa; identical to SEQ ID NO: 88750

SEQ ID NO: 147406 - RNA, 64 nt, hsa; identical to SEQ ID NO: 88751

SEQ ID NO: 147407 - RNA, 64 nt, hsa; identical to SEQ ID NO: 88752

SEQ ID NO: 147408 - RNA, 64 nt, hsa; identical to SEQ ID NO: 88753

SEQ ID NO: 147409 - RNA, 64 nt, hsa; identical to SEQ ID NO: 88754

SEQ ID NO: 147410 - RNA, 64 nt, hsa; identical to SEQ ID NO: 88755

SEQ ID NO: 147411 - RNA, 64 nt, hsa; identical to SEQ ID NO: 88756

SEQ ID NO: 147412 - RNA, 64 nt, hsa; identical to SEQ ID NO: 88757

SEQ ID NO: 147413 - RNA, 64 nt, hsa; identical to SEQ ID NO: 88758

SEQ ID NO: 147414 - RNA, 64 nt, hsa; identical to SEQ ID NO: 88759

SEQ ID NO: 147415 - RNA, 64 nt, hsa; identical to SEQ ID NO: 88760

SEQ ID NO: 147416 - RNA, 64 nt, hsa; identical to SEQ ID NO: 88761

SEQ ID NO: 147417 - RNA, 64 nt, hsa; identical to SEQ ID NO: 88762

SEQ ID NO: 147418 - RNA, 64 nt, hsa; identical to SEQ ID NO: 88763

SEQ ID NO: 147419 - RNA, 64 nt, hsa; identical to SEQ ID NO: 88764

SEQ ID NO: 147420 - RNA, 64 nt, hsa; identical to SEQ ID NO: 88765

SEQ ID NO: 147421 - RNA, 64 nt, hsa
accaggcucuaugaauguacauggaaugaccaggcucuaugaauguacauggaaaaccccuaaa

SEQ ID NO: 147422 - RNA, 64 nt, hsa
cauacgcaacaaggacuccucgcugcugaccaggcucuaugaauguacauggaaugaccaggcu

SEQ ID NO: 147423 - RNA, 64 nt, hsa
guaaauggauaugauuuccuaucaguuuauauuucucuaugauuugaguucaguguuuaaggau

SEQ ID NO: 147424 - RNA, 64 nt, hsa
gauagugcuuuacucuuucuguuuuuaaagggcacucuaugaauugauuuauugucuaagaaaa

SEQ ID NO: 147425 - RNA, 64 nt, hsa
uucgauaucuaaaaggacucacaguggagaaaaacucuaugaguguaagcaaugugggaaaguc

SEQ ID NO: 147426 - RNA, 64 nt, hsa
ucaaaugcauggaagcacucacacuuggcagaaacucuaugaauguaagcaguaugggaaagcc

SEQ ID NO: 147427 - RNA, 64 nt, hsa
ucaaaaaaaauaaaaaaaaagaaaaagaaauaaacucuaugaauguaaaccauguggugaaggc

SEQ ID NO: 147428 - RNA, 64 nt, hsa
aagucaugaaagaacucacacuggagagaagaaacucuaugaaugcaagcagugugggaaagcg

SEQ ID NO: 147429 - RNA, 64 nt, hsa
uuaauuuuuguuuuugcuccagucaauuccugauuauccacaggucaacccacauuuuuucauu

SEQ ID NO: 147430 - RNA, 64 nt, hsa
uuauaucuccacaaacacaaauuauauauauacauauccacacacauacauuacauauaucugu

SEQ ID NO: 147431 - RNA, 64 nt, hsa
caagugagaaucagcuauugauaauggccagagauauccacagcuuggaggagcccagagaccg

SEQ ID NO: 147432 - RNA, 64 nt, hsa
aggugggaaaauucuuugauauuugaugucauuguauccacauuuguuguaagacauauugcau

SEQ ID NO: 147433 - RNA, 64 nt, hsa
gguacauuguugugucccaaaccaaaauuuuccuuauccacaaugucccuucugucucuuccac

SEQ ID NO: 147434 - RNA, 64 nt, hsa
ccaugacugcauuuguuccugccugccucggcgguauccacagaagacaggcaagaggauugga

SEQ ID NO: 147435 - RNA, 64 nt, hsa
auaauugugaccaauacauuuguauuuugugaugaaucuacauuuguuuguauucauguucaug

SEQ ID NO: 147436 - RNA, 64 nt, hsa
cauuuuagcaaauuaugguuauauguuuuaauuuaaucuacagaauguuuuauaguaaaauucu

SEQ ID NO: 147437 - RNA, 64 nt, hsa
uuuguuuucugucuagcuccauaugguaucagagaaucuacaagaagaacagguucacagaagg

SEQ ID NO: 147438 - RNA, 64 nt, hsa
gagauagacucaaaacaguuauuuuuuuacaauuaaucuacaaagggaauuaauauuguugacu

SEQ ID NO: 147439 - RNA, 64 nt, hsa
agaagugcaauguauuuuucuccugugaaaccugaaucuacaaguuuuccugccaagccacuca

SEQ ID NO: 147440 - RNA, 64 nt, hsa
uacccauuuuacauuuucuuauuuuaacuacaguaaucuacauaaauauaccucagaaaucauu

SEQ ID NO: 147441 - RNA, 64 nt, hsa
gagguggaaucuacaucccucuguuguauacaggaaucuacaucccucugugacugcuucgccc

SEQ ID NO: 147442 - RNA, 64 nt, hsa
gcagcaguuugacacacuuucaaucaagagguggaaucuacaucccucuguuguauacaggaau

SEQ ID NO: 147443 - RNA, 64 nt, hsa
aauaacuauguaaauagaaacagauaccagaauaaaucuacagcuagacccuuagucaauaguu

SEQ ID NO: 147444 - RNA, 64 nt, hsa
aucaggaaggaacuuuucaagaaauguaauuauaaaucuacaucaaacagaauuuuaaggaaaa

SEQ ID NO: 147445 - RNA, 64 nt, hsa; identical to SEQ ID NO: 147443

SEQ ID NO: 147446 - RNA, 64 nt, hsa; identical to SEQ ID NO: 147444

SEQ ID NO: 147447 - RNA, 64 nt, hsa
uauuacaauuuaguuuucaguaaucaaaaagauuucuaugaauucuaaaaaauauuuuuuucua

SEQ ID NO: 147448 - RNA, 64 nt, hsa
aaaagauuucuaugaauucuaaaaaauauuuuuuucuaugaaauuacuagugcccagcuguaga

SEQ ID NO: 147449 - RNA, 64 nt, hsa
gggcagucagcucuccauccaucccccucuuuaaucuaugaaucuauaggcucgguguguguaa

SEQ ID NO: 147450 - RNA, 64 nt, hsa
cucugcaggacagacagacagacaaacccucugaucuaugaagucucugcagggcaaggggacc

SEQ ID NO: 147451 - RNA, 64 nt, hsa
uuggaggauauauuuuggagaaugcuucauaaaaucuaugaauacuguacaaugcugauaauaa

SEQ ID NO: 147452 - RNA, 64 nt, hsa
agccaucuggaggaaauaaaaaaaaaaggaagacucuaugaagaaacagagaagucucagaaaa

SEQ ID NO: 147453 - RNA, 64 nt, hsa
ccaggcucuaugaauguacauggaaugaccaggcucuaugaauguacauggaaaaccccuaaaa

SEQ ID NO: 147454 - RNA, 64 nt, hsa
auacgcaacaaggacuccucgcugcugaccaggcucuaugaauguacauggaaugaccaggcuc

SEQ ID NO: 147455 - RNA, 64 nt, hsa
uuuuccacauugaaacacuuugcagacacaaauaucuaugaaaagaugcuuugucagccacugu

SEQ ID NO: 147456 - RNA, 64 nt, hsa
uaaaaaauaagagacuauuuguuuucuuuuaauuucuaugaauaaaagaaauuuuuaaaaacuu

SEQ ID NO: 147457 - RNA, 64 nt, hsa
gucauucaauuuacuuguuuuuaauacaugauucucuaugaaauugaugggcucaaacuagcug

SEQ ID NO: 147458 - RNA, 64 nt, hsa
agucccguguguccuaaaaaucuccuaaaaccagucuaugaacucagggcuuuaaaacauuuuu

SEQ ID NO: 147459 - RNA, 64 nt, hsa
gauucuuuuuuauuaggcauuauuuaugaccuuuucuaugaaaagauaaggacauuaaaaugua

SEQ ID NO: 147460 - RNA, 64 nt, hsa
uaaguuagucauauguuauuuuauuaauuguacuucuaugaaauaauaugcagucuauuuuuaa

SEQ ID NO: 147461 - RNA, 64 nt, hsa
caaaaaaaauaaaaaaaaagaaaaagaaauaaacucuaugaauguaaaccauguggugaaggcu

SEQ ID NO: 147462 - RNA, 64 nt, hsa
agucaugaaagaacucacacuggagagaagaaacucuaugaaugcaagcagugugggaaagcgu

SEQ ID NO: 147463 - RNA, 64 nt, hsa; identical to SEQ ID NO: 44407

SEQ ID NO: 147464 - RNA, 64 nt, hsa; identical to SEQ ID NO: 44408

SEQ ID NO: 147465 - RNA, 64 nt, hsa; identical to SEQ ID NO: 44409

SEQ ID NO: 147466 - RNA, 64 nt, hsa; identical to SEQ ID NO: 44410

SEQ ID NO: 147467 - RNA, 64 nt, hsa; identical to SEQ ID NO: 44411

SEQ ID NO: 147468 - RNA, 64 nt, hsa; identical to SEQ ID NO: 44412

SEQ ID NO: 147469 - RNA, 64 nt, hsa; identical to SEQ ID NO: 44413

SEQ ID NO: 147470 - RNA, 64 nt, hsa; identical to SEQ ID NO: 44414

SEQ ID NO: 147471 - RNA, 64 nt, hsa; identical to SEQ ID NO: 44415

SEQ ID NO: 147472 - RNA, 64 nt, hsa; identical to SEQ ID NO: 44416

SEQ ID NO: 147473 - RNA, 64 nt, hsa
auaaccgaaggaaagaccguucaccagacuuggcuccucuaaacauuugcuguucaaacauguu

SEQ ID NO: 147474 - RNA, 64 nt, hsa
gcucugucaugauggcgguugugcaauucugguauccucuaaauuuguaagcauucauaaaaca

SEQ ID NO: 147475 - RNA, 64 nt, hsa
acagggauguagauaaguugaaacaaaaccaguguccucuaagucucuaucauauacuuauucc

SEQ ID NO: 147476 - RNA, 64 nt, hsa
gagggguuaggauuuggacagggguuuagaacauuccucuaagcuaucuagucuguggaguuug

SEQ ID NO: 147477 - RNA, 64 nt, hsa
uuacuggcuucaucuuccuugggauauauggucauccucuaaugaguguaaaagugcgcaaaac

SEQ ID NO: 147478 - RNA, 64 nt, hsa
guuuggcuuuuuucugugucaucaacuaugguuauccucuaaauaggcauuuaaugaaacauug

SEQ ID NO: 147479 - RNA, 64 nt, hsa
cccaagucccccacccccauccugcuccagcguuuccucuaacagggaccagcucuccgcuuug

SEQ ID NO: 147480 - RNA, 64 nt, hsa
cagggaccagcucuccgcuuugcccccacgggguuccucuaaccagaaccagcuuccuagccuc

SEQ ID NO: 147481 - RNA, 64 nt, hsa
gaggcuguucauugauccacuauucccucuauuuuccucuaagguaaauauuuagagguauuua

SEQ ID NO: 147482 - RNA, 64 nt, hsa
uauguggcaaaaggucagccuugggguuggccguuccucuaaucuggacuugcuugcaaaggug

SEQ ID NO: 147483 - RNA, 64 nt, hsa
gaaaaccacccacaagcucaacugugacccaagcagaaucuacaaaccccagacaagguugaag

SEQ ID NO: 147484 - RNA, 64 nt, hsa
acggcuggggagaucaggcccagccccauaaaggagaaucuacgcugguccucaggacguguua

SEQ ID NO: 147485 - RNA, 64 nt, hsa
agccuuucuauauuaaaggcucaggaugucacggagaaucuaucuaaucccacuguauuaagag

SEQ ID NO: 147486 - RNA, 64 nt, hsa
ucagcaauguugugugaaauauacuaaacaucaaagaaucuauguuggagcacaagauucuaaa

SEQ ID NO: 147487 - RNA, 64 nt, hsa
auuuuuuucuaugaaauuacuagugcccagcuguagaaucuaccuuagguagaugaucccuaga

SEQ ID NO: 147488 - RNA, 64 nt, hsa
aggaauagaucugacuuuaauaaaaacauggcucagaaucuacaggucaaauuaauuugaacag

SEQ ID NO: 147489 - RNA, 64 nt, hsa
uucgguagaacugagugaccuguggaacugcuuuagaaucuaaccugcugucuucgugcucugu

SEQ ID NO: 147490 - RNA, 64 nt, hsa
uaauuagccuauagggcucccuacccuuccauuaagaaucuaccaagcauuagcaaggcugaaa

SEQ ID NO: 147491 - RNA, 64 nt, hsa
cucuucagauuccuaaguagcacaagacuuuaucagaaucuauaggcauaccaaccuggaucac

SEQ ID NO: 147492 - RNA, 64 nt, hsa
aaggguuaugcaaaucucaggguguugccucuaaagaaucuaaagaauagacaugcuuugggcu

SEQ ID NO: 147493 - RNA, 64 nt, hsa
gcgggacccagucaaaccccauucaggucaugguagaaucuacuccuugguagucacuugucau

SEQ ID NO: 147494 - RNA, 64 nt, hsa
aaccagacauuuccaguugguuuuguaaguuuugagaaucuagauacuggguuuuauuuuuuga

SEQ ID NO: 147495 - RNA, 64 nt, hsa
uuugcauguacccacccaaaaugauuauuuuuguagaaucuaaguuaaacuuacuauuuauaau

SEQ ID NO: 147496 - RNA, 64 nt, hsa
uucaggcuaccuuuuauacuaaaccuugaaaacuagaaucuaaugucuaccccaaaaaaguagu

SEQ ID NO: 147497 - RNA, 64 nt, hsa
agcuauaaaggaggacuuuccaucugggagaggcagaaucuauauacugaagggcuaguggcac

SEQ ID NO: 147498 - RNA, 64 nt, hsa
uuuuucaauugaaaaguaauuaaauaacagauuuagaaucuagugagagccuccucucuggugg

SEQ ID NO: 147499 - RNA, 64 nt, hsa
cccuuugaauacccucacuuuccaggccuggcucagaaucuaaccuauuuauugacuguccuga

SEQ ID NO: 147500 - RNA, 64 nt, hsa
ucaucugggaaucauauacuccacucuagcucccagaaucuacagaccuggcuccucggaucug

SEQ ID NO: 147501 - RNA, 64 nt, hsa
aggagaguccauagaucagccguaacuggaacguagaaucuacgucugccucugaauggacuuc

SEQ ID NO: 147502 - RNA, 64 nt, hsa
uaccucugauagaggucagaaugagguccuggggagaaucuaagcccuccgauguguguuucua

SEQ ID NO: 147503 - RNA, 64 nt, hsa
gggagggagggcugugcauagggacauauucuuuagaaucuauuuuauuaacugaccuguuuug

SEQ ID NO: 147504 - RNA, 64 nt, hsa
ggaugguauuacaucagcuccauuguuugagccaagaaucuaagucaucccugacuccaguguc

SEQ ID NO: 147505 - RNA, 64 nt, hsa
auuuuaaagcugacuuuguugccuuaucuugaaaagaaucuagauaggugcuuuuaacuggggu

SEQ ID NO: 147506 - RNA, 64 nt, hsa
gcuccuaugagcuuggagcauggugaaccaucagagaaucuagaaccaaccaagcuaggaacau

SEQ ID NO: 147507 - RNA, 64 nt, hsa
agggggccaaggggauggacaggagaagucaugcagaaucuaagcaggaaugcagauagaacac

SEQ ID NO: 147508 - RNA, 64 nt, hsa
ugaggaauuaugacuacuaugcaagccgaguuccagaaucuauuaaaaaugcacuuguuccuua

SEQ ID NO: 147509 - RNA, 64 nt, hsa
aaauugcugugacuccagauacuuugcacugaagagaaucuaggguguuugauaucuguuucag

SEQ ID NO: 147510 - RNA, 64 nt, hsa
caguugauguaaccaccucauuuuuuacaaauacagaaucuauucuacucaggcuaugggccuc

SEQ ID NO: 147511 - RNA, 64 nt, hsa
uggaaguagaagguaaggaguuuaggaaaauacuagaaucuacucugcuuacauucuuguuuaa

SEQ ID NO: 147512 - RNA, 64 nt, hsa
cagcccgaguucugaauuaaaacaugccucccacagaaucuauuucugaugaauaugaaaggaa

SEQ ID NO: 147513 - RNA, 64 nt, hsa
ccaacgugccuaauuaauuauggaaaaauaauucagaaucuaaacaccacugaaaacuuauaaa

SEQ ID NO: 147514 - RNA, 64 nt, hsa
gucggauuaaugaacugcggaacaagagguugugagaaucuaagauggaaccuuucuuucuuuc

SEQ ID NO: 147515 - RNA, 53 nt, hsa
aagacagugaccuggagugaaacagaaucuacauaaccuaagcccauauacuc

SEQ ID NO: 147516 - RNA, 64 nt, hsa
uaaaugagauuacagcauaaugaagaagaaaacuagaaucuaacagguaugacacauucaguua

SEQ ID NO: 147517 - RNA, 64 nt, hsa
uagacaaugauguuacuaaaugcuucaaagcugaagaaucuaaaugucgucuuugacucaagua

SEQ ID NO: 147518 - RNA, 64 nt, hsa
acuuuguguccucacucugaugucuccuuccuucagaaucuaccaccccucccccaggcuggga

SEQ ID NO: 147519 - RNA, 64 nt, hsa
gaaaagagaauuacuuauauucaucuauuuucucagaaucuauucaguacccuauggaguacau

SEQ ID NO: 147520 - RNA, 64 nt, hsa
agguugauggaaggaauauuuuuauuaaccaaauagaaucuauuuacaaaaaugguucacguau

SEQ ID NO: 147521 - RNA, 64 nt, hsa
cucuuuugacuuuuuauugguacaacuguagggaagaaucuacaaccuggagcauuucagguuu

SEQ ID NO: 147522 - RNA, 64 nt, hsa
ucuuagugaucaguggucaguaaucuucaaagucagaaucuaucaccuugguaaauuauauaaa

SEQ ID NO: 147523 - RNA, 64 nt, hsa
gacuuaaaguuaugcuggcagauucgccaagagaagaaucuaacaaacggcaaagaacuuacug

SEQ ID NO: 147524 - RNA, 64 nt, hsa
cgcaaccuacucaucugacaaagggcuaauaaccagaaucuacaaugaacucaaacaaauuuac

SEQ ID NO: 147525 - RNA, 64 nt, hsa
agaauuauacuugaaaauacaguuggugcacuggagaaucuauuauuuaaaaccacucuguuca

SEQ ID NO: 147526 - RNA, 64 nt, hsa
cgccgugaccuauucacccuccacuucccgucucagaaucuaaacguggucaccuucgaguaga

SEQ ID NO: 147527 - RNA, 64 nt, hsa
uugauugcucucuuuugucuuggucgcugcuucuagaaucuaugcaggggauagcagugagguc

SEQ ID NO: 147528 - RNA, 64 nt, hsa
cauugcacagacugacuguaguuaauuuugucacagaaucuauggacugaaucuaaugcuucca

SEQ ID NO: 147529 - RNA, 61 nt, hsa
caggguaugaaacccagugaauaaggacuccagaaucuaaagccaguggcuugaggcuaca

SEQ ID NO: 147530 - RNA, 64 nt, hsa
cuguagaccauauagaaaaagauuauagaggaggagaaucuacugcuggcaauugggaaccgca

SEQ ID NO: 147531 - RNA, 64 nt, hsa
gaccccucuaagcaaacuacuaagcauuuaaaagagaaucuaauuuuuaaagguguagcaccuu

SEQ ID NO: 147532 - RNA, 64 nt, hsa
cauaccaguucaccauaugguucgcacuucuaugagaaucuaaugcugcugcugaucugacagg

SEQ ID NO: 147533 - RNA, 64 nt, hsa
gcuuagaguuuuggcaccaaugcuguagggcagcagaaucuauucucaguaaaauaacuuaugg

SEQ ID NO: 147534 - RNA, 64 nt, hsa
ccugcacgcguccuccucuaccuuggaagcaguuagaaucuaccaggcacagaugaggccgccc

SEQ ID NO: 147535 - RNA, 64 nt, hsa
gaacaaaugaaccagcaguaaguuucuaaaaaucagaaucuagauagaaguucugcaauaugaa

SEQ ID NO: 147536 - RNA, 64 nt, hsa
auuuccaccauuguagagaauuuccuuccuacugagaaucuaccucuauucccccugcccuagc

SEQ ID NO: 147537 - RNA, 64 nt, hsa
ccucauuccgugucagugaucagcaguagacugaagaaucuaccuuagauuugcuccauacuau

SEQ ID NO: 147538 - RNA, 64 nt, hsa
ccacugauuaauauuuaaugagggaagguaggggagaaucuagccauuuuauaaugccagaaau

SEQ ID NO: 147539 - RNA, 64 nt, hsa
uuggaauccuauuuaguuaauacuuuagcaucuuagaaucuaggcuugagaauuguucaggugu

SEQ ID NO: 147540 - RNA, 64 nt, hsa
uucuccuacuguucuguaaacuuauuaaugggugagaaucuaauuuuacucaucuugauggcuu

SEQ ID NO: 147541 - RNA, 64 nt, hsa
aagcucaguuuuuucaggcucauccuguucuuccagaaucuaucccuuuucuuacacugaagag

SEQ ID NO: 147542 - RNA, 64 nt, hsa
agaugguuucuagagaugguuucuacuggcugccagaaucuagagcaaagccauccccgcuccu

SEQ ID NO: 147543 - RNA, 64 nt, hsa
acauguuggugugaagacugggacgacacuggguagaaucuaguuuuuaauuauuauuaauaua

SEQ ID NO: 147544 - RNA, 64 nt, hsa
caagcccaaauuuaauuugcaaccaucagaauucagaaucuauagugaccagugaucaaggcua

SEQ ID NO: 147545 - RNA, 64 nt, hsa
cucuccucguuucucucuuacuccucauccucccagaaucuaccaguuuaugguagaaagaugg

SEQ ID NO: 147546 - RNA, 64 nt, hsa
uagacccuagaaaauugucucguuuauuuuaaauagaaucuaugcuuccaccaauaaaccaucg

SEQ ID NO: 147547 - RNA, 61 nt, hsa
aucccuuccauuuuguuuaaauugggcuuggagaaucuauucugaaaacauugacucuaga

SEQ ID NO: 147548 - RNA, 64 nt, hsa
acuugucaucuaaacuuaugagaccuugucuuagagaaucuaaaauauauugucauauguuuuc

SEQ ID NO: 147549 - RNA, 64 nt, hsa
uaaagucagcacucaacuuggacauguugaaauuagaaucuauucuuguauuugauagacaaaa

SEQ ID NO: 147550 - RNA, 64 nt, hsa
auguuugcaacgaauccagcucacuugcuaaauaagaaucuaugacauuaaauguaguagaugc

SEQ ID NO: 147551 - RNA, 64 nt, hsa
caacucacucaggcaucuucuuucucuaaauaccagaaucuaguauguaauuguuuucaacacu

SEQ ID NO: 147552 - RNA, 64 nt, hsa
aguuauaucugaaauagucaaaucuuugggaaacagaaucuaguaacaauuugaaaaguaauac

SEQ ID NO: 147553 - RNA, 64 nt, hsa
ggaguguugaugcuuucgucuccagccccuucucagaaucuacccaaaggauacuguaacacuu

SEQ ID NO: 147554 - RNA, 64 nt, hsa
acuaggguuuuauaaguugauuaaacaucaaaucagaaucuagccaagcaggaauuauauugaa

SEQ ID NO: 147555 - RNA, 64 nt, hsa
uuuagagauauguucacuuguaaauaaaaagguuagaaucuaaggacaaagaaugauccaaaaa

SEQ ID NO: 147556 - RNA, 64 nt, hsa
ugaaauaguauagauuaaaaacacucaguagaaaagaaucuaaaauuaaaugaauuuguuuugc

SEQ ID NO: 147557 - RNA, 64 nt, hsa
cuuuucucugugcuucaauuaauaaaaaauggaaagaaucuaauagagugguacagcacuguua

SEQ ID NO: 147558 - RNA, 64 nt, hsa
aagaaugagauacugauguccacaguucauuggcagaaucuaaccccuucuguuaucuuuuuua

SEQ ID NO: 147559 - RNA, 64 nt, hsa
gucuuaauuugagaacaccaaaggaaacuaccccagaaucuaauguaguucgcuauuaauaaca

SEQ ID NO: 147560 - RNA, 64 nt, hsa
aaacagccuucaacaaguauuugugaagugacugagaaucuagcacuucuccacuuguagcugc

SEQ ID NO: 147561 - RNA, 64 nt, hsa
uguuucuggaauugugcuuauuuuuauuucuuuaagaaucuauuuccuuuccagucauuucaau

SEQ ID NO: 147562 - RNA, 64 nt, hsa
uauugcuguaauguguuaagcauuauaugcuaguagaaucuaguuuaauuguuucagguggaaa

SEQ ID NO: 147563 - RNA, 64 nt, hsa
uucccagcauugugggugcuacuugcaaggccauagaaucuagauggcccugucuugacccuga

SEQ ID NO: 147564 - RNA, 64 nt, hsa
agaaccaguguuacuguuuguaucagggaaguggagaaucuaaguguaaaaaagaaauaacuaa

SEQ ID NO: 147565 - RNA, 64 nt, hsa
auaucacagcucacaguuucugaaaauguauaaaagaaucuauaaucuaguacugaaauuacua

SEQ ID NO: 147566 - RNA, 64 nt, hsa
uguuuuaugcaccuucuuuaccugaaacuuacuaagaaucuaccaguaaacaaacauccugucu

SEQ ID NO: 147567 - RNA, 64 nt, hsa
gcacccugaaauggacuaaggccagcuuucauuaagaaucuaaguucuucuaagugggccuuua

SEQ ID NO: 147568 - RNA, 64 nt, hsa
agugacggaaagcagcacgcauaucuuugcgggaagaaucuagagucgcccugggauagaucca

SEQ ID NO: 147569 - RNA, 64 nt, hsa
aucaauuguuuugcaaagaaguuauggccuacuuagaaucuaaaauuuguuauucaaauuaaau

SEQ ID NO: 147570 - RNA, 64 nt, hsa
aaagaccuaaauaugaagacaaaacuuuuaaaugagaaucuauaagguuauuuucaugauuuug

SEQ ID NO: 147571 - RNA, 64 nt, hsa
ccaaaacagauuuuagacuuaccuugaacggauaagaaucuauaguucacugacacaguaaaau

SEQ ID NO: 147572 - RNA, 64 nt, hsa
aaauguaugugaggcguauguggcaaaauguuacagaaucuaacugguggacauggcuguucau

SEQ ID NO: 147573 - RNA, 64 nt, hsa; identical to SEQ ID NO: 147572

SEQ ID NO: 147574 - RNA, 64 nt, hsa
uguuacagcuacuauaaauauacauauaaauuauagaaucuacuuuaauuuauuuugugaacac

SEQ ID NO: 147575 - RNA, 64 nt, hsa
gcugauaaggaccauccaaaauucaaggaaauucagaaucuaauuaaggcgagugcuccagagu

SEQ ID NO: 147576 - RNA, 64 nt, hsa
cuauagaaagaagucaaaagaugaggccccuucuagaaucuaggauaacaagaguguugacagu

SEQ ID NO: 147577 - RNA, 64 nt, hsa
aggugcaguauuuuuuaaauuauuauuuauagaaagaaucuauaaauucuuggggaaguguguu

SEQ ID NO: 147578 - RNA, 64 nt, hsa
augugcaguucccaauggagugugcacuccuaugagaaucuaaugccacuacugaucuaacaag

SEQ ID NO: 147579 - RNA, 64 nt, hsa
gaugugcuuaacguaagguuaguaaagcauacaaagaaucuagugugcucagggcuugguacaa

SEQ ID NO: 147580 - RNA, 64 nt, hsa
ucugugugauuguaaucacauggugacaacacucagaaucuaaauuggacuucuguuguauucu

SEQ ID NO: 147581 - RNA, 64 nt, hsa
uucugagcccuuccucuugacuaccaggaucaccagaaucuaauaaguuagccauucucuauug

SEQ ID NO: 147582 - RNA, 64 nt, hsa
auucaguuuuggagcaaguccugugagcaagauaagaaucuauagaaccaagaugcucauuuuc

SEQ ID NO: 147583 - RNA, 64 nt, hsa
auauguaaaaugggaaaguuaggcuugaugacccagaaucuaggauucucucccuggcugacag

SEQ ID NO: 147584 - RNA, 64 nt, hsa
uguuuguuuuccucauuucuuccuucuagaacacagaaucuaaagggguauuagccagccucgc

SEQ ID NO: 147585 - RNA, 64 nt, hsa
auauuucauugcuaguuaaaaaauaaaaccuuugagaaucuaagauguacauuuuuaccuuuua

SEQ ID NO: 147586 - RNA, 64 nt, hsa
guucuuuggacacucaggccuaacuaguuaucaaagaaucuauuuuagaaaccuugaguuuccu

SEQ ID NO: 147587 - RNA, 64 nt, hsa
uaaaaggcagaaaggucaucacaacuuuagugucagaaucuauagugguggcaaaguuaggaua

SEQ ID NO: 147588 - RNA, 64 nt, hsa
gccuguuggugguguucuugucuuaacccuagauagaaucuaaugaacucagaggcuuagcucg

SEQ ID NO: 147589 - RNA, 64 nt, hsa
aauaugaacuguauuuuaaauuuguuaggucugaagaaucuaaaacuguuaauuuaacccuuaa

SEQ ID NO: 147590 - RNA, 61 nt, hsa
aaacagaaaagacagacuagcuacaucaaacagaaucuauuuccagagagucuugcugcug

SEQ ID NO: 147591 - RNA, 64 nt, hsa
guagauacuucuuaacuggaaauucuuucuuuucagaaucuagguggugaauuuuuuuuaagug

SEQ ID NO: 147592 - RNA, 64 nt, hsa
uuaauggacuuauucucaggguccuacucuaagaagaaucuaauaggaugcugguuguguauua

SEQ ID NO: 147593 - RNA, 64 nt, hsa
caugacuguccuucagucacaauuccagaauaaaagaaucuacuuuguguauuaauguuuuaug

SEQ ID NO: 147594 - RNA, 64 nt, hsa
aucuuauuauaaagaacuauuuguaguaacuaucagaaucuacauucuaaaacagaaauuguau

SEQ ID NO: 147595 - RNA, 64 nt, hsa
gugagauuagucauaucacuaauauacuaacaacagaaucuaaucuucauuuaaggcacuguag

SEQ ID NO: 147596 - RNA, 64 nt, hsa
ccuuuguuuucugucuagcuccauaugguaucagagaaucuacaagaagaacagguucacagaa

SEQ ID NO: 147597 - RNA, 64 nt, hsa
caaacgauauucugauuuugcacauuauuauagaagaaucuauaauccuugauauguuucuaac

SEQ ID NO: 147598 - RNA, 64 nt, hsa
ucagguucuucucacagguaaaucuuucagccacagaaucuaacuggugagcuucagaaccaau

SEQ ID NO: 147599 - RNA, 64 nt, hsa
ugcaaacucugcaucugaugaagguccaauauccagaaucuacaaggaacuuaaacaauucaac

SEQ ID NO: 147600 - RNA, 64 nt, hsa
uuaaaagcaguccaguaaaagguuaacuguauaaagaaucuaugacuuuuugagggaaguguga

SEQ ID NO: 147601 - RNA, 64 nt, hsa
accuguucugcagugagagauuuaauugugggugagaaucuauguacauauaauauguaugaga

SEQ ID NO: 147602 - RNA, 64 nt, hsa
gaaaagcucugcugcucuuagcucuaaauaauucagaaucuauucucuucucuccagucccguu

SEQ ID NO: 147603 - RNA, 64 nt, hsa
ggugcauguguuugguaucuucaacaguagaccaagaaucuaacaucacucucaguaauauaga

SEQ ID NO: 147604 - RNA, 64 nt, hsa
uaaaucuaauaguacuuguaauuucuuucugcuuagaaucuaaagauguguuuagaaccucuug

SEQ ID NO: 147605 - RNA, 64 nt, hsa
aauggauugaaagagugaaagucacuggucucaaagaaucuacggaauuuagcauuuugaaaau

SEQ ID NO: 147606 - RNA, 64 nt, hsa
ugggccuuuuuccaguaaggaaugauauugcugaagaaucuacuuaacccugacaaauuuuaau

SEQ ID NO: 147607 - RNA, 64 nt, hsa
cgagacauagaauaguauucugaucaguugccaaagaaucuaggaaauuaguuguauuuugugc

SEQ ID NO: 147608 - RNA, 64 nt, hsa
uggcaaauauuuuaaaauauuugaaaaacacuccagaaucuaguacgcuuuauuuuuagacuga

SEQ ID NO: 147609 - RNA, 64 nt, hsa
ggaaggauguguuuuuuucucucacuauaguauaagaaucuauuuuggagaaaaaaagaaaaua

SEQ ID NO: 147610 - RNA, 64 nt, hsa
cccuguuguguggacuuugagcacacuuuacacaagaaucuagaaaaucagaucgcgauuaaga

SEQ ID NO: 147611 - RNA, 64 nt, hsa
gggaauauggauaagcauaguaacaaaacccaccagaaucuaagcaguuuucacccccucagaa

SEQ ID NO: 147612 - RNA, 64 nt, hsa
uuaaccagcauuuuucaacccugggaaaauuugcagaaucuaaguugauuguaaugauuuugag

SEQ ID NO: 147613 - RNA, 64 nt, hsa
accauacugcuuucaaaagucuuuucucaucaguagaaucuauuuuggucacuucuagucaaug

SEQ ID NO: 147614 - RNA, 64 nt, hsa
uaaauuauauuaguaaaagucuuaacuggaaaaaagaaucuaaaucagaauagugaucaauuug

SEQ ID NO: 147615 - RNA, 64 nt, hsa
gaaauucuauuugagccacccuuccgcacuggggagaaucuaugcaagccucgucaacaccacu

SEQ ID NO: 147616 - RNA, 64 nt, hsa
ugguaauauggcaagccuuguuccuuucugcaugagaaucuaggagagaauucauaaccacacc

SEQ ID NO: 147617 - RNA, 64 nt, hsa
cccaccuuuccagauacccacaaagcccccagacagaaucuagcaucgggacuauuagcaaugg

SEQ ID NO: 147618 - RNA, 64 nt, hsa
aaauaaaucaaucuaugcuguucuguccuucuugagaaucuaaaacauaccacaaaaauacauc

SEQ ID NO: 147619 - RNA, 64 nt, hsa
ugguugcugauguuuauaaacugagaggucacaaagaaucuaucacuaaaaauuuuuacaaaac

SEQ ID NO: 147620 - RNA, 64 nt, hsa
ucaaacuaaugagaggacaagaagacacaguuuuagaaucuacugcugcuaaagcacauuaaaa

SEQ ID NO: 147621 - RNA, 64 nt, hsa
acaacguguaugcaaauuguuauggauacauuucagaaucuaagaaaucaggcaagugcuuaaa

SEQ ID NO: 147622 - RNA, 64 nt, hsa
cugauggaauucauauaucugucucucuccugcaagaaucuaccugagaccaugccacuagcuu

SEQ ID NO: 147623 - RNA, 64 nt, hsa
auugcucaacaagaacgauucaccuggguuugcaagaaucuaaaccucucuaggggaagcccac

SEQ ID NO: 147624 - RNA, 64 nt, hsa
aaaaaaauaaaaauaaaaauaaaacacuuuaauuagaaucuauuuuuaccuauuuucuaaauuu

SEQ ID NO: 147625 - RNA, 64 nt, hsa
gggaguagagggagagggcagguggaacuggggcagaaucuagucaugcccuaaagcuaguccu

SEQ ID NO: 147626 - RNA, 64 nt, hsa
gagggauuuuaaaguaaagauguauuuauucugaagaaucuaaaagauaacagauuauuugcuu

SEQ ID NO: 147627 - RNA, 64 nt, hsa
aauaaguaaucuaaaaauccuuuuuguauuugagagaaucuacuaaguucaguccagucaagaa

SEQ ID NO: 147628 - RNA, 64 nt, hsa
uauauauauauugugaaagaucaauccaucugccagaaucuagugggauggaaguuuuugcuac

SEQ ID NO: 147629 - RNA, 64 nt, hsa
ggagucugcagauagaaagcauuacauuguuuaaagaaucuacuauacuuugguuggcagcauu

SEQ ID NO: 147630 - RNA, 64 nt, hsa
acaaacuacucuauuuuaaauaaggaaagaauggagaaucuagacauuuuacagguguaucuga

SEQ ID NO: 147631 - RNA, 64 nt, hsa
aauauagaaacacgaacuuuagcugcauccuccaagaaucuaucugcuuaugcaguuuuucaga

SEQ ID NO: 147632 - RNA, 64 nt, hsa
gagaguauuuuuuucuucguguaacuguaaauccagaaucuauccugcaucgcagcccaccgug

SEQ ID NO: 147633 - RNA, 64 nt, hsa
acuguguuguucaugguggcuuuuuggacaauaaagaaucuaaaauggguggggaggguggaag

SEQ ID NO: 147634 - RNA, 64 nt, hsa
gaucuccacagggccaggguugcuacuugcacccagaaucuagugauuuuagucagauccaugg

SEQ ID NO: 147635 - RNA, 64 nt, hsa
ccacugccuucuagccguccuccaccuugcagaaagaaucuagccuuuggucucucucucucuc

SEQ ID NO: 147636 - RNA, 64 nt, hsa
aucauuccucaagucuuacugauuuuuaucagcuagaaucuaucuccuuauuucuaccucuauu

SEQ ID NO: 147637 - RNA, 64 nt, hsa
caauuaaggcaucaucaguccuaccugagcaacaagaaucuaaacuuuauuccaagucagaaac

SEQ ID NO: 147638 - RNA, 64 nt, hsa
gagaccagugggcgccauuuaaaagaacaggaugagaaucuaagauauauuauuaauaaaugua

SEQ ID NO: 147639 - RNA, 64 nt, hsa
uuugcacaguauuauuuuacagaaaaggaaucagagaaucuacaacauagggccccagaacaac

SEQ ID NO: 147640 - RNA, 64 nt, hsa
uacaggcaugagccacugugcccagcugggauauagaaucuaagaguugauuguggaaaacacg

SEQ ID NO: 147641 - RNA, 64 nt, hsa
gcucccuccuucccugucugggagguuggagggaagaaucuaggccuuagcuugcccuccugcc

SEQ ID NO: 147642 - RNA, 64 nt, hsa
accuguucugcagugagagauuuaauugugggugagaaucuauguacauauguaugagaagacu

SEQ ID NO: 147643 - RNA, 64 nt, hsa
uguagacccaguuuugaaaccaaaaaagaaaccuagaaucuaaugcagaagagaucuuuuaaaa

SEQ ID NO: 147644 - RNA, 64 nt, hsa
cagucuugccuuacacaaaggggaucauaaaguuagaaucuauuuucuauguacuaguacugug

SEQ ID NO: 147645 - RNA, 64 nt, hsa
uuuuaagcaaauggguaauaguagaaaauagguuagaaucuauggcuugauuaaaaauauguua

SEQ ID NO: 147646 - RNA, 64 nt, hsa
uuguaucugaucccugcuuggaguuuuaguuuaaagaaucuauauguagcaaggaaaaggugcu

SEQ ID NO: 147647 - RNA, 64 nt, hsa
gcauuaacagaaugcuuuaaaaacuucuaagacaagaaucuauagcauuaguauacacuggcac

SEQ ID NO: 147648 - RNA, 61 nt, hsa
ucaucuucccagcaucuugacaguuuccagaagaaucuaugggauuuuccccccacugguc

SEQ ID NO: 147649 - RNA, 64 nt, hsa
cucuuagguguacucuuuauaagcugguaaaccaagaaucuagggaguggccaaacuaaauaua

SEQ ID NO: 147650 - RNA, 64 nt, hsa
ggcaggcucguuuuaccucauucuagaauauuuaagaaucuaaaaauaaagggcaacucugacu

SEQ ID NO: 147651 - RNA, 64 nt, hsa
gcuaauucuuuugcuuucuguaaaugucuacuaaagaaucuagacuuuucucuauggucuacag

SEQ ID NO: 147652 - RNA, 64 nt, hsa
acaaagaauuuguacuuaauggcauggacucuggagaaucuaugcgaaucaaccuuucuaccuu

SEQ ID NO: 147653 - RNA, 64 nt, hsa
caagagccagcacugcuggccuuggugucaugccagaaucuaccaggacugagggagccagagg

SEQ ID NO: 147654 - RNA, 64 nt, hsa
uugaccuuuucagccauauauuguacagccuuauagaaucuaagcuggucuuaaagucauaaau

SEQ ID NO: 147655 - RNA, 64 nt, hsa
ucuaguauaaaacguucccacaaugcacaaauuaagaaucuauauaagcuauaaaaauacucau

SEQ ID NO: 147656 - RNA, 58 nt, hsa
cagaaagaaaccuuuuguagcaauaucaagaaucuaguuucaucugagaacuucugau

SEQ ID NO: 147657 - RNA, 64 nt, hsa
ccauccccggaagggugcuuauucuuuaacaaagagaaucuaaaaaaaaaaacaaaaaacuguu

SEQ ID NO: 147658 - RNA, 64 nt, hsa
agacuuuuucuuggacgaauucagguagcuacacagaaucuacacagcaaaguuaaccugacac

SEQ ID NO: 147659 - RNA, 64 nt, hsa
caacucauauccacguuaucuagcaaaguacauaagaaucuaucacuaaguaauguauccuuca

SEQ ID NO: 147660 - RNA, 64 nt, hsa
ugcauuagaaaaaaaagagauauauacaccacaaagaaucuaauaagaaauuuauuauggagau

SEQ ID NO: 147661 - RNA, 64 nt, hsa
ugucugaaauguuuauuuugcaaaacagugcaauagaaucuaguuaugccuucaucacuguuga

SEQ ID NO: 147662 - RNA, 64 nt, hsa
gccacuuugcucgcaggggugaggggaaggauagagaaucuauuuuuaauaaauaacauucuag

SEQ ID NO: 147663 - RNA, 64 nt, hsa
cuuaagaauuuugagagggugaggaggguuguucagaaucuaaauuacagauagaugauuguuu

SEQ ID NO: 147664 - RNA, 64 nt, hsa
ugggaaucagaacucuuuaugcaacuugguuaauagaaucuacuaucuggaagauaaaugaagg

SEQ ID NO: 147665 - RNA, 64 nt, hsa
aucaacagcaaucugaagacucugacuaacaugcagaaucuacccaauaccacacugcccccau

SEQ ID NO: 147666 - RNA, 64 nt, hsa
ccagccuuuuaacaacaucuuuugggguacaauuagaaucuaaguguuugcagccauauguguc

SEQ ID NO: 147667 - RNA, 64 nt, hsa
auauacucauguaacaagccugcacauguaccccagaaucuaaaauaaaaauaaaaagaaaaac

SEQ ID NO: 147668 - RNA, 64 nt, hsa
ccguuaaaaaaucaaacaaaaggaccccaaauuaagaaucuaggaagcucagaaacgaaaucua

SEQ ID NO: 147669 - RNA, 64 nt, hsa
caaccugaaagagaaaaggcugcuugaugucagcagaaucuaaaccccuacauuaaagcuuugc

SEQ ID NO: 147670 - RNA, 64 nt, hsa
agaucuaauacuaguuuggauaucuuuaggguuuagaaucuaaccucaagaauaagaaauacaa

SEQ ID NO: 147671 - RNA, 64 nt, hsa
gaaacaaccccucauccaaaucauggguuaguuaagaaucuaacuggggcaauuaagaugaauu

SEQ ID NO: 147672 - RNA, 64 nt, hsa
accuggauuucagcuuugcaugauccucaguaugagaaucuaucuguucugugcuggacuucua

SEQ ID NO: 147673 - RNA, 64 nt, hsa
uccacacccagcuaaaguuagaggagauacauauagaaucuauuuuagauuauuguuaacuauu

SEQ ID NO: 147674 - RNA, 64 nt, hsa
uucuguucuagcuggcuacugcuucacuggauugagaaucuaucuaucuccuugcacacauggg

SEQ ID NO: 147675 - RNA, 64 nt, hsa
ugcgggaagacggaucccaccucccuuucuuagcagaaucuaaauuacagccagaccucuggcu

SEQ ID NO: 147676 - RNA, 64 nt, hsa
acccacccugcaccccucgcccuccccccaccacagaaucuaagaccuuucagcuucgagccag

SEQ ID NO: 147677 - RNA, 64 nt, hsa
uugcuucuuugaugugauaguuuugagaugggugagaaucuaauagaucugugguugaauuugc

SEQ ID NO: 147678 - RNA, 64 nt, hsa
ugguugugcucuuuucuggccaaugauuuacaaaagaaucuacuugacucugucccuggaguga

SEQ ID NO: 147679 - RNA, 64 nt, hsa
gcaaugaugacccacuaaagagugaaugccauuuagaaucuagaaauguucacaagguacccca

SEQ ID NO: 147680 - RNA, 64 nt, hsa
ccuucauaaagaaugccacccaucugauuccucaagaaucuagaccuagaaauaccauuugacc

SEQ ID NO: 147681 - RNA, 64 nt, hsa
gcaugcaagggaucuaggcuaugcgcuccuuaugagaaucuaaugcuugaugaccugaggugua

SEQ ID NO: 147682 - RNA, 64 nt, hsa
cugccacugucagauagccuuggucaugcuuccuagaaucuacuuguccaaguucuccucuccc

SEQ ID NO: 147683 - RNA, 64 nt, hsa
guggucacacagagguagcaugugcccuaguuacagaaucuauuaaggggaugacugucucaaa

SEQ ID NO: 147684 - RNA, 64 nt, hsa
ggaacuuuauuccaaaaguagugcauguggagaaagaaucuagacuuucuuguauacauuuuuc

SEQ ID NO: 147685 - RNA, 64 nt, hsa
ugguguauagaugagaaugcaauuaaaccugaugagaaucuacuugagaauauagaaagucuuu

SEQ ID NO: 147686 - RNA, 64 nt, hsa
uuauuuuuuagguuaacugagcugcuuugugcucagaaucuacauuccagauugaggauuuagu

SEQ ID NO: 147687 - RNA, 64 nt, hsa
ggucauuaggguguauuucccagguuuccaauugagaaucuaaaccaagagaagugagacaaac

SEQ ID NO: 147688 - RNA, 64 nt, hsa
auuuggcacaagucagagauaauugccuauacuaagaaucuauacugcagaauauaguguauca

SEQ ID NO: 147689 - RNA, 64 nt, hsa
gaaauccacauucuuacacaagaaagaccauauuagaaucuaaggaaaacaugcauauucacau

SEQ ID NO: 147690 - RNA, 64 nt, hsa
auuuuccucccuuucucuguaccucuaagaagaaagaaucuaacugaaaauaccaaaaaaaaaa

SEQ ID NO: 147691 - RNA, 64 nt, hsa
auguuguuuucugacuaggcugaucauuaucuaaagaaucuaauucuguugauuuuuaaaacuu

SEQ ID NO: 147692 - RNA, 64 nt, hsa
uguugaaauacauuuuuucuuuugaccaauugacagaaucuaauaagcuuuaauaaucuucccc

SEQ ID NO: 147693 - RNA, 64 nt, hsa
uaauaaaguuuugaaaaguuacacguaaaguagaagaaucuagugcgugggacaguaaaggauc

SEQ ID NO: 147694 - RNA, 64 nt, hsa
aucuagggugacauuccuugaaguaaaucccaggagaaucuaggccaaagagaugagccaaggu

SEQ ID NO: 147695 - RNA, 64 nt, hsa
gcccuuuuuuccuuuguccaaaaugauucuaaauagaaucuaauaaaccaauguagcauuauuu

SEQ ID NO: 147696 - RNA, 64 nt, hsa
uauaaucugaaaggggcagauuaaaaaaaaaaaaagaaucuaaaccuuacauguguaaagguuu

SEQ ID NO: 147697 - RNA, 64 nt, hsa
ccccggaaacucacaggggcccucuucccagaaaagaaucuauucuaucacuucagaaucagga

SEQ ID NO: 147698 - RNA, 64 nt, hsa
cauucucugggcaaaauaauauuaaauggauuaaagaaucuaaaaccagugggaaaacugucug

SEQ ID NO: 147699 - RNA, 64 nt, hsa
cucauuuuccuucugaaagaaacuacuaccuaggagaaucuaagcuauagcagggaugauuuau

SEQ ID NO: 147700 - RNA, 64 nt, hsa
aucucuggcaacagagaggcaaaguaucugaacaagaaucuauauuccaagcacauuuacugaa

SEQ ID NO: 147701 - RNA, 64 nt, hsa
auggguugugcaagcauuaaaaugcaggucuuucagaaucuagaacuaggcauaaccuuacaua

SEQ ID NO: 147702 - RNA, 64 nt, hsa
agcuuguaauagcaaaauuguaaauuacaagggaagaaucuacuuuuuagaaaucgcuuuguuu

SEQ ID NO: 147703 - RNA, 64 nt, hsa
gaauaguugcaguguuuauaggauaguugugguaagaaucuaguuuauuuugcauuuggcuaau

SEQ ID NO: 147704 - RNA, 64 nt, hsa
cuauucaaauugguuucauucuuaguaaaaguacagaaucuauuugaaauuauaguaaaauuuc

SEQ ID NO: 147705 - RNA, 64 nt, hsa
acuugaaucauuucugaauaaguaaaucuaaauaagaaucuauuuuaauuccuuauuucuucau

SEQ ID NO: 147706 - RNA, 64 nt, hsa
guuugugucuuuguagcaguauuuuuauuagaaaagaaucuauuggccuuuuacaggguauuaa

SEQ ID NO: 147707 - RNA, 64 nt, hsa
gucugguccaucaaauuacaacagccaagauuacagaaucuauauagucuaaugcugacaacuu

SEQ ID NO: 147708 - RNA, 64 nt, hsa
ucuuaaaauauccacaauauuccuugagugagucagaaucuauagccgguuagugaugguuuca

SEQ ID NO: 147709 - RNA, 64 nt, hsa
aauuugggcagcuaaugaaugucaugaaagcuguagaaucuacaucaccauccauugcuuuaau

SEQ ID NO: 147710 - RNA, 64 nt, hsa
agagcagugaaggugagguacuugcugccacagcagaaucuaaagaaagcauugaguccugggg

SEQ ID NO: 147711 - RNA, 64 nt, hsa
augggggucucucuucagacucuucucguuucugagaaucuagucuacuguugguugagcuucu

SEQ ID NO: 147712 - RNA, 64 nt, hsa
ucauauuuuauauuccuaauaacagugaugacugagaaucuauuugaguuuccagcuggcagaa

SEQ ID NO: 147713 - RNA, 64 nt, hsa
aggguauaguaucacuccugaguuccacugcucuagaaucuaaccagaaauagaaaccuaguuu

SEQ ID NO: 147714 - RNA, 64 nt, hsa
gaagcuccuuuagauugggauagauuccaaauaaagaaucuagaaauaggagaagauuuaauua

SEQ ID NO: 147715 - RNA, 64 nt, hsa
uugaaaacuugucuuagaaugcgaaucuguguuaagaaucuagucuuuguaauagaaguuuccc

SEQ ID NO: 147716 - RNA, 64 nt, hsa
uuaucucaggaaaggaaaauaugcaugguuggugagaaucuaauaacauuaaaaugcuggggca

SEQ ID NO: 147717 - RNA, 64 nt, hsa
aauuuggccuuaagaacugugucuggcguucucaagaaucuagaagauguguaaacagguauuu

SEQ ID NO: 147718 - RNA, 64 nt, hsa
guggaggcuggcagguuuuucugcaagaugguccagaaucuaaaaugucccauuaaucugguca

SEQ ID NO: 147719 - RNA, 64 nt, hsa
uagagcuauucugcacaguuaacuacugaucuuuagaaucuaaaauuguauaugaacuuauucu

SEQ ID NO: 147720 - RNA, 64 nt, hsa
ccauuccuaaagauuugggguuuucuaaaacuaaagaaucuaggaaccuugccugcgaccaauc

SEQ ID NO: 147721 - RNA, 64 nt, hsa
cugaggcugggcuauugcuucucccuugcuucaaagaaucuagcagcgggggauaggauuuugc

SEQ ID NO: 147722 - RNA, 64 nt, hsa
cucucucuuuuuuuuuuuuuuacuuaaucuagcuagaaucuauuucuguugauuacaacuuaac

SEQ ID NO: 147723 - RNA, 64 nt, hsa
cuucugggacugcugugaggcagaggaaugauggagaaucuaguguagcagccuccaggcagga

SEQ ID NO: 147724 - RNA, 64 nt, hsa
gugacaauagggcuaaauguuuaaagaaaucaaaagaaucuauuagauuuuagaaaaacauuua

SEQ ID NO: 147725 - RNA, 64 nt, hsa
uugccagggccuguggaggucuaggccgccuggcagaaucuagcaccguccgaauccccgcagg

SEQ ID NO: 147726 - RNA, 64 nt, hsa
ucuuguacauacuguaacauacagaguauagugaagaaucuauuuaaggcgccgcggggagggc

SEQ ID NO: 147727 - RNA, 64 nt, hsa
uggcuucgguuacauauuggacuuuaacaacugaagaaucuaugcgugucauuuaaagaaaagu

SEQ ID NO: 147728 - RNA, 64 nt, hsa
guaagagagaggccaguugugauaguggccaaggagaaucuagggcuguauuguuguccacugc

SEQ ID NO: 147729 - RNA, 64 nt, hsa
ccaccucuuuuagagaauuauccuuugaugcugcagaaucuacucuuacaaugccuuccuacag

SEQ ID NO: 147730 - RNA, 64 nt, hsa
cuggccuuugguguugaaauaggaagguuuaaggagaaucuaagcauuuuagacuuuuuuuuau

SEQ ID NO: 147731 - RNA, 64 nt, hsa
ccagaacaaggaagucacuuuucaguggauccaaagaaucuacuccuuaaaccuggagaagaac

SEQ ID NO: 147732 - RNA, 64 nt, hsa
aucauauucaaaaaaggcagcauucaaauuauauagaaucuaguuuuuaaaaucagcacagauc

SEQ ID NO: 147733 - RNA, 64 nt, hsa
aagaguuucuuagguucuaugugaauaagauggcagaaucuaaaucaaguauuuugaaggaagc

SEQ ID NO: 147734 - RNA, 64 nt, hsa
ugacaaguguagcaaaagccagccauauauuuucagaaucuauauccucaggaaaugguccuuu

SEQ ID NO: 147735 - RNA, 64 nt, hsa
cgcaaccuacucaucugacaaagggcuaauauccagaaucuacaaugaacucaaacaaauuuac

SEQ ID NO: 147736 - RNA, 64 nt, hsa
uauaaugagggacaugacaaaaucuguguccacuagaaucuaagcuccaugcaggaacauuguu

SEQ ID NO: 147737 - RNA, 64 nt, hsa
gcaggagauguaagcagaugaguuauuuuuuaagagaaucuaaucuaauuguuuuuauaaaaau

SEQ ID NO: 147738 - RNA, 64 nt, hsa
uguuuacaaacugcaucugacaaagaucuaauccagaaucuauaaagaacucaaacaaaucaac

SEQ ID NO: 147739 - RNA, 64 nt, hsa
auauauauacagauauauauauaugacgcgucacagaaucuaggguagcgcuuucucagauuuc

SEQ ID NO: 147740 - RNA, 64 nt, hsa
uccauuucugugugugucaaaggggacuaacagcagaaucuaccucccaacugccaugugauua

SEQ ID NO: 147741 - RNA, 64 nt, hsa
guuuuuguaucugaauuugcugucuugaacauaaagaaucuaucugcuguuggaccuguguggc

SEQ ID NO: 147742 - RNA, 64 nt, hsa
acagagaacagggcuugggccacuuuggagagacagaaucuaguccugggcaacuucacauccg

SEQ ID NO: 147743 - RNA, 64 nt, hsa
acuguucugggguagcagagucacagaucacucuagaaucuaauacuugguaauuauacugcau

SEQ ID NO: 147744 - RNA, 64 nt, hsa
uuauagaugugagccagcacaccgggccaagugaagaaucuaaugaaugugcaaccuaauugua

SEQ ID NO: 147745 - RNA, 64 nt, hsa
cuuugcuucacguucacacgucauuagacaucagagaaucuauacuggacagaaaucuuacaaa

SEQ ID NO: 147746 - RNA, 64 nt, hsa
cuucaguaacgcuacaaccauugcaaaucauuggagaaucuauaaugaauaaagaucuaacaag

SEQ ID NO: 147747 - RNA, 64 nt, hsa
ucaaggaagaacaagauauauacuucaucucaaaagaaucuacucacacacacuuauuaauuac

SEQ ID NO: 147748 - RNA, 64 nt, hsa
uagauguuuaugugcuuuuuguauccuaacuuuuagaaucuaaauaaaaucagagguaauguau

SEQ ID NO: 147749 - RNA, 64 nt, hsa
cuauggaagaacuagaaucucacucacaguaauaagaaucuaggaggaauuccaaaccgaagca

SEQ ID NO: 147750 - RNA, 64 nt, hsa
cagugccacgagggaggaggggaccugcaaagcuagaaucuagggcacuguuuccuccccaucc

SEQ ID NO: 147751 - RNA, 64 nt, hsa
aaagaacagccugagccaaggccuagugguaguaagaaucuagcaagaauugaggaagaauggu

SEQ ID NO: 147752 - RNA, 64 nt, hsa
agaccuacugagugagaaucuugaggguggaaucagaaucuauuuugaaaaggcauccccaaau

SEQ ID NO: 147753 - RNA, 64 nt, hsa
acauccgguuguguccugugggagggucagaggcagaaucuacuuacagugguguaauuaaagu

SEQ ID NO: 147754 - RNA, 64 nt, hsa
cauauuuuuaaguauuauucacauuuuuuguuacagaaucuauuggaucuuuggcuggaaaacu

SEQ ID NO: 147755 - RNA, 64 nt, hsa
gcagaauccuaggcuccaccccauccaguucaugagaaucuauauuuaacaagaucugcagggg

SEQ ID NO: 147756 - RNA, 64 nt, hsa
uguauuuguuguagaaauggaccagugaauaaagagaaucuaaggauuuguacaaugugaaaua

SEQ ID NO: 147757 - RNA, 64 nt, hsa
acugggauuggaucacuucuuaaacuuccaguuaagaaucuagguccgcccucaagcccauacu

SEQ ID NO: 147758 - RNA, 64 nt, hsa
aacuuggucaaacuaguuagcaaauuagaacuucagaaucuaaugauaguuuaggguuucuaaa

SEQ ID NO: 147759 - RNA, 64 nt, hsa
cacaccccugugugauaugugaugcccucggcaaagaaucuacuggaauagauuccgaggagca

SEQ ID NO: 147760 - RNA, 64 nt, hsa
caggauuucauuuugcccugucuucacauuucccagaaucuagaagaauaaaugccaagaggga

SEQ ID NO: 147761 - RNA, 64 nt, hsa
gugccucuccuauugacccuuacuuugaauucaaagaaucuauuuaagaguuuaauauaugagg

SEQ ID NO: 147762 - RNA, 64 nt, hsa
uuuuuuuuuuaagaaaaaaaagagaaaugaauaaagaaucuacucuuggcuggcucuccggagu

SEQ ID NO: 147763 - RNA, 64 nt, hsa
cagugucuaucuguauauauuauuugauauucagagaaucuaaagcacucgucuacuguuuuaa

SEQ ID NO: 147764 - RNA, 64 nt, hsa
acagacuucuggccuaggaccccucgccuucaggagaaucuacacgcauguaugcaugcacaaa

SEQ ID NO: 147765 - RNA, 64 nt, hsa
guucuuuuuuuaaauuguagauuuauuuaguuucagaaucuaaguuuaugaauggcaugaauca

SEQ ID NO: 147766 - RNA, 64 nt, hsa
aacagaaugaguugguuuauggggaaaagagaagagaaucuaaaaaauaaacaaaucccuaaca

SEQ ID NO: 147767 - RNA, 64 nt, hsa
uccucacaguucuggagccuggaagucugagaucagaaucuagcaagguuaggucuuggugacg

SEQ ID NO: 147768 - RNA, 64 nt, hsa
cagugugacuuugccacuucacccaucaagagguagaaucuauuucuucaaccccugcaacuga

SEQ ID NO: 147769 - RNA, 64 nt, hsa
agugcacacaccacaguguaaauuaugccuuaucagaaucuaaaugaaaauagcgaacauuuaa

SEQ ID NO: 147770 - RNA, 64 nt, hsa
gaaauuaagauuuuaagcuugaaauuauacaagcagaaucuaauuuaauuuugauugacugaag

SEQ ID NO: 147771 - RNA, 64 nt, hsa
aaagaggggaagauaugggagcgaauuuauuccaagaaucuacaaugacauugaaguuguugga

SEQ ID NO: 147772 - RNA, 64 nt, hsa
cuuuuaucagagguaggauucuguuuuauaguauagaaucuacuuuauccuuccuuuuaauagu

SEQ ID NO: 147773 - RNA, 64 nt, hsa
aacuacaaacuggaauccaacuauaaaguguuuaagaaucuacacagaauauucaaauuauaga

SEQ ID NO: 147774 - RNA, 64 nt, hsa
uguuuaucugauuuuuuuauugcuccgcauacugagaaucuaggccaccccaaccucuguuccc

SEQ ID NO: 147775 - RNA, 64 nt, hsa
aaggaagcaguugccuuccggagggggcucugagagaaucuagccuccccucuguccuauugga

SEQ ID NO: 147776 - RNA, 64 nt, hsa
cuagaguaaaaccaaguugggccaaguguccugcagaaucuaaaaugaaguuuaaucagcgugc

SEQ ID NO: 147777 - RNA, 64 nt, hsa
uacacuuucucaaugaaugaacaaauuagucuguagaaucuagccaccuguuuagccuagucau

SEQ ID NO: 147778 - RNA, 64 nt, hsa
uaguaauugacaugugccagggcaaugaugaaugagaaucuacccccagauccaagcagccuga

SEQ ID NO: 147779 - RNA, 64 nt, hsa
gaacauaauucuuuuguugcuguuuguuuaagaagcaccuuaguuuguuuaagaagcaccuuau

SEQ ID NO: 147780 - RNA, 64 nt, hsa
guuuguuuaagaagcaccuuaguuuguuuaagaagcaccuuauauaguauaauauauauuuuuu

SEQ ID NO: 147781 - RNA, 64 nt, hsa
acagccuggcagcucgugccauugcagugcagaagggcaguaucggcaaccuccugggcuuccu

SEQ ID NO: 147782 - RNA, 64 nt, hsa
gguacgucugagcccaagaguucaagaucagccugggcaguauagcaagaccccaucuccauuu

SEQ ID NO: 147783 - RNA, 64 nt, hsa
ucccagugggaggcgcgagccaugauguggaguggggcaguagaaggucggaggcuugggaccg

SEQ ID NO: 147784 - RNA, 64 nt, hsa
gguuggaagaugcaaaguuuauaccugaugaucagggcaguaggcauaauucagcaacaaacaa

SEQ ID NO: 147785 - RNA, 64 nt, hsa
aagaccugucgucaaacuuaaaagguuuugcagagggcaguaucaaaagaaagugguuuucuuc

SEQ ID NO: 147786 - RNA, 64 nt, hsa
aauaugaagaaaaauacacagccaccucuguccagggcaguaagaagggcugcaaggaagggga

SEQ ID NO: 147787 - RNA, 64 nt, hsa
gagauuccuuaaaccuuccuaauuuccugcuccagggcaguaaacacaaauauuucuucaaggg

SEQ ID NO: 147788 - RNA, 64 nt, hsa
ugcuuuaugcuggacccaguaagaugaggaagucgggcaguacacaggaagaggagccaggccc

SEQ ID NO: 147789 - RNA, 64 nt, hsa
gccaggggugccgcuaaacauccuauaaugcacagggcaguaccccacaacgaaaaauaaucug

SEQ ID NO: 147790 - RNA, 64 nt, hsa
ccaacaggagaggaggccuccugggguuuccccagggcaguaggucaaacgaccucaucacagu

SEQ ID NO: 147791 - RNA, 64 nt, hsa
gacagaauucucccagcguuaacacaaaauccaugggcaguaugauggcagguccucuguugca

SEQ ID NO: 147792 - RNA, 64 nt, hsa
uuucccuggguggagcaggacucccaccuaaacggggcaguacuccucccugggggcgggacuc

SEQ ID NO: 147793 - RNA, 64 nt, hsa
uaaaacaaccaguuaaagccacagauggcuuucagggcaguagcagcagaggccaguggacucu

SEQ ID NO: 147794 - RNA, 64 nt, hsa
ucucaucgggggugcgcacaccaucguuacugucgggcaguaacugccgcuugccuugccgcag

SEQ ID NO: 147795 - RNA, 64 nt, hsa
uccugagcuucaugguggagaagggccccacccugggcaguauagagacgucggacuucacggu

SEQ ID NO: 147796 - RNA, 64 nt, hsa
ucuggaaggcuggcugaguggaaugcagggaagagggcaguaccugggaaaggacccacccauc

SEQ ID NO: 147797 - RNA, 64 nt, hsa
gggugggugggaguagaaaauuuuguguauaucagggcaguauuuuuuuaugaacuauaaauga

SEQ ID NO: 147798 - RNA, 64 nt, hsa
ucaugucuuuccccaaaugaagaugcccugcaaagggcaguaaccacacaguuugcugagugaa

SEQ ID NO: 147799 - RNA, 64 nt, hsa
aaacuaagagcucucaagucaaggaagcugggcugggcaguaucccccgccuuuaguucuccac

SEQ ID NO: 147800 - RNA, 64 nt, hsa
ucaaaucgguccccugucgaguucggcucugggugggcaguaggaccaccagugugggguucug

SEQ ID NO: 147801 - RNA, 64 nt, hsa
uauuugugcaggucaugcacacaguuuugauaaagggcaguaacaaguauuggggccuauuuuu

SEQ ID NO: 147802 - RNA, 64 nt, hsa
aucuaccauuaaaacaacaaauggcuugcagacagggcaguaaugguuuauccuaaauuacuca

SEQ ID NO: 147803 - RNA, 64 nt, hsa
gccuaccuagaaucugccugaaagggcuggagaggggcaguauugggggacugugcuagcuuua

SEQ ID NO: 147804 - RNA, 64 nt, hsa
uggcagccuugugaugucauacagagaagucacagggcaguaccugagggucuguagguugcac

SEQ ID NO: 147805 - RNA, 64 nt, hsa
cagacacacaguaaauaauggcugaccagcaugagggcaguacugucagaaauuucuuugagcu

SEQ ID NO: 147806 - RNA, 54 nt, hsa
guaguuguggaggauugugagucugggcaguaaauccacagccaacaaacauag

SEQ ID NO: 147807 - RNA, 64 nt, hsa
ugauggggauggcauugaaucuauaaauuaccuugggcaguauggccauuuucacgauauugau

SEQ ID NO: 147808 - RNA, 64 nt, hsa
gcauuaacuaaaaaaguuuauuuuccuuuugucugggcaguagugaaaauaacuacucacaaca

SEQ ID NO: 147809 - RNA, 64 nt, hsa
gaauaaauaugaaauugaacuauuuucagaaaaagggcaguauauuaagagcagggacuguucu

SEQ ID NO: 147810 - RNA, 64 nt, hsa
ugccauauagacgagauaaaggcagcuaaaacgagggcaguagagagcacuuacccgaccccaa

SEQ ID NO: 147811 - RNA, 64 nt, hsa
cuuuauucaaauuuuaaguaucuuaagaauaguagggcaguaacaguuacuuuugagaguuuuc

SEQ ID NO: 147812 - RNA, 64 nt, hsa
agccaccaucuuugcagguugcuuugcccugguagggcaguaacauuggguccugggucuuuca

SEQ ID NO: 147813 - RNA, 64 nt, hsa
auaauaugcuuugauugaugcagcauuaugcuuugggcaguauuacaaaauagcuggcgagugc

SEQ ID NO: 147814 - RNA, 64 nt, hsa
gggcgugcuagaggugucacgcuccauuggggacgggcaguacaagcgcugcggugucaccucu

SEQ ID NO: 147815 - RNA, 64 nt, hsa
auugugagaggcaguucauuagcaaagauguacugggcaguaacuaaacacacaugcaaacaug

SEQ ID NO: 147816 - RNA, 64 nt, hsa
gaaauguagccaaauuggaguccauucuucuuuagggcaguauaugaaauccuagcagauguaa

SEQ ID NO: 147817 - RNA, 64 nt, hsa
uggcacuucccagggccuggcaguauggucugaugggcaguaugguccaauaggcagcauccuc

SEQ ID NO: 147818 - RNA, 64 nt, hsa
cuaagggcucacaaccaaagugauccgccaagcagggcaguaucuggguuacagccacagcagg

SEQ ID NO: 147819 - RNA, 64 nt, hsa
ccuaagcuucugagaaucauguggcaagugugaugggcaguaaaauaccagagaagauguuuag

SEQ ID NO: 147820 - RNA, 64 nt, hsa
guugcugagcuucucuccaaagucuaaaaugguggggcaguagggaccugugagaggcccaaug

SEQ ID NO: 147821 - RNA, 64 nt, hsa
ugagaguuccagauuguucuguccaguuuccaaagggcaguaaaguuuucgugccgguuuucag

SEQ ID NO: 147822 - RNA, 64 nt, hsa
aacaauuuguucuuuuguuguuuuugccaguuuagggcaguagcugcuuuugucauaaauaucu

SEQ ID NO: 147823 - RNA, 64 nt, hsa
ucauuucaaauguuuugguuauucaugaucacuugggcaguauaagaaaauguagcuucugaau

SEQ ID NO: 147824 - RNA, 64 nt, hsa
uguuggcaccagcccgggcaggggcaucucauuugggcaguacugcugugcaacccagcugcaa

SEQ ID NO: 147825 - RNA, 64 nt, hsa
acugauucuuuucuauuuauaaauguauuuugaugggcaguaaaacaaagugucuuaaaaguuu

SEQ ID NO: 147826 - RNA, 64 nt, hsa
ucucuccuguaccauucuguggcuucagccaugggggcaguagcccuucauuaguguagauagu

SEQ ID NO: 147827 - RNA, 64 nt, hsa
agauacaggcugguauagaggaugcagaaagguagggcaguauguuuaaguccagacuuggcac

SEQ ID NO: 147828 - RNA, 64 nt, hsa
caggggaggaggaccaggucaagggacguucugugggcaguagcccuguguggcccuguuccca

SEQ ID NO: 147829 - RNA, 64 nt, hsa
cucagugaauuguuauuguuugcaaaaaugcacugggcaguaacauuuugugauaaauccuaua

SEQ ID NO: 147830 - RNA, 64 nt, hsa
gaauacuuggaauucuaauuguuuugugugccaggggcaguaaugucccugccucuucucccaa

SEQ ID NO: 147831 - RNA, 64 nt, hsa
auguuaaacuuuaucuuaauuaguauacuagaaagggcaguauaauacuguuuuaaagugaagg

SEQ ID NO: 147832 - RNA, 64 nt, hsa
uuuuuuccaaaguuuucuauguuuggcucaauuagggcaguaucaucaguucuauaauguaaaa

SEQ ID NO: 147833 - RNA, 64 nt, hsa
accucaucuugauucagacugucagucuauuccugggcaguaguaugugauguccagcacccua

SEQ ID NO: 147834 - RNA, 64 nt, hsa
uguauuuuucauccaucuuuucugaagugucuuugggcaguauguaguuauuuauuacaaaauu

SEQ ID NO: 147835 - RNA, 64 nt, hsa
gaugauggauggucgggauugaggcuguugaccugggcaguagcuccucccauggccagugguc

SEQ ID NO: 147836 - RNA, 64 nt, hsa
cauguuaccuagagcaggcacuugauuccuugcugggcaguauccaauaggcauuugauuuugc

SEQ ID NO: 147837 - RNA, 64 nt, hsa
gagugugguugagguuugagguccuggucgagcagggcaguacuggaccaggucuacgucagca

SEQ ID NO: 147838 - RNA, 64 nt, hsa
cucccucucuuuuuccucuguagagaaaugugaggggcaguacauuuacugugcuuuucacacc

SEQ ID NO: 147839 - RNA, 64 nt, hsa
agaaaaaugcauguauuuaccucuucaaccaaaagggcaguaaagaauagggauaauauauuuu

SEQ ID NO: 147840 - RNA, 64 nt, hsa
acuguuuaugcugugauuucacucugucuaucaugggcaguauuagaaaacacacugguuuuca

SEQ ID NO: 147841 - RNA, 64 nt, hsa
acaccauguucuuucccacccuaacaacaacaaagggcaguaaauuaaaguacucuuuguaagg

SEQ ID NO: 147842 - RNA, 64 nt, hsa
gucuuagccuguagacaugcugcuaguaucagaggggcaguagagcuuggacagaaagaaaaga

SEQ ID NO: 147843 - RNA, 64 nt, hsa
cucuucccacuuccucguccucgugagaaccugugggcaguauucaagcccugaugacaaaacc

SEQ ID NO: 147844 - RNA, 58 nt, hsa
uucguggggagagagcguagagguuuccgggcaguaauucuauccaacuuaaaaaggc

SEQ ID NO: 147845 - RNA, 64 nt, hsa
aaacugaaagcaagucauggggaaugaauacuuugggcaguaucuuccugaugucuucuuagcu

SEQ ID NO: 147846 - RNA, 64 nt, hsa
agauaaacuucuguaaccuaugcauauuuuaugggggcaguauuauuacaaauggaucugaaau

SEQ ID NO: 147847 - RNA, 64 nt, hsa
gggagcucacagcaacacccccuaccaccaggaugggcaguaauaugugacagagcccaaagca

SEQ ID NO: 147848 - RNA, 64 nt, hsa
cuagaccccugccacuaacaggcuaggagacuuugggcaguaaugggaggcacugaggguuugc

SEQ ID NO: 147849 - RNA, 64 nt, hsa
gccucauucguaccaugccaaacgcauucacucggggcaguauuaaccguucuagaaagccacu

SEQ ID NO: 147850 - RNA, 64 nt, hsa
uuauccuuaggcccuagagauacugaaaguccuggggcaguaucuucugauggugugcauguga

SEQ ID NO: 147851 - RNA, 64 nt, hsa
cuuaaaguaggaucaaaucuagauccucuagccugggcaguagaggaagaaaugcuagccugga

SEQ ID NO: 147852 - RNA, 64 nt, hsa
cucccugaggugaacguuguuggguugcuagcaagggcaguagcuuaaauacuuuuguugccua

SEQ ID NO: 147853 - RNA, 64 nt, hsa
gggugggugccugucaccuugaggugaccaucuagggcaguaccugcugggcuuaggacagcgc

SEQ ID NO: 147854 - RNA, 64 nt, hsa
cuguacaacucaaucaagaaugagaagcuugaaugggcaguagaugaugaagagaaaaaaaagu

SEQ ID NO: 147855 - RNA, 64 nt, hsa
ggaaucuacaagccaaaagucccucccugccugagggcaguacccuccauugggcacaguccag

SEQ ID NO: 147856 - RNA, 64 nt, hsa
gggucggcccgcagauggcacccaaggccgggaagggcaguaacugcacacgcggcgcugucag

SEQ ID NO: 147857 - RNA, 64 nt, hsa
ugggcuuuggguauaaaggagggggauucuacgggggcaguagcucaacaaggaauagagggag

SEQ ID NO: 147858 - RNA, 64 nt, hsa
aaguggcgcagccaggccaagcuguguaaguuaagggcaguaacguuaagaugcgugggcaggg

SEQ ID NO: 147859 - RNA, 64 nt, hsa
aggugaaggccugcgcacugaacuguaaggcagugggcaguacaggguaacuggaggcggggcc

SEQ ID NO: 147860 - RNA, 64 nt, hsa
auugucauauuguaacaugcgugugccagacaccgggcaguacacuuuggaaagaaugugaaau

SEQ ID NO: 147861 - RNA, 64 nt, hsa
uuugucuuguauauguauguauauuggguccucugggcaguagaggcaaagcucaccucccaug

SEQ ID NO: 147862 - RNA, 64 nt, hsa
cucuuuucuuugcaagauauaucacagcugcuuugggcaguagcugaagccgaaguaugaacag

SEQ ID NO: 147863 - RNA, 64 nt, hsa
agggugagagaggggagggaggggaauaaggugugggcaguagagggaaucugucagucucaug

SEQ ID NO: 147864 - RNA, 64 nt, hsa
ugguuuccuguuagauaaggguuccagcagccuggggcaguaugucucagcuggaauggaaaga

SEQ ID NO: 147865 - RNA, 64 nt, hsa
cguacacuaggggguccuacagcuacguggccgugggcaguacugggggcgaccuggaccugcu

SEQ ID NO: 147866 - RNA, 64 nt, hsa
uuugcugugcaaugacuggaaggccgcccggcaugggcaguagagaccccuggccucugagcac

SEQ ID NO: 147867 - RNA, 64 nt, hsa
aacaugguauuggcuuaucguuuuuaucucugaagggcaguagccugaagauaacagugcacaa

SEQ ID NO: 147868 - RNA, 64 nt, hsa
cuauggccccaggguugaaaaguuaugagggucagggcaguaucucucugccuauuuauugggg

SEQ ID NO: 147869 - RNA, 64 nt, hsa
aggaguuggagagcacaguugccccguugugugagggcaguaguaggcaucuggaaugcuccag

SEQ ID NO: 147870 - RNA, 64 nt, hsa
aacaccucaccuugaaacuguagcaguguguucugggcaguaucuguaauguaugaaauagagu

SEQ ID NO: 147871 - RNA, 64 nt, hsa
ggauggcaucagaauugucuggaaguuuugucuugggcaguaugggcugggccaaaugaaauga

SEQ ID NO: 147872 - RNA, 64 nt, hsa
guaaggagcggggcacgggggaggaggagguagggggcaguaaaaaacuuacucucuuuuuucc

SEQ ID NO: 147873 - RNA, 64 nt, hsa
uuucaaaugacauuggucuuuauuuccaguagaugggcaguaaacagggucaggguggucaagg

SEQ ID NO: 147874 - RNA, 64 nt, hsa
aacgaguauuuguauuuauuaaacucauuaguuugggcaguauacuaagguguggcugucuugg

SEQ ID NO: 147875 - RNA, 64 nt, hsa
aagcccgugugccaggcacugugcuaggcguggugggcaguauaaagaaaucugucuccacagc

SEQ ID NO: 147876 - RNA, 64 nt, hsa
ccuccucuguaacuucuuucugggggauuggggugggcaguaccuauccccaguccccuccuag

SEQ ID NO: 147877 - RNA, 64 nt, hsa
uacguaauugcuaaaauuauuuaauuaaaaaauugggcaguagguaacuggcauuccucucuuu

SEQ ID NO: 147878 - RNA, 64 nt, hsa
ggacaccaguagguagugucaagccagagauucggggcaguagauaaauguucauuuuacugau

SEQ ID NO: 147879 - RNA, 64 nt, hsa
guaaugacagugauauaaugccuggaaccugguugggcaguaggggagggagguagaaggaaaa

SEQ ID NO: 147880 - RNA, 64 nt, hsa
cuggaggauccggaaagaguuuccgaagagugaagggcaguacaguggcuucaagaguccuuac

SEQ ID NO: 147881 - RNA, 64 nt, hsa
acucuuaccgucaugucuugcaacaacccugugagggcaguauuaaugcccccuuacagcagaa

SEQ ID NO: 147882 - RNA, 64 nt, hsa
caccaacaucccauugcccugguuauauucucacgggcaguagcuguggugagguggguuuucu

SEQ ID NO: 147883 - RNA, 64 nt, hsa
uugccuuggugcugccccagaucuguccagcagggggcaguaagugaucuugguaguaucccug

SEQ ID NO: 147884 - RNA, 64 nt, hsa
uccucucagcacagagaaucaagagguggccuuugggcaguagauuuacuuucucagguauguu

SEQ ID NO: 147885 - RNA, 64 nt, hsa
aauagcagcaugacauuuagcaguaauccauuaagggcaguaccucuaacaaggacgccuucca

SEQ ID NO: 147886 - RNA, 64 nt, hsa
ggagacuauggggagcccaccgccuacacaguaggggcaguagcccccagcuccacgccuguug

SEQ ID NO: 147887 - RNA, 64 nt, hsa
uuuuucaagaaaagagaaaugcaggaagcucagggggcaguagcacacuuugcacacgauaaag

SEQ ID NO: 147888 - RNA, 64 nt, hsa
cagcuuuuucccagggagccguuucagggguucugggcaguaggcugggccuggccucagaacc

SEQ ID NO: 147889 - RNA, 64 nt, hsa
cacccccuaaaauucucacccucagcuauuuugugggcaguauucaggaagagcuacuucaaac

SEQ ID NO: 147890 - RNA, 64 nt, hsa
ucucgccccaauagccucacggcacaguacucuugggcaguaacuggacaccuuuuauuugaag

SEQ ID NO: 147891 - RNA, 64 nt, hsa
ccauaaucccuacguguugugggagggacccagugggcaguaauuuaaucaugguggugguuac

SEQ ID NO: 147892 - RNA, 64 nt, hsa
gccuaaugcugcagucagaagcaaugccuggcuggggcaguaggggaaauuccacccaauuuug

SEQ ID NO: 147893 - RNA, 64 nt, hsa
uucauuucauuuaauucuuccacagaaccaguuugggcaguaggaacucaggcuucuggucugc

SEQ ID NO: 147894 - RNA, 64 nt, hsa
aggugaauuuuuacaauucaguuuuacauguuuugggcaguauuuugucuuaagauauauuuuu

SEQ ID NO: 147895 - RNA, 64 nt, hsa
gcuguuuggaggaaggugucugucugggaggauggggcaguaaaugagguuggcagaguggcag

SEQ ID NO: 147896 - RNA, 64 nt, hsa
uggcagaggugaggggauaaguuagaauguaaaagggcaguaauuaggggugagggaaaggaga

SEQ ID NO: 147897 - RNA, 64 nt, hsa
cuggcuccgaguuccccuccugggauuugcaggagggcaguacugaaccugcauucuucuccuu

SEQ ID NO: 147898 - RNA, 64 nt, hsa
ugcccagcggaaggaggcaauuaaggcaaagguggggcaguacgugucccgggcugaggagcuc

SEQ ID NO: 147899 - RNA, 64 nt, hsa
aaucugcauuuuaacuagucgcggggauuguggggggcaguagcuggcuguuucguggcauuuc

SEQ ID NO: 147900 - RNA, 64 nt, hsa
ccucucuccacggaaaggucacaguggacagcccgggcaguaggaugcagccccagaggcuggu

SEQ ID NO: 147901 - RNA, 64 nt, hsa
cagcuaccagcagagacucuauagcugucucuuagggcaguauuuuggggaaguggggcuugaa

SEQ ID NO: 147902 - RNA, 64 nt, hsa
aucuucaaggugaccaugccccaccggggugcuggggcaguagucauggcagacucccggccug

SEQ ID NO: 147903 - RNA, 64 nt, hsa
gcaggaggcauggggcaggguggcccaccccagugggcaguagccuggccuuuuucugugugag

SEQ ID NO: 147904 - RNA, 64 nt, hsa
ggacugugcugcaguaucaccagaagacauuagggggcaguaggcccccacacaaaaccuucag

SEQ ID NO: 147905 - RNA, 64 nt, hsa
uccaaucagucccacucccuccugagguccccaagggcaguauucagagagguuuccugcguuu

SEQ ID NO: 147906 - RNA, 64 nt, hsa
accccgcaccagcccugcccccaccugcccucccgggcaguacuggggaccuucccugggggac

SEQ ID NO: 147907 - RNA, 64 nt, hsa
uugcacgggccuugccaaggcccaggagggacuugggcaguauguucauguggucauauguuuu

SEQ ID NO: 147908 - RNA, 64 nt, hsa
auguuuugugggaggcagcauggcaccguggaaagggcaguagacguggagccggcaccucugg

SEQ ID NO: 147909 - RNA, 64 nt, hsa
gcuguuacgacaucccugugugaucccagaggaggggcaguagcugggcagaaacugcaggcac

SEQ ID NO: 147910 - RNA, 64 nt, hsa
agggcuagaggcccuaagacccugaaaaaggggcgggcaguagggaagguggaggcacacuccu

SEQ ID NO: 147911 - RNA, 64 nt, hsa
gugaccuuagguuuauuaaaggcuagguuuauuugggcaguauuagaaacaaaaucauggauca

SEQ ID NO: 147912 - RNA, 64 nt, hsa
ggccugggcaccagcauuuggcagcacgcaggcggggcaguaugugauggacuggggagcacag

SEQ ID NO: 147913 - RNA, 64 nt, hsa
uguggcaucguuuuguuuauuuggaguuugcuaagggcaguauuuuucugucaagacuauucaa

SEQ ID NO: 147914 - RNA, 64 nt, hsa
ucacagagagcaggcaggggcuucggugccgcgugggcaguacgcaggucccaccgacacucac

SEQ ID NO: 147915 - RNA, 64 nt, hsa
cuucaucuaauuuuagcaagguaacaguugcccagggcaguaccugaauuaacuguccauuuca

SEQ ID NO: 147916 - RNA, 64 nt, hsa
ucuuggagccaagcucuuagguuccucuuauuuggggcaguaccaguccauaccagcugcgauu

SEQ ID NO: 147917 - RNA, 64 nt, hsa
cugcagauccugccccaagaagcugggguggugggggcaguaauuccugccccccucucugccc

SEQ ID NO: 147918 - RNA, 64 nt, hsa
gcauacauuccuugagugacuaugaaugacugccgggcaguaacuucugggcugugguuguaaa

SEQ ID NO: 147919 - RNA, 64 nt, hsa
gcuacugaccagggcagagcuggggagggcgugggggcaguaaagccucugcuacagccggcuc

SEQ ID NO: 147920 - RNA, 64 nt, hsa
uucucccagagcccaaguaaaaacuuuauccugugggcaguagggagcccugggagguguuuga

SEQ ID NO: 147921 - RNA, 64 nt, hsa
ggggccaaagguccagaccccccaaguccagugagggcaguagggauuggguugggggaagaua

SEQ ID NO: 147922 - RNA, 64 nt, hsa
ccgugaggcaaaaucgugccacugcccucagccugggcaguagagucagucuccaucucaaaga

SEQ ID NO: 147923 - RNA, 64 nt, hsa
cugaccacccaaauaugacugugaauuguggaaagggcaguagaucucuaauguggagguggga

SEQ ID NO: 147924 - RNA, 64 nt, hsa
ugcucgugcugcccagaggcugaucugcaaaccugggcaguauuccacacugaagcucaguuug

SEQ ID NO: 147925 - RNA, 64 nt, hsa
uaucguuugcaugcccucaucccacccauucucagggcaguaugggaagccccaaggugaccug

SEQ ID NO: 147926 - RNA, 64 nt, hsa
uccccuccucccaauagaggcugagccggagccagggcaguaugagguggggcugccacugccc

SEQ ID NO: 147927 - RNA, 64 nt, hsa
ucugcccacagcagacucugucccauggcucuccgggcaguagagugugugagugcagacugga

SEQ ID NO: 147928 - RNA, 64 nt, hsa
ggguggguggggagggaugcugcauuucucagcugggcaguaaucaauuuaaugguccuuuaaa

SEQ ID NO: 147929 - RNA, 64 nt, hsa
gcugcccgagccaggaacuguguguguugcaggggggcaguaacuccccaacucccucguuaau

SEQ ID NO: 147930 - RNA, 64 nt, hsa
uguggugacaguuggugcuaauaagaauuugccugggcaguauagugagaucuuuucucuacaa

SEQ ID NO: 147931 - RNA, 64 nt, hsa
ggguggggagcaggccuaccuggcaggccuggcagggcaguaccacuuggagcgguacccggac

SEQ ID NO: 147932 - RNA, 64 nt, hsa
uuacuuaauaauauuauuaaauaauaauaggucugggcaguauuguuuuuaaccugacucaucc

SEQ ID NO: 147933 - RNA, 64 nt, hsa
ggacugaugacacgagcugccauggcgggaggaggggcaguaguuauugauauggugagcccca

SEQ ID NO: 147934 - RNA, 64 nt, hsa
auuacauguuugguaccaagaaaggaaccugucagggcaguacaaugugacuuugaaaauauau

SEQ ID NO: 147935 - RNA, 64 nt, hsa
cacucagaaguccagagucuagcguagugcagcagggcaguagcgguaccaaugcagaacuccc

SEQ ID NO: 147936 - RNA, 64 nt, hsa
guaaccuucgcugguaaaaauaagcccaugugauguccaccaguggaugaaugcuggaccgaga

SEQ ID NO: 147937 - RNA, 64 nt, hsa
uucucauuucuuuugaaauggcaucucgaacaaaguccaccaaucccuuuacaaaagaaugaac

SEQ ID NO: 147938 - RNA, 64 nt, hsa
cuggagucucauuaaaugccugauugugaaccauguccaccaguaucuggggugggcacguggu

SEQ ID NO: 147939 - RNA, 64 nt, hsa
ccgcccccaggcugccugugucuucaccuguccuguccaccagcgccaacagccguggggaagc

SEQ ID NO: 147940 - RNA, 64 nt, hsa
ccuucuagagccgggcugggaauggggacacgguguccaccauccccagcugguggcccugugc

SEQ ID NO: 147941 - RNA, 64 nt, hsa
caggcccuuggcugcaggcaacacuuuagcuuggguccaccaugcagaacaccaauauuaacac

SEQ ID NO: 147942 - RNA, 64 nt, hsa
ucaaaucucaaccugagccauccccaguucuuagccaguugagccagcgacaacagcaccagag

SEQ ID NO: 147943 - RNA, 64 nt, hsa
aaauggcaaacaucaccagcucccagauuuuggaccaguugaaagcuccgaguuugggccaguu

SEQ ID NO: 147944 - RNA, 64 nt, hsa
gcauauaaaaucucugcuguauccuuucggcuucccaguugagcucccaagaccaggacccacu

SEQ ID NO: 147945 - RNA, 64 nt, hsa
ggccugcccuucucugcuguguccuuucggcuucccaguugagcucccaagaccaggacccacu

SEQ ID NO: 147946 - RNA, 64 nt, hsa
ccgcuuccucuuuuucuugcaaguuuuaaauuuccaaccuuaagugaauuuguggaccaaauuu

SEQ ID NO: 147947 - RNA, 64 nt, hsa
aggaaucuaaauauuuauagugagauugugaaagcaaccuuaaaguuuugaagaagacugauga

SEQ ID NO: 147948 - RNA, 64 nt, hsa
uauguuauauguuguucuuacaaaccauacugaaagaguccauuguuuaaaaaucuuaauguau

SEQ ID NO: 147949 - RNA, 64 nt, hsa
uuauacuugaugauaacacuauuugaugagucuuagaguccagacacaaagagacaaagcuuug

SEQ ID NO: 147950 - RNA, 64 nt, hsa
aaacauacauucgugccuggagacccugcaggccagaguccaaauauuuaacaaucagaagggg

SEQ ID NO: 147951 - RNA, 64 nt, hsa
uauuuugccugaacaccccaacacucuugguuuuagaguccaagaguaaguugugcagagacau

SEQ ID NO: 147952 - RNA, 64 nt, hsa
caaaaccaagcugcuugagcccacucucuugcugagaguccaggccugccugccugccagccag

SEQ ID NO: 147953 - RNA, 64 nt, hsa
aggcaacuggugcagggacugggaaaccauagacagaguccacuccuccugccuggccuuuccc

SEQ ID NO: 147954 - RNA, 64 nt, hsa
guaccucauucuucccuuaucacugaaggaaggaagaguccagaagggccacagagaacucaaa

SEQ ID NO: 147955 - RNA, 64 nt, hsa
ggagcucuagagugggagaaagaaugauggaagaagaguccagaacaggccagaaagugaaucc

SEQ ID NO: 147956 - RNA, 64 nt, hsa
gaagcccucccagguguuaacauuccaagacucuagaguccaagguuuaaagagucuagauuca

SEQ ID NO: 147957 - RNA, 64 nt, hsa
uuugcugcauucugccucucuaggaccaugguuaagaguccaagaauccacauuucuaaaaucu

SEQ ID NO: 147958 - RNA, 64 nt, hsa
cgggucaucagcaagaaaugaauuggaggcaggaagaguccaagccugaauaauaacaccccac

SEQ ID NO: 147959 - RNA, 64 nt, hsa
ucucaacccugcuguucagacuugauaagaucucagaguccacaggaaagaagucacuguugca

SEQ ID NO: 147960 - RNA, 64 nt, hsa
ccuguuauuguccccuaaugauaggauauucccugcugccuaccuggagauucaguaggaucuu

SEQ ID NO: 147961 - RNA, 64 nt, hsa
gccuucaccucuguugcugaggaaaugguagaaugcugccuaucaccuccagcacaaucccagu

SEQ ID NO: 147962 - RNA, 64 nt, hsa
gaccgggacccccccacccacgugucucauuguggcugccuauggacucccgggccuugugugc

SEQ ID NO: 147963 - RNA, 64 nt, hsa
gacagaggagucaggcccgccccaggagccuccagcugccuaaccagugccauucuuucacaac

SEQ ID NO: 147964 - RNA, 64 nt, hsa
aagaagcaggaaaagcaagaagaaaagacagcagcaucaagaggaggaggacaucuuggaugua

SEQ ID NO: 147965 - RNA, 64 nt, hsa
gaacaucagaaaaagcaagaagaagaaaaggcgacaucaagaaggaaaggucucagaugaaaga

SEQ ID NO: 147966 - RNA, 64 nt, hsa
uuggaaaucugacuucuugcagaaggaguaggcacaucaagauauucaggggugccccaagagu

SEQ ID NO: 147967 - RNA, 64 nt, hsa
aucuuauuacuguuacucaaaaacauugacucugcaucaagaaagaaacaagaaagcaauaaaa

SEQ ID NO: 147968 - RNA, 64 nt, hsa
acugcuuccaguuccugcccuuuggcaaaggccucaucaagaagugccggaccagcccugaugc

SEQ ID NO: 147969 - RNA, 64 nt, hsa
ugaacagcaacuauuaugucauggaccuugugcucaucaagaauacagacgugcaggcagcccg

SEQ ID NO: 147970 - RNA, 64 nt, hsa
cugggaucaacuccuggaagaaacgccugauccgcaucaagaauggcauccucaggggcgugua

SEQ ID NO: 147971 - RNA, 64 nt, hsa
cuggccgcaggagucuauauguuuucguaaucuucaucaagaaguuuuuaaaaggcaagcaaaa

SEQ ID NO: 147972 - RNA, 64 nt, hsa
acucugucuggugagcucugcuuuuucagugcaccaucaagagaugcagccccguggacaugaa

SEQ ID NO: 147973 - RNA, 64 nt, hsa; identical to SEQ ID NO: 111411

SEQ ID NO: 147974 - RNA, 64 nt, hsa; identical to SEQ ID NO: 111412

SEQ ID NO: 147975 - RNA, 64 nt, hsa; identical to SEQ ID NO: 111413

SEQ ID NO: 147976 - RNA, 64 nt, hsa; identical to SEQ ID NO: 111414

SEQ ID NO: 147977 - RNA, 64 nt, hsa; identical to SEQ ID NO: 111415

SEQ ID NO: 147978 - RNA, 64 nt, hsa; identical to SEQ ID NO: 111416

SEQ ID NO: 147979 - RNA, 64 nt, hsa; identical to SEQ ID NO: 111417

SEQ ID NO: 147980 - RNA, 64 nt, hsa; identical to SEQ ID NO: 111418

SEQ ID NO: 147981 - RNA, 64 nt, hsa; identical to SEQ ID NO: 111419

SEQ ID NO: 147982 - RNA, 64 nt, hsa; identical to SEQ ID NO: 111420

SEQ ID NO: 147983 - RNA, 64 nt, hsa; identical to SEQ ID NO: 111421

SEQ ID NO: 147984 - RNA, 64 nt, hsa; identical to SEQ ID NO: 111422

SEQ ID NO: 147985 - RNA, 64 nt, hsa; identical to SEQ ID NO: 111423

SEQ ID NO: 147986 - RNA, 64 nt, hsa; identical to SEQ ID NO: 111424

SEQ ID NO: 147987 - RNA, 64 nt, hsa; identical to SEQ ID NO: 111425

SEQ ID NO: 147988 - RNA, 64 nt, hsa; identical to SEQ ID NO: 111426

SEQ ID NO: 147989 - RNA, 64 nt, hsa; identical to SEQ ID NO: 111427

SEQ ID NO: 147990 - RNA, 64 nt, hsa; identical to SEQ ID NO: 111428

SEQ ID NO: 147991 - RNA, 64 nt, hsa; identical to SEQ ID NO: 111429

SEQ ID NO: 147992 - RNA, 64 nt, hsa; identical to SEQ ID NO: 111430

SEQ ID NO: 147993 - RNA, 64 nt, hsa; identical to SEQ ID NO: 111431

SEQ ID NO: 147994 - RNA, 64 nt, hsa; identical to SEQ ID NO: 111432

SEQ ID NO: 147995 - RNA, 64 nt, hsa; identical to SEQ ID NO: 111433

SEQ ID NO: 147996 - RNA, 64 nt, hsa; identical to SEQ ID NO: 111434

SEQ ID NO: 147997 - RNA, 58 nt, hsa; identical to SEQ ID NO: 111435

SEQ ID NO: 147998 - RNA, 64 nt, hsa; identical to SEQ ID NO: 111436

SEQ ID NO: 147999 - RNA, 64 nt, hsa; identical to SEQ ID NO: 111437

SEQ ID NO: 148000 - RNA, 64 nt, hsa; identical to SEQ ID NO: 111438

SEQ ID NO: 148001 - RNA, 64 nt, hsa; identical to SEQ ID NO: 111439

SEQ ID NO: 148002 - RNA, 64 nt, hsa; identical to SEQ ID NO: 111440

SEQ ID NO: 148003 - RNA, 64 nt, hsa; identical to SEQ ID NO: 111441

SEQ ID NO: 148004 - RNA, 64 nt, hsa; identical to SEQ ID NO: 111442

SEQ ID NO: 148005 - RNA, 64 nt, hsa; identical to SEQ ID NO: 111443

SEQ ID NO: 148006 - RNA, 64 nt, hsa; identical to SEQ ID NO: 111444

SEQ ID NO: 148007 - RNA, 64 nt, hsa; identical to SEQ ID NO: 111445

SEQ ID NO: 148008 - RNA, 64 nt, hsa; identical to SEQ ID NO: 111446

SEQ ID NO: 148009 - RNA, 64 nt, hsa; identical to SEQ ID NO: 111447

SEQ ID NO: 148010 - RNA, 64 nt, hsa; identical to SEQ ID NO: 111448

SEQ ID NO: 148011 - RNA, 64 nt, hsa; identical to SEQ ID NO: 111449

SEQ ID NO: 148012 - RNA, 64 nt, hsa; identical to SEQ ID NO: 111450

SEQ ID NO: 148013 - RNA, 64 nt, hsa; identical to SEQ ID NO: 111451

SEQ ID NO: 148014 - RNA, 64 nt, hsa; identical to SEQ ID NO: 111452

SEQ ID NO: 148015 - RNA, 64 nt, hsa; identical to SEQ ID NO: 111453

SEQ ID NO: 148016 - RNA, 64 nt, hsa; identical to SEQ ID NO: 111454

SEQ ID NO: 148017 - RNA, 64 nt, hsa; identical to SEQ ID NO: 111455

SEQ ID NO: 148018 - RNA, 64 nt, hsa; identical to SEQ ID NO: 111456

SEQ ID NO: 148019 - RNA, 64 nt, hsa; identical to SEQ ID NO: 111457

SEQ ID NO: 148020 - RNA, 64 nt, hsa; identical to SEQ ID NO: 111458

SEQ ID NO: 148021 - RNA, 64 nt, hsa; identical to SEQ ID NO: 111459

SEQ ID NO: 148022 - RNA, 52 nt, hsa; identical to SEQ ID NO: 111460

SEQ ID NO: 148023 - RNA, 64 nt, hsa; identical to SEQ ID NO: 111461

SEQ ID NO: 148024 - RNA, 64 nt, hsa; identical to SEQ ID NO: 111462

SEQ ID NO: 148025 - RNA, 64 nt, hsa; identical to SEQ ID NO: 111463

SEQ ID NO: 148026 - RNA, 64 nt, hsa; identical to SEQ ID NO: 111464

SEQ ID NO: 148027 - RNA, 64 nt, hsa; identical to SEQ ID NO: 111465

SEQ ID NO: 148028 - RNA, 64 nt, hsa; identical to SEQ ID NO: 111466

SEQ ID NO: 148029 - RNA, 64 nt, hsa; identical to SEQ ID NO: 111467

SEQ ID NO: 148030 - RNA, 62 nt, hsa
acuuuuagauuggauuguuugcuauugcucugugugaggauacauaaucuuucaguaaacug

SEQ ID NO: 148031 - RNA, 62 nt, hsa
uggauacaguuugcuuguaauauuuuuaauaaugugaggaguacaguguuuucuaauucauu

SEQ ID NO: 148032 - RNA, 62 nt, hsa
uggggucaauaccaccuaccucacagggguguugugaggacugagaagaacaaugucaaaug

SEQ ID NO: 148033 - RNA, 62 nt, hsa
agagcaccacucugcugccccaccacgcggccugugaggagccacuaaaccuuuccgugccu

SEQ ID NO: 148034 - RNA, 62 nt, hsa
aaaaacccauguggugaugauguguauauauaugugaggauguaucgggaagauuucuaaau

SEQ ID NO: 148035 - RNA, 62 nt, hsa
ggguugguuccuuuccaacguuuggaagauccugugaggagccccaucugucuaaagauaga

SEQ ID NO: 148036 - RNA, 62 nt, hsa
cauauucuuaugauuacuuggguuaaagcuucugugaggaccuuuuggcucuuaagauaucc

SEQ ID NO: 148037 - RNA, 62 nt, hsa
cuguuaagucccuuccguaauuuuuauguucuugugaggaaaaaaguaaaacauguuuaauu

SEQ ID NO: 148038 - RNA, 62 nt, hsa
uugggaagagguuucuguaaccccugcccuggugugaggaggaaauggcucuggccuggcug

SEQ ID NO: 148039 - RNA, 62 nt, hsa
aaaaccauuuuucuaauucuaacaaguuagaaugugaggaaggaaugaacaugaguguuuag

SEQ ID NO: 148040 - RNA, 62 nt, hsa
ucaagacgagggaaauaugagaaggcaaaugaugugaggauuaguaucuugagauucaccug

SEQ ID NO: 148041 - RNA, 62 nt, hsa
gaagaaucauacuuugaccuaccuuguagagaugugaggauuuagauguuugcuaacuucaa

SEQ ID NO: 148042 - RNA, 62 nt, hsa
gggaaggcaguguggucccuacccugugugaaugugaggauguagacauccaucagugcaac

SEQ ID NO: 148043 - RNA, 62 nt, hsa
auuuaucugggagaaaacuguggugcacagcuugugaggagggcaagguugugacguucgag

SEQ ID NO: 148044 - RNA, 62 nt, hsa
auuuccagaauuuuagacauuauuacaggguuugugaggaccuuugacucagugacaaucau

SEQ ID NO: 148045 - RNA, 62 nt, hsa
caaagaggguugauuaaaucuauaaguuuuuaugugaggacuuuguaagucagcauaaaaau

SEQ ID NO: 148046 - RNA, 62 nt, hsa
uccucagcgacauuucugaugugcugcucuuaugugaggaccagugcuuucucucuuugcac

SEQ ID NO: 148047 - RNA, 62 nt, hsa
uggcacgggcuccucagagcgugguagccgacugugaggaaaagcagagggaaugugaaaga

SEQ ID NO: 148048 - RNA, 62 nt, hsa
cuuccugucuaacuuggggaaggggccugggcugugaggacagggcccccacaggggauggu

SEQ ID NO: 148049 - RNA, 62 nt, hsa
auguaggaaccgaucugcuauuuuuaauuuccugugaggauagagacuugcaguuagacuca

SEQ ID NO: 148050 - RNA, 62 nt, hsa
gauaucccaaguuggaagggaccccagauaccugugaggacugguugucucucuucgguggc

SEQ ID NO: 148051 - RNA, 62 nt, hsa
ggcgagcugggcgagcugggcuggggagagccugugaggaccgagaggagaaaugagaagaa

SEQ ID NO: 148052 - RNA, 62 nt, hsa
agggccuacaacgaggggccuuugcgaugggcugugaggauggggguggugggaagaauugg

SEQ ID NO: 148053 - RNA, 62 nt, hsa
uuaaugcaggaagaacaugacaaccaagcaaaugugaggagucuggugaccuggggcaacuu

SEQ ID NO: 148054 - RNA, 62 nt, hsa
uccgcuauagaauggaguguccagaaauagacugugaggaaggaugggccuugcugaagugu

SEQ ID NO: 148055 - RNA, 62 nt, hsa
cuuccccauuguuuccaucugaucagcuguggugugaggacuucucagacaaaggcaaggcc

SEQ ID NO: 148056 - RNA, 62 nt, hsa
gaccguggccgcuggcuggcuggacaggcgggugugaggaguugcagacccaaacccacgug

SEQ ID NO: 148057 - RNA, 62 nt, hsa
gaacuccaagauguuccauaaguguuuuuacuugugaggaaugagaagccauccauggaaau

SEQ ID NO: 148058 - RNA, 62 nt, hsa
cuuccuucuguagccauuaacugcugaauccaugugaggaagacaggcuucccuuccuuccc

SEQ ID NO: 148059 - RNA, 62 nt, hsa
ggggggcaaugauaccuaccucacagggguguugugaggauuaaaugugaggaggauagugg

SEQ ID NO: 148060 - RNA, 62 nt, hsa
accuaccucacagggguguugugaggauuaaaugugaggaggauaguggcagaugagugaug

SEQ ID NO: 148061 - RNA, 62 nt, hsa
uguacaucaugaugacugauggucuucaagguugugaggaaagccgucucccugcuugacuc

SEQ ID NO: 148062 - RNA, 62 nt, hsa
ggggacggcgacagcgcggcucugugaguggcugugaggaugcugcacguccucagcagagu

SEQ ID NO: 148063 - RNA, 62 nt, hsa
aaccagccaaaugcacuuuugugaaaauggggugugaggagugguucugcagcuugaguccu

SEQ ID NO: 148064 - RNA, 62 nt, hsa
uuuagaauagccagggucuguaggcaucacauugugaggaagggagcuuucuggaaguacuu

SEQ ID NO: 148065 - RNA, 64 nt, hsa
cuuuuuguuuaauaccuuccccaagaggggacagucuggccaacuugcuccaguaaugcaauaa

SEQ ID NO: 148066 - RNA, 64 nt, hsa
ggccuggauagacugccugcguccuuaccacugaucuggccaagaaugaggcccucccaacacu

SEQ ID NO: 148067 - RNA, 64 nt, hsa
gguccaucuugggcauuagguucuccagcagagcucuggccagcugccucuucuuuaacuggga

SEQ ID NO: 148068 - RNA, 64 nt, hsa
uuuauccugcuuucuuugggauugcuaggcaaggucuggccaggccccccuuuuuucccccaag

SEQ ID NO: 148069 - RNA, 64 nt, hsa
ggcggaucaccugaggucaggaguucgagauuagucuggccaacauggugaaaccccaucucua

SEQ ID NO: 148070 - RNA, 64 nt, hsa
gagugcuacuucagaagccuuauaggauuuucuuucuggccaagauuuccuucuguaucacucc

SEQ ID NO: 148071 - RNA, 64 nt, hsa
augcuccccaucgccugcuugcucuccagccgagucuggccaauuugccauggggaggcugcag

SEQ ID NO: 148072 - RNA, 64 nt, hsa
uugcuuccuuuuuugaccagcaggaaacagcaggucuggccagauucucacuugcccaucaauc

SEQ ID NO: 148073 - RNA, 64 nt, hsa
gagcaagggcugagggaagccaucaccuaacaccucuggccacccaggaccaggucuguguggg

SEQ ID NO: 148074 - RNA, 64 nt, hsa
gcucuaaaguacugacuuuucagcaaauuuccuuucuggccaagcccucugaguuugaaauucu

SEQ ID NO: 148075 - RNA, 64 nt, hsa
cauuuugaaaaagaaaaaaaguacacauucagaaucuggccaauuuaaguuuguauuuuaaaaa

SEQ ID NO: 148076 - RNA, 64 nt, hsa
uaucugaggaagucuagguaguuuuccuuuuggaucuggccauuggugcguguuucauucagau

SEQ ID NO: 148077 - RNA, 64 nt, hsa
gggucucacuggccccaagucucccacccagaacucuggccaaaaauggcucucuaggugggcu

SEQ ID NO: 148078 - RNA, 64 nt, hsa
ucaggaggccagccugccaugagagcacauguccucuggccaggaguaguggcugagcucugug

SEQ ID NO: 148079 - RNA, 64 nt, hsa
uugcugugccugacggaugggcuguagaauggggucuggccaccuggccugcugggaaacagca

SEQ ID NO: 148080 - RNA, 64 nt, hsa
cagggagcagcccugugucgggggcuggaauaguucuggccagaccccguuccccuuccucuau

SEQ ID NO: 148081 - RNA, 64 nt, hsa
caggugggggcagcaggagggcagagggcagagcucuggccacuucugcccacuucauuagggu

SEQ ID NO: 148082 - RNA, 64 nt, hsa
ugucuuuugggagaguacuuuucuccacgagcccucuggccacugugggagggaaggacaaggg

SEQ ID NO: 148083 - RNA, 64 nt, hsa
gugguuggagaacccagggggcugccuugggcccucuggccagagggaagcgggcagcucuagc

SEQ ID NO: 148084 - RNA, 64 nt, hsa
gggcggugugacuggucauggcacuugcuggccuucuggccagagguccuccuggaagccccuc

SEQ ID NO: 148085 - RNA, 64 nt, hsa
aggccuguggggagcacuggaggguuacugacucucuggccaugggaacucagagauucucauc

SEQ ID NO: 148086 - RNA, 64 nt, hsa
auaucaguaucucacagucccauccuuccaaccuucuggccagagguuuuccugaugggugagu

SEQ ID NO: 148087 - RNA, 64 nt, hsa
guggacgcgcugccucaacacuuguccagacaccucuggccagguuggacccgcacacuuacuu

SEQ ID NO: 148088 - RNA, 64 nt, hsa
gacaaagcugcagagcacauuccaugccagacgcucuggccaggaagcugaggccgggcuugag

SEQ ID NO: 148089 - RNA, 64 nt, hsa
cccuagggccuucugggccagaggcaccaucccuucuggccauccaucaaguccaucaaggccc

SEQ ID NO: 148090 - RNA, 64 nt, hsa
cccgaagagacuccuggcguccuuccuacucugcucuggccaguggugccaggugccacccagg

SEQ ID NO: 148091 - RNA, 64 nt, hsa
ugugagcagcccagagcccucucuauccacuuggucuggccagccaggcccuuccucaccaggg

SEQ ID NO: 148092 - RNA, 64 nt, hsa
ccaggcccuuccucaccagggucugaggggcagcucuggccagugcucaccagggccagcaggg

SEQ ID NO: 148093 - RNA, 64 nt, hsa
gugggcauacguggugggaggguggagggcucccucuggccagugccagcugugcucagcuggc

SEQ ID NO: 148094 - RNA, 64 nt, hsa
ggggaacaggagcagggccacagcaccccugaggucuggccaggccccaggcacagagcugccu

SEQ ID NO: 148095 - RNA, 64 nt, hsa
uggagcaguagcagaagccucauuccagaacccaucuggccagagaagcagcagcauccugggg

SEQ ID NO: 148096 - RNA, 64 nt, hsa
cugaaaacaguggcguggcuccccugugcccagaucuggccaugggugaggccugcacagaugu

SEQ ID NO: 148097 - RNA, 64 nt, hsa
agcagagagccaagcaucuucccugggaagucuuucuggccaagucuggccagccuggcccugc

SEQ ID NO: 148098 - RNA, 64 nt, hsa
caagcaucuucccugggaagucuuucuggccaagucuggccagccuggcccugcaggucuccca

SEQ ID NO: 148099 - RNA, 64 nt, hsa
gccuggacggggcuuuugucugaugcucugggauucuggccagacccaccccagggcacauguc

SEQ ID NO: 148100 - RNA, 64 nt, hsa
caggcaccuuggcaucugugcagagacggcccagucuggccaaauccucuuccucuccccugcu

SEQ ID NO: 148101 - RNA, 64 nt, hsa
aggcccagcagcaccugcacccacuuccagcugcucuggccaaaaucuccgcucggccaggccc

SEQ ID NO: 148102 - RNA, 64 nt, hsa
ccguagccuccucccaggcaccugucugcaucccucuggccagugcaugcugagcacgugaccu

SEQ ID NO: 148103 - RNA, 64 nt, hsa
ucucuguggucuccauccugacucuugaacuuacccacaauaagaauaaauucugccucaucuu

SEQ ID NO: 148104 - RNA, 64 nt, hsa
gauuuauuuuucccauaguguaucaguuguuaugccacaauaacaacaauaauaauguucuuaa

SEQ ID NO: 148105 - RNA, 64 nt, hsa
gcaauuuucuguggcacugagaaaccauguaugaccacaauaaaaauccauuuugugaaaggau

SEQ ID NO: 148106 - RNA, 64 nt, hsa
agagagggcaggggagcccacaucuggggcuggcccacaauaccugcucccccgacccccucca

SEQ ID NO: 148107 - RNA, 64 nt, hsa
uugcgugcagggaugcuugcugauggaugaaagaccacaauaaaacaagauuagcagcaaaaca

SEQ ID NO: 148108 - RNA, 64 nt, hsa
ccauuugaaaaaaaucucaaaacacagauuaaaaccacaauaggcuguaguauuuuuuauuuug

SEQ ID NO: 148109 - RNA, 64 nt, hsa
uuucuaaugacuugauuuucuauuuucucccuacccacaauacaguuaucuuuuuuauuguguu

SEQ ID NO: 148110 - RNA, 64 nt, hsa
uacguaugccaugcauaccuccugccccgcgggaccacaauaaaaaccuuggcagacgggaguc

SEQ ID NO: 148111 - RNA, 64 nt, hsa
uuucauuugcagucgacuguacagaaggcacucaccacaauaaaccuuuccugaaagcagaggc

SEQ ID NO: 148112 - RNA, 64 nt, hsa
agggcugggcccuguagugcuggacucucccgggccacaauagggacagggcagggacagggac

SEQ ID NO: 148113 - RNA, 64 nt, hsa
cuugggaaucugcaagaaccuccccuuuccccucccacaauaagaccauuuaagugugugcuaa

SEQ ID NO: 148114 - RNA, 64 nt, hsa
aggaaaauaugguguuuggaauguuagauauuaaccacaauaaggcaugaucuggauuaaaugc

SEQ ID NO: 148115 - RNA, 64 nt, hsa
ucuccaccuggucuuccagaugggagucauauucccacaauaagcagcccuuacuaagccgaga

SEQ ID NO: 148116 - RNA, 64 nt, hsa
cuacuuuuuuuuuuuuuccucaagcuucaggugaccacaauagcaacaccucccuauucuguua

SEQ ID NO: 148117 - RNA, 64 nt, hsa
ccauugcucuugcauguuacaugguuaccacaagccacaauaaaaagcauaacuucuaaaggaa

SEQ ID NO: 148118 - RNA, 64 nt, hsa
aagcuguacauuuggugcacuuuucugugucauaccacaauaaaaaaaaaccuagcaucuuaca

SEQ ID NO: 148119 - RNA, 64 nt, hsa
aucauagcuuaaauacauugaaaaaacuaaaguaccacaauagcuguauuuuucccaauccccu

SEQ ID NO: 148120 - RNA, 64 nt, hsa
aauauuuucauaucaagauaaagucgcacauuuuccacaauacauugcuaaaauaaagaggaga

SEQ ID NO: 148121 - RNA, 64 nt, hsa
aacugcaacuuuuaugaaauggucuuuaauauuuccacaauaauccugugcuauauuuguuuua

SEQ ID NO: 148122 - RNA, 64 nt, hsa
aaacaaugguuugaaacaacuacuggaauauuguccacaauaagcuggaaguuuguuguaguau

SEQ ID NO: 148123 - RNA, 64 nt, hsa
gugcaccugauuuuuggucuaaaaggaauuauugccacaauauauuuuauuuauucuuuagauu

SEQ ID NO: 148124 - RNA, 64 nt, hsa
gguagauccuauuacacuucuguuuauauuaaauccacaauauuuuauuacauuuuuaacuugu

SEQ ID NO: 148125 - RNA, 64 nt, hsa
gacuccgaugugaauuuguugugaauuuguugugccacaauagcaguucuggaaugaagcuagg

SEQ ID NO: 148126 - RNA, 64 nt, hsa
acuucauccuaauaaggauaaaacuuaaggaaaaccacaauaaaccaugaagguguacacaucu

SEQ ID NO: 148127 - RNA, 64 nt, hsa
uaagugagcaugcuacuaagucuucuguccugaaccacaauaauaucuuuuaguucucuuuaac

SEQ ID NO: 148128 - RNA, 64 nt, hsa
accccuucauccucugagugugaccaggcauccuccacaauagcagacaguguuuucugggaua

SEQ ID NO: 148129 - RNA, 64 nt, hsa
uccauuccuaggugucaucagaugaccuugaccaccacaauaccaggcccucuuggauggacuu

SEQ ID NO: 148130 - RNA, 64 nt, hsa
ugaagugccuucugaaucaaggauuuaauuaaggccacaauaccuuuuuaauacucaguguucu

SEQ ID NO: 148131 - RNA, 64 nt, hsa
agugacccagagcuauaaucauccaucaagucuuccacaauaauucccaacucauaaauugcuu

SEQ ID NO: 148132 - RNA, 64 nt, hsa
gguugugauuuauauuuuaaagcuuggugcuaaaccacaauauguauagcauauggagugccug

SEQ ID NO: 148133 - RNA, 64 nt, hsa
gguaauauacuauuauauaauucauuugugauauccacaauaauaugacuggcaagaauuggug

SEQ ID NO: 148134 - RNA, 64 nt, hsa
uaaacacuuuauuuuugaguaauaaaaauauguaccacaauaaauuauuguuaauuaacaugua

SEQ ID NO: 148135 - RNA, 64 nt, hsa
aagaaaccacguuaggggaaaugaaaaaagcaagccacaauaccaugauuccuuccauuuucaa

SEQ ID NO: 148136 - RNA, 64 nt, hsa
auuuugggguuauguuuaaaaaaacauuauugucccacaauauuaccuuaagauuuuucuuuuc

SEQ ID NO: 148137 - RNA, 64 nt, hsa
cagagaaaaaucgucaguugucagauuuugcacaccacaauaaauguaccaccacacacggaau

SEQ ID NO: 148138 - RNA, 64 nt, hsa
uaggcccuucagcagagacccauuugugcccagaccacaauauuucuucuuccucagggacuac

SEQ ID NO: 148139 - RNA, 64 nt, hsa
cguuagcagcaucaguccacaaacacuuaguggcccacaauauauagagagauagaaaagguag

SEQ ID NO: 148140 - RNA, 64 nt, hsa
agacucugcacaaccagauugcuugugcagagggccacaauaaguguauguuuuauauuuuauu

SEQ ID NO: 148141 - RNA, 64 nt, hsa
aaugguuaaaagguuuuauguuauguauauuuuaccacaauaaaugcaaaaaauaaaaagucug

SEQ ID NO: 148142 - RNA, 64 nt, hsa
uuuuuucuuuagcuauuuuacuuaagcauaauagccacaauaggacauauaaaagauuauaaau

SEQ ID NO: 148143 - RNA, 64 nt, hsa
ugcuggugcagagcugaagauuuuggaggguccuccacaauaaggucaaugccagagacggaag

SEQ ID NO: 148144 - RNA, 64 nt, hsa
augcaauguaaaacauguauuagacauucaggcuccacaauaaauuuuaaugagcacuacaaau

SEQ ID NO: 148145 - RNA, 64 nt, hsa
gaauuaccauuaauuacauacagauuuuaccuauccacaauagucagaaaacaacuuggcauuu

SEQ ID NO: 148146 - RNA, 64 nt, hsa
aaaauguuuuaaauaaaaauaaagaaaagauuucccacaauaaaaagauuuuuacuggaaaaaa

SEQ ID NO: 148147 - RNA, 64 nt, hsa
aaacaauagggggagauuagacaaaaaaaaaaauccacaauauuccaaguacaacucuucauca

SEQ ID NO: 148148 - RNA, 64 nt, hsa
auaguagagugaggugagggucguggcuaaaaccccacaauaacuuuacauuccuagcuuuaca

SEQ ID NO: 148149 - RNA, 64 nt, hsa
uuuuugcugauugcuaagggaaauaacaguauuuccacaauaggguucaaauuccugcaaaauu

SEQ ID NO: 148150 - RNA, 64 nt, hsa
aaaaauuagacauuuugccaaguuaguuuucuuaccacaauacccucuuggcuuuuuuuuuuuu

SEQ ID NO: 148151 - RNA, 64 nt, hsa
aaaugguaaauauugcaaaaguuaaacaaggguaccacaauaucauuuauaauugaugucaaua

SEQ ID NO: 148152 - RNA, 64 nt, hsa
aagagcaaaucaauucuagucauauauuaaacauccacaauaaccaagauauuuuuaucccaag

SEQ ID NO: 148153 - RNA, 64 nt, hsa
cuggcaccaguggaaacacauacugaagcugccaccacaauagcuugugagguuuuauccagcu

SEQ ID NO: 148154 - RNA, 64 nt, hsa
uaaacccaugaguuuaugcccugggcuccuuagcccacaauaguguaauaaaagugccccgggc

SEQ ID NO: 148155 - RNA, 64 nt, hsa
ggguuggggacaggucugccaaucuaucuaaaagccacaauauggaagaaguauucaauuuaua

SEQ ID NO: 148156 - RNA, 64 nt, hsa
aggggguagcagauuccauucguuuucaauauugccacaauacccagggauuaaugcugccaca

SEQ ID NO: 148157 - RNA, 64 nt, hsa
cauauauacauucagaacuuuuauuuuaaaacaaccacaauaacauuaauaauagaaaauucau

SEQ ID NO: 148158 - RNA, 64 nt, hsa
ugcuggccacaccagcccccuuucaccuccagugccacaauaaaccuguacccagcugugucuu

SEQ ID NO: 148159 - RNA, 64 nt, hsa
caagagccccagccaguuuacuccagguagauuuccacaauaugcaaaguggugguggggucaa

SEQ ID NO: 148160 - RNA, 64 nt, hsa
ucucuccuuugcuuuccuugaagucagcuuuggaccacaauaauuucacuguagaugauaugcu

SEQ ID NO: 148161 - RNA, 64 nt, hsa
gaaagcuuuaaaaguuuuauauccagauauacaaccacaauaaagcaaaauaaccuacuaucaa

SEQ ID NO: 148162 - RNA, 64 nt, hsa
caugaaggcuuaauguuaaguuuccuuuaaugauccacaauaaucccuuugaucacguuaaucu

SEQ ID NO: 148163 - RNA, 64 nt, hsa
ucuaacaagguauaucuaguaggggagaaagccaccacaauaaauauauuuguuaauaguuuuu

SEQ ID NO: 148164 - RNA, 64 nt, hsa
aggaaguuaauaccuauguaauacauagaaacuuccacaauaaaaugccauugaugguugaaau

SEQ ID NO: 148165 - RNA, 64 nt, hsa
gccaccacgccagggcuuuauuuauuuauuuuuaccacaauaguuugaagcaguaagggggaag

SEQ ID NO: 148166 - RNA, 64 nt, hsa
uccuaauugcaagccaaauuuaauguaccuuguuccacaauaauuuuuuauuaaaaaaauccua

SEQ ID NO: 148167 - RNA, 64 nt, hsa
gccccugcuggccgccgcgucccccgagauugacccacaauaaagcacaggccuuaccgcggcg

SEQ ID NO: 148168 - RNA, 64 nt, hsa
aguuauaacucagccuuuaggaacaccggagaacccacaauaauagaaaucuuuucguguuccc

SEQ ID NO: 148169 - RNA, 64 nt, hsa
aucgcuccaauaaacauauauugugaaaaugcauccacaauaaauggaauuccuuccugcaaaa

SEQ ID NO: 148170 - RNA, 64 nt, hsa
caguauuucuuuuucucacaucuuugccguuucaccacaauaauaaaucgggugaagugugcac

SEQ ID NO: 148171 - RNA, 64 nt, hsa
ucauuuuuuucaacaauggagacauagauuugacccacaauaacuucucccccucucuuuuuac

SEQ ID NO: 148172 - RNA, 64 nt, hsa
acacuuuaaaauggaaaauuuauauguauuuuuaccacaauaaacaaaaaacccuaaaaaaacu

SEQ ID NO: 148173 - RNA, 64 nt, hsa
aagcauuucauauuuuaauuuaaauuggauucaaccacaauaaagaaaaugagaaaagcuuuca

SEQ ID NO: 148174 - RNA, 64 nt, hsa
accuuaacugucauguuuuguuguucaucuguggccacaauaaaguuuacuuguaaaauuuuag

SEQ ID NO: 148175 - RNA, 64 nt, hsa
aucgugccugccgccccuucaggucccgaccuccccacaauaaaaugugauuggaucguguggu

SEQ ID NO: 148176 - RNA, 64 nt, hsa
uuuggugucagaacuuugggggccgggccccuccccacaauaaagaugcucuccgaccuuccug

SEQ ID NO: 148177 - RNA, 64 nt, hsa
cuguggcauucauauuucauauucauauuucaaaccacaauauccagcaaaaugucuccugagc

SEQ ID NO: 148178 - RNA, 64 nt, hsa
ucacuggauugucugggaugacuugggcucauauccacaauacuugguauaagguaguagauug

SEQ ID NO: 148179 - RNA, 64 nt, hsa
aaaagcgaagcagacaaaaagaaccuuaccucccccacaauacaacauugggcugcugaaccca

SEQ ID NO: 148180 - RNA, 64 nt, hsa
cucucauguuaguacaugcagaacauuuaauauuccacaauauauaugguuuuuuauucauaag

SEQ ID NO: 148181 - RNA, 64 nt, hsa
ccagguuaugugguguaaagguuuguuauacgugccacaauauagcauauaaauauuaugccau

SEQ ID NO: 148182 - RNA, 64 nt, hsa
aggaggcagcucccuccuggcacaugggggcuggccacaauagcccagagggucagaacuggac

SEQ ID NO: 148183 - RNA, 64 nt, hsa
acugaggaaagggaacaugcugguucuggaaaagccacaauauugaaucuaaaaggaaaccguu

SEQ ID NO: 148184 - RNA, 64 nt, hsa
gagguuauguguguauguuguaguuuuauugcagccacaauaauuuuaccaaaguuuucacaua

SEQ ID NO: 148185 - RNA, 64 nt, hsa
uccugcccuuccucaguuuaauccuucuaguuucccacaauauaaaacuguacuucacugucag

SEQ ID NO: 148186 - RNA, 64 nt, hsa
ggauaauuaaauaaugugccaaauuuaaguuguaccacaauauucaaaucauagucuuauggaa

SEQ ID NO: 148187 - RNA, 64 nt, hsa
ucuguccaaaugaaaaagguauuucuaacaacaaccacaauaacaauaacaacuuagugcuuag

SEQ ID NO: 148188 - RNA, 64 nt, hsa
uagaagggaaaacugcauggcagauacgugacugccacaauaugcaucgaagacaaacuuacua

SEQ ID NO: 148189 - RNA, 64 nt, hsa
uucugcaugauccaggagcacauaccacaaacuaccacaauaaaaaagcuguuuuugcuaauug

SEQ ID NO: 148190 - RNA, 64 nt, hsa
agggccccuagaaaccaccuggguucagccucucccacaauaagaguucuugcccuucauaccc

SEQ ID NO: 148191 - RNA, 64 nt, hsa
uucaaaagugagguagucauccagguucccccucccacaauauuuuuguaucauaaaauuuaga

SEQ ID NO: 148192 - RNA, 64 nt, hsa
ccagccaggccaucucacguguacauaaucagagccacaauaaauucuauuucacaccccuugu

SEQ ID NO: 148193 - RNA, 64 nt, hsa
uaaauaaccucauguuuauuccuaaucuaaauugccacaauauuuuuaauguaugguuacacug

SEQ ID NO: 148194 - RNA, 64 nt, hsa
ccaguugaucuggcaaugacuuuuugugugugggccacaauauugauuuucccauuaacaauuu

SEQ ID NO: 148195 - RNA, 64 nt, hsa
aaaaaaccuucaagucuacuuacccuucuccuguccacaauaaaguugagaaaacaccaagcug

SEQ ID NO: 148196 - RNA, 64 nt, hsa
cuaguauggggcuagaugaagcccagaguaacacccacaauauaaauggguuccaaaauggccc

SEQ ID NO: 148197 - RNA, 64 nt, hsa
gagcaauauugagguuggccgguuauaaggagucccacaauagaauacccaacaaaguggcugc

SEQ ID NO: 148198 - RNA, 64 nt, hsa
uaagauucaucagagcccacccuauucuaaggaaccacaauaacuuacucuggccccaguguua

SEQ ID NO: 148199 - RNA, 64 nt, hsa
guuaaacauucuuauuucucauauuuaaaggauaccacaauaagcugcuguguguggaauugcu

SEQ ID NO: 148200 - RNA, 64 nt, hsa
uggcucuuguagcuuaguaaugagucauagcuacccacaauaaccuaauaaaaacucaaguuca

SEQ ID NO: 148201 - RNA, 64 nt, hsa
ccucugcauguucugcucuugugcccuucugagcccacaauaaaggcugagcucuuaucuugca

SEQ ID NO: 148202 - RNA, 64 nt, hsa
ugucaacuacccaccuggggaugaagcucacuggccacaauacccaccucuguggaugauguug

SEQ ID NO: 148203 - RNA, 64 nt, hsa
cuuccugaagaagagaaauggauguuuccaaauuccacaauaagcaauauguggugauaaugaa

SEQ ID NO: 148204 - RNA, 64 nt, hsa
guucuuuaugaauauuaccuuugauacauaugauccacaauauaaaaaccaaaaacuacugugu

SEQ ID NO: 148205 - RNA, 64 nt, hsa
uuaucuacacacuuucgggucugaccacuaccucccacaauaccuagccauuuuggaaggggaa

SEQ ID NO: 148206 - RNA, 64 nt, hsa
cuuuagaguuaagccuuuguauuuccauguuauuccacaauaugcaauauuucucugaguagcu

SEQ ID NO: 148207 - RNA, 64 nt, hsa
gucauuugggcuuucuguugaaugaaucaacaaaccacaauacuuccugggaccuuuuguacuu

SEQ ID NO: 148208 - RNA, 64 nt, hsa
aauuacuaaaaagcuugguauguaaaauuauucuccacaauauuaccaugcaaguuaucucuga

SEQ ID NO: 148209 - RNA, 64 nt, hsa
cuuguggagcaggacuaccccauaggcaguguacccacaauagauagccuuuuguuguuguugu

SEQ ID NO: 148210 - RNA, 64 nt, hsa
ugccaagggaguauuuucacaaaguucaaaacagccacaauaaucagagauggagcaaaccagu

SEQ ID NO: 148211 - RNA, 64 nt, hsa
auguugagggguugaauguuuuacuacaaacaagccacaauaaagugucuaucaacauguuucu

SEQ ID NO: 148212 - RNA, 64 nt, hsa
ccugugaagauguaugaaugguaucuuuuauaauccacaauacauuucugguaagauggaauca

SEQ ID NO: 148213 - RNA, 64 nt, hsa
agcugcucuuuaggauggggaguauuauggaaauccacaauaacaaucuauggcaagcaacuaa

SEQ ID NO: 148214 - RNA, 64 nt, hsa
uaauuuuaaucaaauucucauagggguucaugacccacaauaggauacaaacgaagaguuuaag

SEQ ID NO: 148215 - RNA, 64 nt, hsa
guaucuuaauuuuuacuugcggugacuauucuugccacaauauuggagaauaaugauagaugau

SEQ ID NO: 148216 - RNA, 64 nt, hsa
auccuuuugguagaaaucagguuacaaagcaaaaccacaauaucagcaacacuuccuaaucaaa

SEQ ID NO: 148217 - RNA, 64 nt, hsa
aucucaccuuuggggcugcguuucaucaccucguccacaauagucaauccuaauugugguccug

SEQ ID NO: 148218 - RNA, 64 nt, hsa
aaagcagaaaaccaggaaaauuuucuuaaaauauccacaauauuccuugagugagucagaaucu

SEQ ID NO: 148219 - RNA, 64 nt, hsa
cuugacugauaacagcucugucaauauuuugaugccacaauaaacuugauuuuucuuuacauuc

SEQ ID NO: 148220 - RNA, 64 nt, hsa
auugaaaauauuguaacuuucaguuagaaaucagccacaauaaacaacaugggaaaaugccuua

SEQ ID NO: 148221 - RNA, 64 nt, hsa
gacuggcacuggugguuuuugcucucgacaguauccacaauagcugacggcuggguguuucagu

SEQ ID NO: 148222 - RNA, 64 nt, hsa
aaugcugaccggugcuuauccucuaagcccugauccacaauaaaaauggacccaacucagcucu

SEQ ID NO: 148223 - RNA, 64 nt, hsa
cacauuuguacaauucauugauucucuuuuccuuccacaauaaaaugguauacaagaacaggag

SEQ ID NO: 148224 - RNA, 64 nt, hsa
uuaguucugacauguauauauugcuucaguagagccacaauauguaucuuugcuguaaagugca

SEQ ID NO: 148225 - RNA, 64 nt, hsa
acagacauugcuuucaaauguuagcugcugaaauccacaauaaacgucauuuaaaaaaaaaaaa

SEQ ID NO: 148226 - RNA, 64 nt, hsa
cccugguuccugucuguuauuuguaaacugaggaccacaauaaagaaaucuuuauauuuaucga

SEQ ID NO: 148227 - RNA, 64 nt, hsa
guuccaguucuguaagucucacuuuguucagcugccacaauagacaucaucguuuggcccucuc

SEQ ID NO: 148228 - RNA, 64 nt, hsa
ccucccaaagugcugggauuauaggcacaagacaccacaauaauuauugccuguaugucaauua

SEQ ID NO: 148229 - RNA, 64 nt, hsa
uaaugugugacaacuuggaaauuuguacugaaauccacaauaaucaguuuuugcuggauggguu

SEQ ID NO: 148230 - RNA, 64 nt, hsa
agggcucacgugggaaccccccucccacccaccgccacaauaaagaucgcccccaccuccaccc

SEQ ID NO: 148231 - RNA, 64 nt, hsa
uccaauguccugaaacaugaacccaaaaagagacccacaauaaacucgugacuuguccccucau

SEQ ID NO: 148232 - RNA, 64 nt, hsa
uauuuaagagguggggucccaggugggaacccccccacaauaaagucugucaauguuuggagag

SEQ ID NO: 148233 - RNA, 64 nt, hsa
ccgacucccggggcccucagacaccccgauccucccacaauaaaggcuucucaauccgcacucu

SEQ ID NO: 148234 - RNA, 64 nt, hsa
aguaugcaaacuuuaaucgcacaucuucuguauuccacaauaguacuuacucuugagaagcaua

SEQ ID NO: 148235 - RNA, 64 nt, hsa
ugugagaaagccuucagcccucucucauugguuaccacaauauuuacaugaggaaaauaccaca

SEQ ID NO: 148236 - RNA, 64 nt, hsa
guaaucaaccuuuacuucccaagcuguuuguucuccacaauaggcucucaacaaauguguggua

SEQ ID NO: 148237 - RNA, 64 nt, hsa
accucagagauauugcaggcuccacuccagaucaccacaauaaugugaauauugcaauaaagca

SEQ ID NO: 148238 - RNA, 64 nt, hsa
uggcuguuggcugaacgcugacugcagcuccuggccacaauagccucaucaacauggcugcuug

SEQ ID NO: 148239 - RNA, 64 nt, hsa
aaucuuuuugagaauuuguuuacuugauuucuuuccacaauaaacugacagagaacgcuacuaa

SEQ ID NO: 148240 - RNA, 64 nt, hsa
ccucaccaccccugucccgcugccagaaauacacccacaauaaaaaccugaaaaccaacuccgc

SEQ ID NO: 148241 - RNA, 64 nt, hsa
acgucccacccuguccccagauccccuauucccuccacaauaacagaaacacucccagggacuc

SEQ ID NO: 148242 - RNA, 64 nt, hsa
ucccgacuccuggagcccugacaccccgauccucccacaauaaaggcuucucaauccgcacucu

SEQ ID NO: 148243 - RNA, 64 nt, hsa
ccgucucccggggcccuaggacaccccgauccucccacaauaaaggcuucucaauccgcacucu

SEQ ID NO: 148244 - RNA, 64 nt, hsa
ggagacagaacaacagagucucagggaaagagaaccacaauagaaaaaggcagaaaaggccggg

SEQ ID NO: 148245 - RNA, 64 nt, hsa
guucuccgagggcugagccccgcccagcuccccuccacaauaaacgcuguuucuccuugagcuu

SEQ ID NO: 148246 - RNA, 64 nt, hsa
accucaaagauauuguggauuggguugcagcccaccacaauaaagcaaauauugcuauaaagug

SEQ ID NO: 148247 - RNA, 64 nt, hsa
guaauaacagaauuggaaccaugccacucuugagccacaauaccugucaccagccuguuguuuu

SEQ ID NO: 148248 - RNA, 64 nt, hsa
cuacaucauuaaccaguaaggacuuuuuaauuaaccacaauaccacuaucacaccuaauaauag

SEQ ID NO: 148249 - RNA, 64 nt, hsa
ccaccaaguucaccagguucaccagacacggccuccacaauagccacacccacaccugagcugu

SEQ ID NO: 148250 - RNA, 64 nt, hsa
gggucugugauggggaaggguggaugucccuuccccacaauaggcuuagugcuuggcucagaca

SEQ ID NO: 148251 - RNA, 64 nt, hsa
ucaaacuucucccuguagaccguaaggaugaauuccacaauaggauccuuuuuaaaaucgauuu

SEQ ID NO: 148252 - RNA, 64 nt, hsa
cuuguauucuuucacuugaaaaaacuccaaaauuccacaauauuuuaguaguuaacuuccuauu

SEQ ID NO: 148253 - RNA, 64 nt, hsa
caaaaacuaaacacacacacaaacccccagaaacccacaauauguacacgcuaaggaaaaacua

SEQ ID NO: 148254 - RNA, 64 nt, hsa
ucuagcccaucuuacuccagguuugauacucuuuccacaauacugagcugccucagaauccuca

SEQ ID NO: 148255 - RNA, 64 nt, hsa
ugcaaucauaugguugacuuuugaauggaaaaccccacaauauuaagaaaagcauucaugugac

SEQ ID NO: 148256 - RNA, 64 nt, hsa
aauuuaauuuauauagaguaccuauuauuauaugccacaauagagcucuaugagaaacaguguc

SEQ ID NO: 148257 - RNA, 64 nt, hsa
gggagggauuuugacuaguugaauuauuaagccaccacaauaaagcagauuuuuaaauaagaaa

SEQ ID NO: 148258 - RNA, 64 nt, hsa
ggggcuuaaugguuuccuggugauucuuaccaauccacaauaaacauggcccauuggcauaucu

SEQ ID NO: 148259 - RNA, 64 nt, hsa
aagcccacagagguggaacuuaauuaccuaagagccacaauaagccacugguaucugggggacu

SEQ ID NO: 148260 - RNA, 64 nt, hsa
agcccucucacccgaggaucccuacccccuggccccacaauaaacaugaucugaagcagcucug

SEQ ID NO: 148261 - RNA, 64 nt, hsa
ccacuuaccuggagcugcucuccuguauuauccuccacaauaaaauucuccagaaaauaagucc

SEQ ID NO: 148262 - RNA, 64 nt, hsa
uacuccuggucugauuauuuuccccaucugaaauccacaauacugcaggagcccucuugaaauu

SEQ ID NO: 148263 - RNA, 64 nt, hsa
aggggaagugagauuuaaaaaaccauucacagguccacaauauucauacuauguguuugcagua

SEQ ID NO: 148264 - RNA, 64 nt, hsa
guguggggacgggggagucagggccccccaagucccacaauagccccaauguuugccuauccac

SEQ ID NO: 148265 - RNA, 63 nt, hsa; identical to SEQ ID NO: 23714

SEQ ID NO: 148266 - RNA, 64 nt, hsa; identical to SEQ ID NO: 23715

SEQ ID NO: 148267 - RNA, 64 nt, hsa; identical to SEQ ID NO: 23716

SEQ ID NO: 148268 - RNA, 64 nt, hsa; identical to SEQ ID NO: 23717

SEQ ID NO: 148269 - RNA, 64 nt, hsa; identical to SEQ ID NO: 23718

SEQ ID NO: 148270 - RNA, 64 nt, hsa; identical to SEQ ID NO: 23719

SEQ ID NO: 148271 - RNA, 64 nt, hsa; identical to SEQ ID NO: 23720

SEQ ID NO: 148272 - RNA, 64 nt, hsa; identical to SEQ ID NO: 23721

SEQ ID NO: 148273 - RNA, 64 nt, hsa; identical to SEQ ID NO: 23722

SEQ ID NO: 148274 - RNA, 64 nt, hsa; identical to SEQ ID NO: 23723

SEQ ID NO: 148275 - RNA, 64 nt, hsa; identical to SEQ ID NO: 23724

SEQ ID NO: 148276 - RNA, 64 nt, hsa; identical to SEQ ID NO: 23725

SEQ ID NO: 148277 - RNA, 64 nt, hsa; identical to SEQ ID NO: 23726

SEQ ID NO: 148278 - RNA, 64 nt, hsa; identical to SEQ ID NO: 23727

SEQ ID NO: 148279 - RNA, 64 nt, hsa; identical to SEQ ID NO: 23728

SEQ ID NO: 148280 - RNA, 64 nt, hsa; identical to SEQ ID NO: 23729

SEQ ID NO: 148281 - RNA, 64 nt, hsa
ccaaagaaaugccaauaugugacauuaguaugaaauuuacuacaguuccauuuaacauuccaac

SEQ ID NO: 148282 - RNA, 64 nt, hsa
aauaaaauauuggcaaacaauacagcaacaaauaauuuacuaucacucaggauuauaaggcugg

SEQ ID NO: 148283 - RNA, 64 nt, hsa
aacccuuuuaaaaccaucagauaucgugagacuuauuuacuaccaugagaacaguaugggggaa

SEQ ID NO: 148284 - RNA, 64 nt, hsa
acaauugcauacccauauuuuaagggacaggugaauuuacuacuuucuaaaguuuauugauacu

SEQ ID NO: 148285 - RNA, 64 nt, hsa
gaguaacauaaaauaaaaguacauuuuauaaaccauuuacuauggcuuuguaacaauugcauac

SEQ ID NO: 148286 - RNA, 64 nt, hsa
guauaucuauuaaaaauuucaacuucccacauauauuuacuaagaugauuaagacuuacauuuu

SEQ ID NO: 148287 - RNA, 64 nt, hsa
aaaugaauaucugcaugggauuugcuaucauaauauuuacuaugcagaugaauucagugugagg

SEQ ID NO: 148288 - RNA, 64 nt, hsa
aauuuuuaaaauucagaauguaaaaauuggguaaauuuacuacugaggggagugcacuuauuua

SEQ ID NO: 148289 - RNA, 64 nt, hsa
auuuuugauguuuauauauaaacucuauauccuaauuuacuaauacucaucagaugucagccuu

SEQ ID NO: 148290 - RNA, 64 nt, hsa
ugauacuaaugacuacaaaaaaagguaaugccucauuuacuaguauuguuguaaaaugaggaau

SEQ ID NO: 148291 - RNA, 64 nt, hsa
uugcuagcaaggcugagcacuuuuccaugugaugauuuacuaguuguauuuccuuguguguaaa

SEQ ID NO: 148292 - RNA, 55 nt, hsa; identical to SEQ ID NO: 118903

SEQ ID NO: 148293 - RNA, 64 nt, hsa
gcuauucguggugggggugggggggaacccuaugauuuacuaugcagaugaagaggguaggaac

SEQ ID NO: 148294 - RNA, 64 nt, hsa
cccuggagggcacuguguuugguugugcaaauguauuuacuaugcguguuuccagcaguuggca

SEQ ID NO: 148295 - RNA, 64 nt, hsa
cucuaucucacuggcugcauucccuacacagggaauuuacuacccuauaugugaauaucccugu

SEQ ID NO: 148296 - RNA, 64 nt, hsa; identical to SEQ ID NO: 65415

SEQ ID NO: 148297 - RNA, 64 nt, hsa; identical to SEQ ID NO: 65416

SEQ ID NO: 148298 - RNA, 64 nt, hsa; identical to SEQ ID NO: 65417

SEQ ID NO: 148299 - RNA, 64 nt, hsa; identical to SEQ ID NO: 65418

SEQ ID NO: 148300 - RNA, 64 nt, hsa; identical to SEQ ID NO: 61352

SEQ ID NO: 148301 - RNA, 64 nt, hsa; identical to SEQ ID NO: 61353

SEQ ID NO: 148302 - RNA, 64 nt, hsa; identical to SEQ ID NO: 65421

SEQ ID NO: 148303 - RNA, 64 nt, hsa; identical to SEQ ID NO: 65422

SEQ ID NO: 148304 - RNA, 64 nt, hsa; identical to SEQ ID NO: 65423

SEQ ID NO: 148305 - RNA, 64 nt, hsa; identical to SEQ ID NO: 65424

SEQ ID NO: 148306 - RNA, 64 nt, hsa; identical to SEQ ID NO: 65425

SEQ ID NO: 148307 - RNA, 64 nt, hsa; identical to SEQ ID NO: 65426

SEQ ID NO: 148308 - RNA, 64 nt, hsa; identical to SEQ ID NO: 61354

SEQ ID NO: 148309 - RNA, 64 nt, hsa; identical to SEQ ID NO: 61355

SEQ ID NO: 148310 - RNA, 64 nt, hsa; identical to SEQ ID NO: 65429

SEQ ID NO: 148311 - RNA, 64 nt, hsa; identical to SEQ ID NO: 65430

SEQ ID NO: 148312 - RNA, 64 nt, hsa; identical to SEQ ID NO: 65431

SEQ ID NO: 148313 - RNA, 64 nt, hsa; identical to SEQ ID NO: 65432

SEQ ID NO: 148314 - RNA, 64 nt, hsa; identical to SEQ ID NO: 65433

SEQ ID NO: 148315 - RNA, 64 nt, hsa; identical to SEQ ID NO: 65434

SEQ ID NO: 148316 - RNA, 64 nt, hsa; identical to SEQ ID NO: 65435

SEQ ID NO: 148317 - RNA, 64 nt, hsa; identical to SEQ ID NO: 65436

SEQ ID NO: 148318 - RNA, 64 nt, hsa; identical to SEQ ID NO: 65437

SEQ ID NO: 148319 - RNA, 64 nt, hsa; identical to SEQ ID NO: 65438

SEQ ID NO: 148320 - RNA, 64 nt, hsa; identical to SEQ ID NO: 65439

SEQ ID NO: 148321 - RNA, 64 nt, hsa; identical to SEQ ID NO: 65440

SEQ ID NO: 148322 - RNA, 64 nt, hsa; identical to SEQ ID NO: 61356

SEQ ID NO: 148323 - RNA, 64 nt, hsa; identical to SEQ ID NO: 61357

SEQ ID NO: 148324 - RNA, 64 nt, hsa; identical to SEQ ID NO: 65443

SEQ ID NO: 148325 - RNA, 64 nt, hsa; identical to SEQ ID NO: 65444

SEQ ID NO: 148326 - RNA, 64 nt, hsa; identical to SEQ ID NO: 65445

SEQ ID NO: 148327 - RNA, 64 nt, hsa; identical to SEQ ID NO: 65446

SEQ ID NO: 148328 - RNA, 64 nt, hsa; identical to SEQ ID NO: 65447

SEQ ID NO: 148329 - RNA, 64 nt, hsa; identical to SEQ ID NO: 65448

SEQ ID NO: 148330 - RNA, 64 nt, hsa; identical to SEQ ID NO: 65449

SEQ ID NO: 148331 - RNA, 64 nt, hsa; identical to SEQ ID NO: 65450

SEQ ID NO: 148332 - RNA, 64 nt, hsa; identical to SEQ ID NO: 65451

SEQ ID NO: 148333 - RNA, 64 nt, hsa; identical to SEQ ID NO: 65452

SEQ ID NO: 148334 - RNA, 64 nt, hsa; identical to SEQ ID NO: 65453

SEQ ID NO: 148335 - RNA, 64 nt, hsa; identical to SEQ ID NO: 65454

SEQ ID NO: 148336 - RNA, 64 nt, hsa; identical to SEQ ID NO: 65455

SEQ ID NO: 148337 - RNA, 64 nt, hsa; identical to SEQ ID NO: 65456

SEQ ID NO: 148338 - RNA, 64 nt, hsa; identical to SEQ ID NO: 65457

SEQ ID NO: 148339 - RNA, 64 nt, hsa; identical to SEQ ID NO: 65458

SEQ ID NO: 148340 - RNA, 64 nt, hsa; identical to SEQ ID NO: 65459

SEQ ID NO: 148341 - RNA, 64 nt, hsa; identical to SEQ ID NO: 65460

SEQ ID NO: 148342 - RNA, 64 nt, hsa; identical to SEQ ID NO: 65461

SEQ ID NO: 148343 - RNA, 64 nt, hsa; identical to SEQ ID NO: 65462

SEQ ID NO: 148344 - RNA, 64 nt, hsa; identical to SEQ ID NO: 65463

SEQ ID NO: 148345 - RNA, 64 nt, hsa; identical to SEQ ID NO: 65464

SEQ ID NO: 148346 - RNA, 64 nt, hsa; identical to SEQ ID NO: 61358

SEQ ID NO: 148347 - RNA, 64 nt, hsa; identical to SEQ ID NO: 61359

SEQ ID NO: 148348 - RNA, 64 nt, hsa; identical to SEQ ID NO: 65467

SEQ ID NO: 148349 - RNA, 64 nt, hsa; identical to SEQ ID NO: 65468

SEQ ID NO: 148350 - RNA, 64 nt, hsa; identical to SEQ ID NO: 65469

SEQ ID NO: 148351 - RNA, 64 nt, hsa; identical to SEQ ID NO: 65470

SEQ ID NO: 148352 - RNA, 64 nt, hsa; identical to SEQ ID NO: 65471

SEQ ID NO: 148353 - RNA, 64 nt, hsa; identical to SEQ ID NO: 65472

SEQ ID NO: 148354 - RNA, 64 nt, hsa; identical to SEQ ID NO: 65473

SEQ ID NO: 148355 - RNA, 64 nt, hsa; identical to SEQ ID NO: 65474

SEQ ID NO: 148356 - RNA, 64 nt, hsa; identical to SEQ ID NO: 65475

SEQ ID NO: 148357 - RNA, 64 nt, hsa; identical to SEQ ID NO: 65476

SEQ ID NO: 148358 - RNA, 64 nt, hsa; identical to SEQ ID NO: 65477

SEQ ID NO: 148359 - RNA, 64 nt, hsa; identical to SEQ ID NO: 65478

SEQ ID NO: 148360 - RNA, 64 nt, hsa; identical to SEQ ID NO: 65479

SEQ ID NO: 148361 - RNA, 64 nt, hsa; identical to SEQ ID NO: 65480

SEQ ID NO: 148362 - RNA, 64 nt, hsa; identical to SEQ ID NO: 65481

SEQ ID NO: 148363 - RNA, 64 nt, hsa; identical to SEQ ID NO: 65482

SEQ ID NO: 148364 - RNA, 64 nt, hsa; identical to SEQ ID NO: 65483

SEQ ID NO: 148365 - RNA, 64 nt, hsa; identical to SEQ ID NO: 65484

SEQ ID NO: 148366 - RNA, 64 nt, hsa; identical to SEQ ID NO: 65485

SEQ ID NO: 148367 - RNA, 64 nt, hsa; identical to SEQ ID NO: 65486

SEQ ID NO: 148368 - RNA, 64 nt, hsa; identical to SEQ ID NO: 65487

SEQ ID NO: 148369 - RNA, 64 nt, hsa; identical to SEQ ID NO: 65488

SEQ ID NO: 148370 - RNA, 64 nt, hsa; identical to SEQ ID NO: 65489

SEQ ID NO: 148371 - RNA, 64 nt, hsa; identical to SEQ ID NO: 65490

SEQ ID NO: 148372 - RNA, 64 nt, hsa; identical to SEQ ID NO: 65491

SEQ ID NO: 148373 - RNA, 64 nt, hsa; identical to SEQ ID NO: 65492

SEQ ID NO: 148374 - RNA, 64 nt, hsa; identical to SEQ ID NO: 65493

SEQ ID NO: 148375 - RNA, 64 nt, hsa; identical to SEQ ID NO: 65494

SEQ ID NO: 148376 - RNA, 64 nt, hsa; identical to SEQ ID NO: 65495

SEQ ID NO: 148377 - RNA, 64 nt, hsa; identical to SEQ ID NO: 65496

SEQ ID NO: 148378 - RNA, 64 nt, hsa; identical to SEQ ID NO: 65497

SEQ ID NO: 148379 - RNA, 64 nt, hsa; identical to SEQ ID NO: 65498

SEQ ID NO: 148380 - RNA, 64 nt, hsa; identical to SEQ ID NO: 65499

SEQ ID NO: 148381 - RNA, 64 nt, hsa; identical to SEQ ID NO: 65500

SEQ ID NO: 148382 - RNA, 64 nt, hsa; identical to SEQ ID NO: 65501

SEQ ID NO: 148383 - RNA, 64 nt, hsa; identical to SEQ ID NO: 65502

SEQ ID NO: 148384 - RNA, 64 nt, hsa; identical to SEQ ID NO: 65503

SEQ ID NO: 148385 - RNA, 64 nt, hsa; identical to SEQ ID NO: 65504

SEQ ID NO: 148386 - RNA, 64 nt, hsa; identical to SEQ ID NO: 65505

SEQ ID NO: 148387 - RNA, 64 nt, hsa; identical to SEQ ID NO: 65506

SEQ ID NO: 148388 - RNA, 64 nt, hsa; identical to SEQ ID NO: 65507

SEQ ID NO: 148389 - RNA, 64 nt, hsa; identical to SEQ ID NO: 65508

SEQ ID NO: 148390 - RNA, 64 nt, hsa; identical to SEQ ID NO: 61360

SEQ ID NO: 148391 - RNA, 64 nt, hsa; identical to SEQ ID NO: 61361

SEQ ID NO: 148392 - RNA, 64 nt, hsa; identical to SEQ ID NO: 65511

SEQ ID NO: 148393 - RNA, 64 nt, hsa; identical to SEQ ID NO: 65512

SEQ ID NO: 148394 - RNA, 64 nt, hsa; identical to SEQ ID NO: 65513

SEQ ID NO: 148395 - RNA, 64 nt, hsa; identical to SEQ ID NO: 65514

SEQ ID NO: 148396 - RNA, 64 nt, hsa; identical to SEQ ID NO: 65515

SEQ ID NO: 148397 - RNA, 64 nt, hsa; identical to SEQ ID NO: 65516

SEQ ID NO: 148398 - RNA, 64 nt, hsa; identical to SEQ ID NO: 65517

SEQ ID NO: 148399 - RNA, 64 nt, hsa; identical to SEQ ID NO: 65518

SEQ ID NO: 148400 - RNA, 64 nt, hsa; identical to SEQ ID NO: 65519

SEQ ID NO: 148401 - RNA, 64 nt, hsa; identical to SEQ ID NO: 65520

SEQ ID NO: 148402 - RNA, 64 nt, hsa; identical to SEQ ID NO: 65521

SEQ ID NO: 148403 - RNA, 64 nt, hsa; identical to SEQ ID NO: 65522

SEQ ID NO: 148404 - RNA, 64 nt, hsa; identical to SEQ ID NO: 65523

SEQ ID NO: 148405 - RNA, 64 nt, hsa; identical to SEQ ID NO: 65524

SEQ ID NO: 148406 - RNA, 64 nt, hsa; identical to SEQ ID NO: 65525

SEQ ID NO: 148407 - RNA, 64 nt, hsa; identical to SEQ ID NO: 65526

SEQ ID NO: 148408 - RNA, 64 nt, hsa; identical to SEQ ID NO: 65527

SEQ ID NO: 148409 - RNA, 64 nt, hsa; identical to SEQ ID NO: 65528

SEQ ID NO: 148410 - RNA, 64 nt, hsa; identical to SEQ ID NO: 61362

SEQ ID NO: 148411 - RNA, 64 nt, hsa; identical to SEQ ID NO: 61363

SEQ ID NO: 148412 - RNA, 64 nt, hsa; identical to SEQ ID NO: 61364

SEQ ID NO: 148413 - RNA, 64 nt, hsa; identical to SEQ ID NO: 61365

SEQ ID NO: 148414 - RNA, 64 nt, hsa; identical to SEQ ID NO: 65533

SEQ ID NO: 148415 - RNA, 64 nt, hsa; identical to SEQ ID NO: 65534

SEQ ID NO: 148416 - RNA, 64 nt, hsa; identical to SEQ ID NO: 65535

SEQ ID NO: 148417 - RNA, 64 nt, hsa; identical to SEQ ID NO: 65536

SEQ ID NO: 148418 - RNA, 64 nt, hsa; identical to SEQ ID NO: 65537

SEQ ID NO: 148419 - RNA, 64 nt, hsa; identical to SEQ ID NO: 65538

SEQ ID NO: 148420 - RNA, 64 nt, hsa; identical to SEQ ID NO: 65539

SEQ ID NO: 148421 - RNA, 64 nt, hsa; identical to SEQ ID NO: 65540

SEQ ID NO: 148422 - RNA, 64 nt, hsa; identical to SEQ ID NO: 65541

SEQ ID NO: 148423 - RNA, 64 nt, hsa; identical to SEQ ID NO: 65542

SEQ ID NO: 148424 - RNA, 64 nt, hsa; identical to SEQ ID NO: 65543

SEQ ID NO: 148425 - RNA, 64 nt, hsa; identical to SEQ ID NO: 65544

SEQ ID NO: 148426 - RNA, 64 nt, hsa; identical to SEQ ID NO: 65545

SEQ ID NO: 148427 - RNA, 64 nt, hsa; identical to SEQ ID NO: 65546

SEQ ID NO: 148428 - RNA, 64 nt, hsa; identical to SEQ ID NO: 65547

SEQ ID NO: 148429 - RNA, 64 nt, hsa; identical to SEQ ID NO: 61366

SEQ ID NO: 148430 - RNA, 64 nt, hsa; identical to SEQ ID NO: 61367

SEQ ID NO: 148431 - RNA, 64 nt, hsa; identical to SEQ ID NO: 65550

SEQ ID NO: 148432 - RNA, 64 nt, hsa; identical to SEQ ID NO: 65551

SEQ ID NO: 148433 - RNA, 64 nt, hsa; identical to SEQ ID NO: 61368

SEQ ID NO: 148434 - RNA, 56 nt, hsa; identical to SEQ ID NO: 61369

SEQ ID NO: 148435 - RNA, 64 nt, hsa; identical to SEQ ID NO: 65554

SEQ ID NO: 148436 - RNA, 64 nt, hsa; identical to SEQ ID NO: 65555

SEQ ID NO: 148437 - RNA, 64 nt, hsa; identical to SEQ ID NO: 65556

SEQ ID NO: 148438 - RNA, 64 nt, hsa; identical to SEQ ID NO: 65557

SEQ ID NO: 148439 - RNA, 64 nt, hsa; identical to SEQ ID NO: 65558

SEQ ID NO: 148440 - RNA, 64 nt, hsa; identical to SEQ ID NO: 65559

SEQ ID NO: 148441 - RNA, 64 nt, hsa; identical to SEQ ID NO: 65560

SEQ ID NO: 148442 - RNA, 64 nt, hsa; identical to SEQ ID NO: 65561

SEQ ID NO: 148443 - RNA, 64 nt, hsa; identical to SEQ ID NO: 65562

SEQ ID NO: 148444 - RNA, 64 nt, hsa; identical to SEQ ID NO: 65563

SEQ ID NO: 148445 - RNA, 64 nt, hsa; identical to SEQ ID NO: 65564

SEQ ID NO: 148446 - RNA, 64 nt, hsa; identical to SEQ ID NO: 65565

SEQ ID NO: 148447 - RNA, 64 nt, hsa; identical to SEQ ID NO: 65566

SEQ ID NO: 148448 - RNA, 64 nt, hsa; identical to SEQ ID NO: 65567

SEQ ID NO: 148449 - RNA, 64 nt, hsa; identical to SEQ ID NO: 65568

SEQ ID NO: 148450 - RNA, 64 nt, hsa; identical to SEQ ID NO: 65569

SEQ ID NO: 148451 - RNA, 64 nt, hsa; identical to SEQ ID NO: 65570

SEQ ID NO: 148452 - RNA, 64 nt, hsa; identical to SEQ ID NO: 65571

SEQ ID NO: 148453 - RNA, 64 nt, hsa; identical to SEQ ID NO: 65572

SEQ ID NO: 148454 - RNA, 64 nt, hsa; identical to SEQ ID NO: 65573

SEQ ID NO: 148455 - RNA, 64 nt, hsa; identical to SEQ ID NO: 61370

SEQ ID NO: 148456 - RNA, 64 nt, hsa; identical to SEQ ID NO: 61371

SEQ ID NO: 148457 - RNA, 64 nt, hsa; identical to SEQ ID NO: 65576

SEQ ID NO: 148458 - RNA, 64 nt, hsa; identical to SEQ ID NO: 65577

SEQ ID NO: 148459 - RNA, 64 nt, hsa; identical to SEQ ID NO: 65578

SEQ ID NO: 148460 - RNA, 64 nt, hsa; identical to SEQ ID NO: 65579

SEQ ID NO: 148461 - RNA, 64 nt, hsa; identical to SEQ ID NO: 65580

SEQ ID NO: 148462 - RNA, 64 nt, hsa; identical to SEQ ID NO: 65581

SEQ ID NO: 148463 - RNA, 64 nt, hsa; identical to SEQ ID NO: 65582

SEQ ID NO: 148464 - RNA, 64 nt, hsa; identical to SEQ ID NO: 65583

SEQ ID NO: 148465 - RNA, 64 nt, hsa; identical to SEQ ID NO: 65584

SEQ ID NO: 148466 - RNA, 64 nt, hsa; identical to SEQ ID NO: 65585

SEQ ID NO: 148467 - RNA, 64 nt, hsa; identical to SEQ ID NO: 65586

SEQ ID NO: 148468 - RNA, 64 nt, hsa; identical to SEQ ID NO: 65587

SEQ ID NO: 148469 - RNA, 64 nt, hsa; identical to SEQ ID NO: 65588

SEQ ID NO: 148470 - RNA, 64 nt, hsa; identical to SEQ ID NO: 65589

SEQ ID NO: 148471 - RNA, 64 nt, hsa; identical to SEQ ID NO: 65590

SEQ ID NO: 148472 - RNA, 64 nt, hsa; identical to SEQ ID NO: 65591

SEQ ID NO: 148473 - RNA, 64 nt, hsa; identical to SEQ ID NO: 65592

SEQ ID NO: 148474 - RNA, 64 nt, hsa; identical to SEQ ID NO: 65593

SEQ ID NO: 148475 - RNA, 64 nt, hsa; identical to SEQ ID NO: 65594

SEQ ID NO: 148476 - RNA, 64 nt, hsa; identical to SEQ ID NO: 65595

SEQ ID NO: 148477 - RNA, 64 nt, hsa; identical to SEQ ID NO: 65596

SEQ ID NO: 148478 - RNA, 64 nt, hsa; identical to SEQ ID NO: 65597

SEQ ID NO: 148479 - RNA, 64 nt, hsa; identical to SEQ ID NO: 65598

SEQ ID NO: 148480 - RNA, 64 nt, hsa; identical to SEQ ID NO: 65599

SEQ ID NO: 148481 - RNA, 64 nt, hsa; identical to SEQ ID NO: 65600

SEQ ID NO: 148482 - RNA, 64 nt, hsa; identical to SEQ ID NO: 65601

SEQ ID NO: 148483 - RNA, 64 nt, hsa; identical to SEQ ID NO: 65602

SEQ ID NO: 148484 - RNA, 64 nt, hsa; identical to SEQ ID NO: 65603

SEQ ID NO: 148485 - RNA, 64 nt, hsa; identical to SEQ ID NO: 65604

SEQ ID NO: 148486 - RNA, 64 nt, hsa; identical to SEQ ID NO: 65605

SEQ ID NO: 148487 - RNA, 64 nt, hsa; identical to SEQ ID NO: 65606

SEQ ID NO: 148488 - RNA, 64 nt, hsa; identical to SEQ ID NO: 65607

SEQ ID NO: 148489 - RNA, 64 nt, hsa; identical to SEQ ID NO: 65608

SEQ ID NO: 148490 - RNA, 64 nt, hsa; identical to SEQ ID NO: 65609

SEQ ID NO: 148491 - RNA, 64 nt, hsa; identical to SEQ ID NO: 65610

SEQ ID NO: 148492 - RNA, 64 nt, hsa; identical to SEQ ID NO: 65611

SEQ ID NO: 148493 - RNA, 64 nt, hsa; identical to SEQ ID NO: 61372

SEQ ID NO: 148494 - RNA, 64 nt, hsa; identical to SEQ ID NO: 61373

SEQ ID NO: 148495 - RNA, 64 nt, hsa; identical to SEQ ID NO: 65614

SEQ ID NO: 148496 - RNA, 64 nt, hsa; identical to SEQ ID NO: 65615

SEQ ID NO: 148497 - RNA, 64 nt, hsa; identical to SEQ ID NO: 65616

SEQ ID NO: 148498 - RNA, 64 nt, hsa; identical to SEQ ID NO: 61374

SEQ ID NO: 148499 - RNA, 64 nt, hsa; identical to SEQ ID NO: 61375

SEQ ID NO: 148500 - RNA, 64 nt, hsa; identical to SEQ ID NO: 65619

SEQ ID NO: 148501 - RNA, 64 nt, hsa; identical to SEQ ID NO: 65620

SEQ ID NO: 148502 - RNA, 64 nt, hsa; identical to SEQ ID NO: 65621

SEQ ID NO: 148503 - RNA, 64 nt, hsa; identical to SEQ ID NO: 65622

SEQ ID NO: 148504 - RNA, 64 nt, hsa; identical to SEQ ID NO: 65623

SEQ ID NO: 148505 - RNA, 64 nt, hsa; identical to SEQ ID NO: 65624

SEQ ID NO: 148506 - RNA, 64 nt, hsa; identical to SEQ ID NO: 65625

SEQ ID NO: 148507 - RNA, 64 nt, hsa; identical to SEQ ID NO: 65626

SEQ ID NO: 148508 - RNA, 64 nt, hsa; identical to SEQ ID NO: 65627

SEQ ID NO: 148509 - RNA, 64 nt, hsa; identical to SEQ ID NO: 65628

SEQ ID NO: 148510 - RNA, 64 nt, hsa; identical to SEQ ID NO: 65629

SEQ ID NO: 148511 - RNA, 64 nt, hsa; identical to SEQ ID NO: 65630

SEQ ID NO: 148512 - RNA, 64 nt, hsa; identical to SEQ ID NO: 65631

SEQ ID NO: 148513 - RNA, 64 nt, hsa; identical to SEQ ID NO: 65632

SEQ ID NO: 148514 - RNA, 64 nt, hsa; identical to SEQ ID NO: 65633

SEQ ID NO: 148515 - RNA, 64 nt, hsa; identical to SEQ ID NO: 65634

SEQ ID NO: 148516 - RNA, 64 nt, hsa; identical to SEQ ID NO: 65635

SEQ ID NO: 148517 - RNA, 64 nt, hsa; identical to SEQ ID NO: 65636

SEQ ID NO: 148518 - RNA, 64 nt, hsa; identical to SEQ ID NO: 65637

SEQ ID NO: 148519 - RNA, 64 nt, hsa; identical to SEQ ID NO: 65638

SEQ ID NO: 148520 - RNA, 64 nt, hsa; identical to SEQ ID NO: 65639

SEQ ID NO: 148521 - RNA, 64 nt, hsa; identical to SEQ ID NO: 65640

SEQ ID NO: 148522 - RNA, 64 nt, hsa; identical to SEQ ID NO: 65641

SEQ ID NO: 148523 - RNA, 64 nt, hsa; identical to SEQ ID NO: 65642

SEQ ID NO: 148524 - RNA, 64 nt, hsa; identical to SEQ ID NO: 65643

SEQ ID NO: 148525 - RNA, 64 nt, hsa; identical to SEQ ID NO: 65644

SEQ ID NO: 148526 - RNA, 60 nt, hsa; identical to SEQ ID NO: 65087

SEQ ID NO: 148527 - RNA, 64 nt, hsa; identical to SEQ ID NO: 65646

SEQ ID NO: 148528 - RNA, 64 nt, hsa; identical to SEQ ID NO: 65647

SEQ ID NO: 148529 - RNA, 64 nt, hsa; identical to SEQ ID NO: 65648

SEQ ID NO: 148530 - RNA, 64 nt, hsa; identical to SEQ ID NO: 65649

SEQ ID NO: 148531 - RNA, 64 nt, hsa; identical to SEQ ID NO: 65650

SEQ ID NO: 148532 - RNA, 64 nt, hsa; identical to SEQ ID NO: 65651

SEQ ID NO: 148533 - RNA, 51 nt, hsa; identical to SEQ ID NO: 65094

SEQ ID NO: 148534 - RNA, 64 nt, hsa; identical to SEQ ID NO: 65653

SEQ ID NO: 148535 - RNA, 64 nt, hsa; identical to SEQ ID NO: 65654

SEQ ID NO: 148536 - RNA, 64 nt, hsa; identical to SEQ ID NO: 65655

SEQ ID NO: 148537 - RNA, 64 nt, hsa; identical to SEQ ID NO: 65656

SEQ ID NO: 148538 - RNA, 64 nt, hsa; identical to SEQ ID NO: 65657

SEQ ID NO: 148539 - RNA, 64 nt, hsa; identical to SEQ ID NO: 65658

SEQ ID NO: 148540 - RNA, 64 nt, hsa; identical to SEQ ID NO: 65659

SEQ ID NO: 148541 - RNA, 64 nt, hsa; identical to SEQ ID NO: 65660

SEQ ID NO: 148542 - RNA, 64 nt, hsa; identical to SEQ ID NO: 65661

SEQ ID NO: 148543 - RNA, 64 nt, hsa; identical to SEQ ID NO: 65662

SEQ ID NO: 148544 - RNA, 64 nt, hsa; identical to SEQ ID NO: 65663

SEQ ID NO: 148545 - RNA, 64 nt, hsa; identical to SEQ ID NO: 65664

SEQ ID NO: 148546 - RNA, 64 nt, hsa; identical to SEQ ID NO: 65665

SEQ ID NO: 148547 - RNA, 64 nt, hsa; identical to SEQ ID NO: 65666

SEQ ID NO: 148548 - RNA, 64 nt, hsa; identical to SEQ ID NO: 65667

SEQ ID NO: 148549 - RNA, 64 nt, hsa; identical to SEQ ID NO: 65668

SEQ ID NO: 148550 - RNA, 64 nt, hsa; identical to SEQ ID NO: 65669

SEQ ID NO: 148551 - RNA, 64 nt, hsa; identical to SEQ ID NO: 65670

SEQ ID NO: 148552 - RNA, 64 nt, hsa; identical to SEQ ID NO: 65671

SEQ ID NO: 148553 - RNA, 64 nt, hsa; identical to SEQ ID NO: 65672

SEQ ID NO: 148554 - RNA, 64 nt, hsa; identical to SEQ ID NO: 65673

SEQ ID NO: 148555 - RNA, 64 nt, hsa; identical to SEQ ID NO: 65674

SEQ ID NO: 148556 - RNA, 64 nt, hsa; identical to SEQ ID NO: 65675

SEQ ID NO: 148557 - RNA, 64 nt, hsa; identical to SEQ ID NO: 65676

SEQ ID NO: 148558 - RNA, 64 nt, hsa; identical to SEQ ID NO: 65677

SEQ ID NO: 148559 - RNA, 64 nt, hsa; identical to SEQ ID NO: 65678

SEQ ID NO: 148560 - RNA, 64 nt, hsa; identical to SEQ ID NO: 65679

SEQ ID NO: 148561 - RNA, 64 nt, hsa; identical to SEQ ID NO: 65680

SEQ ID NO: 148562 - RNA, 64 nt, hsa; identical to SEQ ID NO: 65681

SEQ ID NO: 148563 - RNA, 64 nt, hsa; identical to SEQ ID NO: 65682

SEQ ID NO: 148564 - RNA, 64 nt, hsa; identical to SEQ ID NO: 65683

SEQ ID NO: 148565 - RNA, 64 nt, hsa; identical to SEQ ID NO: 65684

SEQ ID NO: 148566 - RNA, 64 nt, hsa; identical to SEQ ID NO: 65685

SEQ ID NO: 148567 - RNA, 64 nt, hsa; identical to SEQ ID NO: 65686

SEQ ID NO: 148568 - RNA, 64 nt, hsa; identical to SEQ ID NO: 65687

SEQ ID NO: 148569 - RNA, 64 nt, hsa; identical to SEQ ID NO: 65688

SEQ ID NO: 148570 - RNA, 64 nt, hsa; identical to SEQ ID NO: 65689

SEQ ID NO: 148571 - RNA, 64 nt, hsa; identical to SEQ ID NO: 65690

SEQ ID NO: 148572 - RNA, 64 nt, hsa; identical to SEQ ID NO: 65691

SEQ ID NO: 148573 - RNA, 64 nt, hsa; identical to SEQ ID NO: 65692

SEQ ID NO: 148574 - RNA, 64 nt, hsa; identical to SEQ ID NO: 65693

SEQ ID NO: 148575 - RNA, 62 nt, hsa; identical to SEQ ID NO: 69653

SEQ ID NO: 148576 - RNA, 62 nt, hsa; identical to SEQ ID NO: 69654

SEQ ID NO: 148577 - RNA, 62 nt, hsa; identical to SEQ ID NO: 69655

SEQ ID NO: 148578 - RNA, 62 nt, hsa; identical to SEQ ID NO: 69656

SEQ ID NO: 148579 - RNA, 62 nt, hsa; identical to SEQ ID NO: 69657

SEQ ID NO: 148580 - RNA, 62 nt, hsa; identical to SEQ ID NO: 69658

SEQ ID NO: 148581 - RNA, 62 nt, hsa; identical to SEQ ID NO: 69659

SEQ ID NO: 148582 - RNA, 62 nt, hsa; identical to SEQ ID NO: 69660

SEQ ID NO: 148583 - RNA, 62 nt, hsa; identical to SEQ ID NO: 69661

SEQ ID NO: 148584 - RNA, 62 nt, hsa; identical to SEQ ID NO: 69662

SEQ ID NO: 148585 - RNA, 62 nt, hsa; identical to SEQ ID NO: 69663

SEQ ID NO: 148586 - RNA, 62 nt, hsa; identical to SEQ ID NO: 69664

SEQ ID NO: 148587 - RNA, 62 nt, hsa; identical to SEQ ID NO: 69665

SEQ ID NO: 148588 - RNA, 52 nt, hsa; identical to SEQ ID NO: 69143

SEQ ID NO: 148589 - RNA, 62 nt, hsa; identical to SEQ ID NO: 69667

SEQ ID NO: 148590 - RNA, 62 nt, hsa; identical to SEQ ID NO: 69668

SEQ ID NO: 148591 - RNA, 62 nt, hsa; identical to SEQ ID NO: 69669

SEQ ID NO: 148592 - RNA, 62 nt, hsa; identical to SEQ ID NO: 69670

SEQ ID NO: 148593 - RNA, 62 nt, hsa; identical to SEQ ID NO: 69671

SEQ ID NO: 148594 - RNA, 62 nt, hsa; identical to SEQ ID NO: 69672

SEQ ID NO: 148595 - RNA, 62 nt, hsa; identical to SEQ ID NO: 69673

SEQ ID NO: 148596 - RNA, 62 nt, hsa; identical to SEQ ID NO: 69674

SEQ ID NO: 148597 - RNA, 62 nt, hsa; identical to SEQ ID NO: 69675

SEQ ID NO: 148598 - RNA, 62 nt, hsa; identical to SEQ ID NO: 69676

SEQ ID NO: 148599 - RNA, 62 nt, hsa; identical to SEQ ID NO: 69677

SEQ ID NO: 148600 - RNA, 62 nt, hsa; identical to SEQ ID NO: 69678

SEQ ID NO: 148601 - RNA, 62 nt, hsa; identical to SEQ ID NO: 69679

SEQ ID NO: 148602 - RNA, 62 nt, hsa; identical to SEQ ID NO: 69680

SEQ ID NO: 148603 - RNA, 62 nt, hsa; identical to SEQ ID NO: 69681

SEQ ID NO: 148604 - RNA, 62 nt, hsa; identical to SEQ ID NO: 69682

SEQ ID NO: 148605 - RNA, 62 nt, hsa; identical to SEQ ID NO: 69683

SEQ ID NO: 148606 - RNA, 62 nt, hsa; identical to SEQ ID NO: 69684

SEQ ID NO: 148607 - RNA, 62 nt, hsa; identical to SEQ ID NO: 69685

SEQ ID NO: 148608 - RNA, 62 nt, hsa; identical to SEQ ID NO: 69686

SEQ ID NO: 148609 - RNA, 62 nt, hsa; identical to SEQ ID NO: 69687

SEQ ID NO: 148610 - RNA, 62 nt, hsa; identical to SEQ ID NO: 69688

SEQ ID NO: 148611 - RNA, 62 nt, hsa; identical to SEQ ID NO: 69689

SEQ ID NO: 148612 - RNA, 62 nt, hsa; identical to SEQ ID NO: 69690

SEQ ID NO: 148613 - RNA, 62 nt, hsa; identical to SEQ ID NO: 69691

SEQ ID NO: 148614 - RNA, 62 nt, hsa; identical to SEQ ID NO: 69692

SEQ ID NO: 148615 - RNA, 57 nt, hsa; identical to SEQ ID NO: 69170

SEQ ID NO: 148616 - RNA, 62 nt, hsa; identical to SEQ ID NO: 69694

SEQ ID NO: 148617 - RNA, 62 nt, hsa; identical to SEQ ID NO: 69695

SEQ ID NO: 148618 - RNA, 62 nt, hsa; identical to SEQ ID NO: 69696

SEQ ID NO: 148619 - RNA, 62 nt, hsa; identical to SEQ ID NO: 69697

SEQ ID NO: 148620 - RNA, 62 nt, hsa; identical to SEQ ID NO: 69698

SEQ ID NO: 148621 - RNA, 62 nt, hsa; identical to SEQ ID NO: 69699

SEQ ID NO: 148622 - RNA, 62 nt, hsa; identical to SEQ ID NO: 69700

SEQ ID NO: 148623 - RNA, 62 nt, hsa; identical to SEQ ID NO: 69701

SEQ ID NO: 148624 - RNA, 62 nt, hsa; identical to SEQ ID NO: 69702

SEQ ID NO: 148625 - RNA, 62 nt, hsa; identical to SEQ ID NO: 69703

SEQ ID NO: 148626 - RNA, 62 nt, hsa; identical to SEQ ID NO: 69704

SEQ ID NO: 148627 - RNA, 62 nt, hsa; identical to SEQ ID NO: 69705

SEQ ID NO: 148628 - RNA, 62 nt, hsa; identical to SEQ ID NO: 69706

SEQ ID NO: 148629 - RNA, 62 nt, hsa; identical to SEQ ID NO: 69707

SEQ ID NO: 148630 - RNA, 62 nt, hsa; identical to SEQ ID NO: 69708

SEQ ID NO: 148631 - RNA, 62 nt, hsa; identical to SEQ ID NO: 69709

SEQ ID NO: 148632 - RNA, 61 nt, hsa; identical to SEQ ID NO: 69187

SEQ ID NO: 148633 - RNA, 62 nt, hsa; identical to SEQ ID NO: 69711

SEQ ID NO: 148634 - RNA, 62 nt, hsa; identical to SEQ ID NO: 69712

SEQ ID NO: 148635 - RNA, 62 nt, hsa; identical to SEQ ID NO: 69713

SEQ ID NO: 148636 - RNA, 62 nt, hsa; identical to SEQ ID NO: 69714

SEQ ID NO: 148637 - RNA, 62 nt, hsa; identical to SEQ ID NO: 69715

SEQ ID NO: 148638 - RNA, 62 nt, hsa; identical to SEQ ID NO: 69716

SEQ ID NO: 148639 - RNA, 62 nt, hsa; identical to SEQ ID NO: 69717

SEQ ID NO: 148640 - RNA, 62 nt, hsa; identical to SEQ ID NO: 69718

SEQ ID NO: 148641 - RNA, 62 nt, hsa; identical to SEQ ID NO: 69719

SEQ ID NO: 148642 - RNA, 62 nt, hsa; identical to SEQ ID NO: 69720

SEQ ID NO: 148643 - RNA, 62 nt, hsa; identical to SEQ ID NO: 69721

SEQ ID NO: 148644 - RNA, 62 nt, hsa; identical to SEQ ID NO: 69722

SEQ ID NO: 148645 - RNA, 62 nt, hsa; identical to SEQ ID NO: 69723

SEQ ID NO: 148646 - RNA, 62 nt, hsa; identical to SEQ ID NO: 69724

SEQ ID NO: 148647 - RNA, 62 nt, hsa; identical to SEQ ID NO: 69725

SEQ ID NO: 148648 - RNA, 62 nt, hsa; identical to SEQ ID NO: 69726

SEQ ID NO: 148649 - RNA, 62 nt, hsa; identical to SEQ ID NO: 69727

SEQ ID NO: 148650 - RNA, 62 nt, hsa; identical to SEQ ID NO: 69728

SEQ ID NO: 148651 - RNA, 62 nt, hsa; identical to SEQ ID NO: 69729

SEQ ID NO: 148652 - RNA, 62 nt, hsa; identical to SEQ ID NO: 69730

SEQ ID NO: 148653 - RNA, 62 nt, hsa; identical to SEQ ID NO: 69712

SEQ ID NO: 148654 - RNA, 62 nt, hsa; identical to SEQ ID NO: 69732

SEQ ID NO: 148655 - RNA, 62 nt, hsa; identical to SEQ ID NO: 69733

SEQ ID NO: 148656 - RNA, 62 nt, hsa; identical to SEQ ID NO: 69734

SEQ ID NO: 148657 - RNA, 62 nt, hsa; identical to SEQ ID NO: 69735

SEQ ID NO: 148658 - RNA, 62 nt, hsa; identical to SEQ ID NO: 69736

SEQ ID NO: 148659 - RNA, 62 nt, hsa; identical to SEQ ID NO: 69737

SEQ ID NO: 148660 - RNA, 62 nt, hsa; identical to SEQ ID NO: 69738

SEQ ID NO: 148661 - RNA, 62 nt, hsa; identical to SEQ ID NO: 69739

SEQ ID NO: 148662 - RNA, 62 nt, hsa; identical to SEQ ID NO: 69740

SEQ ID NO: 148663 - RNA, 62 nt, hsa; identical to SEQ ID NO: 69741

SEQ ID NO: 148664 - RNA, 62 nt, hsa; identical to SEQ ID NO: 69742

SEQ ID NO: 148665 - RNA, 62 nt, hsa; identical to SEQ ID NO: 69743

SEQ ID NO: 148666 - RNA, 62 nt, hsa; identical to SEQ ID NO: 69744

SEQ ID NO: 148667 - RNA, 62 nt, hsa; identical to SEQ ID NO: 69745

SEQ ID NO: 148668 - RNA, 62 nt, hsa; identical to SEQ ID NO: 69746

SEQ ID NO: 148669 - RNA, 62 nt, hsa; identical to SEQ ID NO: 69747

SEQ ID NO: 148670 - RNA, 62 nt, hsa; identical to SEQ ID NO: 69748

SEQ ID NO: 148671 - RNA, 62 nt, hsa; identical to SEQ ID NO: 69749

SEQ ID NO: 148672 - RNA, 62 nt, hsa; identical to SEQ ID NO: 69750

SEQ ID NO: 148673 - RNA, 62 nt, hsa; identical to SEQ ID NO: 69751

SEQ ID NO: 148674 - RNA, 62 nt, hsa; identical to SEQ ID NO: 69752

SEQ ID NO: 148675 - RNA, 62 nt, hsa; identical to SEQ ID NO: 69753

SEQ ID NO: 148676 - RNA, 62 nt, hsa; identical to SEQ ID NO: 69754

SEQ ID NO: 148677 - RNA, 62 nt, hsa; identical to SEQ ID NO: 69755

SEQ ID NO: 148678 - RNA, 62 nt, hsa; identical to SEQ ID NO: 69756

SEQ ID NO: 148679 - RNA, 62 nt, hsa; identical to SEQ ID NO: 69757

SEQ ID NO: 148680 - RNA, 62 nt, hsa; identical to SEQ ID NO: 69758

SEQ ID NO: 148681 - RNA, 62 nt, hsa; identical to SEQ ID NO: 69759

SEQ ID NO: 148682 - RNA, 62 nt, hsa; identical to SEQ ID NO: 69760

SEQ ID NO: 148683 - RNA, 62 nt, hsa; identical to SEQ ID NO: 69761

SEQ ID NO: 148684 - RNA, 62 nt, hsa; identical to SEQ ID NO: 69762

SEQ ID NO: 148685 - RNA, 62 nt, hsa; identical to SEQ ID NO: 69763

SEQ ID NO: 148686 - RNA, 62 nt, hsa; identical to SEQ ID NO: 69764

SEQ ID NO: 148687 - RNA, 62 nt, hsa; identical to SEQ ID NO: 69765

SEQ ID NO: 148688 - RNA, 62 nt, hsa; identical to SEQ ID NO: 69766

SEQ ID NO: 148689 - RNA, 62 nt, hsa; identical to SEQ ID NO: 69767

SEQ ID NO: 148690 - RNA, 62 nt, hsa; identical to SEQ ID NO: 69768

SEQ ID NO: 148691 - RNA, 62 nt, hsa; identical to SEQ ID NO: 69769

SEQ ID NO: 148692 - RNA, 62 nt, hsa; identical to SEQ ID NO: 69770

SEQ ID NO: 148693 - RNA, 62 nt, hsa; identical to SEQ ID NO: 69771

SEQ ID NO: 148694 - RNA, 62 nt, hsa; identical to SEQ ID NO: 69772

SEQ ID NO: 148695 - RNA, 62 nt, hsa; identical to SEQ ID NO: 69773

SEQ ID NO: 148696 - RNA, 62 nt, hsa; identical to SEQ ID NO: 69774

SEQ ID NO: 148697 - RNA, 62 nt, hsa; identical to SEQ ID NO: 69775

SEQ ID NO: 148698 - RNA, 62 nt, hsa; identical to SEQ ID NO: 69776

SEQ ID NO: 148699 - RNA, 62 nt, hsa; identical to SEQ ID NO: 69777

SEQ ID NO: 148700 - RNA, 62 nt, hsa; identical to SEQ ID NO: 69778

SEQ ID NO: 148701 - RNA, 62 nt, hsa; identical to SEQ ID NO: 69779

SEQ ID NO: 148702 - RNA, 62 nt, hsa; identical to SEQ ID NO: 69780

SEQ ID NO: 148703 - RNA, 62 nt, hsa; identical to SEQ ID NO: 69781

SEQ ID NO: 148704 - RNA, 62 nt, hsa; identical to SEQ ID NO: 69782

SEQ ID NO: 148705 - RNA, 62 nt, hsa; identical to SEQ ID NO: 69783

SEQ ID NO: 148706 - RNA, 62 nt, hsa; identical to SEQ ID NO: 69784

SEQ ID NO: 148707 - RNA, 62 nt, hsa; identical to SEQ ID NO: 69785

SEQ ID NO: 148708 - RNA, 62 nt, hsa; identical to SEQ ID NO: 69786

SEQ ID NO: 148709 - RNA, 62 nt, hsa; identical to SEQ ID NO: 69787

SEQ ID NO: 148710 - RNA, 62 nt, hsa; identical to SEQ ID NO: 69788

SEQ ID NO: 148711 - RNA, 62 nt, hsa; identical to SEQ ID NO: 69789

SEQ ID NO: 148712 - RNA, 62 nt, hsa; identical to SEQ ID NO: 69790

SEQ ID NO: 148713 - RNA, 62 nt, hsa; identical to SEQ ID NO: 69791

SEQ ID NO: 148714 - RNA, 62 nt, hsa; identical to SEQ ID NO: 69792

SEQ ID NO: 148715 - RNA, 62 nt, hsa; identical to SEQ ID NO: 69793

SEQ ID NO: 148716 - RNA, 62 nt, hsa; identical to SEQ ID NO: 69794

SEQ ID NO: 148717 - RNA, 59 nt, hsa; identical to SEQ ID NO: 69272

SEQ ID NO: 148718 - RNA, 62 nt, hsa; identical to SEQ ID NO: 69796

SEQ ID NO: 148719 - RNA, 62 nt, hsa; identical to SEQ ID NO: 69797

SEQ ID NO: 148720 - RNA, 62 nt, hsa; identical to SEQ ID NO: 69798

SEQ ID NO: 148721 - RNA, 62 nt, hsa; identical to SEQ ID NO: 69799

SEQ ID NO: 148722 - RNA, 62 nt, hsa; identical to SEQ ID NO: 69800

SEQ ID NO: 148723 - RNA, 62 nt, hsa; identical to SEQ ID NO: 69801

SEQ ID NO: 148724 - RNA, 62 nt, hsa; identical to SEQ ID NO: 69802

SEQ ID NO: 148725 - RNA, 62 nt, hsa; identical to SEQ ID NO: 69803

SEQ ID NO: 148726 - RNA, 62 nt, hsa; identical to SEQ ID NO: 69804

SEQ ID NO: 148727 - RNA, 62 nt, hsa; identical to SEQ ID NO: 69805

SEQ ID NO: 148728 - RNA, 62 nt, hsa; identical to SEQ ID NO: 69806

SEQ ID NO: 148729 - RNA, 62 nt, hsa; identical to SEQ ID NO: 69807

SEQ ID NO: 148730 - RNA, 62 nt, hsa; identical to SEQ ID NO: 69808

SEQ ID NO: 148731 - RNA, 62 nt, hsa; identical to SEQ ID NO: 69809

SEQ ID NO: 148732 - RNA, 62 nt, hsa; identical to SEQ ID NO: 69810

SEQ ID NO: 148733 - RNA, 62 nt, hsa; identical to SEQ ID NO: 69811

SEQ ID NO: 148734 - RNA, 62 nt, hsa; identical to SEQ ID NO: 69812

SEQ ID NO: 148735 - RNA, 62 nt, hsa; identical to SEQ ID NO: 69813

SEQ ID NO: 148736 - RNA, 62 nt, hsa; identical to SEQ ID NO: 69814

SEQ ID NO: 148737 - RNA, 62 nt, hsa; identical to SEQ ID NO: 69815

SEQ ID NO: 148738 - RNA, 62 nt, hsa; identical to SEQ ID NO: 69816

SEQ ID NO: 148739 - RNA, 62 nt, hsa; identical to SEQ ID NO: 69817

SEQ ID NO: 148740 - RNA, 62 nt, hsa; identical to SEQ ID NO: 69818

SEQ ID NO: 148741 - RNA, 62 nt, hsa; identical to SEQ ID NO: 69819

SEQ ID NO: 148742 - RNA, 62 nt, hsa; identical to SEQ ID NO: 69820

SEQ ID NO: 148743 - RNA, 62 nt, hsa; identical to SEQ ID NO: 69821

SEQ ID NO: 148744 - RNA, 62 nt, hsa; identical to SEQ ID NO: 69822

SEQ ID NO: 148745 - RNA, 62 nt, hsa; identical to SEQ ID NO: 69823

SEQ ID NO: 148746 - RNA, 62 nt, hsa; identical to SEQ ID NO: 69824

SEQ ID NO: 148747 - RNA, 62 nt, hsa; identical to SEQ ID NO: 69825

SEQ ID NO: 148748 - RNA, 62 nt, hsa; identical to SEQ ID NO: 69826

SEQ ID NO: 148749 - RNA, 62 nt, hsa; identical to SEQ ID NO: 69827

SEQ ID NO: 148750 - RNA, 62 nt, hsa; identical to SEQ ID NO: 69828

SEQ ID NO: 148751 - RNA, 62 nt, hsa; identical to SEQ ID NO: 69829

SEQ ID NO: 148752 - RNA, 62 nt, hsa; identical to SEQ ID NO: 69830

SEQ ID NO: 148753 - RNA, 62 nt, hsa; identical to SEQ ID NO: 69831

SEQ ID NO: 148754 - RNA, 62 nt, hsa; identical to SEQ ID NO: 69832

SEQ ID NO: 148755 - RNA, 62 nt, hsa; identical to SEQ ID NO: 69833

SEQ ID NO: 148756 - RNA, 62 nt, hsa; identical to SEQ ID NO: 69834

SEQ ID NO: 148757 - RNA, 62 nt, hsa; identical to SEQ ID NO: 69835

SEQ ID NO: 148758 - RNA, 62 nt, hsa; identical to SEQ ID NO: 69836

SEQ ID NO: 148759 - RNA, 62 nt, hsa; identical to SEQ ID NO: 69837

SEQ ID NO: 148760 - RNA, 62 nt, hsa; identical to SEQ ID NO: 69838

SEQ ID NO: 148761 - RNA, 62 nt, hsa; identical to SEQ ID NO: 69839

SEQ ID NO: 148762 - RNA, 62 nt, hsa; identical to SEQ ID NO: 69840

SEQ ID NO: 148763 - RNA, 62 nt, hsa; identical to SEQ ID NO: 69841

SEQ ID NO: 148764 - RNA, 62 nt, hsa; identical to SEQ ID NO: 69842

SEQ ID NO: 148765 - RNA, 62 nt, hsa; identical to SEQ ID NO: 69843

SEQ ID NO: 148766 - RNA, 62 nt, hsa; identical to SEQ ID NO: 69844

SEQ ID NO: 148767 - RNA, 62 nt, hsa; identical to SEQ ID NO: 69845

SEQ ID NO: 148768 - RNA, 62 nt, hsa; identical to SEQ ID NO: 69846

SEQ ID NO: 148769 - RNA, 62 nt, hsa; identical to SEQ ID NO: 69847

SEQ ID NO: 148770 - RNA, 62 nt, hsa; identical to SEQ ID NO: 69848

SEQ ID NO: 148771 - RNA, 62 nt, hsa; identical to SEQ ID NO: 69849

SEQ ID NO: 148772 - RNA, 62 nt, hsa; identical to SEQ ID NO: 69850

SEQ ID NO: 148773 - RNA, 62 nt, hsa; identical to SEQ ID NO: 69851

SEQ ID NO: 148774 - RNA, 62 nt, hsa; identical to SEQ ID NO: 69852

SEQ ID NO: 148775 - RNA, 62 nt, hsa; identical to SEQ ID NO: 69853

SEQ ID NO: 148776 - RNA, 62 nt, hsa; identical to SEQ ID NO: 69854

SEQ ID NO: 148777 - RNA, 62 nt, hsa; identical to SEQ ID NO: 69855

SEQ ID NO: 148778 - RNA, 62 nt, hsa; identical to SEQ ID NO: 69856

SEQ ID NO: 148779 - RNA, 62 nt, hsa; identical to SEQ ID NO: 69857

SEQ ID NO: 148780 - RNA, 62 nt, hsa; identical to SEQ ID NO: 69858

SEQ ID NO: 148781 - RNA, 62 nt, hsa; identical to SEQ ID NO: 69859

SEQ ID NO: 148782 - RNA, 62 nt, hsa; identical to SEQ ID NO: 69860

SEQ ID NO: 148783 - RNA, 62 nt, hsa; identical to SEQ ID NO: 69861

SEQ ID NO: 148784 - RNA, 62 nt, hsa; identical to SEQ ID NO: 69862

SEQ ID NO: 148785 - RNA, 62 nt, hsa; identical to SEQ ID NO: 69863

SEQ ID NO: 148786 - RNA, 62 nt, hsa; identical to SEQ ID NO: 69864

SEQ ID NO: 148787 - RNA, 62 nt, hsa; identical to SEQ ID NO: 69865

SEQ ID NO: 148788 - RNA, 62 nt, hsa; identical to SEQ ID NO: 69866

SEQ ID NO: 148789 - RNA, 62 nt, hsa; identical to SEQ ID NO: 69867

SEQ ID NO: 148790 - RNA, 62 nt, hsa; identical to SEQ ID NO: 69868

SEQ ID NO: 148791 - RNA, 62 nt, hsa; identical to SEQ ID NO: 69869

SEQ ID NO: 148792 - RNA, 62 nt, hsa; identical to SEQ ID NO: 69870

SEQ ID NO: 148793 - RNA, 62 nt, hsa; identical to SEQ ID NO: 69871

SEQ ID NO: 148794 - RNA, 62 nt, hsa; identical to SEQ ID NO: 69872

SEQ ID NO: 148795 - RNA, 62 nt, hsa; identical to SEQ ID NO: 69873

SEQ ID NO: 148796 - RNA, 54 nt, hsa; identical to SEQ ID NO: 69351

SEQ ID NO: 148797 - RNA, 62 nt, hsa; identical to SEQ ID NO: 69875

SEQ ID NO: 148798 - RNA, 62 nt, hsa; identical to SEQ ID NO: 69876

SEQ ID NO: 148799 - RNA, 62 nt, hsa; identical to SEQ ID NO: 69877

SEQ ID NO: 148800 - RNA, 62 nt, hsa; identical to SEQ ID NO: 69878

SEQ ID NO: 148801 - RNA, 62 nt, hsa; identical to SEQ ID NO: 69879

SEQ ID NO: 148802 - RNA, 62 nt, hsa; identical to SEQ ID NO: 69880

SEQ ID NO: 148803 - RNA, 62 nt, hsa; identical to SEQ ID NO: 69881

SEQ ID NO: 148804 - RNA, 62 nt, hsa; identical to SEQ ID NO: 69882

SEQ ID NO: 148805 - RNA, 62 nt, hsa; identical to SEQ ID NO: 69883

SEQ ID NO: 148806 - RNA, 62 nt, hsa; identical to SEQ ID NO: 69884

SEQ ID NO: 148807 - RNA, 62 nt, hsa; identical to SEQ ID NO: 69885

SEQ ID NO: 148808 - RNA, 62 nt, hsa; identical to SEQ ID NO: 69886

SEQ ID NO: 148809 - RNA, 62 nt, hsa; identical to SEQ ID NO: 69887

SEQ ID NO: 148810 - RNA, 62 nt, hsa; identical to SEQ ID NO: 69888

SEQ ID NO: 148811 - RNA, 62 nt, hsa; identical to SEQ ID NO: 69889

SEQ ID NO: 148812 - RNA, 62 nt, hsa; identical to SEQ ID NO: 69890

SEQ ID NO: 148813 - RNA, 62 nt, hsa; identical to SEQ ID NO: 69891

SEQ ID NO: 148814 - RNA, 62 nt, hsa; identical to SEQ ID NO: 69892

SEQ ID NO: 148815 - RNA, 62 nt, hsa; identical to SEQ ID NO: 69893

SEQ ID NO: 148816 - RNA, 62 nt, hsa; identical to SEQ ID NO: 69894

SEQ ID NO: 148817 - RNA, 62 nt, hsa; identical to SEQ ID NO: 69895

SEQ ID NO: 148818 - RNA, 62 nt, hsa; identical to SEQ ID NO: 69896

SEQ ID NO: 148819 - RNA, 62 nt, hsa; identical to SEQ ID NO: 69897

SEQ ID NO: 148820 - RNA, 54 nt, hsa; identical to SEQ ID NO: 69375

SEQ ID NO: 148821 - RNA, 62 nt, hsa; identical to SEQ ID NO: 69899

SEQ ID NO: 148822 - RNA, 62 nt, hsa; identical to SEQ ID NO: 69900

SEQ ID NO: 148823 - RNA, 62 nt, hsa; identical to SEQ ID NO: 69901

SEQ ID NO: 148824 - RNA, 62 nt, hsa; identical to SEQ ID NO: 69902

SEQ ID NO: 148825 - RNA, 62 nt, hsa; identical to SEQ ID NO: 69903

SEQ ID NO: 148826 - RNA, 62 nt, hsa; identical to SEQ ID NO: 69904

SEQ ID NO: 148827 - RNA, 62 nt, hsa; identical to SEQ ID NO: 69905

SEQ ID NO: 148828 - RNA, 62 nt, hsa; identical to SEQ ID NO: 69906

SEQ ID NO: 148829 - RNA, 62 nt, hsa; identical to SEQ ID NO: 69907

SEQ ID NO: 148830 - RNA, 62 nt, hsa; identical to SEQ ID NO: 69908

SEQ ID NO: 148831 - RNA, 62 nt, hsa; identical to SEQ ID NO: 69909

SEQ ID NO: 148832 - RNA, 62 nt, hsa; identical to SEQ ID NO: 69910

SEQ ID NO: 148833 - RNA, 62 nt, hsa; identical to SEQ ID NO: 69911

SEQ ID NO: 148834 - RNA, 62 nt, hsa; identical to SEQ ID NO: 69912

SEQ ID NO: 148835 - RNA, 62 nt, hsa; identical to SEQ ID NO: 69913

SEQ ID NO: 148836 - RNA, 62 nt, hsa; identical to SEQ ID NO: 69914

SEQ ID NO: 148837 - RNA, 58 nt, hsa; identical to SEQ ID NO: 69392

SEQ ID NO: 148838 - RNA, 62 nt, hsa; identical to SEQ ID NO: 69916

SEQ ID NO: 148839 - RNA, 62 nt, hsa; identical to SEQ ID NO: 69917

SEQ ID NO: 148840 - RNA, 62 nt, hsa; identical to SEQ ID NO: 69918

SEQ ID NO: 148841 - RNA, 62 nt, hsa; identical to SEQ ID NO: 69919

SEQ ID NO: 148842 - RNA, 62 nt, hsa; identical to SEQ ID NO: 69920

SEQ ID NO: 148843 - RNA, 62 nt, hsa; identical to SEQ ID NO: 69921

SEQ ID NO: 148844 - RNA, 62 nt, hsa; identical to SEQ ID NO: 69922

SEQ ID NO: 148845 - RNA, 62 nt, hsa; identical to SEQ ID NO: 69923

SEQ ID NO: 148846 - RNA, 62 nt, hsa; identical to SEQ ID NO: 69924

SEQ ID NO: 148847 - RNA, 62 nt, hsa; identical to SEQ ID NO: 69925

SEQ ID NO: 148848 - RNA, 62 nt, hsa; identical to SEQ ID NO: 69926

SEQ ID NO: 148849 - RNA, 62 nt, hsa; identical to SEQ ID NO: 69927

SEQ ID NO: 148850 - RNA, 62 nt, hsa; identical to SEQ ID NO: 69928

SEQ ID NO: 148851 - RNA, 62 nt, hsa; identical to SEQ ID NO: 69929

SEQ ID NO: 148852 - RNA, 62 nt, hsa; identical to SEQ ID NO: 69930

SEQ ID NO: 148853 - RNA, 62 nt, hsa; identical to SEQ ID NO: 69931

SEQ ID NO: 148854 - RNA, 62 nt, hsa; identical to SEQ ID NO: 69932

SEQ ID NO: 148855 - RNA, 62 nt, hsa; identical to SEQ ID NO: 69933

SEQ ID NO: 148856 - RNA, 62 nt, hsa; identical to SEQ ID NO: 69934

SEQ ID NO: 148857 - RNA, 62 nt, hsa; identical to SEQ ID NO: 69935

SEQ ID NO: 148858 - RNA, 62 nt, hsa; identical to SEQ ID NO: 69936

SEQ ID NO: 148859 - RNA, 62 nt, hsa; identical to SEQ ID NO: 69937

SEQ ID NO: 148860 - RNA, 62 nt, hsa; identical to SEQ ID NO: 69938

SEQ ID NO: 148861 - RNA, 62 nt, hsa; identical to SEQ ID NO: 69939

SEQ ID NO: 148862 - RNA, 62 nt, hsa; identical to SEQ ID NO: 69940

SEQ ID NO: 148863 - RNA, 62 nt, hsa; identical to SEQ ID NO: 69941

SEQ ID NO: 148864 - RNA, 60 nt, hsa; identical to SEQ ID NO: 69419

SEQ ID NO: 148865 - RNA, 62 nt, hsa; identical to SEQ ID NO: 69943

SEQ ID NO: 148866 - RNA, 62 nt, hsa; identical to SEQ ID NO: 69944

SEQ ID NO: 148867 - RNA, 62 nt, hsa; identical to SEQ ID NO: 69945

SEQ ID NO: 148868 - RNA, 62 nt, hsa; identical to SEQ ID NO: 69946

SEQ ID NO: 148869 - RNA, 62 nt, hsa; identical to SEQ ID NO: 69947

SEQ ID NO: 148870 - RNA, 62 nt, hsa; identical to SEQ ID NO: 69948

SEQ ID NO: 148871 - RNA, 62 nt, hsa; identical to SEQ ID NO: 69949

SEQ ID NO: 148872 - RNA, 62 nt, hsa; identical to SEQ ID NO: 69950

SEQ ID NO: 148873 - RNA, 62 nt, hsa; identical to SEQ ID NO: 69951

SEQ ID NO: 148874 - RNA, 62 nt, hsa; identical to SEQ ID NO: 69952

SEQ ID NO: 148875 - RNA, 62 nt, hsa; identical to SEQ ID NO: 69953

SEQ ID NO: 148876 - RNA, 62 nt, hsa; identical to SEQ ID NO: 69954

SEQ ID NO: 148877 - RNA, 62 nt, hsa; identical to SEQ ID NO: 69955

SEQ ID NO: 148878 - RNA, 62 nt, hsa; identical to SEQ ID NO: 69956

SEQ ID NO: 148879 - RNA, 62 nt, hsa; identical to SEQ ID NO: 69957

SEQ ID NO: 148880 - RNA, 62 nt, hsa; identical to SEQ ID NO: 69958

SEQ ID NO: 148881 - RNA, 62 nt, hsa; identical to SEQ ID NO: 69959

SEQ ID NO: 148882 - RNA, 62 nt, hsa; identical to SEQ ID NO: 69960

SEQ ID NO: 148883 - RNA, 62 nt, hsa; identical to SEQ ID NO: 69961

SEQ ID NO: 148884 - RNA, 62 nt, hsa; identical to SEQ ID NO: 69962

SEQ ID NO: 148885 - RNA, 62 nt, hsa; identical to SEQ ID NO: 69963

SEQ ID NO: 148886 - RNA, 62 nt, hsa; identical to SEQ ID NO: 69964

SEQ ID NO: 148887 - RNA, 62 nt, hsa; identical to SEQ ID NO: 69965

SEQ ID NO: 148888 - RNA, 62 nt, hsa; identical to SEQ ID NO: 69966

SEQ ID NO: 148889 - RNA, 59 nt, hsa; identical to SEQ ID NO: 69444

SEQ ID NO: 148890 - RNA, 62 nt, hsa; identical to SEQ ID NO: 69968

SEQ ID NO: 148891 - RNA, 62 nt, hsa; identical to SEQ ID NO: 69969

SEQ ID NO: 148892 - RNA, 62 nt, hsa; identical to SEQ ID NO: 69970

SEQ ID NO: 148893 - RNA, 62 nt, hsa; identical to SEQ ID NO: 69971

SEQ ID NO: 148894 - RNA, 52 nt, hsa; identical to SEQ ID NO: 69449

SEQ ID NO: 148895 - RNA, 62 nt, hsa; identical to SEQ ID NO: 69973

SEQ ID NO: 148896 - RNA, 62 nt, hsa; identical to SEQ ID NO: 69974

SEQ ID NO: 148897 - RNA, 62 nt, hsa; identical to SEQ ID NO: 69975

SEQ ID NO: 148898 - RNA, 62 nt, hsa; identical to SEQ ID NO: 69976

SEQ ID NO: 148899 - RNA, 62 nt, hsa; identical to SEQ ID NO: 69977

SEQ ID NO: 148900 - RNA, 62 nt, hsa; identical to SEQ ID NO: 69978

SEQ ID NO: 148901 - RNA, 62 nt, hsa; identical to SEQ ID NO: 69979

SEQ ID NO: 148902 - RNA, 62 nt, hsa; identical to SEQ ID NO: 69980

SEQ ID NO: 148903 - RNA, 62 nt, hsa; identical to SEQ ID NO: 69981

SEQ ID NO: 148904 - RNA, 62 nt, hsa; identical to SEQ ID NO: 69982

SEQ ID NO: 148905 - RNA, 62 nt, hsa; identical to SEQ ID NO: 69983

SEQ ID NO: 148906 - RNA, 62 nt, hsa; identical to SEQ ID NO: 69984

SEQ ID NO: 148907 - RNA, 62 nt, hsa; identical to SEQ ID NO: 69985

SEQ ID NO: 148908 - RNA, 62 nt, hsa; identical to SEQ ID NO: 69986

SEQ ID NO: 148909 - RNA, 62 nt, hsa; identical to SEQ ID NO: 69987

SEQ ID NO: 148910 - RNA, 62 nt, hsa; identical to SEQ ID NO: 69988

SEQ ID NO: 148911 - RNA, 62 nt, hsa; identical to SEQ ID NO: 69989

SEQ ID NO: 148912 - RNA, 62 nt, hsa; identical to SEQ ID NO: 69990

SEQ ID NO: 148913 - RNA, 62 nt, hsa; identical to SEQ ID NO: 69991

SEQ ID NO: 148914 - RNA, 62 nt, hsa; identical to SEQ ID NO: 69992

SEQ ID NO: 148915 - RNA, 62 nt, hsa; identical to SEQ ID NO: 69993

SEQ ID NO: 148916 - RNA, 62 nt, hsa; identical to SEQ ID NO: 69994

SEQ ID NO: 148917 - RNA, 62 nt, hsa; identical to SEQ ID NO: 69995

SEQ ID NO: 148918 - RNA, 62 nt, hsa; identical to SEQ ID NO: 69996

SEQ ID NO: 148919 - RNA, 62 nt, hsa; identical to SEQ ID NO: 69997

SEQ ID NO: 148920 - RNA, 62 nt, hsa; identical to SEQ ID NO: 69998

SEQ ID NO: 148921 - RNA, 62 nt, hsa; identical to SEQ ID NO: 69999

SEQ ID NO: 148922 - RNA, 62 nt, hsa; identical to SEQ ID NO: 70000

SEQ ID NO: 148923 - RNA, 62 nt, hsa; identical to SEQ ID NO: 70001

SEQ ID NO: 148924 - RNA, 62 nt, hsa; identical to SEQ ID NO: 70002

SEQ ID NO: 148925 - RNA, 62 nt, hsa; identical to SEQ ID NO: 70003

SEQ ID NO: 148926 - RNA, 62 nt, hsa; identical to SEQ ID NO: 70004

SEQ ID NO: 148927 - RNA, 62 nt, hsa; identical to SEQ ID NO: 70005

SEQ ID NO: 148928 - RNA, 61 nt, hsa; identical to SEQ ID NO: 70006

SEQ ID NO: 148929 - RNA, 62 nt, hsa; identical to SEQ ID NO: 70007

SEQ ID NO: 148930 - RNA, 62 nt, hsa; identical to SEQ ID NO: 70008

SEQ ID NO: 148931 - RNA, 62 nt, hsa; identical to SEQ ID NO: 70009

SEQ ID NO: 148932 - RNA, 62 nt, hsa; identical to SEQ ID NO: 70010

SEQ ID NO: 148933 - RNA, 62 nt, hsa; identical to SEQ ID NO: 70011

SEQ ID NO: 148934 - RNA, 62 nt, hsa; identical to SEQ ID NO: 70012

SEQ ID NO: 148935 - RNA, 62 nt, hsa; identical to SEQ ID NO: 70013

SEQ ID NO: 148936 - RNA, 62 nt, hsa; identical to SEQ ID NO: 70014

SEQ ID NO: 148937 - RNA, 62 nt, hsa; identical to SEQ ID NO: 70015

SEQ ID NO: 148938 - RNA, 62 nt, hsa; identical to SEQ ID NO: 70016

SEQ ID NO: 148939 - RNA, 62 nt, hsa; identical to SEQ ID NO: 70017

SEQ ID NO: 148940 - RNA, 62 nt, hsa; identical to SEQ ID NO: 70018

SEQ ID NO: 148941 - RNA, 62 nt, hsa; identical to SEQ ID NO: 70019

SEQ ID NO: 148942 - RNA, 62 nt, hsa; identical to SEQ ID NO: 70020

SEQ ID NO: 148943 - RNA, 62 nt, hsa; identical to SEQ ID NO: 70021

SEQ ID NO: 148944 - RNA, 62 nt, hsa; identical to SEQ ID NO: 70022

SEQ ID NO: 148945 - RNA, 62 nt, hsa; identical to SEQ ID NO: 70023

SEQ ID NO: 148946 - RNA, 62 nt, hsa; identical to SEQ ID NO: 70024

SEQ ID NO: 148947 - RNA, 62 nt, hsa; identical to SEQ ID NO: 70025

SEQ ID NO: 148948 - RNA, 62 nt, hsa; identical to SEQ ID NO: 70026

SEQ ID NO: 148949 - RNA, 62 nt, hsa; identical to SEQ ID NO: 70027

SEQ ID NO: 148950 - RNA, 62 nt, hsa; identical to SEQ ID NO: 70028

SEQ ID NO: 148951 - RNA, 62 nt, hsa; identical to SEQ ID NO: 70029

SEQ ID NO: 148952 - RNA, 62 nt, hsa; identical to SEQ ID NO: 70030

SEQ ID NO: 148953 - RNA, 62 nt, hsa; identical to SEQ ID NO: 70031

SEQ ID NO: 148954 - RNA, 62 nt, hsa; identical to SEQ ID NO: 70032

SEQ ID NO: 148955 - RNA, 62 nt, hsa; identical to SEQ ID NO: 70033

SEQ ID NO: 148956 - RNA, 62 nt, hsa; identical to SEQ ID NO: 70034

SEQ ID NO: 148957 - RNA, 62 nt, hsa; identical to SEQ ID NO: 70035

SEQ ID NO: 148958 - RNA, 62 nt, hsa; identical to SEQ ID NO: 70036

SEQ ID NO: 148959 - RNA, 62 nt, hsa; identical to SEQ ID NO: 70037

SEQ ID NO: 148960 - RNA, 62 nt, hsa; identical to SEQ ID NO: 70038

SEQ ID NO: 148961 - RNA, 62 nt, hsa; identical to SEQ ID NO: 70039

SEQ ID NO: 148962 - RNA, 62 nt, hsa; identical to SEQ ID NO: 70040

SEQ ID NO: 148963 - RNA, 62 nt, hsa; identical to SEQ ID NO: 70041

SEQ ID NO: 148964 - RNA, 62 nt, hsa; identical to SEQ ID NO: 70042

SEQ ID NO: 148965 - RNA, 62 nt, hsa; identical to SEQ ID NO: 70043

SEQ ID NO: 148966 - RNA, 62 nt, hsa; identical to SEQ ID NO: 70044

SEQ ID NO: 148967 - RNA, 62 nt, hsa; identical to SEQ ID NO: 70045

SEQ ID NO: 148968 - RNA, 62 nt, hsa; identical to SEQ ID NO: 70046

SEQ ID NO: 148969 - RNA, 62 nt, hsa; identical to SEQ ID NO: 70047

SEQ ID NO: 148970 - RNA, 62 nt, hsa; identical to SEQ ID NO: 70048

SEQ ID NO: 148971 - RNA, 62 nt, hsa; identical to SEQ ID NO: 70049

SEQ ID NO: 148972 - RNA, 62 nt, hsa; identical to SEQ ID NO: 70050

SEQ ID NO: 148973 - RNA, 62 nt, hsa; identical to SEQ ID NO: 70051

SEQ ID NO: 148974 - RNA, 62 nt, hsa; identical to SEQ ID NO: 70052

SEQ ID NO: 148975 - RNA, 62 nt, hsa; identical to SEQ ID NO: 70053

SEQ ID NO: 148976 - RNA, 62 nt, hsa; identical to SEQ ID NO: 70054

SEQ ID NO: 148977 - RNA, 62 nt, hsa; identical to SEQ ID NO: 70055

SEQ ID NO: 148978 - RNA, 62 nt, hsa; identical to SEQ ID NO: 70056

SEQ ID NO: 148979 - RNA, 62 nt, hsa; identical to SEQ ID NO: 70057

SEQ ID NO: 148980 - RNA, 62 nt, hsa; identical to SEQ ID NO: 70058

SEQ ID NO: 148981 - RNA, 62 nt, hsa; identical to SEQ ID NO: 70059

SEQ ID NO: 148982 - RNA, 62 nt, hsa; identical to SEQ ID NO: 70060

SEQ ID NO: 148983 - RNA, 62 nt, hsa; identical to SEQ ID NO: 70061

SEQ ID NO: 148984 - RNA, 62 nt, hsa; identical to SEQ ID NO: 70062

SEQ ID NO: 148985 - RNA, 62 nt, hsa; identical to SEQ ID NO: 70063

SEQ ID NO: 148986 - RNA, 60 nt, hsa; identical to SEQ ID NO: 69541

SEQ ID NO: 148987 - RNA, 62 nt, hsa; identical to SEQ ID NO: 70065

SEQ ID NO: 148988 - RNA, 62 nt, hsa; identical to SEQ ID NO: 70066

SEQ ID NO: 148989 - RNA, 62 nt, hsa; identical to SEQ ID NO: 70067

SEQ ID NO: 148990 - RNA, 62 nt, hsa; identical to SEQ ID NO: 70068

SEQ ID NO: 148991 - RNA, 62 nt, hsa; identical to SEQ ID NO: 70069

SEQ ID NO: 148992 - RNA, 62 nt, hsa; identical to SEQ ID NO: 70070

SEQ ID NO: 148993 - RNA, 62 nt, hsa; identical to SEQ ID NO: 70071

SEQ ID NO: 148994 - RNA, 62 nt, hsa; identical to SEQ ID NO: 70072

SEQ ID NO: 148995 - RNA, 62 nt, hsa; identical to SEQ ID NO: 70073

SEQ ID NO: 148996 - RNA, 62 nt, hsa; identical to SEQ ID NO: 70074

SEQ ID NO: 148997 - RNA, 62 nt, hsa; identical to SEQ ID NO: 70075

SEQ ID NO: 148998 - RNA, 62 nt, hsa; identical to SEQ ID NO: 70076

SEQ ID NO: 148999 - RNA, 62 nt, hsa; identical to SEQ ID NO: 70077

SEQ ID NO: 149000 - RNA, 62 nt, hsa; identical to SEQ ID NO: 70078

SEQ ID NO: 149001 - RNA, 62 nt, hsa; identical to SEQ ID NO: 70079

SEQ ID NO: 149002 - RNA, 62 nt, hsa; identical to SEQ ID NO: 70080

SEQ ID NO: 149003 - RNA, 62 nt, hsa; identical to SEQ ID NO: 70081

SEQ ID NO: 149004 - RNA, 62 nt, hsa; identical to SEQ ID NO: 70082

SEQ ID NO: 149005 - RNA, 62 nt, hsa; identical to SEQ ID NO: 70083

SEQ ID NO: 149006 - RNA, 62 nt, hsa; identical to SEQ ID NO: 70084

SEQ ID NO: 149007 - RNA, 62 nt, hsa; identical to SEQ ID NO: 70085

SEQ ID NO: 149008 - RNA, 62 nt, hsa; identical to SEQ ID NO: 70086

SEQ ID NO: 149009 - RNA, 62 nt, hsa; identical to SEQ ID NO: 70087

SEQ ID NO: 149010 - RNA, 62 nt, hsa; identical to SEQ ID NO: 70088

SEQ ID NO: 149011 - RNA, 62 nt, hsa; identical to SEQ ID NO: 70089

SEQ ID NO: 149012 - RNA, 62 nt, hsa; identical to SEQ ID NO: 70090

SEQ ID NO: 149013 - RNA, 62 nt, hsa; identical to SEQ ID NO: 70091

SEQ ID NO: 149014 - RNA, 62 nt, hsa; identical to SEQ ID NO: 70092

SEQ ID NO: 149015 - RNA, 60 nt, hsa; identical to SEQ ID NO: 69570

SEQ ID NO: 149016 - RNA, 62 nt, hsa; identical to SEQ ID NO: 70094

SEQ ID NO: 149017 - RNA, 62 nt, hsa; identical to SEQ ID NO: 70095

SEQ ID NO: 149018 - RNA, 62 nt, hsa; identical to SEQ ID NO: 70096

SEQ ID NO: 149019 - RNA, 62 nt, hsa; identical to SEQ ID NO: 70097

SEQ ID NO: 149020 - RNA, 62 nt, hsa; identical to SEQ ID NO: 70098

SEQ ID NO: 149021 - RNA, 62 nt, hsa; identical to SEQ ID NO: 70099

SEQ ID NO: 149022 - RNA, 62 nt, hsa; identical to SEQ ID NO: 70100

SEQ ID NO: 149023 - RNA, 62 nt, hsa; identical to SEQ ID NO: 70101

SEQ ID NO: 149024 - RNA, 62 nt, hsa; identical to SEQ ID NO: 70102

SEQ ID NO: 149025 - RNA, 62 nt, hsa; identical to SEQ ID NO: 70103

SEQ ID NO: 149026 - RNA, 62 nt, hsa; identical to SEQ ID NO: 70104

SEQ ID NO: 149027 - RNA, 62 nt, hsa; identical to SEQ ID NO: 70105

SEQ ID NO: 149028 - RNA, 62 nt, hsa; identical to SEQ ID NO: 70106

SEQ ID NO: 149029 - RNA, 62 nt, hsa; identical to SEQ ID NO: 70107

SEQ ID NO: 149030 - RNA, 62 nt, hsa; identical to SEQ ID NO: 70108

SEQ ID NO: 149031 - RNA, 62 nt, hsa; identical to SEQ ID NO: 70109

SEQ ID NO: 149032 - RNA, 62 nt, hsa; identical to SEQ ID NO: 70110

SEQ ID NO: 149033 - RNA, 62 nt, hsa; identical to SEQ ID NO: 70111

SEQ ID NO: 149034 - RNA, 62 nt, hsa; identical to SEQ ID NO: 70112

SEQ ID NO: 149035 - RNA, 62 nt, hsa; identical to SEQ ID NO: 70113

SEQ ID NO: 149036 - RNA, 62 nt, hsa; identical to SEQ ID NO: 70114

SEQ ID NO: 149037 - RNA, 62 nt, hsa; identical to SEQ ID NO: 70115

SEQ ID NO: 149038 - RNA, 62 nt, hsa; identical to SEQ ID NO: 70116

SEQ ID NO: 149039 - RNA, 62 nt, hsa; identical to SEQ ID NO: 70117

SEQ ID NO: 149040 - RNA, 62 nt, hsa; identical to SEQ ID NO: 70118

SEQ ID NO: 149041 - RNA, 62 nt, hsa; identical to SEQ ID NO: 70119

SEQ ID NO: 149042 - RNA, 62 nt, hsa; identical to SEQ ID NO: 70120

SEQ ID NO: 149043 - RNA, 62 nt, hsa; identical to SEQ ID NO: 70121

SEQ ID NO: 149044 - RNA, 62 nt, hsa; identical to SEQ ID NO: 70122

SEQ ID NO: 149045 - RNA, 62 nt, hsa; identical to SEQ ID NO: 70123

SEQ ID NO: 149046 - RNA, 62 nt, hsa; identical to SEQ ID NO: 70124

SEQ ID NO: 149047 - RNA, 62 nt, hsa; identical to SEQ ID NO: 70125

SEQ ID NO: 149048 - RNA, 62 nt, hsa; identical to SEQ ID NO: 70126

SEQ ID NO: 149049 - RNA, 62 nt, hsa; identical to SEQ ID NO: 70127

SEQ ID NO: 149050 - RNA, 62 nt, hsa; identical to SEQ ID NO: 70128

SEQ ID NO: 149051 - RNA, 62 nt, hsa; identical to SEQ ID NO: 70129

SEQ ID NO: 149052 - RNA, 62 nt, hsa; identical to SEQ ID NO: 70130

SEQ ID NO: 149053 - RNA, 62 nt, hsa; identical to SEQ ID NO: 70131

SEQ ID NO: 149054 - RNA, 62 nt, hsa; identical to SEQ ID NO: 70132

SEQ ID NO: 149055 - RNA, 62 nt, hsa; identical to SEQ ID NO: 70133

SEQ ID NO: 149056 - RNA, 62 nt, hsa; identical to SEQ ID NO: 70134

SEQ ID NO: 149057 - RNA, 62 nt, hsa; identical to SEQ ID NO: 70135

SEQ ID NO: 149058 - RNA, 62 nt, hsa; identical to SEQ ID NO: 70136

SEQ ID NO: 149059 - RNA, 62 nt, hsa; identical to SEQ ID NO: 70137

SEQ ID NO: 149060 - RNA, 62 nt, hsa; identical to SEQ ID NO: 70138

SEQ ID NO: 149061 - RNA, 62 nt, hsa; identical to SEQ ID NO: 70139

SEQ ID NO: 149062 - RNA, 62 nt, hsa; identical to SEQ ID NO: 70140

SEQ ID NO: 149063 - RNA, 62 nt, hsa; identical to SEQ ID NO: 70141

SEQ ID NO: 149064 - RNA, 62 nt, hsa; identical to SEQ ID NO: 70142

SEQ ID NO: 149065 - RNA, 62 nt, hsa; identical to SEQ ID NO: 70143

SEQ ID NO: 149066 - RNA, 62 nt, hsa; identical to SEQ ID NO: 70144

SEQ ID NO: 149067 - RNA, 62 nt, hsa; identical to SEQ ID NO: 70145

SEQ ID NO: 149068 - RNA, 62 nt, hsa; identical to SEQ ID NO: 70146

SEQ ID NO: 149069 - RNA, 62 nt, hsa; identical to SEQ ID NO: 70147

SEQ ID NO: 149070 - RNA, 62 nt, hsa; identical to SEQ ID NO: 70148

SEQ ID NO: 149071 - RNA, 62 nt, hsa; identical to SEQ ID NO: 70149

SEQ ID NO: 149072 - RNA, 62 nt, hsa; identical to SEQ ID NO: 70150

SEQ ID NO: 149073 - RNA, 62 nt, hsa; identical to SEQ ID NO: 70151

SEQ ID NO: 149074 - RNA, 62 nt, hsa; identical to SEQ ID NO: 70152

SEQ ID NO: 149075 - RNA, 62 nt, hsa; identical to SEQ ID NO: 70153

SEQ ID NO: 149076 - RNA, 62 nt, hsa; identical to SEQ ID NO: 70154

SEQ ID NO: 149077 - RNA, 62 nt, hsa; identical to SEQ ID NO: 70155

SEQ ID NO: 149078 - RNA, 62 nt, hsa; identical to SEQ ID NO: 70156

SEQ ID NO: 149079 - RNA, 62 nt, hsa; identical to SEQ ID NO: 70157

SEQ ID NO: 149080 - RNA, 62 nt, hsa; identical to SEQ ID NO: 70158

SEQ ID NO: 149081 - RNA, 62 nt, hsa; identical to SEQ ID NO: 70159

SEQ ID NO: 149082 - RNA, 62 nt, hsa; identical to SEQ ID NO: 70160

SEQ ID NO: 149083 - RNA, 62 nt, hsa; identical to SEQ ID NO: 70161

SEQ ID NO: 149084 - RNA, 62 nt, hsa; identical to SEQ ID NO: 70162

SEQ ID NO: 149085 - RNA, 62 nt, hsa; identical to SEQ ID NO: 70163

SEQ ID NO: 149086 - RNA, 62 nt, hsa; identical to SEQ ID NO: 70164

SEQ ID NO: 149087 - RNA, 62 nt, hsa; identical to SEQ ID NO: 70165

SEQ ID NO: 149088 - RNA, 62 nt, hsa; identical to SEQ ID NO: 70166

SEQ ID NO: 149089 - RNA, 62 nt, hsa; identical to SEQ ID NO: 70167

SEQ ID NO: 149090 - RNA, 62 nt, hsa; identical to SEQ ID NO: 70168

SEQ ID NO: 149091 - RNA, 62 nt, hsa; identical to SEQ ID NO: 70169

SEQ ID NO: 149092 - RNA, 62 nt, hsa; identical to SEQ ID NO: 70170

SEQ ID NO: 149093 - RNA, 62 nt, hsa; identical to SEQ ID NO: 70171

SEQ ID NO: 149094 - RNA, 62 nt, hsa; identical to SEQ ID NO: 70172

SEQ ID NO: 149095 - RNA, 62 nt, hsa; identical to SEQ ID NO: 70173

SEQ ID NO: 149096 - RNA, 62 nt, hsa; identical to SEQ ID NO: 70174

SEQ ID NO: 149097 - RNA, 62 nt, hsa; identical to SEQ ID NO: 70175

SEQ ID NO: 149098 - RNA, 63 nt, hsa; identical to SEQ ID NO: 70176

SEQ ID NO: 149099 - RNA, 63 nt, hsa; identical to SEQ ID NO: 70177

SEQ ID NO: 149100 - RNA, 63 nt, hsa; identical to SEQ ID NO: 70178

SEQ ID NO: 149101 - RNA, 63 nt, hsa; identical to SEQ ID NO: 70179

SEQ ID NO: 149102 - RNA, 63 nt, hsa; identical to SEQ ID NO: 70180

SEQ ID NO: 149103 - RNA, 63 nt, hsa; identical to SEQ ID NO: 70181

SEQ ID NO: 149104 - RNA, 63 nt, hsa; identical to SEQ ID NO: 70182

SEQ ID NO: 149105 - RNA, 63 nt, hsa; identical to SEQ ID NO: 70183

SEQ ID NO: 149106 - RNA, 63 nt, hsa; identical to SEQ ID NO: 70184

SEQ ID NO: 149107 - RNA, 63 nt, hsa; identical to SEQ ID NO: 70185

SEQ ID NO: 149108 - RNA, 63 nt, hsa; identical to SEQ ID NO: 70186

SEQ ID NO: 149109 - RNA, 63 nt, hsa; identical to SEQ ID NO: 70187

SEQ ID NO: 149110 - RNA, 63 nt, hsa; identical to SEQ ID NO: 70188

SEQ ID NO: 149111 - RNA, 52 nt, hsa; identical to SEQ ID NO: 69143

SEQ ID NO: 149112 - RNA, 63 nt, hsa; identical to SEQ ID NO: 70190

SEQ ID NO: 149113 - RNA, 63 nt, hsa; identical to SEQ ID NO: 70191

SEQ ID NO: 149114 - RNA, 63 nt, hsa; identical to SEQ ID NO: 70192

SEQ ID NO: 149115 - RNA, 63 nt, hsa; identical to SEQ ID NO: 70193

SEQ ID NO: 149116 - RNA, 63 nt, hsa; identical to SEQ ID NO: 70194

SEQ ID NO: 149117 - RNA, 63 nt, hsa; identical to SEQ ID NO: 70195

SEQ ID NO: 149118 - RNA, 63 nt, hsa; identical to SEQ ID NO: 70196

SEQ ID NO: 149119 - RNA, 63 nt, hsa; identical to SEQ ID NO: 70197

SEQ ID NO: 149120 - RNA, 63 nt, hsa; identical to SEQ ID NO: 70198

SEQ ID NO: 149121 - RNA, 63 nt, hsa; identical to SEQ ID NO: 70199

SEQ ID NO: 149122 - RNA, 63 nt, hsa; identical to SEQ ID NO: 70200

SEQ ID NO: 149123 - RNA, 63 nt, hsa; identical to SEQ ID NO: 70201

SEQ ID NO: 149124 - RNA, 63 nt, hsa; identical to SEQ ID NO: 70202

SEQ ID NO: 149125 - RNA, 63 nt, hsa; identical to SEQ ID NO: 70203

SEQ ID NO: 149126 - RNA, 63 nt, hsa; identical to SEQ ID NO: 70204

SEQ ID NO: 149127 - RNA, 63 nt, hsa; identical to SEQ ID NO: 70205

SEQ ID NO: 149128 - RNA, 63 nt, hsa; identical to SEQ ID NO: 70206

SEQ ID NO: 149129 - RNA, 63 nt, hsa; identical to SEQ ID NO: 70207

SEQ ID NO: 149130 - RNA, 63 nt, hsa; identical to SEQ ID NO: 70208

SEQ ID NO: 149131 - RNA, 63 nt, hsa; identical to SEQ ID NO: 70209

SEQ ID NO: 149132 - RNA, 63 nt, hsa; identical to SEQ ID NO: 70210

SEQ ID NO: 149133 - RNA, 63 nt, hsa; identical to SEQ ID NO: 70211

SEQ ID NO: 149134 - RNA, 63 nt, hsa; identical to SEQ ID NO: 70212

SEQ ID NO: 149135 - RNA, 63 nt, hsa; identical to SEQ ID NO: 70213

SEQ ID NO: 149136 - RNA, 63 nt, hsa; identical to SEQ ID NO: 70214

SEQ ID NO: 149137 - RNA, 63 nt, hsa; identical to SEQ ID NO: 70215

SEQ ID NO: 149138 - RNA, 57 nt, hsa; identical to SEQ ID NO: 69170

SEQ ID NO: 149139 - RNA, 63 nt, hsa; identical to SEQ ID NO: 70217

SEQ ID NO: 149140 - RNA, 63 nt, hsa; identical to SEQ ID NO: 70218

SEQ ID NO: 149141 - RNA, 63 nt, hsa; identical to SEQ ID NO: 70219

SEQ ID NO: 149142 - RNA, 63 nt, hsa; identical to SEQ ID NO: 70220

SEQ ID NO: 149143 - RNA, 63 nt, hsa; identical to SEQ ID NO: 70221

SEQ ID NO: 149144 - RNA, 63 nt, hsa; identical to SEQ ID NO: 70222

SEQ ID NO: 149145 - RNA, 63 nt, hsa; identical to SEQ ID NO: 70223

SEQ ID NO: 149146 - RNA, 63 nt, hsa; identical to SEQ ID NO: 70224

SEQ ID NO: 149147 - RNA, 63 nt, hsa; identical to SEQ ID NO: 70225

SEQ ID NO: 149148 - RNA, 63 nt, hsa; identical to SEQ ID NO: 70226

SEQ ID NO: 149149 - RNA, 63 nt, hsa; identical to SEQ ID NO: 70227

SEQ ID NO: 149150 - RNA, 63 nt, hsa; identical to SEQ ID NO: 70228

SEQ ID NO: 149151 - RNA, 63 nt, hsa; identical to SEQ ID NO: 70229

SEQ ID NO: 149152 - RNA, 63 nt, hsa; identical to SEQ ID NO: 70230

SEQ ID NO: 149153 - RNA, 63 nt, hsa; identical to SEQ ID NO: 70231

SEQ ID NO: 149154 - RNA, 63 nt, hsa; identical to SEQ ID NO: 70232

SEQ ID NO: 149155 - RNA, 61 nt, hsa; identical to SEQ ID NO: 69187

SEQ ID NO: 149156 - RNA, 63 nt, hsa; identical to SEQ ID NO: 70234

SEQ ID NO: 149157 - RNA, 63 nt, hsa; identical to SEQ ID NO: 70235

SEQ ID NO: 149158 - RNA, 63 nt, hsa; identical to SEQ ID NO: 70236

SEQ ID NO: 149159 - RNA, 63 nt, hsa; identical to SEQ ID NO: 70237

SEQ ID NO: 149160 - RNA, 63 nt, hsa; identical to SEQ ID NO: 70238

SEQ ID NO: 149161 - RNA, 63 nt, hsa; identical to SEQ ID NO: 70239

SEQ ID NO: 149162 - RNA, 63 nt, hsa; identical to SEQ ID NO: 70240

SEQ ID NO: 149163 - RNA, 63 nt, hsa; identical to SEQ ID NO: 70241

SEQ ID NO: 149164 - RNA, 63 nt, hsa; identical to SEQ ID NO: 70242

SEQ ID NO: 149165 - RNA, 63 nt, hsa; identical to SEQ ID NO: 70243

SEQ ID NO: 149166 - RNA, 63 nt, hsa; identical to SEQ ID NO: 70244

SEQ ID NO: 149167 - RNA, 63 nt, hsa; identical to SEQ ID NO: 70245

SEQ ID NO: 149168 - RNA, 63 nt, hsa; identical to SEQ ID NO: 70246

SEQ ID NO: 149169 - RNA, 63 nt, hsa; identical to SEQ ID NO: 70247

SEQ ID NO: 149170 - RNA, 63 nt, hsa; identical to SEQ ID NO: 70248

SEQ ID NO: 149171 - RNA, 63 nt, hsa; identical to SEQ ID NO: 70249

SEQ ID NO: 149172 - RNA, 63 nt, hsa; identical to SEQ ID NO: 70250

SEQ ID NO: 149173 - RNA, 63 nt, hsa; identical to SEQ ID NO: 70251

SEQ ID NO: 149174 - RNA, 63 nt, hsa; identical to SEQ ID NO: 70252

SEQ ID NO: 149175 - RNA, 63 nt, hsa; identical to SEQ ID NO: 70253

SEQ ID NO: 149176 - RNA, 63 nt, hsa; identical to SEQ ID NO: 70235

SEQ ID NO: 149177 - RNA, 63 nt, hsa; identical to SEQ ID NO: 70255

SEQ ID NO: 149178 - RNA, 63 nt, hsa; identical to SEQ ID NO: 70256

SEQ ID NO: 149179 - RNA, 63 nt, hsa; identical to SEQ ID NO: 70257

SEQ ID NO: 149180 - RNA, 63 nt, hsa; identical to SEQ ID NO: 70258

SEQ ID NO: 149181 - RNA, 63 nt, hsa; identical to SEQ ID NO: 70259

SEQ ID NO: 149182 - RNA, 63 nt, hsa; identical to SEQ ID NO: 70260

SEQ ID NO: 149183 - RNA, 63 nt, hsa; identical to SEQ ID NO: 70261

SEQ ID NO: 149184 - RNA, 63 nt, hsa; identical to SEQ ID NO: 70262

SEQ ID NO: 149185 - RNA, 63 nt, hsa; identical to SEQ ID NO: 70263

SEQ ID NO: 149186 - RNA, 63 nt, hsa; identical to SEQ ID NO: 70264

SEQ ID NO: 149187 - RNA, 63 nt, hsa; identical to SEQ ID NO: 70265

SEQ ID NO: 149188 - RNA, 63 nt, hsa; identical to SEQ ID NO: 70266

SEQ ID NO: 149189 - RNA, 63 nt, hsa; identical to SEQ ID NO: 70267

SEQ ID NO: 149190 - RNA, 63 nt, hsa; identical to SEQ ID NO: 70268

SEQ ID NO: 149191 - RNA, 63 nt, hsa; identical to SEQ ID NO: 70269

SEQ ID NO: 149192 - RNA, 63 nt, hsa; identical to SEQ ID NO: 70270

SEQ ID NO: 149193 - RNA, 63 nt, hsa; identical to SEQ ID NO: 70271

SEQ ID NO: 149194 - RNA, 63 nt, hsa; identical to SEQ ID NO: 70272

SEQ ID NO: 149195 - RNA, 63 nt, hsa; identical to SEQ ID NO: 70273

SEQ ID NO: 149196 - RNA, 63 nt, hsa; identical to SEQ ID NO: 70274

SEQ ID NO: 149197 - RNA, 63 nt, hsa; identical to SEQ ID NO: 70275

SEQ ID NO: 149198 - RNA, 63 nt, hsa; identical to SEQ ID NO: 70276

SEQ ID NO: 149199 - RNA, 63 nt, hsa; identical to SEQ ID NO: 70277

SEQ ID NO: 149200 - RNA, 63 nt, hsa; identical to SEQ ID NO: 70278

SEQ ID NO: 149201 - RNA, 63 nt, hsa; identical to SEQ ID NO: 70279

SEQ ID NO: 149202 - RNA, 63 nt, hsa; identical to SEQ ID NO: 70280

SEQ ID NO: 149203 - RNA, 63 nt, hsa; identical to SEQ ID NO: 70281

SEQ ID NO: 149204 - RNA, 63 nt, hsa; identical to SEQ ID NO: 70282

SEQ ID NO: 149205 - RNA, 63 nt, hsa; identical to SEQ ID NO: 70283

SEQ ID NO: 149206 - RNA, 63 nt, hsa; identical to SEQ ID NO: 70284

SEQ ID NO: 149207 - RNA, 63 nt, hsa; identical to SEQ ID NO: 70285

SEQ ID NO: 149208 - RNA, 63 nt, hsa; identical to SEQ ID NO: 70286

SEQ ID NO: 149209 - RNA, 63 nt, hsa; identical to SEQ ID NO: 70287

SEQ ID NO: 149210 - RNA, 63 nt, hsa; identical to SEQ ID NO: 70288

SEQ ID NO: 149211 - RNA, 63 nt, hsa; identical to SEQ ID NO: 70289

SEQ ID NO: 149212 - RNA, 63 nt, hsa; identical to SEQ ID NO: 70290

SEQ ID NO: 149213 - RNA, 63 nt, hsa; identical to SEQ ID NO: 70291

SEQ ID NO: 149214 - RNA, 63 nt, hsa; identical to SEQ ID NO: 70292

SEQ ID NO: 149215 - RNA, 63 nt, hsa; identical to SEQ ID NO: 70293

SEQ ID NO: 149216 - RNA, 63 nt, hsa; identical to SEQ ID NO: 70294

SEQ ID NO: 149217 - RNA, 63 nt, hsa; identical to SEQ ID NO: 70295

SEQ ID NO: 149218 - RNA, 63 nt, hsa; identical to SEQ ID NO: 70296

SEQ ID NO: 149219 - RNA, 63 nt, hsa; identical to SEQ ID NO: 70297

SEQ ID NO: 149220 - RNA, 63 nt, hsa; identical to SEQ ID NO: 70298

SEQ ID NO: 149221 - RNA, 63 nt, hsa; identical to SEQ ID NO: 70299

SEQ ID NO: 149222 - RNA, 63 nt, hsa; identical to SEQ ID NO: 70300

SEQ ID NO: 149223 - RNA, 63 nt, hsa; identical to SEQ ID NO: 70301

SEQ ID NO: 149224 - RNA, 63 nt, hsa; identical to SEQ ID NO: 70302

SEQ ID NO: 149225 - RNA, 63 nt, hsa; identical to SEQ ID NO: 70303

SEQ ID NO: 149226 - RNA, 63 nt, hsa; identical to SEQ ID NO: 70304

SEQ ID NO: 149227 - RNA, 63 nt, hsa; identical to SEQ ID NO: 70305

SEQ ID NO: 149228 - RNA, 63 nt, hsa; identical to SEQ ID NO: 70306

SEQ ID NO: 149229 - RNA, 63 nt, hsa; identical to SEQ ID NO: 70307

SEQ ID NO: 149230 - RNA, 63 nt, hsa; identical to SEQ ID NO: 70308

SEQ ID NO: 149231 - RNA, 63 nt, hsa; identical to SEQ ID NO: 70309

SEQ ID NO: 149232 - RNA, 63 nt, hsa; identical to SEQ ID NO: 70310

SEQ ID NO: 149233 - RNA, 63 nt, hsa; identical to SEQ ID NO: 70311

SEQ ID NO: 149234 - RNA, 63 nt, hsa; identical to SEQ ID NO: 70312

SEQ ID NO: 149235 - RNA, 63 nt, hsa; identical to SEQ ID NO: 70313

SEQ ID NO: 149236 - RNA, 63 nt, hsa; identical to SEQ ID NO: 70314

SEQ ID NO: 149237 - RNA, 63 nt, hsa; identical to SEQ ID NO: 70315

SEQ ID NO: 149238 - RNA, 63 nt, hsa; identical to SEQ ID NO: 70316

SEQ ID NO: 149239 - RNA, 63 nt, hsa; identical to SEQ ID NO: 70317

SEQ ID NO: 149240 - RNA, 59 nt, hsa; identical to SEQ ID NO: 69272

SEQ ID NO: 149241 - RNA, 63 nt, hsa; identical to SEQ ID NO: 70319

SEQ ID NO: 149242 - RNA, 63 nt, hsa; identical to SEQ ID NO: 70320

SEQ ID NO: 149243 - RNA, 63 nt, hsa; identical to SEQ ID NO: 70321

SEQ ID NO: 149244 - RNA, 63 nt, hsa; identical to SEQ ID NO: 70322

SEQ ID NO: 149245 - RNA, 63 nt, hsa; identical to SEQ ID NO: 70323

SEQ ID NO: 149246 - RNA, 63 nt, hsa; identical to SEQ ID NO: 70324

SEQ ID NO: 149247 - RNA, 63 nt, hsa; identical to SEQ ID NO: 70325

SEQ ID NO: 149248 - RNA, 63 nt, hsa; identical to SEQ ID NO: 70326

SEQ ID NO: 149249 - RNA, 63 nt, hsa; identical to SEQ ID NO: 70327

SEQ ID NO: 149250 - RNA, 63 nt, hsa; identical to SEQ ID NO: 70328

SEQ ID NO: 149251 - RNA, 63 nt, hsa; identical to SEQ ID NO: 70329

SEQ ID NO: 149252 - RNA, 63 nt, hsa; identical to SEQ ID NO: 70330

SEQ ID NO: 149253 - RNA, 63 nt, hsa; identical to SEQ ID NO: 70331

SEQ ID NO: 149254 - RNA, 63 nt, hsa; identical to SEQ ID NO: 70332

SEQ ID NO: 149255 - RNA, 63 nt, hsa; identical to SEQ ID NO: 70333

SEQ ID NO: 149256 - RNA, 63 nt, hsa; identical to SEQ ID NO: 70334

SEQ ID NO: 149257 - RNA, 63 nt, hsa; identical to SEQ ID NO: 70335

SEQ ID NO: 149258 - RNA, 63 nt, hsa; identical to SEQ ID NO: 70336

SEQ ID NO: 149259 - RNA, 63 nt, hsa; identical to SEQ ID NO: 70337

SEQ ID NO: 149260 - RNA, 63 nt, hsa; identical to SEQ ID NO: 70338

SEQ ID NO: 149261 - RNA, 63 nt, hsa; identical to SEQ ID NO: 70339

SEQ ID NO: 149262 - RNA, 63 nt, hsa; identical to SEQ ID NO: 70340

SEQ ID NO: 149263 - RNA, 63 nt, hsa; identical to SEQ ID NO: 70341

SEQ ID NO: 149264 - RNA, 63 nt, hsa; identical to SEQ ID NO: 70342

SEQ ID NO: 149265 - RNA, 63 nt, hsa; identical to SEQ ID NO: 70343

SEQ ID NO: 149266 - RNA, 63 nt, hsa; identical to SEQ ID NO: 70344

SEQ ID NO: 149267 - RNA, 63 nt, hsa; identical to SEQ ID NO: 70345

SEQ ID NO: 149268 - RNA, 63 nt, hsa; identical to SEQ ID NO: 70346

SEQ ID NO: 149269 - RNA, 63 nt, hsa; identical to SEQ ID NO: 70347

SEQ ID NO: 149270 - RNA, 63 nt, hsa; identical to SEQ ID NO: 70348

SEQ ID NO: 149271 - RNA, 63 nt, hsa; identical to SEQ ID NO: 70349

SEQ ID NO: 149272 - RNA, 63 nt, hsa; identical to SEQ ID NO: 70350

SEQ ID NO: 149273 - RNA, 63 nt, hsa; identical to SEQ ID NO: 70351

SEQ ID NO: 149274 - RNA, 63 nt, hsa; identical to SEQ ID NO: 70352

SEQ ID NO: 149275 - RNA, 63 nt, hsa; identical to SEQ ID NO: 70353

SEQ ID NO: 149276 - RNA, 63 nt, hsa; identical to SEQ ID NO: 70354

SEQ ID NO: 149277 - RNA, 63 nt, hsa; identical to SEQ ID NO: 70355

SEQ ID NO: 149278 - RNA, 63 nt, hsa; identical to SEQ ID NO: 70356

SEQ ID NO: 149279 - RNA, 63 nt, hsa; identical to SEQ ID NO: 70357

SEQ ID NO: 149280 - RNA, 63 nt, hsa; identical to SEQ ID NO: 70358

SEQ ID NO: 149281 - RNA, 63 nt, hsa; identical to SEQ ID NO: 70359

SEQ ID NO: 149282 - RNA, 63 nt, hsa; identical to SEQ ID NO: 70360

SEQ ID NO: 149283 - RNA, 63 nt, hsa; identical to SEQ ID NO: 70361

SEQ ID NO: 149284 - RNA, 63 nt, hsa; identical to SEQ ID NO: 70362

SEQ ID NO: 149285 - RNA, 63 nt, hsa; identical to SEQ ID NO: 70363

SEQ ID NO: 149286 - RNA, 63 nt, hsa; identical to SEQ ID NO: 70364

SEQ ID NO: 149287 - RNA, 63 nt, hsa; identical to SEQ ID NO: 70365

SEQ ID NO: 149288 - RNA, 63 nt, hsa; identical to SEQ ID NO: 70366

SEQ ID NO: 149289 - RNA, 63 nt, hsa; identical to SEQ ID NO: 70367

SEQ ID NO: 149290 - RNA, 63 nt, hsa; identical to SEQ ID NO: 70368

SEQ ID NO: 149291 - RNA, 63 nt, hsa; identical to SEQ ID NO: 70369

SEQ ID NO: 149292 - RNA, 63 nt, hsa; identical to SEQ ID NO: 70370

SEQ ID NO: 149293 - RNA, 63 nt, hsa; identical to SEQ ID NO: 70371

SEQ ID NO: 149294 - RNA, 63 nt, hsa; identical to SEQ ID NO: 70372

SEQ ID NO: 149295 - RNA, 63 nt, hsa; identical to SEQ ID NO: 70373

SEQ ID NO: 149296 - RNA, 63 nt, hsa; identical to SEQ ID NO: 70374

SEQ ID NO: 149297 - RNA, 63 nt, hsa; identical to SEQ ID NO: 70375

SEQ ID NO: 149298 - RNA, 63 nt, hsa; identical to SEQ ID NO: 70376

SEQ ID NO: 149299 - RNA, 63 nt, hsa; identical to SEQ ID NO: 70377

SEQ ID NO: 149300 - RNA, 63 nt, hsa; identical to SEQ ID NO: 70378

SEQ ID NO: 149301 - RNA, 63 nt, hsa; identical to SEQ ID NO: 70379

SEQ ID NO: 149302 - RNA, 63 nt, hsa; identical to SEQ ID NO: 70380

SEQ ID NO: 149303 - RNA, 63 nt, hsa; identical to SEQ ID NO: 70381

SEQ ID NO: 149304 - RNA, 63 nt, hsa; identical to SEQ ID NO: 70382

SEQ ID NO: 149305 - RNA, 63 nt, hsa; identical to SEQ ID NO: 70383

SEQ ID NO: 149306 - RNA, 63 nt, hsa; identical to SEQ ID NO: 70384

SEQ ID NO: 149307 - RNA, 63 nt, hsa; identical to SEQ ID NO: 70385

SEQ ID NO: 149308 - RNA, 63 nt, hsa; identical to SEQ ID NO: 70386

SEQ ID NO: 149309 - RNA, 63 nt, hsa; identical to SEQ ID NO: 70387

SEQ ID NO: 149310 - RNA, 63 nt, hsa; identical to SEQ ID NO: 70388

SEQ ID NO: 149311 - RNA, 63 nt, hsa; identical to SEQ ID NO: 70389

SEQ ID NO: 149312 - RNA, 63 nt, hsa; identical to SEQ ID NO: 70390

SEQ ID NO: 149313 - RNA, 63 nt, hsa; identical to SEQ ID NO: 70391

SEQ ID NO: 149314 - RNA, 63 nt, hsa; identical to SEQ ID NO: 70392

SEQ ID NO: 149315 - RNA, 63 nt, hsa; identical to SEQ ID NO: 70393

SEQ ID NO: 149316 - RNA, 63 nt, hsa; identical to SEQ ID NO: 70394

SEQ ID NO: 149317 - RNA, 63 nt, hsa; identical to SEQ ID NO: 70395

SEQ ID NO: 149318 - RNA, 63 nt, hsa; identical to SEQ ID NO: 70396

SEQ ID NO: 149319 - RNA, 54 nt, hsa; identical to SEQ ID NO: 69351

SEQ ID NO: 149320 - RNA, 63 nt, hsa; identical to SEQ ID NO: 70398

SEQ ID NO: 149321 - RNA, 63 nt, hsa; identical to SEQ ID NO: 70399

SEQ ID NO: 149322 - RNA, 63 nt, hsa; identical to SEQ ID NO: 70400

SEQ ID NO: 149323 - RNA, 63 nt, hsa; identical to SEQ ID NO: 70401

SEQ ID NO: 149324 - RNA, 63 nt, hsa; identical to SEQ ID NO: 70402

SEQ ID NO: 149325 - RNA, 63 nt, hsa; identical to SEQ ID NO: 70403

SEQ ID NO: 149326 - RNA, 63 nt, hsa; identical to SEQ ID NO: 70404

SEQ ID NO: 149327 - RNA, 63 nt, hsa; identical to SEQ ID NO: 70405

SEQ ID NO: 149328 - RNA, 63 nt, hsa; identical to SEQ ID NO: 70406

SEQ ID NO: 149329 - RNA, 63 nt, hsa; identical to SEQ ID NO: 70407

SEQ ID NO: 149330 - RNA, 63 nt, hsa; identical to SEQ ID NO: 70408

SEQ ID NO: 149331 - RNA, 63 nt, hsa; identical to SEQ ID NO: 70409

SEQ ID NO: 149332 - RNA, 63 nt, hsa; identical to SEQ ID NO: 70410

SEQ ID NO: 149333 - RNA, 63 nt, hsa; identical to SEQ ID NO: 70411

SEQ ID NO: 149334 - RNA, 63 nt, hsa; identical to SEQ ID NO: 70412

SEQ ID NO: 149335 - RNA, 63 nt, hsa; identical to SEQ ID NO: 70413

SEQ ID NO: 149336 - RNA, 63 nt, hsa; identical to SEQ ID NO: 70414

SEQ ID NO: 149337 - RNA, 63 nt, hsa; identical to SEQ ID NO: 70415

SEQ ID NO: 149338 - RNA, 63 nt, hsa; identical to SEQ ID NO: 70416

SEQ ID NO: 149339 - RNA, 63 nt, hsa; identical to SEQ ID NO: 70417

SEQ ID NO: 149340 - RNA, 63 nt, hsa; identical to SEQ ID NO: 70418

SEQ ID NO: 149341 - RNA, 63 nt, hsa; identical to SEQ ID NO: 70419

SEQ ID NO: 149342 - RNA, 63 nt, hsa; identical to SEQ ID NO: 70420

SEQ ID NO: 149343 - RNA, 54 nt, hsa; identical to SEQ ID NO: 69375

SEQ ID NO: 149344 - RNA, 63 nt, hsa; identical to SEQ ID NO: 70422

SEQ ID NO: 149345 - RNA, 63 nt, hsa; identical to SEQ ID NO: 70423

SEQ ID NO: 149346 - RNA, 63 nt, hsa; identical to SEQ ID NO: 70424

SEQ ID NO: 149347 - RNA, 63 nt, hsa; identical to SEQ ID NO: 70425

SEQ ID NO: 149348 - RNA, 63 nt, hsa; identical to SEQ ID NO: 70426

SEQ ID NO: 149349 - RNA, 63 nt, hsa; identical to SEQ ID NO: 70427

SEQ ID NO: 149350 - RNA, 63 nt, hsa; identical to SEQ ID NO: 70428

SEQ ID NO: 149351 - RNA, 63 nt, hsa; identical to SEQ ID NO: 70429

SEQ ID NO: 149352 - RNA, 63 nt, hsa; identical to SEQ ID NO: 70430

SEQ ID NO: 149353 - RNA, 63 nt, hsa; identical to SEQ ID NO: 70431

SEQ ID NO: 149354 - RNA, 63 nt, hsa; identical to SEQ ID NO: 70432

SEQ ID NO: 149355 - RNA, 63 nt, hsa; identical to SEQ ID NO: 70433

SEQ ID NO: 149356 - RNA, 62 nt, hsa; identical to SEQ ID NO: 69911

SEQ ID NO: 149357 - RNA, 63 nt, hsa; identical to SEQ ID NO: 70435

SEQ ID NO: 149358 - RNA, 63 nt, hsa; identical to SEQ ID NO: 70436

SEQ ID NO: 149359 - RNA, 63 nt, hsa; identical to SEQ ID NO: 70437

SEQ ID NO: 149360 - RNA, 58 nt, hsa; identical to SEQ ID NO: 69392

SEQ ID NO: 149361 - RNA, 63 nt, hsa; identical to SEQ ID NO: 70439

SEQ ID NO: 149362 - RNA, 63 nt, hsa; identical to SEQ ID NO: 70440

SEQ ID NO: 149363 - RNA, 63 nt, hsa; identical to SEQ ID NO: 70441

SEQ ID NO: 149364 - RNA, 63 nt, hsa; identical to SEQ ID NO: 70442

SEQ ID NO: 149365 - RNA, 63 nt, hsa; identical to SEQ ID NO: 70443

SEQ ID NO: 149366 - RNA, 63 nt, hsa; identical to SEQ ID NO: 70444

SEQ ID NO: 149367 - RNA, 63 nt, hsa; identical to SEQ ID NO: 70445

SEQ ID NO: 149368 - RNA, 63 nt, hsa; identical to SEQ ID NO: 70446

SEQ ID NO: 149369 - RNA, 63 nt, hsa; identical to SEQ ID NO: 70447

SEQ ID NO: 149370 - RNA, 63 nt, hsa; identical to SEQ ID NO: 70448

SEQ ID NO: 149371 - RNA, 63 nt, hsa; identical to SEQ ID NO: 70449

SEQ ID NO: 149372 - RNA, 63 nt, hsa; identical to SEQ ID NO: 70450

SEQ ID NO: 149373 - RNA, 63 nt, hsa; identical to SEQ ID NO: 70451

SEQ ID NO: 149374 - RNA, 63 nt, hsa; identical to SEQ ID NO: 70452

SEQ ID NO: 149375 - RNA, 63 nt, hsa; identical to SEQ ID NO: 70453

SEQ ID NO: 149376 - RNA, 63 nt, hsa; identical to SEQ ID NO: 70454

SEQ ID NO: 149377 - RNA, 63 nt, hsa; identical to SEQ ID NO: 70455

SEQ ID NO: 149378 - RNA, 63 nt, hsa; identical to SEQ ID NO: 70456

SEQ ID NO: 149379 - RNA, 63 nt, hsa; identical to SEQ ID NO: 70457

SEQ ID NO: 149380 - RNA, 63 nt, hsa; identical to SEQ ID NO: 70458

SEQ ID NO: 149381 - RNA, 63 nt, hsa; identical to SEQ ID NO: 70459

SEQ ID NO: 149382 - RNA, 63 nt, hsa; identical to SEQ ID NO: 70460

SEQ ID NO: 149383 - RNA, 63 nt, hsa; identical to SEQ ID NO: 70461

SEQ ID NO: 149384 - RNA, 63 nt, hsa; identical to SEQ ID NO: 70462

SEQ ID NO: 149385 - RNA, 63 nt, hsa; identical to SEQ ID NO: 70463

SEQ ID NO: 149386 - RNA, 63 nt, hsa; identical to SEQ ID NO: 70464

SEQ ID NO: 149387 - RNA, 60 nt, hsa; identical to SEQ ID NO: 69419

SEQ ID NO: 149388 - RNA, 63 nt, hsa; identical to SEQ ID NO: 70466

SEQ ID NO: 149389 - RNA, 63 nt, hsa; identical to SEQ ID NO: 70467

SEQ ID NO: 149390 - RNA, 63 nt, hsa; identical to SEQ ID NO: 70468

SEQ ID NO: 149391 - RNA, 63 nt, hsa; identical to SEQ ID NO: 70469

SEQ ID NO: 149392 - RNA, 63 nt, hsa; identical to SEQ ID NO: 70470

SEQ ID NO: 149393 - RNA, 63 nt, hsa; identical to SEQ ID NO: 70471

SEQ ID NO: 149394 - RNA, 63 nt, hsa; identical to SEQ ID NO: 70472

SEQ ID NO: 149395 - RNA, 63 nt, hsa; identical to SEQ ID NO: 70473

SEQ ID NO: 149396 - RNA, 63 nt, hsa; identical to SEQ ID NO: 70474

SEQ ID NO: 149397 - RNA, 63 nt, hsa; identical to SEQ ID NO: 70475

SEQ ID NO: 149398 - RNA, 63 nt, hsa; identical to SEQ ID NO: 70476

SEQ ID NO: 149399 - RNA, 63 nt, hsa; identical to SEQ ID NO: 70477

SEQ ID NO: 149400 - RNA, 63 nt, hsa; identical to SEQ ID NO: 70478

SEQ ID NO: 149401 - RNA, 63 nt, hsa; identical to SEQ ID NO: 70479

SEQ ID NO: 149402 - RNA, 63 nt, hsa; identical to SEQ ID NO: 70480

SEQ ID NO: 149403 - RNA, 63 nt, hsa; identical to SEQ ID NO: 70481

SEQ ID NO: 149404 - RNA, 63 nt, hsa; identical to SEQ ID NO: 70482

SEQ ID NO: 149405 - RNA, 63 nt, hsa; identical to SEQ ID NO: 70483

SEQ ID NO: 149406 - RNA, 63 nt, hsa; identical to SEQ ID NO: 70484

SEQ ID NO: 149407 - RNA, 63 nt, hsa; identical to SEQ ID NO: 70485

SEQ ID NO: 149408 - RNA, 63 nt, hsa; identical to SEQ ID NO: 70486

SEQ ID NO: 149409 - RNA, 63 nt, hsa; identical to SEQ ID NO: 70487

SEQ ID NO: 149410 - RNA, 63 nt, hsa; identical to SEQ ID NO: 70488

SEQ ID NO: 149411 - RNA, 63 nt, hsa; identical to SEQ ID NO: 70489

SEQ ID NO: 149412 - RNA, 59 nt, hsa; identical to SEQ ID NO: 69444

SEQ ID NO: 149413 - RNA, 63 nt, hsa; identical to SEQ ID NO: 70491

SEQ ID NO: 149414 - RNA, 63 nt, hsa; identical to SEQ ID NO: 70492

SEQ ID NO: 149415 - RNA, 63 nt, hsa; identical to SEQ ID NO: 70493

SEQ ID NO: 149416 - RNA, 63 nt, hsa; identical to SEQ ID NO: 70494

SEQ ID NO: 149417 - RNA, 52 nt, hsa; identical to SEQ ID NO: 69449

SEQ ID NO: 149418 - RNA, 63 nt, hsa; identical to SEQ ID NO: 70496

SEQ ID NO: 149419 - RNA, 63 nt, hsa; identical to SEQ ID NO: 70497

SEQ ID NO: 149420 - RNA, 63 nt, hsa; identical to SEQ ID NO: 70498

SEQ ID NO: 149421 - RNA, 63 nt, hsa; identical to SEQ ID NO: 70499

SEQ ID NO: 149422 - RNA, 63 nt, hsa; identical to SEQ ID NO: 70500

SEQ ID NO: 149423 - RNA, 63 nt, hsa; identical to SEQ ID NO: 70501

SEQ ID NO: 149424 - RNA, 63 nt, hsa; identical to SEQ ID NO: 70502

SEQ ID NO: 149425 - RNA, 63 nt, hsa; identical to SEQ ID NO: 70503

SEQ ID NO: 149426 - RNA, 63 nt, hsa; identical to SEQ ID NO: 70504

SEQ ID NO: 149427 - RNA, 63 nt, hsa; identical to SEQ ID NO: 70505

SEQ ID NO: 149428 - RNA, 63 nt, hsa; identical to SEQ ID NO: 70506

SEQ ID NO: 149429 - RNA, 63 nt, hsa; identical to SEQ ID NO: 70507

SEQ ID NO: 149430 - RNA, 63 nt, hsa; identical to SEQ ID NO: 70508

SEQ ID NO: 149431 - RNA, 63 nt, hsa; identical to SEQ ID NO: 70509

SEQ ID NO: 149432 - RNA, 63 nt, hsa; identical to SEQ ID NO: 70510

SEQ ID NO: 149433 - RNA, 63 nt, hsa; identical to SEQ ID NO: 70511

SEQ ID NO: 149434 - RNA, 63 nt, hsa; identical to SEQ ID NO: 70512

SEQ ID NO: 149435 - RNA, 63 nt, hsa; identical to SEQ ID NO: 70513

SEQ ID NO: 149436 - RNA, 63 nt, hsa; identical to SEQ ID NO: 70514

SEQ ID NO: 149437 - RNA, 63 nt, hsa; identical to SEQ ID NO: 70515

SEQ ID NO: 149438 - RNA, 63 nt, hsa; identical to SEQ ID NO: 70516

SEQ ID NO: 149439 - RNA, 63 nt, hsa; identical to SEQ ID NO: 70517

SEQ ID NO: 149440 - RNA, 63 nt, hsa; identical to SEQ ID NO: 70518

SEQ ID NO: 149441 - RNA, 63 nt, hsa; identical to SEQ ID NO: 70519

SEQ ID NO: 149442 - RNA, 63 nt, hsa; identical to SEQ ID NO: 70520

SEQ ID NO: 149443 - RNA, 63 nt, hsa; identical to SEQ ID NO: 70521

SEQ ID NO: 149444 - RNA, 63 nt, hsa; identical to SEQ ID NO: 70522

SEQ ID NO: 149445 - RNA, 63 nt, hsa; identical to SEQ ID NO: 70523

SEQ ID NO: 149446 - RNA, 63 nt, hsa; identical to SEQ ID NO: 70524

SEQ ID NO: 149447 - RNA, 63 nt, hsa; identical to SEQ ID NO: 70525

SEQ ID NO: 149448 - RNA, 63 nt, hsa; identical to SEQ ID NO: 70526

SEQ ID NO: 149449 - RNA, 63 nt, hsa; identical to SEQ ID NO: 70527

SEQ ID NO: 149450 - RNA, 63 nt, hsa; identical to SEQ ID NO: 70528

SEQ ID NO: 149451 - RNA, 62 nt, hsa; identical to SEQ ID NO: 70529

SEQ ID NO: 149452 - RNA, 63 nt, hsa; identical to SEQ ID NO: 70530

SEQ ID NO: 149453 - RNA, 63 nt, hsa; identical to SEQ ID NO: 70531

SEQ ID NO: 149454 - RNA, 63 nt, hsa; identical to SEQ ID NO: 70532

SEQ ID NO: 149455 - RNA, 63 nt, hsa; identical to SEQ ID NO: 70533

SEQ ID NO: 149456 - RNA, 63 nt, hsa; identical to SEQ ID NO: 70534

SEQ ID NO: 149457 - RNA, 63 nt, hsa; identical to SEQ ID NO: 70535

SEQ ID NO: 149458 - RNA, 63 nt, hsa; identical to SEQ ID NO: 70536

SEQ ID NO: 149459 - RNA, 63 nt, hsa; identical to SEQ ID NO: 70537

SEQ ID NO: 149460 - RNA, 63 nt, hsa; identical to SEQ ID NO: 70538

SEQ ID NO: 149461 - RNA, 63 nt, hsa; identical to SEQ ID NO: 70539

SEQ ID NO: 149462 - RNA, 63 nt, hsa; identical to SEQ ID NO: 70540

SEQ ID NO: 149463 - RNA, 63 nt, hsa; identical to SEQ ID NO: 70541

SEQ ID NO: 149464 - RNA, 63 nt, hsa; identical to SEQ ID NO: 70542

SEQ ID NO: 149465 - RNA, 63 nt, hsa; identical to SEQ ID NO: 70543

SEQ ID NO: 149466 - RNA, 63 nt, hsa; identical to SEQ ID NO: 70544

SEQ ID NO: 149467 - RNA, 63 nt, hsa; identical to SEQ ID NO: 70545

SEQ ID NO: 149468 - RNA, 63 nt, hsa; identical to SEQ ID NO: 70546

SEQ ID NO: 149469 - RNA, 63 nt, hsa; identical to SEQ ID NO: 70547

SEQ ID NO: 149470 - RNA, 63 nt, hsa; identical to SEQ ID NO: 70548

SEQ ID NO: 149471 - RNA, 63 nt, hsa; identical to SEQ ID NO: 70549

SEQ ID NO: 149472 - RNA, 63 nt, hsa; identical to SEQ ID NO: 70550

SEQ ID NO: 149473 - RNA, 63 nt, hsa; identical to SEQ ID NO: 70551

SEQ ID NO: 149474 - RNA, 63 nt, hsa; identical to SEQ ID NO: 70552

SEQ ID NO: 149475 - RNA, 63 nt, hsa; identical to SEQ ID NO: 70553

SEQ ID NO: 149476 - RNA, 63 nt, hsa; identical to SEQ ID NO: 70554

SEQ ID NO: 149477 - RNA, 63 nt, hsa; identical to SEQ ID NO: 70555

SEQ ID NO: 149478 - RNA, 63 nt, hsa; identical to SEQ ID NO: 70556

SEQ ID NO: 149479 - RNA, 63 nt, hsa; identical to SEQ ID NO: 70557

SEQ ID NO: 149480 - RNA, 63 nt, hsa; identical to SEQ ID NO: 70558

SEQ ID NO: 149481 - RNA, 63 nt, hsa; identical to SEQ ID NO: 70559

SEQ ID NO: 149482 - RNA, 63 nt, hsa; identical to SEQ ID NO: 70560

SEQ ID NO: 149483 - RNA, 63 nt, hsa; identical to SEQ ID NO: 70561

SEQ ID NO: 149484 - RNA, 63 nt, hsa; identical to SEQ ID NO: 70562

SEQ ID NO: 149485 - RNA, 63 nt, hsa; identical to SEQ ID NO: 70563

SEQ ID NO: 149486 - RNA, 63 nt, hsa; identical to SEQ ID NO: 70564

SEQ ID NO: 149487 - RNA, 63 nt, hsa; identical to SEQ ID NO: 70565

SEQ ID NO: 149488 - RNA, 63 nt, hsa; identical to SEQ ID NO: 70566

SEQ ID NO: 149489 - RNA, 63 nt, hsa; identical to SEQ ID NO: 70567

SEQ ID NO: 149490 - RNA, 63 nt, hsa; identical to SEQ ID NO: 70568

SEQ ID NO: 149491 - RNA, 63 nt, hsa; identical to SEQ ID NO: 70569

SEQ ID NO: 149492 - RNA, 63 nt, hsa; identical to SEQ ID NO: 70570

SEQ ID NO: 149493 - RNA, 63 nt, hsa; identical to SEQ ID NO: 70571

SEQ ID NO: 149494 - RNA, 63 nt, hsa; identical to SEQ ID NO: 70572

SEQ ID NO: 149495 - RNA, 63 nt, hsa; identical to SEQ ID NO: 70573

SEQ ID NO: 149496 - RNA, 63 nt, hsa; identical to SEQ ID NO: 70574

SEQ ID NO: 149497 - RNA, 63 nt, hsa; identical to SEQ ID NO: 70575

SEQ ID NO: 149498 - RNA, 63 nt, hsa; identical to SEQ ID NO: 70576

SEQ ID NO: 149499 - RNA, 63 nt, hsa; identical to SEQ ID NO: 70577

SEQ ID NO: 149500 - RNA, 63 nt, hsa; identical to SEQ ID NO: 70578

SEQ ID NO: 149501 - RNA, 63 nt, hsa; identical to SEQ ID NO: 70579

SEQ ID NO: 149502 - RNA, 63 nt, hsa; identical to SEQ ID NO: 70580

SEQ ID NO: 149503 - RNA, 63 nt, hsa; identical to SEQ ID NO: 70581

SEQ ID NO: 149504 - RNA, 63 nt, hsa; identical to SEQ ID NO: 70582

SEQ ID NO: 149505 - RNA, 63 nt, hsa; identical to SEQ ID NO: 70583

SEQ ID NO: 149506 - RNA, 63 nt, hsa; identical to SEQ ID NO: 70584

SEQ ID NO: 149507 - RNA, 63 nt, hsa; identical to SEQ ID NO: 70585

SEQ ID NO: 149508 - RNA, 63 nt, hsa; identical to SEQ ID NO: 70586

SEQ ID NO: 149509 - RNA, 60 nt, hsa; identical to SEQ ID NO: 69541

SEQ ID NO: 149510 - RNA, 63 nt, hsa; identical to SEQ ID NO: 70588

SEQ ID NO: 149511 - RNA, 63 nt, hsa; identical to SEQ ID NO: 70589

SEQ ID NO: 149512 - RNA, 63 nt, hsa; identical to SEQ ID NO: 70590

SEQ ID NO: 149513 - RNA, 63 nt, hsa; identical to SEQ ID NO: 70591

SEQ ID NO: 149514 - RNA, 63 nt, hsa; identical to SEQ ID NO: 70592

SEQ ID NO: 149515 - RNA, 63 nt, hsa; identical to SEQ ID NO: 70593

SEQ ID NO: 149516 - RNA, 63 nt, hsa; identical to SEQ ID NO: 70594

SEQ ID NO: 149517 - RNA, 63 nt, hsa; identical to SEQ ID NO: 70595

SEQ ID NO: 149518 - RNA, 63 nt, hsa; identical to SEQ ID NO: 70596

SEQ ID NO: 149519 - RNA, 63 nt, hsa; identical to SEQ ID NO: 70597

SEQ ID NO: 149520 - RNA, 63 nt, hsa; identical to SEQ ID NO: 70598

SEQ ID NO: 149521 - RNA, 63 nt, hsa; identical to SEQ ID NO: 70599

SEQ ID NO: 149522 - RNA, 63 nt, hsa; identical to SEQ ID NO: 70600

SEQ ID NO: 149523 - RNA, 63 nt, hsa; identical to SEQ ID NO: 70601

SEQ ID NO: 149524 - RNA, 63 nt, hsa; identical to SEQ ID NO: 70602

SEQ ID NO: 149525 - RNA, 63 nt, hsa; identical to SEQ ID NO: 70603

SEQ ID NO: 149526 - RNA, 63 nt, hsa; identical to SEQ ID NO: 70604

SEQ ID NO: 149527 - RNA, 63 nt, hsa; identical to SEQ ID NO: 70605

SEQ ID NO: 149528 - RNA, 63 nt, hsa; identical to SEQ ID NO: 70606

SEQ ID NO: 149529 - RNA, 63 nt, hsa; identical to SEQ ID NO: 70607

SEQ ID NO: 149530 - RNA, 63 nt, hsa; identical to SEQ ID NO: 70608

SEQ ID NO: 149531 - RNA, 63 nt, hsa; identical to SEQ ID NO: 70609

SEQ ID NO: 149532 - RNA, 63 nt, hsa; identical to SEQ ID NO: 70610

SEQ ID NO: 149533 - RNA, 63 nt, hsa; identical to SEQ ID NO: 70611

SEQ ID NO: 149534 - RNA, 63 nt, hsa; identical to SEQ ID NO: 70612

SEQ ID NO: 149535 - RNA, 63 nt, hsa; identical to SEQ ID NO: 70613

SEQ ID NO: 149536 - RNA, 63 nt, hsa; identical to SEQ ID NO: 70614

SEQ ID NO: 149537 - RNA, 63 nt, hsa; identical to SEQ ID NO: 70615

SEQ ID NO: 149538 - RNA, 60 nt, hsa; identical to SEQ ID NO: 69570

SEQ ID NO: 149539 - RNA, 63 nt, hsa; identical to SEQ ID NO: 70617

SEQ ID NO: 149540 - RNA, 63 nt, hsa; identical to SEQ ID NO: 70618

SEQ ID NO: 149541 - RNA, 63 nt, hsa; identical to SEQ ID NO: 70619

SEQ ID NO: 149542 - RNA, 63 nt, hsa; identical to SEQ ID NO: 70620

SEQ ID NO: 149543 - RNA, 63 nt, hsa; identical to SEQ ID NO: 70621

SEQ ID NO: 149544 - RNA, 63 nt, hsa; identical to SEQ ID NO: 70622

SEQ ID NO: 149545 - RNA, 62 nt, hsa; identical to SEQ ID NO: 70100

SEQ ID NO: 149546 - RNA, 63 nt, hsa; identical to SEQ ID NO: 70624

SEQ ID NO: 149547 - RNA, 63 nt, hsa; identical to SEQ ID NO: 70625

SEQ ID NO: 149548 - RNA, 63 nt, hsa; identical to SEQ ID NO: 70626

SEQ ID NO: 149549 - RNA, 63 nt, hsa; identical to SEQ ID NO: 70627

SEQ ID NO: 149550 - RNA, 63 nt, hsa; identical to SEQ ID NO: 70628

SEQ ID NO: 149551 - RNA, 63 nt, hsa; identical to SEQ ID NO: 70629

SEQ ID NO: 149552 - RNA, 63 nt, hsa; identical to SEQ ID NO: 70630

SEQ ID NO: 149553 - RNA, 63 nt, hsa; identical to SEQ ID NO: 70631

SEQ ID NO: 149554 - RNA, 63 nt, hsa; identical to SEQ ID NO: 70632

SEQ ID NO: 149555 - RNA, 63 nt, hsa; identical to SEQ ID NO: 70633

SEQ ID NO: 149556 - RNA, 63 nt, hsa; identical to SEQ ID NO: 70634

SEQ ID NO: 149557 - RNA, 63 nt, hsa; identical to SEQ ID NO: 70635

SEQ ID NO: 149558 - RNA, 63 nt, hsa; identical to SEQ ID NO: 70636

SEQ ID NO: 149559 - RNA, 63 nt, hsa; identical to SEQ ID NO: 70637

SEQ ID NO: 149560 - RNA, 63 nt, hsa; identical to SEQ ID NO: 70638

SEQ ID NO: 149561 - RNA, 63 nt, hsa; identical to SEQ ID NO: 70639

SEQ ID NO: 149562 - RNA, 63 nt, hsa; identical to SEQ ID NO: 70640

SEQ ID NO: 149563 - RNA, 63 nt, hsa; identical to SEQ ID NO: 70641

SEQ ID NO: 149564 - RNA, 63 nt, hsa; identical to SEQ ID NO: 70642

SEQ ID NO: 149565 - RNA, 63 nt, hsa; identical to SEQ ID NO: 70643

SEQ ID NO: 149566 - RNA, 63 nt, hsa; identical to SEQ ID NO: 70644

SEQ ID NO: 149567 - RNA, 63 nt, hsa; identical to SEQ ID NO: 70645

SEQ ID NO: 149568 - RNA, 63 nt, hsa; identical to SEQ ID NO: 70646

SEQ ID NO: 149569 - RNA, 63 nt, hsa; identical to SEQ ID NO: 70647

SEQ ID NO: 149570 - RNA, 63 nt, hsa; identical to SEQ ID NO: 70648

SEQ ID NO: 149571 - RNA, 63 nt, hsa; identical to SEQ ID NO: 70649

SEQ ID NO: 149572 - RNA, 63 nt, hsa; identical to SEQ ID NO: 70650

SEQ ID NO: 149573 - RNA, 63 nt, hsa; identical to SEQ ID NO: 70651

SEQ ID NO: 149574 - RNA, 63 nt, hsa; identical to SEQ ID NO: 70652

SEQ ID NO: 149575 - RNA, 63 nt, hsa; identical to SEQ ID NO: 70653

SEQ ID NO: 149576 - RNA, 63 nt, hsa; identical to SEQ ID NO: 70654

SEQ ID NO: 149577 - RNA, 63 nt, hsa; identical to SEQ ID NO: 70655

SEQ ID NO: 149578 - RNA, 63 nt, hsa; identical to SEQ ID NO: 70656

SEQ ID NO: 149579 - RNA, 63 nt, hsa; identical to SEQ ID NO: 70657

SEQ ID NO: 149580 - RNA, 63 nt, hsa; identical to SEQ ID NO: 70658

SEQ ID NO: 149581 - RNA, 63 nt, hsa; identical to SEQ ID NO: 70659

SEQ ID NO: 149582 - RNA, 63 nt, hsa; identical to SEQ ID NO: 70660

SEQ ID NO: 149583 - RNA, 63 nt, hsa; identical to SEQ ID NO: 70661

SEQ ID NO: 149584 - RNA, 63 nt, hsa; identical to SEQ ID NO: 70662

SEQ ID NO: 149585 - RNA, 63 nt, hsa; identical to SEQ ID NO: 70663

SEQ ID NO: 149586 - RNA, 63 nt, hsa; identical to SEQ ID NO: 70664

SEQ ID NO: 149587 - RNA, 63 nt, hsa; identical to SEQ ID NO: 70665

SEQ ID NO: 149588 - RNA, 63 nt, hsa; identical to SEQ ID NO: 70666

SEQ ID NO: 149589 - RNA, 63 nt, hsa; identical to SEQ ID NO: 70667

SEQ ID NO: 149590 - RNA, 63 nt, hsa; identical to SEQ ID NO: 70668

SEQ ID NO: 149591 - RNA, 63 nt, hsa; identical to SEQ ID NO: 70669

SEQ ID NO: 149592 - RNA, 63 nt, hsa; identical to SEQ ID NO: 70670

SEQ ID NO: 149593 - RNA, 63 nt, hsa; identical to SEQ ID NO: 70671

SEQ ID NO: 149594 - RNA, 63 nt, hsa; identical to SEQ ID NO: 70672

SEQ ID NO: 149595 - RNA, 63 nt, hsa; identical to SEQ ID NO: 70673

SEQ ID NO: 149596 - RNA, 63 nt, hsa; identical to SEQ ID NO: 70674

SEQ ID NO: 149597 - RNA, 63 nt, hsa; identical to SEQ ID NO: 70675

SEQ ID NO: 149598 - RNA, 63 nt, hsa; identical to SEQ ID NO: 70676

SEQ ID NO: 149599 - RNA, 63 nt, hsa; identical to SEQ ID NO: 70677

SEQ ID NO: 149600 - RNA, 63 nt, hsa; identical to SEQ ID NO: 70678

SEQ ID NO: 149601 - RNA, 63 nt, hsa; identical to SEQ ID NO: 70679

SEQ ID NO: 149602 - RNA, 63 nt, hsa; identical to SEQ ID NO: 70680

SEQ ID NO: 149603 - RNA, 63 nt, hsa; identical to SEQ ID NO: 70681

SEQ ID NO: 149604 - RNA, 63 nt, hsa; identical to SEQ ID NO: 70682

SEQ ID NO: 149605 - RNA, 63 nt, hsa; identical to SEQ ID NO: 70683

SEQ ID NO: 149606 - RNA, 63 nt, hsa; identical to SEQ ID NO: 70684

SEQ ID NO: 149607 - RNA, 63 nt, hsa; identical to SEQ ID NO: 70685

SEQ ID NO: 149608 - RNA, 63 nt, hsa; identical to SEQ ID NO: 70686

SEQ ID NO: 149609 - RNA, 63 nt, hsa; identical to SEQ ID NO: 70687

SEQ ID NO: 149610 - RNA, 63 nt, hsa; identical to SEQ ID NO: 70688

SEQ ID NO: 149611 - RNA, 63 nt, hsa; identical to SEQ ID NO: 70689

SEQ ID NO: 149612 - RNA, 63 nt, hsa; identical to SEQ ID NO: 70690

SEQ ID NO: 149613 - RNA, 63 nt, hsa; identical to SEQ ID NO: 70691

SEQ ID NO: 149614 - RNA, 63 nt, hsa; identical to SEQ ID NO: 70692

SEQ ID NO: 149615 - RNA, 63 nt, hsa; identical to SEQ ID NO: 70693

SEQ ID NO: 149616 - RNA, 63 nt, hsa; identical to SEQ ID NO: 70694

SEQ ID NO: 149617 - RNA, 63 nt, hsa; identical to SEQ ID NO: 70695

SEQ ID NO: 149618 - RNA, 63 nt, hsa; identical to SEQ ID NO: 70696

SEQ ID NO: 149619 - RNA, 63 nt, hsa; identical to SEQ ID NO: 70697

SEQ ID NO: 149620 - RNA, 63 nt, hsa; identical to SEQ ID NO: 70698

SEQ ID NO: 149621 - RNA, 62 nt, hsa
ggcaacugucacgugugcuagaagguucgaugccucuggaaugcaugugauacucaucucca

SEQ ID NO: 149622 - RNA, 62 nt, hsa
cucaccuggcagccguccaguacugcuggcuuccucuggaggcccagccacaggcugggguu

SEQ ID NO: 149623 - RNA, 62 nt, hsa
ccucccagguucgcgccauucaccugccucagccucuggaguagcugagacuacaggcgccc

SEQ ID NO: 149624 - RNA, 62 nt, hsa
caggacacagggauggauaccaccuacccucgccucuggaauggccuacccaacccgagaag

SEQ ID NO: 149625 - RNA, 62 nt, hsa
uucucucugcaggaggagagaacgcugccucuccucuggauuggucucaggcucucuguugg

SEQ ID NO: 149626 - RNA, 62 nt, hsa
ggucucacuggaccaucaggacugcugccgccccucuggagagagcagcuuuuuauuugucu

SEQ ID NO: 149627 - RNA, 62 nt, hsa
gguacggcggcccugcaucagccugcggguggccucuggauccuccguggaccgaaccgucc

SEQ ID NO: 149628 - RNA, 62 nt, hsa
gcugugacagaggugccuguucugacuuagaaccucuggaggaggaggggggugccuugguc

SEQ ID NO: 149629 - RNA, 62 nt, hsa
aagaaaccaaagucugccgcccaccucgcuccccucuggaaucuuccccaagggccaaaccc

SEQ ID NO: 149630 - RNA, 62 nt, hsa
caucuccugacccucccacucccaucuccuuaccucuggaaccccccaggcccuacaaugcu

SEQ ID NO: 149631 - RNA, 62 nt, hsa
uggaaacacacuggaaccucaugauaauugacccucuggaucaccagauuaguuuaauuuaa

SEQ ID NO: 149632 - RNA, 62 nt, hsa
ccccagcugaucagugccaggagagaccagagccucuggaggcuacccaggggaccacacca

SEQ ID NO: 149633 - RNA, 62 nt, hsa
agcucuggcccugcaccuacucucacuggccaccucuggaggcucugccuuucccaagggcc

SEQ ID NO: 149634 - RNA, 62 nt, hsa
gaggggcaguguuagagcagggcuggucauacccucuggaguucagaggaagagguaggacc

SEQ ID NO: 149635 - RNA, 62 nt, hsa
accugcuccgcccccuucccuggagggagcacccucuggacagacagaaccaucugaggcuc

SEQ ID NO: 149636 - RNA, 62 nt, hsa
auggaauaaagggcuuagggacuucccugaggccucuggacccaucugucuuccugagggca

SEQ ID NO: 149637 - RNA, 62 nt, hsa
guauccaugcucuguggccaggugccugccacccucuggaacucacaaaagcuggcuuuuau

SEQ ID NO: 149638 - RNA, 53 nt, hsa
uacagacgcaggcuugcugagggccucuggacacaggcuggaccagaugcugu

SEQ ID NO: 149639 - RNA, 62 nt, hsa
aacccuguuucaaauccacugccaauucagcuccucuggaguggagcuuucugauuucuugg

SEQ ID NO: 149640 - RNA, 62 nt, hsa
aggugugcagccugagagacgggaagaggaggccucuggaccugcuggucugcacugacagc

SEQ ID NO: 149641 - RNA, 62 nt, hsa
agcgaccccaccugccauuaccuucagggccuccucuggaagagaacccauucucagagugc

SEQ ID NO: 149642 - RNA, 62 nt, hsa
agguuugggggcucagaugggacaagaagccgccucuggacuaucuccccagaccagcagcc

SEQ ID NO: 149643 - RNA, 62 nt, hsa
ugugagccaggacauucuuccagcaagguuggccucuggauggugaacgggcugugcaaaaa

SEQ ID NO: 149644 - RNA, 62 nt, hsa
gccggacuuagggcuucaagaggcgggcgugcccucuggaguccccuaccaugacugaaggc

SEQ ID NO: 149645 - RNA, 62 nt, hsa
agaggcaggcauagaggcuucuccgccagccuccucuggacggcaggcucacugccaggcca

SEQ ID NO: 149646 - RNA, 62 nt, hsa
ccuugccacaucugugucucuggaacccaggaccucuggaccucagguuccuaagacuucag

SEQ ID NO: 149647 - RNA, 62 nt, hsa
ccuuugacaauauuuuucgguaagaaguaaaaccucuggagaccuaucuuuaagaucucuaa

SEQ ID NO: 149648 - RNA, 62 nt, hsa
accaucgccccacuggucuagccaucaugacaccucuggaggugucaagcuccugaaacaag

SEQ ID NO: 149649 - RNA, 62 nt, hsa
aguugccaagguagagagcugcccgcuccugcccucuggaugacauaggggacaucaacaag

SEQ ID NO: 149650 - RNA, 62 nt, hsa
ucuagugagguaguauugaagccucggcuuucccucuggagccugggacccuguuuacaguu

SEQ ID NO: 149651 - RNA, 62 nt, hsa
aacagcaggauguugaauugaucaucagaugcccucuggaaugguuagcauccaaggugaca

SEQ ID NO: 149652 - RNA, 62 nt, hsa
uaaggcuagauccuucccauaguaucaucuguccucuggaaugacucuccugucccuaaagg

SEQ ID NO: 149653 - RNA, 62 nt, hsa
aaagggguuaagagagagaucaccuagaaaucccucuggacacuuguggguucuuuaggguu

SEQ ID NO: 149654 - RNA, 62 nt, hsa
cuuucuuggugucuguccuuugcccccugugcccucuggauucucugggucuauguaggccc

SEQ ID NO: 149655 - RNA, 62 nt, hsa
agacgagacugagguuaaacaucagaaaaaaaccucuggaaugaccuuccucauuccaggag

SEQ ID NO: 149656 - RNA, 62 nt, hsa
uuaagcagcgccagugacagucagggaaggugccucuggaugcugugaagagucuacagaga

SEQ ID NO: 149657 - RNA, 62 nt, hsa
cuugacugcuuucuucccccacuuucauguccccucuggauuguccaguguaaugcauggca

SEQ ID NO: 149658 - RNA, 62 nt, hsa
uaugauugcuguuagccaugucuauuguuuuuccucuggauucuuuucuuauaacuuggaau

SEQ ID NO: 149659 - RNA, 62 nt, hsa
cuucuacugagcccagcgcccgcauggagccgccucuggagcuuccuguuguucauacuuuu

SEQ ID NO: 149660 - RNA, 62 nt, hsa
cccucccugggccuccaucaccccugagcaucccucuggacucagagggaacaaggugggag

SEQ ID NO: 149661 - RNA, 62 nt, hsa
gcggacaucaagggcggacaccaccaaggggcccucuggaacuugagaccacuggaggcaca

SEQ ID NO: 149662 - RNA, 62 nt, hsa
ggauauggucauuuacaagacacaucuugugcccucuggaagcucauaggguugugaggcaa

SEQ ID NO: 149663 - RNA, 62 nt, hsa
gaaggcacuggaaucacuccacacacccaaagccucuggacuucugguucucaggagucugc

SEQ ID NO: 149664 - RNA, 62 nt, hsa
cagaaggcaaaggaaccacccuacccauuuggccucuggagggggcagaagaaagaaauaaa

SEQ ID NO: 149665 - RNA, 62 nt, hsa
gcuuuccuagaauuuaaaaauaaaaaagucuuccucuggaaagagaagucacacagacaauc

SEQ ID NO: 149666 - RNA, 62 nt, hsa
caucuccuucccuccucaagaagcagaggccuccucuggagugagaggcuccacccacuaca

SEQ ID NO: 149667 - RNA, 62 nt, hsa
gcauaggcucuuuuugcugccugugagcagucccucuggaaagaaacaugugaguaagugag

SEQ ID NO: 149668 - RNA, 62 nt, hsa
augauggacaggucccccuccuccauucuugcccucuggagaagugguuccugcaguguaga

SEQ ID NO: 149669 - RNA, 62 nt, hsa
ggccccuuuccccauucucaacaccauccaucccucuggacaaaggaucauacagguguuau

SEQ ID NO: 149670 - RNA, 56 nt, hsa
ggccuguccgggggcacugagaacucccucuggaauucuugggggguguuggggag

SEQ ID NO: 149671 - RNA, 62 nt, hsa
caccuggucugccccuagauuucuccucaaggccucuggagcaaccagcacuugcccccuug

SEQ ID NO: 149672 - RNA, 62 nt, hsa
ggggguugguggauauugggcaaggcaggaaaccucuggagaccucauuuucuccaugggga

SEQ ID NO: 149673 - RNA, 62 nt, hsa
aauugugaucuaggcugcugggcugaauucucccucuggaaacugaguuacaaccaccaaua

SEQ ID NO: 149674 - RNA, 62 nt, hsa
cuucucacuuuggggacuguucccaucacccaccucuggagcuuacacuguucugggguuug

SEQ ID NO: 149675 - RNA, 62 nt, hsa
cuuggaccucugcucugaggcuuccagagaguccucuggauggcaccagaggcugcagaagg

SEQ ID NO: 149676 - RNA, 62 nt, hsa
ccaacacucucccagcucccauguccccaagaccucuggaguuuccucuugaauguacauga

SEQ ID NO: 149677 - RNA, 62 nt, hsa
ucaagacccuuuuggguuucugcccugcccacccucuggagaaggugggcacuggauuaguu

SEQ ID NO: 149678 - RNA, 62 nt, hsa
ccuuugcaucugggccuggcacccgcucucugccucuggaggcuaaacccugucuggauuuc

SEQ ID NO: 149679 - RNA, 62 nt, hsa
agccaagaauggggccugggcugggggccuggccucuggagagcccugauucuacuccaguc

SEQ ID NO: 149680 - RNA, 62 nt, hsa
cuuucccggagaugggguggccacuuaucuguccucuggaucagguccuuucuccaucccac

SEQ ID NO: 149681 - RNA, 62 nt, hsa
cccccacuucuucccuccagccugcaugcccuccucuggaacugggauuaaacagauaccca

SEQ ID NO: 149682 - RNA, 62 nt, hsa
agggccugguacccaggcccacuccagaauggccucuggacucaccuugagaagggggagcu

SEQ ID NO: 149683 - RNA, 62 nt, hsa
cugaugacccucugcgguugucaggcgugaauccucuggaaggaacuguuugcaguuguaug

SEQ ID NO: 149684 - RNA, 62 nt, hsa
gaggacuagaggugaagaggagauggacacugccucuggagccagccugacaccaaggacag

SEQ ID NO: 149685 - RNA, 62 nt, hsa
gcugcagaugcuacugacugcuugcuagguagccucuggaaagcauuccccauccaucacuc

SEQ ID NO: 149686 - RNA, 62 nt, hsa
cagggagaguaagacaugcucugcugucucuuccucuggagacugaacuuggguugguugug

SEQ ID NO: 149687 - RNA, 62 nt, hsa
ucuucauucuuucucacuuugccaucauguggccucuggacacuguggucagucauuugaaa

SEQ ID NO: 149688 - RNA, 62 nt, hsa
cuguguggacuucaucucaaggggcccagccuccucuggacuccaccuuggaccucagugac

SEQ ID NO: 149689 - RNA, 62 nt, hsa
uuaacaccagccugggcuuguuuuuccuccucccucuggacuuuuuucaucuuuuccuccac

SEQ ID NO: 149690 - RNA, 62 nt, hsa
aggccccugugaucccaguucuguucucuugcccucuggaccuaagcguucccacucgcaga

SEQ ID NO: 149691 - RNA, 62 nt, hsa
acacagaaacucuuuuugggcuccuuuuucucccucuggaucaaaguaggcaggaccauggg

SEQ ID NO: 149692 - RNA, 62 nt, hsa
gaucagacagccccuaccuaccccugcccacuccucuggagacugagccuugcccgugcaua

SEQ ID NO: 149693 - RNA, 62 nt, hsa
gggggcguuggggagccaaagucaacucugggccucuggagcuauagugacuuuugggcuag

SEQ ID NO: 149694 - RNA, 62 nt, hsa
uguggcuugcugccugggagggaugcacagggccucuggagggacaggauggaccuggucag

SEQ ID NO: 149695 - RNA, 62 nt, hsa
aaggagguaccucacaggugggugugaggcccccucuggaguuucuggccauucacuuaccc

SEQ ID NO: 149696 - RNA, 62 nt, hsa
cccauccuuugcuuccucaagcucccugccaaccucuggauacaucaaugggaaggaaacca

SEQ ID NO: 149697 - RNA, 60 nt, hsa
cgaggugcccuugcaggugaccgggcgccgccucuggaagaacguguacgacgagcuggg

SEQ ID NO: 149698 - RNA, 62 nt, hsa
uccaguccugaguuugcuacuuacuucuguggccucuggaaccuuauccaaccucuuggugc

SEQ ID NO: 149699 - RNA, 62 nt, hsa
cucugaggaguucccuggggacaacugagcagccucuggagaggggccauuaauaaagcuca

SEQ ID NO: 149700 - RNA, 62 nt, hsa
cacaccgccgcugcagcuugggccccauccgcccucuggaccuguguagggccucacugcug

SEQ ID NO: 149701 - RNA, 62 nt, hsa
uuuuuuagacuggaaaaaagccagucuaaaggccucuggauacugggcuccccagaacugcu

SEQ ID NO: 149702 - RNA, 62 nt, hsa
uaggaagggggcagggacgugaccuugacuuaccucuggaaagggucccagccuagacugcu

SEQ ID NO: 149703 - RNA, 62 nt, hsa
ccgggcaagcacuaccaggcugugggucugcaccucuggaagguaacucagccccgucuggc

SEQ ID NO: 149704 - RNA, 62 nt, hsa
uaaucucuuugguaccuauaacuuauuagaauccucuggaugaggguuagaagagacuuuuu

SEQ ID NO: 149705 - RNA, 62 nt, hsa
aguaagagcaaaucuguaugauaacauuuuuuccucuggacauaagacauaacaguaacacg

SEQ ID NO: 149706 - RNA, 62 nt, hsa
ggauguucaguuuagaaccauuuugucugcucccucuggaagccuugcgcagagcuuacuuu

SEQ ID NO: 149707 - RNA, 62 nt, hsa
ggaagcccucuuggaaaaguucuuagcagcagccucuggacuuggagagaagggcgugccac

SEQ ID NO: 149708 - RNA, 62 nt, hsa
gacugaaaaucuccacuacauguaacuuucuuccucuggaucaguggcauggcuuauaaucc

SEQ ID NO: 149709 - RNA, 62 nt, hsa
uccugccucaacuggggcugcuggaagggggcccucuggauucccuuuggaggcaucagguu

SEQ ID NO: 149710 - RNA, 62 nt, hsa
uuuuccccuaaguccuaacagaaugguauauuccucuggaaaaagaugaacgucaccaaugg

SEQ ID NO: 149711 - RNA, 62 nt, hsa
ccugagcacaggccgauggaggugguucaaauccucuggaacauagccaagaccaggagaag

SEQ ID NO: 149712 - RNA, 62 nt, hsa
ugcaauacaagcuaauucuagcugcucaguaaccucuggaguuuuuaaagggacauuuuccu

SEQ ID NO: 149713 - RNA, 62 nt, hsa
guuuaugugaacauuccuaucaauccaaauucccucuggaguuucauguuaugccuguugca

SEQ ID NO: 149714 - RNA, 62 nt, hsa
ccaccuggacgguggcccccucagccuggcagccucuggacagagaggaaggaaggauugga

SEQ ID NO: 149715 - RNA, 62 nt, hsa
gaagccagguggccugugcuccccaugggugaccucuggaggcaguggaccaagaugcagca

SEQ ID NO: 149716 - RNA, 62 nt, hsa
gccaaauauauuuccugauaacauuauguggcccucuggauccagccaugccugaggucuac

SEQ ID NO: 149717 - RNA, 62 nt, hsa
accugguucccugccucuguauucagguguggccucuggaaccugacuccguuaggacgaac

SEQ ID NO: 149718 - RNA, 62 nt, hsa
gagacacgcgaccauguuggggcucuuggacuccucuggaugacccguccccaaaguugaca

SEQ ID NO: 149719 - RNA, 62 nt, hsa
ugcagagaggaggacguguacuccaggcgaggccucuggaccuguguuccugugccaaaguc

SEQ ID NO: 149720 - RNA, 62 nt, hsa
cuuugccacucgccggagcaucaaugccgcugccucuggaggagcccuuggauuuucuccau

SEQ ID NO: 149721 - RNA, 62 nt, hsa
gucaucaagaugcacagcauggaacacaagcuccucuggauccugcagcuggugacauggaa

SEQ ID NO: 149722 - RNA, 62 nt, hsa
uugugcucugcccacaaacaggcgucccuuucccucuggauaacaguaagugcccaguaacu

SEQ ID NO: 149723 - RNA, 62 nt, hsa
agaagcauuugugguaguaaaggaaaaccaacccucuggaaaauacauuuugagaaucucaa

SEQ ID NO: 149724 - RNA, 62 nt, hsa
guggccuauggagagacaggccuuucucucagccucuggaagccaccugcucuuuugcucua

SEQ ID NO: 149725 - RNA, 62 nt, hsa
uccucuccaagcccuccucugaaccagcuaucccucuggaaugcagcugaccaaacaaauuc

SEQ ID NO: 149726 - RNA, 62 nt, hsa
aucaguuuacaauaauguucuuaaaacaguauccucuggauaguugaguauggguuagaaau

SEQ ID NO: 149727 - RNA, 62 nt, hsa
aacgugagccuggaagaggagaaaauguggcuccucuggagcuuggcagaccacuuuucggu

SEQ ID NO: 149728 - RNA, 62 nt, hsa
gauaugaaccugaagauuaaaacugaagauuuccucuggaagcuaccacaugcaaacauaca

SEQ ID NO: 149729 - RNA, 62 nt, hsa
guggguucccuuggucagcaacagugcauguaccucuggaugucaucugaggugagaccacc

SEQ ID NO: 149730 - RNA, 62 nt, hsa
ucugaacaugcuacauccugcccaagacugcaccucuggaggugcagggcacccuugagaag

SEQ ID NO: 149731 - RNA, 62 nt, hsa
agugggucugugucacacagguauuucuugguccucuggagagcagaggacucacucagcuc

SEQ ID NO: 149732 - RNA, 62 nt, hsa
ugcuccuucgggguccugagauuguggcucccccucuggaggagguggcuccacgaugccuu

SEQ ID NO: 149733 - RNA, 62 nt, hsa
ccugaugccaagggguaaugggcccagcagugccucuggagcccaggccccaacacagcccc

SEQ ID NO: 149734 - RNA, 62 nt, hsa
acaaugaaccaccugauuacaagagccucauuccucuggaacgugcagucaucaauggucag

SEQ ID NO: 149735 - RNA, 62 nt, hsa
gaagacccccuccagaagcauacuggaagccaccucuggaaaagccucauauggugauaugc

SEQ ID NO: 149736 - RNA, 62 nt, hsa
gcccuuugccagacagcucugucuccccauguccucuggaacagcugggcaugggucauggc

SEQ ID NO: 149737 - RNA, 62 nt, hsa
ccgccagccugaccucacacccucugggcccgccucuggagccagcgcccagggucccucug

SEQ ID NO: 149738 - RNA, 62 nt, hsa
ucuggccauuggugcguguuucauucagaucaccucuggaaucucugugguugugaaggcaa

SEQ ID NO: 149739 - RNA, 62 nt, hsa
aauaugaaccauuaugauucaaguuagauuuuccucuggagagacagaucugaauguucagu

SEQ ID NO: 149740 - RNA, 62 nt, hsa
gauucgagggguuccuuccacuucuggggccaccucuggaucccguucagaaaaccacuuua

SEQ ID NO: 149741 - RNA, 62 nt, hsa
ggguaaacgaaggcauaauaagccauggcugaccucuggagcaccaggugccaggacuuguc

SEQ ID NO: 149742 - RNA, 62 nt, hsa
gugauaaaauuuuuuaaaaguuuugaaggaaaccucuggauaaauggacaaggccuaauuuu

SEQ ID NO: 149743 - RNA, 62 nt, hsa
acauuaagaugagcccuaauauguaagauuuuccucuggaauggaugugagaaauguaaauu

SEQ ID NO: 149744 - RNA, 62 nt, hsa
auuuaacgauucaggcuuugaauuacucugucccucuggaccgaaucucuuuaacugcugga

SEQ ID NO: 149745 - RNA, 61 nt, hsa
agccucagcuucugaagugacaugaaaagagccucuggaugcauuuccauuucucuccuua

SEQ ID NO: 149746 - RNA, 62 nt, hsa
uccuaacuugcuaagaugcuagguaguacgacccucuggauuuggaaggcaaauaaaacucu

SEQ ID NO: 149747 - RNA, 62 nt, hsa
gagaacuaaauuguuucuaaauguagauggucccucuggaaaagcaguuuucagcaggggug

SEQ ID NO: 149748 - RNA, 62 nt, hsa
ugcugcuuuugugccucccccacuuuccaucaccucuggagucccgucuggacgucccuucc

SEQ ID NO: 149749 - RNA, 62 nt, hsa
uaugcagaaaaaaaagugcugcaguuuagauaccucuggaauuuuuccacagugucacaggu

SEQ ID NO: 149750 - RNA, 62 nt, hsa
ucaucuguaucuuaaauggccccaggcaucugccucuggaaaacuauugagccuugcaugua

SEQ ID NO: 149751 - RNA, 62 nt, hsa
cuugcaaaaugaucccagcucugauuagcagcccucuggaguucagaacuuaaguaucagug

SEQ ID NO: 149752 - RNA, 62 nt, hsa
cgucugugauuuauuugguguuucgggcguggccucuggagccccggcacguggugggccac

SEQ ID NO: 149753 - RNA, 62 nt, hsa
uguggagacagaggugucugccaucucuguggccucuggagagugacgucucccugcuggga

SEQ ID NO: 149754 - RNA, 62 nt, hsa
agcucagcuaccacuuccccuucccucugcacccucuggaacccuggcccaauuccucagac

SEQ ID NO: 149755 - RNA, 62 nt, hsa
ggacaaucaccuacugaggagccccacccccgccucuggauggaccgaaucagggacuagag

SEQ ID NO: 149756 - RNA, 62 nt, hsa
gagguggcccuuugauuugugcguguccuugcccucuggacaacuuaauauuucaaguaauc

SEQ ID NO: 149757 - RNA, 62 nt, hsa
auuaaauaugcuuuagaauuuucuaagacaguccucuggauccucuaaaugugaauuuugau

SEQ ID NO: 149758 - RNA, 62 nt, hsa
gaguucugcaaaaggugguccgcauccuuggcccucuggacauuaucacuaaauugcuugug

SEQ ID NO: 149759 - RNA, 62 nt, hsa
uagguaugcuccguauagugauuguagcuguuccucuggauucaccaucuguugaguuguaa

SEQ ID NO: 149760 - RNA, 62 nt, hsa
agaauuuuagcagaugguacuuuucucagugaccucuggaauaaaagaacugacuuuugaua

SEQ ID NO: 149761 - RNA, 62 nt, hsa
gccgaaugggcauggcugcgcuggauccugcgccucuggacgugcuagccauuuccaguguc

SEQ ID NO: 149762 - RNA, 62 nt, hsa
gauccuucuccugaaguucagccacccugaggccucuggaaagcaaagggcuccucuccagu

SEQ ID NO: 149763 - RNA, 62 nt, hsa
gaauccugcuaaaggagcaaagccuuguauuaccucuggaagacaacaaaaacaauuggcaa

SEQ ID NO: 149764 - RNA, 62 nt, hsa
ugcagauaugaagagcauuuuaagaggugcagccucuggaaguggaucaaacuagaacucau

SEQ ID NO: 149765 - RNA, 62 nt, hsa
ucugcuucuaaccacugaggcucucuaaucuuccucuggaguuuuagugaaaggauuuauug

SEQ ID NO: 149766 - RNA, 62 nt, hsa
guucuuccaagagccucugcucacauuguuggccucuggauucuggcccuucuucauuggcu

SEQ ID NO: 149767 - RNA, 62 nt, hsa
aauacuuguguauauuuaaagacccaauugcuccucuggagcuuguacuuucaagaaugauu

SEQ ID NO: 149768 - RNA, 62 nt, hsa
guccccaggcucagauuguccuuccaccuuagccucuggagcagcugggacuacaggugugc

SEQ ID NO: 149769 - RNA, 62 nt, hsa
uuuguagaaaagguuuccucuagaacugaauuccucuggaauugagugauggacuucacaac

SEQ ID NO: 149770 - RNA, 62 nt, hsa
uugcuauguugaaguaauaggguuuuuuuuaaccucuggaugucucgucugugguugaguuu

SEQ ID NO: 149771 - RNA, 62 nt, hsa
gcagugcgaguagugaccccagcauaccuuguccucuggaccuccugucuucucugcuucug

SEQ ID NO: 149772 - RNA, 62 nt, hsa
cucaccuuucugugacuuguucggaauuaacuccucuggauggaaacuuccaucuuacuugg

SEQ ID NO: 149773 - RNA, 62 nt, hsa
uugccugagauccuuccugaggagcguccauuccucuggagucucuccuuguuuggaacaaa

SEQ ID NO: 149774 - RNA, 62 nt, hsa
guauucuugagggacaaugccaauagguauauccucuggaaaaggcuuucaugauuuggcau

SEQ ID NO: 149775 - RNA, 62 nt, hsa
uaggcacccugaagaacaggugagacagcuggccucuggacagagguaggcauaguacagua

SEQ ID NO: 149776 - RNA, 62 nt, hsa
uuuuauucaagauugugcucuucuaucaaaagccucuggaaauaaauguuccgggaucaugu

SEQ ID NO: 149777 - RNA, 62 nt, hsa
gaaggaaaaacuaagagaaugaaaaguauuugccucuggaaagaacaacuggcaggacuguu

SEQ ID NO: 149778 - RNA, 62 nt, hsa
caugggcaucgaagaaguacaacccacauagcccucuggagaccgccuagaucagagacuca

SEQ ID NO: 149779 - RNA, 62 nt, hsa
agcagcaggugccugugaacauaccucagacgccucuggauccaagaaccaggggccugagg

SEQ ID NO: 149780 - RNA, 62 nt, hsa
uuuagaauguaauauguaaacugugauuugguccucuggaaaaaaaaaaaugaaaugaagag

SEQ ID NO: 149781 - RNA, 62 nt, hsa
uggccguguuuugccagcaugagauacuguccccucuggaggauuuuaggggaggaagagcc

SEQ ID NO: 149782 - RNA, 62 nt, hsa
auguguaaaaaccacgucugagcuugcuuuucccucuggacacucugcuuuugauugccuau

SEQ ID NO: 149783 - RNA, 62 nt, hsa
ccaaacacccugcugcuggcugccaggcaggcccucuggaagggaaggggcaggacucauca

SEQ ID NO: 149784 - RNA, 62 nt, hsa
auucaucucagaugugagcacaaggcauuggcccucuggacuccuuucuccuuuucuuuccu

SEQ ID NO: 149785 - RNA, 62 nt, hsa
agcugccagcucugccuugagagguugugggaccucuggauccagcugaccugacaggucau

SEQ ID NO: 149786 - RNA, 62 nt, hsa
aucuuggcaauaaugucaacaccagaaagccuccucuggagaaucuuacagagugauuguag

SEQ ID NO: 149787 - RNA, 62 nt, hsa
uucuguggaugccagcuuuggaaucagagccgccucuggaauaccugugcuuccagaguuag

SEQ ID NO: 149788 - RNA, 62 nt, hsa
caaaaaggcagaggaaaggcaaauucuucucuccucuggagcugagacacucuucuucuucu

SEQ ID NO: 149789 - RNA, 62 nt, hsa
uuuccugccaaaaugagugaggcgcuuggugcccucuggacuuucccacuucccaacauggg

SEQ ID NO: 149790 - RNA, 62 nt, hsa
ucugaaucucuguaagguuuauuuaucuucacccucuggagagaagauguuuuaccaaagcc

SEQ ID NO: 149791 - RNA, 62 nt, hsa
auuuccuaucauuuuauuaucaccaugcaaugccucuggaauaaaacauacaggagucuguc

SEQ ID NO: 149792 - RNA, 62 nt, hsa
ucugguuccauuuuuccucuguucacaaacuaccucuggacaguuguguuguuuuuuguuca

SEQ ID NO: 149793 - RNA, 62 nt, hsa
gagacuugcuuacaguggaugccacuucuaggccucuggaccgcagaugcccuccucccucc

SEQ ID NO: 149794 - RNA, 62 nt, hsa
uguuuuuaaaaguaacuuggguugcauucuucccucuggacuagaguagaaaugcaggggaa

SEQ ID NO: 149795 - RNA, 62 nt, hsa
uuccuccuccccacuuguccgcugggugguacccucuggagggguguggcuccuucccaucg

SEQ ID NO: 149796 - RNA, 62 nt, hsa
acucugcaggccugcuccaccacagcccuaauccucuggacgcuuguguagggccuggggug

SEQ ID NO: 149797 - RNA, 62 nt, hsa
agucuucugggagccauuguggccagggacggccucuggacugccaggcuggguuggggacc

SEQ ID NO: 149798 - RNA, 62 nt, hsa
gauucagggcccccucagcugucuccucccucccucuggaaaggaggguggggcucaggggc

SEQ ID NO: 149799 - RNA, 62 nt, hsa
ugggcccggaucuccaggcccuggggagggagccucuggacggacaguggggacauuguggg

SEQ ID NO: 149800 - RNA, 62 nt, hsa
gauuuuagacagggcaaaaggaagaacaggggccucuggaggcccuugguuauuuaaaucuu

SEQ ID NO: 149801 - RNA, 62 nt, hsa
cucgagugccaccaguaccuccgcaccccgggccucuggacuucuuggaugagcucacccug

SEQ ID NO: 149802 - RNA, 62 nt, hsa
aagcucucucgacagcaaaugguuuccccucaccucuggaauuaaagaaggaacuccaaagu

SEQ ID NO: 149803 - RNA, 62 nt, hsa
ucuguuuacuaacucaaauaaagcaauuguucccucuggagggguccaggugcccccgcccc

SEQ ID NO: 149804 - RNA, 62 nt, hsa
aucauuuucucaucauuaauuaugcacuuuguccucuggaccauuuuaaucuaaaauugcuc

SEQ ID NO: 149805 - RNA, 62 nt, hsa
ugccuucucucccacgaauucugucccuguauccucuggauguaaaaagcaaggagagaccc

SEQ ID NO: 149806 - RNA, 62 nt, hsa
aauacaaaaccacuucagagaccaggguaucuccucuggaaggaucuaagagaagguaagac

SEQ ID NO: 149807 - RNA, 62 nt, hsa
gcugcuccuguuugucugauguggcaaaaggcccucuggagggcugguggccacgagguuaa

SEQ ID NO: 149808 - RNA, 62 nt, hsa
uacgugugaucuuugaaaaccuuggcuuuagcccucuggaaucagagcuuacccaccauagu

SEQ ID NO: 149809 - RNA, 62 nt, hsa
gcauggagcagauugaaaugcaaaaacccacaccucuggaagauaccuucacggccgcugcu

SEQ ID NO: 149810 - RNA, 62 nt, hsa
aaugaguaaucaacaaaaucugccagagagucccucuggaaccauauaaaguuccuggcuuu

SEQ ID NO: 149811 - RNA, 62 nt, hsa
cugggaguagagagacacacuaacagccacacccucuggaaaucugauacaguaaauauaug

SEQ ID NO: 149812 - RNA, 62 nt, hsa
ucuuguuuccuauucuucaaccugcugacuucccucuggauucuucugcaaccagucccaga

SEQ ID NO: 149813 - RNA, 62 nt, hsa
gagugcuacuaaaacauuuucuucucuccuggccucuggaagcaucuuuagcuuugacuuug

SEQ ID NO: 149814 - RNA, 62 nt, hsa
ggccugacuuugggggguuagggcaagggguuccucuggauugcagaccacaucgcacagac

SEQ ID NO: 149815 - RNA, 62 nt, hsa
uucucuugucgggacagguguccuuugcugggccucuggauggcccugcccugacuggggcu

SEQ ID NO: 149816 - RNA, 62 nt, hsa
ucacagccauacaccuguagcccuggagaggcccucuggaguggccacuaagcagaggaggg

SEQ ID NO: 149817 - RNA, 62 nt, hsa
uagucauaaaagaaacacaaugaaguguauggccucuggaguuagucuuaguaaaacuuauu

SEQ ID NO: 149818 - RNA, 62 nt, hsa
cagaguguguggccucaauauuauacauuaugccucuggaucucaacuacucauuugccaag

SEQ ID NO: 149819 - RNA, 62 nt, hsa
ccuccguuuccccucagucaaacuugagccagccucuggaucgaugugaucuuauugcaugu

SEQ ID NO: 149820 - RNA, 62 nt, hsa
gauugauagugaaaccauuagaucauugaauuccucuggaauuagaaaaccagagaguccca

SEQ ID NO: 149821 - RNA, 62 nt, hsa
augcauguaggucucuuaacaaugauggugggccucuggaguccaggggcuggccgguuguu

SEQ ID NO: 149822 - RNA, 62 nt, hsa
ugagucuaccuaauauguuaaggacaaggaaaccucuggacagugguauauuggggaauuuu

SEQ ID NO: 149823 - RNA, 62 nt, hsa
uuccuacaggggcuccucugugggugaggggcccucuggaauggcaucccaugagcuugugg

SEQ ID NO: 149824 - RNA, 62 nt, hsa
guuuauuuaaugauguaauuuauuguugcguuccucuggaagcugugacuggaauaaacccc

SEQ ID NO: 149825 - RNA, 62 nt, hsa
cgccuccugcuagcaagaacagaguccacccuccucuggauauuggggagggacggaaguga

SEQ ID NO: 149826 - RNA, 62 nt, hsa
gagccagggccacucagcugccccuguccccaccucuggagaauccacccccaccagauucc

SEQ ID NO: 149827 - RNA, 62 nt, hsa
ccagggccugcaugggggcaccgggcuccaugccucuggaggccucuggcccucgguggcug

SEQ ID NO: 149828 - RNA, 62 nt, hsa
acaaagacagggauaaauugcuuacauuucaaccucuggagauugagguaacuuuuuguguc

SEQ ID NO: 149829 - RNA, 62 nt, hsa
uccuucugcugcccugggguuggggccucaccccucuggagggccggaggcaggagguggaa

SEQ ID NO: 149830 - RNA, 62 nt, hsa
acugauuccaauauuauuacuuauaacacugaccucuggaaaauauuuuguucacaagaaau

SEQ ID NO: 149831 - RNA, 62 nt, hsa
ccugcauaggcacacacaccuugaaucugcacccucuggagggcaucuguacuccugugcaa

SEQ ID NO: 149832 - RNA, 62 nt, hsa
uuuucuaagcuuuucauuaagaaaacaaaaguccucuggauugagauacuugaccuugcaug

SEQ ID NO: 149833 - RNA, 62 nt, hsa
cucgccugggcccaggcucugggaaggggugcccucuggauccugcuguggccucacuuccc

SEQ ID NO: 149834 - RNA, 62 nt, hsa
aggcagccguuaaccuccugcuuccuuuguuaccucuggauuacuuugcaguaaauugcagg

SEQ ID NO: 149835 - RNA, 62 nt, hsa
aaccccuugggcuaggucugaccccaggugucccucuggaaggggcuggcuggugcccuauu

SEQ ID NO: 149836 - RNA, 62 nt, hsa
ccauguuuucagagugcagggucaaguggcguccucuggacagaugugagaaggcaccaccu

SEQ ID NO: 149837 - RNA, 62 nt, hsa
caguguuaccugacuuaugaaacuugaaaccgccucuggagccgccauucugcagaguauuu

SEQ ID NO: 149838 - RNA, 62 nt, hsa
uccugcguguucucagaggacggcgagaaaugccucuggagcuggaacccagcuuacauuuu

SEQ ID NO: 149839 - RNA, 62 nt, hsa
cugccugcuggcucucccccagccccacauccccucuggaagagaauguaaaauaaaccugg

SEQ ID NO: 149840 - RNA, 62 nt, hsa
gaggcuggccugccccauuccccaagggggcuccucuggagugguggggaggauuaggcugc

SEQ ID NO: 149841 - RNA, 62 nt, hsa
gaaguccaagauuaagggaucaacaaauuaggccucuggaucauacauggcauuuucuagcu

SEQ ID NO: 149842 - RNA, 62 nt, hsa
gauuuggaagauuuguuucuuuuaucucucuuccucuggauguaguuuuuuuuuguuuuuuu

SEQ ID NO: 149843 - RNA, 62 nt, hsa
acuaugcauugaacauucugaaucauucuaagccucuggagagacuguaaugauccauucau

SEQ ID NO: 149844 - RNA, 62 nt, hsa
guccugcuugggguucauaggaauugguaaggccucuggacuggccugucuggccccugaga

SEQ ID NO: 149845 - RNA, 62 nt, hsa
uuuacugguucuugcaaaugggagcugagcagccucuggacagccagugaccuuugaccucg

SEQ ID NO: 149846 - RNA, 62 nt, hsa
ugcccaccaccgacgauguggguauggaacccccucuggauacagaaccccuucuuuuccaa

SEQ ID NO: 149847 - RNA, 62 nt, hsa
gccucccacccuggucccagguuccacaagugccucuggagggcccugggcucuggcagaug

SEQ ID NO: 149848 - RNA, 62 nt, hsa
uugcacgacacagggcuggugaccucccugggccucuggaagcuuuguuucuucuguacccg

SEQ ID NO: 149849 - RNA, 62 nt, hsa
uuuaaggacuugacuuccuuucucccaugauuccucuggacugcacacagcacccacaacca

SEQ ID NO: 149850 - RNA, 62 nt, hsa
ccagcuuccucauucugcuacaacacccaggcccucuggacauccagaaaaccaaguguccg

SEQ ID NO: 149851 - RNA, 62 nt, hsa
cuccaccuggccccuucuccagcaagcagugcccucuggacagcuugacucuacucccagcg

SEQ ID NO: 149852 - RNA, 62 nt, hsa
aacugcugcagcucucggcuuccgcccaacagccucuggaggugaggcgggagcaugcccuc

SEQ ID NO: 149853 - RNA, 62 nt, hsa
augaaacuugccccuucacugaucuggacucaccucuggagccuauggcuuuaagcaagcac

SEQ ID NO: 149854 - RNA, 62 nt, hsa
caccugcugaacuucauuucuguaucaccugaccucuggaugccaaaacguuuauucugcuu

SEQ ID NO: 149855 - RNA, 62 nt, hsa
aaacccuaaaggagaaggaagcagaauauaacccucuggagagcucaagacaguaggaaccu

SEQ ID NO: 149856 - RNA, 62 nt, hsa
ccuggccaccaccuugggcauggccacucugcccucuggaccugucuuucaucgggagaaac

SEQ ID NO: 149857 - RNA, 62 nt, hsa
ggugcagcgcucagguggauccugggaagcagccucuggaugcugaguggagggagccacug

SEQ ID NO: 149858 - RNA, 62 nt, hsa
cuuguacuuuauuuuucugauagaaaugguuuccucuggaucguuuuaugcgguucuuacag

SEQ ID NO: 149859 - RNA, 62 nt, hsa
ccguuuggcacagcuuuggccacagccaggccccucuggaauuguccuuauuaaaccaguuu

SEQ ID NO: 149860 - RNA, 62 nt, hsa
ccugugaugcucugccaacuacaaaugcugcuccucuggagggcgggucccccgugcugugg

SEQ ID NO: 149861 - RNA, 62 nt, hsa
uagacuccacgagggcagggccucuccugucgccucuggacacaaguggcgacagccugcug

SEQ ID NO: 149862 - RNA, 62 nt, hsa
acuucagauucccaaagaagccagcuacagagccucuggaacacuauggucuuacaagcagu

SEQ ID NO: 149863 - RNA, 62 nt, hsa
auugguuuuuuaagugccgggugaauuuuggaccucuggaugugcagcaaguuuuuaugcaa

SEQ ID NO: 149864 - RNA, 62 nt, hsa
cauuauuguauagagcugcuucaauucugaguccucuggacuuccccugccuaucuguuugu

SEQ ID NO: 149865 - RNA, 62 nt, hsa
agugcaggaaaccugaacccagcucucaggucccucuggaacuuuggcucuucuuuguuuug

SEQ ID NO: 149866 - RNA, 62 nt, hsa
cugucugugaaagucagaacacagggcucgagccucuggaacugacccuuugcaagucuuua

SEQ ID NO: 149867 - RNA, 62 nt, hsa
uauauugaugcugaaagaggaacuggucagcuccucuggacaacaaauucuuagucuauaau

SEQ ID NO: 149868 - RNA, 62 nt, hsa
gcuggcuuccuuaccagaaaagccucagccuuccucuggaagcaucccccguucugggcaag

SEQ ID NO: 149869 - RNA, 62 nt, hsa
gggcagcuggggcugccaucccauuucuccugccucuggaagguggguggggcccugcaccg

SEQ ID NO: 149870 - RNA, 62 nt, hsa
aagaauguacaauggccagaguucuacucuuuccucuggagcauuaaaauauauugccauuc

SEQ ID NO: 149871 - RNA, 62 nt, hsa
ucccuacagacagccagucuccacuugccuccccucuggauguaucuggucagggaaguggg

SEQ ID NO: 149872 - RNA, 62 nt, hsa
gagaggcagggaaaaugguuaagcagcccggcccucuggaguccccaugggggcgguagcug

SEQ ID NO: 149873 - RNA, 62 nt, hsa
aucucugugcaggaaccaagauggggcugaagccucuggaggcaguugguugggggcgggca

SEQ ID NO: 149874 - RNA, 62 nt, hsa
ccuuguuaccugcccaaacuugugacugcaucccucuggagucuacccagagacagagaaug

SEQ ID NO: 149875 - RNA, 62 nt, hsa
cuuccaccagccuuaugcaucuaaguguagcuccucuggagauggagagcucuuucaucgua

SEQ ID NO: 149876 - RNA, 62 nt, hsa
cuguaauuuaaggaaagaaaacuucaguucugccucuggauaccaagaugcccauugcucag

SEQ ID NO: 149877 - RNA, 62 nt, hsa
uuuuucuuuuggccuuugggcacagagucugaccucuggaccacucuaacuggagaaggaac

SEQ ID NO: 149878 - RNA, 62 nt, hsa
aggugccaggaaucccuugggucagcuccuauccucuggacggggagcaucaugggaaaaag

SEQ ID NO: 149879 - RNA, 62 nt, hsa
cuccagugucaucuuuguccaccugaaguccaccucuggagagcccaacaucccuugacuuu

SEQ ID NO: 149880 - RNA, 62 nt, hsa
uaacaauuucuacugcuuacacugguuuuuauccucuggacaacauaaaaaacaaaauaugg

SEQ ID NO: 149881 - RNA, 62 nt, hsa
cuucuacccccauuaucuuaccucaacuguuuccucuggagccacuuggacuucaaaaauag

SEQ ID NO: 149882 - RNA, 62 nt, hsa
uggugacucacugaguaccaugguucuguucuccucuggagaucuugcacguaucuguuuuc

SEQ ID NO: 149883 - RNA, 62 nt, hsa
guuuauuucuuaaaucuaguaauuuguagauuccucuggauuuuguauaugcauagucaugu

SEQ ID NO: 149884 - RNA, 62 nt, hsa
cugugacaucccagaagcccagccccucaaccccucuggaugcuacauggggaugcuggacg

SEQ ID NO: 149885 - RNA, 62 nt, hsa
caugugcaauaagaacauagauccuaaaggauccucuggaagcuguauuucuugaauuagaa

SEQ ID NO: 149886 - RNA, 62 nt, hsa
cugucaccuugaaugaacucaggaauagcuucccucuggacuguagaggagcuaacuguuug

SEQ ID NO: 149887 - RNA, 62 nt, hsa
agccccuuuugaaacucaguuuugugccaaguccucuggaucuaauuaccuuaaacaagcag

SEQ ID NO: 149888 - RNA, 62 nt, hsa
gcucugauucagcuggggcuagcugggccgcuccucuggaagcccacacuuguggggacuua

SEQ ID NO: 149889 - RNA, 62 nt, hsa
cucuccuugcuuuugacaaauuucuuuauuccccucuggacuaaaguaguggcuauuuuugu

SEQ ID NO: 149890 - RNA, 62 nt, hsa
cagguaggcuaauugguaguuguucauuucagccucuggauggcuggcugccuuaaacacaa

SEQ ID NO: 149891 - RNA, 62 nt, hsa
acaagcaaugcuguucuguaaauuuauugaaaccucuggaacauuucaccuuuagagaugga

SEQ ID NO: 149892 - RNA, 62 nt, hsa
gucagccaccuuguacuaagcugaaacaugucccucuggagcuuccaccuggccagggagga

SEQ ID NO: 149893 - RNA, 62 nt, hsa
gaggcagacagucucccagagcugagggcuugccucuggagaccccagccccagagggcuuu

SEQ ID NO: 149894 - RNA, 62 nt, hsa
agccccucucugaagagacuguccuugggccuccucuggaagcagcacccccagaggacagg

SEQ ID NO: 149895 - RNA, 62 nt, hsa
ccccuuacuccccgccaaaacccacaucccagccucuggauccuggggaagguuccaguccc

SEQ ID NO: 149896 - RNA, 62 nt, hsa
cggcaugggcuaagucacucugcccuucggagccucuggaagcuuagggcacauugguucca

SEQ ID NO: 149897 - RNA, 62 nt, hsa
uacucuuaggugccagucugguaacugaacucccucuggaggcaggcuugagggaggauucc

SEQ ID NO: 149898 - RNA, 51 nt, hsa
ugaaucagagacgcaucugacccucuggagaacacugccucccgcuggccc

SEQ ID NO: 149899 - RNA, 62 nt, hsa
gagccgagggcgagacaggaguauucucuuggccucuggacacccucccguuccuccaaggc

SEQ ID NO: 149900 - RNA, 62 nt, hsa
uuaugagagaagaaagagugagagaagaauugccucuggacuaucaucaauauguuguaccu

SEQ ID NO: 149901 - RNA, 62 nt, hsa
cacacucaagccgacuuaugcccaccaucccaccucuggauaauuuugcauaaaauuggauu

SEQ ID NO: 149902 - RNA, 62 nt, hsa
auugugaccccuuguaauuuauuacuucauauccucuggaguuugugauuuuaguauaaauu

SEQ ID NO: 149903 - RNA, 62 nt, hsa
gguucuucuaguucgaggccuuggguccccauccucuggaaccagggggaggccuggaagga

SEQ ID NO: 149904 - RNA, 62 nt, hsa
caccaucucucaagccccaaggacuggagccaccucuggaauaauguguuaaauaucuguau

SEQ ID NO: 149905 - RNA, 62 nt, hsa
gcagcccagagacuuuguagauccuuagagguccucuggagcccuaaccccuuccagaucac

SEQ ID NO: 149906 - RNA, 62 nt, hsa
ggguccuugggccuggccagucuuccucuuagccucuggaucuagaagggaccauaagagga

SEQ ID NO: 149907 - RNA, 57 nt, hsa
ugaagaccaaucucuucuagcugccggccucuggaggcuccgagccugcccccagag

SEQ ID NO: 149908 - RNA, 62 nt, hsa
ggauggaaacuuucuaccugcuuggccuggggccucuggaagucugcugugaauuuguauuc

SEQ ID NO: 149909 - RNA, 62 nt, hsa
acuuuacuguuccucugggaaaggagcagggaccucuggaauucccaucuguuucacugucu

SEQ ID NO: 149910 - RNA, 62 nt, hsa
ccccuccacgcaaacacccucccuccuggggaccucuggagccucagccagaaguaccauua

SEQ ID NO: 149911 - RNA, 62 nt, hsa
cuucugugaaagcaaauacuaaaggaugccauccucuggaauccuaauggcaggcaaaggga

SEQ ID NO: 149912 - RNA, 62 nt, hsa
uggucauaggcucacucuuucccccaaaucuuccucuggagcuuugcagccaaggugcuaaa

SEQ ID NO: 149913 - RNA, 62 nt, hsa
cagagaacugaagugcagccaucagguggaagccucuggaaccugaggcggcugcuugaacc

SEQ ID NO: 149914 - RNA, 62 nt, hsa
ggcuuccuuuggaggugggagugggcuggaggccucuggagaagaccuggggugggggcuga

SEQ ID NO: 149915 - RNA, 62 nt, hsa
ggccugcugaggggaggggagcauggacuuggccucuggagugggacacuggcccugggaac

SEQ ID NO: 149916 - RNA, 62 nt, hsa
ugcagcauauuagauucuagacaagcaacaccccucuggagccagcacagugcuccuccaua

SEQ ID NO: 149917 - RNA, 62 nt, hsa
gcaguucucugccccuugccuaaaagccuguaccucuggauuggcggaaguaaaucuggaag

SEQ ID NO: 149918 - RNA, 62 nt, hsa
ccgcagcgcccgcgccuccgaggggacagcgcccucuggagcucgcugggagcaucaccgcc

SEQ ID NO: 149919 - RNA, 62 nt, hsa
gaggacaaagaaaacugcacaauaaaaccaagccucuggaaucuguccucguguccaccugg

SEQ ID NO: 149920 - RNA, 62 nt, hsa
cagacucacauccugaccuugcacaaacagccccucuggacacagccccauguacacggccu

SEQ ID NO: 149921 - RNA, 62 nt, hsa
ccaagcaaggauagggaaggggaaugguugagccucuggagaucauuguaaccaauccugcc

SEQ ID NO: 149922 - RNA, 62 nt, hsa
ugucaaccagagaacagcuccccuagacauggccucuggaaaaaggaaaucuuugguggcca

SEQ ID NO: 149923 - RNA, 62 nt, hsa
gccauuacuaauagaaacacagccuuuccaauccucuggaacauauucugucuggguuuuua

SEQ ID NO: 149924 - RNA, 62 nt, hsa
agguaaucaggccccucccagggcuucuuuccccucuggagugccuccggccuccccaucca

SEQ ID NO: 149925 - RNA, 62 nt, hsa
gaggcuaacccugauccauagugcuaccugcaccucuggauucuggauucacagaccaaguc

SEQ ID NO: 149926 - RNA, 62 nt, hsa
cggccaaaaugcugcuucgagugcacacggugccucuggaugcccgggauggcaaugaggug

SEQ ID NO: 149927 - RNA, 62 nt, hsa
ggcucccaguggucacugugcccaucccucagccucuggauucucuucauggccagguggcu

SEQ ID NO: 149928 - RNA, 62 nt, hsa
ggacaaggggcucagggcugcugccuuccuguccucuggagagaacccagccaggcgcggug

SEQ ID NO: 149929 - RNA, 62 nt, hsa
cucuuucuuuaaaaagaaagaggguugaaaauccucuggacgaacagaagucacuuuggcug

SEQ ID NO: 149930 - RNA, 62 nt, hsa
ggaccuagggaggcauggucugcccucugcauccucuggagccagccgagcaggaggccuag

SEQ ID NO: 149931 - RNA, 62 nt, hsa
gguugaagacaaggaaagcucugcuguggcugccucuggacugacacccucccuaaugaguc

SEQ ID NO: 149932 - RNA, 62 nt, hsa
gccucugucuccugccacaauccugcugggaaccucuggagagccacaggcacccccagcug

SEQ ID NO: 149933 - RNA, 62 nt, hsa
agcaauaaugucaccacacacacuucaugaagccucuggaaaacucuacaguauacuuguga

SEQ ID NO: 149934 - RNA, 62 nt, hsa
auaagcucaucccucccguccgaggcuaguuuccucuggaaccacauuuuuaucuagaugaa

SEQ ID NO: 149935 - RNA, 62 nt, hsa
ucugugguguuauagugguaacugcaguuccuccucuggaauguagacuguauauguuuaau

SEQ ID NO: 149936 - RNA, 62 nt, hsa
acugauccuuccccaccaucuucagaucuguuccucuggagcuugacugggggguggggaug

SEQ ID NO: 149937 - RNA, 62 nt, hsa
aggauaugacaguccagcaucgaugccugugcccucuggaaaaauuuccuccuagcccuucc

SEQ ID NO: 149938 - RNA, 62 nt, hsa
auuucgaagagcacccacuguuugagcgugugccucuggaggaccuggugaguaggggaccu

SEQ ID NO: 149939 - RNA, 62 nt, hsa
cauguugcauuuaacugaaugucauguuuucuccucuggaacuucuuauguaugcaagcucc

SEQ ID NO: 149940 - RNA, 62 nt, hsa
auccaccccacuucugcaaacccaucccgaggccucuggaaugggacuccuucucccucccu

SEQ ID NO: 149941 - RNA, 62 nt, hsa
caggacccaagugugaacaacacucagcccgcccucuggagcgugugcugucuuuagggccc

SEQ ID NO: 149942 - RNA, 62 nt, hsa
gaguuuucuaagcucagggucuucauuagagaccucuggaaauacauuaaggaugguggggg

SEQ ID NO: 149943 - RNA, 62 nt, hsa
ggaucucaggaccuugguggacacuguguacaccucuggauucauugucucucacagaugug

SEQ ID NO: 149944 - RNA, 62 nt, hsa
cugccuccuugcugaggggccccugugagaggccucuggaugggcaugggaagaugggcucc

SEQ ID NO: 149945 - RNA, 62 nt, hsa
cucacacuuugccucuaaggagcuagaguaguccucuggauuaaggugauaaauaacuugag

SEQ ID NO: 149946 - RNA, 62 nt, hsa
guggaggugagggagagcuggcacaagcccucccucuggauccuccacuccuggggauuaug

SEQ ID NO: 149947 - RNA, 62 nt, hsa
uucuccuacccgauuccccaacaccacuagugccucuggauuuagagauauauauccuaggg

SEQ ID NO: 149948 - RNA, 62 nt, hsa
aagacaaauauucacacaaaaaugaaguguguccucuggagggucagauauacaauuucuuu

SEQ ID NO: 149949 - RNA, 62 nt, hsa
cagagcauccgaccucuuggagcaaguuucugccucuggaaagggggcgggcccuuuucaca

SEQ ID NO: 149950 - RNA, 62 nt, hsa
aguuggauaagccaauccucacuccccagccuccucuggauagggaugaagaccccacuggg

SEQ ID NO: 149951 - RNA, 62 nt, hsa
ugaagcagagaggcacgugccugucucauucgccucuggaucugcugcauccaggacugugc

SEQ ID NO: 149952 - RNA, 62 nt, hsa
gccuaggguggaggucacugcacuaccacccaccucuggaagacuggcugugaaaagucagg

SEQ ID NO: 149953 - RNA, 62 nt, hsa
aaauucaauggacaaaaauaaaaugcuggcuaccucuggaucaucuggcugagcaacugaau

SEQ ID NO: 149954 - RNA, 62 nt, hsa
ugucauuuccuuauaaguuuguguaacauccuccucuggauaacuugacuguaauuuaacau

SEQ ID NO: 149955 - RNA, 62 nt, hsa
aaagggagucaaggguuggcuuuggaauugggccucuggacagagucagaaugagggaauaa

SEQ ID NO: 149956 - RNA, 62 nt, hsa
cugaccuguacuuauuuuucucuucccgccucccucuggaauggauauauugguugguucau

SEQ ID NO: 149957 - RNA, 62 nt, hsa
cagggaaguccuugguugauguaucugggucuccucuggagcacucugcccuccugucaccc

SEQ ID NO: 149958 - RNA, 62 nt, hsa
cacugagcccaccagccacagugcccauguccccucuggaagacaaacuaccaauuucucgu

SEQ ID NO: 149959 - RNA, 62 nt, hsa
cuccugcccagcugcucuugucagcccucuggccucuggaugagguugaguucuccacaaca

SEQ ID NO: 149960 - RNA, 62 nt, hsa
gagcaccuuucuuccgucuguucacucugcggccucuggaaucccagcucuucucucucaga

SEQ ID NO: 149961 - RNA, 62 nt, hsa
cuggaaccuggaccccagccuuggugggggagccucuggaaugcauggggcggguccuagcu

SEQ ID NO: 149962 - RNA, 62 nt, hsa
ucuggaaagcucaaccugcaggaguuccaccaccucuggaacaagauuaaggccuggcaggu

SEQ ID NO: 149963 - RNA, 62 nt, hsa
aaguggaauuggcagcuucuagaauauguacaccucuggacaaaauguuccucaaucuuaag

SEQ ID NO: 149964 - RNA, 62 nt, hsa; identical to SEQ ID NO: 70529

SEQ ID NO: 149965 - RNA, 62 nt, hsa
uagaaaugcagaccugugggcucuaccacaggccucuggaaucagaaucuucaggguggggc

SEQ ID NO: 149966 - RNA, 62 nt, hsa
accuaggcuuacaggccauccugagccaggggccucuggaaauucucuuccugaugguccuu

SEQ ID NO: 149967 - RNA, 62 nt, hsa
cccccaccaauuuauacaucuccauuuucugaccucuggacuaacugguugcucagcaaggu

SEQ ID NO: 149968 - RNA, 62 nt, hsa
ugggggcauuuugcuggggggagaugaggcagccucuggaauggcucagggauucagcccuc

SEQ ID NO: 149969 - RNA, 62 nt, hsa
agaagauaagcuacuaauagaaaauguuuuuaccucuggauaugaaauaagugcccugugua

SEQ ID NO: 149970 - RNA, 62 nt, hsa
gccuccggacucuggcacgcuccagcagcccuccucuggaagcugcguccccucacccccug

SEQ ID NO: 149971 - RNA, 62 nt, hsa
caaccuaccuucuuuccagaggaugucuuucuccucuggagaguagaugcuugcucuuggga

SEQ ID NO: 149972 - RNA, 62 nt, hsa
gcugacugagacaauucuguccauguaaagauccucuggaaaaagacuccgagaguuauaac

SEQ ID NO: 149973 - RNA, 62 nt, hsa
gaaauuaaccugcuauuaaauaguaaacuuuuccucuggagucacuuuuuucccccuucaaa

SEQ ID NO: 149974 - RNA, 62 nt, hsa
uucucgaugugcacugugaugccuggaaccuuccucuggaagugcugauuuuauggacugag

SEQ ID NO: 149975 - RNA, 62 nt, hsa
aagcgucuccaauaugacuauuaaaacugucaccucuggaaauacacuagugugagccuuca

SEQ ID NO: 149976 - RNA, 62 nt, hsa
gugauauauuagggacacuuucacaguccuguccucuggaucacagacacugcacagaccuu

SEQ ID NO: 149977 - RNA, 62 nt, hsa
cuuagguuuugcuugggaaacucaacuucuuuccucuggagacggggcaucucccucugauu

SEQ ID NO: 149978 - RNA, 62 nt, hsa
ggaagggcuuggccagcgcuguugagggguccccucuggaaugcacugaauaaagcacgugc

SEQ ID NO: 149979 - RNA, 62 nt, hsa
gaaggugaauugagcaggucugcugcuguuggccucuggaguucauuuaguuaaagcacaug

SEQ ID NO: 149980 - RNA, 62 nt, hsa
caugccagauagcauucaggguguccucucucccucuggaggaccaagcccuccccuaaugc

SEQ ID NO: 149981 - RNA, 62 nt, hsa
uuuggugugagugcagauauugcacugugucaccucuggaucucugcucagaagcagaacaa

SEQ ID NO: 149982 - RNA, 62 nt, hsa
agaggccgggggagcagacagggccggugcucccucuggaagcuugggugaccggggcccug

SEQ ID NO: 149983 - RNA, 62 nt, hsa
gaccucggccagcuggacccacaugagggccaccucuggaaccuucuucgaggcccuggcca

SEQ ID NO: 149984 - RNA, 62 nt, hsa
gugguugccacauuucaucagacagacaccucccucuggagaugcaguugagugacaaccuu

SEQ ID NO: 149985 - RNA, 62 nt, hsa
ugcugccgcccuugaaccuggcugagcucaguccucuggaggaagccguccagucccuagaa

SEQ ID NO: 149986 - RNA, 62 nt, hsa
ggcugcuuggggagacucuuccgugcguucuuccucuggauagaaccaccaccuccugggcg

SEQ ID NO: 149987 - RNA, 62 nt, hsa
uucucuguguggauagacuccccagcguuuuuccucuggaaaugcccacagggcuugccgcg

SEQ ID NO: 149988 - RNA, 62 nt, hsa
caggaagggcugggcagaggaggcuggggccaccucuggaggguguccugcuguuccuguug

SEQ ID NO: 149989 - RNA, 62 nt, hsa
cacuccccacaguuuuaggaucuaaaugauugccucuggaacuauucuucuagacuauccca

SEQ ID NO: 149990 - RNA, 62 nt, hsa
agaacagcagcacugagcucccacccgcagagccucuggacggccuuggcaacagcaaaauc

SEQ ID NO: 149991 - RNA, 62 nt, hsa
gaaaucugaagaccucgagcagaugaugccaaccucuggagcaauguugcuuaggaugugug

SEQ ID NO: 149992 - RNA, 62 nt, hsa
gccucaccuucaacugucugucuuagaauuccccucuggagggcuauggccucccuaugcuu

SEQ ID NO: 149993 - RNA, 62 nt, hsa
cccagagccccaggugccuggccuggccuagaccucuggaauugagauuaaacaauuuggag

SEQ ID NO: 149994 - RNA, 62 nt, hsa
gacaccucucucaggagcuucugagucagacgccucuggagcgagcccuaugucaggcacuc

SEQ ID NO: 149995 - RNA, 62 nt, hsa
cugaggucagucucccaagccuggcauguggcccucuggaucuggguuccaucucugucucc

SEQ ID NO: 149996 - RNA, 62 nt, hsa
ucacagggugagggccaccuccacacccacccccucuggagaaggccuggaagagcugagac

SEQ ID NO: 149997 - RNA, 62 nt, hsa
cuuguuuugguuuucagcugauaggaucuaugccucuggaccagcugaacuuacuggugcag

SEQ ID NO: 149998 - RNA, 62 nt, hsa
gucugagcuaagcuggcacccaucccagggcuccucuggagcuaauccuuuaagcaaaaugu

SEQ ID NO: 149999 - RNA, 62 nt, hsa
cucuuuguuucccuccacccacccuuccauauccucuggagcaggagacaaugugggugccc

SEQ ID NO: 150000 - RNA, 62 nt, hsa
ggaguccaugugugaaauggcaucuaccauuuccucuggauuaaaacuacggacuggggaca

SEQ ID NO: 150001 - RNA, 62 nt, hsa
ucucuugggaacgcuggagagcuugugcacagccucuggaaggaaaggcagcgcugacuucg

SEQ ID NO: 150002 - RNA, 62 nt, hsa
ggacucagccauccauuaagaacccauguuguccucuggacauauuuaucaauauaauuggg

SEQ ID NO: 150003 - RNA, 62 nt, hsa
cucacaucccaccaugguggcuccucccaccuccucuggauuuguucacucugagaucuguu

SEQ ID NO: 150004 - RNA, 62 nt, hsa
agaucucauaagaaagaauccagucugacuucccucuggagaaugacuauggacagaaggcc

SEQ ID NO: 150005 - RNA, 62 nt, hsa
uuccagggacuggggcaaacucaggccccacaccucuggacagcucaaauccaguccccuuc

SEQ ID NO: 150006 - RNA, 62 nt, hsa
aguggggggcuauagccucagagaccacucauccucuggaaucaaccucuuucuaauacccu

SEQ ID NO: 150007 - RNA, 62 nt, hsa
ccaguacauguuuaaaagaagagcucauggaaccucuggaaaggacagggaaguugaguuag

SEQ ID NO: 150008 - RNA, 62 nt, hsa
uuucucucuugauucuugguuuuccuuugaguccucuggagcugccuucucaucaggugcac

SEQ ID NO: 150009 - RNA, 62 nt, hsa
ucucugugggcuucucuuggugcacgguucugccucuggacacucaaaccuuuuuagggcgu

SEQ ID NO: 150010 - RNA, 62 nt, hsa
acccugcagucuucauccucacucagcugcugccucuggaggugccuuuggccacaugugcu

SEQ ID NO: 150011 - RNA, 62 nt, hsa
uugugucuccuucggccccuccucccucuuuuccucuggaugcacucugaugauaccauggu

SEQ ID NO: 150012 - RNA, 62 nt, hsa
acaggaucaagccuugcuugagauuggccuuaccucuggacuuuuuuuguuauaugagcuaa

SEQ ID NO: 150013 - RNA, 62 nt, hsa
cggauaccucuggcccccaccccauuacuguaccucuggagucacuacugugggucgccacu

SEQ ID NO: 150014 - RNA, 62 nt, hsa
gugggagacggcuuuguccuggggacacuuucccucuggaaucucaagacgacguggcacac

SEQ ID NO: 150015 - RNA, 62 nt, hsa
gagccggucccccccugaggcacccggauucaccucuggaccacccugauauugcuucuccu

SEQ ID NO: 150016 - RNA, 62 nt, hsa
ggcccccgggaccugcugcagugccagaggggccucuggagcaggccuggcuuuuaaauggg

SEQ ID NO: 150017 - RNA, 62 nt, hsa
aaaugaugaguucuaguaaacucugauuuuugccucuggauaguagaucucgagcguuuauc

SEQ ID NO: 150018 - RNA, 62 nt, hsa
uucccuccccacccuucauggcuugccuccugccucuggauuuuagguguugauuucuggau

SEQ ID NO: 150019 - RNA, 62 nt, hsa
cugggugcaaagaacggcuuggcuuggcuccuccucuggagguuaaaauuuauagucauucu

SEQ ID NO: 150020 - RNA, 62 nt, hsa
ugaaacaagucuagucuucugguuuucuagccccucuggauucccuuuugacucuuccgugc

SEQ ID NO: 150021 - RNA, 62 nt, hsa
acccaucagcccuugcaagucccccacucaggccucuggaagguccagggaugggcucugau

SEQ ID NO: 150022 - RNA, 62 nt, hsa
cucucuacccagcccaucuugccuccauggugccucuggaggccucugggccuccucuaaca

SEQ ID NO: 150023 - RNA, 62 nt, hsa
cucgugacagccucugacucaccacgaugacgccucuggaccucggugaugccuuccgacac

SEQ ID NO: 150024 - RNA, 62 nt, hsa
gccacuguggacgcccuggggcuuggcacccaccucuggagaaacucggggccaccuccacu

SEQ ID NO: 150025 - RNA, 62 nt, hsa
cagaccagccuggccaaugccuauggguggccccucuggagugcucacuaacaagggugagu

SEQ ID NO: 150026 - RNA, 62 nt, hsa
gcuuugccucaccuuucuccagcagccgggacccucuggagagcuuguuuucccuccaagaa

SEQ ID NO: 150027 - RNA, 62 nt, hsa
cccucucccuucccugcugccuugcagugaccccucuggaacucaggacucgauuuuaagga

SEQ ID NO: 150028 - RNA, 62 nt, hsa
uguccacagcuccuguggggguggaggagacuccucuggagaagggugagaagguggaggcu

SEQ ID NO: 150029 - RNA, 62 nt, hsa
cccuaccuccagcuuccuccagccucaaaccgccucuggaucuagcuguccuucuccgagug

SEQ ID NO: 150030 - RNA, 62 nt, hsa
ugcaggguggauuguuacagcuucgcuggaaaccucuggaggucaucucggcuguuccugag

SEQ ID NO: 150031 - RNA, 62 nt, hsa
gccaaagcgaucggugcucccagaucccgcagccucuggagagagcugacggcagaugaaau

SEQ ID NO: 150032 - RNA, 62 nt, hsa
cucugccuucacaugugagacgguggacuuuuccucuggacaaaaugacagcauccuggcga

SEQ ID NO: 150033 - RNA, 62 nt, hsa
ggaggccgggcccgggcaccugagggcuucucccucuggacacugcgggccagguguacaua

SEQ ID NO: 150034 - RNA, 62 nt, hsa
agauucaagggaaaggcacuaaaugguuuuuuccucuggaagaugagauuguaggugauauu

SEQ ID NO: 150035 - RNA, 62 nt, hsa
acccccuuccagggccucugcuccaaaggaggccucuggaacccaggacucugggguuuuac

SEQ ID NO: 150036 - RNA, 62 nt, hsa
ucccaugagaucaggcgccaucuguaaagucuccucuggaaaugccaauccauccuuccccc

SEQ ID NO: 150037 - RNA, 62 nt, hsa
ugauuuuauuuuuuacacuuaagucuuuaaucccucuggacuggaugguucuucauaggaga

SEQ ID NO: 150038 - RNA, 62 nt, hsa
accaucacuaccugcaccugcuguggucccacccucuggaggccugggaaccuggcugcagc

SEQ ID NO: 150039 - RNA, 62 nt, hsa
ggugagggcagcccucagggucggccgcuuucccucuggaccaccucccgcugcguuuccua

SEQ ID NO: 150040 - RNA, 62 nt, hsa
ugugcugcaacacugaagacagaaagaagaagccucuggacacugccagagauggggguuga

SEQ ID NO: 150041 - RNA, 62 nt, hsa
acagugucucugaacuguucaucccuugaccaccucuggaccacuaacaaguucucagacuu

SEQ ID NO: 150042 - RNA, 62 nt, hsa
auaauuuaauuuuauauaaaaauauuuaauuuccucuggauagucaaaccugccagauauca

SEQ ID NO: 150043 - RNA, 62 nt, hsa
cccccugccaccccuccccagucaccaguucuccucuggacuggccacacccaccccauucc

SEQ ID NO: 150044 - RNA, 62 nt, hsa
aguagggguugugggugaccaguugcacuuggccucuggauugugggaauuaaggaagugac

SEQ ID NO: 150045 - RNA, 62 nt, hsa
gccaguccacauccccugcagagcccucuccuccucuggagucagguggugggaguaccagc

SEQ ID NO: 150046 - RNA, 62 nt, hsa
ucugaaaugcagacagcugugagugacaugggccucuggagaaugcaagucuuugccauggc

SEQ ID NO: 150047 - RNA, 62 nt, hsa
ugugugacaaaauucagaucuaccugaacuugccucuggagaugauaagggccaaaggagca

SEQ ID NO: 150048 - RNA, 62 nt, hsa
ucucaggccagcuucucugugaccccuuuacuccucuggagggcucuguggggagagauaca

SEQ ID NO: 150049 - RNA, 62 nt, hsa
ggccuucuuguaagaggccaggcccugccccaccucuggacagugcccaagucaggguccag

SEQ ID NO: 150050 - RNA, 62 nt, hsa
cugcaaggcuggggucugccccucccuucucaccucuggagcugugcugcacugcuucagcc

SEQ ID NO: 150051 - RNA, 62 nt, hsa
auggucaggucccauguugucccugcugccucccucuggaguggccacuuggccaaagcgcc

SEQ ID NO: 150052 - RNA, 62 nt, hsa
ccugucuucauuguuucagguauuucuuuaccccucuggauuccccacgggcuggaucgaga

SEQ ID NO: 150053 - RNA, 62 nt, hsa
guucuccucuucucucacgggcggcucgcccgccucuggaucagcuggccuccgaagagccg

SEQ ID NO: 150054 - RNA, 62 nt, hsa
aacagauaccccacucgccacuaugcccaaacccucuggaugcugaaaaaugccacuuucgg

SEQ ID NO: 150055 - RNA, 62 nt, hsa
cucucacccauaaacaguaaugacucucugacccucuggaaauauguaaugcuuccaaucuu

SEQ ID NO: 150056 - RNA, 62 nt, hsa
gauagcgcauauauuugcaguaugaacuauugccucuggacguugugagaauugugcuuuca

SEQ ID NO: 150057 - RNA, 62 nt, hsa
aauacuggcucugucugaguaagaaacagaauccucuggaacuugaggaagugaacauuucg

SEQ ID NO: 150058 - RNA, 62 nt, hsa
agccgccaagguugaccucagcuucggagccaccucuggaugaacugcccccagcccccgcc

SEQ ID NO: 150059 - RNA, 62 nt, hsa
uccacccuuuugccuggcuccuggcaccuguaccucuggacucuccuaucgggggauuaaaa

SEQ ID NO: 150060 - RNA, 62 nt, hsa
ucccaagaccuccccccucgucaccagccaucccucuggaccaggcagagggcggaccgggu

SEQ ID NO: 150061 - RNA, 62 nt, hsa
auaaaaauaaaaauaaauauuggcgggggaacccucuggaaucaauaaaggcuuccuuaacc

SEQ ID NO: 150062 - RNA, 62 nt, hsa
gcuccacgugcuuacugaggacaucagguccaccucuggaccccuuggcaggccacagaggg

SEQ ID NO: 150063 - RNA, 62 nt, hsa
aaaaaagaaagcacaacaccuuucccaugccuccucuggagccuucgccuggggagacagaa

SEQ ID NO: 150064 - RNA, 62 nt, hsa
cauccuggguucaagugauucuccugccucagccucuggaggagcugguaucacaggcgucc

SEQ ID NO: 150065 - RNA, 62 nt, hsa
cccagucugcuugucucccuuucccuugcaggccucuggagccucgugccuggcccggacau

SEQ ID NO: 150066 - RNA, 62 nt, hsa
agagaggaaaaccaugacaggcaaaugcauuuccucuggaguuugagacccugacaaacaac

SEQ ID NO: 150067 - RNA, 62 nt, hsa
cuccagaagggguucugggccuaguuguccucccucuggagccccguccuguggucugccuc

SEQ ID NO: 150068 - RNA, 62 nt, hsa
gcaacauuuaacuucucgcacaugguucccguccucuggagcucugucuugucggggagaug

SEQ ID NO: 150069 - RNA, 62 nt, hsa
auccggcccccacagcucucacggcugcugcuccucuggacuccccaaggcagguggccucc

SEQ ID NO: 150070 - RNA, 62 nt, hsa
ccccuaggucugggugggcaguggccccauagccucuggaacugugcguucugcauagaauu

SEQ ID NO: 150071 - RNA, 62 nt, hsa
cagcugucugcagggaacgccaccauguugacccucuggaggagagcgcuguggagccccuc

SEQ ID NO: 150072 - RNA, 62 nt, hsa
ccucuccccgccaccccagggccuccaagccaccucuggaaauacuuggcucugccccaugg

SEQ ID NO: 150073 - RNA, 62 nt, hsa
guucccauuuucgcuuuccucugguuugaaagccucuggaaaacucaggauucucacgacuc

SEQ ID NO: 150074 - RNA, 62 nt, hsa
aaucuaaguagaacugcauugacuaaccagucccucuggaugguggugaaccugaagcaugc

SEQ ID NO: 150075 - RNA, 62 nt, hsa
agggggccaaugggggccucagggggaggcccccucuggaaaugugguucccagggaugggc

SEQ ID NO: 150076 - RNA, 62 nt, hsa
uugaaacacaagaaaagagaguggugaaagaaccucuggauaacugcuuuuugaauugagaa

SEQ ID NO: 150077 - RNA, 62 nt, hsa
acccgcagacccuuaaaaaaaucacccacaacccucuggaaguggccuugcccgguccccuu

SEQ ID NO: 150078 - RNA, 62 nt, hsa
gggcagggguagcuagcgugugccaggcagauccucuggacacguaaccuaugucagacacu

SEQ ID NO: 150079 - RNA, 62 nt, hsa
agcggggagagcacgggguagccggagaagggccucuggagcaggucuggaggggccauggg

SEQ ID NO: 150080 - RNA, 62 nt, hsa
ucccuguccuuuucauagcuccugcccgcagaccucuggauuaggucucuguugacuggcug

SEQ ID NO: 150081 - RNA, 62 nt, hsa
acucccagacucaagugauccuuccaccucagccucuggaguagcugggacuacagacaugc

SEQ ID NO: 150082 - RNA, 62 nt, hsa
gccacagcaggugggggcagggcucgugggacccucuggacagccaccaagauaucugagca

SEQ ID NO: 150083 - RNA, 62 nt, hsa
caccaggcagccaggccaucagcccaccuccaccucuggaggguccccagagacccacgccc

SEQ ID NO: 150084 - RNA, 62 nt, hsa
aggaacgaagauuuccugaagaagaccuggucccucuggagguugcaguggcugaaggaugc

SEQ ID NO: 150085 - RNA, 62 nt, hsa
gcagccccccacgcuucuggagguggggagggccucuggacagauggguguccccuggugcc

SEQ ID NO: 150086 - RNA, 62 nt, hsa
uuucaaccagaguuccaaccaaugggcuccauccucuggauucuggccaaugaaauaucucc

SEQ ID NO: 150087 - RNA, 62 nt, hsa
ucccgcccuggaccuccagcugcccugacuccccucuggacacuaagacuccgccccugagg

SEQ ID NO: 150088 - RNA, 60 nt, hsa
cugagauccgccuggagugacacccccagaccucuggaggagacaauggaugcaaacagc

SEQ ID NO: 150089 - RNA, 50 nt, hsa
agcagccccuccccagauaaccucuggagcagauuugaaagccaggaugg

SEQ ID NO: 150090 - RNA, 62 nt, hsa
gcccucaucacccugacacccccacauucucuccucuggacccccaggaggcuggugccagg

SEQ ID NO: 150091 - RNA, 62 nt, hsa
ggguagcugggcccaggcaacccaccccuccaccucuggaggucccaccaggcuauuaaagg

SEQ ID NO: 150092 - RNA, 62 nt, hsa
agaugaggguuccuaaaccuuaaaccucucugccucuggaggagggugggguauucuggcag

SEQ ID NO: 150093 - RNA, 62 nt, hsa
ucacagaagcagcuaaaccaaggacugagcacccucuggauucugaaucucaagaugggggc

SEQ ID NO: 150094 - RNA, 62 nt, hsa
gcuauguauuagccgaugucuuuaguguugagccucuggauucuggggucugggccaguggc

SEQ ID NO: 150095 - RNA, 62 nt, hsa
acacuucccacugauccauggggccuuuaagcccucuggaagcuuccauuaaagaugauuau

SEQ ID NO: 150096 - RNA, 62 nt, hsa
ugccaaguggagcugucauuuaauuugaugcaccucuggauucagaugaaacauuaaauugu

SEQ ID NO: 150097 - RNA, 62 nt, hsa
ugcagagucgccuuaguccagaaccugacaggccucuggagccaggcgacuucuugggaaac

SEQ ID NO: 150098 - RNA, 62 nt, hsa
ggcaggcucccucugggcaucccuggaugcagccucuggacacaugccuccuuuaaaguguc

SEQ ID NO: 150099 - RNA, 62 nt, hsa
gucgugcuuccauggcuugcuacggagagagaccucuggauccacacuggggcugcgucugg

SEQ ID NO: 150100 - RNA, 62 nt, hsa
auaaagaugcaaggaccaggacucccuccucaccucuggacuggcuagaguccucacuccca

SEQ ID NO: 150101 - RNA, 62 nt, hsa
ccugcuguggaaggaauuggccaugaccuucaccucuggagaguagggucuauggcgaggga

SEQ ID NO: 150102 - RNA, 62 nt, hsa
cacgccgagggccccgggacccugccugccucccucuggagccuucuggacuggccagccca

SEQ ID NO: 150103 - RNA, 62 nt, hsa
auccuuucagaugaucaugggcuggccgcugcccucuggagaaccuucuucaaccggaaaug

SEQ ID NO: 150104 - RNA, 62 nt, hsa
cccaccauuucuccucaccugggccuucucagccucuggacucuccuaagcaccucucagga

SEQ ID NO: 150105 - RNA, 62 nt, hsa
ugcucguuguggacuguaauuaaaugcuuugcccucuggaacuugauuuuuguguaucugag

SEQ ID NO: 150106 - RNA, 62 nt, hsa
uuccgugucagaaacaguaccgagucccacccccucuggaggcacagcuguugcgucaggca

SEQ ID NO: 150107 - RNA, 62 nt, hsa
ugaacacccaaaugccccacgcugggccgcggccucuggagcugggauuugggaggacacag

SEQ ID NO: 150108 - RNA, 62 nt, hsa
ucaugacuugggagcuaagcccaagugugaaaccucuggauccuauggauuugguuucuucc

SEQ ID NO: 150109 - RNA, 62 nt, hsa
guuuuaaggguugcucacuggugcuguguaugccucuggauguguccagaagcuuuaccauc

SEQ ID NO: 150110 - RNA, 62 nt, hsa
gguggacuccguggggcuccaccagccagaagccucuggaaggcaacgaaggcaaugcugcu

SEQ ID NO: 150111 - RNA, 62 nt, hsa
aacuccugggcuugagcaagucuuccccucagccucuggaguagcugggccuacagugugug

SEQ ID NO: 150112 - RNA, 62 nt, hsa
gcccuggcugcuccaaaaccaaaaagcuggguccucuggaggaggggcgagcuguggagcag

SEQ ID NO: 150113 - RNA, 62 nt, hsa
acggaugcucaagguuccugggcagaccagcaccucuggaggacaauggacaaaaugucucu

SEQ ID NO: 150114 - RNA, 62 nt, hsa
uuugccauaaggaaagcgggucaauagggcugccucuggauagcauuacuucaaagcugggu

SEQ ID NO: 150115 - RNA, 62 nt, hsa
gauggauuguguccuaggaagacuuuucuuuuccucuggauuuuuguuccuccuguacaaga

SEQ ID NO: 150116 - RNA, 62 nt, hsa
uucuuggaugucccaguugaaucagaaggggaccucuggaguacacaccucucuccugggcg

SEQ ID NO: 150117 - RNA, 62 nt, hsa
ugagaagcacuuggcuggcugagcaaauucauccucuggaaauauucucucucagccacagu

SEQ ID NO: 150118 - RNA, 62 nt, hsa
agugccccuugcuggccgcccucaggagggggccucuggaccgucaguguggcguaggcagu

SEQ ID NO: 150119 - RNA, 62 nt, hsa
guucacuccagucccaccccacgccugacuccccucuggaaacugcaggccagaugguugcu

SEQ ID NO: 150120 - RNA, 62 nt, hsa
cagggagccggcaggagguggccccugcccucccucuggacccccagccaggggcuuggaaa

SEQ ID NO: 150121 - RNA, 62 nt, hsa
gagacugcgaggaucuccaggcaggguucuccccucuggagucugaccaauuacuucauuuu

SEQ ID NO: 150122 - RNA, 62 nt, hsa
ugucacgccaggaggcuguggcugcugugggcccucuggaauugugcuccucacaaaguuuc

SEQ ID NO: 150123 - RNA, 62 nt, hsa
caauggguuguugcugccaugagcauguacaaccucuggagcuagaagcuccucaggaaagc

SEQ ID NO: 150124 - RNA, 62 nt, hsa
uuccuccucccaaggcauucucccagcucuagccucuggacuggaaagcacaagacuggccc

SEQ ID NO: 150125 - RNA, 62 nt, hsa
caaaugcuuuuccaacccaugagugcuaagagccucuggaagggagggcuucaggcccgaag

SEQ ID NO: 150126 - RNA, 62 nt, hsa
cccaaacccauuuuagagacagaagaaacuacccucuggagauaaaauaaaaagaugaagcu

SEQ ID NO: 150127 - RNA, 62 nt, hsa
uuuaacucuagaaauucucaguaugggguuucccucuggaaaaagaaaaucugaagacauua

SEQ ID NO: 150128 - RNA, 62 nt, hsa
agaggaacauuccauuuauuuguaguggauuuccucuggagggcauguacccacacuaaaua

SEQ ID NO: 150129 - RNA, 62 nt, hsa
aagcggauccaaagacccaggaaugacagguuccucuggagacauuuuugaaagcagcuccc

SEQ ID NO: 150130 - RNA, 62 nt, hsa
acaacaguaucuuaaguuuaacugggcacuucccucuggaaaucacaguguugugcaccagg

SEQ ID NO: 150131 - RNA, 62 nt, hsa
gagcucuuuaaaaauaaauugcucuggucccaccucuggaaaucugauucagccagcaugga

SEQ ID NO: 150132 - RNA, 62 nt, hsa
gaacuuuaaaaagaaauguaaaccucaaauuaccucuggaucucuuagccagaggaauaaac

SEQ ID NO: 150133 - RNA, 62 nt, hsa
aaggcaauaaguaaauauguacugguugaaugccucuggagaccuagaguuuaaaguuuuaa

SEQ ID NO: 150134 - RNA, 62 nt, hsa
uacauaauaccuucuuagccauuaauguaauuccucuggauaaagauaauauauucaaaaaa

SEQ ID NO: 150135 - RNA, 62 nt, hsa
aaugagaaugauaaauuauccuagcaaaggggccucuggagaccaucuuguuccagccucug

SEQ ID NO: 150136 - RNA, 62 nt, hsa
ugagagagaugacauaaccauaugucauguagccucuggaaaaguccucuguauccucauga

SEQ ID NO: 150137 - RNA, 64 nt, hsa
cucuugcucuuguuaaagauuuguuugaauauagaagaugcaugauuucuggguuuuuuuuuuu

SEQ ID NO: 150138 - RNA, 64 nt, hsa
gggauuacaggcauaagccacugcgcccagccagaagaugcaugauuucuuaggaucauaugcu

SEQ ID NO: 150139 - RNA, 64 nt, hsa
cucucccuucaccuccaggaucaggauucugucaaagaugcagugccagaucaacaguuagauu

SEQ ID NO: 150140 - RNA, 64 nt, hsa
ggucguacauuuccuguugaucaauuuuuuuuggaagaugcaauugcugugacaagguaaggaa

SEQ ID NO: 150141 - RNA, 64 nt, hsa
uaugcucuuguuuuuucccucuaauagcuauggaaagaugcauagaaagaguauaauguuuuaa

SEQ ID NO: 150142 - RNA, 64 nt, hsa
uucacaugaaaaaaaucaauuuauuugaaaaggcaagaugcaggagagaggaagccuugcaaac

SEQ ID NO: 150143 - RNA, 64 nt, hsa
aaaaggaauccgugacccacagagcuagacagauaagaugcauaguugaccagucauaaaaggc

SEQ ID NO: 150144 - RNA, 64 nt, hsa
agcaagauggguuccuuggagaagcugauuugccaagaugcacaucgcuauuaacagccagagu

SEQ ID NO: 150145 - RNA, 64 nt, hsa
ucugaggucauuauugagguucauauaaugcccgaagaugcagcauuuggugcuuuguuuuccu

SEQ ID NO: 150146 - RNA, 64 nt, hsa
uggaaaaaacccagagagcaaagugcauuacuuaaagaugcaguauauacuuuucucauuuuua

SEQ ID NO: 150147 - RNA, 64 nt, hsa
uugccagccucugcugcuccugcuccuggguuugaagaugcaggccgaucgccagcuccguggc

SEQ ID NO: 150148 - RNA, 64 nt, hsa
agaaagagaaugcccacaagugggucuucuguggaagaugcagaaggaggaaguuagugcuuac

SEQ ID NO: 150149 - RNA, 64 nt, hsa; identical to SEQ ID NO: 119606

SEQ ID NO: 150150 - RNA, 64 nt, hsa; identical to SEQ ID NO: 119607

SEQ ID NO: 150151 - RNA, 64 nt, hsa; identical to SEQ ID NO: 119608

SEQ ID NO: 150152 - RNA, 64 nt, hsa; identical to SEQ ID NO: 119609

SEQ ID NO: 150153 - RNA, 64 nt, hsa; identical to SEQ ID NO: 119610

SEQ ID NO: 150154 - RNA, 64 nt, hsa; identical to SEQ ID NO: 119611

SEQ ID NO: 150155 - RNA, 64 nt, hsa; identical to SEQ ID NO: 119612

SEQ ID NO: 150156 - RNA, 64 nt, hsa; identical to SEQ ID NO: 119613

SEQ ID NO: 150157 - RNA, 64 nt, hsa; identical to SEQ ID NO: 119614

SEQ ID NO: 150158 - RNA, 64 nt, hsa; identical to SEQ ID NO: 119615

SEQ ID NO: 150159 - RNA, 64 nt, hsa; identical to SEQ ID NO: 119616

SEQ ID NO: 150160 - RNA, 64 nt, hsa; identical to SEQ ID NO: 119617

SEQ ID NO: 150161 - RNA, 64 nt, hsa; identical to SEQ ID NO: 119618

SEQ ID NO: 150162 - RNA, 64 nt, hsa; identical to SEQ ID NO: 119619

SEQ ID NO: 150163 - RNA, 64 nt, hsa; identical to SEQ ID NO: 119620

SEQ ID NO: 150164 - RNA, 64 nt, hsa; identical to SEQ ID NO: 119621

SEQ ID NO: 150165 - RNA, 64 nt, hsa; identical to SEQ ID NO: 119622

SEQ ID NO: 150166 - RNA, 64 nt, hsa; identical to SEQ ID NO: 119623

SEQ ID NO: 150167 - RNA, 64 nt, hsa; identical to SEQ ID NO: 119624

SEQ ID NO: 150168 - RNA, 64 nt, hsa; identical to SEQ ID NO: 119625

SEQ ID NO: 150169 - RNA, 64 nt, hsa; identical to SEQ ID NO: 119626

SEQ ID NO: 150170 - RNA, 64 nt, hsa; identical to SEQ ID NO: 119627

SEQ ID NO: 150171 - RNA, 64 nt, hsa; identical to SEQ ID NO: 119628

SEQ ID NO: 150172 - RNA, 64 nt, hsa; identical to SEQ ID NO: 119629

SEQ ID NO: 150173 - RNA, 64 nt, hsa; identical to SEQ ID NO: 119630

SEQ ID NO: 150174 - RNA, 64 nt, hsa; identical to SEQ ID NO: 119631

SEQ ID NO: 150175 - RNA, 64 nt, hsa
gcuggcccagggcggccucuacgccaagcuggugcagcggcagaugcuggggcuucagcccgcc

SEQ ID NO: 150176 - RNA, 64 nt, hsa
acgggggccaccuugucaucucaggccagaugaccagcggcaaccucaucgccuucaucaucua

SEQ ID NO: 150177 - RNA, 64 nt, hsa; identical to SEQ ID NO: 117299

SEQ ID NO: 150178 - RNA, 64 nt, hsa; identical to SEQ ID NO: 117300

SEQ ID NO: 150179 - RNA, 64 nt, hsa; identical to SEQ ID NO: 117301

SEQ ID NO: 150180 - RNA, 64 nt, hsa; identical to SEQ ID NO: 117302

SEQ ID NO: 150181 - RNA, 64 nt, hsa; identical to SEQ ID NO: 117303

SEQ ID NO: 150182 - RNA, 64 nt, hsa; identical to SEQ ID NO: 117304

SEQ ID NO: 150183 - RNA, 64 nt, hsa; identical to SEQ ID NO: 117305

SEQ ID NO: 150184 - RNA, 64 nt, hsa; identical to SEQ ID NO: 117306

SEQ ID NO: 150185 - RNA, 64 nt, hsa; identical to SEQ ID NO: 117307

SEQ ID NO: 150186 - RNA, 64 nt, hsa; identical to SEQ ID NO: 117308

SEQ ID NO: 150187 - RNA, 64 nt, hsa; identical to SEQ ID NO: 117309

SEQ ID NO: 150188 - RNA, 64 nt, hsa; identical to SEQ ID NO: 117310

SEQ ID NO: 150189 - RNA, 64 nt, hsa; identical to SEQ ID NO: 117311

SEQ ID NO: 150190 - RNA, 64 nt, hsa; identical to SEQ ID NO: 117312

SEQ ID NO: 150191 - RNA, 64 nt, hsa; identical to SEQ ID NO: 117313

SEQ ID NO: 150192 - RNA, 64 nt, hsa; identical to SEQ ID NO: 117314

SEQ ID NO: 150193 - RNA, 64 nt, hsa; identical to SEQ ID NO: 117315

SEQ ID NO: 150194 - RNA, 64 nt, hsa; identical to SEQ ID NO: 117316

SEQ ID NO: 150195 - RNA, 64 nt, hsa; identical to SEQ ID NO: 117317

SEQ ID NO: 150196 - RNA, 64 nt, hsa; identical to SEQ ID NO: 117318

SEQ ID NO: 150197 - RNA, 64 nt, hsa; identical to SEQ ID NO: 117319

SEQ ID NO: 150198 - RNA, 64 nt, hsa; identical to SEQ ID NO: 117320

SEQ ID NO: 150199 - RNA, 64 nt, hsa; identical to SEQ ID NO: 117321

SEQ ID NO: 150200 - RNA, 64 nt, hsa; identical to SEQ ID NO: 117322

SEQ ID NO: 150201 - RNA, 64 nt, hsa; identical to SEQ ID NO: 117323

SEQ ID NO: 150202 - RNA, 64 nt, hsa; identical to SEQ ID NO: 117324

SEQ ID NO: 150203 - RNA, 64 nt, hsa; identical to SEQ ID NO: 117325

SEQ ID NO: 150204 - RNA, 64 nt, hsa; identical to SEQ ID NO: 117326

SEQ ID NO: 150205 - RNA, 64 nt, hsa; identical to SEQ ID NO: 117327

SEQ ID NO: 150206 - RNA, 64 nt, hsa; identical to SEQ ID NO: 117328

SEQ ID NO: 150207 - RNA, 64 nt, hsa
ccucugccucccaggcucaagcaauccucccacuucagucuaaguagcugggacuacaggcacg

SEQ ID NO: 150208 - RNA, 64 nt, hsa
gggauaacugagggaagagaagugacaauuccacucagucuauuagaggucuggauauaaggua

SEQ ID NO: 150209 - RNA, 64 nt, hsa
guucacucuaaaagcugaacuacauccuuaguuuucagucuacuugacucuaucaggagcuuuu

SEQ ID NO: 150210 - RNA, 64 nt, hsa
aacuguccagaagugugggcuauguauuaucugaucagucuauggucccaguaaaaguaaagau

SEQ ID NO: 150211 - RNA, 64 nt, hsa
uggaagucagucuaccguauaguaacacuguaugucagucuacagaccacacucuaguuguuuu

SEQ ID NO: 150212 - RNA, 64 nt, hsa
gucacaagcuucaguaaggccagucagcuggaagucagucuaccguauaguaacacuguauguc

SEQ ID NO: 150213 - RNA, 64 nt, hsa
ccauuggugaaauggcccuuucccucuuugcaguucagucuaagucucguauuugcuuugcugu

SEQ ID NO: 150214 - RNA, 64 nt, hsa
cuucucuuuggacacaugggccuucuuagaggguucagucuaggacccggcucuccuggcccug

SEQ ID NO: 150215 - RNA, 64 nt, hsa
uggggccaacaucuccaagacaaaguuuuucagaaaagaggaaaaaaagaauuuaaaaaaggau

SEQ ID NO: 150216 - RNA, 64 nt, hsa
uauacgcuggaaauugacuccccuuucccuucccaaagaggauaggaccucccaggaugcuucc

SEQ ID NO: 150217 - RNA, 64 nt, hsa
aggagcauccuuaccuccaaaagcacagggacacaaagaggaaucuaaacaaacaggccucuca

SEQ ID NO: 150218 - RNA, 64 nt, hsa
agccugggugacagagcaagacccugucuuaaaaaaagaggauucaacacauauuuuuauauua

SEQ ID NO: 150219 - RNA, 64 nt, hsa
acaugauuucagaagaugacauaagauuccucuuaaagaggaaaugucaggaaucaagccacug

SEQ ID NO: 150220 - RNA, 64 nt, hsa
auuauuuuuuggcuccaaaacuggauugcaaaagaaagaggagaagaauauuuuguguguuccu

SEQ ID NO: 150221 - RNA, 64 nt, hsa
gucaacuuaacugauaaauuauauuugguaaaauaaagaggacguuuauuuagaugguuggugu

SEQ ID NO: 150222 - RNA, 64 nt, hsa
ucccuucccuccaccucuccuuaccaagcacccaaaagaggauuuagaacuagcaggguggaca

SEQ ID NO: 150223 - RNA, 64 nt, hsa
aaagggcaaauugaaagucaaggagaaaaagcgcaaagaggagaaugaagauccagaaaggaaa

SEQ ID NO: 150224 - RNA, 64 nt, hsa
gggcuucggcgccaugcugagauuuggaaagaagaaagaggauaaggguggaaaggcugagcag

SEQ ID NO: 150225 - RNA, 64 nt, hsa
aaacaugauucuaguuaaauguagaagagagaagaaagaggaaguguucacuuuuuuaauacac

SEQ ID NO: 150226 - RNA, 64 nt, hsa
aagaguaauguaaacuauuauugaguagaggccuaaagaggacugugcauuuuugcuauuuaaa

SEQ ID NO: 150227 - RNA, 64 nt, hsa
ugggaggcuugguagcaaaguaacauuuuuuggaaaagaggacagaaaaauugaacuacagcuu

SEQ ID NO: 150228 - RNA, 64 nt, hsa
ccagagugagcaaggauuauguuuuuggauugucaaagaggaugcuuagucuuaaaauaaaaau

SEQ ID NO: 150229 - RNA, 64 nt, hsa
uuuuguucucaguggaacccugucaaaucgcauaaaagaggaaaaaaacaaaacucauuagaau

SEQ ID NO: 150230 - RNA, 64 nt, hsa
aggggaugugugaccuguuuguugagugauugugaaagaggaaugugggagauugggacagcug

SEQ ID NO: 150231 - RNA, 64 nt, hsa
gcccuucccacuggaggucacauucaggaagaugaaagaggagguuuggggucugccaccaucc

SEQ ID NO: 150232 - RNA, 64 nt, hsa
ggacuggaaccagggagaccgagcgcuuucuggaaaagaggaguuucgagguagaguuugaagg

SEQ ID NO: 150233 - RNA, 64 nt, hsa
uccgcaugggacuuguccaaaaaaacucuaaucaaaagaggaaaauuuuggaauaugccaggaa

SEQ ID NO: 150234 - RNA, 64 nt, hsa
aauaccuacccuagaguacauaaaaauuauauuaaaagaggaaguagcaguaugcauaauuuua

SEQ ID NO: 150235 - RNA, 64 nt, hsa
uuguuccuguccauucacccagccaaauuguguuaaagaggaaagccccacaaacuaaaacagc

SEQ ID NO: 150236 - RNA, 64 nt, hsa
uugguuuauauucugguugucuuuuucuuuuuguaaagaggaaacaauguacagaaaaacaaua

SEQ ID NO: 150237 - RNA, 64 nt, hsa
acagaccacacugcaggaagucaaacacgaacucaaagaggacauccagcugcucagcugcaga

SEQ ID NO: 150238 - RNA, 64 nt, hsa
acagaucaucuuucguaagaucagugaugugaagaaagaggaggaggagcgccuccggcagaag

SEQ ID NO: 150239 - RNA, 64 nt, hsa
acaccaguaauggcacucuuccuaggacgggacuaaagaggacgccguccuuaaaaccugacgu

SEQ ID NO: 150240 - RNA, 64 nt, hsa
uauuucccacaggaguccauuggguucagcuuugaaagaggaauagaaucgaggcuccuuugac

SEQ ID NO: 150241 - RNA, 64 nt, hsa
ggucuaugucgagagcuggccaaagagccuuuccaaagaggagcgaugggccccuggccccgcc

SEQ ID NO: 150242 - RNA, 64 nt, hsa
caugaggagggaaaagagugccuaagcgggggugaaagaggacguguuacccacugccaugcac

SEQ ID NO: 150243 - RNA, 64 nt, hsa
cauauuuuuucaggaaaaacaaacuuuaaaaaaaaaagaggagaaauaaaaccuuuucuccccu

SEQ ID NO: 150244 - RNA, 64 nt, hsa
aagaccacagaaaagagaaaggaaaggccaaaaaaaagaggaaaagaaaaauguacaaaaagau

SEQ ID NO: 150245 - RNA, 64 nt, hsa
gcuuuaugcccaugaugucauuucaggcucaaccaaagaggaucaaacaggaauuccaucuugg

SEQ ID NO: 150246 - RNA, 64 nt, hsa
cagcugagaacagauuugacucacagacauuaccaaagaggagcuugugaauccaggaaaagcu

SEQ ID NO: 150247 - RNA, 64 nt, hsa
aaauauauaaacaaacaaacaaaaauugcucaaaaaagaggagaaaagcucaagaggaaaagcu

SEQ ID NO: 150248 - RNA, 64 nt, hsa
gauucccgcaugguuuuuauaauauucauacaacaaagaggauuagacaguaagaguuuacaag

SEQ ID NO: 150249 - RNA, 64 nt, hsa; identical to SEQ ID NO: 130383

SEQ ID NO: 150250 - RNA, 64 nt, hsa; identical to SEQ ID NO: 130384

SEQ ID NO: 150251 - RNA, 64 nt, hsa; identical to SEQ ID NO: 130385

SEQ ID NO: 150252 - RNA, 64 nt, hsa; identical to SEQ ID NO: 130386

SEQ ID NO: 150253 - RNA, 64 nt, hsa; identical to SEQ ID NO: 130387

SEQ ID NO: 150254 - RNA, 64 nt, hsa; identical to SEQ ID NO: 130388

SEQ ID NO: 150255 - RNA, 64 nt, hsa; identical to SEQ ID NO: 130389

SEQ ID NO: 150256 - RNA, 64 nt, hsa; identical to SEQ ID NO: 130390

SEQ ID NO: 150257 - RNA, 64 nt, hsa; identical to SEQ ID NO: 130391

SEQ ID NO: 150258 - RNA, 64 nt, hsa; identical to SEQ ID NO: 130392

SEQ ID NO: 150259 - RNA, 64 nt, hsa; identical to SEQ ID NO: 130393

SEQ ID NO: 150260 - RNA, 64 nt, hsa; identical to SEQ ID NO: 130394

SEQ ID NO: 150261 - RNA, 64 nt, hsa; identical to SEQ ID NO: 130395

SEQ ID NO: 150262 - RNA, 64 nt, hsa; identical to SEQ ID NO: 130396

SEQ ID NO: 150263 - RNA, 64 nt, hsa
cauauuauuuuauaaaauguuuucuguauggcaauaaacugaaaacauggaucaacccuucuuu

SEQ ID NO: 150264 - RNA, 64 nt, hsa
aacugaaaacauggaucaacccuucuuuugaaaauaaacugagucaauuuagccuuuuaaaaau

SEQ ID NO: 150265 - RNA, 64 nt, hsa
cagacagggucaugggaagggggcccugugcuucuaaacugagugguugcugguuaguuuggua

SEQ ID NO: 150266 - RNA, 64 nt, hsa
cucuuaaccgucaacaucaguguuguaaauuugcuaaacugauucacuuuuagcagcagacuuu

SEQ ID NO: 150267 - RNA, 64 nt, hsa
cuccauuuguugacagacaaagccaacaauacucuaaacugaggccugcaagucauuucauuug

SEQ ID NO: 150268 - RNA, 64 nt, hsa
caaugcugacaguuggagccaaugccucauaguguaaacugaaagaaaaauaguugcuuuuuaa

SEQ ID NO: 150269 - RNA, 64 nt, hsa
ugauauauugcuguuaucaaucauuucuagauuauaaacugacuaaacuuacaucagggaaaaa

SEQ ID NO: 150270 - RNA, 64 nt, hsa
acaguggagggaagucuuccuuccugaaggaaaauaaacugacacuuauuaacuaagauaauuu

SEQ ID NO: 150271 - RNA, 64 nt, hsa
ggcugaccuacucuggagcacggugucuuccuucuaaacugagugacuguaguacuaucugugc

SEQ ID NO: 150272 - RNA, 64 nt, hsa
ugagaaaagggcuacagugcauuucuugguaacuuaaacugagucuugaaguuauaaugaucca

SEQ ID NO: 150273 - RNA, 64 nt, hsa
uuuuaaaaugccugaggaaauacauuuuucuuaauaaacugaagagucucaguauggcuauuaa

SEQ ID NO: 150274 - RNA, 64 nt, hsa
ugaucucaccugucgcguagcucuaauauucacauaaacugaaauaaagaaguggaaugaggag

SEQ ID NO: 150275 - RNA, 64 nt, hsa
ggugggagagcuuuuaguuaaguaagaagcuauguaaacugacaaggaugcuaaaauaaaaguc

SEQ ID NO: 150276 - RNA, 64 nt, hsa
cuguuuugguauauuguacacaaaccuacaaaaauaaacugaacuugcaauauuuuugcaaaaa

SEQ ID NO: 150277 - RNA, 64 nt, hsa
agccaagccauuucugucuccagaguuguucucuuaaacugauaugaguucugaaaggagccag

SEQ ID NO: 150278 - RNA, 64 nt, hsa
acuuuuguuccuuuguuaacuguuguguugucacuaaacugaaaggcuggggcuugcccuuaga

SEQ ID NO: 150279 - RNA, 64 nt, hsa
uguuucuauuugagaaggacacuuuuucaucaucuaaacugauucgcauaggugguuagaaugg

SEQ ID NO: 150280 - RNA, 64 nt, hsa
aauugcccugcccaagucacugucuuuuaacuuuuaaacugaauauuaaaauguaucugucuuu

SEQ ID NO: 150281 - RNA, 64 nt, hsa
uucugagaaauucugaacacauagaucucuuuccuaaacugacauuuucuauuuugacuguuuu

SEQ ID NO: 150282 - RNA, 64 nt, hsa
agucucuggcuaggucuggguccagauuaggauuuaaacugauaaaggaaacuguugguaaauc

SEQ ID NO: 150283 - RNA, 64 nt, hsa
uucacauaauuacacacgugaaauaauuaaagcuuaaacugaauuuguauuucauuuuauuguc

SEQ ID NO: 150284 - RNA, 64 nt, hsa
augccuuuauuuucagggauaaguaacucuuaccuaaacugagcugaauguuuguuucagugcc

SEQ ID NO: 150285 - RNA, 64 nt, hsa
uguggauaaaugaacaauuguaaguuuugcaucauaaacugagaacuuucuuuugacagggggg

SEQ ID NO: 150286 - RNA, 64 nt, hsa
uauuuaaaaugcauuuuuauugaaaggccugcauuaaacugaaugguuucacaggcauuugcuu

SEQ ID NO: 150287 - RNA, 64 nt, hsa
acuuuuuuuugauuggcauuuuaaaaucgguauuuaaacugaagacauugucauguuuuauuaa

SEQ ID NO: 150288 - RNA, 64 nt, hsa
gcuuccaguuaccagguugucuagguaaugacaguaaacugacuguagaaugauaauuguggua

SEQ ID NO: 150289 - RNA, 64 nt, hsa
uaaaauaguucuguugaauuucacccuggcgauguaaacugagagcuuaucuucacagaugugg

SEQ ID NO: 150290 - RNA, 64 nt, hsa
aauugugcaugauaucacauuuuuugcaccaagauaaacugauacaaauccguuauaacauguc

SEQ ID NO: 150291 - RNA, 64 nt, hsa
aaagguuugggauguauauugcuauguaauuuaauaaacugauuuuauggauauaaauaugacu

SEQ ID NO: 150292 - RNA, 64 nt, hsa
ccugacauuaauuaucuauccuugaugauguguuuaaacugaguagcagaaaacagaggccaca

SEQ ID NO: 150293 - RNA, 64 nt, hsa
aauguugauguuugaagccaaaaagccaaaugcuuaaacugaucaaugacuguagcuuuuuaga

SEQ ID NO: 150294 - RNA, 64 nt, hsa
uuuaaaaucccuuuugcuaccccaucugguuuuauaaacugaguuucuuagcauucguuaaaau

SEQ ID NO: 150295 - RNA, 64 nt, hsa; identical to SEQ ID NO: 100778

SEQ ID NO: 150296 - RNA, 64 nt, hsa; identical to SEQ ID NO: 100779

SEQ ID NO: 150297 - RNA, 64 nt, hsa; identical to SEQ ID NO: 100780

SEQ ID NO: 150298 - RNA, 64 nt, hsa; identical to SEQ ID NO: 100781

SEQ ID NO: 150299 - RNA, 64 nt, hsa; identical to SEQ ID NO: 100782

SEQ ID NO: 150300 - RNA, 64 nt, hsa; identical to SEQ ID NO: 100783

SEQ ID NO: 150301 - RNA, 64 nt, hsa; identical to SEQ ID NO: 100784

SEQ ID NO: 150302 - RNA, 64 nt, hsa; identical to SEQ ID NO: 100785

SEQ ID NO: 150303 - RNA, 64 nt, hsa; identical to SEQ ID NO: 100786

SEQ ID NO: 150304 - RNA, 64 nt, hsa; identical to SEQ ID NO: 100787

SEQ ID NO: 150305 - RNA, 64 nt, hsa; identical to SEQ ID NO: 100788

SEQ ID NO: 150306 - RNA, 64 nt, hsa; identical to SEQ ID NO: 100789

SEQ ID NO: 150307 - RNA, 64 nt, hsa; identical to SEQ ID NO: 100790

SEQ ID NO: 150308 - RNA, 63 nt, hsa
uggaagguaucauccguguggguucuucccuccugcccucaauuguuuuucugggccuuguuu

SEQ ID NO: 150309 - RNA, 63 nt, hsa
uuucaaaggcuaccuuuaugaaguagacacuauugcccucagaaugagagaacauuaaacuac

SEQ ID NO: 150310 - RNA, 63 nt, hsa
cccagauccuuaauguaguucucauccuccgcaugcccucagccacaagcgggugacugacug

SEQ ID NO: 150311 - RNA, 63 nt, hsa
gagcaccauccugcccuagcagagcccaggccuugcccucaugaagcaucauugaaauagcag

SEQ ID NO: 150312 - RNA, 63 nt, hsa
cuuucuuuaucaaccugcucacucacaaaugugugcccucagccagagaguaagaaagcccaa

SEQ ID NO: 150313 - RNA, 63 nt, hsa
uauguguguacacgcgcacgccuguaugugcgcugcccucagacaugcaagugaaaggaggag

SEQ ID NO: 150314 - RNA, 63 nt, hsa
acugcauccgaaaggcccccacucaccauggucugcccucaccccacauauguguguacacgc

SEQ ID NO: 150315 - RNA, 63 nt, hsa
gccuuugauugcucaccccugcuccccaggcccugcccucacuuuuaccaaagguucucccuc

SEQ ID NO: 150316 - RNA, 63 nt, hsa
uugcugaaguuaguaguacuguacuaagagcucugcccucaugugaauuccugcccuggcgcc

SEQ ID NO: 150317 - RNA, 63 nt, hsa
aguagaaccuuuccagguucucuuagagccauaugcccucaucaucccaggggagaacuacau

SEQ ID NO: 150318 - RNA, 63 nt, hsa
gguguuacacauugaggcugucuuuaaggggccugcccucaucaucaacgucucagcccuuca

SEQ ID NO: 150319 - RNA, 63 nt, hsa
cuuccgguggagcugccucguuccuuugaacuaugcccucacccuucugcccucacuugauuu

SEQ ID NO: 150320 - RNA, 63 nt, hsa
gccucguuccuuugaacuaugcccucacccuucugcccucacuugauuugaaagggucguuaa

SEQ ID NO: 150321 - RNA, 63 nt, hsa
aggaggaguggcauuggcauccugacccagcucugcccucaagguggggauggaugggcaaag

SEQ ID NO: 150322 - RNA, 63 nt, hsa
uuggggcuggucccagccugaggcuccagcugaugcccucagcucccagagagggggugcccc

SEQ ID NO: 150323 - RNA, 63 nt, hsa
ucucaggaacaaaaccugaggcagcccuuuggaugcccucacagccuugcuucucucagccua

SEQ ID NO: 150324 - RNA, 63 nt, hsa
ucaggcagggacagacccagaaagaacacagucugcccucagagagcucuuugcaguguagug

SEQ ID NO: 150325 - RNA, 63 nt, hsa
uccauuccaaaggccaucuuguggucaguuucaugcccucaccugauuuuuuuuuuuuuuuuu

SEQ ID NO: 150326 - RNA, 63 nt, hsa
ggagaaacucacagcuccuccgggauacauaugugcccucagcagcagcucccaggugaaguu

SEQ ID NO: 150327 - RNA, 63 nt, hsa
ucgaaugcacacucaaauaaaaaaccaaacagcugcccucauuagcggauuccguuccauuau

SEQ ID NO: 150328 - RNA, 63 nt, hsa
acuucauuucucuuccaacccauuguguuccucugcccucauucuuuaccuuuguuguaagaa

SEQ ID NO: 150329 - RNA, 63 nt, hsa
ucuccucggccauccuguggggccccgaggccuugcccucacuucagugccugggugcucagg

SEQ ID NO: 150330 - RNA, 63 nt, hsa
aguaauaaaccguggguggugauagugacccagugcccucacugcccagccccgccuguccuc

SEQ ID NO: 150331 - RNA, 63 nt, hsa
caggccagcuuucugcauggauggucagucucuugcccucaaacacuacagcaaacaagcuac

SEQ ID NO: 150332 - RNA, 63 nt, hsa
cagagaaacaaagucuggacccacuccaugcucugcccucagaccuggccaggugaugcucug

SEQ ID NO: 150333 - RNA, 63 nt, hsa
gagcugucugcauccgccacccccuccaaccacugcccucagcccccgaccuuauuuauuacc

SEQ ID NO: 150334 - RNA, 63 nt, hsa
gacccugcccggcuccucccugaccgguccuugugcccucaccagacacccuguuggccauga

SEQ ID NO: 150335 - RNA, 63 nt, hsa
cuccccaaugcugacccuaggauuuuccuucccugcccucaccugcaaaugaguuaaagaaga

SEQ ID NO: 150336 - RNA, 63 nt, hsa
gggacacagugguaaucaagacagccccaacacugcccucauagagcucacaguccaauggag

SEQ ID NO: 150337 - RNA, 63 nt, hsa
uguccaucccacagcucagccuggaugcccaccugcccucaggcaagguagagguggcagggg

SEQ ID NO: 150338 - RNA, 63 nt, hsa
gaauccaggucccccagguggagcugccugccuugcccucacugcccacucugcccacacuuc

SEQ ID NO: 150339 - RNA, 63 nt, hsa
uaagggccacucugguuaucugccaagguugcuugcccucaccccaaugcuccaacagccauu

SEQ ID NO: 150340 - RNA, 63 nt, hsa
uaccuccucccguugggcugugacuuuuccuccugcccucagccucugaaacagaaaucuuug

SEQ ID NO: 150341 - RNA, 63 nt, hsa
aagaaucuucccaaaauccuuuaauuuaccugaugcccucaucaggucguuaaaaauucaaau

SEQ ID NO: 150342 - RNA, 63 nt, hsa
ugacagccucacagggucugguaccagggguugugcccucagcagugacagcagcuuaggugu

SEQ ID NO: 150343 - RNA, 63 nt, hsa
caucugaacuuccguuuccccagggccuccagcugcccucagacacugaugucuguccccagg

SEQ ID NO: 150344 - RNA, 63 nt, hsa
aagggugagggggucagacacaggcccugccccugcccucagugacuggccaguccagcccag

SEQ ID NO: 150345 - RNA, 64 nt, hsa
auuacaguguuaacugccauauauguaauauacacaaacucaauuagcauuguaauggccaaau

SEQ ID NO: 150346 - RNA, 64 nt, hsa
gaagauuugaauaacuagacauuauuuaugcugccaaacucauuuguugcaguuguuuguaaug

SEQ ID NO: 150347 - RNA, 64 nt, hsa
cuggagguggccauuaauuggcaccacucaaacucaaacucaguccaucugaugccaguguuga

SEQ ID NO: 150348 - RNA, 61 nt, hsa
caccuggagguggccauuaauuggcaccacucaaacucaaacucaguccaucugaugccag

SEQ ID NO: 150349 - RNA, 64 nt, hsa
gagaaauaaagcucagauggaagagauaaacgaccaaacucaguucgaccaaacucaguucaaa

SEQ ID NO: 150350 - RNA, 64 nt, hsa
gauggaagagauaaacgaccaaacucaguucgaccaaacucaguucaaaccauuucagccaaac

SEQ ID NO: 150351 - RNA, 64 nt, hsa
cccaaggcagaagaccuaucugcauuugagcccucaaacucaccuugcagagcgccaagucccg

SEQ ID NO: 150352 - RNA, 64 nt, hsa
ggacgggguuuugccauguuagcuaggcuggucucaaacucacaccugggauuacaggcaugag

SEQ ID NO: 150353 - RNA, 64 nt, hsa
ucuuuuguucuuucuuuccuguuuuccauuuuuaaacuaguaacagcaggccuuuugcguuuac

SEQ ID NO: 150354 - RNA, 64 nt, hsa
ucaaugugguuuaaagggaugaaugugaauuaugaacuaguaugugacaauaaaugaccaccaa

SEQ ID NO: 150355 - RNA, 64 nt, hsa
agaaggagguacauggucaaauuacuacaggaaaaacuaguaguuuaaacaaggugaaacaaga

SEQ ID NO: 150356 - RNA, 64 nt, hsa
cuacuauucuuagcagugcuugggugaccauacgaacuaguaaaaaggucuaaauuauucauga

SEQ ID NO: 150357 - RNA, 64 nt, hsa
auuuguauguaaauguacagaaauaaaaacguugccccauuaacagauuuccucuggaaugucu

SEQ ID NO: 150358 - RNA, 64 nt, hsa
ggaguacuugcuauaaagccaccugucaacaaacccccauuauguacagaauaggaccuaucca

SEQ ID NO: 150359 - RNA, 64 nt, hsa
ugaaaagugguuuucuuaaugcagcccugcugguccccauuaacaauugcuugaaauucacaug

SEQ ID NO: 150360 - RNA, 63 nt, hsa
augcaccccagguucgcugaucuaucaacaucaccccauuaagaauacaaagcacuacauucu

SEQ ID NO: 150361 - RNA, 64 nt, hsa
auucuugaaucacccaacccuggaucagaaaccuccccauuaacaaacacugccccuuaagucc

SEQ ID NO: 150362 - RNA, 64 nt, hsa
gagaccccuguuagccagcccucgaucauugaggccccauuauuaacagauacucccauaauaa

SEQ ID NO: 150363 - RNA, 64 nt, hsa
uauuuuauuuuugguuuguauuauuuuuauuuggccccauuauuuuaaauaggaaaaacaguau

SEQ ID NO: 150364 - RNA, 64 nt, hsa
ugcugggauuacaaaugugagccaccacaucuggccccauuauuuuauuuuugguuuguauuau

SEQ ID NO: 150365 - RNA, 64 nt, hsa
ucgaaaccuguccauaaaguaauuuugugaaagaaggagcaagagaacauuccucugcagcacu

SEQ ID NO: 150366 - RNA, 64 nt, hsa
acauaaagguauuuagaauauauuaaaucguuagaggagcaacaggagaugagaguuccagauu

SEQ ID NO: 150367 - RNA, 64 nt, hsa
aauguugcaggauacauagccccaaagauggucuaggagcaaucuaagcuguguuacuccaaag

SEQ ID NO: 150368 - RNA, 64 nt, hsa
aggagggaggaugcugugugagagccaugcugucaggagcaagcuugcugcuccugugcugccc

SEQ ID NO: 150369 - RNA, 64 nt, hsa
ucuggugguggggggcaggggacagaggccaugaaggagcaaguuuuguauuugugaccucagc

SEQ ID NO: 150370 - RNA, 64 nt, hsa
gugaaugaagauccagccggccuugggagccuggaggagcaaagacuggggucuuuugcgaaag

SEQ ID NO: 150371 - RNA, 64 nt, hsa
ggagguucaaguauggaggguaggagugcaacccaggagcaacgcucaagguggccgagaugca

SEQ ID NO: 150372 - RNA, 64 nt, hsa
aaggccccugauggagcuauuucuuccuaguaucaggagcaauugagaccccucaggaguuucc

SEQ ID NO: 150373 - RNA, 64 nt, hsa
aaagcuuuaaaaacaagauugcaucauaacccccaggagcaaagcaaccuggaggcugcauauc

SEQ ID NO: 150374 - RNA, 64 nt, hsa
guuuuguugguuauguggaaaucacaaacuccagaggagcaaagggguuuuucaaugucuuuug

SEQ ID NO: 150375 - RNA, 64 nt, hsa
ugggcugggagacagggacaauggggaaaaguuaaggagcaaaauggggguuggaagcaaaaaa

SEQ ID NO: 150376 - RNA, 64 nt, hsa
ucuuggcccagggccaggcagucgugguugcagaaggagcaauuaggcugccugccugugggcu

SEQ ID NO: 150377 - RNA, 64 nt, hsa
uguccuugaagagagugaggcauugagggccaauaggagcaauggggucccuggccuuguccau

SEQ ID NO: 150378 - RNA, 64 nt, hsa
auauccuuuuuauaaaaauucaugucuguauuucaggagcaaacucuucaggcuccuuuuuuau

SEQ ID NO: 150379 - RNA, 64 nt, hsa; identical to SEQ ID NO: 53335

SEQ ID NO: 150380 - RNA, 64 nt, hsa; identical to SEQ ID NO: 53336

SEQ ID NO: 150381 - RNA, 64 nt, hsa; identical to SEQ ID NO: 53337

SEQ ID NO: 150382 - RNA, 64 nt, hsa; identical to SEQ ID NO: 53338

SEQ ID NO: 150383 - RNA, 64 nt, hsa; identical to SEQ ID NO: 53339

SEQ ID NO: 150384 - RNA, 64 nt, hsa; identical to SEQ ID NO: 53340

SEQ ID NO: 150385 - RNA, 64 nt, hsa; identical to SEQ ID NO: 53341

SEQ ID NO: 150386 - RNA, 64 nt, hsa; identical to SEQ ID NO: 53342

SEQ ID NO: 150387 - RNA, 51 nt, hsa; identical to SEQ ID NO: 53343

SEQ ID NO: 150388 - RNA, 64 nt, hsa; identical to SEQ ID NO: 53344

SEQ ID NO: 150389 - RNA, 64 nt, hsa; identical to SEQ ID NO: 53345

SEQ ID NO: 150390 - RNA, 64 nt, hsa; identical to SEQ ID NO: 53346

SEQ ID NO: 150391 - RNA, 64 nt, hsa; identical to SEQ ID NO: 53347

SEQ ID NO: 150392 - RNA, 64 nt, hsa; identical to SEQ ID NO: 53348

SEQ ID NO: 150393 - RNA, 64 nt, hsa; identical to SEQ ID NO: 53349

SEQ ID NO: 150394 - RNA, 64 nt, hsa; identical to SEQ ID NO: 53350

SEQ ID NO: 150395 - RNA, 64 nt, hsa; identical to SEQ ID NO: 53351

SEQ ID NO: 150396 - RNA, 64 nt, hsa; identical to SEQ ID NO: 53352

SEQ ID NO: 150397 - RNA, 64 nt, hsa; identical to SEQ ID NO: 53353

SEQ ID NO: 150398 - RNA, 64 nt, hsa; identical to SEQ ID NO: 53354

SEQ ID NO: 150399 - RNA, 64 nt, hsa; identical to SEQ ID NO: 53355

SEQ ID NO: 150400 - RNA, 64 nt, hsa; identical to SEQ ID NO: 53356

SEQ ID NO: 150401 - RNA, 64 nt, hsa; identical to SEQ ID NO: 53357

SEQ ID NO: 150402 - RNA, 64 nt, hsa; identical to SEQ ID NO: 53358

SEQ ID NO: 150403 - RNA, 64 nt, hsa; identical to SEQ ID NO: 53359

SEQ ID NO: 150404 - RNA, 64 nt, hsa; identical to SEQ ID NO: 53360

SEQ ID NO: 150405 - RNA, 64 nt, hsa; identical to SEQ ID NO: 53361

SEQ ID NO: 150406 - RNA, 64 nt, hsa; identical to SEQ ID NO: 53362

SEQ ID NO: 150407 - RNA, 64 nt, hsa; identical to SEQ ID NO: 53363

SEQ ID NO: 150408 - RNA, 64 nt, hsa; identical to SEQ ID NO: 53364

SEQ ID NO: 150409 - RNA, 64 nt, hsa; identical to SEQ ID NO: 53365

SEQ ID NO: 150410 - RNA, 64 nt, hsa; identical to SEQ ID NO: 53366

SEQ ID NO: 150411 - RNA, 64 nt, hsa; identical to SEQ ID NO: 53367

SEQ ID NO: 150412 - RNA, 64 nt, hsa; identical to SEQ ID NO: 53368

SEQ ID NO: 150413 - RNA, 64 nt, hsa; identical to SEQ ID NO: 53369

SEQ ID NO: 150414 - RNA, 64 nt, hsa; identical to SEQ ID NO: 53370

SEQ ID NO: 150415 - RNA, 64 nt, hsa; identical to SEQ ID NO: 53371

SEQ ID NO: 150416 - RNA, 64 nt, hsa; identical to SEQ ID NO: 53372

SEQ ID NO: 150417 - RNA, 64 nt, hsa; identical to SEQ ID NO: 128083

SEQ ID NO: 150418 - RNA, 64 nt, hsa; identical to SEQ ID NO: 128084

SEQ ID NO: 150419 - RNA, 64 nt, hsa; identical to SEQ ID NO: 128085

SEQ ID NO: 150420 - RNA, 64 nt, hsa; identical to SEQ ID NO: 128086

SEQ ID NO: 150421 - RNA, 64 nt, hsa; identical to SEQ ID NO: 128087

SEQ ID NO: 150422 - RNA, 64 nt, hsa; identical to SEQ ID NO: 128088

SEQ ID NO: 150423 - RNA, 64 nt, hsa; identical to SEQ ID NO: 128089

SEQ ID NO: 150424 - RNA, 64 nt, hsa; identical to SEQ ID NO: 128090

SEQ ID NO: 150425 - RNA, 64 nt, hsa; identical to SEQ ID NO: 128091

SEQ ID NO: 150426 - RNA, 64 nt, hsa; identical to SEQ ID NO: 128092

SEQ ID NO: 150427 - RNA, 64 nt, hsa; identical to SEQ ID NO: 128093

SEQ ID NO: 150428 - RNA, 64 nt, hsa; identical to SEQ ID NO: 128094

SEQ ID NO: 150429 - RNA, 64 nt, hsa; identical to SEQ ID NO: 128095

SEQ ID NO: 150430 - RNA, 64 nt, hsa; identical to SEQ ID NO: 128096

SEQ ID NO: 150431 - RNA, 64 nt, hsa; identical to SEQ ID NO: 128097

SEQ ID NO: 150432 - RNA, 64 nt, hsa; identical to SEQ ID NO: 128098

SEQ ID NO: 150433 - RNA, 64 nt, hsa; identical to SEQ ID NO: 128099

SEQ ID NO: 150434 - RNA, 64 nt, hsa; identical to SEQ ID NO: 128100

SEQ ID NO: 150435 - RNA, 64 nt, hsa; identical to SEQ ID NO: 128101

SEQ ID NO: 150436 - RNA, 64 nt, hsa; identical to SEQ ID NO: 128102

SEQ ID NO: 150437 - RNA, 64 nt, hsa; identical to SEQ ID NO: 128103

SEQ ID NO: 150438 - RNA, 64 nt, hsa; identical to SEQ ID NO: 128104

SEQ ID NO: 150439 - RNA, 64 nt, hsa; identical to SEQ ID NO: 128105

SEQ ID NO: 150440 - RNA, 64 nt, hsa; identical to SEQ ID NO: 128106

SEQ ID NO: 150441 - RNA, 64 nt, hsa; identical to SEQ ID NO: 128107

SEQ ID NO: 150442 - RNA, 64 nt, hsa; identical to SEQ ID NO: 128108

SEQ ID NO: 150443 - RNA, 64 nt, hsa; identical to SEQ ID NO: 128109

SEQ ID NO: 150444 - RNA, 64 nt, hsa; identical to SEQ ID NO: 128110

SEQ ID NO: 150445 - RNA, 64 nt, hsa; identical to SEQ ID NO: 128111

SEQ ID NO: 150446 - RNA, 64 nt, hsa; identical to SEQ ID NO: 128112

SEQ ID NO: 150447 - RNA, 64 nt, hsa; identical to SEQ ID NO: 128113

SEQ ID NO: 150448 - RNA, 64 nt, hsa; identical to SEQ ID NO: 128114

SEQ ID NO: 150449 - RNA, 64 nt, hsa; identical to SEQ ID NO: 128115

SEQ ID NO: 150450 - RNA, 64 nt, hsa; identical to SEQ ID NO: 128116

SEQ ID NO: 150451 - RNA, 64 nt, hsa; identical to SEQ ID NO: 128117

SEQ ID NO: 150452 - RNA, 64 nt, hsa; identical to SEQ ID NO: 128118

SEQ ID NO: 150453 - RNA, 64 nt, hsa; identical to SEQ ID NO: 128119

SEQ ID NO: 150454 - RNA, 64 nt, hsa; identical to SEQ ID NO: 128120

SEQ ID NO: 150455 - RNA, 64 nt, hsa; identical to SEQ ID NO: 128121

SEQ ID NO: 150456 - RNA, 64 nt, hsa; identical to SEQ ID NO: 106770

SEQ ID NO: 150457 - RNA, 64 nt, hsa; identical to SEQ ID NO: 106771

SEQ ID NO: 150458 - RNA, 64 nt, hsa; identical to SEQ ID NO: 106772

SEQ ID NO: 150459 - RNA, 64 nt, hsa; identical to SEQ ID NO: 106773

SEQ ID NO: 150460 - RNA, 64 nt, hsa; identical to SEQ ID NO: 106774

SEQ ID NO: 150461 - RNA, 64 nt, hsa; identical to SEQ ID NO: 106775

SEQ ID NO: 150462 - RNA, 64 nt, hsa; identical to SEQ ID NO: 106776

SEQ ID NO: 150463 - RNA, 64 nt, hsa; identical to SEQ ID NO: 106777

SEQ ID NO: 150464 - RNA, 64 nt, hsa; identical to SEQ ID NO: 106778

SEQ ID NO: 150465 - RNA, 64 nt, hsa; identical to SEQ ID NO: 106779

SEQ ID NO: 150466 - RNA, 64 nt, hsa; identical to SEQ ID NO: 106780

SEQ ID NO: 150467 - RNA, 64 nt, hsa; identical to SEQ ID NO: 106781

SEQ ID NO: 150468 - RNA, 64 nt, hsa; identical to SEQ ID NO: 106782

SEQ ID NO: 150469 - RNA, 64 nt, hsa; identical to SEQ ID NO: 106783

SEQ ID NO: 150470 - RNA, 64 nt, hsa; identical to SEQ ID NO: 106784

SEQ ID NO: 150471 - RNA, 64 nt, hsa; identical to SEQ ID NO: 106785

SEQ ID NO: 150472 - RNA, 64 nt, hsa; identical to SEQ ID NO: 106786

SEQ ID NO: 150473 - RNA, 64 nt, hsa; identical to SEQ ID NO: 106787

SEQ ID NO: 150474 - RNA, 64 nt, hsa; identical to SEQ ID NO: 106788

SEQ ID NO: 150475 - RNA, 64 nt, hsa; identical to SEQ ID NO: 106789

SEQ ID NO: 150476 - RNA, 64 nt, hsa; identical to SEQ ID NO: 106790

SEQ ID NO: 150477 - RNA, 64 nt, hsa; identical to SEQ ID NO: 106791

SEQ ID NO: 150478 - RNA, 64 nt, hsa; identical to SEQ ID NO: 106792

SEQ ID NO: 150479 - RNA, 64 nt, hsa; identical to SEQ ID NO: 106793

SEQ ID NO: 150480 - RNA, 64 nt, hsa; identical to SEQ ID NO: 106794

SEQ ID NO: 150481 - RNA, 64 nt, hsa; identical to SEQ ID NO: 106795

SEQ ID NO: 150482 - RNA, 64 nt, hsa; identical to SEQ ID NO: 106796

SEQ ID NO: 150483 - RNA, 64 nt, hsa; identical to SEQ ID NO: 106797

SEQ ID NO: 150484 - RNA, 64 nt, hsa; identical to SEQ ID NO: 106798

SEQ ID NO: 150485 - RNA, 64 nt, hsa; identical to SEQ ID NO: 106799

SEQ ID NO: 150486 - RNA, 64 nt, hsa; identical to SEQ ID NO: 106800

SEQ ID NO: 150487 - RNA, 64 nt, hsa; identical to SEQ ID NO: 106801

SEQ ID NO: 150488 - RNA, 64 nt, hsa; identical to SEQ ID NO: 106802

SEQ ID NO: 150489 - RNA, 64 nt, hsa; identical to SEQ ID NO: 106803

SEQ ID NO: 150490 - RNA, 64 nt, hsa; identical to SEQ ID NO: 106804

SEQ ID NO: 150491 - RNA, 64 nt, hsa; identical to SEQ ID NO: 106805

SEQ ID NO: 150492 - RNA, 64 nt, hsa; identical to SEQ ID NO: 106806

SEQ ID NO: 150493 - RNA, 64 nt, hsa; identical to SEQ ID NO: 106807

SEQ ID NO: 150494 - RNA, 64 nt, hsa; identical to SEQ ID NO: 106808

SEQ ID NO: 150495 - RNA, 64 nt, hsa; identical to SEQ ID NO: 106809

SEQ ID NO: 150496 - RNA, 64 nt, hsa; identical to SEQ ID NO: 106810

SEQ ID NO: 150497 - RNA, 64 nt, hsa; identical to SEQ ID NO: 106811

SEQ ID NO: 150498 - RNA, 64 nt, hsa; identical to SEQ ID NO: 106812

SEQ ID NO: 150499 - RNA, 64 nt, hsa; identical to SEQ ID NO: 106813

SEQ ID NO: 150500 - RNA, 64 nt, hsa; identical to SEQ ID NO: 106814

SEQ ID NO: 150501 - RNA, 64 nt, hsa; identical to SEQ ID NO: 106815

SEQ ID NO: 150502 - RNA, 64 nt, hsa; identical to SEQ ID NO: 106816

SEQ ID NO: 150503 - RNA, 64 nt, hsa; identical to SEQ ID NO: 106817

SEQ ID NO: 150504 - RNA, 64 nt, hsa; identical to SEQ ID NO: 106818

SEQ ID NO: 150505 - RNA, 64 nt, hsa; identical to SEQ ID NO: 106819

SEQ ID NO: 150506 - RNA, 64 nt, hsa; identical to SEQ ID NO: 106820

SEQ ID NO: 150507 - RNA, 64 nt, hsa; identical to SEQ ID NO: 106821

SEQ ID NO: 150508 - RNA, 64 nt, hsa; identical to SEQ ID NO: 106822

SEQ ID NO: 150509 - RNA, 64 nt, hsa; identical to SEQ ID NO: 106823

SEQ ID NO: 150510 - RNA, 64 nt, hsa; identical to SEQ ID NO: 106824

SEQ ID NO: 150511 - RNA, 64 nt, hsa; identical to SEQ ID NO: 106825

SEQ ID NO: 150512 - RNA, 64 nt, hsa; identical to SEQ ID NO: 106826

SEQ ID NO: 150513 - RNA, 64 nt, hsa; identical to SEQ ID NO: 106827

SEQ ID NO: 150514 - RNA, 64 nt, hsa; identical to SEQ ID NO: 106828

SEQ ID NO: 150515 - RNA, 64 nt, hsa; identical to SEQ ID NO: 106829

SEQ ID NO: 150516 - RNA, 64 nt, hsa; identical to SEQ ID NO: 106830

SEQ ID NO: 150517 - RNA, 64 nt, hsa; identical to SEQ ID NO: 106831

SEQ ID NO: 150518 - RNA, 64 nt, hsa; identical to SEQ ID NO: 106832

SEQ ID NO: 150519 - RNA, 64 nt, hsa; identical to SEQ ID NO: 106833

SEQ ID NO: 150520 - RNA, 64 nt, hsa; identical to SEQ ID NO: 106834

SEQ ID NO: 150521 - RNA, 64 nt, hsa; identical to SEQ ID NO: 106835

SEQ ID NO: 150522 - RNA, 64 nt, hsa; identical to SEQ ID NO: 106836

SEQ ID NO: 150523 - RNA, 64 nt, hsa; identical to SEQ ID NO: 106837

SEQ ID NO: 150524 - RNA, 64 nt, hsa; identical to SEQ ID NO: 106838

SEQ ID NO: 150525 - RNA, 64 nt, hsa; identical to SEQ ID NO: 106839

SEQ ID NO: 150526 - RNA, 64 nt, hsa; identical to SEQ ID NO: 106840

SEQ ID NO: 150527 - RNA, 64 nt, hsa; identical to SEQ ID NO: 106841

SEQ ID NO: 150528 - RNA, 64 nt, hsa; identical to SEQ ID NO: 106842

SEQ ID NO: 150529 - RNA, 64 nt, hsa; identical to SEQ ID NO: 106843

SEQ ID NO: 150530 - RNA, 64 nt, hsa; identical to SEQ ID NO: 106844

SEQ ID NO: 150531 - RNA, 64 nt, hsa; identical to SEQ ID NO: 106845

SEQ ID NO: 150532 - RNA, 64 nt, hsa; identical to SEQ ID NO: 106846

SEQ ID NO: 150533 - RNA, 64 nt, hsa; identical to SEQ ID NO: 106847

SEQ ID NO: 150534 - RNA, 64 nt, hsa; identical to SEQ ID NO: 106848

SEQ ID NO: 150535 - RNA, 64 nt, hsa; identical to SEQ ID NO: 106849

SEQ ID NO: 150536 - RNA, 64 nt, hsa; identical to SEQ ID NO: 106850

SEQ ID NO: 150537 - RNA, 64 nt, hsa; identical to SEQ ID NO: 106851

SEQ ID NO: 150538 - RNA, 64 nt, hsa; identical to SEQ ID NO: 106852

SEQ ID NO: 150539 - RNA, 64 nt, hsa; identical to SEQ ID NO: 106853

SEQ ID NO: 150540 - RNA, 64 nt, hsa; identical to SEQ ID NO: 106854

SEQ ID NO: 150541 - RNA, 64 nt, hsa; identical to SEQ ID NO: 106855

SEQ ID NO: 150542 - RNA, 64 nt, hsa; identical to SEQ ID NO: 106856

SEQ ID NO: 150543 - RNA, 64 nt, hsa; identical to SEQ ID NO: 106857

SEQ ID NO: 150544 - RNA, 64 nt, hsa; identical to SEQ ID NO: 106858

SEQ ID NO: 150545 - RNA, 64 nt, hsa; identical to SEQ ID NO: 106859

SEQ ID NO: 150546 - RNA, 64 nt, hsa; identical to SEQ ID NO: 106860

SEQ ID NO: 150547 - RNA, 64 nt, hsa; identical to SEQ ID NO: 106861

SEQ ID NO: 150548 - RNA, 64 nt, hsa; identical to SEQ ID NO: 106862

SEQ ID NO: 150549 - RNA, 64 nt, hsa; identical to SEQ ID NO: 106863

SEQ ID NO: 150550 - RNA, 64 nt, hsa; identical to SEQ ID NO: 106864

SEQ ID NO: 150551 - RNA, 64 nt, hsa; identical to SEQ ID NO: 106865

SEQ ID NO: 150552 - RNA, 64 nt, hsa; identical to SEQ ID NO: 106866

SEQ ID NO: 150553 - RNA, 64 nt, hsa; identical to SEQ ID NO: 106867

SEQ ID NO: 150554 - RNA, 64 nt, hsa; identical to SEQ ID NO: 106868

SEQ ID NO: 150555 - RNA, 54 nt, hsa; identical to SEQ ID NO: 106869

SEQ ID NO: 150556 - RNA, 64 nt, hsa; identical to SEQ ID NO: 106870

SEQ ID NO: 150557 - RNA, 64 nt, hsa; identical to SEQ ID NO: 106871

SEQ ID NO: 150558 - RNA, 64 nt, hsa; identical to SEQ ID NO: 106872

SEQ ID NO: 150559 - RNA, 64 nt, hsa; identical to SEQ ID NO: 106873

SEQ ID NO: 150560 - RNA, 60 nt, hsa; identical to SEQ ID NO: 106874

SEQ ID NO: 150561 - RNA, 64 nt, hsa; identical to SEQ ID NO: 106875

SEQ ID NO: 150562 - RNA, 64 nt, hsa; identical to SEQ ID NO: 106876

SEQ ID NO: 150563 - RNA, 64 nt, hsa; identical to SEQ ID NO: 106877

SEQ ID NO: 150564 - RNA, 64 nt, hsa; identical to SEQ ID NO: 106878

SEQ ID NO: 150565 - RNA, 64 nt, hsa; identical to SEQ ID NO: 106879

SEQ ID NO: 150566 - RNA, 64 nt, hsa; identical to SEQ ID NO: 106880

SEQ ID NO: 150567 - RNA, 64 nt, hsa; identical to SEQ ID NO: 106881

SEQ ID NO: 150568 - RNA, 64 nt, hsa; identical to SEQ ID NO: 106882

SEQ ID NO: 150569 - RNA, 64 nt, hsa; identical to SEQ ID NO: 106883

SEQ ID NO: 150570 - RNA, 64 nt, hsa; identical to SEQ ID NO: 106884

SEQ ID NO: 150571 - RNA, 64 nt, hsa; identical to SEQ ID NO: 106885

SEQ ID NO: 150572 - RNA, 64 nt, hsa; identical to SEQ ID NO: 106886

SEQ ID NO: 150573 - RNA, 64 nt, hsa; identical to SEQ ID NO: 106887

SEQ ID NO: 150574 - RNA, 64 nt, hsa; identical to SEQ ID NO: 106888

SEQ ID NO: 150575 - RNA, 64 nt, hsa; identical to SEQ ID NO: 106889

SEQ ID NO: 150576 - RNA, 64 nt, hsa; identical to SEQ ID NO: 106890

SEQ ID NO: 150577 - RNA, 64 nt, hsa; identical to SEQ ID NO: 106891

SEQ ID NO: 150578 - RNA, 64 nt, hsa; identical to SEQ ID NO: 106892

SEQ ID NO: 150579 - RNA, 64 nt, hsa; identical to SEQ ID NO: 106893

SEQ ID NO: 150580 - RNA, 64 nt, hsa; identical to SEQ ID NO: 106894

SEQ ID NO: 150581 - RNA, 64 nt, hsa; identical to SEQ ID NO: 106895

SEQ ID NO: 150582 - RNA, 64 nt, hsa; identical to SEQ ID NO: 106896

SEQ ID NO: 150583 - RNA, 64 nt, hsa; identical to SEQ ID NO: 106897

SEQ ID NO: 150584 - RNA, 64 nt, hsa; identical to SEQ ID NO: 106898

SEQ ID NO: 150585 - RNA, 64 nt, hsa; identical to SEQ ID NO: 106899

SEQ ID NO: 150586 - RNA, 64 nt, hsa; identical to SEQ ID NO: 106900

SEQ ID NO: 150587 - RNA, 64 nt, hsa; identical to SEQ ID NO: 106901

SEQ ID NO: 150588 - RNA, 64 nt, hsa; identical to SEQ ID NO: 106902

SEQ ID NO: 150589 - RNA, 64 nt, hsa; identical to SEQ ID NO: 106903

SEQ ID NO: 150590 - RNA, 64 nt, hsa; identical to SEQ ID NO: 106904

SEQ ID NO: 150591 - RNA, 64 nt, hsa; identical to SEQ ID NO: 106905

SEQ ID NO: 150592 - RNA, 64 nt, hsa; identical to SEQ ID NO: 106906

SEQ ID NO: 150593 - RNA, 64 nt, hsa; identical to SEQ ID NO: 106907

SEQ ID NO: 150594 - RNA, 64 nt, hsa; identical to SEQ ID NO: 106908

SEQ ID NO: 150595 - RNA, 64 nt, hsa; identical to SEQ ID NO: 106909

SEQ ID NO: 150596 - RNA, 64 nt, hsa; identical to SEQ ID NO: 106910

SEQ ID NO: 150597 - RNA, 64 nt, hsa; identical to SEQ ID NO: 106911

SEQ ID NO: 150598 - RNA, 64 nt, hsa; identical to SEQ ID NO: 106912

SEQ ID NO: 150599 - RNA, 64 nt, hsa; identical to SEQ ID NO: 106913

SEQ ID NO: 150600 - RNA, 64 nt, hsa; identical to SEQ ID NO: 106914

SEQ ID NO: 150601 - RNA, 64 nt, hsa; identical to SEQ ID NO: 106915

SEQ ID NO: 150602 - RNA, 64 nt, hsa; identical to SEQ ID NO: 106916

SEQ ID NO: 150603 - RNA, 64 nt, hsa; identical to SEQ ID NO: 106917

SEQ ID NO: 150604 - RNA, 64 nt, hsa; identical to SEQ ID NO: 106918

SEQ ID NO: 150605 - RNA, 64 nt, hsa; identical to SEQ ID NO: 106919

SEQ ID NO: 150606 - RNA, 64 nt, hsa; identical to SEQ ID NO: 106920

SEQ ID NO: 150607 - RNA, 64 nt, hsa; identical to SEQ ID NO: 106921

SEQ ID NO: 150608 - RNA, 64 nt, hsa; identical to SEQ ID NO: 106922

SEQ ID NO: 150609 - RNA, 64 nt, hsa; identical to SEQ ID NO: 106923

SEQ ID NO: 150610 - RNA, 64 nt, hsa; identical to SEQ ID NO: 106924

SEQ ID NO: 150611 - RNA, 64 nt, hsa; identical to SEQ ID NO: 106925

SEQ ID NO: 150612 - RNA, 64 nt, hsa; identical to SEQ ID NO: 106926

SEQ ID NO: 150613 - RNA, 64 nt, hsa; identical to SEQ ID NO: 106927

SEQ ID NO: 150614 - RNA, 64 nt, hsa; identical to SEQ ID NO: 106928

SEQ ID NO: 150615 - RNA, 64 nt, hsa; identical to SEQ ID NO: 106929

SEQ ID NO: 150616 - RNA, 64 nt, hsa; identical to SEQ ID NO: 106930

SEQ ID NO: 150617 - RNA, 64 nt, hsa; identical to SEQ ID NO: 106931

SEQ ID NO: 150618 - RNA, 64 nt, hsa; identical to SEQ ID NO: 106932

SEQ ID NO: 150619 - RNA, 64 nt, hsa; identical to SEQ ID NO: 106933

SEQ ID NO: 150620 - RNA, 64 nt, hsa; identical to SEQ ID NO: 106934

SEQ ID NO: 150621 - RNA, 64 nt, hsa; identical to SEQ ID NO: 106935

SEQ ID NO: 150622 - RNA, 64 nt, hsa; identical to SEQ ID NO: 106936

SEQ ID NO: 150623 - RNA, 64 nt, hsa; identical to SEQ ID NO: 106937

SEQ ID NO: 150624 - RNA, 64 nt, hsa; identical to SEQ ID NO: 106938

SEQ ID NO: 150625 - RNA, 64 nt, hsa; identical to SEQ ID NO: 106939

SEQ ID NO: 150626 - RNA, 64 nt, hsa; identical to SEQ ID NO: 106940

SEQ ID NO: 150627 - RNA, 64 nt, hsa
aacacuggcacacacaaaaaaguaguuuuaagcuuguuugcacaguucuuuuuuuccauuggaa

SEQ ID NO: 150628 - RNA, 64 nt, hsa
aguuuauuuauaaccuguuauaagugcuauauucuguuugcaguuaggaaaugcagaauucaaa

SEQ ID NO: 150629 - RNA, 64 nt, hsa
cagaugcacuaaaacaaagaaaugguaaaugaauuguuugcauuuaaaaaaaaaaacucuuaag

SEQ ID NO: 150630 - RNA, 64 nt, hsa
aaaacuguacuaaaucugaaucauguuuugagcuuguuugcaguacuuuuaaacauuauucacu

SEQ ID NO: 150631 - RNA, 64 nt, hsa
uccccagcuacuucuuauaccacuauucuuuuaauguuugcauaaucauaagcaccucaacacu

SEQ ID NO: 150632 - RNA, 64 nt, hsa
ccuuaaaaagcugccaugguggucaaauggcauguguuugcacaaaaaugaccgauguguuuaa

SEQ ID NO: 150633 - RNA, 64 nt, hsa
ugggcuagugagaguuggugcaaauucuuguguguguuugcauaggaaggugagaugaccaucu

SEQ ID NO: 150634 - RNA, 64 nt, hsa
aaaaauugagauaaacauuuuguucaccauuaaauguuugcaucugcagucuaugaugagaaac

SEQ ID NO: 150635 - RNA, 64 nt, hsa
acuccugggauuuuguuucccaucucuuucuagguguuugcaauguacaaauaauacagcugug

SEQ ID NO: 150636 - RNA, 64 nt, hsa
caaaauguuccaagcacuuuaggcagacaccagcuguuugcaaacaaugugcuaauaugcaaau

SEQ ID NO: 150637 - RNA, 64 nt, hsa
uagucauuuuccuaacuucagggcuuggaggugguguuugcacugcuuuuuguagagaggguca

SEQ ID NO: 150638 - RNA, 64 nt, hsa
auacuuuugaaguguauuuuaucuuuauauaguuuguuugcaagaguauuuuccuaauaacuuc

SEQ ID NO: 150639 - RNA, 64 nt, hsa
cuaaaauagauauuaagcugcuguuguaaaguauuguuugcagcucuuuccaauaucuagagac

SEQ ID NO: 150640 - RNA, 64 nt, hsa
uucaggaggcauuggugauguucggcucacauauuguuugcagacacacaagaaaucuggcuug

SEQ ID NO: 150641 - RNA, 64 nt, hsa
auucuuacaaaguauuuuuuuaccuguuaugcccuguuugcaaaaacaauuuagaaaaaaacaa

SEQ ID NO: 150642 - RNA, 64 nt, hsa
auauuccauauuugccugauuuuacuauucgguguguuugcauagauguugcuacuuggugggu

SEQ ID NO: 150643 - RNA, 64 nt, hsa
cggcgugcaaugguaauuauaaauuggugaugcuuguuugcaaauugcccacucgugauaaguc

SEQ ID NO: 150644 - RNA, 64 nt, hsa
auaccagagaagauguuuaguagcaauuaaaggcuguuugcaccuuuaaggaccagcugggcug

SEQ ID NO: 150645 - RNA, 64 nt, hsa
auuauguuuuuacaaaauaaugacauaugucacauguuugcauguuuguuugcuuguugaauuu

SEQ ID NO: 150646 - RNA, 64 nt, hsa
gcacauauuuguuguaauacggugguuuauuucauguuugcauacuauaaaaucugaauugaug

SEQ ID NO: 150647 - RNA, 64 nt, hsa
aacagaauguacacauuauagcagcucgccauuguguuugcauuuuuuaagaaguacauuuuua

SEQ ID NO: 150648 - RNA, 64 nt, hsa
caauuuucggagaaaagaacagcagcucuuuaaguguuugcauuuucuauuuggggggcaggga

SEQ ID NO: 150649 - RNA, 64 nt, hsa
uggcaaagucuuggcagugguacauuauucaucguguuugcauucuuguuaauuuuuuuuuugg

SEQ ID NO: 150650 - RNA, 64 nt, hsa
acauuguuaucaauucaucaguaaggucagaugcuguuugcacaccuccagcaauagggugcuc

SEQ ID NO: 150651 - RNA, 64 nt, hsa
uccacaacagcccuaugaggguggcucccuuuguuguuugcauuuuaaggaacugggagugagg

SEQ ID NO: 150652 - RNA, 64 nt, hsa
ccugcucuucuaccauuugaauuuguguagaggguguuugcagagcaaugcccguaaugcuuag

SEQ ID NO: 150653 - RNA, 64 nt, hsa
accuacaaugcuggcuuucucccacugaguuugcuguuugcaauuuuuccaugaaguuugaacu

SEQ ID NO: 150654 - RNA, 64 nt, hsa
cggaacaggcuuuuuugcuuugggcucugcuauuuguuugcagaacacccaagagcgagcaaac

SEQ ID NO: 150655 - RNA, 64 nt, hsa
aagcauuugggccagugcacuguuuacuuccaucuguuugcagacacauuugugcccggcguuu

SEQ ID NO: 150656 - RNA, 64 nt, hsa
aguuuauuuguugagagugugaccaaaaguuacauguuugcaccuuucuaguugaaaauaaagu

SEQ ID NO: 150657 - RNA, 64 nt, hsa
ugcucagauagaaugacaguccgucaaaacagauuguuugcaaaggggaggcaucaguguccuu

SEQ ID NO: 150658 - RNA, 64 nt, hsa
uagacacuucccugcauuaacugcacaaacaauauguuugcaaacuuguuagaucaaccuccaa

SEQ ID NO: 150659 - RNA, 64 nt, hsa
augggaggaaaacucaguaagaauuauauuagucuguuugcaaaguagaaaaagauucucauca

SEQ ID NO: 150660 - RNA, 64 nt, hsa
guaagggcacaaacuucacuuagggcaucgcagauguuugcagaaugguuggccuaaugauuau

SEQ ID NO: 150661 - RNA, 64 nt, hsa
cuuaguggugcccacaguuggagcccaggggccauguuugcaaacugauucaugugcauggcug

SEQ ID NO: 150662 - RNA, 64 nt, hsa
auacgaagggcucuuuugaagcuucaguauaccauguuugcauaguuuaucuuuaaaaacaacu

SEQ ID NO: 150663 - RNA, 64 nt, hsa
ugaauuauguaucccuucucuuuugguuuucucuuguuugcagucugcucaguuguuuuaugua

SEQ ID NO: 150664 - RNA, 64 nt, hsa
agucucaauuaacagcagaaucucagagaaaagcuguuugcaauccaaauccagccuuuggagg

SEQ ID NO: 150665 - RNA, 64 nt, hsa
uuaucuuuauuuuaaaauguauguuuccccucacuguuugcagcucccaauguugucauuuuua

SEQ ID NO: 150666 - RNA, 64 nt, hsa
guaacauuauaacuaaaaugcauuccugcaauucuguuugcagugcuucacuaaacauugaaau

SEQ ID NO: 150667 - RNA, 64 nt, hsa
cucuuaccuagagcauucaaagccuggcugucucuguuugcacauguaacagaugcagaacugu

SEQ ID NO: 150668 - RNA, 64 nt, hsa
ugccgccccccucaucuccacccucccccauaucuguuugcauuaggaguuccacgaccauggu

SEQ ID NO: 150669 - RNA, 64 nt, hsa
aguaagauuggaacccagacuugcaguccagcgcuguuugcauuaaaagggugggugagucagg

SEQ ID NO: 150670 - RNA, 64 nt, hsa
guagaaccagggccggguaucaauuauugcuugcuguuugcaaccaggcauaaaaucacuuucu

SEQ ID NO: 150671 - RNA, 64 nt, hsa
uguguguguguguguguguguguguguguguguguguuugcagacaugcaaaacugcagcugaa

SEQ ID NO: 150672 - RNA, 64 nt, hsa
ucuaguauguuuaggguucuguguucagauauuuuguuugcacacuacuuuuuaggaaacuuau

SEQ ID NO: 150673 - RNA, 64 nt, hsa
uguguguggggguguguguguguguguguguguauguuugcauauuauagcucucuuuaagaca

SEQ ID NO: 150674 - RNA, 64 nt, hsa
gauucacauacgugccacuguuugaaaucuggucuguuugcauuucuguuaugacagagagaug

SEQ ID NO: 150675 - RNA, 64 nt, hsa
gucuguuugcauuucuguuaugacagagagaugauguuugcauuucuguuaugacagagagaug

SEQ ID NO: 150676 - RNA, 64 nt, hsa
auugcuucucauucucaucagacucuccuuguuuuguuugcauauuuaauuuuaaauuaaacca

SEQ ID NO: 150677 - RNA, 64 nt, hsa
uacaagacaauguucucuaagaacugagccuagauguuugcaguauugaacccauaaaugauaa

SEQ ID NO: 150678 - RNA, 64 nt, hsa
uuccaaaauguaugcucaacaauaaucauuaaaauguuugcagcguacagaacugugucaugug

SEQ ID NO: 150679 - RNA, 64 nt, hsa
aaaugccauacuaugaagaucaaagucuuaaguguguuugcagcucaaaaauaaagauguauua

SEQ ID NO: 150680 - RNA, 64 nt, hsa
uuaaaaguacccuuuugugugaauugacuaccguuguuugcaaacccgaaaauaaaagacguuc

SEQ ID NO: 150681 - RNA, 64 nt, hsa
acaugcacacacacacgcuuucuuaugcaaucuauguuugcacuugugcuuucaguuagccuuc

SEQ ID NO: 150682 - RNA, 64 nt, hsa
aaaagucaaccagaaaacuguuaugccuuuuauuuguuugcaaggaugucuuuguaauguguuu

SEQ ID NO: 150683 - RNA, 64 nt, hsa
guuaugcucuuaaugcuuaaaagaaggcuagcauuguuugcacaaaaaguuggugauucccacc

SEQ ID NO: 150684 - RNA, 64 nt, hsa
ccuuaccccagggccagacagcauccaucccugcuguuugcaucugagagcagcauggggccug

SEQ ID NO: 150685 - RNA, 64 nt, hsa
ggguuggugcaaccucaguacacgcauuugucuuuguuugcaaaccuuucucagagcgacauau

SEQ ID NO: 150686 - RNA, 64 nt, hsa
gaaguguguugcucuuucaaguucuaucacuuuuuguuugcaaaguucaaagcuguauuguuug

SEQ ID NO: 150687 - RNA, 64 nt, hsa
uguucucauagugacuccugcauauuuugauuaauguuugcaugguuaauauuucuucauuuua

SEQ ID NO: 150688 - RNA, 64 nt, hsa
cugcccaucucuucuccaccuucucuccacagaauguuugcagagcugggcaguugaggaaagg

SEQ ID NO: 150689 - RNA, 64 nt, hsa
aucaaaggucuuccugcacuugaagcuggggcgauguuugcagucaagaccauucuuuccaacc

SEQ ID NO: 150690 - RNA, 64 nt, hsa
agguuuuuuucuuucugugcucuguagaucucauuguuugcacuuguaauuucccagaguugaa

SEQ ID NO: 150691 - RNA, 64 nt, hsa
cucucuuauuugcucuaguguacuaguccaguaguguuugcauguggaugucuguggaugacag

SEQ ID NO: 150692 - RNA, 64 nt, hsa
ggcugcaguuucaacagcuagauauccuggauauuguuugcaccauccauugucccuguaccag

SEQ ID NO: 150693 - RNA, 64 nt, hsa
uuuaaaaucagccagcuccaugcccaaaccuuccuguuugcagaacuuuuuaaugucuuuucuu

SEQ ID NO: 150694 - RNA, 64 nt, hsa
gcuuguguccaggugugacuuguaaacugucuaguguuugcauuaaauaaaauggcaccgagca

SEQ ID NO: 150695 - RNA, 64 nt, hsa
ugacuggacaugccuggaagaccccucagccuucuguuugcagaacguucauuucaggagcuuc

SEQ ID NO: 150696 - RNA, 64 nt, hsa
uuuaugguauaguugaacccaguggcagauuguacacugcuagcacugcuagcacacaguagca

SEQ ID NO: 150697 - RNA, 64 nt, hsa
uaguugaacccaguggcagauuguacacugcuagcacugcuagcacacaguagcaaagcaaaca

SEQ ID NO: 150698 - RNA, 64 nt, hsa
caggccagcuggagaagcuuccagaagggcccugcacugcuacccucuauuucccacucagggc

SEQ ID NO: 150699 - RNA, 64 nt, hsa
cuaaagcuuaucuguaauucaccuccuuuuccaccacugcuaccuuaugugagcccucauugcc

SEQ ID NO: 150700 - RNA, 64 nt, hsa; identical to SEQ ID NO: 98228

SEQ ID NO: 150701 - RNA, 64 nt, hsa; identical to SEQ ID NO: 98229

SEQ ID NO: 150702 - RNA, 64 nt, hsa; identical to SEQ ID NO: 98230

SEQ ID NO: 150703 - RNA, 64 nt, hsa; identical to SEQ ID NO: 98231

SEQ ID NO: 150704 - RNA, 64 nt, hsa; identical to SEQ ID NO: 98232

SEQ ID NO: 150705 - RNA, 64 nt, hsa; identical to SEQ ID NO: 98233

SEQ ID NO: 150706 - RNA, 64 nt, hsa; identical to SEQ ID NO: 98234

SEQ ID NO: 150707 - RNA, 64 nt, hsa; identical to SEQ ID NO: 98235

SEQ ID NO: 150708 - RNA, 64 nt, hsa; identical to SEQ ID NO: 98236

SEQ ID NO: 150709 - RNA, 64 nt, hsa; identical to SEQ ID NO: 98237

SEQ ID NO: 150710 - RNA, 64 nt, hsa; identical to SEQ ID NO: 98238

SEQ ID NO: 150711 - RNA, 64 nt, hsa; identical to SEQ ID NO: 98239

SEQ ID NO: 150712 - RNA, 64 nt, hsa; identical to SEQ ID NO: 98240

SEQ ID NO: 150713 - RNA, 64 nt, hsa; identical to SEQ ID NO: 98241

SEQ ID NO: 150714 - RNA, 64 nt, hsa; identical to SEQ ID NO: 98242

SEQ ID NO: 150715 - RNA, 64 nt, hsa; identical to SEQ ID NO: 98243

SEQ ID NO: 150716 - RNA, 64 nt, hsa; identical to SEQ ID NO: 98244

SEQ ID NO: 150717 - RNA, 64 nt, hsa; identical to SEQ ID NO: 98245

SEQ ID NO: 150718 - RNA, 64 nt, hsa; identical to SEQ ID NO: 98246

SEQ ID NO: 150719 - RNA, 64 nt, hsa; identical to SEQ ID NO: 98247

SEQ ID NO: 150720 - RNA, 64 nt, hsa; identical to SEQ ID NO: 98248

SEQ ID NO: 150721 - RNA, 64 nt, hsa; identical to SEQ ID NO: 98249

SEQ ID NO: 150722 - RNA, 64 nt, hsa; identical to SEQ ID NO: 98250

SEQ ID NO: 150723 - RNA, 64 nt, hsa; identical to SEQ ID NO: 98251

SEQ ID NO: 150724 - RNA, 64 nt, hsa; identical to SEQ ID NO: 98252

SEQ ID NO: 150725 - RNA, 64 nt, hsa; identical to SEQ ID NO: 98253

SEQ ID NO: 150726 - RNA, 64 nt, hsa; identical to SEQ ID NO: 98254

SEQ ID NO: 150727 - RNA, 64 nt, hsa; identical to SEQ ID NO: 98255

SEQ ID NO: 150728 - RNA, 64 nt, hsa; identical to SEQ ID NO: 98256

SEQ ID NO: 150729 - RNA, 64 nt, hsa; identical to SEQ ID NO: 98257

SEQ ID NO: 150730 - RNA, 64 nt, hsa; identical to SEQ ID NO: 98258

SEQ ID NO: 150731 - RNA, 64 nt, hsa; identical to SEQ ID NO: 98259

SEQ ID NO: 150732 - RNA, 64 nt, hsa; identical to SEQ ID NO: 98260

SEQ ID NO: 150733 - RNA, 64 nt, hsa; identical to SEQ ID NO: 98261

SEQ ID NO: 150734 - RNA, 64 nt, hsa; identical to SEQ ID NO: 98262

SEQ ID NO: 150735 - RNA, 64 nt, hsa; identical to SEQ ID NO: 98263

SEQ ID NO: 150736 - RNA, 64 nt, hsa; identical to SEQ ID NO: 98264

SEQ ID NO: 150737 - RNA, 64 nt, hsa
gcuuauuuaugugaaaaggguuauuuuuacuuagcuuagcuaugucagccaauccgauugccuu

SEQ ID NO: 150738 - RNA, 64 nt, hsa
cuaccuguaggaucagggucuaagcaccuuggugcuuagcuagaauaccaccuaauccuucugg

SEQ ID NO: 150739 - RNA, 64 nt, hsa
aggaacaauauuggguguuugggagccagaaagcuuuguugacagaucagaaauaagauugacu

SEQ ID NO: 150740 - RNA, 64 nt, hsa
uauaacccugguuuugugauaaaacugcuuagauuuuguugaugacauuagauuaguaguugca

SEQ ID NO: 150741 - RNA, 64 nt, hsa
aaaugcugaauuauugaaccauguuuuuuuuuccuuuguugaaaaaaauaaaccagggugauuu

SEQ ID NO: 150742 - RNA, 64 nt, hsa
acuugcuuuuuacgcacauugugauagagcaucuuuuguugacucacguaaccuccaugugugg

SEQ ID NO: 150743 - RNA, 64 nt, hsa
ucaaguuauucaaauuuguacaggacuguaaagauuuguugacagcaaaauguugaagaaaaaa

SEQ ID NO: 150744 - RNA, 64 nt, hsa
uucagucuuguagugugugcuuacaguaacuaauuuuguugaaaaugguuucaaguuauucaaa

SEQ ID NO: 150745 - RNA, 64 nt, hsa
cuuuguucuguuauauuguugguuguucauaguuuuuguugaagcucuagcuuaagaagaaacu

SEQ ID NO: 150746 - RNA, 64 nt, hsa
cuacuucauuuuaauuguauauuauucaagcaccuuuguugaagcucaaaaaaaaugaugccuc

SEQ ID NO: 150747 - RNA, 64 nt, hsa
uggggcccagcacagcagccugcaagggccccuguuuguugaugcagcuuuuguugaacaaaaa

SEQ ID NO: 150748 - RNA, 64 nt, hsa
cagccugcaagggccccuguuuguugaugcagcuuuuguugaacaaaaaucgugcucuuuccug

SEQ ID NO: 150749 - RNA, 64 nt, hsa
aauucaggccugcugcugaguuaugcacagacuuuuuguugaccaaaauaaaauauaaaggguu

SEQ ID NO: 150750 - RNA, 64 nt, hsa
ggucacuuaccaguuucugugcccuuuuggagcuuuuguugagggcuucauucucacccuguau

SEQ ID NO: 150751 - RNA, 64 nt, hsa
aacacuuguaugguccuguaaaacuucucugguguuuguugacuucugccugugggucugagga

SEQ ID NO: 150752 - RNA, 64 nt, hsa
gaacccagagcccccaccccagcccaccuggcucuuuguugacagucggcgacaagguugugcg

SEQ ID NO: 150753 - RNA, 64 nt, hsa
uauauuuuugagguggucuuaguaguaauuaccauuuguugaacacauuaaugcuauacuagac

SEQ ID NO: 150754 - RNA, 64 nt, hsa
ucuuuuucucuaaugucaccugauauaaaguacuuuuguugaagugaauuauuuugauguaggc

SEQ ID NO: 150755 - RNA, 64 nt, hsa
ucugagaaucacauuugguuuguugagccuaauauuuguugagauuuugcaggacccugaucuu

SEQ ID NO: 150756 - RNA, 64 nt, hsa
gaacgcuucugcuuaaucugagaaucacauuugguuuguugagccuaauauuuguugagauuuu

SEQ ID NO: 150757 - RNA, 64 nt, hsa
agaauggauaaaaauuauuuugugaucauaacucuuuguugaacuagaguauuuuugcagcauu

SEQ ID NO: 150758 - RNA, 64 nt, hsa
ugagguaaaucuacagcauaguucauuuuuagauuuuguugaguccuguaaagaagaagaagaa

SEQ ID NO: 150759 - RNA, 64 nt, hsa
uucugcuuuguucucagugauguauaugcaacauuuuguugaaagccacgauggacuuacaagc

SEQ ID NO: 150760 - RNA, 64 nt, hsa
auugaagacauuauugugugggauugugcugauuuuuguugauaacacaaaaaacacuauguuu

SEQ ID NO: 150761 - RNA, 64 nt, hsa
uaauauucauaagguauauuuuugaauuuugguauuuguugagauugcauagaagaauaguagg

SEQ ID NO: 150762 - RNA, 64 nt, hsa
ccuggcauugccaguuuucuucauucagaaucuguuuguugaucaagugacuguccccguaaaa

SEQ ID NO: 150763 - RNA, 64 nt, hsa
aauuuggugcuauguguauaucuugagcuuuuaauuuguugaauuuucuaaacgcuuacaacuu

SEQ ID NO: 150764 - RNA, 64 nt, hsa
agcaucuuuaugaaacaggcacaguacccuuugguuuguugacuguuuugauuuuauuucuuug

SEQ ID NO: 150765 - RNA, 64 nt, hsa
aaauucugcggcaaacauuuguugaugcucaucauuuguugaugucaucaaagaucaccagggc

SEQ ID NO: 150766 - RNA, 64 nt, hsa
ggguaggugaugguagaaaauucugcggcaaacauuuguugaugcucaucauuuguugauguca

SEQ ID NO: 150767 - RNA, 64 nt, hsa
auuggguaucauuuuuguuucuugggaagcuaauuuuguugaauguuuagaauugagcaaagau

SEQ ID NO: 150768 - RNA, 64 nt, hsa
gcacagcaacucauuuauauauauauauauaggcuuuguugaugaaaaacgacaauugaagaga

SEQ ID NO: 150769 - RNA, 64 nt, hsa
ucaaagaguaucuggccauggcggacacucagcauuuguugauugaauaaauguuagcucuucu

SEQ ID NO: 150770 - RNA, 64 nt, hsa
ucuuuuugagacuguuuuugcaacaacaaaagcauuuguugacacucgugcuguuaagagauuu

SEQ ID NO: 150771 - RNA, 64 nt, hsa
uuuaggcccuuugacuaaguugauauggaaauauuuuguugaaaaacuguacagagcagcuuua

SEQ ID NO: 150772 - RNA, 64 nt, hsa
uucauuucauuacagaauuguuuauaaaaguucauuuguugaaaaauaaggauccuuuuuaaua

SEQ ID NO: 150773 - RNA, 64 nt, hsa
ugugauuccaccucuugcaccaaaucaauaucuauuuguugagcacuuauugauuaagaccuug

SEQ ID NO: 150774 - RNA, 64 nt, hsa
ugucucaugggugcuccauauauauucauauauauuuguugagugaauuaaugaauuaagagug

SEQ ID NO: 150775 - RNA, 64 nt, hsa
acucccccauuuuugguuuguuucuuuuuaaauauuuguugaguacuuacguguuuaucuaaca

SEQ ID NO: 150776 - RNA, 64 nt, hsa
ucuuggcacuggaaggguaguucuggaaagcuacuuuguugagagucucauucuucccuggagu

SEQ ID NO: 150777 - RNA, 64 nt, hsa
uguuaucuucaagagauguuaaauauuuauaugcuuuguugacuagcugaaaugugaauucugu

SEQ ID NO: 150778 - RNA, 64 nt, hsa
cauuuuucacucugauuuuuuauuucuuguauuuuuuguugagcuguuuuaacacauauugguu

SEQ ID NO: 150779 - RNA, 64 nt, hsa
ugagcuuaaaauacaagacugccauauuaaauuuuuuguugacauuagucucagugaagacuau

SEQ ID NO: 150780 - RNA, 64 nt, hsa
guaauugcaaaaaaaaaaaaaaaguugcagcuguuuuguugacauucugaaugcuucuaaguaa

SEQ ID NO: 150781 - RNA, 64 nt, hsa
ccugcauuuagucugccuuguuccuauuuugauuuuuguugagucuccugccugcuugccaaaa

SEQ ID NO: 150782 - RNA, 64 nt, hsa
uuugagugacuguaguauggauggguuuucuuguuuuguugauuauuugaggcuuuuaaaacaa

SEQ ID NO: 150783 - RNA, 64 nt, hsa
ccagugugaauauucuagcuaccaaacauuguuuuuuguugaaaaacugacuuucuguugucua

SEQ ID NO: 150784 - RNA, 64 nt, hsa
cccugagaggaguguuuauuucugaguaaggggcuuuguugaaagaggggguuagagagagcaa

SEQ ID NO: 150785 - RNA, 64 nt, hsa
ugucccaaucucugcucucucacuucucgugacauuuguugauaaucuuuacugcaaguguaau

SEQ ID NO: 150786 - RNA, 64 nt, hsa
gauaacaagaacuuagcuaguugaguccuggcuuuuuguugauuauuaagcuguguucacucua

SEQ ID NO: 150787 - RNA, 64 nt, hsa
ugggaccagaaaccaaguaauguauaauguggcuuuuguugaguuaaauaagaugcuauauaau

SEQ ID NO: 150788 - RNA, 64 nt, hsa
ggcuuuguaccuuguaccuuuuuuagccuuggcuuuuguugaacuagaacccucagcacauacu

SEQ ID NO: 150789 - RNA, 64 nt, hsa
uuaagaaacaaaagugcauaguuuagauuuuuuuuuuguugaauauguuuguucuuggacuuua

SEQ ID NO: 150790 - RNA, 64 nt, hsa
gcgugggcuuuuucucccuuuguuuaaaaugucauuuguugagcaagaguuguauaguauuauc

SEQ ID NO: 150791 - RNA, 64 nt, hsa
aaggaaaauauuuucccagcuagaaaaguauacucauucucauuuaaacucucucauuuggagg

SEQ ID NO: 150792 - RNA, 64 nt, hsa
uccuuccuuauccuuguagccaauaaaacauugacauucucacguuuuauagaugagguaaaaa

SEQ ID NO: 150793 - RNA, 64 nt, hsa
ucccagugcauuuuaaaaacagcacuggcuggggcauucucauucucugauggagccaucaaug

SEQ ID NO: 150794 - RNA, 64 nt, hsa
aguaguuucauauccuguagacauccucuuaggacauucucaaauuucaaaauaaaaaauauuc

SEQ ID NO: 150795 - RNA, 64 nt, hsa
uggaauguaaaccacaguauuuuggagugcagaacauucucaauuaagugauaaguccaaauga

SEQ ID NO: 150796 - RNA, 64 nt, hsa
aguguauaccagaggguuaguuggggaaaaacuucauucucaggaaaagacuugaaugauuaug

SEQ ID NO: 150797 - RNA, 64 nt, hsa
guucaucagucccaacaagauggccuagaaaucgcauucucaccucgccuugcugcugcuuuaa

SEQ ID NO: 150798 - RNA, 64 nt, hsa
cacauaccauucucaaucccacugaaauugcuggcauucucaaaggcagggcagagggggaucu

SEQ ID NO: 150799 - RNA, 64 nt, hsa
cugaggaucacuccaagaaaagagauccacauaccauucucaaucccacugaaauugcuggcau

SEQ ID NO: 150800 - RNA, 64 nt, hsa
agcuuagacucuaucaugggcccccaugaagcuccauucucaauacugaauaauuauuacuucc

SEQ ID NO: 150801 - RNA, 64 nt, hsa
uugacauuuccuggaguugguuuuguccuugauucauucucaugucauucugcacacagucucu

SEQ ID NO: 150802 - RNA, 64 nt, hsa
cccauguauugggcuuagucaggauugacagauacauucucagcuggccugucauauaaaacau

SEQ ID NO: 150803 - RNA, 64 nt, hsa
gacuaauacuguugguggcauaagagaaucaagccauucucaagagauaacuucauaaccagaa

SEQ ID NO: 150804 - RNA, 64 nt, hsa
cagagcagcugaaaucuugccaucaagcaacccucauucucaugccuguagguuuccauugcuc

SEQ ID NO: 150805 - RNA, 64 nt, hsa
cuucuucuuggcuuccucuuauucuuccacaaaccauucucaauaaagccaaaaaucuuucucu

SEQ ID NO: 150806 - RNA, 64 nt, hsa
cauugccaucuucugggagcuugcaagaaauguacauucucaggauccacuccagaccuauuga

SEQ ID NO: 150807 - RNA, 64 nt, hsa
aaauauauuuuuaaaagcuuuguaaaaauuaugucauucucagaauuguugucuucaaagcauu

SEQ ID NO: 150808 - RNA, 64 nt, hsa
agcagacuccaguauuggcacagucacucacugccauucucacacuauaacaagaaaagaaaug

SEQ ID NO: 150809 - RNA, 64 nt, hsa
uucacccuugccaguaaaaaccuuuccauccacccauucucagcagacuccaguauuggcacag

SEQ ID NO: 150810 - RNA, 64 nt, hsa
auguacauauauauucucacauucugaaaaauaacauucucagaauccacagaaaauauacuua

SEQ ID NO: 150811 - RNA, 64 nt, hsa
uggauuaaugcaaaagggguaauaaagacugcaacauucucaggaccaaauuaaacugcuaaaa

SEQ ID NO: 150812 - RNA, 64 nt, hsa
augggagaucuugaguugcaguccacagcauucacauucucaggauaaacaugcuugucuccau

SEQ ID NO: 150813 - RNA, 64 nt, hsa
gaaaaaaaaaagagugaccagagggcaaaggacccauucucaguaaugggagaucuugaguugc

SEQ ID NO: 150814 - RNA, 64 nt, hsa
cuaugagauugggugcaguguauccuguuagcuccauucucagggcguuugaaugugaauuagg

SEQ ID NO: 150815 - RNA, 64 nt, hsa
uuugcuuccucugaggacaucuuuuucucaccuucauucucagugauguuuuuugcuuguagua

SEQ ID NO: 150816 - RNA, 64 nt, hsa
cagagauuuuauauauauuuuguuuguaaugagccauucucaauaaacauuauucucacugcaa

SEQ ID NO: 150817 - RNA, 64 nt, hsa
gucaccuuccugaaagaugaaugagaaagcugcccauucucaagacucaucugccuagggaggg

SEQ ID NO: 150818 - RNA, 64 nt, hsa
aaaauaaugggcgcuuuggagaagaguguggagucauucucauugaauuauaaaagccagcagg

SEQ ID NO: 150819 - RNA, 64 nt, hsa
cuguuuaugcuuuuggggggcauauauuggguuccauucucaccuauccacacaacauauccgu

SEQ ID NO: 150820 - RNA, 64 nt, hsa
caggagaguagacuaggauuccuucucuuaaaaagguacauauauauggaaaaaaaucauauug

SEQ ID NO: 150821 - RNA, 64 nt, hsa
gaccaugugucaggaaaauugugaacguagaugagguacauacacugccgcuucucaaaucccc

SEQ ID NO: 150822 - RNA, 64 nt, hsa; identical to SEQ ID NO: 80933

SEQ ID NO: 150823 - RNA, 64 nt, hsa; identical to SEQ ID NO: 80934

SEQ ID NO: 150824 - RNA, 64 nt, hsa; identical to SEQ ID NO: 80935

SEQ ID NO: 150825 - RNA, 64 nt, hsa; identical to SEQ ID NO: 80936

SEQ ID NO: 150826 - RNA, 64 nt, hsa; identical to SEQ ID NO: 80937

SEQ ID NO: 150827 - RNA, 64 nt, hsa; identical to SEQ ID NO: 80938

SEQ ID NO: 150828 - RNA, 64 nt, hsa; identical to SEQ ID NO: 80939

SEQ ID NO: 150829 - RNA, 64 nt, hsa; identical to SEQ ID NO: 80940

SEQ ID NO: 150830 - RNA, 64 nt, hsa; identical to SEQ ID NO: 80941

SEQ ID NO: 150831 - RNA, 64 nt, hsa; identical to SEQ ID NO: 80942

SEQ ID NO: 150832 - RNA, 64 nt, hsa; identical to SEQ ID NO: 80943

SEQ ID NO: 150833 - RNA, 64 nt, hsa; identical to SEQ ID NO: 80944

SEQ ID NO: 150834 - RNA, 64 nt, hsa; identical to SEQ ID NO: 80945

SEQ ID NO: 150835 - RNA, 64 nt, hsa; identical to SEQ ID NO: 80946

SEQ ID NO: 150836 - RNA, 64 nt, hsa; identical to SEQ ID NO: 80947

SEQ ID NO: 150837 - RNA, 64 nt, hsa; identical to SEQ ID NO: 80948

SEQ ID NO: 150838 - RNA, 64 nt, hsa; identical to SEQ ID NO: 80949

SEQ ID NO: 150839 - RNA, 64 nt, hsa; identical to SEQ ID NO: 80950

SEQ ID NO: 150840 - RNA, 64 nt, hsa; identical to SEQ ID NO: 80951

SEQ ID NO: 150841 - RNA, 64 nt, hsa; identical to SEQ ID NO: 80952

SEQ ID NO: 150842 - RNA, 64 nt, hsa; identical to SEQ ID NO: 80953

SEQ ID NO: 150843 - RNA, 64 nt, hsa; identical to SEQ ID NO: 80954

SEQ ID NO: 150844 - RNA, 63 nt, hsa; identical to SEQ ID NO: 80955

SEQ ID NO: 150845 - RNA, 64 nt, hsa; identical to SEQ ID NO: 80956

SEQ ID NO: 150846 - RNA, 64 nt, hsa; identical to SEQ ID NO: 80957

SEQ ID NO: 150847 - RNA, 64 nt, hsa; identical to SEQ ID NO: 80958

SEQ ID NO: 150848 - RNA, 64 nt, hsa; identical to SEQ ID NO: 80959

SEQ ID NO: 150849 - RNA, 64 nt, hsa; identical to SEQ ID NO: 80960

SEQ ID NO: 150850 - RNA, 64 nt, hsa; identical to SEQ ID NO: 80961

SEQ ID NO: 150851 - RNA, 64 nt, hsa; identical to SEQ ID NO: 80962

SEQ ID NO: 150852 - RNA, 64 nt, hsa; identical to SEQ ID NO: 80963

SEQ ID NO: 150853 - RNA, 64 nt, hsa; identical to SEQ ID NO: 80964

SEQ ID NO: 150854 - RNA, 64 nt, hsa; identical to SEQ ID NO: 80965

SEQ ID NO: 150855 - RNA, 64 nt, hsa; identical to SEQ ID NO: 80966

SEQ ID NO: 150856 - RNA, 64 nt, hsa; identical to SEQ ID NO: 80967

SEQ ID NO: 150857 - RNA, 64 nt, hsa; identical to SEQ ID NO: 80968

SEQ ID NO: 150858 - RNA, 64 nt, hsa; identical to SEQ ID NO: 80969

SEQ ID NO: 150859 - RNA, 64 nt, hsa; identical to SEQ ID NO: 80970

SEQ ID NO: 150860 - RNA, 64 nt, hsa; identical to SEQ ID NO: 80971

SEQ ID NO: 150861 - RNA, 64 nt, hsa; identical to SEQ ID NO: 80972

SEQ ID NO: 150862 - RNA, 64 nt, hsa; identical to SEQ ID NO: 80973

SEQ ID NO: 150863 - RNA, 64 nt, hsa; identical to SEQ ID NO: 80974

SEQ ID NO: 150864 - RNA, 64 nt, hsa; identical to SEQ ID NO: 80975

SEQ ID NO: 150865 - RNA, 64 nt, hsa; identical to SEQ ID NO: 80976

SEQ ID NO: 150866 - RNA, 64 nt, hsa; identical to SEQ ID NO: 80977

SEQ ID NO: 150867 - RNA, 64 nt, hsa; identical to SEQ ID NO: 80978

SEQ ID NO: 150868 - RNA, 64 nt, hsa; identical to SEQ ID NO: 80979

SEQ ID NO: 150869 - RNA, 64 nt, hsa; identical to SEQ ID NO: 80980

SEQ ID NO: 150870 - RNA, 64 nt, hsa; identical to SEQ ID NO: 80981

SEQ ID NO: 150871 - RNA, 64 nt, hsa; identical to SEQ ID NO: 80982

SEQ ID NO: 150872 - RNA, 64 nt, hsa; identical to SEQ ID NO: 80983

SEQ ID NO: 150873 - RNA, 64 nt, hsa; identical to SEQ ID NO: 80984

SEQ ID NO: 150874 - RNA, 64 nt, hsa; identical to SEQ ID NO: 80985

SEQ ID NO: 150875 - RNA, 64 nt, hsa; identical to SEQ ID NO: 80986

SEQ ID NO: 150876 - RNA, 64 nt, hsa; identical to SEQ ID NO: 80987

SEQ ID NO: 150877 - RNA, 64 nt, hsa; identical to SEQ ID NO: 80988

SEQ ID NO: 150878 - RNA, 64 nt, hsa; identical to SEQ ID NO: 80989

SEQ ID NO: 150879 - RNA, 64 nt, hsa; identical to SEQ ID NO: 80990

SEQ ID NO: 150880 - RNA, 64 nt, hsa; identical to SEQ ID NO: 80991

SEQ ID NO: 150881 - RNA, 64 nt, hsa; identical to SEQ ID NO: 80992

SEQ ID NO: 150882 - RNA, 64 nt, hsa; identical to SEQ ID NO: 80993

SEQ ID NO: 150883 - RNA, 64 nt, hsa; identical to SEQ ID NO: 80994

SEQ ID NO: 150884 - RNA, 64 nt, hsa; identical to SEQ ID NO: 80995

SEQ ID NO: 150885 - RNA, 64 nt, hsa; identical to SEQ ID NO: 80996

SEQ ID NO: 150886 - RNA, 64 nt, hsa; identical to SEQ ID NO: 80997

SEQ ID NO: 150887 - RNA, 64 nt, hsa; identical to SEQ ID NO: 80998

SEQ ID NO: 150888 - RNA, 64 nt, hsa; identical to SEQ ID NO: 80999

SEQ ID NO: 150889 - RNA, 64 nt, hsa; identical to SEQ ID NO: 81000

SEQ ID NO: 150890 - RNA, 64 nt, hsa; identical to SEQ ID NO: 81001

SEQ ID NO: 150891 - RNA, 64 nt, hsa; identical to SEQ ID NO: 81002

SEQ ID NO: 150892 - RNA, 64 nt, hsa; identical to SEQ ID NO: 81003

SEQ ID NO: 150893 - RNA, 64 nt, hsa; identical to SEQ ID NO: 81004

SEQ ID NO: 150894 - RNA, 64 nt, hsa; identical to SEQ ID NO: 81005

SEQ ID NO: 150895 - RNA, 64 nt, hsa; identical to SEQ ID NO: 81006

SEQ ID NO: 150896 - RNA, 64 nt, hsa; identical to SEQ ID NO: 81007

SEQ ID NO: 150897 - RNA, 64 nt, hsa; identical to SEQ ID NO: 81008

SEQ ID NO: 150898 - RNA, 64 nt, hsa; identical to SEQ ID NO: 81009

SEQ ID NO: 150899 - RNA, 64 nt, hsa; identical to SEQ ID NO: 81010

SEQ ID NO: 150900 - RNA, 64 nt, hsa; identical to SEQ ID NO: 81011

SEQ ID NO: 150901 - RNA, 64 nt, hsa; identical to SEQ ID NO: 81012

SEQ ID NO: 150902 - RNA, 64 nt, hsa; identical to SEQ ID NO: 81013

SEQ ID NO: 150903 - RNA, 64 nt, hsa; identical to SEQ ID NO: 81014

SEQ ID NO: 150904 - RNA, 64 nt, hsa; identical to SEQ ID NO: 81015

SEQ ID NO: 150905 - RNA, 64 nt, hsa; identical to SEQ ID NO: 81016

SEQ ID NO: 150906 - RNA, 64 nt, hsa; identical to SEQ ID NO: 81017

SEQ ID NO: 150907 - RNA, 64 nt, hsa; identical to SEQ ID NO: 81018

SEQ ID NO: 150908 - RNA, 64 nt, hsa; identical to SEQ ID NO: 81019

SEQ ID NO: 150909 - RNA, 64 nt, hsa; identical to SEQ ID NO: 81020

SEQ ID NO: 150910 - RNA, 64 nt, hsa; identical to SEQ ID NO: 81021

SEQ ID NO: 150911 - RNA, 64 nt, hsa; identical to SEQ ID NO: 81022

SEQ ID NO: 150912 - RNA, 64 nt, hsa; identical to SEQ ID NO: 81023

SEQ ID NO: 150913 - RNA, 64 nt, hsa; identical to SEQ ID NO: 81024

SEQ ID NO: 150914 - RNA, 64 nt, hsa; identical to SEQ ID NO: 81025

SEQ ID NO: 150915 - RNA, 64 nt, hsa; identical to SEQ ID NO: 81026

SEQ ID NO: 150916 - RNA, 64 nt, hsa; identical to SEQ ID NO: 81027

SEQ ID NO: 150917 - RNA, 64 nt, hsa; identical to SEQ ID NO: 81028

SEQ ID NO: 150918 - RNA, 64 nt, hsa; identical to SEQ ID NO: 81029

SEQ ID NO: 150919 - RNA, 64 nt, hsa; identical to SEQ ID NO: 81030

SEQ ID NO: 150920 - RNA, 64 nt, hsa; identical to SEQ ID NO: 81031

SEQ ID NO: 150921 - RNA, 64 nt, hsa; identical to SEQ ID NO: 81032

SEQ ID NO: 150922 - RNA, 64 nt, hsa; identical to SEQ ID NO: 81033

SEQ ID NO: 150923 - RNA, 64 nt, hsa; identical to SEQ ID NO: 81034

SEQ ID NO: 150924 - RNA, 64 nt, hsa; identical to SEQ ID NO: 81035

SEQ ID NO: 150925 - RNA, 64 nt, hsa; identical to SEQ ID NO: 81036

SEQ ID NO: 150926 - RNA, 64 nt, hsa; identical to SEQ ID NO: 81037

SEQ ID NO: 150927 - RNA, 64 nt, hsa; identical to SEQ ID NO: 81038

SEQ ID NO: 150928 - RNA, 64 nt, hsa; identical to SEQ ID NO: 81039

SEQ ID NO: 150929 - RNA, 64 nt, hsa; identical to SEQ ID NO: 81040

SEQ ID NO: 150930 - RNA, 64 nt, hsa; identical to SEQ ID NO: 81041

SEQ ID NO: 150931 - RNA, 64 nt, hsa; identical to SEQ ID NO: 81042

SEQ ID NO: 150932 - RNA, 61 nt, hsa
acuuuuugaauuguugcaguguuggagaugccauuuucaccuuuuuaaaaagaugcauuuu

SEQ ID NO: 150933 - RNA, 61 nt, hsa
cgccucauucccacccccaacaaagcacuaucauuuucauuuggaauggguauuuucuguu

SEQ ID NO: 150934 - RNA, 61 nt, hsa
uauuuucuugaggaaaauauugcugugucuucauuuucauuaccagguuucauuuugggcc

SEQ ID NO: 150935 - RNA, 61 nt, hsa
ugcuucauuguuacauguaauauauuucagacauuuucacuggaagauuuaugaacagaaa

SEQ ID NO: 150936 - RNA, 61 nt, hsa
aaucccacugcauagaaauaacaagcguuaacauuuucauauuuuuuucuuucagucauuu

SEQ ID NO: 150937 - RNA, 61 nt, hsa
uaagccugucucuauuguuggaauuucaggucauuuucauaaauauuguugcaauaaauau

SEQ ID NO: 150938 - RNA, 61 nt, hsa
gcaaaacaaauggguauucuuuucauacaaccauuuucaaaugaaccuuagaaaagucuua

SEQ ID NO: 150939 - RNA, 61 nt, hsa
auugauccauuuauuuuaauggcugccuuuucauuuucaucuuuucuugcugcuacccauc

SEQ ID NO: 150940 - RNA, 61 nt, hsa
auugaaacucagaacuauauuucuaagccugcauuuucacugaugcauaauuuucuuauua

SEQ ID NO: 150941 - RNA, 61 nt, hsa
cuaccuaucaugcuguauguaucacucauuccauuuucauguuccaugcauacucgggcau

SEQ ID NO: 150942 - RNA, 61 nt, hsa
agauaaagcaaaagauaauuaggcaacaaagcauuuucaaacucaaauuccuguuuccaac

SEQ ID NO: 150943 - RNA, 61 nt, hsa
ugaacucuaagaaaaucaaccauuaaucucucauuuucaucugcaaauugaagcaacaguu

SEQ ID NO: 150944 - RNA, 61 nt, hsa
gaguuauuuaugaauuagaggcuauagcucacauuuucaauccucuauuucuuuuuuuaaa

SEQ ID NO: 150945 - RNA, 61 nt, hsa
acugugaucuuaaaaguuaccaaaccaaagucauuuucaguuugaggcaaccaaaccuuuc

SEQ ID NO: 150946 - RNA, 61 nt, hsa
acagacaaacuugauuucuucuagaagauaacauuuucaauacugucccacuucucaucuu

SEQ ID NO: 150947 - RNA, 61 nt, hsa
uucugcaacugaaauuacauauugcaggagacauuuucauaucaucaaugugacauuuaca

SEQ ID NO: 150948 - RNA, 61 nt, hsa
cacuacauuuuguuaauacugccaauaaaaucauuuucaacuuauuuuuuaaaguagguuu

SEQ ID NO: 150949 - RNA, 61 nt, hsa
ccuuucacagcaaguguuagaagaaagauaacauuuucaaauacuuagcuuuugcuuucuu

SEQ ID NO: 150950 - RNA, 61 nt, hsa
uuauaucuuuguaauuuuccugcuacuuuaucauuuucaagauguccucuaggaauuuuuu

SEQ ID NO: 150951 - RNA, 61 nt, hsa
ugagacuagacuuuacaacugucuuugauggcauuuucagaacaauaaaugucacaauccc

SEQ ID NO: 150952 - RNA, 61 nt, hsa
uccgcuggaacuaaaggauaacugcagugcucauuuucaggccucagaauaagugcacucu

SEQ ID NO: 150953 - RNA, 61 nt, hsa
uaaauaaggguaauucauuuuuuauuaaagucauuuucacguuaaguuccuauuuuuguau

SEQ ID NO: 150954 - RNA, 61 nt, hsa
ugguuguucuuaccagccacaaaguaaacuucauuuucaggcaguguuucugggggagguu

SEQ ID NO: 150955 - RNA, 61 nt, hsa
ggaaggcaaaugaagugaaaaaaaaaaaugccauuuucaauccuuccuuucuccccuuugu

SEQ ID NO: 150956 - RNA, 61 nt, hsa
cuuuugcuuacaguguuguccccaaaugggucauuuucaaggauuacucauuugaaaacac

SEQ ID NO: 150957 - RNA, 61 nt, hsa
agugugggguggggauggauuaugaugaaaucauuuucaaucuuaaaauauaauacaacaa

SEQ ID NO: 150958 - RNA, 61 nt, hsa
cuuauaacuguaauauauagauucagaaauacauuuucauuauccaaaaucagcuucaaca

SEQ ID NO: 150959 - RNA, 61 nt, hsa
uggcagaggcuacuacaaaaagcaaccuuuucauuuucacuaagaguuuaaaagcuauugu

SEQ ID NO: 150960 - RNA, 61 nt, hsa
cuaaaauauauacuacaggaaagcugcaguucauuuucaugcauggaucauuacauuuuuc

SEQ ID NO: 150961 - RNA, 61 nt, hsa
gauuuuaguuuuguuucucuuuauuuggcaacauuuucaucugaauuguauagauauauga

SEQ ID NO: 150962 - RNA, 61 nt, hsa
gaaagaugaaauaaaguauucaaaauauuaacauuuucauaaauauaaggauguauuauug

SEQ ID NO: 150963 - RNA, 61 nt, hsa
uaaaacuuauuaaauucgugugacaaauaaucauuuucaucuuggcagcaaaaaguucuca

SEQ ID NO: 150964 - RNA, 61 nt, hsa
cacuuagucauuuucuccuuuuuuuaagaaccauuuucaucugauuuuuaaacucacgaua

SEQ ID NO: 150965 - RNA, 61 nt, hsa
ccuuuuacagcguauuacuuagugaacauuacauuuucagaauagauccuaauauuuuauu

SEQ ID NO: 150966 - RNA, 61 nt, hsa
uuugacaagagaagaauuugaaggauaugaacauuuucaagaacucugcugaggucacuua

SEQ ID NO: 150967 - RNA, 61 nt, hsa
aaggauuuuuauuuuguuauaauuuaguuaccauuuucaguguuauuucaaagguucuuug

SEQ ID NO: 150968 - RNA, 61 nt, hsa
aaggccagcauuaggaaacuuguucacuuuucauuuucaaaggagccuaguugaagugcua

SEQ ID NO: 150969 - RNA, 61 nt, hsa
uagagaaauaaauggaauauacauaaauaaucauuuucagugguuuauggugggcaauauu

SEQ ID NO: 150970 - RNA, 61 nt, hsa
uuuguguuauuuuugcuugaaacaacgcacacauuuucaacaaccaaaaaaugacaauuuc

SEQ ID NO: 150971 - RNA, 61 nt, hsa
ugagaaaacuuuauuugucaaagucagaaaacauuuucaucuuauugagagauauguuuuu

SEQ ID NO: 150972 - RNA, 61 nt, hsa
ucaucugaugcaauuugcucuuauaaagagacauuuucauagguucagaguaacucaccuc

SEQ ID NO: 150973 - RNA, 61 nt, hsa
augcaucagagagccaaaacauucaguauugcauuuucacauaggugaugaaaugacuuug

SEQ ID NO: 150974 - RNA, 61 nt, hsa
uuuuuuguuacauuguuacaaguguuaaugacauuuucauuaauggaugaaaacuucaggg

SEQ ID NO: 150975 - RNA, 61 nt, hsa
aaugguaagcauuguuaauuucuguaaugaacauuuucaauuaaauuuaucuuguuugugu

SEQ ID NO: 150976 - RNA, 61 nt, hsa
cucuaaauauuuaaaaacaguucuucucaaacauuuucauucagauagcuuucugaaaguu

SEQ ID NO: 150977 - RNA, 61 nt, hsa
aauguaaaauguuauauaugcaucaguacagcauuuucaacauauuggcaacauauuuuaa

SEQ ID NO: 150978 - RNA, 61 nt, hsa
uuugaaaccacauuuuuauuguuugauguuucauuuucagacuuuuuaaugucagucauua

SEQ ID NO: 150979 - RNA, 61 nt, hsa
uugcauuauuaauuugaauagaaaauaaucacauuuucaacccauuuauacaaauuguuaa

SEQ ID NO: 150980 - RNA, 61 nt, hsa
uuuaauaucauacuaagugugagcuucuggacauuuucaagagcuuacaaaaacuaagugg

SEQ ID NO: 150981 - RNA, 61 nt, hsa
ucuguauuuuccccauauuauuuuaaauguccauuuucauuuauaggccaaauccugccag

SEQ ID NO: 150982 - RNA, 60 nt, hsa
cuguccaacagaaaagcugaauaaaaaauucauuuucauuuguugggcagaggcccaaua

SEQ ID NO: 150983 - RNA, 61 nt, hsa
ggccagacauagcaucuuguggcuuugcaaccauuuucauuuguuuguuuuccuuuuauuu

SEQ ID NO: 150984 - RNA, 61 nt, hsa
cuggaaugaguugaaaaaaugugccauuuugcauuuucaucuacucauuuaaaguauuuua

SEQ ID NO: 150985 - RNA, 61 nt, hsa
agaauaaagagaagauuugaauuuucaguuucauuuucaaaaacuauuuaccaaaacaaau

SEQ ID NO: 150986 - RNA, 61 nt, hsa
uucuuuacuaaggauacuauucaaaaauuaacauuuucaucucaguaaguuuuuagaacau

SEQ ID NO: 150987 - RNA, 61 nt, hsa
uuuggccuuuccuguuuuuaaaaaucaguuucauuuucauauuucauagaucagcuauugg

SEQ ID NO: 150988 - RNA, 61 nt, hsa
aaauuauacuaaagugagaugcauuuuuucucauuuucagcaagacuccucuaagcauuua

SEQ ID NO: 150989 - RNA, 61 nt, hsa
cgguccagaaugugacggauucgacucuauucauuuucaaauaaagccaugagccguggaa

SEQ ID NO: 150990 - RNA, 61 nt, hsa
gcuacuacgaagaaaaucuuauuuuucugaacauuuucaugaauccaggggacuugaaaau

SEQ ID NO: 150991 - RNA, 61 nt, hsa
cccuggaagacuugaucaccuuuuucugugucauuuucagucaaagagggccucucuuaca

SEQ ID NO: 150992 - RNA, 61 nt, hsa
uagagcuuaauuucuugagaaauucaacagucauuuucaccagcauaauuuuaucuuaagg

SEQ ID NO: 150993 - RNA, 61 nt, hsa
uuaaagcaggaaaaccugaaugugaugugcacauuuucaucccacauggacaauguaugug

SEQ ID NO: 150994 - RNA, 61 nt, hsa
uucacucugugguaagcugaggaauaugucacauuuucagucaaagaaccaugauuaaaaa

SEQ ID NO: 150995 - RNA, 61 nt, hsa
uaccauucuauagucaugaaccccuucagugcauuuucauuuuuuuauuaacagcaacuaa

SEQ ID NO: 150996 - RNA, 61 nt, hsa
aguauuuccagaaacauuugagagugcccaucauuuucaggucugcagaaccauagcuucc

SEQ ID NO: 150997 - RNA, 61 nt, hsa
ugucugucuguccggucuuguuuguacauuccauuuucaauuguuacagaugugaacuuua

SEQ ID NO: 150998 - RNA, 61 nt, hsa
ugaggccaucucugagcaguggacucaaaagcauuuucaggcaugucagagaagggaggac

SEQ ID NO: 150999 - RNA, 61 nt, hsa
uggaggaacuguuacauguucgguacuaagucauuuucaggggauugaaagacuauugcug

SEQ ID NO: 151000 - RNA, 61 nt, hsa
gagcuuuuaaugaagcagagagcuaguacuucauuuucacuggauacauuuucagcaucau

SEQ ID NO: 151001 - RNA, 61 nt, hsa
cagagagcuaguacuucauuuucacuggauacauuuucagcaucaugaguugucacagccu

SEQ ID NO: 151002 - RNA, 61 nt, hsa
ugaugaauuauuucugaaauuuucuauuuaacauuuucagaccacaguugaccacagguaa

SEQ ID NO: 151003 - RNA, 61 nt, hsa
uaauguguguacuucauaauaauuuuuuauccauuuucaucuuuauauucuguaacaugaa

SEQ ID NO: 151004 - RNA, 61 nt, hsa
uggccauguauccguaaguacuugcugucuucauuuucauguugcaugguucauaacauug

SEQ ID NO: 151005 - RNA, 61 nt, hsa
uuuggcaucauguuguuuuaugcuuauaaagcauuuucauaugaacagaaaguuuauauuu

SEQ ID NO: 151006 - RNA, 61 nt, hsa
uauugguuaaguugcuugcuuuugcuuuguccauuuucaucauuuuaaaaugggggauaau

SEQ ID NO: 151007 - RNA, 61 nt, hsa
auuuuuuaaaauguagaguuuguuuuggagacauuuucagugcauuguuauugccauauuu

SEQ ID NO: 151008 - RNA, 61 nt, hsa
uaaggucuuuucuuaaaaaaaaaauccaccucauuuucaguuaacaugugccauuaaauag

SEQ ID NO: 151009 - RNA, 61 nt, hsa
cauguuuacaaagaacuguuuuguauauagacauuuucaggcacgugcuuugcaccaaccc

SEQ ID NO: 151010 - RNA, 61 nt, hsa
uaguuuggcaaagcauugaaguacaaagguacauuuucaauuaaaaagcacacuucuacaa

SEQ ID NO: 151011 - RNA, 61 nt, hsa
uuuuacauuuuaaacccuauuguccuuuaugcauuuucaaugaaauggaaugaaggcuaau

SEQ ID NO: 151012 - RNA, 61 nt, hsa
aaaagcugaucaauuuuucuuccuagcuucccauuuucaaaugggacaucacucauauccc

SEQ ID NO: 151013 - RNA, 61 nt, hsa
aauuucaagucccuaauuuacucuaaccaagcauuuucagucuuacaaagaaaucuagugc

SEQ ID NO: 151014 - RNA, 61 nt, hsa
gcuuugccaagcuugugagagcugguugcuacauuuucaggauuuuuacaaguugguaaac

SEQ ID NO: 151015 - RNA, 61 nt, hsa
cucaaaucauuuaagaaggaguucugacauucauuuucauuguuuuacuuuugucuuccuc

SEQ ID NO: 151016 - RNA, 61 nt, hsa
cuuagugauuucauguuuaacaggcagcauccauuuucagaauuuccuggcauugauuuau

SEQ ID NO: 151017 - RNA, 61 nt, hsa
cuuuugucaacaauuuuguguacauauuuggcauuuucaguucuguacgcaucugcggguu

SEQ ID NO: 151018 - RNA, 61 nt, hsa
gcugauaagaaugaauauagaugcuggccagcauuuucauucauuuuaaggaaaguagcaa

SEQ ID NO: 151019 - RNA, 61 nt, hsa
auauaacacuuuccagccuauagcagaagcacauuuucagacugcaauauagagacugugu

SEQ ID NO: 151020 - RNA, 61 nt, hsa
ucaaguuugguuuuugaauagacagagguuucauuuucaucucauuagggcuuuuuuguac

SEQ ID NO: 151021 - RNA, 61 nt, hsa
ucucacccaguucagguguauagggaauuuucauuuucauuauuucaaggaauagaguuuu

SEQ ID NO: 151022 - RNA, 64 nt, hsa; identical to SEQ ID NO: 134304

SEQ ID NO: 151023 - RNA, 64 nt, hsa; identical to SEQ ID NO: 134305

SEQ ID NO: 151024 - RNA, 64 nt, hsa; identical to SEQ ID NO: 134306

SEQ ID NO: 151025 - RNA, 64 nt, hsa; identical to SEQ ID NO: 134307

SEQ ID NO: 151026 - RNA, 64 nt, hsa; identical to SEQ ID NO: 134308

SEQ ID NO: 151027 - RNA, 64 nt, hsa; identical to SEQ ID NO: 134309

SEQ ID NO: 151028 - RNA, 64 nt, hsa; identical to SEQ ID NO: 134310

SEQ ID NO: 151029 - RNA, 64 nt, hsa; identical to SEQ ID NO: 134311

SEQ ID NO: 151030 - RNA, 64 nt, hsa; identical to SEQ ID NO: 134312

SEQ ID NO: 151031 - RNA, 64 nt, hsa; identical to SEQ ID NO: 134313

SEQ ID NO: 151032 - RNA, 64 nt, hsa; identical to SEQ ID NO: 134314

SEQ ID NO: 151033 - RNA, 64 nt, hsa; identical to SEQ ID NO: 134315

SEQ ID NO: 151034 - RNA, 64 nt, hsa; identical to SEQ ID NO: 134316

SEQ ID NO: 151035 - RNA, 64 nt, hsa; identical to SEQ ID NO: 134317

SEQ ID NO: 151036 - RNA, 64 nt, hsa; identical to SEQ ID NO: 134318

SEQ ID NO: 151037 - RNA, 64 nt, hsa; identical to SEQ ID NO: 134319

SEQ ID NO: 151038 - RNA, 64 nt, hsa; identical to SEQ ID NO: 134320

SEQ ID NO: 151039 - RNA, 64 nt, hsa; identical to SEQ ID NO: 134321

SEQ ID NO: 151040 - RNA, 64 nt, hsa; identical to SEQ ID NO: 134322

SEQ ID NO: 151041 - RNA, 64 nt, hsa; identical to SEQ ID NO: 134323

SEQ ID NO: 151042 - RNA, 64 nt, hsa; identical to SEQ ID NO: 134324

SEQ ID NO: 151043 - RNA, 64 nt, hsa; identical to SEQ ID NO: 134325

SEQ ID NO: 151044 - RNA, 64 nt, hsa; identical to SEQ ID NO: 134326

SEQ ID NO: 151045 - RNA, 64 nt, hsa; identical to SEQ ID NO: 134327

SEQ ID NO: 151046 - RNA, 64 nt, hsa; identical to SEQ ID NO: 134328

SEQ ID NO: 151047 - RNA, 64 nt, hsa; identical to SEQ ID NO: 134329

SEQ ID NO: 151048 - RNA, 64 nt, hsa; identical to SEQ ID NO: 134330

SEQ ID NO: 151049 - RNA, 64 nt, hsa; identical to SEQ ID NO: 134331

SEQ ID NO: 151050 - RNA, 64 nt, hsa; identical to SEQ ID NO: 134332

SEQ ID NO: 151051 - RNA, 64 nt, hsa; identical to SEQ ID NO: 134333

SEQ ID NO: 151052 - RNA, 64 nt, hsa; identical to SEQ ID NO: 134334

SEQ ID NO: 151053 - RNA, 64 nt, hsa; identical to SEQ ID NO: 134335

SEQ ID NO: 151054 - RNA, 64 nt, hsa; identical to SEQ ID NO: 134336

SEQ ID NO: 151055 - RNA, 64 nt, hsa; identical to SEQ ID NO: 134337

SEQ ID NO: 151056 - RNA, 64 nt, hsa; identical to SEQ ID NO: 134338

SEQ ID NO: 151057 - RNA, 64 nt, hsa; identical to SEQ ID NO: 134339

SEQ ID NO: 151058 - RNA, 64 nt, hsa; identical to SEQ ID NO: 134340

SEQ ID NO: 151059 - RNA, 64 nt, hsa; identical to SEQ ID NO: 134341

SEQ ID NO: 151060 - RNA, 64 nt, hsa; identical to SEQ ID NO: 134342

SEQ ID NO: 151061 - RNA, 64 nt, hsa; identical to SEQ ID NO: 134343

SEQ ID NO: 151062 - RNA, 64 nt, hsa; identical to SEQ ID NO: 134344

SEQ ID NO: 151063 - RNA, 64 nt, hsa; identical to SEQ ID NO: 134345

SEQ ID NO: 151064 - RNA, 64 nt, hsa; identical to SEQ ID NO: 134346

SEQ ID NO: 151065 - RNA, 64 nt, hsa; identical to SEQ ID NO: 134347

SEQ ID NO: 151066 - RNA, 64 nt, hsa; identical to SEQ ID NO: 134348

SEQ ID NO: 151067 - RNA, 64 nt, hsa; identical to SEQ ID NO: 134349

SEQ ID NO: 151068 - RNA, 64 nt, hsa; identical to SEQ ID NO: 134350

SEQ ID NO: 151069 - RNA, 64 nt, hsa; identical to SEQ ID NO: 134351

SEQ ID NO: 151070 - RNA, 64 nt, hsa; identical to SEQ ID NO: 134352

SEQ ID NO: 151071 - RNA, 64 nt, hsa; identical to SEQ ID NO: 134353

SEQ ID NO: 151072 - RNA, 64 nt, hsa; identical to SEQ ID NO: 134354

SEQ ID NO: 151073 - RNA, 64 nt, hsa; identical to SEQ ID NO: 134355

SEQ ID NO: 151074 - RNA, 64 nt, hsa; identical to SEQ ID NO: 134356

SEQ ID NO: 151075 - RNA, 64 nt, hsa; identical to SEQ ID NO: 134357

SEQ ID NO: 151076 - RNA, 64 nt, hsa; identical to SEQ ID NO: 134358

SEQ ID NO: 151077 - RNA, 64 nt, hsa; identical to SEQ ID NO: 134359

SEQ ID NO: 151078 - RNA, 64 nt, hsa; identical to SEQ ID NO: 134360

SEQ ID NO: 151079 - RNA, 64 nt, hsa; identical to SEQ ID NO: 134361

SEQ ID NO: 151080 - RNA, 64 nt, hsa; identical to SEQ ID NO: 134362

SEQ ID NO: 151081 - RNA, 64 nt, hsa; identical to SEQ ID NO: 134363

SEQ ID NO: 151082 - RNA, 64 nt, hsa; identical to SEQ ID NO: 134364

SEQ ID NO: 151083 - RNA, 64 nt, hsa; identical to SEQ ID NO: 134365

SEQ ID NO: 151084 - RNA, 64 nt, hsa; identical to SEQ ID NO: 134366

SEQ ID NO: 151085 - RNA, 64 nt, hsa; identical to SEQ ID NO: 134367

SEQ ID NO: 151086 - RNA, 64 nt, hsa; identical to SEQ ID NO: 134368

SEQ ID NO: 151087 - RNA, 64 nt, hsa; identical to SEQ ID NO: 134369

SEQ ID NO: 151088 - RNA, 64 nt, hsa; identical to SEQ ID NO: 134370

SEQ ID NO: 151089 - RNA, 64 nt, hsa; identical to SEQ ID NO: 134371

SEQ ID NO: 151090 - RNA, 64 nt, hsa; identical to SEQ ID NO: 134372

SEQ ID NO: 151091 - RNA, 64 nt, hsa; identical to SEQ ID NO: 134373

SEQ ID NO: 151092 - RNA, 64 nt, hsa; identical to SEQ ID NO: 134374

SEQ ID NO: 151093 - RNA, 64 nt, hsa; identical to SEQ ID NO: 134375

SEQ ID NO: 151094 - RNA, 64 nt, hsa; identical to SEQ ID NO: 134376

SEQ ID NO: 151095 - RNA, 64 nt, hsa; identical to SEQ ID NO: 134377

SEQ ID NO: 151096 - RNA, 64 nt, hsa; identical to SEQ ID NO: 134378

SEQ ID NO: 151097 - RNA, 64 nt, hsa; identical to SEQ ID NO: 134379

SEQ ID NO: 151098 - RNA, 64 nt, hsa; identical to SEQ ID NO: 134380

SEQ ID NO: 151099 - RNA, 64 nt, hsa; identical to SEQ ID NO: 134381

SEQ ID NO: 151100 - RNA, 64 nt, hsa; identical to SEQ ID NO: 134382

SEQ ID NO: 151101 - RNA, 64 nt, hsa; identical to SEQ ID NO: 134383

SEQ ID NO: 151102 - RNA, 64 nt, hsa; identical to SEQ ID NO: 134384

SEQ ID NO: 151103 - RNA, 64 nt, hsa; identical to SEQ ID NO: 134385

SEQ ID NO: 151104 - RNA, 64 nt, hsa; identical to SEQ ID NO: 134386

SEQ ID NO: 151105 - RNA, 64 nt, hsa; identical to SEQ ID NO: 134387

SEQ ID NO: 151106 - RNA, 64 nt, hsa; identical to SEQ ID NO: 134388

SEQ ID NO: 151107 - RNA, 64 nt, hsa; identical to SEQ ID NO: 134389

SEQ ID NO: 151108 - RNA, 64 nt, hsa; identical to SEQ ID NO: 134390

SEQ ID NO: 151109 - RNA, 64 nt, hsa; identical to SEQ ID NO: 134391

SEQ ID NO: 151110 - RNA, 64 nt, hsa; identical to SEQ ID NO: 134392

SEQ ID NO: 151111 - RNA, 64 nt, hsa; identical to SEQ ID NO: 134393

SEQ ID NO: 151112 - RNA, 64 nt, hsa; identical to SEQ ID NO: 134394

SEQ ID NO: 151113 - RNA, 64 nt, hsa; identical to SEQ ID NO: 134395

SEQ ID NO: 151114 - RNA, 64 nt, hsa; identical to SEQ ID NO: 134396

SEQ ID NO: 151115 - RNA, 64 nt, hsa; identical to SEQ ID NO: 134397

SEQ ID NO: 151116 - RNA, 64 nt, hsa; identical to SEQ ID NO: 134398

SEQ ID NO: 151117 - RNA, 64 nt, hsa; identical to SEQ ID NO: 134399

SEQ ID NO: 151118 - RNA, 64 nt, hsa; identical to SEQ ID NO: 134400

SEQ ID NO: 151119 - RNA, 64 nt, hsa; identical to SEQ ID NO: 134401

SEQ ID NO: 151120 - RNA, 64 nt, hsa; identical to SEQ ID NO: 134402

SEQ ID NO: 151121 - RNA, 64 nt, hsa; identical to SEQ ID NO: 134403

SEQ ID NO: 151122 - RNA, 64 nt, hsa; identical to SEQ ID NO: 134404

SEQ ID NO: 151123 - RNA, 64 nt, hsa; identical to SEQ ID NO: 134405

SEQ ID NO: 151124 - RNA, 64 nt, hsa; identical to SEQ ID NO: 134406

SEQ ID NO: 151125 - RNA, 64 nt, hsa; identical to SEQ ID NO: 134407

SEQ ID NO: 151126 - RNA, 64 nt, hsa; identical to SEQ ID NO: 134408

SEQ ID NO: 151127 - RNA, 64 nt, hsa; identical to SEQ ID NO: 134409

SEQ ID NO: 151128 - RNA, 64 nt, hsa; identical to SEQ ID NO: 134410

SEQ ID NO: 151129 - RNA, 64 nt, hsa; identical to SEQ ID NO: 134411

SEQ ID NO: 151130 - RNA, 64 nt, hsa; identical to SEQ ID NO: 134412

SEQ ID NO: 151131 - RNA, 64 nt, hsa; identical to SEQ ID NO: 134413

SEQ ID NO: 151132 - RNA, 64 nt, hsa; identical to SEQ ID NO: 134414

SEQ ID NO: 151133 - RNA, 64 nt, hsa; identical to SEQ ID NO: 134415

SEQ ID NO: 151134 - RNA, 64 nt, hsa; identical to SEQ ID NO: 134416

SEQ ID NO: 151135 - RNA, 64 nt, hsa; identical to SEQ ID NO: 134417

SEQ ID NO: 151136 - RNA, 64 nt, hsa; identical to SEQ ID NO: 134418

SEQ ID NO: 151137 - RNA, 64 nt, hsa; identical to SEQ ID NO: 134419

SEQ ID NO: 151138 - RNA, 64 nt, hsa; identical to SEQ ID NO: 134420

SEQ ID NO: 151139 - RNA, 64 nt, hsa; identical to SEQ ID NO: 134421

SEQ ID NO: 151140 - RNA, 64 nt, hsa; identical to SEQ ID NO: 134422

SEQ ID NO: 151141 - RNA, 64 nt, hsa; identical to SEQ ID NO: 134423

SEQ ID NO: 151142 - RNA, 64 nt, hsa; identical to SEQ ID NO: 134424

SEQ ID NO: 151143 - RNA, 64 nt, hsa; identical to SEQ ID NO: 134425

SEQ ID NO: 151144 - RNA, 64 nt, hsa; identical to SEQ ID NO: 134426

SEQ ID NO: 151145 - RNA, 64 nt, hsa; identical to SEQ ID NO: 134427

SEQ ID NO: 151146 - RNA, 64 nt, hsa; identical to SEQ ID NO: 134428

SEQ ID NO: 151147 - RNA, 64 nt, hsa; identical to SEQ ID NO: 134429

SEQ ID NO: 151148 - RNA, 64 nt, hsa; identical to SEQ ID NO: 134430

SEQ ID NO: 151149 - RNA, 64 nt, hsa; identical to SEQ ID NO: 134431

SEQ ID NO: 151150 - RNA, 64 nt, hsa; identical to SEQ ID NO: 134432

SEQ ID NO: 151151 - RNA, 64 nt, hsa; identical to SEQ ID NO: 134433

SEQ ID NO: 151152 - RNA, 64 nt, hsa; identical to SEQ ID NO: 134434

SEQ ID NO: 151153 - RNA, 64 nt, hsa; identical to SEQ ID NO: 134435

SEQ ID NO: 151154 - RNA, 64 nt, hsa; identical to SEQ ID NO: 134436

SEQ ID NO: 151155 - RNA, 64 nt, hsa; identical to SEQ ID NO: 134437

SEQ ID NO: 151156 - RNA, 64 nt, hsa; identical to SEQ ID NO: 134438

SEQ ID NO: 151157 - RNA, 64 nt, hsa; identical to SEQ ID NO: 134439

SEQ ID NO: 151158 - RNA, 64 nt, hsa; identical to SEQ ID NO: 134440

SEQ ID NO: 151159 - RNA, 64 nt, hsa; identical to SEQ ID NO: 134441

SEQ ID NO: 151160 - RNA, 64 nt, hsa; identical to SEQ ID NO: 134442

SEQ ID NO: 151161 - RNA, 64 nt, hsa; identical to SEQ ID NO: 134443

SEQ ID NO: 151162 - RNA, 64 nt, hsa; identical to SEQ ID NO: 134444

SEQ ID NO: 151163 - RNA, 64 nt, hsa; identical to SEQ ID NO: 134445

SEQ ID NO: 151164 - RNA, 64 nt, hsa; identical to SEQ ID NO: 134446

SEQ ID NO: 151165 - RNA, 64 nt, hsa; identical to SEQ ID NO: 134447

SEQ ID NO: 151166 - RNA, 64 nt, hsa; identical to SEQ ID NO: 134448

SEQ ID NO: 151167 - RNA, 64 nt, hsa; identical to SEQ ID NO: 134449

SEQ ID NO: 151168 - RNA, 64 nt, hsa; identical to SEQ ID NO: 134450

SEQ ID NO: 151169 - RNA, 64 nt, hsa; identical to SEQ ID NO: 134451

SEQ ID NO: 151170 - RNA, 64 nt, hsa; identical to SEQ ID NO: 134452

SEQ ID NO: 151171 - RNA, 64 nt, hsa; identical to SEQ ID NO: 134453

SEQ ID NO: 151172 - RNA, 64 nt, hsa; identical to SEQ ID NO: 134454

SEQ ID NO: 151173 - RNA, 64 nt, hsa; identical to SEQ ID NO: 134455

SEQ ID NO: 151174 - RNA, 64 nt, hsa; identical to SEQ ID NO: 134456

SEQ ID NO: 151175 - RNA, 64 nt, hsa; identical to SEQ ID NO: 134457

SEQ ID NO: 151176 - RNA, 64 nt, hsa
agccuggcaacagagcaagacuccgucucaaaaaaagggcaauaaaugcccucucugaauguuu

SEQ ID NO: 151177 - RNA, 64 nt, hsa
ccaagaaaaggcauggagacagcgaacuagaagaaagggcaagaaggaaauagccaccgucuac

SEQ ID NO: 151178 - RNA, 64 nt, hsa
aaaauguaaaaccucucuugccagggaaugggggaagggcaagugaggaguucuuuaaugggug

SEQ ID NO: 151179 - RNA, 64 nt, hsa
agagggucucugagggcaagagacauggccaaccaagggcaaggagugacccuguggaggguuc

SEQ ID NO: 151180 - RNA, 64 nt, hsa
uaaagaggcaaagggucacagaaguguucagaagaagggcaaagauaagaacaauauuagcugu

SEQ ID NO: 151181 - RNA, 64 nt, hsa
gaaauaaguaaacaaauacaagagguucauauaaaagggcaaaugaaaaccuuuccuacaguuc

SEQ ID NO: 151182 - RNA, 64 nt, hsa
cuuuccaggccggaugccauaguggaacauccagaagggcaacugucuacugucugcuuauuua

SEQ ID NO: 151183 - RNA, 64 nt, hsa
cugauauuuauauacuuaauagauugaguucuguaagggcaaaaacggauugaaaugaacauag

SEQ ID NO: 151184 - RNA, 64 nt, hsa
uauggaaaggguuugagauagaugauuuuugggaaagggcaaaaugugucagaugcccuaguua

SEQ ID NO: 151185 - RNA, 64 nt, hsa
aaucugaauaagacaauaugugaugaauauaagaaagggcaaaaaauucauuugaaccaguuuu

SEQ ID NO: 151186 - RNA, 64 nt, hsa
cugccaaacacauuuacccuuuggccccacuuugaagggcaagaaauggcgucugcucuggugg

SEQ ID NO: 151187 - RNA, 64 nt, hsa
guauauuaaaacacuuuuuuaaaggacaguugaaaagggcaagaggaaaccagggcaguucuag

SEQ ID NO: 151188 - RNA, 64 nt, hsa
ugguuauuauuacauggugguggugguuuuauuauaugcaaaaucucugucuauuaugagauac

SEQ ID NO: 151189 - RNA, 64 nt, hsa
caagcacaguaauguguguuuuguucagcauuauuaugcaaaaauucacuaguugagaugguuu

SEQ ID NO: 151190 - RNA, 64 nt, hsa
agaaagccuuuguaaggugguuuuaaaagccuuauaugcaaaccuuuuaaucuguguuucugca

SEQ ID NO: 151191 - RNA, 64 nt, hsa
cggaguuggagcuggguauuguuaaaaacugcauuaugcaaaaauuuuguacaguguuaaggcc

SEQ ID NO: 151192 - RNA, 64 nt, hsa
uuucggaagauaucauaaucauucuguguaacauuaugcaaacuucuaagcccaaacaugacuu

SEQ ID NO: 151193 - RNA, 64 nt, hsa
guacuugugaaaacaguaaaauaguuuggauaguuaugcaaaugcaccuauguguaacuucccc

SEQ ID NO: 151194 - RNA, 64 nt, hsa
uucaaguuuaaaaaaucgucuuacauguguacaauaugcaaauuaguuuuagauuagagagugc

SEQ ID NO: 151195 - RNA, 64 nt, hsa
aguguuuggauuguaauuauaaaugguucuuugauaugcaaauuaauauuuucaguugauuuua

SEQ ID NO: 151196 - RNA, 64 nt, hsa
cagagaaaaaguuucuaaaguuacuacuggugucuaugcaaauuggauuccauagaaguuuuag

SEQ ID NO: 151197 - RNA, 64 nt, hsa
uugaugaaacugcugguuuaaaaauauuuacugauaugcaaaugucaugcaaaacuccacuuuc

SEQ ID NO: 151198 - RNA, 64 nt, hsa
caaaaaugaguaugaggaaaucaaauguaaaucauaugcaaauauuauucaaccaagcuucuau

SEQ ID NO: 151199 - RNA, 64 nt, hsa
ugaaauuacuauacauugaaaugccugcaaacuauaugcaaaaaugaguaugaggaaaucaaau

SEQ ID NO: 151200 - RNA, 64 nt, hsa
uauauaaagucuucuccaguaauuaagaaauacauaugcaaauucuuuugugauugaguaaaag

SEQ ID NO: 151201 - RNA, 64 nt, hsa
aaggcaauggcaguccuacauuuaagaauagagcuaugcaaacucuguuaaaaacuaugaggaa

SEQ ID NO: 151202 - RNA, 64 nt, hsa
guuuauuaccuuuucccucaugaaauuuuaaauauaugcaaauauauauaucauuagauuccug

SEQ ID NO: 151203 - RNA, 64 nt, hsa
gugauuaauguauuuuauaaauuaccuuuucacauaugcaaaaucuguuucuacuacaauguua

SEQ ID NO: 151204 - RNA, 64 nt, hsa
auucgaauuuugucuuuaaaauucaugugguuucuaugcaaaguucuucauaucaucacaacau

SEQ ID NO: 151205 - RNA, 64 nt, hsa
aagauguauuauaccagugaaaagguguuauaucuaugcaaaccuacuaacaaauuauacuguu

SEQ ID NO: 151206 - RNA, 64 nt, hsa
agaccuguugugcuguguauuuugauuuccuguguaugcaaauguguguauuuaccauugugua

SEQ ID NO: 151207 - RNA, 64 nt, hsa
uaaaaauuauuuuccauugcagaagcagcuggacuaugcaaaaaguauuucucugucaguuccc

SEQ ID NO: 151208 - RNA, 64 nt, hsa
augaaaccagcauuuaguaccagcauaugguucauaugcaaauaauacuuuccccaaaaucuuu

SEQ ID NO: 151209 - RNA, 64 nt, hsa
ugguuuuguuucauuuugcucuguuuuaaauccauaugcaaauaaaacugcuucucucuuacac

SEQ ID NO: 151210 - RNA, 64 nt, hsa
aaauguuguuaauaagaaugguuuuuacauaaauuaugcaaagguuaacaagcaguaacacugc

SEQ ID NO: 151211 - RNA, 64 nt, hsa
gaagaguccccgauguuuguagaccuuaugugaguaugcaaauauauaaauuugaguaugcuug

SEQ ID NO: 151212 - RNA, 64 nt, hsa
ugauucuuguauauuagcaauuauaauguuuguauaugcaaaacugcuagcuugauuuuaaaaa

SEQ ID NO: 151213 - RNA, 64 nt, hsa
cgcugcuuccacacauuaauggcaugauuuuuuuuaugcaaaaagaaaagaaaagaaaaccacc

SEQ ID NO: 151214 - RNA, 64 nt, hsa
ucucuuaggaaguuaauaaguagauucauaucauuaugcaaauaguauuguggguuuuguaggu

SEQ ID NO: 151215 - RNA, 64 nt, hsa
caauuauauuuccaaaaaugaaccuuuaaaaugguaugcaaaauuuugucuauauauauuugug

SEQ ID NO: 151216 - RNA, 64 nt, hsa
gugugugaauauguguuacaccuaggaugggcauuaugcaaaagcacaaagauuauauaugaca

SEQ ID NO: 151217 - RNA, 64 nt, hsa
guuuucugucaaaguuccuuuugcaugaaacaauuaugcaaacuuauaauuauuagugcugaaa

SEQ ID NO: 151218 - RNA, 64 nt, hsa
aguugccuauauuugcuauucaaaauuuuguaaauaugcaaaucagcuuuauagguuuauuaca

SEQ ID NO: 151219 - RNA, 64 nt, hsa
uuuucccucuuauuuuuguauuguggucauuuccuaugcaaauaauggagcaaacagcuguaua

SEQ ID NO: 151220 - RNA, 64 nt, hsa
ucagagauggagcaaaccagugccauccagucuuuaugcaaaugaaaugcugcaaagggaagca

SEQ ID NO: 151221 - RNA, 64 nt, hsa
accuaggagaaucuaagcuauagcagggaugauuuaugcaaauuugaacuagcuucuuuguuca

SEQ ID NO: 151222 - RNA, 64 nt, hsa
caaaccuccugccugacucgcuagucccugcaaauaugcaaaccccccaucaucugcacacccg

SEQ ID NO: 151223 - RNA, 64 nt, hsa
ugcucaugaggggcugcggaguucuauauucacauaugcaaaccuccugccugacucgcuaguc

SEQ ID NO: 151224 - RNA, 64 nt, hsa
acuaagcauuaaauauuggccgggugcgguggcuuaugcaaaauggcucccagcauuuugggag

SEQ ID NO: 151225 - RNA, 64 nt, hsa
aguaaaaguaaaauauuuaauccauaauuaagucuaugcaaauaucagagaauuuaugguagaa

SEQ ID NO: 151226 - RNA, 64 nt, hsa
caugucuauauaauuauaaaugcauguguauauauaugcaaauauauguacauauacauguaua

SEQ ID NO: 151227 - RNA, 64 nt, hsa
aaugcuccuacuuuaaguaccuugugcugcucuuuaugcaaagguaaaucaaaguucccucuau

SEQ ID NO: 151228 - RNA, 64 nt, hsa
cacaucucacuucugcuuccucaucucagcccacucugaaaaugugcagcacccucacugguuc

SEQ ID NO: 151229 - RNA, 64 nt, hsa
cccccaacgcaaggaggaugcccaauuguugcccucugaaaaugcacaguucuccuggcccuag

SEQ ID NO: 151230 - RNA, 64 nt, hsa
agccacuauucucaguuacaccucccagugcccuucugaaaagugccagcuauuucauuaggca

SEQ ID NO: 151231 - RNA, 64 nt, hsa
gaaaagaguccaguacccaggccccauggaaaggucugaaaauaauauuccagauuacacugua

SEQ ID NO: 151232 - RNA, 64 nt, hsa
gguagccuuaaaaaccuucuaaaaugcuuuugauucugaaaauugggggaaaaaacuuuuaauc

SEQ ID NO: 151233 - RNA, 64 nt, hsa
gccugaggugcaugggaaauauaguuagcuauacucugaaaauacauuauguuuuuuuucuuua

SEQ ID NO: 151234 - RNA, 64 nt, hsa
auguugguguuuuagaaguagauacaggcacugcucugaaaaccuggcuagccaaggauauucu

SEQ ID NO: 151235 - RNA, 64 nt, hsa
aaaggccccacugauaagguaacauuugagcaagucugaaaaaggcaaggggaucuuuggggcu

SEQ ID NO: 151236 - RNA, 64 nt, hsa
ugccuuccaagucaguccuuuggaaaccagcaggucugaaaaagaggcugcaucaaugcaagcc

SEQ ID NO: 151237 - RNA, 64 nt, hsa
uauaaacuccuuaugugaggaaaugcuacuaauaucugaaaagugaaagauuucuauguauuaa

SEQ ID NO: 151238 - RNA, 64 nt, hsa
uugcuaacaauaauguuuggaaauaaagaagugcucugaaaaaauaucagccaccaaaauaguu

SEQ ID NO: 151239 - RNA, 64 nt, hsa
agauacaaucacgucacaggucucuuggccucaaucugaaaacugcugccgccgcgccgaggag

SEQ ID NO: 151240 - RNA, 64 nt, hsa
aaauagcguuucacauaaaaagcauagcagcagcucugaaaagacacuucacaguaaauauguc

SEQ ID NO: 151241 - RNA, 64 nt, hsa
gcaaguuacucaggaaucaaaagagaaaaaaguuucugaaaacaaugaaaccauaaaagauaau

SEQ ID NO: 151242 - RNA, 64 nt, hsa
uuugaggugucugcugucgcuaccacugugcacaucugaaaacucacaaccaagaaaauccauu

SEQ ID NO: 151243 - RNA, 64 nt, hsa
guucuagauauguacuucaugguuaaauucuaaaucugaaaaugcuagugggagauaucaagaa

SEQ ID NO: 151244 - RNA, 64 nt, hsa
ugcaucagcaaggcauugacuucugaaaaaaugaucugaaaaaaguuucaccguuugucuucuu

SEQ ID NO: 151245 - RNA, 64 nt, hsa
gcauguugcgcuuugcaucagcaaggcauugacuucugaaaaaaugaucugaaaaaaguuucac

SEQ ID NO: 151246 - RNA, 64 nt, hsa
uacuuacuuaaauugacacuuuuugaaaugccagucugaaaauaauuaagauaucucugcuuug

SEQ ID NO: 151247 - RNA, 64 nt, hsa
guuaaagaucacaccacaauguuuucaagaaacaucugaaaagauaaaacaaagaacaaauaac

SEQ ID NO: 151248 - RNA, 64 nt, hsa
ugcgugguuuauagacuggggugccauguguacuucugaaaauauuuuaaccagcccacccagc

SEQ ID NO: 151249 - RNA, 64 nt, hsa
caguuaaaucaaacauugguugaacacaucagccucugaaaagguagcucugacucuugucuuu

SEQ ID NO: 151250 - RNA, 64 nt, hsa
acaaucuguugauagaccuggaauuuagaguauaucugaaaagcaguuggacuucaagaaauuu

SEQ ID NO: 151251 - RNA, 64 nt, hsa
uuuuagagcauagaagaagcggcaccugccaucuucugaaaacuccaaagggaaauuucaguag

SEQ ID NO: 151252 - RNA, 64 nt, hsa
auugucuguuaaauuuauuaugcccaaaucaaccucugaaaaaagguuuuuccaggaagauuua

SEQ ID NO: 151253 - RNA, 64 nt, hsa
guagacucuauaguacccucucuauucacuagcuucugaaaagggaggaguauuuuuaguuuga

SEQ ID NO: 151254 - RNA, 64 nt, hsa
gugauauaauccauuuauaucacagcucacaguuucugaaaauguauaaaagaaucuauaaucu

SEQ ID NO: 151255 - RNA, 64 nt, hsa
gcuagaauuaugaucuuugaaguuauaacugugaucugaaaauguguguggugguaugacagca

SEQ ID NO: 151256 - RNA, 64 nt, hsa
guugaaguaccaaguaaccuacaagccuccuaguucugaaaaguuggaagggcaucaugaccuc

SEQ ID NO: 151257 - RNA, 64 nt, hsa
uuuuucuucgacaaaaaaauaauaaaacguuucuucugaaaagcugaacguuucuguauaagcg

SEQ ID NO: 151258 - RNA, 64 nt, hsa
uauaguuuaaaagcacaucuauguucacugccacucugaaaaagggaauuauuucucagucuuu

SEQ ID NO: 151259 - RNA, 64 nt, hsa
agaaacccaagguuggagggugggaugaguacccucugaaaaagggaauuugcuggugaaaaga

SEQ ID NO: 151260 - RNA, 64 nt, hsa
ggggugacagaagagaccuugucucgaaaaggaaucugaaaacaauggaaccaugccuucauaa

SEQ ID NO: 151261 - RNA, 64 nt, hsa
aagguguuuucuaguuuaaguuguucccccucccucugaaaaaaguauguauuuuuacauuaga

SEQ ID NO: 151262 - RNA, 64 nt, hsa
guuuuccuaauacaggaauacagcgacagaccuaucugaaaagucuguuugggggcauacuuuu

SEQ ID NO: 151263 - RNA, 64 nt, hsa
auuucuguagcaugacagggauuucaaucaccuuucugaaaagagugggcugauaaacuuguaa

SEQ ID NO: 151264 - RNA, 64 nt, hsa
gcaaauaguuucaaaugaguuuaaaaaaauaacaucugaaaagaaaugcuaauguaaucauuua

SEQ ID NO: 151265 - RNA, 64 nt, hsa
gaacuguucauuuccaccaaggguaucugcugccucugaaaauauuuuuuucuagcuauaacaa

SEQ ID NO: 151266 - RNA, 64 nt, hsa
cauaguaacagaaucuuuaugaaauaugaccuuuucugaaaauacauacuuuuacauuucuacu

SEQ ID NO: 151267 - RNA, 64 nt, hsa
agauaaaaauaaaagcagaauguauaucaucccaucugaaaaacacuaauuauugacaugugca

SEQ ID NO: 151268 - RNA, 64 nt, hsa
acugaaaugaaaucccauuggauuguacuucucuucugaaaagugugcuuuuugacccuacugg

SEQ ID NO: 151269 - RNA, 64 nt, hsa
ugcuguuugcauuacagaacugcagcuuuucuacucugaaaaggccugggagcagaauggcugg

SEQ ID NO: 151270 - RNA, 64 nt, hsa
uucaggugguuuauuaauuacauuuaaaaaguuuucugaaaaaacuuuugcaauaaaaaaaaau

SEQ ID NO: 151271 - RNA, 64 nt, hsa
uagugaaugguaagacuagugcaaaacaguuauuucugaaaauuaaagaccauuauugcuacca

SEQ ID NO: 151272 - RNA, 64 nt, hsa
gaacccuaaaugcuuauuguuaagugaaaaccaaucugaaaaggcuuucuauguuguaugauug

SEQ ID NO: 151273 - RNA, 64 nt, hsa
ccauuuaaaaguuauaaaucaaaauaacagauuaucugaaaaaaaaucuauccuguacguguga

SEQ ID NO: 151274 - RNA, 64 nt, hsa
accuuauauaaagguauaagagaccaugacaaugucugaaaauggaauagauaaugaugccuuu

SEQ ID NO: 151275 - RNA, 64 nt, hsa
uauuuccauuauaguauuuauuguauuuuuauguucugaaaauuacccauggaacaauaugcuu

SEQ ID NO: 151276 - RNA, 64 nt, hsa
uuuauccccguuuuauaaaagaggaaacugaaguucugaaaaucuccuuccagggccccagcua

SEQ ID NO: 151277 - RNA, 64 nt, hsa
uuugucacgucuucugagaaugacuuucagucucucugaaaaugaaaagcuuaggaccagaaga

SEQ ID NO: 151278 - RNA, 64 nt, hsa
uuuuaaguguuagcaauaguucaaaaaauuaaguucugaaaauugaaaaaauuaaaauguaaaa

SEQ ID NO: 151279 - RNA, 64 nt, hsa
agcagaaucaugagucuucuauuuuugucccauuucugaaaauuaucaagauaacuaguaaaau

SEQ ID NO: 151280 - RNA, 64 nt, hsa
ucccuauuacaggauauguugcaguccccaucuuucugaaaauaacccuuaacguauccaacag

SEQ ID NO: 151281 - RNA, 64 nt, hsa
aacaaguguuuuaaaagaugaguuuuuccuacauucugaaaagcaaacaugaaaaacugaacac

SEQ ID NO: 151282 - RNA, 64 nt, hsa
cauuguaauaaguguagcaaaaucuccuuagauaucugaaaagucauacuggauggaaucugua

SEQ ID NO: 151283 - RNA, 64 nt, hsa
uucugcuugcugauuuuuucccacagcaugugauucugaaaauguaacuacaauauugacauaa

SEQ ID NO: 151284 - RNA, 64 nt, hsa
uauuuucaaugugaauccaaagcuugucugguucucugaaaauaauuuuuuccccuuuagguuc

SEQ ID NO: 151285 - RNA, 64 nt, hsa
uuauuaagcucauugccaacccacaagauauguuucugaaaaccuguaguuucuuaauuuaagu

SEQ ID NO: 151286 - RNA, 64 nt, hsa
cuuuuaaguggacucucugacaaaguggguacuuucugaaaauuuauauaacuguuguugauaa

SEQ ID NO: 151287 - RNA, 64 nt, hsa
uucauacacaacguaaucaaauaugugguccaucucugaaaacaagagacugcuugacaaagga

SEQ ID NO: 151288 - RNA, 64 nt, hsa
uugacaacaacccaaugaaauaacauuuugcauaucugaaaagaagcauugaauauaagccaaa

SEQ ID NO: 151289 - RNA, 64 nt, hsa
uguuuuuuucuaauggaaugaaccauuuuccucuucugaaaauucuguaucugagcacaucaag

SEQ ID NO: 151290 - RNA, 64 nt, hsa
ugugcacauuuggaagcuaaaauguacaucguugucugaaaaaacccaaccccaaaaccuucau

SEQ ID NO: 151291 - RNA, 64 nt, hsa
cucuauuuuuguuuucauuuucucuagacauucaucugaaaaucauuuuaugguucucaauccc

SEQ ID NO: 151292 - RNA, 64 nt, hsa
auacaaauuuuuuuacaaguauuuacauacuguaucugaaaacagacuuuaaagucacaagauu

SEQ ID NO: 151293 - RNA, 64 nt, hsa
acaagauuauaaauguacauauauauucucacauucugaaaaauaacauucucagaauccacag

SEQ ID NO: 151294 - RNA, 64 nt, hsa
ccauguguccucugaucuaaaguugcaugguuggucugaaaauagaguugggcuuaauguugac

SEQ ID NO: 151295 - RNA, 64 nt, hsa
acuuuagauucuuauugaauucauaauacuuaucucugaaaaugucuuugacuguaaauuuagg

SEQ ID NO: 151296 - RNA, 64 nt, hsa
uuuaagccauuuaaggguggaccuccgcgacgauucugaaaaugagcucucugccaagguuuua

SEQ ID NO: 151297 - RNA, 64 nt, hsa
ugucaaaaaagaagagaaaagaucgucugagaaaucugaaaaaaaagaaagcaaggauacuaag

SEQ ID NO: 151298 - RNA, 64 nt, hsa
gauuuaauuauuuguaauaaaagauuugcugcagucugaaaacugcccaggggugcacuguugg

SEQ ID NO: 151299 - RNA, 64 nt, hsa
auucuuaaccccauggacuccuuucccuuucuucucugaaaaaaacuaauuuaaauuugcuuuu

SEQ ID NO: 151300 - RNA, 64 nt, hsa
ucaguuuuuuuaugguacucgaaaaaucaaaccuucugaaaauuaugauauuuguacuucauuu

SEQ ID NO: 151301 - RNA, 64 nt, hsa
agggcuuuguccaguuaucuucauaugacuguucucugaaaaaaggucuuacuaccugauauca

SEQ ID NO: 151302 - RNA, 64 nt, hsa
aggcagggagaucuuaauaccuaauuucaucauuucugaaaauguacuguuuuagaauguauua

SEQ ID NO: 151303 - RNA, 64 nt, hsa
aucaugggccguggaacagaauauauguuggaccucugaaaaguuguaaggggccaauucuaag

SEQ ID NO: 151304 - RNA, 64 nt, hsa
aggcacaaaagaacaccugaaaaaugauauuuugucugaaaagacuugacauuguaaaaauaua

SEQ ID NO: 151305 - RNA, 64 nt, hsa
uccagaguagaaaacuaugaaugugggauagccuucugaaaaagccacaaauuuaugaaacauu

SEQ ID NO: 151306 - RNA, 64 nt, hsa
cagacagcugcauuguaagaguucugucaugcagucugaaaagggaagaaacaggauggcuuuc

SEQ ID NO: 151307 - RNA, 64 nt, hsa
gauuguuguauuauuagauuacugauuuuucuuuucugaaaauacauuugaguuuuaaucacau

SEQ ID NO: 151308 - RNA, 64 nt, hsa
uuaaauaauugugaagccagauaugcaauguguaucugaaaagcaaggaauuugcagccguuuu

SEQ ID NO: 151309 - RNA, 64 nt, hsa
cuucugauucuaauguggaaauuguuguauuuaaucugaaaaugacuuuaccuacaacaguucc

SEQ ID NO: 151310 - RNA, 64 nt, hsa
uuguauuaagacuuuaaaauguaagcauuguaauucugaaaauacacauuuuaagaagaaacua

SEQ ID NO: 151311 - RNA, 64 nt, hsa
ggauacauauuucaguucuuucuuuuucucacuaucugaaaauacauuucccucccucucuucc

SEQ ID NO: 151312 - RNA, 64 nt, hsa
accauaaaaugucagcaaauguaaaaauuuaauuucugaaaagcaccauuagcccauuuccccc

SEQ ID NO: 151313 - RNA, 64 nt, hsa
aucagaaauauuuuuaaaaaauacaauuuagaucucugaaaauuggaaccacucaagaguauca

SEQ ID NO: 151314 - RNA, 64 nt, hsa
gcaguagggaugggguuagguaggggagaacauuucugaaaaagaacuuauaaugaagcuacaa

SEQ ID NO: 151315 - RNA, 64 nt, hsa
guggcaaaaguccuucuguuacucaagaaaaugcucugaaaaauuccuuuucucuuuuuuuuuu

SEQ ID NO: 151316 - RNA, 64 nt, hsa
uuacucauaauccuuagaaguuagcuuguccgcaucugaaaauucacuuuuaccuugaaguuca

SEQ ID NO: 151317 - RNA, 64 nt, hsa; identical to SEQ ID NO: 151188

SEQ ID NO: 151318 - RNA, 64 nt, hsa; identical to SEQ ID NO: 151189

SEQ ID NO: 151319 - RNA, 64 nt, hsa; identical to SEQ ID NO: 151190

SEQ ID NO: 151320 - RNA, 64 nt, hsa; identical to SEQ ID NO: 151191

SEQ ID NO: 151321 - RNA, 64 nt, hsa; identical to SEQ ID NO: 151192

SEQ ID NO: 151322 - RNA, 64 nt, hsa; identical to SEQ ID NO: 151193

SEQ ID NO: 151323 - RNA, 64 nt, hsa; identical to SEQ ID NO: 151194

SEQ ID NO: 151324 - RNA, 64 nt, hsa; identical to SEQ ID NO: 151195

SEQ ID NO: 151325 - RNA, 64 nt, hsa; identical to SEQ ID NO: 151196

SEQ ID NO: 151326 - RNA, 64 nt, hsa; identical to SEQ ID NO: 151197

SEQ ID NO: 151327 - RNA, 64 nt, hsa; identical to SEQ ID NO: 151198

SEQ ID NO: 151328 - RNA, 64 nt, hsa; identical to SEQ ID NO: 151199

SEQ ID NO: 151329 - RNA, 64 nt, hsa; identical to SEQ ID NO: 151200

SEQ ID NO: 151330 - RNA, 64 nt, hsa; identical to SEQ ID NO: 151201

SEQ ID NO: 151331 - RNA, 64 nt, hsa; identical to SEQ ID NO: 151202

SEQ ID NO: 151332 - RNA, 64 nt, hsa; identical to SEQ ID NO: 151203

SEQ ID NO: 151333 - RNA, 64 nt, hsa; identical to SEQ ID NO: 151204

SEQ ID NO: 151334 - RNA, 64 nt, hsa; identical to SEQ ID NO: 151205

SEQ ID NO: 151335 - RNA, 64 nt, hsa; identical to SEQ ID NO: 151206

SEQ ID NO: 151336 - RNA, 64 nt, hsa; identical to SEQ ID NO: 151207

SEQ ID NO: 151337 - RNA, 64 nt, hsa; identical to SEQ ID NO: 151208

SEQ ID NO: 151338 - RNA, 64 nt, hsa; identical to SEQ ID NO: 151209

SEQ ID NO: 151339 - RNA, 64 nt, hsa; identical to SEQ ID NO: 151210

SEQ ID NO: 151340 - RNA, 64 nt, hsa; identical to SEQ ID NO: 151211

SEQ ID NO: 151341 - RNA, 64 nt, hsa; identical to SEQ ID NO: 151212

SEQ ID NO: 151342 - RNA, 64 nt, hsa; identical to SEQ ID NO: 151213

SEQ ID NO: 151343 - RNA, 64 nt, hsa; identical to SEQ ID NO: 151214

SEQ ID NO: 151344 - RNA, 64 nt, hsa; identical to SEQ ID NO: 151215

SEQ ID NO: 151345 - RNA, 64 nt, hsa; identical to SEQ ID NO: 151216

SEQ ID NO: 151346 - RNA, 64 nt, hsa; identical to SEQ ID NO: 151217

SEQ ID NO: 151347 - RNA, 64 nt, hsa; identical to SEQ ID NO: 151218

SEQ ID NO: 151348 - RNA, 64 nt, hsa; identical to SEQ ID NO: 151219

SEQ ID NO: 151349 - RNA, 64 nt, hsa; identical to SEQ ID NO: 151220

SEQ ID NO: 151350 - RNA, 64 nt, hsa; identical to SEQ ID NO: 151221

SEQ ID NO: 151351 - RNA, 64 nt, hsa; identical to SEQ ID NO: 151222

SEQ ID NO: 151352 - RNA, 64 nt, hsa; identical to SEQ ID NO: 151223

SEQ ID NO: 151353 - RNA, 64 nt, hsa; identical to SEQ ID NO: 151224

SEQ ID NO: 151354 - RNA, 64 nt, hsa; identical to SEQ ID NO: 151225

SEQ ID NO: 151355 - RNA, 64 nt, hsa; identical to SEQ ID NO: 151226

SEQ ID NO: 151356 - RNA, 64 nt, hsa; identical to SEQ ID NO: 151227

SEQ ID NO: 151357 - RNA, 64 nt, hsa; identical to SEQ ID NO: 151228

SEQ ID NO: 151358 - RNA, 64 nt, hsa; identical to SEQ ID NO: 151229

SEQ ID NO: 151359 - RNA, 64 nt, hsa; identical to SEQ ID NO: 151230

SEQ ID NO: 151360 - RNA, 64 nt, hsa; identical to SEQ ID NO: 151231

SEQ ID NO: 151361 - RNA, 64 nt, hsa; identical to SEQ ID NO: 151232

SEQ ID NO: 151362 - RNA, 64 nt, hsa; identical to SEQ ID NO: 151233

SEQ ID NO: 151363 - RNA, 64 nt, hsa; identical to SEQ ID NO: 151234

SEQ ID NO: 151364 - RNA, 64 nt, hsa; identical to SEQ ID NO: 151235

SEQ ID NO: 151365 - RNA, 64 nt, hsa; identical to SEQ ID NO: 151236

SEQ ID NO: 151366 - RNA, 64 nt, hsa; identical to SEQ ID NO: 151237

SEQ ID NO: 151367 - RNA, 64 nt, hsa; identical to SEQ ID NO: 151238

SEQ ID NO: 151368 - RNA, 64 nt, hsa; identical to SEQ ID NO: 151239

SEQ ID NO: 151369 - RNA, 64 nt, hsa; identical to SEQ ID NO: 151240

SEQ ID NO: 151370 - RNA, 64 nt, hsa; identical to SEQ ID NO: 151241

SEQ ID NO: 151371 - RNA, 64 nt, hsa; identical to SEQ ID NO: 151242

SEQ ID NO: 151372 - RNA, 64 nt, hsa; identical to SEQ ID NO: 151243

SEQ ID NO: 151373 - RNA, 64 nt, hsa; identical to SEQ ID NO: 151244

SEQ ID NO: 151374 - RNA, 64 nt, hsa; identical to SEQ ID NO: 151245

SEQ ID NO: 151375 - RNA, 64 nt, hsa; identical to SEQ ID NO: 151246

SEQ ID NO: 151376 - RNA, 64 nt, hsa; identical to SEQ ID NO: 151247

SEQ ID NO: 151377 - RNA, 64 nt, hsa; identical to SEQ ID NO: 151248

SEQ ID NO: 151378 - RNA, 64 nt, hsa; identical to SEQ ID NO: 151249

SEQ ID NO: 151379 - RNA, 64 nt, hsa; identical to SEQ ID NO: 151250

SEQ ID NO: 151380 - RNA, 64 nt, hsa; identical to SEQ ID NO: 151251

SEQ ID NO: 151381 - RNA, 64 nt, hsa; identical to SEQ ID NO: 151252

SEQ ID NO: 151382 - RNA, 64 nt, hsa; identical to SEQ ID NO: 151253

SEQ ID NO: 151383 - RNA, 64 nt, hsa; identical to SEQ ID NO: 151254

SEQ ID NO: 151384 - RNA, 64 nt, hsa; identical to SEQ ID NO: 151255

SEQ ID NO: 151385 - RNA, 64 nt, hsa; identical to SEQ ID NO: 151256

SEQ ID NO: 151386 - RNA, 64 nt, hsa; identical to SEQ ID NO: 151257

SEQ ID NO: 151387 - RNA, 64 nt, hsa; identical to SEQ ID NO: 151258

SEQ ID NO: 151388 - RNA, 64 nt, hsa; identical to SEQ ID NO: 151259

SEQ ID NO: 151389 - RNA, 64 nt, hsa; identical to SEQ ID NO: 151260

SEQ ID NO: 151390 - RNA, 64 nt, hsa; identical to SEQ ID NO: 151261

SEQ ID NO: 151391 - RNA, 64 nt, hsa; identical to SEQ ID NO: 151262

SEQ ID NO: 151392 - RNA, 64 nt, hsa; identical to SEQ ID NO: 151263

SEQ ID NO: 151393 - RNA, 64 nt, hsa; identical to SEQ ID NO: 151264

SEQ ID NO: 151394 - RNA, 64 nt, hsa; identical to SEQ ID NO: 151265

SEQ ID NO: 151395 - RNA, 64 nt, hsa; identical to SEQ ID NO: 151266

SEQ ID NO: 151396 - RNA, 64 nt, hsa; identical to SEQ ID NO: 151267

SEQ ID NO: 151397 - RNA, 64 nt, hsa; identical to SEQ ID NO: 151268

SEQ ID NO: 151398 - RNA, 64 nt, hsa; identical to SEQ ID NO: 151269

SEQ ID NO: 151399 - RNA, 64 nt, hsa; identical to SEQ ID NO: 151270

SEQ ID NO: 151400 - RNA, 64 nt, hsa; identical to SEQ ID NO: 151271

SEQ ID NO: 151401 - RNA, 64 nt, hsa; identical to SEQ ID NO: 151272

SEQ ID NO: 151402 - RNA, 64 nt, hsa; identical to SEQ ID NO: 151273

SEQ ID NO: 151403 - RNA, 64 nt, hsa; identical to SEQ ID NO: 151274

SEQ ID NO: 151404 - RNA, 64 nt, hsa; identical to SEQ ID NO: 151275

SEQ ID NO: 151405 - RNA, 64 nt, hsa; identical to SEQ ID NO: 151276

SEQ ID NO: 151406 - RNA, 64 nt, hsa; identical to SEQ ID NO: 151277

SEQ ID NO: 151407 - RNA, 64 nt, hsa; identical to SEQ ID NO: 151278

SEQ ID NO: 151408 - RNA, 64 nt, hsa; identical to SEQ ID NO: 151279

SEQ ID NO: 151409 - RNA, 64 nt, hsa; identical to SEQ ID NO: 151280

SEQ ID NO: 151410 - RNA, 64 nt, hsa; identical to SEQ ID NO: 151281

SEQ ID NO: 151411 - RNA, 64 nt, hsa; identical to SEQ ID NO: 151282

SEQ ID NO: 151412 - RNA, 64 nt, hsa; identical to SEQ ID NO: 151283

SEQ ID NO: 151413 - RNA, 64 nt, hsa; identical to SEQ ID NO: 151284

SEQ ID NO: 151414 - RNA, 64 nt, hsa; identical to SEQ ID NO: 151285

SEQ ID NO: 151415 - RNA, 64 nt, hsa; identical to SEQ ID NO: 151286

SEQ ID NO: 151416 - RNA, 64 nt, hsa; identical to SEQ ID NO: 151287

SEQ ID NO: 151417 - RNA, 64 nt, hsa; identical to SEQ ID NO: 151288

SEQ ID NO: 151418 - RNA, 64 nt, hsa; identical to SEQ ID NO: 151289

SEQ ID NO: 151419 - RNA, 64 nt, hsa; identical to SEQ ID NO: 151290

SEQ ID NO: 151420 - RNA, 64 nt, hsa; identical to SEQ ID NO: 151291

SEQ ID NO: 151421 - RNA, 64 nt, hsa; identical to SEQ ID NO: 151292

SEQ ID NO: 151422 - RNA, 64 nt, hsa; identical to SEQ ID NO: 151293

SEQ ID NO: 151423 - RNA, 64 nt, hsa; identical to SEQ ID NO: 151294

SEQ ID NO: 151424 - RNA, 64 nt, hsa; identical to SEQ ID NO: 151295

SEQ ID NO: 151425 - RNA, 64 nt, hsa; identical to SEQ ID NO: 151296

SEQ ID NO: 151426 - RNA, 64 nt, hsa; identical to SEQ ID NO: 151297

SEQ ID NO: 151427 - RNA, 64 nt, hsa; identical to SEQ ID NO: 151298

SEQ ID NO: 151428 - RNA, 64 nt, hsa; identical to SEQ ID NO: 151299

SEQ ID NO: 151429 - RNA, 64 nt, hsa; identical to SEQ ID NO: 151300

SEQ ID NO: 151430 - RNA, 64 nt, hsa; identical to SEQ ID NO: 151301

SEQ ID NO: 151431 - RNA, 64 nt, hsa; identical to SEQ ID NO: 151302

SEQ ID NO: 151432 - RNA, 64 nt, hsa; identical to SEQ ID NO: 151303

SEQ ID NO: 151433 - RNA, 64 nt, hsa; identical to SEQ ID NO: 151304

SEQ ID NO: 151434 - RNA, 64 nt, hsa; identical to SEQ ID NO: 151305

SEQ ID NO: 151435 - RNA, 64 nt, hsa; identical to SEQ ID NO: 151306

SEQ ID NO: 151436 - RNA, 64 nt, hsa; identical to SEQ ID NO: 151307

SEQ ID NO: 151437 - RNA, 64 nt, hsa; identical to SEQ ID NO: 151308

SEQ ID NO: 151438 - RNA, 64 nt, hsa; identical to SEQ ID NO: 151309

SEQ ID NO: 151439 - RNA, 64 nt, hsa; identical to SEQ ID NO: 151310

SEQ ID NO: 151440 - RNA, 64 nt, hsa; identical to SEQ ID NO: 151311

SEQ ID NO: 151441 - RNA, 64 nt, hsa; identical to SEQ ID NO: 151312

SEQ ID NO: 151442 - RNA, 64 nt, hsa; identical to SEQ ID NO: 151313

SEQ ID NO: 151443 - RNA, 64 nt, hsa; identical to SEQ ID NO: 151314

SEQ ID NO: 151444 - RNA, 64 nt, hsa; identical to SEQ ID NO: 151315

SEQ ID NO: 151445 - RNA, 64 nt, hsa; identical to SEQ ID NO: 151316

SEQ ID NO: 151446 - RNA, 64 nt, hsa
uuuugucuggagaaaucacuuagacucugugugccucuucuacauugcauucugcucugcuaug

SEQ ID NO: 151447 - RNA, 64 nt, hsa
auucugaaauucaguuaguuacuuuugccuuucgcucuucuaucacagccaccuugaccuuggg

SEQ ID NO: 151448 - RNA, 64 nt, hsa
cagcucugaauggagaaacucucuaggccauccccucuucuaccuccugcaacccacccauccu

SEQ ID NO: 151449 - RNA, 64 nt, hsa
uccagauuuccguguacccacucuguuucaggagcucuucuagguaaagcugagaucacaggaa

SEQ ID NO: 151450 - RNA, 64 nt, hsa
cuagagucccuggcuucuggccacugccuccucccucuucuaagccuuggccugaaucugguug

SEQ ID NO: 151451 - RNA, 64 nt, hsa
gagaaaggcagggccacuccucagcaaaguuggccucuucuacacuuccucaccaguguuguuu

SEQ ID NO: 151452 - RNA, 64 nt, hsa
gaucauauuccugaaaagaaauuuaaaucugaagcucuucuauccacccuuacgucagaugccu

SEQ ID NO: 151453 - RNA, 64 nt, hsa
ucuacacagguugucgaaauaauaauuccacagccucuucuaacaaugccuacaaugugaauuc

SEQ ID NO: 151454 - RNA, 64 nt, hsa
auucucuagacaaaaucaaauuguccuauugugacucuucuaaaaaugaagaugaagagcuauu

SEQ ID NO: 151455 - RNA, 64 nt, hsa
cuugccagggaugggcagcccaacagcacuuuuccucuucuagauggaccccagcauuuaagug

SEQ ID NO: 151456 - RNA, 64 nt, hsa
cuccaucuaaagcagaaaacuccacaacuaagaucucuucuaacauuuaaggaauagagccuaa

SEQ ID NO: 151457 - RNA, 64 nt, hsa
ccugaggaccacacuggcugcaacccaaacucgacucuucuacuuacacuugcucagcauuuuu

SEQ ID NO: 151458 - RNA, 64 nt, hsa
gaacuaccuauccuuacauuucaccuacuaaugucucuucuaacaucuuagagguccauggaga

SEQ ID NO: 151459 - RNA, 64 nt, hsa
uaucugguucuauaugaaugcuauuuuuucccuucucuucuaacaugaaauauauuuucucuuu

SEQ ID NO: 151460 - RNA, 64 nt, hsa
caggucuuacagcaaaaagacuucuguauuuuuacucuucuagaugugaaaagagggugcagag

SEQ ID NO: 151461 - RNA, 64 nt, hsa
accuuuuggcuucaaaguccugguuuuacaaacgcucuucuaacaagggaagaacacgggguaa

SEQ ID NO: 151462 - RNA, 64 nt, hsa
uaagauuucuugaaggauuuuagaaaucauauaucucuucuaacccccugaaauccugaguuua

SEQ ID NO: 151463 - RNA, 64 nt, hsa
gcgaggagggccggggaggacacuuccggacacgcucuucuaaagcgugugcagcacggggcga

SEQ ID NO: 151464 - RNA, 64 nt, hsa
ugaaaaaguuaaugcagcucuccaucagaauccacucuucuagggauaugaaaaucucuuaaca

SEQ ID NO: 151465 - RNA, 64 nt, hsa
ggggaauuaauuacucuuuguuagcacucacugacucuucuaugcaguuacuacauaucuagua

SEQ ID NO: 151466 - RNA, 64 nt, hsa
caaauggaaacauaucauucuggaggugcacuuacucuucuacaauguggccggaucauuuguc

SEQ ID NO: 151467 - RNA, 64 nt, hsa
ucggauaucauaacaccaaugucaggauaaauaucucuucuaaagacgauauuuaccuuuuaca

SEQ ID NO: 151468 - RNA, 64 nt, hsa
uccagauuuucguguacccauucuguuucaggagcucuucuagguaaagcugagaucacaggaa

SEQ ID NO: 151469 - RNA, 64 nt, hsa; identical to SEQ ID NO: 151448

SEQ ID NO: 151470 - RNA, 64 nt, hsa
uuuaagaccuccagacucuaacuuuauagaucaucucuucuagagugugcauggauguguguug

SEQ ID NO: 151471 - RNA, 64 nt, hsa
gcugcacagagccccacaccuucacuuacaccuccucuucuagaauugcuuugcucuauuuuug

SEQ ID NO: 151472 - RNA, 64 nt, hsa
uuauauuauuguuuucuacugcuaugugucacacuuugccaaacaggauguggaaaaugaauaa

SEQ ID NO: 151473 - RNA, 64 nt, hsa
cuauauguaugguuguuacuaugggaaaucuuguuuugccaauuuucuuugaaaauucuggcag

SEQ ID NO: 151474 - RNA, 64 nt, hsa
aauaaacaggauaacuguacauuuuucacuuguuuuugccaaugggagguagacacaauaaaau

SEQ ID NO: 151475 - RNA, 64 nt, hsa
ugugcuaccaguacuaagaggggaagacuggcaauuugccaagcacuuggggauuauuauaaca

SEQ ID NO: 151476 - RNA, 64 nt, hsa
uaauuauuauuucuuugaguagcucagacuugguuuugccaaaacucuugguaauuuuugaaga

SEQ ID NO: 151477 - RNA, 64 nt, hsa
uauuugagagguuaguuuuuuuccuacacuuuuuuuugccaacugacuuaacaacauugcuguc

SEQ ID NO: 151478 - RNA, 64 nt, hsa
auccugggccuucuugcuguuguuguggccuuuuuuugccaacuucaaugguccuagucagcau

SEQ ID NO: 151479 - RNA, 64 nt, hsa
uugggaggcccuuuacauagaaaacagcauucuuuuugccaaauaugaccaaauuacuuuuauu

SEQ ID NO: 151480 - RNA, 64 nt, hsa
auaugaaagcauuuuuaucacaaaauaaaaaagguuugccaagcucagugguguuguauuuuuu

SEQ ID NO: 151481 - RNA, 64 nt, hsa
gugaugcucaaauccauugcauccucuuauugaauuugccaauuuguaauuuuugcauaauaaa

SEQ ID NO: 151482 - RNA, 64 nt, hsa
aagaaguuuaagauacuuuagucuuaaauugagguuugccaaaugagaaguucaaaaacuuggg

SEQ ID NO: 151483 - RNA, 64 nt, hsa
aagggaauaagacacuuguacggaacacugaagcuuugccaacuucuacacaugccuuuuuugc

SEQ ID NO: 151484 - RNA, 64 nt, hsa
cugcaaucuugggggugguuuuauuuauuucuuuuuugccaaauagaguguggauucauuucag

SEQ ID NO: 151485 - RNA, 64 nt, hsa
ugaguagggcaauggaaauaccaaaccuucugacuuugccaaaaagcauacaagcaaccugguc

SEQ ID NO: 151486 - RNA, 64 nt, hsa
ucuuucugccccuccaagcugaugaagggaagccuuugccaauggcccauggaagacacuuggu

SEQ ID NO: 151487 - RNA, 64 nt, hsa
gagugauauugggaaagugagauccucucaccauuuugccaagauacucuaaaaugacauccaa

SEQ ID NO: 151488 - RNA, 64 nt, hsa
uuaucacuguuuaaagcuuugaauaucugcaaucuuugccaagguacuuuuuuauuuaaaaaaa

SEQ ID NO: 151489 - RNA, 64 nt, hsa
uuuguccuuuucugcaacaaccuuuccagcuacuuuugccaaauucuauuugucuucuccuuca

SEQ ID NO: 151490 - RNA, 64 nt, hsa
gauaucuaugaaaaccaguggcuuccaucaaaccuuugccaacucagguucacagcagcuuugg

SEQ ID NO: 151491 - RNA, 64 nt, hsa
caggcucuuauugccauuuaaacugccagaaaucuuugccaagguccugguuaaaaaaauugga

SEQ ID NO: 151492 - RNA, 64 nt, hsa
uagguaacacuuuaaauacuuuuuuacucaaagauuugccaagaacacagcuuauuagugaaag

SEQ ID NO: 151493 - RNA, 64 nt, hsa
aucagagagcacaaagauuaaaaguuacuuuaaauuugccaauauuuugggagaacaauaaaac

SEQ ID NO: 151494 - RNA, 64 nt, hsa
uaacaaccuaugguugaaggaaugcucaguuucauuugccaauaaauugguuucucauaacuug

SEQ ID NO: 151495 - RNA, 61 nt, hsa
ccaugaauuccuuuguuuaauuuuuaagcucuuugccaauauuccauuucucuagaauguu

SEQ ID NO: 151496 - RNA, 64 nt, hsa
uugguuuuaugcauugaugguuuuuuuuuucuuuuuugccaaauugacugucacgcggcagcuu

SEQ ID NO: 151497 - RNA, 64 nt, hsa
ggaacccuccuccugucaauggggguguaguauuuuugccaaaauaucauguucaauuucagua

SEQ ID NO: 151498 - RNA, 64 nt, hsa
guucuuuucccguaucaauucauuccuucaucucuuugccaaguuguuuuccuuucagggccug

SEQ ID NO: 151499 - RNA, 64 nt, hsa
guuaugauuuugaaggcuguggguucagggagucuuugccaauccuguuggcccuaaacuauca

SEQ ID NO: 151500 - RNA, 64 nt, hsa
cucuagcaacaugaucuuaauuguauccagaggauuugccaauguauguucagucucucaagau

SEQ ID NO: 151501 - RNA, 64 nt, hsa
gagggaacucaaaauaguuaccagaaaaauaauauuugccaauaugacguguauauugcucagc

SEQ ID NO: 151502 - RNA, 64 nt, hsa
uaaaacuuucaauggagauagggcuagaaauacuuuugccaaauagcauucuuauucacuuuau

SEQ ID NO: 151503 - RNA, 64 nt, hsa
uaaaugcagucaucuuaauacuagucuauacauuuuugccaaauggcgcaaauauaccuccauu

SEQ ID NO: 151504 - RNA, 64 nt, hsa
gagaaagaaaugccaauuccaggccaaagcguuauuugccaaguuuucuuagaaugaauuuuac

SEQ ID NO: 151505 - RNA, 64 nt, hsa
aaaugugagauuaacaggagagcagcaauacgauuuugccaauggaauaacagauuugccggca

SEQ ID NO: 151506 - RNA, 64 nt, hsa
accccucaccacccccacuggugagacaguuuacuuugccaacuugccauguuuuugccaaaac

SEQ ID NO: 151507 - RNA, 64 nt, hsa
ggugagacaguuuacuuugccaacuugccauguuuuugccaaaaccaagauuuugaaggaaaug

SEQ ID NO: 151508 - RNA, 64 nt, hsa
aaagcccaauacuuagagucccaauuuugucucauuugccaaaaaaaaaaaaaaaaaaaaagca

SEQ ID NO: 151509 - RNA, 64 nt, hsa
uggcuuuggaaaaaucucaugaugaaaauucauauuugccaacuuuguuagcugcgugcgugcu

SEQ ID NO: 151510 - RNA, 64 nt, hsa
gaaagaaacuucaguccccauuauuaccugugucuuugccaagcugccuagcauacaucaguau

SEQ ID NO: 151511 - RNA, 64 nt, hsa
auccauacuuagaauuuggcauaucaucugggauuuugccaauauacgucaaagcccuuuaaga

SEQ ID NO: 151512 - RNA, 64 nt, hsa
gggauaugcagaacuugggauguguguauauauaaauauauaauauauauaaauauauauaaua

SEQ ID NO: 151513 - RNA, 64 nt, hsa
gcagaacuugggauguguguauauauaaauauauaauauauauaaauauauauaauacugacuu

SEQ ID NO: 151514 - RNA, 64 nt, hsa
ggauguguguauauauaaauauauaauauauauaaauauauauaauacugacuuaaaaaaucaa

SEQ ID NO: 151515 - RNA, 64 nt, hsa
cacaaguccugaauuucccauucuuacuuacuaaaauauauauagaaauauauacgaacaaaac

SEQ ID NO: 151516 - RNA, 64 nt, hsa
auuucccauucuuacuuacuaaaauauauauagaaauauauacgaacaaaacacacgcgcgcac

SEQ ID NO: 151517 - RNA, 64 nt, hsa
uugucuuuuaaaaugaguacauauauaggcaauaaauauauaugcucagaucaauauacuuguu

SEQ ID NO: 151518 - RNA, 64 nt, hsa
uacuuaccuaguccauccauacucauauuauucaaauauauaggugguacuuuugaaacaauua

SEQ ID NO: 151519 - RNA, 64 nt, hsa
gaaaaccagcaaacuaaaacuucugggcagcaaaaauauauaaaugcuucagaugucaaauacc

SEQ ID NO: 151520 - RNA, 64 nt, hsa
aaucucccuuucuucuucaguuccuuccuuguucaauauauacccuucucuaaacugugcgggu

SEQ ID NO: 151521 - RNA, 64 nt, hsa
acuuucucacaaaagauuuuaagauaacauuucuaauauauaugcaccaauauauaugccuuua

SEQ ID NO: 151522 - RNA, 64 nt, hsa
gauuuuaagauaacauuucuaauauauaugcaccaauauauaugccuuuaauaauuauaccauc

SEQ ID NO: 151523 - RNA, 64 nt, hsa
acauguauuugguaugcauguguaucuauauaaaaauauauaagagggacuuuaugggauagua

SEQ ID NO: 151524 - RNA, 64 nt, hsa
uauguagagucuagauuuauauacugcaauguaaaauauauauauauuuaccuuuuuuaaagac

SEQ ID NO: 151525 - RNA, 64 nt, hsa
ucucagguuacuguauaacuguuauaauauauuuaauauauaaaauuaagacuuuugcuuccag

SEQ ID NO: 151526 - RNA, 64 nt, hsa
uggaaaaacaugaauucauaaauucaggaagcacaauauauaccaaacauauauuuaaauaaaa

SEQ ID NO: 151527 - RNA, 64 nt, hsa
aaaauccaacucugcuuuuggucuugcuucuauaaauauauaguguauacuugguguagacuuu

SEQ ID NO: 151528 - RNA, 64 nt, hsa
gaccccaaacuggcauuuaacacuguuuauaaaaaauauauauauauauauauauauauauaau

SEQ ID NO: 151529 - RNA, 64 nt, hsa
guaacaauauaauuuugcuuuuguauuauagacaaauauauaaauaauaaaggcaggcaacuuu

SEQ ID NO: 151530 - RNA, 64 nt, hsa
agauuguuucauaucuauuccuuaaguguaaagaaauauauaaugcaugguuuguaauaaaauc

SEQ ID NO: 151531 - RNA, 64 nt, hsa
uaguacugaauauuuacuuacaguuucuaucaaaaauauauauuuguuucuaaaauuacuuguu

SEQ ID NO: 151532 - RNA, 64 nt, hsa
gauucuacuuuuaggguuauuuguacuuuugaguaauauauaaagugacaauauuaagguacau

SEQ ID NO: 151533 - RNA, 64 nt, hsa
gaaucuacaaauaucuuuauauguauauaauuugaauauauacauguauguauauacagaugug

SEQ ID NO: 151534 - RNA, 64 nt, hsa
auauauauauauauaucuguauagacacacauauaauauauauagauauauaaucccuauauau

SEQ ID NO: 151535 - RNA, 64 nt, hsa
uguggauauauauacacacacacacagaaagaugaauauauauauauauauaucuguauagaca

SEQ ID NO: 151536 - RNA, 64 nt, hsa
ucuucaauauuuugacauaauguauuaacauuuuaauauauaauguacaauuuaagaauuggug

SEQ ID NO: 151537 - RNA, 64 nt, hsa
gauuuuguucauuaccuacuuaauauuuccuuuaaauauauacuaacuguuaaggcccucuaau

SEQ ID NO: 151538 - RNA, 64 nt, hsa
auauauacauauauauauauauaaauauauauauaauauauaaaauauagauauggaaaugacu

SEQ ID NO: 151539 - RNA, 64 nt, hsa
gugcuagguguauauauacauauauauauauauaaauauauauauaauauauaaaauauagaua

SEQ ID NO: 151540 - RNA, 64 nt, hsa
ugaaagguuuaucuaagaagaaagaaacagagauaauauauauauagaaagauguauauagaug

SEQ ID NO: 151541 - RNA, 64 nt, hsa
uaagguggucucagccaauuguuacaagcuacagaauauauacaugcaucuauguacagagccu

SEQ ID NO: 151542 - RNA, 64 nt, hsa
auucaacuacacuauauauaaauaaaauauauacaauauauacauuguuuucacuguaucacau

SEQ ID NO: 151543 - RNA, 64 nt, hsa
guugcuacuauucaacuacacuauauauaaauaaaauauauacaauauauacauuguuuucacu

SEQ ID NO: 151544 - RNA, 64 nt, hsa
aggucuguaaauguguacauacaugucuuauauaaauauauaauauauaaauauggugucugug

SEQ ID NO: 151545 - RNA, 64 nt, hsa
uaaauguguacauacaugucuuauauaaauauauaauauauaaauauggugucuguguacauau

SEQ ID NO: 151546 - RNA, 64 nt, hsa
augccuaauaaauacauugacuauauauaaaaugaauauauacauacacauguaugccuguaua

SEQ ID NO: 151547 - RNA, 64 nt, hsa
uguguuuuuuaguguugucacuuguuuauagauaaauauauaaauaaccuguuuggauccuggu

SEQ ID NO: 151548 - RNA, 64 nt, hsa
uaauuguuagcuguuuugaaauuauauauauauaaauauauauaaauauauaaauauaugccag

SEQ ID NO: 151549 - RNA, 64 nt, hsa
cuguuuugaaauuauauauauauaaauauauauaaauauauaaauauaugccagucuuggcuga

SEQ ID NO: 151550 - RNA, 64 nt, hsa
cacauaugacuauacgggacauauguaauauauaaauauauauauaaaacauuccccucugucc

SEQ ID NO: 151551 - RNA, 64 nt, hsa
ucacucuacacauaugacuauacgggacauauguaauauauaaauauauauauaaaacauuccc

SEQ ID NO: 151552 - RNA, 64 nt, hsa
ccaaccccuuacacuacacugaacacuaaagaauaauauauaagcacacaaauuggugacagaa

SEQ ID NO: 151553 - RNA, 64 nt, hsa
ugugcccauaaagaucgauucagacucugcugaaaauauauagcucucacaaguucagcaucac

SEQ ID NO: 151554 - RNA, 64 nt, hsa
uuuuuguuuuuguuuuuugcuguuggcaguuuaaaauauauauaauuaauaaaaccugugcuug

SEQ ID NO: 151555 - RNA, 64 nt, hsa
auaguuauuuuauccuguggugcauguuugggcaaauauauauauagccugauaaacaacuucu

SEQ ID NO: 151556 - RNA, 64 nt, hsa
uuaccuggaauuuuugcuuacagccguagcuaugaauauauauagggugguccccagucucugu

SEQ ID NO: 151557 - RNA, 64 nt, hsa
uuaugaccuggauauauaagcaaaucagcuaggaaauauauaauuguauuuuauauuaauguuu

SEQ ID NO: 151558 - RNA, 64 nt, hsa
uuaaacuaguaaugggccaauuaaaauauauauaaauauauauuuuucaaccagcauuuuacua

SEQ ID NO: 151559 - RNA, 64 nt, hsa
uaugcaauuuuuaaacuaguaaugggccaauuaaaauauauauaaauauauauuuuucaaccag

SEQ ID NO: 151560 - RNA, 64 nt, hsa
gucucuacugauaugucuuauuaacaucugaaaaaauauauauuuuuuauuggaaaauucuaau

SEQ ID NO: 151561 - RNA, 64 nt, hsa
ucuugggcaggaguuguugaaaauagguuauuggaauauauaaguuaucucacugcucauguac

SEQ ID NO: 151562 - RNA, 64 nt, hsa
uggcacuucuuuugucuuaggaauacauguuguaaauauauaucuguguauguguguauacaca

SEQ ID NO: 151563 - RNA, 64 nt, hsa
ugggcauugauacauauauaaauauauagauauaaauauauaugaauauauuuuuuuaaguuuc

SEQ ID NO: 151564 - RNA, 64 nt, hsa
gcccacguguuuuaugggcauugauacauauauaaauauauagauauaaauauauaugaauaua

SEQ ID NO: 151565 - RNA, 64 nt, hsa
uaaauuuuagguauaaauaaauauauauauguauaauauauauuccaauguauuccaagcuaag

SEQ ID NO: 151566 - RNA, 64 nt, hsa
gcaugaaguauugcuuaaauuuuagguauaaauaaauauauauauguauaauauauauuccaau

SEQ ID NO: 151567 - RNA, 64 nt, hsa
aucuucugggugguuugauaguguuuuuaaaaguaauauauaauguggggugaaaugggaguag

SEQ ID NO: 151568 - RNA, 64 nt, hsa
ucccucagcugauaaugguaguugaucuguuguaaauauauacauauaugcauauuugcacuuc

SEQ ID NO: 151569 - RNA, 64 nt, hsa
guguuucauuacuugaauguaguuaucuauugaaaauauauauuauauacauagacauauauau

SEQ ID NO: 151570 - RNA, 64 nt, hsa
gggggacuggugauauguugaucuuuuucaaaaaaauauauauaugacaaaaaaaaaaaaaaag

SEQ ID NO: 151571 - RNA, 64 nt, hsa
caccacuaguuuuaauauaguacaaugaaaaaauaauauauauauauauaguacaaugguccag

SEQ ID NO: 151572 - RNA, 64 nt, hsa
uauuagacaacaacaaaaggaacaacuaaccugaaauauauaauaacuuugaacuuaaauauac

SEQ ID NO: 151573 - RNA, 64 nt, hsa
uagcaaaaauuaaaauucuuaagaaaacuucacuaauauauagucauaaugugguauauucaua

SEQ ID NO: 151574 - RNA, 64 nt, hsa
gugauuuuaaaccaaauugucuuccuguagucacaauauauacuguagccuuuuaacagcaagu

SEQ ID NO: 151575 - RNA, 64 nt, hsa
cauauagauagguagauauauauauauauauauaaauauauauacauggauauauaaaguuucu

SEQ ID NO: 151576 - RNA, 64 nt, hsa
cuacaccucuuaaaaaacauugauuggucuaaaaaauauauagauaacauccuaaguuaacaua

SEQ ID NO: 151577 - RNA, 64 nt, hsa
caugcugugugccacaggccaguguuguuggugaaauauauaaacauuuauuuaaagagaaaag

SEQ ID NO: 151578 - RNA, 64 nt, hsa
uaaaaaauuuaauuuguccuuccuaagaaggauaaauauauaaaaaagccacuggaaugaaaac

SEQ ID NO: 151579 - RNA, 64 nt, hsa
gauuugugaugcaguguuuguaguccuuguaaacaauauauacagacuauacaagaauuaauuu

SEQ ID NO: 151580 - RNA, 64 nt, hsa
uuguaaauauauaaauauauauauauauaaaauaaauauauauaaaccuaaaaaagauauauua

SEQ ID NO: 151581 - RNA, 64 nt, hsa
gugaaggaauauauggcagaguuguaaauauauaaauauauauauauauaaaauaaauauauau

SEQ ID NO: 151582 - RNA, 64 nt, hsa
aaccaaaggugaaggaauauauggcagaguuguaaauauauaaauauauauauauauaaaauaa

SEQ ID NO: 151583 - RNA, 64 nt, hsa
uccagcauguauuguuccaaauaugacucccuaaaauauauacacuuugcagaagcucuaggcc

SEQ ID NO: 151584 - RNA, 64 nt, hsa
auuuccaaauuauaaacuauguuaauaccuauaaaauauauagccaggaaccauuuaucaucaa

SEQ ID NO: 151585 - RNA, 64 nt, hsa
auuauugauacucuuucuaaauaagagguuuuaaaauauauaaaaacuuuaugauccaauuaua

SEQ ID NO: 151586 - RNA, 64 nt, hsa
aaaaagaaccccacuuauucuuaguuaauacuaaaauauauagcaauaaauugcuguuuauuuu

SEQ ID NO: 151587 - RNA, 64 nt, hsa
cagaugaaacugaauaucauuguaauaaucucauaauauauauuuguaacuuuguagcuaucuu

SEQ ID NO: 151588 - RNA, 64 nt, hsa
augcaguuuucauggacauagaaaauucaaauagaauauauaauauugaauuuaagauuugggg

SEQ ID NO: 151589 - RNA, 64 nt, hsa
auauauauacauauauauauauauauaaacaugaaauauauauauauggcuccuuugugcccca

SEQ ID NO: 151590 - RNA, 64 nt, hsa
uuuugguaauaguggcagguauuuauuccuucugaauauauaccccauuauaggaauaacuguu

SEQ ID NO: 151591 - RNA, 64 nt, hsa
uaaauuugcuaguggauuuugucuaaugugcagaaauauauaugucuaaugugcagaaauauau

SEQ ID NO: 151592 - RNA, 64 nt, hsa
uaaugugcagaaauauauaugucuaaugugcagaaauauauauguguguauguguguauauaua

SEQ ID NO: 151593 - RNA, 64 nt, hsa
aaaaaagaaaaaaaaaaauaaaacugauguaaugaauauauaauuacaacaaaagaggucuaac

SEQ ID NO: 151594 - RNA, 64 nt, hsa
ccacaauaaauuuuaaugagcacuacaaauuuagaauauauaaaaauaucaguaaccuaugaau

SEQ ID NO: 151595 - RNA, 64 nt, hsa
acuguacuauuucaaagcuucuaaauaaauauaaaauauauauauuauauuauauaauuuuccu

SEQ ID NO: 151596 - RNA, 64 nt, hsa
uuacacaugaauauaaaaucuauaauucuauaugaauauauagagauauagaaacaucugaacu

SEQ ID NO: 151597 - RNA, 64 nt, hsa
uuugcccaaaauaacucauuuuguauuaucugaaaauauauaauuucuggucauguguauguua

SEQ ID NO: 151598 - RNA, 64 nt, hsa
guguuuucucuggcacagaguagaucuuuugggaaauauauaugaaaguggauuaaguuugacu

SEQ ID NO: 151599 - RNA, 64 nt, hsa
gguguaagaguugaugaaugacuuuagcugugugaauauauaauagucaaacugcaaacauuuu

SEQ ID NO: 151600 - RNA, 64 nt, hsa
uucaaaauaauuagcuauauuuuuauauaauaugaauauauacauaaaaauuguuucuauaaau

SEQ ID NO: 151601 - RNA, 64 nt, hsa
uuuaagaagcgaacaaaaaguaauguauaucuguaauauauaaucaaaugauucauuuuucugu

SEQ ID NO: 151602 - RNA, 64 nt, hsa
ggaaauagcagugaauuuuagucauuaacuucaaaauauauauauauauauaauuuaaaggaaa

SEQ ID NO: 151603 - RNA, 64 nt, hsa
aaaauuggcggguaaaaaucacaaaaugcagucgaauauauauaugaaaacuugcauuagguga

SEQ ID NO: 151604 - RNA, 64 nt, hsa
aaccuucuuaacaaaacuucuuaaaacuggaaaaaauauauauuauguaucuauguaucauauu

SEQ ID NO: 151605 - RNA, 64 nt, hsa
aauauaugauuuuuaugucaaucaagacaaaugaaauauauauguauguguauauauauacaug

SEQ ID NO: 151606 - RNA, 64 nt, hsa
auauguauguguauauauauacauguauguaugaaauauauauaugugcguguguguguguaua

SEQ ID NO: 151607 - RNA, 64 nt, hsa
ggccaaaacuagagugauacucaucucaggcacaaauauauauggggacaucaaaacuucaaua

SEQ ID NO: 151608 - RNA, 64 nt, hsa
gcuugcuucaaacuaagguuucccuaccuucaaaaauauauauaacaucucuccauuuagauaa

SEQ ID NO: 151609 - RNA, 64 nt, hsa
auauuuguaugcuguauauauuguaaauauauauaauauauaaaguuauauauuuaugagaaac

SEQ ID NO: 151610 - RNA, 64 nt, hsa
acaugaacaauauuuguaugcuguauauauuguaaauauauauaauauauaaaguuauauauuu

SEQ ID NO: 151611 - RNA, 64 nt, hsa
auuauuugaaaaucauucuaaauauauauuuugaaauauauagauuauauuuguauguaaauua

SEQ ID NO: 151612 - RNA, 64 nt, hsa
aauauuuucuguagauuauuugaaaaucauucuaaauauauauuuugaaauauauagauuauau

SEQ ID NO: 151613 - RNA, 64 nt, hsa
uaaauuauaauguauaaucuauacauuauaauguaauauauaaacuaaaauuuauggcacaaaa

SEQ ID NO: 151614 - RNA, 64 nt, hsa
acucagggguucuuaaccuacauuucaugcaaaaaauauauauauuucaauguauuuuuuauuu

SEQ ID NO: 151615 - RNA, 64 nt, hsa
aacguauguauuuauauauuauauauuuauauauaauauauauuauauauuuagcauugcugag

SEQ ID NO: 151616 - RNA, 64 nt, hsa
aucauaauuugaagaaggccagcauuuaugguagaauauauaauuauauauaagguggccacgc

SEQ ID NO: 151617 - RNA, 64 nt, hsa
caauuugaauauaaauuuaucauuuaguuauaaaaauauauagcgacauccucgaggcccuagc

SEQ ID NO: 151618 - RNA, 64 nt, hsa
uauuuuauuaggaguaccauaauucugguagcuaaauauauauuuuagauagaugaagaagcua

SEQ ID NO: 151619 - RNA, 64 nt, hsa
gaauuuuguauuguuuuacuuuuuuuuuuauuucaauauauacaguuugaugaugugcuugaaa

SEQ ID NO: 151620 - RNA, 64 nt, hsa
uauacaguuugaugaugugcuugaaauuggugcaaauauauacacacccuuguaagugcaaagu

SEQ ID NO: 151621 - RNA, 64 nt, hsa
uguacuaaauacagcagaaaaucuacucuuuagcaauauauaacacaguauaugcuuuuuuaua

SEQ ID NO: 151622 - RNA, 64 nt, hsa
uuuuacauaaaaguugugcucuuaauaaacauguaauauauaauuuaucaauugguuuaugugu

SEQ ID NO: 151623 - RNA, 64 nt, hsa
ugcuugaguguguucgcguguguggguggauauaaauauauauaaauauauauaaauaaauaua

SEQ ID NO: 151624 - RNA, 64 nt, hsa
uguucgcguguguggguggauauaaauauauauaaauauauauaaauaaauauauauauccucu

SEQ ID NO: 151625 - RNA, 64 nt, hsa
gguggauauaaauauauauaaauauauauaaauaaauauauauauccucuguauaaaaugaggu

SEQ ID NO: 151626 - RNA, 64 nt, hsa
aguacacuuguagccaaaacuggaagacaaaaccaauauauaauuuggcugcugauuggcuuac

SEQ ID NO: 151627 - RNA, 64 nt, hsa
cuccuuuccccuucuggucccugcgcuuugguauaauauauauacuucuccauacacagaccuc

SEQ ID NO: 151628 - RNA, 64 nt, hsa
aaauauauauauauauguguguguguguguguguaauauauauauguauauauauaguacaugu

SEQ ID NO: 151629 - RNA, 64 nt, hsa
ucuaucacuccuuuaccuagggaaggaaaaaaaaaauauauauauauaugugugugugugugug

SEQ ID NO: 151630 - RNA, 64 nt, hsa
caaaagugguuuuuguuuauuaaauuugguaauaaauauauauaauacacagacaggauaguuu

SEQ ID NO: 151631 - RNA, 64 nt, hsa
aaauuugauaacaaaucaucaacuuccacuggucaauauauagauuuugggugucugaggcccc

SEQ ID NO: 151632 - RNA, 64 nt, hsa
agacccuuuaauaagugagugccauaagaaagucaauauauauuguuuaaaagauauuucaguc

SEQ ID NO: 151633 - RNA, 64 nt, hsa
ucugugaaauuaacaugcuuguguauagcuuucuaauauauauaauauuaugguaauagcagaa

SEQ ID NO: 151634 - RNA, 64 nt, hsa
cauacuugaaauagguggagcuuuuucuuuugaaaauauauauucacaauuuuaauauuuuaau

SEQ ID NO: 151635 - RNA, 64 nt, hsa
caggcaauuugaggaaagaagaaauggcauggggaauauauauguuuuguuucuuagggaaaac

SEQ ID NO: 151636 - RNA, 64 nt, hsa
aaaacugaauguacugauuuagaaaauauauauaaauauauauuguuaaauauacacgggacug

SEQ ID NO: 151637 - RNA, 64 nt, hsa
aaacaaguuaaaaacugaauguacugauuuagaaaauauauauaaauauauauuguuaaauaua

SEQ ID NO: 151638 - RNA, 64 nt, hsa
cagcauuagcaauaugguuccaauagaggaguuaaauauauauuguuaaaggagaccuguagca

SEQ ID NO: 151639 - RNA, 64 nt, hsa
aaucauuaaaguuggaugaucaguuuuuuauaaaaauauauauuuuuguccaagaaaaaaaaaa

SEQ ID NO: 151640 - RNA, 64 nt, hsa
gauuuauaaauuggaaaucaccagguuacuugccaauauauagucauauugcugccauuguacu

SEQ ID NO: 151641 - RNA, 64 nt, hsa
auagucauauugcugccauuguacuuaauuucuaaauauauaaaauccacauuuaaaaauuaua

SEQ ID NO: 151642 - RNA, 64 nt, hsa
gaaagauauauuuuaaguggugcacuaauuagugaauauauaggaaaauuaucugacgaguauc

SEQ ID NO: 151643 - RNA, 64 nt, hsa
cugaaggcauuuucagcucuagcaauuuauuuauaauauauaaguucauauauuuuuuaaucca

SEQ ID NO: 151644 - RNA, 64 nt, hsa
augcaauggaauauagauauguauauacacauauaauauauaugcuaaaguauaaagaguaaua

SEQ ID NO: 151645 - RNA, 64 nt, hsa
guucucaugucaaagacuacuccuugccccauugaauauauagugguagcagguguacaaauug

SEQ ID NO: 151646 - RNA, 64 nt, hsa
guaaaauaucuaaagcaugaaucuaagagcacgcaauauauaauuuuaaagaaaauauucuauu

SEQ ID NO: 151647 - RNA, 64 nt, hsa
aacacuaucggauuauuuauauuacucaagagacaauauauaugaauucuuaugaaagugcuug

SEQ ID NO: 151648 - RNA, 64 nt, hsa
aacauguauauaaaagaaugaaauugaaaaauaaaauauauaaacauaaauaaauuagguagug

SEQ ID NO: 151649 - RNA, 64 nt, hsa
uuccuguuaacaagcuggcagcaaagcuucagaaaauauauaugcaagcacaacuugaagcuga

SEQ ID NO: 151650 - RNA, 64 nt, hsa
ggagaguaauuuaugcuuuggagaauuugacucaaauauauacuugaccaagcaccaugauccc

SEQ ID NO: 151651 - RNA, 64 nt, hsa
uagacuguacauauuauauauaauauauauauaaaauauauauauauauauauauauauccaua

SEQ ID NO: 151652 - RNA, 64 nt, hsa
aaaguuuuauagcuagacuguacauauuauauauaauauauauauaaaauauauauauauauau

SEQ ID NO: 151653 - RNA, 64 nt, hsa
uaaaaugcuuuuguauuuacugccauguaauugaaauauauagauuauuguaaccuuucaaccu

SEQ ID NO: 151654 - RNA, 64 nt, hsa
gcacucuagccugggcaacagaguaagacaaaaaaauauauauauauugaaaaucaaaggaggc

SEQ ID NO: 151655 - RNA, 64 nt, hsa
uuuccaguguagcagaucucuauauaaauauauaaauauauauaacuggcuuauuuucuuuuaa

SEQ ID NO: 151656 - RNA, 64 nt, hsa
uuuauauguuuccaguguagcagaucucuauauaaauauauaaauauauauaacuggcuuauuu

SEQ ID NO: 151657 - RNA, 64 nt, hsa
augcccagguuacauuuaaacuauacauauacauaauauauacauacguguguacuuauuauau

SEQ ID NO: 151658 - RNA, 64 nt, hsa
ccaguaagauuugauguuuaaagacuuccacugcaauauauaaauacugaaaaugugauguucu

SEQ ID NO: 151659 - RNA, 64 nt, hsa
auaucaguauuuagaaauaaauugcaaaggugggaauauauacuuaaauaauuugucuuaagua

SEQ ID NO: 151660 - RNA, 64 nt, hsa
ucccuauacaauuguuaaugcacaaaugaucucuaauauauacuuacauacguaaaaucauaaa

SEQ ID NO: 151661 - RNA, 64 nt, hsa
cugggcaacauaccaagacccccgucucuuuaaaaauauauauauuuuaaauauacuuaaauau

SEQ ID NO: 151662 - RNA, 64 nt, hsa
cucuuuaaaaauauauauauuuuaaauauacuuaaauauauauuucuaauaucuuuaaauauau

SEQ ID NO: 151663 - RNA, 64 nt, hsa
aaauauacuuaaauauauauuucuaauaucuuuaaauauauauauauauuuuaaagaccaauuu

SEQ ID NO: 151664 - RNA, 64 nt, hsa
aaauuaugacugaaagguuuauuaaaaugauuguaauauauagaaaguaucuguguuuaagaag

SEQ ID NO: 151665 - RNA, 64 nt, hsa
gagugauuucauuuugggaaacagguuucaaaugaauauauauacauggguaaaauuacucugu

SEQ ID NO: 151666 - RNA, 64 nt, hsa
aucugguaaauuguagaacaauugcauguguuuaaauauauauacaaacauaucacacauuaaa

SEQ ID NO: 151667 - RNA, 64 nt, hsa
uguuuaaauauauauacaaacauaucacacauuaaauauauauauauuuaaaucaugcuuuguu

SEQ ID NO: 151668 - RNA, 64 nt, hsa
caaaggaauuauaucauuauguuccuaaggaguaaauauauauuugaccuguaaguguguguau

SEQ ID NO: 151669 - RNA, 64 nt, hsa
cuguagguggagcaaguaauaagccaugcugugcaauauauacauaaagcuucugcuucucaug

SEQ ID NO: 151670 - RNA, 64 nt, hsa
auauuugaauugaaacaauagaaauuuuucucauaauauauaccuaugugaaaccaacuuaucu

SEQ ID NO: 151671 - RNA, 64 nt, hsa
acugcuguguuauuuacacuguuuuguauuguacaauauauaugcucagcacugcccccuucuc

SEQ ID NO: 151672 - RNA, 64 nt, hsa
uguuuuauucucaaguggagaacuucucccacauaauauauauauauauauauauuuuaauuua

SEQ ID NO: 151673 - RNA, 64 nt, hsa
uuuguuuuauauaggucccaaauuauaauugucaaauauauauuuuaaauuaauaaaaguuguc

SEQ ID NO: 151674 - RNA, 64 nt, hsa
uguuuuaauaucagguggauuuuuguuucuaagcaauauauacauaaaaucaaccaacauaucu

SEQ ID NO: 151675 - RNA, 64 nt, hsa
aaauguaaauuguaauaauguaaaugggggcuucaauauauauauauaauacacacacacacac

SEQ ID NO: 151676 - RNA, 64 nt, hsa
cugaugaacuaccacaaaguuuuaagugacuagaaauauauacaguaaaaucccacuuucaugc

SEQ ID NO: 151677 - RNA, 64 nt, hsa
uaccuuuucccucaugaaauuuuaaauauaugcaaauauauauaucauuagauuccuguggugg

SEQ ID NO: 151678 - RNA, 64 nt, hsa
ggaauuaauauucacuucugaaggacuuacuuguaauauauaauuuaucauuuuagccagcagg

SEQ ID NO: 151679 - RNA, 64 nt, hsa
auacacaguggcaaaacaaaaguacauugcuuaaaauauauagugaaaaaugucacuauaucuu

SEQ ID NO: 151680 - RNA, 64 nt, hsa
acugcacuuuguuuagaaaaaaaacugaagaugaaauauauauuguaaagaagggauauuaaga

SEQ ID NO: 151681 - RNA, 64 nt, hsa
gaauauauauauuauauauauaaaauacauauggaauauauauauuuuauauauauauauauau

SEQ ID NO: 151682 - RNA, 64 nt, hsa
auuauauauauuuuuauauauauaauauauauggaauauauauauuauauauauaaaauacaua

SEQ ID NO: 151683 - RNA, 64 nt, hsa
ggaauauguauauuauauauauuuuuauauauauaauauauauggaauauauauauuauauaua

SEQ ID NO: 151684 - RNA, 64 nt, hsa
aagggaaaccuaaaacaaauacccuuccauauauaauauauauggaauauguauauuauauaua

SEQ ID NO: 151685 - RNA, 64 nt, hsa
ucuccaaacccuugcugccaguuccucuuugauaaauauauaguuaauucgaaauaaaauccau

SEQ ID NO: 151686 - RNA, 64 nt, hsa
uauauguuuuauacauaaauaaaacauuucaucuaauauauauaugugugugugaguauaugug

SEQ ID NO: 151687 - RNA, 64 nt, hsa
ccagaacuugagccuuguguauagauuuuaaaagaauauauauaucagccgggcgcgguggcuc

SEQ ID NO: 151688 - RNA, 64 nt, hsa
gaaaaguauuuuucuuguauauuauuaaguaaugaauauauaagaacuguacucuucucagcuu

SEQ ID NO: 151689 - RNA, 64 nt, hsa
aggauuuaaggaggugaagucgggucaaaaauaaaauauauauacauauauacauugcuuagaa

SEQ ID NO: 151690 - RNA, 64 nt, hsa
ucuaauuccacaggucaucagaugccugcuugauaauauauaaacaauaaaaacaacuuucacu

SEQ ID NO: 151691 - RNA, 64 nt, hsa
gccuuaacuucuggccaaguuuguuuuuuauauaaauauauauacauauauacauauuauguau

SEQ ID NO: 151692 - RNA, 64 nt, hsa
ugcuggguugaaaaauguuuugaaagccuuuuaaaauauauaucuuuauaaaguaauauucagg

SEQ ID NO: 151693 - RNA, 64 nt, hsa
cacugcagcugcuuuccauuuuuauauauauauaaauauauauaaauauauacuuuuuaaaaau

SEQ ID NO: 151694 - RNA, 64 nt, hsa
gcuuuccauuuuuauauauauauaaauauauauaaauauauacuuuuuaaaaauaauuuauaaa

SEQ ID NO: 151695 - RNA, 64 nt, hsa
cugacccacacaaagguucuggagauuacuggagaauauauauaaauauauauauguacguaua

SEQ ID NO: 151696 - RNA, 64 nt, hsa
caaagguucuggagauuacuggagaauauauauaaauauauauauguacguauauauguaaaua

SEQ ID NO: 151697 - RNA, 64 nt, hsa
cguauauauguaaauacacauauacguauauauaaauauauauauacauauguguguguauaua

SEQ ID NO: 151698 - RNA, 64 nt, hsa
aaaaugauauuuucuaaguaaguuuauucagaaaaauauauauuaauuuaauucugcaagaaaa

SEQ ID NO: 151699 - RNA, 64 nt, hsa
uuuuucuagcauucacccuugggcugcagauaguaauauauaaacacacacaaugauugcaaga

SEQ ID NO: 151700 - RNA, 64 nt, hsa
accaaagagcucaucuuagcuuacaaacacuaagaauauauacaggauauagagauaaguuguc

SEQ ID NO: 151701 - RNA, 64 nt, hsa
guuuccuaaauaaaugaggaguagcauaguuuaaaauauauauaucuuauaacuuucuacaaca

SEQ ID NO: 151702 - RNA, 64 nt, hsa
uguauauguauaucaaaacauguaguacacccuaaauauauauaauuuuuauuugucaaauaua

SEQ ID NO: 151703 - RNA, 64 nt, hsa
uacagugcaaguuuuuucacuuuuacuuaaacauaauauauaauggauauucauuuauacugau

SEQ ID NO: 151704 - RNA, 64 nt, hsa
ucauugcugcauuuuguacuuugaacacacacauaauauauauaaccagugguaaaucaugacu

SEQ ID NO: 151705 - RNA, 64 nt, hsa
uuauauauauauuauauauauaauauauauauaaaauauauauauauaugcucuccucuuucag

SEQ ID NO: 151706 - RNA, 64 nt, hsa
auaauauaauauauuauauauauauuauauauauaauauauauauaaaauauauauauauaugc

SEQ ID NO: 151707 - RNA, 64 nt, hsa
auauaauauauguguauauauauauuauauauauaauauauaauauaauauauuauauauauau

SEQ ID NO: 151708 - RNA, 64 nt, hsa
gagcaauaguuugccccuuuuggaaugaucucugaauauauaaaacacacacacaaagagcaau

SEQ ID NO: 151709 - RNA, 64 nt, hsa
gagcaauaguuugccccuuuuggaacgaccccugaauauauaaaacacacacacaccccgcgca

SEQ ID NO: 151710 - RNA, 64 nt, hsa
ucugacagguagucaugaaaaucaaaugaugcaaaauauauacaagcacuuuguaaauuguaaa

SEQ ID NO: 151711 - RNA, 64 nt, hsa
guaugagaaucuaucuguucugugcuggacuucuaauauauagaacugugagauaaugggucac

SEQ ID NO: 151712 - RNA, 64 nt, hsa
gguuuuuaaaugcuggaggauuccaaucaauauaaauauauauauauauauacacacacauaua

SEQ ID NO: 151713 - RNA, 64 nt, hsa
acacugggguuaagucucugguauuuaggcuggcaauauauauauuaaccauauuuuaaaagua

SEQ ID NO: 151714 - RNA, 64 nt, hsa
guuuaugucucagaugcuaacgugugaaaauauaaauauauauaauauauaaaguaaccagucu

SEQ ID NO: 151715 - RNA, 64 nt, hsa
ucagaugcuaacgugugaaaauauaaauauauauaauauauaaaguaaccagucuuccuguauu

SEQ ID NO: 151716 - RNA, 64 nt, hsa
auauuucauguaaacauuguacauuuauuauuguaauauauacuauuaugcagcuuauuuuacc

SEQ ID NO: 151717 - RNA, 64 nt, hsa
gcauuuuccuugcaaggacaacuucuaccguaugaauauauauuauauuuauguauuauauuuu

SEQ ID NO: 151718 - RNA, 64 nt, hsa
uguugcauuuuuuuccaugcuguuuuaacuuguaaauauauauguauacauauggaagauauua

SEQ ID NO: 151719 - RNA, 64 nt, hsa
aguugauauggccaaagggagagaggccuuuuaaaauauauauauauauacacauauauaugua

SEQ ID NO: 151720 - RNA, 64 nt, hsa
gcuaaccaguuaaaaguacuguacacccaugcucaauauauaguccuggaaauagcaauugaaa

SEQ ID NO: 151721 - RNA, 64 nt, hsa
gccugggugacaaaagcaaaaguccaucuuaagaaauauauauauauauuauauauauucuuag

SEQ ID NO: 151722 - RNA, 64 nt, hsa
gcaacacagucaagaauuauacaauccuacuagcaauauauaaggacccaaaaugucuucugcu

SEQ ID NO: 151723 - RNA, 64 nt, hsa
ccacauggggagaaccccaaccaaagaaaucugaaauauauaguaaaugcuuuuuuuuccguuu

SEQ ID NO: 151724 - RNA, 64 nt, hsa
uucuauuuuuuuuccugguuuuuacuguuuugguaauauauauauugaaacaagaaauauuaau

SEQ ID NO: 151725 - RNA, 64 nt, hsa
uuuauaagcaugaaacuauuuuacuggaaagaaaaauauauacauccacauaucuaacaguauc

SEQ ID NO: 151726 - RNA, 64 nt, hsa
acaggcuggaagucuuuugugaaauucccaguuaaauauauacaacuaugugacuuagugcaca

SEQ ID NO: 151727 - RNA, 64 nt, hsa
cccucauguacuauaaauuguguacaguuaaaaaaauauauauauauauauauucuuacaugag

SEQ ID NO: 151728 - RNA, 64 nt, hsa
gaaggacuuugaucgugaauuuuuuuagguguuaaauauauacaacugauuaaauuauuguaua

SEQ ID NO: 151729 - RNA, 64 nt, hsa
uuauacugcagggcaucuugugaauauguauguaaauauauacagaauaauacacacaguugug

SEQ ID NO: 151730 - RNA, 64 nt, hsa
aaacuccgucucaaaaaagaugaaaauaaaauaaaauauauauuuacaggccuacaacuuuugc

SEQ ID NO: 151731 - RNA, 64 nt, hsa
uaccaaaaaaaaaaaaaaaaaaaaaaaaaaaaaaaauauauauauauauauacacacacacaca

SEQ ID NO: 151732 - RNA, 64 nt, hsa
uuccccucccaguaauaaaaaaaaaaaaaaaaaaaauauauauauauauauauauauauauaua

SEQ ID NO: 151733 - RNA, 64 nt, hsa
cauaccuguaucaaaauaucucauguaucccauaaauauauacaccuaccauguacccauaaaa

SEQ ID NO: 151734 - RNA, 64 nt, hsa
ucuguuuuuccaaaagguuaaaacuuguaaaaaaaauauauauaaacaauugaguuuacuaaug

SEQ ID NO: 151735 - RNA, 64 nt, hsa
cacuaaaacagaaguacuuaccucuugaagauuuaauauauaaugguugacaugauacauguac

SEQ ID NO: 151736 - RNA, 64 nt, hsa
cuuuacuguuuugugagguaauacugauuuugaaaauauauauaagcuaaaaacaguauuucgu

SEQ ID NO: 151737 - RNA, 64 nt, hsa
uacauguguacauauauguauaauauauaucuacaauauauauuauauauaucuauaucauauu

SEQ ID NO: 151738 - RNA, 64 nt, hsa
ugggugcgugguauacauguguacauauauguauaauauauaucuacaauauauauuauauaua

SEQ ID NO: 151739 - RNA, 64 nt, hsa
gaacacaagggauauaaaaugaaagauuuuuacuaauauauauuuuaagguugcacacaguaca

SEQ ID NO: 151740 - RNA, 64 nt, hsa
uuuguuuuguuuuguuuuuagaaaaauauauauaaauauauaauagauaucuaucgcuauagaa

SEQ ID NO: 151741 - RNA, 64 nt, hsa
aguuguugguuuuguuuuguuuuguuuuuagaaaaauauauauaaauauauaauagauaucuau

SEQ ID NO: 151742 - RNA, 64 nt, hsa
caagaacuucagaaaucugcaacauaauuuuauaaauauauaaauacauguauguaugucaaaa

SEQ ID NO: 151743 - RNA, 64 nt, hsa
uuuaaaauguuaaagaaaaacauuucuauauugaaauauauauaauuuauaaugaaaauuauag

SEQ ID NO: 151744 - RNA, 64 nt, hsa
cugugacacacacacaaaaggaauuuaauaguauaauauauauauaaauaaauauauauacaga

SEQ ID NO: 151745 - RNA, 64 nt, hsa
aaaggaauuuaauaguauaauauauauauaaauaaauauauauacagauauauuuaucauggua

SEQ ID NO: 151746 - RNA, 64 nt, hsa
uuucauauuucaaauuagauucccuaggagguauaauauauauuucuugaguaauaaugugguu

SEQ ID NO: 151747 - RNA, 64 nt, hsa
uaaugcuaauauuuccaucaaaauuugccuguggaauauauacaguucuuaauuuuaaacuguc

SEQ ID NO: 151748 - RNA, 64 nt, hsa
uauugacuugguaagucuacuguauauaacaucuaauauauauauauuauaggccagcuacaag

SEQ ID NO: 151749 - RNA, 64 nt, hsa
uauugacuugguaagucuacuguauauaacaucuaauauauauauuacaggccaaaugaacuaa

SEQ ID NO: 151750 - RNA, 64 nt, hsa
uucccuaaaugguauggccaaaagucagaguuaaaauauauauaguuagauuccaacuuccucc

SEQ ID NO: 151751 - RNA, 64 nt, hsa
cccuauaguauaugauuauaaugcuauuuuaaaaaauauauauauaaaauauuuuuuucuuuuu

SEQ ID NO: 151752 - RNA, 64 nt, hsa
gacagcugauauuuguuuugaaagugaaucucauaauauauauauguauuacacauuauuauga

SEQ ID NO: 151753 - RNA, 64 nt, hsa
cguugaugccuccaggaaacuuaaguauuuuauuaauauauauauaggaauuuuuuuuuauuuu

SEQ ID NO: 151754 - RNA, 64 nt, hsa
uguuuagcuugacaugaaauaauuuauauuuggaaauauauauuuaagaauuauauauauaaaa

SEQ ID NO: 151755 - RNA, 64 nt, hsa
uuggaaauauauauuuaagaauuauauauauaaaaauauauauguauaagaguuauguauuuga

SEQ ID NO: 151756 - RNA, 64 nt, hsa
aauauauauguauaagaguuauguauuugaaaaaaauauauaaaagaauauacaucacaauaua

SEQ ID NO: 151757 - RNA, 64 nt, hsa
auaccuacauuaaaaucauuuucuaugaauauauaauauauacuucacauuuuuagugaacuuc

SEQ ID NO: 151758 - RNA, 64 nt, hsa
uguaaucauaccuacauuaaaaucauuuucuaugaauauauaauauauacuucacauuuuuagu

SEQ ID NO: 151759 - RNA, 64 nt, hsa
acuauuugacuuuuuaaaaucuucugacacaguaaauauauauaucaagauugauguaucaaaa

SEQ ID NO: 151760 - RNA, 64 nt, hsa
aagagacaaggaaguaggaacauuucugauauuaaauauauaaauaauauggauacacaugugu

SEQ ID NO: 151761 - RNA, 64 nt, hsa
gaauaauuguaaauauauguuacgaaucuucuuaaauauauauauauacacacccugugagaac

SEQ ID NO: 151762 - RNA, 64 nt, hsa
aauacuuucaagagaaaacuguguauacacaugaaauauauauauauauauauauauauauaug

SEQ ID NO: 151763 - RNA, 64 nt, hsa
aaauauauauauauauauauauauauauauguauaauauauaaagacuggcacccugccucucu

SEQ ID NO: 151764 - RNA, 64 nt, hsa
auugugcacuuuauuucuauuaugauuacauuguaauauauaaugaaauaauuauacaacucac

SEQ ID NO: 151765 - RNA, 64 nt, hsa
gcaguagggaagagacgauguaaaaauaauaaacaauauauaccuuccuagagugugaaugcau

SEQ ID NO: 151766 - RNA, 64 nt, hsa
ccacuugauguaaacaaaacuuuuuuuuauacauaauauauauauauauauauaaaauaacuua

SEQ ID NO: 151767 - RNA, 64 nt, hsa
gaaccauaaguagaaucacaggauaauauauacaaauauauauauauacauauauauauauaua

SEQ ID NO: 151768 - RNA, 64 nt, hsa
cgcagcagaggaaccauaaguagaaucacaggauaauauauacaaauauauauauauacauaua

SEQ ID NO: 151769 - RNA, 64 nt, hsa
auacuuuguggaccaauuauugauauauauuauaaauauauauaaagaauauauauauauauau

SEQ ID NO: 151770 - RNA, 64 nt, hsa
caauuauugauauauauuauaaauauauauaaagaauauauauauauauauauauauaaaguau

SEQ ID NO: 151771 - RNA, 64 nt, hsa
aauuuggaaauucagaaacuuauaaaccacgagaaauauauaggcuugucucuuuggucuuuua

SEQ ID NO: 151772 - RNA, 64 nt, hsa
acuuuugcuuuuguguuaaauguagaugugcuaaaauauauagaucuaucauauuuuaccuaca

SEQ ID NO: 151773 - RNA, 64 nt, hsa
aauagugauauccucaagguguaaaaaauauauaaauauauauauauaugucaaaagguaggaa

SEQ ID NO: 151774 - RNA, 64 nt, hsa
acaauuggaauagugauauccucaagguguaaaaaauauauaaauauauauauauaugucaaaa

SEQ ID NO: 151775 - RNA, 64 nt, hsa
guauguauucaaaacaaguguguuaauuaauaaaaauauauaaaucucauuugagauuuaagaa

SEQ ID NO: 151776 - RNA, 64 nt, hsa
aaaaaaagaaauauuuuuaaaauguucuuaagcaaauauauaccuauuuuaucuaguuaccuuu

SEQ ID NO: 151777 - RNA, 64 nt, hsa
uuagucucuugcuaguugaaaucaaauaaaagaaaauauauacccaguugguuucucuaccucu

SEQ ID NO: 151778 - RNA, 64 nt, hsa
ucucuguuauuuuugugugucuuuuuuaauauauaauauauaucaagauuuucaaauuauuuag

SEQ ID NO: 151779 - RNA, 64 nt, hsa
ucccacuucucuguuauuuuugugugucuuuuuuaauauauaauauauaucaagauuuucaaau

SEQ ID NO: 151780 - RNA, 64 nt, hsa
aagucuaugcaaauaucagagaauuuaugguagaaauauauaagguacugacacuucagauaua

SEQ ID NO: 151781 - RNA, 64 nt, hsa
gcccagccuguagcauauuuuaauaggagaauacaauauauaauaguagcaggguuaaguaagg

SEQ ID NO: 151782 - RNA, 64 nt, hsa
acauccuauagaaacucacaaauaaugcauaagaaauauauauauaauauauguauguauguau

SEQ ID NO: 151783 - RNA, 64 nt, hsa
aacauagcaagaccccaucucuuaaaaaaaaagaaauauauagacauauaucugcauugaaaac

SEQ ID NO: 151784 - RNA, 64 nt, hsa
uauuggcuugcacuuugugaguauucuauguaaaaauauauauguauauaaaauauauauugca

SEQ ID NO: 151785 - RNA, 64 nt, hsa
ugaguauucuauguaaaaauauauauguauauaaaauauauauugcauaggacagacuuaggag

SEQ ID NO: 151786 - RNA, 64 nt, hsa
auuaugugugcauguguguauaagugcacacagaaauauauauacauauguagacuauauacau

SEQ ID NO: 151787 - RNA, 64 nt, hsa
uuaagagaaauggcaaguuuugauaugaguauacaauauauaaaaauauauauagugcuauaua

SEQ ID NO: 151788 - RNA, 64 nt, hsa
uggcaaguuuugauaugaguauacaauauauaaaaauauauauagugcuauauauauaaauauu

SEQ ID NO: 151789 - RNA, 64 nt, hsa
uguguuuuuuuuuuuuucuuuuuccauaggaaagaauauauaaauuuguaaauccuaauucaaa

SEQ ID NO: 151790 - RNA, 64 nt, hsa
cgugugagggggcuauguguuuuuuaauuuuuuaaauauauauuuuggugcugugugugguaag

SEQ ID NO: 151791 - RNA, 64 nt, hsa
caaccacaaaagaaauuauauauaaauauauauaaauauauaucucuaccauaugugauggaaa

SEQ ID NO: 151792 - RNA, 64 nt, hsa
uugggacguccaaccacaaaagaaauuauauauaaauauauauaaauauauaucucuaccauau

SEQ ID NO: 151793 - RNA, 64 nt, hsa
uuguugaccucuuucucuguagaaaugaaaacuaaauauauauaauugagaaauaauucugaua

SEQ ID NO: 151794 - RNA, 64 nt, hsa
cuccaaauuguaguuuuuaaauuuggggaaugcaaauauauauauauauacacacacacacaca

SEQ ID NO: 151795 - RNA, 64 nt, hsa
acaggugcuuucaauaguuuuaaaauuauuuuuaaauauauauuuuagcuuuuuaauaaacaaa

SEQ ID NO: 151796 - RNA, 64 nt, hsa
uugcacuucaguauuuucacggauaugaauguaaaauauauaaauauauaaaccugcggcuuua

SEQ ID NO: 151797 - RNA, 64 nt, hsa
caguauuuucacggauaugaauguaaaauauauaaauauauaaaccugcggcuuuaacaacugu

SEQ ID NO: 151798 - RNA, 64 nt, hsa
uaauguauauagcaugauacuauuuuuguuuaaaaauauauaaaauauauaaaugcauaaaaaa

SEQ ID NO: 151799 - RNA, 64 nt, hsa
uagcaugauacuauuuuuguuuaaaaauauauaaaauauauaaaugcauaaaaaaauccuggaa

SEQ ID NO: 151800 - RNA, 64 nt, hsa
auguuacuuuaaaauuacauucuauauauauauaaauauauauaaauauauauuaaaauaccag

SEQ ID NO: 151801 - RNA, 64 nt, hsa
aaaauuacauucuauauauauauaaauauauauaaauauauauuaaaauaccaguuuuuuuucu

SEQ ID NO: 151802 - RNA, 64 nt, hsa
cuacgguaacuagaucuaauauauaucaucagaaaauauauauuguauguuuacucuuauuuuc

SEQ ID NO: 151803 - RNA, 64 nt, hsa
gggaugguuuucugacccuacgguaacuagaucuaauauauaucaucagaaaauauauauugua

SEQ ID NO: 151804 - RNA, 64 nt, hsa
uauauauuuuauauauacuuauguauguauauauaauauauauagaaaucuggauauauaugua

SEQ ID NO: 151805 - RNA, 64 nt, hsa
uauugcuuacaaaaaguaugauuauuuuuaaagaaauauauaugguauguauccucaagaccua

SEQ ID NO: 151806 - RNA, 64 nt, hsa
cuuauuuuucuauuuuuuguauuaccuuuuuaaaaauauauaccaguucaaguccuuuuaggaa

SEQ ID NO: 151807 - RNA, 64 nt, hsa
uacaaaucuucauuuucauacauaguacaauguaaauauauaacuuuguuaacacuuuuguuag

SEQ ID NO: 151808 - RNA, 64 nt, hsa
uaacuaaucacuuucccaucuuuuguuagauuugaauauauacauucuaugaucauugcuuuuu

SEQ ID NO: 151809 - RNA, 64 nt, hsa
uuucuuucagagaguuaaguuauuuuauauauauaauauauauauaaaauauauaauauacaau

SEQ ID NO: 151810 - RNA, 64 nt, hsa
guuaaguuauuuuauauauauaauauauauauaaaauauauaauauacaauauaaauauauagu

SEQ ID NO: 151811 - RNA, 64 nt, hsa
uaauauauauauaaaauauauaauauacaauauaaauauauaguguguguguaugcgugugugu

SEQ ID NO: 151812 - RNA, 64 nt, hsa
aagcuuuuucuuuuuccuuuuuaaaaaguaaagcaauauauacacagguaaaaaaauaaaauag

SEQ ID NO: 151813 - RNA, 64 nt, hsa
ccuaccuugcaguagugaagcaaagagaaaauuaaauauauaugaagcaauuuggcuggcaucu

SEQ ID NO: 151814 - RNA, 64 nt, hsa
uccucuuuuugagagcaaaguaguuauccaauggugagacgagacccugacgcucauagaggcc

SEQ ID NO: 151815 - RNA, 64 nt, hsa
uggcuccugagcugacugacugaugucugaaguuugagacgagggauuauuucaggguggggcc

SEQ ID NO: 151816 - RNA, 64 nt, hsa
gagaaaaagaaaaauagaagacauauaaauuaaaugagacgagacaugucgaccaaaaggaaug

SEQ ID NO: 151817 - RNA, 64 nt, hsa
caagacacacuucuaggcuggcuuguggguccccugagacgaaggcugagcagggugagccucg

SEQ ID NO: 151818 - RNA, 64 nt, hsa
auuacugacaaguagaaucaaaggugcagcugacugagacgacaugcauguaagauccacaaaa

SEQ ID NO: 151819 - RNA, 64 nt, hsa
accuuucauuggcgcauuaccccauaaaacuuuuugagacgaggugagaucugaguauaaagau

SEQ ID NO: 151820 - RNA, 64 nt, hsa
ugaagcaauagaauucuaacauaaggccaagaaaugagacgaauguuugggguuuauguuuuuu

SEQ ID NO: 151821 - RNA, 64 nt, hsa
uuuuucucaguuuauaaauacguagcacucagguugagacgacuuggauuuuauucuuagaaau

SEQ ID NO: 151822 - RNA, 64 nt, hsa
caugaauuggauugaggcuugaggggaaauggugugagacgaaugggcucuggacauaugccug

SEQ ID NO: 151823 - RNA, 64 nt, hsa
caggacacuguuuguuguggaacuaggagcucuuugagacgagacuccaaguaguaaucccaga

SEQ ID NO: 151824 - RNA, 64 nt, hsa
gacccaucugccuaucgaaauaugugcaagucagugagacgaaguauagagaacagguggccca

SEQ ID NO: 151825 - RNA, 64 nt, hsa
gcuggauuugggagcucugcuugccgacuggcugugagacgaggcaggggcucugcuuccucag

SEQ ID NO: 151826 - RNA, 64 nt, hsa
guuuuguauauauuuuggaacuuuaguuccucugugagacgaaagaggagagcuauguuuugug

SEQ ID NO: 151827 - RNA, 64 nt, hsa
ucaaagccaaggguggcguuuugggggcgcuucuugagacgaaaaagacccugggaagagauga

SEQ ID NO: 151828 - RNA, 58 nt, hsa
uguaucguucaauaaggugacuuuaaaaugagacgaaaaucauuaaacguaucuuugu

SEQ ID NO: 151829 - RNA, 64 nt, hsa
ccugcgaggaagccuauggaauaguuuccuguccugagacgaaauucagauuaggagauauuuu

SEQ ID NO: 151830 - RNA, 64 nt, hsa
ggcuaccgcggguaugcgagugccagauauuggcugagacgagccagcuuagacuaauugguac

SEQ ID NO: 151831 - RNA, 64 nt, hsa
guuggagaugcagccuucaccauggauccuggauugagacgaaugccauuggaaccuguuaaau

SEQ ID NO: 151832 - RNA, 64 nt, hsa
ugaguccacacggauagauuuuuccuuguaaccuugagacgagaauuccaaggagugucaccau

SEQ ID NO: 151833 - RNA, 64 nt, hsa
auuuuuauuuuauuuuuaauuuuuuauaucuuuaugagacgaucucacucugucaccagguugg

SEQ ID NO: 151834 - RNA, 64 nt, hsa
gauuuguggaggaugagaaagaugaagaagacaaugagacgagaacacuucuaaggcgagccac

SEQ ID NO: 151835 - RNA, 64 nt, hsa
gggcuguugggggcccucagggaggguucaacucugagacgagaacugccuuggugaaggcaag

SEQ ID NO: 151836 - RNA, 64 nt, hsa
auacaucaucggguauuagaaaauguagucuggcugagacgaugaguuaucuucuacauucuag

SEQ ID NO: 151837 - RNA, 64 nt, hsa
aauugcgugaacccgggcccgguggaggcugcagugagacgagaucgcgccacugcacuccagc

SEQ ID NO: 151838 - RNA, 64 nt, hsa
caacaagcucaugacugaaauuucaccagauuucugagacgaugucuuaauauucuaugugcua

SEQ ID NO: 151839 - RNA, 64 nt, hsa
cucgaugaugcggcccugcaacggaggaggacagugagacgaugccacugcgccacgcucgccc

SEQ ID NO: 151840 - RNA, 64 nt, hsa
gggagguggagcuugcagugagcagagcuugcagugagacgagcuugugccacugcacuccagc

SEQ ID NO: 151841 - RNA, 64 nt, hsa
ugcuuauacugauagugaaaaacuuggaugugugugagacgaguuaccgccuucuucauuggau

SEQ ID NO: 151842 - RNA, 64 nt, hsa
ucuuaaugauauuuaaguaguuuuuuuuuuuuuuugagacgaaguuuugcucuuguugcccagg

SEQ ID NO: 151843 - RNA, 64 nt, hsa
caagugccugauuaauugagguggcaacauaguuugagacgagggcagagaacaggaagauaca

SEQ ID NO: 151844 - RNA, 64 nt, hsa
agaauuugaugaguauuuucaggauuuguuucuaugagacgagagagagaagccuccgcuccuu

SEQ ID NO: 151845 - RNA, 64 nt, hsa
guuuaaaccggccccacaugaagagaacaucccuugagacgaauuuggagacugggauuagagc

SEQ ID NO: 151846 - RNA, 64 nt, hsa
agugugccucucuggccgcccacuggaugagcggugagacgaacaaaagggaaaggaaaaaaug

SEQ ID NO: 151847 - RNA, 64 nt, hsa
gucucuuugacuguaagacagggcucuguaucagugagacgaugagaaaagucccaggcuaaug

SEQ ID NO: 151848 - RNA, 64 nt, hsa
guucagugaauagaaagguauccaaggugaagccugagacgaauggcuuucccaggcuaccuuc

SEQ ID NO: 151849 - RNA, 64 nt, hsa
ggccacagguucauauccagaggaauggcagaucugagacgauccaggaagagcuaaaacaugg

SEQ ID NO: 151850 - RNA, 64 nt, hsa
cuuacuugaugauuuuuaacuuuuuauuucuaaaugagacgaaaugcugauguauccuuucauu

SEQ ID NO: 151851 - RNA, 64 nt, hsa
gcugaggcaggcggaucacuugaggucagcaguuugagacgagccuggccaacauggugaaacc

SEQ ID NO: 151852 - RNA, 64 nt, hsa
gaaauuaacagcagggaaaugccaucuuauuaccugagacgaccagcacugggaguuagguacg

SEQ ID NO: 151853 - RNA, 64 nt, hsa
cugagcuucccacaucccguucuucgguuugccaugagacgaugugggguuuccacuguguguc

SEQ ID NO: 151854 - RNA, 64 nt, hsa
gcugaggcggguggaucacuugaggucagaaauuugagacgagccuggccaacauggugaaacc

SEQ ID NO: 151855 - RNA, 64 nt, hsa
acgacucuggaagcuucccucuaccacugggcacugagacgaagcucccugacagccgagacug

SEQ ID NO: 151856 - RNA, 64 nt, hsa
cccugggggcuucuggcucccugagauugggcucugagacgagacggguucccaaggcccuggu

SEQ ID NO: 151857 - RNA, 64 nt, hsa
auauauucacaaugguaauaagguaggaggaaucugagacgauugcauugucuaaacaguggaa

SEQ ID NO: 151858 - RNA, 64 nt, hsa
ccugccgccugcuggggaagucuggagccccugcugagacgauuuggaagucucguuaagauca

SEQ ID NO: 151859 - RNA, 64 nt, hsa
uuagguuaugaugcgccuccuucugugcgaccaaugagacgacuucagcaucuuuuuaaaauaa

SEQ ID NO: 151860 - RNA, 64 nt, hsa
agcuguagaucuguucuuagaucucuugaauuagugagacgacaguucccuuaggcaguuugug

SEQ ID NO: 151861 - RNA, 64 nt, hsa
agaaucgcuugaacccaggaggcggagguugcagugagacgagauugugccacugcacucuagc

SEQ ID NO: 151862 - RNA, 64 nt, hsa
aagauaaaucaccugugugauaauauuuugaaucugagacgaauacaacuuuuaaaaauuguuu

SEQ ID NO: 151863 - RNA, 64 nt, hsa
uccccaacgguugccuggcaccaucucucucugaugagacgaaucucauuuucauuuccauuaa

SEQ ID NO: 151864 - RNA, 64 nt, hsa
acaacacauguccauucagcccucugaauggaucugagacgaagaccuuuuuaaagauaugucu

SEQ ID NO: 151865 - RNA, 64 nt, hsa
ccaagucuuaacuccuggucucguaagguuccacugagacgagaugucugagaacaaccaaaga

SEQ ID NO: 151866 - RNA, 51 nt, hsa
cccaggugucuuuaacguagaugagacgagacuugauuggaagagaaugcc

SEQ ID NO: 151867 - RNA, 64 nt, hsa
ggcgggcagcauaagagaaugugaagcccuucagugagacgagacgagcaaugggaaaccuuuu

SEQ ID NO: 151868 - RNA, 64 nt, hsa
gcagcccgcagaugguggccauguggcacgcugcugagacgacacuaccaauaaaccaaacugc

SEQ ID NO: 151869 - RNA, 64 nt, hsa
ugugaucuccaccuugaagccaggcaggcugcccugagacgaggagggcucuggucccgucacu

SEQ ID NO: 151870 - RNA, 64 nt, hsa
ggggagcaugguuuuuuuguuuuguuuuuguuuuugagacgaggucucacugucacccaggcug

SEQ ID NO: 151871 - RNA, 64 nt, hsa
cgaauacaucugcuuuccaggcugcuguuuauucugagacgacugugcuguagcuucccuugca

SEQ ID NO: 151872 - RNA, 64 nt, hsa
agaugagggaaguuuuagucuuggcggguggaaaugagacgaagccacaguuaucacacuccag

SEQ ID NO: 151873 - RNA, 64 nt, hsa
ugguguuucagaugggcaguguuauggcuacgugauauuugaagggaaggauaaguguugcuuu

SEQ ID NO: 151874 - RNA, 64 nt, hsa
aaguagcauaaaucaguauuuaaccuaaaauuacauauuugaaacagaagauauuauguuaugc

SEQ ID NO: 151875 - RNA, 64 nt, hsa
gcaauuaaucacuaaugaauuaugcgaaagcaacauauuugauaaccguugcaguaaaucauga

SEQ ID NO: 151876 - RNA, 64 nt, hsa
cuauacuuuggggaucauuugccuaccauggcauauauuugaaauugcuuuggacaaguuuucu

SEQ ID NO: 151877 - RNA, 64 nt, hsa
gugauaggccugucuucugggcaauauuucuaaaauauuugagugacauugauguuuaagugac

SEQ ID NO: 151878 - RNA, 64 nt, hsa
cauucauuaaacuacuuuggaagcgucaguggauauauuugaaagugguaauccugaaucucuu

SEQ ID NO: 151879 - RNA, 64 nt, hsa
caaaauuaagcaugaaaaaaauguuuccauugccauauuugauucacuaguggaagauaguguu

SEQ ID NO: 151880 - RNA, 64 nt, hsa
uacguguuuuggaaaauagaguaauuuaaaaaauauauuugaaaugaaaaucuccaacacauua

SEQ ID NO: 151881 - RNA, 64 nt, hsa
cauaacgugcgugaauuaacagcuucucuauuugauauuugaaauucuucuguaagccugucug

SEQ ID NO: 151882 - RNA, 64 nt, hsa
auuuugugauuuuauugcuuauaacagagaacucauauuugacauauuuuuuucauugaugugu

SEQ ID NO: 151883 - RNA, 64 nt, hsa
cuuaauuuaaauuuaauaaacuuuuauuucagagauauuugauuaguuuacaaucuaagaguua

SEQ ID NO: 151884 - RNA, 64 nt, hsa
cauacuguacaccagauuuugauuucagaaaacaauauuugauguauaacuuccacuuaauuua

SEQ ID NO: 151885 - RNA, 64 nt, hsa
cuaagauuuccuuggguaucugguuuuuguuuucauauuugagugugugcaugugugcaugacu

SEQ ID NO: 151886 - RNA, 64 nt, hsa
gugaccaguuugccauguggauauaauuuaguagauauuugacaguuuguguagguauuugagg

SEQ ID NO: 151887 - RNA, 64 nt, hsa
auuauuuuugacuaugaacauuaguccaaauuuaauauuugacacaguucauaccagcuugcua

SEQ ID NO: 151888 - RNA, 64 nt, hsa
augcauauauguguauauguuauaaacgugaaauauauuugacacacacauucacauauaaauu

SEQ ID NO: 151889 - RNA, 64 nt, hsa
cuuaauguacuacuuacugguacucucccuauuaauauuugaaggaccucaauggaauaaauuu

SEQ ID NO: 151890 - RNA, 64 nt, hsa
aaggaggccuauucuuuucaguugaccuuuuguaauauuugauuuagaguauuuuggacaaaug

SEQ ID NO: 151891 - RNA, 64 nt, hsa
ugaacaugaauauuuggacaaaauuucuggcauaauauuugaagugcacauuuuugugauuuuu

SEQ ID NO: 151892 - RNA, 64 nt, hsa
uguccaaugguaggaauuucaagguguaggucagauauuugagaauaggggauuuuuuugaugu

SEQ ID NO: 151893 - RNA, 64 nt, hsa
ugauaaugagcagccccucccagauagaaugucaauauuugagcaguaggauauuggcauuugu

SEQ ID NO: 151894 - RNA, 64 nt, hsa
cauguacuacagcuauauuugauuauguauggauauauuugaaauaguauacauugucuugaug

SEQ ID NO: 151895 - RNA, 64 nt, hsa
guaaucuacaccaaugaaaacauguacuacagcuauauuugauuauguauggauauauuugaaa

SEQ ID NO: 151896 - RNA, 64 nt, hsa
aguucuuuauuggguggaauuauauuugaugcaaauauuugaucacuuaaaacuuuuaaaacuu

SEQ ID NO: 151897 - RNA, 64 nt, hsa
cauuuaaauacaaaguucuuuauuggguggaauuauauuugaugcaaauauuugaucacuuaaa

SEQ ID NO: 151898 - RNA, 64 nt, hsa
ugagauuuauaaccacuugaguguuauugcagugauauuugaacucauuugaauauauucagua

SEQ ID NO: 151899 - RNA, 64 nt, hsa
uuauuuauaacccucaagccaguugauuuuuaauauauuugauuggaaaagaacucucugguau

SEQ ID NO: 151900 - RNA, 64 nt, hsa
uuaauaucuauuuguauucuuauaccuuuucaauauauuugaacaaauauaguuucuggcacua

SEQ ID NO: 151901 - RNA, 64 nt, hsa
auuuguuaacuucuaccuccaacccacaaaaaagauauuugaucugaguuucuaucacuaauuu

SEQ ID NO: 151902 - RNA, 64 nt, hsa
agaagaaacuuuaucuuuuaauuaugugcucuuaauauuugaagaugagaguuaauaccugaga

SEQ ID NO: 151903 - RNA, 64 nt, hsa
ccuuuguaagcuguggaacccaaacuguauggggauauuugauguuuucagaaagaggaagaaa

SEQ ID NO: 151904 - RNA, 64 nt, hsa
ugauucuuguuagaggguuuuuguucuggaagccauauuugauaguauacuuugucuucacugg

SEQ ID NO: 151905 - RNA, 64 nt, hsa
gccaguaaauaaaagugcuaugacuugagcuaagauauuugacuccaaugccuguacugugucu

SEQ ID NO: 151906 - RNA, 64 nt, hsa
ccaggagaucuggggguugcaccagggaaucgccauauuugaccagcauguuuuaaaagcucuu

SEQ ID NO: 151907 - RNA, 64 nt, hsa
cacgccugcccuagaaacaguuuuuuaauaggagauauuugagaggcauugagguaggagacuc

SEQ ID NO: 151908 - RNA, 64 nt, hsa
cagcaguggagaguguuccuguugaaucuugcacauauuugaauguguaagcauuguauacauu

SEQ ID NO: 151909 - RNA, 64 nt, hsa
ggagaaguagcugugaacauugucuggauaccagauauuugaaucuuucuuacuauugguaaua

SEQ ID NO: 151910 - RNA, 64 nt, hsa
cuagauuuaaagggacuuguaagcauuucuggaaauauuugauuuaaaaacauauauuaauaga

SEQ ID NO: 151911 - RNA, 64 nt, hsa
auauuauuugguagucuaguauggcuuuaacugaauauuugauccucagagacaguaucaugag

SEQ ID NO: 151912 - RNA, 64 nt, hsa
uguuuuuccuaaaaaguacuauaucauccaagaaauauuugaguaaaaucccuuguucuuuugg

SEQ ID NO: 151913 - RNA, 64 nt, hsa
auuaucuguuaauguagauuuuauuuaaaaaacuauauuugaacauuggucuuucuuggacgug

SEQ ID NO: 151914 - RNA, 64 nt, hsa
ucucuacauguuuuuuucuuuccguugcugaaaaauauuugaaacuuguggucucugaagcucg

SEQ ID NO: 151915 - RNA, 64 nt, hsa
uuaguauuaaugcguuggcccacguagcaaaaagauauuugauuaucuuaaaaauuguuaaaua

SEQ ID NO: 151916 - RNA, 64 nt, hsa
ucaguauuguaacagcaacuugucaaaccuaagcauauuugaauaugaucucccauaauuugaa

SEQ ID NO: 151917 - RNA, 64 nt, hsa
uauugaauucucuuagcuuguguguguuucuuuaauauuugaacucaagugggauuagaagacu

SEQ ID NO: 151918 - RNA, 64 nt, hsa
uuagaagacuaucaaaauacauguauguuucaggauauuugaccugucauuaaaaaaaacaaac

SEQ ID NO: 151919 - RNA, 64 nt, hsa
ggauaauuuagaaacaaaccaaaaaaaaaaaaagauauuugaaguguuuuuauaggagauguau

SEQ ID NO: 151920 - RNA, 64 nt, hsa
cuuuauucucuccuguauauuggauuuugugauuauauuugagugaauaggagaaaacaauaua

SEQ ID NO: 151921 - RNA, 64 nt, hsa
guguuugucuagcauguuuguuuaauccuuugaaauauuugaaacaucaauuucuauuuucuga

SEQ ID NO: 151922 - RNA, 64 nt, hsa
gaauuauaucauuauguuccuaaggaguaaauauauauuugaccuguaaguguguguauguaua

SEQ ID NO: 151923 - RNA, 64 nt, hsa
gaccaaacacuggcguaaguucaauuuacacagaauauuugaauugaaacaauagaaauuuuuc

SEQ ID NO: 151924 - RNA, 64 nt, hsa
cugauuuuuuaagaauuaguaucuacuaucuuggauauuugaaaaaaaauugguugaaacuaug

SEQ ID NO: 151925 - RNA, 64 nt, hsa
aaacuaugacuguaugauuauuuuagcgagagucauauuugagaugguguucugagccauaguu

SEQ ID NO: 151926 - RNA, 64 nt, hsa
aggaaaaaaaaaaaaggaugugucauuggucaugauauuugaaaaggggaggaggccgaaguug

SEQ ID NO: 151927 - RNA, 64 nt, hsa
gccgaaguuguucccauuuauccaguauuggaaaauauuugacccccuuggcugaauucuuuug

SEQ ID NO: 151928 - RNA, 64 nt, hsa
caggauuagagcauguaaagguacaucuagauucauauuugaaucuuaaacuguauuuuucucu

SEQ ID NO: 151929 - RNA, 64 nt, hsa
gcuucucugccaaaagcaaugucuuucuugguugauauuugaguuuuaaaagggucaaaucuuu

SEQ ID NO: 151930 - RNA, 64 nt, hsa
auucucauuguaaaaauaauuauaugccaaaaauauauuugauguuaaaucaaauagaugauuc

SEQ ID NO: 151931 - RNA, 64 nt, hsa
aagaggcuuauuuuguucuuuuggcugaaugaguauauuugaauugguugaauaauuaauaauu

SEQ ID NO: 151932 - RNA, 64 nt, hsa
uuuauuuggacaguaauacuagcaaaguugguagauauuugauucuucauuuuuuguuuuuuuc

SEQ ID NO: 151933 - RNA, 64 nt, hsa
auuuguaaauugugaugucauugagacuauauuuauauuugacuuggcaacauuaacauguccu

SEQ ID NO: 151934 - RNA, 64 nt, hsa
auaaaccuuaaaugaaaaaaaugaucuauugcagauauuugauguaguuuucuuuuuuaaauua

SEQ ID NO: 151935 - RNA, 64 nt, hsa
auccagugcuuccacagagauuagccuguagcuuauauuugacauucuucacugucuguuguuu

SEQ ID NO: 151936 - RNA, 64 nt, hsa
ugguugggagaaucacagcuuuacaaggguguuuauauuugauuuguguuuauauuugaggcag

SEQ ID NO: 151937 - RNA, 64 nt, hsa
gcuuuacaaggguguuuauauuugauuuguguuuauauuugaggcagguauuguaauauaaagg

SEQ ID NO: 151938 - RNA, 64 nt, hsa
ugaaaaagcugaauacaagucuuuauauagaguaauauuugagcuguguucaaaaauacauagg

SEQ ID NO: 151939 - RNA, 64 nt, hsa
auaugcuuugaccuacuaacuuucuccuaacuaaauauuugauuuuaggagaguguuuaaauaa

SEQ ID NO: 151940 - RNA, 64 nt, hsa
uuuuaaaagauuuuguuuugugaauuuguacuguauauuugaguaacugucaggcuuuuauuua

SEQ ID NO: 151941 - RNA, 64 nt, hsa
gcucauaucugccggcagcaauugaagagauccaauauuugaagauuggccuucauuucucgau

SEQ ID NO: 151942 - RNA, 64 nt, hsa
uaauuuuaauccuucccuauaauuauacuucaaaauauuugacaucugcuauuaugccuucuuu

SEQ ID NO: 151943 - RNA, 64 nt, hsa
uuuuaauuauuacaaaucuauguguaaaaucuagauauuugaaguuugagaucugaugagaaug

SEQ ID NO: 151944 - RNA, 64 nt, hsa
uuuaacuuguuuagaaaaacuaaugcuuaaaacaauauuugaacuacuguauuuauaauuuauu

SEQ ID NO: 151945 - RNA, 64 nt, hsa
uuaaaguauauuucaguuuucuuuagggcaacauauauuugaauuuaaaagcacuuuauuuaaa

SEQ ID NO: 151946 - RNA, 64 nt, hsa
uacagucauuuugacaaucgauauuugaaucacaauauuugaugacaauauccuuacacauuug

SEQ ID NO: 151947 - RNA, 64 nt, hsa
caacuuugauaugguacagucauuuugacaaucgauauuugaaucacaauauuugaugacaaua

SEQ ID NO: 151948 - RNA, 64 nt, hsa
uauguccaccauuaucucaucagggcugugcugaauauuugauaaugagacugaucauuccgcu

SEQ ID NO: 151949 - RNA, 64 nt, hsa
uaugugcuugcuuauuaguuuuuuagcuagcaacauauuugaaucaggcugguaauucggguaa

SEQ ID NO: 151950 - RNA, 64 nt, hsa
caguucauccccaacccuagucuucgaaauguuaauauuugauaaaucuagaaaaugcauucau

SEQ ID NO: 151951 - RNA, 64 nt, hsa
uuuucaucucuuuaaccaaacuuguggccaaaagauauuugaccguuuccaaaauucagauucu

SEQ ID NO: 151952 - RNA, 64 nt, hsa
gugccuuguuuuauccauuuuauaaauagaguagauauuugauauaccacucugauaacucaua

SEQ ID NO: 151953 - RNA, 64 nt, hsa
cucaauuuuacaaaauuacuaauugcucuagugcauauuugaacuacaagcaacuuuuuaggaa

SEQ ID NO: 151954 - RNA, 64 nt, hsa
auuauggaaugugaaauaucaguguugucuauaaauauuugaagguauauaaaaaugagaugau

SEQ ID NO: 151955 - RNA, 64 nt, hsa
uaugaagggcauguauauguaugaaugagcaaacauauuugaaaguuaacuuuuggaugauagg

SEQ ID NO: 151956 - RNA, 64 nt, hsa
uauuugaaauuacugucauauuugaaauucaguaauauuugacauuuuuauuuaucucuagaag

SEQ ID NO: 151957 - RNA, 64 nt, hsa
uuguaauuuuucaguaguauuugaaauuacugucauauuugaaauucaguaauauuugacauuu

SEQ ID NO: 151958 - RNA, 64 nt, hsa
agaugaaaguuguuuauauuugagaguaguauacauauuugauguaguaguuuauccauucacc

SEQ ID NO: 151959 - RNA, 64 nt, hsa
uaccaccauguaucuaaccagaugaaaguuguuuauauuugagaguaguauacauauuugaugu

SEQ ID NO: 151960 - RNA, 64 nt, hsa
cucaugaaggcaugaaauguggugaaaaugaugaauauuugagugcuuuuucuuaauaaguaua

SEQ ID NO: 151961 - RNA, 64 nt, hsa
cagcauuagaauauauuguucagcacaguaaaauauauuugaaauuugauaagccaaaaaugug

SEQ ID NO: 151962 - RNA, 64 nt, hsa
uuauguuucuacauaguaaggugacugccaaauaauauuugaagucaucugucucuuuguaaau

SEQ ID NO: 151963 - RNA, 64 nt, hsa
cauacauauuaccauacugaagggaaauggauuuauauuugaauuugauauuugaauauuugaa

SEQ ID NO: 151964 - RNA, 64 nt, hsa
auacugaagggaaauggauuuauauuugaauuugauauuugaauauuugaaguucucuauuuau

SEQ ID NO: 151965 - RNA, 64 nt, hsa
gggaaauggauuuauauuugaauuugauauuugaauauuugaaguucucuauuuauauuucauu

SEQ ID NO: 151966 - RNA, 64 nt, hsa
cauuauucccauccauuguaaaguuccuuaagucauauuugacugggcgugcagaauaacuucu

SEQ ID NO: 151967 - RNA, 64 nt, hsa
uuuccaggugcaugugaaucccgaaggacugaugauauuugaauguuuauuaaauuauuaucau

SEQ ID NO: 151968 - RNA, 64 nt, hsa
aguuaagcuuaaaaauaaguuuuaucuuaaaaucauauuugaagacaguaagacaguaaacuau

SEQ ID NO: 151969 - RNA, 64 nt, hsa
aagcccuugucuaaaauaaaaggcauuauuggaaauauuugaaaacuagaaaaugauggauaaa

SEQ ID NO: 151970 - RNA, 64 nt, hsa
uaagaauuaaauuauuaguaauuuauuauuuuaaauauuugaccucauuaguuguuaauuuuuu

SEQ ID NO: 151971 - RNA, 64 nt, hsa
aagguaauuuuuuuuagcaauuuagagcaauucuauauuugaguuauuuaauacacuucuaauu

SEQ ID NO: 151972 - RNA, 64 nt, hsa
auuuuugcuguugcuguuuuuauuauaaaauguuauauuugaggauauuuaacauuuuccaauu

SEQ ID NO: 151973 - RNA, 64 nt, hsa
acuuguugccuuaguacuaucaagacuugugaauauauuugaauguauguuguuugaaaaacuu

SEQ ID NO: 151974 - RNA, 64 nt, hsa; identical to SEQ ID NO: 151966

SEQ ID NO: 151975 - RNA, 64 nt, hsa
uuuccaggugcaugugaaucccgaaggacugaugauauuugaauguuuauuaaauuauuaucac

SEQ ID NO: 151976 - RNA, 62 nt, hsa
aucacugaccuggugguggggcugugaccugggcagcucaagacuggugccccuugcugauc

SEQ ID NO: 151977 - RNA, 62 nt, hsa
cuaauuagaccccuccccuugugucaacuccggcagcucaagacccccgagcaacauuugua

SEQ ID NO: 151978 - RNA, 62 nt, hsa
ucaccugguguucagacaccccaugcucuccugcagcucagggcaggugaccccauccccag

SEQ ID NO: 151979 - RNA, 62 nt, hsa
gccuggucccaguagguaucaggucuuucugugcagcucagggagacccuaaguuaaggggc

SEQ ID NO: 151980 - RNA, 62 nt, hsa
auaugcaggcacucaugcuuaccgggacuggggcagcucacuaggauucuauccuuuccaau

SEQ ID NO: 151981 - RNA, 62 nt, hsa
cuagcccaucuucaaugaccccuuaaucugcagcagcucacaggcugggggugaggaguccc

SEQ ID NO: 151982 - RNA, 62 nt, hsa
cauagccucuguccucaggacggaacuugggugcagcucagugggucggaagagaaggcggu

SEQ ID NO: 151983 - RNA, 62 nt, hsa
gucugucuuugagaugcccaggccagcagaaagcagcucagaaguauuguugcucauggugu

SEQ ID NO: 151984 - RNA, 62 nt, hsa
gggcaaacccuggcucggagcccagggcagaggcagcucagaguggaggcucuaggcagguu

SEQ ID NO: 151985 - RNA, 62 nt, hsa
caucagcacaggggucccugccccacccuccggcagcucagggaguguuuuccugugaggcc

SEQ ID NO: 151986 - RNA, 62 nt, hsa
cgcgcccgcaggguggagaucgcugcaucccugcagcucaacgagacccaagugaagaucug

SEQ ID NO: 151987 - RNA, 62 nt, hsa
cccaacgcggugcgcaccaacuucacuaccaagcagcucacggaacuggagaaggaguucca

SEQ ID NO: 151988 - RNA, 62 nt, hsa
aaagagaaaagaggcucagaaaaguuuagagagcagcucagugucacacugggagcugggca

SEQ ID NO: 151989 - RNA, 62 nt, hsa
uugaggagaagagacuuacccaggcucacacagcagcucagccuguuccaggcgcuggucag

SEQ ID NO: 151990 - RNA, 62 nt, hsa
gccgucauggaaaugaugagucagaagauucagcagcucacagcccugggggcagcucaggc

SEQ ID NO: 151991 - RNA, 62 nt, hsa
gucagaagauucagcagcucacagcccugggggcagcucaggcuacugcuaaggccugagag

SEQ ID NO: 151992 - RNA, 62 nt, hsa
gccccacggacagucagccugccggccucccugcagcucacggggcagaaccagcacaucug

SEQ ID NO: 151993 - RNA, 62 nt, hsa
cacuuuauuccuaaaacgugucuuauuuuuaugcagcucauuuuuucuuuaaaggagaaaac

SEQ ID NO: 151994 - RNA, 62 nt, hsa
ccggcuggccuggccccucagggucccugguggcagcucaccucucccuuggauuguccccg

SEQ ID NO: 151995 - RNA, 62 nt, hsa
gcucagggccuggcucagguggggucacucuggcagcucagagagggugggagugggcccaa

SEQ ID NO: 151996 - RNA, 62 nt, hsa
ugcaagaaguacugccaauacugccaaccagagcagcucacucgagaucuuuguguccagag

SEQ ID NO: 151997 - RNA, 62 nt, hsa
uucugccuuggccucccaaagugcugaauuaagcagcucaccauccacacggcugaccucau

SEQ ID NO: 151998 - RNA, 62 nt, hsa
gacuuacaugagugaaaggguugccucaucaagcagcucaguguaaauggggaggcuaggcu

SEQ ID NO: 151999 - RNA, 62 nt, hsa
uucaucaaauggagugguuuaaaacugaucaagcagcucauaauaaugaauuccugcucugu

SEQ ID NO: 152000 - RNA, 62 nt, hsa
gugguccugaagacuccggccaagaggcacaagcagcucaagaacaagcuggagaagaacga

SEQ ID NO: 152001 - RNA, 62 nt, hsa
aguccacucccuuccuggcugugucaccccgagcagcucauccaccauggaggucauuggcc

SEQ ID NO: 152002 - RNA, 62 nt, hsa
gaauacauggaaaagagcaagcaucugcaggagcagcucaaugaacucaagacagaaaucga

SEQ ID NO: 152003 - RNA, 62 nt, hsa
ucuggcaauuccaucugguuuugagaaacuuagcagcucacagagcacagagauccugccuu

SEQ ID NO: 152004 - RNA, 62 nt, hsa
ccacacugccggacccuaggcuguucagggaggcagcucauuuccaccccggccccaggaca

SEQ ID NO: 152005 - RNA, 62 nt, hsa
cucccccugccucccugccuguguccgcuuuugcagcucaaugcagccaugacaaggaaaga

SEQ ID NO: 152006 - RNA, 64 nt, hsa
cuuaauuuuaaggaauuucaaugaaccaaaagauaacugucaauuuauuuggauggauggaugg

SEQ ID NO: 152007 - RNA, 64 nt, hsa
agaggcaaggcagaaauggaugaugaacaucaaaaacugucagaggacaggucugugccaggua

SEQ ID NO: 152008 - RNA, 64 nt, hsa
cacucuucucaacuugacagucuaccugugguauaacugucagguaaaaacauacaucuuuaca

SEQ ID NO: 152009 - RNA, 64 nt, hsa
auucugcucuugauagucaaagaccauggacaacaacugucaucugaaggacucuucuagaagc

SEQ ID NO: 152010 - RNA, 64 nt, hsa
agaggacuuucugugauucauaccaacaguccuaaacugucauuuucuaaaucugggauuuaaa

SEQ ID NO: 152011 - RNA, 64 nt, hsa
uauaaagaaauacuauaauauuucuagaaucuggaacugucaccaugaugaauggcccuuucaa

SEQ ID NO: 152012 - RNA, 64 nt, hsa
cauauuauuguuuuuaaaaaagcaguuuagagcaaacugucacuaaacuuggauaaauggguca

SEQ ID NO: 152013 - RNA, 64 nt, hsa
cucagacauagcccagguagccuguuucuaacacaacugucauaauccugaaauccaaaauugc

SEQ ID NO: 152014 - RNA, 64 nt, hsa
uuacaucuaaaagaucucugguuggauggaaaucaacugucagaauuaccucagguaaguggua

SEQ ID NO: 152015 - RNA, 64 nt, hsa
gaaacgauuccggauggcauuggaaaacuaaagaaacugucaaucuugaagguggaucagaaua

SEQ ID NO: 152016 - RNA, 64 nt, hsa
uguaauuggagaagaaggaaacucugcaaggcuaaacugucauucacaacuuggcuacacauag

SEQ ID NO: 152017 - RNA, 64 nt, hsa
gccagccagcgagcucuaggcaaaaggacauggaaacugucacguuagcuacugaauccugggg

SEQ ID NO: 152018 - RNA, 64 nt, hsa
cuaaagcuuuuuuuaaaaaaagguggaaaauaggaacugucaagaagguuuaugguauaaauga

SEQ ID NO: 152019 - RNA, 64 nt, hsa
aacauuuauaauaauauaauuucagucauuucuuaacugucacaucuauugaaaauggauauag

SEQ ID NO: 152020 - RNA, 64 nt, hsa
auagcucuuugcaagugccuugauuaaaccagaaaacugucaucguuuaacccaaauaucugaa

SEQ ID NO: 152021 - RNA, 64 nt, hsa
uguaguccugauguuauaagugacuuugugaucaaacugucaggcuuggguucuuguuauagaa

SEQ ID NO: 152022 - RNA, 64 nt, hsa
uagaaugaggucugcuucagaaccuuuuguugucaacugucacuguuucuuccaaaagucacaa

SEQ ID NO: 152023 - RNA, 64 nt, hsa
uauauauauaaauauauguauauccagugcaaucaacugucauuucuuuuuccuuaaaacauau

SEQ ID NO: 152024 - RNA, 64 nt, hsa
auccaucuacccaacugucaccaucuuugcaccaaacugucaccaucuuugcagcagaagguca

SEQ ID NO: 152025 - RNA, 64 nt, hsa
cuagguccccagcucuaauuccauccaucuacccaacugucaccaucuuugcaccaaacuguca

SEQ ID NO: 152026 - RNA, 64 nt, hsa
auuuuuaauuugaucagaacuguuaccaaaaaacaacugucaguuuuauugagaugggaaaaau

SEQ ID NO: 152027 - RNA, 64 nt, hsa
agcguggcccgaggggcuguggaacgggucccggaacugucagacauguuugauuuuagcguuu

SEQ ID NO: 152028 - RNA, 64 nt, hsa
cuuaauuuucaaccuuucuggauaccuuaauuguaacugucaguuugcacuggucgguauaugg

SEQ ID NO: 152029 - RNA, 64 nt, hsa
ugcuuaauuuuuuuaaauugucauuuaauucuuaaacugucauuuauuugagauggaaauaaga

SEQ ID NO: 152030 - RNA, 64 nt, hsa
auuuuagaaacagucuuuguggguggauguuauuaacugucauuguuguugcccagagccaugg

SEQ ID NO: 152031 - RNA, 64 nt, hsa
gggaagcugugaaaacccucaaaaagacccagccaacugucauuaacaacuugaagaaaggagc

SEQ ID NO: 152032 - RNA, 64 nt, hsa
gugaaguaauugcagaagcaguuggggugaagaaaacugucaaauaugaagcugcuggggaagc

SEQ ID NO: 152033 - RNA, 61 nt, hsa
cgccuaggacagggucaaucgaggaaugccagaugugcacgguuuuuggcaaaguaggggg

SEQ ID NO: 152034 - RNA, 61 nt, hsa
gccaucgaucgcagauuucuguagaaacacggaugugcaugugcagauucccuuuugcagg

SEQ ID NO: 152035 - RNA, 61 nt, hsa
aacacauauucauaaaaaaaaucaaguagcugaugugcaguugagaaaacuagaggacuga

SEQ ID NO: 152036 - RNA, 61 nt, hsa
uucccucagcugacugguguucuaccugcaagaugugcagagggcauaaaagcaaaucaac

SEQ ID NO: 152037 - RNA, 61 nt, hsa
aguggugggugguggggugguguuuguguaugaugugcagugugugugugugugguguguc

SEQ ID NO: 152038 - RNA, 61 nt, hsa
uuuuaagugccgggugaauuuuggaccucuggaugugcagcaaguuuuuaugcaauaagcc

SEQ ID NO: 152039 - RNA, 61 nt, hsa
auguccucugcuugcccggcugcagagcagagaugugcagcccucuggucagcugguccag

SEQ ID NO: 152040 - RNA, 61 nt, hsa
ccuggcugacaggaagaauuucugagagcuggaugugcaugcccuguggacgaagguacag

SEQ ID NO: 152041 - RNA, 61 nt, hsa
ugagagaaggcuugauguguauaaaagacgugaugugcaccaccucgaucucgguguuuca

SEQ ID NO: 152042 - RNA, 61 nt, hsa
ggcugugaggugaccccagacacugcagaacgaugugcacccucugcguuuuggauguccu

SEQ ID NO: 152043 - RNA, 61 nt, hsa
acuccccaaggugccugagauggcugugcccgaugugcaccuccccgaggugcagcugccg

SEQ ID NO: 152044 - RNA, 61 nt, hsa
acuccccaaggugccugaaauggccgugcccgaugugcaccucccagaggugcagcugccc

SEQ ID NO: 152045 - RNA, 61 nt, hsa
acucccgaaggugcccgagauggcugugcccgaugugcaccucccggaagugcagcucccg

SEQ ID NO: 152046 - RNA, 61 nt, hsa
acucccgaaggugcccgagauggccgugcccgaugugcaccucccagaagugcagcuucca

SEQ ID NO: 152047 - RNA, 64 nt, hsa
agaaucgcuugaaccugggaggcggaguuugcagugagccgagaucacgccauugcacuccagc

SEQ ID NO: 152048 - RNA, 64 nt, hsa
agaaucgcuugaacccgggaggcggagguuacagugagccgagaucacaucacugcacuccagc

SEQ ID NO: 152049 - RNA, 64 nt, hsa
agaaucacuugaacccgggaggcagaggucauggugagccgagaucacgccacugcacuccagc

SEQ ID NO: 152050 - RNA, 64 nt, hsa
agaaucgcuugaaccugggaggcggagguugcagugagccgagaucaugccauugcacuccagc

SEQ ID NO: 152051 - RNA, 64 nt, hsa
agaauugccugaacccgcgaggcggagacugcagugagccgagaucgcaccacugcacuccagc

SEQ ID NO: 152052 - RNA, 64 nt, hsa
agaauugcuugagccugggaggcagagauugcacugagccgagaucgcgccacuauacuccagc

SEQ ID NO: 152053 - RNA, 64 nt, hsa
agaauggggugaacccgggaggaagagcuugcagugagccgagaucgcgccacugcacuccagc

SEQ ID NO: 152054 - RNA, 64 nt, hsa
agaaucucuugaacccaggaggcggagguugcagugagccgagaucgcuccacugcacuccagc

SEQ ID NO: 152055 - RNA, 64 nt, hsa
agggaucuugaguuguuuuaauuuuuuuuuucugcaucugaaucugcaugauuuccaaacccug

SEQ ID NO: 152056 - RNA, 64 nt, hsa
gcaucugaaucugcaugauuuccaaacccuguaccaucugaauuuugcauuuuagcacuugcac

SEQ ID NO: 152057 - RNA, 64 nt, hsa
agaauuaaacuugucaauuuuaacauugcuguuacaucugaaauaaacuuaugugauguucugg

SEQ ID NO: 152058 - RNA, 64 nt, hsa
cuuugacagauugauaacuuuguaagaugggagacaucugaaauauucauguuuuccuuuugua

SEQ ID NO: 152059 - RNA, 64 nt, hsa
uccguuuguauaaaugauagcaauaucuuggacacaucugaaauacaaaauguuuuugucuacc

SEQ ID NO: 152060 - RNA, 64 nt, hsa
aaaauaucaaaacauaugaaguccuggaaaagagcaucugaaaaaccuagaacaaguuuaacug

SEQ ID NO: 152061 - RNA, 64 nt, hsa
aaacauuucacuagugauugaauucuacuuuugccaucugaauugacuugaaugucuuaaaaca

SEQ ID NO: 152062 - RNA, 64 nt, hsa
guuuuguaucuucugaucucguacccugagacuucaucugaaugugcucugccgccuucuuauc

SEQ ID NO: 152063 - RNA, 64 nt, hsa
cagccaccaaaauauauuucacucaaggcuuguacaucugaaguuugcucuucaaggaauggga

SEQ ID NO: 152064 - RNA, 64 nt, hsa
caucaaaacaaaaguuacaacacguaucucuuuucaucugaaaacuaauaccuggaaaaggaua

SEQ ID NO: 152065 - RNA, 64 nt, hsa
ugugaaaccaagaaauguaaucaagcaguaaaaacaucugaauguagaccaugaucucaaguuc

SEQ ID NO: 152066 - RNA, 64 nt, hsa
acaaaauuauguuaauaaauauucccacauaauacaucugaaugguuaaaaauacuggaagagu

SEQ ID NO: 152067 - RNA, 64 nt, hsa
cuuuuccacugaaauagaggauaauuaauugacacaucugaaauccccaaucaaucaaucaaga

SEQ ID NO: 152068 - RNA, 64 nt, hsa
aaaaaucauuacucuuuuucucaguaaaucauaucaucugaaauauuacaaauuucaaauuucu

SEQ ID NO: 152069 - RNA, 64 nt, hsa
aguaugaccuuuuuaaaucaaccuuauuuggaugcaucugaaccagcagagcuguguuauauuu

SEQ ID NO: 152070 - RNA, 64 nt, hsa
ucuuguuauaaguagagaugggcucgugcugaaacaucugaaugccaagcgaagucugugagca

SEQ ID NO: 152071 - RNA, 64 nt, hsa
ucccugaaacgggcuucaggucaaacccuuaagacaucugaagcugcaaccuggccuuuggugu

SEQ ID NO: 152072 - RNA, 64 nt, hsa
auucugccaccccucacacagccaaaccccagaucaucugaaacuacuaacuuugugguuccag

SEQ ID NO: 152073 - RNA, 64 nt, hsa
uuacaggcacuaaaguuaguaaagaaaaguuuaccaucugaaaaagcuggauuuucuuuaagag

SEQ ID NO: 152074 - RNA, 64 nt, hsa
acuuacuugcauaccaaguugauacuugaauaaccaucugaaagugguacuugaucauuuuuac

SEQ ID NO: 152075 - RNA, 64 nt, hsa
uagcuucucuuuuuuauucuggugucauuaccagcaucugaauuucaaguucuuaaaauuucaa

SEQ ID NO: 152076 - RNA, 64 nt, hsa
gcagauaauagcuuuuggugcacuuuuguuucaccaucugaaaauucacaaaacuucuugcuuc

SEQ ID NO: 152077 - RNA, 64 nt, hsa
gaaggaucuuugauggaggaagaagacccagacucaucugaaggaucgucagaggagggugagg

SEQ ID NO: 152078 - RNA, 64 nt, hsa
gaaggaucuucacaagaggaugaagaccuagacucaucugaaggaucuuugauggaggaagaag

SEQ ID NO: 152079 - RNA, 64 nt, hsa
uuucucaaauuaucuucccuucucuuggggacaacaucugaaggguauguugcaugcauuuuua

SEQ ID NO: 152080 - RNA, 64 nt, hsa
ucuggaccauccuggcuggaaacuuggcuguagacaucugaagagggugcaccuuuucucuuua

SEQ ID NO: 152081 - RNA, 64 nt, hsa
uggauuucuuacuaccuaacgcccaagaaaaccaacuaaggacucucaaaccauaccugguggg

SEQ ID NO: 152082 - RNA, 64 nt, hsa
agcucccccugggaccuccagcauaugacaguggacuaaggacugugggguuuuccuccaaggg

SEQ ID NO: 152083 - RNA, 64 nt, hsa
uuauggacaucgauaugaaaaauaaauaaauaaaacuaaggaacccuggaaacuaccagugggc

SEQ ID NO: 152084 - RNA, 64 nt, hsa
aaauuuugaggucuuuuacauacagugauaugguacuaaggagaauuaaacuccuacugcuucc

SEQ ID NO: 152085 - RNA, 64 nt, hsa
augguauagugaaaagacauugacuugagaugauacuaaggaagcuuuggcucacucucacuug

SEQ ID NO: 152086 - RNA, 64 nt, hsa
ucuuuaaacacuaaagcaaaaucaaaugagcaaaacuaaggaugaaauguaauauucaucagaa

SEQ ID NO: 152087 - RNA, 64 nt, hsa
acagagcauacucuacaguguauucuaaaauaagacuaaggaagcuguuuauauucugauauga

SEQ ID NO: 152088 - RNA, 64 nt, hsa
ugaaacuaccaucaagauguauaaaguaaaaauaacuaaggaguggaacaguguauauggcaua

SEQ ID NO: 152089 - RNA, 64 nt, hsa
ucacaccuggcagcuucauggauguuguaucugaacuaaggaccagaggcugccagauguuucu

SEQ ID NO: 152090 - RNA, 64 nt, hsa
cgccuuccagccuucccuggcuagcccaaauggcacuaaggaggccacugagggaauccuccac

SEQ ID NO: 152091 - RNA, 64 nt, hsa
caaaaagguaaaugcuaucaagaguagaacuuuguagcuguagauuaguuauguuuaaaacgcc

SEQ ID NO: 152092 - RNA, 64 nt, hsa
agccuaauucauuaucuguaugaaguuauaaaaguagcuguagauggcuaggaauuaugucauu

SEQ ID NO: 152093 - RNA, 64 nt, hsa
caccuguuuucauaaauaacguuuuauuggagcauagcuguacccauuuguuuacauauuggcu

SEQ ID NO: 152094 - RNA, 64 nt, hsa
uuuauugaauuuaagagauugguauuaguuuucauagcuguaguccauucuaauaauuucugau

SEQ ID NO: 152095 - RNA, 64 nt, hsa
gagaacucagcaccaagggcugccuaucuguagauagcuguaaaauggaauauuuuuaaaugaa

SEQ ID NO: 152096 - RNA, 64 nt, hsa
uauucuuucaaugaaugucaguaggaccuuccuuuagcuguaagacuuggugggcggggugggg

SEQ ID NO: 152097 - RNA, 64 nt, hsa
ucacaauccacuuaaagaaguuugguuauauuucagugaaaauuuucuuccagaguagguuuuu

SEQ ID NO: 152098 - RNA, 64 nt, hsa
aacugguaauugcagaauccacuuugccuguguaagugaaaaauauagacuguuaucuuguugg

SEQ ID NO: 152099 - RNA, 64 nt, hsa
auuccuuuuuguauaggcuaagaaacagguuaucagugaaaaguuaauuauggcuuuggcacua

SEQ ID NO: 152100 - RNA, 64 nt, hsa
uucuuuaauuccuacaagguacucgaaaaccuuaagugaaaaagauuucuaucuuuuuaucuua

SEQ ID NO: 152101 - RNA, 64 nt, hsa
guuuuacuugaaauuuugcagaauacccagguggagugaaaauuggaaggguuuugugcaauga

SEQ ID NO: 152102 - RNA, 64 nt, hsa
uaauauucuuagcaaucaauuuggauaucccuuaagugaaaagaaucugaaauacacucaggug

SEQ ID NO: 152103 - RNA, 64 nt, hsa
aaaaggaguugcaauagccaaguauagagagaauagugaaaaauuaaucuugcccuuucaagcc

SEQ ID NO: 152104 - RNA, 64 nt, hsa
guaguggugguagagagaaauuaauaacaaaaagagugaaaauauuuuaauuagcaguagaugg

SEQ ID NO: 152105 - RNA, 64 nt, hsa
aaauagaugagaauaugguacagauuguucuauaagugaaaagcauuauguacuugaaaguaaa

SEQ ID NO: 152106 - RNA, 64 nt, hsa
uaagccaguuauugggagaguuaauuaauuccugagugaaaaagugaacuauguuuuuuuucag

SEQ ID NO: 152107 - RNA, 64 nt, hsa
aaggcuuccugcuuuuuuacccuuguauauuaucagugaaaaggaucaacaguuaauuugagcc

SEQ ID NO: 152108 - RNA, 64 nt, hsa
uuaccacuaauaccaguaaaauuaucuuucugauagugaaaagguucugucaagauuuucacug

SEQ ID NO: 152109 - RNA, 64 nt, hsa
auuaaccuggauuggucucaaaaacauaaugcucagugaaaauagcaaguuguagaaaguuaua

SEQ ID NO: 152110 - RNA, 64 nt, hsa
ggcauauuuagguuuuuuguagaagaaagauacaagugaaaauuaggaguggauuggagaaauu

SEQ ID NO: 152111 - RNA, 64 nt, hsa
cgaguacagcuaauuggauaaucucaaacccuuuagugaaaauaucuuaaaugcauugagaaua

SEQ ID NO: 152112 - RNA, 64 nt, hsa
uguuguguuuuugccuaaauacuaguaacauaucagugaaaaacccuaauuuuuuuucucuuca

SEQ ID NO: 152113 - RNA, 64 nt, hsa
gugugaucugaucaacacucugguuaccuuggucagugaaaagaugcuacuauauugcuuuugu

SEQ ID NO: 152114 - RNA, 64 nt, hsa
acacaagaaaugugugucugcugucauaacuuacagugaaaaagcccaauaauacagaacaaga

SEQ ID NO: 152115 - RNA, 64 nt, hsa
gagauucagcucuaguuugcaccuugauuuccccagugaaaagggagaagagccaaaguauugu

SEQ ID NO: 152116 - RNA, 64 nt, hsa
uuuccuugcaucaucuuccucuugaaggugaggaagugaaaacuacagaccucccccggacagc

SEQ ID NO: 152117 - RNA, 64 nt, hsa
ugcugcauuaucuguccaguuugacuuuuuuuucagugaaaacaccaugucauggaguguagga

SEQ ID NO: 152118 - RNA, 64 nt, hsa
caugggaaaagagauaggcuuuauauuuccacagagugaaaaauccucugucauggagccuguc

SEQ ID NO: 152119 - RNA, 64 nt, hsa
uugugcuuacauguauggauguguguauauguacagugaaaauguugucucuuuacaaccaauu

SEQ ID NO: 152120 - RNA, 64 nt, hsa
cugccauaauccuuuggaaaagauguauuauaccagugaaaagguguuauaucuaugcaaaccu

SEQ ID NO: 152121 - RNA, 64 nt, hsa
aauaugguuaauuucauguaaaacagaaaaaaagagugaaaaagagaauauacaugaagaauag

SEQ ID NO: 152122 - RNA, 64 nt, hsa
augauugaguggguauaccuuugugauucugucuagugaaaaugggacauuuuuaauagugcca

SEQ ID NO: 152123 - RNA, 64 nt, hsa
ugaaugcaguucuuggcacaaagacaaaagcugcagugaaaauuuuggacucaaaaggagguau

SEQ ID NO: 152124 - RNA, 63 nt, hsa
uucugagugaaaacuaccuaauauaaauaaaauuagugaaaagaaaacaugggaauuuuucuc

SEQ ID NO: 152125 - RNA, 64 nt, hsa
uauaucuaaaccugaaaaaugaauugauauucugagugaaaacuaccuaauauaaauaaaauua

SEQ ID NO: 152126 - RNA, 64 nt, hsa
cuugugugcaccugauuuggccaauaggaucaacagugaaaagacagaagaggcaauaccagca

SEQ ID NO: 152127 - RNA, 64 nt, hsa
ucuguuuucugccacaaaaaugugaauaguucagagugaaaaccuuuugugaugguugaugucu

SEQ ID NO: 152128 - RNA, 64 nt, hsa
aagguauuugcuuguugaaaaaaaaaacuggcaaagugaaaagauacagucaaaaaucuagaau

SEQ ID NO: 152129 - RNA, 64 nt, hsa
aauauuuuuuaaguuugggggaagagaaacuugcagugaaaaggaguuuuuucauuccugaaag

SEQ ID NO: 152130 - RNA, 64 nt, hsa
aaagacauauaggaacccuaaaugcuuauuguuaagugaaaaccaaucugaaaaggcuuucuau

SEQ ID NO: 152131 - RNA, 64 nt, hsa
acugaggagaaaauugucaauuuaagaaaucuaaagugaaaauuuugcuuagaaauaaaauaug

SEQ ID NO: 152132 - RNA, 64 nt, hsa
aggaaaaaaugcuuaaaauccugucauuuagaacagugaaaaguaucuuuugagauuaaaguga

SEQ ID NO: 152133 - RNA, 64 nt, hsa
guugucaucaauugcuuuacuaagauuuuuaaauagugaaaaccuccuguuuagacuuuggugg

SEQ ID NO: 152134 - RNA, 64 nt, hsa
uccauaucagcaacauacguguuuuuugacagaaagugaaaacaaauuccguaaaacuguuagu

SEQ ID NO: 152135 - RNA, 64 nt, hsa
cauaggacuuuuaaaaggcuugugcuaucuuuccagugaaaacugaaagugcauuauuauggaa

SEQ ID NO: 152136 - RNA, 64 nt, hsa
augcuuuccuaaaaugauaguggauaauagacaaagugaaaacauuuaaaaaggaagagaaacu

SEQ ID NO: 152137 - RNA, 64 nt, hsa
gaaagagaaaaaagauaaaguagaaaaagaaaaaagugaaaaggaaacaacuagcaaaaagaau

SEQ ID NO: 152138 - RNA, 64 nt, hsa
uuguuugcuuaccccuucagccuccaauuuuuuaagugaaaauauagcuaauaacaugugaaaa

SEQ ID NO: 152139 - RNA, 64 nt, hsa
uaccagugccuuaaacucuguuacacuuuuuggaagugaaaacuuuguaguaugauagguuauu

SEQ ID NO: 152140 - RNA, 64 nt, hsa
cuggcauuugcugcauuucaaguuaauucucagaagugaaaaagacuucaaauguuauucaaua

SEQ ID NO: 152141 - RNA, 64 nt, hsa
uuaccuauugcuguaaauaaaaauagcuauaaauagugaaaauuuuauugaauauaauggccuc

SEQ ID NO: 152142 - RNA, 64 nt, hsa
aaaugauuuuuauuuuuccuuugguauuugcuacagugaaaagaaguuuggaaaguagauacau

SEQ ID NO: 152143 - RNA, 64 nt, hsa
gaauuuaggcauuaccucagggaaaagccuugacagugaaaagaaacuacuuaaucgcuaauag

SEQ ID NO: 152144 - RNA, 64 nt, hsa
cccaauuccauccuucccugaaggagagaagggaagugaaaaguagaguaacuccccagcauuu

SEQ ID NO: 152145 - RNA, 64 nt, hsa
cuagccuaaggggccugcugucccucugaggccuagugaaaaagcugcaggaggugcauccucc

SEQ ID NO: 152146 - RNA, 64 nt, hsa
gaucuuuuucugucuaucaaaacuauuugauccaagugaaaaaaaaaaaaaaacuagaaagcua

SEQ ID NO: 152147 - RNA, 64 nt, hsa
uggggaaaacaagcugugucuucuuaacugcccaagugaaaagcaaccaaguccaggaaauuac

SEQ ID NO: 152148 - RNA, 64 nt, hsa
uucauaaacacagaguguagagugaaaacacuagagugaaaacacaugcuacaaugaggcagca

SEQ ID NO: 152149 - RNA, 64 nt, hsa
gcucaggcuauucauucauaaacacagaguguagagugaaaacacuagagugaaaacacaugcu

SEQ ID NO: 152150 - RNA, 61 nt, hsa
auauaaaggcgacugaauagauggaugagggagugaaaacuuugcauagaauccucacgca

SEQ ID NO: 152151 - RNA, 64 nt, hsa
uuaacuuacaaaaagucacaaaaacuuacaugagagugaaaauuuguuaugacuguuuugagag

SEQ ID NO: 152152 - RNA, 64 nt, hsa
cugcacuuacccucaauccagccccggagaagcaagugaaaagggugggucccucauaggcuag

SEQ ID NO: 152153 - RNA, 64 nt, hsa
ccugaacaaccaguaugugucuucuucuccagauagugaaaaagguguccagauaaacccaccu

SEQ ID NO: 152154 - RNA, 64 nt, hsa
acaaauggugccauaguuauuuuucucaaaauuuagugaaaaucccucccauguagacauguug

SEQ ID NO: 152155 - RNA, 64 nt, hsa
uuuggaaaacuuaccaguuuuuagauguagauguagugaaaaacuucaagaaugaagcagagca

SEQ ID NO: 152156 - RNA, 64 nt, hsa
uuuuaaagcaaguuguugcuuaucuuuuccaaaaagugaaaaauguuaaaacagacaacuggua

SEQ ID NO: 152157 - RNA, 64 nt, hsa
aagaggaucuccagcugguucugugggcugcugcagugaaaagcaggaagaagauggccuugac

SEQ ID NO: 152158 - RNA, 64 nt, hsa
cggauaccucauuugaaacucagccuaguaaggaagugaaaacuuagcagucagugacaugggg

SEQ ID NO: 152159 - RNA, 64 nt, hsa
uuaauguucccaauagucaagcuuguuuugcaguagugaaaagcuuagaugaguacggauaccu

SEQ ID NO: 152160 - RNA, 64 nt, hsa
augcauuguuuuguuuaaguaaauucugccuacaagugaaaaggucggugcgcucuucugugca

SEQ ID NO: 152161 - RNA, 64 nt, hsa
ugcuccgaacacuuaaaaaauacuaagacgugauagugaaaauagcuuugaaaagaaacuacau

SEQ ID NO: 152162 - RNA, 64 nt, hsa
uagcuauuuugcuuaaauuucuacaguauguaaaagugaaaaaaugaugaagacgggugcaccu

SEQ ID NO: 152163 - RNA, 64 nt, hsa
gacugguuuuguuuuuauauauauaaaaaaaaaaagugaaaacaccaaugugugaaaugccuua

SEQ ID NO: 152164 - RNA, 64 nt, hsa
aacccauauaaauaugcucagcugauuuugaaaaagugaaaaagcaauucaauggaggaagaau

SEQ ID NO: 152165 - RNA, 64 nt, hsa
augacuuacuuaucucaauggcuaaagaaaaaauagugaaaauaccaaauacugaugaggauac

SEQ ID NO: 152166 - RNA, 64 nt, hsa
uuagacuuaggaaaaaaggcagaguaacauuacuuaaaaaaaaaaggauauguuuacauuuaau

SEQ ID NO: 152167 - RNA, 64 nt, hsa
auccacucacuccaacaaagaacacuuagaaugauaaaaaaaaaaaaaaaaaaccugacaaaag

SEQ ID NO: 152168 - RNA, 64 nt, hsa
uguuuaaauauaaacagaaguguaccuuuuauaauaaaaaaaagaaguugaguaaaaaaaaaaa

SEQ ID NO: 152169 - RNA, 64 nt, hsa
aguguaccuuuuauaauaaaaaaaagaaguugaguaaaaaaaaaaaacacacaaaccuguuagu

SEQ ID NO: 152170 - RNA, 64 nt, hsa
aaauaguugaugcaauuuuuaacguuaauugauauaaaaaaaaaaacaacaaaauuaggcuugu

SEQ ID NO: 152171 - RNA, 64 nt, hsa
aaacaagugaaaaggucaagauacaaauguguauuaaaaaaaaaaaagccuauuaauaggguuu

SEQ ID NO: 152172 - RNA, 64 nt, hsa
acuugacuugcuaucucagcaagauaaauuauauuaaaaaaauaagaauccugcaguguuuaag

SEQ ID NO: 152173 - RNA, 64 nt, hsa
aagauuuuuacauuuugaagaaggggagcaaaucuaaaaaaaauucaguugaacuucugagagu

SEQ ID NO: 152174 - RNA, 64 nt, hsa
auauuuaauaugugcccagauuauucuaaaaucuuaaaaaaagaugcauauagugaaauuuuuu

SEQ ID NO: 152175 - RNA, 64 nt, hsa
agcccuaaaggagucuggcuuuuacuaucuuucuuaaaaaaaaaaaaaagucaaaaaaauucaa

SEQ ID NO: 152176 - RNA, 64 nt, hsa
uguaaaauauugaaauuuucuuucaagcaaaguguaaaaaaauauauugagccuguaaauugcu

SEQ ID NO: 152177 - RNA, 64 nt, hsa
uacauuguaaaauaaaguugagcuuaguuuuuuuuaaaaaaaaaaacaaagcaacaaauuaacu

SEQ ID NO: 152178 - RNA, 64 nt, hsa
uuagcgaacuuguauacuuauuuucuguucagauuaaaaaaaaaaaaaaaaaacucagauaucc

SEQ ID NO: 152179 - RNA, 64 nt, hsa
cuuucauucccacaaaaccaguauuacuuuuuuuuaaaaaaagaaagaaauuggaaaucugugc

SEQ ID NO: 152180 - RNA, 64 nt, hsa
uacuucauuuuacaauacauauucccuuuuaacuuaaaaaaauuguaaaugugggagaaaaaac

SEQ ID NO: 152181 - RNA, 64 nt, hsa
uaauuuacaaugucccugauauugagcuaacucuuaaaaaaaccaaacaaaacucguaucugag

SEQ ID NO: 152182 - RNA, 64 nt, hsa
gaccuaagacagggaggggucagagugauggugauaaaaaaaaaaaaucaucagcaauaagcug

SEQ ID NO: 152183 - RNA, 64 nt, hsa
ggcuguuuucacaaaugacuuguaaugucgugauuaaaaaaauuccuauauucuucugcaaauc

SEQ ID NO: 152184 - RNA, 64 nt, hsa
gaaagcccugagcuuucugcuaucaaagagguuuuaaaaaaaucccauuuaaaaaaaaucccuu

SEQ ID NO: 152185 - RNA, 64 nt, hsa
ucugcuaucaaagagguuuuaaaaaaaucccauuuaaaaaaaaucccuuaccucggugccuucc

SEQ ID NO: 152186 - RNA, 64 nt, hsa
uucucgcacuaaccaccagaagacuugaaaaucuuaaaaaaaaaaaacaaaaaaacaagaaaag

SEQ ID NO: 152187 - RNA, 64 nt, hsa
uauaacuuuuuuaaauaaagguaguauuuaccauuaaaaaaauuuuagcuaaugcuuuuuaucc

SEQ ID NO: 152188 - RNA, 64 nt, hsa
gcagcuuggguaacagauugagaaccugucucauuaaaaaaaaaaaaaaaaaaaaagccguuag

SEQ ID NO: 152189 - RNA, 64 nt, hsa
ggccaacauggugaaacccugucucuacugaaaauaaaaaaaacuagcugggcaugguggcaga

SEQ ID NO: 152190 - RNA, 64 nt, hsa
cuaaaacauaaucacaaagcuuuaucguguuguauaaaaaaauuaacaauauaauggcaauagg

SEQ ID NO: 152191 - RNA, 64 nt, hsa
caacauguaauuauuuaauaaaacuuuggaacauuaaaaaaauaaauuggaggcuuaaggauua

SEQ ID NO: 152192 - RNA, 64 nt, hsa
ugaauauauuuugucuacaaaguguauuuggauuuaaaaaaauuaauuaggucuuucaguuggu

SEQ ID NO: 152193 - RNA, 64 nt, hsa
aauggaaauaagcaaaauauaauguuuuaagaaguaaaaaaaucaauauaauuuaauuaauagc

SEQ ID NO: 152194 - RNA, 64 nt, hsa
gaacuaaugucucauaugauguauuuacuuauuuuaaaaaaaagaauaggaaugagaugucccu

SEQ ID NO: 152195 - RNA, 64 nt, hsa
auguucuuauauuuauguauauuuguuaaaacuguaaaaaaauuucacagauuuuuuuccaaua

SEQ ID NO: 152196 - RNA, 64 nt, hsa
aacacacacagaaugggcugguuucuuucaaguuuaaaaaaagcccccuucuccaugcacaagu

SEQ ID NO: 152197 - RNA, 64 nt, hsa
cacuccagccuaggagacaaaacgagacuucauuuaaaaaaaauaaaaauaaaaauaaaaauaa

SEQ ID NO: 152198 - RNA, 64 nt, hsa
aauguauuuauuuuuuuacuuggacaugaaacuuuaaaaaaauucacagauuauauuuauaacc

SEQ ID NO: 152199 - RNA, 64 nt, hsa
accugacuagagcaggugauguauuuuuauacaguaaaaaaaaaaaaccuuguaaauucuagaa

SEQ ID NO: 152200 - RNA, 64 nt, hsa
ggauucauaaucacaaauauagagaauuccuauuuaaaaaaauagaaaaauagugaagacuaca

SEQ ID NO: 152201 - RNA, 64 nt, hsa
gucuaagcauacguauacaauaaaacuaugcuauuaaaaaaaaagaagguaacugauaaaccaa

SEQ ID NO: 152202 - RNA, 64 nt, hsa
ccuaacauuuagcccugccccauauggaacauguuaaaaaaaaaaaaagccaggccgagcgugu

SEQ ID NO: 152203 - RNA, 64 nt, hsa
cauccuggcgaacacggugaaaccccgucucuacuaaaaaaaauacaaaaaaauuagccaggcg

SEQ ID NO: 152204 - RNA, 64 nt, hsa
acuuuaaggcuuguaaauacauagaacaaauauuuaaaaaaacaaaaagaaauugacucaguac

SEQ ID NO: 152205 - RNA, 64 nt, hsa
aaaugcuguggaccacagaacuccaagaauuguuuaaaaaaaaaaaagugcuacccugagaaaa

SEQ ID NO: 152206 - RNA, 64 nt, hsa
uuuaaucuuuucuuuuuaaacaaggacucauacuuaaaaaaauguuuagcaaaaaaaaaaaaag

SEQ ID NO: 152207 - RNA, 64 nt, hsa
cugauugccuuguuauuacuagguuuuuugagauuaaaaaaaaaaaaucccugguuuaaaacca

SEQ ID NO: 152208 - RNA, 64 nt, hsa
cuggcagccuuaagcccaccugggcacuuuuagauaaaaaaaaaaaaaaaacaaaaaacaacac

SEQ ID NO: 152209 - RNA, 64 nt, hsa
cauaaaagcaaguacauauaguagugacuauauuuaaaaaaacagcauaaaaugcuuaaaaaug

SEQ ID NO: 152210 - RNA, 64 nt, hsa
gaaagcacugaguugagcaagcaauuccuuuauuuaaaaaaaaaaguacguauuuagauaauca

SEQ ID NO: 152211 - RNA, 64 nt, hsa
cauuucauugaguuuggauguauuuuccacauauuaaaaaaauaguucccuaaggcagcuuuau

SEQ ID NO: 152212 - RNA, 64 nt, hsa
acaaggccuaucauguccuugucaugaaaagcacuaaaaaaaaaaagaguuuaaguggcuaaag

SEQ ID NO: 152213 - RNA, 64 nt, hsa
guuaacuacacuucuugauauucaaauguucuauuaaaaaaacugaguaugaagaaaaacacuu

SEQ ID NO: 152214 - RNA, 64 nt, hsa
acauucaagaggagacuuggaguuuauuguuuuuuaaaaaaaccaugcuuccuuuggauagacu

SEQ ID NO: 152215 - RNA, 64 nt, hsa
aacuauuugccuucuggagcucuuugugaaaaauuaaaaaaaaacuuagcucaaagauaugauu

SEQ ID NO: 152216 - RNA, 64 nt, hsa
uucugucacaagucuuauugaaaaguagauuuuuuaaaaaaaaaaaaucuuagucccuguuauc

SEQ ID NO: 152217 - RNA, 64 nt, hsa
uaagugccuugcauuacacauaguaaacuuucuuuaaaaaaaaaaaaaaaagauuuuggagacu

SEQ ID NO: 152218 - RNA, 64 nt, hsa
uacugcaugccacgcacuguguugggcuuaguaauaaaaaaaagaaaagauaagugcuuguucu

SEQ ID NO: 152219 - RNA, 64 nt, hsa
uucauuuaagaggcaauaaggcaaaugccagaauuaaaaaaaaaaaucaucaaagacagaaaau

SEQ ID NO: 152220 - RNA, 64 nt, hsa
uccccuuuuuucuaaauuugaaauagcuuuaguuuaaaaaaaaauccucccuucccccuuuccu

SEQ ID NO: 152221 - RNA, 64 nt, hsa
uguagaguagggcaaaucuguguguguaugucauuaaaaaaauucuaccaucuuucuuuaucau

SEQ ID NO: 152222 - RNA, 64 nt, hsa
ccuuuuucugugggaaucacaagaguuuauccacuaaaaaaagauauguaaaaaagauacuuuc

SEQ ID NO: 152223 - RNA, 64 nt, hsa
ccuucccuaccaucaaaagcauaccugcucuaauuaaaaaaaaaaaaaaaaaaaauucaaguuc

SEQ ID NO: 152224 - RNA, 64 nt, hsa
cacuggugguguccuucuuacaaaacuuuugaaauaaaaaaaaaacucaaaucuucacugucug

SEQ ID NO: 152225 - RNA, 64 nt, hsa
auaagcaaauguuucagcccaaugucaacccaguuaaaaaaaaaauuaaugcuguguaaaaugg

SEQ ID NO: 152226 - RNA, 64 nt, hsa
ccuguacaaugacaacccuggaaguugcuuuuuuuaaaaaaauaauaaauuucuuaaaucaacu

SEQ ID NO: 152227 - RNA, 64 nt, hsa
uugcggagaaaucaaguuuaaaauuccuucugauuaaaaaaauauaguggaauacaauugucug

SEQ ID NO: 152228 - RNA, 64 nt, hsa
uuuaccuuguaaaauuuuguacagcauaaauaaguaaaaaaaucacuguuuuucucaacuuuuu

SEQ ID NO: 152229 - RNA, 64 nt, hsa
caaaaucuuguaguuuuuaaucuuaaacacugaauaaaaaaacuuuccccuaaauuggaaugau

SEQ ID NO: 152230 - RNA, 64 nt, hsa
cccuccucaauuuuguauuuuuaaaaguacaugguaaaaaaaaaaauucacaacaguauauaag

SEQ ID NO: 152231 - RNA, 64 nt, hsa
uuuugauaaucauuugcuuccaguguuuaaaaauuaaaaaaagaauggggagaagguuaugaga

SEQ ID NO: 152232 - RNA, 64 nt, hsa
uauaugagacuugccagucaaaugcuauuugguuuaaaaaaauuauugcaaucucaaguuaaug

SEQ ID NO: 152233 - RNA, 64 nt, hsa
ggaacgaaaaugaaagcuacucauagcgggggccuaaaaaaaaaaagcuucacaguacccaaac

SEQ ID NO: 152234 - RNA, 64 nt, hsa
ugauacuuugacaguguuuuuagaccuguguuacuaaaaaaaagaugaauguccugaaaagggu

SEQ ID NO: 152235 - RNA, 64 nt, hsa
cacuccagcuugggcaacagggcgagaccuuguuuaaaaaaaaaauucaauauugggguuggaa

SEQ ID NO: 152236 - RNA, 64 nt, hsa
auuaggaguguuucauuugauaugugaaugcucauaaaaaaaugucaaggaaugaagaacaaca

SEQ ID NO: 152237 - RNA, 64 nt, hsa
uucuauuuuuuucucccauuuggauccuuugagguaaaaaaacauaaugucuucagccucauaa

SEQ ID NO: 152238 - RNA, 64 nt, hsa
aaugucuucagccucauaauaaaggaaaguuaauuaaaaaaaaaaagcaaagagccauuuuguc

SEQ ID NO: 152239 - RNA, 64 nt, hsa
ggaugacuagacagcaaaaaaggaaaaguuaaacuaaaaaaaaaaaggccgccgugaccuauuc

SEQ ID NO: 152240 - RNA, 64 nt, hsa
uucauuauaaucucaaaggagaaaaaaaaccuuguaaaaaaagcaaaaaugacaacagaaaaac

SEQ ID NO: 152241 - RNA, 64 nt, hsa
uuaugaaauaaaaaaaagauggguuuuguaaaaauaaaaaaaaaauauuuuuagcagaacagga

SEQ ID NO: 152242 - RNA, 64 nt, hsa
aaguacagacguacuuuaaauuuuuguuaugaaauaaaaaaaagauggguuuuguaaaaauaaa

SEQ ID NO: 152243 - RNA, 64 nt, hsa
uuauauguagccuuuacuguuugauauaccaaauuaaaaaaaaauuguaucucauuacuuauac

SEQ ID NO: 152244 - RNA, 64 nt, hsa
ccauaauguacugauuucaguaagucucauagguuaaaaaaaaaagucaccaaauagugugaaa

SEQ ID NO: 152245 - RNA, 64 nt, hsa
uucauacacccauuuugucccuuuauugaaaaaauaaaaaaaauuaaaguacacauuguaagcu

SEQ ID NO: 152246 - RNA, 64 nt, hsa
ucuaugccuuggauacacaccgcucuucagguuguaaaaaaaaaaaacauacauuggggaaagg

SEQ ID NO: 152247 - RNA, 64 nt, hsa
aacacaaucucauugaggagcauuuuuuaaaaacuaaaaaaaaaaaaacuuugccagccauuua

SEQ ID NO: 152248 - RNA, 64 nt, hsa
aauucuuaagacuugcauuuaaaugugacauucuuaaaaaaagaagagaaagaauuuuaagagu

SEQ ID NO: 152249 - RNA, 64 nt, hsa
ucaucuucagcuugugcacaauucuguuuuagguuaaaaaaaggcauuguuugagcugucccau

SEQ ID NO: 152250 - RNA, 64 nt, hsa
cugauaugauuuaaaacauguaauauaaagauguuaaaaaaaaaaaccaaaacugugcagaguc

SEQ ID NO: 152251 - RNA, 64 nt, hsa
aauuguaccacuccuugaagaacuacaggcacaguaaaaaaaauauggcguauuaugugaacua

SEQ ID NO: 152252 - RNA, 64 nt, hsa
cauuuuaagaaaaaggugaaaaucauuuggggaguaaaaaaaugaaaaagcugaaacgaguaau

SEQ ID NO: 152253 - RNA, 64 nt, hsa
guacucaucugcugugaaaagucuuuagguucauuaaaaaaacagguuuuagaaaugaucuuag

SEQ ID NO: 152254 - RNA, 64 nt, hsa
uaaaguuccuuaagcaucugauagaaugauguuuuaaaaaaauuugacgcuugcuuaggagauu

SEQ ID NO: 152255 - RNA, 64 nt, hsa
aguaaugauacuguguguuuucccaaagcacuuuuaaaaaaauuuuuauaaauuacuaucuguu

SEQ ID NO: 152256 - RNA, 64 nt, hsa
uguguugccuuagcacuucuuuccucuccaauuguaaaaaaaaaaaaaaaaaaaaaaaaaaaaa

SEQ ID NO: 152257 - RNA, 64 nt, hsa
uguauuauuuucuauagcucuucuauuuaaaaaauaaaaaaauacaguaaaguuuaaaaaauac

SEQ ID NO: 152258 - RNA, 64 nt, hsa
auuuauauauuugaaagguauaaaagguaggaguuaaaaaaaaaaccucuauguguagauauua

SEQ ID NO: 152259 - RNA, 64 nt, hsa
aaugaguucuuaaagaaaagacuuguuuauguauuaaaaaaaccacuucacagugagucgcuuu

SEQ ID NO: 152260 - RNA, 64 nt, hsa
ccaaaaggaaucagaauaaggaucacugagaauuuaaaaaaauaaaaaaggaaguaaaaauuuu

SEQ ID NO: 152261 - RNA, 64 nt, hsa
uagugcagugauccuuuacagguuuauuucuuuguaaaaaaaaauaauaauaauuugaaucaug

SEQ ID NO: 152262 - RNA, 64 nt, hsa
acuuccguuauuggauaugguaucuccuaaaguguaaaaaaaaucuguuacuauauagugauaa

SEQ ID NO: 152263 - RNA, 64 nt, hsa
aguaucuuugcuaaucuuacuaauagauauugauuaaaaaaaaaaaaccucaguacugcaucac

SEQ ID NO: 152264 - RNA, 64 nt, hsa
cauaauucuuauccuaagagaaagcuuucauauuuaaaaaaaagucuuuucagauaaaaucugc

SEQ ID NO: 152265 - RNA, 64 nt, hsa
auucucaaaacaucacaucacauuagcagaacuauaaaaaaaaaucugcuacucagauccacug

SEQ ID NO: 152266 - RNA, 64 nt, hsa
ggucccaucaucugaagauucuguauagaauuauuaaaaaaaaaauccaucuuucuuuauuuuc

SEQ ID NO: 152267 - RNA, 64 nt, hsa
uaucacacaaagagaccaauaaaaauaaaaaaaauaaaaaaaaaaaaagacgaacuauuggagg

SEQ ID NO: 152268 - RNA, 64 nt, hsa
guaggucauuaucacacaaagagaccaauaaaaauaaaaaaaauaaaaaaaaaaaaagacgaac

SEQ ID NO: 152269 - RNA, 64 nt, hsa
gcuugucacauugcaaaaccuagcuuaagagcauuaaaaaaaaaaacuuaaguagauaggagcu

SEQ ID NO: 152270 - RNA, 64 nt, hsa
agaagauagagguuguuuucguuucuuuucuuuuuaaaaaaaaaaaaauuuauuugaccgacau

SEQ ID NO: 152271 - RNA, 64 nt, hsa
caaagucuucuuugaauaucagggacugagucaauaaaaaaaauaguagaaagguggcuuuuac

SEQ ID NO: 152272 - RNA, 64 nt, hsa
aguaugcagguagcaaagauguaauaaauuugcuuaaaaaaagaaauuaaaguuuuauuuagaa

SEQ ID NO: 152273 - RNA, 64 nt, hsa
gcuuuggaaacauauguccuagaaaacauaaaauuaaaaaaaaacacuauaguguaguuuuugg

SEQ ID NO: 152274 - RNA, 64 nt, hsa
auuauaugcuaaagaauaaaacuccaguuagauuuaaaaaaaucccauuuacaagcauugcacc

SEQ ID NO: 152275 - RNA, 64 nt, hsa
uaaaauagaaaagaacaagugaauuguugcuauuuaaaaaaauuuuacaauucuuacuaaggag

SEQ ID NO: 152276 - RNA, 64 nt, hsa
uaauaaauuugacucauuaaaaaccuuuuuuuuuuaaaaaaaaaaaaaaagaaaaucucauuag

SEQ ID NO: 152277 - RNA, 64 nt, hsa
ugugaauuuauaauaauuucaaaauaaaacaaguuaaaaaaaaacccacuaugcuauaaguuag

SEQ ID NO: 152278 - RNA, 64 nt, hsa
aauuuuauaaaauccaccuccuccaaaaaagcaauaaaaaaaaaacaaacuauaauaagcuuuu

SEQ ID NO: 152279 - RNA, 64 nt, hsa
gcacuccagccaggugacauagcgagauccugucuaaaaaaauaaaaaauaaauaauggaacac

SEQ ID NO: 152280 - RNA, 64 nt, hsa
gcaaguccuaggaaguagguuaaaacuaauucuuuaaaaaaaaaaaaaaguugagccugaauua

SEQ ID NO: 152281 - RNA, 64 nt, hsa
uguguguaugugcgugugauuaccagagaacuacuaaaaaaaccaacugcuuuuuaaauccuau

SEQ ID NO: 152282 - RNA, 64 nt, hsa
uugccauuguggaagaaauuauuugguacauuaauaaaaaaaguugguaaaacaugguuuuaua

SEQ ID NO: 152283 - RNA, 64 nt, hsa
uuaaacauggugugguauucuaaagccuuuuuuuuaaaaaaagagaucuuuuugagagaaacaa

SEQ ID NO: 152284 - RNA, 64 nt, hsa
guucccugucucuugaaaaaugcccauuugccuuuaaaaaaaaaaguuacagaaauacuauaac

SEQ ID NO: 152285 - RNA, 64 nt, hsa
ugcaauauuccuuugggccucugcuucucucaccuaaaaaaagagaauuagauuauauuggugg

SEQ ID NO: 152286 - RNA, 64 nt, hsa
gaaagaacuaugucugaaauauaaaaaauaaaaauaaaaaaacaacuaugaauaugcacaaggg

SEQ ID NO: 152287 - RNA, 64 nt, hsa
aaaauguuuauugcuguuuugucuuucuuuuuucuaaaaaaagaaaaaaaagaaaaaaaggaaa

SEQ ID NO: 152288 - RNA, 64 nt, hsa
uuuagaucauuacaguuuaaguuuucugaccaauuaaaaaaacauagagaacaaaagcauauuu

SEQ ID NO: 152289 - RNA, 64 nt, hsa
uuuugcucuuguauggcaaaauaauuagugaguuuaaaaaaaaucuauaguuuccaauaaacaa

SEQ ID NO: 152290 - RNA, 64 nt, hsa
ggauaugcuagaaaaggcauuuugggguuauguuuaaaaaaacauuauugucccacaauauuac

SEQ ID NO: 152291 - RNA, 64 nt, hsa
ccaaauuagccagacaugguggcaugcgcuuguuuaaaaaaacaaauaaauaaauaaucgacuc

SEQ ID NO: 152292 - RNA, 64 nt, hsa
acuuuuuuuucauucucauuguuacaugauuuuuuaaaaaaaggaaaagaaaaugugaaacaca

SEQ ID NO: 152293 - RNA, 64 nt, hsa
cuccacacugaucuuuggaaacuugccccuuauuuaaaaaaaaaaaagaaaaaaaagaguuugu

SEQ ID NO: 152294 - RNA, 64 nt, hsa
augucaaguaaaaaaaagauuguuuuguaacacauaaaaaaauggaagaaacugauaccacacc

SEQ ID NO: 152295 - RNA, 64 nt, hsa
guguuuauacugcaccuugguuguugaugucaaguaaaaaaaagauuguuuuguaacacauaaa

SEQ ID NO: 152296 - RNA, 64 nt, hsa
uugugucagucaccacaaaguaggccagauaaguuaaaaaaaauuuuuuuuuaaauaauaauug

SEQ ID NO: 152297 - RNA, 64 nt, hsa
accucuucccuucaauaucuguucuucguauuuuuaaaaaaauuuguuuuagacugccuuguuc

SEQ ID NO: 152298 - RNA, 64 nt, hsa
guuguagcagugaauauaguuaaaauacguacauuaaaaaaaaaauuauuagguccuuaccagu

SEQ ID NO: 152299 - RNA, 64 nt, hsa
cuauagagaauuugcuauaagcuagucuuguuuguaaaaaaaaaaaaaaaaaaagaaaaagaaa

SEQ ID NO: 152300 - RNA, 64 nt, hsa
caaacagcaauaacaauauuauuauuguuauaacuaaaaaaaaaaaaacaaaaacaagcagcuu

SEQ ID NO: 152301 - RNA, 64 nt, hsa
aaggacaaagucuagaaaccacuaucauaguugcuaaaaaaaaugguuuucaaaugucaaauac

SEQ ID NO: 152302 - RNA, 64 nt, hsa
ugcuuuuugugcaacugcuuuauauuaacgauacuaaaaaaaaauagcuuuggaaaaaaaacua

SEQ ID NO: 152303 - RNA, 64 nt, hsa
ccucaguucaaaccuuuagggaaugauuaaaauuuaaaaaaaaaacauuucacucaguugcacu

SEQ ID NO: 152304 - RNA, 64 nt, hsa
uguauaaagggcagucuguggucacgcaagacuuuaaaaaaaaaaaaaaaaaaaaaaaaaaaaa

SEQ ID NO: 152305 - RNA, 64 nt, hsa
acaaugacaaauaugccaguuuauuuaauuuguuuaaaaaaaaaaaggcagaaaacccaccaug

SEQ ID NO: 152306 - RNA, 64 nt, hsa
uuaugguuaccuaaaauugccacuuuuuuuagguuaaaaaaaacuucaguauccucauuaacau

SEQ ID NO: 152307 - RNA, 64 nt, hsa
gaaaagcucccucaguuuuuuggagggaauaacuuaaaaaaauacuuaaauggcuaaguuuacu

SEQ ID NO: 152308 - RNA, 64 nt, hsa
uuuucucugagaguuuuaauacuuucaaggacuuuaaaaaaauaaucauguuugaauuguuuuc

SEQ ID NO: 152309 - RNA, 64 nt, hsa
uuucuuuuuuuuuuuuuuuaaaaaaagaaaacuuuaaaaaaacucccauuaaaaacaaaacauc

SEQ ID NO: 152310 - RNA, 64 nt, hsa
gccguuuguccuuaacuuucuuuuuuuuuuuuuuuaaaaaaagaaaacuuuaaaaaaacuccca

SEQ ID NO: 152311 - RNA, 64 nt, hsa
uuuuuauuuucuuggcacuaaagauuagcuuuuuuaaaaaaacaucccauaaaacaguagaaac

SEQ ID NO: 152312 - RNA, 64 nt, hsa
uacuuuauuaagauugccaaaaacuguuaaaauuuaaaaaaaauuuaaaucauguguauacaau

SEQ ID NO: 152313 - RNA, 64 nt, hsa
gagugucuauguuaacuucccucuaucccgcuuauaaaaaaauucuccaacaaaaauacuuguu

SEQ ID NO: 152314 - RNA, 64 nt, hsa
guacaaauaacaagacuaauaauauuuucuuauuuaaaaaaagcaugggaagauuuuuauuuau

SEQ ID NO: 152315 - RNA, 64 nt, hsa
ccucuguuauuguuuaaaaaaaauaaauaaaaauuaaaaaaaucugugcaauaauuuuaaaaug

SEQ ID NO: 152316 - RNA, 64 nt, hsa
agguccacaucugugguugaccucuguuauuguuuaaaaaaaauaaauaaaaauuaaaaaaauc

SEQ ID NO: 152317 - RNA, 64 nt, hsa
aacuuuuuuuuuaauuaccauagagaagauacauuaaaaaaaaucuucugauguuuuguagcca

SEQ ID NO: 152318 - RNA, 64 nt, hsa
gccuucuuuuggacaaaccuugaaaauguuuauuuaaaaaaaaaaaagaugacaaagaaaaaca

SEQ ID NO: 152319 - RNA, 64 nt, hsa
agccaucaauauucagcaaaaugauuccuuucuuuaaaaaaaaaaaauguggaggaaaguagaa

SEQ ID NO: 152320 - RNA, 64 nt, hsa
cuuuuuaaaaaguuauauuuucuaaagaaaaaaauaaaaaaaguuguauuuucuaauuuuuauu

SEQ ID NO: 152321 - RNA, 64 nt, hsa
cguugugcacauguacccuagaacuuaaaguauauaaaaaaaagaaaccuugcacugauuuugu

SEQ ID NO: 152322 - RNA, 64 nt, hsa
ugugcccuuuuauaaggaaacuucugauguuuauuaaaaaaacuggccuuuugauagagguaac

SEQ ID NO: 152323 - RNA, 64 nt, hsa
uuuuacaguugcagagaauuguuucugggcucauuaaaaaaaguaguauugcagacauugcugc

SEQ ID NO: 152324 - RNA, 64 nt, hsa
ccuuaaauuuuaucaauaacagaauuauuguauuuaaaaaaaaacuaauacuuaucuuuaaaau

SEQ ID NO: 152325 - RNA, 64 nt, hsa
cuccagccuggugacagagcaagacuccggcucuuaaaaaaaaaaaaaaaaaaaaaaaaagaga

SEQ ID NO: 152326 - RNA, 64 nt, hsa
uagaagaacggaucaugugccaacuguaguuuuuuaaaaaaaacgcuccuuuguaggguuuuaa

SEQ ID NO: 152327 - RNA, 64 nt, hsa
agccaccacaccuggccuuucugcaacauuuuuuuaaaaaaaucuaauaaaucuuagauuuuua

SEQ ID NO: 152328 - RNA, 64 nt, hsa
gcuccuuauugccauacccacgaacuguuaaauauaaaaaaauucaaaguauuugacaucuuaa

SEQ ID NO: 152329 - RNA, 64 nt, hsa
agggugcaagugaccaaggccuuaucuugaaaguuaaaaaaaaaaaguaaagaaaucacaguaa

SEQ ID NO: 152330 - RNA, 64 nt, hsa
uauuccaaugggcauuuauuuuuuauccugucauuaaaaaaaaaagacuguuauccugcuacac

SEQ ID NO: 152331 - RNA, 64 nt, hsa
uugaaacaguacugugcaauccgauggaucuaauuaaaaaaaaggcaauauuuuuauauuaaag

SEQ ID NO: 152332 - RNA, 64 nt, hsa
ugugauagagacaucucuaaaguauuuugaauuuuaaaaaaagauggcagauuuucugcauuua

SEQ ID NO: 152333 - RNA, 64 nt, hsa
ugugcacauucuaauuaauuaaacuucuuccgucuaaaaaaagugggggaaauguauagcuagu

SEQ ID NO: 152334 - RNA, 64 nt, hsa
aaaaggcagaaacauaccuuugacuauaagaaauuaaaaaaaaaacaccaaaauaauauuuuuc

SEQ ID NO: 152335 - RNA, 64 nt, hsa
cuagcauuauuuugccaccuuuauauuguauuuauaaaaaaaaaaguacuaucaaucaaucaua

SEQ ID NO: 152336 - RNA, 64 nt, hsa
uauccagaagauuaaaaugccuacauugagugcuuaaaaaaaaaaaaacaacugugaugaugug

SEQ ID NO: 152337 - RNA, 64 nt, hsa
guuuaacauuuauaauugcaaaauaaaccaacuauaaaaaaagaaacuaagagagaauugguac

SEQ ID NO: 152338 - RNA, 64 nt, hsa
auauuaauaaauggauacacauucaaaauacuuuuaaaaaaaagaaaauguuaccaguuuuuuu

SEQ ID NO: 152339 - RNA, 64 nt, hsa
uaaaaagacauuacaggcuuaaauuccauuuuauuaaaaaaaaaaaauugccuguaaucccagc

SEQ ID NO: 152340 - RNA, 64 nt, hsa
aauuggauaagaugggacagcacuuauaaugaaauaaaaaaaaacuuugagccccucucauucc

SEQ ID NO: 152341 - RNA, 64 nt, hsa
uuggcuaacugcaugacaugcccauucuaccauuuaaaaaaaaaucuuaaagccuguaauuucu

SEQ ID NO: 152342 - RNA, 64 nt, hsa
ccaguaccuauuuuuacucuuacaaaauuuccuguaaaaaaauacuacauuugaaauuauuuca

SEQ ID NO: 152343 - RNA, 64 nt, hsa
acuuaaauuaauuuuuguaaacccaaguaaguucuaaaaaaaaguaaaaaauacauagaauacu

SEQ ID NO: 152344 - RNA, 64 nt, hsa
guacuuuucuugauacuguuaacuuugugcuuuuuaaaaaaagugauucucuaacagaccucuu

SEQ ID NO: 152345 - RNA, 64 nt, hsa
aguuuuuucauuuaauaauucaaaccaacacuuuuaaaaaaauaauucagaugagacugagcca

SEQ ID NO: 152346 - RNA, 64 nt, hsa
aguguuugccugguacaucacccaugaugucaauuaaaaaaaguuuugaucuuuuaauguaacu

SEQ ID NO: 152347 - RNA, 64 nt, hsa
uauauaaaucaaaguacacauuauuuaaaauauuuaaaaaaauuuucaguuucuucauuuuuaa

SEQ ID NO: 152348 - RNA, 64 nt, hsa
uaaacauugcauguuauuacuuauauguggaagcuaaaaaaauugauaucauagaaguaaaaaa

SEQ ID NO: 152349 - RNA, 62 nt, hsa
uauuggaucugaaaauaaagugucauccaagccauaaaaaaaaaagaaaagaaaaauaaaaa

SEQ ID NO: 152350 - RNA, 64 nt, hsa
ugugcacauguacccuaaaacuuaaaguauaauuuaaaaaaagcaaaaaaaaaaaauacaacuc

SEQ ID NO: 152351 - RNA, 64 nt, hsa
uucuuucuuauaacugcagagaaaauauccugacuaaaaaaaauucauuuuuuuggauuccuuu

SEQ ID NO: 152352 - RNA, 64 nt, hsa
ucagacauuuuuuccuguggauauuucuccauccuaaaaaaaguggcaaccaaggaaaauauuu

SEQ ID NO: 152353 - RNA, 64 nt, hsa
auauuaaguacagugauaaagcaucuauauucuguaaaaaaaaaaaaaaucugccuaugcaugu

SEQ ID NO: 152354 - RNA, 64 nt, hsa
uucuuaauucggcaauggaauaucuuuuaaguuuuaaaaaaacuggaauaauuauaucuaucuu

SEQ ID NO: 152355 - RNA, 64 nt, hsa
ucagacaauggcuauaaacugaauuaggcagucuuaaaaaaaaaaaaaaacagaaaaagaaaaa

SEQ ID NO: 152356 - RNA, 64 nt, hsa
caugugaagaugugaucauuugugauguuacuuguaaaaaaaaguauauauacauaucuuuuga

SEQ ID NO: 152357 - RNA, 64 nt, hsa
cagaaacucuuagguggaauguuucugaaggcuuuaaaaaaaauacaauaaaguaaaaaccgca

SEQ ID NO: 152358 - RNA, 64 nt, hsa
auucuuuuguuauuaaaaaaacacaaaaaaauaauaaaaaaauauauacagauuccuguugugu

SEQ ID NO: 152359 - RNA, 64 nt, hsa
uagucaauauggggcauuaauauucuuuuguuauuaaaaaaacacaaaaaaauaauaaaaaaau

SEQ ID NO: 152360 - RNA, 64 nt, hsa
aaacaauguauauuauguuccuguguguugaauuuaaaaaaaaaauacuuuacuuggauauuca

SEQ ID NO: 152361 - RNA, 64 nt, hsa
gaagaugaaaucauuccuaaauuaaccuuuuuuuuaaaaaaaaacaauguauauuauguuccug

SEQ ID NO: 152362 - RNA, 64 nt, hsa
uauauguuacccugaaaagagaauaagacuuacuuaaaaaaaugaauuaugaccuguuaggcug

SEQ ID NO: 152363 - RNA, 64 nt, hsa
cacaucucuguaaacaaccuuuuuuaaguaauuuuaaaaaaaauaaacacucugcuuacuacuu

SEQ ID NO: 152364 - RNA, 64 nt, hsa
auccuuuuuuaaaaguaaauguacaggaugccaguaaaaaaaaaaaauggcuucagaauuaaaa

SEQ ID NO: 152365 - RNA, 64 nt, hsa
agugccugauaagcuucaaagcugcuuuauucaauaaaaaaaagaaaugaaaaagauauaugaa

SEQ ID NO: 152366 - RNA, 64 nt, hsa
uauauguauauauaugcacauauauauauguauuuaaaaaaaucaaaacaaaaaaaaacucauu

SEQ ID NO: 152367 - RNA, 64 nt, hsa
uuaauaaaguauaagugauguuuuauaugauuuuuaaaaaaaauucucaagugcaauguguuuu

SEQ ID NO: 152368 - RNA, 64 nt, hsa
cucaucaaaagugugugaauuuuaaaacaaauucuaaaaaaacuauagugcuaaauugguaacu

SEQ ID NO: 152369 - RNA, 64 nt, hsa
aaugcaguagaaaguagugguaauaauuccuuuuuaaaaaaauuucgguagucauauaguaaca

SEQ ID NO: 152370 - RNA, 64 nt, hsa
gagacagacugaauauaucuaaaauuuccagcaauaaaaaaaaaagcauuuaacuugcaccaag

SEQ ID NO: 152371 - RNA, 64 nt, hsa
auuuagaccccucucaguuaagaaaugcuuagauuaaaaaaaaaaaauuacguaggauuaauac

SEQ ID NO: 152372 - RNA, 64 nt, hsa
uaguucucaauugaugacaguguuugaaucaucauaaaaaaaauaccugcuuuucaucuggaca

SEQ ID NO: 152373 - RNA, 64 nt, hsa
cuucaggcuuuuagcucuccucaaaguuugagguuaaaaaaauguuaaaagaugugaguuaaag

SEQ ID NO: 152374 - RNA, 64 nt, hsa
uccaaggugcagugcacugugaaucuuuuauuuuuaaaaaaauuuguaggugcuuuuauguaua

SEQ ID NO: 152375 - RNA, 64 nt, hsa
ucagaauauuaagaaaaugaaguaacugauuuucuaaaaaaaaaaaaaaaaaaaauuucuacau

SEQ ID NO: 152376 - RNA, 64 nt, hsa
acugucugugaaauaauguaagaagcuuuucacuuaaaaaaaaugcauuacuuucacuuaacac

SEQ ID NO: 152377 - RNA, 64 nt, hsa
cuguacuuuuaccaguuucuuugucccaccaacuuaaaaaaaaaaaguacaauucauuguuuug

SEQ ID NO: 152378 - RNA, 64 nt, hsa
augcuauauaucuuuuguaagacauuuccuuuuuuaaaaaaauuuuugcaaauaacugaucuca

SEQ ID NO: 152379 - RNA, 64 nt, hsa
uauaaauaauuuuucacauuguauuguugcuauauaaaaaaaauaauagaauugguuggguuuc

SEQ ID NO: 152380 - RNA, 64 nt, hsa
uucagugugaauaguguuuaaguugaaaauauuguaaaaaaauuauauuuuuucaaaaauauuu

SEQ ID NO: 152381 - RNA, 64 nt, hsa
uauuguaaaaaaauuauauuuuuucaaaaauauuuaaaaaaauaaauaauaguagaacugagca

SEQ ID NO: 152382 - RNA, 64 nt, hsa
caccuuucgcuguuuguuguuucauagauuuauuuaaaaaaagagaaagucuauagcuauaaau

SEQ ID NO: 152383 - RNA, 64 nt, hsa
ggcauuaauauaaaagagguaggagucuguuauuuaaaaaaagcauuaaauuuaaaaaaaaacu

SEQ ID NO: 152384 - RNA, 64 nt, hsa
guaggagucuguuauuuaaaaaaagcauuaaauuuaaaaaaaaacugucuugucuacuuuuagc

SEQ ID NO: 152385 - RNA, 64 nt, hsa
guuuugucaaacuucccacugcaaugccuuuauuuaaaaaaauugucuacuuaucuaaauauuc

SEQ ID NO: 152386 - RNA, 64 nt, hsa
aauaaaacuguuaaaucauggccugauaucaucuuaaaaaaaaaucucagaaucugaaauaagc

SEQ ID NO: 152387 - RNA, 64 nt, hsa
aggaauagggaacuaauuuaugaaacagccaucuuaaaaaaaaaaaaaguaaacugcaaaagua

SEQ ID NO: 152388 - RNA, 64 nt, hsa
aaagaaaaaauuaaaaagaaucaguuuuuuuaauuaaaaaaauagaaagcuguuaggcuccuaa

SEQ ID NO: 152389 - RNA, 64 nt, hsa
uugaaguaguuuuuucauguuuaauuuguauuuguaaaaaaacaaaaagcaaaaaaauucccaa

SEQ ID NO: 152390 - RNA, 64 nt, hsa
cuauuuaucuuugauuucagucuuggcaauuguuuaaaaaaaaaaucuagauuuguuuuauuag

SEQ ID NO: 152391 - RNA, 64 nt, hsa
aucccucaaaaaguuaccaccacaucagaaaaaauaaaaaaaaaauaguaaaguaggcagagcu

SEQ ID NO: 152392 - RNA, 64 nt, hsa
aauuuaguuguaacauagaaaaugaaaaaacaguuaaaaaaagugaaguaguugcaaaguguuu

SEQ ID NO: 152393 - RNA, 64 nt, hsa
uucgcaugaaaaugacagauaacacuguaguuccuaaaaaaaaaauuaaaugcauaagcauaag

SEQ ID NO: 152394 - RNA, 64 nt, hsa
uuugcagugguuucagaggcagaucugagaagauuaaaaaaaaaucucaauguaucagcuuuuu

SEQ ID NO: 152395 - RNA, 64 nt, hsa
uugauuuagucagaauuccuagacugaaagaaccuaaaaaaaaaaauauuuuaaagauauaaau

SEQ ID NO: 152396 - RNA, 64 nt, hsa
uuuuucuaaguuuuggaaagcagguuuuuuccuuuaaaaaaauuauagacacgguucacuaaau

SEQ ID NO: 152397 - RNA, 64 nt, hsa
uaauguuuuauauuuauauuuuuguauuuauuuuuaaaaaaauaaaccaguuuuuacaacuacu

SEQ ID NO: 152398 - RNA, 64 nt, hsa
aauuuuacaguauauccuguucuguacauuaaauuaaaaaaacaaaaauguacaugugauguua

SEQ ID NO: 152399 - RNA, 64 nt, hsa
ucgugucauugugauauuugacaacucuaaaaaauaaaaaaaaaaaacuuagagcacaauaauc

SEQ ID NO: 152400 - RNA, 64 nt, hsa
uuugaugagcaaaaucuacuucuaguguuaggaauaaaaaaaaaagaccaguaacuuuguuuuu

SEQ ID NO: 152401 - RNA, 64 nt, hsa
accaaaacagugccccaccuguauacauuuuuauuaaaaaaauguaaugcuuauguauaaacau

SEQ ID NO: 152402 - RNA, 64 nt, hsa
uaacucagugguuaucuaauagcucuaaacucauuaaaaaaacuccaagccuuccaccaaaaca

SEQ ID NO: 152403 - RNA, 64 nt, hsa
agaaaacuauaaaauacuuaaagauauauaaauuuaaaaaaacauagcugcaggucuuuggucc

SEQ ID NO: 152404 - RNA, 64 nt, hsa
acuuuuauuauuaaauguauugagguauuauauuuaaaaaaaacuauguucagaacuucaucug

SEQ ID NO: 152405 - RNA, 64 nt, hsa
uuaaaaacaauacaaguuuuagaaaacaaagcauuaaaaaaaaagccuaucaguauuaugggca

SEQ ID NO: 152406 - RNA, 64 nt, hsa
aggaaucuuggauugggaauucaguacuuugcuuuaaaaaaauuuuguggcagaauuaaauuuc

SEQ ID NO: 152407 - RNA, 64 nt, hsa
aagaaaacaccgacagcuguaaaauguucuaagauaaaaaaacucgagcuacaaagaaagaaug

SEQ ID NO: 152408 - RNA, 64 nt, hsa
auuuaacaaucuccauguaguccaaauuugucauuaaaaaaaaaucaaagaaagaaggccacgu

SEQ ID NO: 152409 - RNA, 64 nt, hsa
uuuauguauuaauauaugcauucacuugaaaaacuaaaaaaaaacaauaauuuggaaaaaccca

SEQ ID NO: 152410 - RNA, 64 nt, hsa
uuuggaaagaaguucauugaagauaaagcaaaaguaaaaaaaaaaaaaaaaaaaacaaggggaa

SEQ ID NO: 152411 - RNA, 64 nt, hsa
gccacacaugguuuauuugaaguauuuuauaauuuaaaaaaauacagaagcaggaaaaccaauu

SEQ ID NO: 152412 - RNA, 64 nt, hsa
cauaaagaaccucucuaugucccuuuuuuuaauuuaaaaaaaaugacucuugucuaauauucgu

SEQ ID NO: 152413 - RNA, 64 nt, hsa
guauuucuaauuauauaaaauauuaagaaucuuuuaaaaaaaucugugaaauuaacaugcuugu

SEQ ID NO: 152414 - RNA, 64 nt, hsa
ggaucagagaccauuaaaagaggaccauaccuauuaaaaaaaaauguggaguuggagggcuaac

SEQ ID NO: 152415 - RNA, 64 nt, hsa
uuguuccaauuggcauacucuggggaugaucacuuaaaaaaacagauuuuacauaaugccuacu

SEQ ID NO: 152416 - RNA, 64 nt, hsa
cauugacuauuuucaucauaauuucaucauugauuaaaaaaagaaaaccacuuguuuauucagu

SEQ ID NO: 152417 - RNA, 64 nt, hsa
accagacuggccaacacagcgagacccccaucucuaaaaaaaaaaaaauuaauaagacauggau

SEQ ID NO: 152418 - RNA, 64 nt, hsa
cuggccaucugaauacucccccaucacuaauuguuaaaaaaagaaucaacuguucuuacucuag

SEQ ID NO: 152419 - RNA, 64 nt, hsa
uuauguccauuggauacuuuccuuuuuaucaucuuaaaaaaagauaacuaguacuaaucauugu

SEQ ID NO: 152420 - RNA, 64 nt, hsa
auauuuuuuggucgggggaaaaauugaccugcaguaaaaaaaccuuugaccauuuuuaugucca

SEQ ID NO: 152421 - RNA, 64 nt, hsa
guaauuauuccaacacccaucugccaugcgauguuaaaaaaaaaaaaaaggaagaaaaauaaca

SEQ ID NO: 152422 - RNA, 64 nt, hsa
ccuuuauuccaagagguauuuauuuuuucacuuguaaaaaaauaauguuuccacguaaagaacu

SEQ ID NO: 152423 - RNA, 58 nt, hsa
aggagaaacacaggaaaugaaaaauuuuuaaaaaaagaaggaaaaauguuuuaaauac

SEQ ID NO: 152424 - RNA, 64 nt, hsa
uauauuagguagaauacacauacaaucaaaauuuuaaaaaaaaaagcuaaauaacuuaaaaaaa

SEQ ID NO: 152425 - RNA, 64 nt, hsa
caaucaaaauuuuaaaaaaaaaagcuaaauaacuuaaaaaaaaacugaggcguacaacggagca

SEQ ID NO: 152426 - RNA, 64 nt, hsa
cccagaggaacuuagggauuucaccccuggcuuuuaaaaaaaacgaaauaccgacaagccacaa

SEQ ID NO: 152427 - RNA, 64 nt, hsa
aaaauuaagaaaaaaaucaaaaaaggaagaaaacuaaaaaaaaaaaaaaucaaaucaccuugug

SEQ ID NO: 152428 - RNA, 64 nt, hsa
gguucuuuuuaauguuuauacuuagauuuucuuuuaaaaaaauuaaaauaaaacaaaaaaaaau

SEQ ID NO: 152429 - RNA, 64 nt, hsa
ggcugauguugguauuggguguaggaacaugauuuaaaaaaaaacucuugccucugcuuucccc

SEQ ID NO: 152430 - RNA, 64 nt, hsa
aaaaaaagauuuugacauaaaagagccuugauuuuaaaaaaaaaagagagagagauguaauuua

SEQ ID NO: 152431 - RNA, 64 nt, hsa
gggggggauguuaaauguuaaucuaaaauauagcuaaaaaaagauuuugacauaaaagagccuu

SEQ ID NO: 152432 - RNA, 64 nt, hsa
guuacugggacacuuuuaaacucugaauaggcauuaaaaaaaauauggcuaacuaguguguuuu

SEQ ID NO: 152433 - RNA, 64 nt, hsa
caauuuaauaaauaguaaauccaauaagaacccuuaaaaaaaaacaacuuccagaaaauguuua

SEQ ID NO: 152434 - RNA, 64 nt, hsa
aaacuauugaaaaauuaauauuucuauaaucuauuaaaaaaaauggagaauguuuucucucaaa

SEQ ID NO: 152435 - RNA, 64 nt, hsa
aacacuuauagccuuaaaccauucaagggcuaauuaaaaaaauaguuaugaaaucuuagccaca

SEQ ID NO: 152436 - RNA, 64 nt, hsa
ccccccugagcucuaguuuuaaacuuucuccuguuaaaaaaauuguacuuuuauuucauguaaa

SEQ ID NO: 152437 - RNA, 64 nt, hsa
uuuaaaaaacaagaaugcaugaucucagagugauuaaaaaaaaaucaguggaaauaaaugauca

SEQ ID NO: 152438 - RNA, 64 nt, hsa
guuuguuuguagauguuugucugaugcauuucauuaaaaaaaaaaccaugaauuacgaagcacc

SEQ ID NO: 152439 - RNA, 64 nt, hsa
ccauugaaaauaguacuuucuucguuucacaaauuaaaaaaaaaaucugguaucaacccacauu

SEQ ID NO: 152440 - RNA, 64 nt, hsa
auuuguggguuuugaaugcaucuuuaaagugcuuuaaaaaaaaguuuuauaaguagggagaaau

SEQ ID NO: 152441 - RNA, 64 nt, hsa
cacuuccugcgcauguaccccugaacuuaaaaguuaaaaaaaaguugaacuuaaaaauaacaga

SEQ ID NO: 152442 - RNA, 64 nt, hsa
ucuguacacaauuccuccuaaaaacauccuuuuuuaaaaaaagaauuguucagccauaaagaaa

SEQ ID NO: 152443 - RNA, 64 nt, hsa
aagucagcauaugaggaauuaaagacauuguuuuuaaaaaaaaaaaaucauuuagaugcacuuu

SEQ ID NO: 152444 - RNA, 64 nt, hsa
uaccuuugaacuuucauagcacugcagaaaccuuuaaaaaaaaaaugcuucaugaauuucuccu

SEQ ID NO: 152445 - RNA, 64 nt, hsa
uguuuacuuuuuauauuaagaauuaaacuguaccuaaaaaaacucugacuauucccauuuguca

SEQ ID NO: 152446 - RNA, 64 nt, hsa
cuauaaguauguacauacaguuucacuucaaaaauaaaaaaaaaaucccuaaaaacucucuaua

SEQ ID NO: 152447 - RNA, 64 nt, hsa
ccaguggacgggugugcuaaggguuuauuuuauguaaaaaaaaaaaaaaaaacaaaaaaaaacc

SEQ ID NO: 152448 - RNA, 64 nt, hsa
acuccagccuggacaacaagagcgaaauucugucuaaaaaaacaaaagucccaauuaagaaccu

SEQ ID NO: 152449 - RNA, 64 nt, hsa
ccccuucucugaaauggguaaaggacaaauuguguaaaaaaaccuaugcacuauagaagggaau

SEQ ID NO: 152450 - RNA, 64 nt, hsa
agcaacuucccuggggaagccaaacacauauucauaaaaaaaaucaaguagcugaugugcaguu

SEQ ID NO: 152451 - RNA, 64 nt, hsa
cucaagguuccauaguaucuuuuacaaaauggauuaaaaaaaaaaugccuaugcaacuucaaau

SEQ ID NO: 152452 - RNA, 64 nt, hsa
guggcuugauguugauacacauuugaauuuuuuuuaaaaaaagaaaguuaucguagccagccug

SEQ ID NO: 152453 - RNA, 64 nt, hsa
uacugauucuggaacaaaacaguuagaaaaacuuuaaaaaaaaaaaaaccgacaaaguuacgag

SEQ ID NO: 152454 - RNA, 64 nt, hsa
uuguugccuuuccaagugaccucuccucuucuuuuaaaaaaagaacacuuucugcucauaucau

SEQ ID NO: 152455 - RNA, 64 nt, hsa
gaaugccagaaauuugucaguucaugcaguaggauaaaaaaaaaaaaaaaaaaaaaaaaaaggc

SEQ ID NO: 152456 - RNA, 64 nt, hsa
gagaaacacagcauacuguucauuaauaguauuuuaaaaaaauuguuuuucaaaugucaccaau

SEQ ID NO: 152457 - RNA, 64 nt, hsa
aguuuaacacuugagcaaaugcuuaagaaggaauuaaaaaaaaaaagcuuugccaauagcuaaa

SEQ ID NO: 152458 - RNA, 64 nt, hsa
agaaaaaaggaaaaguagauagugauacugaggguaaaaaaaaauugauucaauuuuaugguaa

SEQ ID NO: 152459 - RNA, 64 nt, hsa
augaauguuaguuagaaaauguuagguuuuaacuuaaaaaaaauuguauugugauuuucaauuu

SEQ ID NO: 152460 - RNA, 64 nt, hsa
uuacuuuuuauuaugaguuaauauaguuuagcaguaaaaaaaaaaaaaaaaaccacaccuaaaa

SEQ ID NO: 152461 - RNA, 64 nt, hsa
aauaaauuuuaaucucuguuaaucuuaccugcuuuaaaaaaaaguucuuguguguucguaucuu

SEQ ID NO: 152462 - RNA, 64 nt, hsa
cuugguaauacagagauggacaaucguacugggguaaaaaaacccugcugaagagaggacagug

SEQ ID NO: 152463 - RNA, 64 nt, hsa
aaucagcagugaaucaucuugcagcuaugcaauuuaaaaaaaauacagauuaccaauuucaagu

SEQ ID NO: 152464 - RNA, 64 nt, hsa
gcuaaauuugcauauaccaucuaaaauccuuuuuuaaaaaaauuuaauguaauaaagauucaug

SEQ ID NO: 152465 - RNA, 64 nt, hsa
guaaacauugcagguuuaaacauaaaggagucuuuaaaaaaaaaucauuuacguuggaauuuua

SEQ ID NO: 152466 - RNA, 64 nt, hsa
guucaaaguuugcuuaguuacaacaaagcaccuuuaaaaaaaauacauuuuaaaaaaacauucc

SEQ ID NO: 152467 - RNA, 64 nt, hsa
guuacaacaaagcaccuuuaaaaaaaauacauuuuaaaaaaacauuccaagccaauuggaagac

SEQ ID NO: 152468 - RNA, 64 nt, hsa
uccuaaguauaaaugguugucuguuuuuguaacuuaaaaaaaaaaaaaaaaguuuggccgggug

SEQ ID NO: 152469 - RNA, 64 nt, hsa
cacuccggccugaugacagagcgagauuccgucuuaaaaaaaaaaaaaaaaaaguuuguuuuua

SEQ ID NO: 152470 - RNA, 64 nt, hsa
ccgucuuaaaaaaaaaaaaaaaaaaguuuguuuuuaaaaaaaucuaaauaaaauaacuuugccc

SEQ ID NO: 152471 - RNA, 64 nt, hsa
uuauccaaaagauuuuuaaaaauagggcuguguuuaaaaaaaaaaaacaaaacaagaaaagcag

SEQ ID NO: 152472 - RNA, 64 nt, hsa
uggaguuaauuuguuuuacaggaauuuuguuuuuuaaaaaaauaggaucauucugaacuuugga

SEQ ID NO: 152473 - RNA, 64 nt, hsa
uuacacugaucuaaaggacauauauauaacccuuuaaaaaaaaaaucacugccucauucuuauu

SEQ ID NO: 152474 - RNA, 64 nt, hsa
aagcuauuuugaagauuuuuaagcacugauaaauuaaaaaaaaaaaauuagacuccaccuuaag

SEQ ID NO: 152475 - RNA, 64 nt, hsa
ccuauauaaaaaucauuggcacaguuacacuuaauaaaaaaaauuaaacagaagagcacccuga

SEQ ID NO: 152476 - RNA, 64 nt, hsa
uuguuacguaaaguuaaaaugauuuuugucugaauaaaaaaaaagcauugcaaaugcuuuagaa

SEQ ID NO: 152477 - RNA, 64 nt, hsa
ugucaguacagcuauaauaguaucuugaaaguuguaaaaaaauuaaagcauauuuguuacguaa

SEQ ID NO: 152478 - RNA, 64 nt, hsa
gaucaugguguaauaagacauaacguuuuuccuuuaaaaaaauuuaagugcguguguagaguua

SEQ ID NO: 152479 - RNA, 64 nt, hsa
uuaauaacauuaccuuacuguggaggaaggauuguaaaaaaaaaugccuuugagacaguuucuu

SEQ ID NO: 152480 - RNA, 64 nt, hsa
cuuggaauugucucuaaaugcaucaagcauacaauaaaaaaaacugaaauuaacauccagugga

SEQ ID NO: 152481 - RNA, 64 nt, hsa
uuagauggaaaaugcuauuggcagggaauaauaauaaaaaaaaaagaaaaucauucuguuuccu

SEQ ID NO: 152482 - RNA, 64 nt, hsa
gggaaauaauuguguacauaaaauuaggcuuuuuuaaaaaaauagauuaugaugcagaauauug

SEQ ID NO: 152483 - RNA, 64 nt, hsa
cuaagaauacagaaccaaauuggauccauuuuuuuaaaaaaaugguuuugcauggaaccuggac

SEQ ID NO: 152484 - RNA, 64 nt, hsa
acuacuguaaaagauuuuugcuucccucuugugguaaaaaaaauuauauucucacacauuucuu

SEQ ID NO: 152485 - RNA, 64 nt, hsa
cuuuugaagaauuuauauuuggaaaguaaaaaaguaaaaaaauaaaucauccaacuucuuugca

SEQ ID NO: 152486 - RNA, 64 nt, hsa
agcucaaagcaauuaagugggaacauuuuuaauuuaaaaaaaauuuccaaauauuugugggucc

SEQ ID NO: 152487 - RNA, 64 nt, hsa
gguauaaguagcugccaauuuguaauucaucuguuaaaaaaaaucuagauuauaacaaacugcu

SEQ ID NO: 152488 - RNA, 64 nt, hsa
ucucuggaucuuauuugcaauucaaaagaaauuuuaaaaaaauccuacuaacaccaccacaaau

SEQ ID NO: 152489 - RNA, 64 nt, hsa
aauuagcuuaucaacuccccuccaaacaaacaauuaaaaaaaaaacauacagacacucaaauuc

SEQ ID NO: 152490 - RNA, 64 nt, hsa
uaaaaaaaugcauugaaaccauauggugugugauuaaaaaaaaugaauaaauugugaagaacug

SEQ ID NO: 152491 - RNA, 64 nt, hsa
gaaaaguuaacuuguuaaauucuuuugaauugaauaaaaaaaugcauugaaaccauauggugug

SEQ ID NO: 152492 - RNA, 64 nt, hsa
ccucuaucucuguacuccuauaugaagagaacaguaaaaaaaauuacugguauuuauuugguua

SEQ ID NO: 152493 - RNA, 64 nt, hsa
ucaaguaaguguggguagcaaaaacaauuaucuuuaaaaaaaaaaucacaucaguauaggccau

SEQ ID NO: 152494 - RNA, 64 nt, hsa
cugagguaauauuaugguaacuccaauauuugguuaaaaaaacuauacaaaucagaauaguacu

SEQ ID NO: 152495 - RNA, 64 nt, hsa
uucauacccuacuuuuucuguaccuaaauuuucuuaaaaaaaaaucuaguauagcacuacauuc

SEQ ID NO: 152496 - RNA, 64 nt, hsa
uaagccgagagcugucuuugcagaauuaucuuauuaaaaaaaaauacaaaaaaaaagcaccaug

SEQ ID NO: 152497 - RNA, 64 nt, hsa
uguauaugcuuauauauuaagucuaugggcugguuaaaaaaaacagauuauauuaaaauuuaaa

SEQ ID NO: 152498 - RNA, 64 nt, hsa
agauaauacaaucuacuuacacacaugaauuucuuaaaaaaaucaauuuaaugcccuaacucuc

SEQ ID NO: 152499 - RNA, 64 nt, hsa
cuccacaacuccuuggcuuaaacagcuccaccgguaaaaaaaaaaaaaaaaaaaaaaaaaaaaa

SEQ ID NO: 152500 - RNA, 64 nt, hsa
ugcuuggccuccaguagcugccuccauucucuuuuaaaaaaagggggugauucugaggcacuga

SEQ ID NO: 152501 - RNA, 64 nt, hsa
gagcuuuguuaauuuucaauguuuucccagccuauaaaaaaaggaagguacacguuguccuuuu

SEQ ID NO: 152502 - RNA, 64 nt, hsa
aauugcucuaucagcugacuuuucaggguauccuuaaaaaaaaacacacacgaaaaacaaaagu

SEQ ID NO: 152503 - RNA, 64 nt, hsa
cagcaaauuuauaucaccaucuuagaaugguauauaaaaaaauugaacuguuuaugauaccaaa

SEQ ID NO: 152504 - RNA, 64 nt, hsa
gacagcuaaucucucuagggacuauuuggugguuuaaaaaaagggucagacuuuuaaacacucu

SEQ ID NO: 152505 - RNA, 64 nt, hsa
ucugcguugugugaaauguccaucuuaguuuuguuaaaaaaaaaaaaaaaaaaaggaaacagcc

SEQ ID NO: 152506 - RNA, 64 nt, hsa
auauaauaagcucuugugccuuguaugcacuauuuaaaaaaaguuuuuuuuauuugaguccagu

SEQ ID NO: 152507 - RNA, 64 nt, hsa
ccagaccggaaccuauagcuacugcuagaagucuuaaaaaaaccaacagcagcacaggauguau

SEQ ID NO: 152508 - RNA, 64 nt, hsa
auuucuuguaauggcaccucaaauuuuauacucuuaaaaaaaaacaauaauuugugaauuacca

SEQ ID NO: 152509 - RNA, 64 nt, hsa
acuuuuuaaguccugagugcuuacagguaguuguuaaaaaaauuuuaaggccaggcaugguggc

SEQ ID NO: 152510 - RNA, 64 nt, hsa
aaggcaaggcacaacaaaaaaauauccugggcaauaaaaaaaauauuuuaaaccagcuuuggag

SEQ ID NO: 152511 - RNA, 64 nt, hsa
guucccgugauugcaguaaaaauauuuacuauucuaaaaaaaugagaauugaagacuuagccag

SEQ ID NO: 152512 - RNA, 64 nt, hsa
agugagcuaugauugcaccacuguacuccugccuuaaaaaaaaaaaaaaaaucccaauagucca

SEQ ID NO: 152513 - RNA, 64 nt, hsa
uaccccccaacuuuuuuagagacagccugucucuuaaaaaaaaaauuaauuugguagugagagc

SEQ ID NO: 152514 - RNA, 64 nt, hsa
ugugaaaaugcucaaaguuuuggcgagagugauauaaaaaaacugacuguggcugaaagaauug

SEQ ID NO: 152515 - RNA, 64 nt, hsa
uuugccuauggugugaaauccuuuguuauuuuucuaaaaaaauaaaauuuaaaaagaaagaaaa

SEQ ID NO: 152516 - RNA, 64 nt, hsa
ucaguguguaggagugaagacaggaucccgugcuuaaaaaaauaaaaaauaaaaaaauaaaaaa

SEQ ID NO: 152517 - RNA, 64 nt, hsa
gaagacaggaucccgugcuuaaaaaaauaaaaaauaaaaaaauaaaaaaaaaauaagacuuuaa

SEQ ID NO: 152518 - RNA, 64 nt, hsa
gaucccgugcuuaaaaaaauaaaaaauaaaaaaauaaaaaaaaaauaagacuuuaacugcaguu

SEQ ID NO: 152519 - RNA, 64 nt, hsa
aaaccccauuuuccuaaagaacaaaguaguaaaauaaaaaaaaauuuaaaaaauuaaaaaauaa

SEQ ID NO: 152520 - RNA, 64 nt, hsa
aguaaaauaaaaaaaaauuuaaaaaauuaaaaaauaaaaaaaagaggucacuaaaagaccaaga

SEQ ID NO: 152521 - RNA, 64 nt, hsa
ggcuauguguaaauguagaacccuaauuuuucuauaaaaaaacaaacuaacuaacuaacugugu

SEQ ID NO: 152522 - RNA, 64 nt, hsa
gccuccguccaaaagauuccuccaaaaaaagauuuaaaaaaagauuucggcaucgacacggacg

SEQ ID NO: 152523 - RNA, 64 nt, hsa
ugcuuucuuuguaauaaguauuuugccacaccuguaaaaaaaaaaaccucacuuuuaacucucu

SEQ ID NO: 152524 - RNA, 64 nt, hsa
uuucaagaucuuucugguaauccgugaauauauuuaaaaaaaaaaagucugugacaaaacggug

SEQ ID NO: 152525 - RNA, 64 nt, hsa
uauuucuuggauuuauaguaccuuauacuaagguuaaaaaaauaugcuugauauugugaaaagg

SEQ ID NO: 152526 - RNA, 64 nt, hsa
ugugcuauccagauuuuuuauaugucugcauguuuaaaaaaaaaaagcaacaaaagaaaaugca

SEQ ID NO: 152527 - RNA, 64 nt, hsa
cuuuggugaugggguuuuuuuuuuuauaacuuaguaaaaaaaaaaaaauguauguggaauucug

SEQ ID NO: 152528 - RNA, 64 nt, hsa
gaaaggacugugagcaagaugaauuuacuuuucuuaaaaaaaaaaaaaaaaaaaaaaaaaaaga

SEQ ID NO: 152529 - RNA, 64 nt, hsa
caauuuucucccauugugcgaacauuuuauuuuuuaaaaaaaagaaacaaaaauauuuuucccc

SEQ ID NO: 152530 - RNA, 64 nt, hsa
aaagagccugggcaauuuuuuuaagacucugucuuaaaaaaaacuaaaaagaaaaaaagaagcc

SEQ ID NO: 152531 - RNA, 64 nt, hsa
acuccagccugggcaagaguuuuuuuaagacucuuaaaaaaagagccugggcaauuuuuuuaag

SEQ ID NO: 152532 - RNA, 64 nt, hsa
auuacuuauauaaaaacaguucagaauauuuuuuuaaaaaaaauucuauauauacuguaaaauu

SEQ ID NO: 152533 - RNA, 64 nt, hsa
cauauccuccucuagccuguaaaggaguuucauuuaaaaaaauaacauuugauuacuuauauaa

SEQ ID NO: 152534 - RNA, 64 nt, hsa
aaaugacuacuuugaaauaguugaaguaccagcauaaaaaaaugaaauguguauugauuucuaa

SEQ ID NO: 152535 - RNA, 64 nt, hsa
auccuugaaauuucugguagugccuuagcuugguuaaaaaaaaaaaaaaaaaaaaaaaaaaggg

SEQ ID NO: 152536 - RNA, 64 nt, hsa
gggugggagguuuuuagaagaguauauaucucuuuaaaaaaaaacagaaagaaaaauauuucug

SEQ ID NO: 152537 - RNA, 64 nt, hsa
uaauguacaguuuucacaacuguaucugcucuaauaaaaaaaaguugguuauuaaugaaguugg

SEQ ID NO: 152538 - RNA, 64 nt, hsa
ccuauagcuccuuacgcugggaaagcugguuuuuuaaaaaaauaauaauaaaauauuuaaucuu

SEQ ID NO: 152539 - RNA, 64 nt, hsa
cagucaaucagauaagaaguauacuuugauuaaguaaaaaaaaucccuauucuuggaaaauaca

SEQ ID NO: 152540 - RNA, 64 nt, hsa
gcuugaaauaucuuguuaugccagaaaguaauguuaaaaaaaaaaauagagguauauugccaaa

SEQ ID NO: 152541 - RNA, 64 nt, hsa
uuuauuuuuagcccauuguuuaaaaaauaaaaguuaaaaaaauuuaacugcuuaaaaguaaagu

SEQ ID NO: 152542 - RNA, 64 nt, hsa
cuagcuauuucuaaauauuuuaaauuagcuuuucuaaaaaaaaaauccagccucauaaaguaga

SEQ ID NO: 152543 - RNA, 64 nt, hsa
uuaaauauauacugacuccuagaaaucuauuuauuaaaaaaagacaugaaaacuugcuguacau

SEQ ID NO: 152544 - RNA, 64 nt, hsa
auuuaaucccuucaauuuggggcuuaaucuuguuuaaaaaaauguaagugaagauggaaggcug

SEQ ID NO: 152545 - RNA, 64 nt, hsa
gucauugguaaauaguagucuauuuuccucugcuuaaaaaaaauuuuaaguauauccuuuaaag

SEQ ID NO: 152546 - RNA, 64 nt, hsa
aaaaucauuuucuuguuuaaauaguuucuuuuuuuaaaaaaaugguuacauuaguuuuaaaaua

SEQ ID NO: 152547 - RNA, 64 nt, hsa
gaaacaggcccaccccugaagugugugccaucgguaaaaaaaaucagaggaaaggaggcugcca

SEQ ID NO: 152548 - RNA, 64 nt, hsa
ucauuuucauuuuugcauuuuuuuguuugcauauuaaaaaaagagaaaagagaaagcaagagac

SEQ ID NO: 152549 - RNA, 64 nt, hsa
ucaaccaguucgugacuguuguagcgaaugaaguuaaaaaaaugucuuucugauguuguguugu

SEQ ID NO: 152550 - RNA, 64 nt, hsa
auucaauagcuuguaaugucuuaugaagaccuauuaaaaaaauacuucauagagccugccuuau

SEQ ID NO: 152551 - RNA, 64 nt, hsa
guaacugaaauauaaucagaaacauuaaagccuguaaaaaaaaauugcugcguuuuugguaaag

SEQ ID NO: 152552 - RNA, 64 nt, hsa
auauaacagaagccauccugaaaugaaacuagucuaaaaaaauucauuguucuacuuaguugca

SEQ ID NO: 152553 - RNA, 64 nt, hsa
auugcuucuguuuauuaaaauugaccugcaaaguuaaaaaaaaauuaaaguugagaacagguau

SEQ ID NO: 152554 - RNA, 64 nt, hsa
uauuuuaaaguguuccagacccaaaaaggaaaaauaaaaaaaaaggaauauuuguacccaacag

SEQ ID NO: 152555 - RNA, 64 nt, hsa
aaauuucaucacuguugaugugguucuuuuguguuaaaaaaaaaaagugcaacuaucaaaacua

SEQ ID NO: 152556 - RNA, 64 nt, hsa
auaugaaauucugugaaaaaaaacccuuugaucuuaaaaaaaaaaaaaccaccccccccuucug

SEQ ID NO: 152557 - RNA, 64 nt, hsa
aguuuacccuaacgcuucuuuaaaagaaaguagguaaaaaaagaaaaggguagauaaucuuucg

SEQ ID NO: 152558 - RNA, 64 nt, hsa
uuuaugcgauaacuccuuuuuguuacaauuuuuuuaaaaaaagcuauuuuuguuaauguaaagu

SEQ ID NO: 152559 - RNA, 59 nt, hsa
agaugaaugccagacugugaaggaaaauauaaaaaaaaagucgacugcuaugcucaaaa

SEQ ID NO: 152560 - RNA, 64 nt, hsa
uauaaaaaaaaagucgacugcuaugcucaaaaaguaaaaaaagcucaacaguuaaaaucuaaug

SEQ ID NO: 152561 - RNA, 64 nt, hsa
uccaaggcagguguuguuaaucuaucauagcacuuaaaaaaaaaaaaaaaaagagaccaaaaau

SEQ ID NO: 152562 - RNA, 64 nt, hsa
guguuuuuuucuggaacuacuucaagugagaaaauaaaaaaaaauggugacaaagcuguacaga

SEQ ID NO: 152563 - RNA, 64 nt, hsa
augaugcgugcuacuugcuauuaugagagaagcuuaaaaaaaaaaaggaagauauuucugaaag

SEQ ID NO: 152564 - RNA, 64 nt, hsa
auauuucugaaagaccagcucuaaguaggccaauuaaaaaaaucuaauuccucaaauuugugug

SEQ ID NO: 152565 - RNA, 64 nt, hsa
uuuaccaacauguaucugucuacuuucucuuguuuaaaaaaagaaaaaaaaacuuaaaaaaaug

SEQ ID NO: 152566 - RNA, 64 nt, hsa
uacuuucucuuguuuaaaaaaagaaaaaaaaacuuaaaaaaaugggguuauagaaggucagcaa

SEQ ID NO: 152567 - RNA, 64 nt, hsa
uguuuuuuuuuuuuuaaucaaaaaacaauuuuuuuaaaaaaaaagcuuugaaaauggaugguuu

SEQ ID NO: 152568 - RNA, 64 nt, hsa
ggaugguuuggguauuaaaaagaaaaaaaaaacuuaaaaaaaaaaagacacuaacggccaguga

SEQ ID NO: 152569 - RNA, 64 nt, hsa
agccuuuuccaguguguaacccaguuugaaaucuuaaaaaaagaaaaaaugaaaaaaaaaggaa

SEQ ID NO: 152570 - RNA, 64 nt, hsa
cagccauuuuauaagcacucugauuucuaaaaguuaaaaaaaauauaugaaaucucuguagccu

SEQ ID NO: 152571 - RNA, 64 nt, hsa
acacaacaauaguuuaagaaauuuuuuuuuuaaauaaaaaaaaaggaaaagaggaagacuggac

SEQ ID NO: 152572 - RNA, 64 nt, hsa
aggccaauuuguuggccaccagaaaaccgcuuuuuaaaaaaacacuuggugauucuuucaagug

SEQ ID NO: 152573 - RNA, 64 nt, hsa
uaaacuauugccauacuucaguaagugucuuuuuuaaaaaaaauucacuuguauaaaaaugguc

SEQ ID NO: 152574 - RNA, 64 nt, hsa
ucuauucauuuauguuagcauuaaugcacauuuuuaaaaaaagaaaaaaacauggucuuguuuu

SEQ ID NO: 152575 - RNA, 64 nt, hsa
ucauuuaaaaaaaaagaauucugguccuguuuucuaaaaaaaaaaacuguuguagaaauucuua

SEQ ID NO: 152576 - RNA, 64 nt, hsa
uauggaaguaaaggcauuccacaggaucaucauuuaaaaaaaaagaauucugguccuguuuucu

SEQ ID NO: 152577 - RNA, 64 nt, hsa
gcacuuagauggauauaaaugcagcaacuuguuuuaaaaaaaugcacaauuuacuucccaaaaa

SEQ ID NO: 152578 - RNA, 64 nt, hsa
aaccacucucuugaaucacguuaacuuuugagauuaaaaaaaaaaacgccauagcacagcuguc

SEQ ID NO: 152579 - RNA, 64 nt, hsa
ucacucuuauaaauagugcugcuaugaaugucuguaaaaaaaaaaaacugcuccuucuuuugga

SEQ ID NO: 152580 - RNA, 64 nt, hsa
acauucauuuguauucagaugugaguagaagaacuaaaaaaagaaaguuacauaucacuaugac

SEQ ID NO: 152581 - RNA, 64 nt, hsa
acuuuuuugcccaugugucuuuuaagugugauuuuaaaaaaaugagugguucaguucauucccc

SEQ ID NO: 152582 - RNA, 64 nt, hsa
cucauugucuucuguacaucuuacuggguuuaauuaaaaaaaaagaaaaaacucuguuguaaaa

SEQ ID NO: 152583 - RNA, 64 nt, hsa
cacuaaauuaaaaaaaaauuaaaaguuaugggauuaaaaaaaguuaugggauaaaaaagguuau

SEQ ID NO: 152584 - RNA, 64 nt, hsa
aagaucacugucaucuaaaagcuggccacuaaauuaaaaaaaaauuaaaaguuaugggauuaaa

SEQ ID NO: 152585 - RNA, 64 nt, hsa
cucaacuuuaaaaaaaaaaaaagaagaaaagauuuaaaaaaaaaaaaaaaggagacuuuuuuug

SEQ ID NO: 152586 - RNA, 64 nt, hsa
agguuuccauacacugaagcuuuuaccucaacuuuaaaaaaaaaaaaagaagaaaagauuuaaa

SEQ ID NO: 152587 - RNA, 64 nt, hsa
uuugugguuuuuuaauauaguauaaaaauccuuuuaaaaaaacaacaaucugugugccucucug

SEQ ID NO: 152588 - RNA, 64 nt, hsa
cucaagugcuucaaugaugcagcauuucuugcacuaaaaaaaaaaaaaaaaaaaaaacuagaaa

SEQ ID NO: 152589 - RNA, 64 nt, hsa
aaaaaaagaauuucaaaaaaaaaaguuguuugcuuaaaaaaaauuucaugugagggaaaaaaaa

SEQ ID NO: 152590 - RNA, 64 nt, hsa
uuuuauuauguguuuuguauaaaucccuaauauuuaaaaaaaaaaacaaaacaaaaaaagguua

SEQ ID NO: 152591 - RNA, 64 nt, hsa
uuuacuguuuguuuuuauuaucuuaagugcuaauuaaaaaaaaaauaaaauuuuaaaaaaaccu

SEQ ID NO: 152592 - RNA, 64 nt, hsa
aucuuaagugcuaauuaaaaaaaaaauaaaauuuuaaaaaaaccuguaguuucauuaccuuuuu

SEQ ID NO: 152593 - RNA, 64 nt, hsa
auuuuguaccaguggaacuuuuuauacuggagauuaaaaaaaaaauggaaauuuuuguggcuug

SEQ ID NO: 152594 - RNA, 64 nt, hsa
uuuuugaggccaguacaaccuugauaacaaaaccuaaaaaaaaaacaacaaaaaaacccauaaa

SEQ ID NO: 152595 - RNA, 64 nt, hsa
auguuuauuagggcaaucaaaagauuuauuauuuuaaaaaaaucaguguggacuuccauuccuc

SEQ ID NO: 152596 - RNA, 64 nt, hsa
aagugacauuauagugauuaaauucuucccccuuuaaaaaaacaguuagugguuuucacuauuu

SEQ ID NO: 152597 - RNA, 64 nt, hsa
aauguuuauaauguguauauagaauuguucacuguaaaaaaaauggccaaaauguguuuuuuuu

SEQ ID NO: 152598 - RNA, 64 nt, hsa
auauacccccaccccacaaagauuuucuucagguuaaaaaaaaaguuuaaaaaaaagauuuuaa

SEQ ID NO: 152599 - RNA, 64 nt, hsa
ccacaaagauuuucuucagguuaaaaaaaaaguuuaaaaaaaagauuuuaaaauaaagcauuua

SEQ ID NO: 152600 - RNA, 64 nt, hsa
aaaaccaaaaugacaucuuuuuaaagcuuauccauaaaaaaaaauagaugucuuuuauagugga

SEQ ID NO: 152601 - RNA, 64 nt, hsa
uauacuuuaaauaauuuaacuacccuuaauuacuuaaaaaaaaaaaaaagcuuuaugauuuuca

SEQ ID NO: 152602 - RNA, 64 nt, hsa
aucauauuguguauaacuuggaaauggugcuguuuaaaaaaauuguguauuuauacaguaacag

SEQ ID NO: 152603 - RNA, 64 nt, hsa
aaguauaagucaaucuauggucagugucuuugguuaaaaaaaaaaaaaaacacaggcaguucuu

SEQ ID NO: 152604 - RNA, 64 nt, hsa
acauuuaaaaaguuuucugaaaaaacuuuugcaauaaaaaaaaauaaauugcccaucaauaagu

SEQ ID NO: 152605 - RNA, 64 nt, hsa
aaagguuuuuguccuuuccuucacugauuugcuuuaaaaaaaauaaaagauaaugauuuauugc

SEQ ID NO: 152606 - RNA, 64 nt, hsa
gcuggucagacuuuuuuuguuagauucucucauuuaaaaaaaauacuguuuguuuaaagcaugc

SEQ ID NO: 152607 - RNA, 64 nt, hsa
ucccugucaagguuaguaaauaaaauaagugacauaaaaaaaaaaaaaacuaaacuacuuguug

SEQ ID NO: 152608 - RNA, 64 nt, hsa
uuaagaauugcaguggagcaaauuggucauuuuuuaaaaaaauauauuuuaaccuacagucacc

SEQ ID NO: 152609 - RNA, 64 nt, hsa
ucccaaggguucuggcaccuuaugauguacuuuguaaaaaaauugauugaagauuuuaaauaaa

SEQ ID NO: 152610 - RNA, 64 nt, hsa
auuuguggcuagaaauuuuaaucuaaacuuuuuuuaaaaaaaaucauaauaguuaggauaguuu

SEQ ID NO: 152611 - RNA, 64 nt, hsa
cucauuugccgacuuauuuuuauaggaagccaauuaaaaaaaaaaaaaguuuucuuauaguauu

SEQ ID NO: 152612 - RNA, 64 nt, hsa
cuaccuauguaaauguuugaauggaggacgccaguaaaaaaacaaaaacaaaaacaaaacaaaa

SEQ ID NO: 152613 - RNA, 64 nt, hsa
ccggaagggugcuuauucuuuaacaaagagaaucuaaaaaaaaaaacaaaaaacuguugucuaa

SEQ ID NO: 152614 - RNA, 64 nt, hsa
uagcuucaggaauacugcucguuauaaacacuacuaaaaaaacaguuuauauuuuauauacaca

SEQ ID NO: 152615 - RNA, 64 nt, hsa
gaaacacuaaauaguguaauauuucuuuugcuuuuaaaaaaauuccugguagcaaaucaagaua

SEQ ID NO: 152616 - RNA, 64 nt, hsa
caagaauaaauaaaacaaacuuaaucuucaucuuuaaaaaaaagaaaaaagaaaccaaaaugag

SEQ ID NO: 152617 - RNA, 64 nt, hsa
ugcuuuugauucacauuaagcugcuuucagaaauuaaaaaaacacuuuuuaaagggugcauuga

SEQ ID NO: 152618 - RNA, 64 nt, hsa
uaaugaauuccaauuauaccuuacaucagcaaguuaaaaaaaguacuuuaaaauaaagcaaagg

SEQ ID NO: 152619 - RNA, 64 nt, hsa
uuaagaguuuaaaaaucuuaugagugagaaauauuaaaaaaaucuuauuuucaccucuuuagaa

SEQ ID NO: 152620 - RNA, 64 nt, hsa
caaaggaaaacacgugguuuuuaaagccauuagguaaaaaaaguucucaauaaaggcauuacaa

SEQ ID NO: 152621 - RNA, 64 nt, hsa
agauggacuuuucugauaaaucuuggcagacaucuaaaaaaaaaaccauauuuuucacaagaaa

SEQ ID NO: 152622 - RNA, 64 nt, hsa
aaaucucugccauuuuagauacugugaaacaaacuaaaaaaaaaaaagcuuuuguuuuguauuu

SEQ ID NO: 152623 - RNA, 64 nt, hsa
ggccuacaagaacaaaacuccaucucaaaauaaauaaaaaaauaaauaaaaauaaaaauagacu

SEQ ID NO: 152624 - RNA, 64 nt, hsa
cucucucuagggcagcagagagcuuuuugcacuuuaaaaaaaaaaagaaagaaagaaaggucgg

SEQ ID NO: 152625 - RNA, 64 nt, hsa
uuuauauauauauaauauaaaaucacuuggugauuaaaaaaauaacugcuccauaaauaaaacu

SEQ ID NO: 152626 - RNA, 64 nt, hsa
auauuguauuaaucucauggaugguucucaaagguaaaaaaagagagagaaagagagagagcua

SEQ ID NO: 152627 - RNA, 64 nt, hsa
uugaaaccuacagaaccgacaaaaauuagggugcuaaaaaaaugacagugaaaucucaucguaa

SEQ ID NO: 152628 - RNA, 64 nt, hsa
uuaagcaguuugaaggcauacuuuugcauagaaauaaaaaaaauacugauuuggggcaaugagg

SEQ ID NO: 152629 - RNA, 64 nt, hsa
guucacugaacaccaagaccagaauggauuuuuuuaaaaaaauagauguuccuuuugugaagca

SEQ ID NO: 152630 - RNA, 64 nt, hsa
gaaaguuuuuuuaaagaacagaaacuuuuccaauuaaaaaaaaaaagcagacuucugguucaag

SEQ ID NO: 152631 - RNA, 64 nt, hsa
ugauaugaaaaacuuugucuugucauuauaauaauaaaaaaaugaacauuuauuauggaauuuc

SEQ ID NO: 152632 - RNA, 64 nt, hsa
uuuugaaaaugucucuguaauauuuuaucuucuuuaaaaaaaagggggggaaauaccaaagugu

SEQ ID NO: 152633 - RNA, 64 nt, hsa
gauguaacaugaagccauuccagaaaugguaacuuaaaaaaaaaaagacuacaugucuaggaaa

SEQ ID NO: 152634 - RNA, 64 nt, hsa
gagucuagaacuuacugcaaaaacaagacaaaacuaaaaaaauacaacugagaagggugaagag

SEQ ID NO: 152635 - RNA, 64 nt, hsa
uacaugucagagacauuuauaaaaagugaaaggauaaaaaaaaaaaaaaacaacuaauaccggg

SEQ ID NO: 152636 - RNA, 64 nt, hsa
ccauccugucuuuuacacaauggacaaaucaaguuaaaaaaauuuuuagauagcuuagcuuguu

SEQ ID NO: 152637 - RNA, 64 nt, hsa
ccaacauggugugagaccccgucucuacuaaaaauaaaaaaauuagccgggugcgguggcacac

SEQ ID NO: 152638 - RNA, 64 nt, hsa
uaagacaaggucacugugcugauugauuuuuaucuaaaaaaauucauuuuuauaucgaagaaaa

SEQ ID NO: 152639 - RNA, 64 nt, hsa
aaacccacugccauauuaguuauucugaauauacuaaaaaaauccagcuagauugcaguuuaau

SEQ ID NO: 152640 - RNA, 64 nt, hsa
gauguuuuuaaaacaauauuaacagcuguuagguuaaaaaaauagcuggacauuuguuuucagu

SEQ ID NO: 152641 - RNA, 64 nt, hsa
aggagugaacauuuggguaaaucauggcuaagcuuaaaaaaaacucauggugaggcuuaacaau

SEQ ID NO: 152642 - RNA, 64 nt, hsa
guugccguugccaagaacugaaaacauaaaaaguuaaaaaaaauaauaaauugcaugcugcuuu

SEQ ID NO: 152643 - RNA, 64 nt, hsa
acaugagucacagcuuuuguucugugguaaccuauaaaaaaaguuugucuuugagauucaaugu

SEQ ID NO: 152644 - RNA, 64 nt, hsa
uucuguugcacuuguaaaaugcuacaaggaauauuaaaaaaaucuauucacuuuaacuuauaau

SEQ ID NO: 152645 - RNA, 64 nt, hsa
cgcaaaccauugguugggagucagauugguuucuuaaaaaaaaaaaaaaaaugacauacgugac

SEQ ID NO: 152646 - RNA, 64 nt, hsa
ccuuaaaucucuuguauggcaaccaaaauuacuguaaaaaaauaaauauacuauugcacuaagg

SEQ ID NO: 152647 - RNA, 64 nt, hsa
guuacuuuugugcuuuuauucuuuuuagacuuuauaaaaaaaaaaaaaagcuccuguaauuugc

SEQ ID NO: 152648 - RNA, 64 nt, hsa
aaucaacuccaucacuucuuaaaucgguauuuguuaaaaaaaucaguuauuuuauuuauugagu

SEQ ID NO: 152649 - RNA, 64 nt, hsa
cuuugcaaugacauuuauuuauuaauucaugccuuaaaaaaauaggaagggaagcuuuuuuuuu

SEQ ID NO: 152650 - RNA, 64 nt, hsa
ccugugaaugccaaaguaaacuuuauguacaguguaaaaaaaaaaaaucucaguuauguuuuua

SEQ ID NO: 152651 - RNA, 64 nt, hsa
aaauuaaguucugaaaauugaaaaaauuaaaauguaaaaaaauuaaagaauaaaaauacuucua

SEQ ID NO: 152652 - RNA, 64 nt, hsa
uuucuuucucauuuuauguugaacuaaaaaggauuaaaaaaaaaaucuccagacucaaguugcu

SEQ ID NO: 152653 - RNA, 64 nt, hsa
gccuacuaaccgugccaucuugcaaacuacacuuuaaaaaaaacucauugcuuuguauuguagu

SEQ ID NO: 152654 - RNA, 64 nt, hsa
uuccuuccugccccaaaauuauaaacucuaaguguaaaaaaaagucuuaacaacagcuucuugc

SEQ ID NO: 152655 - RNA, 64 nt, hsa
agccuaacauuggugcaaagauugccucuugaauuaaaaaaaaaaacuagauugacuauuuaua

SEQ ID NO: 152656 - RNA, 64 nt, hsa
cuggaaagggggggaaaaaagcaaaaaacaaaauuaaaaaaaauugauuuccauauuuuauuuu

SEQ ID NO: 152657 - RNA, 64 nt, hsa
acugcaguucauccgcacuguaaauacauguauuuaaaaaaacaaucccaaguaaaaauuucuu

SEQ ID NO: 152658 - RNA, 64 nt, hsa
uagagauguagcgauguaagugucgauguuuuuuuaaaaaaaaaugcaaaaaaauucuuauggc

SEQ ID NO: 152659 - RNA, 64 nt, hsa
caggggaauuaugugugugaaugucaucuacaauuaaaaaaaauuagcacaucccuuuacuuac

SEQ ID NO: 152660 - RNA, 64 nt, hsa
guuguuuuuguucuuuguguuuuagggugaaacuuaaaaaaaaaauucugcccccaccuagauc

SEQ ID NO: 152661 - RNA, 64 nt, hsa
uaauguccucuugcugucuacaguagcugcuaccuaaaaaaagauguuuuauuuugccaguugg

SEQ ID NO: 152662 - RNA, 64 nt, hsa
uugaauguauuugacuuaguucuuauuuuaaggcuaaaaaaacuuugucauauuuaagucggca

SEQ ID NO: 152663 - RNA, 64 nt, hsa
agcuaugcccauuuauucccaaauauuaagcccuuaaaaaaauaaaaccucugaaccaaaaucu

SEQ ID NO: 152664 - RNA, 64 nt, hsa
guaacugacucuuaaguguuaaauaauguagaaguaaaaaaauuuuuuuuaaaggcuuaauuug

SEQ ID NO: 152665 - RNA, 64 nt, hsa
ccugugcugaaauuugggggaaguuuagguccuuuaaaaaaacauauuaaucauugacuacauc

SEQ ID NO: 152666 - RNA, 64 nt, hsa
ccaugugcaccuugggguuuuguaaugacagugcuaaaaaaaaaaagcauuuuuuuuuuaugau

SEQ ID NO: 152667 - RNA, 64 nt, hsa
auuaacguuauuuguaauuuaguuuguagcucauuaaaaaaaugugccuaguuuuauaguucau

SEQ ID NO: 152668 - RNA, 64 nt, hsa
gaagauaaaaaauauuguuaagugugcaaguuauuaaaaaaaaaaaauugggccaggcacggug

SEQ ID NO: 152669 - RNA, 64 nt, hsa
ucauauaaugacuuuuuuuuaagagucucuuuuuuaaaaaaacuuaauucucuaaaaccgaaau

SEQ ID NO: 152670 - RNA, 64 nt, hsa
uugcauguuuuucagaugcuuucaaaucuuuuuuuaaaaaaauaguguaaaauauuuuaauaag

SEQ ID NO: 152671 - RNA, 64 nt, hsa
caucaaauaaaaauggaaaaaaugaucauggcuuuaaaaaaaaaacaaaaacacacacacauga

SEQ ID NO: 152672 - RNA, 64 nt, hsa
auguacaguguucuguuuaauacucauccuuguauaaaaaaaauaguugagccagcagacauug

SEQ ID NO: 152673 - RNA, 64 nt, hsa
acauugccuauuucaguggcacgucaucuaguuuuaaaaaaauaaaacauuuuaaauggacaga

SEQ ID NO: 152674 - RNA, 64 nt, hsa
uugcugacaaacuuaucccaaaacuuuaguggcuuaaaaaaaccugcccccaacuguuagucaa

SEQ ID NO: 152675 - RNA, 64 nt, hsa
gcugggaugauggagaaagcucgaggugaaguuuuaaaaaaaaaguuguggaaaggaaaguucc

SEQ ID NO: 152676 - RNA, 64 nt, hsa
gaaagaauuaucuggcacauuagguauuggaguuuaaaaaaaaagccaaauuucacagucuuaa

SEQ ID NO: 152677 - RNA, 64 nt, hsa
aaaagccaaauuucacagucuuaauaacuuuuuuuaaaaaaaacuaaaaggcgcuucaugucca

SEQ ID NO: 152678 - RNA, 64 nt, hsa
cacguauauuauguagucuauuugcaacuguucuuaaaaaaaugacauuaaaagaauaguuuau

SEQ ID NO: 152679 - RNA, 64 nt, hsa
ugugugaagggguagaauuugugcgguaaagacuuaaaaaaaaaaguagggagauuaaaaaaaa

SEQ ID NO: 152680 - RNA, 64 nt, hsa
ugcgguaaagacuuaaaaaaaaaaguagggagauuaaaaaaaaagaaagaaaaugcuuccuuau

SEQ ID NO: 152681 - RNA, 64 nt, hsa
acugaauuuauuuuaaaaaauaauaauaaaaauuuaaaaaaauuaaaaauaaaaaaaaccacag

SEQ ID NO: 152682 - RNA, 64 nt, hsa
aaaaauaauaauaaaaauuuaaaaaaauuaaaaauaaaaaaaaccacagaaaacaacuuuacau

SEQ ID NO: 152683 - RNA, 64 nt, hsa
uuagauuuauuuaaaguucuuaaugccaacaguuuaaaaaaaaauuaaaacauuugaaugaacu

SEQ ID NO: 152684 - RNA, 64 nt, hsa
ucagauucauuuuucuugauguaauuuaucaccauaaaaaaaaacccaugcaaaccugagugag

SEQ ID NO: 152685 - RNA, 64 nt, hsa
gcuugguacaagcuuaugcugucuuaaauuauuuuaaaaaaauaaauacugucugugagaaacc

SEQ ID NO: 152686 - RNA, 64 nt, hsa
uccaucauguuccuaaauuuuuguaaucuuacuguaaaaaaaagugcacugaacuucaaaacaa

SEQ ID NO: 152687 - RNA, 64 nt, hsa
acuuuaaagaauugugaucaggucacauuguuaauaaaaaaaaaaaacgggcuagucccuaugu

SEQ ID NO: 152688 - RNA, 64 nt, hsa
aaaacauacuuauuuuaaaaaagaaaaaaaaggauaaaaaaacccaaacugaaauucuauauac

SEQ ID NO: 152689 - RNA, 64 nt, hsa
aaccauuuaaccguauguaaacuugguuucuaauuaaaaaaaaauuucuuuuuccaauuugguu

SEQ ID NO: 152690 - RNA, 64 nt, hsa
aaggauaugcaugauucuuaaccaggcuauauguuaaaaaaaaauuggaaaaugcaauacauuu

SEQ ID NO: 152691 - RNA, 64 nt, hsa
cagccuggccaacacggugaaaccccaucucuacuaaaaaaaaauacaaaaauuagccgggcgu

SEQ ID NO: 152692 - RNA, 64 nt, hsa
acuccagccugggugaagaagugagacucugucuuaaaaaaaaaaauuggugcugauaaauauu

SEQ ID NO: 152693 - RNA, 64 nt, hsa
cagccuggccaacauggugaaaccccaucucuacuaaaaaaaaaaaaaaaauuagucgggcgug

SEQ ID NO: 152694 - RNA, 64 nt, hsa
aagaaaaucuuaagugauugaugcuguuuucuuuuaaaaaaaaaaaaaaaaauucauuuucuuu

SEQ ID NO: 152695 - RNA, 64 nt, hsa
cuuuggaacgagaugcuauacuaauaagcaaguguaaaaaaaaaaaaaaaagaggaagaaaauc

SEQ ID NO: 152696 - RNA, 64 nt, hsa
aaugcagugacuuauacuaagacaauuuauuguuuaaaaaaaaaauuggcaagacaacuauaug

SEQ ID NO: 152697 - RNA, 64 nt, hsa
accauuuaguaaaauguagcuggcccaggacauguaaaaaaaaaaaaaaaacaacaacaauaaa

SEQ ID NO: 152698 - RNA, 64 nt, hsa
uagacuccaguguguucagugaauaaguagaauauaaaaaaauauaaccaguauuuuacuucaa

SEQ ID NO: 152699 - RNA, 64 nt, hsa
ucaaaugcaauacuuuggguugguuucuuuccuuuaaaaaaauuuguauaaaacuggaagugug

SEQ ID NO: 152700 - RNA, 64 nt, hsa
ccaaaucaugggcucacuuuaaaaaaagaaagaauaaaaaaaccuucagcugugcuaaacagua

SEQ ID NO: 152701 - RNA, 64 nt, hsa
aaucugggaaagacaccaaaucaugggcucacuuuaaaaaaagaaagaauaaaaaaaccuucag

SEQ ID NO: 152702 - RNA, 64 nt, hsa
uagguugacuaucuaaauaggcauuuuuagucauuaaaaaaaaucuagucaccaggaggauccc

SEQ ID NO: 152703 - RNA, 64 nt, hsa
auuuaauuccaaaaauacucuguaauucuacaucuaaaaaaaccgauucccuaauucgaauuua

SEQ ID NO: 152704 - RNA, 64 nt, hsa
cuaauagccaaauagauaacacuaaugcuuuguuuaaaaaaacgaaaaaaacaaaacaaaacaa

SEQ ID NO: 152705 - RNA, 64 nt, hsa
aagacacacuuguacgaauguagauuuauuuuuuuaaaaaaaaaaaagcaaagcuuucugccag

SEQ ID NO: 152706 - RNA, 64 nt, hsa
uuuuuuaaucuucacaguguuuuaaagaacauguuaaaaaaaaaaaaaucuagugcuccugcug

SEQ ID NO: 152707 - RNA, 64 nt, hsa
uuugcuucauuuggggaaaauaauaccuuuucuuuaaaaaaaaaaaaaaaaaaaaaaaaguaaa

SEQ ID NO: 152708 - RNA, 64 nt, hsa
uagaccucaucucuacaaaaauaaaaaauaaaaauaaaaaaaacuuagcuaggcauguugccac

SEQ ID NO: 152709 - RNA, 64 nt, hsa
uuuagagguugcuaacugacaauguuaagaaauuuaaaaaaaaaaaaaagccugggcaugaugg

SEQ ID NO: 152710 - RNA, 64 nt, hsa
auauaaaauaaaaacuuaaaaaaaauuuaaaaaauaaaaaaaguuuuaaaaacugaucaaguua

SEQ ID NO: 152711 - RNA, 64 nt, hsa
acuuuuacuuuguagauaauauaaaauaaaaacuuaaaaaaaauuuaaaaaauaaaaaaaguuu

SEQ ID NO: 152712 - RNA, 64 nt, hsa
aaguaacaagagugauucuugcugcuauuacugcuaaaaaaaaaaaaaaaaaaaaaucaagacu

SEQ ID NO: 152713 - RNA, 64 nt, hsa
caaaacuguguuuacugaaagccgaaaacaguauuaaaaaaaguguguaaguaaaguguuaugg

SEQ ID NO: 152714 - RNA, 64 nt, hsa
uggacaaaaagccaaaauaaauauucuuccugauuaaaaaaauuuuuuuugaaaaaaacaaggc

SEQ ID NO: 152715 - RNA, 64 nt, hsa
uaaaaaugugacuuucuuguuuugucucaaaacuuaaaaaaacaaacacaaaaagaugaguccc

SEQ ID NO: 152716 - RNA, 64 nt, hsa
auuugaaagaauacaaaaauaugugaaguucauuuaaaaaaauaacuacaguauagcgcuggua

SEQ ID NO: 152717 - RNA, 64 nt, hsa
acacaaaaaauaaaaaaccccuacaaaaaaacuuuaaaaaaaauggcagcaaaggguaguuuuc

SEQ ID NO: 152718 - RNA, 64 nt, hsa
uucuugaaauaaucuaaaguuuaaaacauuauauuaaaaaaaaaguuguguggugggaauguga

SEQ ID NO: 152719 - RNA, 64 nt, hsa
guacuugaaguugagccuuuguggugggacuuuuuaaaaaaaugccuuuuuaaagcauuaaugg

SEQ ID NO: 152720 - RNA, 64 nt, hsa
uccaaacuagggcuuucaugacucaaguacuuccuaaaaaaacccaaucuucuccccugacacc

SEQ ID NO: 152721 - RNA, 64 nt, hsa
ccagugugguagacuuaaggcuucauugugggguuaaaaaaaaaaaaagauacaaagaaauaug

SEQ ID NO: 152722 - RNA, 64 nt, hsa
agugaacuuaaagcaaagaccucuuaguaaaaaauaaaaaaaaauaaaaaauaaaaauaaaaaa

SEQ ID NO: 152723 - RNA, 64 nt, hsa
uuaguaaaaaauaaaaaaaaauaaaaaauaaaaauaaaaaaaguuaaauuuauuuauagaaauu

SEQ ID NO: 152724 - RNA, 64 nt, hsa
uuaaguggcuaugcaagcaaaagcauagauagguuaaaaaaaaggaucagcuggcugggcaggg

SEQ ID NO: 152725 - RNA, 64 nt, hsa
auggggagggagaaugcuuuuccccucccaguaauaaaaaaaaaaaaaaaaaaaauauauauau

SEQ ID NO: 152726 - RNA, 64 nt, hsa
aaauauguguuguaugucuuuuuugcuuuuuuuuuaaaaaaaagaauaacuuuuuuugccucuu

SEQ ID NO: 152727 - RNA, 64 nt, hsa
agugguguuuugaagaggguauuuuauuguuuuuuaaaaaaagguucuuaaacauuauuugaaa

SEQ ID NO: 152728 - RNA, 64 nt, hsa
aagaauuacuagguugccauguggcucacuuauuuaaaaaaaaaaaaaaaaaacucacccguuu

SEQ ID NO: 152729 - RNA, 64 nt, hsa
gguugcauauggcaaugaaguguuuguuuuauauuaaaaaaaaccuguuauguacaguugaaau

SEQ ID NO: 152730 - RNA, 64 nt, hsa
ucaagugaauuuauuuguguguucuuuacuuauauaaaaaaagauaacuuuaaggaugugcaag

SEQ ID NO: 152731 - RNA, 64 nt, hsa
guaaaugaagaucaguauuucugccuagaucugauaaaaaaauuuucuugucuuaguuauaaaa

SEQ ID NO: 152732 - RNA, 64 nt, hsa
aaccuguacuuacagauucuuccuguaaacuaaauaaaaaaaaaaugauagugcauuuuggugg

SEQ ID NO: 152733 - RNA, 64 nt, hsa
cuuacuccuuagaguucagaugaauucuuaaaauuaaaaaaaaacuccauaguacuaauuuugu

SEQ ID NO: 152734 - RNA, 64 nt, hsa
cuuuucugguuuuaguuugggaauaaucauucauuaaaaaaaauguauugugguuuaugcgaac

SEQ ID NO: 152735 - RNA, 64 nt, hsa
ugucuuucaccaacucccuuuuaguuuucuugguuaaaaaaaaaaacaaaaaaaaaaacccucc

SEQ ID NO: 152736 - RNA, 64 nt, hsa
uaauuuuguauaugggcuuagguuuuguaaccaauaaaaaaagcugcuaucaaauaugauaaaa

SEQ ID NO: 152737 - RNA, 64 nt, hsa
gcaaaagucuaaaauacccauuggugauguuuuuuaaaaaaaucuugcuuucagcuuucaggag

SEQ ID NO: 152738 - RNA, 64 nt, hsa
caagaaacuugguuauugaauaaacagauaaguuuaaaaaaaaaaaaaaacuacuucaucuacc

SEQ ID NO: 152739 - RNA, 64 nt, hsa
aguaaauuaaauuucacccuauuuaaacauaugauaaaaaaagaaaugcacuuguaaacagaau

SEQ ID NO: 152740 - RNA, 64 nt, hsa
gaaaauuaguacuaacagcuauaggacuuguauuuaaaaaaaaaaaaaaagcuuggacaugguu

SEQ ID NO: 152741 - RNA, 64 nt, hsa
aaaaguaaaaaaaacaaaaaaaaaacaaaaaauuuaaaaaaaagguuugcuaaucugauaguua

SEQ ID NO: 152742 - RNA, 64 nt, hsa
aucuuaaugccacgguucaccaucaauuuaaaaguaaaaaaaacaaaaaaaaaacaaaaaauuu

SEQ ID NO: 152743 - RNA, 64 nt, hsa
acauuccacaucuguuucaaacugaauuuguucuuaaaaaaauaaaauauuuuuuuccuaugga

SEQ ID NO: 152744 - RNA, 64 nt, hsa
uuguggcaauuaaguggucccaaugcucagcgcuuaaaaaaacaaauuggacagcuacuucugg

SEQ ID NO: 152745 - RNA, 64 nt, hsa
gaaaaaaagaggaaagaaggaaaaaaaaaagaauuaaaaaaaaaaaaaagaaaaacagaagaug

SEQ ID NO: 152746 - RNA, 64 nt, hsa
cagaagaugaccuugauggaaaaaaaauauuuuuuaaaaaaaagauauacuguggaagggggga

SEQ ID NO: 152747 - RNA, 64 nt, hsa
uaugugacauuugcccuagccuaagaguagcagguaaaaaaaaguuucuuucaucuuuugccuu

SEQ ID NO: 152748 - RNA, 64 nt, hsa
auccuucuuggcaaaaguagcuuuugaacugauauaaaaaaaaaugcugaguaacagaaaagua

SEQ ID NO: 152749 - RNA, 64 nt, hsa
cuguaauuuauacgguguacuauauaaugggauuuaaaaaaagugcuaucuuuucuauuucaag

SEQ ID NO: 152750 - RNA, 64 nt, hsa
caaacaguuuuguaacucuuugcuuuuuaaaucuuaaaaaaaaaaaaguugcugaaguacugua

SEQ ID NO: 152751 - RNA, 64 nt, hsa
caguugcauuaacuauuucaaaaauuacugccuuuaaaaaaaacaaccucaagcuauauuugua

SEQ ID NO: 152752 - RNA, 64 nt, hsa
aaacagaugauguauuucuccauugaaaacacaauaaaaaaaaaacagcacaaucucacaguug

SEQ ID NO: 152753 - RNA, 64 nt, hsa
ccuaagggacauguuuugauaaaguaguaaaaauuaaaaaaaaaaaacuuuacuaagaugacau

SEQ ID NO: 152754 - RNA, 64 nt, hsa
gcaguuacaugcauacuucaaaaguauuuuccuguaaaaaaaaaaaaguuauauagguuuuguu

SEQ ID NO: 152755 - RNA, 64 nt, hsa
gagagagccagaccuugucucaaaaaauaaaaaauaaaaaaauaaaaacaaaauaaggaauccu

SEQ ID NO: 152756 - RNA, 64 nt, hsa
cuuuaaaaaaaaaaaagaaucugcgguauuuuuuuaaaaaaaaaguuuaccgcuguagugugaa

SEQ ID NO: 152757 - RNA, 64 nt, hsa
acuuguuaacuucuuacagcaguaguaccuucuuuaaaaaaaaaaaagaaucugcgguauuuuu

SEQ ID NO: 152758 - RNA, 64 nt, hsa
ggacuauaggugcaugccaccacacccagcuaauuaaaaaaauuuuuuguguggagucuauguu

SEQ ID NO: 152759 - RNA, 64 nt, hsa
cagccugaccaaaauggugaaacccugucucuacuaaaaaaaagaaaaauuagccagacguggu

SEQ ID NO: 152760 - RNA, 64 nt, hsa
aggaguuauaugucugcuaucuguguugcucauuuaaaaaaaguauacauugaauaaggcuguu

SEQ ID NO: 152761 - RNA, 64 nt, hsa
gguuauuuuauuuuaaaaaaaugaaaaauuaauuuaaaaaaaugcaaaaaacuguuggauuauu

SEQ ID NO: 152762 - RNA, 64 nt, hsa
uuuguaacuuuacacuuuuuugguuauuuuauuuuaaaaaaaugaaaaauuaauuuaaaaaaau

SEQ ID NO: 152763 - RNA, 64 nt, hsa
aaaaauaacaacaaaaaaaaaaugagagaaaagcuaaaaaaaaaaaaguaaggggugagcaguu

SEQ ID NO: 152764 - RNA, 64 nt, hsa
gcuaaaguuccccaguucauaugugacaucuuuuuaaaaaaaauaacaacaaaaaaaaaaugag

SEQ ID NO: 152765 - RNA, 64 nt, hsa
uucauuaggggcuuaagcuagcuccuuuggcuuuuaaaaaaaauuuuuuuucaaauuucuucau

SEQ ID NO: 152766 - RNA, 64 nt, hsa
uuuugcuuugcuuuggauaagaaauccuuaccuuuaaaaaaagcuucuagucuccauaaccccc

SEQ ID NO: 152767 - RNA, 64 nt, hsa
aacgaaggugacucacuuugcuuuuucaguccauuaaaaaaacauuuuauuuugcaaccauucu

SEQ ID NO: 152768 - RNA, 64 nt, hsa
acucuuuccuccuugccacuuaccuuugcaaaguuaaaaaaaaggggggagggaaugggagaga

SEQ ID NO: 152769 - RNA, 64 nt, hsa
aaaauacguuuacaguauuggguacauacaaggguaaaaaaaaaauuguguguauguguguugg

SEQ ID NO: 152770 - RNA, 64 nt, hsa
cuuuagaaacuaacaaagccacauuuacuuuaaguaaaaaaaaaaaaaauucugguugaagaua

SEQ ID NO: 152771 - RNA, 64 nt, hsa
cgcuaggcugcauagcauuauaaccugggaacguuaaaaaaaauacagacauucuugauucuua

SEQ ID NO: 152772 - RNA, 64 nt, hsa
auacuuucagaauuguauuucaguuuugaagauuuaaaaaaaaugugaaaauaaauauauauua

SEQ ID NO: 152773 - RNA, 64 nt, hsa
cuuguaagaugagaacugcuuuuuacacauuuaauaaaaaaaggucucugaauuaucugauguc

SEQ ID NO: 152774 - RNA, 64 nt, hsa
caagaacagaaaacaagaagucauaccuuuuucuuaaaaaaaaaaaaaaaguuuuugcuucaag

SEQ ID NO: 152775 - RNA, 64 nt, hsa
uuuuacuuuuuuuuaugaucaaggaaaagaucauuaaaaaaaaacacaaagaaguuuuucuuug

SEQ ID NO: 152776 - RNA, 64 nt, hsa
ucuucuuaaaaucaaauguaaaucaauuacagauuaaaaaaaaaagccuguauuuaacucauau

SEQ ID NO: 152777 - RNA, 64 nt, hsa
uuauuuuaugagccccaguuuucugggcuuaguuuaaaaaaaaaaucaagucuaaacauugcau

SEQ ID NO: 152778 - RNA, 64 nt, hsa
aagcuuuuguucuuggauaaaaagucauacacuuuaaaaaaaaaaaaaacuuuuuccaggaaaa

SEQ ID NO: 152779 - RNA, 64 nt, hsa
aaaagacugucaaaugaacuuuuacagaaugcauuaaaaaaaaaaaaaaacuccugugucgguc

SEQ ID NO: 152780 - RNA, 64 nt, hsa
ugauucaguaucuuagaguuuacaguuuguguuuuaaaaaaacugaagguuuuuuuuuuaagug

SEQ ID NO: 152781 - RNA, 64 nt, hsa
acaaauucauuugucagccucuuuuuaguucucuuaaaaaaaaaaaaaucauaugaucauuuuc

SEQ ID NO: 152782 - RNA, 64 nt, hsa
auucuacaguggauagaauuaggaauugauggcuuaaaaaaaaaagucuaugaagagucuguuu

SEQ ID NO: 152783 - RNA, 64 nt, hsa
acuguuacauuaagugcaucuguguauccugguuuaaaaaaauguaaucuuuuuugaaauaaac

SEQ ID NO: 152784 - RNA, 64 nt, hsa
gaagaaguaaggaaaaggagagagcuagucuagauaaaaaaagagauaaagacuacagaaggaa

SEQ ID NO: 152785 - RNA, 64 nt, hsa
auaauggagcaaguggccaaacaucagaaucgauuaaaaaaagugaagaaaagaagcgaauaag

SEQ ID NO: 152786 - RNA, 64 nt, hsa
augaugaaaagaguaguucaagaaguucuggagauaaaaaaaauacgagugauagaaguagcaa

SEQ ID NO: 152787 - RNA, 64 nt, hsa
caauacaugcaguaguacaucauuuuagcaacucuaaaaaaaaaaaaaauacaaauaaaaagga

SEQ ID NO: 152788 - RNA, 64 nt, hsa
gaaaguaauaaaaacuuaaauucuuuguaccaguuaaaaaaaauguauaaaauuuacaucugug

SEQ ID NO: 152789 - RNA, 64 nt, hsa
caacucugcuuuaaaacaaaaccaaacaaaacuuuaaaaaaaaaugugugauccagcuuucucu

SEQ ID NO: 152790 - RNA, 64 nt, hsa
uuugagaaaaaaaaauguuuacucuuccaucauuuaaaaaaaauguaaaagacaaaaaaaaaau

SEQ ID NO: 152791 - RNA, 64 nt, hsa
gagcaugguucucaggaaaaccaguuccccaguuuaaaaaaaaaaaaaaaaauuccuuguaguu

SEQ ID NO: 152792 - RNA, 64 nt, hsa
uuucccucuaauaggaaacaguauaaauuuuaauuaaaaaaaaaaggcaaacuaaaauuucuug

SEQ ID NO: 152793 - RNA, 64 nt, hsa
uagccaaugcaaaucuguuuuaaaacaaauaguuuaaaaaaagaacaaguuuuuaagggcuuua

SEQ ID NO: 152794 - RNA, 64 nt, hsa
ucugucuuuaaaguguuuacaaaaaaaaauuauauaaaaaaaaagucuagugucgacugguguu

SEQ ID NO: 152795 - RNA, 64 nt, hsa
auauuaaaauacaaaaaaaaacuuauaaaauguuuaaaaaaauguucaaagcuugggagaaaag

SEQ ID NO: 152796 - RNA, 64 nt, hsa
gugcgggaagaagcagaagcaaaaaaaauaaaaauaaaaaaauaaauaaaaauaaaaaaaauaa

SEQ ID NO: 152797 - RNA, 64 nt, hsa
gcaaaaaaaauaaaaauaaaaaaauaaauaaaaauaaaaaaaauaaaaaaggaaaaaaaaaaaa

SEQ ID NO: 152798 - RNA, 64 nt, hsa
aaaaaaacuuuuuuuaaucguuguaauaauuguauaaaaaaaaucgcucuguauaguuacaacu

SEQ ID NO: 152799 - RNA, 55 nt, hsa
cggcucucuccucauccuaguucuuuaaaaaaaacaaaaaaacaaaaaaaacuuu

SEQ ID NO: 152800 - RNA, 64 nt, hsa
uuauaaugguuacaucugcuuuuugucuuuaaaauaaaaaaaaaaaucagagaaaagcccaccu

SEQ ID NO: 152801 - RNA, 64 nt, hsa
uauacuauuuuuuuccuuuuuuaauucaguuuuuuaaaaaaacaaauguauuguggcuuccagu

SEQ ID NO: 152802 - RNA, 64 nt, hsa
gcuaucaguuuuuuggggcaggggagaugaacuuuaaaaaaaaaaaaaaaacuucauuggcuug

SEQ ID NO: 152803 - RNA, 64 nt, hsa
aaaaagagagaaagaaaggaguaaacagugguaauaaaaaaauccaucugucuucuugcuaugu

SEQ ID NO: 152804 - RNA, 64 nt, hsa
acuugaaaaugggaagcgaugacaaaucugacuuuaaaaaaaaucuuugauuugcacuguuaua

SEQ ID NO: 152805 - RNA, 64 nt, hsa
aucagggcccuagaaagugcuaggaggaagggguuaaaaaaaaaauuuguccgcguugcaaacu

SEQ ID NO: 152806 - RNA, 64 nt, hsa
auaccucacuauuaaacugccaugaugccucaguuaaaaaaaaaauuaaauguccgucaguguc

SEQ ID NO: 152807 - RNA, 64 nt, hsa
acuccagccugggcaaccaagcgagacucugccuuaaaaaaaaaaaaaagaaaauguggcacau

SEQ ID NO: 152808 - RNA, 64 nt, hsa
cuauauagcaagccuacacaugugccccugaaccuaaaaaaaaaguuaaaagaaaaacguuugg

SEQ ID NO: 152809 - RNA, 64 nt, hsa
ugaaauuuugugagacuuuuccugcacuggacaguaaaaaaauaauaaaagacaaaaacaaauu

SEQ ID NO: 152810 - RNA, 64 nt, hsa
acaguaaaaaaauaauaaaagacaaaaacaaauuuaaaaaaaaauuuaagccacaaaaaaaggc

SEQ ID NO: 152811 - RNA, 64 nt, hsa
gcuguguuuucuaacacauuuuucuguuuuuaauuaaaaaaaaaaaaaaaagguuuucaguugc

SEQ ID NO: 152812 - RNA, 64 nt, hsa
cccccucugcgagaaacacccaagaaugaucaauuaaaaaaaaaauaauauaauaauaauucuu

SEQ ID NO: 152813 - RNA, 64 nt, hsa
caguauuaaguucuuagucauugauuuuuguguuuaaaaaaaaauaggaaagagggaaacugca

SEQ ID NO: 152814 - RNA, 64 nt, hsa
ucgggcuuuaauuugcuaaagcugugcacauauguaaaaaaaaaaaaaaaaagauuauuuuagg

SEQ ID NO: 152815 - RNA, 64 nt, hsa
guaaaagcugaaaaaaucccuuuguuucuauuuauaaaaaaagugcuuuucuauauguacccuu

SEQ ID NO: 152816 - RNA, 64 nt, hsa
aagaugauaaagcauuugaaugguacaguagauguaaaaaaaauucaguuuaaaagaacauuug

SEQ ID NO: 152817 - RNA, 64 nt, hsa
uucuucuuucccuaccuuuuuuuucuuuuuuucuuaaaaaaauauuuuguguuauuaacagaaa

SEQ ID NO: 152818 - RNA, 64 nt, hsa
acugcuuccuugaaacauuuuugugcuauuguuuuaaaaaaauaauuaaaaaacaguuggcguu

SEQ ID NO: 152819 - RNA, 64 nt, hsa
cuuggaaaagagaaaaacaauggaguuacuuauuuaaaaaaaaagaaagaaaguuaucucuucc

SEQ ID NO: 152820 - RNA, 64 nt, hsa
cgaaguuuuguuuacugaugcagcacaagagauguaaaaaaaaaaaaaaaaaaaaaaaaaaaaa

SEQ ID NO: 152821 - RNA, 64 nt, hsa
caauuauuuuccuuuuuguuccccccaaccccauuaaaaaaauuuuuuuuugauuuuuguuuuu

SEQ ID NO: 152822 - RNA, 64 nt, hsa
gaggagagaaauaauaacuaaaaaauauacccuuuaaaaaaaccuauauuucucugucuaaaaa

SEQ ID NO: 152823 - RNA, 64 nt, hsa
cuugggagauuuggaugauuugagaagagugacuuaaaaaaaaugcuucugugcucuaagauau

SEQ ID NO: 152824 - RNA, 64 nt, hsa
cuaaucauuuccuggguuccacuuacucuugauuuaaaaaaaaaaaaacaacaaaagaguuugu

SEQ ID NO: 152825 - RNA, 64 nt, hsa
uaauuuuugaauuuuaaaacuaaucuauuuuauuuaaaaaaaaucaaguacuuuggaagugaau

SEQ ID NO: 152826 - RNA, 64 nt, hsa
caagccagcuggcuuaugcugguucucagcuguuuaaaaaaaaaaaaaaaaaggaauagaaaca

SEQ ID NO: 152827 - RNA, 64 nt, hsa
gugaucugggaacuuuuugcuguacaaaucuguuuaaaaaaaaaaaaaaguaacucauugaauu

SEQ ID NO: 152828 - RNA, 64 nt, hsa
cacgaugcaagcccauuguguuuccgggcuuuuuuaaaaaaaaaauuguagcacugggcguggu

SEQ ID NO: 152829 - RNA, 64 nt, hsa
ggccaacauggugaaaccccgucucuacuaaagauaaaaaaauuagcugaguguguuggugggu

SEQ ID NO: 152830 - RNA, 64 nt, hsa
aacaaagcaagacucugucucaaaaaaauaaaaauaaaaaaaaaaucuuaguuccauggaauuu

SEQ ID NO: 152831 - RNA, 64 nt, hsa
uccucaggcuuugcgauuuaaggaggagcugccuuaaaaaaaaauaaaggccuuauuuugcaau

SEQ ID NO: 152832 - RNA, 64 nt, hsa
uuuuuaaaaaagacagcaaacuuuuuuuuuuauuuaaaaaaagauauauuaacaguuuuagaag

SEQ ID NO: 152833 - RNA, 64 nt, hsa
uauuccuuuucggcagccgaaugaaaaaaaaauuuaaaaaaaugugcgagcuaauauggcaaaa

SEQ ID NO: 152834 - RNA, 64 nt, hsa
uuuaggggacaauugagauggcugaacuacugaauaaaaaaaaaacaacgcuguuuucuagucc

SEQ ID NO: 152835 - RNA, 64 nt, hsa
uagguccucacacaauuccuuacagagcacuuauuaaaaaaaaaucuuaagaguugaucuguuu

SEQ ID NO: 152836 - RNA, 64 nt, hsa
uuuguguuuuuuuaaauaaaaauuuucaaaaaguuaaaaaaaaagacauauaagguugauuaaa

SEQ ID NO: 152837 - RNA, 64 nt, hsa
uuaaaaaaaaaaaagaaggaaaaauugaaaaaaauaaaaaaaaaaguuacagaaugcuguguac

SEQ ID NO: 152838 - RNA, 64 nt, hsa
ucuugauucuguucgcaaagcacagacuagugcuuaaaaaaaaaaaagaaggaaaaauugaaaa

SEQ ID NO: 152839 - RNA, 64 nt, hsa
uguuugcaaguuaaaggguuugucauuguuucuuuaaaaaaaaauacaauaaugcaccauaucc

SEQ ID NO: 152840 - RNA, 64 nt, hsa
aaugugguugucagaacccugaaaguauuaguucuaaaaaaaaaaagauauauacuagaaguaa

SEQ ID NO: 152841 - RNA, 64 nt, hsa
auacaaaacaguucuaggggguugaacuacauaguaaaaaaauaaaauaaauaguacuuagugu

SEQ ID NO: 152842 - RNA, 64 nt, hsa
caucaugccacgcauuguuuuuaaagcauugcguuaaaaaaaaaauuaacuaaaccaagaugcu

SEQ ID NO: 152843 - RNA, 64 nt, hsa
cauuguaguugacuuuuuaaaaaaaaaaaaaauuuaaaaaaaaucuacaaauuguguuuugcua

SEQ ID NO: 152844 - RNA, 64 nt, hsa
aucccgauggaauauagcauuguaguugacuuuuuaaaaaaaaaaaaaauuuaaaaaaaaucua

SEQ ID NO: 152845 - RNA, 64 nt, hsa
uuaaaaccaaucauaaguagaacccacuucaaaauaaaaaaacagcauuacuauuucuaauccc

SEQ ID NO: 152846 - RNA, 64 nt, hsa
uguucaggggcucccuguuuuuaagagacucuuuuaaaaaaaaaaaaaccuaauguuuuuaucu

SEQ ID NO: 152847 - RNA, 64 nt, hsa
caugaucuugaacagcuccuguacuugcucuuuguaaaaaaaaauaaaauuauuuugaauuauu

SEQ ID NO: 152848 - RNA, 64 nt, hsa
ugauacuuaaauaaagaaagugugaggucuacuuuaaaaaaauucaaaugaagagaaaaagaaa

SEQ ID NO: 152849 - RNA, 64 nt, hsa
ugaacacuggauaaccuaauuuuuuuuaaugcuuuaaaaaaauggcaaaaagacgucaggccac

SEQ ID NO: 152850 - RNA, 64 nt, hsa
agugcuuuagaaaaaaguuaaaauuggaagucauuaaaaaaagacuguuauaaugguguauaug

SEQ ID NO: 152851 - RNA, 64 nt, hsa
cagaguuaucagacauuauuuauaaaacuuaguuuaaaaaaaagacaaaaaaaaaaaagccaag

SEQ ID NO: 152852 - RNA, 64 nt, hsa
aaagggaagaaaguauaauagaaacuuugcuaguuaaaaaaaaaagaaaaaaaaagaaaaaaaa

SEQ ID NO: 152853 - RNA, 64 nt, hsa
guaugcuguuuuauaauaaauuagcaauauacuuuaaaaaaaauccaguuucuccuauaacaug

SEQ ID NO: 152854 - RNA, 64 nt, hsa
acuguacuuggcaugcgcaauaaagcagcacauguaaaaaaaaaauacacagugcaaggacuuu

SEQ ID NO: 152855 - RNA, 64 nt, hsa
aaugcacauggaggggauguaguugcauuuuugcuaaaaaaaaaaaaaaaccuuuaaaaauugu

SEQ ID NO: 152856 - RNA, 64 nt, hsa
caggccaagaaaugaucauaccccuugccaaagguaaaaaaaaaaaaaaaaaaaugaguugaaa

SEQ ID NO: 152857 - RNA, 64 nt, hsa
uaauauuauguaaaggccuggaaauuacuguugcuaaaaaaagucauguaguuucauguagugu

SEQ ID NO: 152858 - RNA, 64 nt, hsa
ucauccuuacaauccugucccaugguauuuaacauaaaaaaaaauaaaacuguuaacagauucu

SEQ ID NO: 152859 - RNA, 64 nt, hsa
agucauuauguucugagugugugguauguucccuuaaaaaaaaaugacacuuggaagaaaaaug

SEQ ID NO: 152860 - RNA, 64 nt, hsa
guguauuuuauauaaaaaucccauuucuugaagauaaaaaaauuguuauucaaauuguuaugca

SEQ ID NO: 152861 - RNA, 64 nt, hsa
aaaugucuuuuaagaaacauucuuuuccacuuguuaaaaaaauuaaauauauuuuaaagcacuu

SEQ ID NO: 152862 - RNA, 64 nt, hsa
augcuguauuuggguauuuuucuccucuaccuucuaaaaaaaaauaccauaagaagaaucagaa

SEQ ID NO: 152863 - RNA, 64 nt, hsa
uauucucuuaacaaauuuuaaaagguagugaucuuaaaaaaaaaucacuggauaacuaggaaau

SEQ ID NO: 152864 - RNA, 64 nt, hsa
ggugucaugucacuaaguuuaaugcugcuguuuuuaaaaaaaaaaaaaaguuuuuuuaaaaagc

SEQ ID NO: 152865 - RNA, 64 nt, hsa
uuuaugcaaccuuuuuuccuugaauuaacagcaauaaaaaaaugaaaaacagcuuaagaauugu

SEQ ID NO: 152866 - RNA, 64 nt, hsa
acccaguggcaaagaauuuuuucaauuguggcuuuaaaaaaauaauuaaauauacauguguaua

SEQ ID NO: 152867 - RNA, 64 nt, hsa
guuuucauaaacacuagagaggaacagcaauggauaaaaaaacagaugguagggagagagagcc

SEQ ID NO: 152868 - RNA, 64 nt, hsa
uuucaaacucauuuuucauugcuaggauuucuuuuaaaaaaauuaaaguaauuucacuucauag

SEQ ID NO: 152869 - RNA, 64 nt, hsa
uggugagugguugaccaagaacacugcacaaauauaaaaaaaguucuggaaaugcagaauggcg

SEQ ID NO: 152870 - RNA, 64 nt, hsa
uuuaagagcaguuacagugugacucacucauguuuaaaaaaaaucgaagagcuaaaaaauacgu

SEQ ID NO: 152871 - RNA, 64 nt, hsa
aggaacggaagaaaccuauugugaauuccaaaucuaaaaaaagaaauauuuuuaaaauguucuu

SEQ ID NO: 152872 - RNA, 64 nt, hsa
guauaugcacuuuccaaauuggggacaagggcucuaaaaaaagccccaaaaggagaagaacauc

SEQ ID NO: 152873 - RNA, 64 nt, hsa
uuuaaugcugugguugauauuucgaaagcugcuuuaaaaaaauacaugcaucucagcguuuuuu

SEQ ID NO: 152874 - RNA, 64 nt, hsa
ggaauauggggguuaucuguacauccuggggcauuaaaaaaaaaaucaaugguggggaacuaua

SEQ ID NO: 152875 - RNA, 64 nt, hsa
uuccaauuuugcuuauacugcuguaauauuuuuguaaaaaaaaaaaaaaaggaaaaaaaagacc

SEQ ID NO: 152876 - RNA, 64 nt, hsa
aaagaaaucuugaggacuuuguuuaaaccuuccauaaaaaaacaauuuucgguuucucggguuc

SEQ ID NO: 152877 - RNA, 64 nt, hsa
uuuaaauauuucuuucucuaacccaucagcacaauaaaaaaaagucacugguucaacaacaggg

SEQ ID NO: 152878 - RNA, 64 nt, hsa
aauaaaaaaaagucacugguucaacaacaggguuuaaaaaaaaugucuucagcuuuaauucaaa

SEQ ID NO: 152879 - RNA, 64 nt, hsa
cccaggagcuguuuuacugucuacuuuucaggauuaaaaaaaaaaucaaaacuuaaaaaaaaaa

SEQ ID NO: 152880 - RNA, 64 nt, hsa
ucuacuuuucaggauuaaaaaaaaaaucaaaacuuaaaaaaaaaaaaguuuaaaaagcaaaaug

SEQ ID NO: 152881 - RNA, 64 nt, hsa
caacugaaauguuaaggaagaagauagauccaauuaaaaaaaauuaaaaccaauuuaaaaaaaa

SEQ ID NO: 152882 - RNA, 64 nt, hsa
agauagauccaauuaaaaaaaauuaaaaccaauuuaaaaaaaaaaagaacacaggagauuccag

SEQ ID NO: 152883 - RNA, 64 nt, hsa
acucagaauacagacaaguagaaagauucucgcuuaaaaaaaauguauuuauuuuauggcaagu

SEQ ID NO: 152884 - RNA, 64 nt, hsa
auggaaucauauaguauguaaccuguuuugagcuuaaaaaaaaaguauacaugacuuuaaugag

SEQ ID NO: 152885 - RNA, 64 nt, hsa
ggaccacaggcugcaccauaagacccacucacaauaaaaaaauaaaaggccgagccgggcaugg

SEQ ID NO: 152886 - RNA, 64 nt, hsa
aggccgagccgggcaugguugcucacucccguaauaaaaaaauaaaagaacaggcugagccggg

SEQ ID NO: 152887 - RNA, 64 nt, hsa
ugugcacaugguacccuaaaacuuaaaguauaauuaaaaaaaaaaauuagagguuuuucuucgg

SEQ ID NO: 152888 - RNA, 64 nt, hsa
uccagccagguugacagaaugagacccugucucuuaaaaaaaaaaaaaaaaauccuggugaugc

SEQ ID NO: 152889 - RNA, 64 nt, hsa
aauuuuggaaccaaaacaguaucuuuuuuuaagcuaaaaaaaaaguuuuaaauggugucuuucu

SEQ ID NO: 152890 - RNA, 64 nt, hsa
gcggggaauauauacaagacuuuauuuagucaaguaaaaaaaaaucacuaauguuuaacugaag

SEQ ID NO: 152891 - RNA, 64 nt, hsa
uugaacauugaaaaguuacaguagucagcucugauaaaaaaaugaugcaguagggugaggguag

SEQ ID NO: 152892 - RNA, 64 nt, hsa
cugacuguuuuuguaugguccaugaucuagaauuuaaaaaaauuuuaaaggguugaaaaaagug

SEQ ID NO: 152893 - RNA, 64 nt, hsa
ggauauuaaaaaaaaaaaaagacaaaaguguuuuuaaaaaaaagcaacacccacaccugugucu

SEQ ID NO: 152894 - RNA, 64 nt, hsa
aguauacuagcuugucuuuuaagaaaggggauauuaaaaaaaaaaaaagacaaaaguguuuuua

SEQ ID NO: 152895 - RNA, 64 nt, hsa
cgacagaguccauguuggaggugauaaaaaacuguaaaaaaaaaaaaaaaaaaaaagacaaaac

SEQ ID NO: 152896 - RNA, 64 nt, hsa
aagcaacaaaaaaagaaaacacacagaagagauuuaaaaaaaaaaaaggaaaaaaaaaaaagac

SEQ ID NO: 152897 - RNA, 64 nt, hsa
gucuggacauugcaucgcccuaguuuucuuucuuuaaaaaaaaaaaauuccaacagaagccaca

SEQ ID NO: 152898 - RNA, 64 nt, hsa
cuggcaacagagugagacuccaucucaaaaaaaauaaaaaaaaagaaaaagaaauaaacucuau

SEQ ID NO: 152899 - RNA, 64 nt, hsa
aagcauuugguuguuuccaguaccuuucucuucauaaaaaaaucauacagcagaaaaaccuuau

SEQ ID NO: 152900 - RNA, 64 nt, hsa
ugguucuucucguuuuccuuuuuuuuuuuuuuuuuaaaaaaaaacuauuuaauuuuuuaauuua

SEQ ID NO: 152901 - RNA, 64 nt, hsa
augaaacucgagcaggucucuggaagccauuuguuaaaaaaaaaaaaaaaaguuuuaaaaauac

SEQ ID NO: 152902 - RNA, 64 nt, hsa
ucugcucacaucuuacucaacaucagagaguacuuaaaaaaaguauuauaaauuuaauuacugu

SEQ ID NO: 152903 - RNA, 64 nt, hsa
aagcauuuaacuggucccuaaaucuuacuaaacauaaaaaaacuuaaacuggagagaaacuaca

SEQ ID NO: 152904 - RNA, 64 nt, hsa
gugagaagauuaaaucagaauaguuguucuuuguuaaaaaaaaaauuagauucuuaaagugugg

SEQ ID NO: 152905 - RNA, 64 nt, hsa
aagccuuuuaccaguccucaacucuuacuaaacauaaaaaaauucauacuggagggaacuccug

SEQ ID NO: 152906 - RNA, 64 nt, hsa
ccaugagccaccaugaccaacguguuucuuaauuuaaaaaaaaaaaaauagaccaggugcucug

SEQ ID NO: 152907 - RNA, 64 nt, hsa
uugguucaguaauaaauaugugagacuuuucauuuaaaaaaagucaaaugacuuaauucuguau

SEQ ID NO: 152908 - RNA, 64 nt, hsa
cauccuggcuaacguggagaaaccccgucucuacuaaaaaaaaaaauuacaaaaaauuagccgg

SEQ ID NO: 152909 - RNA, 64 nt, hsa
aaccugggcaauauagggagauccugucucuauuuaaaaaaagaaguuauggccgggcgcggug

SEQ ID NO: 152910 - RNA, 64 nt, hsa
auuccuuuacuuucuuaacaaauuugcuuucacuuaaaaaaaaaccuuuaaguucaaggaagaa

SEQ ID NO: 152911 - RNA, 64 nt, hsa
cuggacaacauauagcaagacucugccucuauuauaaaaaaacaaaauaaaugaaaaggacugu

SEQ ID NO: 152912 - RNA, 64 nt, hsa
ccaaccuugggcaacauagcaagaccccauuucuuaaaaaaaaaaaaaaaaaauuuaaacuuag

SEQ ID NO: 152913 - RNA, 64 nt, hsa
ccugggcaauaaaguaacucuugacucaaaaaaauaaaaaaaauuguagugguagccauguguu

SEQ ID NO: 152914 - RNA, 64 nt, hsa
uuuaagucugacacauuucuauuuuauucuaacauaaaaaaacuuccauuauauauuuacuaag

SEQ ID NO: 152915 - RNA, 64 nt, hsa
ggcuuaguucaaacauaaggaaacaguguuugauuaaaaaaaacacaucuaguaagacguaagg

SEQ ID NO: 152916 - RNA, 64 nt, hsa
auauagagacuucuaaaucauaaucauccuuuuuuaaaaaaaagaauuuuaaaaaagauggauu

SEQ ID NO: 152917 - RNA, 64 nt, hsa
gcugagauguuuaguagcugauaaagaaaccuuuuaaaaaaauaauauaaaugaaugaaauaua

SEQ ID NO: 152918 - RNA, 64 nt, hsa
caauagcuuucaauuguucuuucuggaagacuuuuaaaaaaauauaaauaugcauauauauaua

SEQ ID NO: 152919 - RNA, 64 nt, hsa
cugccuucaagaaacaaugaccugauucugucuuuaaaaaaaaaaaucucagaauucuuuuuuu

SEQ ID NO: 152920 - RNA, 64 nt, hsa
uuggggggaaagaauagauauggggaaauaaacuuaaaaaaaaaucaggaauuuaaaaaaacga

SEQ ID NO: 152921 - RNA, 64 nt, hsa
auggggaaauaaacuuaaaaaaaaaucaggaauuuaaaaaaacgagcaauuugaagagaaucuu

SEQ ID NO: 152922 - RNA, 64 nt, hsa
agaaauagaauggugcucuuaucuuucuugacuuuaaaaaaauuauuaaaaacaaaaaaaaaau

SEQ ID NO: 152923 - RNA, 64 nt, hsa
aauucaguuucaaucaaguuuacauuauguugcuuaaaaaaauagaaauuauucuuuaucuugc

SEQ ID NO: 152924 - RNA, 64 nt, hsa
accugucucuuaaaaaaaaaaauuuuuuuuuaauuaaaaaaacccacccuuuuucauuucccaa

SEQ ID NO: 152925 - RNA, 64 nt, hsa
ccauccugggugauggagcgaagaaccugucucuuaaaaaaaaaaauuuuuuuuuaauuaaaaa

SEQ ID NO: 152926 - RNA, 64 nt, hsa
uccuccauugcuguuguugcagggaagucuuacuuaaaaaaaaaaaaaaauuuugugagugacu

SEQ ID NO: 152927 - RNA, 64 nt, hsa
uauauaaggaggaaaacgggaaagaauauaaaguuaaaaaaaagccuccgguuuccacuacugu

SEQ ID NO: 152928 - RNA, 62 nt, hsa
ccccucaaaaaaauaaaaauaaaaaaaauaaaaauaaaaaaacauuuuuuucaagcagggag

SEQ ID NO: 152929 - RNA, 64 nt, hsa
aauaaacugugcaauccccucaaaaaaauaaaaauaaaaaaaauaaaaauaaaaaaacauuuuu

SEQ ID NO: 152930 - RNA, 64 nt, hsa
uuuguuggauuucuuguuuguguucuuaaaaaaauaaaaaaaacugauuuccacgggguccguu

SEQ ID NO: 152931 - RNA, 64 nt, hsa
cucaguucuuuguuggauuucuuguuuguguucuuaaaaaaauaaaaaaaacugauuuccacgg

SEQ ID NO: 152932 - RNA, 64 nt, hsa
uauuaaaaaaaaaaaaagaaaaagaaaaacgauuuaaaaaaaaaaaaaaaagcaaccaacccca

SEQ ID NO: 152933 - RNA, 64 nt, hsa
uccccuuuuuauauuuguauuaacuuuaacuuauuaaaaaaaaaaaaagaaaaagaaaaacgau

SEQ ID NO: 152934 - RNA, 64 nt, hsa
aaccugcccuuguuuuaaucguuauuuuucucuuuaaaaaaaauagaagcuauaaagaaaagag

SEQ ID NO: 152935 - RNA, 64 nt, hsa
ggccaacauggcgaaaccccgucucuacuaaacauaaaaaaauuagucagguguggcggugcgu

SEQ ID NO: 152936 - RNA, 64 nt, hsa
ccagucugcagacguguuuuguuuggacuucacuuaaaaaaaugccuuaguuguuaucaucuuu

SEQ ID NO: 152937 - RNA, 64 nt, hsa
aagugacaauaaaacaugagauauaaaucaagcuuaaaaaaaaaaagcagcaccugugggccau

SEQ ID NO: 152938 - RNA, 64 nt, hsa
cucacaagccaguggaagggauuccugauuuuacuaaaaaaaaaaaaaaaaaagagagggcggg

SEQ ID NO: 152939 - RNA, 64 nt, hsa
cuagcuauagaaauccaauuaagacucacuuggguaaaaaaaaauaaaaaaauaaacaaaauaa

SEQ ID NO: 152940 - RNA, 64 nt, hsa
aaauccaauuaagacucacuuggguaaaaaaaaauaaaaaaauaaacaaaauaaacugcucacu

SEQ ID NO: 152941 - RNA, 64 nt, hsa
gaucauuuaugaauaacaaucugaagucuuuucauaaaaaaaauuaauaaacuuuaguuguaca

SEQ ID NO: 152942 - RNA, 64 nt, hsa
uaaaaagcugaauguuacuaauauuuuucauaucuaaaaaaaaauucuuagcaaugaaauugcu

SEQ ID NO: 152943 - RNA, 64 nt, hsa
uugauuacaauugagggaaguuugauagauccuuuaaaaaaaaggcagauuuccauuuuuugua

SEQ ID NO: 152944 - RNA, 64 nt, hsa
cuguuaaacaacucuuuaaaggauaauuauccaauaaaaaaaaaccuagugcugauucacagcu

SEQ ID NO: 152945 - RNA, 64 nt, hsa
ucgaagauuuuuuaaaaauaauauuguuaaucaguaaaaaaaaaaaauauuuuugaucuaaaca

SEQ ID NO: 152946 - RNA, 64 nt, hsa
aacuuuuacuugugggggugggaguuagauguauuaaaaaaacgaaacuacaaaauccuuuuaa

SEQ ID NO: 152947 - RNA, 64 nt, hsa
cuacccugucuguuggucagacucaaaugagaguuaaaaaaaaaaaaaaaaaucuguaugccug

SEQ ID NO: 152948 - RNA, 64 nt, hsa
gagauaaaggauuugguuucccugccaugaguauuaaaaaaauuuaaguuuucccaagcuugca

SEQ ID NO: 152949 - RNA, 64 nt, hsa
gggugcaaagauguucauucuuuuaaaaaauguuuaaaaaaaaaaaaaaacugccuuucuuccc

SEQ ID NO: 152950 - RNA, 64 nt, hsa
agaauuuuuuucguuauuuuuacaucuaacaaaguaaaaaaauuaaaaagaggguaagaaacga

SEQ ID NO: 152951 - RNA, 64 nt, hsa
ugggaaaauauaaacgagggaagaaaacaaacuuuaaaaaaaagcgagagggauaaaaaauuaa

SEQ ID NO: 152952 - RNA, 64 nt, hsa
acaaaaaaagagaaaaaacauaacaaguaaauuuuaaaaaaaagaacaaaauauaagaggaaca

SEQ ID NO: 152953 - RNA, 64 nt, hsa
caaaaaaauuauuaaaaauacauuaaagaugauuuaaaaaaaagaaaauuccugggcauuugau

SEQ ID NO: 152954 - RNA, 64 nt, hsa
agggauggguugggggcgggguaauuauuuuauuuaaaaaaauaccgagcagcaaaaggggaga

SEQ ID NO: 152955 - RNA, 64 nt, hsa
gggauaaaauagcuguuucacaaacaguuuuauuuaaaaaaacaaaaaacaaaaaaaaucaaaa

SEQ ID NO: 152956 - RNA, 64 nt, hsa
uuguaaauuguauaauuuuuaaauaucugaguuuuaaaaaaagaaaaaaguacaaaaaaaucuu

SEQ ID NO: 152957 - RNA, 64 nt, hsa
agcuggaaaauuacuuaaaacaggaaagugucaauaaaaaaacuugagcaacaccaacauauuu

SEQ ID NO: 152958 - RNA, 64 nt, hsa
gcugcugaauuugugccccuggauuggaagcaaauaaaaaaaaaaaacaacacauaaacuaaac

SEQ ID NO: 152959 - RNA, 64 nt, hsa
uuuaccaagaggaaagcuuuuacuguguugaagcuaaaaaaauaauggcucuuugacaaaacuu

SEQ ID NO: 152960 - RNA, 64 nt, hsa
auccaguagaaaauguuaggauaugugugcuauauaaaaaaaaaaaaagacuuguuaaguuuua

SEQ ID NO: 152961 - RNA, 64 nt, hsa
auuuagagcaaucccacaugcuuuucacaaacauuaaaaaaaaaaaccuuucagggucuuucau

SEQ ID NO: 152962 - RNA, 64 nt, hsa
uuccuuuuguccacuuauauaguuauuuucucuuuaaaaaaaaauuuuuuuuaauguauuagag

SEQ ID NO: 152963 - RNA, 64 nt, hsa
ccaugugcauggaaaagauguucaugguacauuguaaaaaaauaaaauuaaaauuaaaaaaagu

SEQ ID NO: 152964 - RNA, 64 nt, hsa
uucaugguacauuguaaaaaaauaaaauuaaaauuaaaaaaaguuugcagaaccgcauauacag

SEQ ID NO: 152965 - RNA, 64 nt, hsa
auuauaaauguaguuaguuugauacuccuuagaauaaaaaaaugaaacaguaacaacuuuuaug

SEQ ID NO: 152966 - RNA, 64 nt, hsa
agaauaaaaaaaugaaacaguaacaacuuuuauguaaaaaaauuuuacauaagaguuagcaucu

SEQ ID NO: 152967 - RNA, 64 nt, hsa
uguaaauuaucaagcuucaaaaagcuuuuuuuuuuaaaaaaaaacaugcauauucuaaaaauga

SEQ ID NO: 152968 - RNA, 64 nt, hsa
aucugcacaguuugguuuuugcacaaaagucauuuaaaaaaaucugaguaauugucaaauauua

SEQ ID NO: 152969 - RNA, 64 nt, hsa
caaaaacaccaaaucauuugaaaucacuguccauuaaaaaaaaucaccaguggaacuaaacagu

SEQ ID NO: 152970 - RNA, 64 nt, hsa
ccacagagcaagacuccgucucaaaacauaaaaauaaaaaaaauacaaauagcugacccgggug

SEQ ID NO: 152971 - RNA, 64 nt, hsa
gaccugggcagcauagcgagaccccaucucuauauaaaaaaaaagauguuaaaacagugaaauu

SEQ ID NO: 152972 - RNA, 64 nt, hsa
ugacauugaaguuguuggaggaauguacuguauuuaaaaaaaccuucugugacacauucaaaaa

SEQ ID NO: 152973 - RNA, 64 nt, hsa
cggggacaacaucugaaggguauguugcaugcauuaaaaaaaaucaucucacaugcauuuuaua

SEQ ID NO: 152974 - RNA, 64 nt, hsa
gucauuuaaagucaauauuuauuuauguauguaauaaaaaaaguuggauuuuuguguaugucug

SEQ ID NO: 152975 - RNA, 64 nt, hsa
guucagauggugauucugaagcuuacaucucccuuaaaaaaaucuaaagcagcucuuaugggcu

SEQ ID NO: 152976 - RNA, 64 nt, hsa
aauuuuuuuucacuucugaagggaaaguguauuauaaaaaaagauuuuuuuuuuuuuuauaaaa

SEQ ID NO: 152977 - RNA, 64 nt, hsa
gauauauucacaaagagaaaacaaaaggaacuuuuaaaaaaaaaaucacuucacuuauauuaag

SEQ ID NO: 152978 - RNA, 64 nt, hsa
aucacuaguguggcuaaauaaccaaacauuuguguaaaaaaaaaaaaaagccaagauuucauug

SEQ ID NO: 152979 - RNA, 64 nt, hsa
uucuuuucauagucguauuuugccaccguaaacauaaaaaaaaaaaaaaagauuuccaaaaugc

SEQ ID NO: 152980 - RNA, 64 nt, hsa
gccuuaacucuguauuaaaaaaaauguuuuuguuuaaaaaaaacuguucccauaggugcagcaa

SEQ ID NO: 152981 - RNA, 64 nt, hsa
ugugaaauauaagccugcggccuuaacucuguauuaaaaaaaauguuuuuguuuaaaaaaaacu

SEQ ID NO: 152982 - RNA, 64 nt, hsa
uuugaccucauuaguuguuaauuuuuuaguuggauaaaaaaaaaacucgcugacauaaucuccc

SEQ ID NO: 152983 - RNA, 64 nt, hsa
aaaauaguuugccuuaggucacgccuuaggauuuuaaaaaaauuacauugaaacaucaaacuua

SEQ ID NO: 152984 - RNA, 64 nt, hsa
uaacuauuucacaugagucaaaacaaagcagcuuuaaaaaaauaauuggaagcacaagugcaug

SEQ ID NO: 152985 - RNA, 64 nt, hsa
aguagguauuaaucuuauuguuuaaucuuuuuuuuaaaaaaacuggauauuucaaucuuuuaaa

SEQ ID NO: 152986 - RNA, 64 nt, hsa
uggagugaagugcaauauuauaaauauuauagauuaaaaaaaaaauagccgugcacucuugacc

SEQ ID NO: 152987 - RNA, 64 nt, hsa
ccucauucauccauuuuucuuaaaagcuggaaauuaaaaaaaaaaaagagagagagaggcuuua

SEQ ID NO: 152988 - RNA, 64 nt, hsa
gaggagagaggcuuucgguggacacguuugacauuaaaaaaaaaaaaaaaaaaaaaaaaaaacu

SEQ ID NO: 152989 - RNA, 64 nt, hsa
ggacaacaucugaaggguauguugcaugcauuuuuaaaaaaaucaucucauaugcauuguauag

SEQ ID NO: 152990 - RNA, 64 nt, hsa
acuccagccuggacgacagagcaagacccuguauuaaaaaaaaaauucauccugcacagggaaa

SEQ ID NO: 152991 - RNA, 64 nt, hsa
ggccugggcagcauagcgagaccccaucucuauauaaaaaaaaagauguuaaaacagugaaauu

SEQ ID NO: 152992 - RNA, 64 nt, hsa
gauccgcagauucaugcagcauuccauauuuuuuuaaaaaaagguuacacugugcaccgacgug

SEQ ID NO: 152993 - RNA, 64 nt, hsa
cucauucaaacuucuguccaugucccuccacuguuccuaucagcagguggccccugggcaucag

SEQ ID NO: 152994 - RNA, 64 nt, hsa
ccugucuaccuccucucacccugccacagauucuuccuaucacacagggaugccaguuguauuu

SEQ ID NO: 152995 - RNA, 64 nt, hsa
caucaauuuugcauugagaaccugcagaaacucauccuaucagaaacaucuauuuuugaugucc

SEQ ID NO: 152996 - RNA, 64 nt, hsa
uaugagcuucgccauaaccaaguagagucuaucuuccuaucagcuauugacauguauggacauc

SEQ ID NO: 152997 - RNA, 64 nt, hsa
uggagcuuugcagccaaggugcuaaaaggaauagguaggagaccucuucuaucuaauccuuaaa

SEQ ID NO: 152998 - RNA, 64 nt, hsa
gagaccaagcuuguuucccugcuggccaaagucaguaggagaggaugcacaguuugcuauuugc

SEQ ID NO: 152999 - RNA, 64 nt, hsa
uggaccacaccuccgugguucacuuuggucacaaguaggagacacagauggcaccuguggccag

SEQ ID NO: 153000 - RNA, 64 nt, hsa
caaaaccugaugcaaaaaacagaaaaggggugauguaggagauggucagguugguaggagaagc

SEQ ID NO: 153001 - RNA, 64 nt, hsa
cagaaaaggggugauguaggagauggucagguugguaggagaagcuauaaggaaagacgcaauu

SEQ ID NO: 153002 - RNA, 64 nt, hsa
uucccauuauuucuuaugagauuaguuguuucaaguaggagacagaaaaguucuguuuuguugg

SEQ ID NO: 153003 - RNA, 64 nt, hsa
accauauuauuaaauaccuauauaucacagcuaaguaggagaaagggagaccuuuuuauuuugu

SEQ ID NO: 153004 - RNA, 64 nt, hsa
gugguacuggcaauaagauacacagcuccgagcuguaggagagucggucugcuuuggaugauuu

SEQ ID NO: 153005 - RNA, 64 nt, hsa
cagcacuuugguuuugcugagaucgaagaggccaguaggagacacgacagcacacacaguggau

SEQ ID NO: 153006 - RNA, 64 nt, hsa
agaucacaguagugccuaaugaagguugagaaccguaggagaggcucucaugcuguaaauaaug

SEQ ID NO: 153007 - RNA, 64 nt, hsa
cacagagaauccaaaccaauccaugauaaugucaguaggagacuuaaccuuaguguguuacaca

SEQ ID NO: 153008 - RNA, 64 nt, hsa
cuugaaugauggauaaggggguacacagaccaagucccuauaaacaaggaccuuccaguccagg

SEQ ID NO: 153009 - RNA, 64 nt, hsa
aacccuccucagggugguugaguuccagccaugcucccuauaaaugucauguggcuuaccucuc

SEQ ID NO: 153010 - RNA, 64 nt, hsa
agucauucuuugaaggugacacuguucuguauauucccuauaggcagcuggagagaucugugug

SEQ ID NO: 153011 - RNA, 64 nt, hsa
ugcuauguuaccugcuaggcuggcuucuuuggacucccuauaugauugaugaugugaaaaccua

SEQ ID NO: 153012 - RNA, 64 nt, hsa
acuuaaugacuggaaaaaacuugcuuauugccuuucccuauauaaauauuaauugucuagaaug

SEQ ID NO: 153013 - RNA, 64 nt, hsa
uauagacacacauauaauauauauagauauauaaucccuauauaucuugaaucuacaaauaucu

SEQ ID NO: 153014 - RNA, 64 nt, hsa
cucugauugccccaauaaaaaucuuuguuguccaucccuauacaaccugccaacaugguugaca

SEQ ID NO: 153015 - RNA, 64 nt, hsa
aguggaauuuucugucauggauaaugugcuugagucccuauaaucuauagacaugugauagcaa

SEQ ID NO: 153016 - RNA, 64 nt, hsa
ccucuaggcccggggguggguccucacccuaaacucccuauagccacucucuucaccgcccucu

SEQ ID NO: 153017 - RNA, 64 nt, hsa
agucauuccaaguccuauggccuggaaauuguauucccuauaauauacaaauuuuccuguaaua

SEQ ID NO: 153018 - RNA, 64 nt, hsa
gccuggccuccagcccgagucgucauccccggagucccuauacagagguccugccauggaaccu

SEQ ID NO: 153019 - RNA, 64 nt, hsa
uggguuuuggggauuuucuuguaguucuuauauaucccuauauauuauaucuauauugcaaaau

SEQ ID NO: 153020 - RNA, 62 nt, hsa
uugguuuguauuuaauuguuugaaauaaaagugaucccuauauugaaucucaugccuguuaa

SEQ ID NO: 153021 - RNA, 64 nt, hsa
gacugugcacauuuccucuaguucaugucuguagucccuauagaaugaucuguaauaaaauagu

SEQ ID NO: 153022 - RNA, 64 nt, hsa
uuaaguagauguaaugacuagaaagcugcuuugcucccuauauugagaaauuguggacauggua

SEQ ID NO: 153023 - RNA, 64 nt, hsa
auuguuuuuccacauugccuucuaauuugaucacucccuauaacagauguucaaaauucggcca

SEQ ID NO: 153024 - RNA, 64 nt, hsa
gaaauaaguuaaaaggcagcuuacaagagccuauucccuauaaaggguauaauuuuacacagua

SEQ ID NO: 153025 - RNA, 64 nt, hsa
aaaacugcaucgauccccagccugguguuguucuucccuauacuucacacugaacucaggaugg

SEQ ID NO: 153026 - RNA, 64 nt, hsa
uuuaaagguuagacacuuucagagaucaaggugcucccuauacucccuuguuccaucagaagcu

SEQ ID NO: 153027 - RNA, 64 nt, hsa
cucucugcuaaccuuccaccuuaugcacacacuuucccuauauuuuaagauaagucugcuagga

SEQ ID NO: 153028 - RNA, 64 nt, hsa
gaugcccucuagauuaggugcccuuacuauccauucccuauacacccuguucuuucccagacau

SEQ ID NO: 153029 - RNA, 64 nt, hsa
uacuguagaacacuauuuuuaauacagaaaaagcucccuauaaugcacuucagagaaauuaaaa

SEQ ID NO: 153030 - RNA, 64 nt, hsa
gaagaaggauccugggcuugaugaccaugaaguuucccuauaaacccucaaccaccuauucauu

SEQ ID NO: 153031 - RNA, 64 nt, hsa
uuuuuacaugauuuugaaauagacuagaaagcuuucccuauagacauauuaauauuccaaucau

SEQ ID NO: 153032 - RNA, 64 nt, hsa
ugagaaaugaauaagcuuucucucagaaaugcugucccuauacacuagacaaaacugagccugu

SEQ ID NO: 153033 - RNA, 64 nt, hsa
gaagucuccccgcagcccucuccacccagaggucucccuauaccgagacccaccauccuuccau

SEQ ID NO: 153034 - RNA, 64 nt, hsa
uuaucaaaagaagaaaaaacugaagguacuuuacucccuauagagaaaccauugccaucauugu

SEQ ID NO: 153035 - RNA, 64 nt, hsa
cuaaacauuaccauuuauguggcagaaguucuguucccuauaaucugcaaugcugaaguaucuc

SEQ ID NO: 153036 - RNA, 64 nt, hsa
agagcaucauaggucuccuugugcuaccuuuuacucccuauaaauagaaauccaaguauacuuu

SEQ ID NO: 153037 - RNA, 64 nt, hsa
uuuguuuaacacuaucugccaaaauaaacuuuauucccuauaacuuaaaauguguauauauaua

SEQ ID NO: 153038 - RNA, 64 nt, hsa
aagucuuaggaaagacuacucaaguuaagguacuucccuauauccaucucuuuuagguacgcaa

SEQ ID NO: 153039 - RNA, 64 nt, hsa
uugggagcccuuuguaucaauguucugacaagggucccuauaaccuuaaccuacucgaaaccgg

SEQ ID NO: 153040 - RNA, 64 nt, hsa
cuuugggucuucauuugaugcauugacuuuaauuucccuauacaggaaaugauuggaauagaau

SEQ ID NO: 153041 - RNA, 64 nt, hsa
uuuucccucuggacacucugcuuuugauugccuaucccuauaaguggcucauuuuacugucuuc

SEQ ID NO: 153042 - RNA, 64 nt, hsa
cuagccauagauuccuuucagccuugcugacuucucccuauaaaaguaaagccuuuuucugccc

SEQ ID NO: 153043 - RNA, 64 nt, hsa
ucauagaggaccaccuuuuggaucauaaauucuuucccuauaacauuccuucucugccucucua

SEQ ID NO: 153044 - RNA, 64 nt, hsa
ucauuagagcagaggcuauuuuucugcauucuugucccuauaacagggaugcuuaauuuuuuuu

SEQ ID NO: 153045 - RNA, 64 nt, hsa
ugaagagaacuagggaaguacauaucuucagauaucccuauauaguucucuaccuucaguuuua

SEQ ID NO: 153046 - RNA, 64 nt, hsa
cuauggagagcagcaaguugaucuuaguuaagucucccuauaugagggauaaguuccugauuuu

SEQ ID NO: 153047 - RNA, 64 nt, hsa
aaaugaaauugaagaauucauucaaaugcucuuuucccuauaaccucuuuucucaccaaaaagg

SEQ ID NO: 153048 - RNA, 64 nt, hsa
gggacuaguauuuucuaauguuucugggauaugcucccuauaaaaugaaauguuuuccuggaac

SEQ ID NO: 153049 - RNA, 64 nt, hsa
uaauaucauuauaauguuuuugucuuuuagugcuucccuauacaauuguuaaugcacaaaugau

SEQ ID NO: 153050 - RNA, 64 nt, hsa
ccuaaggagcuccucagcuugaaauggggcugcaucccuauaaacccaucauaaagucaaaaaa

SEQ ID NO: 153051 - RNA, 64 nt, hsa
aaagaaugucuacugcucuuguccuuggcugugaucccuauacauagugugaauuuauauccag

SEQ ID NO: 153052 - RNA, 64 nt, hsa
acccgcucggacuuacugccugaccuuggaaucgucccuauaucagggccugagugaccuccuu

SEQ ID NO: 153053 - RNA, 64 nt, hsa
cuccuuggcuuuaugacuuaaaccaacuacaacuucccuauagcuucuaagcaguuucaucagc

SEQ ID NO: 153054 - RNA, 64 nt, hsa
accuucuugaaaaggaagcauuugaacuuguuccucccuauaguucuauugccuuauaugcaaa

SEQ ID NO: 153055 - RNA, 64 nt, hsa
aaauucuuacuuuccauuccauaucauauucuguucccuauaaccucuucauuguuuucuuuuc

SEQ ID NO: 153056 - RNA, 64 nt, hsa
uagcccugcgcacguaggacugaauucagugauaucccuauacacugccauuuaguggauaggu

SEQ ID NO: 153057 - RNA, 64 nt, hsa
ccuuuuaccguggcaaccgucaagcuauucucugucccuauaccaggugucaucaaauuuuuuu

SEQ ID NO: 153058 - RNA, 64 nt, hsa
gagagaguuugaaagaaauuuucagauguucuguucccuauagagggccuauuccaggaucuaa

SEQ ID NO: 153059 - RNA, 64 nt, hsa
aaaaauauaaaaauuaguugcgugugguggcacaucccuauagucccagcuacuugggaggcug

SEQ ID NO: 153060 - RNA, 64 nt, hsa
aacugugccuggugagagacuuuggcccccucccucccuauaaggcuguggaaccugaggaagu

SEQ ID NO: 153061 - RNA, 64 nt, hsa
uuggcccacagucucccagaaaugauguuuugagucccuauaguuuaaacucccucucuuaaau

SEQ ID NO: 153062 - RNA, 64 nt, hsa
aaucaggaaaaaaauuuuuuuucaauaaucuuauucccuauauuaaauuagauuugaagaggau

SEQ ID NO: 153063 - RNA, 64 nt, hsa
agucgcgaucaaggacucucucacacaggaaacuucccuauacuggcagauacacuugugacug

SEQ ID NO: 153064 - RNA, 64 nt, hsa
uugugcagagugggauguaaauaucgccuuccucucccuauaucccucccaugaaaaauggcuu

SEQ ID NO: 153065 - RNA, 64 nt, hsa
cugaauguaaaacacuccuagccaguuguugcauucccuauauuuauuuacuuccaauauuuua

SEQ ID NO: 153066 - RNA, 64 nt, hsa
cuuuucucuuuuguuuuagugccccccgcccccaucccuauaauaucuguaacuacuccuaaaa

SEQ ID NO: 153067 - RNA, 64 nt, hsa
aguugaauuuugauaucuacccauuuuucugucaucccuauaguucacuuuguauuaaauuggg

SEQ ID NO: 153068 - RNA, 64 nt, hsa
ugcaaaaucccuauggagccugucaccacuccccucccuauauacccccaccccacaaagauuu

SEQ ID NO: 153069 - RNA, 64 nt, hsa
uugcuccguggacacucggaggccugcguucuguucccuauaaauggaagcgugcucugagccu

SEQ ID NO: 153070 - RNA, 64 nt, hsa
gaugaagaaaaugugugugaucuuuaauaacacaucccuauagaaaguggauaaaagauauacc

SEQ ID NO: 153071 - RNA, 64 nt, hsa
gaaauggguuuuaaacuuugguaugcaucagaauucccuauagaucuuuuugaaaauauaggua

SEQ ID NO: 153072 - RNA, 64 nt, hsa
aaaauauauuuuuucuuuucauugucaaauaucuucccuauaucuaaacaaugcaaaaucuaaa

SEQ ID NO: 153073 - RNA, 64 nt, hsa
gugcccccaccuaaaauaucaucuugaauuguaaucccuauaauccccacaucaagggagagau

SEQ ID NO: 153074 - RNA, 64 nt, hsa
gaaaccuacugcccaggcacugcaaaccgccaccucccuauacugcuuggagcugagcaaauca

SEQ ID NO: 153075 - RNA, 64 nt, hsa
gccuuuguuuguaaaccaaaaaguaauaaaugaaucccuauauuuccauuauaguauuuauugu

SEQ ID NO: 153076 - RNA, 64 nt, hsa
ugguguggaaauggcugaagaguuugcucuuguaucccuauaguccaagguuucucaaucugca

SEQ ID NO: 153077 - RNA, 64 nt, hsa
ccugaggaaauggaaugaaccacucccugcccauucccuauaagaauaucccaagacccaggca

SEQ ID NO: 153078 - RNA, 64 nt, hsa
ccauaacaauucccccauccuucagugaacuaagucccuauaauaaaggcugaggcugcaucug

SEQ ID NO: 153079 - RNA, 64 nt, hsa
uuuugaauuacuagagcuuuggucaguauuuccuucccuauaugucacagagggcaccacugag

SEQ ID NO: 153080 - RNA, 64 nt, hsa
uuagcuuuagaaaauaacaguuugugaacuuacuucccuauauuugcagcuguaucucacacua

SEQ ID NO: 153081 - RNA, 64 nt, hsa
ggcugcucuugcucucccucccagggcuugaggcucccuauacuuuucugucuuccagguucua

SEQ ID NO: 153082 - RNA, 64 nt, hsa
auguuuucuuguuuaucacacauacaaguaucuuucccuauauauuuguaccacuuuugagagc

SEQ ID NO: 153083 - RNA, 64 nt, hsa
uaugucaguuagcuaaaacuucagaauacauuucucccuauaaagaguuauaaaugaugguuua

SEQ ID NO: 153084 - RNA, 64 nt, hsa
uaaccgugaaaacuugagaggcacucugcccucuucccuauaaaaucacacagcgugauuuuac

SEQ ID NO: 153085 - RNA, 64 nt, hsa
ucaagacuagccugggcaacauggcaagacccugucccuauaaaaaauacaaaaauuagccagg

SEQ ID NO: 153086 - RNA, 64 nt, hsa
cccuaacucuccuuccuuggcucaaacaauauuuucccuauaacaaaggcaauaggacacaaaa

SEQ ID NO: 153087 - RNA, 64 nt, hsa
agucccuuccuccaggaccuuuccuauuuauaugucccuauacaaaauccaucugcuuuuauac

SEQ ID NO: 153088 - RNA, 64 nt, hsa
uuaacccugauucauacuccuuuuggcuggggagucccuauaguuucaccacuccucucccuug

SEQ ID NO: 153089 - RNA, 64 nt, hsa
guauaagauuuuggacuuguucauguccccucucucccuauaaaugauguauuugugacacccu

SEQ ID NO: 153090 - RNA, 64 nt, hsa
uuucuaagauaacugauacuaauacuuguuuucuucccuauaacauaaaaaacuucacuguuaa

SEQ ID NO: 153091 - RNA, 64 nt, hsa
uaaucacacugcgguaggucauucuuuugccacaucccuauagaccacuggguuuggcaaaacu

SEQ ID NO: 153092 - RNA, 64 nt, hsa
caagggauucuuuuccuaguucuauguguuuguuucccuauaugcagucuuuaaaggauuacaa

SEQ ID NO: 153093 - RNA, 64 nt, hsa
acauuuaaguaucccgaauuuucuugaauugcuuucccuauagauuaauuacaauuggauuuca

SEQ ID NO: 153094 - RNA, 64 nt, hsa
auucacaaggucaaaguucugguccacaaacccuucccuauagaaguucaauggcugcgaaaga

SEQ ID NO: 153095 - RNA, 64 nt, hsa
uuuucagcuaacuugcuucugcacagacccccuuucccuauaagggcacacauucacugguccc

SEQ ID NO: 153096 - RNA, 64 nt, hsa
uuacugaccuguccuccuucagggacaugagcauucccuauagauuaggguucuucuuauccuc

SEQ ID NO: 153097 - RNA, 64 nt, hsa
aguucccccuggauaaagaguuaauuuuaauccuucccuauaauuauacuucaaaauauuugac

SEQ ID NO: 153098 - RNA, 64 nt, hsa
aucccaagacccaucaauaucaguauuuuuuuccucccuauacagugcccugcccacccuuauc

SEQ ID NO: 153099 - RNA, 64 nt, hsa
ugagacauagaaagcuuaaauaauuugcucuaggucccuauacuaauugagauguuuucagcag

SEQ ID NO: 153100 - RNA, 64 nt, hsa
uuggucccauuagcugagguuuaguaaucuaaagucccuauaguauaugauuauaaugcuauuu

SEQ ID NO: 153101 - RNA, 64 nt, hsa
guaagaaagcaacagguaagauaggcuuucucucucccuauaccaaguaauuuauaccuacaca

SEQ ID NO: 153102 - RNA, 64 nt, hsa
cccugaggguaaggacugaggcacugagggucccucccuauacuccucaggcuccuggguggcc

SEQ ID NO: 153103 - RNA, 64 nt, hsa
aauauucuuuugaccugauuaaucagucagaaagucccuauaggauagagcuggcagcugagaa

SEQ ID NO: 153104 - RNA, 64 nt, hsa
cuaggucagucccugcagacucuucucaacucuuucccuauaggaaacuuacuccgcguccugc

SEQ ID NO: 153105 - RNA, 64 nt, hsa
ugguggcuucugaauuugguauuugaacuaggagucccuauagaggggcugcuuuaugggaagu

SEQ ID NO: 153106 - RNA, 64 nt, hsa
gaagccauuagcagaccuuugggccagggcagccucccuauaauuuucuucaucucuugcuaau

SEQ ID NO: 153107 - RNA, 64 nt, hsa
gcuuuuuaaauugucacuauauauuaugagcauuucccuauaauauacaauauucuuccacauu

SEQ ID NO: 153108 - RNA, 64 nt, hsa
gugcagagggggcuggggcgcacggagaagcaggucccuauauugaccaaggaguuugugguac

SEQ ID NO: 153109 - RNA, 64 nt, hsa
uuuuuuuuuuuuuuuaacugacauugugaaauucucccuauagcuuuugccauucaagcaacau

SEQ ID NO: 153110 - RNA, 64 nt, hsa
cuuuguccuccccauagagcuggggugggguggaucccuauaccuggggcaggcagccccaaag

SEQ ID NO: 153111 - RNA, 64 nt, hsa
uugcacuuacacaagacuuuccccauacucugucucccuauaaugcuggagcggcuacuaaaaa

SEQ ID NO: 153112 - RNA, 64 nt, hsa
aaucacuuuauuguaaacacuagcagaacucuucucccuauacaagguggauggcugauuuuaa

SEQ ID NO: 153113 - RNA, 64 nt, hsa
aaaacauuugacuccagugagggcucaaguuagaucccuauagaaagaggacacuucaucuuac

SEQ ID NO: 153114 - RNA, 64 nt, hsa
aaguaaauuuuagccaacucaucauucugaaaugucccuauaaagaaugagucgaacuagacca

SEQ ID NO: 153115 - RNA, 64 nt, hsa
ccucaccgucucggggguuguggcccccgcccccucccuauaugcaccccuggaaccagcaagu

SEQ ID NO: 153116 - RNA, 64 nt, hsa
aauguguccugucuaaaaaugauucucuaaacuuucccuauacuuaggcauagucuucuuucuu

SEQ ID NO: 153117 - RNA, 64 nt, hsa
cacgggucaggagggcaacgccugaagucagaccucccuauaggucaacagggacaaccugggg

SEQ ID NO: 153118 - RNA, 64 nt, hsa
gcccaggagaagcugucccaggagggcuguuaacucccuauagagccaggagacaggauagggg

SEQ ID NO: 153119 - RNA, 64 nt, hsa
ugguaaguguggaaaagccuuuagaucauaugaaucccuauacaugugagaaaucuuacagaag

SEQ ID NO: 153120 - RNA, 64 nt, hsa
guuggguucgaucccuaaucugacaucacuggugucccuauaagggaaacugaaggaaggauac

SEQ ID NO: 153121 - RNA, 64 nt, hsa
aaaaacacaaaaauuagccaggugugguggugcaucccuauacucccagcaacucagggggcug

SEQ ID NO: 153122 - RNA, 64 nt, hsa
auguucagcagcgcggcagagucauggggguuaaucccuauauccugaagaagaacaugauccu

SEQ ID NO: 153123 - RNA, 64 nt, hsa
cuagucucaagagauacagugguggaaaaauauaucccuauacucaugaagcuuaccgacuagu

SEQ ID NO: 153124 - RNA, 64 nt, hsa
uggaccuuuuauugaaaauaucacaaguucagaaucccuauacaaugugaauauguggaaauaa

SEQ ID NO: 153125 - RNA, 64 nt, hsa
aauauugaauuuccuuuggccgauaaucaggauuucccuauaagucacuuggacauuggucacu

SEQ ID NO: 153126 - RNA, 64 nt, hsa
guuggagacauaucuaaauccuuuuuacuuccacucccuauauauaguagaugcucaguguaua

SEQ ID NO: 153127 - RNA, 64 nt, hsa
aggaguggugaugucugaugcucaauuacuauuuucccuauaagaguuucagcaugagcuuaau

SEQ ID NO: 153128 - RNA, 64 nt, hsa
uauaaucauugucaacccuuugaugagugauauuucccuauaccuauguacccagauagauaua

SEQ ID NO: 153129 - RNA, 64 nt, hsa
uaugcuguaggauggaacagguuauugcugaagcucccuauaauccugaaaugaagagaauucc

SEQ ID NO: 153130 - RNA, 64 nt, hsa
caaacccccacuccauuguauuuggagacuggccucccuauaaaugugguagcuucuuuuauua

SEQ ID NO: 153131 - RNA, 64 nt, hsa
aaaccuuaaaugucuggccgggugugguggcucaucccuauaauccuacacuuugggaggccaa

SEQ ID NO: 153132 - RNA, 64 nt, hsa
ccuucuaggaauggaggagccaggccccaccccuucccuauaggaacagcccagcacagguauu

SEQ ID NO: 153133 - RNA, 64 nt, hsa
aacaaacaucaagucagcaagcauuugccaccacucccuauacuucucccuccuucuuacacac

SEQ ID NO: 153134 - RNA, 65 nt, hsa; identical to SEQ ID NO: 46699

SEQ ID NO: 153135 - RNA, 65 nt, hsa; identical to SEQ ID NO: 46700

SEQ ID NO: 153136 - RNA, 65 nt, hsa; identical to SEQ ID NO: 46729

SEQ ID NO: 153137 - RNA, 65 nt, hsa; identical to SEQ ID NO: 46730

SEQ ID NO: 153138 - RNA, 65 nt, hsa; identical to SEQ ID NO: 46736

SEQ ID NO: 153139 - RNA, 65 nt, hsa; identical to SEQ ID NO: 46737

SEQ ID NO: 153140 - RNA, 65 nt, hsa; identical to SEQ ID NO: 46784

SEQ ID NO: 153141 - RNA, 65 nt, hsa; identical to SEQ ID NO: 46785

SEQ ID NO: 153142 - RNA, 65 nt, hsa; identical to SEQ ID NO: 46787

SEQ ID NO: 153143 - RNA, 65 nt, hsa; identical to SEQ ID NO: 46788

SEQ ID NO: 153144 - RNA, 65 nt, hsa; identical to SEQ ID NO: 46800

SEQ ID NO: 153145 - RNA, 65 nt, hsa; identical to SEQ ID NO: 46801

SEQ ID NO: 153146 - RNA, 65 nt, hsa; identical to SEQ ID NO: 46823

SEQ ID NO: 153147 - RNA, 65 nt, hsa; identical to SEQ ID NO: 46824

SEQ ID NO: 153148 - RNA, 65 nt, hsa; identical to SEQ ID NO: 46864

SEQ ID NO: 153149 - RNA, 65 nt, hsa; identical to SEQ ID NO: 46865

SEQ ID NO: 153150 - RNA, 64 nt, hsa
uaugcaaccugacaaaccacugaggucauggugacucagugaucagcagaugguacuucaacag

SEQ ID NO: 153151 - RNA, 64 nt, hsa
agaagauuggaaugcuuccaaagcaagaaucuuucucagugaaaucucauuauacaaagagaac

SEQ ID NO: 153152 - RNA, 64 nt, hsa
ugagccuggcccugaagcguuuuucucaaaggcccucagugagauaaauuagauuuggcaucuc

SEQ ID NO: 153153 - RNA, 64 nt, hsa
uuccuacuguccucagaggcgugcugguccccuccucagugacaucaaagccuggccuaauugu

SEQ ID NO: 153154 - RNA, 64 nt, hsa
uggcuaaaucuagagcugcuaaaagggcuuuacccucagugaaaagugucuucuauuuucauua

SEQ ID NO: 153155 - RNA, 64 nt, hsa
uagcagcagaaggugcuccuugaauucaugaugccucagugaccaccucuuucccugggaccag

SEQ ID NO: 153156 - RNA, 64 nt, hsa
cugccucuucuggccuggugucuccucaugcccccucagugaggaucuucauguaccugcucuu

SEQ ID NO: 153157 - RNA, 64 nt, hsa
gauccagugcugagcaagcaauguacaccagagccucagugagcccaucugcacaguggggagc

SEQ ID NO: 153158 - RNA, 64 nt, hsa
ugugaagaugcguugggcugcaaguaacagaaaucucagugaacaguggccuggcgugguggcu

SEQ ID NO: 153159 - RNA, 64 nt, hsa
gaugaucauugcuagaacugagagaccagccuggcucagugaacuucagggcguuccguucauu

SEQ ID NO: 153160 - RNA, 64 nt, hsa
agaagaaccuccuuuuuaucaucaucccuuuaaacucagugaacccaaaccuauuuuuuucaau

SEQ ID NO: 153161 - RNA, 64 nt, hsa
agcaaugagugaacgggcacuugcucagaaaagacucagugagaaugcauuugaucuugaagcc

SEQ ID NO: 153162 - RNA, 52 nt, hsa
uugcugccacuuccaacugaagcucagugaccugggugggcaguggccaagc

SEQ ID NO: 153163 - RNA, 64 nt, hsa
ugacauggccuugaggagauucagggcaccuuuccucagugagcuuugauaugguccaaaaaca

SEQ ID NO: 153164 - RNA, 64 nt, hsa
ucacugaacacacgaauaacuuggauagcaaauccugagacaauggaaaaccauuaacuuuacu

SEQ ID NO: 153165 - RNA, 64 nt, hsa
uuuugccaaauauccagauaaccaguuuucacaucugagacauuacaaaguaucugccucaauu

SEQ ID NO: 153166 - RNA, 64 nt, hsa
guccugaccuucugugauguggaaacccuaggcucugagacacacucucuggugucugagacag

SEQ ID NO: 153167 - RNA, 64 nt, hsa
gaaacccuaggcucugagacacacucucuggugucugagacagaaccaaagcaauaacguugug

SEQ ID NO: 153168 - RNA, 63 nt, hsa
cuuggaaauaccagacauagcaauaacaacauucugagacacagaggugccagugauggacug

SEQ ID NO: 153169 - RNA, 64 nt, hsa
aaugaugagucuucccuuucaacuguuguuaaaucugagacauccugacucucgagcugggaag

SEQ ID NO: 153170 - RNA, 64 nt, hsa
agagcaacugaggagcucugcgagagugugcccucugagacagcccuguccgccccgcccaggu

SEQ ID NO: 153171 - RNA, 64 nt, hsa
gggcggccagugcagugaugccuggcgcuuccagcugagacaggaguccggacagaggugggca

SEQ ID NO: 153172 - RNA, 64 nt, hsa
ggccugcuuccaggccucuuugcugucagcccuucugagacaggaccuggcuucaggacugugg

SEQ ID NO: 153173 - RNA, 64 nt, hsa
uugucuucccaguguugguuugaacccugugagccugagacagagagggccaggcaccaaccac

SEQ ID NO: 153174 - RNA, 64 nt, hsa
ucuccagccuccaccugccugucugauccaagagcugagacacggccacccagcaccagucacu

SEQ ID NO: 153175 - RNA, 64 nt, hsa
gucuugugaguugugcagggugaagaccgcuucccugagacaggggcaguggugcugauggaau

SEQ ID NO: 153176 - RNA, 64 nt, hsa
uuggaccacauccuaaccugagacaaugccgagccugagacaaacccgugacucagacuugcca

SEQ ID NO: 153177 - RNA, 64 nt, hsa
auaauaagugggaguccuuggaccacauccuaaccugagacaaugccgagccugagacaaaccc

SEQ ID NO: 153178 - RNA, 64 nt, hsa
ugcaggcaccgcuggguucugacucuggaccaugcugagacaucccucaucuagucuugaccuc

SEQ ID NO: 153179 - RNA, 64 nt, hsa
caccuuugcagggaauaccucguuagagaauggccugagacagugcguugcaacuuuuuaauuc

SEQ ID NO: 153180 - RNA, 64 nt, hsa
ugguaugugccuguagucucagcuacucaggaggcugagacaggagaaucacuugaacccugga

SEQ ID NO: 153181 - RNA, 64 nt, hsa
caggaccucaagcagacuuccuagagacuuguuucugagacaguucuuugccuucacuucccug

SEQ ID NO: 153182 - RNA, 64 nt, hsa
ugaaggaacagcuccugaaaccagucucccugggcugagacaaccugggcucuucuuaggaaau

SEQ ID NO: 153183 - RNA, 64 nt, hsa
gaucaccaggucaagcaccuaggccuggcuucuccugagacagaggacucagaaguggccuuuc

SEQ ID NO: 153184 - RNA, 64 nt, hsa
ggaggguacgccaggcgagcccagggcacagaugcugagacagccucuccuucucagugcaggg

SEQ ID NO: 153185 - RNA, 64 nt, hsa
uucaccccugccaggcaagcccagggcauagaugcugagacagccucucccucucagugcaggg

SEQ ID NO: 153186 - RNA, 64 nt, hsa
auaacugcuguauucaugaaucuugagaguguuccugagacagaauuaauggucauuugggaaa

SEQ ID NO: 153187 - RNA, 64 nt, hsa
guucuguuuucuaaaggagcagaaggacaggucucugagacaggaucguugucccuacaggagg

SEQ ID NO: 153188 - RNA, 64 nt, hsa
uuacuaggcacacaggugaugcugacucgauggccugagacacaccccuugagaagaagcugcu

SEQ ID NO: 153189 - RNA, 64 nt, hsa
acaauggacaacucaccaucaguccucugcucaccugagacaaaugcaugucugauugcuuccu

SEQ ID NO: 153190 - RNA, 64 nt, hsa
uguucccuaucuccacucccugaggccacuuagccugagacaugaugcaagagcugcaggccgg

SEQ ID NO: 153191 - RNA, 64 nt, hsa
uggcucacgccuguaaucccagcacuuugggaggcugagacaggcagaucacuugaggucagga

SEQ ID NO: 153192 - RNA, 64 nt, hsa
uaaucuuuaaacuaucaggaaaaaaaccaaaacuuuauaccaaugauuuaguaauuuugaggca

SEQ ID NO: 153193 - RNA, 64 nt, hsa
ucuuucaaaauauuuucaugaaaaauuacuuuuauuauaccauuaugugcauguuauugguagc

SEQ ID NO: 153194 - RNA, 64 nt, hsa
gauugacuuucuugauggguaauuuuuuuuaagauuauaccaacaguggaucagcuggguuuug

SEQ ID NO: 153195 - RNA, 64 nt, hsa
accaggugggguauuugguuucuauuuuuuaauuuuauaccaccacuccccccugaaguugacu

SEQ ID NO: 153196 - RNA, 64 nt, hsa
ccuuuugcuguuuggauguuuccacgggucucacuuauaccaaagggaaaacucuucauuaaag

SEQ ID NO: 153197 - RNA, 64 nt, hsa
gccuaggccugugagguaacugggaucgcaccuuuuauaccagagaccugaggcagaugaaauu

SEQ ID NO: 153198 - RNA, 64 nt, hsa
auguggugcaagaagagaucuuaggucucuucuuuuauaccaagcucaucuuuuauaccaagcu

SEQ ID NO: 153199 - RNA, 64 nt, hsa
ucuuaggucucuucuuuuauaccaagcucaucuuuuauaccaagcugugcaggugacuaugccu

SEQ ID NO: 153200 - RNA, 64 nt, hsa
agagaagucuauguucguaaagucauauaaaagguuauaccacuauuuaguaaaaaguuuuagu

SEQ ID NO: 153201 - RNA, 64 nt, hsa
aacugauuaauagugagcauuucaugaagugcuuuuauaccacuauuauauaucagagaaagau

SEQ ID NO: 153202 - RNA, 64 nt, hsa
uguuuuuugacuacuuuuuauaacuuaagaauuuuuauaccaucuacaucuauccuacuuaugc

SEQ ID NO: 153203 - RNA, 64 nt, hsa
auauacaaguauguuugaguuccaaucuuacauuuuauaccaaguucaaaacacuuucagauag

SEQ ID NO: 153204 - RNA, 64 nt, hsa
cguucccauagauuugaagaucugauuuauaccauuauaccagcaaagagaauguauuuccuuu

SEQ ID NO: 153205 - RNA, 64 nt, hsa
agaugacucguucccauagauuugaagaucugauuuauaccauuauaccagcaaagagaaugua

SEQ ID NO: 153206 - RNA, 64 nt, hsa
ccccuuuuugccuuacaagugauauuugcagguauuauaccauuuuucuauucuugguggcuuc

SEQ ID NO: 153207 - RNA, 64 nt, hsa
aacaagccugccauaauccuuuggaaaagauguauuauaccagugaaaagguguuauaucuaug

SEQ ID NO: 153208 - RNA, 64 nt, hsa
gaaauacauugugccuuucucuagaugugauacguuauaccaaaaucuuuguagugugcagagc

SEQ ID NO: 153209 - RNA, 64 nt, hsa
uggccagguuuuccucaggcuccaacaacugugcuuauaccaagcagauccucauccuccauau

SEQ ID NO: 153210 - RNA, 64 nt, hsa
uuugucugucuuuuuuccucugaucaguauuuuuuuauaccaguuuuggagacuggcugagaug

SEQ ID NO: 153211 - RNA, 64 nt, hsa
cagccugucgggucucuuucuuccugcccauauauuauaccaguugcuucugcagcccgcagau

SEQ ID NO: 153212 - RNA, 64 nt, hsa
uaaauguaucuaugucucgacuuuucugaugaaguuauaccagaaaaguuaauuauuugauggg

SEQ ID NO: 153213 - RNA, 64 nt, hsa
gcaguguuagcagggguggcaguccuuguguuuguuauaccaauaaaugcuuuagcugcaacua

SEQ ID NO: 153214 - RNA, 64 nt, hsa
cuagaucagggcuggugaagaagguuagguguuuuagguacauuccagcugucauaggaagauc

SEQ ID NO: 153215 - RNA, 64 nt, hsa
cccaagaucugugucacuggucgauuuugaacuuuagguacauguguucuuuucaaaaauucag

SEQ ID NO: 153216 - RNA, 64 nt, hsa
uuggcauauuauuguacuaucccuguaacugccaagagcucaggagccaggcuagugaucacac

SEQ ID NO: 153217 - RNA, 64 nt, hsa
ccauauucuuacaggccuuccagucaauaauggaagagcucacucuauacaaaaccaauaugca

SEQ ID NO: 153218 - RNA, 64 nt, hsa
cugggcuccuggcuagaugcaagcaagguggacaagagcucaggacuccagcccacugccacug

SEQ ID NO: 153219 - RNA, 64 nt, hsa
auagaaacauguucauugcacacacccaaggagaagagcucaagcgcuuggaagaggaugcuuu

SEQ ID NO: 153220 - RNA, 64 nt, hsa
uauaaaugugauguaugugggaaaauuuuccaucagagcucagcccuuacuagacaucagagaa

SEQ ID NO: 153221 - RNA, 64 nt, hsa
uacaaauguaaagaaugugaaaagucuuucagucagagcucaagucuuagucgacauaaaagaa

SEQ ID NO: 153222 - RNA, 64 nt, hsa
gcaaagagaaccuauuauuugccaguuuuuaagcagagcucaaucuaugccagcucucuggcau

SEQ ID NO: 153223 - RNA, 64 nt, hsa
ugagauccuaagcucucaaaauagcauauucccuagagcucaagaaagcugguccaggagguug

SEQ ID NO: 153224 - RNA, 64 nt, hsa
ggaaagugugggcagccacagaugcccccaaaucagagcucacagugagugagccccuaagcuu

SEQ ID NO: 153225 - RNA, 64 nt, hsa
uggccacuuuacuacuccuaaggcuaagauguugagagcucagaccacugcucagagcaguaau

SEQ ID NO: 153226 - RNA, 64 nt, hsa
caaaccagguguccuuggcauuguguccacccagagagcucacuguuuucuuuucuuuuucuuu

SEQ ID NO: 153227 - RNA, 64 nt, hsa
gggauuacagguguuagccacugcgcccggcccuagagcucacuguuuucuaguuaguccaucu

SEQ ID NO: 153228 - RNA, 64 nt, hsa
aagagcucaccccagguucucaccucagggguuaagagcucagaguucagacagguccaaguuc

SEQ ID NO: 153229 - RNA, 64 nt, hsa
cuccucacucuagagggguuggucccauggguuaagagcucaccccagguucucaccucagggg

SEQ ID NO: 153230 - RNA, 64 nt, hsa
uugagacaagaguggugggaucagagccauguggagagcucauggccugucuaaauuguugcca

SEQ ID NO: 153231 - RNA, 64 nt, hsa
agaaaacaugacugaaaguccagaguguuagcuuagagcucaaaauacuagcugcuguuucaag

SEQ ID NO: 153232 - RNA, 64 nt, hsa
cccguuaccucgagcugacucuagaggggaaggcagagcucaggagggugggugggagcugcag

SEQ ID NO: 153233 - RNA, 64 nt, hsa
guccucggguugggcuuggcccucucugccugagagagcucagcacacacacagcucagaccca

SEQ ID NO: 153234 - RNA, 64 nt, hsa
gccuggaggcaguggcugagccagaaaguaacacagagcucaugcuuggagagagagagucuug

SEQ ID NO: 153235 - RNA, 64 nt, hsa
ggagagauguguacauagguuuuaaagcagacccagagcucaugggggccuguguucugggugu

SEQ ID NO: 153236 - RNA, 64 nt, hsa
cgacugagggccucugggccacccucccggcuggagagcucaggugcuggucccguccccugca

SEQ ID NO: 153237 - RNA, 64 nt, hsa
auuaaaacuaaccgugaccacuacuccaaacaaaacacaauaugccuaggggcacggaugaacg

SEQ ID NO: 153238 - RNA, 64 nt, hsa
uucuaauguaguuagaaguuucauugucugauggacacaauaugcccuuccgguucuauucaaa

SEQ ID NO: 153239 - RNA, 64 nt, hsa
auuugauaaugcuuuuccaaagugaaaauaagauacacaauaaucauugcucugugugauuaca

SEQ ID NO: 153240 - RNA, 64 nt, hsa
auuuaauuguauuuuguguuuauacagguauuucacacaauaauuuguucuuaaugcagccacu

SEQ ID NO: 153241 - RNA, 64 nt, hsa
auuaaaucuuaauagauuuaaugcaauuuuacagacacaauaccuucaugaauuucaaaauuca

SEQ ID NO: 153242 - RNA, 64 nt, hsa
acacuugugcacugaaagcuaacagggagagguuacacaauauuuuacaguuucuuaaacauaa

SEQ ID NO: 153243 - RNA, 64 nt, hsa
guuuuuucuguaauguaaauaaacuauuuauaucacacaauauaguuuuuucuuucccauguau

SEQ ID NO: 153244 - RNA, 64 nt, hsa
uuucacaguggcuggacuaccgagagcuuggacuacacaauacaguauuauagacaaaagaaua

SEQ ID NO: 153245 - RNA, 64 nt, hsa
cauaggguauuugauacaaucauuaauggaucauacacaauagguuuuuaaaaauuaauaacuu

SEQ ID NO: 153246 - RNA, 64 nt, hsa
uuuacaugaucugauacaaccauuaaugaaucauacacaauagguuuuuuaaaauuaauauuaa

SEQ ID NO: 153247 - RNA, 64 nt, hsa; identical to SEQ ID NO: 145127

SEQ ID NO: 153248 - RNA, 64 nt, hsa; identical to SEQ ID NO: 145128

SEQ ID NO: 153249 - RNA, 64 nt, hsa; identical to SEQ ID NO: 138011

SEQ ID NO: 153250 - RNA, 64 nt, hsa; identical to SEQ ID NO: 138012

SEQ ID NO: 153251 - RNA, 64 nt, hsa; identical to SEQ ID NO: 138013

SEQ ID NO: 153252 - RNA, 64 nt, hsa; identical to SEQ ID NO: 138014

SEQ ID NO: 153253 - RNA, 64 nt, hsa; identical to SEQ ID NO: 138015

SEQ ID NO: 153254 - RNA, 59 nt, hsa; identical to SEQ ID NO: 138016

SEQ ID NO: 153255 - RNA, 64 nt, hsa; identical to SEQ ID NO: 138017

SEQ ID NO: 153256 - RNA, 64 nt, hsa; identical to SEQ ID NO: 138018

SEQ ID NO: 153257 - RNA, 64 nt, hsa; identical to SEQ ID NO: 138019

SEQ ID NO: 153258 - RNA, 64 nt, hsa; identical to SEQ ID NO: 138020

SEQ ID NO: 153259 - RNA, 64 nt, hsa; identical to SEQ ID NO: 138021

SEQ ID NO: 153260 - RNA, 64 nt, hsa; identical to SEQ ID NO: 138022

SEQ ID NO: 153261 - RNA, 64 nt, hsa; identical to SEQ ID NO: 138023

SEQ ID NO: 153262 - RNA, 64 nt, hsa; identical to SEQ ID NO: 138024

SEQ ID NO: 153263 - RNA, 64 nt, hsa; identical to SEQ ID NO: 138025

SEQ ID NO: 153264 - RNA, 64 nt, hsa; identical to SEQ ID NO: 138026

SEQ ID NO: 153265 - RNA, 64 nt, hsa; identical to SEQ ID NO: 138027

SEQ ID NO: 153266 - RNA, 64 nt, hsa; identical to SEQ ID NO: 138028

SEQ ID NO: 153267 - RNA, 64 nt, hsa; identical to SEQ ID NO: 138029

SEQ ID NO: 153268 - RNA, 64 nt, hsa; identical to SEQ ID NO: 138030

SEQ ID NO: 153269 - RNA, 64 nt, hsa; identical to SEQ ID NO: 138031

SEQ ID NO: 153270 - RNA, 64 nt, hsa; identical to SEQ ID NO: 138032

SEQ ID NO: 153271 - RNA, 64 nt, hsa; identical to SEQ ID NO: 138033

SEQ ID NO: 153272 - RNA, 64 nt, hsa; identical to SEQ ID NO: 138034

SEQ ID NO: 153273 - RNA, 64 nt, hsa; identical to SEQ ID NO: 138035

SEQ ID NO: 153274 - RNA, 64 nt, hsa; identical to SEQ ID NO: 138036

SEQ ID NO: 153275 - RNA, 64 nt, hsa; identical to SEQ ID NO: 138037

SEQ ID NO: 153276 - RNA, 64 nt, hsa; identical to SEQ ID NO: 138038

SEQ ID NO: 153277 - RNA, 64 nt, hsa; identical to SEQ ID NO: 138039

SEQ ID NO: 153278 - RNA, 64 nt, hsa; identical to SEQ ID NO: 138040

SEQ ID NO: 153279 - RNA, 64 nt, hsa; identical to SEQ ID NO: 138041

SEQ ID NO: 153280 - RNA, 64 nt, hsa; identical to SEQ ID NO: 138042

SEQ ID NO: 153281 - RNA, 64 nt, hsa; identical to SEQ ID NO: 138043

SEQ ID NO: 153282 - RNA, 64 nt, hsa; identical to SEQ ID NO: 138044

SEQ ID NO: 153283 - RNA, 64 nt, hsa; identical to SEQ ID NO: 138045

SEQ ID NO: 153284 - RNA, 64 nt, hsa; identical to SEQ ID NO: 138046

SEQ ID NO: 153285 - RNA, 64 nt, hsa; identical to SEQ ID NO: 138047

SEQ ID NO: 153286 - RNA, 64 nt, hsa; identical to SEQ ID NO: 138048

SEQ ID NO: 153287 - RNA, 64 nt, hsa; identical to SEQ ID NO: 138049

SEQ ID NO: 153288 - RNA, 64 nt, hsa; identical to SEQ ID NO: 138050

SEQ ID NO: 153289 - RNA, 64 nt, hsa; identical to SEQ ID NO: 138051

SEQ ID NO: 153290 - RNA, 64 nt, hsa; identical to SEQ ID NO: 138052

SEQ ID NO: 153291 - RNA, 64 nt, hsa; identical to SEQ ID NO: 138053

SEQ ID NO: 153292 - RNA, 64 nt, hsa; identical to SEQ ID NO: 138054

SEQ ID NO: 153293 - RNA, 64 nt, hsa; identical to SEQ ID NO: 138055

SEQ ID NO: 153294 - RNA, 64 nt, hsa; identical to SEQ ID NO: 138056

SEQ ID NO: 153295 - RNA, 64 nt, hsa; identical to SEQ ID NO: 138057

SEQ ID NO: 153296 - RNA, 64 nt, hsa; identical to SEQ ID NO: 138058

SEQ ID NO: 153297 - RNA, 64 nt, hsa; identical to SEQ ID NO: 138059

SEQ ID NO: 153298 - RNA, 64 nt, hsa; identical to SEQ ID NO: 138060

SEQ ID NO: 153299 - RNA, 64 nt, hsa; identical to SEQ ID NO: 138061

SEQ ID NO: 153300 - RNA, 64 nt, hsa; identical to SEQ ID NO: 138062

SEQ ID NO: 153301 - RNA, 64 nt, hsa; identical to SEQ ID NO: 138063

SEQ ID NO: 153302 - RNA, 64 nt, hsa; identical to SEQ ID NO: 138064

SEQ ID NO: 153303 - RNA, 64 nt, hsa; identical to SEQ ID NO: 138065

SEQ ID NO: 153304 - RNA, 64 nt, hsa; identical to SEQ ID NO: 138066

SEQ ID NO: 153305 - RNA, 64 nt, hsa
uggaacacagaugggcugcuugggaaagaaacuuucaccugagcuucaccugaggucagacugc

SEQ ID NO: 153306 - RNA, 64 nt, hsa
ugggcugcuugggaaagaaacuuucaccugagcuucaccugaggucagacugcaguuucagaaa

SEQ ID NO: 153307 - RNA, 53 nt, hsa
uggucccucagugugccuaauucucaccugaaggcagagggaugaaaugccaa

SEQ ID NO: 153308 - RNA, 64 nt, hsa
uauuauauuguuuuauaaauggagguacaggauaucaccugaauuauuaaugaaugcccaggaa

SEQ ID NO: 153309 - RNA, 64 nt, hsa
aaucccagcacuuugggaggccgagguggccagaucaccugaggucaggaguucgagaccaccc

SEQ ID NO: 153310 - RNA, 64 nt, hsa
aaucccagcacuuugggaggcccaggugggcggaucaccugagguuagaaguuugagaccagcc

SEQ ID NO: 153311 - RNA, 64 nt, hsa
aggccucagaugcaggggcccagaacaccugcucucaccugagccccaggugaaggggcccggg

SEQ ID NO: 153312 - RNA, 64 nt, hsa
agccccaggugaaggggcccgggaacaccugcucucaccugagccccaggugaaggggcccggg

SEQ ID NO: 153313 - RNA, 64 nt, hsa
agccccaggugaaggggcccgggaacaccugcucucaccugaaccccaggugaaggggcccgga

SEQ ID NO: 153314 - RNA, 64 nt, hsa
gaaccccaggugaaggggcccggaacaccugcucucaccugagccccaggugaaggggcccgga

SEQ ID NO: 153315 - RNA, 64 nt, hsa
gagccccaggugaaggggcccggaacaccugcucucaccugagccccaggugaaggggcccggg

SEQ ID NO: 153316 - RNA, 64 nt, hsa; identical to SEQ ID NO: 153312

SEQ ID NO: 153317 - RNA, 64 nt, hsa
agccccaggugaaggggcccgggaacaccugcucucaccugaaccccaggugaaggggcccaga

SEQ ID NO: 153318 - RNA, 64 nt, hsa
gaaccccaggugaaggggcccagaacaccugcucucaccugagccccaggugaaggggcccgga

SEQ ID NO: 153319 - RNA, 64 nt, hsa; identical to SEQ ID NO: 153315

SEQ ID NO: 153320 - RNA, 64 nt, hsa
agccccaggugaaggggcccgggaacaccugcucucaccugagccccuggugaaggggcccgga

SEQ ID NO: 153321 - RNA, 64 nt, hsa
gagccccuggugaaggggcccggaacacuugcucucaccugagccccaggugaaggggcccgga

SEQ ID NO: 153322 - RNA, 64 nt, hsa
gagccccaggugaaggggcccggaacaccugcucucaccugagcccccggugaaggggcccgga

SEQ ID NO: 153323 - RNA, 64 nt, hsa
gagcccccggugaaggggcccggaacacuugcucucaccugagccccaggugaaggggcccgga

SEQ ID NO: 153324 - RNA, 64 nt, hsa
gagccccaggugaaggggcccggaacaccuccucucaccugagccccaggugaaggggcccgga

SEQ ID NO: 153325 - RNA, 64 nt, hsa
gagccccaggugaaggggcccggaacaccuccugucaccugagccccaggugaaggggcccggg

SEQ ID NO: 153326 - RNA, 64 nt, hsa
cugagccccaggugaaggggcccgggaacaccucucaccugaacccgggggucccaucccagga

SEQ ID NO: 153327 - RNA, 64 nt, hsa
aguuuguucucuuugcaagagaggggcauuacugucaccugacuugaggagcuguuuuguuguu

SEQ ID NO: 153328 - RNA, 64 nt, hsa
uuuggagaagaaaugaaggugucaaagaguccauucaccugagaaaugugugaagacauacuua

SEQ ID NO: 153329 - RNA, 64 nt, hsa
ggggcuuccaggcccuggaugggguauuuuggugucaccugaagucccucugacaucaccuugu

SEQ ID NO: 153330 - RNA, 64 nt, hsa
cucuguggauccacagccuggcagagccgagccgucaccugauuuuucaguguuucuaccugug

SEQ ID NO: 153331 - RNA, 64 nt, hsa
aaucccagcacuuugggaggcaggggcggguggaucaccugaggucaggaguucaagacuagcc

SEQ ID NO: 153332 - RNA, 64 nt, hsa
aaucccagcuacucaggaggcugagacaggagaaucaccugaaccccagaggcagagguugcag

SEQ ID NO: 153333 - RNA, 64 nt, hsa
aaucccagcacuuugagaggcugaggugguaggaucaccugaggucaggaguucaagaccagcc

SEQ ID NO: 153334 - RNA, 64 nt, hsa
aucccagcacuuuggggggccaaggcaggcuggaucaccugaggacaggaguucgagaccaguc

SEQ ID NO: 153335 - RNA, 64 nt, hsa
ucacacacuuugggaggccaagcgggggugcagaucaccugaggucaggaguuugagaccagcc

SEQ ID NO: 153336 - RNA, 64 nt, hsa
aaucccagcacuuugggaggccaaggcugguggaucaccugaggucaggaguucgagaccagcc

SEQ ID NO: 153337 - RNA, 64 nt, hsa
aaucccagcacuuugggaggcuuaggcggcuggaucaccugaggucaggaguucaagaccagcc

SEQ ID NO: 153338 - RNA, 64 nt, hsa
aaucucagcacuuugggaggcugagauggguggaucaccugagguugggaguucgagaccagcc

SEQ ID NO: 153339 - RNA, 64 nt, hsa
cuggaaacguaacuaaacagcgaaccauguagcuucaccugacucagugcugggggccucuacc

SEQ ID NO: 153340 - RNA, 64 nt, hsa
aaucccagcacuuugggaggccgaggcaggcggaucaccugaaaucaggaguucaagaucagcc

SEQ ID NO: 153341 - RNA, 64 nt, hsa
accugaguuucgucuccugucucucuggcugaugucaccugaauaaagccuucuucccuggcaa

SEQ ID NO: 153342 - RNA, 64 nt, hsa
caccuaccucauaggggagguugugaggccaccaucaccugaccugggggucaaggcaggagga

SEQ ID NO: 153343 - RNA, 64 nt, hsa
uuccgucucaucgugcguggucucugaucguccaucaccugaccuucuccaggacugucuucuc

SEQ ID NO: 153344 - RNA, 64 nt, hsa
agucccaacuaccugggaggcugaggcgggagaaucaccugagccugggaggucgaggcugcag

SEQ ID NO: 153345 - RNA, 64 nt, hsa
aaucccagcacugugagaggcugaggcgggaugaucaccugaggucaggaguucaagaucagcc

SEQ ID NO: 153346 - RNA, 64 nt, hsa
ccccuucccugggagccaguggucagacaccauuucaccugagaccaauaggugcacccucuga

SEQ ID NO: 153347 - RNA, 51 nt, hsa
ggaagaaaaugagggcuugagucaccugaaccaagagcaggaagagguugc

SEQ ID NO: 153348 - RNA, 64 nt, hsa
uguagucccaccuacucgagaagcugagauagggucaccugagccugguaggcugaggcugcag

SEQ ID NO: 153349 - RNA, 64 nt, hsa
aaucccagcacuuugggaggcuaaggugggcggaucaccugaugucaggaguucaagaccagcc

SEQ ID NO: 153350 - RNA, 64 nt, hsa
uaaucccagacuuugggaggccgaggcaggcggaucaccugaggugaggaguuugagaacagcc

SEQ ID NO: 153351 - RNA, 64 nt, hsa
aaucccagcacucugggaggcugagguggguggaucaccugaggucaggaguucaagaccagcc

SEQ ID NO: 153352 - RNA, 64 nt, hsa
acucucuccugggguuugucuaucuuuguuucucucaccugagagaaacgcagguguuccagag

SEQ ID NO: 153353 - RNA, 64 nt, hsa
ccugguguccucgcuccacccacccacgcugcugucaccugaggggaaucugcuucuuaggagu

SEQ ID NO: 153354 - RNA, 64 nt, hsa
aaucccagcacuuugggaggcugaggcugggggaucaccugaggucaggaguucgagaucagcc

SEQ ID NO: 153355 - RNA, 64 nt, hsa
uuuguuuguuuuuguuuuuggugggagguuuauuucaccugaauauaauuccuaacugaugcac

SEQ ID NO: 153356 - RNA, 64 nt, hsa
aaucccaguacuuugggaggccaaggcaagcagaucaccugaagucaggagagaccagccuggc

SEQ ID NO: 153357 - RNA, 64 nt, hsa
aaucccagcacuuugggaggcugaggcagguggaucaccugaggucgggaguucgagaccagcc

SEQ ID NO: 153358 - RNA, 64 nt, hsa
uggggcaagaucccccagcccgacuagacccaccucaccugaagggggugagacccuuguuggc

SEQ ID NO: 153359 - RNA, 64 nt, hsa
aauccuagcacauugggaggccaaggcaggcacaucaccugaguucaggaguucaagaccagcc

SEQ ID NO: 153360 - RNA, 64 nt, hsa; identical to SEQ ID NO: 127122

SEQ ID NO: 153361 - RNA, 64 nt, hsa; identical to SEQ ID NO: 127123

SEQ ID NO: 153362 - RNA, 64 nt, hsa; identical to SEQ ID NO: 127124

SEQ ID NO: 153363 - RNA, 64 nt, hsa; identical to SEQ ID NO: 127125

SEQ ID NO: 153364 - RNA, 64 nt, hsa; identical to SEQ ID NO: 127126

SEQ ID NO: 153365 - RNA, 64 nt, hsa; identical to SEQ ID NO: 127127

SEQ ID NO: 153366 - RNA, 64 nt, hsa; identical to SEQ ID NO: 127128

SEQ ID NO: 153367 - RNA, 64 nt, hsa; identical to SEQ ID NO: 127129

SEQ ID NO: 153368 - RNA, 64 nt, hsa; identical to SEQ ID NO: 127130

SEQ ID NO: 153369 - RNA, 64 nt, hsa; identical to SEQ ID NO: 127131

SEQ ID NO: 153370 - RNA, 64 nt, hsa; identical to SEQ ID NO: 127132

SEQ ID NO: 153371 - RNA, 64 nt, hsa; identical to SEQ ID NO: 127133

SEQ ID NO: 153372 - RNA, 64 nt, hsa; identical to SEQ ID NO: 127134

SEQ ID NO: 153373 - RNA, 64 nt, hsa; identical to SEQ ID NO: 127135

SEQ ID NO: 153374 - RNA, 64 nt, hsa; identical to SEQ ID NO: 127136

SEQ ID NO: 153375 - RNA, 64 nt, hsa; identical to SEQ ID NO: 127137

SEQ ID NO: 153376 - RNA, 64 nt, hsa; identical to SEQ ID NO: 127138

SEQ ID NO: 153377 - RNA, 64 nt, hsa; identical to SEQ ID NO: 127139

SEQ ID NO: 153378 - RNA, 64 nt, hsa; identical to SEQ ID NO: 127140

SEQ ID NO: 153379 - RNA, 64 nt, hsa; identical to SEQ ID NO: 127141

SEQ ID NO: 153380 - RNA, 64 nt, hsa; identical to SEQ ID NO: 127142

SEQ ID NO: 153381 - RNA, 64 nt, hsa; identical to SEQ ID NO: 127143

SEQ ID NO: 153382 - RNA, 64 nt, hsa; identical to SEQ ID NO: 127144

SEQ ID NO: 153383 - RNA, 64 nt, hsa; identical to SEQ ID NO: 127145

SEQ ID NO: 153384 - RNA, 64 nt, hsa; identical to SEQ ID NO: 127146

SEQ ID NO: 153385 - RNA, 64 nt, hsa; identical to SEQ ID NO: 127147

SEQ ID NO: 153386 - RNA, 64 nt, hsa; identical to SEQ ID NO: 127148

SEQ ID NO: 153387 - RNA, 64 nt, hsa; identical to SEQ ID NO: 127149

SEQ ID NO: 153388 - RNA, 64 nt, hsa; identical to SEQ ID NO: 127150

SEQ ID NO: 153389 - RNA, 64 nt, hsa; identical to SEQ ID NO: 127151

SEQ ID NO: 153390 - RNA, 64 nt, hsa; identical to SEQ ID NO: 127152

SEQ ID NO: 153391 - RNA, 64 nt, hsa; identical to SEQ ID NO: 127153

SEQ ID NO: 153392 - RNA, 64 nt, hsa; identical to SEQ ID NO: 127154

SEQ ID NO: 153393 - RNA, 64 nt, hsa; identical to SEQ ID NO: 127155

SEQ ID NO: 153394 - RNA, 64 nt, hsa; identical to SEQ ID NO: 127156

SEQ ID NO: 153395 - RNA, 64 nt, hsa; identical to SEQ ID NO: 127157

SEQ ID NO: 153396 - RNA, 64 nt, hsa; identical to SEQ ID NO: 127158

SEQ ID NO: 153397 - RNA, 64 nt, hsa; identical to SEQ ID NO: 127159

SEQ ID NO: 153398 - RNA, 64 nt, hsa; identical to SEQ ID NO: 127160

SEQ ID NO: 153399 - RNA, 64 nt, hsa; identical to SEQ ID NO: 127161

SEQ ID NO: 153400 - RNA, 64 nt, hsa; identical to SEQ ID NO: 127162

SEQ ID NO: 153401 - RNA, 64 nt, hsa; identical to SEQ ID NO: 127163

SEQ ID NO: 153402 - RNA, 64 nt, hsa; identical to SEQ ID NO: 127164

SEQ ID NO: 153403 - RNA, 64 nt, hsa; identical to SEQ ID NO: 127165

SEQ ID NO: 153404 - RNA, 64 nt, hsa; identical to SEQ ID NO: 127166

SEQ ID NO: 153405 - RNA, 64 nt, hsa; identical to SEQ ID NO: 127167

SEQ ID NO: 153406 - RNA, 64 nt, hsa; identical to SEQ ID NO: 127168

SEQ ID NO: 153407 - RNA, 64 nt, hsa; identical to SEQ ID NO: 127169

SEQ ID NO: 153408 - RNA, 64 nt, hsa; identical to SEQ ID NO: 127170

SEQ ID NO: 153409 - RNA, 64 nt, hsa; identical to SEQ ID NO: 127171

SEQ ID NO: 153410 - RNA, 64 nt, hsa; identical to SEQ ID NO: 127172

SEQ ID NO: 153411 - RNA, 64 nt, hsa; identical to SEQ ID NO: 127173

SEQ ID NO: 153412 - RNA, 64 nt, hsa; identical to SEQ ID NO: 127174

SEQ ID NO: 153413 - RNA, 64 nt, hsa; identical to SEQ ID NO: 127175

SEQ ID NO: 153414 - RNA, 64 nt, hsa; identical to SEQ ID NO: 127176

SEQ ID NO: 153415 - RNA, 64 nt, hsa; identical to SEQ ID NO: 127177

SEQ ID NO: 153416 - RNA, 64 nt, hsa; identical to SEQ ID NO: 127178

SEQ ID NO: 153417 - RNA, 64 nt, hsa; identical to SEQ ID NO: 127179

SEQ ID NO: 153418 - RNA, 64 nt, hsa; identical to SEQ ID NO: 127180

SEQ ID NO: 153419 - RNA, 64 nt, hsa; identical to SEQ ID NO: 127181

SEQ ID NO: 153420 - RNA, 64 nt, hsa; identical to SEQ ID NO: 127182

SEQ ID NO: 153421 - RNA, 64 nt, hsa; identical to SEQ ID NO: 127183

SEQ ID NO: 153422 - RNA, 64 nt, hsa; identical to SEQ ID NO: 127184

SEQ ID NO: 153423 - RNA, 64 nt, hsa; identical to SEQ ID NO: 127185

SEQ ID NO: 153424 - RNA, 64 nt, hsa; identical to SEQ ID NO: 127186

SEQ ID NO: 153425 - RNA, 64 nt, hsa; identical to SEQ ID NO: 127187

SEQ ID NO: 153426 - RNA, 64 nt, hsa; identical to SEQ ID NO: 127188

SEQ ID NO: 153427 - RNA, 64 nt, hsa; identical to SEQ ID NO: 127189

SEQ ID NO: 153428 - RNA, 64 nt, hsa; identical to SEQ ID NO: 127190

SEQ ID NO: 153429 - RNA, 64 nt, hsa; identical to SEQ ID NO: 127191

SEQ ID NO: 153430 - RNA, 64 nt, hsa; identical to SEQ ID NO: 127192

SEQ ID NO: 153431 - RNA, 64 nt, hsa; identical to SEQ ID NO: 127193

SEQ ID NO: 153432 - RNA, 64 nt, hsa; identical to SEQ ID NO: 127194

SEQ ID NO: 153433 - RNA, 64 nt, hsa; identical to SEQ ID NO: 127195

SEQ ID NO: 153434 - RNA, 64 nt, hsa; identical to SEQ ID NO: 127196

SEQ ID NO: 153435 - RNA, 64 nt, hsa; identical to SEQ ID NO: 127197

SEQ ID NO: 153436 - RNA, 64 nt, hsa; identical to SEQ ID NO: 127198

SEQ ID NO: 153437 - RNA, 64 nt, hsa; identical to SEQ ID NO: 127199

SEQ ID NO: 153438 - RNA, 64 nt, hsa; identical to SEQ ID NO: 127200

SEQ ID NO: 153439 - RNA, 64 nt, hsa; identical to SEQ ID NO: 127201

SEQ ID NO: 153440 - RNA, 64 nt, hsa; identical to SEQ ID NO: 127202

SEQ ID NO: 153441 - RNA, 64 nt, hsa; identical to SEQ ID NO: 127203

SEQ ID NO: 153442 - RNA, 64 nt, hsa; identical to SEQ ID NO: 127204

SEQ ID NO: 153443 - RNA, 64 nt, hsa; identical to SEQ ID NO: 127205

SEQ ID NO: 153444 - RNA, 64 nt, hsa; identical to SEQ ID NO: 127206

SEQ ID NO: 153445 - RNA, 64 nt, hsa; identical to SEQ ID NO: 127207

SEQ ID NO: 153446 - RNA, 64 nt, hsa; identical to SEQ ID NO: 127208

SEQ ID NO: 153447 - RNA, 64 nt, hsa; identical to SEQ ID NO: 127209

SEQ ID NO: 153448 - RNA, 64 nt, hsa; identical to SEQ ID NO: 127210

SEQ ID NO: 153449 - RNA, 64 nt, hsa; identical to SEQ ID NO: 127211

SEQ ID NO: 153450 - RNA, 64 nt, hsa; identical to SEQ ID NO: 127212

SEQ ID NO: 153451 - RNA, 64 nt, hsa; identical to SEQ ID NO: 127213

SEQ ID NO: 153452 - RNA, 64 nt, hsa; identical to SEQ ID NO: 127214

SEQ ID NO: 153453 - RNA, 64 nt, hsa; identical to SEQ ID NO: 127215

SEQ ID NO: 153454 - RNA, 64 nt, hsa; identical to SEQ ID NO: 127216

SEQ ID NO: 153455 - RNA, 64 nt, hsa; identical to SEQ ID NO: 127217

SEQ ID NO: 153456 - RNA, 64 nt, hsa; identical to SEQ ID NO: 127218

SEQ ID NO: 153457 - RNA, 64 nt, hsa; identical to SEQ ID NO: 127219

SEQ ID NO: 153458 - RNA, 64 nt, hsa; identical to SEQ ID NO: 127220

SEQ ID NO: 153459 - RNA, 64 nt, hsa; identical to SEQ ID NO: 127221

SEQ ID NO: 153460 - RNA, 64 nt, hsa; identical to SEQ ID NO: 127222

SEQ ID NO: 153461 - RNA, 64 nt, hsa; identical to SEQ ID NO: 127223

SEQ ID NO: 153462 - RNA, 64 nt, hsa; identical to SEQ ID NO: 127224

SEQ ID NO: 153463 - RNA, 64 nt, hsa; identical to SEQ ID NO: 127225

SEQ ID NO: 153464 - RNA, 64 nt, hsa; identical to SEQ ID NO: 127226

SEQ ID NO: 153465 - RNA, 64 nt, hsa; identical to SEQ ID NO: 127227

SEQ ID NO: 153466 - RNA, 64 nt, hsa; identical to SEQ ID NO: 127228

SEQ ID NO: 153467 - RNA, 64 nt, hsa; identical to SEQ ID NO: 127229

SEQ ID NO: 153468 - RNA, 64 nt, hsa; identical to SEQ ID NO: 127230

SEQ ID NO: 153469 - RNA, 64 nt, hsa; identical to SEQ ID NO: 127231

SEQ ID NO: 153470 - RNA, 64 nt, hsa; identical to SEQ ID NO: 127232

SEQ ID NO: 153471 - RNA, 64 nt, hsa; identical to SEQ ID NO: 127233

SEQ ID NO: 153472 - RNA, 64 nt, hsa; identical to SEQ ID NO: 127234

SEQ ID NO: 153473 - RNA, 64 nt, hsa; identical to SEQ ID NO: 127235

SEQ ID NO: 153474 - RNA, 64 nt, hsa; identical to SEQ ID NO: 127236

SEQ ID NO: 153475 - RNA, 64 nt, hsa; identical to SEQ ID NO: 127237

SEQ ID NO: 153476 - RNA, 64 nt, hsa; identical to SEQ ID NO: 127238

SEQ ID NO: 153477 - RNA, 64 nt, hsa; identical to SEQ ID NO: 127239

SEQ ID NO: 153478 - RNA, 64 nt, hsa; identical to SEQ ID NO: 127240

SEQ ID NO: 153479 - RNA, 64 nt, hsa; identical to SEQ ID NO: 127241

SEQ ID NO: 153480 - RNA, 64 nt, hsa; identical to SEQ ID NO: 127242

SEQ ID NO: 153481 - RNA, 64 nt, hsa; identical to SEQ ID NO: 127243

SEQ ID NO: 153482 - RNA, 64 nt, hsa; identical to SEQ ID NO: 127244

SEQ ID NO: 153483 - RNA, 64 nt, hsa; identical to SEQ ID NO: 127245

SEQ ID NO: 153484 - RNA, 64 nt, hsa; identical to SEQ ID NO: 127246

SEQ ID NO: 153485 - RNA, 64 nt, hsa; identical to SEQ ID NO: 127247

SEQ ID NO: 153486 - RNA, 64 nt, hsa; identical to SEQ ID NO: 127248

SEQ ID NO: 153487 - RNA, 64 nt, hsa; identical to SEQ ID NO: 127249

SEQ ID NO: 153488 - RNA, 64 nt, hsa; identical to SEQ ID NO: 127250

SEQ ID NO: 153489 - RNA, 64 nt, hsa; identical to SEQ ID NO: 127251

SEQ ID NO: 153490 - RNA, 64 nt, hsa; identical to SEQ ID NO: 127252

SEQ ID NO: 153491 - RNA, 64 nt, hsa; identical to SEQ ID NO: 127253

SEQ ID NO: 153492 - RNA, 64 nt, hsa; identical to SEQ ID NO: 127254

SEQ ID NO: 153493 - RNA, 64 nt, hsa; identical to SEQ ID NO: 127255

SEQ ID NO: 153494 - RNA, 64 nt, hsa; identical to SEQ ID NO: 127256

SEQ ID NO: 153495 - RNA, 64 nt, hsa; identical to SEQ ID NO: 127257

SEQ ID NO: 153496 - RNA, 64 nt, hsa; identical to SEQ ID NO: 127258

SEQ ID NO: 153497 - RNA, 64 nt, hsa; identical to SEQ ID NO: 127259

SEQ ID NO: 153498 - RNA, 64 nt, hsa; identical to SEQ ID NO: 127260

SEQ ID NO: 153499 - RNA, 64 nt, hsa; identical to SEQ ID NO: 127261

SEQ ID NO: 153500 - RNA, 64 nt, hsa; identical to SEQ ID NO: 127262

SEQ ID NO: 153501 - RNA, 64 nt, hsa; identical to SEQ ID NO: 127263

SEQ ID NO: 153502 - RNA, 64 nt, hsa; identical to SEQ ID NO: 127264

SEQ ID NO: 153503 - RNA, 64 nt, hsa; identical to SEQ ID NO: 127265

SEQ ID NO: 153504 - RNA, 64 nt, hsa; identical to SEQ ID NO: 127266

SEQ ID NO: 153505 - RNA, 64 nt, hsa; identical to SEQ ID NO: 127267

SEQ ID NO: 153506 - RNA, 64 nt, hsa; identical to SEQ ID NO: 127268

SEQ ID NO: 153507 - RNA, 64 nt, hsa; identical to SEQ ID NO: 127269

SEQ ID NO: 153508 - RNA, 64 nt, hsa; identical to SEQ ID NO: 127270

SEQ ID NO: 153509 - RNA, 64 nt, hsa; identical to SEQ ID NO: 127271

SEQ ID NO: 153510 - RNA, 64 nt, hsa; identical to SEQ ID NO: 127272

SEQ ID NO: 153511 - RNA, 64 nt, hsa; identical to SEQ ID NO: 127273

SEQ ID NO: 153512 - RNA, 64 nt, hsa; identical to SEQ ID NO: 127274

SEQ ID NO: 153513 - RNA, 64 nt, hsa; identical to SEQ ID NO: 127275

SEQ ID NO: 153514 - RNA, 64 nt, hsa; identical to SEQ ID NO: 127276

SEQ ID NO: 153515 - RNA, 64 nt, hsa; identical to SEQ ID NO: 127277

SEQ ID NO: 153516 - RNA, 64 nt, hsa; identical to SEQ ID NO: 127278

SEQ ID NO: 153517 - RNA, 64 nt, hsa; identical to SEQ ID NO: 127279

SEQ ID NO: 153518 - RNA, 64 nt, hsa; identical to SEQ ID NO: 127280

SEQ ID NO: 153519 - RNA, 64 nt, hsa; identical to SEQ ID NO: 127281

SEQ ID NO: 153520 - RNA, 64 nt, hsa; identical to SEQ ID NO: 127282

SEQ ID NO: 153521 - RNA, 64 nt, hsa; identical to SEQ ID NO: 127283

SEQ ID NO: 153522 - RNA, 64 nt, hsa; identical to SEQ ID NO: 127284

SEQ ID NO: 153523 - RNA, 64 nt, hsa; identical to SEQ ID NO: 127285

SEQ ID NO: 153524 - RNA, 64 nt, hsa; identical to SEQ ID NO: 127286

SEQ ID NO: 153525 - RNA, 64 nt, hsa; identical to SEQ ID NO: 127287

SEQ ID NO: 153526 - RNA, 64 nt, hsa; identical to SEQ ID NO: 127288

SEQ ID NO: 153527 - RNA, 64 nt, hsa; identical to SEQ ID NO: 127289

SEQ ID NO: 153528 - RNA, 64 nt, hsa; identical to SEQ ID NO: 127290

SEQ ID NO: 153529 - RNA, 64 nt, hsa; identical to SEQ ID NO: 127291

SEQ ID NO: 153530 - RNA, 64 nt, hsa; identical to SEQ ID NO: 127292

SEQ ID NO: 153531 - RNA, 64 nt, hsa; identical to SEQ ID NO: 127293

SEQ ID NO: 153532 - RNA, 64 nt, hsa; identical to SEQ ID NO: 127294

SEQ ID NO: 153533 - RNA, 64 nt, hsa; identical to SEQ ID NO: 127295

SEQ ID NO: 153534 - RNA, 64 nt, hsa; identical to SEQ ID NO: 127296

SEQ ID NO: 153535 - RNA, 64 nt, hsa; identical to SEQ ID NO: 127297

SEQ ID NO: 153536 - RNA, 64 nt, hsa; identical to SEQ ID NO: 127298

SEQ ID NO: 153537 - RNA, 64 nt, hsa; identical to SEQ ID NO: 127299

SEQ ID NO: 153538 - RNA, 64 nt, hsa; identical to SEQ ID NO: 127300

SEQ ID NO: 153539 - RNA, 64 nt, hsa; identical to SEQ ID NO: 127301

SEQ ID NO: 153540 - RNA, 64 nt, hsa; identical to SEQ ID NO: 127302

SEQ ID NO: 153541 - RNA, 64 nt, hsa; identical to SEQ ID NO: 127303

SEQ ID NO: 153542 - RNA, 64 nt, hsa; identical to SEQ ID NO: 127304

SEQ ID NO: 153543 - RNA, 64 nt, hsa; identical to SEQ ID NO: 127305

SEQ ID NO: 153544 - RNA, 64 nt, hsa; identical to SEQ ID NO: 127306

SEQ ID NO: 153545 - RNA, 64 nt, hsa; identical to SEQ ID NO: 127307

SEQ ID NO: 153546 - RNA, 64 nt, hsa; identical to SEQ ID NO: 127308

SEQ ID NO: 153547 - RNA, 64 nt, hsa; identical to SEQ ID NO: 127309

SEQ ID NO: 153548 - RNA, 64 nt, hsa; identical to SEQ ID NO: 127310

SEQ ID NO: 153549 - RNA, 64 nt, hsa; identical to SEQ ID NO: 127311

SEQ ID NO: 153550 - RNA, 64 nt, hsa; identical to SEQ ID NO: 127312

SEQ ID NO: 153551 - RNA, 64 nt, hsa; identical to SEQ ID NO: 127313

SEQ ID NO: 153552 - RNA, 64 nt, hsa; identical to SEQ ID NO: 127314

SEQ ID NO: 153553 - RNA, 64 nt, hsa; identical to SEQ ID NO: 127315

SEQ ID NO: 153554 - RNA, 64 nt, hsa; identical to SEQ ID NO: 127316

SEQ ID NO: 153555 - RNA, 64 nt, hsa; identical to SEQ ID NO: 127317

SEQ ID NO: 153556 - RNA, 64 nt, hsa; identical to SEQ ID NO: 127318

SEQ ID NO: 153557 - RNA, 64 nt, hsa; identical to SEQ ID NO: 127319

SEQ ID NO: 153558 - RNA, 64 nt, hsa; identical to SEQ ID NO: 127320

SEQ ID NO: 153559 - RNA, 64 nt, hsa; identical to SEQ ID NO: 127321

SEQ ID NO: 153560 - RNA, 64 nt, hsa; identical to SEQ ID NO: 127322

SEQ ID NO: 153561 - RNA, 64 nt, hsa; identical to SEQ ID NO: 127323

SEQ ID NO: 153562 - RNA, 64 nt, hsa; identical to SEQ ID NO: 127324

SEQ ID NO: 153563 - RNA, 64 nt, hsa; identical to SEQ ID NO: 127325

SEQ ID NO: 153564 - RNA, 64 nt, hsa; identical to SEQ ID NO: 127326

SEQ ID NO: 153565 - RNA, 64 nt, hsa; identical to SEQ ID NO: 127327

SEQ ID NO: 153566 - RNA, 63 nt, hsa; identical to SEQ ID NO: 127328

SEQ ID NO: 153567 - RNA, 64 nt, hsa; identical to SEQ ID NO: 127329

SEQ ID NO: 153568 - RNA, 64 nt, hsa; identical to SEQ ID NO: 127330

SEQ ID NO: 153569 - RNA, 64 nt, hsa; identical to SEQ ID NO: 127331

SEQ ID NO: 153570 - RNA, 64 nt, hsa; identical to SEQ ID NO: 127332

SEQ ID NO: 153571 - RNA, 64 nt, hsa; identical to SEQ ID NO: 127333

SEQ ID NO: 153572 - RNA, 64 nt, hsa; identical to SEQ ID NO: 127334

SEQ ID NO: 153573 - RNA, 64 nt, hsa; identical to SEQ ID NO: 127335

SEQ ID NO: 153574 - RNA, 64 nt, hsa; identical to SEQ ID NO: 127336

SEQ ID NO: 153575 - RNA, 64 nt, hsa; identical to SEQ ID NO: 127337

SEQ ID NO: 153576 - RNA, 64 nt, hsa; identical to SEQ ID NO: 127338

SEQ ID NO: 153577 - RNA, 64 nt, hsa; identical to SEQ ID NO: 127339

SEQ ID NO: 153578 - RNA, 64 nt, hsa; identical to SEQ ID NO: 127340

SEQ ID NO: 153579 - RNA, 64 nt, hsa; identical to SEQ ID NO: 127341

SEQ ID NO: 153580 - RNA, 64 nt, hsa; identical to SEQ ID NO: 127342

SEQ ID NO: 153581 - RNA, 64 nt, hsa; identical to SEQ ID NO: 127343

SEQ ID NO: 153582 - RNA, 64 nt, hsa; identical to SEQ ID NO: 127344

SEQ ID NO: 153583 - RNA, 64 nt, hsa; identical to SEQ ID NO: 127345

SEQ ID NO: 153584 - RNA, 64 nt, hsa; identical to SEQ ID NO: 127346

SEQ ID NO: 153585 - RNA, 64 nt, hsa; identical to SEQ ID NO: 127347

SEQ ID NO: 153586 - RNA, 64 nt, hsa; identical to SEQ ID NO: 127348

SEQ ID NO: 153587 - RNA, 64 nt, hsa; identical to SEQ ID NO: 127349

SEQ ID NO: 153588 - RNA, 64 nt, hsa; identical to SEQ ID NO: 127350

SEQ ID NO: 153589 - RNA, 64 nt, hsa; identical to SEQ ID NO: 127351

SEQ ID NO: 153590 - RNA, 64 nt, hsa; identical to SEQ ID NO: 127352

SEQ ID NO: 153591 - RNA, 64 nt, hsa; identical to SEQ ID NO: 127353

SEQ ID NO: 153592 - RNA, 64 nt, hsa; identical to SEQ ID NO: 127354

SEQ ID NO: 153593 - RNA, 64 nt, hsa; identical to SEQ ID NO: 127355

SEQ ID NO: 153594 - RNA, 64 nt, hsa; identical to SEQ ID NO: 127356

SEQ ID NO: 153595 - RNA, 64 nt, hsa; identical to SEQ ID NO: 127357

SEQ ID NO: 153596 - RNA, 64 nt, hsa; identical to SEQ ID NO: 127358

SEQ ID NO: 153597 - RNA, 64 nt, hsa; identical to SEQ ID NO: 127359

SEQ ID NO: 153598 - RNA, 64 nt, hsa; identical to SEQ ID NO: 127360

SEQ ID NO: 153599 - RNA, 64 nt, hsa; identical to SEQ ID NO: 127361

SEQ ID NO: 153600 - RNA, 64 nt, hsa; identical to SEQ ID NO: 127362

SEQ ID NO: 153601 - RNA, 64 nt, hsa; identical to SEQ ID NO: 127363

SEQ ID NO: 153602 - RNA, 64 nt, hsa; identical to SEQ ID NO: 127364

SEQ ID NO: 153603 - RNA, 64 nt, hsa; identical to SEQ ID NO: 127365

SEQ ID NO: 153604 - RNA, 64 nt, hsa; identical to SEQ ID NO: 127366

SEQ ID NO: 153605 - RNA, 64 nt, hsa; identical to SEQ ID NO: 127367

SEQ ID NO: 153606 - RNA, 64 nt, hsa; identical to SEQ ID NO: 127368

SEQ ID NO: 153607 - RNA, 64 nt, hsa; identical to SEQ ID NO: 127369

SEQ ID NO: 153608 - RNA, 64 nt, hsa; identical to SEQ ID NO: 127370

SEQ ID NO: 153609 - RNA, 64 nt, hsa
gucaucuuuuuguuauaagugaccuuugucuggaaugucugaaaaguaguuaaugcuuuuuggu

SEQ ID NO: 153610 - RNA, 64 nt, hsa
uacauaauauuguccuuagauuuugaucaauucuaugucugacuuugaaauuccauuuacaaug

SEQ ID NO: 153611 - RNA, 64 nt, hsa
auagaugucucaaaaauccuuaugcaugaaaugaaugucugagauacgucugugacuuaucuac

SEQ ID NO: 153612 - RNA, 64 nt, hsa
ugccaccccagguuuuucaucugaaaagcaguucaugucugaaacagagaaccaaaccgcaaac

SEQ ID NO: 153613 - RNA, 64 nt, hsa
uuuaaaaaaagcaaaucuauuuucaaauugugcaaugucugaauggaauuggcaaaugagguga

SEQ ID NO: 153614 - RNA, 64 nt, hsa
auuauagaucuauauauguaauauauuuguuuggaugucugaucuuuuccuacaguuccugccc

SEQ ID NO: 153615 - RNA, 64 nt, hsa
acaccaugccuggcccuuaagaagugcucaauaaaugucugaacaaauaagugaguggagugag

SEQ ID NO: 153616 - RNA, 64 nt, hsa
uauaucuguauaauguugagauuacuuacgaaauaugucugagugacacuuuucacccuuguac

SEQ ID NO: 153617 - RNA, 64 nt, hsa
ugcuccuggcacagaauuccaccggugcaaggagaugucugaauacugcagcacucugugccgc

SEQ ID NO: 153618 - RNA, 64 nt, hsa
cacuuuagugauugcuuuuauuacauuaguuaagaugucugagagaccaucuccuaucuuuuau

SEQ ID NO: 153619 - RNA, 64 nt, hsa
uaauaguacuauuaacaacccauaggcacuugggaugucugagaucagugccuauggguuguua

SEQ ID NO: 153620 - RNA, 64 nt, hsa
gauuuacuacuuaugcguaagugguaugcaugggaugucugaaaucagugccuauggguuguca

SEQ ID NO: 153621 - RNA, 64 nt, hsa
ugaaagaaucauuugcauuaucagccuguuugggaugucugagaucagugccucuggguuguua

SEQ ID NO: 153622 - RNA, 64 nt, hsa
cucuggaaugcuuuaguuuccuuuuccccucaagaugucugagucagcuaggaugcuguuuacc

SEQ ID NO: 153623 - RNA, 64 nt, hsa
gagaacaauaguagucucaagaauggaaaccugaaugucugagggaaugggcugguagacuuuu

SEQ ID NO: 153624 - RNA, 64 nt, hsa
auuucgaagcaaucuagacuguugugaugaguguaugucugaaccuguaauucuuaaaagacuu

SEQ ID NO: 153625 - RNA, 64 nt, hsa
cauaguauugaaucucaggaaaaacuauucuuucaugucugauucugagauuucuaauuguguu

SEQ ID NO: 153626 - RNA, 64 nt, hsa
gacugaaaauacuccugaguacucccuuggcuguaugucugacagucuuuagcuauggugacua

SEQ ID NO: 153627 - RNA, 64 nt, hsa
ugccuauauuaaagguauacaaauaaauaaggccaugucugacuucaaggaacucaguuuaauu

SEQ ID NO: 153628 - RNA, 64 nt, hsa
aaaaacaucuagccauauccauaaacuauaucaucaccaagagauguuuauuagggcaaucaaa

SEQ ID NO: 153629 - RNA, 64 nt, hsa
gggaugagaggaguuguggcuuugugucugcuggcaccaagagggcugagggugagguguggaa

SEQ ID NO: 153630 - RNA, 64 nt, hsa
agucugcuucaugccaaggcugggcuuugggucccaccaagaugaguucucuguaagacugugg

SEQ ID NO: 153631 - RNA, 64 nt, hsa
gcccacucuccuccaagacuguguugucuuuucucaccaagaguauuaacacuacuaagucuuu

SEQ ID NO: 153632 - RNA, 64 nt, hsa
ggagaccaguuucuggggagcuuccaagagcacccaccaagacacagcaggacaggccagggga

SEQ ID NO: 153633 - RNA, 64 nt, hsa
agacccacccacucgggcugcaaaaggugaaaagcaccaagagguuuucagauggaagugagag

SEQ ID NO: 153634 - RNA, 64 nt, hsa
caggaagccugugaaaaacgugauuccugggccccaccaagacccaccaaaaccaucucugggg

SEQ ID NO: 153635 - RNA, 64 nt, hsa
ccaccugccccaauaagaucugcucugucugcgacaccaagauccagcuggggacuccccugag

SEQ ID NO: 153636 - RNA, 64 nt, hsa
ccacccaucgaaaccagccaccccuucccugugccaccaagacagccuuuuccaguggccaucc

SEQ ID NO: 153637 - RNA, 64 nt, hsa
ggccugcagccuaccugaccaucucuuuagcugucaccaagaaaauaaaccccacugucucucu

SEQ ID NO: 153638 - RNA, 64 nt, hsa
guuuggugacuugaggcuggagcucccucuguuaccuuuccaucuagcaaguucccaaaggcaa

SEQ ID NO: 153639 - RNA, 64 nt, hsa
gccaacuggaguccagguucgccucccacuguccccuuuccacuuccccagcuucugccccaau

SEQ ID NO: 153640 - RNA, 64 nt, hsa
gcaaauggauccuccugugagagugacgucaccuccuuuccagagccauuagugagccuggcuu

SEQ ID NO: 153641 - RNA, 64 nt, hsa
gaugagcguccuuuaaaccacugugccuucucacccuuuccaucuucaguuugaaugacuccca

SEQ ID NO: 153642 - RNA, 64 nt, hsa
gcugagggagaaaaagaaaacauacauuaugaagccuuuccaaaauuaggugcuugguaaucac

SEQ ID NO: 153643 - RNA, 64 nt, hsa
aagagucaaugauucuguucgacuaaauagcuguccuuuccaacacauugcuacuuuuuuaaau

SEQ ID NO: 153644 - RNA, 64 nt, hsa
gauuuuuuuguuuugaucauggccucuacaugcaccuuuccagaguggucucuucucaggcccu

SEQ ID NO: 153645 - RNA, 64 nt, hsa
uccagaguggucucuucucaggcccuuuuuagucccuuuccaaagcugcccccaccacccugcu

SEQ ID NO: 153646 - RNA, 64 nt, hsa
augacuuagaaccauccuugacccuuaggcccaaccuuuccacagagaaaucaccucucuuccu

SEQ ID NO: 153647 - RNA, 64 nt, hsa
ccauuugucagaaauguauuuggcuuuuuaaacuccuuuccacaaaaguuuaagucuaaugacc

SEQ ID NO: 153648 - RNA, 64 nt, hsa
cugggauuacaggcaugagccaccacacccagccccuuuccaaccauuucuaaguagauuuuuu

SEQ ID NO: 153649 - RNA, 64 nt, hsa
guugaauaaauaguaauauuuaucaguaaauacuccuuuccaacuuccuuuuuuuuuuuuuuuu

SEQ ID NO: 153650 - RNA, 64 nt, hsa
aaaagagagggagguauggacugggggccagaguccuuuccaaggcuucuccaauucugcccaa

SEQ ID NO: 153651 - RNA, 64 nt, hsa
guaaccauuugcacuggaguucuaugcucucgcaccuuuccaaaguuaacagauuuugggguug

SEQ ID NO: 153652 - RNA, 64 nt, hsa
uuuuuuccaagagugugaaggaaaauggggcauuccuuuccacucuggcauaguucaugagcuu

SEQ ID NO: 153653 - RNA, 64 nt, hsa
aguccaaucuccaaugagaacaugagcaaauagaccuuuccagguugaaagugaaacauacugg

SEQ ID NO: 153654 - RNA, 64 nt, hsa
cgucccgggccugccuuucccauccuuugguucuccuuuccagucuggguucacacccugaaaa

SEQ ID NO: 153655 - RNA, 64 nt, hsa
uugaaaguaucgugaccauguggcccaccagcagccuuuccaaaggggaacuccagagacauuu

SEQ ID NO: 153656 - RNA, 64 nt, hsa
uguauguuucuucuuucuuuuaagcagacccauaccuuuccagggucaaaguacagaauagaau

SEQ ID NO: 153657 - RNA, 64 nt, hsa
aucauuagagcuuaaauugucagaucguucauugccuuuccaggguuauuuaguaaaguuuguu

SEQ ID NO: 153658 - RNA, 64 nt, hsa
ccugagccuggauuuucacucaucccugagaagcccuuuccaguagggugggcaauucccaacu

SEQ ID NO: 153659 - RNA, 64 nt, hsa
agcagagggagcacauuuuguggaccugguuccaccuuuccauuccaaaccaccuguuuccccu

SEQ ID NO: 153660 - RNA, 64 nt, hsa
cagacaccuucuugcagagugauuuugaccaaugccuuuccagcaccuuccccugguuaugaca

SEQ ID NO: 153661 - RNA, 64 nt, hsa
ucucuucaggacaaaugguuuguccuuaugguccccuuuccacuaggauuuucucauccucauc

SEQ ID NO: 153662 - RNA, 64 nt, hsa
aagccaaaaauggcaacaauuuacagaaaucccaccuuuccaugcuuaagacaaaaaugucuua

SEQ ID NO: 153663 - RNA, 64 nt, hsa
auuaagaccaggguuuacacacuuaggcaauaguccuuuccaaaccaugacaaaaacuacaagu

SEQ ID NO: 153664 - RNA, 64 nt, hsa
agucagaugauauagcacuagcaaagcauucaucccuuuccauauaacaggagggaggggaaga

SEQ ID NO: 153665 - RNA, 64 nt, hsa
aacaguggagcuggagcuaacuuccuucuuucauccuuuccaauuuuucuauuccagaagacag

SEQ ID NO: 153666 - RNA, 64 nt, hsa
uaguauugaaauggccaguuuacuugucugccuuccuuuccaagaccguuggugccuagaggac

SEQ ID NO: 153667 - RNA, 64 nt, hsa
cuccagugcauacuucucaaucuuugcuuuauggccuuuccaucauaguugcccacucccucuc

SEQ ID NO: 153668 - RNA, 64 nt, hsa
uuccucccucccuuccuucccuccuucccuucucccuuuccaaccccuuccuuccuuuuccucc

SEQ ID NO: 153669 - RNA, 64 nt, hsa
cccauccuuccauucuuccccucccucccuucuuccuuuccaaccccuuccuuccuuuuccucc

SEQ ID NO: 153670 - RNA, 64 nt, hsa
cauuguuaaaggugcuuacgaucuuuuuuguuuuccuuuccacuccauuguaucaauuuuuuga

SEQ ID NO: 153671 - RNA, 64 nt, hsa
uugaaugugaacugauccagaaauaagugcuguaccuuuccacugcacuugaaguucaacuuaa

SEQ ID NO: 153672 - RNA, 64 nt, hsa
guccccguccccagccuaccaaagaguauucacaccuuuccaucccugacucuauggguuacug

SEQ ID NO: 153673 - RNA, 64 nt, hsa
ucuuuucagcuggggaggggaagaggugcuggcuccuuuccagacaugcuuauguauaaguaaa

SEQ ID NO: 153674 - RNA, 58 nt, hsa
caggcggugggaugcuuguagcuccucacagcaggauuccugcccacuguuuuuucuc

SEQ ID NO: 153675 - RNA, 58 nt, hsa
caauaugcccuuccgguucuauucaaaccagcaggaucugucggugcuuagagauggc

SEQ ID NO: 153676 - RNA, 58 nt, hsa
cccauucauucacccaacuuccuucauucagcaggagguccuauuacccucuccagcu

SEQ ID NO: 153677 - RNA, 58 nt, hsa
cugcauccaacaugggagcagagacuggcagcaggaggggggaacauggugagaagug

SEQ ID NO: 153678 - RNA, 58 nt, hsa
gucgugccauucacaaagucagaaaauacagcaggaagagacagcuuuuagaggggca

SEQ ID NO: 153679 - RNA, 58 nt, hsa
gauggaaugacuucugcaacuguagucccagcaggaacugugaagaccagcugcccug

SEQ ID NO: 153680 - RNA, 58 nt, hsa
gguuggguaggugugggguuccagaggacagcaggacacucucgcauacuuugccaaa

SEQ ID NO: 153681 - RNA, 58 nt, hsa
ccagacucugugcacuucagaccagcagcagcaggagggcucccgagggccuuaugag

SEQ ID NO: 153682 - RNA, 58 nt, hsa
cugccuggggccugggucaagggccagucagcaggaggcugccggaacaacagcggcu

SEQ ID NO: 153683 - RNA, 58 nt, hsa
cuuggagagucggccagacggcggggggcagcaggaacuuugccucauaccccaccaa

SEQ ID NO: 153684 - RNA, 58 nt, hsa
ugugugugcacacucaugaguuuugucucagcaggauagaauaagcaaauccaugaac

SEQ ID NO: 153685 - RNA, 58 nt, hsa
agauaauauuucuccaauugggacuccccagcaggaauacuuagggauaaggaagaau

SEQ ID NO: 153686 - RNA, 58 nt, hsa
gggggcccuugggugccagagugagacacagcaggacccuuccccaaauacuaggcuc

SEQ ID NO: 153687 - RNA, 58 nt, hsa
uaggcucagagcaaccuccagccuucuccagcaggaucugcucccuguguccuuggac

SEQ ID NO: 153688 - RNA, 58 nt, hsa
cuuuuuuuccccaaggcacuuuaaaaaucagcaggacaacccugaggcaaacuggaag

SEQ ID NO: 153689 - RNA, 58 nt, hsa
caugauuuguucauuucugagucacaaacagcaggauaccucacagguaagccauacc

SEQ ID NO: 153690 - RNA, 58 nt, hsa
gccucugcaaggcacucagggugggggacagcaggaucaagacaacccguuggagccc

SEQ ID NO: 153691 - RNA, 58 nt, hsa
gcagcuuccuccacagccggcuguggagcagcaggaccuggcccuucugccugggcag

SEQ ID NO: 153692 - RNA, 58 nt, hsa
uagagaggcguuagugggcagguggccacagcaggacugaggacaggcccccauuauc

SEQ ID NO: 153693 - RNA, 58 nt, hsa
ccaggaccaccucguccucguggcggggcagcaggagcgguagaaagggguccgaugu

SEQ ID NO: 153694 - RNA, 58 nt, hsa
cugcuggcaucaguaccugguguugggacagcaggauaggguucuaaaggugguuuuc

SEQ ID NO: 153695 - RNA, 58 nt, hsa
ccaggaaucccuuccucccauguccuggcagcaggaccccaggcuacauauggaaggu

SEQ ID NO: 153696 - RNA, 58 nt, hsa
gcuggucucuguguguuuguguguuccucagcaggaaugagugucuuuguguaucacc

SEQ ID NO: 153697 - RNA, 58 nt, hsa
uguugaaaagcuccuuggguucuccugacagcaggaaccacuggccuggcaccaccug

SEQ ID NO: 153698 - RNA, 58 nt, hsa
ugucauguauaacugagacacacaaacacagcaggagaaaucuaaaccguugugccuu

SEQ ID NO: 153699 - RNA, 58 nt, hsa
augauuaguauagcuuucuccagcauggcagcaggaaguaacuacagggccucuuuua

SEQ ID NO: 153700 - RNA, 58 nt, hsa
aagagaguucuggaugucuggcucaaagcagcaggacugugggaaagagccuaacauc

SEQ ID NO: 153701 - RNA, 58 nt, hsa
ucccaaggccccacuuucaagaaucagacagcaggaagccauagaugcuggcuggguu

SEQ ID NO: 153702 - RNA, 58 nt, hsa
aacaaagcacuuuuggacaaugcuaucccagcaggaaaaaaaaggauaauauaacugu

SEQ ID NO: 153703 - RNA, 58 nt, hsa
uuugaucccuagauaagaacaugcaaaucagcaggaacuggucauacaggguaagcac

SEQ ID NO: 153704 - RNA, 58 nt, hsa
gccuucucaggacuccuggguggcacagcagcaggaccuugucaugggacugaugcug

SEQ ID NO: 153705 - RNA, 58 nt, hsa
agcaagggugacuccuggcaggugggggcagcaggagggcagagggcagagcucuggc

SEQ ID NO: 153706 - RNA, 58 nt, hsa
acaggagcucccagcuuuuguccacggccagcaggaugggcugucguguauauagcug

SEQ ID NO: 153707 - RNA, 58 nt, hsa
gcgccggacccgguaggggcagucugggcagcaggaaggaagggcgcagcguccccuc

SEQ ID NO: 153708 - RNA, 58 nt, hsa
gaaaugagaaagcuggaauccugguccccagcaggagagccuaguccucccccagccc

SEQ ID NO: 153709 - RNA, 58 nt, hsa
cugccagauccacucacucugcugccuccagcaggacccaaggccacuuucaacucuu

SEQ ID NO: 153710 - RNA, 58 nt, hsa
ugagagaaaggaggugguauggaagacucagcaggaacaagguaggcuucaaagagcc

SEQ ID NO: 153711 - RNA, 58 nt, hsa
gggccccugcugggcccagccaccaggacagcaggaaccagggccuacuccucuuaug

SEQ ID NO: 153712 - RNA, 58 nt, hsa
gcuccuacuccucacaucuggaggauuccagcaggagggguuuuggaggggaccugcu

SEQ ID NO: 153713 - RNA, 58 nt, hsa
auccagccauagauggcugcugggugugcagcaggagaaggaggauggucagccuugg

SEQ ID NO: 153714 - RNA, 58 nt, hsa
gucuauauugcacugagagaggaagggacagcaggagugaggugaagagggcggagag

SEQ ID NO: 153715 - RNA, 58 nt, hsa
caguagagagaccaggagccaccucaaucagcaggacagccucacugccccucuugca

SEQ ID NO: 153716 - RNA, 58 nt, hsa
ggagcuuccaagagcacccaccaagacacagcaggacaggccaggggagggcaucugg

SEQ ID NO: 153717 - RNA, 58 nt, hsa
cacuugacucucuguaaaauggaccaaucagcaggauguggguggggcgagacaagag

SEQ ID NO: 153718 - RNA, 58 nt, hsa
ccagcaguggcugcuggggaagcagcugcagcaggagggagacggucuugccucucag

SEQ ID NO: 153719 - RNA, 58 nt, hsa
gcugcgugggacaagggcuguguugucacagcaggaauagguuuuccucuguuggccu

SEQ ID NO: 153720 - RNA, 58 nt, hsa
ucucuauggugcugaggaagagcagcagcagcaggauggugaaguaguaaacuggggg

SEQ ID NO: 153721 - RNA, 58 nt, hsa
uccuuaccccccagccccugcccaccuucagcaggaugaggcccuggguugccgugcu

SEQ ID NO: 153722 - RNA, 58 nt, hsa
aggaggggugguagccguucccaccucgcagcaggacccccagugcagaggcucacag

SEQ ID NO: 153723 - RNA, 58 nt, hsa
ugagggggucugaccaggaggccaccuacagcaggaagugaggcugccauguuuccuu

SEQ ID NO: 153724 - RNA, 58 nt, hsa
uggcguccacaagcaauaccucucguuccagcaggaccaagggagccagccuccagug

SEQ ID NO: 153725 - RNA, 58 nt, hsa
cgagcuauagggcaucagguggugggaacagcaggaaaaggcauuccagucugcccca

SEQ ID NO: 153726 - RNA, 58 nt, hsa
ugaagcccacagaugcgcacgcaaugaccagcaggaaccggaagcccugggucacccc

SEQ ID NO: 153727 - RNA, 58 nt, hsa
cccuccccucucuuagagacugugccuucagcaggacucuuaauaucugcugcaacuu

SEQ ID NO: 153728 - RNA, 58 nt, hsa
caugcagaggugguagaaaggcuggacucagcaggaacaccaaaucccggaccaggca

SEQ ID NO: 153729 - RNA, 58 nt, hsa
gcagggcucagcagcacccggugaacagcagcaggaggagccgcuagagcagcugcuc

SEQ ID NO: 153730 - RNA, 58 nt, hsa
uucagcuugaggggagcucccacugccucagcaggagcaauucugcaucccuaauucu

SEQ ID NO: 153731 - RNA, 58 nt, hsa
aauuauuaaguuugacuuggaaguggagcagcaggacuuuguaguuguaugcuugauu

SEQ ID NO: 153732 - RNA, 58 nt, hsa
gcugcuuuugagcuucaagguaauaggacagcaggaaccuaaaauaucugccaucauc

SEQ ID NO: 153733 - RNA, 58 nt, hsa
gacaccaucuuggaauaccuuugggaagcagcaggaaaugugcauguggguagagauc

SEQ ID NO: 153734 - RNA, 64 nt, hsa
uuuucuacuuuggcaacucacgucacacacauauuacacacaugugcgcauuacacacacacaa

SEQ ID NO: 153735 - RNA, 64 nt, hsa
ucacgucacacacauauuacacacaugugcgcauuacacacacacaauacacauacaugcauau

SEQ ID NO: 153736 - RNA, 64 nt, hsa
cacaacuuguuucuuaguucauauaaucucgggauacacacacacacacacauauauauacaca

SEQ ID NO: 153737 - RNA, 64 nt, hsa
aaucucgggauacacacacacacacacauauauauacacacacauacguauacacacacauaca

SEQ ID NO: 153738 - RNA, 64 nt, hsa
cacacacacacauauauauacacacacauacguauacacacacauacauauauauaaauauacc

SEQ ID NO: 153739 - RNA, 64 nt, hsa
ucaaagacuaucugcagcuaguguguuucuucuuuacacacauauacacacagacaucagaaaa

SEQ ID NO: 153740 - RNA, 64 nt, hsa
ucugcagcuaguguguuucuucuuuacacacauauacacacagacaucagaaaauucuguugag

SEQ ID NO: 153741 - RNA, 64 nt, hsa
gcaacuugaauuaagaccaaacagaacaugagaauacacacacacacacacauauacacacaca

SEQ ID NO: 153742 - RNA, 64 nt, hsa
acagaacaugagaauacacacacacacacacauauacacacacacacacuucacacauacacac

SEQ ID NO: 153743 - RNA, 64 nt, hsa
agagaaucauauauaguccagucuucauuuuacauacacacacauauuuuacacacacacacau

SEQ ID NO: 153744 - RNA, 64 nt, hsa
guccagucuucauuuuacauacacacacauauuuuacacacacacacauuuuacacacacacac

SEQ ID NO: 153745 - RNA, 64 nt, hsa
cauacacacacauauuuuacacacacacacauuuuacacacacacacacacacacacacauaug

SEQ ID NO: 153746 - RNA, 64 nt, hsa
guacacacgcagacacagacaccacacacacacauacacacacacacacacacacaccugaggc

SEQ ID NO: 153747 - RNA, 64 nt, hsa
agcuuuccugaacuggaacgucgggggcaaagcauacacacacacuccaauccauccaugcaua

SEQ ID NO: 153748 - RNA, 64 nt, hsa
ugauauacacacacauuauauauauauauauauauacacacacacacacacacacacguauauc

SEQ ID NO: 153749 - RNA, 64 nt, hsa
cuggcagcucuuaaaacuaagaaaaaauaugauauacacacacauuauauauauauauauauau

SEQ ID NO: 153750 - RNA, 64 nt, hsa
gacucaaauguaugcaguacuauucagaaugauauacacacauauguguauauguauuuacaua

SEQ ID NO: 153751 - RNA, 64 nt, hsa
agcagaucaugcuauugugacauuugcagagauauacacacacuuuuuguacagaagaggcuug

SEQ ID NO: 153752 - RNA, 64 nt, hsa
auuccugggauuauuauacugagauauauauauauacacacacacacacauauguguauauaug

SEQ ID NO: 153753 - RNA, 64 nt, hsa
uguguauauauguauauauauaugugaguauauauacacacacacacacacacacacauauaua

SEQ ID NO: 153754 - RNA, 64 nt, hsa
uacacacacacacacacacacacauauauauauauacacacacgcacacauauauguugcugca

SEQ ID NO: 153755 - RNA, 64 nt, hsa
cuccauguucuucuaaaacauauacauauauacauacacacauacacauauucuucaggucucu

SEQ ID NO: 153756 - RNA, 64 nt, hsa
gagaccuagguucuuacacauaugcacacacgcauacacacaugcacgcacacacacauacaca

SEQ ID NO: 153757 - RNA, 64 nt, hsa
cacacacgcauacacacaugcacgcacacacacauacacacaugcacgcacgcacgcaugcaca

SEQ ID NO: 153758 - RNA, 64 nt, hsa
auaacaugugcccgaacauacacacacacauauguacacacacaccucagaguacucuuucuua

SEQ ID NO: 153759 - RNA, 64 nt, hsa
aaccugugacuguugaauaacaugugcccgaacauacacacacacauauguacacacacaccuc

SEQ ID NO: 153760 - RNA, 64 nt, hsa
guugcaguucagacaaauguaacacacacacacauacacacacacacacacacacagagacaca

SEQ ID NO: 153761 - RNA, 64 nt, hsa
uggcuccggggcauccuggauuuagaacauggacuacacacaauacagugguauaaacuuuuua

SEQ ID NO: 153762 - RNA, 64 nt, hsa
aaccucuguacacacacacacacacacacacauauacacacacucacagacccacacacauaca

SEQ ID NO: 153763 - RNA, 64 nt, hsa
cucgcagaagaaaguucucacuuauaaaccucuguacacacacacacacacacacacauauaca

SEQ ID NO: 153764 - RNA, 64 nt, hsa
uucuguaucguguguaguuaccauuauguaacuauacacacauacagcuacggauauaaugaaa

SEQ ID NO: 153765 - RNA, 64 nt, hsa
acauguuguaaauauauaucuguguauguguguauacacacacacagacacacacacacacaca

SEQ ID NO: 153766 - RNA, 64 nt, hsa
acauacauauguguguguauaguauauauauauauacacacauauauguuucuguguuccucuu

SEQ ID NO: 153767 - RNA, 64 nt, hsa
gugauauacauauauacauauauauguauauauauacacacacauacauauguguguguauagu

SEQ ID NO: 153768 - RNA, 64 nt, hsa
ucucaaaaguuaaaauuauauauauauauauauauacacacacacacauauauauauauauaua

SEQ ID NO: 153769 - RNA, 64 nt, hsa
gaauuuuuuaaagguauucauggugacucaggaauacacacauacacacacacacacacacaca

SEQ ID NO: 153770 - RNA, 64 nt, hsa
uaaagguauucauggugacucaggaauacacacauacacacacacacacacacacacacacaca

SEQ ID NO: 153771 - RNA, 64 nt, hsa
uacacacacacacacacacacacacacacacacauacacacauauaauuugaaagaggugagua

SEQ ID NO: 153772 - RNA, 64 nt, hsa
ucauuacucuuacacacacacacacacacacacauacacacacacacacuccuucucuaagauu

SEQ ID NO: 153773 - RNA, 64 nt, hsa
cucgagugcauugagacuuccagaucauuacucuuacacacacacacacacacacacauacaca

SEQ ID NO: 153774 - RNA, 64 nt, hsa
uccauaauggacuagaauauaaauuacaaacacauacacacaucuucacuuaaaguuguuuuaa

SEQ ID NO: 153775 - RNA, 64 nt, hsa
ccauguauacaccuguaugugcacauacacacauuacacacacacacagaaugcacauuucaca

SEQ ID NO: 153776 - RNA, 64 nt, hsa
aaauguuugccauguauacaccuguaugugcacauacacacauuacacacacacacagaaugca

SEQ ID NO: 153777 - RNA, 64 nt, hsa
guauguaccugugguauaccaaauagcauacauguacacacaaaaauguguguauacauuuggg

SEQ ID NO: 153778 - RNA, 64 nt, hsa
ggggccuucccucccaggucugugucugauagcauacacacacacauauauauacacacacaca

SEQ ID NO: 153779 - RNA, 64 nt, hsa
ucugugucugauagcauacacacacacauauauauacacacacacacacacacacacacacaca

SEQ ID NO: 153780 - RNA, 64 nt, hsa
cacacacacacacacacacacacacacacauacauacacacacacauauauauacacacacaca

SEQ ID NO: 153781 - RNA, 64 nt, hsa
cacacacacacauacauacacacacacauauauauacacacacacacacacacacacacacaca

SEQ ID NO: 153782 - RNA, 64 nt, hsa
augauaguauuuuuaugcacucuucucccacacauacacacacgugcauguaucugagcugcuc

SEQ ID NO: 153783 - RNA, 64 nt, hsa
agaagaccuauaccccggugccccugugucccacuacacacagaaaacccugugagauggccag

SEQ ID NO: 153784 - RNA, 64 nt, hsa
cauauuuagguauacacacacacacacacacacauacacacacacggaccaaaauacuuacacc

SEQ ID NO: 153785 - RNA, 64 nt, hsa
ugcagaaaccauuaagcaguuacauauuuagguauacacacacacacacacacacauacacaca

SEQ ID NO: 153786 - RNA, 64 nt, hsa
cauacauauauauauauauauacauauauauacauacacacauacauauaauuuuuuuuuuuuu

SEQ ID NO: 153787 - RNA, 64 nt, hsa
aaaaagcagggaaucucaaacuuuauuccauauauacacacacacacacacacacacacacaca

SEQ ID NO: 153788 - RNA, 64 nt, hsa
acguauacauauguguauauaugauacauacacauacacacacacgagagacagaaggaaagag

SEQ ID NO: 153789 - RNA, 64 nt, hsa
aaaagagagagaaguaccacuguggcuagauauauacacacacauauauauauggauggaugua

SEQ ID NO: 153790 - RNA, 64 nt, hsa
gaccugaaaugacucauagauaauacaaucuacuuacacacaugaauuucuuaaaaaaaucaau

SEQ ID NO: 153791 - RNA, 64 nt, hsa
cuccaaauccaauucagagguaauaugcuccaccuacacacaauuuuagaaauaaauuaaaaau

SEQ ID NO: 153792 - RNA, 64 nt, hsa
uguauguguauguguguguguguguguguauauauacacacacacacacauacuuaaaucuugc

SEQ ID NO: 153793 - RNA, 64 nt, hsa
uaauguaaaugggggcuucaauauauauauauaauacacacacacacacacaugcacacauacc

SEQ ID NO: 153794 - RNA, 64 nt, hsa
uauauauauauauacacacacacacacgcacauauacacacacacacacacacacacacacaca

SEQ ID NO: 153795 - RNA, 64 nt, hsa
aaaggcuccauauauauauauauauauauauauauacacacacacacacgcacauauacacaca

SEQ ID NO: 153796 - RNA, 64 nt, hsa
cuauaucuauauguguguauacauauauaauauauacacacagauacaaguguacacacacaca

SEQ ID NO: 153797 - RNA, 64 nt, hsa
auacauauauaauauauacacacagauacaaguguacacacacacaccacacaccacacacacc

SEQ ID NO: 153798 - RNA, 64 nt, hsa
uuauggaaacccauugacauuccaaaacaauauauacacacacacauaaaucagccaaaaucag

SEQ ID NO: 153799 - RNA, 64 nt, hsa
gcaauaagagucuggauuuuaaaaaacacaugcauacacacaauuaagagcucaugucuuagca

SEQ ID NO: 153800 - RNA, 64 nt, hsa
uaccccuuuaaacacacacacacacacaugcacauacacacacacacacacacacacacacagu

SEQ ID NO: 153801 - RNA, 64 nt, hsa
gugugugcauuuauguaugcucuguggcuacauauacacacacguauuuccuugagauaaacaa

SEQ ID NO: 153802 - RNA, 64 nt, hsa
aaaaaauuuauauauacauuguguguguguguaauacacacacacaacccccuauaccuggaag

SEQ ID NO: 153803 - RNA, 64 nt, hsa
aacauacaugcaugcacacauacauacauauguauacacacacauaauuugaaaacugauuggc

SEQ ID NO: 153804 - RNA, 64 nt, hsa
gccuggagaaggccuuuuacacacacacaacacauacacacacacacacacacacacauaucac

SEQ ID NO: 153805 - RNA, 64 nt, hsa
ccaaggggcccuuccuggccuggagaaggccuuuuacacacacacaacacauacacacacacac

SEQ ID NO: 153806 - RNA, 64 nt, hsa
cacaggcacacccaccaguacacacgcgugcgcauacacacauuuugguuugacgcccuguuuu

SEQ ID NO: 153807 - RNA, 64 nt, hsa
caaccugggagcaucuggcaggcaggggggcagguacacacacacccacaggcacacccaccag

SEQ ID NO: 153808 - RNA, 64 nt, hsa
augaaugcgaauuuucagauuugauuuuauucucuacacacaccucuucuuuucuugguauuuc

SEQ ID NO: 153809 - RNA, 64 nt, hsa
caaacguguacacaagugugagcuccuacacgcauacacacacacacguguacaugcaccaaag

SEQ ID NO: 153810 - RNA, 64 nt, hsa
ugaacagcguaaguuccuacacacggacgugugauacacacaugcauguacagguaagcacaca

SEQ ID NO: 153811 - RNA, 64 nt, hsa
gugcacacaucguacacaugugagcucccacacguacacacagaugcacauggacacaccccaa

SEQ ID NO: 153812 - RNA, 64 nt, hsa
gcacauggacacaccccaaacacgcacaggcuccuacacacaugcacacacguguacaccacaa

SEQ ID NO: 153813 - RNA, 64 nt, hsa
cacaaacacaugcgcaggcuccugcaggcgugaauacacacaugcacacacauauacacacaug

SEQ ID NO: 153814 - RNA, 64 nt, hsa
ccugcaggcgugaauacacacaugcacacacauauacacacaugugccacaaacaagugcacac

SEQ ID NO: 153815 - RNA, 64 nt, hsa
uuuaauguacaucacacacacacucacacucacauacacacacacacacacacucugacugucu

SEQ ID NO: 153816 - RNA, 64 nt, hsa
uuacaggcgugagacagacacacauacacacacauacacacacacagagucuuuauugcagaag

SEQ ID NO: 153817 - RNA, 64 nt, hsa
agugcuaggauuacaggcgugagacagacacacauacacacacauacacacacacagagucuuu

SEQ ID NO: 153818 - RNA, 64 nt, hsa
ucuaaaauuuguccuugucuagguugagaacuuuuacacacacuaagauaaagauagaaaucug

SEQ ID NO: 153819 - RNA, 64 nt, hsa
cacguguauaugaggauguauguguauauguuuauacacacaggagucagugcccauguguaug

SEQ ID NO: 153820 - RNA, 64 nt, hsa
aaauauuacucugccugucaaguuuuuauaccuguacacacacagacacacaagcagacacaca

SEQ ID NO: 153821 - RNA, 64 nt, hsa
uagggagccuccccucccuguaucacccccucccuacacacacacacacacacacacacacaca

SEQ ID NO: 153822 - RNA, 64 nt, hsa
aacacagaccccuagggauuuaaagggacaccccuacacacacccaggcccaugccaaggccuc

SEQ ID NO: 153823 - RNA, 64 nt, hsa
cgcucgugcacaggcacgcagaugcgcucacacguacacacacacaaaugcacgcccacuugca

SEQ ID NO: 153824 - RNA, 64 nt, hsa
caugcacacucacgcucacacaugcugucacgcauacacacacgcacauacuccugcacauguu

SEQ ID NO: 153825 - RNA, 64 nt, hsa
uuucaccacaugugcacaugcacgugugugcacguacacacacauacacacacacgcgugcaca

SEQ ID NO: 153826 - RNA, 64 nt, hsa
ugugcacaugcacgugugugcacguacacacacauacacacacacgcgugcacacaccagagcc

SEQ ID NO: 153827 - RNA, 64 nt, hsa
auuauucuggauguagauugagcuuauuaaauguuacacacaaaguauucaugcauggugaauc

SEQ ID NO: 153828 - RNA, 64 nt, hsa
aaaagacaaagggugagaguuagcguccuguagauacacacagagacuaggccguauauuaacu

SEQ ID NO: 153829 - RNA, 64 nt, hsa
cacacacacacacacacacacacauauauacauauacacacacacacacacacacacacacaca

SEQ ID NO: 153830 - RNA, 64 nt, hsa
guauauauauauauauauuauauauauauauauauacacacacacacacacacacacacacaua

SEQ ID NO: 153831 - RNA, 64 nt, hsa
cuccuucuccaucucacccucccucucucacacauacacacacaaacacauacacacaacacua

SEQ ID NO: 153832 - RNA, 64 nt, hsa
cccucccucucucacacauacacacacaaacacauacacacaacacuaagugccuagacuuuaa

SEQ ID NO: 153833 - RNA, 64 nt, hsa
gauauuguguacaccaugcccauguauauacaaguacacacagauguacacacagauguacaca

SEQ ID NO: 153834 - RNA, 64 nt, hsa
accaugcccauguauauacaaguacacacagauguacacacagauguacacaugcuccagcccc

SEQ ID NO: 153835 - RNA, 64 nt, hsa
guauauaaagcgcauguagagcuacagauccagauacacacacuuguguauauauguacauaca

SEQ ID NO: 153836 - RNA, 64 nt, hsa
guguugacguuucccagaugugugcuugugaugauacacacacaugcacagguucucaaccacg

SEQ ID NO: 153837 - RNA, 64 nt, hsa
uguguguguguguguguauauguguuuauagagauacacacacauauauauguguguauauaua

SEQ ID NO: 153838 - RNA, 64 nt, hsa
uauauguguguauauauauacacauacauauauauacacacacgcauuugcacagacacacaca

SEQ ID NO: 153839 - RNA, 64 nt, hsa
gugauucucaaucucuuugaauuuuacuuacauuuacacacacacgcacacacauauguauaua

SEQ ID NO: 153840 - RNA, 64 nt, hsa
uucucaaccucuuugaauuuuacuuauaauuacauacacacacacacugcuacuuauauaaaug

SEQ ID NO: 153841 - RNA, 64 nt, hsa
cacacacacacacacagagacccuugaguacacauacacacacacacacacagacacacacaca

SEQ ID NO: 153842 - RNA, 64 nt, hsa
ggaccuuuuuucggagaagcacuguugaaauuuauacacacacacacacacagagacccuugag

SEQ ID NO: 153843 - RNA, 64 nt, hsa
ucugcccacacacacacaaacacauacacacacauacacacacacagacacacacacacgaaac

SEQ ID NO: 153844 - RNA, 64 nt, hsa
uaaaagaaauucugcccacacacacacaaacacauacacacacauacacacacacagacacaca

SEQ ID NO: 153845 - RNA, 64 nt, hsa
uuucucucugcaaaccuuuaguuuucugaugaucuacacacacacauacacacacacacacaca

SEQ ID NO: 153846 - RNA, 64 nt, hsa
aaccuuuaguuuucugaugaucuacacacacacauacacacacacacacacacacgugcacaca

SEQ ID NO: 153847 - RNA, 64 nt, hsa
cccauccccuaucuacuuaauccagauagccuggauuuaacaaaaccaauaguauaaaaaugug

SEQ ID NO: 153848 - RNA, 64 nt, hsa
guaaugaaguuuaaaugcuuguuuggaaaacuuuauuuaacaguuuagaaggcuugauagaaag

SEQ ID NO: 153849 - RNA, 64 nt, hsa
auaauucauugugguaagaaugauugaaaugcagauuuaacaaucuuauaaucuauugaaugcc

SEQ ID NO: 153850 - RNA, 64 nt, hsa
gugaagaaaguauuuaaauccaacuuuugaacagauuuaacaaacaugaggaacuuuuuuauuu

SEQ ID NO: 153851 - RNA, 64 nt, hsa
uagaaaaugaauuguucacuacaauuagagaaucauuuaacauccugaccugguaagcugccac

SEQ ID NO: 153852 - RNA, 64 nt, hsa
uucuaugacccgugucuucauuuuuggcacucuuauuuaacaaugccacaccugaagcacuugg

SEQ ID NO: 153853 - RNA, 64 nt, hsa
agaaggaagaagagacguuaagaauggcagauaaauuuaacagguaaugauacagagauuggcc

SEQ ID NO: 153854 - RNA, 64 nt, hsa
auuauuuuaggucauaaagguuauaacaaaauacauuuaacauugcuuucuuuuuagcaagagg

SEQ ID NO: 153855 - RNA, 64 nt, hsa
uuuuuuuauugcuuucauuucccaguuaaaugauauuuaacaccugggaaaacaggacagcuca

SEQ ID NO: 153856 - RNA, 64 nt, hsa
guauuugcagcuagagguuacugucacaucauagauuuaacauuuaccaucuucaaaguacaaa

SEQ ID NO: 153857 - RNA, 64 nt, hsa
gacaguauuauauguacauaucuauucuaauuaaauuuaacaaucaaaggauuggauuacuuuu

SEQ ID NO: 153858 - RNA, 64 nt, hsa
gacccugggcuugucugggcagagacagaagcugauuuaacagcauagagcacagcgcccuacu

SEQ ID NO: 153859 - RNA, 64 nt, hsa
gauauuuuggagauaaacaagacaaacugagucaauuuaacaauccugacaugcucccuccaau

SEQ ID NO: 153860 - RNA, 64 nt, hsa
gaaaguuuuauuuaaauauuaauauuaaucaagaauuuaacagauauaugugacagaaaucuaa

SEQ ID NO: 153861 - RNA, 64 nt, hsa
uuaaaguuucaacaacaaaccccaagguuuauuuauuuaacaacagguauucguugaggugccu

SEQ ID NO: 153862 - RNA, 64 nt, hsa
guauuccuuuaaaauauuguuuuccuacaggccuauuuaacaagauguuucauuuuacuguaua

SEQ ID NO: 153863 - RNA, 64 nt, hsa
augucucacuuuacuuucaaguaauauuggugcuauuuaacauuuuacaguaaauguuacuucu

SEQ ID NO: 153864 - RNA, 64 nt, hsa
uucagagaggagaauacaacaucuuaguccagacauuuaacauacugcauuucaaguacaugug

SEQ ID NO: 153865 - RNA, 64 nt, hsa
ccaaaccaugacaaaaacuacaaguuuauuuauaauuuaacaacucagcugaaaauauaacggg

SEQ ID NO: 153866 - RNA, 64 nt, hsa
gagaaagagcaauugauaaaguaaaugagguaaaauuuaacaauaaucugagcaaaagguauau

SEQ ID NO: 153867 - RNA, 64 nt, hsa
uaaagagagcaauugauaaggcaaauaagguaacauuuaacaauaaucugauacacauaaauag

SEQ ID NO: 153868 - RNA, 64 nt, hsa
cguaugucaucucagggagcuuaaaaugggcuugauuuaacauuguuuuuguguuauuuuugcu

SEQ ID NO: 153869 - RNA, 64 nt, hsa
ucucagaacauuuagccugcaguugggcaaaaccauuuaacacaaagccuauuuuauaaugaag

SEQ ID NO: 153870 - RNA, 64 nt, hsa
aaaguucagguaugacaaaguauagaauuuauucauuuaacauauucacauuuaguuuauguuu

SEQ ID NO: 153871 - RNA, 64 nt, hsa
acuguuuuaaaaguuccucucuauuuuauuuuuuauuuaacaugaaguaaaauugaaauuucuu

SEQ ID NO: 153872 - RNA, 64 nt, hsa
aguuaacucuacuuacuguuuuaacauacauuugauuuaacaaauuguucagcauaacacuucu

SEQ ID NO: 153873 - RNA, 64 nt, hsa
uucuguuugauuauauuuccuacacaaacuucuuauuuaacaggauagccuacuaaauuaaaug

SEQ ID NO: 153874 - RNA, 64 nt, hsa
uuaucccccagaauccuucaccuuucaaggaguuauuuaacaaugagcccagugacucaauagg

SEQ ID NO: 153875 - RNA, 64 nt, hsa
gcauguaauaaaacaagggccuaucuccuuuaaaauuuaacauuccauguaacuuuucugacuu

SEQ ID NO: 153876 - RNA, 64 nt, hsa
gguggauauaguuuguaaacaaugugaauaaaguauuuaacauguucaacugucuguguaucau

SEQ ID NO: 153877 - RNA, 64 nt, hsa
aaagagcuaagccaucaagcugggacuuaauuggauuuaacauagguucacagaaaguuuccua

SEQ ID NO: 153878 - RNA, 64 nt, hsa
cauaaaagccacugcuuuuaacaucccauuguacauuuaacacauaaaugguguuaacauccca

SEQ ID NO: 153879 - RNA, 64 nt, hsa
uuaacacauaaaugguguuaacaucccauuguacauuuaacacauaaauggccauugucuuugu

SEQ ID NO: 153880 - RNA, 64 nt, hsa
caagaaguguauauuuucaaacaauuuuuuaaugauuuaacaauuuuuguaaaucauuuucagg

SEQ ID NO: 153881 - RNA, 64 nt, hsa
acaaggccuaauuugcaguaacuauugcuguuuuauuuaacaaugccuuguugcuuuguaugca

SEQ ID NO: 153882 - RNA, 64 nt, hsa
uucuguucaggaaaucuuguaguuuauuguuguuauuuaacaguauuaaguggauuuuuguaua

SEQ ID NO: 153883 - RNA, 64 nt, hsa
ggaaucauugcugcuaaauaacuacugucuguuuauuuaacacaacaauugaaugccugaagaa

SEQ ID NO: 153884 - RNA, 64 nt, hsa
cauuguaauuuaacaugguuaaugguuaauuacuauuuaacacacauuucaaaugaauauuauu

SEQ ID NO: 153885 - RNA, 64 nt, hsa
aagguauauagcuuauuuguugcuuuucauuguaauuuaacaugguuaaugguuaauuacuauu

SEQ ID NO: 153886 - RNA, 64 nt, hsa
aauccuaccucaaaauuuaacaguuaccugagagauuuaacauuaucuaguucauugaaucauu

SEQ ID NO: 153887 - RNA, 64 nt, hsa
gaaccccugaaguauuuuuuaauccuaccucaaaauuuaacaguuaccugagagauuuaacauu

SEQ ID NO: 153888 - RNA, 64 nt, hsa
agaauauuuguuguugcaauuuucacauaagaaaauuuaacaguugugucauguuguuucuguc

SEQ ID NO: 153889 - RNA, 64 nt, hsa
aaauauauguuacauauuauauuuaaacauacauauuuaacauuuuuuacauaucuaucaauau

SEQ ID NO: 153890 - RNA, 64 nt, hsa
uucaccauauugcaugugcuauauagccuuuuaaauuuaacacuauuuucagucgcauugaugc

SEQ ID NO: 153891 - RNA, 64 nt, hsa
uguaacacuuugacaauacuaaacucucauaagcauuuaacacuucagauguuuaacauuucug

SEQ ID NO: 153892 - RNA, 64 nt, hsa
cauuaaauguauuuugcaaagccuaaaguuauauauuuaacaguuuuuauauguuguauauuug

SEQ ID NO: 153893 - RNA, 64 nt, hsa
aguuuuuauauguuguauauuuguagaaaauccuauuuaacaauuaacguggcagucccggccg

SEQ ID NO: 153894 - RNA, 64 nt, hsa
uguggauaugaugacguuucuuuaaaauguauguauuuaacaaauacuuaauuguauuaagguc

SEQ ID NO: 153895 - RNA, 64 nt, hsa
aaacauugggauccuccaaaggccugccccauguauuuaacaguaauacaggaagcauggcagg

SEQ ID NO: 153896 - RNA, 64 nt, hsa
uuuccaauuuuagaaaaucaagcagguuagagaaaauagagaugaauuaggggacacugucuua

SEQ ID NO: 153897 - RNA, 64 nt, hsa
ugaauaauaguaugaguaaugcuuaagggaguuuaauagagaaggaaagcuuuggcaguguuuu

SEQ ID NO: 153898 - RNA, 64 nt, hsa
acuuacuauaaccacaucauaagaauucuggaaaaauagagaacaaaaggaaaagauuguuacc

SEQ ID NO: 153899 - RNA, 64 nt, hsa
aaauaccuuuuuaaaaauuauuuuauuauuuuuuaauagagacuauguugccuaggcuggucuu

SEQ ID NO: 153900 - RNA, 64 nt, hsa
cuggcacaaaaacacacguagacugauggaacagaauagagaauuuagaaaugagaccacacac

SEQ ID NO: 153901 - RNA, 64 nt, hsa
cccaccaccacgccuggcuaauuuuuguauuuuuaauagagacgggguuucaccauguuggcca

SEQ ID NO: 153902 - RNA, 64 nt, hsa
uguucgaagacacauuuguaaauuuucaagcagcaauagagaaaaaaauucaugcaucucaaca

SEQ ID NO: 153903 - RNA, 64 nt, hsa
ggacuuaaaacaaaccuugugcucuuuucaagaaaauagagaucuuaugucaaguucuacauca

SEQ ID NO: 153904 - RNA, 64 nt, hsa
ugccacucuguuaauuucuuguuccagacauuuuaauagagauugcuugagccauguuguuuga

SEQ ID NO: 153905 - RNA, 64 nt, hsa
auguuguuggcucaacuguuuuuuuuuuuucccuaauagagauggaguaucgcuauguugcuca

SEQ ID NO: 153906 - RNA, 64 nt, hsa
augugugugauuuacuuuucugaucucuuugagaaauagagaaauauaaaaguguguucuuaac

SEQ ID NO: 153907 - RNA, 64 nt, hsa
augaagcaugaauuauuuucauauaaauauagaaaauagagaaaaggcuaugccuguaauuuuu

SEQ ID NO: 153908 - RNA, 64 nt, hsa
uucaauaagcuauuuuuuuucuuuucuuauuuuaaauagagagagagucuugcuauguuuccca

SEQ ID NO: 153909 - RNA, 64 nt, hsa
gcccagcgcugcggccccgggaagggccacugcgaauagagaggaagcuggaaaaguuccuggg

SEQ ID NO: 153910 - RNA, 64 nt, hsa
ccuaccaccaugcccagcuaauuuuuguauuuuuaauagagaugggguuucaccauguuggcca

SEQ ID NO: 153911 - RNA, 64 nt, hsa
aaaaaaaaaaaaaaaaagaauauauugacggaagaauagagaggaggcuugaaggaaccagcaa

SEQ ID NO: 153912 - RNA, 64 nt, hsa
gauguuuuuuuuaaugguauaacuaucuugauuuucacugaaauuauaugguucugucacuacu

SEQ ID NO: 153913 - RNA, 64 nt, hsa
cuccauuuguuacgugagagaaugcgucugcugaucacugaagugucccuuuuagcuucugauu

SEQ ID NO: 153914 - RNA, 64 nt, hsa
guauauacucaugucccccagauuccaacauuucucacugaaagggggcauguaugcaaaccuc

SEQ ID NO: 153915 - RNA, 64 nt, hsa
accugguguguuucuugggaucaugguacauuuaucacugaauuaagccaucagggaaaaaaca

SEQ ID NO: 153916 - RNA, 64 nt, hsa
uccuaaauguuuuaauuguaccauaguguuuugcucacugaagaagcuucuuauggaccuugca

SEQ ID NO: 153917 - RNA, 64 nt, hsa
auuaguugauuuuuucauuuuguuagagguauuuucacugaacaaggucaauugguuaccucag

SEQ ID NO: 153918 - RNA, 64 nt, hsa
acucacccuccacagcacucagucccaucgacguucacugaacauuggcuuucucuuucugacu

SEQ ID NO: 153919 - RNA, 64 nt, hsa
uuuguuuuuuucuuacugaaaauggaccugccuuucacugaauuuucugagggcagagucuuag

SEQ ID NO: 153920 - RNA, 64 nt, hsa
acugaaauugaagaugaggaaaguagcuguacacucacugaaugcucccccuuacuagauauuu

SEQ ID NO: 153921 - RNA, 64 nt, hsa
ccuguuuugaguauggaagccagugccuguguacucacugaaauugaagaugaggaaaguagcu

SEQ ID NO: 153922 - RNA, 64 nt, hsa
agacucccgaguagcugggacuacaggcacacagucacugaagcaggcccuguuugcaauucac

SEQ ID NO: 153923 - RNA, 64 nt, hsa
guaccaagugcuggugccagccuguuaccuguucucacugaaaagucuggcuaaugcucuugug

SEQ ID NO: 153924 - RNA, 64 nt, hsa
aagucauacaugcuuaagcuaacaaaaacuaaucucacugaauagacauguaccaagcuaaaua

SEQ ID NO: 153925 - RNA, 64 nt, hsa
uugguuuuuccauaauuuacuuaaccaauccuugucacugaacauuaaggcugcuuucacacug

SEQ ID NO: 153926 - RNA, 64 nt, hsa
cauccaugcacagccacuaucauacccuuuauucucacugaaaggcagaacucagaaccuguua

SEQ ID NO: 153927 - RNA, 64 nt, hsa
agugaggggcccuuugcauagcucuccuucccccucacugaagcuggguagccuauugggguug

SEQ ID NO: 153928 - RNA, 64 nt, hsa
aaauuacauguuucacugaaaccagugaaauauuucacugaaacagugaaauaaaaugaaaaca

SEQ ID NO: 153929 - RNA, 64 nt, hsa
uuuauugagaauaaauuuucuaaaauuacauguuucacugaaaccagugaaauauuucacugaa

SEQ ID NO: 153930 - RNA, 64 nt, hsa
agcugaggggauguggggccccaaacucauuaauucacugaagacacaggucccacagggagcg

SEQ ID NO: 153931 - RNA, 64 nt, hsa
accagucugcaacccugcucuaugcugacccuugucacugaacccugaucuagacuuauaugaa

SEQ ID NO: 153932 - RNA, 64 nt, hsa
cucauaaaggugccacucaguuuuagccaugucuucacugaaauugcaaaaguacuuuuaggga

SEQ ID NO: 153933 - RNA, 64 nt, hsa
ugagagguaggacuggauuaaaugaccacugaacucacugaauccagaucauucauaucaucaa

SEQ ID NO: 153934 - RNA, 64 nt, hsa
aucuccacaaaugccauugggagguuuugaaaaaccaguuaauuuaauagcucaaaauuguccc

SEQ ID NO: 153935 - RNA, 64 nt, hsa
acuuugauuacuuuggucucaauuauuugucaccccaguuaaacaugaaagguugcagugcuuc

SEQ ID NO: 153936 - RNA, 64 nt, hsa
gaaagcucugccucuggcuuuccggucauggguuccaguuaauucaugccucccauggaccuau

SEQ ID NO: 153937 - RNA, 64 nt, hsa
uuuggaaaaguggauuucauucauuucugauuguccaguuaagugaucaccaaaggacugagaa

SEQ ID NO: 153938 - RNA, 64 nt, hsa
ugugguuuugaaguuuguacuuucucugugggugccaguuaaauauuggagagcaaggaaugug

SEQ ID NO: 153939 - RNA, 64 nt, hsa
aagacccugucucagaaaaaaagaaaauucaaggccaguuaagacaaaaugcuaugacuuugaa

SEQ ID NO: 153940 - RNA, 64 nt, hsa
agccuguuuggaugauggaugccauuccuuuugcccaguuaaauguucaccaaucauuuuaacu

SEQ ID NO: 153941 - RNA, 64 nt, hsa
guggaauguauccuuuuuuagguuucccugcuuuccaguuaauuuuuaaaaugguagcgcuuug

SEQ ID NO: 153942 - RNA, 64 nt, hsa
cuguugaaaaacuaccugggaggagugaguuccuccaguuaaauguggcuguagauguuggagg

SEQ ID NO: 153943 - RNA, 64 nt, hsa
uguaauuggggaacauuaaaacaguaacugacauccaguuaaagccacgaucgucagcaauucu

SEQ ID NO: 153944 - RNA, 64 nt, hsa
uuugcuuacagcauaugguaaccaagguuagaugccaguuaaaauuccuuagaaauuggaugag

SEQ ID NO: 153945 - RNA, 64 nt, hsa
cucuauugcuuggugucauuuauaggaagcacugccaguuaaagagcauuagaagaggugguug

SEQ ID NO: 153946 - RNA, 64 nt, hsa
gccagcaauuggcugggguccaggaaacaaagcaaaagcacaauaugugaaugugcugauugug

SEQ ID NO: 153947 - RNA, 64 nt, hsa
aaauuuauguuggcgauagccaagaccacaagcaaaagcacauacuggaaaugaugaguuagaa

SEQ ID NO: 153948 - RNA, 64 nt, hsa
gagcacaaacaacuuuguugaggauuuuggaaggaaagcacaacuggguccuuuauucauuucu

SEQ ID NO: 153949 - RNA, 64 nt, hsa
auuauauuugcaaacuucuuuauaaaaggugaaaaaagcacacaaaagagagggugucuucaua

SEQ ID NO: 153950 - RNA, 64 nt, hsa
uggcacccagagaaaaggagcauccuuaccuccaaaagcacagggacacaaagaggaaucuaaa

SEQ ID NO: 153951 - RNA, 64 nt, hsa
aaacguauuucacuaacucuggcuccuucuccauaaagcacauuuuaaggaacaagaauugcua

SEQ ID NO: 153952 - RNA, 64 nt, hsa
ugaagcagugucgccgucccucugccuugcacaaaaagcacaagcauuccuuagcagcucaggc

SEQ ID NO: 153953 - RNA, 64 nt, hsa
ggccccaaagcccagcccggcugaccaacauucaaaagcacaaacccuggggacucugcuuggc

SEQ ID NO: 153954 - RNA, 64 nt, hsa
auauauauauauauaauucaaagcacaauaauugaaagcacaauaauugacagaaaaauacagg

SEQ ID NO: 153955 - RNA, 64 nt, hsa
uacacacacacacauauauauauauauauaauucaaagcacaauaauugaaagcacaauaauug

SEQ ID NO: 153956 - RNA, 64 nt, hsa
ugguagacuuuuauuaaaacauauauggauguggaaagcacauauauuaaugcagucaucccuu

SEQ ID NO: 153957 - RNA, 64 nt, hsa
gaagaugaugcugcuuuuuacaaagcaucguuuuaaagcacauggccuuuuuuuuuuaauuauu

SEQ ID NO: 153958 - RNA, 64 nt, hsa
gucuuuccuacaacauuuuagcuuuugcccaucuaaagcacaauuaaaauuaggcuacauucuu

SEQ ID NO: 153959 - RNA, 64 nt, hsa
aagauacuuuaagagaaauacaaaggaaauuucuaaagcacaagaaauagugagguaguaguua

SEQ ID NO: 153960 - RNA, 64 nt, hsa
aguaaauggccucuaguagaugauaagccuaaaaaaagcacaauuauuaaaacaaacagaucca

SEQ ID NO: 153961 - RNA, 64 nt, hsa
uuaaaagcaggacauucccuaccuuuaauagugcaaagcacaguuucagcaauggcuacaugac

SEQ ID NO: 153962 - RNA, 64 nt, hsa
guuuauguuauuaaucugaaugcaacagaagacaaaagcacaggcaugcacacacacagaaccc

SEQ ID NO: 153963 - RNA, 64 nt, hsa
acugaagaacugcagccaagaccuuaauuccaggaaagcacagaggacaaaguuaauucaaaaa

SEQ ID NO: 153964 - RNA, 64 nt, hsa
uuacaauggaguaaccgacaauauauuuauuuauaaagcacauauucauaauaacgagaagaau

SEQ ID NO: 153965 - RNA, 64 nt, hsa
uugaccaagcaccaugaucccuaggggcaugagaaaagcacauaauggauguggaugugauagg

SEQ ID NO: 153966 - RNA, 64 nt, hsa
acaagaagacacaguuuuagaaucuacugcugcuaaagcacauuaaaaacaaauccugguuuuu

SEQ ID NO: 153967 - RNA, 64 nt, hsa
ugauguaugcgaacauaugugauuuugggguacuaaagcacaaaaaaaucccccauaaaauaaa

SEQ ID NO: 153968 - RNA, 64 nt, hsa
guuguuguuuucauuucuguuauaaguaaaacuaaaagcacagaauggugggaaaggggcuaua

SEQ ID NO: 153969 - RNA, 64 nt, hsa
gauauacaaaucucccuguaggaaaugugaaagaaaagcacaacaaaacuaggguuuuuuguuc

SEQ ID NO: 153970 - RNA, 64 nt, hsa
auguguagauauaacuuaaauauggagcuuucaaaaagcacaaauaggcuggacaugguggcuc

SEQ ID NO: 153971 - RNA, 64 nt, hsa
aaagggcaaaauucuagagagugguaaaucucagaaagcacaagcauaaaaugcagcucugggg

SEQ ID NO: 153972 - RNA, 64 nt, hsa
acccacuucugcugaaaugcauugggagccugugaaagcacaaagcuggaggcugggcgccugc

SEQ ID NO: 153973 - RNA, 64 nt, hsa
ccuccacuuuugugcauuuaucuuuguuaggaucaaagcacaagcucaccaucaaugagccugg

SEQ ID NO: 153974 - RNA, 64 nt, hsa
gugcagccaggagggcucuugggauuuccuuuccaaagcacaaaaauacugggacccaagaaga

SEQ ID NO: 153975 - RNA, 64 nt, hsa
aagagggcuaagauacguuuucugucuugagcugaaagcacagucuacucuccuucguuuuguc

SEQ ID NO: 153976 - RNA, 64 nt, hsa
gggaguaagcuugggacuugaaucauugagaaauaaagcacauuugacucuaagaaguauguag

SEQ ID NO: 153977 - RNA, 64 nt, hsa
ccaauauguugaaagcguuuuguuaucuucuaucaaagcacauaaaaccaguuauaggacacag

SEQ ID NO: 153978 - RNA, 64 nt, hsa
gcagggacagaccagaccagacccaggagucuccaaagcacagaguggcaaacaaaacccgagc

SEQ ID NO: 153979 - RNA, 64 nt, hsa
ggaggugcccuauaaaccagaagagaaaauacugaaagcacaggggcagggacagaccagacca

SEQ ID NO: 153980 - RNA, 64 nt, hsa
gccucuaccuuacgagagagcuaugcuccuccucaaagcacaaucauccugugacagaaguugc

SEQ ID NO: 153981 - RNA, 64 nt, hsa
gagcugcauauugcauuguuagccacucuuggaaaaagcacaaccuaacaaacauguuuacuau

SEQ ID NO: 153982 - RNA, 64 nt, hsa
guauuaaauuauagcauuugcaaauauuaauauaaaagcacaacaaaauguaguggaaaaugac

SEQ ID NO: 153983 - RNA, 64 nt, hsa
aaagaaaaaaaaaagagcuauagaaauccuugucaaagcacaaagucauggcugguuuuguuuc

SEQ ID NO: 153984 - RNA, 64 nt, hsa
cugacugucaagcauccccuguccccaaguuccaaaagcacagacucaaagggaaaccccccag

SEQ ID NO: 153985 - RNA, 64 nt, hsa
ccccaucugacaagaaagccuggagcgaggaaggaaagcacagcgaacccaauggguaacgugg

SEQ ID NO: 153986 - RNA, 64 nt, hsa
gggcuauauauacuggaaguugaagguuaaaggaaaagcacaagaaacuuuggaagcacuuuuu

SEQ ID NO: 153987 - RNA, 64 nt, hsa
caggucuuugccauaacuuuaugaagugcuacagaaagcacaaagaauugauucauguucauca

SEQ ID NO: 153988 - RNA, 64 nt, hsa
gcugguuucuuuucuguggggcccagacuucuguaaagcacacagauguggguaagaugaaaaa

SEQ ID NO: 153989 - RNA, 64 nt, hsa
cucccucucuuccccacccuucucucuucccugcaaagcacaaccuguaccccaggggcgccgg

SEQ ID NO: 153990 - RNA, 64 nt, hsa
ccggccugagugggggauauugacacccccagcuaaagcacaagcaccuuagucaccccuccuc

SEQ ID NO: 153991 - RNA, 64 nt, hsa
uccuggccugccaccccaccccagcguuuaccccaaagcacaaugcccuggucacuuggcaagc

SEQ ID NO: 153992 - RNA, 64 nt, hsa
aagcugaggacagggugugagcgccacaucucugaaagcacaggagacacugugcuauaaaucc

SEQ ID NO: 153993 - RNA, 64 nt, hsa
ggccugaaggaggugagagaagaccucugugaggaaagcacacagucaccuucucggcaacuaa

SEQ ID NO: 153994 - RNA, 64 nt, hsa
gagugaccagagcaaguaugaaggugaugcugccaaagcacaagccaguuucuugggaaaauuc

SEQ ID NO: 153995 - RNA, 64 nt, hsa
uuuuuagaguuucuuuuuuugaucacuuacuuucaaagcacacagucaaacaagguuaugccaa

SEQ ID NO: 153996 - RNA, 64 nt, hsa
aacggaucaugucuguacauuguguaaugaaugaaaagcacauaaauguaaucuacuuugaacu

SEQ ID NO: 153997 - RNA, 64 nt, hsa
aguaacugaucuuuugucuaaggauuuuuaccugaaagcacaauguauugagucucuugaaaau

SEQ ID NO: 153998 - RNA, 64 nt, hsa; identical to SEQ ID NO: 125533

SEQ ID NO: 153999 - RNA, 64 nt, hsa; identical to SEQ ID NO: 125534

SEQ ID NO: 154000 - RNA, 64 nt, hsa; identical to SEQ ID NO: 125535

SEQ ID NO: 154001 - RNA, 64 nt, hsa; identical to SEQ ID NO: 125536

SEQ ID NO: 154002 - RNA, 64 nt, hsa; identical to SEQ ID NO: 125537

SEQ ID NO: 154003 - RNA, 64 nt, hsa; identical to SEQ ID NO: 125538

SEQ ID NO: 154004 - RNA, 64 nt, hsa; identical to SEQ ID NO: 125539

SEQ ID NO: 154005 - RNA, 64 nt, hsa; identical to SEQ ID NO: 125540

SEQ ID NO: 154006 - RNA, 64 nt, hsa; identical to SEQ ID NO: 125541

SEQ ID NO: 154007 - RNA, 64 nt, hsa; identical to SEQ ID NO: 125542

SEQ ID NO: 154008 - RNA, 64 nt, hsa; identical to SEQ ID NO: 125543

SEQ ID NO: 154009 - RNA, 64 nt, hsa; identical to SEQ ID NO: 125544

SEQ ID NO: 154010 - RNA, 64 nt, hsa; identical to SEQ ID NO: 125545

SEQ ID NO: 154011 - RNA, 64 nt, hsa; identical to SEQ ID NO: 125546

SEQ ID NO: 154012 - RNA, 64 nt, hsa; identical to SEQ ID NO: 125547

SEQ ID NO: 154013 - RNA, 64 nt, hsa; identical to SEQ ID NO: 125548

SEQ ID NO: 154014 - RNA, 64 nt, hsa; identical to SEQ ID NO: 125549

SEQ ID NO: 154015 - RNA, 64 nt, hsa; identical to SEQ ID NO: 125550

SEQ ID NO: 154016 - RNA, 64 nt, hsa; identical to SEQ ID NO: 125551

SEQ ID NO: 154017 - RNA, 64 nt, hsa; identical to SEQ ID NO: 125552

SEQ ID NO: 154018 - RNA, 64 nt, hsa; identical to SEQ ID NO: 125553

SEQ ID NO: 154019 - RNA, 64 nt, hsa; identical to SEQ ID NO: 125554

SEQ ID NO: 154020 - RNA, 64 nt, hsa; identical to SEQ ID NO: 125555

SEQ ID NO: 154021 - RNA, 64 nt, hsa; identical to SEQ ID NO: 125556

SEQ ID NO: 154022 - RNA, 64 nt, hsa; identical to SEQ ID NO: 125557

SEQ ID NO: 154023 - RNA, 64 nt, hsa; identical to SEQ ID NO: 125558

SEQ ID NO: 154024 - RNA, 64 nt, hsa; identical to SEQ ID NO: 125559

SEQ ID NO: 154025 - RNA, 64 nt, hsa; identical to SEQ ID NO: 125560

SEQ ID NO: 154026 - RNA, 64 nt, hsa; identical to SEQ ID NO: 125561

SEQ ID NO: 154027 - RNA, 64 nt, hsa; identical to SEQ ID NO: 125562

SEQ ID NO: 154028 - RNA, 64 nt, hsa; identical to SEQ ID NO: 125563

SEQ ID NO: 154029 - RNA, 64 nt, hsa; identical to SEQ ID NO: 125564

SEQ ID NO: 154030 - RNA, 64 nt, hsa; identical to SEQ ID NO: 125565

SEQ ID NO: 154031 - RNA, 64 nt, hsa; identical to SEQ ID NO: 125566

SEQ ID NO: 154032 - RNA, 64 nt, hsa; identical to SEQ ID NO: 125567

SEQ ID NO: 154033 - RNA, 64 nt, hsa; identical to SEQ ID NO: 125568

SEQ ID NO: 154034 - RNA, 64 nt, hsa; identical to SEQ ID NO: 81753

SEQ ID NO: 154035 - RNA, 64 nt, hsa; identical to SEQ ID NO: 81754

SEQ ID NO: 154036 - RNA, 64 nt, hsa; identical to SEQ ID NO: 81755

SEQ ID NO: 154037 - RNA, 64 nt, hsa; identical to SEQ ID NO: 81756

SEQ ID NO: 154038 - RNA, 64 nt, hsa; identical to SEQ ID NO: 81757

SEQ ID NO: 154039 - RNA, 64 nt, hsa; identical to SEQ ID NO: 81758

SEQ ID NO: 154040 - RNA, 64 nt, hsa; identical to SEQ ID NO: 81759

SEQ ID NO: 154041 - RNA, 64 nt, hsa; identical to SEQ ID NO: 81760

SEQ ID NO: 154042 - RNA, 61 nt, hsa; identical to SEQ ID NO: 81761

SEQ ID NO: 154043 - RNA, 64 nt, hsa; identical to SEQ ID NO: 81762

SEQ ID NO: 154044 - RNA, 64 nt, hsa; identical to SEQ ID NO: 81763

SEQ ID NO: 154045 - RNA, 64 nt, hsa; identical to SEQ ID NO: 81764

SEQ ID NO: 154046 - RNA, 64 nt, hsa; identical to SEQ ID NO: 81765

SEQ ID NO: 154047 - RNA, 64 nt, hsa; identical to SEQ ID NO: 81766

SEQ ID NO: 154048 - RNA, 64 nt, hsa; identical to SEQ ID NO: 81767

SEQ ID NO: 154049 - RNA, 64 nt, hsa; identical to SEQ ID NO: 81768

SEQ ID NO: 154050 - RNA, 64 nt, hsa; identical to SEQ ID NO: 81769

SEQ ID NO: 154051 - RNA, 56 nt, hsa; identical to SEQ ID NO: 81770

SEQ ID NO: 154052 - RNA, 64 nt, hsa; identical to SEQ ID NO: 81771

SEQ ID NO: 154053 - RNA, 64 nt, hsa; identical to SEQ ID NO: 81772

SEQ ID NO: 154054 - RNA, 64 nt, hsa; identical to SEQ ID NO: 81773

SEQ ID NO: 154055 - RNA, 64 nt, hsa; identical to SEQ ID NO: 81774

SEQ ID NO: 154056 - RNA, 64 nt, hsa; identical to SEQ ID NO: 81775

SEQ ID NO: 154057 - RNA, 64 nt, hsa; identical to SEQ ID NO: 81776

SEQ ID NO: 154058 - RNA, 64 nt, hsa; identical to SEQ ID NO: 81777

SEQ ID NO: 154059 - RNA, 64 nt, hsa; identical to SEQ ID NO: 81778

SEQ ID NO: 154060 - RNA, 64 nt, hsa; identical to SEQ ID NO: 81779

SEQ ID NO: 154061 - RNA, 64 nt, hsa; identical to SEQ ID NO: 81780

SEQ ID NO: 154062 - RNA, 64 nt, hsa; identical to SEQ ID NO: 81781

SEQ ID NO: 154063 - RNA, 64 nt, hsa; identical to SEQ ID NO: 81782

SEQ ID NO: 154064 - RNA, 64 nt, hsa; identical to SEQ ID NO: 81783

SEQ ID NO: 154065 - RNA, 64 nt, hsa; identical to SEQ ID NO: 81784

SEQ ID NO: 154066 - RNA, 64 nt, hsa; identical to SEQ ID NO: 81785

SEQ ID NO: 154067 - RNA, 64 nt, hsa; identical to SEQ ID NO: 81786

SEQ ID NO: 154068 - RNA, 64 nt, hsa; identical to SEQ ID NO: 81787

SEQ ID NO: 154069 - RNA, 64 nt, hsa; identical to SEQ ID NO: 81788

SEQ ID NO: 154070 - RNA, 64 nt, hsa; identical to SEQ ID NO: 81789

SEQ ID NO: 154071 - RNA, 64 nt, hsa; identical to SEQ ID NO: 81790

SEQ ID NO: 154072 - RNA, 64 nt, hsa; identical to SEQ ID NO: 81791

SEQ ID NO: 154073 - RNA, 64 nt, hsa; identical to SEQ ID NO: 81792

SEQ ID NO: 154074 - RNA, 64 nt, hsa; identical to SEQ ID NO: 81793

SEQ ID NO: 154075 - RNA, 64 nt, hsa; identical to SEQ ID NO: 81794

SEQ ID NO: 154076 - RNA, 64 nt, hsa; identical to SEQ ID NO: 81795

SEQ ID NO: 154077 - RNA, 64 nt, hsa; identical to SEQ ID NO: 81796

SEQ ID NO: 154078 - RNA, 64 nt, hsa; identical to SEQ ID NO: 81797

SEQ ID NO: 154079 - RNA, 64 nt, hsa; identical to SEQ ID NO: 81798

SEQ ID NO: 154080 - RNA, 64 nt, hsa; identical to SEQ ID NO: 81799

SEQ ID NO: 154081 - RNA, 64 nt, hsa; identical to SEQ ID NO: 81800

SEQ ID NO: 154082 - RNA, 64 nt, hsa; identical to SEQ ID NO: 81801

SEQ ID NO: 154083 - RNA, 64 nt, hsa; identical to SEQ ID NO: 81802

SEQ ID NO: 154084 - RNA, 64 nt, hsa
acccugcgaaggggcccugguccuuccaggcccccaccacuaggacucugaggcucuuucuggg

SEQ ID NO: 154085 - RNA, 64 nt, hsa
cugcugcaccacaagcacccagaacggaagcaggcaccacuaacuuaugaaaaggaggaggaac

SEQ ID NO: 154086 - RNA, 64 nt, hsa
cccacuccagcuccuucgcuuaagccagcacucacaccacuaacaugcccuguucagcuacucc

SEQ ID NO: 154087 - RNA, 64 nt, hsa
uguuaccuuaggagcugaacauucaauucaguuacaccacuaugacuaaaaacaguuuggaucu

SEQ ID NO: 154088 - RNA, 64 nt, hsa
gaguggugccaggugcaaguuaggcuaaagaagccaccacuauuccucucucuugcccauugug

SEQ ID NO: 154089 - RNA, 64 nt, hsa
uggggacauuaauaguccaaggcauucccucccccaccacuauucauaaaguauuaaccaacug

SEQ ID NO: 154090 - RNA, 64 nt, hsa
uccaguuggcagaugacuugaucuccgacauuuucaccacuauuggcucagugacugucgccuu

SEQ ID NO: 154091 - RNA, 64 nt, hsa
gcuguuugccaccucaaaacuuuaugaacuucaccaccacuagugucuguccauggaguuagag

SEQ ID NO: 154092 - RNA, 64 nt, hsa
uccgagcacgcuguaggguaugggaagaacccagcaccacuaauaaagcugcugcuuggcugga

SEQ ID NO: 154093 - RNA, 64 nt, hsa
gucagucuccugaguagcugggauuacaggcacccaccacuaugcccagcuaauuuuuuuauuu

SEQ ID NO: 154094 - RNA, 64 nt, hsa
aacaacccugagcccagggccaaccccuacggaacaccacuacuuuacccagguugauauugac

SEQ ID NO: 154095 - RNA, 64 nt, hsa
guguuucacccauugucuguguuuaguccuuguucaccacuaaggcaaggaauucuuaacuagg

SEQ ID NO: 154096 - RNA, 64 nt, hsa
ccaaaauaugcguaugaguaaaauuagagaauuccaccacuaagcaacaauagauuuuauaugu

SEQ ID NO: 154097 - RNA, 64 nt, hsa
aaaaacaaauaauaaaauauucagcagugggggacaccacuaaagaaacaucugagcaaacaaa

SEQ ID NO: 154098 - RNA, 64 nt, hsa
agcuuaaugaugcuucuguuugaggcccagcaagcaccacuaaauuacuggaugaaaugaaauu

SEQ ID NO: 154099 - RNA, 64 nt, hsa
ucacuucuguaguaugguuuccaccuaucucuaacaccacuauuaagguacaccaguguuaagg

SEQ ID NO: 154100 - RNA, 64 nt, hsa
gggucaguagcucuccacaugaagaccugucacucaccacuaugcaggagagggagguggucau

SEQ ID NO: 154101 - RNA, 64 nt, hsa
auauauccccugcccucacacaugcauagccucccaccacuaucaguaucccacaccagagugg

SEQ ID NO: 154102 - RNA, 64 nt, hsa
cccaggcggcagagguugcagugagucgagauugcaccacuacacuccagccugggcaacagag

SEQ ID NO: 154103 - RNA, 64 nt, hsa
gacuuucaguccuaauuugaggggaaauuacugucaccacuaguuuuaauauaguacaaugaaa

SEQ ID NO: 154104 - RNA, 64 nt, hsa
cagagugugcagacugaugggacaucaaauuugccaccacuagagcugagagucugaaagacag

SEQ ID NO: 154105 - RNA, 64 nt, hsa
aacacuuaguucauuggcuuuaguauuugcucuucaccacuacaagcccacuccccuuuacuuc

SEQ ID NO: 154106 - RNA, 64 nt, hsa
agaauuguucccaacccaguccauggcuucuagccaccacuacagggcuguuucauguacuucu

SEQ ID NO: 154107 - RNA, 64 nt, hsa
ucagugcugccuauuaguaguuaauucugucacucaccacuacaucacuugagacaaaucuaug

SEQ ID NO: 154108 - RNA, 51 nt, hsa
ucuaccaugacaccaacugaucaccacuaacucagagccuccuccaggcca

SEQ ID NO: 154109 - RNA, 64 nt, hsa
aucagaguuuggauacuaguguuagugguggugucaccacuacuuaauugggagauaaugaaac

SEQ ID NO: 154110 - RNA, 64 nt, hsa
ccgagaagagcaaaucagagucuucaaaauggaucaccacuaagggcauguucauucuucacuu

SEQ ID NO: 154111 - RNA, 64 nt, hsa
ggccauugauaguucucauguaauuaguuuugcucaccacuaguacagaugacccguuuacacg

SEQ ID NO: 154112 - RNA, 64 nt, hsa
aggcacuucugguaacauugacacuguaucuugacaccacuaagcaacaggaaggaauaaauuc

SEQ ID NO: 154113 - RNA, 64 nt, hsa
gggacaacauccuuaagucaaaagagagaagaggcaccacuaaaagaucgcaguuugccuggug

SEQ ID NO: 154114 - RNA, 64 nt, hsa
ucacgaucaucuuacgauaucaagcugaaaaugucaccacuaccuggacaguugcacauguuuu

SEQ ID NO: 154115 - RNA, 64 nt, hsa
caacugcagcaggugccaccaccaccacaaaagacaccacuacccuuguaacuacugcuucuac

SEQ ID NO: 154116 - RNA, 64 nt, hsa
uuuaagagcagauuuuagauuaauaauguuuuaucaccacuaauuugcccacaacaaacucagu

SEQ ID NO: 154117 - RNA, 64 nt, hsa
aucgucaaaauaaugucaaaauaguuuuggggaucaccacuauauuuuguuuugauuuuuaacc

SEQ ID NO: 154118 - RNA, 64 nt, hsa
gcaggaaaugcuggcauagagcagcacuaaaugacaccacuaaagaaacgaucagacagaucug

SEQ ID NO: 154119 - RNA, 64 nt, hsa; identical to SEQ ID NO: 154118

SEQ ID NO: 154120 - RNA, 64 nt, hsa
uuaaucuacagaauguuuuauaguaaaauucuagcaccacuagaauaaucacauagcauguaca

SEQ ID NO: 154121 - RNA, 64 nt, hsa
gagauugacuuccuaagcuacuuaagacaacuugcaccacuaagaaaaaaauguagaaccauuu

SEQ ID NO: 154122 - RNA, 64 nt, hsa
aucagucaauaaaaauuacaguaauuauuagacccaccacuaggucaucuuauuugaugcauca

SEQ ID NO: 154123 - RNA, 64 nt, hsa
gggaugcagaugggugcuaucagagccucucccacaccacuauaguguaauaauguuauuauua

SEQ ID NO: 154124 - RNA, 64 nt, hsa
cuuuuguuuuuugaugggguuuuauccucuucaccaccacuacccacuccauuuuuuuucuauu

SEQ ID NO: 154125 - RNA, 64 nt, hsa
cccaggaguucgaggcugcagugagcuaugaucucaccacuacacuccagccugggugacagca

SEQ ID NO: 154126 - RNA, 64 nt, hsa
accugaaaacaaacaaacaaacccuaaaacucagcaccacuaccauuuccagaagcuuuuuuaa

SEQ ID NO: 154127 - RNA, 64 nt, hsa
uagaguccugccaauacagcuguugcauuuuccccaccacuagccccacuuaaacuacuacuac

SEQ ID NO: 154128 - RNA, 64 nt, hsa
ggaggaugcauuauccuguauucuccuccaacaucaccacuagcguaaaagcaaaaagcuuuua

SEQ ID NO: 154129 - RNA, 64 nt, hsa
aagccuuugccagguguaacuguugugaaauacccaccacuaaaguuuuuuaaguuccauauuu

SEQ ID NO: 154130 - RNA, 64 nt, hsa
gaagauuuuuugaccguuccaagucuuaaugccacaccacuauuccagcgaauuuaugcuacaa

SEQ ID NO: 154131 - RNA, 64 nt, hsa
aaaugaaucaaagacccauuccuguuccucuccccaccacuacuguuuucuacuguaaucugaa

SEQ ID NO: 154132 - RNA, 64 nt, hsa
ccugggaggcgaagauugcagugagcugaaaucacaccacuacacuccagccaaagcaacaaga

SEQ ID NO: 154133 - RNA, 64 nt, hsa
uaacuuugagguucuauauagucagagacuaugacaccacuaagguucagaauaaaguuuaggc

SEQ ID NO: 154134 - RNA, 64 nt, hsa
cuacaacauucacuaccucuacuacugguuaaagcaccacuacaauguccauuuuaauggccug

SEQ ID NO: 154135 - RNA, 57 nt, hsa
aacgccaguugcuuaaauaauaugcagcaccacuagcuugugcugguuuuuagauuu

SEQ ID NO: 154136 - RNA, 64 nt, hsa
aagucugugguucuucucauucucaucuauaauccaccacuaccaagagagauuucugugucuu

SEQ ID NO: 154137 - RNA, 64 nt, hsa
cccuggaggcagagguugcaaugagccgagaucacaccacuacacuccagccuaggcaacagag

SEQ ID NO: 154138 - RNA, 64 nt, hsa
uaauuaacaugucuaggagugggagccugacagacaccacuauuaaaaaaaaaaaaaaucccca

SEQ ID NO: 154139 - RNA, 64 nt, hsa
cagcagcaccucacagucagucagacgcugcaggcaccacuaucaccaggaguggccaaguaaa

SEQ ID NO: 154140 - RNA, 64 nt, hsa
caguuuguccaacucuuuccaacagcccauuagacaccacuagcuggauauuucacaggcaucu

SEQ ID NO: 154141 - RNA, 64 nt, hsa
gcccuggcauaucaccccgcacuguggggccaggcaccacuagccuggcucaaauauuccccag

SEQ ID NO: 154142 - RNA, 64 nt, hsa
cucagccucccgaguagcugggauuacaagcacccaccacuacacucagcuaauuuuuuguauu

SEQ ID NO: 154143 - RNA, 64 nt, hsa
accgccaccaccaccaacaccgccacaccaacaccaccacuacaaaaaaaaaagaauuaauaag

SEQ ID NO: 154144 - RNA, 64 nt, hsa
uuagaguaguguugaaauacucggcuagcaucagcaccacuauagcacuguccgugucauauga

SEQ ID NO: 154145 - RNA, 64 nt, hsa
auaggagcgcaaagaagcuacagccuggacuuaccaccacuaaacugcgagagaagcuaaacgu

SEQ ID NO: 154146 - RNA, 64 nt, hsa
acaucccucugcccauccgagaccucuguccuuacaccacuagccaccccacgugggacuucca

SEQ ID NO: 154147 - RNA, 64 nt, hsa
aauauuuguuucaguauuuugucugaaaagaaaacaccacuaauuguguacauauguauuauau

SEQ ID NO: 154148 - RNA, 64 nt, hsa
aaaauaaaugcuuaaccaacacuacuacuguuagcaccacuacuaauuaucauucauugauaau

SEQ ID NO: 154149 - RNA, 64 nt, hsa
uuauucaacucccuaggauccuuuagaaaaaauucaccacuauaggcuucuuugauuuucuuuc

SEQ ID NO: 154150 - RNA, 64 nt, hsa
gauuuuauguaucacuaacauuagaaguuuuuugcaccacuaauuuuuuaaaaauggaagguaa

SEQ ID NO: 154151 - RNA, 64 nt, hsa
cucagccucccaaguagcugggacuacaggugugcaccacuacuccuggauauuuuuuuguguu

SEQ ID NO: 154152 - RNA, 64 nt, hsa
caggcgccacgcuggcgguucgugagugucgaggcaccacuaaauauagcugucugccguccac

SEQ ID NO: 154153 - RNA, 64 nt, hsa
ccugucaggcucggagaggucaggagaccgaccccaccacuaacuuuggagaaaauguggguuu

SEQ ID NO: 154154 - RNA, 64 nt, hsa
aaucacaucacuguaucuuuuacaucaauagccucaccacuaauauaucuuguaucuagguguc

SEQ ID NO: 154155 - RNA, 64 nt, hsa
cucagucuuccggguagcugggacuacaggugugcaccacuaugccuggcuaauuuuguauuuu

SEQ ID NO: 154156 - RNA, 64 nt, hsa
aaacaagacagacuccacucaaaauuuauaugaacaccacuagauacuuccugaucaaacauca

SEQ ID NO: 154157 - RNA, 64 nt, hsa
uauaguucugugaauuuuaacagaaagauuugugcaccacuacugcagucgguacagaacaguu

SEQ ID NO: 154158 - RNA, 64 nt, hsa
uggcugcagguuucaucauauugcaguuugaggucaccacuauuuggggaacaagcuugcgucc

SEQ ID NO: 154159 - RNA, 64 nt, hsa
uuaaaccacuucccauuacugaccauuaaaagcucaccacuagaguuccugaaacaggugaaac

SEQ ID NO: 154160 - RNA, 64 nt, hsa
ucucaucucaaauccuauggccuucuggaagauccaccacuauccaaaggaaaaaguagauuaa

SEQ ID NO: 154161 - RNA, 64 nt, hsa
ucuauuuuucagauguugacuugaguaaauauaucaccacuauugcuggagucaugacacuaag

SEQ ID NO: 154162 - RNA, 64 nt, hsa
acccaggaagcgggguugcagugagccaaagguacaccacuacacuccagccugggcaacagag

SEQ ID NO: 154163 - RNA, 64 nt, hsa
guuaaacagccuauuccugaacuauaacaccugccaccacuauaaaaugucuucaaggcuucag

SEQ ID NO: 154164 - RNA, 64 nt, hsa
cccaggaggcagagguugcagugagcuaagaucacaccacuacacuccagccugggcgagacgg

SEQ ID NO: 154165 - RNA, 63 nt, hsa
aagaaaaauaucgagucuaaagacaugaauucucaccacuaaagucccagauagcaucauauu

SEQ ID NO: 154166 - RNA, 64 nt, hsa
auuauaggugcaaggcaccccauccacacauuugcaccacuacuccaagauaguauuuuucuuu

SEQ ID NO: 154167 - RNA, 50 nt, hsa
cuccacagcagaagauuuagcaccacuaucuccguuccaucugggcuuau

SEQ ID NO: 154168 - RNA, 64 nt, hsa
cacgcagcugaggcgcaugugguggccuucuucccaccacuaccccaguacaccgugagguaga

SEQ ID NO: 154169 - RNA, 64 nt, hsa
cauguggcauuuggauggccagagugcccugaagcaccacuaccaaccuugccucccccuccuc

SEQ ID NO: 154170 - RNA, 64 nt, hsa
gcgaaguccacgcucauccugguguguggcccgccaccacuaauccagacggcggcucacccua

SEQ ID NO: 154171 - RNA, 64 nt, hsa
uauagggcguuuggcccugugacuauggcucuggcaccacuaggguccuggcccucuucuuauu

SEQ ID NO: 154172 - RNA, 64 nt, hsa
auauuuauugcuacauaacuauauauaauuuucccaccacuaauaccacacuuuauauucaguu

SEQ ID NO: 154173 - RNA, 64 nt, hsa
guauuggagaguacaauaauguaaauccuaaaagcaccacuauuuuagcauaauaaaagaaagu

SEQ ID NO: 154174 - RNA, 64 nt, hsa
gaggccagagagcagccacugcuacugcuaaugccaccacuaccccugccaucacugccccaca

SEQ ID NO: 154175 - RNA, 64 nt, hsa
cucucgacuuuaggaggaauauccuucccaacaucaccacuacuuaccucaagucgugcauuua

SEQ ID NO: 154176 - RNA, 64 nt, hsa
gugacgaccaccgccccaccaccuccugggaccacaccacuaccgcccccaaccacagcagaga

SEQ ID NO: 154177 - RNA, 64 nt, hsa
ugguuuuaguaaauucacaaacuuguucaaccaucaccacuaucuaauuccagacucacgcuuu

SEQ ID NO: 154178 - RNA, 64 nt, hsa
uaaaaauacgucauuuuaaagauuucccaaaccacaccacuaaauuuguuuuaugaauugauuu

SEQ ID NO: 154179 - RNA, 64 nt, hsa
agcguccucuucagcgucuuuuccuagagcuggucaccacuaggcugucacuauaaauuccuug

SEQ ID NO: 154180 - RNA, 64 nt, hsa
ucucugugcagaaguguuggcugggugcucuccccaccacuacccuuguaaacuuccaggaaga

SEQ ID NO: 154181 - RNA, 64 nt, hsa
uuacauacacaguuuucucuccacacauaaauaacaccacuaaaguuguuuuguaagguuccaa

SEQ ID NO: 154182 - RNA, 64 nt, hsa
aauauugcccaaugacuaguccucauccauguagcaccacuaauucuuccaugccuggaagaaa

SEQ ID NO: 154183 - RNA, 64 nt, hsa
agaacagauaaaugcgaaggaaaccauguauauucaccacuaggacagguuaaaaagaccauug

SEQ ID NO: 154184 - RNA, 64 nt, hsa
cagcuaagggcagaggcugugccuagggcuauaccaccacuagcaucuguauuugagacuguuu

SEQ ID NO: 154185 - RNA, 64 nt, hsa
ucuggaagagucugugcgcccauggauggcugagcaccacuacgacuuaguccgggauaagggc

SEQ ID NO: 154186 - RNA, 64 nt, hsa
cagaggaggucuaacgaccagaguauugcccugccaccacuaucucuagucucccuagcuuggu

SEQ ID NO: 154187 - RNA, 64 nt, hsa
uugcugugaauauuucuccuacccgauuccccaacaccacuagugccucuggauuuagagauau

SEQ ID NO: 154188 - RNA, 64 nt, hsa
cuaacgucugucagcuauccuuuugccuuuaccucaccacuauuacccuagagaagacuuucau

SEQ ID NO: 154189 - RNA, 64 nt, hsa
acaagcaggccgcucucccagacuuaaaauguaucaccacuaaccugugagggggacccaaucu

SEQ ID NO: 154190 - RNA, 64 nt, hsa
auggcacaucagcacgauuucuguuuagauaauacaccacuacauucuguuaaucauuaggugu

SEQ ID NO: 154191 - RNA, 64 nt, hsa
cauuguuuuuauuuuacaaaggcagaaaaugaaacaccacuagguaaaagaauuaaaaaucuaa

SEQ ID NO: 154192 - RNA, 64 nt, hsa
aggaucuaagacuggauucccugucacuaaacugcaccacuauaccugucucucuguguggggg

SEQ ID NO: 154193 - RNA, 64 nt, hsa
caguguuuccagcguuucagcugugggcuucuaccaccacuaagccgcucaccuagaguuguua

SEQ ID NO: 154194 - RNA, 64 nt, hsa
cuacacccgugucaccuacuacuuggacuggauccaccacuauguccccaagaagcccugagcc

SEQ ID NO: 154195 - RNA, 64 nt, hsa
ucacaguuuuuuacugugaugaaaucuuguuaaccaccacuagggaaucuccagaugaacuauu

SEQ ID NO: 154196 - RNA, 64 nt, hsa
gcgggggugcccccaauggugcagcugcagcagucaccacuagggggugauggagaggaagggg

SEQ ID NO: 154197 - RNA, 64 nt, hsa
cuucccugugccuccucccucccucuccgacucacaccacuagccucaggggucugagcuccag

SEQ ID NO: 154198 - RNA, 64 nt, hsa
cucagccucccaaguagcugggaccacaggcaugcaccacuacgcaugacuaauuuuuuaaaua

SEQ ID NO: 154199 - RNA, 64 nt, hsa
aaguuuggauuacucaggcagggccauccagccccaccacuagaaaagcucuucagaaucuugu

SEQ ID NO: 154200 - RNA, 64 nt, hsa
ggccuucugcacggcccaaggagaaccuggaggccaccacuaaagcugaaugaccugugucuug

SEQ ID NO: 154201 - RNA, 64 nt, hsa
uugauuugcauaguccaauggaugugugcuuuaacaccacuauguugcacaaaaauuuaagucu

SEQ ID NO: 154202 - RNA, 64 nt, hsa
cacuguaacacuggagagcccagguuauaucagacaccacuaguagauagaaguucuaacaacu

SEQ ID NO: 154203 - RNA, 64 nt, hsa
agguuuuguugcuuguacagugucagaugaggaacaccacuaucuuaauuuugcgauacacugc

SEQ ID NO: 154204 - RNA, 64 nt, hsa
auuuuuuuuaaacuuaaauuuugggucaacuugacaccacuaagaugauuuuuuaaggagcugg

SEQ ID NO: 154205 - RNA, 64 nt, hsa
agacacugucugaaagaugacaugaguaguaauucaccacuaucugaaccaagcaaggaucaau

SEQ ID NO: 154206 - RNA, 64 nt, hsa
aucaaggaccucagccuuauauaaucauuguccccaccacuaccauggacuggacaccuucacu

SEQ ID NO: 154207 - RNA, 64 nt, hsa
uugggaggauacagaggagaugccacuucucacucaccacuaccagccagccucagaaggcccc

SEQ ID NO: 154208 - RNA, 59 nt, hsa
ugcugguacggguggaaugaggggugagacaccacuacuacaagcacagucgggccgcg

SEQ ID NO: 154209 - RNA, 64 nt, hsa
cccuuucaccagaugccacccucccugaaccccccaccacuaccagcucccuggccucccugcc

SEQ ID NO: 154210 - RNA, 64 nt, hsa
ggaagcucugucgugccccuaccccacgccgccccaccacuauaggcugcuggaguccuggaac

SEQ ID NO: 154211 - RNA, 64 nt, hsa
ccagccaaccacacuauucaaaaagcaaaguguucaccacuaaagcuaaccauucaucugguug

SEQ ID NO: 154212 - RNA, 64 nt, hsa
cccuucuguuaccaccccccacccuccuccaggacaccacuagguggugcuggaugcuuguucu

SEQ ID NO: 154213 - RNA, 64 nt, hsa
aaagcugcuucauuuuugaaagaugauggagacccaccacuacuauaugaugaauagcacuaau

SEQ ID NO: 154214 - RNA, 64 nt, hsa
uuuuucauagucauugugguuuagauccaauucccaccacuaaaaaaccaacaaugugauuuau

SEQ ID NO: 154215 - RNA, 64 nt, hsa
ggacagaauagcacguaaaacaaauucuugccuacaccacuagaagacaucuauugaagagaau

SEQ ID NO: 154216 - RNA, 64 nt, hsa
acauccggaguccuggagccgggugucccaguggcaccacuaggugccugcugccuccacagug

SEQ ID NO: 154217 - RNA, 64 nt, hsa
cucagccucccgaguagcugggccuaaaggugcccaccacuauacccggcuaauuuuuguauuu

SEQ ID NO: 154218 - RNA, 64 nt, hsa
ggccuccuugggaacguguaggccacggcucugccaccacuagguaccugcugagggcgcuggc

SEQ ID NO: 154219 - RNA, 64 nt, hsa
uucuggacucugccccaaucggguccagagaccacaccacuaaccauccccaacuccauggggu

SEQ ID NO: 154220 - RNA, 64 nt, hsa
caagaguaugaggcugcagugagcccaugagccccaccacuacacuccagccuggaagacacca

SEQ ID NO: 154221 - RNA, 61 nt, hsa
ccucccgcagcauuccaugaucuacuucuuccaccacuacgagcugccugccauccugcag

SEQ ID NO: 154222 - RNA, 64 nt, hsa
acccacuugguaacaggcauccuugccaagccuccaccacuaggucaguguaagaauuaaagaa

SEQ ID NO: 154223 - RNA, 64 nt, hsa
uuuaccagagucugggauggugggcuucuccccccaccacuaacaccucagacgcuugggcagg

SEQ ID NO: 154224 - RNA, 64 nt, hsa
auucaggugaugguuacaugaacagcccagacuucaccacuacgcaauauauccauguaacaaa

SEQ ID NO: 154225 - RNA, 64 nt, hsa
gaugagugaggacuuggguccucggucuuacccccaccacuaagagaauacaggaaaaucccuu

SEQ ID NO: 154226 - RNA, 64 nt, hsa
auucagucacguuaccauaucaagcugaaaaugucaccacuaucuggagaguuggacauguuuu

SEQ ID NO: 154227 - RNA, 64 nt, hsa
ucucaguaggauacuccauaacacaauagcaguacaccacuaggcucuuaaacgaucaagaaca

SEQ ID NO: 154228 - RNA, 64 nt, hsa
cugggauuacaggcgugagccacugcacccggcucaccacuaguuuuuagcccuuuuuguuggg

SEQ ID NO: 154229 - RNA, 64 nt, hsa
aaaauacugaguuguuauguuuauguuaucaccccaccacuaccuccaugguuguucauuuagg

SEQ ID NO: 154230 - RNA, 64 nt, hsa
ccaccaccuccaccaccaccaccaccaccaccaccaccacuaccaccaccacccaacuggggcu

SEQ ID NO: 154231 - RNA, 64 nt, hsa
aagcccagagagguuaagaaauuugcuaggaucacaccacuaauaagcaacagagccaggauuc

SEQ ID NO: 154232 - RNA, 64 nt, hsa
gagcugcagaugagggagcccguacacucccugccaccacuagguuguaagccuguagcuggcu

SEQ ID NO: 154233 - RNA, 64 nt, hsa
ucuggaggguucuaagugggagaaggacuaucaacaccacuaggaaucccagaggugggauccu

SEQ ID NO: 154234 - RNA, 64 nt, hsa
gcugcacaaaaugcauuuuuucguaucaaaaagucaccacuaacccucccccagaagcucacaa

SEQ ID NO: 154235 - RNA, 64 nt, hsa
cucuuugggagaugacaugaguggaacucacagccaccacuaccaccacuuuagacaggaccga

SEQ ID NO: 154236 - RNA, 64 nt, hsa
aagucauuguaagugcacugauaucuucacaaaacaccacuauuugauguguacagaguuggac

SEQ ID NO: 154237 - RNA, 64 nt, hsa
ggcuccccuccuguggggaggccaccuuuuaaggcaccacuagcagucaggauaugguggcauc

SEQ ID NO: 154238 - RNA, 62 nt, hsa
uaauauacuuucaguauugaaacucacgacggcaccacuaggccagaggcguggcugcccca

SEQ ID NO: 154239 - RNA, 64 nt, hsa
cuccuucugggggucagggacgcagcuccacccucaccacuagcccacccugcccgugggcaua

SEQ ID NO: 154240 - RNA, 62 nt, hsa
cagccgagaacaacagcuagcaccaagaagcccaccacuagggggagacaugcuguagggga

SEQ ID NO: 154241 - RNA, 64 nt, hsa
auaauaaaagugccuuagcauguguugcagcugucaccacuacaguaagcugguuuacagaugu

SEQ ID NO: 154242 - RNA, 64 nt, hsa
uggacagccguuuucagagccuccagcauuugcacaccacuacucacccucucugcugcuggca

SEQ ID NO: 154243 - RNA, 64 nt, hsa
uuuaugcuaaaucuggccaaagaugagcauuguccaccacuaaaaugccucugccacuuugaau

SEQ ID NO: 154244 - RNA, 64 nt, hsa
uggaucucccccugcccauugccugcuugaggggcaccacuacuccagcccagaaggaaagggg

SEQ ID NO: 154245 - RNA, 64 nt, hsa
gcucgggugaugggugcaccaaaaucucacaaaucaccacuaaauaauguacucauguaaccaa

SEQ ID NO: 154246 - RNA, 64 nt, hsa
ugaucucagcccugcaacuugacccagguagggccaccacuacgccuucacuugucacccaagc

SEQ ID NO: 154247 - RNA, 64 nt, hsa
aauuccagugagaagcucuggcugagaagaaaaucaccacuauuaaaaaagcugcuccccaagc

SEQ ID NO: 154248 - RNA, 64 nt, hsa
ucacgaucauguuaccauaucaagcugaaaaugucaccacuaucuggagauuucgacguguuuu

SEQ ID NO: 154249 - RNA, 64 nt, hsa
ucucuugugcuaaauuuggccaaagaugauuguccaccacuaaaaaugccucucccacuuggaa

SEQ ID NO: 154250 - RNA, 64 nt, hsa
gcccauaaaaacauaaauggccuuauugaugcuuucagcagaauuucaucuagaaguggcagca

SEQ ID NO: 154251 - RNA, 64 nt, hsa
acagaugauguggaaggagcucaaacagacgacuucagcagacucaucucuggagggucguuua

SEQ ID NO: 154252 - RNA, 64 nt, hsa
gcgccguccaggccgagcgcagacuguuuaggacucagcagacccagcaagaggcaucugcccu

SEQ ID NO: 154253 - RNA, 64 nt, hsa
ccccagccaccuccccagcaagcaaccugaaaucucagcagaugcccaccauuucucuagaucg

SEQ ID NO: 154254 - RNA, 64 nt, hsa
uccuucccgcuacagaaucgcucaucggcgaggcucagcagaaagacccugaaggcaggcugca

SEQ ID NO: 154255 - RNA, 64 nt, hsa
aggguccuagaauuuuucugauuucuauaauccuucagcagaauauuaagaaauaaagcaugau

SEQ ID NO: 154256 - RNA, 64 nt, hsa
gguacuuagaggucgcacuuaaagauuaugcacaucagcagaggaaaggccagccaagcuuggg

SEQ ID NO: 154257 - RNA, 64 nt, hsa
cccaguuguugacugugacaggcucagcaugggcucagcagaugcugucuuaauuuguggauga

SEQ ID NO: 154258 - RNA, 64 nt, hsa
ccaaaauggaugucccugaaugaaaaucaaggugucagcagagcugugcuccuucugaaggcuc

SEQ ID NO: 154259 - RNA, 64 nt, hsa
uggagucauacacgaagggcguguggccaucgugucagcagagagagucucuguacacagcccc

SEQ ID NO: 154260 - RNA, 64 nt, hsa
uggagucauacgcgaaggccauauggccaucgugucagcagagagagucucuguacacagcccc

SEQ ID NO: 154261 - RNA, 64 nt, hsa
cgcggggagguaaugaauugucugugguaucaugucagcagagucuccaagccccacgaacccu

SEQ ID NO: 154262 - RNA, 64 nt, hsa
cuuuccagcuaucagcacuuucagcaucggcucuucagcagauccaaacccccucagcaacuug

SEQ ID NO: 154263 - RNA, 64 nt, hsa
gccugagacaucaggggagagccugcagcugaguucagcagaaaggaggaauccuggcccucag

SEQ ID NO: 154264 - RNA, 64 nt, hsa
agaacaaauuguggaucaugguauaugcaggcuaucagcagaaggaucagacaauaaaaugagu

SEQ ID NO: 154265 - RNA, 64 nt, hsa
ugaguuagugcaaaccauuuaguaaaaauaacuaucagcagaguuguuccagauuaaaaauagu

SEQ ID NO: 154266 - RNA, 64 nt, hsa
uuuccuuauagaauggacauggugguggucgaagucagcagacacuagacaguaaguauagcag

SEQ ID NO: 154267 - RNA, 64 nt, hsa
ucagaucccagcuucugcaguggaaaugccugguucagcagaugucacaggauuaaaugugcag

SEQ ID NO: 154268 - RNA, 64 nt, hsa
aguugcugaaguagggucugagagaacccuggcaucagcagacccagggugcuucugucuccug

SEQ ID NO: 154269 - RNA, 64 nt, hsa
uguccacaaugguacugaauuugcaucugcacagucagcagagauaacaaguguugaacugacc

SEQ ID NO: 154270 - RNA, 64 nt, hsa
gcuuuagcuagaagaauuucaaggaaaagaauucucagcagagcucaagauuguagaaacucag

SEQ ID NO: 154271 - RNA, 64 nt, hsa
aagaauucucagcagagcucaagauuguagaaacucagcagaagcugguaaaaacauggggagc

SEQ ID NO: 154272 - RNA, 64 nt, hsa
ggaugacuccgcacugccccucaacagggaugacucagcagagaugacucagcacugucccuua

SEQ ID NO: 154273 - RNA, 64 nt, hsa
ggaugacucagcauugccccucaacagggaugacucagcagacucagcagggaugacucagcac

SEQ ID NO: 154274 - RNA, 64 nt, hsa
cgccccucagcaaggaugacucagcagggaugauucagcagagauaacucggggaugacucuga

SEQ ID NO: 154275 - RNA, 64 nt, hsa
uaccccagggcagcaggcucagaguacagucccuucagcagagggcacagcaggcuacaggguu

SEQ ID NO: 154276 - RNA, 64 nt, hsa
ugucccccaggucucagcccccaaggcugcccccucagcagaggcagcugguggcuuugcccuc

SEQ ID NO: 154277 - RNA, 64 nt, hsa
guagaccaccagcuccccuccccaucuccuugagucagcagacuguccaaugugcucagccagg

SEQ ID NO: 154278 - RNA, 64 nt, hsa
ccccugaauagcuccuucggccccaucuccauccucagcagaugacacugauuggccucacggg

SEQ ID NO: 154279 - RNA, 64 nt, hsa
acccagcuccuuuuguccccagggccccucccucugccccaagcagccagccagucuugccuag

SEQ ID NO: 154280 - RNA, 64 nt, hsa
gaacaagucacagcugcagcugggccccaugcucugccccaagcccccaaccccgcggugcucu

SEQ ID NO: 154281 - RNA, 64 nt, hsa
gcagcugcagugguugggaggagcuugaccagugugccccaaggaguggaguagagcccaaucu

SEQ ID NO: 154282 - RNA, 64 nt, hsa
aauacaggcugaaccuggcccaacagaaaaacccugccccaaugcaccugcaggcaagguaccc

SEQ ID NO: 154283 - RNA, 64 nt, hsa
uaacaacauggccagugccuguuccccacucccuugccccaaaaggaucuggaacacagguguu

SEQ ID NO: 154284 - RNA, 64 nt, hsa
cuagggaacagagcuggauuccuugugccucauaugccccaaugcuggucucaguaaaacacug

SEQ ID NO: 154285 - RNA, 64 nt, hsa
ccccugcaccuccaccugccccagccccugccucugccccaaguggggccagcugcccucacuu

SEQ ID NO: 154286 - RNA, 64 nt, hsa
gguugggguuucugccacuuccgggucuaggcccugccccaaauccagccaguccugccccagc

SEQ ID NO: 154287 - RNA, 64 nt, hsa
cuuaacaguugaauuauggagggaaauucccuuuugccccaagcauuucuauauuuaaagcaau

SEQ ID NO: 154288 - RNA, 64 nt, hsa
agcaucccuaaucugaacaguuaaaacccccaaaugccccaaaauccaaaccuuccugaacgcu

SEQ ID NO: 154289 - RNA, 64 nt, hsa
ggccaaaugcagagaugaggcuaaggcaagaauaugccccaacuaaagcauagauuccccaaag

SEQ ID NO: 154290 - RNA, 64 nt, hsa
cuacuccugcugccugugugugccugggggcuacugccccaacuccugcggugacaccacccag

SEQ ID NO: 154291 - RNA, 64 nt, hsa
uuuuaagguauaucauuauaacugaaggagaaggugccccaaaaugcaagauuuuccacaagau

SEQ ID NO: 154292 - RNA, 64 nt, hsa
ucaccaggaauguuaaagucagugggaacgugacugccccaacuccuggaagcuguguccuugc

SEQ ID NO: 154293 - RNA, 64 nt, hsa
ucccagcauccagauccuggauccuagacuccuaugccccaaccacugggucaugcgaucccca

SEQ ID NO: 154294 - RNA, 64 nt, hsa
ucccaguacccagauccuggauccuagacuccuaugccccaaccauugggucaugggaucccag

SEQ ID NO: 154295 - RNA, 64 nt, hsa
aggggcucccagccugcacuugcaggaguggugaugccccaagucugcgaauccagggugcacg

SEQ ID NO: 154296 - RNA, 64 nt, hsa
uuccaaagcaggugcugcauggcucaccaucauaugccccaaacaacugaaaguuggcgguuau

SEQ ID NO: 154297 - RNA, 64 nt, hsa
gggcaggucaaucuucccaccccaccgugugggcugccccaaccccaaaugugcccagggaggg

SEQ ID NO: 154298 - RNA, 64 nt, hsa
cugucuuggccggccccacugcccccccauucuaugccccaaccaccaaggcuuucccaucuug

SEQ ID NO: 154299 - RNA, 64 nt, hsa
acagucgugccauucacaaagucagaaaauacagcaggaagagacagcuuuuagaggggcagag

SEQ ID NO: 154300 - RNA, 64 nt, hsa
aaugcacacaacagaaccauaggcaacaccaacacaggaagaaauagaagucaccuauugaaaa

SEQ ID NO: 154301 - RNA, 64 nt, hsa
ucuaagaagagacuguccaagcaaguuaggcuugcaggaagauaugacccagcugagaagcccu

SEQ ID NO: 154302 - RNA, 64 nt, hsa
ucuagugggauggaguugggguauagaaauuaaccaggaagauguuuccaccaagccugcugug

SEQ ID NO: 154303 - RNA, 64 nt, hsa
gcaauguggugaagcugaguuucuguccaaugagcaggaagauucugagacauuucgccugaga

SEQ ID NO: 154304 - RNA, 64 nt, hsa
gguuggggagcaggccagauggaggugguggugccaggaagaaauggagcgaugacugacugug

SEQ ID NO: 154305 - RNA, 64 nt, hsa
caggaagaugaacugugagggcuccuauaaggggcaggaagagcaaagcuguccuaggccaacc

SEQ ID NO: 154306 - RNA, 64 nt, hsa
uguuacccaagggugccucacucaucugcgccaccaggaagaugaacugugagggcuccuauaa

SEQ ID NO: 154307 - RNA, 64 nt, hsa
guagaucauuuuuaucccgccagggagugugaugcaggaagaccacaugcgcuccuggcuuuua

SEQ ID NO: 154308 - RNA, 64 nt, hsa
ugcaagcuccaguagcuccgcgugucucauuugccaggaagauggguucccacguagcaaaucg

SEQ ID NO: 154309 - RNA, 64 nt, hsa
ccccaucugugugugaauuccuuuagacuaagggcaggaagacuuccagcuuucucuuuguucu

SEQ ID NO: 154310 - RNA, 64 nt, hsa
caguggcaagggacggagaggucccaacaggagucaggaagagguuugauuauaaccaagaaaa

SEQ ID NO: 154311 - RNA, 64 nt, hsa
gugccuguaauuccagcuacucgggaggcugaggcaggaagaaucacuugaacccaggaggcgg

SEQ ID NO: 154312 - RNA, 64 nt, hsa
guggcgcaggccccggggggagugccugugcugucaggaagagggggugcugguuugagggccg

SEQ ID NO: 154313 - RNA, 64 nt, hsa
cauccuggugccugcauaccucuggcagcuggcccaggaagagccagcaagagcaaggcauggg

SEQ ID NO: 154314 - RNA, 54 nt, hsa
guaguccuagccuccuauaaggcccaggaagagggcagaggggccagaaggacu

SEQ ID NO: 154315 - RNA, 64 nt, hsa
uagugccagccccucacacgccuucauccugaaacaggaagaggacggcaccaaguugggggug

SEQ ID NO: 154316 - RNA, 64 nt, hsa
cagcuucaaagcuuaaaaagagcucaggcuuuuccaggaagauccaggagggcuaauuagaaau

SEQ ID NO: 154317 - RNA, 64 nt, hsa
uaguaaauaugugaagaaaaagaccugcauuuggcaggaagauguaugcuuugaaugcaaaaga

SEQ ID NO: 154318 - RNA, 64 nt, hsa
ccccgugaaugcuuaccugugagauaaccacaaccaggaagaacaaaucugggcauugagcaag

SEQ ID NO: 154319 - RNA, 64 nt, hsa
acaaugcaguagccagcacguucgaggcgguuuccaggaagagugugcuugucaucugccacuu

SEQ ID NO: 154320 - RNA, 64 nt, hsa
ccgccuggaggagauccgcaucuggggaccccuccaggaagaugcugacauccaggucagcagg

SEQ ID NO: 154321 - RNA, 64 nt, hsa
ccugugcauggacucugcccucagggugccuguccaggaagagcuguguggccuggcaagcaag

SEQ ID NO: 154322 - RNA, 64 nt, hsa
cacaguaggcgcccaggacaaguggguugcaagacaggaagaaaggaaaaggaagggcagagug

SEQ ID NO: 154323 - RNA, 64 nt, hsa
uccuugcgggguuggggcugcauggccaggguggcaggaagacauccccccuccaucccagccc

SEQ ID NO: 154324 - RNA, 64 nt, hsa
cuggccuacagcuugucuguuucucaagcagaggcaggaagagcuagucuuagcauuuauauuu

SEQ ID NO: 154325 - RNA, 64 nt, hsa
agaguccacuugucccgggcuuccaccuggcugacaggaagaauuucugagagcuggaugugca

SEQ ID NO: 154326 - RNA, 64 nt, hsa
uuccauguaacaaucuggaaggaaacuucacggacaggaagacugcuggagaagagaagcgugu

SEQ ID NO: 154327 - RNA, 64 nt, hsa
aaugccuugggaccuggagugcugggcuugugcacaggaagagcaccagccgcugagucaggau

SEQ ID NO: 154328 - RNA, 64 nt, hsa
ggguaacacgaagaagacccggcccuuagggcaucaggaagacuagcuccccugccccggagga

SEQ ID NO: 154329 - RNA, 64 nt, hsa
cuggaaugauucuagaaccaaaauaaaguuggggcaggaagagggggcuuccagggagcccugc

SEQ ID NO: 154330 - RNA, 64 nt, hsa
cauggaagauuagagguuugucaacacaaagacacaggaagaaugggcugcagaagauuuagau

SEQ ID NO: 154331 - RNA, 64 nt, hsa
uaacagaagaggagggaccuacugaacccagagucaggaagagauuuaacacuaaaauuccacu

SEQ ID NO: 154332 - RNA, 64 nt, hsa
auggcuaacaaaaacuaaaggggaagugaggaaacaggaagaaguauggugggggcugggguag

SEQ ID NO: 154333 - RNA, 64 nt, hsa
uaguuuucuucaggugucaauggcguuagacucccaggaagacuagcccugcccacagggccac

SEQ ID NO: 154334 - RNA, 64 nt, hsa
gguuuuggucaauacuugacaagggugcccaggacaggaagacguguacugcugaguguuccuu

SEQ ID NO: 154335 - RNA, 64 nt, hsa
cagcacaaaccuggucauuuugaugacuguacaacaggaagacuugaaaaaucacguggauuca

SEQ ID NO: 154336 - RNA, 64 nt, hsa
agaaaaugagggcuugagucgccugaaccaagagcaggaagagguugcuggagcaagaggagag

SEQ ID NO: 154337 - RNA, 64 nt, hsa
agaaaaugagggcuugagucgccugaacgaagagcaggaagagguugcugagauuguuggaaca

SEQ ID NO: 154338 - RNA, 64 nt, hsa
agaaaaugagggcuugagucaccugaaccaagagcaggaagagguugcucagguuguuggagca

SEQ ID NO: 154339 - RNA, 64 nt, hsa
agaugggagauagauaccaaugauuuagauggcacaggaagagcaaguucuggauauaauaaau

SEQ ID NO: 154340 - RNA, 64 nt, hsa
acacaugcuacaaugaggcagcaucagcugagagcaggaagagcgaucuacuuuacaccccaca

SEQ ID NO: 154341 - RNA, 64 nt, hsa
gagagcugagaguauucgcucgacugagcacauucaggaagaucagggcaggcgugugggaggu

SEQ ID NO: 154342 - RNA, 64 nt, hsa
cacguaugguucuuucugugggucuguggcacagcaggaagagcccggugccgccagcaccuug

SEQ ID NO: 154343 - RNA, 64 nt, hsa
gcccaaguagguuauuuguacagucagagggcaacaggaagaugcaggccuucaagggcaagga

SEQ ID NO: 154344 - RNA, 64 nt, hsa
uccagcugguucugugggcugcugcagugaaaagcaggaagaagauggccuugacuuuuuaaau

SEQ ID NO: 154345 - RNA, 64 nt, hsa
caucuucgagcccaaaggagucacgcuggcauaucaggaagauguccuuccugggaagaagaag

SEQ ID NO: 154346 - RNA, 55 nt, hsa
gcccaaaagagucacagugacaccucaggaagauguccuuccuggggaagaagaa

SEQ ID NO: 154347 - RNA, 64 nt, hsa
caaugugcaaucccccugcccccacagccaaggucaggaagaggcccuguggucaccgugucug

SEQ ID NO: 154348 - RNA, 64 nt, hsa
gaagcgauggcugaccagauugaaccccgaaacucaggaagagugaaaugcuacacgacaaccu

SEQ ID NO: 154349 - RNA, 64 nt, hsa
uacccaguuuuguuucugaaacuacgguagggggcaggaagaggagcagaaaagaagggcuggg

SEQ ID NO: 154350 - RNA, 64 nt, hsa
guaaagcccuuuggcucuuggcaggcagacuuuccaggaagaggcuccauguggcuccugcuuc

SEQ ID NO: 154351 - RNA, 64 nt, hsa
aggccgcggaggagccggaugcugagccgggaggcaggaagaagacggaggagccgggcgacag

SEQ ID NO: 154352 - RNA, 64 nt, hsa
gcagguggaggcggaacgaggauggagccaucugcaggaagagcauaaagaagaugcuggaagu

SEQ ID NO: 154353 - RNA, 64 nt, hsa
acuccuguaacccugggacuuugggaagcugaggcaggaagauugagccuaggaguucgagacc

SEQ ID NO: 154354 - RNA, 64 nt, hsa
auuucugaggacaggagcucacaucuggaagaaacaggaagauuggaaucugccuggaacaaag

SEQ ID NO: 154355 - RNA, 64 nt, hsa
agguguccauaugucuuuaccuaccuaaguaaaacaggaagaaaaucaguaacauuauccuuag

SEQ ID NO: 154356 - RNA, 64 nt, hsa
ucagaggcccggacucuccuaugugacuuuagugcaggaagaacuucugucaaucauggacgca

SEQ ID NO: 154357 - RNA, 64 nt, hsa
gacuuguuuauaauucugcacuuuagaagaaaaacaguguuaaucuguaguugaaagaaagcuu

SEQ ID NO: 154358 - RNA, 64 nt, hsa
aggccgguucuaauugaggggacccagugugcuucaguguuaagaguggggcaaugaagaguga

SEQ ID NO: 154359 - RNA, 64 nt, hsa
cuuuugugcaacuguguuuugaauaaagccaugacaguguuaaaaacaaacaaaaaaauuugca

SEQ ID NO: 154360 - RNA, 64 nt, hsa
gaugaagaaagaaaagcaggggugcuuuuggaagcaguguuaguguuccucaaaagucggaaca

SEQ ID NO: 154361 - RNA, 64 nt, hsa
aagaggguaacauggguuaccuuugcaccagcuucaguguuaagcucacccuguucuuugaagc

SEQ ID NO: 154362 - RNA, 64 nt, hsa
uuuaaucuguguuucugcaagugccauccuuguacaguguuaagaggguaacauggguuaccuu

SEQ ID NO: 154363 - RNA, 64 nt, hsa
auuguuaaaaacugcauuaugcaaaaauuuuguacaguguuaaggccuaaaaacugugugguuc

SEQ ID NO: 154364 - RNA, 64 nt, hsa
agaaccaaguuuuucuaugauauuaaaaaauguacaguguuagguauuauuugaauggaaagac

SEQ ID NO: 154365 - RNA, 64 nt, hsa
uuaugauaacuuuuaaaaagugucuguaaaucuucaguguuaaaaaaacagaugcccauuuguu

SEQ ID NO: 154366 - RNA, 64 nt, hsa
ccccacccuuuuuuuuugguuuuaaaucacuguacaguguuauuugauauuuuaauuuauuuuu

SEQ ID NO: 154367 - RNA, 64 nt, hsa
uuggugaaggcaagucucugaaagcagaacuauccaguguuaucuaaaaauuaaucugagcaca

SEQ ID NO: 154368 - RNA, 64 nt, hsa
uccauaugccucccuaugcagugaagggcccuagcaguguuaacaaauugcugagaucccacgg

SEQ ID NO: 154369 - RNA, 64 nt, hsa
aaaacaagauacauacauaguauaacacaccucacaguguuaagauuuauauugugaaaugaga

SEQ ID NO: 154370 - RNA, 64 nt, hsa
gaagguuucucuuuugcaauagaacgucauggaccaguguuaaaugugaguggaaggaguucug

SEQ ID NO: 154371 - RNA, 64 nt, hsa
ugcaaaggccuaaacugagaauuaaucuaaaagucaguguuauuuaaacauuuucaaugugcau

SEQ ID NO: 154372 - RNA, 64 nt, hsa
uggaacccucacugaaaguccagaaugucuaagccaguguuagauuuuguaaacaaguggaaca

SEQ ID NO: 154373 - RNA, 64 nt, hsa
cuaagccaguguuagauuuuguaaacaaguggaacaguguuaaauuucuaugauguuggagcca

SEQ ID NO: 154374 - RNA, 64 nt, hsa
ugacaaagaguaaguaagcaguauucuugggagucaguguuauguguuucagcagaguauuauu

SEQ ID NO: 154375 - RNA, 64 nt, hsa
uuauaguucuucuccauguuucuccagaauuaaucaguguuaguccucuguuuaucucgcaugu

SEQ ID NO: 154376 - RNA, 64 nt, hsa
uuauucauuucuguaaauuccuauguagaaggcucaguguuagaaauaaaguuauucuacuagu

SEQ ID NO: 154377 - RNA, 64 nt, hsa
agaaucugggaagagaaauggagaauaagcagcacaguguuauucauuucuguaaauuccuaug

SEQ ID NO: 154378 - RNA, 64 nt, hsa
ugccauucugagccuugaagggcaaggagggaaacaguguuaccagagcccaguaagaacugcu

SEQ ID NO: 154379 - RNA, 64 nt, hsa
cgcuggacucucagucucugagcagugaaugauucaguguuaaaugugaugaauacuguauuuu

SEQ ID NO: 154380 - RNA, 64 nt, hsa
aggaacccuuacaguaggagcccagcucugaaaccaguguuagggaagggccugccacagccuc

SEQ ID NO: 154381 - RNA, 64 nt, hsa
uuaacauuuauagugaggauugacagaaauuaagcaguguuaagaauaccagcauccauguuac

SEQ ID NO: 154382 - RNA, 64 nt, hsa
cggcacccaauucagcagggcugaauccccuucacaguguuaacacaaaagggcaucaccaucc

SEQ ID NO: 154383 - RNA, 64 nt, hsa
uggagaaaagcaccuggcuccagggccaguguuacaguguuacccuguaagguguuagccuuaa

SEQ ID NO: 154384 - RNA, 64 nt, hsa
aguuuucauggagaaaagcaccuggcuccagggccaguguuacaguguuacccuguaagguguu

SEQ ID NO: 154385 - RNA, 64 nt, hsa
aaagugguauuacagacauucagugacaaugaaucaguguuaauucuaaauccuugauccucug

SEQ ID NO: 154386 - RNA, 64 nt, hsa
acuccuucauuuuuccuucucccuucccuuuggacaguguuacagugaacacuuagcauccugu

SEQ ID NO: 154387 - RNA, 64 nt, hsa
uaaaaggaaguuuaauguccguuguaucacaaaucaguguuaaaacaccagaacuuuagccaaa

SEQ ID NO: 154388 - RNA, 64 nt, hsa
cuauuuacaacucaguuuuacauuuaaauucaggcaguguuaauaugccaagguagggaaugug

SEQ ID NO: 154389 - RNA, 64 nt, hsa
ucgaggguucaugcagucaguguuauaccaaacccaguguuaggagaaaggacacagcguaaug

SEQ ID NO: 154390 - RNA, 64 nt, hsa
caaugaguuauggagacucgaggguucaugcagucaguguuauaccaaacccaguguuaggaga

SEQ ID NO: 154391 - RNA, 64 nt, hsa
uguuuggaacccuccccaaagaggcagucaggcugaugcucagugcuuugugcucccugcuccu

SEQ ID NO: 154392 - RNA, 64 nt, hsa
gcuguggggauggugggguggauggucagggagggaugcucagggagggauaugcuggugugag

SEQ ID NO: 154393 - RNA, 64 nt, hsa
uaaagcuuuuaaguauagacuaccuuagcaugaagaugcucaugccuaagaaugaaaauuguug

SEQ ID NO: 154394 - RNA, 64 nt, hsa
ucccacuuuacauaaaaacccaucaggacagaaugaugcucaauauuuuaaaauucuaaaaaua

SEQ ID NO: 154395 - RNA, 64 nt, hsa
uucugcaagggggcagucuccccagcucccugaugaugcucacccccgcccccccaccucaggu

SEQ ID NO: 154396 - RNA, 64 nt, hsa
ggaggaaaggcagguaggaaggaguaaggauggagaugcucagaaucaagagcauggcggagua

SEQ ID NO: 154397 - RNA, 64 nt, hsa
cccagcgucaggugggaguacugcaaccugacgcgaugcucagacagaagggacuguggucgcu

SEQ ID NO: 154398 - RNA, 64 nt, hsa
cccaaagucagaugggaguacugcaaccugacacgaugcucagacacagaagggacugcagucg

SEQ ID NO: 154399 - RNA, 64 nt, hsa
cccaaagucaggugggaguacugcaaccugacaggaugcucagacaagaauagggcuguggccg

SEQ ID NO: 154400 - RNA, 64 nt, hsa
auccacuguuggagaugcucaacagcuagacacagaugcucacagccgaccuguggccucuugc

SEQ ID NO: 154401 - RNA, 64 nt, hsa
cucaggucuaccuggacacucauccacuguuggagaugcucaacagcuagacacagaugcucac

SEQ ID NO: 154402 - RNA, 64 nt, hsa
guuccaggauccuccacugaugguaaaaucugaggaugcucaagucccuuguauaaaauggcau

SEQ ID NO: 154403 - RNA, 64 nt, hsa
acaaaacaucauucuauaagucaguauacuuuuggaugcucaaaaugccauaucuucaaccagu

SEQ ID NO: 154404 - RNA, 64 nt, hsa
gagcccaaguagccucuggccagggacccaaugucccgaggaaucugccucccacccacugacu

SEQ ID NO: 154405 - RNA, 64 nt, hsa
aggggcccagagcaaagggcaucagggagaaagucccgaggaaaugugaccagugguuucugcu

SEQ ID NO: 154406 - RNA, 64 nt, hsa
ccaauggccaaggauuccgugugucaucugcaggagugaguaggccugcuguauuucuuguaac

SEQ ID NO: 154407 - RNA, 64 nt, hsa
uagcuuuaaguuugugcaagugaaaauguugaaaagugaguaaccucgauauuaaaaucauccu

SEQ ID NO: 154408 - RNA, 64 nt, hsa
auauuucuaucccugccagcacagugcuggacauagugaguacugaacaccuaagaggcacuca

SEQ ID NO: 154409 - RNA, 64 nt, hsa
gcacuagucagccgccugcauagacuuucuaaacagugaguaaauaccauggaaugucagaaau

SEQ ID NO: 154410 - RNA, 64 nt, hsa
ugagagaucccaucuguugguuuccagggauguaagugaguaauaaaagcuguuucaaguuuau

SEQ ID NO: 154411 - RNA, 64 nt, hsa
acauacuuacugccuuuuguggaaauucaccuagagugaguacuuuccuugugcaauggaggga

SEQ ID NO: 154412 - RNA, 64 nt, hsa
auccuuuuccuggugugcuuauuaucccuuuugcagugaguacaguuuauuaaguugucagccc

SEQ ID NO: 154413 - RNA, 64 nt, hsa
guaccucccuguguaacucaccuucccccaugacagugaguaagagacacucacaggcuaugag

SEQ ID NO: 154414 - RNA, 64 nt, hsa
aaauuucuugaaauaucacuucucccugaucugcagugaguauaaauucacuugucaccucagu

SEQ ID NO: 154415 - RNA, 64 nt, hsa
uaggaaaugguauacuauuuugcuauuuguacugagugaguacauuggcauaaauauagaaauu

SEQ ID NO: 154416 - RNA, 64 nt, hsa
aggaauuuguacuuuuucauaaugcccagugauuagugaguauuucccuuuugccaguugacaa

SEQ ID NO: 154417 - RNA, 64 nt, hsa
cauucacuugauauuggcaagguggcccacaaugagugaguagugauuuuuggauauuucaaaa

SEQ ID NO: 154418 - RNA, 64 nt, hsa
caaaccagcaaacuuuccugggcaaaucacaaucagugaguaaauagacagccuuucugcugcc

SEQ ID NO: 154419 - RNA, 64 nt, hsa
uuuacauuaaacucccuuucauguuaaucaaacaagugaguagcucacgcagcaacguuuuuaa

SEQ ID NO: 154420 - RNA, 64 nt, hsa
cuuuacugacaagaauggaauagaaauguaaaaguacucugaaaagcaauugcccuguaacuua

SEQ ID NO: 154421 - RNA, 64 nt, hsa
cagacaccguuugucccccggggcaaggucuccuuacucugagcccaggccguuccccuuggcu

SEQ ID NO: 154422 - RNA, 64 nt, hsa
gaucaauacaauaacaaaccuuuuuccuuugacauacucugaauuuuguuguuuggggggaggg

SEQ ID NO: 154423 - RNA, 64 nt, hsa
ugcugguagcuuaaaauuuuuauuuuaggacuuguacucugaauuuucaggaaccgucaaagga

SEQ ID NO: 154424 - RNA, 64 nt, hsa
uuuuuacacccuguagaauugugggcuguagcguuacucugauuuucugucuaguaucagagaa

SEQ ID NO: 154425 - RNA, 64 nt, hsa
caauccucuauuucuuuuuuuaaauauaacuuucuacucugaugagagaaugugguuuuaaucu

SEQ ID NO: 154426 - RNA, 64 nt, hsa
ugcgccaucacaacuagcugguggucaguuuuguuacucugagagcuguucacuucucugaauu

SEQ ID NO: 154427 - RNA, 64 nt, hsa
gucuaauauuucagauucuuucuuuucgacuuuauacucugaguuauuacuuacuguaaguggu

SEQ ID NO: 154428 - RNA, 64 nt, hsa
caacagcuuauaccauggaaugaggacaaggugauacucugagcuguggacugaacuggcagac

SEQ ID NO: 154429 - RNA, 64 nt, hsa
uuuuuuuuuuuuuuugguagaaaacaaagaggcauacucugauuuuuauacucuguuuuugcag

SEQ ID NO: 154430 - RNA, 64 nt, hsa
cuuuauuuuccaugagcuacuaagucauuagagauacucugaagcauaguuaguuuaggaaauc

SEQ ID NO: 154431 - RNA, 64 nt, hsa
ucuucauuugucaccaucuuuucccaugcacgcauacucugaacauccuugugugggcccaucc

SEQ ID NO: 154432 - RNA, 64 nt, hsa
agacuguguaugcaacccccaauagacccccuuuuacucugaucuggagaauguaucuggcuuc

SEQ ID NO: 154433 - RNA, 64 nt, hsa
cucucuuagaaugagaguggaggguguaggauaugaggguuaggccuuugccacauuauacaaa

SEQ ID NO: 154434 - RNA, 64 nt, hsa
auacugaguaccagcauguccauuugaacaugcagaggguuaauccugcuuccuaaagccucaa

SEQ ID NO: 154435 - RNA, 64 nt, hsa
ucauuaaaauaaauuuucacuguauuugagaugggaggguuaaggcucagggauuuuauuucag

SEQ ID NO: 154436 - RNA, 64 nt, hsa
guguaauaauaacaacuacuuugucgguugcucugaggguuaaaugaaaauaaaaagaaaaugu

SEQ ID NO: 154437 - RNA, 64 nt, hsa; identical to SEQ ID NO: 154420

SEQ ID NO: 154438 - RNA, 64 nt, hsa; identical to SEQ ID NO: 154421

SEQ ID NO: 154439 - RNA, 64 nt, hsa; identical to SEQ ID NO: 154422

SEQ ID NO: 154440 - RNA, 64 nt, hsa; identical to SEQ ID NO: 154423

SEQ ID NO: 154441 - RNA, 64 nt, hsa; identical to SEQ ID NO: 154424

SEQ ID NO: 154442 - RNA, 64 nt, hsa; identical to SEQ ID NO: 154425

SEQ ID NO: 154443 - RNA, 64 nt, hsa; identical to SEQ ID NO: 154426

SEQ ID NO: 154444 - RNA, 64 nt, hsa; identical to SEQ ID NO: 154427

SEQ ID NO: 154445 - RNA, 64 nt, hsa; identical to SEQ ID NO: 154428

SEQ ID NO: 154446 - RNA, 64 nt, hsa; identical to SEQ ID NO: 154429

SEQ ID NO: 154447 - RNA, 64 nt, hsa; identical to SEQ ID NO: 154430

SEQ ID NO: 154448 - RNA, 64 nt, hsa; identical to SEQ ID NO: 154431

SEQ ID NO: 154449 - RNA, 64 nt, hsa; identical to SEQ ID NO: 154432

SEQ ID NO: 154450 - RNA, 64 nt, hsa; identical to SEQ ID NO: 154433

SEQ ID NO: 154451 - RNA, 64 nt, hsa; identical to SEQ ID NO: 154434

SEQ ID NO: 154452 - RNA, 64 nt, hsa; identical to SEQ ID NO: 154435

SEQ ID NO: 154453 - RNA, 64 nt, hsa; identical to SEQ ID NO: 154436

SEQ ID NO: 154454 - RNA, 64 nt, hsa; identical to SEQ ID NO: 154420

SEQ ID NO: 154455 - RNA, 64 nt, hsa; identical to SEQ ID NO: 154421

SEQ ID NO: 154456 - RNA, 64 nt, hsa; identical to SEQ ID NO: 154422

SEQ ID NO: 154457 - RNA, 64 nt, hsa; identical to SEQ ID NO: 154423

SEQ ID NO: 154458 - RNA, 64 nt, hsa; identical to SEQ ID NO: 154424

SEQ ID NO: 154459 - RNA, 64 nt, hsa; identical to SEQ ID NO: 154425

SEQ ID NO: 154460 - RNA, 64 nt, hsa; identical to SEQ ID NO: 154426

SEQ ID NO: 154461 - RNA, 64 nt, hsa; identical to SEQ ID NO: 154427

SEQ ID NO: 154462 - RNA, 64 nt, hsa; identical to SEQ ID NO: 154428

SEQ ID NO: 154463 - RNA, 64 nt, hsa; identical to SEQ ID NO: 154429

SEQ ID NO: 154464 - RNA, 64 nt, hsa; identical to SEQ ID NO: 154430

SEQ ID NO: 154465 - RNA, 64 nt, hsa; identical to SEQ ID NO: 154431

SEQ ID NO: 154466 - RNA, 64 nt, hsa; identical to SEQ ID NO: 154432

SEQ ID NO: 154467 - RNA, 64 nt, hsa; identical to SEQ ID NO: 154433

SEQ ID NO: 154468 - RNA, 64 nt, hsa; identical to SEQ ID NO: 154434

SEQ ID NO: 154469 - RNA, 64 nt, hsa; identical to SEQ ID NO: 154435

SEQ ID NO: 154470 - RNA, 64 nt, hsa; identical to SEQ ID NO: 154436

SEQ ID NO: 154471 - RNA, 64 nt, hsa; identical to SEQ ID NO: 154420

SEQ ID NO: 154472 - RNA, 64 nt, hsa; identical to SEQ ID NO: 154421

SEQ ID NO: 154473 - RNA, 64 nt, hsa; identical to SEQ ID NO: 154422

SEQ ID NO: 154474 - RNA, 64 nt, hsa; identical to SEQ ID NO: 154423

SEQ ID NO: 154475 - RNA, 64 nt, hsa; identical to SEQ ID NO: 154424

SEQ ID NO: 154476 - RNA, 64 nt, hsa; identical to SEQ ID NO: 154425

SEQ ID NO: 154477 - RNA, 64 nt, hsa; identical to SEQ ID NO: 154426

SEQ ID NO: 154478 - RNA, 64 nt, hsa; identical to SEQ ID NO: 154427

SEQ ID NO: 154479 - RNA, 64 nt, hsa; identical to SEQ ID NO: 154428

SEQ ID NO: 154480 - RNA, 64 nt, hsa; identical to SEQ ID NO: 154429

SEQ ID NO: 154481 - RNA, 64 nt, hsa; identical to SEQ ID NO: 154430

SEQ ID NO: 154482 - RNA, 64 nt, hsa; identical to SEQ ID NO: 154431

SEQ ID NO: 154483 - RNA, 64 nt, hsa; identical to SEQ ID NO: 154432

SEQ ID NO: 154484 - RNA, 64 nt, hsa; identical to SEQ ID NO: 154433

SEQ ID NO: 154485 - RNA, 64 nt, hsa; identical to SEQ ID NO: 154434

SEQ ID NO: 154486 - RNA, 64 nt, hsa; identical to SEQ ID NO: 154435

SEQ ID NO: 154487 - RNA, 64 nt, hsa; identical to SEQ ID NO: 154436

SEQ ID NO: 154488 - RNA, 64 nt, hsa; identical to SEQ ID NO: 154420

SEQ ID NO: 154489 - RNA, 64 nt, hsa; identical to SEQ ID NO: 154421

SEQ ID NO: 154490 - RNA, 64 nt, hsa; identical to SEQ ID NO: 154422

SEQ ID NO: 154491 - RNA, 64 nt, hsa; identical to SEQ ID NO: 154423

SEQ ID NO: 154492 - RNA, 64 nt, hsa; identical to SEQ ID NO: 154424

SEQ ID NO: 154493 - RNA, 64 nt, hsa; identical to SEQ ID NO: 154425

SEQ ID NO: 154494 - RNA, 64 nt, hsa; identical to SEQ ID NO: 154426

SEQ ID NO: 154495 - RNA, 64 nt, hsa; identical to SEQ ID NO: 154427

SEQ ID NO: 154496 - RNA, 64 nt, hsa; identical to SEQ ID NO: 154428

SEQ ID NO: 154497 - RNA, 64 nt, hsa; identical to SEQ ID NO: 154429

SEQ ID NO: 154498 - RNA, 64 nt, hsa; identical to SEQ ID NO: 154430

SEQ ID NO: 154499 - RNA, 64 nt, hsa; identical to SEQ ID NO: 154431

SEQ ID NO: 154500 - RNA, 64 nt, hsa; identical to SEQ ID NO: 154432

SEQ ID NO: 154501 - RNA, 64 nt, hsa; identical to SEQ ID NO: 154433

SEQ ID NO: 154502 - RNA, 64 nt, hsa; identical to SEQ ID NO: 154434

SEQ ID NO: 154503 - RNA, 64 nt, hsa; identical to SEQ ID NO: 154435

SEQ ID NO: 154504 - RNA, 64 nt, hsa; identical to SEQ ID NO: 154436

SEQ ID NO: 154505 - RNA, 64 nt, hsa; identical to SEQ ID NO: 154420

SEQ ID NO: 154506 - RNA, 64 nt, hsa; identical to SEQ ID NO: 154421

SEQ ID NO: 154507 - RNA, 64 nt, hsa; identical to SEQ ID NO: 154422

SEQ ID NO: 154508 - RNA, 64 nt, hsa; identical to SEQ ID NO: 154423

SEQ ID NO: 154509 - RNA, 64 nt, hsa; identical to SEQ ID NO: 154424

SEQ ID NO: 154510 - RNA, 64 nt, hsa; identical to SEQ ID NO: 154425

SEQ ID NO: 154511 - RNA, 64 nt, hsa; identical to SEQ ID NO: 154426

SEQ ID NO: 154512 - RNA, 64 nt, hsa; identical to SEQ ID NO: 154427

SEQ ID NO: 154513 - RNA, 64 nt, hsa; identical to SEQ ID NO: 154428

SEQ ID NO: 154514 - RNA, 64 nt, hsa; identical to SEQ ID NO: 154429

SEQ ID NO: 154515 - RNA, 64 nt, hsa; identical to SEQ ID NO: 154430

SEQ ID NO: 154516 - RNA, 64 nt, hsa; identical to SEQ ID NO: 154431

SEQ ID NO: 154517 - RNA, 64 nt, hsa; identical to SEQ ID NO: 154432

SEQ ID NO: 154518 - RNA, 64 nt, hsa; identical to SEQ ID NO: 154433

SEQ ID NO: 154519 - RNA, 64 nt, hsa; identical to SEQ ID NO: 154434

SEQ ID NO: 154520 - RNA, 64 nt, hsa; identical to SEQ ID NO: 154435

SEQ ID NO: 154521 - RNA, 64 nt, hsa; identical to SEQ ID NO: 154436

SEQ ID NO: 154522 - RNA, 64 nt, hsa
ccaaaaccuuaacuaugacuaagaaauuaaagaagaaaaccagcaaacuaaaacuucugggcag

SEQ ID NO: 154523 - RNA, 64 nt, hsa
aacuuugauauucagggagguaggaaagguaacagaaaaccagcauauuuaaucaaagcaagaa

SEQ ID NO: 154524 - RNA, 64 nt, hsa
aggauuauaaaacucccaaaguaccaguuuuccagaaaaccacauuuuacaguuuaugaugauu

SEQ ID NO: 154525 - RNA, 64 nt, hsa
gcuuauaugagaaacauguuuaggcaacuagucagaaaaccagcuauggccuuacagaaaggga

SEQ ID NO: 154526 - RNA, 64 nt, hsa
gaauaccaugaucgaugaugucccaugcuucgaggaaaaccaaacacuuuccgccucucuugca

SEQ ID NO: 154527 - RNA, 64 nt, hsa
caacgagcaacaaucggaaaccaaauacuggagagaaaaccaacguuuccacccacagacccuu

SEQ ID NO: 154528 - RNA, 64 nt, hsa
cccuggaggggggccuggggcagaggaggcagcagaaaaccaaacauuucacugagaaagcccc

SEQ ID NO: 154529 - RNA, 64 nt, hsa
uguuauugcuacaggcuacugagcgucguaacaggaaaaccacccacagcugaccggcucggug

SEQ ID NO: 154530 - RNA, 64 nt, hsa
gaggauuuaauuagaaagcccagagaaaaagccagaaaaccaagguaaguuucccuuuauuuuu

SEQ ID NO: 154531 - RNA, 64 nt, hsa
gaucacaaaacugggacaucuccuagagucaaaagaaaaccacugcaacagacucauugaagaa

SEQ ID NO: 154532 - RNA, 64 nt, hsa
ucacagauacuuuuguacccauuuugcacuagaggaaaaccaugaagcaguugcucaaauguug

SEQ ID NO: 154533 - RNA, 64 nt, hsa
uuucagagcaauauucuucugcauuauaguaagagaaaaccauuuuuaaucuuaguuaaaauua

SEQ ID NO: 154534 - RNA, 64 nt, hsa
aauaaagcagaagcaaccuuuuucccucuucccagaaaaccagucuguguuuacagacagaaga

SEQ ID NO: 154535 - RNA, 64 nt, hsa
ggaacugacaauaugcaggagcaguaaacuggcagaaaaccaggaaucagagaaagaaaauaua

SEQ ID NO: 154536 - RNA, 64 nt, hsa
cuugaauaaacauuuuggaucaccuccaaagaaugaaaaccaguaguacguuuuagucauauua

SEQ ID NO: 154537 - RNA, 64 nt, hsa
aaaaauaaauuaugacauuuaguaucuaagguuagaaaaccacgcccacaugcuaauaugggug

SEQ ID NO: 154538 - RNA, 64 nt, hsa
acaauauaugcaauuuucauugaacuuaaagagugaaaaccauguaaacuauugaaacuauugu

SEQ ID NO: 154539 - RNA, 64 nt, hsa
aguguuaaugcaaaguuuacagacuuuugauauggaaaaccagauaaaacaauguuacaaaagg

SEQ ID NO: 154540 - RNA, 64 nt, hsa
aguguguuauacacuuugcuuccuucuuauuggugaaaaccagggggaugaguggcuuccaugg

SEQ ID NO: 154541 - RNA, 64 nt, hsa
ucaaguucuugauuuuuaaaauuccaacucuagagaaaaccaauauaugguggugcugggcuuu

SEQ ID NO: 154542 - RNA, 64 nt, hsa
ugacguuucuuaaaaaaaaaauuuaaaaaaugccgaaaaccagcgauugugguguggggcgggu

SEQ ID NO: 154543 - RNA, 64 nt, hsa
uauauuuaaagaaagaaauauuauugauucuauagaaaaccauuuaccaacugaaaggacacga

SEQ ID NO: 154544 - RNA, 64 nt, hsa
uuaagcaucuuuguuuuacauaaaauuagaguaugaaaaccaguguucaauuuuuuaucuuguu

SEQ ID NO: 154545 - RNA, 64 nt, hsa
uaugaagucauacauuuuugauaaaauaccuguggaaaaccagggauccucuccuguuucucuc

SEQ ID NO: 154546 - RNA, 64 nt, hsa
aaugacaagccaggucuuacagcugggcucuucagaaaaccagguuucuacauccaaagacugc

SEQ ID NO: 154547 - RNA, 64 nt, hsa
aacacugcggaaggcggcaggguccucugccuaggaaaaccagagaccuuuguucacuuguuga

SEQ ID NO: 154548 - RNA, 64 nt, hsa
aacaauacagaaggagagauagaugagagaucaugaaaaccaaauuuuaucuuuuacauggccc

SEQ ID NO: 154549 - RNA, 64 nt, hsa
guuuaaaaauuguucauguuguuuggaugguaucgaaaaccagaaaccacuuuuaauaaugugu

SEQ ID NO: 154550 - RNA, 64 nt, hsa
cuuggguuggcaauagaaggugacauggaauggagaaaaccaagauuccagauggggauaguaa

SEQ ID NO: 154551 - RNA, 64 nt, hsa
gugcuucagaugcacugccugcgggugccagucugaaaaccagaccgcacagaggccuggggcu

SEQ ID NO: 154552 - RNA, 64 nt, hsa
gaccacagugagaaccacugauuuuuuccacugaccuacugaauaucuagcauccuuagauugg

SEQ ID NO: 154553 - RNA, 64 nt, hsa
gcaagugagccaagaaccuaggagcagggccauuccuacugaaggacgggcccccuacggagau

SEQ ID NO: 154554 - RNA, 64 nt, hsa
ggaaacagacaugagcccucaacagacaacugcaccuacugauguuuugauguugaacuuccca

SEQ ID NO: 154555 - RNA, 64 nt, hsa
auuaccugggcuauuggggaaauguggucucuuuccuacugagcacauauucuuguuguauuug

SEQ ID NO: 154556 - RNA, 64 nt, hsa
aaugcaauuugaaaacuacaggcuuaggacucugugccaaaaaucucuauuuuaaaugaaaaua

SEQ ID NO: 154557 - RNA, 64 nt, hsa
augauucaagaaaugugauguagauuuuugagaaugccaaaaaucagguuucagaaaagcuaca

SEQ ID NO: 154558 - RNA, 64 nt, hsa
aauuagaauuguuggcaugaugacauuucauuugugccaaaaauauuaaaaaugccuuuuuugg

SEQ ID NO: 154559 - RNA, 64 nt, hsa
auguaauaaaugguuaacuuucaaaugaugcugcugccaaaauuauauuaauagugaguuucag

SEQ ID NO: 154560 - RNA, 64 nt, hsa
cucgggguugggccucuauauggagugaccaaaaugccaaaauuguccaucugccucugaguag

SEQ ID NO: 154561 - RNA, 64 nt, hsa
aguagggcaauggaaauaccaaaccuucugacuuugccaaaaagcauacaagcaaccuggucau

SEQ ID NO: 154562 - RNA, 64 nt, hsa
uaauucuguauuucuacuaagauaaucugcuuugugccaaaacaguaauuuccaaacuucuguu

SEQ ID NO: 154563 - RNA, 64 nt, hsa
uugcagucuguuuuuuagguguucugaagauaaaugccaaaaauuucagcucuuauuuuaaugg

SEQ ID NO: 154564 - RNA, 64 nt, hsa
gaaaauccuaauggggauuccucugguuguucacugccaaaacuguggcauuuucauuacagga

SEQ ID NO: 154565 - RNA, 64 nt, hsa
aggacuuuugugcaauauggucuuaagaaauaauugccaaaaaaaucggccaugguuugcauuu

SEQ ID NO: 154566 - RNA, 64 nt, hsa
uguauucacuuucuuuaaaaaauccaaguaaaagugccaaaacuacacuucuguaaaucucuug

SEQ ID NO: 154567 - RNA, 64 nt, hsa
cagcccucaagcuaugcuaggaaaaguuauaaaaugccaaaauauuuauaaacauuuacuuugu

SEQ ID NO: 154568 - RNA, 64 nt, hsa
uugucacugcuguaaagcaaaauauuugugaaagugccaaaauaaagucugucaugccaaaagu

SEQ ID NO: 154569 - RNA, 64 nt, hsa
aauauuugugaaagugccaaaauaaagucugucaugccaaaaguaaaucauuguauagacugac

SEQ ID NO: 154570 - RNA, 64 nt, hsa
gaaaguaauguuaaaaaaaaaaauagagguauauugccaaaacauagagccagcuugaaggggc

SEQ ID NO: 154571 - RNA, 64 nt, hsa
guguauacacaugcauauauuuacuaauccuaucugccaaaauggcuuagacacaaaaacaccu

SEQ ID NO: 154572 - RNA, 64 nt, hsa
gagacugcugaugucuguaaccacuggggagcacugccaaaaauacagcuuucugguuugugag

SEQ ID NO: 154573 - RNA, 64 nt, hsa
uuaauuaguaugguauaaucuuuaauaaauuucgugccaaaaugcaugguuuuccacuuagcau

SEQ ID NO: 154574 - RNA, 64 nt, hsa
aguauaaaauuuccucaccugaaguaacuuuguuugccaaaaaaguuguuuuaauaaacuauaa

SEQ ID NO: 154575 - RNA, 64 nt, hsa
aaacaugucccaaauuucuaaaauucugcuucucugccaaaagcaaugucuuucuugguugaua

SEQ ID NO: 154576 - RNA, 64 nt, hsa
uucugcuuuuggggaauugugcuaugaaagcagcugccaaaauaagcucauuuauuuucuucaa

SEQ ID NO: 154577 - RNA, 64 nt, hsa
uggaaaaauugucuuccacaaaacuggucccuggugccaaaaauguuggggaccacugcucuag

SEQ ID NO: 154578 - RNA, 64 nt, hsa
cagaaaaugaacuaagacaaugcccuagaugagcugccaaaaucugagcagauaugagccauca

SEQ ID NO: 154579 - RNA, 64 nt, hsa
uagcuugauuuaaucaucccacacuguauacauaugccaaaauaucauuuuguaugccauaaua

SEQ ID NO: 154580 - RNA, 64 nt, hsa
uaagaugaauccaaaugugaaagaugcauguuacugccaaaaccaaauugagcucagcuuccua

SEQ ID NO: 154581 - RNA, 64 nt, hsa
uucgcaaauguugcucuagucaguccagcucaucugccaaaauguagggcuaccgucuuggaug

SEQ ID NO: 154582 - RNA, 64 nt, hsa
caaaaaaacaaugugcccccagaugucagaaugaggcgacuagggcaccauacucacuuuccag

SEQ ID NO: 154583 - RNA, 64 nt, hsa
cguggguccaucguucuuccgagaggguuuguguggcgacuacacccucagcgucccuggcaag

SEQ ID NO: 154584 - RNA, 64 nt, hsa
uuuucucuccucucuucugccucuuuucacuuuuggcgacuagaaacaauuccaguaaauguga

SEQ ID NO: 154585 - RNA, 64 nt, hsa
ucauccuuugggaggcugacuuggacccaaacugggcgacuagggcuuugagcugggcaguuuu

SEQ ID NO: 154586 - RNA, 64 nt, hsa
uggcauuuucggaggaaacuuguaggacacccaaggcgacuaagagacagccuccuuggcaagg

SEQ ID NO: 154587 - RNA, 64 nt, hsa
ucucaggacacccugccacaccccacggggcuugggcgacuacagggucuucgggccccagccc

SEQ ID NO: 154588 - RNA, 64 nt, hsa
acagaagacuucaagccagccaggaaauuaaaguggcgacuaaaacagccuuaagaauugcagu

SEQ ID NO: 154589 - RNA, 64 nt, hsa
cuuuccacauuauguuguagcuggcuggcugucaggcgacuacaagacugagggucuugugccu

SEQ ID NO: 154590 - RNA, 64 nt, hsa
ucauaccccaagccaggcacuagauuuuggagggggcgacuaccccagugccccccccgcucca

SEQ ID NO: 154591 - RNA, 64 nt, hsa
aguuaucgguuguggugcugugcagcgcucugugggcgacuaagugccacucacgcagcauguu

SEQ ID NO: 154592 - RNA, 64 nt, hsa; identical to SEQ ID NO: 148065

SEQ ID NO: 154593 - RNA, 64 nt, hsa; identical to SEQ ID NO: 148066

SEQ ID NO: 154594 - RNA, 64 nt, hsa; identical to SEQ ID NO: 148067

SEQ ID NO: 154595 - RNA, 64 nt, hsa; identical to SEQ ID NO: 148068

SEQ ID NO: 154596 - RNA, 64 nt, hsa; identical to SEQ ID NO: 148069

SEQ ID NO: 154597 - RNA, 64 nt, hsa; identical to SEQ ID NO: 148070

SEQ ID NO: 154598 - RNA, 64 nt, hsa; identical to SEQ ID NO: 148071

SEQ ID NO: 154599 - RNA, 64 nt, hsa; identical to SEQ ID NO: 148072

SEQ ID NO: 154600 - RNA, 64 nt, hsa; identical to SEQ ID NO: 148073

SEQ ID NO: 154601 - RNA, 64 nt, hsa; identical to SEQ ID NO: 148074

SEQ ID NO: 154602 - RNA, 64 nt, hsa; identical to SEQ ID NO: 148075

SEQ ID NO: 154603 - RNA, 64 nt, hsa; identical to SEQ ID NO: 148076

SEQ ID NO: 154604 - RNA, 64 nt, hsa; identical to SEQ ID NO: 148077

SEQ ID NO: 154605 - RNA, 64 nt, hsa; identical to SEQ ID NO: 148078

SEQ ID NO: 154606 - RNA, 64 nt, hsa; identical to SEQ ID NO: 148079

SEQ ID NO: 154607 - RNA, 64 nt, hsa; identical to SEQ ID NO: 148080

SEQ ID NO: 154608 - RNA, 64 nt, hsa; identical to SEQ ID NO: 148081

SEQ ID NO: 154609 - RNA, 64 nt, hsa; identical to SEQ ID NO: 148082

SEQ ID NO: 154610 - RNA, 64 nt, hsa; identical to SEQ ID NO: 148083

SEQ ID NO: 154611 - RNA, 64 nt, hsa; identical to SEQ ID NO: 148084

SEQ ID NO: 154612 - RNA, 64 nt, hsa; identical to SEQ ID NO: 148085

SEQ ID NO: 154613 - RNA, 64 nt, hsa; identical to SEQ ID NO: 148086

SEQ ID NO: 154614 - RNA, 64 nt, hsa; identical to SEQ ID NO: 148087

SEQ ID NO: 154615 - RNA, 64 nt, hsa; identical to SEQ ID NO: 148088

SEQ ID NO: 154616 - RNA, 64 nt, hsa; identical to SEQ ID NO: 148089

SEQ ID NO: 154617 - RNA, 64 nt, hsa; identical to SEQ ID NO: 148090

SEQ ID NO: 154618 - RNA, 64 nt, hsa; identical to SEQ ID NO: 148091

SEQ ID NO: 154619 - RNA, 64 nt, hsa; identical to SEQ ID NO: 148092

SEQ ID NO: 154620 - RNA, 64 nt, hsa; identical to SEQ ID NO: 148093

SEQ ID NO: 154621 - RNA, 64 nt, hsa; identical to SEQ ID NO: 148094

SEQ ID NO: 154622 - RNA, 64 nt, hsa; identical to SEQ ID NO: 148095

SEQ ID NO: 154623 - RNA, 64 nt, hsa; identical to SEQ ID NO: 148096

SEQ ID NO: 154624 - RNA, 64 nt, hsa; identical to SEQ ID NO: 148097

SEQ ID NO: 154625 - RNA, 64 nt, hsa; identical to SEQ ID NO: 148098

SEQ ID NO: 154626 - RNA, 64 nt, hsa; identical to SEQ ID NO: 148099

SEQ ID NO: 154627 - RNA, 64 nt, hsa; identical to SEQ ID NO: 148100

SEQ ID NO: 154628 - RNA, 64 nt, hsa; identical to SEQ ID NO: 148101

SEQ ID NO: 154629 - RNA, 64 nt, hsa; identical to SEQ ID NO: 148102

SEQ ID NO: 154630 - RNA, 63 nt, hsa
gagauauuuugcucacuaucccuccccacuugcuucccugauaugugcucugagcuucccuga

SEQ ID NO: 154631 - RNA, 63 nt, hsa
uccccacuugcuucccugauaugugcucugagcuucccugaaccaggaucugccuauuacugc

SEQ ID NO: 154632 - RNA, 63 nt, hsa
agucuccagcccagcuuuuccccaaccaguggguucccugaguccagagccuaugccccuaga

SEQ ID NO: 154633 - RNA, 63 nt, hsa
cuggggcggcccaccccugccaagcuugccaacuucccugagguggaugucuuugugcuauua

SEQ ID NO: 154634 - RNA, 63 nt, hsa
uuguuuggcugauggaauaaagggcuuagggacuucccugaggccucuggacccaucugucuu

SEQ ID NO: 154635 - RNA, 63 nt, hsa
aagccugaaccaugccugccaugucuugucuuauucccugaggcucccuugacucaggacugu

SEQ ID NO: 154636 - RNA, 63 nt, hsa
cagacugccuucuuucacccuguccugauagacuucccugaucuagauauccuucgucaugac

SEQ ID NO: 154637 - RNA, 63 nt, hsa
gcaugcccucagccacaagcgggugacugacuguucccugaugauuuggcccaccuccugugu

SEQ ID NO: 154638 - RNA, 63 nt, hsa
ggaagggauucggcuuucaacuuugcuaccaucuucccugaagcaggaaaaugaacauggacu

SEQ ID NO: 154639 - RNA, 63 nt, hsa
cagcagguguagggccugacaagaacauauuguuucccugaccccuaggccgucacaccacac

SEQ ID NO: 154640 - RNA, 63 nt, hsa
uuugaaucuguuuucuuaguuucaaaugaccauuucccugaugcucugagcuuaugaucacac

SEQ ID NO: 154641 - RNA, 63 nt, hsa
cauuugggugggguuuccccaggcauaccuuaguucccugauccucugcaaagaguagcucau

SEQ ID NO: 154642 - RNA, 63 nt, hsa
ccccucaccccugugugcuagugucugggaaguuucccugaaaggugggaggcgggugggugg

SEQ ID NO: 154643 - RNA, 63 nt, hsa
ggaagcagcuuccugggagauuagaaauucuacuucccugacuggagcuaaaucccaccagcc

SEQ ID NO: 154644 - RNA, 63 nt, hsa
cagcaagcaaaaguugucuguggugccauuugauucccugacacugcccccugcuugaauuga

SEQ ID NO: 154645 - RNA, 63 nt, hsa
aggcagccagaccucuuuuucagaaguuguugguucccugauuuuugucuugagcaggcacca

SEQ ID NO: 154646 - RNA, 63 nt, hsa
ccccagaggaacugcucccaccucuccuucucuuucccugaaaagccuugaaggggguugagg

SEQ ID NO: 154647 - RNA, 63 nt, hsa
aaaagauaaauauuauauuauauauauauauauuucccugaaggaaccaaagcgaauuuuaaa

SEQ ID NO: 154648 - RNA, 63 nt, hsa
cucaggcccaaagccucgacacagaguggacuguucccugaggugggagauguggaaaagcca

SEQ ID NO: 154649 - RNA, 63 nt, hsa
guccaucuuuagcgcaugggcugagaacaccucuucccugaggcuucugaagguugcugucug

SEQ ID NO: 154650 - RNA, 63 nt, hsa
ucuacaagcuucaguaacuaaagaaaaaggaacuucccugaguggcuugaauguguuugccca

SEQ ID NO: 154651 - RNA, 63 nt, hsa
aaaucgaggaggcgagacuagaacugcaccagcuucccugaugucugcagccauggcuuugca

SEQ ID NO: 154652 - RNA, 63 nt, hsa
caacuauugccugggaucuugcgaaaagcgagguucccugaucccugggagccucacguauuu

SEQ ID NO: 154653 - RNA, 63 nt, hsa
aucugcugguagcaggcugggacagucccuuccuucccugaaacccugcucuauugcaauucc

SEQ ID NO: 154654 - RNA, 63 nt, hsa
cucugacuuguccuaggccgauuucucuauggcuucccugagaaaggugaggcccaaaggaga

SEQ ID NO: 154655 - RNA, 63 nt, hsa
cagggcuucugauuacucagaaacaugccccucuucccugaauaaccaagaacauguucuaug

SEQ ID NO: 154656 - RNA, 63 nt, hsa
uaucucaggguaggaaccauguggagccacacauucccugaccacagggaagcaccuggcuca

SEQ ID NO: 154657 - RNA, 63 nt, hsa
ugccuucagccuccucacuccagaaacguguguuucccugaugcgggagguguccucgccugg

SEQ ID NO: 154658 - RNA, 63 nt, hsa
guuucuccuguuuggugaaagcauuucuuaugguucccugagucaguucgucccacacauccu

SEQ ID NO: 154659 - RNA, 63 nt, hsa
acuguguugauuucuuuaaugguuugacuuuuuuucccugagggugagggaugggugggaaga

SEQ ID NO: 154660 - RNA, 63 nt, hsa
guggucuugugaguugugcagggugaagaccgcuucccugagacaggggcaguggugcugaug

SEQ ID NO: 154661 - RNA, 63 nt, hsa
cuggaagcuguguccuugcaccugcauccguaguucccugaaaacccagagaggaaucagacu

SEQ ID NO: 154662 - RNA, 63 nt, hsa
gaucagugcuugaguuuggggaaugcggccgcauucccugagucaccaggaauguuaaaguca

SEQ ID NO: 154663 - RNA, 63 nt, hsa
uccucuccucucugguagguuuaauuuuaugcuuucccugauuccagcuuucugcuuccugag

SEQ ID NO: 154664 - RNA, 63 nt, hsa
guucaugaggacuuugccucuucuccugccucauucccugacuuucucuaguuagaugucagu

SEQ ID NO: 154665 - RNA, 63 nt, hsa
cucgccuccuucagccuccuccucccucaucuguucccugaugucacauucccugugcaaucu

SEQ ID NO: 154666 - RNA, 63 nt, hsa
caccaugugccagguggcaucugccuuacugccuucccugaggagcugggacaugcugggcag

SEQ ID NO: 154667 - RNA, 63 nt, hsa
cuggauuccgaaaaggccgggaagccagucuccuucccugaagcaagcccaggagaagacucu

SEQ ID NO: 154668 - RNA, 63 nt, hsa
uucacugguucggggcugacuuugagaucuuuguucccugaggugccaggcaggcaacuuuag

SEQ ID NO: 154669 - RNA, 63 nt, hsa
acacccucaggccgagggugcagacugaugcucuucccugauggagacccugagaucuucccc

SEQ ID NO: 154670 - RNA, 63 nt, hsa
guuaauccccaccgcuuucagugguagaaagaauucccugagugggccaggcuggugcccucc

SEQ ID NO: 154671 - RNA, 63 nt, hsa
gagccacuuguaggcacauuagcuccgcucauguucccugagcacagauaaugucuuuuaauc

SEQ ID NO: 154672 - RNA, 63 nt, hsa
ucagggucaauuacagauagcuauaauaaagauuucccugagacgggagucaaaaucagcauc

SEQ ID NO: 154673 - RNA, 63 nt, hsa
cuuccgucuaucaaaaagcccccuuggcccagguucccugagcugugggauucugcacuggug

SEQ ID NO: 154674 - RNA, 63 nt, hsa
cugagcugugggauucugcacuggugcuuuggauucccugauauguuccuucaaaucugcuga

SEQ ID NO: 154675 - RNA, 63 nt, hsa
gaagaaacugugaaguauaugagccuuugaaaguucccugaaguuucucaguucaggaacauu

SEQ ID NO: 154676 - RNA, 63 nt, hsa
ccuggacaauugaggaugcccauccccuccccuuucccugaucuuuuacugaggggcugugug

SEQ ID NO: 154677 - RNA, 63 nt, hsa
gucccugcucaggugucaccuucccugagaggcuucccugaccuccugucuaaaaugucaccc

SEQ ID NO: 154678 - RNA, 63 nt, hsa
ucacuuuauucaagucccugcucaggugucaccuucccugagaggcuucccugaccuccuguc

SEQ ID NO: 154679 - RNA, 63 nt, hsa
guuguugauacagcauaagugaaucaugggcauuucccugagagcagugggagaggcccucug

SEQ ID NO: 154680 - RNA, 63 nt, hsa
cacacaggcucagcucucuccaccacccagcucuucccugaccuucacgaagggauggcucuc

SEQ ID NO: 154681 - RNA, 63 nt, hsa
aaaggagccugagugauucucuuuucuucuuguuucccugauuaugaugagcuuccauuguuc

SEQ ID NO: 154682 - RNA, 64 nt, hsa; identical to SEQ ID NO: 128910

SEQ ID NO: 154683 - RNA, 64 nt, hsa; identical to SEQ ID NO: 128911

SEQ ID NO: 154684 - RNA, 64 nt, hsa; identical to SEQ ID NO: 128912

SEQ ID NO: 154685 - RNA, 64 nt, hsa; identical to SEQ ID NO: 128913

SEQ ID NO: 154686 - RNA, 64 nt, hsa; identical to SEQ ID NO: 128914

SEQ ID NO: 154687 - RNA, 64 nt, hsa; identical to SEQ ID NO: 128915

SEQ ID NO: 154688 - RNA, 64 nt, hsa; identical to SEQ ID NO: 128916

SEQ ID NO: 154689 - RNA, 64 nt, hsa; identical to SEQ ID NO: 128917

SEQ ID NO: 154690 - RNA, 64 nt, hsa; identical to SEQ ID NO: 128918

SEQ ID NO: 154691 - RNA, 64 nt, hsa; identical to SEQ ID NO: 128919

SEQ ID NO: 154692 - RNA, 64 nt, hsa; identical to SEQ ID NO: 128920

SEQ ID NO: 154693 - RNA, 64 nt, hsa; identical to SEQ ID NO: 128921

SEQ ID NO: 154694 - RNA, 64 nt, hsa; identical to SEQ ID NO: 128922

SEQ ID NO: 154695 - RNA, 64 nt, hsa; identical to SEQ ID NO: 128923

SEQ ID NO: 154696 - RNA, 64 nt, hsa; identical to SEQ ID NO: 128924

SEQ ID NO: 154697 - RNA, 64 nt, hsa; identical to SEQ ID NO: 128925

SEQ ID NO: 154698 - RNA, 64 nt, hsa; identical to SEQ ID NO: 128926

SEQ ID NO: 154699 - RNA, 64 nt, hsa; identical to SEQ ID NO: 128927

SEQ ID NO: 154700 - RNA, 64 nt, hsa; identical to SEQ ID NO: 128928

SEQ ID NO: 154701 - RNA, 64 nt, hsa; identical to SEQ ID NO: 128929

SEQ ID NO: 154702 - RNA, 64 nt, hsa; identical to SEQ ID NO: 128930

SEQ ID NO: 154703 - RNA, 64 nt, hsa; identical to SEQ ID NO: 128931

SEQ ID NO: 154704 - RNA, 64 nt, hsa; identical to SEQ ID NO: 128932

SEQ ID NO: 154705 - RNA, 64 nt, hsa; identical to SEQ ID NO: 128933

SEQ ID NO: 154706 - RNA, 64 nt, hsa; identical to SEQ ID NO: 128934

SEQ ID NO: 154707 - RNA, 64 nt, hsa; identical to SEQ ID NO: 128935

SEQ ID NO: 154708 - RNA, 64 nt, hsa; identical to SEQ ID NO: 128936

SEQ ID NO: 154709 - RNA, 64 nt, hsa; identical to SEQ ID NO: 128937

SEQ ID NO: 154710 - RNA, 64 nt, hsa; identical to SEQ ID NO: 128938

SEQ ID NO: 154711 - RNA, 64 nt, hsa; identical to SEQ ID NO: 128939

SEQ ID NO: 154712 - RNA, 64 nt, hsa; identical to SEQ ID NO: 128940

SEQ ID NO: 154713 - RNA, 64 nt, hsa; identical to SEQ ID NO: 128941

SEQ ID NO: 154714 - RNA, 64 nt, hsa; identical to SEQ ID NO: 128942

SEQ ID NO: 154715 - RNA, 64 nt, hsa; identical to SEQ ID NO: 128943

SEQ ID NO: 154716 - RNA, 64 nt, hsa
gauguuuuuaggcacagaaguuggagaagagauuucaugaaagacaacaucacugcauugagag

SEQ ID NO: 154717 - RNA, 64 nt, hsa
auuuccuaaaaucaugucuugaaaacauguuuucucaugaaacuugaauacuaucucaaauagg

SEQ ID NO: 154718 - RNA, 64 nt, hsa
cagaauuaggcauauguacaaaaccaaaauuuugucaugaaauuuugccuuuccacgcuucccu

SEQ ID NO: 154719 - RNA, 64 nt, hsa
ggccuaaugaggugauuaggugaagucucugcccucaugaaaagauuaaucccauuaucucagg

SEQ ID NO: 154720 - RNA, 64 nt, hsa
aucuaugaauucaucaugaaagacaagcaauccaucaugaaauucguucuaaaagugaaucaau

SEQ ID NO: 154721 - RNA, 64 nt, hsa
aauuuaagaaauaggaaagucaucuaugaauucaucaugaaagacaagcaauccaucaugaaau

SEQ ID NO: 154722 - RNA, 63 nt, hsa
cagaacuguaugaccccuuuagaaauaaaauuuaucaugaaaugcuaguucuuuuaaguuugu

SEQ ID NO: 154723 - RNA, 64 nt, hsa
uaagcauguguauauaauaaauaagcauguuuuaucaugaaaaauuauugugaacaauuuagau

SEQ ID NO: 154724 - RNA, 64 nt, hsa
uaacaaaucaaauugcacuuuuggaagcccggugucaugaaaugaaaccaaaccucggugccau

SEQ ID NO: 154725 - RNA, 64 nt, hsa
ugaguuguauaaaauacauacucccuaaacuagaucaugaaacugguuucuguuuuaugcaguu

SEQ ID NO: 154726 - RNA, 64 nt, hsa
accuaggauuguacaguuuaccauaaaauuuacuucaugaaagugggaaucacugaacauguag

SEQ ID NO: 154727 - RNA, 64 nt, hsa
guuuaagagagauuuuggucuuaaaggcuucacaucaugaaaguguacaugcauaugcaagugu

SEQ ID NO: 154728 - RNA, 64 nt, hsa
aguuagacauaaugcauauaacgugauauuugguucaugaaagaguuguuuucaugugguuauu

SEQ ID NO: 154729 - RNA, 64 nt, hsa
cacuuguguuucuacacagcaaaccauuuuucuuucaugaaaauaauauauuauuaacaugaau

SEQ ID NO: 154730 - RNA, 64 nt, hsa
gacuuuuacagguaagugcaaaggagaagugguuucaugaaauguucuaauguauaauaacauu

SEQ ID NO: 154731 - RNA, 64 nt, hsa
auuugauuaucuuaaaaauuguuaaauaccguuuucaugaaauuucucaguauuguaacagcaa

SEQ ID NO: 154732 - RNA, 64 nt, hsa
cauuccaaaguuauugccuacuaaguaaugacugucaugaaagcagcauugaaauaauuuguuu

SEQ ID NO: 154733 - RNA, 64 nt, hsa
cagaaacauaugggcugauaaacccggggugaccucaugaaaugaguugcagcagaaguuuauu

SEQ ID NO: 154734 - RNA, 64 nt, hsa
uauucuugaaccuucugaaaauaaguugcagacaucaugaaaauguaaaauacuucaucauauu

SEQ ID NO: 154735 - RNA, 64 nt, hsa
uaaagcccucuguggcugccacaaaagacuagaaucaugaaaucuuuguccaagcuaagaaagg

SEQ ID NO: 154736 - RNA, 64 nt, hsa
gggagggaggguuuaucacugcuuaacuucaucuucaugaaaugaaacuuuguaacuuauugua

SEQ ID NO: 154737 - RNA, 64 nt, hsa
ugggagaaacuuugugaaugcaccauuuugaugaucaugaaacgcugaugaaaaaugccuccaa

SEQ ID NO: 154738 - RNA, 64 nt, hsa
uugaggaagauuggguaaugcugauguguuccauucaugaaacuguauuugauacauaauccua

SEQ ID NO: 154739 - RNA, 64 nt, hsa
uccauauuuuaaggaaggagcuaaaaauggaaauucaugaaacauaaaugguaucaagaacuuu

SEQ ID NO: 154740 - RNA, 64 nt, hsa
ccucuccgcauugccuauugauacacuuuacuaaucaugaaauucuaaccuaaaaggaaaacau

SEQ ID NO: 154741 - RNA, 64 nt, hsa
ccuggcauauuuauuuugcagucuuguugaaaguucaugaaacuuuguacuuuuuaauaagaug

SEQ ID NO: 154742 - RNA, 64 nt, hsa
cagacucacgcuuuuuuaaacaauaaaugucauuucaugaaaucuuuggugauaaaguauuuug

SEQ ID NO: 154743 - RNA, 64 nt, hsa
ugggaacagccauguuaacgugagcaaauuccucucaugaaauagccugcagcuauuaagaagc

SEQ ID NO: 154744 - RNA, 64 nt, hsa
ccucaccgcgccagcgugaaguucccgggcauggucaugaaagcgugguucuguaagaaaucag

SEQ ID NO: 154745 - RNA, 64 nt, hsa
uaauguugaauuugccuuuuaggaaaacaauguuucaugaaacacuuguaagauacuuauuuug

SEQ ID NO: 154746 - RNA, 64 nt, hsa
agagucacccguggcuccuaaggaaaaaacagcaucaugaaaggcaaaaaguauuugaaacgua

SEQ ID NO: 154747 - RNA, 64 nt, hsa
aaaacucagcaauaauuugggcagcuaaugaaugucaugaaagcuguagaaucuacaucaccau

SEQ ID NO: 154748 - RNA, 64 nt, hsa
uaaugucuguuuccaggguucagaaaaggcaaacucaugaaaugccacugaaaagaacuuucaa

SEQ ID NO: 154749 - RNA, 64 nt, hsa
ugcccauccaggagaaguggguaguaauucuucaucaugaaaaugauauauuacauauuuagua

SEQ ID NO: 154750 - RNA, 64 nt, hsa
ucagagauaccaucuugagaaauccuccuugguaucaugaaacuggagcagaggaauugcaauu

SEQ ID NO: 154751 - RNA, 64 nt, hsa
uucaguuguaguuuggaagguuccuugguguggcucaugaaaucacagagcucagagauaccau

SEQ ID NO: 154752 - RNA, 64 nt, hsa
ggaaagccuuuguuuccuucacuuccuuucgauaucaugaaaggacucacacuggagagaaccc

SEQ ID NO: 154753 - RNA, 64 nt, hsa
gcaaagcuuucacuucuuccaguucuuuucaauaucaugaaagaacacacuagggagaaacccu

SEQ ID NO: 154754 - RNA, 64 nt, hsa
caaaagccuuuauuucuuccacuucuuuucaauaucaugaaaggacucacaugggagagaaacc

SEQ ID NO: 154755 - RNA, 64 nt, hsa
ggaaagccuucauuucuucuaguucccuucaauaucaugaaaggacucacacuggagagaagcc

SEQ ID NO: 154756 - RNA, 64 nt, hsa
guaaagccuucaaucuuuccaguuccuuucaguaucaugaaaggacucacacuggagagaaacc

SEQ ID NO: 154757 - RNA, 64 nt, hsa
ggaaagccuucagaucugccucacaccuucaaauucaugaaaggacacaaacacacauaagaau

SEQ ID NO: 154758 - RNA, 64 nt, hsa
ggaaagccuucagaucugccaagaaccuucgaauucaugaaaggacacaaacacacguaagaau

SEQ ID NO: 154759 - RNA, 64 nt, hsa
uauaaacaauacagaaggagagauagaugagagaucaugaaaaccaaauuuuaucuuuuacaug

SEQ ID NO: 154760 - RNA, 64 nt, hsa
ggaccacaugaguucugguugguaaguguccuugucaugaaaacacuugccuuacaaggcucua

SEQ ID NO: 154761 - RNA, 64 nt, hsa
acauaugauaaugauaccaaaggaaagauaauuaucaugaaaccaacuuuuggaucauucccuu

SEQ ID NO: 154762 - RNA, 64 nt, hsa
uagcaagguuugagaugcuauauuaacauuuaaaucaugaaaaugagcaaguaaauagaauaau

SEQ ID NO: 154763 - RNA, 64 nt, hsa
gcccuggccucccucccccuaccucacacgcugcucaugaaaguuuccacccacgcugucucca

SEQ ID NO: 154764 - RNA, 64 nt, hsa
aaauaaauccuaccugguuuuuaaauuuuauuuuucaugaaaaugcuccuuucucuacauuuau

SEQ ID NO: 154765 - RNA, 64 nt, hsa
uggucccauuccagacaggggccucuggccuggcugaguucacagcccagucuggggacagcug

SEQ ID NO: 154766 - RNA, 64 nt, hsa
uugggaggacucacugacauaccuaccuucaagaugaguucaggugggcucaguucuggggcuu

SEQ ID NO: 154767 - RNA, 64 nt, hsa
agaggauagcgguuuccaucauaaaccaagaugaugaguucagccuuuaucccucgugguucca

SEQ ID NO: 154768 - RNA, 64 nt, hsa
agaggauagcgguuuccaucauaaaccaagaugaugaguucagccuuuaucccucgugguuccg

SEQ ID NO: 154769 - RNA, 64 nt, hsa
uuuuauuuucugaacuugauguuuuugcauucuuugaguucaguuuaaagacaacuacgagcau

SEQ ID NO: 154770 - RNA, 64 nt, hsa
gguuagaguucaucagaaacagaauucuaaaaugugaguucaauucaauaaauuugaauuucug

SEQ ID NO: 154771 - RNA, 64 nt, hsa
aggcagagguaugcuccugcuguaaucaggcaaaugaguucaacuggauuucuuuugacaauac

SEQ ID NO: 154772 - RNA, 64 nt, hsa
uuuguaacauugugcuuccuuguaguuuguaaugugaguucaaucaguauuuauguugaaauuu

SEQ ID NO: 154773 - RNA, 64 nt, hsa; identical to SEQ ID NO: 154770

SEQ ID NO: 154774 - RNA, 64 nt, hsa; identical to SEQ ID NO: 154769

SEQ ID NO: 154775 - RNA, 64 nt, hsa
ucggaaaauucacccuaaaagucucacaaaagaaugaguucauggggagauucuguaaagugau

SEQ ID NO: 154776 - RNA, 64 nt, hsa
aagcugucagcugaaccugacugaguguucuuccugaguucacgaggauaggcuagagugcauu

SEQ ID NO: 154777 - RNA, 64 nt, hsa
aaaaauaauuguccuuuuuucuuucuuucuuuuuuuacaauaaggcucuugaaaauugucauua

SEQ ID NO: 154778 - RNA, 64 nt, hsa
acucuagcccugacuaugaugccccugugugcauuuacaauaaagacuccaacggagggagccu

SEQ ID NO: 154779 - RNA, 64 nt, hsa
aaauccuucccauccaucuguuuacuacaauagguuacaauaauucacugaucacauccauuuu

SEQ ID NO: 154780 - RNA, 64 nt, hsa
acuuucacacaagggucuguaacaauuguauaucuuacaauauuuuuccuugcauuguaauuuu

SEQ ID NO: 154781 - RNA, 64 nt, hsa
uaacccccuuaaauuuaauaccagauaccuuaucuuacaauauugauugggaaaacauuugcug

SEQ ID NO: 154782 - RNA, 64 nt, hsa
uguagaggcuuguuuaccuuucucucucuaagguuuacaauaggaguggugauuugaaaaauau

SEQ ID NO: 154783 - RNA, 64 nt, hsa
uuauaguaguacauuaugaaucacauauaaaaucuuacaauacagaacaacuguuaagauggaa

SEQ ID NO: 154784 - RNA, 64 nt, hsa
gcagaaaacguucagauuuuguaguuaauuuucauuacaauagaaacaugcacauggaaaccca

SEQ ID NO: 154785 - RNA, 64 nt, hsa
ugcacuaaauagugcacugcaagaccagaaaauuuuacaauauuuuuucuuuacaauauguucu

SEQ ID NO: 154786 - RNA, 64 nt, hsa
cugcaagaccagaaaauuuuacaauauuuuuucuuuacaauauguucuguaguauguuuacccu

SEQ ID NO: 154787 - RNA, 64 nt, hsa
cuacuuuaacuaguuuuauaaauuucuuaauauguuacaauaacuuagggacauuuugacaccc

SEQ ID NO: 154788 - RNA, 64 nt, hsa
agcuauauuuccacuuagaaaaacuaagguaauuuuacaauauaugcugagauuaaaaaccaag

SEQ ID NO: 154789 - RNA, 64 nt, hsa
ugaaauacaaggaaaugcaguaaagccagggaauuuacaauaacauuuccguuuccaucauuga

SEQ ID NO: 154790 - RNA, 64 nt, hsa
gguuuguguauauauacauauacaaauacaacauuuacaauaaauaaaauacuugaaauucucu

SEQ ID NO: 154791 - RNA, 64 nt, hsa
uuuuuacuaugauauccauuuuccagaauugugauuacaauaugcaaagagucauaaauaugcc

SEQ ID NO: 154792 - RNA, 64 nt, hsa
gauuacaauaugcaaagagucauaaauaugccauuuacaauaaggaggaggcaaggcaaaugca

SEQ ID NO: 154793 - RNA, 64 nt, hsa
gaguucuuaaaauuuugucagagccuucuucauuuuacaauauuuuguuauuuuuauuuuaccu

SEQ ID NO: 154794 - RNA, 64 nt, hsa
aauauuuuguuauuuuuauuuuaccuuuuucauuuuacaauauuucguuauuuuuauuuuaccu

SEQ ID NO: 154795 - RNA, 64 nt, hsa
uuauuuugggaagaaaaccuguauuuuuguuaguuuacaauauuaugaaauuucacuucaggag

SEQ ID NO: 154796 - RNA, 64 nt, hsa
aaacaaaauugcaauuucuuagguaaccuuauauuuacaauaaaugaagauuacccucaaaugc

SEQ ID NO: 154797 - RNA, 64 nt, hsa
caauugucuauauggaauuuaggauaaagaauauuuacaauaaagaauauuuacaauaaagagu

SEQ ID NO: 154798 - RNA, 64 nt, hsa
auuuaggauaaagaauauuuacaauaaagaauauuuacaauaaagaguuuauuauuauuuguaa

SEQ ID NO: 154799 - RNA, 64 nt, hsa
auuaauuggcuauauggaauuuaggauagaauauuuacaauaaagaguauuuacaauaaagagu

SEQ ID NO: 154800 - RNA, 64 nt, hsa
gaauuuaggauagaauauuuacaauaaagaguauuuacaauaaagaguuuguuauuauuuguaa

SEQ ID NO: 154801 - RNA, 64 nt, hsa
uccauauggacuguggauaccuaucuaaaagaagaaaacugauggcuaaguuugcaugaaaacu

SEQ ID NO: 154802 - RNA, 64 nt, hsa
uuacauuucaaaagugaacuugauucaaccugagaaaacugauuaaaaaauuaguuuaaauuug

SEQ ID NO: 154803 - RNA, 64 nt, hsa
uuuguaauuuuuuuucuacaaaugucuaacauccaaaacugaggguugggaaaaggacuucccu

SEQ ID NO: 154804 - RNA, 64 nt, hsa
aucccagcuuggugggaaagugcagaagaauugcaaaacugacaucccauuucacagcaauagu

SEQ ID NO: 154805 - RNA, 64 nt, hsa
ccuuuaaacagcaguuuguaaacuaugcaacugaaaaacugaggaugauuguuagcuccacgag

SEQ ID NO: 154806 - RNA, 64 nt, hsa
acuaauaaauguguuuuuacuuuuuauucccguuaaaacugauguaaaacaggauaaaggcuug

SEQ ID NO: 154807 - RNA, 64 nt, hsa
uuaugauuaagcuuaaacccuguuagcaaaacugaaaacugaaauguucucaauaucaacauau

SEQ ID NO: 154808 - RNA, 64 nt, hsa
gcaauuguuaugauuaagcuuaaacccuguuagcaaaacugaaaacugaaauguucucaauauc

SEQ ID NO: 154809 - RNA, 64 nt, hsa
agccuguggcccauugggugauuuccuguauuuuaaaacugacaguagccugaucaaagugaua

SEQ ID NO: 154810 - RNA, 64 nt, hsa
ucauauccacaauuccaaaaucuccaaaccucugaaaacugaaauauuuuucauaaauuaggcg

SEQ ID NO: 154811 - RNA, 64 nt, hsa
acagaaacuacauuguaaccuguuugucuuucuuaaaacugacauuuguuguuaaugucauuug

SEQ ID NO: 154812 - RNA, 64 nt, hsa
guaaauccuaaucuuagaguuaucaaaagaagaaaaaacugaagguacuuuacucccuauagag

SEQ ID NO: 154813 - RNA, 64 nt, hsa
agcugggaggcauuacauagucaugugcgaggucaaaacugagucaccaccacaaccaaguucc

SEQ ID NO: 154814 - RNA, 64 nt, hsa
ugagacuuggucucuaaaaaagaaaaaaaaaaauaaaacugauguaaugaauauauaauuacaa

SEQ ID NO: 154815 - RNA, 64 nt, hsa
uucauagacuuuuccaauccuuaguuaaauauuaaaaacugaguauuguaguuauuugcuaggu

SEQ ID NO: 154816 - RNA, 64 nt, hsa
cuuuaagcaaacuacuacagccaacucaaaagcuaaaacugaacaaauuugauguuaugcaaac

SEQ ID NO: 154817 - RNA, 64 nt, hsa
ucaacgaauaguaaauaaugaacucgugcaagacaaaacugaaacccucuuuccaggaccucag

SEQ ID NO: 154818 - RNA, 64 nt, hsa
ugauuauguggucacacccaagucacagaaauaaaaaacugacuuuaccgcugcaauuuuucug

SEQ ID NO: 154819 - RNA, 64 nt, hsa
aacagugguuuuauuuuuuccucuacucaaaguuaaaacugaccaaaguuacuggcuuuuuacu

SEQ ID NO: 154820 - RNA, 64 nt, hsa
aaaaaaauagcaucuaguccaacuccuugauuguaaaacugaaaaacuaagguuauuugaaugu

SEQ ID NO: 154821 - RNA, 64 nt, hsa
guuugcauacagugaacacauaaaaucuauauugaaaacugacagaaauaugaaugucgagggg

SEQ ID NO: 154822 - RNA, 64 nt, hsa
uuaacuaaaggguaguuguuuuacaaugaagacuaaaacugaacaagauguugcaugcucuuga

SEQ ID NO: 154823 - RNA, 64 nt, hsa
uuggauaaauagcacauuuauaagaaccgcaaugaaaacugacuugaaauaaugcuuguaauca

SEQ ID NO: 154824 - RNA, 64 nt, hsa
aacuugcaauauuuuugcaaaaaaaucugucguuaaaacugaggauaaaauaccugcucaauuu

SEQ ID NO: 154825 - RNA, 64 nt, hsa
aagucuuuuuaaaagaaacaugguuuacuugcacaaaacugaucaguuuugagagaucguuaau

SEQ ID NO: 154826 - RNA, 64 nt, hsa
uugcugccaguuaucauaggcuguuuuaaguuagaaaacugaauagcaacacugaauacuguag

SEQ ID NO: 154827 - RNA, 64 nt, hsa
gugucuacaguuuauccauauaacuucucuucugaaaacugaggaguguccucuguucuuccag

SEQ ID NO: 154828 - RNA, 64 nt, hsa
caucacauggaacuguaaggccauauaacuacacaaaacugaccaaucuggguugccaaagcag

SEQ ID NO: 154829 - RNA, 64 nt, hsa
aaauuuagcaggaaaaaagagaacaucaccuuguaaaacugaagauugugaccagucagaauaa

SEQ ID NO: 154830 - RNA, 64 nt, hsa
acuacaagaagaauguaguugugcaaaucuaugcaaaacugaugguggccugcuauuuccuuca

SEQ ID NO: 154831 - RNA, 64 nt, hsa
cagcugugugauauucugcugugcaaauccaugcaaaacugacugugguagugaaaagucugua

SEQ ID NO: 154832 - RNA, 64 nt, hsa
gcuucaggauugucugguuaaauaguaugggaaaaaaacugaagaguuucacauaauuacacac

SEQ ID NO: 154833 - RNA, 64 nt, hsa
ucaaccaucuuuaagguauugugcaucgacacuaaaaacugaucaguguaaaaaggaaaaccca

SEQ ID NO: 154834 - RNA, 64 nt, hsa
uguguaucauuaaaauauauguucugcaagaauuaaaacugaguccaugaaaauaccauaggaa

SEQ ID NO: 154835 - RNA, 64 nt, hsa
ucaguaucuuagaguuuacaguuuguguuuuaaaaaaacugaagguuuuuuuuuuaagugcaac

SEQ ID NO: 154836 - RNA, 64 nt, hsa
caguauucuagguagugcccuauuuuacaauuguaaaacugaggcacgagcaaagugaagacac

SEQ ID NO: 154837 - RNA, 64 nt, hsa
acugugccuuugaguuuccucaggcugcuggaggaaaacugagacucagacaggaaagggaagg

SEQ ID NO: 154838 - RNA, 64 nt, hsa
uaacugggacuguagcccguccaaguugacacauaaaacugaccaucgggccgggggcgguggc

SEQ ID NO: 154839 - RNA, 64 nt, hsa
gcgacagggcaagacucugucucaaaaaaaauaaaaaacugaccaucuaguccuugucaucugg

SEQ ID NO: 154840 - RNA, 64 nt, hsa
ucaaaacuaggugagaaaauagagcauugugggaaaaacugaguccaacuagauuagcaaaugu

SEQ ID NO: 154841 - RNA, 64 nt, hsa
uagccgacaaugguagcuucucaaguuaugaaauaaaacugagagauaauggagaaaauaauuu

SEQ ID NO: 154842 - RNA, 64 nt, hsa
uuauuacuuuguaauuuaaaaaacugaaaaaaaaaaaacugaagaacuuuggggggaauuuugu

SEQ ID NO: 154843 - RNA, 64 nt, hsa
aaagagcaaagcuuuuuauuacuuuguaauuuaaaaaacugaaaaaaaaaaaacugaagaacuu

SEQ ID NO: 154844 - RNA, 64 nt, hsa
uuuucuuuaguuuuaauugaaaauguuugcuuuuaaaacugauagguauuguuggaaagcagga

SEQ ID NO: 154845 - RNA, 64 nt, hsa
acaguauugcagucuugaaaauccugagagcuaaaaaacugaaaggaauuuuuccacaccuuga

SEQ ID NO: 154846 - RNA, 64 nt, hsa
uaaucuaguucaaugcccuuauuuuacagaugggaaaacugaggccuggagguaggaagggacu

SEQ ID NO: 154847 - RNA, 64 nt, hsa
agcugccugagaaccuaaauuucagcaacagugaaaaacugagaugaaagauguauaauguaga

SEQ ID NO: 154848 - RNA, 64 nt, hsa
uagguaucauuccaaccucuauuuuacagaugagaaaacugaagcacagagaaguuaagugacu

SEQ ID NO: 154849 - RNA, 64 nt, hsa; identical to SEQ ID NO: 138852

SEQ ID NO: 154850 - RNA, 64 nt, hsa; identical to SEQ ID NO: 138853

SEQ ID NO: 154851 - RNA, 64 nt, hsa; identical to SEQ ID NO: 138854

SEQ ID NO: 154852 - RNA, 64 nt, hsa; identical to SEQ ID NO: 138855

SEQ ID NO: 154853 - RNA, 64 nt, hsa; identical to SEQ ID NO: 138856

SEQ ID NO: 154854 - RNA, 64 nt, hsa; identical to SEQ ID NO: 138857

SEQ ID NO: 154855 - RNA, 64 nt, hsa; identical to SEQ ID NO: 138858

SEQ ID NO: 154856 - RNA, 64 nt, hsa; identical to SEQ ID NO: 138859

SEQ ID NO: 154857 - RNA, 64 nt, hsa; identical to SEQ ID NO: 138860

SEQ ID NO: 154858 - RNA, 64 nt, hsa; identical to SEQ ID NO: 138861

SEQ ID NO: 154859 - RNA, 64 nt, hsa; identical to SEQ ID NO: 138862

SEQ ID NO: 154860 - RNA, 64 nt, hsa; identical to SEQ ID NO: 138863

SEQ ID NO: 154861 - RNA, 64 nt, hsa; identical to SEQ ID NO: 138864

SEQ ID NO: 154862 - RNA, 64 nt, hsa; identical to SEQ ID NO: 138865

SEQ ID NO: 154863 - RNA, 64 nt, hsa; identical to SEQ ID NO: 138866

SEQ ID NO: 154864 - RNA, 64 nt, hsa; identical to SEQ ID NO: 138867

SEQ ID NO: 154865 - RNA, 64 nt, hsa; identical to SEQ ID NO: 138868

SEQ ID NO: 154866 - RNA, 64 nt, hsa; identical to SEQ ID NO: 138869

SEQ ID NO: 154867 - RNA, 64 nt, hsa; identical to SEQ ID NO: 138870

SEQ ID NO: 154868 - RNA, 64 nt, hsa; identical to SEQ ID NO: 138871

SEQ ID NO: 154869 - RNA, 64 nt, hsa; identical to SEQ ID NO: 138872

SEQ ID NO: 154870 - RNA, 64 nt, hsa; identical to SEQ ID NO: 138873

SEQ ID NO: 154871 - RNA, 64 nt, hsa; identical to SEQ ID NO: 138874

SEQ ID NO: 154872 - RNA, 64 nt, hsa; identical to SEQ ID NO: 138875

SEQ ID NO: 154873 - RNA, 64 nt, hsa; identical to SEQ ID NO: 138876

SEQ ID NO: 154874 - RNA, 64 nt, hsa; identical to SEQ ID NO: 138877

SEQ ID NO: 154875 - RNA, 64 nt, hsa; identical to SEQ ID NO: 138878

SEQ ID NO: 154876 - RNA, 64 nt, hsa; identical to SEQ ID NO: 138879

SEQ ID NO: 154877 - RNA, 64 nt, hsa; identical to SEQ ID NO: 138880

SEQ ID NO: 154878 - RNA, 64 nt, hsa; identical to SEQ ID NO: 138881

SEQ ID NO: 154879 - RNA, 64 nt, hsa; identical to SEQ ID NO: 138882

SEQ ID NO: 154880 - RNA, 64 nt, hsa; identical to SEQ ID NO: 138883

SEQ ID NO: 154881 - RNA, 64 nt, hsa; identical to SEQ ID NO: 138884

SEQ ID NO: 154882 - RNA, 64 nt, hsa; identical to SEQ ID NO: 138885

SEQ ID NO: 154883 - RNA, 64 nt, hsa; identical to SEQ ID NO: 138886

SEQ ID NO: 154884 - RNA, 64 nt, hsa; identical to SEQ ID NO: 138887

SEQ ID NO: 154885 - RNA, 64 nt, hsa; identical to SEQ ID NO: 138888

SEQ ID NO: 154886 - RNA, 64 nt, hsa; identical to SEQ ID NO: 138889

SEQ ID NO: 154887 - RNA, 64 nt, hsa; identical to SEQ ID NO: 138890

SEQ ID NO: 154888 - RNA, 64 nt, hsa; identical to SEQ ID NO: 138891

SEQ ID NO: 154889 - RNA, 64 nt, hsa; identical to SEQ ID NO: 138892

SEQ ID NO: 154890 - RNA, 64 nt, hsa
uauggagagauccuccuuuacccucuugaaauuucuuagccagcaacuuguucugcaggggccc

SEQ ID NO: 154891 - RNA, 64 nt, hsa
uuguccuccacuagaggggcuaagcuugacugcccuuagccaggcaagcacaguaauguguguu

SEQ ID NO: 154892 - RNA, 64 nt, hsa
ugcuaaaaugccuuuguuuuuuuguuauuauuuucuuagccagaacaucucucuuugaacucac

SEQ ID NO: 154893 - RNA, 64 nt, hsa
uagugcuggugaaaagguagggcugagugauuaccuuagccacaggguggcugagcaggaacuu

SEQ ID NO: 154894 - RNA, 64 nt, hsa
gcagccaaaacaccaggaaacacauuucuguggccuuagccaagcaguuuguuaguuacauauu

SEQ ID NO: 154895 - RNA, 64 nt, hsa
gggguggucaaccugagaacauuuauuugaaccucuuagccacauuuccagcagggcaaaccaa

SEQ ID NO: 154896 - RNA, 64 nt, hsa
cauccccugccugaacgaagacuuccgccgcgaagcccgauagaucgggggaaaauggggccuu

SEQ ID NO: 154897 - RNA, 64 nt, hsa
ugcuaguacagugucaguuauuuaaagugguaaugcccgauaaugucuuuuaaauguuugagga

SEQ ID NO: 154898 - RNA, 64 nt, hsa
aguccucugaagacaaugagaggauuuaggaugagcccgauagguguggcagaccaaauggaca

SEQ ID NO: 154899 - RNA, 64 nt, hsa
caaaugaguaagcagugccaccaacuaguguuuugcccgauagaagagccagcauguucacguu

SEQ ID NO: 154900 - RNA, 64 nt, hsa
caggagaagugcucaaucuucaugagacaaaggggcccgauagggccagcagccacaaggccuu

SEQ ID NO: 154901 - RNA, 55 nt, hsa
gacuuacuguggaaagcugagaacugcccgauacacggcaucaucccaucucuaa

SEQ ID NO: 154902 - RNA, 64 nt, hsa
cccaccuugagccagagucaagggcugcagcacugcccgauagaacacgcccgcccucacugcu

SEQ ID NO: 154903 - RNA, 64 nt, hsa
ucugaagaaaaggucagaucuauuggaaaugacagcccgauacuugagccuccucuuuaaaagg

SEQ ID NO: 154904 - RNA, 64 nt, hsa
gguaagaggaauaauauggguaaaacaagaaauggcccgauaguuucacacuauuccuauaccu

SEQ ID NO: 154905 - RNA, 64 nt, hsa
gcugcauccaggacugugccagcacaaagugggagcccgauaaauauuuauugaagaaaugaaa

SEQ ID NO: 154906 - RNA, 64 nt, hsa
cuaacauaaguuuucacuguggugggauggugccgcccgauaugcuugauaugcuuuuccuucc

SEQ ID NO: 154907 - RNA, 64 nt, hsa
aggcaucuccaggcaaggaaaacugaagucauuggcccgauacaaaacauuuccugcaacgaag

SEQ ID NO: 154908 - RNA, 64 nt, hsa
ucuacagccgucccgcguucaagacuugagcggagcccgauauucucccugaccuuagcguucu

SEQ ID NO: 154909 - RNA, 64 nt, hsa
gcccguggacaccccagaccugcgaaggaugaucgcccgauaaagacggauucuaaggacucua

SEQ ID NO: 154910 - RNA, 64 nt, hsa
aacagaauuuguacaggugagaagccuaaugaaagcccgauauguguaaagaucuacucucaca

SEQ ID NO: 154911 - RNA, 64 nt, hsa
ugcuguauggagagugggcagacuucuguggagggcccgauaguaaccauuugaagcuuucugg

SEQ ID NO: 154912 - RNA, 64 nt, hsa; identical to SEQ ID NO: 128601

SEQ ID NO: 154913 - RNA, 64 nt, hsa; identical to SEQ ID NO: 128602

SEQ ID NO: 154914 - RNA, 64 nt, hsa; identical to SEQ ID NO: 128603

SEQ ID NO: 154915 - RNA, 64 nt, hsa; identical to SEQ ID NO: 128604

SEQ ID NO: 154916 - RNA, 64 nt, hsa; identical to SEQ ID NO: 128605

SEQ ID NO: 154917 - RNA, 64 nt, hsa; identical to SEQ ID NO: 128606

SEQ ID NO: 154918 - RNA, 64 nt, hsa; identical to SEQ ID NO: 128607

SEQ ID NO: 154919 - RNA, 64 nt, hsa; identical to SEQ ID NO: 128608

SEQ ID NO: 154920 - RNA, 64 nt, hsa; identical to SEQ ID NO: 128609

SEQ ID NO: 154921 - RNA, 64 nt, hsa; identical to SEQ ID NO: 128610

SEQ ID NO: 154922 - RNA, 64 nt, hsa; identical to SEQ ID NO: 128611

SEQ ID NO: 154923 - RNA, 64 nt, hsa; identical to SEQ ID NO: 128612

SEQ ID NO: 154924 - RNA, 64 nt, hsa; identical to SEQ ID NO: 128613

SEQ ID NO: 154925 - RNA, 64 nt, hsa; identical to SEQ ID NO: 128614

SEQ ID NO: 154926 - RNA, 64 nt, hsa; identical to SEQ ID NO: 128615

SEQ ID NO: 154927 - RNA, 64 nt, hsa; identical to SEQ ID NO: 128616

SEQ ID NO: 154928 - RNA, 64 nt, hsa; identical to SEQ ID NO: 128617

SEQ ID NO: 154929 - RNA, 64 nt, hsa; identical to SEQ ID NO: 128618

SEQ ID NO: 154930 - RNA, 64 nt, hsa; identical to SEQ ID NO: 128619

SEQ ID NO: 154931 - RNA, 64 nt, hsa; identical to SEQ ID NO: 128620

SEQ ID NO: 154932 - RNA, 64 nt, hsa; identical to SEQ ID NO: 128621

SEQ ID NO: 154933 - RNA, 64 nt, hsa; identical to SEQ ID NO: 128622

SEQ ID NO: 154934 - RNA, 64 nt, hsa; identical to SEQ ID NO: 128623

SEQ ID NO: 154935 - RNA, 64 nt, hsa; identical to SEQ ID NO: 128624

SEQ ID NO: 154936 - RNA, 64 nt, hsa; identical to SEQ ID NO: 128625

SEQ ID NO: 154937 - RNA, 64 nt, hsa; identical to SEQ ID NO: 128626

SEQ ID NO: 154938 - RNA, 64 nt, hsa; identical to SEQ ID NO: 128627

SEQ ID NO: 154939 - RNA, 64 nt, hsa; identical to SEQ ID NO: 128628

SEQ ID NO: 154940 - RNA, 64 nt, hsa; identical to SEQ ID NO: 128629

SEQ ID NO: 154941 - RNA, 64 nt, hsa; identical to SEQ ID NO: 128630

SEQ ID NO: 154942 - RNA, 64 nt, hsa; identical to SEQ ID NO: 128631

SEQ ID NO: 154943 - RNA, 64 nt, hsa; identical to SEQ ID NO: 128632

SEQ ID NO: 154944 - RNA, 64 nt, hsa; identical to SEQ ID NO: 128633

SEQ ID NO: 154945 - RNA, 64 nt, hsa; identical to SEQ ID NO: 128634

SEQ ID NO: 154946 - RNA, 64 nt, hsa; identical to SEQ ID NO: 128635

SEQ ID NO: 154947 - RNA, 64 nt, hsa; identical to SEQ ID NO: 128636

SEQ ID NO: 154948 - RNA, 64 nt, hsa; identical to SEQ ID NO: 128637

SEQ ID NO: 154949 - RNA, 64 nt, hsa; identical to SEQ ID NO: 128638

SEQ ID NO: 154950 - RNA, 64 nt, hsa; identical to SEQ ID NO: 128639

SEQ ID NO: 154951 - RNA, 64 nt, hsa; identical to SEQ ID NO: 128640

SEQ ID NO: 154952 - RNA, 64 nt, hsa; identical to SEQ ID NO: 128641

SEQ ID NO: 154953 - RNA, 64 nt, hsa; identical to SEQ ID NO: 128642

SEQ ID NO: 154954 - RNA, 64 nt, hsa; identical to SEQ ID NO: 128643

SEQ ID NO: 154955 - RNA, 64 nt, hsa; identical to SEQ ID NO: 128644

SEQ ID NO: 154956 - RNA, 64 nt, hsa; identical to SEQ ID NO: 128645

SEQ ID NO: 154957 - RNA, 64 nt, hsa; identical to SEQ ID NO: 128646

SEQ ID NO: 154958 - RNA, 64 nt, hsa; identical to SEQ ID NO: 128647

SEQ ID NO: 154959 - RNA, 60 nt, hsa
ccucuuguccugcuggaaagauagcaguguucuccugacuucgcccuacugcaugcagcc

SEQ ID NO: 154960 - RNA, 60 nt, hsa
guuucaccauguuggccaggguggucucaaucuccugaccucgugauccacccaccucga

SEQ ID NO: 154961 - RNA, 60 nt, hsa
gaccucuuuaguuugggggauccuccucacucuccugaagugucucaaguauaccagugg

SEQ ID NO: 154962 - RNA, 60 nt, hsa
gcuugagauagggggcugugguccuuccuuucuccugaggagaaaguccuugcucuggug

SEQ ID NO: 154963 - RNA, 60 nt, hsa
guuucaccauguuggccaggauggucucgaucuccugaccucgugauccacccgacucgg

SEQ ID NO: 154964 - RNA, 60 nt, hsa
cuaaacaucauucuugagagcauugggauaucuccugaaaagguuuaugaaaaagaagaa

SEQ ID NO: 154965 - RNA, 60 nt, hsa
augacaacuggugggaaaccuagcauuuccucuccugaagaauaaauguauaaauguuau

SEQ ID NO: 154966 - RNA, 60 nt, hsa
guguagcuggucagggacuuuuuuuucuuuucuccugaacuacaugauucuaauuggaau

SEQ ID NO: 154967 - RNA, 60 nt, hsa
aacaucugcucuucggguuccaccaaagagucuccugagcccugagggauggaugucucc

SEQ ID NO: 154968 - RNA, 60 nt, hsa
aagagucuccugagcccugagggauggaugucuccugacccuuccaccccgccucacucc

SEQ ID NO: 154969 - RNA, 60 nt, hsa
ucucuuguucucuccugagugucuuucuacucuccugagcgucuuucugcucuccuuauc

SEQ ID NO: 154970 - RNA, 60 nt, hsa
cauaauaagaaugggcaggaucucuuguucucuccugagugucuuucuacucuccugagc

SEQ ID NO: 154971 - RNA, 60 nt, hsa
uuauaucugguuuucccacuugucugaagcucuccugaucuuagaaccuggagcugcaga

SEQ ID NO: 154972 - RNA, 60 nt, hsa
guuucacuguguuagccaggauggucucgaucuccugaccucgugauccgcccaccuugg

SEQ ID NO: 154973 - RNA, 60 nt, hsa
ucaaggauucuaauaaauaucccgcagucaucuccugagcagcuuuccucuguuucacuu

SEQ ID NO: 154974 - RNA, 60 nt, hsa
caguauuauucuuguuuucugaauucugagucuccugaacaaaaggcuuacuauccaugg

SEQ ID NO: 154975 - RNA, 60 nt, hsa
uucagguaccaccuuugacguguggcucuuucuccugaccaucaugggaagugucugcug

SEQ ID NO: 154976 - RNA, 60 nt, hsa
uccugaauuucaaauaccucaugcaaaaugucuccugaaauaagggaaaaaaaaaaaacc

SEQ ID NO: 154977 - RNA, 60 nt, hsa
agggcucugccccuuuaacuccucacucuuucuccugaagccuugugaagaaggugcuuu

SEQ ID NO: 154978 - RNA, 60 nt, hsa
ggaucaugggggugguuuccccuacgauguucuccugauagugggugaguucucacaaga

SEQ ID NO: 154979 - RNA, 60 nt, hsa
accacauggacaugccuuacacuggcguccucuccugagucccuccgcacucuccaucag

SEQ ID NO: 154980 - RNA, 60 nt, hsa
cugccccagcuccucucugcaacccagcccucuccugagcucuaggcugggauuacaccc

SEQ ID NO: 154981 - RNA, 60 nt, hsa
uucacauuucuauucuaaaaucucagguuaucuccugaacacuuuugggcagaugaaguu

SEQ ID NO: 154982 - RNA, 60 nt, hsa
guuucaccguguuggccaggauggucuugaucuccugaccgcauaauccacccaccucgg

SEQ ID NO: 154983 - RNA, 60 nt, hsa
gaucaccaggucaagcaccuaggccuggcuucuccugagacagaggacucagaaguggcc

SEQ ID NO: 154984 - RNA, 60 nt, hsa
gauuuacuggggugggcugguccagguagcucuccugaaccuccuccuuccccaagcuga

SEQ ID NO: 154985 - RNA, 60 nt, hsa
gccguguugucccagugcccugguucagugucuccugaguggaugacaggucuucauucu

SEQ ID NO: 154986 - RNA, 60 nt, hsa
uaguucaguucuuuacuguuccucgaauaaucuccugacuaaggcaaaaaaaaaaagcuu

SEQ ID NO: 154987 - RNA, 60 nt, hsa
uuuuuuuuuuuuuuuuacuggauuucuuuuucuccugauuuucggccucagcuccuagag

SEQ ID NO: 154988 - RNA, 60 nt, hsa
guuucaccauguuagacaggauggucuccaucuccugaguuugugaucugcccgccuugg

SEQ ID NO: 154989 - RNA, 60 nt, hsa
guuucaccauguugaccaggauggucucaaucuccugaccuugugauccacccaccucgg

SEQ ID NO: 154990 - RNA, 60 nt, hsa
guuucaccguguuagccaggauagucuugaucuccugaccucgugauccgcccuccucgg

SEQ ID NO: 154991 - RNA, 60 nt, hsa
guuucaucguguuaaccaggauggucucgaucuccugaccucgugaucugcccaccucgg

SEQ ID NO: 154992 - RNA, 60 nt, hsa
guuucaccauguuggccaggauggucucgaucuccugaccuugucauccaccugucuugg

SEQ ID NO: 154993 - RNA, 60 nt, hsa
auaugcaccagcccuugugcauuuauuguuucuccugauuuuguggauuuaaauguccaa

SEQ ID NO: 154994 - RNA, 60 nt, hsa
ugcugauauuguacuuuagacauacgcuugucuccugaauguccucugaauauuuauagu

SEQ ID NO: 154995 - RNA, 60 nt, hsa
ccucugcuggggacgguaguugcuuuucucucuccugaugcuagguuggggcccacccug

SEQ ID NO: 154996 - RNA, 60 nt, hsa
gccccaugcagaugaaaaggacgggcagggucuccugagcagcagguggcucgaggcggu

SEQ ID NO: 154997 - RNA, 60 nt, hsa
gaauggaggcucuaauugaauuuucaagcaucuccugaggaucagaaaguaauuucuucu

SEQ ID NO: 154998 - RNA, 60 nt, hsa
uaagaguuagguuuaacauaaagguuauuuucuccugauauagaucacauaacagaaugc

SEQ ID NO: 154999 - RNA, 64 nt, hsa
augaacaagguaaaccucgguugccauggggaagaaggaugauguggaaaccauauugguaaag

SEQ ID NO: 155000 - RNA, 64 nt, hsa
ccuuuguacaaucacagauauccuauggagauuuaaggaugaaagcccugaguuguucuugggu

SEQ ID NO: 155001 - RNA, 64 nt, hsa
auacaugcuuaugcaugaaacaauucugcaaaaaaaggaugaauuuccuccaucacccagauuu

SEQ ID NO: 155002 - RNA, 64 nt, hsa
gaggcaggagaauaggguacagagauagggaucuaaggaugacuuggacacacucccuggcacu

SEQ ID NO: 155003 - RNA, 64 nt, hsa
auuugaccuuaagagggaagggaaaaaagugugaaaggaugaugaagaaaauaauuuuacuauu

SEQ ID NO: 155004 - RNA, 64 nt, hsa
cuaaaaagcccaugauaccuuacuguugaugaaaaaggaugaucauauauauagaacuugauua

SEQ ID NO: 155005 - RNA, 64 nt, hsa
agggcagauauuggacacuccuuauuugucaccaaaggaugacuguaggccgugugcuggccuu

SEQ ID NO: 155006 - RNA, 64 nt, hsa
caucuucauuccuuuuuauggggcuccaggucauaaggaugagauauauuugggguacuggcag

SEQ ID NO: 155007 - RNA, 64 nt, hsa
ugucucuguucagaugugcauuucaccugugacaaaggaugaagaacacagcaugugccaagau

SEQ ID NO: 155008 - RNA, 64 nt, hsa
uuauucuaauaaauauacuaugaaauaaaaaaaaaaggaugaaagcuacuuuugcuuuuguggu

SEQ ID NO: 155009 - RNA, 64 nt, hsa
acucagcacugucccuuagcagggaugacacagcaaggaugacucagcacugccccucagcaag

SEQ ID NO: 155010 - RNA, 64 nt, hsa
acacagcaaggaugacucagcacugccccucagcaaggaugacucagcacugccgcucaacaga

SEQ ID NO: 155011 - RNA, 64 nt, hsa; identical to SEQ ID NO: 155009

SEQ ID NO: 155012 - RNA, 64 nt, hsa
acacagcaaggaugacucagcacugccccucagcaaggaugacucagcacugccgcucaacagg

SEQ ID NO: 155013 - RNA, 64 nt, hsa
acucagcacugucccuuagcagugaugacacagcaaggaugacucagcacugccccucagcaag

SEQ ID NO: 155014 - RNA, 64 nt, hsa; identical to SEQ ID NO: 155010

SEQ ID NO: 155015 - RNA, 64 nt, hsa
acucagcagugucccuuagcagcgaugacacagcaaggaugacucagcacugccccucaccaag

SEQ ID NO: 155016 - RNA, 64 nt, hsa
acacagcaaggaugacucagcacugccccucaccaaggaugacucagcacugccgcucaacaga

SEQ ID NO: 155017 - RNA, 64 nt, hsa
acucagcagggaugacucagcaccgccccucagcaaggaugacucagcagggaugauucagcag

SEQ ID NO: 155018 - RNA, 64 nt, hsa
cucugcuguucucuggggccgcucagcacagaagaaggaugagggggcucagcggggggagcug

SEQ ID NO: 155019 - RNA, 64 nt, hsa
gcucuagaggaauuaaugcuggaaugggguguugaaggaugaguaggaguuaguuaggcauuga

SEQ ID NO: 155020 - RNA, 64 nt, hsa
aaggaaagccacgcaaguuggggagaaaacccccaaggaugaaucugccaauguaagucaggga

SEQ ID NO: 155021 - RNA, 64 nt, hsa
ggagacccugggagaagaacagcacaaccuugccaaggaugaagucgucuucuucggugaccac

SEQ ID NO: 155022 - RNA, 64 nt, hsa
ccaucacaaccaagucagacuuguauuauaagucaaggaugagccugaucuggggagagggccg

SEQ ID NO: 155023 - RNA, 64 nt, hsa
uagaccuugaacaacaaaaaggguauaagggaauaaggaugaacucugcugugaagagcaagcc

SEQ ID NO: 155024 - RNA, 64 nt, hsa
aacucauacauguacaccaggagauguguacaagaauauucauagcaacccuauucacaaaagc

SEQ ID NO: 155025 - RNA, 64 nt, hsa
ugcccaugagcaagagaguggacaaguaaacuggaauauucacauaauagaacauuauacaauu

SEQ ID NO: 155026 - RNA, 64 nt, hsa
gaaaauuuuuguacuccaaauuuacuucccaauaaauauucagcaaaguaguaaaaugaccuua

SEQ ID NO: 155027 - RNA, 64 nt, hsa
ugaaaagcaacuauuguuguguuacaguguuaaaaauauucaguuuucuuugacaaaaaugugu

SEQ ID NO: 155028 - RNA, 64 nt, hsa
accuaugauccucauggaacuuaauuuuuuauuaaauauucagguaacaguucugaauucaugu

SEQ ID NO: 155029 - RNA, 64 nt, hsa
auacauguagcucaacuugagguacugcuauauaaauauucacucacauuaucacggaauuuau

SEQ ID NO: 155030 - RNA, 64 nt, hsa
cggaaaauucuaaaaaucaacauuugguaacuuaaauauucauuggcacaugauucugugccug

SEQ ID NO: 155031 - RNA, 64 nt, hsa
auuuuacggcuuuauugaaaacauugauauauugaauauucauaaauuuuaauuuaacuuucuu

SEQ ID NO: 155032 - RNA, 64 nt, hsa
acugugucuuagcaauguuguauauaguucuuuuaauauucauaagguauauuuuugaauuuug

SEQ ID NO: 155033 - RNA, 64 nt, hsa
aauaucugucaaacuugaauaaugucuucucuuuaauauucacauaaggcagccuauuaacugu

SEQ ID NO: 155034 - RNA, 64 nt, hsa
caaaaucaaaugagcaaaacuaaggaugaaauguaauauucaucagaacaaggaucacugagaa

SEQ ID NO: 155035 - RNA, 64 nt, hsa
guaauauucaucagaacaaggaucacugagaaaaaauauucagaaacaacuuuaauaaaaccug

SEQ ID NO: 155036 - RNA, 64 nt, hsa
uaaaaucauauugaauguuuccaaccuggaguauaauauucagauauaaaacaguuuugucagu

SEQ ID NO: 155037 - RNA, 64 nt, hsa
gaaaauuaaaauaaguguguggucccaaguuggaaauauucaugcuucuuccuuacccugcgau

SEQ ID NO: 155038 - RNA, 64 nt, hsa
uaauguauauaguugauuggaaugagguuuuaugaauauucauguuuuugaaggccuuuaauuu

SEQ ID NO: 155039 - RNA, 64 nt, hsa
aaucaaaauacuacucuuuauaagacauuucacaaauauucacuuacauuacaggcuggaagua

SEQ ID NO: 155040 - RNA, 64 nt, hsa
uauaugcaaguacucagugauaaauggauuaaaaaauauucagaaauguauugggggguggagg

SEQ ID NO: 155041 - RNA, 64 nt, hsa
cuuauuuaaaauuguuuuuguauuuucuuaaagcaauauucacuguuacaccuuggggacuucu

SEQ ID NO: 155042 - RNA, 64 nt, hsa
uaaagcuuaauauagguuuugggggaauuauuuuaauauucaaagaauguuuuauuauaguccu

SEQ ID NO: 155043 - RNA, 64 nt, hsa
uuagagauuuaaacauucauuugauucagagcuaaauauucaccauaauccaggagggucuccu

SEQ ID NO: 155044 - RNA, 64 nt, hsa
cccugccucuugcacuaccaaugucucaagacauaauauucaucucuugcugucagacccauuc

SEQ ID NO: 155045 - RNA, 64 nt, hsa
ucuauuugaauguuaaguggucuuucuuguuuuuaauauucaugcauguauauucaucauauuu

SEQ ID NO: 155046 - RNA, 64 nt, hsa
aaauagauuuuuaaaauucagaauggacaaagagaauauucauuuucuuauuaauaagauaaag

SEQ ID NO: 155047 - RNA, 64 nt, hsa
cauuuuuaguguaguacuguuggcucguauuuagaauauucagcuacgacaguuuuggacuguu

SEQ ID NO: 155048 - RNA, 64 nt, hsa
acguauauccaaauuuguccuguaguaauagauuaauauucauagauuguugguguuuaaagau

SEQ ID NO: 155049 - RNA, 64 nt, hsa
auagaacccagcaugacauaacagugcagggcaaaauauucacugggccaauucaauacaaaca

SEQ ID NO: 155050 - RNA, 64 nt, hsa
gcaaaaaguggggcagagccucccaaggagaacaaauauucagaauauucauauuggaaaaauc

SEQ ID NO: 155051 - RNA, 64 nt, hsa
ggggcagagccucccaaggagaacaaauauucagaauauucauauuggaaaaaucacaauuuuu

SEQ ID NO: 155052 - RNA, 64 nt, hsa
caggggugguggguguggcauguggagaguugucaauauucaccaugaaguuugaugguuguua

SEQ ID NO: 155053 - RNA, 64 nt, hsa
guagaacaauuugggggccauuugacaucauuaaaauauucaaucuuccuauucauuaacaugg

SEQ ID NO: 155054 - RNA, 64 nt, hsa
aaacuugaauuugauuuaaaauagggcugggaaaaauauucaauaacuguaagcccccuuuugg

SEQ ID NO: 155055 - RNA, 64 nt, hsa
caguaaaauuagaaucagaaauacuucuuuaaaaaauauucaaaauguguuuguuucccauggg

SEQ ID NO: 155056 - RNA, 64 nt, hsa
caauuaaguuacaauuacaucucuaauuuuggauaauauucauugguuaacaauaaagugacaa

SEQ ID NO: 155057 - RNA, 64 nt, hsa
acugaagaaaucuuuccaguuagaaggagguucuaauauucacauguucuaauacuuuguuuau

SEQ ID NO: 155058 - RNA, 64 nt, hsa
aggaaauaaggaugaauauucauuuagaagaauuaauauucauauuaacacauugcucucagau

SEQ ID NO: 155059 - RNA, 64 nt, hsa
auucauccaccuauacaaguaggaaauaaggaugaauauucauuuagaagaauuaauauucaua

SEQ ID NO: 155060 - RNA, 64 nt, hsa
aucauauuguauauaaauaaugaaaugcauuaagaauauucacaacauugaacccaggaggcgg

SEQ ID NO: 155061 - RNA, 64 nt, hsa
cauuucaugagguuguacuguaauuauacacuggaauauucagguagucaucuuugauuuuuca

SEQ ID NO: 155062 - RNA, 64 nt, hsa
gaaugaaaauucugaaauuguaaaugucuauuuuaauauucaccuaugaaagaaucugugaaua

SEQ ID NO: 155063 - RNA, 64 nt, hsa
aaauccaguuucuccuauaacaugauguaaauuaaauauucaggaauauuucaggucugaaauc

SEQ ID NO: 155064 - RNA, 64 nt, hsa
aauaagcccaauucuaaguugauagguaauuuuaaauauucaaaccaaaucuucccaacaguug

SEQ ID NO: 155065 - RNA, 64 nt, hsa
cauggacauuugaucaaccuuuaguuggaauaauaauauucauauuugcuaugaauccuuuuaa

SEQ ID NO: 155066 - RNA, 64 nt, hsa
gauguuguucuuuaguuuaaguauguaacaaaguaauauucaaaggggauguuugggggugggg

SEQ ID NO: 155067 - RNA, 64 nt, hsa
uuccucuaacucccccauuuaucuuuugucuauuaauauucacuagccaacauaguauuuuugc

SEQ ID NO: 155068 - RNA, 64 nt, hsa
ggguccccuccuuuaccccugaguuccuuacuguucccccaagccugggagcagucuauccccc

SEQ ID NO: 155069 - RNA, 64 nt, hsa
uccuuacuguucccccaagccugggagcagucuaucccccaacccugccaucucccuuacucau

SEQ ID NO: 155070 - RNA, 64 nt, hsa
gauuccugggcucccagccuuaaaacucacugccucccccaagggcccccucuaaggagggugu

SEQ ID NO: 155071 - RNA, 64 nt, hsa
gacaggccuucuguacccagcguuuguacuugccucccccaacagugggccuguucuacccgug

SEQ ID NO: 155072 - RNA, 64 nt, hsa
uggaacacaucccugccuccgggaaguguggcucucccccaacccuccccaccguccccccuuc

SEQ ID NO: 155073 - RNA, 64 nt, hsa
uuuuuuuucuuuuugagacggaguuucgcuuuugucccccaagcuggaguacaaugacaggauc

SEQ ID NO: 155074 - RNA, 64 nt, hsa
gggacaagacugguugcuagcacauacuuuauuaucccccaaggauggucagccauuucuuccc

SEQ ID NO: 155075 - RNA, 64 nt, hsa
cucagcuuugggggccccagggaauuggaacucuucccccaagacagagcaggggugaacugua

SEQ ID NO: 155076 - RNA, 64 nt, hsa
aauccaccaguuuuucuaagcuagaaccuuugagucccccaaacugccugaagacuuaaguuuu

SEQ ID NO: 155077 - RNA, 64 nt, hsa
uaaccuugacgaggauacaaaagugaaagcaucaucccccaaaggaucacugcacaguccuacu

SEQ ID NO: 155078 - RNA, 64 nt, hsa
augagccuucgugcccccccuucccccuuuuuugucccccaacuugagauguaugaaggcuuuu

SEQ ID NO: 155079 - RNA, 64 nt, hsa
cggugaaggugacagcagucgguuggagcgagcaucccccaaaguucacaauguggccgaggac

SEQ ID NO: 155080 - RNA, 64 nt, hsa
gcauuuuggagaguccacaccacggaccagguuuucccccaaggcuuggcuuuguguagcuacu

SEQ ID NO: 155081 - RNA, 64 nt, hsa
gagugugggcagagagaauuauguggccucauccucccccaaggcugugcuugcagcccgggca

SEQ ID NO: 155082 - RNA, 64 nt, hsa
agggcuugcagcagcagcaguguggccaucuccaucccccaaagcacacuugcucucucaauau

SEQ ID NO: 155083 - RNA, 64 nt, hsa
cacuuuuuuaaaggggauuaaaaaacacagccucucccccaaaggguguccguucuuaauuccc

SEQ ID NO: 155084 - RNA, 64 nt, hsa
cgggaggagcagcuguguguccccggcaccucacucccccaaaaugacacccaccgucgucagg

SEQ ID NO: 155085 - RNA, 64 nt, hsa
uccuggccgaguuuccucugccccuucuugcuggucccccaaagggcgcuccgcucccugcccu

SEQ ID NO: 155086 - RNA, 64 nt, hsa
aacccaggacaucugugccaggcuucccaugcccucccccaacagucccucagcuucacccagc

SEQ ID NO: 155087 - RNA, 64 nt, hsa
cacugcucuccagccugggaggcacagcaaacugucccccaaaaaaaaaaaagaguccuuacca

SEQ ID NO: 155088 - RNA, 64 nt, hsa
acuaaagguggccacaaauucuuugacacucaagucccccaagaccuaaggguuuuaucuccuc

SEQ ID NO: 155089 - RNA, 64 nt, hsa
auuuccuucacuuaauucuauccacagucaaaaaucccccaaggaggaaagcugaaagaugcac

SEQ ID NO: 155090 - RNA, 64 nt, hsa
aaauaaguuugauaacauuuaaaagaugggcguuucccccaaugaaauacacaaguaaacauuc

SEQ ID NO: 155091 - RNA, 64 nt, hsa
ugauugagcuucagagcuaaaaugccuucacccuucccccaaguuggaauauauccucccccaa

SEQ ID NO: 155092 - RNA, 64 nt, hsa
ugccuucacccuucccccaaguuggaauauauccucccccaaauuaaggacccauuugucuucu

SEQ ID NO: 155093 - RNA, 64 nt, hsa
guguuuuaggacauugcaaaucuucuagaaguucucccccaaaucaggucaaugugugcccucc

SEQ ID NO: 155094 - RNA, 64 nt, hsa
ccacccaggcaucuccagugcucaugaucaugugucccccaacuccaccccucacaguuugggc

SEQ ID NO: 155095 - RNA, 64 nt, hsa
gaauaauuuuucuuucaaguagguuagcuagcucucccccaauaaaaauaccacuaucagagua

SEQ ID NO: 155096 - RNA, 64 nt, hsa
gaaaaaugcuacuuuuaucuucucuaaaauuauuucccccaagguagugaaguaauuggaauga

SEQ ID NO: 155097 - RNA, 64 nt, hsa
uuuuaaaugauagagguuuuugugggaaucaaaaucccccaaauguuaagguauaugguaaaaa

SEQ ID NO: 155098 - RNA, 64 nt, hsa
cauaaacuuuguuuuaacauaauuaguacuguuuucccccaaaaguacaaguuuuugaguagca

SEQ ID NO: 155099 - RNA, 64 nt, hsa
uugcucacacuacuugagaaaaugcaggagagcuucccccaaggcugaugcauucccggugcag

SEQ ID NO: 155100 - RNA, 64 nt, hsa
uccuuuguguccauugaugucauucagcagucagucccccaauaauccuuaaacuagcuaaaac

SEQ ID NO: 155101 - RNA, 64 nt, hsa
gaacgaggagcgccuccgggcccccccgcccccgucccccaaccagaacaacaacgccauagac

SEQ ID NO: 155102 - RNA, 64 nt, hsa
ggcagugugggcaccugguggccaagccucaguuucccccaaaugagcaaaggggauaaagagg

SEQ ID NO: 155103 - RNA, 62 nt, hsa
uaccuucaggcuauguguauaaaguauauaugagccauaaaugaauuuuguguuuagacuuu

SEQ ID NO: 155104 - RNA, 62 nt, hsa
cugcuggacacugagggacccaaagcucaaucagccauaaucccugcuuucagaguuuauau

SEQ ID NO: 155105 - RNA, 64 nt, hsa
gcuggagugcagugaugcaaucuuggcucacugcagccucuaccucccagguucaagugauuau

SEQ ID NO: 155106 - RNA, 64 nt, hsa
guuauagguugauuuccuaaguguggcugaugguagccucuaguuugaagugagggaagaauga

SEQ ID NO: 155107 - RNA, 64 nt, hsa
uggaguguagggucacugggagagcagaggucacagccucuagagaagggagaggggcgugugc

SEQ ID NO: 155108 - RNA, 64 nt, hsa
uucccguucacucugcccccacccccaaaggcucagccucuaaaucucagacuccaccaccucu

SEQ ID NO: 155109 - RNA, 64 nt, hsa; identical to SEQ ID NO: 77130

SEQ ID NO: 155110 - RNA, 64 nt, hsa; identical to SEQ ID NO: 77131

SEQ ID NO: 155111 - RNA, 64 nt, hsa; identical to SEQ ID NO: 77132

SEQ ID NO: 155112 - RNA, 64 nt, hsa; identical to SEQ ID NO: 77133

SEQ ID NO: 155113 - RNA, 64 nt, hsa; identical to SEQ ID NO: 77134

SEQ ID NO: 155114 - RNA, 64 nt, hsa; identical to SEQ ID NO: 77135

SEQ ID NO: 155115 - RNA, 64 nt, hsa; identical to SEQ ID NO: 77136

SEQ ID NO: 155116 - RNA, 62 nt, hsa; identical to SEQ ID NO: 77137

SEQ ID NO: 155117 - RNA, 64 nt, hsa; identical to SEQ ID NO: 77138

SEQ ID NO: 155118 - RNA, 64 nt, hsa; identical to SEQ ID NO: 77139

SEQ ID NO: 155119 - RNA, 64 nt, hsa; identical to SEQ ID NO: 77140

SEQ ID NO: 155120 - RNA, 64 nt, hsa; identical to SEQ ID NO: 77141

SEQ ID NO: 155121 - RNA, 64 nt, hsa; identical to SEQ ID NO: 77142

SEQ ID NO: 155122 - RNA, 64 nt, hsa; identical to SEQ ID NO: 77143

SEQ ID NO: 155123 - RNA, 64 nt, hsa; identical to SEQ ID NO: 77144

SEQ ID NO: 155124 - RNA, 64 nt, hsa; identical to SEQ ID NO: 77145

SEQ ID NO: 155125 - RNA, 64 nt, hsa; identical to SEQ ID NO: 77146

SEQ ID NO: 155126 - RNA, 64 nt, hsa; identical to SEQ ID NO: 77147

SEQ ID NO: 155127 - RNA, 64 nt, hsa; identical to SEQ ID NO: 77148

SEQ ID NO: 155128 - RNA, 64 nt, hsa; identical to SEQ ID NO: 77149

SEQ ID NO: 155129 - RNA, 64 nt, hsa; identical to SEQ ID NO: 77150

SEQ ID NO: 155130 - RNA, 64 nt, hsa; identical to SEQ ID NO: 77151

SEQ ID NO: 155131 - RNA, 64 nt, hsa; identical to SEQ ID NO: 77152

SEQ ID NO: 155132 - RNA, 64 nt, hsa; identical to SEQ ID NO: 77153

SEQ ID NO: 155133 - RNA, 64 nt, hsa; identical to SEQ ID NO: 77154

SEQ ID NO: 155134 - RNA, 64 nt, hsa; identical to SEQ ID NO: 77155

SEQ ID NO: 155135 - RNA, 64 nt, hsa; identical to SEQ ID NO: 77156

SEQ ID NO: 155136 - RNA, 64 nt, hsa; identical to SEQ ID NO: 77157

SEQ ID NO: 155137 - RNA, 64 nt, hsa; identical to SEQ ID NO: 77158

SEQ ID NO: 155138 - RNA, 64 nt, hsa; identical to SEQ ID NO: 77159

SEQ ID NO: 155139 - RNA, 64 nt, hsa; identical to SEQ ID NO: 77160

SEQ ID NO: 155140 - RNA, 64 nt, hsa
gccccuccagguuuacagaauguugcuacuucacaauggcgauguggugagaaacuccugaaug

SEQ ID NO: 155141 - RNA, 64 nt, hsa
ccgggguccaggggucaacugcuacaugccggccaauggcgagacggugacgcugcccacaagc

SEQ ID NO: 155142 - RNA, 64 nt, hsa
cacgaaacauuuuugcuuucuccaguuuucuguuaauggcgaaagaauggaagcgaauaaaguu

SEQ ID NO: 155143 - RNA, 64 nt, hsa
auuccccgugaguuaaugaaaacugauucaaccaaauggcgaagucagagacuaucgggggcca

SEQ ID NO: 155144 - RNA, 64 nt, hsa
uccccaacugaagcuucaaaaagccacuuuuccaaauggcgacaguugcuucuuagcuauugcu

SEQ ID NO: 155145 - RNA, 64 nt, hsa
uccuguugagcugguaggauguaagccuggagcuaauggcgaucaucuuugccaccaccugggg

SEQ ID NO: 155146 - RNA, 64 nt, hsa
cagagcauggaaaaucguuuauaauuguuaauagaauggcgauuuuuuuuuaagaacuucagau

SEQ ID NO: 155147 - RNA, 64 nt, hsa
uuuuccuuugucuuaaucgaucugguaggggagaaauggcgaaugucauacacaugagauggua

SEQ ID NO: 155148 - RNA, 64 nt, hsa
uucugacucuugaguaggauggaggcuuaaauuuaauggcgacuuggggggaagggagccaccc

SEQ ID NO: 155149 - RNA, 64 nt, hsa
cucaaauaaagugcuuuguuauuauuucagagggaauggcgauugaaauguuacaacagagauu

SEQ ID NO: 155150 - RNA, 57 nt, hsa
ggcaggagucgaggcgcugaucccuaaaauggcgaacauguguuuucaucauuucag

SEQ ID NO: 155151 - RNA, 64 nt, hsa
guaacugaaaucuucaaugacacauuaacaucacaauggcgaauggugacuuuucuuucacgau

SEQ ID NO: 155152 - RNA, 64 nt, hsa
uuucagaggaaguggaauuacuuuugcccagaaaaauggcgaauacaugaaacaaccagugauc

SEQ ID NO: 155153 - RNA, 64 nt, hsa
ugacuacucaagcucuguuuacagaagaaaauugaauggcgaggguguggccauaugaacugac

SEQ ID NO: 155154 - RNA, 64 nt, hsa
aauggaagaauuuaguuuuguugguugaauugaaaauggcgacuugagaaacaacugugccuuc

SEQ ID NO: 155155 - RNA, 64 nt, hsa
uguacacccuuauuuuauaccguuuuucuucaacaauggcgaaauugacuguagugcugaacca

SEQ ID NO: 155156 - RNA, 64 nt, hsa
gcagcacagggagagaaacaggauaggaaagcagaauggcgagcagccuauggcccagggccug

SEQ ID NO: 155157 - RNA, 64 nt, hsa
acaaauguacagauguuaauauauuuuuggugccaauggcgauguuuuuaagagugggauggag

SEQ ID NO: 155158 - RNA, 64 nt, hsa
ccucacccuggucaaccuacaugauccuuaagcuaauggcgaaucacgaugaccuuguagacau

SEQ ID NO: 155159 - RNA, 64 nt, hsa
gucuccuuccggagcugagauccagcccagggcgaauggcgagcuuggcucaggccucugcggg

SEQ ID NO: 155160 - RNA, 64 nt, hsa
auccuacuauguggucagugggaaugacccugccaauggcgagccaagccgggcugugcuggau

SEQ ID NO: 155161 - RNA, 64 nt, hsa
auucggcucgaagaagaccccguucuuccgggaaaauggcgacucccgcucgugccccggaguc

SEQ ID NO: 155162 - RNA, 64 nt, hsa
uccuggcuuggagggaucuuugggcucauggaugaauggcgagccaccuguugucagcugcccc

SEQ ID NO: 155163 - RNA, 64 nt, hsa
uuucucggcccaaaccaugcuccccagcaguggcaauggcgagcacccugcagcugggcgggca

SEQ ID NO: 155164 - RNA, 64 nt, hsa
aacccucccauuaggaagcaugcuuuugcaguuaaauggcgaugguggaggugauagggacuuc

SEQ ID NO: 155165 - RNA, 54 nt, hsa
ugaagagcaagguagagugaagccaauggcgagagaucagguccgaaaugcugc

SEQ ID NO: 155166 - RNA, 64 nt, hsa
gugguuuuguuuucauucuggaaccauacuaucaaauggcgacagacuguuccguuccaccccc

SEQ ID NO: 155167 - RNA, 64 nt, hsa
auggcgcaugcagggggcaaccugcauaauuaucaauggcgacuuuccguguccuucugauaca

SEQ ID NO: 155168 - RNA, 64 nt, hsa
guggggaggagagcuggcauuccuccagguggcaaauggcgacucuauacucuccgcccgcccc

SEQ ID NO: 155169 - RNA, 64 nt, hsa
agaggaggggguuggggaggacccaccucuccagaauggcgacuguccccauccgccuggcuga

SEQ ID NO: 155170 - RNA, 64 nt, hsa
gcccgcugcgccccuaauugccaaaggguagggaaauggcgaagccagccaccaggucgcuggu

SEQ ID NO: 155171 - RNA, 64 nt, hsa
auucagcccaaucugguucaacuuuguguaauaaaauggcgaguuguuuuucaguugucgugga

SEQ ID NO: 155172 - RNA, 64 nt, hsa
guuuggucucaaaaaccuuugaggaauugccaagaauggcgagugauugcuuuccuucagagaa

SEQ ID NO: 155173 - RNA, 64 nt, hsa
cucucugguuguaaccuggagacauguggaggggaauggcgaugggauuauaggacucucccca

SEQ ID NO: 155174 - RNA, 64 nt, hsa
uugaguccagacaguugggaagugccuguaggaaaauggcgauggcugagaaaagcccggagga

SEQ ID NO: 155175 - RNA, 64 nt, hsa
auggagaaaccaaauuggacaaauccucacuaccaauggcgaugauuacaauaaaaucaaguuu

SEQ ID NO: 155176 - RNA, 64 nt, hsa
ucaccucugcuggcacaccaguggcaaggcccagaauggcgaccucucuuuagcucaauuucug

SEQ ID NO: 155177 - RNA, 65 nt, hsa
gaagcgggguugcagugagccaaagguacaccacuacacuccagccugggcaacagagcaagacu

SEQ ID NO: 155178 - RNA, 65 nt, hsa
gaccacccagacaucugacuaauggcucugugcccacacuccaagaccugugccuuuuagagaag

SEQ ID NO: 155179 - RNA, 65 nt, hsa
acuuuaaaauguauauacauuuuagacaaaaaugcacacuccaguauuaauauuugugcuaccau

SEQ ID NO: 155180 - RNA, 65 nt, hsa
gacaacuaaaacaaaugauaaaaauguuuauuuuuacacuccagcauaucgggugaguuuuaggg

SEQ ID NO: 155181 - RNA, 65 nt, hsa
aagccuuaacuuagcaaacaguuguuagaagugggacacuccaaccacauuccaagcugagauaa

SEQ ID NO: 155182 - RNA, 65 nt, hsa
gacuggcuaggaccuagaacuaagaucuuauaaccacacuccaugcaacuaugagucucuaaauc

SEQ ID NO: 155183 - RNA, 65 nt, hsa
ggcucugaagcagccucacucuuaacuucguguucacacuccauggaaaccccagacugggacac

SEQ ID NO: 155184 - RNA, 65 nt, hsa
cugccccucccaccccucucugcccugggagcccuacacuccacuuggagucuggauggacacau

SEQ ID NO: 155185 - RNA, 65 nt, hsa
gugagcucacaaccaccauucagucaagugaggugacacuccaguugcagaccaucgcacaccaa

SEQ ID NO: 155186 - RNA, 65 nt, hsa
uuucuucucuacacccacccaaaagucacccagggacacuccaacucuacacagcucagcagaca

SEQ ID NO: 155187 - RNA, 64 nt, hsa; identical to SEQ ID NO: 44076

SEQ ID NO: 155188 - RNA, 64 nt, hsa; identical to SEQ ID NO: 44077

SEQ ID NO: 155189 - RNA, 64 nt, hsa; identical to SEQ ID NO: 44078

SEQ ID NO: 155190 - RNA, 64 nt, hsa; identical to SEQ ID NO: 44079

SEQ ID NO: 155191 - RNA, 64 nt, hsa; identical to SEQ ID NO: 44080

SEQ ID NO: 155192 - RNA, 64 nt, hsa; identical to SEQ ID NO: 44081

SEQ ID NO: 155193 - RNA, 64 nt, hsa; identical to SEQ ID NO: 44082

SEQ ID NO: 155194 - RNA, 64 nt, hsa; identical to SEQ ID NO: 44083

SEQ ID NO: 155195 - RNA, 64 nt, hsa; identical to SEQ ID NO: 44084

SEQ ID NO: 155196 - RNA, 64 nt, hsa; identical to SEQ ID NO: 44085

SEQ ID NO: 155197 - RNA, 64 nt, hsa; identical to SEQ ID NO: 44086

SEQ ID NO: 155198 - RNA, 64 nt, hsa; identical to SEQ ID NO: 44087

SEQ ID NO: 155199 - RNA, 64 nt, hsa; identical to SEQ ID NO: 44088

SEQ ID NO: 155200 - RNA, 64 nt, hsa; identical to SEQ ID NO: 44089

SEQ ID NO: 155201 - RNA, 64 nt, hsa; identical to SEQ ID NO: 44090

SEQ ID NO: 155202 - RNA, 64 nt, hsa; identical to SEQ ID NO: 44091

SEQ ID NO: 155203 - RNA, 64 nt, hsa; identical to SEQ ID NO: 44092

SEQ ID NO: 155204 - RNA, 64 nt, hsa; identical to SEQ ID NO: 44093

SEQ ID NO: 155205 - RNA, 64 nt, hsa; identical to SEQ ID NO: 44094

SEQ ID NO: 155206 - RNA, 64 nt, hsa; identical to SEQ ID NO: 44095

SEQ ID NO: 155207 - RNA, 64 nt, hsa; identical to SEQ ID NO: 44096

SEQ ID NO: 155208 - RNA, 64 nt, hsa; identical to SEQ ID NO: 44097

SEQ ID NO: 155209 - RNA, 64 nt, hsa; identical to SEQ ID NO: 44098

SEQ ID NO: 155210 - RNA, 64 nt, hsa; identical to SEQ ID NO: 44099

SEQ ID NO: 155211 - RNA, 64 nt, hsa; identical to SEQ ID NO: 23251

SEQ ID NO: 155212 - RNA, 64 nt, hsa; identical to SEQ ID NO: 23252

SEQ ID NO: 155213 - RNA, 64 nt, hsa; identical to SEQ ID NO: 23253

SEQ ID NO: 155214 - RNA, 64 nt, hsa; identical to SEQ ID NO: 23254

SEQ ID NO: 155215 - RNA, 64 nt, hsa; identical to SEQ ID NO: 23255

SEQ ID NO: 155216 - RNA, 64 nt, hsa; identical to SEQ ID NO: 23256

SEQ ID NO: 155217 - RNA, 64 nt, hsa; identical to SEQ ID NO: 23257

SEQ ID NO: 155218 - RNA, 64 nt, hsa; identical to SEQ ID NO: 23258

SEQ ID NO: 155219 - RNA, 64 nt, hsa; identical to SEQ ID NO: 23259

SEQ ID NO: 155220 - RNA, 64 nt, hsa; identical to SEQ ID NO: 23260

SEQ ID NO: 155221 - RNA, 64 nt, hsa; identical to SEQ ID NO: 23261

SEQ ID NO: 155222 - RNA, 64 nt, hsa; identical to SEQ ID NO: 23262

SEQ ID NO: 155223 - RNA, 64 nt, hsa; identical to SEQ ID NO: 23263

SEQ ID NO: 155224 - RNA, 64 nt, hsa; identical to SEQ ID NO: 23264

SEQ ID NO: 155225 - RNA, 64 nt, hsa; identical to SEQ ID NO: 23265

SEQ ID NO: 155226 - RNA, 64 nt, hsa; identical to SEQ ID NO: 23266

SEQ ID NO: 155227 - RNA, 64 nt, hsa; identical to SEQ ID NO: 23267

SEQ ID NO: 155228 - RNA, 64 nt, hsa; identical to SEQ ID NO: 23268

SEQ ID NO: 155229 - RNA, 64 nt, hsa; identical to SEQ ID NO: 23269

SEQ ID NO: 155230 - RNA, 64 nt, hsa; identical to SEQ ID NO: 23270

SEQ ID NO: 155231 - RNA, 64 nt, hsa; identical to SEQ ID NO: 23271

SEQ ID NO: 155232 - RNA, 64 nt, hsa; identical to SEQ ID NO: 23272

SEQ ID NO: 155233 - RNA, 64 nt, hsa; identical to SEQ ID NO: 23273

SEQ ID NO: 155234 - RNA, 64 nt, hsa; identical to SEQ ID NO: 23274

SEQ ID NO: 155235 - RNA, 64 nt, hsa; identical to SEQ ID NO: 23275

SEQ ID NO: 155236 - RNA, 64 nt, hsa; identical to SEQ ID NO: 23276

SEQ ID NO: 155237 - RNA, 64 nt, hsa; identical to SEQ ID NO: 23277

SEQ ID NO: 155238 - RNA, 64 nt, hsa; identical to SEQ ID NO: 23278

SEQ ID NO: 155239 - RNA, 64 nt, hsa; identical to SEQ ID NO: 23279

SEQ ID NO: 155240 - RNA, 64 nt, hsa; identical to SEQ ID NO: 23280

SEQ ID NO: 155241 - RNA, 64 nt, hsa; identical to SEQ ID NO: 23281

SEQ ID NO: 155242 - RNA, 64 nt, hsa; identical to SEQ ID NO: 23282

SEQ ID NO: 155243 - RNA, 64 nt, hsa; identical to SEQ ID NO: 23283

SEQ ID NO: 155244 - RNA, 64 nt, hsa; identical to SEQ ID NO: 23284

SEQ ID NO: 155245 - RNA, 64 nt, hsa; identical to SEQ ID NO: 23285

SEQ ID NO: 155246 - RNA, 64 nt, hsa; identical to SEQ ID NO: 23286

SEQ ID NO: 155247 - RNA, 64 nt, hsa; identical to SEQ ID NO: 23287

SEQ ID NO: 155248 - RNA, 64 nt, hsa; identical to SEQ ID NO: 23288

SEQ ID NO: 155249 - RNA, 64 nt, hsa; identical to SEQ ID NO: 23289

SEQ ID NO: 155250 - RNA, 64 nt, hsa; identical to SEQ ID NO: 23290

SEQ ID NO: 155251 - RNA, 64 nt, hsa; identical to SEQ ID NO: 23291

SEQ ID NO: 155252 - RNA, 64 nt, hsa; identical to SEQ ID NO: 23292

SEQ ID NO: 155253 - RNA, 64 nt, hsa; identical to SEQ ID NO: 23293

SEQ ID NO: 155254 - RNA, 64 nt, hsa; identical to SEQ ID NO: 23294

SEQ ID NO: 155255 - RNA, 64 nt, hsa; identical to SEQ ID NO: 23295

SEQ ID NO: 155256 - RNA, 64 nt, hsa; identical to SEQ ID NO: 23296

SEQ ID NO: 155257 - RNA, 64 nt, hsa; identical to SEQ ID NO: 23297

SEQ ID NO: 155258 - RNA, 64 nt, hsa; identical to SEQ ID NO: 23298

SEQ ID NO: 155259 - RNA, 64 nt, hsa; identical to SEQ ID NO: 23299

SEQ ID NO: 155260 - RNA, 64 nt, hsa; identical to SEQ ID NO: 23300

SEQ ID NO: 155261 - RNA, 64 nt, hsa; identical to SEQ ID NO: 23301

SEQ ID NO: 155262 - RNA, 64 nt, hsa; identical to SEQ ID NO: 23302

SEQ ID NO: 155263 - RNA, 64 nt, hsa; identical to SEQ ID NO: 23303

SEQ ID NO: 155264 - RNA, 64 nt, hsa; identical to SEQ ID NO: 23304

SEQ ID NO: 155265 - RNA, 64 nt, hsa; identical to SEQ ID NO: 23305

SEQ ID NO: 155266 - RNA, 64 nt, hsa; identical to SEQ ID NO: 23306

SEQ ID NO: 155267 - RNA, 64 nt, hsa; identical to SEQ ID NO: 23307

SEQ ID NO: 155268 - RNA, 64 nt, hsa; identical to SEQ ID NO: 23308

SEQ ID NO: 155269 - RNA, 64 nt, hsa; identical to SEQ ID NO: 23309

SEQ ID NO: 155270 - RNA, 64 nt, hsa; identical to SEQ ID NO: 23310

SEQ ID NO: 155271 - RNA, 64 nt, hsa; identical to SEQ ID NO: 23311

SEQ ID NO: 155272 - RNA, 64 nt, hsa; identical to SEQ ID NO: 23312

SEQ ID NO: 155273 - RNA, 64 nt, hsa; identical to SEQ ID NO: 23313

SEQ ID NO: 155274 - RNA, 64 nt, hsa; identical to SEQ ID NO: 23314

SEQ ID NO: 155275 - RNA, 64 nt, hsa; identical to SEQ ID NO: 23315

SEQ ID NO: 155276 - RNA, 64 nt, hsa; identical to SEQ ID NO: 23316

SEQ ID NO: 155277 - RNA, 64 nt, hsa; identical to SEQ ID NO: 23317

SEQ ID NO: 155278 - RNA, 64 nt, hsa; identical to SEQ ID NO: 23318

SEQ ID NO: 155279 - RNA, 64 nt, hsa; identical to SEQ ID NO: 23319

SEQ ID NO: 155280 - RNA, 64 nt, hsa; identical to SEQ ID NO: 23320

SEQ ID NO: 155281 - RNA, 64 nt, hsa; identical to SEQ ID NO: 23321

SEQ ID NO: 155282 - RNA, 64 nt, hsa; identical to SEQ ID NO: 23322

SEQ ID NO: 155283 - RNA, 64 nt, hsa; identical to SEQ ID NO: 23323

SEQ ID NO: 155284 - RNA, 64 nt, hsa; identical to SEQ ID NO: 23324

SEQ ID NO: 155285 - RNA, 64 nt, hsa; identical to SEQ ID NO: 23325

SEQ ID NO: 155286 - RNA, 64 nt, hsa; identical to SEQ ID NO: 23326

SEQ ID NO: 155287 - RNA, 64 nt, hsa; identical to SEQ ID NO: 23327

SEQ ID NO: 155288 - RNA, 64 nt, hsa; identical to SEQ ID NO: 23328

SEQ ID NO: 155289 - RNA, 64 nt, hsa; identical to SEQ ID NO: 23329

SEQ ID NO: 155290 - RNA, 64 nt, hsa
agcacugccccucagcaaggaugacucagcacugccgcucaacagacaugacucagggauggcu

SEQ ID NO: 155291 - RNA, 64 nt, hsa
agcacugccccucagcaaggaugacucagcacugccgcucaacagggaugacucagggauggcu

SEQ ID NO: 155292 - RNA, 64 nt, hsa; identical to SEQ ID NO: 155290

SEQ ID NO: 155293 - RNA, 64 nt, hsa
agcacugccccucaccaaggaugacucagcacugccgcucaacagacaugacucagggauggcu

SEQ ID NO: 155294 - RNA, 64 nt, hsa
guuuuauuaaaagcuacauuuuauaacacuggcacacacaaaaaaguaguuuuaagcuuguuug

SEQ ID NO: 155295 - RNA, 64 nt, hsa
agggagaauaaagauaauuguauuuuauguuuugcacacaaacgcagaauuuguauaaccauau

SEQ ID NO: 155296 - RNA, 64 nt, hsa
aaaagaggcugagaugagcagugaacuaagaggccacacaaaagcagagguuugggaauuccag

SEQ ID NO: 155297 - RNA, 64 nt, hsa
agaaauugacgcaagugaacugaaaacuuauguucacacaaaaacucgcacaugacuguuuaua

SEQ ID NO: 155298 - RNA, 64 nt, hsa
caugccuuuuccucccauccaccucccccgcacacacacaaagaugaccugggacaugauuuuu

SEQ ID NO: 155299 - RNA, 64 nt, hsa
uauuugcaaacuucuuuauaaaaggugaaaaaagcacacaaaagagagggugucuucauauuaa

SEQ ID NO: 155300 - RNA, 64 nt, hsa
ggguuagcuacugucaucaguuagcaaauucauccacacaaacacaauuagaguuugguuuuuu

SEQ ID NO: 155301 - RNA, 64 nt, hsa
uacugcucaaagucauugccaaggucugauuuuucacacaaaaaauugcaacccccagcauaaa

SEQ ID NO: 155302 - RNA, 64 nt, hsa
aguaucacaucacacaaaaggaacaaaagcgaaacacacaaaccagccucaacuuacacuuggu

SEQ ID NO: 155303 - RNA, 64 nt, hsa
ccccccaggcaaagcagugcucugaguaucacaucacacaaaaggaacaaaagcgaaacacaca

SEQ ID NO: 155304 - RNA, 64 nt, hsa
auguaccugugguauaccaaauagcauacauguacacacaaaaauguguguauacauuuggguu

SEQ ID NO: 155305 - RNA, 64 nt, hsa
ccgagggaugagauuaaggcagaggcaaaaguuucacacaaaguuucugcaaccuaacguuuaa

SEQ ID NO: 155306 - RNA, 64 nt, hsa
guguuuuucuccucuugguuuucauuugcucaagcacacaaaagggacuuuuguuuacucuauc

SEQ ID NO: 155307 - RNA, 64 nt, hsa
cuccaagccaugugcacagcacacacgugcagugcacacaaagaaaugacauggaaauagaugc

SEQ ID NO: 155308 - RNA, 64 nt, hsa
auagaaaacaccaggccagaacuauagucauacucacacaaagggagaaauuuaaacucgaacc

SEQ ID NO: 155309 - RNA, 64 nt, hsa
ucugccguccuagcacaaaagcagccauagacaacacacaaacgagagggcuuggcucccuucc

SEQ ID NO: 155310 - RNA, 64 nt, hsa
ugaauugaaaauaucccuuaggaaaaaaaaaaaacacacaaaaaaccacaagagccccagccag

SEQ ID NO: 155311 - RNA, 64 nt, hsa
cauuaaguaauuuucuuuuugacuuaguauccggcacacaaaguggguuaguacuacaguauuu

SEQ ID NO: 155312 - RNA, 64 nt, hsa
gcaacccuugcauuccacccugaguuugccaaggcacacaaaaauagggaacauuuucuuaaag

SEQ ID NO: 155313 - RNA, 64 nt, hsa
cuuccuugucaggcagccaacucccagcccuguucacacaaauuuuaugcuagggccccaugcc

SEQ ID NO: 155314 - RNA, 64 nt, hsa
cauuuggagauguaugguguaaaacacacaaacacacacaaaaaagcacaagcccgcugcauga

SEQ ID NO: 155315 - RNA, 64 nt, hsa
auaaauacuucauuuggagauguaugguguaaaacacacaaacacacacaaaaaagcacaagcc

SEQ ID NO: 155316 - RNA, 64 nt, hsa
uuuaaacacacagauacacacacacacacacacacacacaaaccuucugccuuugauguuacag

SEQ ID NO: 155317 - RNA, 64 nt, hsa
uaggugagaaaaaaacaaucuggaagaaaaaaaccacacaaagacauugauucagccuguuugg

SEQ ID NO: 155318 - RNA, 64 nt, hsa
ggguugugacccuucauacacacacgcacgcacgcacacaaacaugcacacacgcaugcacaca

SEQ ID NO: 155319 - RNA, 64 nt, hsa
cgcacgcacacaaacaugcacacacgcaugcacacacacaaagccuuaagcagaagaaugucuu

SEQ ID NO: 155320 - RNA, 64 nt, hsa
cgacuccagggugaucugcucaaaggcugagucacacacaaaacgcucacggaccuugaacgag

SEQ ID NO: 155321 - RNA, 64 nt, hsa
uggggaaaggagaaccggcuaggugggcucuagccacacaaagggaagcaggccugccaugaga

SEQ ID NO: 155322 - RNA, 64 nt, hsa
aaaacaaauaaaugaauaaagcugcugugacacacacacaaaaggaauuuaauaguauaauaua

SEQ ID NO: 155323 - RNA, 64 nt, hsa
uccgaaaagcaagagacaaagcaagacaaauauucacacaaaaaugaaguguguccucuggagg

SEQ ID NO: 155324 - RNA, 64 nt, hsa
ugggaaggaccuggcuuuaaaacacgcacacaaacacacaaauaaacagacauaagaugucauc

SEQ ID NO: 155325 - RNA, 64 nt, hsa
aacgaaugugggaaggaccuggcuuuaaaacacgcacacaaacacacaaauaaacagacauaag

SEQ ID NO: 155326 - RNA, 64 nt, hsa
uccccugccagagcccuuccguucugaggucagacacacaaaaccuucgucaauugcacaccgg

SEQ ID NO: 155327 - RNA, 64 nt, hsa
uccaggggucugggccuccuucccucaaggcugccacacaaaguagcagaaauaggaugauguu

SEQ ID NO: 155328 - RNA, 64 nt, hsa
aauacguaauaaagaauacauauauauauaucuacacacaaauuauauaucuaucuaucuauac

SEQ ID NO: 155329 - RNA, 64 nt, hsa
uuuaagggggggaaagguuucaaauggggaaaaacacacaaaaaaaaaaaucacuaaaaauucc

SEQ ID NO: 155330 - RNA, 64 nt, hsa
ggcugaacaggggacuagugcccaggugacacugcacacaaagccaagggcaaacccuauagag

SEQ ID NO: 155331 - RNA, 64 nt, hsa
uaugcuguucuuuccauuccuuuucccucugaaacacacaaaauaccaaaggaacuuacgcaac

SEQ ID NO: 155332 - RNA, 64 nt, hsa
auuuggugguucugcaugugugaugaaucucuuucacacaaauagacgagaggauauuuagggc

SEQ ID NO: 155333 - RNA, 64 nt, hsa
uauuguagagagaugcucaguguuaaaacugaaacacacaaacacacacacacacacauuuuuc

SEQ ID NO: 155334 - RNA, 64 nt, hsa
auaauaauaauaacacaucuuuggucaucuaugucacacaaaaauuuuccuuuguuugcggggg

SEQ ID NO: 155335 - RNA, 64 nt, hsa
ggugagccacaggcaacucuucucucggaaccugcacacaaacuggggcuauagagauucucca

SEQ ID NO: 155336 - RNA, 64 nt, hsa
uucuguccaaacaaacaaacaaaaacuaaacacacacacaaacccccagaaacccacaauaugu

SEQ ID NO: 155337 - RNA, 64 nt, hsa
acugaugauauuugaauguuuauuaaauuauuaucacacaaauguguugauauuguggcuauug

SEQ ID NO: 155338 - RNA, 64 nt, hsa
aauuguucaguucuuaaaauguaauuaugucacacacacaaaaaaauccuuuucaauccugaga

SEQ ID NO: 155339 - RNA, 64 nt, hsa; identical to SEQ ID NO: 118126

SEQ ID NO: 155340 - RNA, 64 nt, hsa; identical to SEQ ID NO: 118127

SEQ ID NO: 155341 - RNA, 64 nt, hsa; identical to SEQ ID NO: 118128

SEQ ID NO: 155342 - RNA, 64 nt, hsa; identical to SEQ ID NO: 118129

SEQ ID NO: 155343 - RNA, 64 nt, hsa; identical to SEQ ID NO: 118130

SEQ ID NO: 155344 - RNA, 64 nt, hsa; identical to SEQ ID NO: 118131

SEQ ID NO: 155345 - RNA, 64 nt, hsa; identical to SEQ ID NO: 118132

SEQ ID NO: 155346 - RNA, 64 nt, hsa; identical to SEQ ID NO: 118133

SEQ ID NO: 155347 - RNA, 64 nt, hsa; identical to SEQ ID NO: 118134

SEQ ID NO: 155348 - RNA, 64 nt, hsa; identical to SEQ ID NO: 118135

SEQ ID NO: 155349 - RNA, 64 nt, hsa; identical to SEQ ID NO: 118136

SEQ ID NO: 155350 - RNA, 64 nt, hsa; identical to SEQ ID NO: 118137

SEQ ID NO: 155351 - RNA, 64 nt, hsa; identical to SEQ ID NO: 118138

SEQ ID NO: 155352 - RNA, 64 nt, hsa; identical to SEQ ID NO: 118139

SEQ ID NO: 155353 - RNA, 64 nt, hsa; identical to SEQ ID NO: 118140

SEQ ID NO: 155354 - RNA, 64 nt, hsa; identical to SEQ ID NO: 118141

SEQ ID NO: 155355 - RNA, 64 nt, hsa; identical to SEQ ID NO: 118142

SEQ ID NO: 155356 - RNA, 64 nt, hsa; identical to SEQ ID NO: 118143

SEQ ID NO: 155357 - RNA, 64 nt, hsa; identical to SEQ ID NO: 118144

SEQ ID NO: 155358 - RNA, 64 nt, hsa; identical to SEQ ID NO: 118145

SEQ ID NO: 155359 - RNA, 64 nt, hsa; identical to SEQ ID NO: 118146

SEQ ID NO: 155360 - RNA, 64 nt, hsa; identical to SEQ ID NO: 118147

SEQ ID NO: 155361 - RNA, 64 nt, hsa; identical to SEQ ID NO: 118148

SEQ ID NO: 155362 - RNA, 64 nt, hsa; identical to SEQ ID NO: 118149

SEQ ID NO: 155363 - RNA, 64 nt, hsa; identical to SEQ ID NO: 118150

SEQ ID NO: 155364 - RNA, 64 nt, hsa; identical to SEQ ID NO: 118151

SEQ ID NO: 155365 - RNA, 64 nt, hsa; identical to SEQ ID NO: 118152

SEQ ID NO: 155366 - RNA, 64 nt, hsa; identical to SEQ ID NO: 118153

SEQ ID NO: 155367 - RNA, 64 nt, hsa; identical to SEQ ID NO: 118154

SEQ ID NO: 155368 - RNA, 64 nt, hsa; identical to SEQ ID NO: 118155

SEQ ID NO: 155369 - RNA, 64 nt, hsa; identical to SEQ ID NO: 118156

SEQ ID NO: 155370 - RNA, 64 nt, hsa; identical to SEQ ID NO: 118157

SEQ ID NO: 155371 - RNA, 64 nt, hsa; identical to SEQ ID NO: 118158

SEQ ID NO: 155372 - RNA, 64 nt, hsa; identical to SEQ ID NO: 118159

SEQ ID NO: 155373 - RNA, 64 nt, hsa
gaggcagagagacagagagggagagagggacagagagagauagagcaggaggucggggcacucu

SEQ ID NO: 155374 - RNA, 64 nt, hsa
gaggggagagagaaagagagguggggagaggggagagagauaugaggagagagagacagaggag

SEQ ID NO: 155375 - RNA, 64 nt, hsa
aauugauaguacaaaauccaacaacaauacugagaugaucuaagaagguuauaacaaaaugcuc

SEQ ID NO: 155376 - RNA, 64 nt, hsa
uauggaaguuuaaagaaaggacaucaucauagauaugaucuaacaguauuucuaacuauauuug

SEQ ID NO: 155377 - RNA, 64 nt, hsa
gagcuaguauugcuguguaucuacucuaaaugagaugaucuauuuuuuugcuagccaucucucc

SEQ ID NO: 155378 - RNA, 64 nt, hsa
acacauuuuaucugguguucaaaccaaagaaacaaugaucuacucaaacauuggagaaaaaaac

SEQ ID NO: 155379 - RNA, 64 nt, hsa
aaagaggucugucaucuucccccugggauauaagaugaucuagcucccgguagaggaucaccgg

SEQ ID NO: 155380 - RNA, 64 nt, hsa
augcugugagucugaaguaugugccuggugugaaaugaucuauggccuguuucuuacacaggaa

SEQ ID NO: 155381 - RNA, 64 nt, hsa
uauuauuauugguuauauacuguccauagucuccugucccuacaucauggaucauguccaccuu

SEQ ID NO: 155382 - RNA, 64 nt, hsa
uucucuuagaggguggcaaaaugccuuugcccagugucccuauuuuaggcaucuuuuccuuccu

SEQ ID NO: 155383 - RNA, 64 nt, hsa
ggcuguucuguuacuuuccuuccaccugugcccucccugggauauguaugccucgcccgcccuc

SEQ ID NO: 155384 - RNA, 64 nt, hsa
cucuagcucucucugcaucucccaccccccgacacccugggacccucgaccccacccuucuuuc

SEQ ID NO: 155385 - RNA, 64 nt, hsa
caaagaaugaagagccccaugggcccagccccugcccugggaaccaggcagccuuccagaccuc

SEQ ID NO: 155386 - RNA, 64 nt, hsa
auuuggggccaaaugaggaaggacacagacucugcccugggaucuccugugcuagcggccaaug

SEQ ID NO: 155387 - RNA, 64 nt, hsa
uggggcggggcuucucuccgcgggugggacucuucccugggaaccgcccuccugauuaaggcgu

SEQ ID NO: 155388 - RNA, 64 nt, hsa
guuccaugaagcgagucggguccccaacccgugccccugggauccgagggccccucuccaagcg

SEQ ID NO: 155389 - RNA, 64 nt, hsa
gaacagaaagcugucccuggcugcgcuuucucagcccugggaggggcgccugaacccagaacau

SEQ ID NO: 155390 - RNA, 64 nt, hsa
caguuuuuugucauguaagauacuaaccuagccacccugggagagaacagaaagcugucccugg

SEQ ID NO: 155391 - RNA, 64 nt, hsa
gguauuuaugggccacugcacaugcccgcugcagcccugggaucagcuggaagcugccugucau

SEQ ID NO: 155392 - RNA, 64 nt, hsa
ccacuguccuccaggcaggcuuuuuggugcuaggcccugggacuggaagucgcccagcccguau

SEQ ID NO: 155393 - RNA, 64 nt, hsa
aauaguuagcccucagucaguucccggagcacagcccugggagggggcuauuucucuccccacu

SEQ ID NO: 155394 - RNA, 64 nt, hsa
caucacucccuggauguguggggcaugguuccuucccugggaaggcuaaguucaguucuguuuu

SEQ ID NO: 155395 - RNA, 64 nt, hsa
ucccuucagcucagcugcucuucucccccacccacccugggaugugggugcucugggcugaacc

SEQ ID NO: 155396 - RNA, 64 nt, hsa
gccccccauguggcacuggcaucauucucugcuucccugggaggaauuuuuucaccauguuauu

SEQ ID NO: 155397 - RNA, 64 nt, hsa
caggcagcaucccaccagccugcaccacaggcuccccugggaggacgagggaaacgcugaugag

SEQ ID NO: 155398 - RNA, 64 nt, hsa
agaggcagcauuggcccacaggauaagccucaggcccugggaaaccucccgaccccugcaccuu

SEQ ID NO: 155399 - RNA, 64 nt, hsa
cucuggcuguuuagcuugagggcagcacagaggccccugggacaccuacaggccagaaagauca

SEQ ID NO: 155400 - RNA, 64 nt, hsa
ucagacauguccguggugggcacagugccuguugcccugggaaagggcaaccucccuuucacug

SEQ ID NO: 155401 - RNA, 64 nt, hsa
ccucacagcccuuggcuggggcuccuccagcucccccugggaccuccagcauaugacaguggac

SEQ ID NO: 155402 - RNA, 64 nt, hsa
cuuucagcaucuugguugaacuugcuuucauugucccugggauauuguggaaggaaaggugacu

SEQ ID NO: 155403 - RNA, 64 nt, hsa
ucauuccacacugguuagauacuucaguugucaccccugggaagauucucccaccuccucccuu

SEQ ID NO: 155404 - RNA, 64 nt, hsa
cuucuccuuuugcucacagcugccuuggccccaccccugggagauguagcaaauugaguguggg

SEQ ID NO: 155405 - RNA, 64 nt, hsa
ugccgucuaugcaaaugcaugcaaauacuccaggcccugggaugugggcuuguguuuugucacu

SEQ ID NO: 155406 - RNA, 64 nt, hsa
cugcuguucucccuuucuccguccuucauggaagcccugggagauaaccuggcuuccuggaguu

SEQ ID NO: 155407 - RNA, 64 nt, hsa
auuuaagaagcuaggggaauuaggccacaacacccccugggacauccgaaagcuacaccacaga

SEQ ID NO: 155408 - RNA, 64 nt, hsa
ggguaggggcuccugggcggccagaugaaugggucccugggaacccagaccucagaugaggacu

SEQ ID NO: 155409 - RNA, 64 nt, hsa
uacaaagggagaguuggcugcuccagcuccacagcccugggaccccaacuccugucuucccugc

SEQ ID NO: 155410 - RNA, 64 nt, hsa
uucuucucugugacauguuggcuuucaucagccacccugggaagcggaaaguagcugccacuau

SEQ ID NO: 155411 - RNA, 64 nt, hsa
cuaacauguucccaggggaugcugaugcugcuggcccugggacugcacugcaugcaugugaagc

SEQ ID NO: 155412 - RNA, 64 nt, hsa
ccaggaccuagugcaugccagcagcuaucuggggcccugggaaaaaugugcgagucuugagcgc

SEQ ID NO: 155413 - RNA, 64 nt, hsa
ccucuagagaagcagaaaccaaagucccccugugcccugggaggguggggccgucuaauuuauu

SEQ ID NO: 155414 - RNA, 64 nt, hsa
auguugacagccuugcacuuccacaggcuacaagcccugggaccaucuuucugccuuaagggca

SEQ ID NO: 155415 - RNA, 64 nt, hsa
gggcaggagcccacuucuguggcaccagauuccacccugggaacuguggaaaaaguaggagagg

SEQ ID NO: 155416 - RNA, 64 nt, hsa
uguagaaaugugucaccccagagggccuggcucucccugggaggcuggggccccuaagcuccua

SEQ ID NO: 155417 - RNA, 64 nt, hsa
agcccuucuguaccuggcagcccugggccccaggcccugggacgucugugauguucccaccugc

SEQ ID NO: 155418 - RNA, 64 nt, hsa
caccaacccugcauugcagguuggcaccuuacuucccugggauccccagaguugguccaaggag

SEQ ID NO: 155419 - RNA, 64 nt, hsa
cucccuggcugacagguggggagaccgaaucccucccugggaagauucuuggaguuacugaggu

SEQ ID NO: 155420 - RNA, 64 nt, hsa
uucuguagaugccaaagggcucuuuuucagcuaacccugggaaggcucugugggagggaggucg

SEQ ID NO: 155421 - RNA, 64 nt, hsa
uguuccagucugcccaccugugcucaggaugcagcccugggauccagcacccauggaagcuucu

SEQ ID NO: 155422 - RNA, 64 nt, hsa
uaggaugguggcuggagacaggcaggcuucucugcccugggaagagcccacucagcuuaauugc

SEQ ID NO: 155423 - RNA, 64 nt, hsa
aggcgguucaagugaaaaccaacacacucagcaucccugggaacugagaggugccagcaauugc

SEQ ID NO: 155424 - RNA, 64 nt, hsa
agaagccugcgccccaggaaggaucuguguuagucccugggauggcuccaaggccugcucuagg

SEQ ID NO: 155425 - RNA, 64 nt, hsa
aaagaauucagggaaccauccacacaccugccaacccugggaagcauccaguucucaaaucguu

SEQ ID NO: 155426 - RNA, 64 nt, hsa
accccugccagcagcccugggacccugccagcagcccugggaaaaggcuguggccucagggcgc

SEQ ID NO: 155427 - RNA, 64 nt, hsa
cucugcucaacaggaccacaaccccugccagcagcccugggacccugccagcagcccugggaaa

SEQ ID NO: 155428 - RNA, 64 nt, hsa
gggcccccugcccgcucgcggacagauuuuuuaucccugggaucaugagcguccggucuugccc

SEQ ID NO: 155429 - RNA, 64 nt, hsa
ggacaagucauuaacacacuuuaagcgaauggugcccugggaagcgcacucccccugcccgggc

SEQ ID NO: 155430 - RNA, 64 nt, hsa
uggagaaggugaccgugugaggcuccaucggccgcccugggagcuggggccccucgcacuccug

SEQ ID NO: 155431 - RNA, 64 nt, hsa
guucagcagacgccgaccacucagacggaggggccccugggauucccugucucagauggccugg

SEQ ID NO: 155432 - RNA, 64 nt, hsa
ucucgugcugggaggucucagcgcgcucuccugucccugggacgugcgucucuccuucucaugc

SEQ ID NO: 155433 - RNA, 64 nt, hsa
guguggaugggggugaugcagggacugaggggaacccugggacaggcacaggcugggcagaggc

SEQ ID NO: 155434 - RNA, 64 nt, hsa
caaagcacuugacaucagggacccugaacccuuccccugggaggugagggccugaucaaggcac

SEQ ID NO: 155435 - RNA, 64 nt, hsa
ccagggccuuggggaagggucagagaugccagcccccugggaccucccccauccuuuuugccuc

SEQ ID NO: 155436 - RNA, 64 nt, hsa
ucuuagcuggcaggucugggugccccuuuuccuccccugggaagggcuggaauaggauagaaag

SEQ ID NO: 155437 - RNA, 64 nt, hsa
gacuugggcacccccagccugggccuauggagagcccugggaccgcuacaccacucuggcagcc

SEQ ID NO: 155438 - RNA, 64 nt, hsa
ugcugagaaccuggccuucaguguaccgcgucuacccugggauucaggaaaaggccugggguga

SEQ ID NO: 155439 - RNA, 64 nt, hsa
ugcuuucccccucccuagaggugcccauuccauacccugggagacugaggagagcauuggcuga

SEQ ID NO: 155440 - RNA, 64 nt, hsa
uaacccucaggacggaucugauauuaaaugccuucccugggaggaagggugcuuucccccuccc

SEQ ID NO: 155441 - RNA, 64 nt, hsa
cccaggccugcacuuuggagauuucuggauccuucccugggagggagaggucuccuaacucgau

SEQ ID NO: 155442 - RNA, 64 nt, hsa
acaaugacauaaacggcucuuuuauuuaugaaggcccugggagcagcguuaagggcuccaggau

SEQ ID NO: 155443 - RNA, 64 nt, hsa
uuugaugaguaccuauuuugaugcaaaggaacggcccugggaccucagagggccacagaugggc

SEQ ID NO: 155444 - RNA, 64 nt, hsa
ccguuccccaaggcagggagagggaguggcccgucccugggaggcuggcaaagugcucuccagg

SEQ ID NO: 155445 - RNA, 64 nt, hsa
augggccauauuccgcacugggcacaggccgucacccugggagcagucggcacagugcagcaag

SEQ ID NO: 155446 - RNA, 64 nt, hsa
gaugcugcuguacaacuucugggccucucuuggacccugggagugaggguggguguggguggaa

SEQ ID NO: 155447 - RNA, 64 nt, hsa
ggggcaguuuguugcguucuucgugguucccaggcccugggacaucucacuccacuccuaccuc

SEQ ID NO: 155448 - RNA, 64 nt, hsa
cuauuggccccaggacugaagcugccucccuucacccugggacugugguuccaaggaugagagc

SEQ ID NO: 155449 - RNA, 64 nt, hsa
gaguccccaucagaggcagugaggugggccccggcccugggacaggcagcugccuucuggucug

SEQ ID NO: 155450 - RNA, 64 nt, hsa
ggacaccugaggggucaggauauccccacccccacccugggaaagacgccuuuccccacuccug

SEQ ID NO: 155451 - RNA, 64 nt, hsa
cuggcugucucucucacacagauacacgugcgcucccugggauccgggaggcccugggcuuccu

SEQ ID NO: 155452 - RNA, 64 nt, hsa
guaaaugagagagaagaauagacaggcuuccaaacccugggaagaaagcugcuuaauuauguga

SEQ ID NO: 155453 - RNA, 64 nt, hsa
cucucucugaguuccucugggcugccgcaggcuccccugggaauagagcaagacgugaguccua

SEQ ID NO: 155454 - RNA, 64 nt, hsa
gugagcccagcguccccuccuuggcuuccaggagcccugggaagcauuuuuaacuggguagaau

SEQ ID NO: 155455 - RNA, 64 nt, hsa
uuuugaaguccagagcuggagcaggcgggcagugcccugggagaccccgcucuggauaagacac

SEQ ID NO: 155456 - RNA, 64 nt, hsa
agccgccacccaaggagccccauccgcccacccacccugggacccacgcggccacuccagggau

SEQ ID NO: 155457 - RNA, 64 nt, hsa
gccacagguccugggaaagaagugggaucuagggcccugggaggagguugagccuggggaagga

SEQ ID NO: 155458 - RNA, 64 nt, hsa
uucaggcccaggaccccaagcuccucagccuggccccugggauugcaguugagaguuauucagu

SEQ ID NO: 155459 - RNA, 64 nt, hsa
ggcugccucucccuucucgguggcuuccccuacgcccugggaguuugaucucuuaagggaacuu

SEQ ID NO: 155460 - RNA, 64 nt, hsa
ggacugucuuggguuuaaaacugcaagucuccuacccugggaucccauccaguuccacacgaac

SEQ ID NO: 155461 - RNA, 64 nt, hsa
uucuugucaguggagggagcagcuccccacucagcccugggacaggcccugggacugugguggc

SEQ ID NO: 155462 - RNA, 64 nt, hsa
gagggagcagcuccccacucagcccugggacaggcccugggacugugguggccgguggcccugg

SEQ ID NO: 155463 - RNA, 64 nt, hsa
accagagggacccucuggcucaggaggguugggucccugggaggccggcagccaggccacagaa

SEQ ID NO: 155464 - RNA, 64 nt, hsa
aggccacagaauccacacguggaccauugugggucccugggaggccggcagccaggccacggaa

SEQ ID NO: 155465 - RNA, 64 nt, hsa
uugccgucuuguaagggugggggcugacggccgacccugggaggaggugacaucgccgggggag

SEQ ID NO: 155466 - RNA, 64 nt, hsa
gaacgugugguguguccccugggaagucucugggcccugggaagagggaaggugcacguccugg

SEQ ID NO: 155467 - RNA, 64 nt, hsa
agacucauguccagcaaggaacgugugguguguccccugggaagucucugggcccugggaagag

SEQ ID NO: 155468 - RNA, 64 nt, hsa
gagaccucagcccaagcucaggacaaggaggccucccugggagagggggccuuucucccaccau

SEQ ID NO: 155469 - RNA, 64 nt, hsa
cuuccuugggaccagugcaaggaaguucugcugucccugggaagucucagaaccaggaaggaaa

SEQ ID NO: 155470 - RNA, 64 nt, hsa
gcucagaaccugucacuaauacagcugccugugacccugggacccgcaaccuuccagcugcuuc

SEQ ID NO: 155471 - RNA, 64 nt, hsa
ccacgagcggaaguagccgacaggagggcgaggccccugggacggacagggcuggcugucucuc

SEQ ID NO: 155472 - RNA, 64 nt, hsa
ugucacgcgcuuccccgugcccaacgagaaggugcccugggagacggaguuccugaucuaugac

SEQ ID NO: 155473 - RNA, 64 nt, hsa
aagacagggcacaggcuacucagagcugaggggccccugggacccuuggccaucaggcgagggg

SEQ ID NO: 155474 - RNA, 64 nt, hsa
cgcagagggccccugccaggguuggccccagggacccugggacgaggcugcagaagcucucccu

SEQ ID NO: 155475 - RNA, 64 nt, hsa
ugggacgaggcugcagaagcucucccucccuacucccugggagccacgugcuggccauguggcc

SEQ ID NO: 155476 - RNA, 64 nt, hsa
aaucacagagucugcccugagcagaggcugcugucccugggacuccuagccauggucagacugu

SEQ ID NO: 155477 - RNA, 64 nt, hsa
ucaccacucccugggcuggcuggcagguauggcacccugggagcccggcauauacccagggcac

SEQ ID NO: 155478 - RNA, 64 nt, hsa
acaucccaagucugugcagcagggagccccaugccccugggacaugaacccaccugcguggaau

SEQ ID NO: 155479 - RNA, 64 nt, hsa
cugcugccaccuccugugcacuuugagcaaugcccccugggaucaccccagccacaagcccuuc

SEQ ID NO: 155480 - RNA, 64 nt, hsa
auggcccaccuuggagcagagagccaagcaucuucccugggaagucuuucuggccaagucuggc

SEQ ID NO: 155481 - RNA, 64 nt, hsa
acuuacuccugccuccaggggcggggcggggccccccugggaccucuuaaggcccaaggugggc

SEQ ID NO: 155482 - RNA, 64 nt, hsa
caggcaguauauaggggccgcccaccuucagcugcccugggaugggaaggacccagcccgaccc

SEQ ID NO: 155483 - RNA, 64 nt, hsa
uccucuugcagccccccaaacugggaccgaaugacccugggaaggggaacuuggguagguuggg

SEQ ID NO: 155484 - RNA, 64 nt, hsa
guuauucuccccagccagagcccgagcuccugcucccugggaaaaguggcguauggcccugagc

SEQ ID NO: 155485 - RNA, 64 nt, hsa
cugggcaugugcugagguugacuuagggaacaagcccugggauuggacaaaagggcccaugcug

SEQ ID NO: 155486 - RNA, 64 nt, hsa
ugaaggggugacucccuggccuaguauagugugacccugggacuaacuuaauguccuaaagcau

SEQ ID NO: 155487 - RNA, 64 nt, hsa
aggaacagaagugaggaugagacccagccccuuccccugggaacucuccuggccuucuaggaau

SEQ ID NO: 155488 - RNA, 64 nt, hsa
auggaagaggaguccugaucaggccucaccccuccccugggacuuucccacccaggaaaggagg

SEQ ID NO: 155489 - RNA, 64 nt, hsa
cgugguuuuucccaccccagcugccccagcacgcgggacccauagcacaccccuuagcgcuugc

SEQ ID NO: 155490 - RNA, 64 nt, hsa
ccgggcuucgaugugccuggaggauuuccccacagggacccacgcaccucccuguaucugcgca

SEQ ID NO: 155491 - RNA, 64 nt, hsa
gggaggcccacuccuggcucaccucucccucucagggacccacgugggagccuggaucccugga

SEQ ID NO: 155492 - RNA, 64 nt, hsa
ccacacuagcagcccugacuccacacuccuccuggggacccaagaggcaguguugcugucugca

SEQ ID NO: 155493 - RNA, 64 nt, hsa
aagagggugaugagacaggacuagaaaguagugggggacccagcgaguggacgcccugcuccgg

SEQ ID NO: 155494 - RNA, 64 nt, hsa
cagcugugugagaaaaugaaagccgacguccacagggacccaggcaggguuggguguugugacu

SEQ ID NO: 155495 - RNA, 64 nt, hsa
acagggaaaauggagcccaaguagccucuggccagggacccaaugucccgaggaaucugccucc

SEQ ID NO: 155496 - RNA, 64 nt, hsa
ucuacaccugggcuccaagucugaguucccacaggggacccagcagccuccaggaaguccauac

SEQ ID NO: 155497 - RNA, 64 nt, hsa
auccuggaggagaggaaacagugacuaaaagcuggggacccacagagggguuggcagcuucucu

SEQ ID NO: 155498 - RNA, 64 nt, hsa
ccuccgcgggagguggcccucagcugggacaguggggacccaggcuucuccucagagccaggcc

SEQ ID NO: 155499 - RNA, 64 nt, hsa
ccaacaggcccgugggaccaugacuuagggaggugggacccacccacccccauccaggaaccgu

SEQ ID NO: 155500 - RNA, 64 nt, hsa
auguuaaggugaaccccaccccuucuuacagauggggacccagagccugcucuugggaacagcc

SEQ ID NO: 155501 - RNA, 64 nt, hsa
cuuucuuccccagggaauucucuagcagagggaggggacccaccccagugaggaaguagauugc

SEQ ID NO: 155502 - RNA, 64 nt, hsa
accuaggacucuucccuggagucaugggcugccugggacccaggacccaugagggggcugagag

SEQ ID NO: 155503 - RNA, 64 nt, hsa
agcagggguccagagaggcaggcuggggaggcaagggacccauccuaggcccgcuuucuugccg

SEQ ID NO: 155504 - RNA, 64 nt, hsa
guagggguauaagucuguuccaugcagucacucagggacccagucuccuuuugucuggugacuc

SEQ ID NO: 155505 - RNA, 64 nt, hsa
caggucagcaggaacccuuuucugcagucacucagggacccagacuuacagaguggguaggaug

SEQ ID NO: 155506 - RNA, 64 nt, hsa
ccucacccugcuccccacccaggcagggcagcaugggacccagugucucagugccuucaaaacc

SEQ ID NO: 155507 - RNA, 64 nt, hsa
ugaggaagggaauggaccagggagucccaggccugggacccagagccaagaaagcugagauauc

SEQ ID NO: 155508 - RNA, 64 nt, hsa
ugugcuccucgguguuacuucccuuucauaugaggggacccagcgccggggggagggaggaggg

SEQ ID NO: 155509 - RNA, 64 nt, hsa
ccaaggggcccgaggggcugcgugugggaggcuggggacccagacuuuuggccccagcgcuggc

SEQ ID NO: 155510 - RNA, 64 nt, hsa
ccagcuccuggaagagauguccuaauaucucuuagggacccagaccccuaaauucuccuccucc

SEQ ID NO: 155511 - RNA, 64 nt, hsa
gucuccuguugaauggcccuuguugcccuagagugggacccagcccucaccucccccagagcua

SEQ ID NO: 155512 - RNA, 64 nt, hsa
gcaaggcaguccccccacgcccgagaaagccugggggacccagacaccuguccccacagucaaa

SEQ ID NO: 155513 - RNA, 64 nt, hsa
ggacccagacaccuguccccacagucaaagccuggggacccagacauccuguccccacagucag

SEQ ID NO: 155514 - RNA, 61 nt, hsa
ccaacccuuuccuucucuagugccugggccugggacccacccagagcaccugugcuggagg

SEQ ID NO: 155515 - RNA, 64 nt, hsa
uuugaggccccaacaugacagccacugggccaccgggacccaagaagacagcccccugccccau

SEQ ID NO: 155516 - RNA, 64 nt, hsa
gcuagggcuaggugucaagagagggugugggauugggacccaggcccuucuuucuaaacucaac

SEQ ID NO: 155517 - RNA, 64 nt, hsa
ccccuacugauugcugccuucucuguggcuacaagggacccacagaauuacagggaaguuacag

SEQ ID NO: 155518 - RNA, 64 nt, hsa
ggauccugaccccugcagggcucaggggucagcagggacccacugccccaucucccucucccca

SEQ ID NO: 155519 - RNA, 64 nt, hsa
ccugagucugcuggggagugggcauucucugccagggacccaugagcaggcugcauggucuaga

SEQ ID NO: 155520 - RNA, 64 nt, hsa
gucgcucucccacccagccuggacuuggccccaugggacccauccucagugcucccuccagauc

SEQ ID NO: 155521 - RNA, 64 nt, hsa
gggcagguugcuaagucaggugcagagguucugagggacccaggcucuuccucuggguaaaggu

SEQ ID NO: 155522 - RNA, 64 nt, hsa
ugcuaaaugguuguagggugagaagugcaagaaugaagaugaagccccacugcucggucagucu

SEQ ID NO: 155523 - RNA, 64 nt, hsa
gucugccuccguguguccucugaaauaagcagaugaagaugaaagggcaacuuuguuuucuucu

SEQ ID NO: 155524 - RNA, 64 nt, hsa
gucacucagaaauccuucaaacaugauuaauuaugaagaugaaacacuagagucauauaagaaa

SEQ ID NO: 155525 - RNA, 64 nt, hsa
aaauauauuugaaaugaaaaucuccaacacauuagaagaugaugauguuagaugcccaucgugu

SEQ ID NO: 155526 - RNA, 64 nt, hsa
aauaaggaaugauauaagguuuuuuuuucucacagaagaugaagcacacaggaaccuaaugggc

SEQ ID NO: 155527 - RNA, 64 nt, hsa
guguggaaauguaugauccaacuagaaaugaauggaagaugaugggaaauaugacuucaccaag

SEQ ID NO: 155528 - RNA, 64 nt, hsa
cgaugugaagaugaaugaauguaacuccuggugugaagaugaauguaaacccuggcgacaguug

SEQ ID NO: 155529 - RNA, 64 nt, hsa
ucucgguaaccacggcagagagcagcgccgaugugaagaugaaugaauguaacuccugguguga

SEQ ID NO: 155530 - RNA, 64 nt, hsa
aggcaugacagcuaacagggacgggcuuucuuuggaagaugaugaaauuguggaaugaugguug

SEQ ID NO: 155531 - RNA, 64 nt, hsa
gaauauacuagaaaccaaugaauuaaaaacuuuggaagaugaauuuuauggucugugaauuaua

SEQ ID NO: 155532 - RNA, 64 nt, hsa
gaacaagcuggugaauaaccuuggcaguggaagggaagaugaugccauuguccuggaugaugcc

SEQ ID NO: 155533 - RNA, 64 nt, hsa
caaaaggaccggcucauuuggucacuagucuauagaagaugacacagaaauuggaaccaacaaa

SEQ ID NO: 155534 - RNA, 64 nt, hsa
guuuuacuuaauauucccuaaaaacuugaggaaggaagaugauagaacaugagauacucuuugu

SEQ ID NO: 155535 - RNA, 64 nt, hsa
uaucuauuuuuauuuaaccuuucuuauauuaucugaagaugaauauguauguggcuguauuuug

SEQ ID NO: 155536 - RNA, 64 nt, hsa
uaugguagugacuguucaucauaugacauuuacugaagaugaacuggguccaugaugaagugug

SEQ ID NO: 155537 - RNA, 64 nt, hsa
aaaaggcaaacacaaggaaagaucagaugaaacagaagaugauaguaaaagugauccuaaguaa

SEQ ID NO: 155538 - RNA, 64 nt, hsa
aagaauaucacaggcuaauagcgugguugggggugaagaugauagcaguuauuaaaucaggaau

SEQ ID NO: 155539 - RNA, 64 nt, hsa
uuuuacccccuuguuauaaaacugugcagagcaagaagaugauacuuauuuuugaauuuguauu

SEQ ID NO: 155540 - RNA, 64 nt, hsa
gcacuuaguagcugugaaggaaggugcagagucagaagaugaagaagaggaggaugugaaacuc

SEQ ID NO: 155541 - RNA, 64 nt, hsa
aaaacuugcugcugcugcugaugaugaugaugaugaagaugaugaugaugaugaugacgaggaa

SEQ ID NO: 155542 - RNA, 64 nt, hsa
uuuuugugguuguaaauagacuuacuugcacuuugaagaugaguuacuccuugucaucuuacaa

SEQ ID NO: 155543 - RNA, 64 nt, hsa
gccucauaucccccuuauugaugacacugaugccgaagaugaugcuccuacaaaacguaacucc

SEQ ID NO: 155544 - RNA, 64 nt, hsa
ccucgugggucugguagauuauccugaugaugaugaagaugaugaugaggaugaagauaaggaa

SEQ ID NO: 155545 - RNA, 64 nt, hsa
agaagaugaagaagagaugugguuuaacacagaugaagaugacauggaagauggagaagcugua

SEQ ID NO: 155546 - RNA, 64 nt, hsa
gaaucacagauaucgaagagaugccagaacacuagaagaugaagaagagaugugguuuaacaca

SEQ ID NO: 155547 - RNA, 64 nt, hsa
guuguaguccuaugaugauguaaacuugguacuacauaaugacuugcuccacacaugcaguaaa

SEQ ID NO: 155548 - RNA, 64 nt, hsa
acauaaugacuugcuccacacaugcaguaaacuacauaaugauguacugguaaacuagaaacaa

SEQ ID NO: 155549 - RNA, 64 nt, hsa
uuauauugucacuagaaucucuuaaguauaauuccauaaugacaugggcauauaccguaacauu

SEQ ID NO: 155550 - RNA, 64 nt, hsa
auaacuagaaguuagaaaguuuaaaaguuuuccacauaaugaaaguccuucugauaauuugaca

SEQ ID NO: 155551 - RNA, 64 nt, hsa
auuucaaaauacauuuguaaguguaaaaaaugucucaugucaaugaccauucaauuagugguca

SEQ ID NO: 155552 - RNA, 64 nt, hsa
uuaaggugauuugugaaacaguugcugugaacuuucaugucaccuacauaugcugaucuuuuaa

SEQ ID NO: 155553 - RNA, 64 nt, hsa
acaccuguugcauuuauauucuuuccauuugcuaucaugucagugaacgccaggagugcuuucu

SEQ ID NO: 155554 - RNA, 64 nt, hsa
gugagguuuaggaagauuuucauaaagucauauuucaugucaaaggaaaucagcagugauagau

SEQ ID NO: 155555 - RNA, 64 nt, hsa
gaaaaaaaaauuaauacuacuagcuuccagacaaucaugucaaaauuuaguugaacugguuuuu

SEQ ID NO: 155556 - RNA, 64 nt, hsa
uucacuucaaaucauaaacuuagaauucuguaucucaugucagaaauauguuuauggccuugcu

SEQ ID NO: 155557 - RNA, 64 nt, hsa
ucauuaauggcuaacaacacguagggacuucaugucaugucaaagauagcucuuugcaagugcc

SEQ ID NO: 155558 - RNA, 64 nt, hsa
ugccaucauuaauggcuaacaacacguagggacuucaugucaugucaaagauagcucuuugcaa

SEQ ID NO: 155559 - RNA, 64 nt, hsa
uuuuugcuuuuuuaaaggaggggaaauauuugccucaugucauaauugaaaagauuaaauaaga

SEQ ID NO: 155560 - RNA, 64 nt, hsa
acauucccugaccacagggaagcaccuggcucaaucaugucacacagcaguggaaagaauacgg

SEQ ID NO: 155561 - RNA, 64 nt, hsa
uuuugcuggcugaaagaguauggaauaauauaucucaugucauuuuuuagaagaaaaacuauuu

SEQ ID NO: 155562 - RNA, 64 nt, hsa
cccacaccugagaacucgucucauuacuuuauagucaugucauguauguuuuuuuaaccaugaa

SEQ ID NO: 155563 - RNA, 64 nt, hsa
aauauucauaaugguuggugucuuuugaaugaauucaugucaaaaauguuauucagcuggggaa

SEQ ID NO: 155564 - RNA, 64 nt, hsa
cuuuaaaaaugaaucuugcuucauuugaugaauuucaugucacaaagcuucucucaagagcucu

SEQ ID NO: 155565 - RNA, 64 nt, hsa
ccacaaguccauucugccuucaaaguguaaguucucaugucauuauggauuuggaguuugucag

SEQ ID NO: 155566 - RNA, 64 nt, hsa
gguaauuugacagaguguuggaugugucaugucaucaugucaaacccaaauauuugaccuaagg

SEQ ID NO: 155567 - RNA, 64 nt, hsa
cuugugcagguaauuugacagaguguuggaugugucaugucaucaugucaaacccaaauauuug

SEQ ID NO: 155568 - RNA, 64 nt, hsa
caaacauaguuauguuuucucuaacuugaugaggucaugucacagaccauuuuaucccuucagu

SEQ ID NO: 155569 - RNA, 64 nt, hsa
uuuuguauuauuuuuuuuauucgugcauauuugcucaugucacaggaauauggaagagauugug

SEQ ID NO: 155570 - RNA, 64 nt, hsa
acuguugucucuaccuucccaauuugaucaauuuucaugucauuggcugggugcgguggcuccu

SEQ ID NO: 155571 - RNA, 64 nt, hsa
acuuguaaugaucacuaauuauuauugccggcugucaugucagccuccuuaccagccacuuucc

SEQ ID NO: 155572 - RNA, 64 nt, hsa
gccuggagagaaacuuccagaccagcccucucacuacagccaggagaggccuuucccgccugga

SEQ ID NO: 155573 - RNA, 64 nt, hsa
accgggagagaaacuuccagaccagcccucucacuacagccagaagaggccuuucccaccggga

SEQ ID NO: 155574 - RNA, 64 nt, hsa
aauacuauauuuauacuguauauauaauacugacugagaauauaauacuguauuugagaauaua

SEQ ID NO: 155575 - RNA, 64 nt, hsa
uauauaauacugacugagaauauaauacuguauuugagaauauaaaaaacuuuuuucagggaag

SEQ ID NO: 155576 - RNA, 64 nt, hsa
cauaauuucaugcacaaguugacugagcuaaucuugagaauauauucguaaaauaggagcacau

SEQ ID NO: 155577 - RNA, 64 nt, hsa
aaacauuugaaauacuaccauauuugugauuuauugagaauaaaaauccauuuugaaauguaaa

SEQ ID NO: 155578 - RNA, 64 nt, hsa
aagguaguaggucucuuucaacugagugcaacauugagaauaaugauuugguucagggcaacua

SEQ ID NO: 155579 - RNA, 64 nt, hsa
ggacacugucaggcaaauuugaaaauauacacauugagaauaauuuuuuauuauuauauccuau

SEQ ID NO: 155580 - RNA, 64 nt, hsa
cuagccuuuuaagagagguuuuuaaccugaagcaugagaauauaucaccugugguuuuuccuuu

SEQ ID NO: 155581 - RNA, 64 nt, hsa
acccaaaauuaacuuaugcucauauauuaggaugugagaauaucaucuguuuauggacacauga

SEQ ID NO: 155582 - RNA, 64 nt, hsa
acuugugcaauauauauguuuuaaaaaacaaauuugagaauacauuuaaucauagggauauaga

SEQ ID NO: 155583 - RNA, 64 nt, hsa
uaucuuuauaugucaaacugguugaacacuguaaugagaauaaacugcacagaguuuauucuga

SEQ ID NO: 155584 - RNA, 64 nt, hsa
cuggucugagacuuacugugugcaggaagucucgugagaauauacuuagaaaaucacacuuauc

SEQ ID NO: 155585 - RNA, 64 nt, hsa
gacucuaagaaguauguagaaccuuguuuauaggugagaauaggcuguauuauaugaaaccagc

SEQ ID NO: 155586 - RNA, 64 nt, hsa
gucucuuccuaauugugcuguaauaaccuguguaugagaauaaaaugauuuccaccaucaggau

SEQ ID NO: 155587 - RNA, 64 nt, hsa
gaagauuucaagaaaggacaacucacuguacacuugagaauaauaccuacagagguucauacug

SEQ ID NO: 155588 - RNA, 64 nt, hsa
acuuaacauucuuuuucuguauuucuuuaaacccugagaauaauuuacaugcucauaauacagg

SEQ ID NO: 155589 - RNA, 64 nt, hsa
ugucauuuuguugaugaugcaaagcacguuggacugagaauacuuaacauucuuuuucuguauu

SEQ ID NO: 155590 - RNA, 64 nt, hsa
uaaggagaggagcggcguuggcaaaugugaaccaugagaauaucagugauacugaugagaauaa

SEQ ID NO: 155591 - RNA, 64 nt, hsa
caaaugugaaccaugagaauaucagugauacugaugagaauaaacuaaacgccuuuguaacagc

SEQ ID NO: 155592 - RNA, 64 nt, hsa
uguauuaaccauuauugagaauaaauuuuuuuauugagaauaaauuuucuaaaauuacauguuu

SEQ ID NO: 155593 - RNA, 64 nt, hsa
aaugcuguuucugaguuauuguauuaaccauuauugagaauaaauuuuuuuauugagaauaaau

SEQ ID NO: 155594 - RNA, 64 nt, hsa
uuauguaaaauauuaaagcauuaauauaaauaugugagaauaaaaacaaucuaaauccagaaaa

SEQ ID NO: 155595 - RNA, 64 nt, hsa
ggauucguguagguggcaaagcuagaugaggacaugagaauaauucaggagaacaaaaggaaac

SEQ ID NO: 155596 - RNA, 64 nt, hsa
gauuuccccacagggacccacgcaccucccuguaucugcgcagcuugcucguguggcuggaagc

SEQ ID NO: 155597 - RNA, 64 nt, hsa
agcaaucucagggauagccagcagcagcuccaggucugcgcagcaggaauuacuuuuuguuguu

SEQ ID NO: 155598 - RNA, 64 nt, hsa
aaaagcaagggguuuguccagguggccccugaauucugcgcaagggaugggccugggggaacuc

SEQ ID NO: 155599 - RNA, 64 nt, hsa
uuccagacggaugucuuaaaaugggaucucaucgucugcgcagugguugcuguccucucauuug

SEQ ID NO: 155600 - RNA, 64 nt, hsa
ccugcucgagagcccgcgcuagagucggggaggaucugcgcagagaccgcagcaucacccaaau

SEQ ID NO: 155601 - RNA, 64 nt, hsa
gagaugaguaaaaacaucagcuuccacguugccuucugcgcaaaggguuucaccaaggauggag

SEQ ID NO: 155602 - RNA, 64 nt, hsa
auccucugaggcggccaccgcgcgccggccgcgcucugcgcacaaaagccaaacgcauccgacu

SEQ ID NO: 155603 - RNA, 64 nt, hsa
auaagaaugauuuagacugaccuguccuuuuuuaucugcgcaugcgagaacaucaccuuccucu

SEQ ID NO: 155604 - RNA, 64 nt, hsa
aauggauguuggguaggccaucaauaagguccauucugcgcaguaucucaacugccguucaaca

SEQ ID NO: 155605 - RNA, 64 nt, hsa
uccccaugguuccugccacuugcuaaccaugcuaucugcgcagacgcuuccgagggcagaaaua

SEQ ID NO: 155606 - RNA, 64 nt, hsa
ucucccuccccuaccccucuaucauuuaguuucuucugcgcaagccacucuggcuuccuuucag

SEQ ID NO: 155607 - RNA, 64 nt, hsa
aagugagaaagacugaguugcgugucuguaaaugucugcgcagggugcacaugcugcgaggucu

SEQ ID NO: 155608 - RNA, 64 nt, hsa
auccacugggcacuucuuaaccuucuauuugaccucugcgcauuuggcccuguugagcacucuu

SEQ ID NO: 155609 - RNA, 64 nt, hsa
guuaaucaggggugucuuucuugugcagucagggucugcgcacagucaaucaggguagaggggg

SEQ ID NO: 155610 - RNA, 64 nt, hsa
aguguuauuccauuacuagcgucauggagcuaccucugcgcaucagacuucagaccuugaacaa

SEQ ID NO: 155611 - RNA, 64 nt, hsa
gcccagggucgccgccgccccucgcaccgcuaggucugcgcaccaucucgcccccgccgugggg

SEQ ID NO: 155612 - RNA, 64 nt, hsa
accaggcuccagcucaucccuccaaggcccugucucugcgcacagcaaccauggacaugggaga

SEQ ID NO: 155613 - RNA, 64 nt, hsa
acacacacacacaaaauaaagacacacaaggacgucugcgcagcaagaaaagaaucucaguugc

SEQ ID NO: 155614 - RNA, 64 nt, hsa
uauguauaccugccaagauaccuuuuccagggugucugcgcacauuuuaaguuaauucacauaa

SEQ ID NO: 155615 - RNA, 64 nt, hsa
ugcucccugcucuuucugccucugggcucauguaucugcgcagcucugguacccucugugggug

SEQ ID NO: 155616 - RNA, 64 nt, hsa
ucuuccugcagcgccgguacauagccaaggcucgucugcgcaccuugugucuuguaggguaugg

SEQ ID NO: 155617 - RNA, 64 nt, hsa
cagaaugaauucgaugcguauucuguggccgccaucugcgcaggguggugguauucugucauuu

SEQ ID NO: 155618 - RNA, 64 nt, hsa
cccgggcugcucaccucuccccuucugcugagcuucugcgcaccccucccuggaacuuagccau

SEQ ID NO: 155619 - RNA, 64 nt, hsa
auuuccuuauuaggagaaauaaauuucgcuuagcucugcgcacucccauuuccaaaaauaaacu

SEQ ID NO: 155620 - RNA, 64 nt, hsa
ggggcguucccacugccuggaugccggcuugaguucugcgcacgcaggauucaguguggggacg

SEQ ID NO: 155621 - RNA, 64 nt, hsa
caccucgugccuuuauccgcccugucccuuccucucugcgcaucucacccgcccggcuggcccc

SEQ ID NO: 155622 - RNA, 64 nt, hsa
uuuucucccuggccuccagugcccaccaggaggaucugcgcacggugcacagcccaccagagca

SEQ ID NO: 155623 - RNA, 64 nt, hsa
cugggcccgagcucagaaacagcugucgccucagucugcgcacaggcaugcaccccaggguagu

SEQ ID NO: 155624 - RNA, 64 nt, hsa
ugcuugggccauaacacaggagaccugcucccuaucugcgcacccggagguggggugaggacgg

SEQ ID NO: 155625 - RNA, 64 nt, hsa
aaugugacauuaacauucccaucgccuaccauuuucugcgcagauaugcuaggguaagagagaa

SEQ ID NO: 155626 - RNA, 64 nt, hsa
guucauugauggaugucuucuagcugcagaugccucugcgcaccaaggaauggagaggagggga

SEQ ID NO: 155627 - RNA, 61 nt, hsa
aauuuccccuuuuuuuaaaaaauggaaauauucaauugagacuugaggggaauaauagaaa

SEQ ID NO: 155628 - RNA, 61 nt, hsa
uaacauuguuaaugcacuaagugauuuaaauucaauugaugaagaugugauuuuacagaag

SEQ ID NO: 155629 - RNA, 64 nt, hsa
cgggcagaucacgagaucaggaguucaagaccagccuggccaauaugaugaaaccccgucucua

SEQ ID NO: 155630 - RNA, 64 nt, hsa
gguggaucaccugaggucagaaguuugagaccagccuggccaacauggugaaaccccgucucua

SEQ ID NO: 155631 - RNA, 64 nt, hsa
caaagugcugggauuacaggcaugagccaccacgccuggccaaaaaaauauguuuuaaaugucc

SEQ ID NO: 155632 - RNA, 64 nt, hsa
gguggaucacccaaggucaggaguuugagaccagccuggccaaauggugaaaccccaucucuac

SEQ ID NO: 155633 - RNA, 64 nt, hsa
caggagcaguccgacuaggccccaggcccgcccuccuggccagcagaguggggcacuggggggc

SEQ ID NO: 155634 - RNA, 64 nt, hsa
gcauccugccuugcugcucugucccccacaucuuccuggccacagccccuugccccuccucuaa

SEQ ID NO: 155635 - RNA, 64 nt, hsa
cacgaggauccucagugaccaugguggccacacgccuggccagccugcuggcuccugggugagc

SEQ ID NO: 155636 - RNA, 64 nt, hsa
cucugucccccucuacugucccuuucacaccuugccuggccaaggggcuagaccucccaggcua

SEQ ID NO: 155637 - RNA, 64 nt, hsa
cacagaaucagaaagagcuagaagaaaaggcucaccuggccacuguuuaggcacccagacauaa

SEQ ID NO: 155638 - RNA, 64 nt, hsa
caugcagaaguagaagcuggugaggggcagggucccuggccagaaggggcauggccaccuccca

SEQ ID NO: 155639 - RNA, 64 nt, hsa
ggcagaucaccugaagucaggaguucaagaccauccuggccaacacagugaaaccccaucugua

SEQ ID NO: 155640 - RNA, 64 nt, hsa
cugucacgaagcagaguuggcacauaacauggaaccuggccaggcaugguggcucacaccuaua

SEQ ID NO: 155641 - RNA, 64 nt, hsa
uuccagugaagcacgaggucuugguuccaggguuccuggccaggugcccccuuagcauuuguuc

SEQ ID NO: 155642 - RNA, 64 nt, hsa
gcguucugcagcauguagcaugcccaccuagcucccuggccagggcccuggggaggcagagggu

SEQ ID NO: 155643 - RNA, 64 nt, hsa
ggguagauaccugaagucaggaguucgagacuagccuggccaauaugguaaaaccccgugucua

SEQ ID NO: 155644 - RNA, 64 nt, hsa
ucccaccccaaacccucucccgggacucagucucccuggccacugcguaucaggcuucugggga

SEQ ID NO: 155645 - RNA, 64 nt, hsa
gccagaucaccugaggucaggaguucgagaccacccuggccaacauggugaaaccccaucucua

SEQ ID NO: 155646 - RNA, 64 nt, hsa
ggcggaucaccugagguuagaaguuugagaccagccuggccaacauggugaaaccuggccucua

SEQ ID NO: 155647 - RNA, 64 nt, hsa
auuagggcagcuuaccccaacaugaaaaugaugaccuggccauuuuuaauggccagagcuugaa

SEQ ID NO: 155648 - RNA, 64 nt, hsa
cgggcggaucacaagguccagaguucaagagcagccuggccaacauggugaaaccccgucucua

SEQ ID NO: 155649 - RNA, 64 nt, hsa
caaacggaucacgaggucaggagaucaagaccauccuggccaacauggugaaaccccaucucua

SEQ ID NO: 155650 - RNA, 64 nt, hsa
gguggaucucuugaggucgggaguuugagaccagccuggccaacauggugaaacccugucuuua

SEQ ID NO: 155651 - RNA, 64 nt, hsa
agauuuuuucuguugcucuuugaaaacuaugagcccuggccagcuuaaccuggucugaggugag

SEQ ID NO: 155652 - RNA, 64 nt, hsa
ggcggaucaccugaugucagggguucgagaccagccuggccaacauggugaaacccuguugcua

SEQ ID NO: 155653 - RNA, 64 nt, hsa
cggggggaucacgaggucaagagaucgagaccauccuggccaacauggugaaaccccgucucua

SEQ ID NO: 155654 - RNA, 64 nt, hsa
gacacccuccugccuguuuuucucugcaucccaaccuggccaaggccccuccuguggggugccc

SEQ ID NO: 155655 - RNA, 64 nt, hsa
uccccuggcuccagagauggucacaugacccaggccuggccagucaaaguagucucuccccugg

SEQ ID NO: 155656 - RNA, 64 nt, hsa
ugacccaggccuggccagucaaaguagucucuccccuggccacaguaauuggucaugugaugca

SEQ ID NO: 155657 - RNA, 64 nt, hsa
cugcccugcuaaagacagugcggaugcaagagcaccuggccaagcgagagcagcuggguaagcg

SEQ ID NO: 155658 - RNA, 64 nt, hsa
agauggggcgagccaggaccacagagcuccuggcccuggccagaagcaggagugugaggaggag

SEQ ID NO: 155659 - RNA, 64 nt, hsa
caaagugcugggauuacagacaugagccaccgagccuggccaauuuuuguguuuuuuguagaga

SEQ ID NO: 155660 - RNA, 64 nt, hsa
cgggcagaucacgaggucaagagaucaagaccauccuggccaacauggugaaauccugccucua

SEQ ID NO: 155661 - RNA, 64 nt, hsa
caaagggcugagauuacaggugugagcuaccucaccuggccaaaacaguuuuuuuagaaaugaa

SEQ ID NO: 155662 - RNA, 64 nt, hsa
uuccuucugccaugggaggaugaaacaugaaggcccuggccagguguggccccuccaucuuccg

SEQ ID NO: 155663 - RNA, 64 nt, hsa
ccaaaagagagggauggcuuucccagaagacacuccuggccaucuguggauuugucugugcacc

SEQ ID NO: 155664 - RNA, 64 nt, hsa
aguccacuugggucaucagcucugccaagcugagccuggccaagcuagguggacagacccuugc

SEQ ID NO: 155665 - RNA, 64 nt, hsa
gacaggccugaggcccugggcacagugacgguggccuggccagcccucgggaccccuccccacc

SEQ ID NO: 155666 - RNA, 64 nt, hsa
ucacuaugcaaacuagaauauccucagcagguggccuggccacucuggagaaagaaacccaagg

SEQ ID NO: 155667 - RNA, 64 nt, hsa
cugucucucccuuccaggaaugcugggcccccagccuggccagacaagaagacugucaggaagg

SEQ ID NO: 155668 - RNA, 64 nt, hsa
ggccaggagcccacagugccuguacaggaaggugccuggccaugucaccuggcugcuaggccag

SEQ ID NO: 155669 - RNA, 64 nt, hsa
uggguggaucacaaggucaggaguuugagaccagccuggccaagaugguaaaaccccgucucua

SEQ ID NO: 155670 - RNA, 64 nt, hsa
ggccuggcugaucucaaacuccuggucuugaacuccuggccacaagugaucugcccgccuuggc

SEQ ID NO: 155671 - RNA, 64 nt, hsa
gguggaccacaugaggucaggaguuugagaucagccuggccaacauggugaaaccccaucucua

SEQ ID NO: 155672 - RNA, 64 nt, hsa
cgggcggaucaugaggucaagagaucaagaucauccuggccaacauggugaaacccugucucua

SEQ ID NO: 155673 - RNA, 64 nt, hsa
gguggaucaccugaggucaggaguucaugaccagccuggccagcaugguaaaacccugucucca

SEQ ID NO: 155674 - RNA, 64 nt, hsa
ugggcagaucuugaggucgguagauggagaccauccuggccaacauggugaaacccugucucua

SEQ ID NO: 155675 - RNA, 64 nt, hsa
ucaccccaccuucaucaucaugcuccagggucacccuggccagcucuugugcugggacagggga

SEQ ID NO: 155676 - RNA, 64 nt, hsa
aguagauggugggggacagcggcguggguccuagccuggccagugaugcugcuggcguccagac

SEQ ID NO: 155677 - RNA, 64 nt, hsa
aggggaaaaccucaguuggccucugccccucuucccuggccaggggcuucucccccucagcucu

SEQ ID NO: 155678 - RNA, 64 nt, hsa
cuuccagggccccacgguccccaggaggacgcuuccuggccaaagccccaagccuuuggugaga

SEQ ID NO: 155679 - RNA, 64 nt, hsa
augguauccuucuuggccaacagaugguaucuuuccuggccaugacagugugauucccccagag

SEQ ID NO: 155680 - RNA, 64 nt, hsa
aguggccguagcaucaccccaucagaaaggggaaccuggccagccagcuuccugcuaugcuggg

SEQ ID NO: 155681 - RNA, 64 nt, hsa
ccaacauuuaagaaaccccaauagacaccucugcccuggccacguucacagauccuucucuuga

SEQ ID NO: 155682 - RNA, 64 nt, hsa
ggcagaucaccugagguuaggaguucaagaccagccuggccaacauggugaaaccccaucucua

SEQ ID NO: 155683 - RNA, 64 nt, hsa
ucaugaaaauagcucuuucagggggguugugaggccuggccaggcacccccuggagagaaguuu

SEQ ID NO: 155684 - RNA, 64 nt, hsa
uggggggaucacaaggucacuagauggcgagcauccuggccaacauggugaaaccccgucucua

SEQ ID NO: 155685 - RNA, 64 nt, hsa
auauccccaggcacacucuggccucagguuuugcccuggccaugucaucuaccuggagugggcc

SEQ ID NO: 155686 - RNA, 64 nt, hsa
cccacuuccacucaggaaauugggcugcccccaaccuggccacugaaugucuccaggcagauau

SEQ ID NO: 155687 - RNA, 64 nt, hsa
caggcggaucacaagguccagagaucgagaccauccuggccaacauggugaaaccccgucucua

SEQ ID NO: 155688 - RNA, 64 nt, hsa
ggcggaucacuugaggccaggaguucaagaccagccuggccaacauggcaaaaucccaucucua

SEQ ID NO: 155689 - RNA, 64 nt, hsa
gugucuuuugaauauuuuuuauuaagccaccacuccuggccaacuguaguugaacucagguauu

SEQ ID NO: 155690 - RNA, 64 nt, hsa
ggcggaucacuugaggucaggaguucaaaaccagccuggccaagauggugaaaccccaucucua

SEQ ID NO: 155691 - RNA, 64 nt, hsa
uuucugcaauaagcucucagaccaucagcauccuccuggccagccacauaagccaaucggggau

SEQ ID NO: 155692 - RNA, 64 nt, hsa
uuucugcaauucacucucagaccaucagcauccuccuggccagcugcauaaauguauuuuucug

SEQ ID NO: 155693 - RNA, 64 nt, hsa
caaagugcugagauugcagaugugagccaccgugccuggccagauuuuucuuuuauucuucuuu

SEQ ID NO: 155694 - RNA, 64 nt, hsa
cgaaaaagaggcauacacacagcagugugaauagccuggccaccagccauccucccuccaccuc

SEQ ID NO: 155695 - RNA, 64 nt, hsa
ccugccuagucucacaugucccuguuccucuuccccuggccagggccccugcgcagacugucag

SEQ ID NO: 155696 - RNA, 64 nt, hsa
ucaacuaaucacgucucugcacccagggucccagccuggccaccagccucccuuucugccugac

SEQ ID NO: 155697 - RNA, 64 nt, hsa
ccugccuagucucacaugucccugucccucucgcccuggccagggccucugugcagacaguguc

SEQ ID NO: 155698 - RNA, 64 nt, hsa
uuaacuagucuugcaucugcacccagggucccagccuggccaccagcuucccucugccugaccc

SEQ ID NO: 155699 - RNA, 64 nt, hsa
caaaguguugggauuacaggcaugagccacugcgccuggccagcaaaugcuuuuugugcagaau

SEQ ID NO: 155700 - RNA, 64 nt, hsa
aggggcaagcagcauugcauucugggggaacgauccuggccacagccgccaaacaaacauucac

SEQ ID NO: 155701 - RNA, 64 nt, hsa
cagacuguugggauuacaggcaugagccaccacgccuggccaguuucuucauuuuacauauggu

SEQ ID NO: 155702 - RNA, 64 nt, hsa
aucauuccgagucaucaucucuguuugcugccuuccuggccagccagguggaagaaaguuucca

SEQ ID NO: 155703 - RNA, 64 nt, hsa
caguggagccaugccuggguuucagagcagagcuccuggccagagcguuugaccgacagacaau

SEQ ID NO: 155704 - RNA, 64 nt, hsa
cuccccaugcagagcgggagccugccuaccugggccuggccagcaggcagggcugccuucugcu

SEQ ID NO: 155705 - RNA, 64 nt, hsa
gaucucaucaucauccuuagucaagcagcagggcccuggccacguggagcaacacugacuagaa

SEQ ID NO: 155706 - RNA, 64 nt, hsa
uucuguucuucccucacuccauccccgcuaccguccuggccagcuaccgucagagagaaccaga

SEQ ID NO: 155707 - RNA, 64 nt, hsa
ggcaaaucaccugaggucaagaguuugagaccagccuggccaacauggugaaaccccaucucua

SEQ ID NO: 155708 - RNA, 64 nt, hsa
gguggauugcuugaggccaggaguucgagaccagccuggccaacguggugaaacgcugucucua

SEQ ID NO: 155709 - RNA, 64 nt, hsa
ccagcacuuugggaggccaggaguucgagaccagccuggccaacauggugaaacccggucucua

SEQ ID NO: 155710 - RNA, 64 nt, hsa
ggcggaucaccugaggucaggaguuugagaccagccuggccaacauggcaaaaccccgucucua

SEQ ID NO: 155711 - RNA, 64 nt, hsa
ucccugcugugagccgaagcucucccugccccgcccuggccaugugaucguguuggugacagac

SEQ ID NO: 155712 - RNA, 64 nt, hsa
cucuugucgccuuggcaggacuugacucugccucccuggccagccuugcaagaggacugggguc

SEQ ID NO: 155713 - RNA, 64 nt, hsa
gguggaaauggggaugucaguuugaaagcugagaccuggccaggugcgguggcucacuccugua

SEQ ID NO: 155714 - RNA, 64 nt, hsa
cacuucacagccaacggcuaugacaaaaccacucccuggccaauggcaucacucuucaggcugg

SEQ ID NO: 155715 - RNA, 64 nt, hsa
cuggaggcccagaaguugcugcccugucuaucuuccuggccacagggcuucauucccagaucuu

SEQ ID NO: 155716 - RNA, 64 nt, hsa
aaggcugcccugcccccgacucuccugccgcaccccuggccauuguaccuuuugauguuuagaa

SEQ ID NO: 155717 - RNA, 64 nt, hsa
ucuccugguugaaugagaugcaguggggggugcaccuggccagacucucccuccuguccuguac

SEQ ID NO: 155718 - RNA, 64 nt, hsa
agagagagccacuuacaaagucgaucuugagagaccuggccacaugcagcugggcugagugaug

SEQ ID NO: 155719 - RNA, 64 nt, hsa
ucaaccagggcuggccacccuggucuugaggguuccuggccaccuagccugcuccucugcucuc

SEQ ID NO: 155720 - RNA, 64 nt, hsa
gccucuuaggaguccucagagagccuucugugccccuggccagcugauaauccuagguucauga

SEQ ID NO: 155721 - RNA, 64 nt, hsa
uucuuaacauguugagagaugauucuuucuuggcccuggccaucucgggaagcuugauggcaau

SEQ ID NO: 155722 - RNA, 64 nt, hsa
guggccucuucaucagggguauugggguuagugaccuggccagagggugccaagaggggggcag

SEQ ID NO: 155723 - RNA, 64 nt, hsa
gccauccuucggggcucucucccucugucucccuccuggccauucugggcuuggguaucuccuu

SEQ ID NO: 155724 - RNA, 64 nt, hsa
ggcggaucacuugaggucaggagcucgagaccagccuggccaacacggugaaaccccaucucua

SEQ ID NO: 155725 - RNA, 64 nt, hsa
ggcggaucacuugaggucaggagcucaagaccagccuggccaacauggugaaaccccaucucua

SEQ ID NO: 155726 - RNA, 64 nt, hsa
gaaggaucaccugagaucaggaguuccagaccagccuggccaacauggcgaaaccccaucucua

SEQ ID NO: 155727 - RNA, 64 nt, hsa
ugggcggaucacaaggucaggaguucgagaccagccuggccaauauggugaaaccccaucucua

SEQ ID NO: 155728 - RNA, 64 nt, hsa
gggaauuccggccagcagcuuccuccuucagccaccuggccauaccccuuaaauaagccccuca

SEQ ID NO: 155729 - RNA, 64 nt, hsa
gauguuaccuugcuuguccacagcagccagucacccuggccagucccacuuccuggauaauucu

SEQ ID NO: 155730 - RNA, 58 nt, hsa
ccgagagguuccugaucuaggccccagaccuggccaggccagccucccugugcgugug

SEQ ID NO: 155731 - RNA, 64 nt, hsa
cugccucgcccccuacaggccucugggcccagcuccuggccaggcugcugccaaggucaagccc

SEQ ID NO: 155732 - RNA, 64 nt, hsa
cccagcauuguauuucccugugaccccuuacucuccuggccagaacuugagccagcugugggau

SEQ ID NO: 155733 - RNA, 64 nt, hsa
gguggaucaccugagguuaggaguucgagaucagccuggccaacauggugaaacccugucuacu

SEQ ID NO: 155734 - RNA, 64 nt, hsa
ugugugaaggugaggacucuuggaagcaggccauccuggccagacacccuagcaggaaggggcu

SEQ ID NO: 155735 - RNA, 64 nt, hsa
cucagccaguaccugccccaugggcucaaggauuccuggccagcuccugccaccuccagcagac

SEQ ID NO: 155736 - RNA, 64 nt, hsa
gguggaucacucaaggucaggcauuugagaccagccuggccaacauagugaaaccccgucucua

SEQ ID NO: 155737 - RNA, 64 nt, hsa
ggcagaucaccugaggcuaggaguugcagaccagccuggccaacauggcaaaaccccgucucua

SEQ ID NO: 155738 - RNA, 64 nt, hsa
cuagcugggaaagaagaguggagcagagacucugccuggccacugagaacagccaaauucacaa

SEQ ID NO: 155739 - RNA, 64 nt, hsa
ccgugucccaggaccguaccguccgcaucugggaccuggccacccugcagcaggugggguuugg

SEQ ID NO: 155740 - RNA, 64 nt, hsa
cccagcugcugcgaguugacaucggcacucuggaccuggccagcagccgccuggacucagccau

SEQ ID NO: 155741 - RNA, 64 nt, hsa
cgaagugcugggauuauaggcguaagccaccaugccuggccaaaaauuaaaagauuuuaugaaa

SEQ ID NO: 155742 - RNA, 64 nt, hsa
ugcugauuuccuaaaugcuacccuuugaucauuuccuggccaccaucacaauacuaaggggcuc

SEQ ID NO: 155743 - RNA, 64 nt, hsa
ggccucuguaccacccuguggguuuucuuggacaccuggccagugcugaagggcuguugugaug

SEQ ID NO: 155744 - RNA, 64 nt, hsa
gugacugacuggugucuucccauuuggacuguggccuggccagagccccuugcauauccccacu

SEQ ID NO: 155745 - RNA, 64 nt, hsa
gacucagugaccacgucaugacagaacagcacauccuggccagcaccccuggcuggaguggguu

SEQ ID NO: 155746 - RNA, 64 nt, hsa
aaguuccugauagcacuugugccucagccccucaccuggccaccugccagggcaccugcaaccc

SEQ ID NO: 155747 - RNA, 64 nt, hsa
ucucaaaccaaucaaucaaucaaucaaucacuguccuggccaguugcaguggcucacgccuaua

SEQ ID NO: 155748 - RNA, 64 nt, hsa
agucucgcuauguugcccaggcuggucucgaacuccuggccacaagugugccucccgccuuggc

SEQ ID NO: 155749 - RNA, 64 nt, hsa
acuuaagcagggagcugggcuagcagaggccggcccuggccaucgggagagcucugaccugcac

SEQ ID NO: 155750 - RNA, 64 nt, hsa
cuuccuccuacuucugcuguagccugggaccagaccuggccaaggucagccagcggggagggcc

SEQ ID NO: 155751 - RNA, 64 nt, hsa
gcccagcccuaugcucugugcuuggcccugggccccuggccauccacaaacagcagaggccuuc

SEQ ID NO: 155752 - RNA, 64 nt, hsa
cacaucacaaggcgaacacaaauggacacacauaccuggccacgaacccacaccuccucagaca

SEQ ID NO: 155753 - RNA, 64 nt, hsa
agcccuucaguggcuucuucaggccuaggauaacccuggccaggccccaugguccugcucuggg

SEQ ID NO: 155754 - RNA, 63 nt, hsa
cgaaguuugucucagcguagggcaggaggcccuccuggccaggccagcagugaagcaguaugg

SEQ ID NO: 155755 - RNA, 64 nt, hsa
ccggcagagagugguugccuuuccauuugcccucccuggccaugccuucuugccuuuggaaaaa

SEQ ID NO: 155756 - RNA, 64 nt, hsa
ccuagggaugcucuaaagcugggcucaagcaagcccuggccagagguccuaaagaugcugacug

SEQ ID NO: 155757 - RNA, 64 nt, hsa
gccucugccuuguccugaugcugugcucaaucagccuggccaucuggauuuucacacaguaaag

SEQ ID NO: 155758 - RNA, 64 nt, hsa
uucgccucugcuggaacaagcaggacccuaacuaccuggccaccauggccauggauggaaugga

SEQ ID NO: 155759 - RNA, 64 nt, hsa
gcacccacuguuaccagaagcugcucuaggaguuccuggccagucaccccaucgcccucugugg

SEQ ID NO: 155760 - RNA, 64 nt, hsa
ggccagaccccagagcccuugugccaucuuucuuccuggccagagugaugggguuccagccaug

SEQ ID NO: 155761 - RNA, 64 nt, hsa
cugugccaacccuguacagaaucgagugcuguagccuggccagaccccagagcccuugugccau

SEQ ID NO: 155762 - RNA, 64 nt, hsa
aguucucugugcaucuguccauccucccuauggcccuggccagagcucagcaugggcagggguu

SEQ ID NO: 155763 - RNA, 64 nt, hsa
ggcggaucaccugaagucagaaguuugagaccagccuggccaacauaauuaaaaugucucuacu

SEQ ID NO: 155764 - RNA, 64 nt, hsa
accuggagauagccagauagccagaugcccugcuccuggccaccuuuaaagccccugcauauga

SEQ ID NO: 155765 - RNA, 64 nt, hsa
ggccgaucacuugaggucaggaguucaagaccagccuggccaacauggugaaaccccaucucua

SEQ ID NO: 155766 - RNA, 64 nt, hsa
gguggaucacuugaggccaggaguucaagaccagccuggccaacaugaugagaccuccgucucu

SEQ ID NO: 155767 - RNA, 64 nt, hsa
cucagcaucacacugacacucacccugcccugccccuggccagaggguacugccgacggcacuu

SEQ ID NO: 155768 - RNA, 64 nt, hsa
uaagggggcccucuaaaccccuugccuggccucaccuggccagcucaccccuuuuggguguagg

SEQ ID NO: 155769 - RNA, 64 nt, hsa
gggguacuccagagaccucacguguggagccaggccuggccagggcaggggccugaaacccacu

SEQ ID NO: 155770 - RNA, 64 nt, hsa
ccuuuuaaggaaagaagccguguuucgaugaagaccuggccacauggggccacugggacuucaa

SEQ ID NO: 155771 - RNA, 64 nt, hsa
cacccaccccaccugggcccagccaggagccccgccuggccaucaguauuuauugccuccgucc

SEQ ID NO: 155772 - RNA, 64 nt, hsa
gggugugcugcugcugcuccccagcccaccagugccuggccagccugcccccuucccuggacag

SEQ ID NO: 155773 - RNA, 64 nt, hsa
gugggggccgggccguccuccagccccgcugcucccuggccagcccccuugucgcugucggucc

SEQ ID NO: 155774 - RNA, 64 nt, hsa
uguggguccccugucaggccacagugugaccagcccuggccaugcuugcugggugacccugggu

SEQ ID NO: 155775 - RNA, 64 nt, hsa
ugucagugucuguuggcuggggcagcccucagagccuggccacguggaccuccccagcaugauc

SEQ ID NO: 155776 - RNA, 64 nt, hsa
cugagguggguggaucacuggaguuugagaccacccuggccaacauggugaaaccccaucucua

SEQ ID NO: 155777 - RNA, 64 nt, hsa
ugggcggaucacgaggucaggaguucgagaccagccuggccaacauagugaaaccccaucucua

SEQ ID NO: 155778 - RNA, 64 nt, hsa
uccuggcagaacaguacuuuggaguucccuggagccuggccagcccucaccucuucuggauaga

SEQ ID NO: 155779 - RNA, 64 nt, hsa
gaccacuggucuagagcccugugguccccuggagccuggccacgcccuugaagcccuggacacu

SEQ ID NO: 155780 - RNA, 64 nt, hsa
ggggugcacugacggagaugcggacuccugggucccuggccaagaagccaggagagggacggcu

SEQ ID NO: 155781 - RNA, 64 nt, hsa
acucggggggcaggccccucccaccuccugacacccuggccagcgcgggggacuuucucugcac

SEQ ID NO: 155782 - RNA, 64 nt, hsa
caaaguguugggauuacaggugugagccacagcaccuggccaaccaacacuucucagggccucu

SEQ ID NO: 155783 - RNA, 64 nt, hsa
ugaguagcugggacuacaggcaugagccaccaugccuggccaacucacauuuuucuuucuauua

SEQ ID NO: 155784 - RNA, 64 nt, hsa
aguucugugcacacccugagcucugcuccucuggccuggccaccaguccuugucugagugcccc

SEQ ID NO: 155785 - RNA, 64 nt, hsa
caaagcguugggauuauaggcgugagccaccgcaccuggccagggaaccuucuuuauaccaagu

SEQ ID NO: 155786 - RNA, 64 nt, hsa
ugucccuuucauccugggccugugugaaucccagccuggccauacccucaaccucagugggcug

SEQ ID NO: 155787 - RNA, 53 nt, hsa
agggaaccuggaggcucugaucaccuggccaacccacugggguagggaucaaa

SEQ ID NO: 155788 - RNA, 64 nt, hsa
caaugcucuuguguugucccucugucuggacgcgccuggccacuccgaaggcuuuucaccccau

SEQ ID NO: 155789 - RNA, 64 nt, hsa
ggacagaucguagugccuuauuccauuguccuccccuggccaggccuccuggcucagcuggaag

SEQ ID NO: 155790 - RNA, 64 nt, hsa
cccccaauguggcccucaagagccauccccacugccuggccagagccauuguuguccccuacuu

SEQ ID NO: 155791 - RNA, 64 nt, hsa
ggcagaucacuugaggugaggaguucaagaccagccuggccaacauggugaauuaucucuacua

SEQ ID NO: 155792 - RNA, 64 nt, hsa
agaggggcucuccugaguggaagccacucacaugccuggccacaugcugcccccucccccgugg

SEQ ID NO: 155793 - RNA, 64 nt, hsa
ugaggcauuaagcccagggguucacuuucaggccccuggccaaucugaguuuccugauucugcc

SEQ ID NO: 155794 - RNA, 64 nt, hsa
agccugggcagccaggcugccaaggccagaguggccuggccaggagcucuucaggccucccucu

SEQ ID NO: 155795 - RNA, 64 nt, hsa
ggugggguagggcugacuagaagggccaguccugccuggccaggcagaucugugccccaugccu

SEQ ID NO: 155796 - RNA, 64 nt, hsa
ggcacaucaccugaguucaggaguucaagaccagccuggccaacauggugaaaucccgucucua

SEQ ID NO: 155797 - RNA, 64 nt, hsa
cuccugccccagccgacugcuguucccagacuucccuggccacgcuccaagacgccagcucugc

SEQ ID NO: 155798 - RNA, 64 nt, hsa
gaggagguaguaccuuugaagaugcuguugaccaccuggccacagccagucaggggccuggugg

SEQ ID NO: 155799 - RNA, 64 nt, hsa
uuggccgggggaacccauucaugcuguuccucugccuggccauccugcuggagcaccgcgacca

SEQ ID NO: 155800 - RNA, 64 nt, hsa
gguggaucaccugaggucaggaguucgagaccagccuggccaacauggcaaaacccccaucucu

SEQ ID NO: 155801 - RNA, 64 nt, hsa
uggagcaaucacuguauaauuuuaaaauaguuuaccuggccaggcaugguggcucacgccugua

SEQ ID NO: 155802 - RNA, 64 nt, hsa
ggcagaucacuugaggucaggaguucaagaccagccuggccaacauggugaaaccccaucucua

SEQ ID NO: 155803 - RNA, 64 nt, hsa
gcagaucacuugagguuaggaguuugagaacuggccuggccaacauagcaaaaccucaucucua

SEQ ID NO: 155804 - RNA, 64 nt, hsa
caggcagaucacgaggucaggaguucgagaccauccuggccaacauggugaaaccccgucucua

SEQ ID NO: 155805 - RNA, 64 nt, hsa
uaagagaaaaauaggcucaguuagaaaaggacucccuggccaggcgcagugacuuacgccugua

SEQ ID NO: 155806 - RNA, 64 nt, hsa
gguggauugcuugaggccaggaguuagagaccagccuggccaacaaggcaaaaccccgucucua

SEQ ID NO: 155807 - RNA, 64 nt, hsa
guggcucacgcugaggucaggaguucgagaccagccuggccaaccaacauggugaaaccucgug

SEQ ID NO: 155808 - RNA, 64 nt, hsa
ggcagaucagcugaggucaggagaucgagaccagccuggccaacauggcgaaaccccgucucua

SEQ ID NO: 155809 - RNA, 64 nt, hsa
ugaauagaggcagagcuauuuuauauuaucaaaugagagcuacucuguuacauuucuuaacaua

SEQ ID NO: 155810 - RNA, 64 nt, hsa
caaucuggaggcuucuguuucugcauucugccacgagagcuagguccuugaucuuuucuuuaga

SEQ ID NO: 155811 - RNA, 64 nt, hsa
uucacuugauaaaugaauauuuauuagcugguuggagagcuagaaccuggagagcuagaaccug

SEQ ID NO: 155812 - RNA, 64 nt, hsa
aauauuuauuagcugguuggagagcuagaaccuggagagcuagaaccuggagaacuagaaccug

SEQ ID NO: 155813 - RNA, 64 nt, hsa
gcuggaggacuagaaccuggagggcuggaaucuggagagcuagaaccuggagggcuagaaccug

SEQ ID NO: 155814 - RNA, 64 nt, hsa
ccuggagggcuagaaccuggagggcuagaaucuggagagcuagaaccuggagggcuagaaucug

SEQ ID NO: 155815 - RNA, 64 nt, hsa
ucuggagagcuagaaccuggagggcuagaaucuggagagcuagaaccuggagggcuagaaccug

SEQ ID NO: 155816 - RNA, 64 nt, hsa
ucuggagagcuagaaccuggagggcuagaaccuggagagcuagaaccuagaagggcuagaaccu

SEQ ID NO: 155817 - RNA, 64 nt, hsa
cuagaagggcuagaaccuggagggcuggaaucuggagagcuagaaccuggagggcuagaaccug

SEQ ID NO: 155818 - RNA, 64 nt, hsa; identical to SEQ ID NO: 155817

SEQ ID NO: 155819 - RNA, 64 nt, hsa
cuggaagggcuagaaccuguagagcuagaacauggagagcuagaacccggcaggcuagaaccug

SEQ ID NO: 155820 - RNA, 64 nt, hsa
aucuugguacauccagacaggaugaggguggagggagagcuauuuaacacaaauccuaagauuu

SEQ ID NO: 155821 - RNA, 64 nt, hsa
aggacauuucacacaguccuuagaacccccaggagagagcuacugacuuguuaucaucuccauu

SEQ ID NO: 155822 - RNA, 64 nt, hsa; identical to SEQ ID NO: 91262

SEQ ID NO: 155823 - RNA, 64 nt, hsa; identical to SEQ ID NO: 91263

SEQ ID NO: 155824 - RNA, 64 nt, hsa; identical to SEQ ID NO: 91264

SEQ ID NO: 155825 - RNA, 64 nt, hsa; identical to SEQ ID NO: 91265

SEQ ID NO: 155826 - RNA, 64 nt, hsa; identical to SEQ ID NO: 91266

SEQ ID NO: 155827 - RNA, 64 nt, hsa; identical to SEQ ID NO: 91267

SEQ ID NO: 155828 - RNA, 64 nt, hsa; identical to SEQ ID NO: 91268

SEQ ID NO: 155829 - RNA, 64 nt, hsa; identical to SEQ ID NO: 91269

SEQ ID NO: 155830 - RNA, 64 nt, hsa; identical to SEQ ID NO: 91270

SEQ ID NO: 155831 - RNA, 64 nt, hsa; identical to SEQ ID NO: 91271

SEQ ID NO: 155832 - RNA, 64 nt, hsa; identical to SEQ ID NO: 91272

SEQ ID NO: 155833 - RNA, 64 nt, hsa; identical to SEQ ID NO: 91273

SEQ ID NO: 155834 - RNA, 64 nt, hsa; identical to SEQ ID NO: 91274

SEQ ID NO: 155835 - RNA, 64 nt, hsa; identical to SEQ ID NO: 91275

SEQ ID NO: 155836 - RNA, 64 nt, hsa; identical to SEQ ID NO: 91276

SEQ ID NO: 155837 - RNA, 64 nt, hsa; identical to SEQ ID NO: 91277

SEQ ID NO: 155838 - RNA, 64 nt, hsa; identical to SEQ ID NO: 91278

SEQ ID NO: 155839 - RNA, 64 nt, hsa; identical to SEQ ID NO: 91279

SEQ ID NO: 155840 - RNA, 64 nt, hsa; identical to SEQ ID NO: 91280

SEQ ID NO: 155841 - RNA, 64 nt, hsa; identical to SEQ ID NO: 91281

SEQ ID NO: 155842 - RNA, 64 nt, hsa; identical to SEQ ID NO: 91282

SEQ ID NO: 155843 - RNA, 64 nt, hsa; identical to SEQ ID NO: 91283

SEQ ID NO: 155844 - RNA, 64 nt, hsa; identical to SEQ ID NO: 91284

SEQ ID NO: 155845 - RNA, 64 nt, hsa; identical to SEQ ID NO: 91285

SEQ ID NO: 155846 - RNA, 64 nt, hsa; identical to SEQ ID NO: 91286

SEQ ID NO: 155847 - RNA, 64 nt, hsa; identical to SEQ ID NO: 91287

SEQ ID NO: 155848 - RNA, 64 nt, hsa; identical to SEQ ID NO: 91288

SEQ ID NO: 155849 - RNA, 64 nt, hsa; identical to SEQ ID NO: 91289

SEQ ID NO: 155850 - RNA, 64 nt, hsa; identical to SEQ ID NO: 91290

SEQ ID NO: 155851 - RNA, 64 nt, hsa; identical to SEQ ID NO: 91291

SEQ ID NO: 155852 - RNA, 64 nt, hsa; identical to SEQ ID NO: 91292

SEQ ID NO: 155853 - RNA, 64 nt, hsa; identical to SEQ ID NO: 91293

SEQ ID NO: 155854 - RNA, 64 nt, hsa; identical to SEQ ID NO: 91294

SEQ ID NO: 155855 - RNA, 64 nt, hsa; identical to SEQ ID NO: 91295

SEQ ID NO: 155856 - RNA, 64 nt, hsa; identical to SEQ ID NO: 91296

SEQ ID NO: 155857 - RNA, 64 nt, hsa; identical to SEQ ID NO: 91297

SEQ ID NO: 155858 - RNA, 64 nt, hsa; identical to SEQ ID NO: 91298

SEQ ID NO: 155859 - RNA, 64 nt, hsa; identical to SEQ ID NO: 91299

SEQ ID NO: 155860 - RNA, 64 nt, hsa; identical to SEQ ID NO: 91300

SEQ ID NO: 155861 - RNA, 64 nt, hsa; identical to SEQ ID NO: 91301

SEQ ID NO: 155862 - RNA, 64 nt, hsa; identical to SEQ ID NO: 91302

SEQ ID NO: 155863 - RNA, 64 nt, hsa; identical to SEQ ID NO: 91303

SEQ ID NO: 155864 - RNA, 64 nt, hsa; identical to SEQ ID NO: 91304

SEQ ID NO: 155865 - RNA, 64 nt, hsa; identical to SEQ ID NO: 91305

SEQ ID NO: 155866 - RNA, 64 nt, hsa; identical to SEQ ID NO: 91306

SEQ ID NO: 155867 - RNA, 64 nt, hsa; identical to SEQ ID NO: 91307

SEQ ID NO: 155868 - RNA, 64 nt, hsa; identical to SEQ ID NO: 91308

SEQ ID NO: 155869 - RNA, 64 nt, hsa; identical to SEQ ID NO: 91309

SEQ ID NO: 155870 - RNA, 64 nt, hsa; identical to SEQ ID NO: 91310

SEQ ID NO: 155871 - RNA, 64 nt, hsa; identical to SEQ ID NO: 91311

SEQ ID NO: 155872 - RNA, 64 nt, hsa; identical to SEQ ID NO: 91312

SEQ ID NO: 155873 - RNA, 64 nt, hsa; identical to SEQ ID NO: 91313

SEQ ID NO: 155874 - RNA, 64 nt, hsa; identical to SEQ ID NO: 91314

SEQ ID NO: 155875 - RNA, 64 nt, hsa; identical to SEQ ID NO: 91315

SEQ ID NO: 155876 - RNA, 64 nt, hsa; identical to SEQ ID NO: 91316

SEQ ID NO: 155877 - RNA, 64 nt, hsa; identical to SEQ ID NO: 91317

SEQ ID NO: 155878 - RNA, 64 nt, hsa; identical to SEQ ID NO: 91318

SEQ ID NO: 155879 - RNA, 64 nt, hsa; identical to SEQ ID NO: 91319

SEQ ID NO: 155880 - RNA, 64 nt, hsa; identical to SEQ ID NO: 91320

SEQ ID NO: 155881 - RNA, 64 nt, hsa; identical to SEQ ID NO: 91321

SEQ ID NO: 155882 - RNA, 64 nt, hsa; identical to SEQ ID NO: 91322

SEQ ID NO: 155883 - RNA, 64 nt, hsa; identical to SEQ ID NO: 91323

SEQ ID NO: 155884 - RNA, 64 nt, hsa; identical to SEQ ID NO: 91324

SEQ ID NO: 155885 - RNA, 64 nt, hsa; identical to SEQ ID NO: 91325

SEQ ID NO: 155886 - RNA, 64 nt, hsa; identical to SEQ ID NO: 91326

SEQ ID NO: 155887 - RNA, 64 nt, hsa; identical to SEQ ID NO: 91327

SEQ ID NO: 155888 - RNA, 64 nt, hsa; identical to SEQ ID NO: 91328

SEQ ID NO: 155889 - RNA, 64 nt, hsa; identical to SEQ ID NO: 91329

SEQ ID NO: 155890 - RNA, 64 nt, hsa; identical to SEQ ID NO: 91330

SEQ ID NO: 155891 - RNA, 64 nt, hsa; identical to SEQ ID NO: 91331

SEQ ID NO: 155892 - RNA, 64 nt, hsa; identical to SEQ ID NO: 91332

SEQ ID NO: 155893 - RNA, 64 nt, hsa; identical to SEQ ID NO: 91333

SEQ ID NO: 155894 - RNA, 64 nt, hsa; identical to SEQ ID NO: 91334

SEQ ID NO: 155895 - RNA, 64 nt, hsa; identical to SEQ ID NO: 91335

SEQ ID NO: 155896 - RNA, 64 nt, hsa; identical to SEQ ID NO: 91336

SEQ ID NO: 155897 - RNA, 64 nt, hsa; identical to SEQ ID NO: 91337

SEQ ID NO: 155898 - RNA, 64 nt, hsa; identical to SEQ ID NO: 91338

SEQ ID NO: 155899 - RNA, 64 nt, hsa; identical to SEQ ID NO: 91339

SEQ ID NO: 155900 - RNA, 64 nt, hsa; identical to SEQ ID NO: 91340

SEQ ID NO: 155901 - RNA, 64 nt, hsa; identical to SEQ ID NO: 91341

SEQ ID NO: 155902 - RNA, 64 nt, hsa; identical to SEQ ID NO: 91342

SEQ ID NO: 155903 - RNA, 64 nt, hsa; identical to SEQ ID NO: 91343

SEQ ID NO: 155904 - RNA, 64 nt, hsa; identical to SEQ ID NO: 91344

SEQ ID NO: 155905 - RNA, 64 nt, hsa; identical to SEQ ID NO: 91345

SEQ ID NO: 155906 - RNA, 64 nt, hsa; identical to SEQ ID NO: 91346

SEQ ID NO: 155907 - RNA, 64 nt, hsa; identical to SEQ ID NO: 91347

SEQ ID NO: 155908 - RNA, 64 nt, hsa; identical to SEQ ID NO: 91348

SEQ ID NO: 155909 - RNA, 64 nt, hsa; identical to SEQ ID NO: 91349

SEQ ID NO: 155910 - RNA, 64 nt, hsa; identical to SEQ ID NO: 91350

SEQ ID NO: 155911 - RNA, 64 nt, hsa; identical to SEQ ID NO: 91351

SEQ ID NO: 155912 - RNA, 64 nt, hsa; identical to SEQ ID NO: 91352

SEQ ID NO: 155913 - RNA, 64 nt, hsa; identical to SEQ ID NO: 91353

SEQ ID NO: 155914 - RNA, 54 nt, hsa; identical to SEQ ID NO: 91354

SEQ ID NO: 155915 - RNA, 64 nt, hsa; identical to SEQ ID NO: 91355

SEQ ID NO: 155916 - RNA, 64 nt, hsa; identical to SEQ ID NO: 91356

SEQ ID NO: 155917 - RNA, 64 nt, hsa; identical to SEQ ID NO: 91357

SEQ ID NO: 155918 - RNA, 64 nt, hsa; identical to SEQ ID NO: 91358

SEQ ID NO: 155919 - RNA, 64 nt, hsa; identical to SEQ ID NO: 91359

SEQ ID NO: 155920 - RNA, 64 nt, hsa; identical to SEQ ID NO: 91360

SEQ ID NO: 155921 - RNA, 64 nt, hsa; identical to SEQ ID NO: 91361

SEQ ID NO: 155922 - RNA, 64 nt, hsa; identical to SEQ ID NO: 91362

SEQ ID NO: 155923 - RNA, 64 nt, hsa; identical to SEQ ID NO: 91363

SEQ ID NO: 155924 - RNA, 64 nt, hsa; identical to SEQ ID NO: 91364

SEQ ID NO: 155925 - RNA, 64 nt, hsa; identical to SEQ ID NO: 91365

SEQ ID NO: 155926 - RNA, 64 nt, hsa; identical to SEQ ID NO: 91366

SEQ ID NO: 155927 - RNA, 64 nt, hsa; identical to SEQ ID NO: 91367

SEQ ID NO: 155928 - RNA, 64 nt, hsa; identical to SEQ ID NO: 91368

SEQ ID NO: 155929 - RNA, 64 nt, hsa; identical to SEQ ID NO: 91369

SEQ ID NO: 155930 - RNA, 64 nt, hsa; identical to SEQ ID NO: 91370

SEQ ID NO: 155931 - RNA, 64 nt, hsa; identical to SEQ ID NO: 91371

SEQ ID NO: 155932 - RNA, 64 nt, hsa; identical to SEQ ID NO: 91372

SEQ ID NO: 155933 - RNA, 64 nt, hsa; identical to SEQ ID NO: 91373

SEQ ID NO: 155934 - RNA, 64 nt, hsa; identical to SEQ ID NO: 91374

SEQ ID NO: 155935 - RNA, 64 nt, hsa; identical to SEQ ID NO: 91375

SEQ ID NO: 155936 - RNA, 64 nt, hsa; identical to SEQ ID NO: 91376

SEQ ID NO: 155937 - RNA, 64 nt, hsa; identical to SEQ ID NO: 91377

SEQ ID NO: 155938 - RNA, 64 nt, hsa; identical to SEQ ID NO: 91378

SEQ ID NO: 155939 - RNA, 64 nt, hsa; identical to SEQ ID NO: 91379

SEQ ID NO: 155940 - RNA, 64 nt, hsa; identical to SEQ ID NO: 91380

SEQ ID NO: 155941 - RNA, 64 nt, hsa
uaaaauuacagaaaauauuuaaaugcaacuuauugcuauagaagcaaagaggacuaaagggcaa

SEQ ID NO: 155942 - RNA, 64 nt, hsa
aaccuaaaaaaaaaacaacaaaaaaacccauaaagcuauagaccaaagucucauagauuuagau

SEQ ID NO: 155943 - RNA, 64 nt, hsa
acugaacuugaacuuccauugugauaugaaaacagcuauagacaaucauaaaugaaugaucaug

SEQ ID NO: 155944 - RNA, 64 nt, hsa
agcaacucaauucuaccacugugguaugaaaacagcuauagacaaucauaaaugaaugaucaug

SEQ ID NO: 155945 - RNA, 64 nt, hsa
uaucuuggucacucugaagcacaauauuuaugaagcuauagaacguuaagaccucuuucacagc

SEQ ID NO: 155946 - RNA, 64 nt, hsa
gcugaagcaggaggaucacuugaggccaggaguuugagaccagccugggcaacauagugagauc

SEQ ID NO: 155947 - RNA, 64 nt, hsa
gcccaggugggcggaucaccugagguuagaaguuugagaccagccuggccaacauggugaaacc

SEQ ID NO: 155948 - RNA, 64 nt, hsa
ugguaugaaaacuuauuaggaaccuuuuuguuuuugagaccauugcauucuggcugguuugugc

SEQ ID NO: 155949 - RNA, 64 nt, hsa
ugguuuaacgacaucuaagaagguuuagaaauggugagaccaaaacaauaacuguuaaugaugg

SEQ ID NO: 155950 - RNA, 64 nt, hsa
agggcucaaaacuccuggacaaguugcuggcuccugagaccaguauuuccuggagcugugccuc

SEQ ID NO: 155951 - RNA, 64 nt, hsa
acugggauuaaucucuaaucaggugaguagaccaugagaccaaugugugcucacauuacccuuu

SEQ ID NO: 155952 - RNA, 64 nt, hsa
accaaggcgggcagaucacuugaggucagaaguuugagaccagccaggccaacauggugaaacu

SEQ ID NO: 155953 - RNA, 64 nt, hsa
gccaagagaggaagauugcuugagcccaggaguuugagaccaaucuaggcaauguagugagacc

SEQ ID NO: 155954 - RNA, 64 nt, hsa
gcccaggaguuugagaccagcuaaggcaauauagugagaccaugucucuacagaaaaaauuuaa

SEQ ID NO: 155955 - RNA, 64 nt, hsa
gcugagucgggaggauagcgugagcccaggaguuugagaccagcuaaggcaauauagugagacc

SEQ ID NO: 155956 - RNA, 64 nt, hsa
caucagucauucacugaucagcagcuaaaguccaugagaccaaaugguuuuauauggaaccaac

SEQ ID NO: 155957 - RNA, 64 nt, hsa
ccgaggugagcggaucaccugaggucaggaguuuugagaccagccuggccaacaugguaaaauc

SEQ ID NO: 155958 - RNA, 64 nt, hsa
uagucuguuuucacgcugcugauaaagacauaccugagaccaggaagaaaaagagguuuaauug

SEQ ID NO: 155959 - RNA, 64 nt, hsa
uacuccaguucccaaaaaguuuuucaucuccaucugagaccaccucagccugaauuuuauuguc

SEQ ID NO: 155960 - RNA, 64 nt, hsa
gcagagagguggguggcgggcaccucaugccagcugagaccaagagugguuguauacauuucug

SEQ ID NO: 155961 - RNA, 64 nt, hsa
ugagagaaggagcaagaggcagaaacacugacucugagaccaugaccuuggaagauccucagag

SEQ ID NO: 155962 - RNA, 64 nt, hsa
gccaaagcugauggaucgcuugagcccaggaguuugagaccagccugggcaacauggcaaaacc

SEQ ID NO: 155963 - RNA, 64 nt, hsa
gccgagauagguggaucaccugaagucagguguuugagaccagccuggccaacaugguggaacc

SEQ ID NO: 155964 - RNA, 64 nt, hsa
uugggaggccacggaucacuugaggacagggguuugagaccagcuuggccaacauggugaaacc

SEQ ID NO: 155965 - RNA, 64 nt, hsa
cggugcuaagagcugugggaaacaugaagagcaaugagaccaggucccugcucugaggagacgu

SEQ ID NO: 155966 - RNA, 64 nt, hsa
gccagggugggaggaucacuugagcucaggaguuugagaccagccuagacaacauacuacgacc

SEQ ID NO: 155967 - RNA, 64 nt, hsa
uacucgggaggcugagugaggcaggaggaucacuugagaccaggagguuguggcuguagugagu

SEQ ID NO: 155968 - RNA, 64 nt, hsa
ucuccgacacaggcugguggaccaccuaccccacugagaccaccucucagggugccugcccugg

SEQ ID NO: 155969 - RNA, 64 nt, hsa
cagagcuuugggaggccaaggugggaggaucgcuugagaccaggaguucgagaccagccugggc

SEQ ID NO: 155970 - RNA, 64 nt, hsa
ugagaccacgcccggccccacucacucuauccugugagaccacgccuggccccacucccaccau

SEQ ID NO: 155971 - RNA, 64 nt, hsa
uaagacugugcccggccccauucacuccauccugugagaccacgcccggccccacucacucuau

SEQ ID NO: 155972 - RNA, 64 nt, hsa
gagccccgcacccggccccucucacaccauccugugagaccacgcccggccccacucccaccau

SEQ ID NO: 155973 - RNA, 64 nt, hsa
gccaaggcgggcggaucaccugaggucgggaguuugagaccagcccgaccaacauggagaaacc

SEQ ID NO: 155974 - RNA, 64 nt, hsa
gcugaggugggaggauuacuugaaacccacaguuugagaccagccugggcaacauagugagacc

SEQ ID NO: 155975 - RNA, 64 nt, hsa
gcugaggugggaggguugcuugagcccagggguuugagaccagcuugggcaacaacaacaaaaa

SEQ ID NO: 155976 - RNA, 64 nt, hsa
gcugaggcaggcggaucaccugaagucagaaguuugagaccagccuggccaacauaauuaaaau

SEQ ID NO: 155977 - RNA, 64 nt, hsa
cuaguguuuauuacagcuugugaggccaggaguuugagaccauccuaggcaacauaaugagaca

SEQ ID NO: 155978 - RNA, 64 nt, hsa
guacccgauucaaagaaggacucugcucccugucugagaccacccccggcucugacugagagua

SEQ ID NO: 155979 - RNA, 64 nt, hsa
ggugcaguggcucacgccuguaauccuagcacuuugagaccacuaaggcagguggaucaccuga

SEQ ID NO: 155980 - RNA, 64 nt, hsa
uguugcaagauguaauuuuucuuuuccuuuuuuuugagaccaagucucacucugucacccacgc

SEQ ID NO: 155981 - RNA, 64 nt, hsa
gcugagguggguggaucaccugaagucagaaguuugagaccagccuggcaaacauggcaaaacu

SEQ ID NO: 155982 - RNA, 64 nt, hsa
aggccaagguggguggaucacgaggucaggagauugagaccauccuggcuaauauggugaaacc

SEQ ID NO: 155983 - RNA, 64 nt, hsa
gccauggcagguggaucaccugaggucgggauuuugagaccagccugaccaacacugagaaacc

SEQ ID NO: 155984 - RNA, 64 nt, hsa
gacaagguggguggaucacuugaggccaggaguuugagaccaaccugguuaacauggugaaacc

SEQ ID NO: 155985 - RNA, 64 nt, hsa
aaaacugaaacaagaagaaacaucaaauuugcgaugagaccagaugcuguggcucaggccugua

SEQ ID NO: 155986 - RNA, 64 nt, hsa
gccaagacagguaggucacuugaggucaugaauuugagaccagccuggccaacagacgggagcc

SEQ ID NO: 155987 - RNA, 64 nt, hsa
ccuggguugggaggauugcuuaaggccaggaguuugagaccagcuugggcaacauagugaaacc

SEQ ID NO: 155988 - RNA, 64 nt, hsa
gccaaggcaggcagaucaccugaggucaggaguuugagaccagccuggccaacaugaugaaacc

SEQ ID NO: 155989 - RNA, 61 nt, hsa
agacuggagugagauuuggguguggagggggaggcgccaagguggaggagcuucccacucc

SEQ ID NO: 155990 - RNA, 61 nt, hsa
cgugcccucuggaguccccuaccaugacugaaggcgccagagacuggcggugucuuaagac

SEQ ID NO: 155991 - RNA, 61 nt, hsa
cugcgugggaugcacacggaugacagaaucaaggcgccaggaugggcacucugcccuggau

SEQ ID NO: 155992 - RNA, 61 nt, hsa
cgcaggagugaggcccaggcgccgagacccaaggcgccacugagggcaccgcgcaccagag

SEQ ID NO: 155993 - RNA, 61 nt, hsa
ccuaaaacuucugcagggaagccccuggcggaggcgccauugaaagcauggucuugccagu

SEQ ID NO: 155994 - RNA, 54 nt, hsa
cccugaaugaugugagcugagcccaggcgccaccacugaugccacccaggaccu

SEQ ID NO: 155995 - RNA, 61 nt, hsa
ccugcagacugggcucagcccgacauccaacaggcgccaaacucacagagcccuugugcag

SEQ ID NO: 155996 - RNA, 61 nt, hsa
uggaaugggucucucuugccccaccuggcugaggcgccacccuucuucaggcccaggcucc

SEQ ID NO: 155997 - RNA, 55 nt, hsa
ucagcaucuauuaccacugaugcacaggcgccaggccaagggggaaaugcucuuu

SEQ ID NO: 155998 - RNA, 61 nt, hsa
agauuucucugguugucaguuucccuggagaaggcgccagauaggaaucuccaaucaguug

SEQ ID NO: 155999 - RNA, 61 nt, hsa
agaacaggcuguccuuggcggcaguaggagcaggcgccagguuuccuggagcucuuggcuu

SEQ ID NO: 156000 - RNA, 61 nt, hsa
ccucuccucucccacgcggcuggcccuacccaggcgccaccuucggucucagucuggcaag

SEQ ID NO: 156001 - RNA, 61 nt, hsa
uuggugaagaaaagaaugaaugauucuuuguaggcgccaucagccacuuuuagaagccauc

SEQ ID NO: 156002 - RNA, 61 nt, hsa
caagacucaccucauccuuaccgcacauuuaaggcgccauugcuuuugggagacuggaaaa

SEQ ID NO: 156003 - RNA, 61 nt, hsa
cauccagcagguuggguucuagggcugaaccaggcgccaggcuccagaggacgaagggacu

SEQ ID NO: 156004 - RNA, 61 nt, hsa
ggaggaggagagcgcgagugagcaggggccaaggcgccagaugcagacccaggacuccgga

SEQ ID NO: 156005 - RNA, 61 nt, hsa
ugcggaaggcucugguucucuagggacuugaaggcgccaacagaguagucuccaugguggg

SEQ ID NO: 156006 - RNA, 61 nt, hsa
gguggggggagcuggcagcugggcaagauccaggcgccacgcuggcgguucgugagugucg

SEQ ID NO: 156007 - RNA, 61 nt, hsa
cagcgaccuccgucucaaguuccgcauccucaggcgccagccuguccaguagcaugaacac

SEQ ID NO: 156008 - RNA, 58 nt, hsa
ggccugggagcggagccuaggguuccgaaggcgccauccccggaccuaggaccggugc

SEQ ID NO: 156009 - RNA, 61 nt, hsa
ccccugggcuacuaaggacaguuuaaagaugaggcgccauaggcauccgucuccagagccc

SEQ ID NO: 156010 - RNA, 61 nt, hsa
gacuaaugcacagaggguaggagucuagccgaggcgccauggggcguugcaucagcaggac

SEQ ID NO: 156011 - RNA, 61 nt, hsa
gccacaccaagccacccgagcgcagugccacaggcgccaagagcaaguaccucaucuucac

SEQ ID NO: 156012 - RNA, 61 nt, hsa
acagcagggagacuugggugaccccccuuccaggcgccaucuagcacagccuggcccugau

SEQ ID NO: 156013 - RNA, 61 nt, hsa
augcuccaggcccccugggccagcuccgagaaggcgccagugaaggaccagggaccaggcc

SEQ ID NO: 156014 - RNA, 61 nt, hsa
ggcugaagaugcgagcccguccucaugacgcaggcgccacccugcugccggagccgggcuu

SEQ ID NO: 156015 - RNA, 61 nt, hsa
gcagggacuggcagcugccacccccuucaagaggcgccauagacccuagcggggagggcag

SEQ ID NO: 156016 - RNA, 61 nt, hsa
gaagccccaugagcuccuggcggaaggaacgaggcgccacaccccugcucuuccuccugac

SEQ ID NO: 156017 - RNA, 61 nt, hsa
ccccggucgcaggaguccggggagggccgggaggcgccauggucucucucuguagccuuuc

SEQ ID NO: 156018 - RNA, 61 nt, hsa
gccaccgugccaagccggcagaggucaugccaggcgccaagggccaugugcccagcugcug

SEQ ID NO: 156019 - RNA, 61 nt, hsa
ggagcccuuaggagagugguuuaacaugagaaggcgccaacagcacacagggucaggguca

SEQ ID NO: 156020 - RNA, 61 nt, hsa
ggucagcacggaagcuccaccuucuggguggaggcgccauccuaaccauccagccaggcca

SEQ ID NO: 156021 - RNA, 61 nt, hsa
cuucuagaagggggccucccaccuuaaguucaggcgccaucugauagccuuuucugcaggc

SEQ ID NO: 156022 - RNA, 61 nt, hsa
cugccucagccucccgaguagcugggauuagaggcgccagccaacacacccggcuaauuuu

SEQ ID NO: 156023 - RNA, 61 nt, hsa
agaagucauucuugaccagccaugaaaccagaggcgccaucccauucugccggaggacagc

SEQ ID NO: 156024 - RNA, 61 nt, hsa
agagcaucaauagccuaaggaugugccguggaggcgccagcugccuguucuuaccuccgcc

SEQ ID NO: 156025 - RNA, 61 nt, hsa
gaguaccgagagacacggucuggacagcccaaggcgccaggaugcaaccugcuuucaccag

SEQ ID NO: 156026 - RNA, 61 nt, hsa
ucccacccucaaccgcggccccuguaggccaaggcgccaggcaggacgacagcagcagcag

SEQ ID NO: 156027 - RNA, 54 nt, hsa
gagcccugggcaggcaguagggggaggcgccacccauggcugcaguggaggggc

SEQ ID NO: 156028 - RNA, 61 nt, hsa
aacaacagacucuuaaacuaacaauucaagcaggcgccaagugcuaugacagaggugugaa

SEQ ID NO: 156029 - RNA, 61 nt, hsa
cucuguugcucccuccucugcagcugcacgaaggcgccaucuggugucugcauggguguug

SEQ ID NO: 156030 - RNA, 61 nt, hsa
gggcgaggccaucucugccugccucccuagcaggcgccagcgguggaggcugagucgcagg

SEQ ID NO: 156031 - RNA, 61 nt, hsa
auggcggggaagcugaaaccucugaauguggaggcgccagaagcuacugaggaggcugaag

SEQ ID NO: 156032 - RNA, 61 nt, hsa
ccaaccuagccagguagccaccacugugcccaggcgccaaauaaacccugguugggaagag

SEQ ID NO: 156033 - RNA, 61 nt, hsa
uucgugaaacgacucuugccaaacguucccgaggcgccaaggaguguaguacacccuggcu

SEQ ID NO: 156034 - RNA, 61 nt, hsa
acccuggagcaagugcgcagcaucauggaugaggcgccacucacggacgucagggacauca

SEQ ID NO: 156035 - RNA, 61 nt, hsa
cauugaauguacuauguauguucaaguauucaggcgccaugucuuauauacugaagaaaga

SEQ ID NO: 156036 - RNA, 61 nt, hsa
aagugggggagggggauggcagagacuguaaaggcgccacuggacucuggcaaggccuuua

SEQ ID NO: 156037 - RNA, 61 nt, hsa
gugacuauccagugagccuucagugggugcaaggcgccauacuugcugugagagagcugag

SEQ ID NO: 156038 - RNA, 61 nt, hsa
ccgugcagcccagugaccacugcccagugggaggcgccacuuuguauauuucaggacuggg

SEQ ID NO: 156039 - RNA, 61 nt, hsa
aauugagcgcugaaucgugucccaugagaucaggcgccaucuguaaagucuccucuggaaa

SEQ ID NO: 156040 - RNA, 61 nt, hsa
cccucccggcgauccgcccccagcacuggggaggcgccacugaaccgagaagggacgguca

SEQ ID NO: 156041 - RNA, 61 nt, hsa
auaaucacuuguggagcgccagcucugcccaaggcgccaccugggcggacagccaggagcu

SEQ ID NO: 156042 - RNA, 61 nt, hsa
ccuccaggagguuccucacacacaacuccagaggcgccauuuacacuguagucuguacaac

SEQ ID NO: 156043 - RNA, 61 nt, hsa
acuuugacagccauaucccucccagcacaccaggcgccaggugagcugguucagaccccuc

SEQ ID NO: 156044 - RNA, 61 nt, hsa
ugcucggaaagcguaagacaagaugaagagcaggcgccauuauaaauaucaaagcccaaga

SEQ ID NO: 156045 - RNA, 61 nt, hsa
uguuguguguagguccccuggggacacaagcaggcgccaaugguaucugggcggagcucac

SEQ ID NO: 156046 - RNA, 61 nt, hsa
acccugaccugggcuugucaucugcuggaacaggcgccauggggccugccagcccugccug

SEQ ID NO: 156047 - RNA, 61 nt, hsa
agagagugagccccacgccgccccagggaggaggcgccagagcgcggggcagacgcaaagu

SEQ ID NO: 156048 - RNA, 61 nt, hsa
gccuaguaagcgccacaggugacucugaugcaggcgccacagccacacuugaagaaacaca

SEQ ID NO: 156049 - RNA, 61 nt, hsa
cuugcgccucgggcauagggacguggggugcaggcgccaacaucaguggcagcagccaggg

SEQ ID NO: 156050 - RNA, 61 nt, hsa
gccguguacacucuccaggcaccaugggcggaggcgccagaggcugggaagaaauaauguu

SEQ ID NO: 156051 - RNA, 61 nt, hsa
cucagccucacgaguagcuggaauuacaggcaggcgccaccagacccggcuaauuuuuugu

SEQ ID NO: 156052 - RNA, 61 nt, hsa
ccgcccgcaugcagcuucaccuccccuuuccaggcgccacuguugagaagcuagagauugu

SEQ ID NO: 156053 - RNA, 61 nt, hsa
cucggacggaucugcucagaaaggaagaggcaggcgccagggggaacccccuucguguuuu

SEQ ID NO: 156054 - RNA, 59 nt, hsa
cugagagguccucagcgucugacucucggccaggcgccagcaaggaggggccggucccc

SEQ ID NO: 156055 - RNA, 61 nt, hsa
uggucucugccagcccaagcaucacugcccgaggcgccagcucaguuucaccguccacguc

SEQ ID NO: 156056 - RNA, 61 nt, hsa
agguguguccuacggacgugugggagguggcaggcgccagccuccgagcaguguggugguu

SEQ ID NO: 156057 - RNA, 61 nt, hsa
ggaaagugacgcgcauggacggggcccagcuaggcgccaggacuuggccucacccucuggc

SEQ ID NO: 156058 - RNA, 61 nt, hsa
ccgucugugcccugugccuuuccagggagccaggcgccaugggcuucugguccaagcugug

SEQ ID NO: 156059 - RNA, 61 nt, hsa
caucuuucugugcucagcgugagucugaagcaggcgccagggccucugguguacggggcuu

SEQ ID NO: 156060 - RNA, 61 nt, hsa
uguguggagguggaaacagagcuacgccagcaggcgccaagcacccaacuccagagaugga

SEQ ID NO: 156061 - RNA, 61 nt, hsa
uaaccgcaaaacucuagagggggaguugagcaggcgccagggcugucaucaacauggauau

SEQ ID NO: 156062 - RNA, 61 nt, hsa
cugccucagccuccugaguagcugggacuacaggcgccagccaccaugccuggcuaauuuu

SEQ ID NO: 156063 - RNA, 64 nt, hsa
ggccacuuucagagcccccagcccugggaaccacucccaccacaggcauaagcuaucaccuagc

SEQ ID NO: 156064 - RNA, 64 nt, hsa
cggagggauggagaaagaaguggagacaguccuuucccaccauuccugccuuuaagccaaagaa

SEQ ID NO: 156065 - RNA, 64 nt, hsa
gaaacaggcgggacacaguggcucacgccuguaaucccaccacuuuggaaagcugaggcaggug

SEQ ID NO: 156066 - RNA, 64 nt, hsa
cagaaccuccaggcugacgaggcaagacaaagccucccaccagacuuggagauugaaguucuua

SEQ ID NO: 156067 - RNA, 64 nt, hsa
uaaaugaaugaauggccuucccuucucaggcuauucccaccauuagucugcccaccuuucuagg

SEQ ID NO: 156068 - RNA, 64 nt, hsa
cuuggcgccccuauugucucuggcuaccuccuugucccaccaccuccaggcugcaucccaccuu

SEQ ID NO: 156069 - RNA, 64 nt, hsa
cacagggcacagauuccccagaaaguuaacacaaucccaccaugagggauggguaaauucucag

SEQ ID NO: 156070 - RNA, 64 nt, hsa
accaugugguuggaaggauagacugcccccuaccucccaccaccaccaugaaguuuggugacuu

SEQ ID NO: 156071 - RNA, 64 nt, hsa
uauauuuuaaaaguuuacugccaugaaauacuccucccaccacacacacaugcuccaaaagagg

SEQ ID NO: 156072 - RNA, 64 nt, hsa
caugguacauuaaaaugauauucuuaaaauuuuuucccaccaagguauuccaaagaaaauauua

SEQ ID NO: 156073 - RNA, 64 nt, hsa
cccuggccucacgcccagccuccucccaccacccucccaccaugcgcugcucaaccucucuccu

SEQ ID NO: 156074 - RNA, 64 nt, hsa
cgcucugcccucccuggccucacgcccagccuccucccaccacccucccaccaugcgcugcuca

SEQ ID NO: 156075 - RNA, 64 nt, hsa
uccaguggucacuucccaccauugcaggcagacuucccaccauugcaggcagcugggcccacuu

SEQ ID NO: 156076 - RNA, 64 nt, hsa
uugccauagaggagcccucccuccaguggucacuucccaccauugcaggcagacuucccaccau

SEQ ID NO: 156077 - RNA, 64 nt, hsa
agacacaacagccgcaguuuggccagccacuaagucccaccagcugagguccgaggaaagcggg

SEQ ID NO: 156078 - RNA, 64 nt, hsa
gaggaauuucugcauggggcgugaaggcacacugucccaccacaacugaaccagaagagaguga

SEQ ID NO: 156079 - RNA, 64 nt, hsa
agguaagaauaacaaguaacuauaaacgggugcaucccaccacucccuggaggcauuagacacc

SEQ ID NO: 156080 - RNA, 64 nt, hsa
cagcaucuacacauucaaaagauaagcugaguguucccaccaggaagucacgcgcagagaggag

SEQ ID NO: 156081 - RNA, 64 nt, hsa
uuccucgcuccauagcccucaacugcccaggcgcucccaccagcagaacugagccugccuccuc

SEQ ID NO: 156082 - RNA, 64 nt, hsa
gaggccacgcugcuauggaggcugccuccuagucucccaccaggucccaggcuguggaaagccc

SEQ ID NO: 156083 - RNA, 64 nt, hsa
ucagccgaugccccccgguaugggaaccagcaccucccaccaaccaaccacacccggugggggc

SEQ ID NO: 156084 - RNA, 64 nt, hsa
ucagccgaugccccccaguaugggaaccagcaccucccaccaaccagccacacccggugggggc

SEQ ID NO: 156085 - RNA, 64 nt, hsa
ucagccgaugccccccggugugggaaccagcaccucccaccaaccagccacacccagugggggc

SEQ ID NO: 156086 - RNA, 64 nt, hsa
acccggggggcccccgggugcagaaaacagcaccucccaccaaccagccacucccgguggggac

SEQ ID NO: 156087 - RNA, 64 nt, hsa
ucccauggaaguuuccucacaaagucagcuccucucccaccacaggcucacacugcccuuacuu

SEQ ID NO: 156088 - RNA, 64 nt, hsa
cagagccccugccccauggcccuggaugucacacucccaccagggcugaagacaaggauguucc

SEQ ID NO: 156089 - RNA, 64 nt, hsa
aguaggugcucauuggcucccuuccaccugucauucccaccacccugaggccccaaccgccaca

SEQ ID NO: 156090 - RNA, 64 nt, hsa
aagauucccuccuuacccccaacccacucuuuuuucccaccacccacucuccucugccucagua

SEQ ID NO: 156091 - RNA, 64 nt, hsa
cagucagccgaggauguaguuguugcugccgucgucccaccaccucagggaccagagggcuagg

SEQ ID NO: 156092 - RNA, 64 nt, hsa
uccuccguuguugcgugagaacccgugugccccuucccaccauauccacccucgcuccaucuuu

SEQ ID NO: 156093 - RNA, 64 nt, hsa
ucacaccauccuaugagcccacgcccggccccacucccaccauccugugaaccccacuccacuc

SEQ ID NO: 156094 - RNA, 64 nt, hsa
ucacucuauccugugagaccacgccuggccccacucccaccauccugugagccccacuccuggc

SEQ ID NO: 156095 - RNA, 64 nt, hsa
cccaccauccugugagccccacucccagccccacucccaccauccugugagccccacucccggc

SEQ ID NO: 156096 - RNA, 64 nt, hsa
cccaccauccugugagccccacuuccagccccacucccaccauccugugagccccacucccagc

SEQ ID NO: 156097 - RNA, 64 nt, hsa
cacuccauccugugagucccacucccagccccacucccaccauccugugagccccacuuccagc

SEQ ID NO: 156098 - RNA, 64 nt, hsa
cacuccauccugugagucccacucccagccccacucccaccauccugugagcccaugcccggcc

SEQ ID NO: 156099 - RNA, 64 nt, hsa
ucacaccauccugugagaccacgcccggccccacucccaccaucuuguaagacugugcccagcc

SEQ ID NO: 156100 - RNA, 64 nt, hsa
ugugaugugucucgacaccaauacacaacccccuucccaccauccuucaugucacuagauacac

SEQ ID NO: 156101 - RNA, 64 nt, hsa
accauccuucaugucacuagauacacaacccccuucccaccaucccuucagucacuaguggaag

SEQ ID NO: 156102 - RNA, 64 nt, hsa
gguuccugguccccugggcuguguagacccggugucccaccaggcuccaggcucccaccaucua

SEQ ID NO: 156103 - RNA, 64 nt, hsa
cuguguagacccggugucccaccaggcuccaggcucccaccaucuacagaggggcuuacagcgc

SEQ ID NO: 156104 - RNA, 64 nt, hsa
ggcaagcugggggcccaucgccguggggagucccucccaccacccucgccgcaggcagcugcag

SEQ ID NO: 156105 - RNA, 64 nt, hsa
gcacagcccucacagcucaaacgcccacccccacucccaccaucugcagguggugaaaacaaac

SEQ ID NO: 156106 - RNA, 64 nt, hsa
guuucucaucccaugggcgaccagggccaucuccucccaccaguggcccccacucacagggagc

SEQ ID NO: 156107 - RNA, 64 nt, hsa
ucauuagugaauuacacucaaggaaaagaugugcucccaccaggcagcuccagcuguuaccuga

SEQ ID NO: 156108 - RNA, 64 nt, hsa
gcgcagcuccuucccuaggcaccucugugcugcaucccaccagccugagcaagacgcccucucg

SEQ ID NO: 156109 - RNA, 64 nt, hsa
agccucccucuccucuguccccauagcugguuuuucccaccaauccucaccuaacaguuacuuu

SEQ ID NO: 156110 - RNA, 64 nt, hsa
acccaggugugggcagucagggagggagggagugucccaccacguucucagggcagcccuugac

SEQ ID NO: 156111 - RNA, 64 nt, hsa
ccgagcagcaaaaggggagaagaucccacuacucucccaccaccugcccuuucucugagggacg

SEQ ID NO: 156112 - RNA, 62 nt, hsa
aauuggauauuggacucugcucauauaagcuacagacaaaagccaaaagacucucgcugucc

SEQ ID NO: 156113 - RNA, 62 nt, hsa
gccuguaaucccagcauuuugggaggcucaggcagacaaaucgcucuagcucagaaguugca

SEQ ID NO: 156114 - RNA, 62 nt, hsa
ugggcaacauggugaaacccgucucuaccaaacagacaaaaagcagccaggcgugguggcac

SEQ ID NO: 156115 - RNA, 62 nt, hsa
guccuaacuacaaaugcuaaugaaaauguuuucagacaaagcacugaauuugaaauaaucuc

SEQ ID NO: 156116 - RNA, 62 nt, hsa
uaaaagaucacuuacaggaucauguuagugagcagacaaauagucacaaauuucaaacuugu

SEQ ID NO: 156117 - RNA, 62 nt, hsa
guccauucugcugaauucagguucaucauugccagacaaauguaguaagcuaguguuucaca

SEQ ID NO: 156118 - RNA, 62 nt, hsa
cugcaugugugggacacugguaucucccgucucagacaaauggcugauguucucuaugauau

SEQ ID NO: 156119 - RNA, 62 nt, hsa
uauaugcauuguguaauccacucagaauuaaacagacaaaagguaugcuugcuuuggaauga

SEQ ID NO: 156120 - RNA, 62 nt, hsa
auuuaaaaacaaauuggcuuugucucauugaucagacaaaaagaaacuaguauuaagggaag

SEQ ID NO: 156121 - RNA, 62 nt, hsa
caccucugcaccuaguuuuuucccauugguuccagacaaaggugacuuauaaauauauuuag

SEQ ID NO: 156122 - RNA, 62 nt, hsa
cuuucucaaagcggugaccacucaggccagcccagacaaaucugagggauggccagugcacu

SEQ ID NO: 156123 - RNA, 62 nt, hsa
aguaggagauuuuauaaaagaaagaccugagucagacaaauaauaaaggucugcuguggcua

SEQ ID NO: 156124 - RNA, 62 nt, hsa
guggcuaaaaaagcaaaaacaaaaaagcuauccagacaaaauacauagggaucagaaacuuu

SEQ ID NO: 156125 - RNA, 62 nt, hsa
cccggacagacagacacagccugaaacagacccagacaaacagacagacagacacagccuga

SEQ ID NO: 156126 - RNA, 62 nt, hsa
ccuagacagacagacacagauugaaacagacccagacaaacagacagacacagccugaaaca

SEQ ID NO: 156127 - RNA, 62 nt, hsa
uguuauuuauuagcccuaauuguguuugguuucagacaaaaccuuuucuccuguguaucuuu

SEQ ID NO: 156128 - RNA, 62 nt, hsa
aguuauuuauuagcccuaauuguguuugauuucagacaaaauuaacccuuuucuccugugua

SEQ ID NO: 156129 - RNA, 62 nt, hsa
agcuuuguggcacccucagugcaaccucagaacagacaaaucaugaaugagcuggaacuuug

SEQ ID NO: 156130 - RNA, 62 nt, hsa
uggugggagggaagccgggaauguauccuuuucagacaaaauuaaauauuuugaaaugagaa

SEQ ID NO: 156131 - RNA, 62 nt, hsa
gaggaaaacauguucagugaggaaaaaacauucagacaaauguucagugaggaaaaaaaggg

SEQ ID NO: 156132 - RNA, 62 nt, hsa
ugcaucuugaagcaacaaagcagccacaguuucagacaaauguucagugugagugaggaaaa

SEQ ID NO: 156133 - RNA, 64 nt, hsa
auggauuuauaaacuuguuuuuuuucuaggugacccuguuuaauaggcuuucacagacugggga

SEQ ID NO: 156134 - RNA, 64 nt, hsa
uuacugaacuucauccuguuagauggagagcaugccuguuuaagggauuacugguccuacagcc

SEQ ID NO: 156135 - RNA, 64 nt, hsa
ccugucuaacuggaugcucauugccugggcaaggccuguuuaggccgguugcgguggcucaugc

SEQ ID NO: 156136 - RNA, 64 nt, hsa
agacuccaucucaaaaaaaaaagaaaagaaaaagccuguuuaaugcacaggugugaguggauug

SEQ ID NO: 156137 - RNA, 64 nt, hsa
uaagagcucuagaaaaaagggaacagaaagucugccuguuuaguaaguggcaauuccauacaua

SEQ ID NO: 156138 - RNA, 64 nt, hsa
auguacauauauauguauauaaucuugcuucccgccuguuuauggcaguacugaagagaaaugg

SEQ ID NO: 156139 - RNA, 64 nt, hsa
auuuaagaauauuauccugguuuaacaacagugcccuguuuacaacagauugugcccuaucuca

SEQ ID NO: 156140 - RNA, 64 nt, hsa
gauuggcuuguuuuuauguggcgccaagaacgaaccuguuuaacagcuguaaccaaugguacug

SEQ ID NO: 156141 - RNA, 64 nt, hsa
uauuggucaugguugacugaggagccaauuaaaaccuguuuaugccuaguguuccauuauugga

SEQ ID NO: 156142 - RNA, 64 nt, hsa
cgggccgaguucuaucuaggugugucuuccagaaccuguuuacggcuaacuggauaacugagag

SEQ ID NO: 156143 - RNA, 64 nt, hsa
ggcccagccgccucccucucuugggacgcaacuucuuccccacucggaugggcuuuaaauuauu

SEQ ID NO: 156144 - RNA, 64 nt, hsa
auuccaagggcccuggcguccucugccuuccccgcuuccccaugagcgucugcaaaacacuugc

SEQ ID NO: 156145 - RNA, 64 nt, hsa
cucugugcucacugaagggugagccaggccagugcuuccccagccccugggccuggucacuaca

SEQ ID NO: 156146 - RNA, 64 nt, hsa
ggucacuacacaguggaaaacagacaagcggccccuuccccaaaucccaagagugucuugcugc

SEQ ID NO: 156147 - RNA, 64 nt, hsa
uauuccuuuccuuucuauccuuuuauauuuuucccuuccccacccccucacucaaugguauaaa

SEQ ID NO: 156148 - RNA, 64 nt, hsa
cagaucucucuuuugcaacauuuuacccauuucccuuccccaaaccaugugcuuauuagauggu

SEQ ID NO: 156149 - RNA, 64 nt, hsa
uggacuuggcccugccugaugccaagcaaagacccuuccccagaggccuaccccccauaugucc

SEQ ID NO: 156150 - RNA, 64 nt, hsa
gggaggagggagccugcucaccccacuccagggccuuccccagcggccaccaacugaccugggg

SEQ ID NO: 156151 - RNA, 64 nt, hsa
agaggagauacuuauuggucuuuuuguuuaauaccuuccccaagaggggacagucuggccaacu

SEQ ID NO: 156152 - RNA, 64 nt, hsa
cucuaaagucauuuaacuaauagccagcacaucccuuccccaaacugucaauugaaaucuuaac

SEQ ID NO: 156153 - RNA, 64 nt, hsa
caaauaacaauauagaacaacauuauuauaugugcuuccccaaguuuaaaggcccugcagaaau

SEQ ID NO: 156154 - RNA, 64 nt, hsa
aaaaaagggucuuuaagaaccuacuuccuaaucucuuccccaauccaaaccauagcugucuguc

SEQ ID NO: 156155 - RNA, 64 nt, hsa
ugcaccuguccucaucucugcaaaguucagcuuccuuccccaggucucugugcacucugucuug

SEQ ID NO: 156156 - RNA, 64 nt, hsa
gggaggcuggaauggagaaucuggauucucuccucuuccccauucuccagagggagggaggugg

SEQ ID NO: 156157 - RNA, 64 nt, hsa
gaagggcuaggcagggggcaaauugagccccucccuuccccaguuuuucucuaagauauacagu

SEQ ID NO: 156158 - RNA, 64 nt, hsa
cacaguuccaaugugccuguucacucaccucucccuuccccaacccuucucuacuuggcugcug

SEQ ID NO: 156159 - RNA, 64 nt, hsa
ccuucucuacuuggcugcuguuuuaaaguuugcccuuccccaaauuuggauuuuuauuacagau

SEQ ID NO: 156160 - RNA, 64 nt, hsa
ugucccuuuccagugcuguggcauucuguggcagcuuccccagguguggugacggggggggggc

SEQ ID NO: 156161 - RNA, 64 nt, hsa
gcuugaggguggacggcgugccucucccaggagccuuccccauguccuugccuugcugagaauu

SEQ ID NO: 156162 - RNA, 64 nt, hsa
uacaaauuaaagguuaaaggccccuuuacaugcccuuccccagucuccucuuccucccccggaa

SEQ ID NO: 156163 - RNA, 64 nt, hsa
ucaaauggaaauugugcacuuuccuguuuauacccuuccccacguuauuguaaaagaguuuaac

SEQ ID NO: 156164 - RNA, 64 nt, hsa
gcccuugggugccagagugagacacagcaggacccuuccccaaauacuaggcucagagcaaccu

SEQ ID NO: 156165 - RNA, 64 nt, hsa
ucccuguguccuuggacagcagauccacacaccacuuccccacccacacacaguacccugggcu

SEQ ID NO: 156166 - RNA, 64 nt, hsa
gcagagagagccuuggcgccucuguuugccaccacuuccccaggaaggagggacagcauuucuc

SEQ ID NO: 156167 - RNA, 64 nt, hsa
ggggcagcuuuauuccuguugggccucaguuucucuuccccacacaguuuaucuuccgucacau

SEQ ID NO: 156168 - RNA, 64 nt, hsa
ccccccguccugccauccccccccgccguccugccuuccccaccccacccuuaggucccaggua

SEQ ID NO: 156169 - RNA, 64 nt, hsa
gucucuguuuacugccuuugaacagaacuucuuccuuccccaugcuuugggucaccucgggcug

SEQ ID NO: 156170 - RNA, 64 nt, hsa
agaguggugcuuacugugcugacuguguacuuaucuuccccaagagaaaaugcuucuuuugagc

SEQ ID NO: 156171 - RNA, 64 nt, hsa
aagagaggaguuugcucugaauuuguaaauaagucuuccccauuccucauacucgagccucucc

SEQ ID NO: 156172 - RNA, 64 nt, hsa
gccuucuggcugcugcagucagcacagagagcggcuuccccaucgccuucuggggaggggcucc

SEQ ID NO: 156173 - RNA, 64 nt, hsa
cccauugccuucuggggagggacacagaggacagcuuccccaucgccuucuggcugcugcaguc

SEQ ID NO: 156174 - RNA, 64 nt, hsa
gccuucuggccgcugcagucagcacagagagcggcuuccccauugccuucuggggagggacaca

SEQ ID NO: 156175 - RNA, 64 nt, hsa
cccauugccuucuggggagggacacagaggacggcuuccccaucgccuucuggccgcugcaguc

SEQ ID NO: 156176 - RNA, 64 nt, hsa
acugccaggcagcugcaguuagcacagaggauggcuuccccauugccuucuggggagggacaca

SEQ ID NO: 156177 - RNA, 64 nt, hsa
ggacagcuuugcuccgcucccaccgcccccaccccuuccccaggcccaccaucaccaccgccuc

SEQ ID NO: 156178 - RNA, 64 nt, hsa
ugucuuugucaccacguggggcucacuuuucauccuuccccaacuucccuaguccccguacuag

SEQ ID NO: 156179 - RNA, 64 nt, hsa
uuuacauucuccucuggggcucuaccucuccacacuuccccagaagggaaaagggcacccugga

SEQ ID NO: 156180 - RNA, 64 nt, hsa
uggaaaucacuccuuggugggcagcauccugaggcuuccccagaaccaggccucugcucuggcc

SEQ ID NO: 156181 - RNA, 64 nt, hsa
ucuccaaacucauccuuguguauagucucacacccuuccccauaaguauaaaugggcccauauu

SEQ ID NO: 156182 - RNA, 64 nt, hsa
ucuugccacuccuagcuccagaagggcucagggccuuccccacagaucuaaggacugggcuacc

SEQ ID NO: 156183 - RNA, 64 nt, hsa
ccaaccuucccccacagcuaucuucacucucugccuuccccaucucagauacugucaacuccau

SEQ ID NO: 156184 - RNA, 64 nt, hsa
cccuugagucucuccucuucuccaucuucacuggcuuccccagccacucacguucauguccuua

SEQ ID NO: 156185 - RNA, 64 nt, hsa
gguggggcuggugggucugcagcuggugugggaacuuccccacggauggcgguggaggggguuc

SEQ ID NO: 156186 - RNA, 64 nt, hsa
ccugaggcuggcugggggcaggacaacacagcugcuuccccaggcugcccacucuggggacccg

SEQ ID NO: 156187 - RNA, 64 nt, hsa
ccccacccuaccucaccucuucucaggcaccccucuuccccagcuguccugccagcccuucucg

SEQ ID NO: 156188 - RNA, 64 nt, hsa
cuugagcugaacugggcuguguuuaccccaaacucuuccccaccucggguccccaagccgcugg

SEQ ID NO: 156189 - RNA, 64 nt, hsa
aagggauuacuuagaagacauuuuuguacaugcucuuccccaaggauuguacguauuauacaaa

SEQ ID NO: 156190 - RNA, 64 nt, hsa
uuacugaugagaugaaaccuauuuguaaggagaucuuccccaggagcauuucuguugccuucuu

SEQ ID NO: 156191 - RNA, 64 nt, hsa
uguggacugggcugcuggccugcuugcuuccucccuuccccauuccuagcagggccugaggccc

SEQ ID NO: 156192 - RNA, 64 nt, hsa
augacgggaagcugagugacccugaggccuuaagcuuccccagucuuggccccaaaugcaguca

SEQ ID NO: 156193 - RNA, 64 nt, hsa
ugcccuuccaagcccggcuuugggccaggaaaggcuuccccagguggcucuucuaccaggcuuu

SEQ ID NO: 156194 - RNA, 64 nt, hsa
ccgccugcagaaaggaccugcccugauaaugucccuuccccagauucucaagcagaugcccaag

SEQ ID NO: 156195 - RNA, 64 nt, hsa
gcuccuggcagagggagaggacaggaggaggagccuuccccaggaggaacgaggagagguggcc

SEQ ID NO: 156196 - RNA, 64 nt, hsa
augacaagcgacaaguguacccagaguagaaggccuuccccacucccaccucaaacccaggagc

SEQ ID NO: 156197 - RNA, 64 nt, hsa
gauguuucuggcaggcccagaagugcuggccguucuuccccagccuccccacugcucccuccuc

SEQ ID NO: 156198 - RNA, 64 nt, hsa
cuuggccccugggguccugccucaugaaugaggccuuccccagggcuggccugacugugcuggg

SEQ ID NO: 156199 - RNA, 64 nt, hsa
gggccaggccugccugcccacuggccaucgccaccuuccccagcugccuccuaccagcaguuuc

SEQ ID NO: 156200 - RNA, 64 nt, hsa
gcuccucuuccccagacgccuggcugcugaucgccuuccccacccaccaacccucagggcaaag

SEQ ID NO: 156201 - RNA, 64 nt, hsa
ucucacccuggaggcaccugguggccaugcuccucuuccccagacgccuggcugcugaucgccu

SEQ ID NO: 156202 - RNA, 64 nt, hsa
ugcccagaaacaagaaacacgauaccauucuggccuuccccaccccacauccucucuuggccuu

SEQ ID NO: 156203 - RNA, 64 nt, hsa
uuuuugauuuggugugugcccuaggguauguacccuuccccaucugagccucgguguguccaug

SEQ ID NO: 156204 - RNA, 64 nt, hsa
cccuggaucaggguuguucugggaguccugucagcuuccccaggagcucucugcugagcagccc

SEQ ID NO: 156205 - RNA, 64 nt, hsa
gccccagaacaauucugcagaguggugaaguucacuuccccaacucuucuccaagucuagcuuu

SEQ ID NO: 156206 - RNA, 64 nt, hsa
cuggggcggcuuuggucccuuuuccuggcccuuccuuccccacuucuaagccaaagaaaggaga

SEQ ID NO: 156207 - RNA, 64 nt, hsa
gcccgggcagcccugcccagcucaggccccuuuccuuccccauugagguugggguagguggggg

SEQ ID NO: 156208 - RNA, 64 nt, hsa
gguugugguuuuucaugcccucuaccaugugggccuuccccaggagaugauccuguuaaguguu

SEQ ID NO: 156209 - RNA, 64 nt, hsa
aauguucuagcugauggugagcggcacagucccacuuccccaucuccccaaguaggugguguua

SEQ ID NO: 156210 - RNA, 53 nt, hsa
gcagcugcacacugcucugagcccuuccccaggcccaggcuguagaccaccau

SEQ ID NO: 156211 - RNA, 64 nt, hsa
cuuuauccucauggugcccacuacgagucauacucuuccccaugcugcucauccuccugggccc

SEQ ID NO: 156212 - RNA, 64 nt, hsa
cuaggagcaaagucucaccccuuugucuacguugcuuccccaaaccaugagcagagggacuucg

SEQ ID NO: 156213 - RNA, 64 nt, hsa
augccaaaccagacucggguccccuccugcuucccuuccccacuuaucccccaagugccuuccc

SEQ ID NO: 156214 - RNA, 64 nt, hsa
aagaaaagaguuccuuuugccuuauuccuuaugccuuccccacugguauugaggguuuugauaa

SEQ ID NO: 156215 - RNA, 64 nt, hsa
ugguaggaaaaaaaaguaccuccuagaaggaagccuuccccaccauuuccaggugccaacugcu

SEQ ID NO: 156216 - RNA, 64 nt, hsa
ccugcguguggagggggugcugcccaagggucgccuuccccagcuugugcuccaggggagcccc

SEQ ID NO: 156217 - RNA, 64 nt, hsa
gaggacgcccgagcccaccccugcugacccaggacuuccccaaccuccagggcagaaagagccc

SEQ ID NO: 156218 - RNA, 64 nt, hsa
guguacauggccacaguacagucugguccuuuuccuuccccaucucuuguacacauuuuaauaa

SEQ ID NO: 156219 - RNA, 64 nt, hsa
auacaaaaccucuccacuccacugaccugguggucuuccccaacuuucaguuauacgaaugcca

SEQ ID NO: 156220 - RNA, 64 nt, hsa
accccacccaggcacauuagcgaccaggcuugggcuuccccagcgccccaccaccaccacgugc

SEQ ID NO: 156221 - RNA, 64 nt, hsa
aucaccugaccuucuccaggacugucuucucacccuuccccacucccugguccccgggagcagc

SEQ ID NO: 156222 - RNA, 64 nt, hsa
gcccagcaccccuaucccauuuccagaguucuuccuuccccaucugggccuucauaaaaugcag

SEQ ID NO: 156223 - RNA, 64 nt, hsa
gcuacaggccacucuaggcccaagggcuaguccucuuccccaguccccucagaggcccccgcca

SEQ ID NO: 156224 - RNA, 64 nt, hsa
ccuuaagggggagggcuagugugggggagggaggcuuccccagccuuaagagacccucucagcc

SEQ ID NO: 156225 - RNA, 64 nt, hsa
ccauaaauuuucuuauggaacucucccacauccucuuccccaacuucauuugcuucucucaaca

SEQ ID NO: 156226 - RNA, 64 nt, hsa
caaucuuacaaaguguugguccagagucccaucucuuccccaacccuggauaccaguagcuucc

SEQ ID NO: 156227 - RNA, 64 nt, hsa
aaagcaagggcacagggauuagaccuguggcacacuuccccaauucccucaucuguaggauuug

SEQ ID NO: 156228 - RNA, 64 nt, hsa
ggguuugauggacagaggcugaggaauuuccuggcuuccccagauaguguccugggacauggua

SEQ ID NO: 156229 - RNA, 64 nt, hsa
gcaauaccugcauccccagcacugguccugggcacuuccccaccccagccaggugucccuccua

SEQ ID NO: 156230 - RNA, 64 nt, hsa
aaggcagguccugaggcaggcacugcccuguggucuuccccagguugaggagagaaguggaagc

SEQ ID NO: 156231 - RNA, 64 nt, hsa
uguggcgcuacauuaauuucaagaugucuccuggcuuccccaagaagcugaauaggguagaacc

SEQ ID NO: 156232 - RNA, 64 nt, hsa
ugcuuuucuucauuuacuucauaccccaggaccccuuccccagcagcagagacccuggagcaca

SEQ ID NO: 156233 - RNA, 64 nt, hsa
gagggcagggaggcuuccugggccuuccagccuccuuccccaccuccuucccaaacccucuugg

SEQ ID NO: 156234 - RNA, 64 nt, hsa
cuuaccgcucuguuuauagugacccacccuagaucuuccccaagagggacugggguuucugggg

SEQ ID NO: 156235 - RNA, 64 nt, hsa
ucuuuggucuuguugauuuccucugggcauaucccuuccccagaucugcuccuccccuuucaca

SEQ ID NO: 156236 - RNA, 64 nt, hsa
uucugcuaggugcccugccccugucucugccccccuuccccagccagcauccccaacugcgacu

SEQ ID NO: 156237 - RNA, 64 nt, hsa
aggauugcucuccaaggccauaaugaccccuugccuuccccaugauucucuacaaagcucuugc

SEQ ID NO: 156238 - RNA, 64 nt, hsa
uccuccucccacauuucuggagcuuuuuuuuuuccuuccccauugaccuuuguggucuucugug

SEQ ID NO: 156239 - RNA, 64 nt, hsa
gacccucuggccucucaccccacuucagugcucucuuccccaacuucucucgggcucuuugcuc

SEQ ID NO: 156240 - RNA, 64 nt, hsa
auccccucucaaccaggaguggagggcuaggucccuuccccauggggaguacacuuggguguuc

SEQ ID NO: 156241 - RNA, 64 nt, hsa
cuacgggcuuagcccucgccucccucacugggagcuuccccauccucccugccuuccccagugg

SEQ ID NO: 156242 - RNA, 64 nt, hsa
ccucccucacugggagcuuccccauccucccugccuuccccagugggaaguuagggaagcucag

SEQ ID NO: 156243 - RNA, 64 nt, hsa
uccgcacacacuucuuccccaucaagcccauuuccuuccccaaccacaaagguguuugugauuc

SEQ ID NO: 156244 - RNA, 64 nt, hsa
agaacaugcuccgcaaaguucuccgcacacacuucuuccccaucaagcccauuuccuuccccaa

SEQ ID NO: 156245 - RNA, 64 nt, hsa
ccgggcagggcccccacaccagaccccaacauagcuuccccacccaggcacccccucccggggc

SEQ ID NO: 156246 - RNA, 64 nt, hsa
cucauagaacuuugcucuucccgagacagggucccuuccccagcucaggcacaacagagucugg

SEQ ID NO: 156247 - RNA, 64 nt, hsa
ugccucaggcuccuuccuggucuggcccagcuggcuuccccagccccucagccauccagggcua

SEQ ID NO: 156248 - RNA, 64 nt, hsa
ugggcugguccagguagcucuccugaaccuccuccuuccccaagcugagaagcugagagcugga

SEQ ID NO: 156249 - RNA, 64 nt, hsa
ccaacauccauuguagggggaaucuaugauucugcuuccccagcggauucccacucuguccacc

SEQ ID NO: 156250 - RNA, 64 nt, hsa
ugagccucccucugacacagaggagguggcuccccuuccccacaccuuagaguggcugggaggg

SEQ ID NO: 156251 - RNA, 64 nt, hsa
uacuuuaacaccagguuuauggaaaaugucaggccuuccccacaacuccugucuaacugcuguc

SEQ ID NO: 156252 - RNA, 64 nt, hsa
accugugaggcagccuucugauggccuggcccaccuuccccagaaccaggggaggccugaggcu

SEQ ID NO: 156253 - RNA, 64 nt, hsa
cagagcagugggaccagcauggggaucagcuucccuuccccaccuggagccagggacuguccgg

SEQ ID NO: 156254 - RNA, 64 nt, hsa
acacuggaaagucuguuuuuuuuuuuucuuucuucuuccccaccccuuaauuuuaacuuugugg

SEQ ID NO: 156255 - RNA, 64 nt, hsa
agugagacuccgucacaacaacaacaacaaaaagcuuccccaacuaaagccuagaagagcuucu

SEQ ID NO: 156256 - RNA, 64 nt, hsa
ccagauucuaccacacagcagcaguuacaaaaaccuuccccaggcuggacgugguggcucacgc

SEQ ID NO: 156257 - RNA, 64 nt, hsa
aaccucuuccagauuucucuaagaauagcacccccuuccccauugccccagcuuagccucuucu

SEQ ID NO: 156258 - RNA, 64 nt, hsa
ccagacaugugccccuuugcugcuggcuaccacucuuccccagagcagcaggccccgagccccu

SEQ ID NO: 156259 - RNA, 64 nt, hsa
gaggccagagcucggcagagucacccacccugcccuuccccaggaccccugagaggggcuuauu

SEQ ID NO: 156260 - RNA, 64 nt, hsa
ccagacccaccacagcuggagggccaggccuccucuuccccaggcugccacccacgcuggcgga

SEQ ID NO: 156261 - RNA, 64 nt, hsa
auuugucucucuguccacccacuccugggggggccuuccccaucucuccuccaggccccccggg

SEQ ID NO: 156262 - RNA, 64 nt, hsa
agggagacagccccaacccuuuucuccaaucccccuuccccagguuccugggcuccccuucucu

SEQ ID NO: 156263 - RNA, 64 nt, hsa
ugcuccagcuucuggguauccagagagcacugcacuuccccaaaacggaaggggccccugggca

SEQ ID NO: 156264 - RNA, 64 nt, hsa
cuuaccuuggagaggguccuggagagaauuuccucuuccccagcuaaauacccugccugcaacu

SEQ ID NO: 156265 - RNA, 64 nt, hsa
accagucugucuggggacaggaucccugcugcaccuuccccacccccuccugggaagugccccc

SEQ ID NO: 156266 - RNA, 64 nt, hsa
gacagcugcccccagaacucccuucaagggaggacuuccccagcuaugggaagugccaucaggg

SEQ ID NO: 156267 - RNA, 64 nt, hsa
uuuaaaugcagugccuagagagagaguauugucucuuccccaacacuaaccccacucccaugaa

SEQ ID NO: 156268 - RNA, 64 nt, hsa
ucaaaggaccaguuuuccuaggccaaagaagucucuuccccauguuaguccuaugccuugaaau

SEQ ID NO: 156269 - RNA, 64 nt, hsa
cguccuaucccaacucacccccaaacccccaucccuuccccaccuccagcaguauuacuuguaa

SEQ ID NO: 156270 - RNA, 64 nt, hsa
uuuaaucucuuggccucacccagggaccgucuggcuuccccagcuggacugggaggucaggaag

SEQ ID NO: 156271 - RNA, 64 nt, hsa
caacccccaaacccacgacucacuuccacaccgucuuccccagcgucccccgacccacuucauc

SEQ ID NO: 156272 - RNA, 64 nt, hsa
uuuggaaaagucaaaucauaucacuucucugcuucuuccccaacacagcugcauggcucccgcu

SEQ ID NO: 156273 - RNA, 64 nt, hsa
gaagcucagccugagagaaggagcuggcgagaaccuuccccacacucagcuccaaacgccuccu

SEQ ID NO: 156274 - RNA, 64 nt, hsa
cucuggggucugugauggggaaggguggaugucccuuccccacaauaggcuuagugcuuggcuc

SEQ ID NO: 156275 - RNA, 64 nt, hsa
uggagugcauucauucauccucuuauaugugccccuuccccaugcucagcucagcauuguguac

SEQ ID NO: 156276 - RNA, 64 nt, hsa
uucaugcucagcacaucaucuuccuaggcagucucuuccccaaagucucaccuuuucuuccaau

SEQ ID NO: 156277 - RNA, 64 nt, hsa
ccagaguccccaguguccccuccccuccaucucucuuccccauagaccccauaaccccagacca

SEQ ID NO: 156278 - RNA, 64 nt, hsa
ccucccucggcuccagcccaaugccccagcuggccuuccccagccugcaaggagccuguagcau

SEQ ID NO: 156279 - RNA, 64 nt, hsa
ugcauggggcuucgcccacaaccauucuguaccccuuccccagccugggccuugaccguccagc

SEQ ID NO: 156280 - RNA, 64 nt, hsa
gucacagaaauuugugaucugaaaacccggcucccuuccccacaaggcuccugggccuccggga

SEQ ID NO: 156281 - RNA, 64 nt, hsa
gcggacucuccaagggguacccccaccccgcuaccuuccccacggacgggccccuccuggagcc

SEQ ID NO: 156282 - RNA, 64 nt, hsa
cgguguucugucccagugcggugccuccucuugacuuccccacugcucucuguggugagaaauu

SEQ ID NO: 156283 - RNA, 64 nt, hsa
ccugcugaccaugcagccgcaccagagagagauucuuccccaauuggcucuagucacuggcauc

SEQ ID NO: 156284 - RNA, 64 nt, hsa
ggaggucccagcccuggggguuuaagcucugccccuuccccaugaacccugcccugcucugccc

SEQ ID NO: 156285 - RNA, 64 nt, hsa
aggcaaggaggaggagucagaugaggcccugcaccuuccccaaaggaaccgcccagugcaggua

SEQ ID NO: 156286 - RNA, 64 nt, hsa
cgcagggccugccgccacugccuacaucuucucucuuccccaucuugcauuggaggucccagaa

SEQ ID NO: 156287 - RNA, 64 nt, hsa
ccuucucugcccugugcccacucccuucucuacucuuccccagcaccaugccaaaaggucuuau

SEQ ID NO: 156288 - RNA, 64 nt, hsa; identical to SEQ ID NO: 139090

SEQ ID NO: 156289 - RNA, 64 nt, hsa; identical to SEQ ID NO: 139091

SEQ ID NO: 156290 - RNA, 64 nt, hsa; identical to SEQ ID NO: 139092

SEQ ID NO: 156291 - RNA, 64 nt, hsa; identical to SEQ ID NO: 139093

SEQ ID NO: 156292 - RNA, 64 nt, hsa; identical to SEQ ID NO: 139094

SEQ ID NO: 156293 - RNA, 64 nt, hsa; identical to SEQ ID NO: 139095

SEQ ID NO: 156294 - RNA, 64 nt, hsa; identical to SEQ ID NO: 139096

SEQ ID NO: 156295 - RNA, 64 nt, hsa; identical to SEQ ID NO: 139097

SEQ ID NO: 156296 - RNA, 64 nt, hsa; identical to SEQ ID NO: 139098

SEQ ID NO: 156297 - RNA, 64 nt, hsa; identical to SEQ ID NO: 139099

SEQ ID NO: 156298 - RNA, 64 nt, hsa; identical to SEQ ID NO: 139100

SEQ ID NO: 156299 - RNA, 64 nt, hsa; identical to SEQ ID NO: 139101

SEQ ID NO: 156300 - RNA, 64 nt, hsa; identical to SEQ ID NO: 139102

SEQ ID NO: 156301 - RNA, 64 nt, hsa; identical to SEQ ID NO: 139103

SEQ ID NO: 156302 - RNA, 64 nt, hsa; identical to SEQ ID NO: 139104

SEQ ID NO: 156303 - RNA, 64 nt, hsa; identical to SEQ ID NO: 139105

SEQ ID NO: 156304 - RNA, 64 nt, hsa; identical to SEQ ID NO: 139106

SEQ ID NO: 156305 - RNA, 64 nt, hsa; identical to SEQ ID NO: 139107

SEQ ID NO: 156306 - RNA, 64 nt, hsa; identical to SEQ ID NO: 139108

SEQ ID NO: 156307 - RNA, 64 nt, hsa; identical to SEQ ID NO: 139109

SEQ ID NO: 156308 - RNA, 64 nt, hsa; identical to SEQ ID NO: 139110

SEQ ID NO: 156309 - RNA, 64 nt, hsa; identical to SEQ ID NO: 139111

SEQ ID NO: 156310 - RNA, 64 nt, hsa; identical to SEQ ID NO: 139112

SEQ ID NO: 156311 - RNA, 64 nt, hsa; identical to SEQ ID NO: 139113

SEQ ID NO: 156312 - RNA, 64 nt, hsa; identical to SEQ ID NO: 139114

SEQ ID NO: 156313 - RNA, 64 nt, hsa; identical to SEQ ID NO: 139115

SEQ ID NO: 156314 - RNA, 52 nt, hsa; identical to SEQ ID NO: 112167

SEQ ID NO: 156315 - RNA, 64 nt, hsa; identical to SEQ ID NO: 139117

SEQ ID NO: 156316 - RNA, 64 nt, hsa; identical to SEQ ID NO: 139118

SEQ ID NO: 156317 - RNA, 64 nt, hsa; identical to SEQ ID NO: 139119

SEQ ID NO: 156318 - RNA, 64 nt, hsa; identical to SEQ ID NO: 139120

SEQ ID NO: 156319 - RNA, 64 nt, hsa; identical to SEQ ID NO: 139121

SEQ ID NO: 156320 - RNA, 64 nt, hsa; identical to SEQ ID NO: 139122

SEQ ID NO: 156321 - RNA, 64 nt, hsa; identical to SEQ ID NO: 139123

SEQ ID NO: 156322 - RNA, 64 nt, hsa; identical to SEQ ID NO: 139124

SEQ ID NO: 156323 - RNA, 64 nt, hsa; identical to SEQ ID NO: 139125

SEQ ID NO: 156324 - RNA, 64 nt, hsa; identical to SEQ ID NO: 139126

SEQ ID NO: 156325 - RNA, 64 nt, hsa; identical to SEQ ID NO: 139127

SEQ ID NO: 156326 - RNA, 64 nt, hsa; identical to SEQ ID NO: 139128

SEQ ID NO: 156327 - RNA, 64 nt, hsa; identical to SEQ ID NO: 139129

SEQ ID NO: 156328 - RNA, 64 nt, hsa; identical to SEQ ID NO: 139130

SEQ ID NO: 156329 - RNA, 64 nt, hsa; identical to SEQ ID NO: 139131

SEQ ID NO: 156330 - RNA, 64 nt, hsa
uuucagugggcaauuuuguaauauauucagacuauccagauacagagaugacuaaggucauuga

SEQ ID NO: 156331 - RNA, 64 nt, hsa
cuagcagauugcuucccagggcucccugaguguguccagauaccaagugaggaaugagguguga

SEQ ID NO: 156332 - RNA, 64 nt, hsa
caccaaagacggaagccaaauagguagccaaaaauccagauauuugagaagcaggaaauuuaua

SEQ ID NO: 156333 - RNA, 64 nt, hsa
agaauuuuacuuaggaaaaguauugaaguucaaauccagauaguauuacauuugaaauuguuau

SEQ ID NO: 156334 - RNA, 64 nt, hsa
augcaguguacauuucagauaauuuccuucagucuccagauaggaguguauccaaacaucuaau

SEQ ID NO: 156335 - RNA, 64 nt, hsa
ucuggaucagauccgcgcuauuccccaacccaccuccagauaaugugagaaaauagccauguca

SEQ ID NO: 156336 - RNA, 64 nt, hsa
cagcuugaagagguagcuagguguuuaaaguuccuccagauacuuuuaccugagugaugcuucc

SEQ ID NO: 156337 - RNA, 64 nt, hsa
uucuacuguguagaauacuuugacuuaauuuucuuccagauacagggggauaccugccuguuuu

SEQ ID NO: 156338 - RNA, 64 nt, hsa
uaugugucuucuucuccagauagugaaaaagguguccagauaaacccaccuaagugaaauggcc

SEQ ID NO: 156339 - RNA, 64 nt, hsa
cagcagcccugaacaaccaguaugugucuucuucuccagauagugaaaaagguguccagauaaa

SEQ ID NO: 156340 - RNA, 64 nt, hsa
caagaagagugaaugugucccauccaaaggugcauccagauaugucuguguuacuauggcuuca

SEQ ID NO: 156341 - RNA, 64 nt, hsa
gaaagcaggauuugagagaacauacaccuugccuuccagauaugugguuuuugugauucaccca

SEQ ID NO: 156342 - RNA, 64 nt, hsa; identical to SEQ ID NO: 39289

SEQ ID NO: 156343 - RNA, 64 nt, hsa; identical to SEQ ID NO: 39290

SEQ ID NO: 156344 - RNA, 64 nt, hsa; identical to SEQ ID NO: 39291

SEQ ID NO: 156345 - RNA, 64 nt, hsa; identical to SEQ ID NO: 39292

SEQ ID NO: 156346 - RNA, 64 nt, hsa; identical to SEQ ID NO: 39293

SEQ ID NO: 156347 - RNA, 64 nt, hsa; identical to SEQ ID NO: 39294

SEQ ID NO: 156348 - RNA, 64 nt, hsa; identical to SEQ ID NO: 39295

SEQ ID NO: 156349 - RNA, 64 nt, hsa; identical to SEQ ID NO: 39296

SEQ ID NO: 156350 - RNA, 64 nt, hsa; identical to SEQ ID NO: 39297

SEQ ID NO: 156351 - RNA, 64 nt, hsa; identical to SEQ ID NO: 39298

SEQ ID NO: 156352 - RNA, 64 nt, hsa; identical to SEQ ID NO: 39299

SEQ ID NO: 156353 - RNA, 64 nt, hsa; identical to SEQ ID NO: 39300

SEQ ID NO: 156354 - RNA, 64 nt, hsa; identical to SEQ ID NO: 39301

SEQ ID NO: 156355 - RNA, 64 nt, hsa; identical to SEQ ID NO: 39302

SEQ ID NO: 156356 - RNA, 64 nt, hsa; identical to SEQ ID NO: 39303

SEQ ID NO: 156357 - RNA, 64 nt, hsa; identical to SEQ ID NO: 39304

SEQ ID NO: 156358 - RNA, 64 nt, hsa; identical to SEQ ID NO: 39305

SEQ ID NO: 156359 - RNA, 64 nt, hsa; identical to SEQ ID NO: 39306

SEQ ID NO: 156360 - RNA, 64 nt, hsa; identical to SEQ ID NO: 39307

SEQ ID NO: 156361 - RNA, 64 nt, hsa; identical to SEQ ID NO: 39308

SEQ ID NO: 156362 - RNA, 64 nt, hsa; identical to SEQ ID NO: 39309

SEQ ID NO: 156363 - RNA, 64 nt, hsa; identical to SEQ ID NO: 39310

SEQ ID NO: 156364 - RNA, 64 nt, hsa; identical to SEQ ID NO: 39311

SEQ ID NO: 156365 - RNA, 64 nt, hsa; identical to SEQ ID NO: 39312

SEQ ID NO: 156366 - RNA, 64 nt, hsa; identical to SEQ ID NO: 39313

SEQ ID NO: 156367 - RNA, 64 nt, hsa; identical to SEQ ID NO: 39314

SEQ ID NO: 156368 - RNA, 64 nt, hsa; identical to SEQ ID NO: 39315

SEQ ID NO: 156369 - RNA, 64 nt, hsa; identical to SEQ ID NO: 39316

SEQ ID NO: 156370 - RNA, 64 nt, hsa; identical to SEQ ID NO: 39317

SEQ ID NO: 156371 - RNA, 64 nt, hsa; identical to SEQ ID NO: 39318

SEQ ID NO: 156372 - RNA, 64 nt, hsa; identical to SEQ ID NO: 39319

SEQ ID NO: 156373 - RNA, 64 nt, hsa; identical to SEQ ID NO: 39320

SEQ ID NO: 156374 - RNA, 64 nt, hsa; identical to SEQ ID NO: 39321

SEQ ID NO: 156375 - RNA, 64 nt, hsa; identical to SEQ ID NO: 39322

SEQ ID NO: 156376 - RNA, 64 nt, hsa; identical to SEQ ID NO: 39323

SEQ ID NO: 156377 - RNA, 64 nt, hsa; identical to SEQ ID NO: 39324

SEQ ID NO: 156378 - RNA, 64 nt, hsa; identical to SEQ ID NO: 39325

SEQ ID NO: 156379 - RNA, 64 nt, hsa; identical to SEQ ID NO: 39326

SEQ ID NO: 156380 - RNA, 64 nt, hsa; identical to SEQ ID NO: 39327

SEQ ID NO: 156381 - RNA, 64 nt, hsa; identical to SEQ ID NO: 39328

SEQ ID NO: 156382 - RNA, 64 nt, hsa; identical to SEQ ID NO: 39329

SEQ ID NO: 156383 - RNA, 64 nt, hsa; identical to SEQ ID NO: 39330

SEQ ID NO: 156384 - RNA, 64 nt, hsa; identical to SEQ ID NO: 39331

SEQ ID NO: 156385 - RNA, 64 nt, hsa; identical to SEQ ID NO: 39332

SEQ ID NO: 156386 - RNA, 61 nt, hsa; identical to SEQ ID NO: 39333

SEQ ID NO: 156387 - RNA, 64 nt, hsa; identical to SEQ ID NO: 39334

SEQ ID NO: 156388 - RNA, 64 nt, hsa; identical to SEQ ID NO: 39335

SEQ ID NO: 156389 - RNA, 64 nt, hsa; identical to SEQ ID NO: 39336

SEQ ID NO: 156390 - RNA, 64 nt, hsa; identical to SEQ ID NO: 39337

SEQ ID NO: 156391 - RNA, 64 nt, hsa; identical to SEQ ID NO: 39338

SEQ ID NO: 156392 - RNA, 64 nt, hsa; identical to SEQ ID NO: 39339

SEQ ID NO: 156393 - RNA, 64 nt, hsa; identical to SEQ ID NO: 39340

SEQ ID NO: 156394 - RNA, 64 nt, hsa; identical to SEQ ID NO: 39341

SEQ ID NO: 156395 - RNA, 64 nt, hsa; identical to SEQ ID NO: 39342

SEQ ID NO: 156396 - RNA, 64 nt, hsa; identical to SEQ ID NO: 39343

SEQ ID NO: 156397 - RNA, 64 nt, hsa; identical to SEQ ID NO: 39344

SEQ ID NO: 156398 - RNA, 64 nt, hsa; identical to SEQ ID NO: 39345

SEQ ID NO: 156399 - RNA, 64 nt, hsa; identical to SEQ ID NO: 39346

SEQ ID NO: 156400 - RNA, 64 nt, hsa
guaaaaguggcauuuccuggucagugguggucuucaagacgacagcucuguaucugccauguga

SEQ ID NO: 156401 - RNA, 64 nt, hsa
uuucucuuaggagauuaaacaaaaacagaaagcacaagacgaacucaguagcagaccccagacu

SEQ ID NO: 156402 - RNA, 64 nt, hsa
uuuaaaaggacuauugaugauagaagaauaggggcaagacgacaaaaguaccuuugaauaaaac

SEQ ID NO: 156403 - RNA, 64 nt, hsa
cccucagcuggaguuauuggaaccacuuuguagucaagacgaaagcacugaauuuugcuucaaa

SEQ ID NO: 156404 - RNA, 64 nt, hsa
ucuguagcuauagcuucagaagcauuuuuacuugcaagacgauggacacauuccccuugggcuu

SEQ ID NO: 156405 - RNA, 64 nt, hsa
augcugucugucuuacacauuuauaaggacccugcaagacgacgacaaaggccuuuggccugug

SEQ ID NO: 156406 - RNA, 64 nt, hsa
aacugaaggcaauaauguuggcuuuuggaaggggcaagacgagaaacucugaagaaagcucuga

SEQ ID NO: 156407 - RNA, 64 nt, hsa
uuuccauucaugugcauuuuucugccacugaccacaagacgauuuccugaguuuuguaauccuc

SEQ ID NO: 156408 - RNA, 64 nt, hsa
agaauguuaaacugcauaacaggcaccagauggucaagacgagggaaauaugagaaggcaaaug

SEQ ID NO: 156409 - RNA, 64 nt, hsa
auguaggggaaaguuucaugaugguaucuauagucaagacgaacauguagcauggugccuaugu

SEQ ID NO: 156410 - RNA, 64 nt, hsa
aauguaaaaccaucuuuuaaagccuucagacugucaagacgacaugagcagcucaccauaugau

SEQ ID NO: 156411 - RNA, 64 nt, hsa
caucaauggucaguuauaugaggagagugagaaucaagacgaggacccuaaugaugagggaucu

SEQ ID NO: 156412 - RNA, 64 nt, hsa
gacuuauuuuuaaucugacuauggcauaacauuacaagacgaggcaaaaauauuuaacccccaa

SEQ ID NO: 156413 - RNA, 64 nt, hsa
auuucaacaucuccccccaggcgauguucucccccaagacgaccagaaaauuguuuauugggga

SEQ ID NO: 156414 - RNA, 64 nt, hsa
ggcauuguccuacacauuggcccaguaucacagccaagacgagaagucauuucccagcgauguc

SEQ ID NO: 156415 - RNA, 64 nt, hsa
ccgugggugaggccugaccaccuugggacaccugcaagacgacuccaacccaacaacaaccaga

SEQ ID NO: 156416 - RNA, 64 nt, hsa
aauuuauauccagguuucccaggaucaauauugacaagacgacuuuggcaucugaauuguuuua

SEQ ID NO: 156417 - RNA, 64 nt, hsa
gcuguggccgcgccucugacuauuaucccgguuccaagacgagaggauacuuccaaacaaggua

SEQ ID NO: 156418 - RNA, 64 nt, hsa
uuuuugucacucagcacuuuuucuccauauucuucaagacgauugugaguaugguacguaacag

SEQ ID NO: 156419 - RNA, 64 nt, hsa
acugcagaaaauaguguuuuguaguucaacaacucaagacgaagcuuauuucugaggauaagcu

SEQ ID NO: 156420 - RNA, 64 nt, hsa
gccgagguggguagaucgcuugagcucaggaguucaagacgagccugggcaacauggcaaaugc

SEQ ID NO: 156421 - RNA, 56 nt, hsa
uaaaguccagaaggcaguagggaucccaagacgaccucacccaaagggcucccugg

SEQ ID NO: 156422 - RNA, 64 nt, hsa
auacaaugguauguuauugccagggagugagguacaagacgauggcucaugucacaggccuacc

SEQ ID NO: 156423 - RNA, 64 nt, hsa
aggcaagcugaggugaacauuuaaaaggcuauuucaagacgaggugcgguggcuauaauccuag

SEQ ID NO: 156424 - RNA, 64 nt, hsa
cagcuucgaagaaaagcugaaagggagacguuugcaagacgaguuguacugcugucacaggaaa

SEQ ID NO: 156425 - RNA, 64 nt, hsa
accuaaagcccaaucuugaaaauauguugugcaccaagacgacugcuucagcuucuucucuuau

SEQ ID NO: 156426 - RNA, 64 nt, hsa
ccaacuguuucccugcugaaugccucgcucccuucaagacgaggggcagggaaggacaggaccc

SEQ ID NO: 156427 - RNA, 64 nt, hsa
gaagagcaggaagagguugcugagauuguuggaacaagacgagagguuguuggagcaagaggag

SEQ ID NO: 156428 - RNA, 64 nt, hsa
uccgugcaaauggcugucucggguuuucauagaacaagacgaugacaugcuggaggcugccaag

SEQ ID NO: 156429 - RNA, 64 nt, hsa
gaauccugccaguugcauucuucccccuuggagccaagacgauuggccagacaucaccucagau

SEQ ID NO: 156430 - RNA, 64 nt, hsa
ucccuucaacguagucauccccuggugguggaagcaagacgacggccccugacgugcagccaca

SEQ ID NO: 156431 - RNA, 64 nt, hsa
gcuuuguccuggggacacuuucccucuggaaucucaagacgacguggcacacauuccacguggg

SEQ ID NO: 156432 - RNA, 64 nt, hsa
gcucuuuuugucacacaggauggcaugugauccucaagacgacgaacaaugaacuaaagccaaa

SEQ ID NO: 156433 - RNA, 64 nt, hsa
cuguaucuuaucaugauuccuguagguaaaaguacaagacgaccucuagaugucuuuucuuucu

SEQ ID NO: 156434 - RNA, 64 nt, hsa
uggugcccuucuagaugggcgacggaggcaaggacaagacgaguccgagcucaauaaaugcgcu

SEQ ID NO: 156435 - RNA, 64 nt, hsa
uucaugaggaaagagaaauccugggguuggaccccaagacgacguacaacagguucugcggaga

SEQ ID NO: 156436 - RNA, 64 nt, hsa
cggcccggaguuguccaucuguccaucccaacagcaagacgaggauguggcuguugagaugugg

SEQ ID NO: 156437 - RNA, 64 nt, hsa; identical to SEQ ID NO: 95478

SEQ ID NO: 156438 - RNA, 64 nt, hsa; identical to SEQ ID NO: 95479

SEQ ID NO: 156439 - RNA, 64 nt, hsa; identical to SEQ ID NO: 95480

SEQ ID NO: 156440 - RNA, 64 nt, hsa; identical to SEQ ID NO: 95481

SEQ ID NO: 156441 - RNA, 64 nt, hsa; identical to SEQ ID NO: 95482

SEQ ID NO: 156442 - RNA, 64 nt, hsa; identical to SEQ ID NO: 95483

SEQ ID NO: 156443 - RNA, 64 nt, hsa; identical to SEQ ID NO: 95484

SEQ ID NO: 156444 - RNA, 64 nt, hsa; identical to SEQ ID NO: 95485

SEQ ID NO: 156445 - RNA, 64 nt, hsa; identical to SEQ ID NO: 95486

SEQ ID NO: 156446 - RNA, 64 nt, hsa; identical to SEQ ID NO: 95487

SEQ ID NO: 156447 - RNA, 64 nt, hsa; identical to SEQ ID NO: 95488

SEQ ID NO: 156448 - RNA, 64 nt, hsa; identical to SEQ ID NO: 95489

SEQ ID NO: 156449 - RNA, 64 nt, hsa; identical to SEQ ID NO: 95490

SEQ ID NO: 156450 - RNA, 64 nt, hsa; identical to SEQ ID NO: 95491

SEQ ID NO: 156451 - RNA, 64 nt, hsa; identical to SEQ ID NO: 95492

SEQ ID NO: 156452 - RNA, 64 nt, hsa; identical to SEQ ID NO: 95493

SEQ ID NO: 156453 - RNA, 64 nt, hsa; identical to SEQ ID NO: 95494

SEQ ID NO: 156454 - RNA, 64 nt, hsa; identical to SEQ ID NO: 95495

SEQ ID NO: 156455 - RNA, 64 nt, hsa; identical to SEQ ID NO: 95496

SEQ ID NO: 156456 - RNA, 64 nt, hsa; identical to SEQ ID NO: 95497

SEQ ID NO: 156457 - RNA, 64 nt, hsa; identical to SEQ ID NO: 95498

SEQ ID NO: 156458 - RNA, 64 nt, hsa; identical to SEQ ID NO: 95499

SEQ ID NO: 156459 - RNA, 64 nt, hsa; identical to SEQ ID NO: 95500

SEQ ID NO: 156460 - RNA, 64 nt, hsa; identical to SEQ ID NO: 95501

SEQ ID NO: 156461 - RNA, 64 nt, hsa; identical to SEQ ID NO: 95502

SEQ ID NO: 156462 - RNA, 64 nt, hsa; identical to SEQ ID NO: 95503

SEQ ID NO: 156463 - RNA, 64 nt, hsa; identical to SEQ ID NO: 95504

SEQ ID NO: 156464 - RNA, 64 nt, hsa; identical to SEQ ID NO: 95505

SEQ ID NO: 156465 - RNA, 64 nt, hsa; identical to SEQ ID NO: 95506

SEQ ID NO: 156466 - RNA, 64 nt, hsa; identical to SEQ ID NO: 95507

SEQ ID NO: 156467 - RNA, 64 nt, hsa; identical to SEQ ID NO: 95508

SEQ ID NO: 156468 - RNA, 64 nt, hsa; identical to SEQ ID NO: 95509

SEQ ID NO: 156469 - RNA, 64 nt, hsa; identical to SEQ ID NO: 95510

SEQ ID NO: 156470 - RNA, 64 nt, hsa; identical to SEQ ID NO: 95511

SEQ ID NO: 156471 - RNA, 64 nt, hsa; identical to SEQ ID NO: 95512

SEQ ID NO: 156472 - RNA, 64 nt, hsa; identical to SEQ ID NO: 95513

SEQ ID NO: 156473 - RNA, 64 nt, hsa; identical to SEQ ID NO: 95514

SEQ ID NO: 156474 - RNA, 64 nt, hsa; identical to SEQ ID NO: 95515

SEQ ID NO: 156475 - RNA, 64 nt, hsa; identical to SEQ ID NO: 95516

SEQ ID NO: 156476 - RNA, 64 nt, hsa; identical to SEQ ID NO: 95517

SEQ ID NO: 156477 - RNA, 64 nt, hsa; identical to SEQ ID NO: 95518

SEQ ID NO: 156478 - RNA, 64 nt, hsa; identical to SEQ ID NO: 95519

SEQ ID NO: 156479 - RNA, 64 nt, hsa; identical to SEQ ID NO: 95520

SEQ ID NO: 156480 - RNA, 64 nt, hsa; identical to SEQ ID NO: 95521

SEQ ID NO: 156481 - RNA, 64 nt, hsa; identical to SEQ ID NO: 95522

SEQ ID NO: 156482 - RNA, 64 nt, hsa; identical to SEQ ID NO: 95523

SEQ ID NO: 156483 - RNA, 64 nt, hsa; identical to SEQ ID NO: 95524

SEQ ID NO: 156484 - RNA, 64 nt, hsa; identical to SEQ ID NO: 95525

SEQ ID NO: 156485 - RNA, 63 nt, hsa
gggguagcaaaaauaaagucacgaggacauaguggucaccacugucaguuacaacuugucugu

SEQ ID NO: 156486 - RNA, 63 nt, hsa
aaagcccuuguguugaaaaggccgaggacgaguggucaccaaacaggguggcuccccaggucc

SEQ ID NO: 156487 - RNA, 63 nt, hsa
gcagucaucggacucacccgaucacagacgagcggucaccagaaucgcccgaucacagacgag

SEQ ID NO: 156488 - RNA, 63 nt, hsa
gcagucaucggacucacccgaucacagacgagcggucaccagacucgcccgaucacagacgag

SEQ ID NO: 156489 - RNA, 63 nt, hsa
gaacaagucauucugaaaggucccucugacccaggucaccaaauuugggccagaacuggcacu

SEQ ID NO: 156490 - RNA, 63 nt, hsa
uuacggacuucccggccgccacugggcccugccggucaccaggccacugugcagugggcgcag

SEQ ID NO: 156491 - RNA, 63 nt, hsa
auucucccaaacuaaugauucuugggugcugugggucaccaacaggcuguuuacaaagcagaa

SEQ ID NO: 156492 - RNA, 63 nt, hsa
cuucuuucucucuuuuucuuugaggagaaugauggucaccaccacaauuaauuguaauuaagg

SEQ ID NO: 156493 - RNA, 63 nt, hsa
uaagaugauugaagcuuuacugguuaaguauagggucaccagagaaaguuccuuuccccaguu

SEQ ID NO: 156494 - RNA, 63 nt, hsa
gugagggucacaaaggagaccuuggcucccucaggucaccaauaaaccuguucuuuaaucaag

SEQ ID NO: 156495 - RNA, 64 nt, hsa
ccccuaagaccacaguggccaagaucacaguggccacggccacggccacagucaugguggccac

SEQ ID NO: 156496 - RNA, 64 nt, hsa
agaccacaguggccaagaucacaguggccacggccacggccacagucaugguggccacggccac

SEQ ID NO: 156497 - RNA, 64 nt, hsa
caguggccacggccacggccacagucaugguggccacggccacagccacuaaucaggaggccag

SEQ ID NO: 156498 - RNA, 64 nt, hsa
cuccaggccgaccagcacuugggaucugaugggacacggccagugccuaggggugccaagucca

SEQ ID NO: 156499 - RNA, 64 nt, hsa
gccccaggcaggcuagaggaggcacaggcccugccacggccaacucaggucagccagccugagg

SEQ ID NO: 156500 - RNA, 64 nt, hsa
cucaccuucagcuccugcaccgacaucaggaacccacggccaccaccuccuccccucaaggcau

SEQ ID NO: 156501 - RNA, 64 nt, hsa
cacaaagucaucaacuggaaaaaaagcaaaaacccacggccaaaauaaauugguacuguuuguu

SEQ ID NO: 156502 - RNA, 64 nt, hsa
agcaggcccugucaccgacgggucaccucgcccacacggccagcaccgacucaccacagcccuu

SEQ ID NO: 156503 - RNA, 64 nt, hsa
ccuuucuguccgugggcagcccaguccccacagucacggccaagccacgcagaacgaacaugac

SEQ ID NO: 156504 - RNA, 64 nt, hsa
cacgcacacacgcacacacacacacguacacacacauacaaaaucccucugcaguuuuggggag

SEQ ID NO: 156505 - RNA, 64 nt, hsa
ucuuugggacugauucucaguggagggcuuagaucauacaaaaaucuuuauuggguccgugugu

SEQ ID NO: 156506 - RNA, 64 nt, hsa
aagccgccugacgaucuaauuguaaaaaguaaagcauacaaauacuagaagaaaauggaggaaa

SEQ ID NO: 156507 - RNA, 64 nt, hsa
uguauugacaggauuccaauaauuaagaauacuucauacaaaaagaaauguaaaugaccuuuaa

SEQ ID NO: 156508 - RNA, 64 nt, hsa
acaaacaguugcuaccaaagauucuucaaauaaacauacaaauaaauguguauauuuaauguuu

SEQ ID NO: 156509 - RNA, 64 nt, hsa
ccuuaaagauuggaguauuuuauaauucaaggagcauacaaaacaaugguugggaacauaugcc

SEQ ID NO: 156510 - RNA, 64 nt, hsa
cuguacuucuacauacaaauguacuguacuucuacauacaaauguuauguuaaagaauuacuuc

SEQ ID NO: 156511 - RNA, 64 nt, hsa
uuguaaauucuuaucucuguauacuguacuucuacauacaaauguacuguacuucuacauacaa

SEQ ID NO: 156512 - RNA, 64 nt, hsa
aacacacacagagauaucuauacauauauacauacauacaaacauaggcuaucuuggcacacua

SEQ ID NO: 156513 - RNA, 64 nt, hsa
cuucaccagcucuucagguucaaagcagacccagcauacaaacaagagcugagccaccuuugcu

SEQ ID NO: 156514 - RNA, 64 nt, hsa
auugacaaaagcaaaguaaucuuacaacuaugugcauacaaaagcaauacuauuuugugacuaa

SEQ ID NO: 156515 - RNA, 64 nt, hsa
ccuguugaaaaaaacugguucuccaccccucccccauacaaaauccacaacaaagcgcaguggu

SEQ ID NO: 156516 - RNA, 64 nt, hsa
uaaaucuacccaaugagacuuuucagccuuuguacauacaaaauucuuccaaaagagagaggag

SEQ ID NO: 156517 - RNA, 64 nt, hsa
uacucacaaacacacacacaagcacuugcacauacauacaaacacaugcaaacauaccuacaca

SEQ ID NO: 156518 - RNA, 64 nt, hsa
gguaugguuguuuuuguuuuccucccucuccucuggcugcuacaacuuccccuuucugguacaa

SEQ ID NO: 156519 - RNA, 64 nt, hsa
aacucaagcaggcauuuuuuuuuucuuaccgaaaggcugcuauugugcaagggcacauaauggg

SEQ ID NO: 156520 - RNA, 64 nt, hsa
uuugccuuagcacaggguuucuguagggagugggggcugcuagaggggauuaguuccggagacu

SEQ ID NO: 156521 - RNA, 64 nt, hsa
cuggaggaacucugguugcagggcuaaacuuagaggcugcuagaguguagugguuaagaacagg

SEQ ID NO: 156522 - RNA, 64 nt, hsa
caggggaaaagagaguuaaggacacucacccccacccacgcacacacacaaggcagcgucgggu

SEQ ID NO: 156523 - RNA, 64 nt, hsa
gccggcaucaccugcggccacaccugagauggaccccacgcagcccugaucgcaggaggccugg

SEQ ID NO: 156524 - RNA, 64 nt, hsa; identical to SEQ ID NO: 123292

SEQ ID NO: 156525 - RNA, 64 nt, hsa; identical to SEQ ID NO: 123293

SEQ ID NO: 156526 - RNA, 64 nt, hsa; identical to SEQ ID NO: 123294

SEQ ID NO: 156527 - RNA, 64 nt, hsa; identical to SEQ ID NO: 123295

SEQ ID NO: 156528 - RNA, 64 nt, hsa; identical to SEQ ID NO: 123296

SEQ ID NO: 156529 - RNA, 64 nt, hsa; identical to SEQ ID NO: 123297

SEQ ID NO: 156530 - RNA, 64 nt, hsa; identical to SEQ ID NO: 123298

SEQ ID NO: 156531 - RNA, 64 nt, hsa; identical to SEQ ID NO: 123299

SEQ ID NO: 156532 - RNA, 64 nt, hsa; identical to SEQ ID NO: 123300

SEQ ID NO: 156533 - RNA, 64 nt, hsa; identical to SEQ ID NO: 123301

SEQ ID NO: 156534 - RNA, 64 nt, hsa; identical to SEQ ID NO: 123302

SEQ ID NO: 156535 - RNA, 64 nt, hsa; identical to SEQ ID NO: 123303

SEQ ID NO: 156536 - RNA, 64 nt, hsa; identical to SEQ ID NO: 123304

SEQ ID NO: 156537 - RNA, 64 nt, hsa; identical to SEQ ID NO: 123305

SEQ ID NO: 156538 - RNA, 64 nt, hsa; identical to SEQ ID NO: 123306

SEQ ID NO: 156539 - RNA, 64 nt, hsa; identical to SEQ ID NO: 123307

SEQ ID NO: 156540 - RNA, 64 nt, hsa
agaucccacugagaaaauccacccuggcaucugggcuccugaucagcugauggagcuccugauu

SEQ ID NO: 156541 - RNA, 64 nt, hsa
acccuggcaucugggcuccugaucagcugauggagcuccugauuugacaaaggagcuugccucc

SEQ ID NO: 156542 - RNA, 64 nt, hsa
agccagcucuaaacaacacacagagcacaaauaugcuccugacggacucaggaaaaugccaaca

SEQ ID NO: 156543 - RNA, 64 nt, hsa
gagaugccugguccgucuugggucugcccuccgugcuccugaccccugcugcccaagagagccu

SEQ ID NO: 156544 - RNA, 64 nt, hsa
uugagugucccaaaacacugaugccaugaugugggcuccugacuggccuccuuuuccuuugacu

SEQ ID NO: 156545 - RNA, 64 nt, hsa
uaagggacccugagccacagugaguuggucaaaugcuccugacaguguggagaaaccaacaggc

SEQ ID NO: 156546 - RNA, 64 nt, hsa
aaaaccgcucaacugcauggaaacaggacaagcugcuccugaaugaguacuggguacauaacga

SEQ ID NO: 156547 - RNA, 64 nt, hsa
ucgguuucuugaugucuuuugguucuccuugccugcuccugaugcuuggaccccuuuuauugau

SEQ ID NO: 156548 - RNA, 64 nt, hsa
uauuaaaauagaaacagggauugauuaaugucccgcuccugaauacauguaaaauuuguacaaa

SEQ ID NO: 156549 - RNA, 64 nt, hsa
cucuggacgaggccuccuuccucagguuccuccugcuccugaccucccagugugauguccgggu

SEQ ID NO: 156550 - RNA, 64 nt, hsa
cagugaacuauuccucagugggaucgguucuucagcuccugaugggggcuguguaaugggggca

SEQ ID NO: 156551 - RNA, 64 nt, hsa
gagauuuugucaccaccaggccugcccuaaaagagcuccugaaggaagcacuaaacauggaaag

SEQ ID NO: 156552 - RNA, 64 nt, hsa
aaaaccgcucaacuacuuggaaacugaacaaccugcuccugaaugacuacuggguacauaacga

SEQ ID NO: 156553 - RNA, 64 nt, hsa
ggugcccaagggaccugaagugaagcuccccaaggcuccugaggucaagcuuccaaaagugccc

SEQ ID NO: 156554 - RNA, 64 nt, hsa
cuuugggcuuucccucuuggagccccggcccgcugcuccugaaguuguagagagcaagcugaag

SEQ ID NO: 156555 - RNA, 64 nt, hsa
uggaguccauucuucuuuagggcaguauaugaaauccuagcagauguaaaauggaaaagaaucc

SEQ ID NO: 156556 - RNA, 64 nt, hsa
augcaauauacugugaugccuuccuacucaagccuccuagcauucaaacuuccauccuauuagu

SEQ ID NO: 156557 - RNA, 64 nt, hsa
cacugaccuagacauguccagaugggagucccauuccuagcagacaagcugagcaccguuguaa

SEQ ID NO: 156558 - RNA, 64 nt, hsa
uguuuaggccgguugcgguggcucaugccuguaauccuagcacuuugggaggcugaggugggug

SEQ ID NO: 156559 - RNA, 64 nt, hsa
uuggauuaggagaacagguguuccuccuccccucuccuagcagcccuaaugucugaccuagccu

SEQ ID NO: 156560 - RNA, 64 nt, hsa
aaagguaacuucucccuucuccugaccuacuuccuccuagcaaccaacuuuaccucuucuucuc

SEQ ID NO: 156561 - RNA, 64 nt, hsa
uauucuggcugggcacaguggcucacaccuguaauccuagcacuuugggaggccaaggcaggug

SEQ ID NO: 156562 - RNA, 64 nt, hsa
acuucaggcugggcacaguggcucaugccugaaauccuagcacuuugggaagacaaugugggag

SEQ ID NO: 156563 - RNA, 64 nt, hsa
ugugauccuuggaauuauccuagcaacaacauuguccuagcaaccauaucccaagagccauuua

SEQ ID NO: 156564 - RNA, 64 nt, hsa
uguguaauuguuuugcuugugauccuuggaauuauccuagcaacaacauuguccuagcaaccau

SEQ ID NO: 156565 - RNA, 64 nt, hsa
gacaguugcuggguguaguggcucaugccuguaauccuagcaacucggggcugaggugggagga

SEQ ID NO: 156566 - RNA, 64 nt, hsa
aaugcaggcugggcgcgguggcucacgccuguaauccuagcacuuugggaggccgaggcaggug

SEQ ID NO: 156567 - RNA, 64 nt, hsa
ugaggacggguacuccagcuccaggccuggagaggcuucccagcaacaccugcaguccagcccc

SEQ ID NO: 156568 - RNA, 64 nt, hsa
agggcaggggucagaggcccaggcccugacuucggcuucccagagaucucuccgccuuaguuaa

SEQ ID NO: 156569 - RNA, 64 nt, hsa
aacuccugaccucaggcgauccacccccaccucggcuucccaaagugcugagauuacaggugug

SEQ ID NO: 156570 - RNA, 64 nt, hsa
gggagucaaagaaacugagccuggggcaaacgaggcuucccacacugccaggggagccucacug

SEQ ID NO: 156571 - RNA, 64 nt, hsa
uaggaucauaggaaaggggcccuauuuuccugcugcuucccagcucagaacauauacugaaugg

SEQ ID NO: 156572 - RNA, 64 nt, hsa
cuuucagggacaggaaucuauugcucauacuucugcuucccagaguuuugccaaucuaaaggca

SEQ ID NO: 156573 - RNA, 64 nt, hsa
ggucucuccgccuucaccuagcaaugggaacccugcuucccaggggaggaaccaacugcuccac

SEQ ID NO: 156574 - RNA, 64 nt, hsa
cugaugcugcugcugccuuugcaaggacuacugggcuucccaagaaacucaagagccuccguac

SEQ ID NO: 156575 - RNA, 64 nt, hsa
cucgaucuccugaccucacgauuugcccgccucggcuucccagagugcugggauuacaggcgug

SEQ ID NO: 156576 - RNA, 64 nt, hsa
caaacuccuggggucaaaugauccgccugcgucggcuucccagagugcugggauuacagguguc

SEQ ID NO: 156577 - RNA, 64 nt, hsa
gggcugcuuugagcaaugacgcuggcccagagcagcuucccacaugaccccagagccgaggguc

SEQ ID NO: 156578 - RNA, 64 nt, hsa
cuuagcuuucuaggccacugggaguuguggcugggcuucccaucuuccacagagacaucucccu

SEQ ID NO: 156579 - RNA, 64 nt, hsa
ugugaaaguggcugguugggagcagagcuaaguggcuucccauuaaccugaggucucuuucuuu

SEQ ID NO: 156580 - RNA, 64 nt, hsa
uguucuggcgugaguugugaaagaguugaagacagcuucccaugccgguacacagccaguagcc

SEQ ID NO: 156581 - RNA, 64 nt, hsa
uaugugauucuggaagcaaauggcaaaaccaguagcuucccaaaaacagccccccugcugcugc

SEQ ID NO: 156582 - RNA, 64 nt, hsa
caccagcccaguggccggggucagcuuaggcucugcuucccaguggacgggugugcuaaggguu

SEQ ID NO: 156583 - RNA, 64 nt, hsa
uucuccaagucacuuacaucauagauaaauuuuagcuucccaguaacugagggauuuguuuccu

SEQ ID NO: 156584 - RNA, 64 nt, hsa
uuuuugcuuugcuaguuaaagcuuacuuugcagagcuucccaaagugaaagggaaacugaacuu

SEQ ID NO: 156585 - RNA, 64 nt, hsa
aaaggaaaacugaaacccaguccuucaagcaucagcuucccaucuaaagaugcacguuagauga

SEQ ID NO: 156586 - RNA, 64 nt, hsa
auuccccucaccccagcccaagacgugggaggcugcuucccaguaagaauccaggagcaagcuu

SEQ ID NO: 156587 - RNA, 64 nt, hsa
uuaccugggggaaccucacccagcacccugccccgcuucccagggcuggccaagagagaagacu

SEQ ID NO: 156588 - RNA, 64 nt, hsa
cuggggcauauaaaaucucugcuguauccuuucggcuucccaguugagcucccaagaccaggac

SEQ ID NO: 156589 - RNA, 64 nt, hsa
gagggggccugcccuucucugcuguguccuuucggcuucccaguugagcucccaagaccaggac

SEQ ID NO: 156590 - RNA, 64 nt, hsa
ccuuuuuuauuuuucuuuucacucucuuucuaaugcuucccaccuuaccuuuuagauucuuuug

SEQ ID NO: 156591 - RNA, 64 nt, hsa
uuucacuggggagagaacagggagugcuccuccagcuucccaaagaaauauguuuuuguaagug

SEQ ID NO: 156592 - RNA, 64 nt, hsa
cccccugugccagagcacagccucaccggaugcugcuucccacacugaaguguccuguccgacc

SEQ ID NO: 156593 - RNA, 64 nt, hsa
cagaaacagaaagacagcaguggccagguggagagcuucccaagcugugccgauuagagccagc

SEQ ID NO: 156594 - RNA, 64 nt, hsa
ucugcccaggaggcaggggaaaaaucuccuuucugcuucccagagagggucuggccuugcccaa

SEQ ID NO: 156595 - RNA, 64 nt, hsa
cccuucaagaugccauuuggaggguaggggaucugcuucccacugugacugggcuaugggauuc

SEQ ID NO: 156596 - RNA, 64 nt, hsa
aguuaacaugggaccuucuguuuagcuuccucuugcuucccaaagauuuuaagcauuuuguaaa

SEQ ID NO: 156597 - RNA, 64 nt, hsa
gaggaggccgcuucaucccagacucucuucuagggcuucccaccaucagccccucccacuugag

SEQ ID NO: 156598 - RNA, 64 nt, hsa
augucagggaaggggagggcucggguugacgguggcuucccacugagcaccagcauccaggugc

SEQ ID NO: 156599 - RNA, 64 nt, hsa
aucuuccagaagcccagcuccacccgcacacgcagcuucccauccaguccuucaacucaauucu

SEQ ID NO: 156600 - RNA, 64 nt, hsa
guccaggaggugggcgcccuccauccuucgagaagcuucccaggcuccucugcuucucugucuc

SEQ ID NO: 156601 - RNA, 64 nt, hsa
cuggcccuggagcugcagaagcagcuucugaggggcuucccaggccugcauuucacagaugggg

SEQ ID NO: 156602 - RNA, 64 nt, hsa
ggcggcccaggaggcugaagacaggugcacagaugcuucccacgaccuugccauuugggguggg

SEQ ID NO: 156603 - RNA, 64 nt, hsa
ccccaacaggucucucuuguuggccagagggccugcuucccaugggcauugcaagugccaccgu

SEQ ID NO: 156604 - RNA, 64 nt, hsa
uuccagcagcuggcaccugcagcacggagcuccggcuucccaaacccucaggauggcgccuuca

SEQ ID NO: 156605 - RNA, 64 nt, hsa
ugccucgcuuagauccaggacagagaggaaacaagcuucccacgggggaacaaggccuggauga

SEQ ID NO: 156606 - RNA, 64 nt, hsa
uucagguccaaauucaccuuccccuaaaccccaagcuucccaacagaucauaugguaggacccu

SEQ ID NO: 156607 - RNA, 64 nt, hsa
cauuacccuacagacagcuuacaggagccagccugcuucccacaacuacuagugugacuccuua

SEQ ID NO: 156608 - RNA, 64 nt, hsa
acaacugauccgugugugaggugggaguacugcaaccugacacaaugcucagaaacagaaucag

SEQ ID NO: 156609 - RNA, 64 nt, hsa
acgauggaucccaaagucagaugggaguacugcaaccugacacgaugcucagacacagaaggga

SEQ ID NO: 156610 - RNA, 64 nt, hsa
acaacggaucccaaagucaggugggaguacugcaaccugacaggaugcucagacaagaauaggg

SEQ ID NO: 156611 - RNA, 64 nt, hsa
gagaaauacaagaugagccugaaucaucucauguaccugacaguaagaaaauacucuggcuggu

SEQ ID NO: 156612 - RNA, 64 nt, hsa
ggacauuggagugggcaaagauuucuuguguaauaccugacaaacaggcaaccaaagcaaaagu

SEQ ID NO: 156613 - RNA, 64 nt, hsa
cuuuuuagggcgugugcagggcuggggccaguggaccugacaguaccuuaccuggcucugagaa

SEQ ID NO: 156614 - RNA, 64 nt, hsa
uguaauggcuuauggggaacauugugagcuuccuaccugacauguuggcagaaguagaauauua

SEQ ID NO: 156615 - RNA, 64 nt, hsa
ucccucagccucccaaguagcugggauuacaggcacccacgagcaugcccggcuaauuuuuugu

SEQ ID NO: 156616 - RNA, 64 nt, hsa
acuaaaaaggggaggaaggcagaccuccugggagacccacgaaggguuuuuagccagggaaaac

SEQ ID NO: 156617 - RNA, 64 nt, hsa
gagaaagcacuuugaaauuuauuacuagcuugcuacccacgaugaaaucaacaaccuguaucug

SEQ ID NO: 156618 - RNA, 64 nt, hsa
aaaucacauacauacauuuaaaaaaaaaacaacaacccacgaggagucugaggcugugaauagu

SEQ ID NO: 156619 - RNA, 64 nt, hsa
ugucaccuccaaugacuagggugggcaaccacaaacccacgagggcagagugcugcuugcugcu

SEQ ID NO: 156620 - RNA, 64 nt, hsa
guauuuuugaauaauuaccaagcagccgaagaccacccacgaaugguuaucuuacgacuguuac

SEQ ID NO: 156621 - RNA, 64 nt, hsa
uggguaugaagaugcuucagagcucaugcgcguuacccacgauggcaugacuagcacagagcug

SEQ ID NO: 156622 - RNA, 64 nt, hsa
caggccaagguucaauuauuucagcgcagguaucacccacgagaaauuuuuccagaguuucaca

SEQ ID NO: 156623 - RNA, 64 nt, hsa
auaucauugucagaccauuuuugcugcuguggucacccacgauuucauuugucuuauacccagg

SEQ ID NO: 156624 - RNA, 64 nt, hsa
aaauggugaggcgaggggcuugagaggaacgcccacccacgaaggcccagggcgccagacggcc

SEQ ID NO: 156625 - RNA, 64 nt, hsa
uauuaguguggguauggcuaaugaguucugauucacccacgaagguuacauuuaugcugaauac

SEQ ID NO: 156626 - RNA, 64 nt, hsa
agcaugggugcccccagaaguaagcagcucuuggacccacgagcagggcugcgucgguuugugg

SEQ ID NO: 156627 - RNA, 64 nt, hsa
auggaguucuucaugucugucaagccuugaggacacccacgaauggcaaaucuccacgcuagac

SEQ ID NO: 156628 - RNA, 64 nt, hsa
auaaucagaucaaacaccugcuccuuauugccauacccacgaacuguuaaauauaaaaaaauuc

SEQ ID NO: 156629 - RNA, 64 nt, hsa
gugacugaaacauucacacagggcucuuugauggacccacgaacgcucuuagcuuucucagggg

SEQ ID NO: 156630 - RNA, 64 nt, hsa
guuuuucuggcauuuucuguuccagguuucuuccacccacgagcacuuuauucuccuccgagac

SEQ ID NO: 156631 - RNA, 64 nt, hsa
aguuacauuccucuccacaaugaggcuaaaugucacccacgaaagaacuuuauucccuuauauu

SEQ ID NO: 156632 - RNA, 64 nt, hsa
agggacaugggaagaccacgggaccucuuucacuacccacgaugaccuccggggguauccuggg

SEQ ID NO: 156633 - RNA, 64 nt, hsa
gcccccgugauucaauuaccucccacuuggucccacccacgacacgugggaauugugggagcua

SEQ ID NO: 156634 - RNA, 64 nt, hsa
augcccacggccuccuccuguagcuccugccugcacccacgaugcugcacgggcccgcccuggu

SEQ ID NO: 156635 - RNA, 64 nt, hsa
gcaggcuuggggagcuuuaagccucaguuauauaacccacgaaaaacagagccuccuagaugua

SEQ ID NO: 156636 - RNA, 58 nt, hsa
ugaggucauuuguacccuaggcccacgaacccacgagaauguccucugacuuccagcc

SEQ ID NO: 156637 - RNA, 64 nt, hsa
augaaacguguaucguaaaauguauuuuuauuuuacccacgagaauguuguuauuuuuagcaaa

SEQ ID NO: 156638 - RNA, 64 nt, hsa
cuggcucccccagcucaccguggugcuguccuugacccacgagcuguugagaagggugcagagc

SEQ ID NO: 156639 - RNA, 64 nt, hsa
accagugcuuccuucgucagcagcgccuccccagacccacgaggauacucacacugcacgccug

SEQ ID NO: 156640 - RNA, 64 nt, hsa
gagggaaagggagggaugaccuucccagggagaaacccacgaccuguccugucuuugaucgccu

SEQ ID NO: 156641 - RNA, 64 nt, hsa
uggcccauugccccuggcacuccuugcagaggccacccacgaucuucuuugggcuuccauuucc

SEQ ID NO: 156642 - RNA, 64 nt, hsa
aguucuccagaaucccaggcgaugacaagucugaacccacgaaaauacccagcgcagcaucuac

SEQ ID NO: 156643 - RNA, 64 nt, hsa
cggaccccccucgaagcccccuggacugauucccacccacgacucacaggcauuccucccacag

SEQ ID NO: 156644 - RNA, 64 nt, hsa
ggacugauucccaggaagaaaagcccaaagggaaacccacgauuccuuucgaguagauguggga

SEQ ID NO: 156645 - RNA, 64 nt, hsa
aaguggcuuccaauuuuuggccaugaggaagagaacccacgaacauuccuggacuugucuuuug

SEQ ID NO: 156646 - RNA, 64 nt, hsa
auggcccugccugagcccgggccggccucgggccacccacgagggccucccggccuagggcccg

SEQ ID NO: 156647 - RNA, 64 nt, hsa
cggcugccagcccugaggccaagcacggcuggagacccacgaccuggccugccguugcccugag

SEQ ID NO: 156648 - RNA, 64 nt, hsa
cuagguucccggucccgaguacagucuguaucaaacccacgauuuucuccagcucagaacccag

SEQ ID NO: 156649 - RNA, 64 nt, hsa
ggaauauaaggggguagugggaaaagugguacuaacccacgauucugagcccugaguaugccug

SEQ ID NO: 156650 - RNA, 64 nt, hsa
gcgccuucgggacgccggggacucugcggcggcgacccacgagcucgcggcccgcgcccggcuc

SEQ ID NO: 156651 - RNA, 64 nt, hsa
ucaucuguuucucguguccgccugguugaggaggacccacgagugcugccgagguguggagggc

SEQ ID NO: 156652 - RNA, 64 nt, hsa
ucauguguccagagaucuuggaaaauauuuuuucacccacgauuuauuuuguuauugaugauuu

SEQ ID NO: 156653 - RNA, 64 nt, hsa
uggaggugcccuaccugcauccugcugcacccccacccacgacacucgagugcaagaucgccuc

SEQ ID NO: 156654 - RNA, 64 nt, hsa
cuuugaguacuaccggggcuucacacucuuccagacccacgaaaaccgagagcaccuggugaug

SEQ ID NO: 156655 - RNA, 64 nt, hsa
ccucuacaccuucugccaccaccugcaccugccuacccacgacaaggagacagaggagcuggua

SEQ ID NO: 156656 - RNA, 64 nt, hsa
gguuguuucuguuucugaguggaccaacagcagaacccacgaggauuuguuuugaguauggagc

SEQ ID NO: 156657 - RNA, 64 nt, hsa
gaaagcaggacgcagagaagaacaaaugaggcucacccacgaggcuggguggccagcagucugg

SEQ ID NO: 156658 - RNA, 64 nt, hsa
ucccugaaagacugaagaaaguguagugcaugggacccacgaaacugcccuggcuccagugaaa

SEQ ID NO: 156659 - RNA, 64 nt, hsa
gaggacacaguggagcccacgagcacgagcuggaacccacgaggauggccuggaacccauguca

SEQ ID NO: 156660 - RNA, 64 nt, hsa
cucccccccagcacaacccccccaaaacaacccaacccacgaggaccaucgggggcagagucgu

SEQ ID NO: 156661 - RNA, 64 nt, hsa
ccccacauccccucagaacgcugcgcccagccacacccacgaucaaguuacacagcuuuauugg

SEQ ID NO: 156662 - RNA, 64 nt, hsa
aagugccuuccaagcuucccccaagauccacaucacccacgacccugccacuguuuuugcugug

SEQ ID NO: 156663 - RNA, 54 nt, hsa
ccagccagcaguccaaguagcuggacccacgaggaggaaccaggcuacuuuccc

SEQ ID NO: 156664 - RNA, 64 nt, hsa
ucuuggaacuuuaacuccugccagcccuucuaagacccacgagcggggugagagaagugugcaa

SEQ ID NO: 156665 - RNA, 64 nt, hsa
uagguagggacacguguccacgcaccacagacacacccacgacaccugaucucguaucacuagc

SEQ ID NO: 156666 - RNA, 64 nt, hsa
uccugccuccacgcccacccagcgucgacccuugacccacgaagugcguagcaugcaguauuua

SEQ ID NO: 156667 - RNA, 64 nt, hsa
ggcccggcccggaacuuuucuccccaacccccaaacccacgacucacuuccacaccgucuuccc

SEQ ID NO: 156668 - RNA, 64 nt, hsa
uggaugccgcgagggacggacacacguccggggcacccacgaggagggcccccagccugggaga

SEQ ID NO: 156669 - RNA, 64 nt, hsa
uagucuguaguuaaugucaacaguuaauuuaugaacccacgaucguuccacacugcaccaaagu

SEQ ID NO: 156670 - RNA, 64 nt, hsa
gguguuauuauacaaaauaauuuuuaaucugcagacccacgaaaagggucucagggacuccucc

SEQ ID NO: 156671 - RNA, 64 nt, hsa
gccucccgaagugccaagagugcagccucugcccggccgccaccccgucugggaagugaggagc

SEQ ID NO: 156672 - RNA, 64 nt, hsa
ugcccagucuggaaagugaggagcgucucugcccggccgccaucccaucuaggaagugaggagc

SEQ ID NO: 156673 - RNA, 64 nt, hsa
ccccuuccccaggcccaccaucaccaccgccucuggccgccacccccaucuuccaccugugccc

SEQ ID NO: 156674 - RNA, 64 nt, hsa
cacuuauuguccaggugaggcccaagagcccuguggccgccaccugaggugggcuggggcugcu

SEQ ID NO: 156675 - RNA, 64 nt, hsa
gccucccaaagugccgagauugcagccucugcccggccgccaccccgucuggaaagugaggagc

SEQ ID NO: 156676 - RNA, 64 nt, hsa
caccccgucuggaaagugaggagcgccucugcccggccgccaucccaucuaggaagugaggagc

SEQ ID NO: 156677 - RNA, 64 nt, hsa
ggccuugccacuccagugaaagcuguucuucucuuagacacaauuucuucaucuggacgagcag

SEQ ID NO: 156678 - RNA, 64 nt, hsa
uaugucuaaaaauuacuuuacacaugugccuacauagacacaccaagaaguggauguauauaau

SEQ ID NO: 156679 - RNA, 64 nt, hsa
uuucaaauuaaaacaaaaaaaucaacgacagcaguagacacaggcaccacauuccuuugcaggg

SEQ ID NO: 156680 - RNA, 64 nt, hsa
cauacacacacacuccaauccauccaugcauacauagacacaagacacacacgcucaaaccccu

SEQ ID NO: 156681 - RNA, 64 nt, hsa
auuuagagccauuuuuacuaugcuagacacauaauagacacaugcuuugaugagcuugggcuac

SEQ ID NO: 156682 - RNA, 64 nt, hsa
auuuauaugcaauuuagagccauuuuuacuaugcuagacacauaauagacacaugcuuugauga

SEQ ID NO: 156683 - RNA, 64 nt, hsa
ggccucuugcucugaagccaucccccaucuucccuagacacagcagacaucugagaaagcuuca

SEQ ID NO: 156684 - RNA, 64 nt, hsa
ggacacucauccacuguuggagaugcucaacagcuagacacagaugcucacagccgaccugugg

SEQ ID NO: 156685 - RNA, 64 nt, hsa
ccuaggaaaaaauuaucaccuucaaagauaggcauagacacauaauuaugcuuaagcuuuuaac

SEQ ID NO: 156686 - RNA, 64 nt, hsa
ggaguucugagagcuuaagagcuaaacaugaguuuagacacacaagauucuaaaaugcaaaugu

SEQ ID NO: 156687 - RNA, 64 nt, hsa
uuucucuuuucuaguuugcucauacuacauugaguagacacauuuaaggaugggguuaugaacc

SEQ ID NO: 156688 - RNA, 64 nt, hsa
cuuuuaccagcuuuuaaccaucugauaucuauaguagacacacuaucauaguuaacauaguaag

SEQ ID NO: 156689 - RNA, 64 nt, hsa
caagguaguuauaugcuggagaagaaaaauccucuagacacaugaaggcccacauagucaaguc

SEQ ID NO: 156690 - RNA, 64 nt, hsa
ggauaaaauaguucagaguucauagucauauucauagacacagaaucaagcuuuuaacauauac

SEQ ID NO: 156691 - RNA, 64 nt, hsa
cagacggccgaagaagucuuaggcagggcgcccugggcugcaggccugcccgaggcugggaugg

SEQ ID NO: 156692 - RNA, 64 nt, hsa
gcuggcuguguccauggccagguggccagggucagggcugcaagccagggguccagggcccuuc

SEQ ID NO: 156693 - RNA, 64 nt, hsa
ucuuccuucagcccaccucaggauccgggcuugagggcugcagggccugcgugcgcucccuccc

SEQ ID NO: 156694 - RNA, 64 nt, hsa
caguguggugugaacucagaagaaacgguuacuggggcugcauggagaauuucaccugcgguga

SEQ ID NO: 156695 - RNA, 64 nt, hsa
cuuucuugcaucuacaccccagggcccugugguggggcugcagggggaagcugugcaccugaga

SEQ ID NO: 156696 - RNA, 64 nt, hsa
aauguuccauaugggagccccaaaggaacuggaugggcugcagugaggugggggcgggugggca

SEQ ID NO: 156697 - RNA, 64 nt, hsa
ucuagcuuccagggcagggagcaggccccaccuagggcugcaggcagucuggccugugccagca

SEQ ID NO: 156698 - RNA, 64 nt, hsa
ggucaggguucgugugcuccuccuccugcugcaggggcugcacaucccauugccccacuucugc

SEQ ID NO: 156699 - RNA, 64 nt, hsa
aaucccaaugaauaguccuaggcuggacagcaaugggcugcaauuaggcagauaaagacaucag

SEQ ID NO: 156700 - RNA, 64 nt, hsa
uucccccgagugcauggcuuggagagcagaaugugggcugcauauaagcacacucaucccuuug

SEQ ID NO: 156701 - RNA, 64 nt, hsa
cuuuauaauuccuucugccuaacuuguaaaaagggggcugcauucuuguugguagcauguacuc

SEQ ID NO: 156702 - RNA, 64 nt, hsa
auccaacccaaggaccuuuuggaaugacuggggagggcugcagucacauugauguaaggacugu

SEQ ID NO: 156703 - RNA, 64 nt, hsa
gugcaaggcagggguggaggggagggaccagcccgggcugcaccagugggaguggcuccacccu

SEQ ID NO: 156704 - RNA, 64 nt, hsa
gagucacccagccaaaggaggagauggcucagcggggcugcaccaaggggccaagaggcccuac

SEQ ID NO: 156705 - RNA, 64 nt, hsa
ucagacacagcugaguccgacaaccauugggguggggcugcaucagucuccggaguggcccgcc

SEQ ID NO: 156706 - RNA, 64 nt, hsa
cuggaggggcccacgguugggccaagggcagagggggcugcaccugcgggccugggaagcauug

SEQ ID NO: 156707 - RNA, 64 nt, hsa
aguagcuacgacugcaagcaccugccaccauaaagggcugcauuuugccaccauaaagggcugc

SEQ ID NO: 156708 - RNA, 64 nt, hsa
gccaccauaaagggcugcauuuugccaccauaaagggcugcauuuuuuuaaaaagccuaggcag

SEQ ID NO: 156709 - RNA, 64 nt, hsa
gagaugagaugcucuuggacuccccacugcaucugggcugcagggccagagcuagucugaccau

SEQ ID NO: 156710 - RNA, 64 nt, hsa
uucuguuaggagcuacuccugggaaccccucucagggcugcagcuuacaggugggcagcuguga

SEQ ID NO: 156711 - RNA, 64 nt, hsa
aaggcaggcuccuguggcucugcuggcucagugugggcugcaggaggacugcagacucagcugc

SEQ ID NO: 156712 - RNA, 64 nt, hsa
uuaguuuuuaaugucaguggcgacucgguuccuggggcugcagccagccugggacuuuuguaag

SEQ ID NO: 156713 - RNA, 64 nt, hsa
gcuggggcgacagauagcacauaggcuguuucuggggcugcaggggcuucccugagcuggaugu

SEQ ID NO: 156714 - RNA, 64 nt, hsa
cgcccuugucagcuuagggggagcccaguccugagggcugcaucucuguuguaggcccagccac

SEQ ID NO: 156715 - RNA, 64 nt, hsa
gccccagguggcgccauucucucacgcaaggauggggcugcagggugagcagcgugggcugcag

SEQ ID NO: 156716 - RNA, 64 nt, hsa
ucacgcaaggauggggcugcagggugagcagcgugggcugcagugugucagucccaggagugag

SEQ ID NO: 156717 - RNA, 64 nt, hsa
ugaggucugagagggccccgggcugcacuggugugggcugcacaggcacagacgcagacggccc

SEQ ID NO: 156718 - RNA, 64 nt, hsa
ugggcacgcguguggugaggucugagagggccccgggcugcacuggugugggcugcacaggcac

SEQ ID NO: 156719 - RNA, 64 nt, hsa
uucugucuccagggccugaucuuuaccacugcaggggcugcaggccguuaaguggacaggaagu

SEQ ID NO: 156720 - RNA, 64 nt, hsa
gccgccugcugcaucagugggugacccccuucccgggcugcacuuuggguccagcuguggaagc

SEQ ID NO: 156721 - RNA, 64 nt, hsa
gcagacuuacaaaauagaacugccuacugauuccgggcugcaacaacagaaggcugccuucuga

SEQ ID NO: 156722 - RNA, 64 nt, hsa
ugagcacgcugccauguacugguuugagcaguaggggcugcaucgcacagcgcucgucccccgg

SEQ ID NO: 156723 - RNA, 64 nt, hsa
cggggcaagccaaguacgaagcagcagccaucgcgggcugcaucaucccccagccaggucccca

SEQ ID NO: 156724 - RNA, 50 nt, hsa
gccugggcauccggugguaggggcugcaggaccaggacucccaggaggcc

SEQ ID NO: 156725 - RNA, 64 nt, hsa
gcacccccucccggggcagcaggcgugggagucagggcugcaugcuccuccccucccaccucac

SEQ ID NO: 156726 - RNA, 64 nt, hsa
gccuccagugugggccggcuccugcaggguccgagggcugcaucucuaccagccagcccagggc

SEQ ID NO: 156727 - RNA, 64 nt, hsa
ggggccaggccucgcacuugcagaggagcccagugggcugcacgcuccccuccauccccaucgg

SEQ ID NO: 156728 - RNA, 64 nt, hsa
gccaucccccucucacgccacccccgcccccaccgggcugcaggugcugcugaugcgcugggau

SEQ ID NO: 156729 - RNA, 64 nt, hsa
ugccgggucggcucugguccacagcacggugccggggcugcagguuguugagggcugugacucc

SEQ ID NO: 156730 - RNA, 64 nt, hsa
cgguggccugggagcugcuuucuccccacuggcugggcugcaucuggcccuggcuggaggccuu

SEQ ID NO: 156731 - RNA, 64 nt, hsa
uggagggggaggcugaccaagggccccgcagggcgggcugcaacuuuucuguugauccuggaau

SEQ ID NO: 156732 - RNA, 64 nt, hsa
aguggcugagggagccaggaggccggggggccgggggcugcaggggaggcuguggggguccugg

SEQ ID NO: 156733 - RNA, 64 nt, hsa
cgaagcucccucccggugcuggggggcagcugaggggcugcaggggcagucucccuccuccaag

SEQ ID NO: 156734 - RNA, 64 nt, hsa
gagcuuuucacuuuaugcaaaauggcuccugugagggcugcaagcuggaggguggugcaggccu

SEQ ID NO: 156735 - RNA, 64 nt, hsa
cugauccaaagcagccuguugagcugguucuccagggcugcagucucuccagguguacagcugc

SEQ ID NO: 156736 - RNA, 64 nt, hsa
aucagcaaagcauuuggcuuuguccugcccaagugggcugcagacugagugcugcccuuguagc

SEQ ID NO: 156737 - RNA, 64 nt, hsa
gaggggagagcugcccggugcagacccaggacgagggcugcacuugguguggccguguccugag

SEQ ID NO: 156738 - RNA, 64 nt, hsa
gucgggggcaaggggcucagccccacuggacucugggcugcagaggccaccccccagguggggg

SEQ ID NO: 156739 - RNA, 64 nt, hsa; identical to SEQ ID NO: 153164

SEQ ID NO: 156740 - RNA, 64 nt, hsa; identical to SEQ ID NO: 153165

SEQ ID NO: 156741 - RNA, 64 nt, hsa; identical to SEQ ID NO: 153166

SEQ ID NO: 156742 - RNA, 64 nt, hsa; identical to SEQ ID NO: 153167

SEQ ID NO: 156743 - RNA, 63 nt, hsa; identical to SEQ ID NO: 153168

SEQ ID NO: 156744 - RNA, 64 nt, hsa; identical to SEQ ID NO: 153169

SEQ ID NO: 156745 - RNA, 64 nt, hsa; identical to SEQ ID NO: 153170

SEQ ID NO: 156746 - RNA, 64 nt, hsa; identical to SEQ ID NO: 153171

SEQ ID NO: 156747 - RNA, 64 nt, hsa; identical to SEQ ID NO: 153172

SEQ ID NO: 156748 - RNA, 64 nt, hsa; identical to SEQ ID NO: 153173

SEQ ID NO: 156749 - RNA, 64 nt, hsa; identical to SEQ ID NO: 153174

SEQ ID NO: 156750 - RNA, 64 nt, hsa; identical to SEQ ID NO: 153175

SEQ ID NO: 156751 - RNA, 64 nt, hsa; identical to SEQ ID NO: 153176

SEQ ID NO: 156752 - RNA, 64 nt, hsa; identical to SEQ ID NO: 153177

SEQ ID NO: 156753 - RNA, 64 nt, hsa; identical to SEQ ID NO: 153178

SEQ ID NO: 156754 - RNA, 64 nt, hsa; identical to SEQ ID NO: 153179

SEQ ID NO: 156755 - RNA, 64 nt, hsa; identical to SEQ ID NO: 153180

SEQ ID NO: 156756 - RNA, 64 nt, hsa; identical to SEQ ID NO: 153181

SEQ ID NO: 156757 - RNA, 64 nt, hsa; identical to SEQ ID NO: 153182

SEQ ID NO: 156758 - RNA, 64 nt, hsa; identical to SEQ ID NO: 153183

SEQ ID NO: 156759 - RNA, 64 nt, hsa; identical to SEQ ID NO: 153184

SEQ ID NO: 156760 - RNA, 64 nt, hsa; identical to SEQ ID NO: 153185

SEQ ID NO: 156761 - RNA, 64 nt, hsa; identical to SEQ ID NO: 153186

SEQ ID NO: 156762 - RNA, 64 nt, hsa; identical to SEQ ID NO: 153187

SEQ ID NO: 156763 - RNA, 64 nt, hsa; identical to SEQ ID NO: 153188

SEQ ID NO: 156764 - RNA, 64 nt, hsa; identical to SEQ ID NO: 153189

SEQ ID NO: 156765 - RNA, 64 nt, hsa; identical to SEQ ID NO: 153190

SEQ ID NO: 156766 - RNA, 64 nt, hsa; identical to SEQ ID NO: 153191

SEQ ID NO: 156767 - RNA, 64 nt, hsa
cugacucuccacaaaccacuguuaaaacuuaccugcuaggaaugcuagauugaaugggauggga

SEQ ID NO: 156768 - RNA, 64 nt, hsa
gcuaaaguucuuauggaaaaauacacacgcaauagcuaggaaaacacagggaaagaagaguucu

SEQ ID NO: 156769 - RNA, 64 nt, hsa
cuaucuucaucugagagaggcuaaaauguuuucagcuaggaacaaaucuuccuggucgaaaguu

SEQ ID NO: 156770 - RNA, 64 nt, hsa
caauccuuacaaaugauugcuuuuaaaauuuuaagcuaggaaaagaaaucuauagaaaguguuc

SEQ ID NO: 156771 - RNA, 64 nt, hsa
agaugcuuucagugaugcucucuauacucauaaauaagcaaauguggcaggcuuugcuuucugg

SEQ ID NO: 156772 - RNA, 64 nt, hsa
accuuuauguauuuucuuaaagcacgccuuuaaauaagcaaaaacuuuaaaaggcaggaaagag

SEQ ID NO: 156773 - RNA, 64 nt, hsa
cucagauaaacuuuuaggaccucauauuaagagcuaagcaaauggccacauuuccuauauuuug

SEQ ID NO: 156774 - RNA, 64 nt, hsa
uuuacaggcaagauuuuuuuuuucauugcucccauaagcaaauuuguuuuaaaauaauuguaaa

SEQ ID NO: 156775 - RNA, 64 nt, hsa
cuugugcuuucuguauuuaaaacuuuggcuguacuaagcaaaugcaagguuauaauuuagcuaa

SEQ ID NO: 156776 - RNA, 64 nt, hsa
ugaauaacaaaugaaugcuuauugcugcaugauguaagcaaaagucauuauuuuuccuauucau

SEQ ID NO: 156777 - RNA, 64 nt, hsa
cuagagauuuucuuggcaguauuccaugggauguuaagcaaaggaaaccaaaggaaucguuuca

SEQ ID NO: 156778 - RNA, 64 nt, hsa
uugugcugagaauagugucugauuauacgacuuuuaagcaaaguuggguguaauuaggugaaaa

SEQ ID NO: 156779 - RNA, 64 nt, hsa
uuuuuauuccuggcauccagagugacagugaacuuaagcaaauuacccuccuacccaauucuau

SEQ ID NO: 156780 - RNA, 64 nt, hsa
aaauuuuagauugugaauauuuuguaaaaaacaguaagcaaaauuuuccagaauucccaaaaug

SEQ ID NO: 156781 - RNA, 64 nt, hsa
uggugacuuugcuucacuacagguuaaaagaccauaagcaaacugguuauuuaaaauguaaaaa

SEQ ID NO: 156782 - RNA, 64 nt, hsa
aaaaugauaaaagcuaagaugccuucuaacuucauaagcaaaccuuuaacuaauuauguaucug

SEQ ID NO: 156783 - RNA, 64 nt, hsa
gccaggugcugcaccuggggacugugaccgacuuuaagcaaaccgucaacaaagguaagagaaa

SEQ ID NO: 156784 - RNA, 64 nt, hsa
aauuuaaaauguaauuccagaaaaaaaaagggaauaagcaaagggggaagaauugaaagagaga

SEQ ID NO: 156785 - RNA, 64 nt, hsa
acugaaaguuuuuauccaacaauuauguucauuuuaagcaaaauuuuaagaaaguuuugaaauu

SEQ ID NO: 156786 - RNA, 64 nt, hsa
gaaauguugaguaaggugacauuuugagcgcuaauaagcaaaagagcaugcagugcuguugaau

SEQ ID NO: 156787 - RNA, 64 nt, hsa
agccugcugagaugaagaaaucacuucaugaaaauaagcaaagaccacacauuuuuuacuacaa

SEQ ID NO: 156788 - RNA, 64 nt, hsa
uguucagaugaugcuauuaaagaaauguguguacuaagcaaaaauauauaaauagugacaaaua

SEQ ID NO: 156789 - RNA, 64 nt, hsa
acuuguaaaccacaucuuuuuugcacuuuuuuuauaagcaaaaacgugccguuuaaaccacugg

SEQ ID NO: 156790 - RNA, 64 nt, hsa
aaaacaucuuuguacauuuaagucuguauuauaauaagcaaaaagauuguguguauguauguuu

SEQ ID NO: 156791 - RNA, 64 nt, hsa
uuuguaaaacucguuuguuuucaaaggucuggacuaagcaaaacaacagugucaguuuaggaaa

SEQ ID NO: 156792 - RNA, 64 nt, hsa
ugaaugcucccccaacauuccuuugguuuuccuauaagcaaaaccaaauaccacuauaaauaca

SEQ ID NO: 156793 - RNA, 64 nt, hsa
gaaaucacggacaguaguuucaguucugaugguauaagcaaaacaaauaaaacguuuauaaaag

SEQ ID NO: 156794 - RNA, 64 nt, hsa
ucauucugacuucauggagaauuaaucccaccuuuaagcaaaggcuacuaaguuaaugguauuu

SEQ ID NO: 156795 - RNA, 64 nt, hsa
ccaagcaauugcugcaucuuaguagggugagggauaagcaaaagaggauguucaccauaaccca

SEQ ID NO: 156796 - RNA, 64 nt, hsa
aaaaaaacucauggugaggcuuaacaaugucuuguaagcaaaagguagagcccuguaucaaccc

SEQ ID NO: 156797 - RNA, 64 nt, hsa
agaaaagguuauguucauuuuucaaaaagggaaguaagcaaacaaauauugccaacucuucuau

SEQ ID NO: 156798 - RNA, 64 nt, hsa
uaaaacucaacauuacuguuaacugugcguuaaauaagcaaauaaacaguggcucauaaaaaua

SEQ ID NO: 156799 - RNA, 64 nt, hsa
uguuuguuuguuugcaauacacucagugcagccuuaagcaaaugagaucauuuucagauuucau

SEQ ID NO: 156800 - RNA, 64 nt, hsa
aacucuuuccaaccguagcaggguuguuuucuguuaagcaaagccgagauccagugcaauaccu

SEQ ID NO: 156801 - RNA, 64 nt, hsa
cuaaaguggcuauaguuacugauuuuuuauuauguaagcaaaaccaauaaaaauuuaaguuuuu

SEQ ID NO: 156802 - RNA, 64 nt, hsa
gcuuugugcguuccugccuaauuuuuauaucuucuaagcaaagugccuuaggauagcuugggau

SEQ ID NO: 156803 - RNA, 64 nt, hsa
cucuucuucuuuuuuguucaugggacaugguaccuaagcaaauaggaguuggguuugguuuuuc

SEQ ID NO: 156804 - RNA, 64 nt, hsa
ccuuuuuguguuuagagaauuaugggaaaccugguaagcaaaacuuuccucccagauaauugcu

SEQ ID NO: 156805 - RNA, 64 nt, hsa
acccacuggaugaaaaucuaggacuguauggaaguaagcaaacauuacauuuuuagguggaaau

SEQ ID NO: 156806 - RNA, 64 nt, hsa
aggauuagagaaaucuacaaauguaugucauaaauaagcaaauuuguaaacuuuucugaacuuu

SEQ ID NO: 156807 - RNA, 64 nt, hsa
uugcauauccaaaccuuagugaguuuugaagcuuuaagcaaauucuuuuaaaaaauucuuguau

SEQ ID NO: 156808 - RNA, 64 nt, hsa
ucuuguauuucuagcauuacuagauauuaaaaguuaagcaaauagauuaaugacguauacauag

SEQ ID NO: 156809 - RNA, 64 nt, hsa
uuugagcucauuugcaaacccgagucugccugggaacccgcacugugccuggguguauucuuua

SEQ ID NO: 156810 - RNA, 64 nt, hsa
acccguuuguucucagauaaaaagcaguuuuauaaacccgcaaucugcuccagauucaagcagu

SEQ ID NO: 156811 - RNA, 64 nt, hsa
gaccagagcagccaggcuggggccccucugucucaacccgcagacccuugacugaaugagagag

SEQ ID NO: 156812 - RNA, 64 nt, hsa
aauauucuuuguuuaaaugaaagcauacuguugaaacccgcaguguugcauuuagaaaacaguu

SEQ ID NO: 156813 - RNA, 64 nt, hsa
aacguauuuccuucguggaaaggauuuagauuguaacccgcacacaaaagcacgguguuuguga

SEQ ID NO: 156814 - RNA, 64 nt, hsa
auauauauacauauauauauauauauauguaugaaacccgcauggaauuaucuguaugaaauca

SEQ ID NO: 156815 - RNA, 64 nt, hsa
auauuucaaagccuugaacuaagacucaauuaccaacccgcaguuuugugucagugcccaaagg

SEQ ID NO: 156816 - RNA, 64 nt, hsa
ccugcaggagcaggucaacccccaccggaccuacaacccgcagucccacaucaucucaggcggg

SEQ ID NO: 156817 - RNA, 64 nt, hsa
gcuggagccggucaucucccgcgcggugcuggacaacccgcaccgugagucuggcucagcagcc

SEQ ID NO: 156818 - RNA, 64 nt, hsa
acacauuuccuguucauaaguuugggauuuacauaacccgcaaccaccauguuccuuuguauau

SEQ ID NO: 156819 - RNA, 64 nt, hsa
caugucaugcacgugaugcauuucacugggcuguaacccgcaggggcacagguaucuuuggcaa

SEQ ID NO: 156820 - RNA, 64 nt, hsa
acccgggugcuuuguggccagcagcacagaaucaaacccgcaucccagcauugggccacccauc

SEQ ID NO: 156821 - RNA, 64 nt, hsa
cuucuuguucucuccuccaaaaguagcuuccuccaacccgcagccucucugcacacuaauaaaa

SEQ ID NO: 156822 - RNA, 64 nt, hsa
uauguaaauaccaagagcaauuuaccugguacuaaacccgcaccccagugcggacccuucccag

SEQ ID NO: 156823 - RNA, 64 nt, hsa
cccgggccggcggguuucucuaacaaauaaacagaacccgcacugcccaggcgagcguugccac

SEQ ID NO: 156824 - RNA, 64 nt, hsa
uuaaguugaagcccuuacugguguaccgcucagaaacccgcaaggcucugaaggguucuugaag

SEQ ID NO: 156825 - RNA, 64 nt, hsa
uugccucccaggccccuuguggacuuagacucaaaacccgcaggagaaacagguccgacucagu

SEQ ID NO: 156826 - RNA, 64 nt, hsa
acgacugugcuguagcuucccuugcagcugcaauaacccgcaggucuucacugagguggaggcu

SEQ ID NO: 156827 - RNA, 64 nt, hsa
accuucccugcugggucucuggggcacagugugaaacccgcacccuagccaggccccagggagc

SEQ ID NO: 156828 - RNA, 64 nt, hsa
ugcaggcugggcucagggacaaagucccccccaaaacccgcagguccucauguccagacgcugc

SEQ ID NO: 156829 - RNA, 64 nt, hsa
gucacgcccccugaggaccucaggaggccagcagaacccgcaggcuccugaagacuggccacgc

SEQ ID NO: 156830 - RNA, 64 nt, hsa
ugggguucaggaugcugcagucugugcaauaauaaacccgcaucugcucacgggcucuggcugg

SEQ ID NO: 156831 - RNA, 64 nt, hsa
cagaacuccugcccacccuaccccgagggaggcgaacccgcacuuccaggcuugggaggaccau

SEQ ID NO: 156832 - RNA, 64 nt, hsa
gcccagggcuccaggaucagggauauuacuucucaacccgcacuucuccucuacugaacccacu

SEQ ID NO: 156833 - RNA, 64 nt, hsa
aggccuggaucacuuuaggaucaauauuuugacacgggagaaggcagcucagaaaggauuaagg

SEQ ID NO: 156834 - RNA, 64 nt, hsa
cugcuccauacauuggguguauauuuauucugaacgggagaaguuauauuguuaaaaguguaaa

SEQ ID NO: 156835 - RNA, 64 nt, hsa
cggguaccguaauccuagcuacucgggagacugacgggagaaucgcuugaacccaggaggcgga

SEQ ID NO: 156836 - RNA, 64 nt, hsa
gugccuguaaucucagcuacucaguaggcuggagcgggagaacugcuugaaccugggaggugga

SEQ ID NO: 156837 - RNA, 64 nt, hsa
ggaaagaaaccaggaacguggaggguuauuacugcgggagaagggacacgaggauggcuuugcu

SEQ ID NO: 156838 - RNA, 64 nt, hsa
cgcgccuauaaucccagcuacugggaggcugaggcgggagaaucgcuugagccggggaggcgga

SEQ ID NO: 156839 - RNA, 64 nt, hsa
cuuguauauuccccacaaagccguucgcagcuuccgggagaaggggccagagcccgguggggcc

SEQ ID NO: 156840 - RNA, 64 nt, hsa
uuugagaagugcugcuguaauuccccuuaaaggacgggagaaagggccccggccaucuugcagc

SEQ ID NO: 156841 - RNA, 64 nt, hsa
augccuguaaucccaacauucugggaggcccaggcgggagaacugcuugagcccaggaguucag

SEQ ID NO: 156842 - RNA, 64 nt, hsa
guuagcacacucagcgcugugagucgugaagacacgggagaaaauccaccauaauaaaacugac

SEQ ID NO: 156843 - RNA, 64 nt, hsa
gaaccauugggaccugaggcaggagugucaccugcgggagaagucugcccgcugcccucuguca

SEQ ID NO: 156844 - RNA, 64 nt, hsa
ccauccucagugagaacaccagagaacccggggccgggagaaggugguucuucaagccgagagg

SEQ ID NO: 156845 - RNA, 64 nt, hsa
cuaguuccaaguuuuaaauacauggaaggaaguccgggagaaccauaugaaggagcaggaggag

SEQ ID NO: 156846 - RNA, 64 nt, hsa
ccagcuacccugcugcaggaccacgguggacccacgggagaagcuggaggugcuggagaggaca

SEQ ID NO: 156847 - RNA, 64 nt, hsa
gcuggggccccugcaaccucggggagugccacuucgggagaagaaggcaacccaaaugguggcc

SEQ ID NO: 156848 - RNA, 64 nt, hsa
ugggggugaaucccaaugagggucccucucagagcgggagaacgccagagcccuggauggugau

SEQ ID NO: 156849 - RNA, 64 nt, hsa
auuuuuaaauauaaggauuuuccuagauauugcacgggagaauauacaaauagcaaaauugagg

SEQ ID NO: 156850 - RNA, 64 nt, hsa
gggucgcguggaucuacccucuaguuuacuugcucgggagaagaaacugacucguuuuauuuag

SEQ ID NO: 156851 - RNA, 64 nt, hsa
gucccucccucuugaguuggcucugauuugaaaucgggagaaacagagcugcugccaaugggau

SEQ ID NO: 156852 - RNA, 64 nt, hsa
gcaccuguagucccagcuacucaggaggcugaggcgggagaauggcaugaacccgggaggugga

SEQ ID NO: 156853 - RNA, 64 nt, hsa
gugccuguaaucccagcuacuggggaggcugaggcgggagaaucgcuugaacccaggaggugga

SEQ ID NO: 156854 - RNA, 64 nt, hsa
agggaggcugagugaggccacgcagccgccugcccgggagaacccugccugaagcucuggaaac

SEQ ID NO: 156855 - RNA, 64 nt, hsa
uuaauuaggcaauuuaugucugugauaauucuuacgggagaaagaggauuugauuggaaagcag

SEQ ID NO: 156856 - RNA, 64 nt, hsa
ggggaugugagugggaggaaaggggucuguaaagcgggagaacaaggcuagccucccccuaaca

SEQ ID NO: 156857 - RNA, 64 nt, hsa
uauuguccagugaauucaagaccaaauacaauaucgggagaaaauacaaacucccuguguuuaa

SEQ ID NO: 156858 - RNA, 64 nt, hsa
uguguuccuacaauuggcccagcacccuggggcacgggagaaggguggggaccguugcugucac

SEQ ID NO: 156859 - RNA, 64 nt, hsa
gugccuguaaucccagcuacuugggaggcugaggcgggagaaucgcuugaaccagggagucaga

SEQ ID NO: 156860 - RNA, 64 nt, hsa
aggccuguaaucccagcuccuugggaggcugaggcgggagaauugcuugaacccggggacggag

SEQ ID NO: 156861 - RNA, 64 nt, hsa
gaaacauccgggacccucagacacuguuguuuuucgggagaaaaaaccaaaggaggugauggga

SEQ ID NO: 156862 - RNA, 64 nt, hsa
cucagggucucacaccuugggguugucagguucccgggagaaggcggugaggacucggccaaac

SEQ ID NO: 156863 - RNA, 64 nt, hsa
agugagcaaacaucgcugaguuuguuuucuuguucgggagaauggggccggggcuggccuggcc

SEQ ID NO: 156864 - RNA, 64 nt, hsa
uaauuuuuaugaaauacugcgugugauaagcaaacgggagaaauuuauaucagauucuuggcug

SEQ ID NO: 156865 - RNA, 64 nt, hsa
ccaggacucacccuccacaaagcaaaggcagucccgggagaaaagacggauggcaggauccaag

SEQ ID NO: 156866 - RNA, 64 nt, hsa
cauggccacucugcccucuggaccugucuuucaucgggagaaaccacucagagauggaucccau

SEQ ID NO: 156867 - RNA, 64 nt, hsa
cagugggcagguggccgccccugaggcuucacgccgggagaagccaccuucccaccccuucaua

SEQ ID NO: 156868 - RNA, 64 nt, hsa
uuuuuuuuuuuuuucuggcggugagccagagggucgggagaaacgcugcucgccccacaccccg

SEQ ID NO: 156869 - RNA, 64 nt, hsa
cugguuucuaagacaaccgugggaaccacugugacgggagaaaccgcuugugcuucgcgcaugc

SEQ ID NO: 156870 - RNA, 64 nt, hsa
cuguuacucacagaaguguuucuggugggcucugcgggagaagacacuaagggccccacaggcu

SEQ ID NO: 156871 - RNA, 64 nt, hsa
auguuaguaauggcagagcagucuaaacagaguccgggagaaugcuggcaaaggcuggcugugu

SEQ ID NO: 156872 - RNA, 64 nt, hsa
cagggggccucucugccuccagccccaccuuccccgggagaagcuuuccccaauccccaggucu

SEQ ID NO: 156873 - RNA, 64 nt, hsa
cccacugcaggcaaaccgugacgcccuccccacucgggagaagcagagcugaccuuaggaccga

SEQ ID NO: 156874 - RNA, 64 nt, hsa
ccuguccuggggcuguugagcagcauaauaaucccgggagaaugauuccccucauagaaagaca

SEQ ID NO: 156875 - RNA, 64 nt, hsa
guggcuguagucgcagcuacucaggaggcugaggcgggagaauggcgugaacccaggagacgga

SEQ ID NO: 156876 - RNA, 63 nt, hsa
ugaggcagucuccaccuugauggagaggccaggcgggagaacuaccgcagcaggugggcguac

SEQ ID NO: 156877 - RNA, 64 nt, hsa
ccagcaccugcaggaccaagugcagaggcucaugcgggagaagcugacggacuggaaggacuuc

SEQ ID NO: 156878 - RNA, 64 nt, hsa
gcuuuaaaagcgaccucucuugagguaggagaggcgggagaacugaaguuuccgcccccgcccc

SEQ ID NO: 156879 - RNA, 64 nt, hsa
ccggcagcugcuggcugaaguucaggcccugagccgggagaacagggagcuccuggagcgcagc

SEQ ID NO: 156880 - RNA, 64 nt, hsa
uuuucccacaccgaucaagucaacucaguacucacgggagaaaaauagacuuuauuuacaagua

SEQ ID NO: 156881 - RNA, 64 nt, hsa
cauuucucacugccuucugucugcccaguuucaccgggagaagucggccucuuccugaugggca

SEQ ID NO: 156882 - RNA, 64 nt, hsa
aguccucuacugcaugaagaaaagacucuacuaucgggagaagaaauauaaauauguggaagau

SEQ ID NO: 156883 - RNA, 64 nt, hsa
ccggaccacguugcugcccaggucuggaccucagcgggagaacuggcuccggggggaguggggc

SEQ ID NO: 156884 - RNA, 64 nt, hsa
ggugauuaaagauacggagucccuguucaaaacccgggagaaggaguaucaggagaccauugac

SEQ ID NO: 156885 - RNA, 64 nt, hsa
gcgccuguaaucccagcuacuugggaagcugaggcgggagaaucaugugaacccgggacgcagg

SEQ ID NO: 156886 - RNA, 52 nt, hsa
caagaagcaggaggagguaaugcgggagaagcagcuggcucaggaagccaag

SEQ ID NO: 156887 - RNA, 64 nt, hsa
acgcuuguagucccaacuaccugggaggcugaggcgggagaaucaccugagccugggaggucga

SEQ ID NO: 156888 - RNA, 64 nt, hsa
aaaguaggaucccagugcauuaggcagccagucucgggagaaggggaacuugugccccagaaag

SEQ ID NO: 156889 - RNA, 64 nt, hsa
caguuuugaucccaaaagcuuuuuuguuacaaaucgggagaaaaauccauuuuaguucuaugga

SEQ ID NO: 156890 - RNA, 64 nt, hsa
cucgccagggcacggagccgucaguccacuguuacgggagaauguugauuucgcgggugcgagg

SEQ ID NO: 156891 - RNA, 64 nt, hsa
aaaaaaagcaaaaagcaagggagaaaagagaaaccgggagaaggcaugagaaagaauuugagac

SEQ ID NO: 156892 - RNA, 64 nt, hsa
gauccacaccuggucugaggggcaacugagucugcgggagaagagcggcccuaugcauggugua

SEQ ID NO: 156893 - RNA, 64 nt, hsa
ugcagggagagggcaggcggcugcugcuguugcacgggagaacuuuccucacccgccccugccc

SEQ ID NO: 156894 - RNA, 64 nt, hsa
auccucugcuguaacugcagggucacaggcaucccgggagaaugggccuccacccucagccagc

SEQ ID NO: 156895 - RNA, 64 nt, hsa
accagagccagaggucagugcugaagacguggaccgggagaaugaguacauaagcaggcuggcu

SEQ ID NO: 156896 - RNA, 64 nt, hsa
auguugaaugaauccacguucuggaaccccgaggcgggagaaguagggagcuguucguuuaagc

SEQ ID NO: 156897 - RNA, 64 nt, hsa
caugauguuuggaugcuagacuaguugcaucugacgggagaaguuuguguuguaccagcgcaug

SEQ ID NO: 156898 - RNA, 64 nt, hsa
agcagcaguguaccagugucacucuggaguacagcgggagaaacacaaaauaguauaacugaaa

SEQ ID NO: 156899 - RNA, 64 nt, hsa
gcgggaucccgagggccuuccugcccacaugccccgggagaaaccgaggccccucccuccuccu

SEQ ID NO: 156900 - RNA, 64 nt, hsa
ugcugcuccuuugcuucggaccuccgccucugcccgggagaaagcccaggccagccugcuggac

SEQ ID NO: 156901 - RNA, 64 nt, hsa
gacuucccgccggcagcugugcgcaccaaagacucgggagaacuggaaaggcugucuggggucu

SEQ ID NO: 156902 - RNA, 64 nt, hsa
guguuucagccacacugaacccaauuacacacagcgggagaacgcaguaaacagcuuucccaca

SEQ ID NO: 156903 - RNA, 64 nt, hsa
cugucucaaauaaauaaauaugagauaaugcagucgggagaagggagggagagaauuuuauuaa

SEQ ID NO: 156904 - RNA, 64 nt, hsa
cuauauuguacagggcugggggggcccuuggcugcgggagaaggcccagagcccuggaggagcc

SEQ ID NO: 156905 - RNA, 64 nt, hsa
ccugccuggcacccacgcuggcucucuccugccgcgggagaaagcaccagcagguucugagccc

SEQ ID NO: 156906 - RNA, 64 nt, hsa
cuccaccaugucagucuaaagagucuaaaggggccgggagaagcaugagcgaggggcagauucu

SEQ ID NO: 156907 - RNA, 64 nt, hsa
gugucuguaaucccagcuacucaggaggcugaggcgggagaaucacuugaaccugggaggcaga

SEQ ID NO: 156908 - RNA, 64 nt, hsa
cagaagucagcgcaggaagagccugcuuuggacacgggagaaaagaagccauugcuaacuacuu

SEQ ID NO: 156909 - RNA, 64 nt, hsa
gggccuguaaucccagcuacucgggaggcugaugcgggagaaucacuugaaacccacaggcgga

SEQ ID NO: 156910 - RNA, 64 nt, hsa
augccuguaaucccagcuacuugggagccugaggcgggagaauugcuugaacccgggaggcaga

SEQ ID NO: 156911 - RNA, 64 nt, hsa
aaagggaggugacuucgcccgguggcaauaguuccgggagaauuggccauugguaaaaagacuu

SEQ ID NO: 156912 - RNA, 59 nt, hsa
uagaugagaaauccuuuuaguggaagcaacgggagaagcuuucuguugucccacuuccu

SEQ ID NO: 156913 - RNA, 64 nt, hsa
gagggcugcccccaccacacacacccccgcgucucgggagaaacccacccucuucagagccugc

SEQ ID NO: 156914 - RNA, 50 nt, hsa
gacaccagaggacacacugacgggagaaaccuguguaugcaggggucaug

SEQ ID NO: 156915 - RNA, 64 nt, hsa
ccacuucaaaugacaaguucauauauagaauuuacgggagaaacuugagaccauuuacggggag

SEQ ID NO: 156916 - RNA, 64 nt, hsa
ccugagugcaaagugugccagaacugcaaacaaucgggagaagauagcaagaugcuagugugug

SEQ ID NO: 156917 - RNA, 64 nt, hsa
ccugguccucugcguuguagugcuaccucaaucucgggagaaacagcccuauauucuaacaagu

SEQ ID NO: 156918 - RNA, 64 nt, hsa
aagaccagguuugcugggcauaagcuucacaggacgggagaaccugcccaugguggacugucgu

SEQ ID NO: 156919 - RNA, 64 nt, hsa
acgcucuacuucguaaaagcauuauacaaagucacgggagaaaaauaugggacauuucuugauu

SEQ ID NO: 156920 - RNA, 64 nt, hsa
gcugccacggucccuccugucauucucacgacuccgggagaaacugugcuguaugauacagauc

SEQ ID NO: 156921 - RNA, 64 nt, hsa
cagcggcccgcccucuguucucagaggugaggggcgggagaagguugucuccucuggggccagc

SEQ ID NO: 156922 - RNA, 64 nt, hsa
auucuacuccaagagauucugccucccuuguguccgggagaacaucaaugcuuuuccucaggaa

SEQ ID NO: 156923 - RNA, 64 nt, hsa
ucuucuuuucaucucagucauaacccaaaagcuacgggagaaaaagcagaaguguaaucucugu

SEQ ID NO: 156924 - RNA, 64 nt, hsa
ccugagccgguuuaagucuguggaaaaggaagcacgggagaaauccacguaaccuuugcuuucu

SEQ ID NO: 156925 - RNA, 64 nt, hsa; identical to SEQ ID NO: 24398

SEQ ID NO: 156926 - RNA, 64 nt, hsa; identical to SEQ ID NO: 24399

SEQ ID NO: 156927 - RNA, 64 nt, hsa; identical to SEQ ID NO: 24400

SEQ ID NO: 156928 - RNA, 64 nt, hsa; identical to SEQ ID NO: 24401

SEQ ID NO: 156929 - RNA, 64 nt, hsa; identical to SEQ ID NO: 24402

SEQ ID NO: 156930 - RNA, 64 nt, hsa; identical to SEQ ID NO: 24403

SEQ ID NO: 156931 - RNA, 64 nt, hsa; identical to SEQ ID NO: 24404

SEQ ID NO: 156932 - RNA, 64 nt, hsa; identical to SEQ ID NO: 24405

SEQ ID NO: 156933 - RNA, 64 nt, hsa; identical to SEQ ID NO: 24406

SEQ ID NO: 156934 - RNA, 64 nt, hsa; identical to SEQ ID NO: 24407

SEQ ID NO: 156935 - RNA, 64 nt, hsa; identical to SEQ ID NO: 24408

SEQ ID NO: 156936 - RNA, 64 nt, hsa; identical to SEQ ID NO: 24409

SEQ ID NO: 156937 - RNA, 64 nt, hsa; identical to SEQ ID NO: 24410

SEQ ID NO: 156938 - RNA, 64 nt, hsa; identical to SEQ ID NO: 24411

SEQ ID NO: 156939 - RNA, 64 nt, hsa; identical to SEQ ID NO: 24412

SEQ ID NO: 156940 - RNA, 64 nt, hsa; identical to SEQ ID NO: 24413

SEQ ID NO: 156941 - RNA, 64 nt, hsa; identical to SEQ ID NO: 24414

SEQ ID NO: 156942 - RNA, 64 nt, hsa; identical to SEQ ID NO: 24415

SEQ ID NO: 156943 - RNA, 64 nt, hsa; identical to SEQ ID NO: 24416

SEQ ID NO: 156944 - RNA, 64 nt, hsa; identical to SEQ ID NO: 24417

SEQ ID NO: 156945 - RNA, 64 nt, hsa
uggucuauuuagggacaaagaagguauaaaguccagagaugagaaaacugggucagcccucaga

SEQ ID NO: 156946 - RNA, 64 nt, hsa
agggcaagacucuuccauaagccugcuaaaaaacagagaugauaccucuuacaaacuuuaccuc

SEQ ID NO: 156947 - RNA, 64 nt, hsa
ucuuggucacugucauauuuugaaccaucucaucagagaugaauaauaucuuuuuaccagagag

SEQ ID NO: 156948 - RNA, 64 nt, hsa
gaucucuuacaaagaacaaugcggcacugaaggaagagaugauuccuuuacucaaaccugcagg

SEQ ID NO: 156949 - RNA, 64 nt, hsa
ccaauuuuagaaaaucaagcagguuagagaaaauagagaugaauuaggggacacugucuuaugg

SEQ ID NO: 156950 - RNA, 64 nt, hsa
gcuuuggcaguguuuugagaacuuaaguggcuaaagagaugagacaaacaugcaggucgcuacu

SEQ ID NO: 156951 - RNA, 64 nt, hsa
guagcuuuucacccucugucccagggaaucuaggagagaugaggcccgucagagucaagagaug

SEQ ID NO: 156952 - RNA, 64 nt, hsa
uuucauucuucacuuaggggaagugaaaucgcucagagaugagauccuuuaauugaaaacgaag

SEQ ID NO: 156953 - RNA, 64 nt, hsa
gaucauugguuggacacugugguuaugcagaagcagagaugaggaggcuggccccagagaugau

SEQ ID NO: 156954 - RNA, 64 nt, hsa
guuaugcagaagcagagaugaggaggcuggccccagagaugaucuugcccuuccuaacuaaagg

SEQ ID NO: 156955 - RNA, 64 nt, hsa
caucaagaagccagggccgugccuggagcacugcagagaugacuuuggagaaagcaaagcagug

SEQ ID NO: 156956 - RNA, 64 nt, hsa
ugaaccaguuuaaaaacgagguuuuauuuacuguagagaugaaugcaaaucagaaccaaugauc

SEQ ID NO: 156957 - RNA, 64 nt, hsa
cuuugaucuggaaacuaagacuagagaagucuuaagagaugacugcucaggugaguaaggcaga

SEQ ID NO: 156958 - RNA, 64 nt, hsa
aaaucagcaucauaagggaauguagccuuccaacagagaugaugcuguucguauguuaaucuca

SEQ ID NO: 156959 - RNA, 64 nt, hsa
agugcagccucacagugacuuucucagaggugacagagaugauggaugagcagcuggauuuucg

SEQ ID NO: 156960 - RNA, 64 nt, hsa
cgcuagggacuccuggggagcuggggggcgagggagagaugagcggaagguggagguggguagc

SEQ ID NO: 156961 - RNA, 64 nt, hsa
aguuuugauauuuucugaaagaggaacauguguuagagaugaagaaucuuccaaggcucaugca

SEQ ID NO: 156962 - RNA, 64 nt, hsa
ccgaagagauaaagcuuacuugacuuucaaauggagagaugaugaaaacccacucauucacucu

SEQ ID NO: 156963 - RNA, 64 nt, hsa
uuugccuuuuggguuuuuuguuuguuauuauagaagagaugacuucugcugauuuugcuuuaga

SEQ ID NO: 156964 - RNA, 64 nt, hsa
uuugugagcaaguucuauuuguucauugcuugccagagaugaacacagaauguucuguuucauu

SEQ ID NO: 156965 - RNA, 64 nt, hsa
gaaaucuggucuguuugcauuucuguuaugacagagagaugauguuugcauuucuguuaugaca

SEQ ID NO: 156966 - RNA, 64 nt, hsa
cagagagaugauguuugcauuucuguuaugacagagagaugaugaaaguaggcagggcuguguu

SEQ ID NO: 156967 - RNA, 64 nt, hsa
caccaugccuggcuuaauuuuuuguauuuuuaguagagaugagguuucaccauguuggccagac

SEQ ID NO: 156968 - RNA, 64 nt, hsa
ucuguuacaucacugugacuguggcuguguuauuagagaugaauucugaguuaaauuuguacuu

SEQ ID NO: 156969 - RNA, 64 nt, hsa
augagguaauacucccauuucacauauaauacugagagaugaguugcacaagauuauacacugu

SEQ ID NO: 156970 - RNA, 64 nt, hsa
cuguaaggaagugcuucuauaaauucuuagguuuagagaugauaccaucuggguaccuuugcuu

SEQ ID NO: 156971 - RNA, 64 nt, hsa
cauagacggggaugacucagcacuaccccucaacagagaugacuuugaugacucugccccucag

SEQ ID NO: 156972 - RNA, 64 nt, hsa
acuccgcacugccccucaacagggaugacucagcagagaugacucagcacugucccuuagcagg

SEQ ID NO: 156973 - RNA, 64 nt, hsa
acucagcaccgccccucaacaggcaugacucugcagagaugacucagcacugucccuuagcagg

SEQ ID NO: 156974 - RNA, 64 nt, hsa
acucagcaccgccccucaacaggcaugacucugcagagaugacuuaguacugccccucagcagg

SEQ ID NO: 156975 - RNA, 64 nt, hsa
acucagcaccgccccucaacaggcaugacucugcagagaugacucagcacugccccucagcagg

SEQ ID NO: 156976 - RNA, 64 nt, hsa
gggaguuaacuauaaauugcacaggguaccuuacagagaugauggaaauguccuaaaacuagau

SEQ ID NO: 156977 - RNA, 64 nt, hsa
caccacaccuggauaauuaaaaaauuauuucuguagagaugaagucucacuguguugcccagcc

SEQ ID NO: 156978 - RNA, 64 nt, hsa
gccaccaugccuggcuaauuuugguauuuuuaguagagaugagguuuugccauuuuggucaggc

SEQ ID NO: 156979 - RNA, 64 nt, hsa
uucgacuccccgaggugcagcugccaaaagucucagagaugaaacuccccaaggugccugaaau

SEQ ID NO: 156980 - RNA, 64 nt, hsa
ugcaccucccggaagugcagcucccgaaagucccagagaugaaacucccuaaaaugccugagau

SEQ ID NO: 156981 - RNA, 64 nt, hsa
ugcaccucccagaagugcagcuuccaaaagucccagagaugaagcucccugagaugaaacuccc

SEQ ID NO: 156982 - RNA, 64 nt, hsa
ugcggcuuccagaggugcagcugccgaaagugccagagaugaaagucccugagaugaagcuucc

SEQ ID NO: 156983 - RNA, 64 nt, hsa
ugcggcuuccagagguacagcugccgaaagugucagagaugaaacucccagaggugucagaggu

SEQ ID NO: 156984 - RNA, 64 nt, hsa
ugcggcuuccagagguagagcugcccaaagugucagagaugaaacucccaaaggugccagagau

SEQ ID NO: 156985 - RNA, 64 nt, hsa
uucgacucccagagguggagcuccccaaggugucagagaugaaacucccaaaggugccagagau

SEQ ID NO: 156986 - RNA, 64 nt, hsa
ucuauaugguuugugcauuuucucaacuaaaaauagagaugauaauccgaauucuccauauauu

SEQ ID NO: 156987 - RNA, 64 nt, hsa
uuccuguaaauauuucugugaaaacuaggagaacagagaugagauuugacaaaaaaaaauugaa

SEQ ID NO: 156988 - RNA, 64 nt, hsa
uaaaauuggggguaaggagggaaggaagagggaaagagaugacuaacuaaaaucauuuuuacag

SEQ ID NO: 156989 - RNA, 64 nt, hsa
aacaaagaaccugcucugaugacacuuagaggggagagaugaaagccaaacaaaugaauaaaca

SEQ ID NO: 156990 - RNA, 64 nt, hsa
agcuggaaagguaagacugaggucagaaaggugcagagaugaaaagauuuugaaggaccuuaug

SEQ ID NO: 156991 - RNA, 64 nt, hsa
acugcauugugaagaggaggaaaagugaaucacggagagagaaaggaaaggauagaaucacagg

SEQ ID NO: 156992 - RNA, 64 nt, hsa
auccaugucugugacacaggacggugggaagccugagagagagugaaauuaugugauacacuga

SEQ ID NO: 156993 - RNA, 64 nt, hsa
ccagcccacagugguggccucugccucuuuccuggagagagaaggacagugcacggagagguuu

SEQ ID NO: 156994 - RNA, 64 nt, hsa
ucugcccuaccugucuuuccugaguguuugaggggagagagagacccacaucuccccaaagaga

SEQ ID NO: 156995 - RNA, 64 nt, hsa
ugcccuaccugucuuuccugaguguuugaggggagagagagacccacaucuccccaaagagaug

SEQ ID NO: 156996 - RNA, 64 nt, hsa
cggcaggcucacugccaggccagccuccgagagggagagagagagagagaggacagcuugagcc

SEQ ID NO: 156997 - RNA, 64 nt, hsa
gcaggcucacugccaggccagccuccgagagggagagagagagagagaggacagcuugagccgg

SEQ ID NO: 156998 - RNA, 64 nt, hsa
aggcucacugccaggccagccuccgagagggagagagagagagagaggacagcuugagccgggc

SEQ ID NO: 156999 - RNA, 64 nt, hsa
gcucacugccaggccagccuccgagagggagagagagagagagaggacagcuugagccgggccc

SEQ ID NO: 157000 - RNA, 64 nt, hsa
ucacugccaggccagccuccgagagggagagagagagagagaggacagcuugagccgggccccu

SEQ ID NO: 157001 - RNA, 64 nt, hsa
gugagaucuuacagguaucaggcacaggcaggaagagagagagagagguucuggggaggaaggg

SEQ ID NO: 157002 - RNA, 64 nt, hsa
gagaucuuacagguaucaggcacaggcaggaagagagagagagagguucuggggaggaagggcc

SEQ ID NO: 157003 - RNA, 64 nt, hsa
gaucuuacagguaucaggcacaggcaggaagagagagagagagguucuggggaggaagggccag

SEQ ID NO: 157004 - RNA, 64 nt, hsa
gagagagagagagguucuggggaggaagggccaggagagagaucuagaaaguggguucacuaga

SEQ ID NO: 157005 - RNA, 64 nt, hsa
ucucccuuucccugucuggcuucucccuuaagaagagagagauacuuguagaauuggguggggg

SEQ ID NO: 157006 - RNA, 64 nt, hsa
cuguccuuccauuugggauauguuacauuagagugagagagagaauaaggagccuuucuuaugg

SEQ ID NO: 157007 - RNA, 64 nt, hsa
guccuuccauuugggauauguuacauuagagugagagagagaauaaggagccuuucuuauggaa

SEQ ID NO: 157008 - RNA, 64 nt, hsa
uagaugggaccucgaggcucgagcugaagcaggcgagagagaaacagcuacugcgugcgugcgc

SEQ ID NO: 157009 - RNA, 64 nt, hsa
ucucucugucgaagaaagaagcucugucaaguuagagagagacaauguguaggaaauguucuuu

SEQ ID NO: 157010 - RNA, 64 nt, hsa
aggaacucuccguccccccggggcccuccggagggagagagagaggaacugcuguuuaucucac

SEQ ID NO: 157011 - RNA, 64 nt, hsa
gaacucuccguccccccggggcccuccggagggagagagagaggaacugcuguuuaucucacuc

SEQ ID NO: 157012 - RNA, 64 nt, hsa
gcaaaagagcauguacaugggagugagagaaaaagagagagagagacagaguggcgggggcggg

SEQ ID NO: 157013 - RNA, 64 nt, hsa
aaaagagcauguacaugggagugagagaaaaagagagagagagacagaguggcgggggcgggga

SEQ ID NO: 157014 - RNA, 64 nt, hsa
aagagcauguacaugggagugagagaaaaagagagagagagacagaguggcgggggcggggagg

SEQ ID NO: 157015 - RNA, 64 nt, hsa
cagcaguuccuaaaugauucucacaagcaacccugagagagacagucuugugagggagaucugg

SEQ ID NO: 157016 - RNA, 64 nt, hsa
aaacaaacaaaaaacaauggaaaagaugaagcuggagagagaggaaccaguugccaagguagag

SEQ ID NO: 157017 - RNA, 64 nt, hsa
cauagcagcagccucagcagcugucuugguaaaggagagagagagacauggggccaguaauucc

SEQ ID NO: 157018 - RNA, 64 nt, hsa
uagcagcagccucagcagcugucuugguaaaggagagagagagacauggggccaguaauuccgg

SEQ ID NO: 157019 - RNA, 64 nt, hsa
gcagcagccucagcagcugucuugguaaaggagagagagagacauggggccaguaauuccgggg

SEQ ID NO: 157020 - RNA, 64 nt, hsa
gugugaaacugaggagucugcaauuuggaauauggagagagagacugauuugcugaauuuccuu

SEQ ID NO: 157021 - RNA, 64 nt, hsa
gugaaacugaggagucugcaauuuggaauauggagagagagacugauuugcugaauuuccuucu

SEQ ID NO: 157022 - RNA, 64 nt, hsa
uggagaaccacaaugcacauuagcauauuagucugagagagaacuuauaguaaggaaacucacu

SEQ ID NO: 157023 - RNA, 64 nt, hsa
guuuccuggaaacuuugacaagcuuuauuaaguugagagagagagaggggaaaaaaaaaagccu

SEQ ID NO: 157024 - RNA, 64 nt, hsa
uuccuggaaacuuugacaagcuuuauuaaguugagagagagagaggggaaaaaaaaaagccuuu

SEQ ID NO: 157025 - RNA, 64 nt, hsa
ccuggaaacuuugacaagcuuuauuaaguugagagagagagaggggaaaaaaaaaagccuuucg

SEQ ID NO: 157026 - RNA, 64 nt, hsa
guucggcggccgcggcugggcccugcaggagggagagagagacacagucauggcccccuuccuc

SEQ ID NO: 157027 - RNA, 64 nt, hsa
caguucggcggccgcggcugggcccugcaggagggagagagagacacagucauggcccccuucc

SEQ ID NO: 157028 - RNA, 64 nt, hsa
auaugaaauguccagaauaggcaaaucuguuugagagagagaaaguagaugaguacuugccuag

SEQ ID NO: 157029 - RNA, 64 nt, hsa
uuauaugaaauguccagaauaggcaaaucuguuugagagagagaaaguagaugaguacuugccu

SEQ ID NO: 157030 - RNA, 64 nt, hsa
caggguucuccccccuacacccucugcagguggagagagagaagcugggcccagccgggccgug

SEQ ID NO: 157031 - RNA, 64 nt, hsa
gccaggguucuccccccuacacccucugcagguggagagagagaagcugggcccagccgggccg

SEQ ID NO: 157032 - RNA, 64 nt, hsa
agagucucuagagguagaaauuugccuugcugcagagagagaaggaauggcgugggauggggga

SEQ ID NO: 157033 - RNA, 64 nt, hsa
gaagagacacaggucucccgucccugcaccagcugagagagacuugccgcaaagcacaaggcug

SEQ ID NO: 157034 - RNA, 64 nt, hsa
aaugaaauaaaaagaagagagggaggaagaaagggagagagaagaaaagaaaaaugaagaaaag

SEQ ID NO: 157035 - RNA, 64 nt, hsa
uucccuagggucugcuuuagagaagggggauaaagagagagaaggacuguuaugaaaaacagaa

SEQ ID NO: 157036 - RNA, 64 nt, hsa
uucugggacuccaggucuugaggagagagacagagagagagaauggauccucauaggucaggga

SEQ ID NO: 157037 - RNA, 64 nt, hsa
uguucugggacuccaggucuugaggagagagacagagagagagaauggauccucauaggucagg

SEQ ID NO: 157038 - RNA, 64 nt, hsa
uuuggagcacuguucugggacuccaggucuugaggagagagacagagagagagaauggauccuc

SEQ ID NO: 157039 - RNA, 64 nt, hsa
agggagagccccacaaaacuuuggggacaagggagagagagacucaucugacacuucuuuugga

SEQ ID NO: 157040 - RNA, 64 nt, hsa
aaagggagagccccacaaaacuuuggggacaagggagagagagacucaucugacacuucuuuug

SEQ ID NO: 157041 - RNA, 64 nt, hsa
gagagagacagaaagagagagagagagagagagagagagagauccucagaguggaaggaggggg

SEQ ID NO: 157042 - RNA, 64 nt, hsa
gagagagagacagaaagagagagagagagagagagagagagagauccucagaguggaaggaggg

SEQ ID NO: 157043 - RNA, 64 nt, hsa
gagagagagagacagaaagagagagagagagagagagagagagagauccucagaguggaaggag

SEQ ID NO: 157044 - RNA, 64 nt, hsa
cagagagagagagacagaaagagagagagagagagagagagagagagauccucagaguggaagg

SEQ ID NO: 157045 - RNA, 64 nt, hsa
agcagagagagagagacagaaagagagagagagagagagagagagagagauccucagaguggaa

SEQ ID NO: 157046 - RNA, 64 nt, hsa
guagcagagagagagagacagaaagagagagagagagagagagagagagagauccucagagugg

SEQ ID NO: 157047 - RNA, 64 nt, hsa
ggguagcagagagagagagacagaaagagagagagagagagagagagagagagauccucagagu

SEQ ID NO: 157048 - RNA, 64 nt, hsa
aaggguagcagagagagagagacagaaagagagagagagagagagagagagagagauccucaga

SEQ ID NO: 157049 - RNA, 64 nt, hsa
ggaaggguagcagagagagagagacagaaagagagagagagagagagagagagagagauccuca

SEQ ID NO: 157050 - RNA, 64 nt, hsa
ugggaaggguagcagagagagagagacagaaagagagagagagagagagagagagagagauccu

SEQ ID NO: 157051 - RNA, 64 nt, hsa
guugggaaggguagcagagagagagagacagaaagagagagagagagagagagagagagagauc

SEQ ID NO: 157052 - RNA, 64 nt, hsa
gugucugagggcagguugggaaggguagcagagagagagagacagaaagagagagagagagaga

SEQ ID NO: 157053 - RNA, 64 nt, hsa
cagugucugagggcagguugggaaggguagcagagagagagagacagaaagagagagagagaga

SEQ ID NO: 157054 - RNA, 64 nt, hsa
ugcagugucugagggcagguugggaaggguagcagagagagagagacagaaagagagagagaga

SEQ ID NO: 157055 - RNA, 64 nt, hsa
uaaaaauguguguguguguucugugugugugugagagagagaguacuugauucauuaaaaaguc

SEQ ID NO: 157056 - RNA, 64 nt, hsa
uauaaaaauguguguguguguucugugugugugugagagagagaguacuugauucauuaaaaag

SEQ ID NO: 157057 - RNA, 64 nt, hsa
uguauuggagaaggacugggucagagaucuguuggagagagagaauaaagagauuauuuuucau

SEQ ID NO: 157058 - RNA, 64 nt, hsa
uauuggagaaggacugggucagagaucuguuggagagagagaauaaagagauuauuuuucauua

SEQ ID NO: 157059 - RNA, 64 nt, hsa
cgagcacacauaaaagcacaaagacagagacgcagagagagagagagagccacggagaggaaaa

SEQ ID NO: 157060 - RNA, 64 nt, hsa
agcacacauaaaagcacaaagacagagacgcagagagagagagagagccacggagaggaaaagc

SEQ ID NO: 157061 - RNA, 64 nt, hsa
cacacauaaaagcacaaagacagagacgcagagagagagagagagccacggagaggaaaagcag

SEQ ID NO: 157062 - RNA, 64 nt, hsa
cacauaaaagcacaaagacagagacgcagagagagagagagagccacggagaggaaaagcagau

SEQ ID NO: 157063 - RNA, 64 nt, hsa
caucgcccagcaccccugcugauaccaccagacagagagagagagcacuugauucuucccgaga

SEQ ID NO: 157064 - RNA, 64 nt, hsa
ucgcccagcaccccugcugauaccaccagacagagagagagagcacuugauucuucccgagaua

SEQ ID NO: 157065 - RNA, 64 nt, hsa
acaguccacagguggacaaagggauccccagccagagagagagagaccagccaacagcuugaua

SEQ ID NO: 157066 - RNA, 64 nt, hsa
aguccacagguggacaaagggauccccagccagagagagagagaccagccaacagcuugauaga

SEQ ID NO: 157067 - RNA, 64 nt, hsa
uccacagguggacaaagggauccccagccagagagagagagaccagccaacagcuugauagacc

SEQ ID NO: 157068 - RNA, 64 nt, hsa
guguguguguguguguguguguguguguguggcagagagagagaaagagagagagagagagaaa

SEQ ID NO: 157069 - RNA, 64 nt, hsa
guguguguguguguguguguguguguguggcagagagagagaaagagagagagagagagaaauu

SEQ ID NO: 157070 - RNA, 64 nt, hsa
guguguguguguguguguggcagagagagagaaagagagagagagagagaaauucuguuaaaau

SEQ ID NO: 157071 - RNA, 64 nt, hsa
guguguguguguguguggcagagagagagaaagagagagagagagagaaauucuguuaaaaucu

SEQ ID NO: 157072 - RNA, 64 nt, hsa
guguguguguguguggcagagagagagaaagagagagagagagagaaauucuguuaaaaucuau

SEQ ID NO: 157073 - RNA, 64 nt, hsa
guguguguguguggcagagagagagaaagagagagagagagagaaauucuguuaaaaucuauuc

SEQ ID NO: 157074 - RNA, 64 nt, hsa
guguguguguggcagagagagagaaagagagagagagagagaaauucuguuaaaaucuauucug

SEQ ID NO: 157075 - RNA, 64 nt, hsa
aggggauagcagugaggucagaagucuuucccgggagagagauggccuggguuaucauugcuga

SEQ ID NO: 157076 - RNA, 64 nt, hsa
cagacauaggacugagccaaggaagagucugccugagagagacgcuuggccugugcuuugcugc

SEQ ID NO: 157077 - RNA, 64 nt, hsa
uguuuccaguuccguucugagagaaaaagagagagagagagaaaaagaccaugcugcauacauu

SEQ ID NO: 157078 - RNA, 64 nt, hsa
gcuguuuccaguuccguucugagagaaaaagagagagagagagaaaaagaccaugcugcauaca

SEQ ID NO: 157079 - RNA, 64 nt, hsa
uugcuguuuccaguuccguucugagagaaaaagagagagagagagaaaaagaccaugcugcaua

SEQ ID NO: 157080 - RNA, 64 nt, hsa
uguugcuguuuccaguuccguucugagagaaaaagagagagagagagaaaaagaccaugcugca

SEQ ID NO: 157081 - RNA, 64 nt, hsa
ggcuuucugaaagaucuagugguucacacagagagagagagaguacugaaaaagcaacuccucu

SEQ ID NO: 157082 - RNA, 64 nt, hsa
caggcuuucugaaagaucuagugguucacacagagagagagagaguacugaaaaagcaacuccu

SEQ ID NO: 157083 - RNA, 64 nt, hsa
accaggcuuucugaaagaucuagugguucacacagagagagagagaguacugaaaaagcaacuc

SEQ ID NO: 157084 - RNA, 64 nt, hsa
uuguugggauguggauggaugugugcauaagagagagagagaauaugugugugugugugugcgu

SEQ ID NO: 157085 - RNA, 64 nt, hsa
aauuguugggauguggauggaugugugcauaagagagagagagaauaugugugugugugugugc

SEQ ID NO: 157086 - RNA, 64 nt, hsa
gcaauuguugggauguggauggaugugugcauaagagagagagagaauaugugugugugugugu

SEQ ID NO: 157087 - RNA, 64 nt, hsa
agggggaaaagagagagagagagagagagagagagagagagaaagauggaggagaagaacuugg

SEQ ID NO: 157088 - RNA, 64 nt, hsa
ggagggggaaaagagagagagagagagagagagagagagagagaaagauggaggagaagaacuu

SEQ ID NO: 157089 - RNA, 64 nt, hsa
ggggagggggaaaagagagagagagagagagagagagagagagagaaagauggaggagaagaac

SEQ ID NO: 157090 - RNA, 64 nt, hsa
gaggggagggggaaaagagagagagagagagagagagagagagagagaaagauggaggagaaga

SEQ ID NO: 157091 - RNA, 64 nt, hsa
cagaggggagggggaaaagagagagagagagagagagagagagagagagaaagauggaggagaa

SEQ ID NO: 157092 - RNA, 64 nt, hsa
ugcagaggggagggggaaaagagagagagagagagagagagagagagagagaaagauggaggag

SEQ ID NO: 157093 - RNA, 64 nt, hsa
auugcagaggggagggggaaaagagagagagagagagagagagagagagagagaaagauggagg

SEQ ID NO: 157094 - RNA, 64 nt, hsa
gaauugcagaggggagggggaaaagagagagagagagagagagagagagagagagaaagaugga

SEQ ID NO: 157095 - RNA, 64 nt, hsa
gugaauugcagaggggagggggaaaagagagagagagagagagagagagagagagagaaagaug

SEQ ID NO: 157096 - RNA, 64 nt, hsa
aagugaauugcagaggggagggggaaaagagagagagagagagagagagagagagagagaaaga

SEQ ID NO: 157097 - RNA, 64 nt, hsa
ggaagugaauugcagaggggagggggaaaagagagagagagagagagagagagagagagagaaa

SEQ ID NO: 157098 - RNA, 64 nt, hsa
agggaagugaauugcagaggggagggggaaaagagagagagagagagagagagagagagagaga

SEQ ID NO: 157099 - RNA, 64 nt, hsa
agagggaagugaauugcagaggggagggggaaaagagagagagagagagagagagagagagaga

SEQ ID NO: 157100 - RNA, 64 nt, hsa
uugaacucaucugaaucaucaguuccuugauggagagagagaaggagauggaaugugucuggua

SEQ ID NO: 157101 - RNA, 64 nt, hsa
gauugaacucaucugaaucaucaguuccuugauggagagagagaaggagauggaaugugucugg

SEQ ID NO: 157102 - RNA, 64 nt, hsa
ccuguucgacugggagguucuggaaagaaagagagagagagaaaagagguaaaggagggagcca

SEQ ID NO: 157103 - RNA, 64 nt, hsa
uuccuguucgacugggagguucuggaaagaaagagagagagagaaaagagguaaaggagggagc

SEQ ID NO: 157104 - RNA, 64 nt, hsa
uuuuccuguucgacugggagguucuggaaagaaagagagagagagaaaagagguaaaggaggga

SEQ ID NO: 157105 - RNA, 64 nt, hsa
acaaggcuagaaaccuggcuggcugugagucagagagagagaggauggacgugggagaaagcaa

SEQ ID NO: 157106 - RNA, 64 nt, hsa
ugacaaggcuagaaaccuggcuggcugugagucagagagagagaggauggacgugggagaaagc

SEQ ID NO: 157107 - RNA, 64 nt, hsa
gcugaucuagggguuucuuggccacauuucccuugagagagagugggauuugcccuauccacag

SEQ ID NO: 157108 - RNA, 64 nt, hsa
uggguucaaaaagaaaaaaauaauaaaaauaaaagagagagagaaucagaccuggguggaacuc

SEQ ID NO: 157109 - RNA, 64 nt, hsa
gguucaaaaagaaaaaaauaauaaaaauaaaagagagagagaaucagaccuggguggaacucuc

SEQ ID NO: 157110 - RNA, 64 nt, hsa
cugccugggguggacauucagcagagugcgaguggagagagagagaugguguuuacucagaacc

SEQ ID NO: 157111 - RNA, 64 nt, hsa
gccugggguggacauucagcagagugcgaguggagagagagagaugguguuuacucagaaccug

SEQ ID NO: 157112 - RNA, 64 nt, hsa
cugggguggacauucagcagagugcgaguggagagagagagaugguguuuacucagaaccugcu

SEQ ID NO: 157113 - RNA, 64 nt, hsa
uguucaaggaaucauuguuuggcauugaaaauaggagagagaucaugagaaauuaccaaaaugu

SEQ ID NO: 157114 - RNA, 64 nt, hsa
agaugaagucuuguucaggguauggggcuaggaugagagagaaugccacagaguaugaaggaag

SEQ ID NO: 157115 - RNA, 64 nt, hsa
uaucaagucaacaaagaacuuaccuuggaggauagagagagagaagggaccaauuaugaggacu

SEQ ID NO: 157116 - RNA, 64 nt, hsa
ucaagucaacaaagaacuuaccuuggaggauagagagagagaagggaccaauuaugaggacuga

SEQ ID NO: 157117 - RNA, 64 nt, hsa
accccuuaguguuuggguauauucauuucaaagggagagagagagguuuuuuucuguucugucu

SEQ ID NO: 157118 - RNA, 64 nt, hsa
cccuuaguguuuggguauauucauuucaaagggagagagagagguuuuuuucuguucugucuca

SEQ ID NO: 157119 - RNA, 64 nt, hsa
cuugguuuugaugcuagagaggaaaaaggacuuggagagagagaaggaauggcugguccagagg

SEQ ID NO: 157120 - RNA, 64 nt, hsa
ugguuuugaugcuagagaggaaaaaggacuuggagagagagaaggaauggcugguccagaggcu

SEQ ID NO: 157121 - RNA, 50 nt, hsa
gguucacugagauggagugagagagagagagagagagagaugacaaggag

SEQ ID NO: 157122 - RNA, 52 nt, hsa
gguucacugagauggagugagagagagagagagagagagaugacaaggagca

SEQ ID NO: 157123 - RNA, 54 nt, hsa
gguucacugagauggagugagagagagagagagagagagaugacaaggagcaca

SEQ ID NO: 157124 - RNA, 56 nt, hsa
gguucacugagauggagugagagagagagagagagagagaugacaaggagcacaag

SEQ ID NO: 157125 - RNA, 58 nt, hsa
gguucacugagauggagugagagagagagagagagagagaugacaaggagcacaagaa

SEQ ID NO: 157126 - RNA, 60 nt, hsa
gguucacugagauggagugagagagagagagagagagagaugacaaggagcacaagaagu

SEQ ID NO: 157127 - RNA, 62 nt, hsa
gguucacugagauggagugagagagagagagagagagagaugacaaggagcacaagaagugg

SEQ ID NO: 157128 - RNA, 64 nt, hsa
aaaaagggaauaagcaaagggggaagaauugaaagagagagagaagaaagaauacagagagcuu

SEQ ID NO: 157129 - RNA, 64 nt, hsa
aaagggaauaagcaaagggggaagaauugaaagagagagagaagaaagaauacagagagcuuac

SEQ ID NO: 157130 - RNA, 64 nt, hsa
gcuucuuuauguguguguaugugugucagagaaagagagagagagagagagaagggaggaugag

SEQ ID NO: 157131 - RNA, 64 nt, hsa
uucuuuauguguguguaugugugucagagaaagagagagagagagagagaagggaggaugagaa

SEQ ID NO: 157132 - RNA, 64 nt, hsa
cuuuauguguguguaugugugucagagaaagagagagagagagagagaagggaggaugagaacg

SEQ ID NO: 157133 - RNA, 64 nt, hsa
uuauguguguguaugugugucagagaaagagagagagagagagagaagggaggaugagaacgaa

SEQ ID NO: 157134 - RNA, 64 nt, hsa
auguguguguaugugugucagagaaagagagagagagagagagaagggaggaugagaacgaaug

SEQ ID NO: 157135 - RNA, 64 nt, hsa
guguguguaugugugucagagaaagagagagagagagagagaagggaggaugagaacgaauggg

SEQ ID NO: 157136 - RNA, 64 nt, hsa
gugaaagaaccaaaagagaucacaauacucaaaagagagagagagagaaaaaagagagaucuug

SEQ ID NO: 157137 - RNA, 64 nt, hsa
gaaagaaccaaaagagaucacaauacucaaaagagagagagagagaaaaaagagagaucuugau

SEQ ID NO: 157138 - RNA, 64 nt, hsa
aagaaccaaaagagaucacaauacucaaaagagagagagagagaaaaaagagagaucuugaucc

SEQ ID NO: 157139 - RNA, 64 nt, hsa
gaaccaaaagagaucacaauacucaaaagagagagagagagaaaaaagagagaucuugauccac

SEQ ID NO: 157140 - RNA, 64 nt, hsa
agugugugcagaaaucaaaugacagagaggaagugagagagagaggugucggggaggugccagg

SEQ ID NO: 157141 - RNA, 64 nt, hsa
ugugugcagaaaucaaaugacagagaggaagugagagagagaggugucggggaggugccaggcu

SEQ ID NO: 157142 - RNA, 64 nt, hsa
cguuggugcuacacagcuagaauagauauauuuagagagagagauauuuuuaagacaaagccca

SEQ ID NO: 157143 - RNA, 64 nt, hsa
uuggugcuacacagcuagaauagauauauuuagagagagagauauuuuuaagacaaagcccaca

SEQ ID NO: 157144 - RNA, 64 nt, hsa
guuggcauuggaagcuuauucuuuuuguucacuggagagagagagaacuguuuacaguuaaucu

SEQ ID NO: 157145 - RNA, 64 nt, hsa
uggcauuggaagcuuauucuuuuuguucacuggagagagagagaacuguuuacaguuaaucugu

SEQ ID NO: 157146 - RNA, 64 nt, hsa
gcauuggaagcuuauucuuuuuguucacuggagagagagagaacuguuuacaguuaaucugugu

SEQ ID NO: 157147 - RNA, 64 nt, hsa
cuaacaggaccaucacagcuucugaacugagccggagagagagaauggaauugcugaccccugg

SEQ ID NO: 157148 - RNA, 64 nt, hsa
aacaggaccaucacagcuucugaacugagccggagagagagaauggaauugcugaccccuggaa

SEQ ID NO: 157149 - RNA, 64 nt, hsa
guauaaaaacauagacuggaggagguaauccauggagagagaaaaagaagagggcucaggacaa

SEQ ID NO: 157150 - RNA, 64 nt, hsa
ccaauauugauggcaacagucaagauggugugaugagagagaugggaggggcacaaagaggagg

SEQ ID NO: 157151 - RNA, 64 nt, hsa
gagaccuuguauuagcauccaagaaaugaugagagagagagaaauuauauacuaugaaaagugc

SEQ ID NO: 157152 - RNA, 64 nt, hsa
cugagaccuuguauuagcauccaagaaaugaugagagagagagaaauuauauacuaugaaaagu

SEQ ID NO: 157153 - RNA, 64 nt, hsa
cacugagaccuuguauuagcauccaagaaaugaugagagagagagaaauuauauacuaugaaaa

SEQ ID NO: 157154 - RNA, 64 nt, hsa
aacagagugagacuccaucucaaaaaaaaaaagagagagagaugaaaagaguaggaaaaugaga

SEQ ID NO: 157155 - RNA, 64 nt, hsa
gcaacagagugagacuccaucucaaaaaaaaaaagagagagagaugaaaagaguaggaaaauga

SEQ ID NO: 157156 - RNA, 64 nt, hsa
aacaccugccccgaagacuccuaauaggucaagagagagagacccagacaagcaaacucaaaau

SEQ ID NO: 157157 - RNA, 64 nt, hsa
caaacaccugccccgaagacuccuaauaggucaagagagagagacccagacaagcaaacucaaa

SEQ ID NO: 157158 - RNA, 64 nt, hsa
auuuucauuaauaauaugagaaaugauaccuggagagagagauuaugagcaaauguauugcuuc

SEQ ID NO: 157159 - RNA, 64 nt, hsa
gcauuuucauuaauaauaugagaaaugauaccuggagagagagauuaugagcaaauguauugcu

SEQ ID NO: 157160 - RNA, 64 nt, hsa
ggaagagcaagaaaagagaaaauauuaaaacgaggagagagaaaaauaauauuaacacaaaaaa

SEQ ID NO: 157161 - RNA, 64 nt, hsa
uuggguuuuguaggagcggguuugggggagucuggagagagacuggacaggggagugcuggaac

SEQ ID NO: 157162 - RNA, 64 nt, hsa
uuuaaaaaaaaaaaagaugacaaagaaaaacagagagagagaauauuggagauguccugaauuu

SEQ ID NO: 157163 - RNA, 64 nt, hsa
uauuuaaaaaaaaaaaagaugacaaagaaaaacagagagagagaauauuggagauguccugaau

SEQ ID NO: 157164 - RNA, 64 nt, hsa
ccggcucuuaaaaaaaaaaaaaaaaaaaaaaaaagagagagagagaauaaauagaaaagaaugu

SEQ ID NO: 157165 - RNA, 64 nt, hsa
ggcucuuaaaaaaaaaaaaaaaaaaaaaaaaagagagagagagaauaaauagaaaagaaugugg

SEQ ID NO: 157166 - RNA, 64 nt, hsa
cucuuaaaaaaaaaaaaaaaaaaaaaaaaagagagagagagaauaaauagaaaagaauguggcu

SEQ ID NO: 157167 - RNA, 64 nt, hsa
cuucaauaauguucaacugaaucucacagaugaggagagagaagaaacggaagaggaaguuuau

SEQ ID NO: 157168 - RNA, 64 nt, hsa
ugguggaauggaggaguuguuuggggagggaaaggagagagaaggaaaggagugagguauuucc

SEQ ID NO: 157169 - RNA, 64 nt, hsa
caucugacaaauucaaaagagagagagagaucuugagagagaaaugcuguucguucaaaagugg

SEQ ID NO: 157170 - RNA, 64 nt, hsa
ccugcguaacuccaucugacaaauucaaaagagagagagagaucuugagagagaaaugcuguuc

SEQ ID NO: 157171 - RNA, 64 nt, hsa
aaccugcguaacuccaucugacaaauucaaaagagagagagagaucuugagagagaaaugcugu

SEQ ID NO: 157172 - RNA, 64 nt, hsa
gaaaccugcguaacuccaucugacaaauucaaaagagagagagagaucuugagagagaaaugcu

SEQ ID NO: 157173 - RNA, 64 nt, hsa
agugacuguguugugauucauaguacauuaaaaagagagagagagagaaagaaucccacagggc

SEQ ID NO: 157174 - RNA, 64 nt, hsa
ugacuguguugugauucauaguacauuaaaaagagagagagagagaaagaaucccacagggcac

SEQ ID NO: 157175 - RNA, 64 nt, hsa
acuguguugugauucauaguacauuaaaaagagagagagagagaaagaaucccacagggcacua

SEQ ID NO: 157176 - RNA, 64 nt, hsa
uguguugugauucauaguacauuaaaaagagagagagagagaaagaaucccacagggcacuauu

SEQ ID NO: 157177 - RNA, 64 nt, hsa
aacugacuucugcuagguagaggcauuugucuuagagagagagagagcgcgggagagagugaga

SEQ ID NO: 157178 - RNA, 64 nt, hsa
cugacuucugcuagguagaggcauuugucuuagagagagagagagcgcgggagagagugagaga

SEQ ID NO: 157179 - RNA, 64 nt, hsa
gacuucugcuagguagaggcauuugucuuagagagagagagagcgcgggagagagugagagaga

SEQ ID NO: 157180 - RNA, 64 nt, hsa
uugucuuagagagagagagagcgcgggagagagugagagagagugagagcacaaagauaacgca

SEQ ID NO: 157181 - RNA, 64 nt, hsa
agugagagagagugagagcacaaagauaacgcaggagagagagagagaaagaaugagaaagaaa

SEQ ID NO: 157182 - RNA, 64 nt, hsa
ugagagagagugagagcacaaagauaacgcaggagagagagagagaaagaaugagaaagaaaag

SEQ ID NO: 157183 - RNA, 64 nt, hsa
agagagagugagagcacaaagauaacgcaggagagagagagagaaagaaugagaaagaaaagga

SEQ ID NO: 157184 - RNA, 64 nt, hsa
agagagugagagcacaaagauaacgcaggagagagagagagaaagaaugagaaagaaaaggaau

SEQ ID NO: 157185 - RNA, 64 nt, hsa
aggaacaauagauuauuucuguuuuacuccaaaagagagagagagagugagugugagugugugu

SEQ ID NO: 157186 - RNA, 64 nt, hsa
gaacaauagauuauuucuguuuuacuccaaaagagagagagagagugagugugagugugugugu

SEQ ID NO: 157187 - RNA, 64 nt, hsa
acaauagauuauuucuguuuuacuccaaaagagagagagagagugagugugagugugugugugu

SEQ ID NO: 157188 - RNA, 64 nt, hsa
gaggauccaaacuuccugcaacauuuucuuagaggagagagagaaauauuaaaagagaaaugaa

SEQ ID NO: 157189 - RNA, 64 nt, hsa
ggauccaaacuuccugcaacauuuucuuagaggagagagagaaauauuaaaagagaaaugaaac

SEQ ID NO: 157190 - RNA, 64 nt, hsa
caggaagucgagacaccaucccagguguguguaagagagagagagagaacagggaggauacaga

SEQ ID NO: 157191 - RNA, 64 nt, hsa
ggaagucgagacaccaucccagguguguguaagagagagagagagaacagggaggauacagaag

SEQ ID NO: 157192 - RNA, 64 nt, hsa
aagucgagacaccaucccagguguguguaagagagagagagagaacagggaggauacagaagua

SEQ ID NO: 157193 - RNA, 64 nt, hsa
gucgagacaccaucccagguguguguaagagagagagagagaacagggaggauacagaaguauu

SEQ ID NO: 157194 - RNA, 64 nt, hsa
uugcuaagaugcauuuaauaaaaaaaaagagagagagagagaggugugagggacaaaaugcaaa

SEQ ID NO: 157195 - RNA, 64 nt, hsa
uuuugcuaagaugcauuuaauaaaaaaaaagagagagagagagaggugugagggacaaaaugca

SEQ ID NO: 157196 - RNA, 64 nt, hsa
acuuuugcuaagaugcauuuaauaaaaaaaaagagagagagagagaggugugagggacaaaaug

SEQ ID NO: 157197 - RNA, 64 nt, hsa
cuacuuuugcuaagaugcauuuaauaaaaaaaaagagagagagagagaggugugagggacaaaa

SEQ ID NO: 157198 - RNA, 64 nt, hsa
uucuuccuccccuugcuuccagggaagaugaagagagagagauuuggaaggggcucuggcuccc

SEQ ID NO: 157199 - RNA, 64 nt, hsa
acuucuuccuccccuugcuuccagggaagaugaagagagagagauuuggaaggggcucuggcuc

SEQ ID NO: 157200 - RNA, 64 nt, hsa
ggguuuccucagugcccuuuggcuguugaggagugagagagagagagagagagagagagagaga

SEQ ID NO: 157201 - RNA, 64 nt, hsa
guuuccucagugcccuuuggcuguugaggagugagagagagagagagagagagagagagagaga

SEQ ID NO: 157202 - RNA, 64 nt, hsa
uuccucagugcccuuuggcuguugaggagugagagagagagagagagagagagagagagagaga

SEQ ID NO: 157203 - RNA, 64 nt, hsa
ccucagugcccuuuggcuguugaggagugagagagagagagagagagagagagagagagagaga

SEQ ID NO: 157204 - RNA, 64 nt, hsa
ucagugcccuuuggcuguugaggagugagagagagagagagagagagagagagagagagagaga

SEQ ID NO: 157205 - RNA, 64 nt, hsa
agugcccuuuggcuguugaggagugagagagagagagagagagagagagagagagagagagaga

SEQ ID NO: 157206 - RNA, 64 nt, hsa
ugcccuuuggcuguugaggagugagagagagagagagagagagagagagagagagagagagaga

SEQ ID NO: 157207 - RNA, 64 nt, hsa
cccuuuggcuguugaggagugagagagagagagagagagagagagagagagagagagagagaca

SEQ ID NO: 157208 - RNA, 64 nt, hsa
cuuuggcuguugaggagugagagagagagagagagagagagagagagagagagagagagacaag

SEQ ID NO: 157209 - RNA, 64 nt, hsa
uuggcuguugaggagugagagagagagagagagagagagagagagagagagagagagacaagca

SEQ ID NO: 157210 - RNA, 64 nt, hsa
ggcuguugaggagugagagagagagagagagagagagagagagagagagagagagacaagcagg

SEQ ID NO: 157211 - RNA, 64 nt, hsa
cuguugaggagugagagagagagagagagagagagagagagagagagagagagacaagcaggag

SEQ ID NO: 157212 - RNA, 64 nt, hsa
guugaggagugagagagagagagagagagagagagagagagagagagagagacaagcaggagcg

SEQ ID NO: 157213 - RNA, 64 nt, hsa
ugaggagugagagagagagagagagagagagagagagagagagagagagacaagcaggagcgug

SEQ ID NO: 157214 - RNA, 64 nt, hsa
aggagugagagagagagagagagagagagagagagagagagagagagacaagcaggagcguggc

SEQ ID NO: 157215 - RNA, 64 nt, hsa
gagugagagagagagagagagagagagagagagagagagagagagacaagcaggagcguggcug

SEQ ID NO: 157216 - RNA, 64 nt, hsa
gugagagagagagagagagagagagagagagagagagagagagacaagcaggagcguggcugcu

SEQ ID NO: 157217 - RNA, 64 nt, hsa
gagagagagagagagagagagagagagagagagagagagagacaagcaggagcguggcugcucg

SEQ ID NO: 157218 - RNA, 64 nt, hsa
cacagucacauucgaauucggguggcauccuccggagagagagagaggaaggagauuccacaca

SEQ ID NO: 157219 - RNA, 64 nt, hsa
cagucacauucgaauucggguggcauccuccggagagagagagaggaaggagauuccacacagg

SEQ ID NO: 157220 - RNA, 64 nt, hsa
gucacauucgaauucggguggcauccuccggagagagagagaggaaggagauuccacacagggg

SEQ ID NO: 157221 - RNA, 64 nt, hsa
gccaaccuagaaacguuuucauucgucauuccaagagagagagaggaaagaaaaauacaacuuu

SEQ ID NO: 157222 - RNA, 64 nt, hsa
caaccuagaaacguuuucauucgucauuccaagagagagagaggaaagaaaaauacaacuuuca

SEQ ID NO: 157223 - RNA, 64 nt, hsa
uuucagccuagugggagagagugggggagaggaagagagagagagagcauguauacccguaugu

SEQ ID NO: 157224 - RNA, 64 nt, hsa
ucagccuagugggagagagugggggagaggaagagagagagagagcauguauacccguauguua

SEQ ID NO: 157225 - RNA, 64 nt, hsa
agccuagugggagagagugggggagaggaagagagagagagagcauguauacccguauguuauc

SEQ ID NO: 157226 - RNA, 64 nt, hsa
ggagagagugaggagagugugugauagcuagaaagagagagagacagagagauggcaagcacug

SEQ ID NO: 157227 - RNA, 64 nt, hsa
agagagugaggagagugugugauagcuagaaagagagagagacagagagauggcaagcacugag

SEQ ID NO: 157228 - RNA, 64 nt, hsa
gacauaaaagagccuugauuuuaaaaaaaaaagagagagagauguaauuuaaaaaguuuauuau

SEQ ID NO: 157229 - RNA, 64 nt, hsa
uugacauaaaagagccuugauuuuaaaaaaaaaagagagagagauguaauuuaaaaaguuuauu

SEQ ID NO: 157230 - RNA, 64 nt, hsa
cauggccuuauuugacuucaaagaauccacaugagagagagacugcauaaauguaauaacugag

SEQ ID NO: 157231 - RNA, 64 nt, hsa
cacauggccuuauuugacuucaaagaauccacaugagagagagacugcauaaauguaauaacug

SEQ ID NO: 157232 - RNA, 63 nt, hsa
aucuggauaacagcaaaaaaacugaaaauaaagagagagagagaucuggguguuggugguugc

SEQ ID NO: 157233 - RNA, 64 nt, hsa
uuaucuggauaacagcaaaaaaacugaaaauaaagagagagagagaucuggguguuggugguug

SEQ ID NO: 157234 - RNA, 64 nt, hsa
aucagcuccauaucugcauuccacuggggaaagagagagagaaaagagcagauuuuaaaaaaaa

SEQ ID NO: 157235 - RNA, 64 nt, hsa
ucaucagcuccauaucugcauuccacuggggaaagagagagagaaaagagcagauuuuaaaaaa

SEQ ID NO: 157236 - RNA, 64 nt, hsa
agagacaauggagagagaaagagagagagagcgcgagagagaucaagacccaaguuuugaaucu

SEQ ID NO: 157237 - RNA, 64 nt, hsa
cacaguuuuucuagagacaauggagagagaaagagagagagagcgcgagagagaucaagaccca

SEQ ID NO: 157238 - RNA, 64 nt, hsa
gccacaguuuuucuagagacaauggagagagaaagagagagagagcgcgagagagaucaagacc

SEQ ID NO: 157239 - RNA, 64 nt, hsa
cucuguccuugccacaguuuuucuagagacaauggagagagaaagagagagagagcgcgagaga

SEQ ID NO: 157240 - RNA, 64 nt, hsa
ggcuugacauggugggcacacuggcgcccaguaagagagagagagagccaaagcuguccguuuu

SEQ ID NO: 157241 - RNA, 64 nt, hsa
cuugacauggugggcacacuggcgcccaguaagagagagagagagccaaagcuguccguuuugc

SEQ ID NO: 157242 - RNA, 64 nt, hsa
ugacauggugggcacacuggcgcccaguaagagagagagagagccaaagcuguccguuuugcag

SEQ ID NO: 157243 - RNA, 64 nt, hsa
ggagccaggacacagcucagcuugcucacgcccagagagagaaaaaguuaagcugcugacccug

SEQ ID NO: 157244 - RNA, 64 nt, hsa
uuuugucccaaagugaguaaaauccccuagagcagagagagagagagagagagagagugucuuc

SEQ ID NO: 157245 - RNA, 64 nt, hsa
uugucccaaagugaguaaaauccccuagagcagagagagagagagagagagagagugucuucau

SEQ ID NO: 157246 - RNA, 64 nt, hsa
gucccaaagugaguaaaauccccuagagcagagagagagagagagagagagagugucuucaugc

SEQ ID NO: 157247 - RNA, 64 nt, hsa
cccaaagugaguaaaauccccuagagcagagagagagagagagagagagagugucuucaugcca

SEQ ID NO: 157248 - RNA, 64 nt, hsa
caaagugaguaaaauccccuagagcagagagagagagagagagagagagugucuucaugccaac

SEQ ID NO: 157249 - RNA, 64 nt, hsa
aagugaguaaaauccccuagagcagagagagagagagagagagagagugucuucaugccaacca

SEQ ID NO: 157250 - RNA, 64 nt, hsa
gugaguaaaauccccuagagcagagagagagagagagagagagagugucuucaugccaaccaca

SEQ ID NO: 157251 - RNA, 64 nt, hsa
gaguaaaauccccuagagcagagagagagagagagagagagagugucuucaugccaaccacagc

SEQ ID NO: 157252 - RNA, 64 nt, hsa
ccugccuuugggucgacauaguauggaaguauuugagagagagaaccuuuccacucccacugcc

SEQ ID NO: 157253 - RNA, 64 nt, hsa
ugccuuugggucgacauaguauggaaguauuugagagagagaaccuuuccacucccacugccag

SEQ ID NO: 157254 - RNA, 64 nt, hsa
aaagcaaauguacuuaagucaucauucagagugagagagagaaagcacggcugaggcugaguca

SEQ ID NO: 157255 - RNA, 64 nt, hsa
guaaagcaaauguacuuaagucaucauucagagugagagagagaaagcacggcugaggcugagu

SEQ ID NO: 157256 - RNA, 64 nt, hsa
cauugcaaaugcuuuagaaaucucugauaauggagagagagacagaggacccuccucacuaccc

SEQ ID NO: 157257 - RNA, 64 nt, hsa
agcauugcaaaugcuuuagaaaucucugauaauggagagagagacagaggacccuccucacuac

SEQ ID NO: 157258 - RNA, 64 nt, hsa
gcacugaggagaaugguagagaggagaggagagagagagagaaugugauuuuuggccuuguggc

SEQ ID NO: 157259 - RNA, 64 nt, hsa
uggcacugaggagaaugguagagaggagaggagagagagagagaaugugauuuuuggccuugug

SEQ ID NO: 157260 - RNA, 64 nt, hsa
ccuggcacugaggagaaugguagagaggagaggagagagagagagaaugugauuuuuggccuug

SEQ ID NO: 157261 - RNA, 64 nt, hsa
caccuggcacugaggagaaugguagagaggagaggagagagagagagaaugugauuuuuggccu

SEQ ID NO: 157262 - RNA, 64 nt, hsa
agugagacuccaucucaaaaaaaaaaaagagagagagagagaaagaaauagaagagaagagcca

SEQ ID NO: 157263 - RNA, 64 nt, hsa
agagugagacuccaucucaaaaaaaaaaaagagagagagagagaaagaaauagaagagaagagc

SEQ ID NO: 157264 - RNA, 64 nt, hsa
acagagugagacuccaucucaaaaaaaaaaaagagagagagagagaaagaaauagaagagaaga

SEQ ID NO: 157265 - RNA, 64 nt, hsa
ucacagagugagacuccaucucaaaaaaaaaaaagagagagagagagaaagaaauagaagagaa

SEQ ID NO: 157266 - RNA, 64 nt, hsa
ggaaagaagagggagggagagagaaagacgaagggagagagaaagcaguuuccaaggauauguu

SEQ ID NO: 157267 - RNA, 64 nt, hsa
caguacugaagagaaaugggaaagaagagggagggagagagaaagacgaagggagagagaaagc

SEQ ID NO: 157268 - RNA, 64 nt, hsa
gaugugcacugaacucgggauguuggggauuggagagagagaauugccaaaguaacagcaaaaa

SEQ ID NO: 157269 - RNA, 64 nt, hsa
uagaugugcacugaacucgggauguuggggauuggagagagagaauugccaaaguaacagcaaa

SEQ ID NO: 157270 - RNA, 64 nt, hsa
uaagcugugaucaugccacugcauuccagccugggagagagagaggaccugucuguugaaaaaa

SEQ ID NO: 157271 - RNA, 64 nt, hsa
agcugugaucaugccacugcauuccagccugggagagagagaggaccugucuguugaaaaaaac

SEQ ID NO: 157272 - RNA, 64 nt, hsa
gcugugggcucagagcucaggagucgccuuaccugagagagauguucuagcugagagggccugg

SEQ ID NO: 157273 - RNA, 64 nt, hsa
uggugucccuguccccagagggaggagcaggcaggagagagaggggaaggagguaugaauccca

SEQ ID NO: 157274 - RNA, 64 nt, hsa
aauguugacuuaagugagggggaaauaaaacccagagagagagagagagcgagagagagagaca

SEQ ID NO: 157275 - RNA, 64 nt, hsa
uguugacuuaagugagggggaaauaaaacccagagagagagagagagcgagagagagagacaug

SEQ ID NO: 157276 - RNA, 64 nt, hsa
uugacuuaagugagggggaaauaaaacccagagagagagagagagcgagagagagagacauguu

SEQ ID NO: 157277 - RNA, 64 nt, hsa
gacuuaagugagggggaaauaaaacccagagagagagagagagcgagagagagagacauguuac

SEQ ID NO: 157278 - RNA, 64 nt, hsa
agggggaaauaaaacccagagagagagagagagcgagagagagagacauguuacuaugaaagac

SEQ ID NO: 157279 - RNA, 64 nt, hsa
ggggaaauaaaacccagagagagagagagagcgagagagagagacauguuacuaugaaagacuu

SEQ ID NO: 157280 - RNA, 64 nt, hsa
ggaaauaaaacccagagagagagagagagcgagagagagagacauguuacuaugaaagacuugu

SEQ ID NO: 157281 - RNA, 64 nt, hsa
gucccagcaguggagugccgggacccucagaguggagagagagacccgggaugugugugcugua

SEQ ID NO: 157282 - RNA, 64 nt, hsa
cccagcaguggagugccgggacccucagaguggagagagagacccgggaugugugugcuguacc

SEQ ID NO: 157283 - RNA, 64 nt, hsa
cccgcccucgcggcgggcgcccccagggccaggagagagagacagggcuggcuccucucgcccc

SEQ ID NO: 157284 - RNA, 64 nt, hsa
gccccgcccucgcggcgggcgcccccagggccaggagagagagacagggcuggcuccucucgcc

SEQ ID NO: 157285 - RNA, 64 nt, hsa
ucggaaccaggacacaaaagcagcaagaagcggggagagagagggauagaaaacaagcgcagga

SEQ ID NO: 157286 - RNA, 64 nt, hsa
gauucacucauccugagacuuucuuuuugcaguggagagagagaauaaucuaguuggggcaaac

SEQ ID NO: 157287 - RNA, 64 nt, hsa
uucacucauccugagacuuucuuuuugcaguggagagagagaauaaucuaguuggggcaaacac

SEQ ID NO: 157288 - RNA, 64 nt, hsa
aguuugggagcugugugugucugugugugugugagagagagaucuugucugcgugugugugugu

SEQ ID NO: 157289 - RNA, 64 nt, hsa
aaaguuugggagcugugugugucugugugugugugagagagagaucuugucugcgugugugugu

SEQ ID NO: 157290 - RNA, 64 nt, hsa
uugucccgacauuuuuuuucuguuucuauucugagagagagaugaucaaguuuuaauuugggua

SEQ ID NO: 157291 - RNA, 64 nt, hsa
acuugucccgacauuuuuuuucuguuucuauucugagagagagaugaucaaguuuuaauuuggg

SEQ ID NO: 157292 - RNA, 64 nt, hsa
uugcagugagccaagaucgcaccaccgcaugagagagagagauuacuauuucuugucccuuuuu

SEQ ID NO: 157293 - RNA, 64 nt, hsa
gguugcagugagccaagaucgcaccaccgcaugagagagagagauuacuauuucuugucccuuu

SEQ ID NO: 157294 - RNA, 64 nt, hsa
gagguugcagugagccaagaucgcaccaccgcaugagagagagagauuacuauuucuugucccu

SEQ ID NO: 157295 - RNA, 64 nt, hsa
guguguguguguguguguguguguguaugagagagagagagacuuugacgguuguagauauuuu

SEQ ID NO: 157296 - RNA, 64 nt, hsa
guguguguguguguguguguguguguguaugagagagagagagacuuugacgguuguagauauu

SEQ ID NO: 157297 - RNA, 64 nt, hsa
guguguguguguguguguguguguguguguaugagagagagagagacuuugacgguuguagaua

SEQ ID NO: 157298 - RNA, 64 nt, hsa
guguguguguguguguguguguguguguguguaugagagagagagagacuuugacgguuguaga

SEQ ID NO: 157299 - RNA, 64 nt, hsa
gaggcagcgccuuugucugucuaucuggugacaagagagagacaaguaaaugggggccguuggg

SEQ ID NO: 157300 - RNA, 64 nt, hsa
caagacuccaucucaaaaaauaaauaaauagaaagagagagagaggaaaaaaaaagaaaagaac

SEQ ID NO: 157301 - RNA, 64 nt, hsa
agacuccaucucaaaaaauaaauaaauagaaagagagagagaggaaaaaaaaagaaaagaacac

SEQ ID NO: 157302 - RNA, 64 nt, hsa
agcccuaucuccugcaaccucagugccucagccugagagagagaugagaugcucuuggacuccc

SEQ ID NO: 157303 - RNA, 64 nt, hsa
cccuaucuccugcaaccucagugccucagccugagagagagaugagaugcucuuggacucccca

SEQ ID NO: 157304 - RNA, 64 nt, hsa
gugagagacacagagagaaggagaaagagggagggagagagagaaagagagagaaagagagaga

SEQ ID NO: 157305 - RNA, 64 nt, hsa
gagagacacagagagaaggagaaagagggagggagagagagaaagagagagaaagagagagaga

SEQ ID NO: 157306 - RNA, 64 nt, hsa
gagagaaggagaaagagggagggagagagagaaagagagagaaagagagagagagagagagaga

SEQ ID NO: 157307 - RNA, 64 nt, hsa
gaaagagggagggagagagagaaagagagagaaagagagagagagagagagagagagaaagcug

SEQ ID NO: 157308 - RNA, 64 nt, hsa
aagagggagggagagagagaaagagagagaaagagagagagagagagagagagagaaagcugaa

SEQ ID NO: 157309 - RNA, 64 nt, hsa
gagggagggagagagagaaagagagagaaagagagagagagagagagagagagaaagcugaacg

SEQ ID NO: 157310 - RNA, 64 nt, hsa
gggagggagagagagaaagagagagaaagagagagagagagagagagagagaaagcugaacgug

SEQ ID NO: 157311 - RNA, 64 nt, hsa
gagggagagagagaaagagagagaaagagagagagagagagagagagagaaagcugaacgugca

SEQ ID NO: 157312 - RNA, 64 nt, hsa
gggagagagagaaagagagagaaagagagagagagagagagagagagaaagcugaacgugcacu

SEQ ID NO: 157313 - RNA, 64 nt, hsa
gagagagagaaagagagagaaagagagagagagagagagagagagaaagcugaacgugcacucu

SEQ ID NO: 157314 - RNA, 64 nt, hsa
gagagagaaagagagagaaagagagagagagagagagagagagaaagcugaacgugcacucuga

SEQ ID NO: 157315 - RNA, 64 nt, hsa
gagagaaagagagagaaagagagagagagagagagagagagaaagcugaacgugcacucugaca

SEQ ID NO: 157316 - RNA, 64 nt, hsa
cugccaggggcugguagacaagaacugugaaagagagagagaaaaaaccucaacuguguauuuu

SEQ ID NO: 157317 - RNA, 64 nt, hsa
uucugccaggggcugguagacaagaacugugaaagagagagagaaaaaaccucaacuguguauu

SEQ ID NO: 157318 - RNA, 64 nt, hsa
uggagcagccaggcgcucuggagccagcuggagagagagagauccugauaccucuguggggacu

SEQ ID NO: 157319 - RNA, 64 nt, hsa
ucuggagcagccaggcgcucuggagccagcuggagagagagagauccugauaccucugugggga

SEQ ID NO: 157320 - RNA, 64 nt, hsa
ucucuggagcagccaggcgcucuggagccagcuggagagagagagauccugauaccucuguggg

SEQ ID NO: 157321 - RNA, 64 nt, hsa
cuagaaaugcaacuuguauaaaacaaaaaugggagagagagagguauuaaacaaauaccccccu

SEQ ID NO: 157322 - RNA, 64 nt, hsa
ggcuagaaaugcaacuuguauaaaacaaaaaugggagagagagagguauuaaacaaauaccccc

SEQ ID NO: 157323 - RNA, 64 nt, hsa
gugugugugugugugugagagagagagagagagagagagagaccagcaucuucaagagaaguau

SEQ ID NO: 157324 - RNA, 64 nt, hsa
gugugugugugugugugugagagagagagagagagagagagagaccagcaucuucaagagaagu

SEQ ID NO: 157325 - RNA, 64 nt, hsa
uugugugugugugugugugugagagagagagagagagagagagagaccagcaucuucaagagaa

SEQ ID NO: 157326 - RNA, 64 nt, hsa
guuugugugugugugugugugugagagagagagagagagagagagagaccagcaucuucaagag

SEQ ID NO: 157327 - RNA, 64 nt, hsa
guguuugugugugugugugugugugagagagagagagagagagagagagaccagcaucuucaag

SEQ ID NO: 157328 - RNA, 64 nt, hsa
guguguuugugugugugugugugugugagagagagagagagagagagagagaccagcaucuuca

SEQ ID NO: 157329 - RNA, 64 nt, hsa
guguguguuugugugugugugugugugugagagagagagagagagagagagagaccagcaucuu

SEQ ID NO: 157330 - RNA, 64 nt, hsa
guguguguguuugugugugugugugugugugagagagagagagagagagagagagaccagcauc

SEQ ID NO: 157331 - RNA, 64 nt, hsa
guguguguguguuugugugugugugugugugugagagagagagagagagagagagagaccagca

SEQ ID NO: 157332 - RNA, 64 nt, hsa
cuguguguguguguuugugugugugugugugugugagagagagagagagagagagagagaccag

SEQ ID NO: 157333 - RNA, 64 nt, hsa
augaguauuuucaggauuuguuucuaugagacgagagagagaagccuccgcuccuuaaugugaa

SEQ ID NO: 157334 - RNA, 64 nt, hsa
ugaugaguauuuucaggauuuguuucuaugagacgagagagagaagccuccgcuccuuaaugug

SEQ ID NO: 157335 - RNA, 64 nt, hsa
cuccuuuuucaacaaaggaguguguucagaaaaggagagagaggcugagaucauucaggaguuu

SEQ ID NO: 157336 - RNA, 64 nt, hsa
agugagagaacucagcaagccaaccugggaaucagagagagaaggagaaggaggggagccuguc

SEQ ID NO: 157337 - RNA, 64 nt, hsa
acuuucauauuucuaaaaggggccaaugcaaaaggagagagaaggacuggauuuaagccaguuu

SEQ ID NO: 157338 - RNA, 64 nt, hsa
ucccgaacuaauuuuuuuaaggauacugaaaaaugagagagaguggucgaaugccugaaauuuu

SEQ ID NO: 157339 - RNA, 64 nt, hsa
uuggagucuuuguugcuauauuuuguggggcugggagagagagauuagauuauuuugacauggg

SEQ ID NO: 157340 - RNA, 64 nt, hsa
ggagucuuuguugcuauauuuuguggggcugggagagagagauuagauuauuuugacaugggau

SEQ ID NO: 157341 - RNA, 64 nt, hsa
aaagaaaaagauuacccaaaaacugucuuuaaaagagagagagagaaaaaaaaaauaguauuug

SEQ ID NO: 157342 - RNA, 64 nt, hsa
agaaaaagauuacccaaaaacugucuuuaaaagagagagagagaaaaaaaaaauaguauuugca

SEQ ID NO: 157343 - RNA, 64 nt, hsa
aaaaagauuacccaaaaacugucuuuaaaagagagagagagaaaaaaaaaauaguauuugcaua

SEQ ID NO: 157344 - RNA, 64 nt, hsa
uccaucgccuuuuccuuccaucaguugaguggcugagagagaagugccucaucccugagccaca

SEQ ID NO: 157345 - RNA, 64 nt, hsa
uaugggacaaaaccgguugaccagaaaaugggcagagagagaugaccucggaagcauuuccaca

SEQ ID NO: 157346 - RNA, 64 nt, hsa
uuaaucucauggaugguucucaaagguaaaaaaagagagagaaagagagagagcuagcuguggg

SEQ ID NO: 157347 - RNA, 64 nt, hsa
ggaugguucucaaagguaaaaaaagagagagaaagagagagagcuagcugugggauucugugua

SEQ ID NO: 157348 - RNA, 64 nt, hsa
acucccuguuuccugggcuagucuuggaccccacgagagagaaucguuccucagccucauggug

SEQ ID NO: 157349 - RNA, 64 nt, hsa
uugcaucuccguaaaugugcucugcuccucagcugagagagaaaaaaauaaacuguauuuggcu

SEQ ID NO: 157350 - RNA, 64 nt, hsa
auuaacuggaaaagauguuaacaguaaagauggagagagagagugugugcguguguguguauau

SEQ ID NO: 157351 - RNA, 64 nt, hsa
acauuaacuggaaaagauguuaacaguaaagauggagagagagagugugugcguguguguguau

SEQ ID NO: 157352 - RNA, 64 nt, hsa
aagugcagaauucuuuugguucuuugguuccagagagagagaagaugcuugugccagguggcac

SEQ ID NO: 157353 - RNA, 64 nt, hsa
gaaagugcagaauucuuuugguucuuugguuccagagagagagaagaugcuugugccagguggc

SEQ ID NO: 157354 - RNA, 64 nt, hsa
gaccuuaucucaaaaaaaaaaaaaaaaagagagagagagagaaaaagaaaugcuguguuuaauc

SEQ ID NO: 157355 - RNA, 64 nt, hsa
gagaccuuaucucaaaaaaaaaaaaaaaaagagagagagagagaaaaagaaaugcuguguuuaa

SEQ ID NO: 157356 - RNA, 64 nt, hsa
gugagaccuuaucucaaaaaaaaaaaaaaaaagagagagagagagaaaaagaaaugcuguguuu

SEQ ID NO: 157357 - RNA, 64 nt, hsa
gagugagaccuuaucucaaaaaaaaaaaaaaaaagagagagagagagaaaaagaaaugcugugu

SEQ ID NO: 157358 - RNA, 64 nt, hsa
uguguguguguguguguacucuguguguguaugagagagagaaaugcuaaccuuguagcaugug

SEQ ID NO: 157359 - RNA, 64 nt, hsa
uguguguguguguguguguacucuguguguguaugagagagagaaaugcuaaccuuguagcaug

SEQ ID NO: 157360 - RNA, 64 nt, hsa
uguuguauggcugagcaagagagagagagaaugagagagagacugugugugugugugugugugu

SEQ ID NO: 157361 - RNA, 64 nt, hsa
gguguuguauggcugagcaagagagagagagaaugagagagagacugugugugugugugugugu

SEQ ID NO: 157362 - RNA, 64 nt, hsa
auccuggagggguguuguauggcugagcaagagagagagagaaugagagagagacugugugugu

SEQ ID NO: 157363 - RNA, 64 nt, hsa
ucauccuggagggguguuguauggcugagcaagagagagagagaaugagagagagacugugugu

SEQ ID NO: 157364 - RNA, 64 nt, hsa
uaucauccuggagggguguuguauggcugagcaagagagagagagaaugagagagagacugugu

SEQ ID NO: 157365 - RNA, 64 nt, hsa
uaccaagaaaaauuuccaaaacuauugagagagagagagagaaaguauugaaauuuuguucugc

SEQ ID NO: 157366 - RNA, 64 nt, hsa
gguaccaagaaaaauuuccaaaacuauugagagagagagagagaaaguauugaaauuuuguucu

SEQ ID NO: 157367 - RNA, 64 nt, hsa
uugguaccaagaaaaauuuccaaaacuauugagagagagagagagaaaguauugaaauuuuguu

SEQ ID NO: 157368 - RNA, 64 nt, hsa
uauugguaccaagaaaaauuuccaaaacuauugagagagagagagagaaaguauugaaauuuug

SEQ ID NO: 157369 - RNA, 64 nt, hsa
gauauugguaccaagaaaaauuuccaaaacuauugagagagagagagagaaaguauugaaauuu

SEQ ID NO: 157370 - RNA, 64 nt, hsa
caauuuugaaucuaucuuaaaauacugagguguggagagagagacaggaucaggagcgauagag

SEQ ID NO: 157371 - RNA, 64 nt, hsa
auuuugaaucuaucuuaaaauacugagguguggagagagagacaggaucaggagcgauagagag

SEQ ID NO: 157372 - RNA, 64 nt, hsa
ccuaguguguguguguguguguguguguguguaugagagagagagagagagacaacagagacag

SEQ ID NO: 157373 - RNA, 64 nt, hsa
uaguguguguguguguguguguguguguguaugagagagagagagagagacaacagagacagag

SEQ ID NO: 157374 - RNA, 64 nt, hsa
guguguguguguguguguguguguguguaugagagagagagagagagacaacagagacagagag

SEQ ID NO: 157375 - RNA, 64 nt, hsa
guguguguguguguguguguguguguaugagagagagagagagagacaacagagacagagagag

SEQ ID NO: 157376 - RNA, 64 nt, hsa
guguguguguguguguguguguguaugagagagagagagagagacaacagagacagagagaggc

SEQ ID NO: 157377 - RNA, 64 nt, hsa
guguguguguguguguguguguaugagagagagagagagagacaacagagacagagagaggcag

SEQ ID NO: 157378 - RNA, 64 nt, hsa
gagacagagagaggcagagaggcauagagagacagagagagagacaagaaacagagauagacag

SEQ ID NO: 157379 - RNA, 64 nt, hsa
gacagagagaggcagagaggcauagagagacagagagagagacaagaaacagagauagacagaa

SEQ ID NO: 157380 - RNA, 64 nt, hsa
acucugucucagaaaaaaaaaaaaaaaagagagagagagagaaagagaacaauauuugggagag

SEQ ID NO: 157381 - RNA, 64 nt, hsa
agacucugucucagaaaaaaaaaaaaaaaagagagagagagagaaagagaacaauauuugggag

SEQ ID NO: 157382 - RNA, 64 nt, hsa
caagacucugucucagaaaaaaaaaaaaaaaagagagagagagagaaagagaacaauauuuggg

SEQ ID NO: 157383 - RNA, 64 nt, hsa
agcaagacucugucucagaaaaaaaaaaaaaaaagagagagagagagaaagagaacaauauuug

SEQ ID NO: 157384 - RNA, 64 nt, hsa
guaggugcuguucucaggugaaaagagagagagagagagagacauaagaaauuuagagaaaaau

SEQ ID NO: 157385 - RNA, 64 nt, hsa
cuguaggugcuguucucaggugaaaagagagagagagagagagacauaagaaauuuagagaaaa

SEQ ID NO: 157386 - RNA, 64 nt, hsa
aacuguaggugcuguucucaggugaaaagagagagagagagagagacauaagaaauuuagagaa

SEQ ID NO: 157387 - RNA, 64 nt, hsa
gaaacuguaggugcuguucucaggugaaaagagagagagagagagagacauaagaaauuuagag

SEQ ID NO: 157388 - RNA, 64 nt, hsa
uggaaacuguaggugcuguucucaggugaaaagagagagagagagagagacauaagaaauuuag

SEQ ID NO: 157389 - RNA, 64 nt, hsa
aauggaaacuguaggugcuguucucaggugaaaagagagagagagagagagacauaagaaauuu

SEQ ID NO: 157390 - RNA, 64 nt, hsa
uuuguugaccaugauaaugcaaauaacagaaggagagagagaaugaacccuuucuggguguuuc

SEQ ID NO: 157391 - RNA, 64 nt, hsa
cauuuguugaccaugauaaugcaaauaacagaaggagagagagaaugaacccuuucuggguguu

SEQ ID NO: 157392 - RNA, 64 nt, hsa
ccgagaggaggcugaauuucucaagccauuaggagagagagaaauugggagugguccccaaaga

SEQ ID NO: 157393 - RNA, 64 nt, hsa
caccgagaggaggcugaauuucucaagccauuaggagagagagaaauugggagugguccccaaa

SEQ ID NO: 157394 - RNA, 64 nt, hsa
agaaagagagagagagaggagaaagagagagaaggagagagacaguagccaagagaaccccacg

SEQ ID NO: 157395 - RNA, 64 nt, hsa
cauuuccuagagaaagagagagagagaggagaaagagagagaaggagagagacaguagccaaga

SEQ ID NO: 157396 - RNA, 64 nt, hsa
cugcuucacaacagacauuuccuagagaaagagagagagagaggagaaagagagagaaggagag

SEQ ID NO: 157397 - RNA, 64 nt, hsa
gccugcuucacaacagacauuuccuagagaaagagagagagagaggagaaagagagagaaggag

SEQ ID NO: 157398 - RNA, 64 nt, hsa
aggccugcuucacaacagacauuuccuagagaaagagagagagagaggagaaagagagagaagg

SEQ ID NO: 157399 - RNA, 64 nt, hsa
agggccacuugcuugauuuaucaugagagaagaggagagagagagagacugagcgcuaggagug

SEQ ID NO: 157400 - RNA, 64 nt, hsa
ggccacuugcuugauuuaucaugagagaagaggagagagagagagacugagcgcuaggagugug

SEQ ID NO: 157401 - RNA, 64 nt, hsa
ccacuugcuugauuuaucaugagagaagaggagagagagagagacugagcgcuaggagugugug

SEQ ID NO: 157402 - RNA, 64 nt, hsa
acuugcuugauuuaucaugagagaagaggagagagagagagacugagcgcuaggagugugugua

SEQ ID NO: 157403 - RNA, 64 nt, hsa
gggagagguggggagggagacagagacagaaacagagagagacagagacagagagagacugagg

SEQ ID NO: 157404 - RNA, 64 nt, hsa
gagacagagacagaaacagagagagacagagacagagagagacugagggagagacucugaggac

SEQ ID NO: 157405 - RNA, 64 nt, hsa
agagagagacugagggagagacucugaggacauggagagagacucaaagagacuccaagauuca

SEQ ID NO: 157406 - RNA, 64 nt, hsa
aaccaagagagcgggagggagggaaggagggagggagagagauagagagagagagagagagaga

SEQ ID NO: 157407 - RNA, 64 nt, hsa
gcgggagggagggaaggagggagggagagagauagagagagagagagagagagaggaugugugg

SEQ ID NO: 157408 - RNA, 64 nt, hsa
gggagggagggaaggagggagggagagagauagagagagagagagagagagaggaugugugggc

SEQ ID NO: 157409 - RNA, 64 nt, hsa
gagggagggaaggagggagggagagagauagagagagagagagagagagaggaugugugggccc

SEQ ID NO: 157410 - RNA, 64 nt, hsa
gggagggaaggagggagggagagagauagagagagagagagagagagaggaugugugggcccua

SEQ ID NO: 157411 - RNA, 64 nt, hsa
gagggaaggagggagggagagagauagagagagagagagagagagaggaugugugggcccuaag

SEQ ID NO: 157412 - RNA, 64 nt, hsa
gggaaggagggagggagagagauagagagagagagagagagagaggaugugugggcccuaaggc

SEQ ID NO: 157413 - RNA, 64 nt, hsa
gaaggagggagggagagagauagagagagagagagagagagaggaugugugggcccuaaggcug

SEQ ID NO: 157414 - RNA, 64 nt, hsa
gucaagaucgcaccacuugcacugcagccugagagagagagagccagaccuugucucaaaaaau

SEQ ID NO: 157415 - RNA, 64 nt, hsa
gggucaagaucgcaccacuugcacugcagccugagagagagagagccagaccuugucucaaaaa

SEQ ID NO: 157416 - RNA, 64 nt, hsa
cagggucaagaucgcaccacuugcacugcagccugagagagagagagccagaccuugucucaaa

SEQ ID NO: 157417 - RNA, 64 nt, hsa
gugugugugugugugugugugugagagagagagagagagagaugggugguggugagaaguguug

SEQ ID NO: 157418 - RNA, 64 nt, hsa
gugugugugugugugugugugugugagagagagagagagagagaugggugguggugagaagugu

SEQ ID NO: 157419 - RNA, 64 nt, hsa
gugugugugugugugugugugugugugagagagagagagagagagaugggugguggugagaagu

SEQ ID NO: 157420 - RNA, 64 nt, hsa
gugugugugugugugugugugugugugugagagagagagagagagagaugggugguggugagaa

SEQ ID NO: 157421 - RNA, 64 nt, hsa
aagugugugugugugugugugugugugugugagagagagagagagagagaugggugguggugag

SEQ ID NO: 157422 - RNA, 64 nt, hsa
ggaagugugugugugugugugugugugugugugagagagagagagagagagaugggugguggug

SEQ ID NO: 157423 - RNA, 64 nt, hsa
auggaagugugugugugugugugugugugugugugagagagagagagagagagauggguggugg

SEQ ID NO: 157424 - RNA, 64 nt, hsa
acacacacacacacacacacacacacgaaggagagagagagaaaacugauggggaaaacaagcu

SEQ ID NO: 157425 - RNA, 64 nt, hsa
acacacacacacacacacacacacacacgaaggagagagagagaaaacugauggggaaaacaag

SEQ ID NO: 157426 - RNA, 64 nt, hsa
acacacacacacacacacacacacacacacgaaggagagagagagaaaacugauggggaaaaca

SEQ ID NO: 157427 - RNA, 64 nt, hsa
agucccuggccuuuccuuuuguaauaagaaagaagagagagaacuugaugcaaaguccacgaaa

SEQ ID NO: 157428 - RNA, 64 nt, hsa
ggcucucugaccucccugcuugcauugggucugggagagagaguggaauauuugguagggaccu

SEQ ID NO: 157429 - RNA, 64 nt, hsa
cccugucauuccccacacacguccuguucaccucgagagagagagagagagagcaccuuucuuc

SEQ ID NO: 157430 - RNA, 64 nt, hsa
cugucauuccccacacacguccuguucaccucgagagagagagagagagagcaccuuucuuccg

SEQ ID NO: 157431 - RNA, 64 nt, hsa
gucauuccccacacacguccuguucaccucgagagagagagagagagagcaccuuucuuccguc

SEQ ID NO: 157432 - RNA, 64 nt, hsa
cauuccccacacacguccuguucaccucgagagagagagagagagagcaccuuucuuccgucug

SEQ ID NO: 157433 - RNA, 64 nt, hsa
uuccccacacacguccuguucaccucgagagagagagagagagagcaccuuucuuccgucuguu

SEQ ID NO: 157434 - RNA, 64 nt, hsa
ccccacacacguccuguucaccucgagagagagagagagagagcaccuuucuuccgucuguuca

SEQ ID NO: 157435 - RNA, 64 nt, hsa
uuagauuuuaaguguugaggagcagaggugagaagagagagagagagagaaagucaaauaaagu

SEQ ID NO: 157436 - RNA, 64 nt, hsa
agauuuuaaguguugaggagcagaggugagaagagagagagagagagaaagucaaauaaaguca

SEQ ID NO: 157437 - RNA, 64 nt, hsa
auuuuaaguguugaggagcagaggugagaagagagagagagagagaaagucaaauaaagucaaa

SEQ ID NO: 157438 - RNA, 64 nt, hsa
uuuaaguguugaggagcagaggugagaagagagagagagagagaaagucaaauaaagucaaaga

SEQ ID NO: 157439 - RNA, 64 nt, hsa
uaaguguugaggagcagaggugagaagagagagagagagagaaagucaaauaaagucaaagacc

SEQ ID NO: 157440 - RNA, 64 nt, hsa
cccccacccaagacauuuuaauaguaaauagagagagagagaagaguuaaugaacaugagguag

SEQ ID NO: 157441 - RNA, 64 nt, hsa
cacccccacccaagacauuuuaauaguaaauagagagagagagaagaguuaaugaacaugaggu

SEQ ID NO: 157442 - RNA, 64 nt, hsa
cccacccccacccaagacauuuuaauaguaaauagagagagagagaagaguuaaugaacaugag

SEQ ID NO: 157443 - RNA, 64 nt, hsa
gagcgccuagaaauugaaaggcaaaaacuagagagagagagaauggaacgcgaacgcuuggaaa

SEQ ID NO: 157444 - RNA, 64 nt, hsa
gagagcgccuagaaauugaaaggcaaaaacuagagagagagagaauggaacgcgaacgcuugga

SEQ ID NO: 157445 - RNA, 64 nt, hsa
gagagagcgccuagaaauugaaaggcaaaaacuagagagagagagaauggaacgcgaacgcuug

SEQ ID NO: 157446 - RNA, 64 nt, hsa
ucgugaacgggaagaacgggaacgcuuacagagagagagagagcgccuagaaauugaaaggcaa

SEQ ID NO: 157447 - RNA, 64 nt, hsa
auucgugaacgggaagaacgggaacgcuuacagagagagagagagcgccuagaaauugaaaggc

SEQ ID NO: 157448 - RNA, 64 nt, hsa
uaauucgugaacgggaagaacgggaacgcuuacagagagagagagagcgccuagaaauugaaag

SEQ ID NO: 157449 - RNA, 64 nt, hsa
aauacugauuuuugguagacgaagagagauugcagagagagagcgucgagagcgagaacgcauu

SEQ ID NO: 157450 - RNA, 64 nt, hsa
gcaacagauggagauccuuucagggagagagagagagagagaggagaagacagagagauuaaag

SEQ ID NO: 157451 - RNA, 64 nt, hsa
gugcaacagauggagauccuuucagggagagagagagagagagaggagaagacagagagauuaa

SEQ ID NO: 157452 - RNA, 64 nt, hsa
uggugcaacagauggagauccuuucagggagagagagagagagagaggagaagacagagagauu

SEQ ID NO: 157453 - RNA, 64 nt, hsa
ccuggugcaacagauggagauccuuucagggagagagagagagagagaggagaagacagagaga

SEQ ID NO: 157454 - RNA, 64 nt, hsa
guccuggugcaacagauggagauccuuucagggagagagagagagagagaggagaagacagaga

SEQ ID NO: 157455 - RNA, 64 nt, hsa
caguccuggugcaacagauggagauccuuucagggagagagagagagagagaggagaagacaga

SEQ ID NO: 157456 - RNA, 64 nt, hsa
agcugcauuuccugcugggguccugguuccucaggagagagagaccacagggugagagugagcc

SEQ ID NO: 157457 - RNA, 64 nt, hsa
cugcauuuccugcugggguccugguuccucaggagagagagaccacagggugagagugagccag

SEQ ID NO: 157458 - RNA, 64 nt, hsa
aaaacauggccuuggcaguuauuuuuccaucaccgagagagagagacagagagagaaaauaaac

SEQ ID NO: 157459 - RNA, 64 nt, hsa
aacauggccuuggcaguuauuuuuccaucaccgagagagagagacagagagagaaaauaaacua

SEQ ID NO: 157460 - RNA, 64 nt, hsa
cauggccuuggcaguuauuuuuccaucaccgagagagagagacagagagagaaaauaaacuacc

SEQ ID NO: 157461 - RNA, 64 nt, hsa
gcaguuauuuuuccaucaccgagagagagagacagagagagaaaauaaacuaccccuccuauuc

SEQ ID NO: 157462 - RNA, 64 nt, hsa
gagagaaagagagugagagagagagagaaagagagagagagaugcuguugaaucagaaacagau

SEQ ID NO: 157463 - RNA, 64 nt, hsa
gagagagaaagagagugagagagagagagaaagagagagagagaugcuguugaaucagaaacag

SEQ ID NO: 157464 - RNA, 64 nt, hsa
gagagagagaaagagagugagagagagagagaaagagagagagagaugcuguugaaucagaaac

SEQ ID NO: 157465 - RNA, 64 nt, hsa
gccagagagugagagagagaaagagagugagagagagagagaaagagagagagagaugcuguug

SEQ ID NO: 157466 - RNA, 64 nt, hsa
gagccagagagugagagagagaaagagagugagagagagagagaaagagagagagagaugcugu

SEQ ID NO: 157467 - RNA, 64 nt, hsa
gagagccagagagugagagagagaaagagagugagagagagagagaaagagagagagagaugcu

SEQ ID NO: 157468 - RNA, 64 nt, hsa
cagagagccagagagugagagagagaaagagagugagagagagagagaaagagagagagagaug

SEQ ID NO: 157469 - RNA, 64 nt, hsa
gagaguaaccaguuuccagagagccagagagugagagagagaaagagagugagagagagagaga

SEQ ID NO: 157470 - RNA, 64 nt, hsa
aagagaguaaccaguuuccagagagccagagagugagagagagaaagagagugagagagagaga

SEQ ID NO: 157471 - RNA, 64 nt, hsa
agccugaggccgcugguagacuuuuguuaaaagagagagagacagagacagagaaauaagcauu

SEQ ID NO: 157472 - RNA, 64 nt, hsa
ugagccugaggccgcugguagacuuuuguuaaaagagagagagacagagacagagaaauaagca

SEQ ID NO: 157473 - RNA, 64 nt, hsa
gccacuuuacaaaggaaauuugaauaaauggagagagagagaagccuuguuguuggauaggaaa

SEQ ID NO: 157474 - RNA, 64 nt, hsa
gggccacuuuacaaaggaaauuugaauaaauggagagagagagaagccuuguuguuggauagga

SEQ ID NO: 157475 - RNA, 64 nt, hsa
gagggccacuuuacaaaggaaauuugaauaaauggagagagagagaagccuuguuguuggauag

SEQ ID NO: 157476 - RNA, 64 nt, hsa
cccagaagugcuggggcagggaggcccaggagaugagagagaagguccgaguaggugauagaag

SEQ ID NO: 157477 - RNA, 64 nt, hsa
gggcacggaguugccaggagcaaaccaaagugaagagagagauaggaagcugccucggggccac

SEQ ID NO: 157478 - RNA, 64 nt, hsa
ugugaaaggucuaaaugcccacuugaaugaagcugagagagagaucuagcaaaagcuaaaacuc

SEQ ID NO: 157479 - RNA, 64 nt, hsa
ugaaaggucuaaaugcccacuugaaugaagcugagagagagaucuagcaaaagcuaaaacucau

SEQ ID NO: 157480 - RNA, 64 nt, hsa
uuucacuccggagugagaagcuuugcccuccuaagagagagagacagagagacagagagagaga

SEQ ID NO: 157481 - RNA, 64 nt, hsa
ucacuccggagugagaagcuuugcccuccuaagagagagagacagagagacagagagagagaaa

SEQ ID NO: 157482 - RNA, 64 nt, hsa
cuuugcccuccuaagagagagagacagagagacagagagagagaaagagagagugugugggucu

SEQ ID NO: 157483 - RNA, 64 nt, hsa
uugcccuccuaagagagagagacagagagacagagagagagaaagagagagugugugggucuau

SEQ ID NO: 157484 - RNA, 64 nt, hsa
uuuaauuuaucucugugaccugccagggagaggggagagagagagagaugcuguugagcacaug

SEQ ID NO: 157485 - RNA, 64 nt, hsa
uaauuuaucucugugaccugccagggagaggggagagagagagagaugcuguugagcacaugac

SEQ ID NO: 157486 - RNA, 64 nt, hsa
auuuaucucugugaccugccagggagaggggagagagagagagaugcuguugagcacaugacaa

SEQ ID NO: 157487 - RNA, 64 nt, hsa
uuaucucugugaccugccagggagaggggagagagagagagaugcuguugagcacaugacaaaa

SEQ ID NO: 157488 - RNA, 64 nt, hsa
caccugggagcuauuuacaaauguccaugugggagagagagagcaugagagcacaguagcccag

SEQ ID NO: 157489 - RNA, 64 nt, hsa
cccaccugggagcuauuuacaaauguccaugugggagagagagagcaugagagcacaguagccc

SEQ ID NO: 157490 - RNA, 64 nt, hsa
gagaggcagagagacagagagggagagagggacagagagagauagagcaggaggucggggcacu

SEQ ID NO: 157491 - RNA, 64 nt, hsa
agaggagacagagagggagagagagacagagggagagagagacagaggggaagagaggcagaga

SEQ ID NO: 157492 - RNA, 64 nt, hsa
acagaggagacagagagggagagagagacagagggagagagagacagaggggaagagaggcaga

SEQ ID NO: 157493 - RNA, 64 nt, hsa
agagagggagagaaacagaggagacagagagggagagagagacagagggagagagagacagagg

SEQ ID NO: 157494 - RNA, 64 nt, hsa
gcagagagggagagaaacagaggagacagagagggagagagagacagagggagagagagacaga

SEQ ID NO: 157495 - RNA, 64 nt, hsa
agagagguggggagaggggagagagauaugaggagagagagacagaggaggcagagagggagag

SEQ ID NO: 157496 - RNA, 64 nt, hsa
aaagagagguggggagaggggagagagauaugaggagagagagacagaggaggcagagagggag

SEQ ID NO: 157497 - RNA, 64 nt, hsa
aggaggggagagagaaagagagguggggagaggggagagagauaugaggagagagagacagagg

SEQ ID NO: 157498 - RNA, 64 nt, hsa
gggaaaggaggagggagagagauggagaggaggggagagagaaagagagguggggagaggggag

SEQ ID NO: 157499 - RNA, 64 nt, hsa
gcauaaaugggggucagggagggaaaggaggagggagagagauggagaggaggggagagagaaa

SEQ ID NO: 157500 - RNA, 64 nt, hsa
gagugccugauuggaaaaaaaaaaaaaagagagagagagagaagaagaagaagaagagacacaa

SEQ ID NO: 157501 - RNA, 64 nt, hsa
gagagugccugauuggaaaaaaaaaaaaaagagagagagagagaagaagaagaagaagagacac

SEQ ID NO: 157502 - RNA, 64 nt, hsa
cagagagugccugauuggaaaaaaaaaaaaaagagagagagagagaagaagaagaagaagagac

SEQ ID NO: 157503 - RNA, 64 nt, hsa
uacagagagugccugauuggaaaaaaaaaaaaaagagagagagagagaagaagaagaagaagag

SEQ ID NO: 157504 - RNA, 64 nt, hsa
cuuaucagcaucuggcauccaaagcaacaucagagagagagaacacagaagaaaagcaauugcc

SEQ ID NO: 157505 - RNA, 64 nt, hsa
cccuuaucagcaucuggcauccaaagcaacaucagagagagagaacacagaagaaaagcaauug

SEQ ID NO: 157506 - RNA, 64 nt, hsa
aaaaguuauuuggaaagaaagaaagaaagagagagagagagaaagaaagaaagaaaggcugccu

SEQ ID NO: 157507 - RNA, 64 nt, hsa
gaaaaaguuauuuggaaagaaagaaagaaagagagagagagagaaagaaagaaagaaaggcugc

SEQ ID NO: 157508 - RNA, 64 nt, hsa
aggaaaaaguuauuuggaaagaaagaaagaaagagagagagagagaaagaaagaaagaaaggcu

SEQ ID NO: 157509 - RNA, 64 nt, hsa
ugaggaaaaaguuauuuggaaagaaagaaagaaagagagagagagagaaagaaagaaagaaagg

SEQ ID NO: 157510 - RNA, 64 nt, hsa
uugaaugggcagaggugagagagagagagagaaagagagagaaugaaugcaguugcauugauuc

SEQ ID NO: 157511 - RNA, 64 nt, hsa
ccagugccuuuugaaugggcagaggugagagagagagagagaaagagagagaaugaaugcaguu

SEQ ID NO: 157512 - RNA, 64 nt, hsa
cuccagugccuuuugaaugggcagaggugagagagagagagagaaagagagagaaugaaugcag

SEQ ID NO: 157513 - RNA, 64 nt, hsa
gacuccagugccuuuugaaugggcagaggugagagagagagagagaaagagagagaaugaaugc

SEQ ID NO: 157514 - RNA, 64 nt, hsa
aggacuccagugccuuuugaaugggcagaggugagagagagagagagaaagagagagaaugaau

SEQ ID NO: 157515 - RNA, 64 nt, hsa
caaggacuccagugccuuuugaaugggcagaggugagagagagagagagaaagagagagaauga

SEQ ID NO: 157516 - RNA, 64 nt, hsa
cugcuauggacacggaguggggcgggcaucuggagagagagagggagcggaggcuaaggacugg

SEQ ID NO: 157517 - RNA, 64 nt, hsa
cacugcuauggacacggaguggggcgggcaucuggagagagagagggagcggaggcuaaggacu

SEQ ID NO: 157518 - RNA, 64 nt, hsa
ggaggaauuucagugggucucuguguguguaugagagagagaguguguguuuguguguuucaag

SEQ ID NO: 157519 - RNA, 64 nt, hsa
aaggaggaauuucagugggucucuguguguguaugagagagagaguguguguuuguguguuuca

SEQ ID NO: 157520 - RNA, 64 nt, hsa
cucuacaaaguguugauccccuucuuucccaugagagagagaacuggugauacuccaacaccgu

SEQ ID NO: 157521 - RNA, 64 nt, hsa
cucucuacaaaguguugauccccuucuuucccaugagagagagaacuggugauacuccaacacc

SEQ ID NO: 157522 - RNA, 64 nt, hsa
caguagcaucuguaacagcauuaacugucuuaaagagagagagagagaauuccgaauuggggaa

SEQ ID NO: 157523 - RNA, 64 nt, hsa
guagcaucuguaacagcauuaacugucuuaaagagagagagagagaauuccgaauuggggaaca

SEQ ID NO: 157524 - RNA, 64 nt, hsa
agcaucuguaacagcauuaacugucuuaaagagagagagagagaauuccgaauuggggaacaca

SEQ ID NO: 157525 - RNA, 64 nt, hsa
caucuguaacagcauuaacugucuuaaagagagagagagagaauuccgaauuggggaacacacg

SEQ ID NO: 157526 - RNA, 64 nt, hsa
ugcugaacgggcccacccacacguuguauauucagagagagagagggagucaaggugugaccgu

SEQ ID NO: 157527 - RNA, 64 nt, hsa
cugaacgggcccacccacacguuguauauucagagagagagagggagucaaggugugaccgucg

SEQ ID NO: 157528 - RNA, 64 nt, hsa
cugucugaaagaaagagagaaagaaagaaagaaagagagagaaagaaagaaagaaagaaaggga

SEQ ID NO: 157529 - RNA, 64 nt, hsa
aagauggaaggaaggaaggaaaaagaaagagaaagagagagagagagaaagaaaaagaaagaaa

SEQ ID NO: 157530 - RNA, 64 nt, hsa
gauggaaggaaggaaggaaaaagaaagagaaagagagagagagagaaagaaaaagaaagaaaag

SEQ ID NO: 157531 - RNA, 64 nt, hsa
uggaaggaaggaaggaaaaagaaagagaaagagagagagagagaaagaaaaagaaagaaaagua

SEQ ID NO: 157532 - RNA, 64 nt, hsa
gaaggaaggaaggaaaaagaaagagaaagagagagagagagaaagaaaaagaaagaaaaguaag

SEQ ID NO: 157533 - RNA, 64 nt, hsa
aucacucgagcucaagaauucaagaccugggcaagagagagagacuuugucucuauuaaaaaua

SEQ ID NO: 157534 - RNA, 64 nt, hsa
cacucgagcucaagaauucaagaccugggcaagagagagagacuuugucucuauuaaaaauaaa

SEQ ID NO: 157535 - RNA, 64 nt, hsa
ucuuuagacacacaaaacaaacaaacacaugggggagagagacuuggaagaggaggaggaggag

SEQ ID NO: 157536 - RNA, 64 nt, hsa
agacuuggaagaggaggaggaggaggagaaggaggagagagaggggaagagacaaagugggugu

SEQ ID NO: 157537 - RNA, 64 nt, hsa
gagacaccauuucccuccucuagaccucaucuuggagagagagauguuggauggggccaucuau

SEQ ID NO: 157538 - RNA, 64 nt, hsa
gacaccauuucccuccucuagaccucaucuuggagagagagauguuggauggggccaucuauuc

SEQ ID NO: 157539 - RNA, 64 nt, hsa
ccccguggaaccccgaagccuggcgggagagagagagagagaagucuccucugcauuuuggguu

SEQ ID NO: 157540 - RNA, 64 nt, hsa
ggccccguggaaccccgaagccuggcgggagagagagagagagaagucuccucugcauuuuggg

SEQ ID NO: 157541 - RNA, 64 nt, hsa
ugggccccguggaaccccgaagccuggcgggagagagagagagagaagucuccucugcauuuug

SEQ ID NO: 157542 - RNA, 64 nt, hsa
gaugggccccguggaaccccgaagccuggcgggagagagagagagagaagucuccucugcauuu

SEQ ID NO: 157543 - RNA, 64 nt, hsa
gggaugggccccguggaaccccgaagccuggcgggagagagagagagagaagucuccucugcau

SEQ ID NO: 157544 - RNA, 64 nt, hsa
ugugugcgcacgcccuuuugugcagugagagagagagagagauugcacacaugugucucuguag

SEQ ID NO: 157545 - RNA, 64 nt, hsa
ugugugugcgcacgcccuuuugugcagugagagagagagagagauugcacacaugugucucugu

SEQ ID NO: 157546 - RNA, 64 nt, hsa
ugugugugugcgcacgcccuuuugugcagugagagagagagagagauugcacacaugugucucu

SEQ ID NO: 157547 - RNA, 64 nt, hsa
cgugugugugugcgcacgcccuuuugugcagugagagagagagagagauugcacacaugugucu

SEQ ID NO: 157548 - RNA, 64 nt, hsa
aacgugugugugugcgcacgcccuuuugugcagugagagagagagagagauugcacacaugugu

SEQ ID NO: 157549 - RNA, 64 nt, hsa
aaaaaaaaaaaaaagcgagcgagagagagagcgagagagagagcgagagcagaagaaauuccua

SEQ ID NO: 157550 - RNA, 64 nt, hsa
aaaaaaaaaaaaaaaagcgagcgagagagagagcgagagagagagcgagagcagaagaaauucc

SEQ ID NO: 157551 - RNA, 64 nt, hsa
ugaaaagacaaaaaaaaaaaaaaaaagcgagcgagagagagagcgagagagagagcgagagcag

SEQ ID NO: 157552 - RNA, 64 nt, hsa
guugaaaagacaaaaaaaaaaaaaaaaagcgagcgagagagagagcgagagagagagcgagagc

SEQ ID NO: 157553 - RNA, 64 nt, hsa
accccagggucuggugauggcagggauggggggagagagagaaaauccacaaauuccaauguca

SEQ ID NO: 157554 - RNA, 64 nt, hsa
gaaccccagggucuggugauggcagggauggggggagagagagaaaauccacaaauuccaaugu

SEQ ID NO: 157555 - RNA, 64 nt, hsa
gagaaaacagaaacccgagaaagagagagacagagagagagaaaaaaaaucacccaccaccccc

SEQ ID NO: 157556 - RNA, 64 nt, hsa
aagagaaaacagaaacccgagaaagagagagacagagagagagaaaaaaaaucacccaccaccc

SEQ ID NO: 157557 - RNA, 64 nt, hsa
aaaaaccaaaaagagaaaacagaaacccgagaaagagagagacagagagagagaaaaaaaauca

SEQ ID NO: 157558 - RNA, 64 nt, hsa
gcagcagagagagagagagagaaagagagagagagagagagaaggggcccaagagagacagcac

SEQ ID NO: 157559 - RNA, 64 nt, hsa
gggcagcagagagagagagagagaaagagagagagagagagagaaggggcccaagagagacagc

SEQ ID NO: 157560 - RNA, 64 nt, hsa
ccgggcagcagagagagagagagagaaagagagagagagagagagaaggggcccaagagagaca

SEQ ID NO: 157561 - RNA, 64 nt, hsa
ccccgggcagcagagagagagagagagaaagagagagagagagagagaaggggcccaagagaga

SEQ ID NO: 157562 - RNA, 64 nt, hsa
cuccccgggcagcagagagagagagagagaaagagagagagagagagagaaggggcccaagaga

SEQ ID NO: 157563 - RNA, 64 nt, hsa
cccuccccgggcagcagagagagagagagagaaagagagagagagagagagaaggggcccaaga

SEQ ID NO: 157564 - RNA, 64 nt, hsa
cccucccacccccuccccgggcagcagagagagagagagagaaagagagagagagagagagaag

SEQ ID NO: 157565 - RNA, 64 nt, hsa
ugcccucccacccccuccccgggcagcagagagagagagagagaaagagagagagagagagaga

SEQ ID NO: 157566 - RNA, 64 nt, hsa
ccugcccucccacccccuccccgggcagcagagagagagagagagaaagagagagagagagaga

SEQ ID NO: 157567 - RNA, 64 nt, hsa
cgccugcccucccacccccuccccgggcagcagagagagagagagagaaagagagagagagaga

SEQ ID NO: 157568 - RNA, 64 nt, hsa
cccgccugcccucccacccccuccccgggcagcagagagagagagagagaaagagagagagaga

SEQ ID NO: 157569 - RNA, 64 nt, hsa
cuuuuccauuaaguacaugugccaggaaacaagagagagagaaaguaaaggcaguaaugccuuc

SEQ ID NO: 157570 - RNA, 64 nt, hsa
uccuuuuccauuaaguacaugugccaggaaacaagagagagagaaaguaaaggcaguaaugccu

SEQ ID NO: 157571 - RNA, 64 nt, hsa
auauuauauauuauauagagagagggaggagagcgagagagagugaggacaccgaacugggcug

SEQ ID NO: 157572 - RNA, 64 nt, hsa
auaaagauacagagagucaaauagagagaauggagagagagaaacauauauuauauauuauaua

SEQ ID NO: 157573 - RNA, 64 nt, hsa
gaauaaagauacagagagucaaauagagagaauggagagagagaaacauauauuauauauuaua

SEQ ID NO: 157574 - RNA, 64 nt, hsa
aaugcugugacucaaggccacggcucuacuaaaagagagagaggaagcgagagagagagagaaa

SEQ ID NO: 157575 - RNA, 64 nt, hsa
aggccacggcucuacuaaaagagagagaggaagcgagagagagagagaaaaaacaaaaaacaga

SEQ ID NO: 157576 - RNA, 64 nt, hsa
gccacggcucuacuaaaagagagagaggaagcgagagagagagagaaaaaacaaaaaacagaaa

SEQ ID NO: 157577 - RNA, 64 nt, hsa
cacggcucuacuaaaagagagagaggaagcgagagagagagagaaaaaacaaaaaacagaaaac

SEQ ID NO: 157578 - RNA, 64 nt, hsa
cggcucuacuaaaagagagagaggaagcgagagagagagagaaaaaacaaaaaacagaaaacac

SEQ ID NO: 157579 - RNA, 64 nt, hsa
cucucgcuuuaguuuucaaccuuguuggugcugagagagagaaccgagaggucccaguacaagg

SEQ ID NO: 157580 - RNA, 64 nt, hsa
cucucucgcuuuaguuuucaaccuuguuggugcugagagagagaaccgagaggucccaguacaa

SEQ ID NO: 157581 - RNA, 64 nt, hsa
ccagcgccgccuccuagacucgagcagagccggagagagagacgagagggugggaggucccgga

SEQ ID NO: 157582 - RNA, 64 nt, hsa
cgccagcgccgccuccuagacucgagcagagccggagagagagacgagagggugggaggucccg

SEQ ID NO: 157583 - RNA, 64 nt, hsa
ccuuccccuggugucugcacagccuuuauaaagagagagagagcuccgaagcaauaacaacacc

SEQ ID NO: 157584 - RNA, 64 nt, hsa
gcccuuccccuggugucugcacagccuuuauaaagagagagagagcuccgaagcaauaacaaca

SEQ ID NO: 157585 - RNA, 64 nt, hsa
cuauuagcacuguucacuacauuaacaugcaagagagagagaagccuuguuacauuuccugcua

SEQ ID NO: 157586 - RNA, 64 nt, hsa
ggcuauuagcacuguucacuacauuaacaugcaagagagagagaagccuuguuacauuuccugc

SEQ ID NO: 157587 - RNA, 64 nt, hsa
gcauauucccagacugaggcagggcagguuugcagagagagacccagagugcacgugacccgca

SEQ ID NO: 157588 - RNA, 64 nt, hsa
auccuccuuaccacccaccaggccagauuuacaggagagagaaauccacuccacucuuccuuaa

SEQ ID NO: 157589 - RNA, 64 nt, hsa
aaaauuauaggauuuuuuuuucuucuuuuuuagagagagagauuagaaaacgacauuaggaauu

SEQ ID NO: 157590 - RNA, 64 nt, hsa
ccaaaauuauaggauuuuuuuuucuucuuuuuuagagagagagauuagaaaacgacauuaggaa

SEQ ID NO: 157591 - RNA, 64 nt, hsa
cuggaagacagugguucugauggguucagcccuagagagagagagagaagcggggagaauaaga

SEQ ID NO: 157592 - RNA, 64 nt, hsa
ggaagacagugguucugauggguucagcccuagagagagagagagaagcggggagaauaagagu

SEQ ID NO: 157593 - RNA, 64 nt, hsa
aagacagugguucugauggguucagcccuagagagagagagagaagcggggagaauaagagugc

SEQ ID NO: 157594 - RNA, 64 nt, hsa
gacagugguucugauggguucagcccuagagagagagagagaagcggggagaauaagagugcac

SEQ ID NO: 157595 - RNA, 64 nt, hsa
gcugagccagaaaguaacacagagcucaugcuuggagagagagagucuuggccauggcuuuccu

SEQ ID NO: 157596 - RNA, 64 nt, hsa
ugagccagaaaguaacacagagcucaugcuuggagagagagagucuuggccauggcuuuccugc

SEQ ID NO: 157597 - RNA, 64 nt, hsa
auccucuccggaucugucgauuuggagaccuuccgagagagaaccaagggugcagucagcuuaa

SEQ ID NO: 157598 - RNA, 64 nt, hsa
auucauauuuagaaguaaaacacaaaacaaaaaagagagagaaaagaaaagaaaucacaaugua

SEQ ID NO: 157599 - RNA, 64 nt, hsa
ggccucugggccuccagcgcuggguuugucgagugagagagagagaggagcuuggguugcuucc

SEQ ID NO: 157600 - RNA, 64 nt, hsa
ccucugggccuccagcgcuggguuugucgagugagagagagagaggagcuuggguugcuucccu

SEQ ID NO: 157601 - RNA, 64 nt, hsa
ucugggccuccagcgcuggguuugucgagugagagagagagaggagcuuggguugcuucccugu

SEQ ID NO: 157602 - RNA, 64 nt, hsa
acauagaagagggaaggaaagagagaaggaaagagagagagaaagaaagucuccagaccaggaa

SEQ ID NO: 157603 - RNA, 64 nt, hsa
caacauagaagagggaaggaaagagagaaggaaagagagagagaaagaaagucuccagaccagg

SEQ ID NO: 157604 - RNA, 64 nt, hsa
uaugucaaaauguuacaaccgcuguaaaaugacggagagagagagaaagaaucccagacauuaa

SEQ ID NO: 157605 - RNA, 64 nt, hsa
ugucaaaauguuacaaccgcuguaaaaugacggagagagagagaaagaaucccagacauuaacg

SEQ ID NO: 157606 - RNA, 64 nt, hsa
ucaaaauguuacaaccgcuguaaaaugacggagagagagagaaagaaucccagacauuaacggu

SEQ ID NO: 157607 - RNA, 59 nt, hsa
cacaguggaagugggagccugguccuuccccugcccauggagagcucuuuaagggaucc

SEQ ID NO: 157608 - RNA, 59 nt, hsa
cagcccccaggugaggcuuccagcugggaccugcccagacaggcugagccugggcgugg

SEQ ID NO: 157609 - RNA, 59 nt, hsa
gcccugcccgccucuccccccacgcucaaccugcccacuuguccaggccuggccucuuu

SEQ ID NO: 157610 - RNA, 59 nt, hsa
cucacucugccaugagaacaggacaccauccugcccagcccagacgggguugcuccugg

SEQ ID NO: 157611 - RNA, 59 nt, hsa
ggcucuggcccacugagccaccgcgcccuccugcccacgggaggacaagcaauaacucu

SEQ ID NO: 157612 - RNA, 59 nt, hsa
uuaggaaccuucucccuucuugggucugcccugcccauacugagccugccaaagugccu

SEQ ID NO: 157613 - RNA, 59 nt, hsa
gcaggugugguggcucauggcguaaugggccugcccaaugcuuugggaggccaaggcag

SEQ ID NO: 157614 - RNA, 59 nt, hsa
ugugacugaaggggcacaccacugcccugccugcccacuuagccguccauggcaccagc

SEQ ID NO: 157615 - RNA, 59 nt, hsa
cuaggguuguccugccccuuggcucuaucccugcccagaggugggaacuggaggagugg

SEQ ID NO: 157616 - RNA, 59 nt, hsa
cacacauuauagucaugugccaccaccuuccugcccacaggccgagggacagggugagg

SEQ ID NO: 157617 - RNA, 59 nt, hsa
augugacauggcuucuccucagggcaaccccugcccaacccucauccccaucuucucag

SEQ ID NO: 157618 - RNA, 59 nt, hsa
cuccugggaccacugccaccugcaagagcccugcccaggagauagaagaccuggacucc

SEQ ID NO: 157619 - RNA, 59 nt, hsa
ugaaaggagggugaggcugccgaugccuuccugcccagaaguggaugaugugggaguug

SEQ ID NO: 157620 - RNA, 59 nt, hsa
acuguccaagcucucagccccacagggaaccugcccagagagcuuuaccuuucccaagc

SEQ ID NO: 157621 - RNA, 59 nt, hsa
ccccugcccuggcagccuggaagaccgugccugcccagcccucgucaccacagggacuc

SEQ ID NO: 157622 - RNA, 59 nt, hsa
ccaccccggggucucuggggaacugucaaccugcccacgggacauguacauuuccccuu

SEQ ID NO: 157623 - RNA, 59 nt, hsa
cauuccuuucuaaguguguuuuauggcauccugcccacaaagaacucacagucugauua

SEQ ID NO: 157624 - RNA, 59 nt, hsa
acagguugacuaguaucuguggguaccucccugcccagguuauucacucacaagccacc

SEQ ID NO: 157625 - RNA, 56 nt, hsa; identical to SEQ ID NO: 77590

SEQ ID NO: 157626 - RNA, 59 nt, hsa
acaacggucagcacuccucucccagccccccugcccacuguucucaauaaaaugugagu

SEQ ID NO: 157627 - RNA, 59 nt, hsa
gguuggggaccgaaaggacagggaugccgccugcccaguguuucugggccucacggugc

SEQ ID NO: 157628 - RNA, 59 nt, hsa
uccccccggccaccucucuacccguccagccugcccagacccucucagaggaacggggu

SEQ ID NO: 157629 - RNA, 59 nt, hsa
caaggggcaaggcugggccccuagcuuguccugcccauuccuccagguguugaucuuga

SEQ ID NO: 157630 - RNA, 59 nt, hsa
cccuggcaacaggaaccugggcagcuuauccugcccacagguaagccccugggagcauc

SEQ ID NO: 157631 - RNA, 59 nt, hsa
ucccuguguggucccucccuucgugugccccugcccagccucuuggcaccuccuguuua

SEQ ID NO: 157632 - RNA, 59 nt, hsa
gguuucaaacaagacaaaaggcauuccucccugcccaaucccagugcagucaaggccaa

SEQ ID NO: 157633 - RNA, 59 nt, hsa
uggcaccuuucccuucugaaagucugguuccugcccagugacccuuggccuugugagcc

SEQ ID NO: 157634 - RNA, 59 nt, hsa
cagccccacacccucauuuauaccaauuaccugcccaguaacuguggacuuuugcuucc

SEQ ID NO: 157635 - RNA, 59 nt, hsa
cuuuccuaugggcaaggcccagugcucuuccugcccaccagggaccauggagcaguggc

SEQ ID NO: 157636 - RNA, 59 nt, hsa
cagacugcaauaacuggaggcgccuccuuccugcccacccuucgcucacgccccagcgc

SEQ ID NO: 157637 - RNA, 59 nt, hsa
cccugccaggucccgcgcaccaucccugcccugcccacgugguauugcugggcuccugg

SEQ ID NO: 157638 - RNA, 59 nt, hsa
ccugaucagcccguaucaucugaggccugccugcccacccugccacccuccccucccuu

SEQ ID NO: 157639 - RNA, 59 nt, hsa
agaugccaacuggagggccagaccuguguccugcccauguccuccuugguggacguuuc

SEQ ID NO: 157640 - RNA, 59 nt, hsa
ucuguuuacucagagcugcuagagaccauccugcccauccgaguucugagauugggacu

SEQ ID NO: 157641 - RNA, 59 nt, hsa
ugcuaugauggugguauccgaggccuuucccugcccagucuggugccugccccacauug

SEQ ID NO: 157642 - RNA, 59 nt, hsa
gggauccaagaccugagauaaagcaacagccugcccagaucccucuguucauccuaucc

SEQ ID NO: 157643 - RNA, 59 nt, hsa
cugccauugccuccucuccauugcagacgccugcccaucaaguauuaccugcggcgacu

SEQ ID NO: 157644 - RNA, 59 nt, hsa
gcucaacuucaccaagaugcauucucauaccugcccacagcuccauuuuggaggcaggc

SEQ ID NO: 157645 - RNA, 59 nt, hsa
uuccucaccucucagccuccagaucccuuccugcccaucccuucccuacaaugcccacu

SEQ ID NO: 157646 - RNA, 59 nt, hsa
gugaguggcaaguggcuuaucuggagccaccugcccaagucuuacuaaaaugcagcugu

SEQ ID NO: 157647 - RNA, 59 nt, hsa
gaaagaaagcacauccaaagcauaguuuaccugcccacgaguucuggaaagguggccuu

SEQ ID NO: 157648 - RNA, 59 nt, hsa
cuuuaggaacacaguuggaggucaccucuccugcccagcucccgcacccugcguuuagg

SEQ ID NO: 157649 - RNA, 59 nt, hsa
aguaguacaagcuccccucagccagccugccugcccagcgaggcccccagguucaaggu

SEQ ID NO: 157650 - RNA, 59 nt, hsa
accugguacagguagguggcgcucacguuccugcccaaaugcagcccaucggggaguca

SEQ ID NO: 157651 - RNA, 59 nt, hsa
aauaccauccugcccauuguccuuaccguccugcccauacagacuguggcuccuuccuc

SEQ ID NO: 157652 - RNA, 59 nt, hsa
gagauggcauagagaagaucuaauaccauccugcccauuguccuuaccguccugcccau

SEQ ID NO: 157653 - RNA, 59 nt, hsa
ugcaugggagagcugucccuccuucuccaccugcccaccgggacacucccccugcucuc

SEQ ID NO: 157654 - RNA, 59 nt, hsa
gccucguccaggucucuaucucccaaagaccugcccaccuccugggcucucccagggaa

SEQ ID NO: 157655 - RNA, 59 nt, hsa
gcacacaagacgggagucacccugugcuuccugcccaagauacugacccauugaacccc

SEQ ID NO: 157656 - RNA, 59 nt, hsa
cucucuggccauugcagagcugcuggccuccugcccagguggaggguccuggggacggc

SEQ ID NO: 157657 - RNA, 59 nt, hsa
gccccaaggcuggggccacagcuccuaccccugcccagcagcccugagcucagcugcag

SEQ ID NO: 157658 - RNA, 59 nt, hsa
ccgaguagagggcaucccggagcccccagccugcccacuacauccagccuguggcuuug

SEQ ID NO: 157659 - RNA, 59 nt, hsa
ugagaggccuaauagggcagagauggaggccugcccagacuaggaggcagcggggauag

SEQ ID NO: 157660 - RNA, 59 nt, hsa
ccaccuccgcauccacccccguccgccauccugcccaccaccaggucgguucccgaggc

SEQ ID NO: 157661 - RNA, 59 nt, hsa
agggcuucgggggagugguuacccugcucccugcccagugacaagcccuccuuuccccu

SEQ ID NO: 157662 - RNA, 59 nt, hsa
uccccugggggcccuccuuuccccugcucccugcccagcuacggggcccuccuuucagc

SEQ ID NO: 157663 - RNA, 59 nt, hsa
uguccuggugcccaggagcccuccagcccccugcccacagaagggaaggccugcagagg

SEQ ID NO: 157664 - RNA, 59 nt, hsa
gcagugaagguucuucucugugugggugcccugcccacccccuccuuugccuguguccu

SEQ ID NO: 157665 - RNA, 59 nt, hsa
agugagggaaaaacguuaggugcuaaccaccugcccagaagaguggaucucacagccca

SEQ ID NO: 157666 - RNA, 59 nt, hsa
aggaacccaagccaccccggcuccccucgccugcccaggggccguggugacucacgggc

SEQ ID NO: 157667 - RNA, 59 nt, hsa
gcugucccuguggacccgccauccaccguccugcccacgccgccucagccugccaccuc

SEQ ID NO: 157668 - RNA, 59 nt, hsa
cuggguucucuccuucuucuuccugcuguccugcccaagaacugagggucuccccggcc

SEQ ID NO: 157669 - RNA, 59 nt, hsa
ugcccugccagagacagacccaugcgcugccugcccaccgugccccuuuguccccaugu

SEQ ID NO: 157670 - RNA, 59 nt, hsa
aaugucuaccucugaagccuccuucccugccugcccaccccuccaugcuccacgcaggc

SEQ ID NO: 157671 - RNA, 59 nt, hsa
gagacuauuugcugugggcucuccuccagccugcccagggcccacccagaugccucugg

SEQ ID NO: 157672 - RNA, 59 nt, hsa
cgggcacaagaaaccagaguccugcccagccugcccauccccuucccagucagggcucc

SEQ ID NO: 157673 - RNA, 59 nt, hsa
uagucuuuccgggcacaagaaaccagaguccugcccagccugcccauccccuucccagu

SEQ ID NO: 157674 - RNA, 59 nt, hsa
agcuguggcauccacuguggcaucuccguccugcccaccuucuuaagaggcgagaugga

SEQ ID NO: 157675 - RNA, 59 nt, hsa
aauuuaaaaugauccauggccacagggcuccugcccaggggcuugucaccuuccccucc

SEQ ID NO: 157676 - RNA, 59 nt, hsa
cauaccgggccucuggcccagaccuaagcccugcccacaaagacuaauggaugccagug

SEQ ID NO: 157677 - RNA, 59 nt, hsa
aaguacagccacuguaaauaacccucgucccugcccaggaacccagacuggacuucagu

SEQ ID NO: 157678 - RNA, 59 nt, hsa
uugccuccugaggcgcagcgcacuccuccccugcccaagccuacugccucccgcugccg

SEQ ID NO: 157679 - RNA, 59 nt, hsa
ggcgcugcucagcuugggcugguccagggccugcccaggcuggggcaccuuugccuccu

SEQ ID NO: 157680 - RNA, 59 nt, hsa
agcugccccauucuuuuaacguuguagggccugcccauggagcggacccuccucuuugg

SEQ ID NO: 157681 - RNA, 59 nt, hsa
uuuuaggccucacucccaucagaacccugccugcccaccugcaacucccccccaacaau

SEQ ID NO: 157682 - RNA, 59 nt, hsa
ugccgggcacaugcccgggggacgccugcccugcccagguggccuccuggcccgcccuc

SEQ ID NO: 157683 - RNA, 59 nt, hsa
ggccggccggaccucugagcacauaguguccugcccacccuaccagcuccuccagcccu

SEQ ID NO: 157684 - RNA, 59 nt, hsa
guugcacgggagaacuuuccucacccgccccugcccagacagggugaggaaagggcucc

SEQ ID NO: 157685 - RNA, 59 nt, hsa
aucaaguaucugagccagaugcugcgggaccugcccagcugcccgugugccuacccacu

SEQ ID NO: 157686 - RNA, 59 nt, hsa
gggaaguagagauguggcggcuuucccacccugcccacagcaggcccuccugcccagcu

SEQ ID NO: 157687 - RNA, 59 nt, hsa
gcuuucccacccugcccacagcaggcccuccugcccagcugcucuugucagcccucugg

SEQ ID NO: 157688 - RNA, 59 nt, hsa
gcccagagugaccaagcagcaccagcaggccugcccaggaugcugaaagcagauuucuu

SEQ ID NO: 157689 - RNA, 59 nt, hsa
ugccccacuggugagaggaggaccuugugccugcccagagccugcaggacagcacgccu

SEQ ID NO: 157690 - RNA, 59 nt, hsa
gcugcuugcucagaaacaacccgugcaucccugcccauggauucugcaggaccuagaag

SEQ ID NO: 157691 - RNA, 59 nt, hsa
cugccugggggcuaugugcacuccagaccccugcccaggcucaggcccaugagguaugg

SEQ ID NO: 157692 - RNA, 59 nt, hsa
cagaggccaggaggggaccuggugugucaccugcccaccaccuggcucaucccucaggc

SEQ ID NO: 157693 - RNA, 59 nt, hsa
uauccugucuguccccaccccagcuguccccugcccagggagcuggcauaaaagcacga

SEQ ID NO: 157694 - RNA, 59 nt, hsa
cugcuugagaacagagacugcuaccccauccugcccaugcaggcaggcucuugccagcc

SEQ ID NO: 157695 - RNA, 59 nt, hsa
gagggcagacgccacccuggacugcucucccugcccagcugggccucucuggccuauuc

SEQ ID NO: 157696 - RNA, 59 nt, hsa
cuguccccgggacugagcugccaugccagccugcccacagcagccuccuagaguuagca

SEQ ID NO: 157697 - RNA, 59 nt, hsa
guagugacacucaggauccaaaagcuagcccugcccaccccagccccuggaccugcuua

SEQ ID NO: 157698 - RNA, 59 nt, hsa
agcucgccugcccugcuuggcucugaggaccugcccagcgcucaaagggaacggaagcc

SEQ ID NO: 157699 - RNA, 59 nt, hsa
cuugcccuagcaugaggcucugagagccaccugcccaccaaucuggugaggauaauggu

SEQ ID NO: 157700 - RNA, 59 nt, hsa
ccuccauuccggaccccaugggcccagccccugcccaucuaguugguuuggggacccug

SEQ ID NO: 157701 - RNA, 59 nt, hsa
acccugugacugagccuguguccugucugccugcccagccaugcuccaucggcugugag

SEQ ID NO: 157702 - RNA, 59 nt, hsa
ggcagccgccaggcgagcaggcugcuuucccugcccagucaugcaccucccccucuggg

SEQ ID NO: 157703 - RNA, 59 nt, hsa
uggcaaucagggccgcaguguguucugcgccugcccagagcugacuccugauuuaaccg

SEQ ID NO: 157704 - RNA, 59 nt, hsa
uggauccuugccaggcgucccugauccucccugcccaagucuuccuucgugagcuggcc

SEQ ID NO: 157705 - RNA, 59 nt, hsa
cacagccucccucccuccagcaagcccucccugcccagaaggaauggguccaggugugg

SEQ ID NO: 157706 - RNA, 59 nt, hsa
agcccacaagaucugagugaaaaaagucaccugcccaauaaagcuugacaagacacucg

SEQ ID NO: 157707 - RNA, 59 nt, hsa
gcccccagcuggaaguuaagagaaagucaccugcccaagaaacaccgagugaggccaua

SEQ ID NO: 157708 - RNA, 59 nt, hsa
ugcagacgcagggggacugcacaauuccaccugcccaggaccugacccuggcgugugcu

SEQ ID NO: 157709 - RNA, 59 nt, hsa
gauggcucuggccucgguccucccccaacccugcccaagccagacagacagcaccugca

SEQ ID NO: 157710 - RNA, 59 nt, hsa
aucagacgugcucccucccauccuccagcccugcccacccucccuccacuccucucaac

SEQ ID NO: 157711 - RNA, 59 nt, hsa
acccugaccguguacauagcccuggugcuccugcccagccaccccucagaugcguucgc

SEQ ID NO: 157712 - RNA, 59 nt, hsa
ugccccucuguucucuccccucacauccuccugcccagcuccucacauacccacacauu

SEQ ID NO: 157713 - RNA, 59 nt, hsa
cguuccuucgcacacugugauuuugcccuccugcccacgcagaccugcagcgggcaaag

SEQ ID NO: 157714 - RNA, 59 nt, hsa
guuggcuucuucccaggccuugcaugggcccugcccacaagcacacccucaggccgagg

SEQ ID NO: 157715 - RNA, 59 nt, hsa
agugggguuugaagcagaguucagggaacccugcccaagguccuccuguucagacauuc

SEQ ID NO: 157716 - RNA, 59 nt, hsa
acugggccgggcccagggccucuggcuucccugcccaauccucccuggagaagggacau

SEQ ID NO: 157717 - RNA, 59 nt, hsa
ccacuagcuaagcaagccaggagaagaccccugcccaaguggcucuugggacaacgugc

SEQ ID NO: 157718 - RNA, 59 nt, hsa
agguguggaccggccgcagcccccacugaccugcccauguccagagggacuggacagcc

SEQ ID NO: 157719 - RNA, 57 nt, hsa; identical to SEQ ID NO: 77684

SEQ ID NO: 157720 - RNA, 59 nt, hsa
cagaguggcgugagcugcccggcgccugcccugcccaagugaccagggaagugugugug

SEQ ID NO: 157721 - RNA, 59 nt, hsa
uggccagcgccagggcccaggccauguggccugcccagccucaaugucacuugguggcg

SEQ ID NO: 157722 - RNA, 59 nt, hsa
gucuuucugucuguuuaccugucucccugccugcccaucugcaucuuuugcagcccacu

SEQ ID NO: 157723 - RNA, 59 nt, hsa
ccccgaagcccaccugcaaucucccaccuccugcccaucccucucuugagggagcagca

SEQ ID NO: 157724 - RNA, 59 nt, hsa
gaggccugaagcggaagcaccacaucgucccugcccaucucacucucucccuugaugau

SEQ ID NO: 157725 - RNA, 59 nt, hsa
ccacaggcauaugguggagagggggguacccugcccaccuuggggugguggcaccagag

SEQ ID NO: 157726 - RNA, 59 nt, hsa
gggaaggucucugaucacacagaagcagcccugcccagccuggucauuugcuguccgcu

SEQ ID NO: 157727 - RNA, 59 nt, hsa
cagggaagugaaaggucccaggcacacacccugcccauugcagguggcucuuacagcuc

SEQ ID NO: 157728 - RNA, 59 nt, hsa
auaauccagugggggugacugggugcacaccugcccaggugaacacagcggcugccagu

SEQ ID NO: 157729 - RNA, 59 nt, hsa
auugguuauaauaacaguuaucaguaauuccugcccagaagacuuuuauuuauuuuuuu

SEQ ID NO: 157730 - RNA, 59 nt, hsa
caucuggagauacaggcccaccccucaguccugcccacagagaggcuuggucggucucc

SEQ ID NO: 157731 - RNA, 59 nt, hsa
ggcccugcugaaguccagacccucccccuccugcccacugugcucuaaacccugcucag

SEQ ID NO: 157732 - RNA, 59 nt, hsa
cugcauucccuggagacucacugcaaguuccugcccaggaggcugagggcaccccaucc

SEQ ID NO: 157733 - RNA, 59 nt, hsa
ucguacacggagacuggcagcgccgacguccugcccaccacgcacucccggagagcacg

SEQ ID NO: 157734 - RNA, 59 nt, hsa
aagcagcacgugugagcugggccaggagcccugcccaccuccgugcagcugaccugccc

SEQ ID NO: 157735 - RNA, 59 nt, hsa
ugcugauacacacuguuguuaggccugcaccugcccauccagaaagcagcagcugccuu

SEQ ID NO: 157736 - RNA, 59 nt, hsa
uccggcucacacacgcccugccugcccucccugcccagcuguaaggaccgggggucucc

SEQ ID NO: 157737 - RNA, 59 nt, hsa
uaaacagacccccuucugcuccgcuuccuccugcccagccaggcaacacccucaaccgg

SEQ ID NO: 157738 - RNA, 59 nt, hsa
aaaugcugagcccugauccaaaguugucuccugcccaugagcaccacagucaggccuug

SEQ ID NO: 157739 - RNA, 59 nt, hsa
uagcccacaauucuccauuucacuugaccccugcccaccucuccaaccuaacuggcuua

SEQ ID NO: 157740 - RNA, 59 nt, hsa
acacccugauagcacaaucuccuuggggcccugcccaccuccaggccucucccaccuca

SEQ ID NO: 157741 - RNA, 59 nt, hsa
ccgaggccaccgccccccccuccgcugccccugcccaccccgaggcagggcuggggcuu

SEQ ID NO: 157742 - RNA, 59 nt, hsa
ccaguccucccagggaguccucgagucgcccugcccagagcccuggcaccagagacgcc

SEQ ID NO: 157743 - RNA, 59 nt, hsa
caaacaaaccaaccagagggagaagagccccugcccacugcacucuuugguucucugcu

SEQ ID NO: 157744 - RNA, 59 nt, hsa
gcuuguugaagaugaauucuugaauucugccugcccacccccggccagaucccuggagc

SEQ ID NO: 157745 - RNA, 59 nt, hsa
gcugcaggcauggcugucuccugccccugccugcccaucuggccuauaccccagccgug

SEQ ID NO: 157746 - RNA, 59 nt, hsa
cuucugugaccccgcugugguaaguccagccugcccagggcugcugagggcugccucuu

SEQ ID NO: 157747 - RNA, 59 nt, hsa
ggcucaggcuguaaaaguagcugagccauccugcccauuccuggagguccuacagguga

SEQ ID NO: 157748 - RNA, 59 nt, hsa
auagacguauccaaugggaaaacagcggaccugcccagagcagggaggugucguggaac

SEQ ID NO: 157749 - RNA, 59 nt, hsa
aucgucucaacaccaccaaguuuguaggaccugcccaaguucuaguaguauucaaaacu

SEQ ID NO: 157750 - RNA, 59 nt, hsa
uugccugguuccauauggcuccuuccagcccugcccaccaagugcagcucccacuuucc

SEQ ID NO: 157751 - RNA, 59 nt, hsa
gcccaccaagugcagcucccacuuuccauccugcccauacgccccucuucccccgacau

SEQ ID NO: 157752 - RNA, 59 nt, hsa
agagcuucagugagguuuccgagccucucccugcccauccucaccacugaggccacgac

SEQ ID NO: 157753 - RNA, 59 nt, hsa
ccgcucuccaaggugugcuagcagugggcccugcccaacuucaggcagaacagggaggc

SEQ ID NO: 157754 - RNA, 59 nt, hsa
gccugggagucgggcggccccggucaggcccugcccagagagcuccugguuccugaacu

SEQ ID NO: 157755 - RNA, 59 nt, hsa
cccacccgaggcucugcccaccgccuggaccugcccaccccugaaagacuggccccugg

SEQ ID NO: 157756 - RNA, 59 nt, hsa
gguuccuggcgcccugagguggcucagcaccugcccaggguaggccuggcaugaggggu

SEQ ID NO: 157757 - RNA, 59 nt, hsa
agauggccugccuuuggcugagagggcuaccugcccagccccucccccaacaagaucuc

SEQ ID NO: 157758 - RNA, 59 nt, hsa
ccugguauguuuuucuuauagauguuagcccugcccaacagccagggcuacacuacaaa

SEQ ID NO: 157759 - RNA, 59 nt, hsa
gacagcccagagccugccgcuacccucggccugcccaccaccaagcaagcagcaagcaa

SEQ ID NO: 157760 - RNA, 59 nt, hsa
uuuuguaccagucccugcucucaggccacccugcccaggacccaggcccgccucccccu

SEQ ID NO: 157761 - RNA, 59 nt, hsa
ggccaagcgcuggccccucagcggugagcccugcccacucuuaccgagcaaggugggug

SEQ ID NO: 157762 - RNA, 59 nt, hsa
aggacagagugcccuggggcauccaccuuccugcccaggggacguggcgcugucggugu

SEQ ID NO: 157763 - RNA, 59 nt, hsa
ccccuggcccugccucacugugaccugcuccugcccacgugcagcaccugucaccuuuu

SEQ ID NO: 157764 - RNA, 59 nt, hsa
gcugcucucggacuccugaucucaggugaccugcccaccucggccucccgaagugcugg

SEQ ID NO: 157765 - RNA, 59 nt, hsa
cugggcauaagcuucacaggacgggagaaccugcccaugguggacugucguucuccaca

SEQ ID NO: 157766 - RNA, 59 nt, hsa
cuccgagccccaggcagcggugauucagcccugcccaaccugauucugaugacugcgga

SEQ ID NO: 157767 - RNA, 59 nt, hsa
ggcgccugcugagcacuuccgccccucacccugcccagccccugccaugagcucugggc

SEQ ID NO: 157768 - RNA, 59 nt, hsa
guccccucucuccacacccagccccugcuccugcccaggcugcccugcccagcgccuca

SEQ ID NO: 157769 - RNA, 59 nt, hsa
cacccagccccugcuccugcccaggcugcccugcccagcgccucaucagccucugccuu

SEQ ID NO: 157770 - RNA, 59 nt, hsa
uuccccaucaggcugggcucuggcagggaccugcccaggauggagaugagagaggguga

SEQ ID NO: 157771 - RNA, 50 nt, hsa; identical to SEQ ID NO: 77736

SEQ ID NO: 157772 - RNA, 59 nt, hsa
cacgcacgccccgugcuguguuccugggcccugcccauggccucaauaaacucucugcu

SEQ ID NO: 157773 - RNA, 59 nt, hsa
ggugcuacccggagccccauucacccccaccugcccacuugggaaucugaggcagagga

SEQ ID NO: 157774 - RNA, 59 nt, hsa
uccuggccccaccagggccuugggcaaguccugcccaccauaggccucugcuaccugcc

SEQ ID NO: 157775 - RNA, 59 nt, hsa
gcacuggaguugucucuuaccccacccucccugcccaucaacuguaucugauuucacua

SEQ ID NO: 157776 - RNA, 59 nt, hsa
ggaggagcgucucaagugaacagugggagccugcccaccuggcacugcacuggaguugu

SEQ ID NO: 157777 - RNA, 59 nt, hsa
acuugaggggggucauauucccuccucagccugcccacgcacuggccuucccuccugcc

SEQ ID NO: 157778 - RNA, 59 nt, hsa
ucucugccuaccugccugagccauguucaccugcccacuuguccccugcugccugccca

SEQ ID NO: 157779 - RNA, 59 nt, hsa
auguucaccugcccacuuguccccugcugccugcccaaacaccccaccauuggccuguc

SEQ ID NO: 157780 - RNA, 64 nt, hsa
uauuauugacaauggcagagaacaauuaaaggguugacucaagaacuaguuccaaaccuagcag

SEQ ID NO: 157781 - RNA, 64 nt, hsa
ugguaacaagcuguuaucuuuuaagacauuuuaaugacucaaagguacacuauacauuuaccau

SEQ ID NO: 157782 - RNA, 64 nt, hsa
ccaacauaaaaauuauaauaggaauaauuugagaugacucaauauuacaaccucuucuucucuu

SEQ ID NO: 157783 - RNA, 64 nt, hsa
ccuuuuccauuuuggauuuaucucuuuacuguaaugacucaaaagguauuuaagaauugacgag

SEQ ID NO: 157784 - RNA, 64 nt, hsa
uucagcaaaacuuauaccuguauauguuuuuauuugacucaaaaauuagauauuuuaccauaua

SEQ ID NO: 157785 - RNA, 64 nt, hsa
uucucaagauuuuucuaaauacagccuuuaaauuugacucaaauggaaauugugcacuuuccug

SEQ ID NO: 157786 - RNA, 64 nt, hsa
acaguuggcagcagugaccucaguagggaacauguccgucuacccucucgcacucaugacaccu

SEQ ID NO: 157787 - RNA, 64 nt, hsa
cagccgggaugggaggcacguggccucucuuuuauccgucuauuuauuuuguaaguguauucgu

SEQ ID NO: 157788 - RNA, 64 nt, hsa
uagcauucccccagucccucccucuucaccuugcuccgucuaugucuucccagcucagccuuuu

SEQ ID NO: 157789 - RNA, 64 nt, hsa
cccguggaagaaaacagaacacacccuccucaguuccgucuaaauguguuucuucugcuucaau

SEQ ID NO: 157790 - RNA, 64 nt, hsa
aagacaguauacaguccuguggucuccuuggaaauccgucuaguuaacauuucaagggcaauac

SEQ ID NO: 157791 - RNA, 64 nt, hsa
aaggcuagaucaugaagaaccuugacggcauugcuccgucuaagucaugagcugagcagggaga

SEQ ID NO: 157792 - RNA, 64 nt, hsa
agggggguuggcaguugauuauguucuggaugauuccgucuauauaugugugaauaauguaagu

SEQ ID NO: 157793 - RNA, 64 nt, hsa
uaauuuugugcacauucuaauuaauuaaacuucuuccgucuaaaaaaagugggggaaauguaua

SEQ ID NO: 157794 - RNA, 64 nt, hsa
caaguaaaauaguaaagcacauagugaguguauguccgucuaacugguacauugauaauuuagu

SEQ ID NO: 157795 - RNA, 64 nt, hsa
gcacgguggggcgaugcugggcgcgagccguguuuccgucuauuguugacuuccucacgaugcu

SEQ ID NO: 157796 - RNA, 64 nt, hsa
agaaaauauaguuacugccugcaaagaauuaacauccgucuagugggagaaacaaacacacccc

SEQ ID NO: 157797 - RNA, 64 nt, hsa
agggaagggcuuuucuccacacaagggcagagaguccgucuagauuucuugcuguccugccagc

SEQ ID NO: 157798 - RNA, 64 nt, hsa
gccccgcagggggcuuggagggcuggacggcaaguccgucuagcucacgggccccuccagugga

SEQ ID NO: 157799 - RNA, 64 nt, hsa
gagaugguguucugagccauaguucucuaacaucuccgucuacauauaacacaaaacuuuuaua

SEQ ID NO: 157800 - RNA, 64 nt, hsa
ugugugugugugugugugugugugugugugcucuuccgucuaaggcaugaauaagaggggaggu

SEQ ID NO: 157801 - RNA, 64 nt, hsa
cagcucuuuucuagcgacugaaaguagaagucuguccgucuaugaacaugcgggggaaggaucc

SEQ ID NO: 157802 - RNA, 61 nt, hsa
gcugcagagacaagagauaauuccagcagaauccgucuaagaagaccuuucauguacuucc

SEQ ID NO: 157803 - RNA, 64 nt, hsa
auucaaguauucauuguugauccuccuauucucuuccgucuaaucucucaccugcuaaaggaga

SEQ ID NO: 157804 - RNA, 64 nt, hsa
uauguagguuuaucagugaaaugaaaggcuuguuuccgucuagucuaacuuuuugaguguguuu

SEQ ID NO: 157805 - RNA, 64 nt, hsa
uggcucucuggucuaggcccuuugggcaagaauguccgucuacccggcuuccaccacccucugg

SEQ ID NO: 157806 - RNA, 64 nt, hsa
auggagcuucaaggaaagaaaccccucaguuuuuuccgucuaguccgccaccucauuccccauu

SEQ ID NO: 157807 - RNA, 64 nt, hsa
ugggugcuuuuccuccaguuugcuggcuggcuucuccgucuacccacagugaccucacagagag

SEQ ID NO: 157808 - RNA, 64 nt, hsa
cccuguuuaauaacgaaggggugggggagagcaguccgucuacaaccuggaaucagauuugcaa

SEQ ID NO: 157809 - RNA, 64 nt, hsa
auaaaguauuauaaauuguugugaauuugaagaauccgucuacuguauuauugcuaaauauuuu

SEQ ID NO: 157810 - RNA, 64 nt, hsa
ccaccugcucccucucuccucacuggccuuucuuuccgucuagcuuccucuucaggaaaugucc

SEQ ID NO: 157811 - RNA, 64 nt, hsa
uuguuuaccuuucgugcgguggauucuuuuuaacuccgucuaccuggcguuuuguuagaaaugu

SEQ ID NO: 157812 - RNA, 64 nt, hsa
caguccucauucccagcugccucuuccuacugcuuccgucuaucaaaaagcccccuuggcccag

SEQ ID NO: 157813 - RNA, 64 nt, hsa
cgggagcccggcugcacaccaggcugcugcuuuguccgucuauccacccgcccacccgccccca

SEQ ID NO: 157814 - RNA, 64 nt, hsa
aggcccuucagccagaagacugacaaagucauccuccgucuaccagagcgugcacuugugaucc

SEQ ID NO: 157815 - RNA, 64 nt, hsa; identical to SEQ ID NO: 102876

SEQ ID NO: 157816 - RNA, 64 nt, hsa; identical to SEQ ID NO: 102877

SEQ ID NO: 157817 - RNA, 61 nt, hsa
cuccagagaccauauuuucucucccuccauuucuacccagaccuccaggccuccuucugga

SEQ ID NO: 157818 - RNA, 61 nt, hsa
ccauagaggucaguuuuccucuuucuuggcuucuacccacaaacauucaccaaucauuuau

SEQ ID NO: 157819 - RNA, 61 nt, hsa
agguuauccaccucugccuggaagucuauacucuacccagggcaucccucuggucagaggc

SEQ ID NO: 157820 - RNA, 61 nt, hsa
aauaacuugaucccugaugacagagccaacuucuacccauugcagcagaccaauguguaca

SEQ ID NO: 157821 - RNA, 61 nt, hsa
uguuugaauuuauaaacaaggcugguggcugucuacccacccucccuucuagcagauuuug

SEQ ID NO: 157822 - RNA, 61 nt, hsa
aaccaaagugccugugacggggcggguggcgucuacccacccucccuucuagcagauucuu

SEQ ID NO: 157823 - RNA, 61 nt, hsa
aacuucagugggagagcugucugguucauauucuacccaggaaugguacuuuucagugcag

SEQ ID NO: 157824 - RNA, 61 nt, hsa
cacuguaggagauuuacuaauaucccuggccucuacccaguaguaccacuagcaccuauuc

SEQ ID NO: 157825 - RNA, 61 nt, hsa
accagcauguucuccccaaagacuggaauauucuacccaaaugucaggaccaggauuuucu

SEQ ID NO: 157826 - RNA, 61 nt, hsa
auauucuacccaaaugucaggaccaggauuuucuacccagagaccaagguguucuucccaa

SEQ ID NO: 157827 - RNA, 61 nt, hsa
accaagguguucuucccaaagaccaaaauauucuacccauaugucaggaccaggauuuucu

SEQ ID NO: 157828 - RNA, 61 nt, hsa
auauucuacccauaugucaggaccaggauuuucuacccagagaccaagguuaucuuccuaa

SEQ ID NO: 157829 - RNA, 61 nt, hsa
accaagguuaucuuccuaaagaccaaaauauucuacccauaugucaggaccgggauuuucu

SEQ ID NO: 157830 - RNA, 61 nt, hsa
auauucuacccauaugucaggaccgggauuuucuacccagagaccugcauguucucuccaa

SEQ ID NO: 157831 - RNA, 61 nt, hsa
accugcauguucucuccaacgaccagaauauucuacccaaaugucaggaccaagauuuucu

SEQ ID NO: 157832 - RNA, 61 nt, hsa
ugcacaucaugaugacuuuaccuccauucccucuacccagaacccuaaauuauucuguuau

SEQ ID NO: 157833 - RNA, 61 nt, hsa
auuggggagguuggucagggaagagagggguucuacccacagaucaacuguguaaucuuuu

SEQ ID NO: 157834 - RNA, 61 nt, hsa
gaagaauggaagguaaggggaaggucugucaucuacccaggacauucccaugaugaguaca

SEQ ID NO: 157835 - RNA, 61 nt, hsa
caguauuucacuuuuaaaaagacaaggcaucucuacccauuaacucugcaagccacuccac

SEQ ID NO: 157836 - RNA, 61 nt, hsa
aaagaauauacauucuuuucaccccucccagucuacccauccagccuucaugauucauucc

SEQ ID NO: 157837 - RNA, 61 nt, hsa
guaaaucagauaaaugcuuggaauuugauugucuacccaaucaacaguuuucccucuuugc

SEQ ID NO: 157838 - RNA, 64 nt, hsa
aaaaagguacuuaaacaguuauagucaccaucaccugcuucagaauggucuuuuagauuugugu

SEQ ID NO: 157839 - RNA, 64 nt, hsa
ucuuuccaucacaaaacggguagaaacacauucacugcuucaggguucuaaucugugugucucc

SEQ ID NO: 157840 - RNA, 64 nt, hsa
ugcaaccuccgccucccagguucaagcgauucuccugcuucaaccuccugaguagcugggauua

SEQ ID NO: 157841 - RNA, 64 nt, hsa
uacaggccagcuugcugugcugcgcucugagcuccugcuucaugcuucuucuccaacccagcuc

SEQ ID NO: 157842 - RNA, 64 nt, hsa
ccauuugggacaucaagccuagcaucucggggaccugcuucacaaguuacaguucguccugaca

SEQ ID NO: 157843 - RNA, 64 nt, hsa
ggagcgucuuggcugccgcccugcuccacgcagucugcuucagugcagugaagguaggugugag

SEQ ID NO: 157844 - RNA, 64 nt, hsa
ggacaaacaacagugaaaaugcagcaucugucuccugcuucacagggucgacugucagggugac

SEQ ID NO: 157845 - RNA, 64 nt, hsa
acuccuugccguucagccacugugaaaccagaaucugcuucacagaaaaaagcaucucaguuag

SEQ ID NO: 157846 - RNA, 64 nt, hsa
guuugaacuguuccagugucaacugccaugugcucugcuucaagggggaacuagccuuuuguga

SEQ ID NO: 157847 - RNA, 64 nt, hsa
uuguguucauauaguaacugcacagggcuuauagcugcuucauucugcuacuuuguaacuagga

SEQ ID NO: 157848 - RNA, 64 nt, hsa
gccuaggcucccgaacuccugagcucaagcaauccugcuucagccucccaaaguacugggauua

SEQ ID NO: 157849 - RNA, 64 nt, hsa
cacuuucagucuccuauaacccucccaccagcugcugcuucagguauaauguuacagcaguuug

SEQ ID NO: 157850 - RNA, 64 nt, hsa
gcugcugcagagcuagaaggcccugcagcuacagcugcuucauucccugcauuagugccugguu

SEQ ID NO: 157851 - RNA, 64 nt, hsa
cgggcuacagagcuagaaggcccugcagcuacagcugcuucauucccugcauuagcgagcaguu

SEQ ID NO: 157852 - RNA, 64 nt, hsa
ucaaggacuuugcugcuguuuuccuaugucauuucugcuucagcucuuugcugcuucacuucuu

SEQ ID NO: 157853 - RNA, 64 nt, hsa
uguuuuccuaugucauuucugcuucagcucuuugcugcuucacuucuuuguaaaguuguaaccu

SEQ ID NO: 157854 - RNA, 64 nt, hsa
uaggauacagggcagggauaaauacagugcaugucugcuucaauuagcagaugccgcaacucca

SEQ ID NO: 157855 - RNA, 64 nt, hsa
uaaacagaaaugccaaauugaugguuaauuguugcugcuucaaaaauaaguauaaaauuaauau

SEQ ID NO: 157856 - RNA, 64 nt, hsa
ucccucuuuuccccagccucuggcaaccaccauucugcuucaugacauugauuuuauucacuua

SEQ ID NO: 157857 - RNA, 64 nt, hsa
aaauuuucauggacaugcaaucuuaucuaaaagccugcuucagggcugggcgcgguggcuaaca

SEQ ID NO: 157858 - RNA, 64 nt, hsa
agucggcccaggacggucuacucagcacaacugacugcuucagugcugcuaucagaagaugucu

SEQ ID NO: 157859 - RNA, 64 nt, hsa
acuccccuacgccccuucaaccuuuuuucucugucugcuucaccugagaagaaaguguacgaag

SEQ ID NO: 157860 - RNA, 64 nt, hsa
uuucuuuugcugguuauaguugcuaauucuaaagcugcuucagacugcuucaugaggagguuaa

SEQ ID NO: 157861 - RNA, 64 nt, hsa
ugguuauaguugcuaauucuaaagcugcuucagacugcuucaugaggagguuaaucuacaauua

SEQ ID NO: 157862 - RNA, 64 nt, hsa
aaauguuuacauauguuuacauguuugugugcaacugcuucauugcuauuaauaguuaaaugaa

SEQ ID NO: 157863 - RNA, 64 nt, hsa
uuaugacaaauaaauaugccauguaauaugaaagcugcuucagcuuuuuaugagcuuucacauu

SEQ ID NO: 157864 - RNA, 64 nt, hsa
ucguguugccuacaugucccuggcuguugaggcgcugcuucagccugcaccccucccuugucuc

SEQ ID NO: 157865 - RNA, 64 nt, hsa
cugcaagggagccccuagccccuggcagacauagcugcuucagugccccuuuucucucugcuag

SEQ ID NO: 157866 - RNA, 64 nt, hsa
ugcaagcucugucuccuggguucaugccauucuccugcuucagccucccgaguagucccaggag

SEQ ID NO: 157867 - RNA, 64 nt, hsa
gacaacuuuacaauuuacuggcuuccaagacuuccugcuucaaaacccccagccagacuauuca

SEQ ID NO: 157868 - RNA, 64 nt, hsa
ugauagacucaagcauaaaacuuggcaguuuuaucugcuucaaaaugccauugaucauuauucc

SEQ ID NO: 157869 - RNA, 64 nt, hsa
uuuacaaugacuuaauauaagacugacuuuuauccugcuucauaacuuguauggagaacucacc

SEQ ID NO: 157870 - RNA, 64 nt, hsa
aguugcagacucaucaccaugguuaccauagugacugcuucauugccaugguuacauacuaauu

SEQ ID NO: 157871 - RNA, 64 nt, hsa
cauacuaauugcugcagcucuguggcccagcccacugcuucagcugugggccaucugaggguac

SEQ ID NO: 157872 - RNA, 64 nt, hsa
cuguccaaccuccuuucugguagauuccuuucuccugcuucauauaggccaaaccucagggcaa

SEQ ID NO: 157873 - RNA, 64 nt, hsa
gucacagguugcucuccuuguaacucauaccugucugcuucagcaacugcuuugcaaugacauu

SEQ ID NO: 157874 - RNA, 64 nt, hsa
uccauaaccaccaaaaauacuauggagagcuacacugcuucaguggggaccaagcagucauuug

SEQ ID NO: 157875 - RNA, 64 nt, hsa
ugcugugcaguucaaccaucuggagguggucaaacugcuucaagauuaccaggacuccuacaca

SEQ ID NO: 157876 - RNA, 64 nt, hsa
guuugaguucuguaagucuucguguucugacuuacugcuucagagggauuggccuguccccuuu

SEQ ID NO: 157877 - RNA, 64 nt, hsa
aguccagcagccuggcugacccacuauuucuccucugcuucagaggaaacccaggaaaugcccu

SEQ ID NO: 157878 - RNA, 64 nt, hsa
cacuuugcucugauuauggaaaagucuucaagggcugcuucaaacucaaacacagagagaaacu

SEQ ID NO: 157879 - RNA, 64 nt, hsa
cuccuuccaacugcugccccaaaggaagcuuucucugcuucagcuugcuucauugggcuguuuu

SEQ ID NO: 157880 - RNA, 64 nt, hsa
caagaggccucaguuuagcaccuuaguaccuccgcugcuucacuugcuuuagccaaagccauaa

SEQ ID NO: 157881 - RNA, 64 nt, hsa
gcaugaggaacccucuuuccuccgcucagagaugcugcuucauuuacccaggaggucauauucu

SEQ ID NO: 157882 - RNA, 64 nt, hsa
ccaaggaauuucugcucugguuagaaaaaggacucugcuucaguccacuucugcucugguuaga

SEQ ID NO: 157883 - RNA, 64 nt, hsa
ucaguccacuucugcucugguuagaaaaaggacucugcuucaguccacaguacauaaaauguac

SEQ ID NO: 157884 - RNA, 64 nt, hsa
aaugaagaucacguucagaagaauggaaggaaagcugcuucauuuuugaaagaugauggagacc

SEQ ID NO: 157885 - RNA, 64 nt, hsa
accacuacuauaugaugaauagcacuaauacccacugcuucaguguuaacacagcagugauugu

SEQ ID NO: 157886 - RNA, 64 nt, hsa
uuccaagcaggccucaccagucucuuucucuuuccugcuucaccccugcaaugagccaagaacc

SEQ ID NO: 157887 - RNA, 64 nt, hsa
gugagugucacuacuuggcuuugcuuagcagguucugcuucacacuuguucuuugaccugcuga

SEQ ID NO: 157888 - RNA, 64 nt, hsa
caucaggaacugagcagguccaggacucagcuuucugcuucagccuaagccaguacuccuuguu

SEQ ID NO: 157889 - RNA, 64 nt, hsa
uuuuucccccguggggaaauaaacugacuuuggacugcuucagucucugccaucuuccaugacu

SEQ ID NO: 157890 - RNA, 64 nt, hsa
guuggcugguuugaacgauagaaauaugcagcaugcaauauaugcuuauauuucauuuuaauuu

SEQ ID NO: 157891 - RNA, 64 nt, hsa
gaaucuuugauguuuuuugucauuguucucaagugcaauauaacaauguaaccaaaucuagaua

SEQ ID NO: 157892 - RNA, 64 nt, hsa
auuuucacuaggaaaagaaaucaaauaugcuuaugcaauauauauuuguguguuuuuccuuaau

SEQ ID NO: 157893 - RNA, 64 nt, hsa
ucuuuuaucugcuaaguuguaccuuaauuagagggcaauauauguuucauaaagaagagucuuu

SEQ ID NO: 157894 - RNA, 64 nt, hsa
caaauuaaguacaaggaauguuuauucauuuucugcaauauacuauauguaauagggaauaccu

SEQ ID NO: 157895 - RNA, 64 nt, hsa
aucucucuaguaugaaagauuuggagggaguguugcaauauauauaaaugaaaacauuuaauug

SEQ ID NO: 157896 - RNA, 64 nt, hsa
auuguuuuguuggcucucaaacuuagcaaaauuagcaauauauuauccaaucuucugaacuuga

SEQ ID NO: 157897 - RNA, 64 nt, hsa
auuuugaaaaacacaaugauuccuucuuuucuaggcaauauaaggaaagugauccaaaauuuga

SEQ ID NO: 157898 - RNA, 64 nt, hsa
aauauuguguuuaaccacaugguauuaaaauuuugcaauauauuguguauuggucugauauuuu

SEQ ID NO: 157899 - RNA, 64 nt, hsa
acugcagagaucauguucauuuacauucccauuagcaauauauccaaugcucagaauugaaaau

SEQ ID NO: 157900 - RNA, 64 nt, hsa
ucuacacuuucucugaaucauuuagguuuaagauguaagugaacaauucuuucuuucugccaag

SEQ ID NO: 157901 - RNA, 64 nt, hsa
cauucugcagugagauugccgagaccugaagaggguaagugacuugcccaaggucagagccacu

SEQ ID NO: 157902 - RNA, 64 nt, hsa
aggacucaaucucugacccagcagaaaugugucuguaagugaaacugccaaugucugcaccauu

SEQ ID NO: 157903 - RNA, 64 nt, hsa
ucaacagaaaucuccgauaugauaaguuacaauuguaagugaugcuuguagauucucucacagg

SEQ ID NO: 157904 - RNA, 64 nt, hsa
uuauugucuucuagccuugagccucugagggucaguaagugaaguacagauagcaaaauuuuac

SEQ ID NO: 157905 - RNA, 64 nt, hsa
cuagguaaaauucaguauaauaggcugaaguggaguaagugaaaaccugccuuuugccacucuu

SEQ ID NO: 157906 - RNA, 64 nt, hsa
auccaauccuaaaacuuacauuccaaaggaauuauaucauuauguuccuaaggaguaaauauau

SEQ ID NO: 157907 - RNA, 64 nt, hsa
uaccagauuaauaaaaauuuaugaauauuaaaauuaucauuaauaauauaaaacacuuauuuga

SEQ ID NO: 157908 - RNA, 64 nt, hsa
ucugcuuucugaacucuaaugugccuucauugauuaucauuaaaauuaucauuaaaauugccuu

SEQ ID NO: 157909 - RNA, 64 nt, hsa
acucuaaugugccuucauugauuaucauuaaaauuaucauuaaaauugccuuauuucuauggac

SEQ ID NO: 157910 - RNA, 64 nt, hsa
ugcagaggacuugcuauuugccaggugcuuuauguaucauuaaauuuuucucauaguucagaaa

SEQ ID NO: 157911 - RNA, 64 nt, hsa
auuuaucauuaaauuuaguucuaucauuugguacuaucauuaauguauuauauacacugauacu

SEQ ID NO: 157912 - RNA, 64 nt, hsa
cuuuuuccuuuuaaauuuaguucuaucauuaauuuaucauuaaauuuaguucuaucauuuggua

SEQ ID NO: 157913 - RNA, 64 nt, hsa
acuuagaaugacuuuuuccuuuuaaauuuaguucuaucauuaauuuaucauuaaauuuaguucu

SEQ ID NO: 157914 - RNA, 64 nt, hsa
uuaaugugcauauaucauuauuuucagaugcagcuaucauuauuccaaaauacaaaauaaagaa

SEQ ID NO: 157915 - RNA, 64 nt, hsa
ugcucuuuuucuuaaauacucauuaaugugcauauaucauuauuuucagaugcagcuaucauua

SEQ ID NO: 157916 - RNA, 64 nt, hsa
aauaaacauuuauacuagauuuuuuauuuccacuuaucauuaaugauuuaauguuggauuucag

SEQ ID NO: 157917 - RNA, 64 nt, hsa
acuuuguacaggcuguuuugcaccugauuuuauuuaucauuagugccacgccaagaucauuuag

SEQ ID NO: 157918 - RNA, 64 nt, hsa
guguauuacuuaaagauacuauauacguuuuguauaucauuaaaucuuuaaaagaaaugaaaua

SEQ ID NO: 157919 - RNA, 64 nt, hsa
guuugugguacuuaagaaauuaauucaguuggauuaucauuaugugauacuggcagauugcagu

SEQ ID NO: 157920 - RNA, 64 nt, hsa
uugugaacauugcucuucauuuuggccuguacuucucccucagggacguagaacaauggaaugu

SEQ ID NO: 157921 - RNA, 64 nt, hsa
aaaacuuuuucuuuaaaauucaauuaagguacuucucccucagggacguagaacaauggaaugu

SEQ ID NO: 157922 - RNA, 64 nt, hsa
ugccuuguggcaugucugucuagccucuuccucccucccucaugaugaagugccauuucuguua

SEQ ID NO: 157923 - RNA, 64 nt, hsa
caaaauuauuucaucuuguauucuuuguaaaauucucccucaccccacccugcuuuuaaaaauu

SEQ ID NO: 157924 - RNA, 64 nt, hsa
gcaaaacucaagucccucuuccuccgugaagcuucucccucagcugagcagugaucacuuacuc

SEQ ID NO: 157925 - RNA, 64 nt, hsa
ggagggccuacggauggguccguagaggucccaccucccucauuccuccuuggccccucucccu

SEQ ID NO: 157926 - RNA, 64 nt, hsa
caguccccgaucgcugcugugagcaccucaguggcucccucagaccagaucccguaggcagccc

SEQ ID NO: 157927 - RNA, 64 nt, hsa
ggagauugcccuucccuaugccacgguucccacccucccucaccaguuuggacaauuugaaauu

SEQ ID NO: 157928 - RNA, 64 nt, hsa
guugcugcucccucaaccuuccugcugucuuccccucccucaaccccaauaggaggaucccagg

SEQ ID NO: 157929 - RNA, 64 nt, hsa
cuaaaguuaaucucuuggucuggccaaguugcugcucccucaaccuuccugcugucuuccccuc

SEQ ID NO: 157930 - RNA, 64 nt, hsa
aagugggggaggugagacagaucuggaaagccgucucccucagaugguuucauuuaaugcuuua

SEQ ID NO: 157931 - RNA, 64 nt, hsa
ccucccgugacagccggcaggcccagcccauccccucccucauccucgucuguccugucaccug

SEQ ID NO: 157932 - RNA, 64 nt, hsa
uaugguagcuaccucuuacuucaaauucuucugccucccucaugcucgcagccacucugugccc

SEQ ID NO: 157933 - RNA, 64 nt, hsa
uuccucccuuucucagucuaccuacucuuugugacucccucauaucuuuucccccuggcaugga

SEQ ID NO: 157934 - RNA, 64 nt, hsa
uccccgacuccucaccccugagccucacccugaacucccucaucuugcaaggccauaaguguuu

SEQ ID NO: 157935 - RNA, 64 nt, hsa
ccuuagcccccuguaugacccuaugcaaguccuccucccucaucucaaaggguccucaaagcuc

SEQ ID NO: 157936 - RNA, 64 nt, hsa
ucaaguugugauaaauuugaucccaauagaauaccucccucauuuaagaaaaaucauaacucac

SEQ ID NO: 157937 - RNA, 64 nt, hsa
guuuggaaauggagggaggaauuuucauugccuucucccucaugcaugaagauucgaacagcuu

SEQ ID NO: 157938 - RNA, 64 nt, hsa
ucccuuagccgucuuacucaacugccccuuuccucucccucagaauuuguguuugcugccucua

SEQ ID NO: 157939 - RNA, 64 nt, hsa
cugucaaguggaauccuucccuuuccaacucuaccucccucacucagcuccuuuccccugauca

SEQ ID NO: 157940 - RNA, 64 nt, hsa
cucagacugggaaucccugaagauggggccgugucucccucaaaguggggcucccucaggacag

SEQ ID NO: 157941 - RNA, 64 nt, hsa
cugaagauggggccgugucucccucaaaguggggcucccucaggacagcguugugucuccccuc

SEQ ID NO: 157942 - RNA, 64 nt, hsa
cucagacugcggcucccugaggacggggcugugucucccucagacuggggcucccugaagaaag

SEQ ID NO: 157943 - RNA, 64 nt, hsa
cucagacuggggcucccugaagaaagggcugcuucucccucagacuggagcucccugaagaugg

SEQ ID NO: 157944 - RNA, 64 nt, hsa
gcccguguggcagagcuguggacuuucuucucggcucccucaacccuggcucaggcacagaagg

SEQ ID NO: 157945 - RNA, 64 nt, hsa
uugccagcguugggugggacacccguggcggcugcucccucagaccucccuucuguggacugac

SEQ ID NO: 157946 - RNA, 64 nt, hsa
uguuuccaucucaggcauguaucccaccaagugccucccucacagccaugcccagaagccucac

SEQ ID NO: 157947 - RNA, 64 nt, hsa
cccuggggacuggggcgcuccucccucaggcuuucucccucagucuuggcuucuccagggcucu

SEQ ID NO: 157948 - RNA, 64 nt, hsa
ugcaccaggccggucccuggggacuggggcgcuccucccucaggcuuucucccucagucuuggc

SEQ ID NO: 157949 - RNA, 64 nt, hsa
gacugagccuuuuuggugcucccucagaggaacucucccucacccaggacagccuguggccuuu

SEQ ID NO: 157950 - RNA, 62 nt, hsa; identical to SEQ ID NO: 115690

SEQ ID NO: 157951 - RNA, 64 nt, hsa
ggacucucuggccaccuccuccaccgcaguccagcucccucagucuggcacccacugcuacacu

SEQ ID NO: 157952 - RNA, 64 nt, hsa
gccagcccggagcccacagugcugcccagcguaccucccucaccgucuggggcucuucugggag

SEQ ID NO: 157953 - RNA, 64 nt, hsa
uccccagacccagagguccaggucccagccccuccucccucagacccagcgguccaaugccacc

SEQ ID NO: 157954 - RNA, 64 nt, hsa
ccucagacccagggguccaggcccccaaccccuccucccucagacucagagguccaggccccca

SEQ ID NO: 157955 - RNA, 64 nt, hsa
cucagacccaggaguccagaccccccagccccuccucccucagacccaggaguccagccccucc

SEQ ID NO: 157956 - RNA, 64 nt, hsa
cccuccucccucagacccaggaguccagccccuccucccucagacccaggaguccagacccccc

SEQ ID NO: 157957 - RNA, 64 nt, hsa; identical to SEQ ID NO: 157955

SEQ ID NO: 157958 - RNA, 64 nt, hsa
cccucaaaccaaggguacagauccccagccccuccucccucagacccaggaguccagacccccc

SEQ ID NO: 157959 - RNA, 64 nt, hsa
ccucaggcccaggaguccaggcccccagccccuccucccucaaaccaaggguacagauccccag

SEQ ID NO: 157960 - RNA, 64 nt, hsa
gaaggaauucaggaauaucuguucccagccccuccucccucaggcccaggaguccaggccccca

SEQ ID NO: 157961 - RNA, 64 nt, hsa
ccucagacccgggaguccaggcccccagccccuccucccucagacccaggaguccaggccccag

SEQ ID NO: 157962 - RNA, 64 nt, hsa
ccucagacccaggaguccaggcccccagccccuccucccucagacccgggaguccaggccccca

SEQ ID NO: 157963 - RNA, 64 nt, hsa
acucaggacccaggaguccaggccccagccccuccucccucagacccaggaguccaggccccca

SEQ ID NO: 157964 - RNA, 64 nt, hsa
ccucagacccaggauucccgggccccaguaccuccucccucagacccaggacuccaggccccca

SEQ ID NO: 157965 - RNA, 64 nt, hsa
ccucagauccaggagucuaguccuccagcuccuccucccucagacccaggauucccgggcccca

SEQ ID NO: 157966 - RNA, 64 nt, hsa
uaucaacaccacuaggaaucccagaggugggauccucccucauggcucuggcacaguguaaucc

SEQ ID NO: 157967 - RNA, 64 nt, hsa
cccucucucugggcccaggggcuguggccgucuccucccucagcucucugggaccuccuuagcc

SEQ ID NO: 157968 - RNA, 64 nt, hsa
gcugucccaagcccaccccuccucccaccaucaccucccucaccucgggacaguagcccuccac

SEQ ID NO: 157969 - RNA, 64 nt, hsa
agaaaaacaggucucagcccaggguccucgcucacucccucacuccccacuuugaagccaucuc

SEQ ID NO: 157970 - RNA, 64 nt, hsa
ccuggggcucaagcgcugggccgcccacuccugccucccucaucugugucccgaguuccugaag

SEQ ID NO: 157971 - RNA, 64 nt, hsa
ccaggugguggccagagaggcuccaggggcuagacucccucaggaggcugaauugaaaaagggc

SEQ ID NO: 157972 - RNA, 64 nt, hsa
agccgcuaagacugcaagccuuacaccucaccaucucccucaugaguaagacugaaauaaaacu

SEQ ID NO: 157973 - RNA, 64 nt, hsa
aaugaauagaaacuucuuauaagccuuuuuccuacucccucagauuauguaauuuauuuguaag

SEQ ID NO: 157974 - RNA, 64 nt, hsa
aggggcugaguuaucagagcagcaacccuucuacccacccuacugaguccccauucuaccuucg

SEQ ID NO: 157975 - RNA, 64 nt, hsa
cuguucccagaccuggggucccuuggcuuuucgaccacccuagcacuggcccuaggaggggcug

SEQ ID NO: 157976 - RNA, 64 nt, hsa
cuuccaccugucccccagacccaaagcucucuccccacccuaccugcccaccuggggcuccugu

SEQ ID NO: 157977 - RNA, 64 nt, hsa
cuggggcuccugugcccccuccccacuccagaggccacccuacaaguuguccucaaggucaucc

SEQ ID NO: 157978 - RNA, 64 nt, hsa
cuaugugaucaucuaaaaaagggggagcuggccuccacccuauguuccauggauucggaacaag

SEQ ID NO: 157979 - RNA, 64 nt, hsa
aaaaaaaaaaauggccacaacaguugcacagugcccacccuauggccuagcuucagguacuuca

SEQ ID NO: 157980 - RNA, 64 nt, hsa
uagaacaaauaauaauacuauuuuugggcaaaauccacccuacuugaugaggaccauuugcuug

SEQ ID NO: 157981 - RNA, 64 nt, hsa
gucuucugguuucacaggcuucagcucauggguuccacccuaacuuggggaaacaaaagccuuc

SEQ ID NO: 157982 - RNA, 64 nt, hsa
agcuaggucggggccccaguuaagcugugccccaccacccuaggcaaugaggggcaggaaaggg

SEQ ID NO: 157983 - RNA, 64 nt, hsa
ccucaaagucauuugacugcccccauccaccccaccacccuaaucuuccaccaccucuccggcu

SEQ ID NO: 157984 - RNA, 64 nt, hsa
gaguuuauacucaccuuuuaugaaagcacugcaugaauaaaauuauuccuuuguauuuuuacuu

SEQ ID NO: 157985 - RNA, 64 nt, hsa
ccucuuuguguuuuauuuugguguccuauuaaaggaauaaaaugacacaacuugucccuuuuuu

SEQ ID NO: 157986 - RNA, 64 nt, hsa
ugugaucauuauuuggaaauauguccuauggaaagaauaaaagcauguacuucacagcuagcau

SEQ ID NO: 157987 - RNA, 64 nt, hsa
aaguuauaccuuuauuuugagcuguguauagguagaauaaaaaauuccuuucauaucguuauug

SEQ ID NO: 157988 - RNA, 64 nt, hsa
ccauuaaacugaaucagaaauccauuuucuggcugaauaaaaaguuuggcuugccuguguaaug

SEQ ID NO: 157989 - RNA, 64 nt, hsa
guguguguagauuuauaguuuuugguaguggcaggaauaaaaaaaauccauccuacaucuuccc

SEQ ID NO: 157990 - RNA, 64 nt, hsa
uguuuuauccacaacuuuucaaguauugaaaguagaauaaaaacauggguucuuagucuuuagc

SEQ ID NO: 157991 - RNA, 64 nt, hsa
agggccuuuauuuggcaaauaacugagccaaccagaauaaaauaaccaauacuccacugcucau

SEQ ID NO: 157992 - RNA, 64 nt, hsa
acugggcaucuaacuguuacaccaaaucuuaagugaauaaaacuuuaccaaggcuucucaguua

SEQ ID NO: 157993 - RNA, 64 nt, hsa
ucuaguuuugccaauagaaaaugcuucuuccauugaauaaaaguuauuucaaauugaauuugug

SEQ ID NO: 157994 - RNA, 64 nt, hsa
aagcaaaaucuuguaguuuuuaaucuuaaacacugaauaaaaaaacuuuccccuaaauuggaau

SEQ ID NO: 157995 - RNA, 64 nt, hsa
aaggaccuagaguaccuauaggacaaaaaguauagaauaaaaauaugccuuuagucauuugguu

SEQ ID NO: 157996 - RNA, 64 nt, hsa
ggaccccuuaccccaacuuuaugaguaaugcuuggaauaaaaacucuuaaggcaacucacugau

SEQ ID NO: 157997 - RNA, 64 nt, hsa
cauuugaaauacuaccauauuugugauuuauugagaauaaaaauccauuuugaaauguaaaauu

SEQ ID NO: 157998 - RNA, 64 nt, hsa
aacguuuuuauagagaaucuuguuuuucaaaaaagaauaaaaaguuugaauagcuauuauuaaa

SEQ ID NO: 157999 - RNA, 64 nt, hsa
agaauggccauauaccacuucauuuacguaaaaggaauaaaauaagcaaguuaagcuucagggu

SEQ ID NO: 158000 - RNA, 64 nt, hsa
gauauaaauuuaucauauaaaccaggacaucucggaauaaaaggggcucuguuagucauuaugu

SEQ ID NO: 158001 - RNA, 64 nt, hsa
cuguggaaugaagugcuagacugaaggacuaccagaauaaaacagggucuacaauggggagaac

SEQ ID NO: 158002 - RNA, 64 nt, hsa
aauaaaacaaucucagagcagcuccuaaacaagagaauaaaaaugggccaucccagcacuuaua

SEQ ID NO: 158003 - RNA, 64 nt, hsa
acucucaucaacuuaugauaaauuggacuauuaggaauaaaacaaucucagagcagcuccuaaa

SEQ ID NO: 158004 - RNA, 64 nt, hsa
uccugucaucuuuucgccuaccugaucuuucuuggaauaaaauaauauauccuuggggucaaga

SEQ ID NO: 158005 - RNA, 64 nt, hsa
gcgacguauucauggcacaaagcuuucccaagcugaauaaaaacaaacauuaacaaauuuuuac

SEQ ID NO: 158006 - RNA, 64 nt, hsa
agaaaaauggggauauuuccuaggguuguccugagaauaaaaugaguucugugugacaguuaac

SEQ ID NO: 158007 - RNA, 64 nt, hsa
uuccauuaaacggaaagccucccugacauuaacugaauaaaaccucauguugugggacuucugu

SEQ ID NO: 158008 - RNA, 64 nt, hsa
uuaagaugaaaagcauugguuuuuuaaaauuagagaauaaaauauguauuuaaauuuuuggugu

SEQ ID NO: 158009 - RNA, 64 nt, hsa
uugaaugacagcauauuguaagaaaaaaaaaggugaauaaaauuugacauuagauuauaaaugg

SEQ ID NO: 158010 - RNA, 64 nt, hsa
aguuauuauaagaagaucuagauccuagauauuagaauaaaauuuauuuucuacuguauccauu

SEQ ID NO: 158011 - RNA, 64 nt, hsa
gagagaaaccuguauaauaguaagaucuuauuuugaauaaaaacgucuauaauuacaaggaguu

SEQ ID NO: 158012 - RNA, 64 nt, hsa
uuaagcuacaaauugagaaaaccguuauaaauaagaauaaaauaggccaggcacaguggcucac

SEQ ID NO: 158013 - RNA, 64 nt, hsa
gagacccugucuccaaaggaaaaacaaaaaagaagaauaaaauaauuuggaugaaaaucauguu

SEQ ID NO: 158014 - RNA, 64 nt, hsa
agaguuaauaaaaugcaauuucauguuagagcuagaauaaaaguaauugagcagucauuugcaa

SEQ ID NO: 158015 - RNA, 64 nt, hsa
uugauuccccaaaaccuugacagauguaucgauggaauaaaaguauguuuuaaagguuacuuga

SEQ ID NO: 158016 - RNA, 64 nt, hsa
auacauguuguaaaaaauucaaauauacagaauggaauaaaaaaaugaucucccuuuauuaccc

SEQ ID NO: 158017 - RNA, 64 nt, hsa
gguuaaauuugugaaugaucauuucaaauauauugaauaaaauaagcaaaagcuauuguuauuu

SEQ ID NO: 158018 - RNA, 64 nt, hsa
cauaaaauagacaauguuuuugucucaagaacaagaauaaaauugaaaucugcauucaugccaa

SEQ ID NO: 158019 - RNA, 64 nt, hsa
aauggcguacaaaucuuauuauuucuaaaaauaagaauaaaaagguaaaacuacauuuagacuu

SEQ ID NO: 158020 - RNA, 64 nt, hsa
uuuaaggauaaauaaaaaauaaaguaguaauaaagaauaaaauacuuuacuaaaauauuguaug

SEQ ID NO: 158021 - RNA, 64 nt, hsa
aaccagaagguaaaacuuagauguccuuguaaaagaauaaaaaagguaaauauuuuaaguuauu

SEQ ID NO: 158022 - RNA, 64 nt, hsa
ccuggagaauguccaccuuguguucagaugcuuagaauaaaaugucacuguaagaucacaagcc

SEQ ID NO: 158023 - RNA, 64 nt, hsa
accuuaguagaauacagagcuuugguaauuacaugaauaaaauuaagaaaauagccauauacaa

SEQ ID NO: 158024 - RNA, 64 nt, hsa
ucacuuuauaguuugggagacagaaucaggucuugaauaaaauaauuguaaugagugcuaaaug

SEQ ID NO: 158025 - RNA, 64 nt, hsa
aauauaauggaaaacagauuuuucaucauaucaugaauaaaauauagagguaacuauguuguau

SEQ ID NO: 158026 - RNA, 64 nt, hsa
ccauuugaugagcaaaaucuacuucuaguguuaggaauaaaaaaaaaagaccaguaacuuuguu

SEQ ID NO: 158027 - RNA, 64 nt, hsa
agugugcuucagaaauauauacugcuuuaaaaaagaauaaaagaauauccuuuuacaaguggcu

SEQ ID NO: 158028 - RNA, 64 nt, hsa
auuucccccacagagugccuagaaucuuaauaaugaauaaaauaaaaagcagcaauaugucauu

SEQ ID NO: 158029 - RNA, 64 nt, hsa
uaguaugauggaaaguuucuuuuuucuuugcucugaauaaaacugaacuguggguucucuauaa

SEQ ID NO: 158030 - RNA, 64 nt, hsa
uugccuuugcuuuguucauaauuucagcagggcagaauaaaaaccaugggaggcaaagaaagga

SEQ ID NO: 158031 - RNA, 64 nt, hsa
ugcugguuuuaucugagugaaauacuguacaggggaauaaaagagaucuuauuuuuuuuuuuau

SEQ ID NO: 158032 - RNA, 64 nt, hsa
gaucuuauuuuuuuuuuuauacuuggcguuuuuugaauaaaaaccuuuugucuuaacucguggc

SEQ ID NO: 158033 - RNA, 64 nt, hsa
agcuuuacuaaaagaacauaagucaagggaggaugaauaaaaacagcaaaaccaaauaaagugg

SEQ ID NO: 158034 - RNA, 64 nt, hsa
gaaguuaaaagguuguacucauuguauuuacaaagaauaaaaauauauugaauuuaaaugaacu

SEQ ID NO: 158035 - RNA, 64 nt, hsa
ggugaaaagccaaauuuuaggaacagaaucaaaagaauaaaaaucugugaagagauccuacuac

SEQ ID NO: 158036 - RNA, 64 nt, hsa
cuggcuuuugccaguuaauccagcugucuuucaagaauaaaaguugggguuuucaaggaucgcc

SEQ ID NO: 158037 - RNA, 64 nt, hsa
aacuagcaaucuauaaagugcaccaggucaacuugaauaaaaacacuaugacagacagguuugc

SEQ ID NO: 158038 - RNA, 64 nt, hsa
uaaaucugauggcucacugauuuuugaaaagccugaauaaaauuggaaagacuggaaaguuagg

SEQ ID NO: 158039 - RNA, 64 nt, hsa
ggacugucauaccagugaagaauaaaagggugaagaauaaaagggauaugaugacaagguugau

SEQ ID NO: 158040 - RNA, 64 nt, hsa
gcuaagaugguauagggacugucauaccagugaagaauaaaagggugaagaauaaaagggauau

SEQ ID NO: 158041 - RNA, 64 nt, hsa
uguuaagaacacguguauuaaauucauguaaguggaauaaaaguuuuaugaauggacuuuucaa

SEQ ID NO: 158042 - RNA, 64 nt, hsa
gaaaacugccuacauacugguuuguccuggcggggaauaaaagggaucauugguuccagucaca

SEQ ID NO: 158043 - RNA, 64 nt, hsa
uauggucuacacauucugauuuuuuuuuuagauugaauaaaauuuguaaaucauuauuuucauu

SEQ ID NO: 158044 - RNA, 64 nt, hsa
ggcaacacagcaagacucugucucaaaaauaaaugaauaaaauaaaaaccugccaccaaauuau

SEQ ID NO: 158045 - RNA, 64 nt, hsa
ccuuaaugcucaugagacuauauuuaugaucagugaauaaaaaugucagaacugugcuuugucu

SEQ ID NO: 158046 - RNA, 64 nt, hsa
uuuuaugauuuuuuaauuguugagaacaagccaagaauaaaauugcugcaccagaaggaggguc

SEQ ID NO: 158047 - RNA, 64 nt, hsa
gaaauuccacacaugaguauugugaugaguaaaugaauaaaacauuugcaaagaccuuuagaga

SEQ ID NO: 158048 - RNA, 64 nt, hsa
aaaauacaauuuuguuucuccaaauuugacagcagaauaaaaacccuacccuuucacuguguau

SEQ ID NO: 158049 - RNA, 64 nt, hsa
gauauuuagaaaguuaauuucuaauuccggaauggaauaaaaacaauaugaguaguguaaucuu

SEQ ID NO: 158050 - RNA, 64 nt, hsa
gccacaguugccuuauauguaaaugaaguguuuagaauaaaauaguuaaauuuccuuauuuuuc

SEQ ID NO: 158051 - RNA, 64 nt, hsa
gagccacugcaccuggccaaguaauuucuuuuaggaauaaaagguacuuggcauuccuuauuug

SEQ ID NO: 158052 - RNA, 64 nt, hsa
augggaauuuuuaucuuagaaauggaugauucgugaauaaaacuagguacauaguaaguguaug

SEQ ID NO: 158053 - RNA, 64 nt, hsa
ucuucuauucaaaaucuuuuuuuuauuuuuaagggaauaaaaauuuuaaaaauuaagagauaua

SEQ ID NO: 158054 - RNA, 64 nt, hsa
cuuuuauuuuaugaaguaauguuaauuuuacuaagaauaaaacauccaaauuuuaaguauuaug

SEQ ID NO: 158055 - RNA, 64 nt, hsa
cacuugagaacagaauaggauuucaacaauaagagaauaaaauaagaacauguauaacaaaaag

SEQ ID NO: 158056 - RNA, 64 nt, hsa
aaaauugaaaaaauuaaaauguaaaaaaauuaaagaauaaaaauacuucuauuauucuuuuauc

SEQ ID NO: 158057 - RNA, 64 nt, hsa
ucuuccuaauugugcuguaauaaccuguguaugagaauaaaaugauuuccaccaucaggauucu

SEQ ID NO: 158058 - RNA, 64 nt, hsa
aaaagaagaaaaaaucaaugaacuugaagaguaagaauaaaaacuaccaaagugauauacagag

SEQ ID NO: 158059 - RNA, 64 nt, hsa
guaaaguauauguuaaaugcuuuuaucacuuugagaauaaaaaguuacuaaugcuguuguauuu

SEQ ID NO: 158060 - RNA, 64 nt, hsa
uuaaguuagguaacauuuuauauuacuuucauaugaauaaaaguaauccaugcauuguagaguc

SEQ ID NO: 158061 - RNA, 64 nt, hsa
guauguauugguaaugaugucauuaaaaguauaugaauaaaaauaugaguaacaucauaaaaau

SEQ ID NO: 158062 - RNA, 64 nt, hsa
uuuuguaucauuuguuuuccucaucuaaaaaguugaauaaaaucuguuugauucaguucuccua

SEQ ID NO: 158063 - RNA, 64 nt, hsa
aagaaugcaauccuauucacaauugccacaaaaagaauaaaauaccuaggaauacagcuaacca

SEQ ID NO: 158064 - RNA, 64 nt, hsa
uccuacacccacagaacccggcuuuguccccaaagaauaaaaacaccucucuaaaagcugcucu

SEQ ID NO: 158065 - RNA, 64 nt, hsa
auguauuaaaguuuucuugguuuuauauaucagagaauaaaaacuuuuuugacuuuugaguaaa

SEQ ID NO: 158066 - RNA, 64 nt, hsa
gauacaauuaaauuuuauauaauguguuuugcuugaauaaaauguuacauuuauacuuugagaa

SEQ ID NO: 158067 - RNA, 64 nt, hsa
gaugaacauauuguaaugaugcuucugugaauuugaauaaaaucaacacuaaccagcccuagua

SEQ ID NO: 158068 - RNA, 64 nt, hsa
uugggaaacaaaugcugucucuugugaaauagaugaauaaaaugugauaguaacauaguagagu

SEQ ID NO: 158069 - RNA, 64 nt, hsa
ccugaaaugaucaaauaacuacaaaugaucuguugaauaaaaauaguugagcugauauauguua

SEQ ID NO: 158070 - RNA, 64 nt, hsa
auuuuaugugcuuucaucacaaauccaaaggaaagaauaaaaauuucuuaacacaacccagcgg

SEQ ID NO: 158071 - RNA, 64 nt, hsa
aguugaaauuaucuuuguuagcaguaguaguauagaauaaaagauccguaugcugguucguaga

SEQ ID NO: 158072 - RNA, 64 nt, hsa
gcuuugucuaaaguccucauuuucuuuuaaaauugaauaaaauuucuguauacagauucauugu

SEQ ID NO: 158073 - RNA, 64 nt, hsa
agucuuauaggaaugacucuggcugcuauguggggaauaaaaucaagacgugcaagaguggaag

SEQ ID NO: 158074 - RNA, 64 nt, hsa
auaaggaaaaggagagaaaaaagaaauugguuaugaauaaaagugacaauaaaacaugagauau

SEQ ID NO: 158075 - RNA, 64 nt, hsa
cucuaaggaaggcagagaccuggguugagccucagaauaaaagaucuucuuccaagaaaugcaa

SEQ ID NO: 158076 - RNA, 64 nt, hsa
ccagcgacaauuugaaucgguuuuguagguagaggaauaaaaugaaauacuaaaucuuucugua

SEQ ID NO: 158077 - RNA, 64 nt, hsa
aaaaauguauaaaaagaauuaguguaugcuuccugaauaaaaaggagccaaaguugaucagaau

SEQ ID NO: 158078 - RNA, 64 nt, hsa
agcgggaagggcuuggucuggauguagagagggugaauaaaauugccaagagagauauugaaca

SEQ ID NO: 158079 - RNA, 64 nt, hsa
auccaaaauggucugcagagagugagcggaggcaccagaucaauguugguucuuugcacuggug

SEQ ID NO: 158080 - RNA, 64 nt, hsa
ugggaggaacuaaagcauccuguuuuguaucuguccagaucauuauuucugucucuuguuuuuu

SEQ ID NO: 158081 - RNA, 64 nt, hsa
agccgaugggaugaaagaagcuugucucagagauccagaucaugguccuauaauggauauuauu

SEQ ID NO: 158082 - RNA, 64 nt, hsa
ucaaggagcagaucuucuaggaguagaucuuauuccagaucauauacaagaucacguagucuag

SEQ ID NO: 158083 - RNA, 64 nt, hsa
aaaguaccgggaagaaggagguggcugagaagagccagaucaaccucauugauaagaaauggaa

SEQ ID NO: 158084 - RNA, 64 nt, hsa
gacaauaauuaacacagaggacuuucccccacacccagaucacaaacagccuacagccagaacu

SEQ ID NO: 158085 - RNA, 64 nt, hsa
ucucugggaccgaugcaguaucagcagcucuuuuccagaucaaagaacucaaagaaaacugucu

SEQ ID NO: 158086 - RNA, 64 nt, hsa
ggaccacgaucaagggguccgggggaccgaggucccagaucagugaggggagaagguugagcuc

SEQ ID NO: 158087 - RNA, 64 nt, hsa
ugccaggugccccucacucuuccugaccccaaagccagaucacccccuggguuaaaacuuuuuu

SEQ ID NO: 158088 - RNA, 64 nt, hsa
uaacacauaccaaccauuauccagaggcaccauggagaguuagucauggaauaaagcacugucc

SEQ ID NO: 158089 - RNA, 64 nt, hsa
ucugaucaaugaagaccuguaacacuaaguacuugagaguuacagucugaauaaugaagucgua

SEQ ID NO: 158090 - RNA, 64 nt, hsa
ucuugaguucacuaacauugucaccuucuggagagagaguuaauggggggcauugaggaugaua

SEQ ID NO: 158091 - RNA, 64 nt, hsa
ugacuucuuuucacuuuggcuuauaucaauucuugagaguuaaugugaucaugauauugcaaac

SEQ ID NO: 158092 - RNA, 64 nt, hsa
gcuuagcuaaccaacagguuuuuuuuguuuccaagagaguuauuugaaaaguuaacagaacaau

SEQ ID NO: 158093 - RNA, 64 nt, hsa
aauggaaaauugguuccugcaaaagacaaagggugagaguuagcguccuguagauacacacaga

SEQ ID NO: 158094 - RNA, 64 nt, hsa
uucuuucuuguucaauucaucuagauuauaaccuuaaugugacaccugagaccuuuagacaguu

SEQ ID NO: 158095 - RNA, 64 nt, hsa
uccauuauaucaaggcuacaaggucuaugagcaauaaugugauuucuggacauugcccauggau

SEQ ID NO: 158096 - RNA, 64 nt, hsa
aucaauaaccaggugugagcuacaggucucuguguaaugugaagcucucccguauuucauuucu

SEQ ID NO: 158097 - RNA, 64 nt, hsa
ugguccccaaaccaaagaguugccugcagguugguaaugugacuuuguagauauuccuugauua

SEQ ID NO: 158098 - RNA, 64 nt, hsa
ggaaagguaacuuauuucucuucugcacagagcauaaugugaaguuuuauaccuacuuuuaaaa

SEQ ID NO: 158099 - RNA, 64 nt, hsa
caugguucguauuuuaaaaaucuugcacaaauuguaaugugauacugugaaacaaauugaaaac

SEQ ID NO: 158100 - RNA, 64 nt, hsa
ccuaguucucuuaucuuugaucguauauuucucauaaugugaaauaugaugagauucacuuagg

SEQ ID NO: 158101 - RNA, 64 nt, hsa
uuccagccauuuuuuuaguuaguaaaaauccuauuaaugugaaccagccaggaauaacaguguu

SEQ ID NO: 158102 - RNA, 64 nt, hsa
ggcgcugcauuuggcuauuuucuuuggaaauaaauaaugugauguuucucuuccucuuuugaau

SEQ ID NO: 158103 - RNA, 64 nt, hsa
ggcacuuguacccgaucauaauaaaaauggauaauaaugugaaggaagaaaagagccgcuugaa

SEQ ID NO: 158104 - RNA, 64 nt, hsa
guugggaguuagugcauaucaucagcccuccaucuaaugugauugcuaagaugugcaggauagg

SEQ ID NO: 158105 - RNA, 64 nt, hsa
agggcauuccggagaaacuuuugcaacaguguauuaaugugauugguuuucuuuuuguuuuaag

SEQ ID NO: 158106 - RNA, 64 nt, hsa
ucuaaauuuguaccuaugugacagacauuuucaauaaugugaacugcugauuugauggagcuac

SEQ ID NO: 158107 - RNA, 64 nt, hsa
ugaucuauagaugaccuagaauagccauguacuauaaugugaugauucuaaauuuguaccuaug

SEQ ID NO: 158108 - RNA, 64 nt, hsa
aagggaugaaaauaaugggaguauaauacccauuuaaugugaaaaacauaagagucuuaaaaga

SEQ ID NO: 158109 - RNA, 64 nt, hsa
ugaguacgcucuaugcauaguaugacuucuauuuuaaugugaagaauuuuuugucucucuccug

SEQ ID NO: 158110 - RNA, 64 nt, hsa
ucagauuuuugggucaugucuguuguauuuucaguaaugugauuucagauggucaucuggauuc

SEQ ID NO: 158111 - RNA, 64 nt, hsa
cuuccagcaaaccugaaacgugagggagauggauuaaugugaguaacaggaaugugucuuuaaa

SEQ ID NO: 158112 - RNA, 64 nt, hsa
aaucuguauuaucaauuucucauagacacugugcuaaugugaauuuuaaaugaccugcaucaag

SEQ ID NO: 158113 - RNA, 64 nt, hsa
uuuucauuuucuguauuauauaugaaaaguaaauuaaugugaaaccuggcccagcuugcuggaa

SEQ ID NO: 158114 - RNA, 64 nt, hsa
uccaaaucuuuuucauagguaaugacagaugccuuaaugugaagcuuauuuauaauagcaauaa

SEQ ID NO: 158115 - RNA, 64 nt, hsa
aaaacucuugagcuguuauaagagauaguucuuuuaaugugacuaugcaacaugauagccaaug

SEQ ID NO: 158116 - RNA, 64 nt, hsa
uacaaaguuguacugaauaacuauuagaauugcauaaugugagauauuuuguuaguccucaaaa

SEQ ID NO: 158117 - RNA, 64 nt, hsa
aaaaauacccuuugcuuugugccucaaagugauguaaugugaucacagcuuuuguuguguugaa

SEQ ID NO: 158118 - RNA, 64 nt, hsa
aacaggcacugauggggagaaagcuagcuguagguaaugugagcaaagauguggaagccaaaau

SEQ ID NO: 158119 - RNA, 64 nt, hsa
aaggaauagcugcauaagacauuuugaaauaauguaaugugaaguguuucuuaaagcucugaac

SEQ ID NO: 158120 - RNA, 64 nt, hsa
gugugugcagcguuuuuaccuaggcaccaucauuuaaugugacaguguucaguaaacaaaucag

SEQ ID NO: 158121 - RNA, 64 nt, hsa
gaagcaaaugcuacauauaugcaauauaaaauaguaaugugaugcugaugcuguuaaccaaagg

SEQ ID NO: 158122 - RNA, 64 nt, hsa
uugaugaaggaggcaaaacaaaggcagcaggagauaaugugauugguacacaaaagcuaaagca

SEQ ID NO: 158123 - RNA, 64 nt, hsa
uugugaaugcauauguaugugugguuacuuuuuauaaugugaaauaaugaauaaugaauuuacu

SEQ ID NO: 158124 - RNA, 64 nt, hsa
uuccacuccugcuuuccuaaggaugaaacagugauaaugugaacucaaaugagguuuccugggu

SEQ ID NO: 158125 - RNA, 64 nt, hsa
agugauaaugugaacucaaaugagguuuccuggguaaugugacaccugcagaaacuauagagcg

SEQ ID NO: 158126 - RNA, 64 nt, hsa
aacauuuuguaacauugugcuuccuuguaguuuguaaugugaguucaaucaguauuuauguuga

SEQ ID NO: 158127 - RNA, 64 nt, hsa
auucagaaaugacuuggccucauuuuggauuucauaaugugaaguauucaugauuuugaacugg

SEQ ID NO: 158128 - RNA, 64 nt, hsa
uguguauauaucucuacacuuuauggauuaguaauaaugugauucucuauggcuucuagcuuca

SEQ ID NO: 158129 - RNA, 64 nt, hsa
accacacacacacaaccacacacacaaaugggggcaaccacauccaguacaagcuuuuacaaau

SEQ ID NO: 158130 - RNA, 64 nt, hsa
cagcuguggccaccaacacacaaccacacacacacaaccacacacacaaaugggggcaaccaca

SEQ ID NO: 158131 - RNA, 64 nt, hsa
uggugacagaggcucagcuguggccaccaacacacaaccacacacacacaaccacacacacaaa

SEQ ID NO: 158132 - RNA, 64 nt, hsa
ccgccaccucaagugaacugcaggaauccuccaacaaccacaaacacaugcuucgcuguuagug

SEQ ID NO: 158133 - RNA, 64 nt, hsa
ugaucaagccuaacgccaaguguacaaacuggcccaaccacaggagcugccaguauccagcagu

SEQ ID NO: 158134 - RNA, 64 nt, hsa
aaccacgguccccaccacgacacaaucacguucacaaccacaaccacgcagccacagcuauaac

SEQ ID NO: 158135 - RNA, 64 nt, hsa
uccuugaugucugugaucaaaccaugacaggaugcaaccacaacacacggcuaugaucaugaca

SEQ ID NO: 158136 - RNA, 64 nt, hsa
ccccccgguaugggaaccagcaccucccaccaaccaaccacacccggugggggcacagcacaga

SEQ ID NO: 158137 - RNA, 64 nt, hsa
guugaggcccacaacacggugaccucuggcaccgcaaccacagucauugagauacaaguuuccg

SEQ ID NO: 158138 - RNA, 64 nt, hsa
aauugagagauaaacaaugacaagagcugccagccaaccacacuauucaaaaagcaaaguguuc

SEQ ID NO: 158139 - RNA, 64 nt, hsa
gcacaccccgaauauugaagagggggccaaaaaacaaccacauggauuuuuuauaggaacaaca

SEQ ID NO: 158140 - RNA, 64 nt, hsa
cuggaugucaacaaaccucaccacuggauccugacaaccacaaugccuggauccuggggccccc

SEQ ID NO: 158141 - RNA, 64 nt, hsa
ucccacacaaaucagugaauggaucccaacaccccaaccacaggagcacggauucccuguaccu

SEQ ID NO: 158142 - RNA, 64 nt, hsa
ccccccacaccucagccacuggagacugaugauccaaccacaggaucccuacucuuuggccacg

SEQ ID NO: 158143 - RNA, 64 nt, hsa
ccuuuguccucucguggaaacagcacacagcaagcaaccacaaaaccagagcggaaggagggac

SEQ ID NO: 158144 - RNA, 64 nt, hsa
caccacuccugagcgccacaucccaugaucacuucaaccacaggccuuugacuuugccacaugg

SEQ ID NO: 158145 - RNA, 64 nt, hsa
ccagacaccuaauucuucaguucacugcccaugugauacugauugccacauuaagguugaacag

SEQ ID NO: 158146 - RNA, 64 nt, hsa
ccagacaccuaauucuucaguucacuacucaugugauacugauucccacauuaagguugaacaa

SEQ ID NO: 158147 - RNA, 64 nt, hsa
gauuguuagaaauugacgauguguuuguuccagugauacugaaaguagugggggcaagaauuga

SEQ ID NO: 158148 - RNA, 64 nt, hsa
uacuugagaauauagaaagucuuucucuaaaggagauacugacucccugguuuauugcauuaaa

SEQ ID NO: 158149 - RNA, 64 nt, hsa
uuccucccgggauggugaaaauguuccggaccuagauacugacgaagguagcacgacacuguga

SEQ ID NO: 158150 - RNA, 64 nt, hsa
ucccuacuacacuguggaugaaccuugaaugcaugauacugaaugaaagacgucagaugcaaaa

SEQ ID NO: 158151 - RNA, 64 nt, hsa
aguuaauuuguuucugcauauaugcacauacauacguaaggaucuuaaacccagucuugacaga

SEQ ID NO: 158152 - RNA, 64 nt, hsa
uguuucauggcuucauggucaucacucaagcucccguaaggauauuaccgucucaggaaaggau

SEQ ID NO: 158153 - RNA, 64 nt, hsa
ucagagaccuuaauuuauauucuccuuccugugccguaaggauugcaucggacuaaacuaucug

SEQ ID NO: 158154 - RNA, 64 nt, hsa
caaacgucugcaauucuccaguuuuuaguuugcacguaaggauucguaggauugauuucagauu

SEQ ID NO: 158155 - RNA, 64 nt, hsa
ucaaacuaaaaugucuuaauggcugugugacacacguaaggaaaggaaagggggucacgcacau

SEQ ID NO: 158156 - RNA, 64 nt, hsa
cucaaggcgugaggaugggaaggagggagguauucguaaggaugggaaggagggagguauucgu

SEQ ID NO: 158157 - RNA, 64 nt, hsa
ccuguaagcauuuccaccagaacuugaggcaaaucguaaggaagcuguuucuuuuaaaacacaa

SEQ ID NO: 158158 - RNA, 64 nt, hsa
guguccuggagcugugcugggcagcagggccucgcguaaggaacugcuggaacccacugagccc

SEQ ID NO: 158159 - RNA, 64 nt, hsa
acuagugucacagcauaaaaucauauuacaaguacguaaggauucagggucucuugauagacuu

SEQ ID NO: 158160 - RNA, 64 nt, hsa
ugcaaacuacuugaaauuugaauccggacaugaucguaaggaaacucuuucauaaagcacuuuu

SEQ ID NO: 158161 - RNA, 64 nt, hsa
cugcuucuccaagagcagaccaggccaccucauccguaaggacucgguucuguguugggacccc

SEQ ID NO: 158162 - RNA, 64 nt, hsa
caggggaaaccugaugaggagaaggauaagacugcguaaggagaaauccucauaggagcuauaa

SEQ ID NO: 158163 - RNA, 64 nt, hsa
uggguuuuuucauaucuguacauaaugccgagugcguaaggaaaccguggcgucgcgcacagug

SEQ ID NO: 158164 - RNA, 64 nt, hsa
auugguguaauuuacuacauauuaguacuauauucguaaggauuuuuuauuaaccauuacagau

SEQ ID NO: 158165 - RNA, 64 nt, hsa
auauuauuguuacaucuuucugaaaccuucaaaccguaaggaaguguuaacuggcaagcaguug

SEQ ID NO: 158166 - RNA, 64 nt, hsa
uuccugcccuuugcguuauauuguauaauaccaacguaaggaaauaaaccuuuggaauuguugg

SEQ ID NO: 158167 - RNA, 64 nt, hsa
ugggacccuccccagccuggagaguucaucacuacguaaggaaagcuccuuccgccccuccaaa

SEQ ID NO: 158168 - RNA, 64 nt, hsa
ccuccugccuggaccaugguagcuucuguguucccguaaggauacagcuuccuuugggaagccc

SEQ ID NO: 158169 - RNA, 64 nt, hsa
aagcugucaaagagguaagcacauuuuauauagacguaaggaaagugauuauuguuuaauaucu

SEQ ID NO: 158170 - RNA, 64 nt, hsa
uucuuuuuuuuuugcuaugacagaguaaugcuaacguaaggacaacugaguuugaucaguguuu

SEQ ID NO: 158171 - RNA, 64 nt, hsa
ugaauauagacuuucugggaaaagguuuacugcucguaaggaaacauuuuauguauuaaaauaa

SEQ ID NO: 158172 - RNA, 64 nt, hsa
ggaaagggaacgcauucguauugaacaggaacgucguaaggaagcugaacggauugcucgagaa

SEQ ID NO: 158173 - RNA, 64 nt, hsa
gucugcugaugagagacagcgcaugcuggugcagcguaaggacgaacuccuccagcaagcucgc

SEQ ID NO: 158174 - RNA, 64 nt, hsa
uguuuucuguuuguugguuuguuuguuucuuccacguaaggaaaaguaguguaaacaguagcga

SEQ ID NO: 158175 - RNA, 64 nt, hsa
uaacuugcgcaaacuuuuuacauauggugaggugcguaaggaagcccuggccaacuuaaagauu

SEQ ID NO: 158176 - RNA, 64 nt, hsa
guauagugaggcuuacgauguuuuguagucuuggcguaaggacacagcccaaguaacugacguu

SEQ ID NO: 158177 - RNA, 64 nt, hsa
cuguccuucccuaaauguaaagccaucuguccggcguaaggacgacaccgucagcuguccgacu

SEQ ID NO: 158178 - RNA, 64 nt, hsa
ugccauguugggcuccucacacaugaucguguuucguaaggagccagaggcagcauagugaaaa

SEQ ID NO: 158179 - RNA, 64 nt, hsa
cuuaauccaguuuuucaaacuucucccuguagaccguaaggaugaauuccacaauaggauccuu

SEQ ID NO: 158180 - RNA, 64 nt, hsa
acagucuccacauugcaguuccaauggccuggaccguaaggauaaagccuguaauauaugcaac

SEQ ID NO: 158181 - RNA, 64 nt, hsa
acagaaaaagaagaauuccaggagagggaaagaucguaaggaugagagaggagaccauccaagc

SEQ ID NO: 158182 - RNA, 64 nt, hsa
uuguguggaacacuucacauauuggcgcacaguacguaaggaggucucaugugcuguaggagua

SEQ ID NO: 158183 - RNA, 64 nt, hsa
cuuuuuuccugggccagaaguagaggggugggugcguaaggaugugugaguuuugcuuuugacu

SEQ ID NO: 158184 - RNA, 62 nt, hsa
cucauggauuuugucaaauagaugaucuuugacacgauuagacacuccuccccacaaaggcu

SEQ ID NO: 158185 - RNA, 62 nt, hsa
uggugucguggaaccucuuacugcuuucaauacacgauuaguaaucaacuguuuuguauacu

SEQ ID NO: 158186 - RNA, 62 nt, hsa
gcaaaccacaagaaucauuaguuguagagaagcacgauuauaauaaauucaaaacauuuggu

SEQ ID NO: 158187 - RNA, 62 nt, hsa
ccucagcuucccacggaaucagauggauccuccacgauuacgugaauaaaaugauggaacca

SEQ ID NO: 158188 - RNA, 62 nt, hsa
guugaggaaauaucauugauauuucuaucaugcacgauuauuuuagauuucuaccaccgugu

SEQ ID NO: 158189 - RNA, 62 nt, hsa
augcugauauuuacuggaaaccuagccagcuucacgauuaugacuaaaguaccagauuauaa

SEQ ID NO: 158190 - RNA, 62 nt, hsa
cucucuuccuacauuugucccugagaguacuccacgauuacuagguucuugauucccuuaua

SEQ ID NO: 158191 - RNA, 62 nt, hsa
aagguagaguaggcuguggcaauggaauaaaacacgauuaaaaacguuaagaacugcguuag

SEQ ID NO: 158192 - RNA, 62 nt, hsa
uacuaauagaacuuguuaaccuuucuaaccuucacgauuaacugugaaauguacgucauuug

SEQ ID NO: 158193 - RNA, 62 nt, hsa
guguguacgugcgcgcgugcgugaggcccugccacgauuaaagacugagaccggcccucugg

SEQ ID NO: 158194 - RNA, 62 nt, hsa
aaggaagcauuuaccccgaugguuaccuagaccacgauuauuuggauuggggggagggggga

SEQ ID NO: 158195 - RNA, 62 nt, hsa
cuaggcagagacagaagaauguugaauaagagcacgauuagaguccugucugguuaucuguu

SEQ ID NO: 158196 - RNA, 62 nt, hsa
uuuuacgacuuuuacauuugaguaaccaucaacacgauuaguuuacagaacugaaaaggaau

SEQ ID NO: 158197 - RNA, 62 nt, hsa
cuggcucugucacccaggcuggagugcaguggcacgauuauggcucauugcagccucgacuu

SEQ ID NO: 158198 - RNA, 62 nt, hsa
uuagaugagugcuuuggccccucugugaauagcacgauuaaaauccaguuguauauaaugga

SEQ ID NO: 158199 - RNA, 62 nt, hsa
uuggcacuuauuagcuucucucauaaacugaucacgauuauaaauuaaauguuuggguucau

SEQ ID NO: 158200 - RNA, 62 nt, hsa
cggccgcccucggucugguguaagcacacaugcacgauuaaagaggagacgccgggaccccc

SEQ ID NO: 158201 - RNA, 62 nt, hsa
uugucgguaccuucagaaacuuuuaccaaagucacgauuagcugcuugugguggggccccaa

SEQ ID NO: 158202 - RNA, 62 nt, hsa
uauauuucacaggcuguaaauugaacuucccacacgauuagcuuuauuauggcuugugaacu

SEQ ID NO: 158203 - RNA, 62 nt, hsa
ucaaagcaggaccuauuuggagcauuacgauccacgauuauugauguugacauguccaugua

SEQ ID NO: 158204 - RNA, 64 nt, hsa
uuuaauaagucauggggaugacaauuugauuauuacaauuuaguuuucaguaaucaaaaagauu

SEQ ID NO: 158205 - RNA, 64 nt, hsa
auuuuuaaaguauguaacauucccaguuucagccacaauuuagccaagaauaagauaaaaacuu

SEQ ID NO: 158206 - RNA, 64 nt, hsa
uuuuaaaucauaaauaacauguucaagauacuuaacaauuuauuuaaaaucuaagauugcucua

SEQ ID NO: 158207 - RNA, 64 nt, hsa
uaaaaauguaaauguuacauguauauuacuuggcacaauuuauuucuacacagaaaguuuuuaa

SEQ ID NO: 158208 - RNA, 64 nt, hsa
aaaacauuuuuuagaaauuuguugcgauguuuguacaauuuaccucauaagagaaccacacccu

SEQ ID NO: 158209 - RNA, 64 nt, hsa
cugagagaaauucuguugccaccaguuauacuugacaauuuaguugaagcucagaaaguuauau

SEQ ID NO: 158210 - RNA, 64 nt, hsa
ugccacaauuuaaaaauaaaaccagagguuauauacaauuuaaauugggcuaaaaauuaaaaau

SEQ ID NO: 158211 - RNA, 64 nt, hsa
aaauaaaguguauauuaggauuuaaauuuaugccacaauuuaaaaauaaaaccagagguuauau

SEQ ID NO: 158212 - RNA, 64 nt, hsa
gugcuucaaggacauuggugagaguccaacagacacaauuuauacugcgacagaacuucagcau

SEQ ID NO: 158213 - RNA, 64 nt, hsa
uaauaauguaacaugauuucccuccagagaaagcacaauuuaaaacaauccuuacuaaguaggu

SEQ ID NO: 158214 - RNA, 64 nt, hsa
cuucuaaaggguaagucauaaucuguguaauacuacaauuuaugggaugcucacuaugcccugu

SEQ ID NO: 158215 - RNA, 64 nt, hsa
augggaugcucacuaugcccuguuucucuucuaaacaauuuacauguaaugucucauuccucac

SEQ ID NO: 158216 - RNA, 64 nt, hsa
uuuaaauauaaaugcauuuugagaaauguuaagaacaauuuagucaaucguucaucugucauug

SEQ ID NO: 158217 - RNA, 64 nt, hsa
uagcuucugaaaagggaggaguauuuuuaguuugacaauuuaauaauuuaaaaacaagacaucu

SEQ ID NO: 158218 - RNA, 64 nt, hsa
uaugcagaaaaauaggcaauaagaacuucauuuuacaauuuaguuuucaaaaaaaaaaugcagg

SEQ ID NO: 158219 - RNA, 64 nt, hsa
caagaaaaaagauuuagcuuaucacaagaagcagacaauuuauaaaacuacacaaugucuaaac

SEQ ID NO: 158220 - RNA, 64 nt, hsa
uuauuuuucuuuuaauaguuauaugucagugagaacaauuuauaugucuuacacugagaaauaa

SEQ ID NO: 158221 - RNA, 64 nt, hsa
gcuacacccccacaggugacuuggauucagaaauacaauuuauauuucuucuuuuuaaauuguu

SEQ ID NO: 158222 - RNA, 64 nt, hsa
ugagaaaaaguuuaaaauucucaauacaaaucaaacaauuuaaauauuuuaagaaaaaaggaaa

SEQ ID NO: 158223 - RNA, 64 nt, hsa
auaaagaggauagacaaccucuuaaaauauuuuuacaauuuaaugagaaaaaguuuaaaauucu

SEQ ID NO: 158224 - RNA, 64 nt, hsa
auuuugaauaugugaaaggauuaauuuaaacuuuacaauuuacaucaauauuuugaauaucuga

SEQ ID NO: 158225 - RNA, 64 nt, hsa
uaguacauucuagaauguaaaaggauuaaacuuuacaauuuagaucaauauuuugaauauguga

SEQ ID NO: 158226 - RNA, 64 nt, hsa
cacauuucaucuaaguaaagcucaguucuuuaucacaauuuacugaccaaauaccuagcaccag

SEQ ID NO: 158227 - RNA, 64 nt, hsa
aacuucuuaucaauuaccuaaaucucaacgaaaaacaauuuacugaagccgacuccccucccca

SEQ ID NO: 158228 - RNA, 64 nt, hsa
uaaauuguaucuaacuggauuacaagucaguuugacaauuuacgaugucucagugauguuucug

SEQ ID NO: 158229 - RNA, 64 nt, hsa
uaguuaaacucuaaggaagaccugggaaaugaaaacaauuuauggaaguccccuacagucaguu

SEQ ID NO: 158230 - RNA, 64 nt, hsa
cugacuguaacuuuauuaauuuaaaagguaggaaguaagcuacuuagugguuucaccugugaaa

SEQ ID NO: 158231 - RNA, 64 nt, hsa
aaauuggacccaaaacauugaacaguuugggguaguaagcuaaauuucaucuuguggagauuuu

SEQ ID NO: 158232 - RNA, 64 nt, hsa
guauuagauacuaauagaagagaaaaauuguaacacacugaacaauagauacuguauguucuua

SEQ ID NO: 158233 - RNA, 64 nt, hsa
gcuaagcgacuguacgugcuacuaaaaaugucugacacugaaauaauuuuacucaacuauguuu

SEQ ID NO: 158234 - RNA, 64 nt, hsa
caaucagcugugucgcacuuaaacuggagaaguuacacugaaguauaaucacacugaauguuag

SEQ ID NO: 158235 - RNA, 64 nt, hsa
acuuaaacuggagaaguuacacugaaguauaaucacacugaauguuagacuuuuucaucugcca

SEQ ID NO: 158236 - RNA, 64 nt, hsa
caccucuaaaacaguccuucaaacuuccagugcaacacugaagcucuugaagacacugaaauau

SEQ ID NO: 158237 - RNA, 64 nt, hsa
ucaaacuuccagugcaacacugaagcucuugaagacacugaaauauacacacagcaguagcagu

SEQ ID NO: 158238 - RNA, 64 nt, hsa
aaucucuguuauuaagauauuucaagaugagacaacacugaagaucaaauuguguuuaguauca

SEQ ID NO: 158239 - RNA, 64 nt, hsa
uuuaauauauuaauuacuaaaaaggcauaagauuacacugaacauauuagcuacuaaaaaggca

SEQ ID NO: 158240 - RNA, 64 nt, hsa
agcguuccaaccugaggccaacccaucucaccugacacugaauacugccuugguagaaagugag

SEQ ID NO: 158241 - RNA, 64 nt, hsa
ggaccuguaauccagcauucuuguuaaagcugaaacacugaaacagccauugccuugaccaaca

SEQ ID NO: 158242 - RNA, 64 nt, hsa
agcugcaaaucugauggccuuaauuuccuuuuugacacugaaaguuuuguaaaagaaaucaugu

SEQ ID NO: 158243 - RNA, 64 nt, hsa
guccauacacuuuguugcaagaugugaauuauugacacugaacuuaauaacuguguacuguucg

SEQ ID NO: 158244 - RNA, 64 nt, hsa
cagcagcuguucaacaagaguaaauauugucacaacacugaaccucuggcuagaggacauauuc

SEQ ID NO: 158245 - RNA, 64 nt, hsa
aauuaaggcagcugaaaaguaaauugccuucuagacacugaaggcaaaucuccuuuguccauuu

SEQ ID NO: 158246 - RNA, 64 nt, hsa
ccacuauuacagaaauucugaauuuugguaaaucacacugaaacuuucuguauaacuuguauua

SEQ ID NO: 158247 - RNA, 64 nt, hsa
aacuuguauuauuagacucucuaguuuuaucuuaacacugaaacuguucuucauuagauguuua

SEQ ID NO: 158248 - RNA, 64 nt, hsa; identical to SEQ ID NO: 158246

SEQ ID NO: 158249 - RNA, 64 nt, hsa; identical to SEQ ID NO: 158247

SEQ ID NO: 158250 - RNA, 64 nt, hsa
ccgauagagucgcuauuucugguuaauauacauauauaaauauauaaauacaaacacacacaca

SEQ ID NO: 158251 - RNA, 64 nt, hsa
gucgcuauuucugguuaauauacauauauaaauauauaaauacaaacacacacacacacuuuuu

SEQ ID NO: 158252 - RNA, 64 nt, hsa
uggugggauaugcagaacuugggauguguguauauauaaauauauaauauauauaaauauauau

SEQ ID NO: 158253 - RNA, 64 nt, hsa
cuugggauguguguauauauaaauauauaauauauauaaauauauauaauacugacuuaaaaaa

SEQ ID NO: 158254 - RNA, 64 nt, hsa
ugugugcgagugugugggcuggugugugaauaucuauaaauaaguauauaugguguauauuaua

SEQ ID NO: 158255 - RNA, 64 nt, hsa
uauaaauaaguauauaugguguauauuauauguguauaaauaaagucuguacauauuggagcuc

SEQ ID NO: 158256 - RNA, 64 nt, hsa
ugcccccuaguaagucuacguguggaaugugagauauaaauauaaauauauaaagcuauauuuu

SEQ ID NO: 158257 - RNA, 64 nt, hsa
cuaguaagucuacguguggaaugugagauauaaauauaaauauauaaagcuauauuuucaggcu

SEQ ID NO: 158258 - RNA, 58 nt, hsa
aacgugagcuuacugucuaaauauuuuuuauaaauagugaagauacgucuagccagac

SEQ ID NO: 158259 - RNA, 64 nt, hsa
guuagcacugaccauccuuaaaaaauguuaacucuauaaauaugauguucaugugguuauguau

SEQ ID NO: 158260 - RNA, 64 nt, hsa
uauugugaacuuuaaaagacuauuuugauaaauuuauaaauauauaaaauuauguaaaaacuac

SEQ ID NO: 158261 - RNA, 64 nt, hsa
gaaaguuuuuagaaagugauuuuuaugcucgcacuauaaauauggcaggucaguucauucuuuu

SEQ ID NO: 158262 - RNA, 64 nt, hsa
uagaagcaaaaaaaaaaagcauagagauguguuuuauaaauagguuuauguguacugguuugca

SEQ ID NO: 158263 - RNA, 64 nt, hsa
ugcauagguaaccauuaacuauguacauauaaaguauaaauauguuuauauucuguacauaugg

SEQ ID NO: 158264 - RNA, 61 nt, hsa
cucaagaacuuuggaaauaauuuuauauauauauaaauaauauauauauauauacauauau

SEQ ID NO: 158265 - RNA, 64 nt, hsa
auauauauaaauaauauauauauauauacauauauauaaauagaucucuauauaguugugguac

SEQ ID NO: 158266 - RNA, 64 nt, hsa
uaaucaaguaaucauuaauuaguuacccccuauauauaaauauauguaaucaauuucuucaaau

SEQ ID NO: 158267 - RNA, 64 nt, hsa
uaauuuggucaaacaacagucuauugcauugauuuauaaauaguugucaguucacauagcaauu

SEQ ID NO: 158268 - RNA, 64 nt, hsa
uggaccaacauaauauuaaaguauguauauauuauauaaauauauauguauaugugcucgcuug

SEQ ID NO: 158269 - RNA, 64 nt, hsa
aucuguguuaaucugaguaacuuauugccuagccuauaaauaaauuccaaaauauccaauucau

SEQ ID NO: 158270 - RNA, 64 nt, hsa
uauagcaagcuaugauuuuuauauauaaauauuauauaaauaauguauaaaacauuaaaaguua

SEQ ID NO: 158271 - RNA, 64 nt, hsa
ucauuucaacuuauagcaagcuaugauuuuuauauauaaauauuauauaaauaauguauaaaac

SEQ ID NO: 158272 - RNA, 64 nt, hsa
caauauaauuuugcuuuuguauuauagacaaauauauaaauaauaaaggcaggcaacuuucauu

SEQ ID NO: 158273 - RNA, 64 nt, hsa
uuuuuauuaaaaaccuggacagaaaauuauaaauuauaaauaugacuuuauccuggcuauaaaa

SEQ ID NO: 158274 - RNA, 64 nt, hsa
accucuugguaucuagaaaagcuuguucauccauuauaaauauaucuuuagccacagcaaacca

SEQ ID NO: 158275 - RNA, 64 nt, hsa
agcuuucuuagagaauucccuagaacuaaaaauuuauaaauauggaauucuucaggguaucuua

SEQ ID NO: 158276 - RNA, 64 nt, hsa
ugacuggaaaaaacuugcuuauugccuuucccuauauaaauauuaauugucuagaaugaaagcu

SEQ ID NO: 158277 - RNA, 64 nt, hsa
uucucuaaaauauucugaaauagguuaaaucuuauauaaauauuacuuugugcaauauuguugu

SEQ ID NO: 158278 - RNA, 64 nt, hsa
cacugugcuagguguauauauacauauauauauauauaaauauauauauaauauauaaaauaua

SEQ ID NO: 158279 - RNA, 64 nt, hsa
ugccuccccuccccucuuugucacuuugguuuccuauaaauauguauguaucguaugugcaucu

SEQ ID NO: 158280 - RNA, 64 nt, hsa
uuacaguuucuaauacuauacuguaugaaauauguauaaauauaugaugcugagucuguggaau

SEQ ID NO: 158281 - RNA, 64 nt, hsa
cccacaguauauauuauacagcagucauaauaucuauaaauacauagaguuuauguugugaagu

SEQ ID NO: 158282 - RNA, 64 nt, hsa
aaaauucacuaugugaaugagauguuuuaggagcuauaaauaaauugaauauauugguugcuca

SEQ ID NO: 158283 - RNA, 64 nt, hsa
gagacacaugguaacacauacuccagauugaccuuauaaauaaaagaaugcccaccagauugaa

SEQ ID NO: 158284 - RNA, 64 nt, hsa
uugaaggucuguaaauguguacauacaugucuuauauaaauauauaauauauaaauaugguguc

SEQ ID NO: 158285 - RNA, 64 nt, hsa
uguguacauacaugucuuauauaaauauauaauauauaaauauggugucuguguacauauagug

SEQ ID NO: 158286 - RNA, 64 nt, hsa
uuuauuguauacuguaucauagaaguuggagguauauaaauagaacauuuugcuaaagugaaaa

SEQ ID NO: 158287 - RNA, 64 nt, hsa
aacuuguauucauucuuguguauuuauuacaauauauaaauaauggcaacucuuuguuuuauac

SEQ ID NO: 158288 - RNA, 64 nt, hsa
acuaaaauuuguaucugaucaaagcacauaagaauauaaauaauagcaaacuacuauuaaacaa

SEQ ID NO: 158289 - RNA, 64 nt, hsa
cauguuauguagaaaauggucaauggcaaauuuuuauaaauacagcuaccccaucaaagcugaa

SEQ ID NO: 158290 - RNA, 64 nt, hsa
ucaccuagcaauaaaaucuaauuuuuaaaaaguauauaaauauaaaauguauaaaugauggaua

SEQ ID NO: 158291 - RNA, 64 nt, hsa
uuuuuuaguguugucacuuguuuauagauaaauauauaaauaaccuguuuggauccugguccuu

SEQ ID NO: 158292 - RNA, 64 nt, hsa
acacuaauuguuagcuguuuugaaauuauauauauauaaauauauauaaauauauaaauauaug

SEQ ID NO: 158293 - RNA, 64 nt, hsa
uuagcuguuuugaaauuauauauauauaaauauauauaaauauauaaauauaugccagucuugg

SEQ ID NO: 158294 - RNA, 64 nt, hsa
uuugaaauuauauauauauaaauauauauaaauauauaaauauaugccagucuuggcugaaaug

SEQ ID NO: 158295 - RNA, 64 nt, hsa
ucuucccauuucucuuuauauauauauauauaaauauaaauauauguuuguuuguuuuuuuaau

SEQ ID NO: 158296 - RNA, 64 nt, hsa
aauuugucuucccauuucucuuuauauauauauauauaaauauaaauauauguuuguuuguuuu

SEQ ID NO: 158297 - RNA, 64 nt, hsa
aacacauuacuugcacaagcuuguauauacauauuauaaauaaaugccaacauacccuucuuua

SEQ ID NO: 158298 - RNA, 64 nt, hsa
auuuuuaaacuaguaaugggccaauuaaaauauauauaaauauauauuuuucaaccagcauuuu

SEQ ID NO: 158299 - RNA, 64 nt, hsa
uuuaugggcauugauacauauauaaauauauagauauaaauauauaugaauauauuuuuuuaag

SEQ ID NO: 158300 - RNA, 64 nt, hsa
uugggcccacguguuuuaugggcauugauacauauauaaauauauagauauaaauauauaugaa

SEQ ID NO: 158301 - RNA, 64 nt, hsa
agcaaguagcaugaaguauugcuuaaauuuuagguauaaauaaauauauauauguauaauauau

SEQ ID NO: 158302 - RNA, 64 nt, hsa
gguauuaagucguugccuuuauuuguaaagcuguuauaaauauauauuauauaaauauauuaaa

SEQ ID NO: 158303 - RNA, 64 nt, hsa
ccuuuauuuguaaagcuguuauaaauauauauuauauaaauauauuaaaaaggaaaauguuuca

SEQ ID NO: 158304 - RNA, 64 nt, hsa
auauuaaagaaaauagaaaaaauuaccuuaaauauauaaauaagagaauuuuggcccuucugug

SEQ ID NO: 158305 - RNA, 64 nt, hsa
uuuuccuguaugguaagacguauuuuucucaguuuauaaauacguagcacucagguugagacga

SEQ ID NO: 158306 - RNA, 64 nt, hsa
agaaucccuugaaaaggaaauauuuucuguuucuuauaaauaaaagaguaaucuuacuuucaga

SEQ ID NO: 158307 - RNA, 64 nt, hsa
auuaaaagaacaaagaucuuuuauauggauaucuuauaaauauauaaucauugcuaaguaagaa

SEQ ID NO: 158308 - RNA, 64 nt, hsa
aauauuuuugaaaucccugaguaucaggccuuguuauaaauaagcugcauaaucaauaaauaga

SEQ ID NO: 158309 - RNA, 64 nt, hsa
uuaaauuauggaguauuuuaagucuacaaaaagguauaaauaauaauauaaugaauuccuauau

SEQ ID NO: 158310 - RNA, 64 nt, hsa
guaaaaauauacugauuuugaaaaguaucaggaauauaaauauuugguaauucuguguaacaag

SEQ ID NO: 158311 - RNA, 64 nt, hsa
uacaaaacaucuuggcauauuuaagaguggcuuuuauaaauagcuuuauucugauauuaaucag

SEQ ID NO: 158312 - RNA, 64 nt, hsa
agcuacuccucagcugauggcccacuuuuguuuauauaaauaagagcuucugccccaccugcag

SEQ ID NO: 158313 - RNA, 64 nt, hsa
cauauauauauauauacauauauauaaauauaaauauaaauauaucucauugcagccagugauu

SEQ ID NO: 158314 - RNA, 64 nt, hsa
acauaacauauauauauauauacauauauauaaauauaaauauaaauauaucucauugcagcca

SEQ ID NO: 158315 - RNA, 64 nt, hsa
uuuuguacauaacauauauauauauauacauauauauaaauauaaauauaaauauaucucauug

SEQ ID NO: 158316 - RNA, 64 nt, hsa
aauuauacauguagcucaacuugagguacugcuauauaaauauucacucacauuaucacggaau

SEQ ID NO: 158317 - RNA, 64 nt, hsa
uauagauaaacuuacuagauauaaauuaaaauuuuauaaauauuucauauuuuucugaguaaau

SEQ ID NO: 158318 - RNA, 64 nt, hsa
auuugccucacucauuacuccugugugacaguuauauaaauagcaugcagcucacaucuguuuu

SEQ ID NO: 158319 - RNA, 64 nt, hsa
aauaaucagaauauuucaucuaacugcuuagaacuauaaauagcauucuaaauuugaguaaaua

SEQ ID NO: 158320 - RNA, 64 nt, hsa
uuaaguuaauuucuucucuuuccaucuaccuuuuuauaaauacauaucuaugucucauaaaaau

SEQ ID NO: 158321 - RNA, 64 nt, hsa
auuuuaaauuauggaacugcuaaauagauauuucuauaaauagauaauuuuuauuuauguagcu

SEQ ID NO: 158322 - RNA, 64 nt, hsa
cucauuguuuaaauguaacuugcugugucugagguauaaauauagucugugggagugagaggca

SEQ ID NO: 158323 - RNA, 64 nt, hsa
ccuuuuuugcugaggaaaugaagauaagcaaaaauauaaauauauauauaaauauaugaguuau

SEQ ID NO: 158324 - RNA, 64 nt, hsa
aggaaaugaagauaagcaaaaauauaaauauauauauaaauauaugaguuauuaaaaucagaag

SEQ ID NO: 158325 - RNA, 64 nt, hsa
gaagaaaauccauuuccaugacugaagcauuggauauaaauaugguguccugcuuuuuuuguag

SEQ ID NO: 158326 - RNA, 64 nt, hsa
guucuacaaagguaguagaaucaaucucgaccuauauaaauaguagauuuuuuauggugaaacu

SEQ ID NO: 158327 - RNA, 64 nt, hsa
auugaucaacuuuaaauuaagcacaguaaauguguauaaauaugaaggcaaucauaaggauuuu

SEQ ID NO: 158328 - RNA, 64 nt, hsa
augacuguauuuuaaaauacuuaaaagugcuugauauaaauagcuuuuccuucugaaccacguu

SEQ ID NO: 158329 - RNA, 64 nt, hsa
acgucaaucaaaaugucaaauaugugugucagaauauaaauaauuuuucacauuguauuguugc

SEQ ID NO: 158330 - RNA, 64 nt, hsa
cuuuggaugauuaucaccuuugccacuuaaaauauauaaauauccuuuuuacuucaugaggaag

SEQ ID NO: 158331 - RNA, 64 nt, hsa
augcuaauauuaaauuuuguaaaaauaacuuauuuauaaauaauuuuuaaagagaaaaaucuca

SEQ ID NO: 158332 - RNA, 64 nt, hsa
caucauaggucuccuugugcuaccuuuuacucccuauaaauagaaauccaaguauacuuuaaua

SEQ ID NO: 158333 - RNA, 64 nt, hsa
ugcgugcuugaguguguucgcguguguggguggauauaaauauauauaaauauauauaaauaaa

SEQ ID NO: 158334 - RNA, 64 nt, hsa
aguguguucgcguguguggguggauauaaauauauauaaauauauauaaauaaauauauauauc

SEQ ID NO: 158335 - RNA, 64 nt, hsa
cguguguggguggauauaaauauauauaaauauauauaaauaaauauauauauccucuguauaa

SEQ ID NO: 158336 - RNA, 64 nt, hsa
aagugccaacuucaucaaguaaugcaugcuuuauuauaaauaaaauucuagcuuugaaaggcgu

SEQ ID NO: 158337 - RNA, 64 nt, hsa
uuacugagagaucuucauauacuucauuuuuuaauauaaauaauuuuaauaaauuuuauuuucu

SEQ ID NO: 158338 - RNA, 64 nt, hsa
caagaauauuugcaaugacacaugaauuuaauuuuauaaauauaauggaaaacagauuuuucau

SEQ ID NO: 158339 - RNA, 64 nt, hsa
aagaccacaaauaaucaagaguugauuucaagauuauaaauacucaugaucagaaaauaguacu

SEQ ID NO: 158340 - RNA, 64 nt, hsa
aauaguguuucacaguauuucuauuuaaggcagcuauaaauauaggagaaaaauguuuuuggag

SEQ ID NO: 158341 - RNA, 64 nt, hsa
uuucuucagugauuacaaucauacucuucauuacuauaaauauuucauuucccauuugaugagc

SEQ ID NO: 158342 - RNA, 64 nt, hsa
cauaucuguauauauacauauauauauauauaaauauaaauauauucuuuacuuuuuguaucag

SEQ ID NO: 158343 - RNA, 64 nt, hsa
cguauacauaucuguauauauacauauauauauauauaaauauaaauauauucuuuacuuuuug

SEQ ID NO: 158344 - RNA, 64 nt, hsa
uuuaaaaaauuguuugcuugaaaauacuacugaauauaaauaagaaugugcacaguaguuuuuu

SEQ ID NO: 158345 - RNA, 64 nt, hsa
uugaaacuuguauuauuuuuaaagagaucuauacuauaaauauggugauauauuuacaaguaau

SEQ ID NO: 158346 - RNA, 64 nt, hsa
uauguuuccaguguagcagaucucuauauaaauauauaaauauauauaacuggcuuauuuucuu

SEQ ID NO: 158347 - RNA, 64 nt, hsa
guuuuuuauauguuuccaguguagcagaucucuauauaaauauauaaauauauauaacuggcuu

SEQ ID NO: 158348 - RNA, 64 nt, hsa
cuagaucuccuauuuuucagaaugcucuucuacguauaaauaugaaaugauaaagaugucaaau

SEQ ID NO: 158349 - RNA, 64 nt, hsa
cuucgacccuuucucugagagagaugaucgugccuauaaauaguaggaccaauguugugauuaa

SEQ ID NO: 158350 - RNA, 64 nt, hsa
acugauuuuuuuuuaaaugguaaaugaccuuguauauaaauauugccauaucaugguaccuaua

SEQ ID NO: 158351 - RNA, 64 nt, hsa
uguaagucuucuaaacuugguuuauugacguuaguauaaauaacauacaauaccagaugucuac

SEQ ID NO: 158352 - RNA, 64 nt, hsa
ccaauaccuuuguauacucucaguucucauucaguauaaauaaaauuuuaaaauccuuucauag

SEQ ID NO: 158353 - RNA, 64 nt, hsa
aaaaagaaaaaaaaagaaaaaacugggaccuaaguauaaauaucucauccuaaaguaaacaaua

SEQ ID NO: 158354 - RNA, 64 nt, hsa
augaaaaacaaaaaauugcaaguaguaugcaaauuauaaauauacagucuucccacuucacuaa

SEQ ID NO: 158355 - RNA, 64 nt, hsa
ggucuuuaguccgggggacuuggggcugagagaguauaaauaacccugggcuguccagccuuaa

SEQ ID NO: 158356 - RNA, 64 nt, hsa
uaaaaccagagaaucuuaaggucuaacuguggaauauaaauagcugaaaacuaauguacuguac

SEQ ID NO: 158357 - RNA, 64 nt, hsa
uaugacaauauuuuaacauaccucucucucuacauauaaauaccauaaaguaaacuaaaaugac

SEQ ID NO: 158358 - RNA, 64 nt, hsa
gccuaugaaaugaacuuacugguuauagugggaauauaaauaaagugagggauccaacauuacu

SEQ ID NO: 158359 - RNA, 64 nt, hsa
gaaacacuuugaagucuauaaaaaauaaaauaauuauaaauaucauuguacauagcauguuuau

SEQ ID NO: 158360 - RNA, 64 nt, hsa
guuuucauuuacucuaaaaacugauugaaugauauauaaauauauuuauagccugaguaaaguu

SEQ ID NO: 158361 - RNA, 64 nt, hsa
ccuccuacauuguaacaauugcuucagccuacguuauaaauaaagaaccacuagauuaaaaaag

SEQ ID NO: 158362 - RNA, 64 nt, hsa
accucucccugugcaguuuuuuguucuaaacuuguauaaauaacaauuguguaaugugucuccc

SEQ ID NO: 158363 - RNA, 64 nt, hsa
uuacuuguauguauuuugugauucugauaggauguauaaauacuuagaugcauacaagccgaug

SEQ ID NO: 158364 - RNA, 64 nt, hsa
uuaagaagucuaauaugauauacauucauccuaguauaaauaaauaaucucuaaguuuucugaa

SEQ ID NO: 158365 - RNA, 64 nt, hsa
ugugccccuucugugguaugcccuugcccuguucuauaaauaucuauaaauacucauauauaua

SEQ ID NO: 158366 - RNA, 64 nt, hsa
cugugguaugcccuugcccuguucuauaaauaucuauaaauacucauauauauacacaccuaca

SEQ ID NO: 158367 - RNA, 64 nt, hsa
aaaacaucuaaagcuguuggagaagagggacucauauaaauaguuggauugcguuuugcuuuuu

SEQ ID NO: 158368 - RNA, 64 nt, hsa
gaccagccugggcaacauagcgagacuccaucucuauaaauaaaaaaaaaggaaaugcauuaaa

SEQ ID NO: 158369 - RNA, 64 nt, hsa
cucugucagaggccugcaggcugugaguuauauuuauaaauauaucuucagaaauuaaucuuaa

SEQ ID NO: 158370 - RNA, 64 nt, hsa
gguagccuuaacuucuggccaaguuuguuuuuuauauaaauauauauacauauauacauauuau

SEQ ID NO: 158371 - RNA, 64 nt, hsa
cuuauaaagaaaaagaagcuuuucuagggguuuguauaaauaguguugaaacuuuauuuuaugu

SEQ ID NO: 158372 - RNA, 64 nt, hsa
aauauauuuugaugaaauagguauuguguaaaucuauaaauauuugaauccaaaccaaauauaa

SEQ ID NO: 158373 - RNA, 64 nt, hsa
aucacacugcagcugcuuuccauuuuuauauauauauaaauauauauaaauauauacuuuuuaa

SEQ ID NO: 158374 - RNA, 64 nt, hsa
agcugcuuuccauuuuuauauauauauaaauauauauaaauauauacuuuuuaaaaauaauuua

SEQ ID NO: 158375 - RNA, 64 nt, hsa
cacacaaagguucuggagauuacuggagaauauauauaaauauauauauguacguauauaugua

SEQ ID NO: 158376 - RNA, 64 nt, hsa
uguacguauauauguaaauacacauauacguauauauaaauauauauauacauaugugugugua

SEQ ID NO: 158377 - RNA, 64 nt, hsa
aauuuucauuugauauuagauauaaauaucugaauauaaauaauuuuaauauacuagucaugau

SEQ ID NO: 158378 - RNA, 64 nt, hsa
aaaauuugguaguaaauuuucauuugauauuagauauaaauaucugaauauaaauaauuuuaau

SEQ ID NO: 158379 - RNA, 64 nt, hsa
uucugauuugaagaaacugacauuccuuuaaaaauauaaauauaaauacauacauacauagaua

SEQ ID NO: 158380 - RNA, 64 nt, hsa
uuugaagaaacugacauuccuuuaaaaauauaaauauaaauacauacauacauagauauauacc

SEQ ID NO: 158381 - RNA, 64 nt, hsa
uaaacugcuuaacuucaaagauaguuauugaccuuauaaauaaauauuucaaaauuuugauucg

SEQ ID NO: 158382 - RNA, 64 nt, hsa
uauguguggaagacauucguacucuuaucuuuacuauaaauaaauucauaaaaguuaacaaagg

SEQ ID NO: 158383 - RNA, 64 nt, hsa
agcuucauguguauuauugcagcuugaucauuuauauaaauauuugucuaguacaaugcuugac

SEQ ID NO: 158384 - RNA, 64 nt, hsa
uuacuguucaaacauuuuuggugagugcugcuuuuauaaauaugugaugucacauauuucagug

SEQ ID NO: 158385 - RNA, 64 nt, hsa
cuaauaucaacaguauaucucagugugugagauauauaaauacacauacaccccaugugcuuuu

SEQ ID NO: 158386 - RNA, 64 nt, hsa
uaguuucucauagcuuuacagauguagauauaaauauaaauauauguauacauauagauagaua

SEQ ID NO: 158387 - RNA, 64 nt, hsa
acaaguuaguuucucauagcuuuacagauguagauauaaauauaaauauauguauacauauaga

SEQ ID NO: 158388 - RNA, 64 nt, hsa
gaauccugggaaaauuaauaaugauugugagaauuauaaauacagacauaaaaagaggaguaca

SEQ ID NO: 158389 - RNA, 64 nt, hsa
cacacacacaccuaauacuacauucaaaguauuuuauaaauacuaacccuugaagaaagcaguu

SEQ ID NO: 158390 - RNA, 64 nt, hsa
aauuaaaucccuguuucucuauguagucuggcaguauaaauauaaauauuuaccauauaaucuu

SEQ ID NO: 158391 - RNA, 64 nt, hsa
aucccuguuucucuauguagucuggcaguauaaauauaaauauuuaccauauaaucuuggaaua

SEQ ID NO: 158392 - RNA, 64 nt, hsa
cacuccugaauacagaggcauauucuuuuuaaacuauaaauaccauuuugagugagaaaguacu

SEQ ID NO: 158393 - RNA, 64 nt, hsa
aaacaagaaagaaauuguacauuaugacuaaaguuauaaauacaauauuuauaucuauaaaucu

SEQ ID NO: 158394 - RNA, 64 nt, hsa
auuggaaaaauauuuugugaaaagcuguauuuauuauaaauacuagggccaugacauaguacca

SEQ ID NO: 158395 - RNA, 64 nt, hsa
cucaguuuaugucucagaugcuaacgugugaaaauauaaauauauauaauauauaaaguaacca

SEQ ID NO: 158396 - RNA, 64 nt, hsa
augccggacacggauuuauauauaaauauauauauauaaauauauuauacucacucaucacggc

SEQ ID NO: 158397 - RNA, 64 nt, hsa
ggugccacagucagaugccggacacggauuuauauauaaauauauauauauaaauauauuauac

SEQ ID NO: 158398 - RNA, 64 nt, hsa
uugucuauacuaguagaagugaucagugacauacuauaaauaauccuaaaugguuauauuugau

SEQ ID NO: 158399 - RNA, 64 nt, hsa
aaccuauuuuugaauaguaguugcagcuuguuuguauaaauacuaaaaaauaucuuaacagauu

SEQ ID NO: 158400 - RNA, 64 nt, hsa
acuuuuuccaacacauaauccucuccaacuggauuauaaauaaauugaaaauaacucauuauac

SEQ ID NO: 158401 - RNA, 64 nt, hsa
guuacuacauaucuaguaaaaccucguuuaauacuauaaauaauauucuauucauuuugaaaaa

SEQ ID NO: 158402 - RNA, 64 nt, hsa
cagggcgcuugaguugcugagaugcaaggaauucuauaaauaacccauucauagcauagcuaga

SEQ ID NO: 158403 - RNA, 64 nt, hsa
auagaagaagaggugguugcugcucauguagaucuauaaauauguguuguaugucuuuuuugcu

SEQ ID NO: 158404 - RNA, 64 nt, hsa
aaaaagguucuuaaacauuauuugaaauaguuaauauaaauacauaauugcauuugcucuguuu

SEQ ID NO: 158405 - RNA, 64 nt, hsa
cuaagaucaaacauuuuaauaugugcauguuauauauaaauauguaaauucugugauacucuau

SEQ ID NO: 158406 - RNA, 64 nt, hsa
acagauuugguuaguuuagaagaaaagaaagcucuauaaauauaaaucuauauuccuguauuuu

SEQ ID NO: 158407 - RNA, 64 nt, hsa
uaaaucuauauuccuguauuuuuauuuaauaauuuauaaauaccaaguucauuugacuuuuauu

SEQ ID NO: 158408 - RNA, 64 nt, hsa
cucucaagaacuucagaaaucugcaacauaauuuuauaaauauauaaauacauguauguauguc

SEQ ID NO: 158409 - RNA, 64 nt, hsa
aacuucagaaaucugcaacauaauuuuauaaauauauaaauacauguauguaugucaaaacacu

SEQ ID NO: 158410 - RNA, 64 nt, hsa
gaaaauuccacaaagauuucugguaacuuugagcuauaaauaccuuaaaaauaauagauugaug

SEQ ID NO: 158411 - RNA, 64 nt, hsa
ugaugauuuucuuuauuuccuagagaauuuauuuuauaaauacuuuguuuacauuuuagauugu

SEQ ID NO: 158412 - RNA, 64 nt, hsa
aaaaagacuguuacauauuaaaauaguguacauauauaaauauuaccucuuuugcuguacaguu

SEQ ID NO: 158413 - RNA, 64 nt, hsa
agucuguaauuauuguacagauauuuuaauagcauauaaauaaguauauuccuuuuauuuugaa

SEQ ID NO: 158414 - RNA, 64 nt, hsa
acaauucaguugacuuugaccuaauauuuaagaauauaaauauauuuuauuugaaaggcugagu

SEQ ID NO: 158415 - RNA, 64 nt, hsa
uuguguccucauugaguuuuugggugauacaguuuauaaauauaacaauuauacacccucauac

SEQ ID NO: 158416 - RNA, 64 nt, hsa
ggugguggaauuaugggaugggguggaguauugauauaaauauauaaauacaaauguauauuuu

SEQ ID NO: 158417 - RNA, 64 nt, hsa
aauuaugggaugggguggaguauugauauaaauauauaaauacaaauguauauuuuucaggaug

SEQ ID NO: 158418 - RNA, 64 nt, hsa
uuugugucauguauaugccuaaauuuuaauuaucuauaaauaaaacaucugacauaaaagugua

SEQ ID NO: 158419 - RNA, 64 nt, hsa
uguauauuggaaauaacuguguaacaaaucguauuauaaauauuucaauuaauuuuacucugaa

SEQ ID NO: 158420 - RNA, 64 nt, hsa
uaggacuguguuuacuaaaguguguaaauguuuauauaaauaccaaauugcagcauccccaaaa

SEQ ID NO: 158421 - RNA, 64 nt, hsa
caauaucuuacagugauacaguuuuguauuuacauauaaauauaccgacaugaucaaaacccuu

SEQ ID NO: 158422 - RNA, 64 nt, hsa
aauauauauuguaugugauaauaugaucguauucuauaaauacauauacacacgauacuccuuu

SEQ ID NO: 158423 - RNA, 64 nt, hsa
guaauggugcuacuucauuuuuuaaguauuucuauauaaauaaaauauugaagaaaaucuuauc

SEQ ID NO: 158424 - RNA, 64 nt, hsa
gucaaaaagaacuguugaugcuuucuaacauuuguauaaauagaauucagugcaaguuacaaaa

SEQ ID NO: 158425 - RNA, 64 nt, hsa
gccugggaaaccugaacaccugaaaugcaugcucuauaaauaauaggaacggcgacauucuagu

SEQ ID NO: 158426 - RNA, 64 nt, hsa
aauuuuuccuuugaaauuauuuauauguucuauauauaaauacauauguacauagauauauggg

SEQ ID NO: 158427 - RNA, 64 nt, hsa
uugccuccuugguuucagaagagaguaguuuuauuauaaauauuguauggacuuuguauauuaa

SEQ ID NO: 158428 - RNA, 64 nt, hsa
cuaucucaucauagcauaucugcuuuggaauaacuauaaauaaaagaugaaguuaggaaaugug

SEQ ID NO: 158429 - RNA, 64 nt, hsa
ugcucaacaugguuuacuacuaacauuuuaaaaauauaaauacuuuagcaaaaacauucacucu

SEQ ID NO: 158430 - RNA, 64 nt, hsa
ggagguaaacuuugucauguauagguaaggguacuauaaauaugagauuccccuacauucuccu

SEQ ID NO: 158431 - RNA, 64 nt, hsa
cuuucauuauggaaugugaaauaucaguguugucuauaaauauuugaagguauauaaaaaugag

SEQ ID NO: 158432 - RNA, 64 nt, hsa
ucaauucugacuuuuuuauagugguuuuuaagaguauaaauagaagggagaguguauaugugua

SEQ ID NO: 158433 - RNA, 64 nt, hsa
gauauauuugcacuguuuuccugguuuuaagugcuauaaauaaagaugcugugaaaucuacaua

SEQ ID NO: 158434 - RNA, 64 nt, hsa
aaauuguuuuuguaaaugguuuuuauaaauuuuauauaaauaaguuauaugaauuuuuauugau

SEQ ID NO: 158435 - RNA, 64 nt, hsa
aaaucuaaauggugaaauauauacuaaugccaucuauaaauacaaacaaauagaauguuuauag

SEQ ID NO: 158436 - RNA, 64 nt, hsa
ggucaaauauucaauuuaagagcaaggaaauucuuauaaauauaacaauagaggcagaacucau

SEQ ID NO: 158437 - RNA, 64 nt, hsa
uauuggguauugcaggaguucauuccuuuuuguuuauaaauacucuuccgucauaugaauagua

SEQ ID NO: 158438 - RNA, 64 nt, hsa
uucaauuguucuuucuggaagacuuuuaaaaaaauauaaauaugcauauauauauauaaauuau

SEQ ID NO: 158439 - RNA, 64 nt, hsa
aaaaaaauauaaauaugcauauauauauauaaauuauaaauagauuccccacgcaguguggugg

SEQ ID NO: 158440 - RNA, 64 nt, hsa
cguccaaccacaaaagaaauuauauauaaauauauauaaauauauaucucuaccauaugugaug

SEQ ID NO: 158441 - RNA, 64 nt, hsa
agcuuugggacguccaaccacaaaagaaauuauauauaaauauauauaaauauauaucucuacc

SEQ ID NO: 158442 - RNA, 64 nt, hsa
uauauaaauguugagauuuugcacuauuuuuuaauauaaauaugucagugcuugcuugauggaa

SEQ ID NO: 158443 - RNA, 64 nt, hsa
aaaaccuuuguuuaaagaucugcaauauuauauauauaaauauauauaagauaagagaaacugu

SEQ ID NO: 158444 - RNA, 64 nt, hsa
gcaucguguggcccuccccucccaccucccuguguauaaauauuuacaugugaugucuggucug

SEQ ID NO: 158445 - RNA, 64 nt, hsa
uguccauacuaugacaaucuuauugucaacacuauauaaauaagcuuuuaaacaagucauuuuu

SEQ ID NO: 158446 - RNA, 64 nt, hsa
aacaacugugaguagccuaugaaugaaauucuuuuauaaauauuaggcauaaauuaaaauguaa

SEQ ID NO: 158447 - RNA, 64 nt, hsa
uuuuuaaaacuaaugaguaugaacuugagaucuguauaaauaagagcaugauuugaaaaaaagc

SEQ ID NO: 158448 - RNA, 64 nt, hsa
guuaauguuacuuuaaaauuacauucuauauauauauaaauauauauaaauauauauuaaaaua

SEQ ID NO: 158449 - RNA, 64 nt, hsa
cuuuaaaauuacauucuauauauauauaaauauauauaaauauauauuaaaauaccaguuuuuu

SEQ ID NO: 158450 - RNA, 64 nt, hsa
acuguuguaaaucaugcaauuaaaguugauuacuuauaaauaugaacuuuggaucacuguauag

SEQ ID NO: 158451 - RNA, 64 nt, hsa
aguugauguacccuuauauauauauacauauauauauaaauauaaauauauauaaaaacaacaa

SEQ ID NO: 158452 - RNA, 64 nt, hsa
uguacccuuauauauauauacauauauauauaaauauaaauauauauaaaaacaacaaaacaaa

SEQ ID NO: 158453 - RNA, 64 nt, hsa
uaucuuggguuaaauuugagagugauucucuguauauaaauaugugaaauauuauuaucucaac

SEQ ID NO: 158454 - RNA, 64 nt, hsa
gcaagguugugcuuuucauugugcucuguacguauauaaauauauauauauauacacacacaca

SEQ ID NO: 158455 - RNA, 64 nt, hsa
uuuuauaucaaauauacaguucuaauauaaaaguuauaaauaauuauuuuuguuaacaaagaca

SEQ ID NO: 158456 - RNA, 64 nt, hsa
ucauuuuuuuaagaaaggaauagcgauagauuuauauaaauaucuaaaugucucaguagaggag

SEQ ID NO: 158457 - RNA, 64 nt, hsa
auuaacuuuacugacauggagugaagugcaauauuauaaauauuauagauuaaaaaaaaaauag

SEQ ID NO: 158458 - RNA, 64 nt, hsa
ccguaguaugaauguacaucuuguaaaacugagauauaaauaaacuuauaaauauuuguauuca

SEQ ID NO: 158459 - RNA, 64 nt, hsa
uguacaucuuguaaaacugagauauaaauaaacuuauaaauauuuguauucaaguguuaaaaaa

SEQ ID NO: 158460 - RNA, 64 nt, hsa
guauggcuguauuugcuguugauucagacuuucacaccauuaauggggaaaagcguggccacaa

SEQ ID NO: 158461 - RNA, 64 nt, hsa
agaaugccacuuuggcugaacuacaaguguaggccaccauuauaauuuauaaauacagcauacu

SEQ ID NO: 158462 - RNA, 64 nt, hsa
auuagucugcccaccuuucuaggcugggcuuggccaccauuaaacacggggugggggugagggc

SEQ ID NO: 158463 - RNA, 64 nt, hsa
augaaugaauggccuucccuucucaggcuauucccaccauuagucugcccaccuuucuaggcug

SEQ ID NO: 158464 - RNA, 64 nt, hsa
uuuagaaaccagaaugcuuuguuuuuaccagauucaccauuagagguugauggggcaacugcag

SEQ ID NO: 158465 - RNA, 64 nt, hsa
ggcaaaauuacacaagaaaacaguauugcaaugacaccauuacauaaggaacauugaacuguua

SEQ ID NO: 158466 - RNA, 64 nt, hsa
caaucacacgcagccccuccccgccacagagacacaccauuacauacacagacacacacagaaa

SEQ ID NO: 158467 - RNA, 64 nt, hsa
caaucgcagauacgcccuuccggccacagaaacacaccauuacacacacauacacagaaagaca

SEQ ID NO: 158468 - RNA, 64 nt, hsa
aaaucacacacacacccuccccgccacagagacacaccauuacauacacagacacgcaaucgca

SEQ ID NO: 158469 - RNA, 64 nt, hsa
caaaaucacacacacacccuccccgccacagagacaccauuacauacacagacacacacagaaa

SEQ ID NO: 158470 - RNA, 64 nt, hsa
ucaaaucacacacacccccuccccaccacagagacaccauuacauacacagacacacacagaaa

SEQ ID NO: 158471 - RNA, 64 nt, hsa
cgcgcuguuccggcuucuucacggcugacauucggcuaacgagggauuacuuuggccaaaaccu

SEQ ID NO: 158472 - RNA, 64 nt, hsa
ucuaugaaaaauucuugccuuuccuuguuucagugcuaacgauuucucaccucgaagcgccuuu

SEQ ID NO: 158473 - RNA, 64 nt, hsa
aagcugccccugacagcacagggccugggggguggcuaacgagagaggccuuacagugccggca

SEQ ID NO: 158474 - RNA, 64 nt, hsa
gguucccgccugcuguccccucccugaucacacagcuaacgaggcugccuccagcauuuccuga

SEQ ID NO: 158475 - RNA, 64 nt, hsa
gggcaagaaccaccucaugauucugcaggccauugcuaacgaacagcucauugcuacaaccagu

SEQ ID NO: 158476 - RNA, 64 nt, hsa
cagcuccaaguaaacuaguuaccuggguaaaagcgcuaacgacccaaaggcucuucuaagagcc

SEQ ID NO: 158477 - RNA, 64 nt, hsa
ucauucccuagagacaccaguaaccccgggcuuagcuaacgaaaguggggagccucaggcugaa

SEQ ID NO: 158478 - RNA, 64 nt, hsa
guuucccucaccucggucuucccaagauggagaugcuaacgaaacugagaagggggcguauguu

SEQ ID NO: 158479 - RNA, 64 nt, hsa
uguaucucacuuuuucucuaacacugauuuaauagcuaacgagguagaagcaacauucauucuc

SEQ ID NO: 158480 - RNA, 64 nt, hsa
gcuuauuguaggguagaaaagagcuuucuacucagcuaacgauuacucauugauccaaaacuua

SEQ ID NO: 158481 - RNA, 64 nt, hsa
cuucucaggguccccuccuaaccgcaagcguccugcuaacgagaaggcaacugaugacuaucau

SEQ ID NO: 158482 - RNA, 64 nt, hsa
cucagggagguuaagugacuugcccaguuucagggcuaacgaccacagggucugcacucuaacc

SEQ ID NO: 158483 - RNA, 64 nt, hsa
gaaguuacuggggauuacucgaccucauuacuuagcuaacgacuggauaaaauuucuuaauugu

SEQ ID NO: 158484 - RNA, 64 nt, hsa
cuggcaacaucacgauuuaagcuaagguugggaggcuaacgagucuaccucccucuuuguaaau

SEQ ID NO: 158485 - RNA, 64 nt, hsa
uaauuggcuuacuugaucauuugauggaaucuaggcuaacgagacaaaggaagucugaaggcuu

SEQ ID NO: 158486 - RNA, 64 nt, hsa
uaagauggaaucacuaccucugaucacauaucaggcuaacgauagagaaagcauuagguuuaag

SEQ ID NO: 158487 - RNA, 64 nt, hsa
auaacaagcuaaaagcacaacuaaaauuucacaugcuaacgacaacuugaaugaacugcugggg

SEQ ID NO: 158488 - RNA, 64 nt, hsa
acaguucuugagcaaacugaguuagggaggguaugcuaacgacagaaccuaugcaaguucuuag

SEQ ID NO: 158489 - RNA, 64 nt, hsa
uugauaaagggaauguugcauuugggacuaugcugcuaacgaaaugguuugaaguauuuucaug

SEQ ID NO: 158490 - RNA, 64 nt, hsa
ucugcagaauaucaucagggacaaagaucucgaggcuaacgauguagguuucauuucucagacu

SEQ ID NO: 158491 - RNA, 64 nt, hsa
gacaggcagaccuagauaagaaaagcagagaacuacuuuggaaaacaguuuaucugcuguaauu

SEQ ID NO: 158492 - RNA, 64 nt, hsa
gccaggugcgguggcucacgccuguaaucccaaaacuuuggaaggcugaggcagguggaucacc

SEQ ID NO: 158493 - RNA, 64 nt, hsa
guucuaauaauuuuuaguugugagugauuaaaaaacuuuggaucaauuuuggucaaacaugcca

SEQ ID NO: 158494 - RNA, 64 nt, hsa
uaagugaaaugaguauaauccaaguaacuggugaacuuuggagguuuggagcuugaagagaaug

SEQ ID NO: 158495 - RNA, 64 nt, hsa
ugccuuccugccucuacuccaccuccaucccuggacuuuggacccuuggccuaggagccuaagg

SEQ ID NO: 158496 - RNA, 64 nt, hsa
gcaccacccaagaaagaggaaaacuuugccuacaacuuuggaaaugcuggggucccuggugugg

SEQ ID NO: 158497 - RNA, 64 nt, hsa
ggccagcaccacuuccuuuaaagaugaacucugaacuuuggagagugagcuacagagccgagca

SEQ ID NO: 158498 - RNA, 64 nt, hsa
gaauacaaauuuuaaaggaugaaaaucuuaccguacuuuggaacuugcuguuuaaaaagacaga

SEQ ID NO: 158499 - RNA, 64 nt, hsa
uuuauuccagcauucgaugcauuuuuauagaaacacuuuggaaacacuuuggaugaaccaaggc

SEQ ID NO: 158500 - RNA, 64 nt, hsa
auucgaugcauuuuuauagaaacacuuuggaaacacuuuggaugaaccaaggccuuuuccuuau

SEQ ID NO: 158501 - RNA, 64 nt, hsa
gcacagaaaauacacauuuacuguccaauuuaaaacuuuggaauugcugugauuaaagugauca

SEQ ID NO: 158502 - RNA, 64 nt, hsa
uauaaaaaaaaaaguacuaucaaucaaucauacuacuuuggauuguugugcugguguaaugugg

SEQ ID NO: 158503 - RNA, 64 nt, hsa
aaauucucucuguugagagcauuucagccagaggacuuuggaacugugaauauacuuccugaag

SEQ ID NO: 158504 - RNA, 64 nt, hsa
uggaaccagaacaggcuaaggcauacaguucuugacuuuggacaauccaagagugaaccagaau

SEQ ID NO: 158505 - RNA, 64 nt, hsa
cuuuuggauggguugggagauguggcuggaaaguacuuuggaaaauauacaaucaagauaucuc

SEQ ID NO: 158506 - RNA, 64 nt, hsa
uuuugguaaaucucuuaauguaaguagcuauuugacuuuggaauuuugcauucgagguauacug

SEQ ID NO: 158507 - RNA, 64 nt, hsa
cccaguuuaaaaagaguccaguuaggguggacuaacuuuggacacaaauuggcuuccauuuccu

SEQ ID NO: 158508 - RNA, 64 nt, hsa
cgauauugugcuugaaguucuucggaaacuucugacuuuggauuaagaaagacuucuguugccu

SEQ ID NO: 158509 - RNA, 64 nt, hsa
ggguguucaaggaagaguggcucuuagcagaggcacuuuggaaggugugaggcauaaaugcuuc

SEQ ID NO: 158510 - RNA, 64 nt, hsa
uaaguaaggcugucagucugcuuaagggaagaaaacuuuggauuugcugggucugaaucggcuu

SEQ ID NO: 158511 - RNA, 64 nt, hsa
agcugcaguuagggaagggagccauugagcacagacuuuggaaggaaccuuuuuuuuguuguuu

SEQ ID NO: 158512 - RNA, 64 nt, hsa
ccccagcaucaaaaaaccaaugauuuugcugcagacuuuggaaugauccaaaauggaaaagcca

SEQ ID NO: 158513 - RNA, 64 nt, hsa
gugucgauauccacaacccagcccccaggccugcacuuuggagauuucuggauccuucccuggg

SEQ ID NO: 158514 - RNA, 64 nt, hsa
aagccaccguggccggccaagcacaagcucacccacuuuggagcagcauuucuccuccccagag

SEQ ID NO: 158515 - RNA, 64 nt, hsa
ccaagcaggacauggacaaggaugaucuaggaagacuuuggaaagaguaggaagacuuuggaaa

SEQ ID NO: 158516 - RNA, 64 nt, hsa
gaugaucuaggaagacuuuggaaagaguaggaagacuuuggaaagacuuuuccaacccucauca

SEQ ID NO: 158517 - RNA, 64 nt, hsa
uuucuagaaaagccacaccugcaucuggggacacacuuuggaaagugggacccuccagccugga

SEQ ID NO: 158518 - RNA, 64 nt, hsa
ucugaacucugaccugugaauagaagcagcaugcacuuuggaaauccggccuuuugaccagaac

SEQ ID NO: 158519 - RNA, 64 nt, hsa
gcauuauugcauuauauaccauuuaucuguauuaacuuuggaauguacucuguucaauguuuaa

SEQ ID NO: 158520 - RNA, 64 nt, hsa
gcccaccugugaguuuaaagcaaggcuuuaaaugacuuuggagagggucacaaauccuaaaaga

SEQ ID NO: 158521 - RNA, 64 nt, hsa
aaaagucacaggugacagcccuccugaggcccacacuuuggaggggguccauguccaagagacc

SEQ ID NO: 158522 - RNA, 64 nt, hsa
cagcucugccuggcugguguucaggcccucagucacuuuggaagugagaagaacccuucagcca

SEQ ID NO: 158523 - RNA, 64 nt, hsa
aauaggguuguuacaacugucacuagcggaggucacuuuggagaagggugggccuuacauccag

SEQ ID NO: 158524 - RNA, 64 nt, hsa
agugggugugguggcucacaccugcaaucccagcacuuuggaaggccgaggugggcagaucauc

SEQ ID NO: 158525 - RNA, 64 nt, hsa
uucucaagguuauuuccgacuuuggaucagaaacacuuuggagauuuccauuugucucauacag

SEQ ID NO: 158526 - RNA, 64 nt, hsa
uuguuguuuuccuacuuucucaagguuauuuccgacuuuggaucagaaacacuuuggagauuuc

SEQ ID NO: 158527 - RNA, 64 nt, hsa
acgcacacacgcacacacacacacguacacacacauacaaaaucccucugcaguuuuggggaga

SEQ ID NO: 158528 - RNA, 64 nt, hsa
cuuugggacugauucucaguggagggcuuagaucauacaaaaaucuuuauuggguccguguguu

SEQ ID NO: 158529 - RNA, 64 nt, hsa
agcuuuuaaacuggugucuuuggaaggaagguagauacaaaaagauugugguaaaaacuggggu

SEQ ID NO: 158530 - RNA, 64 nt, hsa
uuuauuuguuuuugagauggagucucuacuaaaaauacaaaaaauuagccaggcauggugccgc

SEQ ID NO: 158531 - RNA, 64 nt, hsa
uggccaauauggugaaaccccaucucuacuaagaauacaaaaaauuagcugagcaugguggugg

SEQ ID NO: 158532 - RNA, 64 nt, hsa
uggccaauaugaugaaaccccgucucuacuaaaaauacaaaauuagucggguaugguggcacau

SEQ ID NO: 158533 - RNA, 64 nt, hsa
uacacugaaaugacuuuuguuuuucuucuaacucauacaaaacugguuuggaaagucuuugcuu

SEQ ID NO: 158534 - RNA, 64 nt, hsa
uggccaacauggugaaaccccgucucuacuaaaaauacaaaaaguagccaggcgugguggcgug

SEQ ID NO: 158535 - RNA, 64 nt, hsa
cucucauuacuguagugcugagguuauugaaguuauacaaaacacaucucagucucuguuucuu

SEQ ID NO: 158536 - RNA, 64 nt, hsa
uugaguugaauauugaacucuaacaguuuucuacauacaaaacacagugucaugaagguuauuc

SEQ ID NO: 158537 - RNA, 64 nt, hsa
uggcuaacacggugaaacuccaucucuacuaaaaauacaaaaaauuggccgggcgcagcggcuc

SEQ ID NO: 158538 - RNA, 64 nt, hsa
uggccaacauggugacaccccgucucuacuaaaaauacaaaaauuacccaggcauaguggcaca

SEQ ID NO: 158539 - RNA, 64 nt, hsa
cucugucucaaaaaaacaaaacaaacaaacaaaaauacaaaaaauuagccgggcgugguggcac

SEQ ID NO: 158540 - RNA, 64 nt, hsa
ugggcaacauggugaaacccccgucucuacuaaaauacaaaaaaauuagccaggcauaguggcg

SEQ ID NO: 158541 - RNA, 64 nt, hsa
uggccaacauagugaaaccccuuguuuacucaaaauacaaaaauuggcugggugcggugguaca

SEQ ID NO: 158542 - RNA, 64 nt, hsa
aagcuuacagacuaacuggggagauguagugugcauacaaaacaguaaaagagccaucucaagg

SEQ ID NO: 158543 - RNA, 64 nt, hsa
accacacccggcuaauuuuuuguguuuuuacaaaauacaaaaaaguagagacaggauuucacug

SEQ ID NO: 158544 - RNA, 64 nt, hsa
cuggugauaaguuccaaauauguuaagggcuuuaauacaaaaagcaaaaauugucaguguuugg

SEQ ID NO: 158545 - RNA, 64 nt, hsa
uggcuaacauggugaaacccugucucuacuaaaaauacaaaaaaaauuagccagccaugguggc

SEQ ID NO: 158546 - RNA, 64 nt, hsa
cgaacacggugaaaccccgucucuacuaaaaaaaauacaaaaaaauuagccaggcguggucgug

SEQ ID NO: 158547 - RNA, 64 nt, hsa
ugaccaacauggcgaaaccccaucucuacuaaaaauacaaaaauuagccuggcauggugguggg

SEQ ID NO: 158548 - RNA, 64 nt, hsa
ugaccaacacggugaaaccccgucucuacuaaaaauacaaaaauuauccgggcaugguggcaca

SEQ ID NO: 158549 - RNA, 64 nt, hsa
accuagaaauguagcuugcuaauaagauagaaugauacaaaagugaaguaguagccacaguaca

SEQ ID NO: 158550 - RNA, 64 nt, hsa
auuuguucuuuuacagaauucuguagcaaagccaauacaaaaaucagcuaaagcugccacagaa

SEQ ID NO: 158551 - RNA, 64 nt, hsa
ugggcaauguggcaaaaccgcguguuuacaaaaaauacaaaaauuagccaggcaugguggugca

SEQ ID NO: 158552 - RNA, 64 nt, hsa
uugaauacaaaacuuugccuguuguacauagccuauacaaaaugcuggguugagccuuucauga

SEQ ID NO: 158553 - RNA, 64 nt, hsa
cuauaaauugaggcagcuaacgucaaauucuugaauacaaaacuuugccuguuguacauagccu

SEQ ID NO: 158554 - RNA, 64 nt, hsa
uggcuaacauggugaaacccuguaucugcuaaaaauacaaaaauuagccaggcgugguggcggg

SEQ ID NO: 158555 - RNA, 64 nt, hsa
cugaccaacaugguaaaaccccaucucuacuaaaauacaaaaauuggcugggcgugguggcacu

SEQ ID NO: 158556 - RNA, 64 nt, hsa
cauggugaaaccccaucucuacaguuuuguaaaaauacaaaaaauuaccugggccugguggcac

SEQ ID NO: 158557 - RNA, 64 nt, hsa
cuuuaauuuuacuuaauuaagaaauggaauuuauauacaaaaauauuuuccauuuccguuauua

SEQ ID NO: 158558 - RNA, 64 nt, hsa
uggccaacauggugaaaccuggccucuacuaaaaauacaaaaauuagccggguguggugguggg

SEQ ID NO: 158559 - RNA, 64 nt, hsa
guuccauuuuauaauucugaugucuucauuagaaauacaaaaauacaauccuuguauuuuuucu

SEQ ID NO: 158560 - RNA, 64 nt, hsa
agauuucauagaagucgugaauacuaaguaauguauacaaaagaaauaugugaugaugugucua

SEQ ID NO: 158561 - RNA, 64 nt, hsa
ucagggaagaagcauacaacuuuggacauagcgaauacaaaauuggaagcugucauaaaaagac

SEQ ID NO: 158562 - RNA, 64 nt, hsa
uggccaacauggugaaaccccgucucuacuaaaaauacaaaaauuagcugagcauggugguacg

SEQ ID NO: 158563 - RNA, 64 nt, hsa
guaauaggguaguucuggagagaugguaugcagcauacaaaaauauauuaaaaauauaaacaau

SEQ ID NO: 158564 - RNA, 64 nt, hsa
aacccauuauuccucaccuacccucaaaguagguauacaaaagacuaguuuguuauuaauccac

SEQ ID NO: 158565 - RNA, 64 nt, hsa
ccugagauguauuuuuucuuuaagucuugaaugaauacaaaaggagcccauuuuauaauauaaa

SEQ ID NO: 158566 - RNA, 64 nt, hsa
uauguaaauggaaauacaaaggauucuuacuaacauacaaaaauaaugcacaacagaaauaucu

SEQ ID NO: 158567 - RNA, 64 nt, hsa
augaaacaucaucucuacauaaaaaaauacauauauacaaaaauuagcugggcaucauggcaca

SEQ ID NO: 158568 - RNA, 64 nt, hsa
uuugguuagaaguucuacaacauuguauguacauauacaaaauuucauuuucucugaaagucga

SEQ ID NO: 158569 - RNA, 64 nt, hsa
uggccaacauggugaaacccugucucuacuaaaaauacaaaaauuagccagguguggagguaca

SEQ ID NO: 158570 - RNA, 64 nt, hsa
uggcuaacauggugaaaccccgucucuacuaaaaauacaaaaaauuagccaggcgugguggcac

SEQ ID NO: 158571 - RNA, 64 nt, hsa
cauuuggaggcuaaaauguaauguuuuuucauucauacaaaauaauggacacucccuaauucca

SEQ ID NO: 158572 - RNA, 64 nt, hsa
ucgccaacaaggugaaaccccaccucuauuaaaaauacaaaaauuagccgggagugguggugcg

SEQ ID NO: 158573 - RNA, 64 nt, hsa
uggccaauaugaugaaaccccaucucuacuaaaaauacaaaaauuaggccggguacaguggcuc

SEQ ID NO: 158574 - RNA, 64 nt, hsa
ucauacacuuaauaguacuguaacugcaauucacauacaaaaugucugauuuuaaugugcugaa

SEQ ID NO: 158575 - RNA, 64 nt, hsa
augccuuucuguuccccucucaugacauuugcagauacaaaagauggaaauuuuucuguaaaac

SEQ ID NO: 158576 - RNA, 64 nt, hsa
cgaggcacagaaaacaaauaucaaagaucuaauaauacaaaacaaacuugauuaaaacuggugc

SEQ ID NO: 158577 - RNA, 64 nt, hsa
agaaugaguuaaaccauuuaaacacauuugaaacauacaaaaauagaaaugugaaagcauuugg

SEQ ID NO: 158578 - RNA, 64 nt, hsa
uggccaacauagugaaaccccaucucuacugaaaauacaaaaauuagcugggugugguggcacg

SEQ ID NO: 158579 - RNA, 64 nt, hsa
gagauaauuagccaaaaacccaguagccuagaagauacaaaacuccacuggccucuaaaauuau

SEQ ID NO: 158580 - RNA, 64 nt, hsa
uggcuaacacagugaaaccccgucucuacuaaaaauacaaaaaauuagccggguguggugucgg

SEQ ID NO: 158581 - RNA, 64 nt, hsa
ugacuaacauggugaaaucccgucucuacuaaaaauacaaaaaaaaaaaaaaaaaaaagccagg

SEQ ID NO: 158582 - RNA, 64 nt, hsa
uggccaacauggugaaauccugccucuacuaaaaauacaaaaaaaaaaaaaaauuagcugggca

SEQ ID NO: 158583 - RNA, 64 nt, hsa
augaaaguugccuuugagaagcuuguuauucauuauacaaaaaguauuugcccauuccuauucu

SEQ ID NO: 158584 - RNA, 64 nt, hsa
guuuguagcucuaugugcaucuauuuuuguagaaauacaaaaaguuugguuuagcauugauggg

SEQ ID NO: 158585 - RNA, 64 nt, hsa
ugagcaauguggugaaaccccaucucuacuaaaaauacaaaaauuaucugggcuugguggcggg

SEQ ID NO: 158586 - RNA, 64 nt, hsa
aaugaaacaacagaaguacaaaaaagaauaucagauacaaaaaucaaucgugaagaaaaucugu

SEQ ID NO: 158587 - RNA, 64 nt, hsa
auauguaaaguaguauugcugacauuuuaaaaaaauacaaaauacaaaagaaaccauuagaaau

SEQ ID NO: 158588 - RNA, 64 nt, hsa
aaguaguauugcugacauuuuaaaaaaauacaaaauacaaaagaaaccauuagaaauuaauaac

SEQ ID NO: 158589 - RNA, 64 nt, hsa
uggccaacauggugaaaccccaucucuacuaaaaauacaaaaauuagccggacgcaguggcacg

SEQ ID NO: 158590 - RNA, 64 nt, hsa
uggccaacauggugaaacccugucucuacuaaaaauacaaaaaugagcugggcaugguggggcg

SEQ ID NO: 158591 - RNA, 64 nt, hsa
acugucacaucuuuacagucuuguauguuauagaauacaaaauaaguugaugguuuuguuuggu

SEQ ID NO: 158592 - RNA, 64 nt, hsa
gggagagguuuuuuuuuuuaauuuuucccccuuuauacaaaaaaaaaagaacauuuccaaaacu

SEQ ID NO: 158593 - RNA, 64 nt, hsa
uggccaacaugaugaaaccuugucuuuacuaaaaauacaaaaauuagcugggcaugguggcagg

SEQ ID NO: 158594 - RNA, 64 nt, hsa
uggccagcaugguaaaacccugucuccacuaaaaauacaaaaauuagccaggcaugguggcggg

SEQ ID NO: 158595 - RNA, 64 nt, hsa
uggccaacauggugaaacccugucucuacuaaaaauacaaaaauuagcugggugugguggugug

SEQ ID NO: 158596 - RNA, 64 nt, hsa
aaguauugagggggcaaaaauuaccaauuaugguauacaaaaauaagccuauaaauguguuuca

SEQ ID NO: 158597 - RNA, 64 nt, hsa
agggucacuuugaauugugcacauaagaaaaccaauacaaaaaacaauuuguauucaauauugu

SEQ ID NO: 158598 - RNA, 64 nt, hsa
cggcuaaaacggugaaaccccgucucuacuaaaaauacaaaaaauuagccgggcguaguggcgg

SEQ ID NO: 158599 - RNA, 64 nt, hsa
auauaugaaaaugcuuuuuaaacacaaaagcuuuauacaaaauauuguugaauuuaaauaaggu

SEQ ID NO: 158600 - RNA, 64 nt, hsa
uaucuggaauacauuaaagaagcaaaagaaccucauacaaaagucauugaguaaaugacagcca

SEQ ID NO: 158601 - RNA, 64 nt, hsa
uggccaucauggcgaaaccucaucucuacuaaaaauacaaaaguuaaccagguguguggugcac

SEQ ID NO: 158602 - RNA, 64 nt, hsa
guauuuauugucaguuuuguucacuuguuaucuaauacaaaauuauaaagccuucagaggguuu

SEQ ID NO: 158603 - RNA, 64 nt, hsa
aggccaacauggugaaacuucaucucuacuaaaaauacaaaaacuagccaggugugguucucca

SEQ ID NO: 158604 - RNA, 64 nt, hsa
uggucuacauggugaaaccccaucucaacuaaaaauacaaaaaauacaaaaaauuagccgggcg

SEQ ID NO: 158605 - RNA, 64 nt, hsa
uggugaaaccccaucucaacuaaaaauacaaaaaauacaaaaaauuagccgggcgcgguggcuc

SEQ ID NO: 158606 - RNA, 64 nt, hsa
uggccaacauggugaaacccugucucuauuaaaaauacaaaaauuagcugggcgugguggcgca

SEQ ID NO: 158607 - RNA, 64 nt, hsa
uggccaauauggugaaacccugucucuacaaaaaauacaaaaauuagcugggcaugguggugcg

SEQ ID NO: 158608 - RNA, 64 nt, hsa
cugugugguaguauuuuguuggaagagaauguuuauacaaaaaaugaaauucuuccaacagcag

SEQ ID NO: 158609 - RNA, 64 nt, hsa
uggcuaacacugugaaaccccgucucuacuaaaaauacaaaaaauuagcggggcaugguggcac

SEQ ID NO: 158610 - RNA, 64 nt, hsa
uaguucuuuaagcauuauuuuaaacacuauauugauacaaaaauaucuugcuuacucuaaacuu

SEQ ID NO: 158611 - RNA, 64 nt, hsa
cggcuaacauggugaaacccugccucuacuaaaaauacaaaaaaaaacaaaauuagccgggcgu

SEQ ID NO: 158612 - RNA, 64 nt, hsa
ggucaacaugucaaaacccuguaccuacaaaaaaauacaaaaguuaaccaagccuaugcuugua

SEQ ID NO: 158613 - RNA, 64 nt, hsa
ugaccaacauggagaaaccccgucucuacuaaaaauacaaaaauauuagccgggcgugguggug

SEQ ID NO: 158614 - RNA, 64 nt, hsa
uggcccacauggugagaccccaacucuacuaaaaauacaaaaauuagcugggugugguggcaug

SEQ ID NO: 158615 - RNA, 64 nt, hsa
uggccagcauggugaaaccccaucucuacuaaaaauacaaaaauuagccaggugugguggcaca

SEQ ID NO: 158616 - RNA, 64 nt, hsa
ccaaauuauccaaaauuauuuuauuaaauauugcauacaaaagaaaauguguaaggcuugcuaa

SEQ ID NO: 158617 - RNA, 64 nt, hsa
guuuacauauuauguuuguauuuaugcuacuuaaauacaaaacuggacaggccaggcauggugg

SEQ ID NO: 158618 - RNA, 64 nt, hsa
ugaccaacauggugaaacuccaucucuacuaaaaauacaaaaauuaaccaggcuugauggugug

SEQ ID NO: 158619 - RNA, 64 nt, hsa
uggcuaacauagugagacccuguuucuacuaaaaauacaaaaauaagccaggugugguggugca

SEQ ID NO: 158620 - RNA, 64 nt, hsa
uggccaacauggcaaaacuccgucucugcaaaaaauacaaaaaugagcccgguauguuggcaua

SEQ ID NO: 158621 - RNA, 64 nt, hsa
ugaccaacauagugaaaccccaucucuacuaaaaauacaaaaauuagcugggcgugguggugua

SEQ ID NO: 158622 - RNA, 64 nt, hsa
acagaaggcuaucaaaauuuuaauuaaguuuaaaauacaaaauuggaucaagacauucacccua

SEQ ID NO: 158623 - RNA, 64 nt, hsa
cagggcaacauggugaaaccccaucucuacuaaaauacaaaaaguuagcugggcuuggcggugu

SEQ ID NO: 158624 - RNA, 64 nt, hsa
uuucuuuuauugcuauuuacacauacauacacacauacaaaaccuuuaaauuuugggaucugaa

SEQ ID NO: 158625 - RNA, 64 nt, hsa
uggccaacauggugaaaccuugucucuacuaaaaauacaaaaauuagccaggcgugguggugca

SEQ ID NO: 158626 - RNA, 64 nt, hsa
ugaccaacacggagaaacccuaucucuacuaaaaauacaaaaguagccgggcguggugaugcgu

SEQ ID NO: 158627 - RNA, 64 nt, hsa
uggccaacauggugaaaccccgucucuacuaaaaauacaaaaauuagcugggcaugguggggca

SEQ ID NO: 158628 - RNA, 64 nt, hsa
uggccaacauggcaaaaucccaucucuacuaaaaauacaaaaauucacaggguguguuggcaca

SEQ ID NO: 158629 - RNA, 64 nt, hsa
cugggcaacacggugaaaccccaucucuauuaaaauacaaaaaauuagcugggcaugguggugc

SEQ ID NO: 158630 - RNA, 64 nt, hsa
aaaagauugaaaauggacgccuuccuuaugccauauacaaaaauuaacucaagauggauuaaag

SEQ ID NO: 158631 - RNA, 64 nt, hsa
ugaccaacauggacaaaccccgucucuacuaaaaauacaaaauuggcagggugugguggcacau

SEQ ID NO: 158632 - RNA, 64 nt, hsa
ugggcaacauggcgaaacccuaucucuacaaaaaauacaaaaauuagccagacaugguggcaca

SEQ ID NO: 158633 - RNA, 64 nt, hsa
uggccaacauggugaaaccucgucuguacuaaaaauacaaaauuuagcugagugugguggcagg

SEQ ID NO: 158634 - RNA, 64 nt, hsa
uggcuaacacggugaaacccugucucuacuaaaaauacaaaaaaauuagccaggcgugguggcg

SEQ ID NO: 158635 - RNA, 64 nt, hsa
uaguacuaguuuugcuuuaaaaugcuauguaaauauacaaaaaaacuagaaagaaauauauaua

SEQ ID NO: 158636 - RNA, 64 nt, hsa
uggcuaaugcguugaaacuccgucucuacuaaaaauacaaaaaauuagcugggcgugguggugg

SEQ ID NO: 158637 - RNA, 64 nt, hsa
cuggccaacauggugaaacccuucucuacugaaaauacaaaaauuagccaggugugguggcgca

SEQ ID NO: 158638 - RNA, 64 nt, hsa
uggcuaauauggugaaaccucgucucuacuaaaaauacaaaaauuagcugggcaugguggugcg

SEQ ID NO: 158639 - RNA, 64 nt, hsa
acuuuuaaggacuugagauaacuaauuuguuuauauacaaaaauuaauguuacuguguuacuua

SEQ ID NO: 158640 - RNA, 64 nt, hsa
ccugagauacccgauucuauauguaaaagcuaauauacaaaaaagcagauuaaauuacaugaua

SEQ ID NO: 158641 - RNA, 64 nt, hsa
uggccaacauggggaaaccccgucucuacuaaaaauacaaaaauuagccgggcauggugguggg

SEQ ID NO: 158642 - RNA, 64 nt, hsa
uggccaauguggugaaaccccaucucuacuaaaaauacaaaaauuagcugggcgugguggugca

SEQ ID NO: 158643 - RNA, 64 nt, hsa
uguugauaagacaaguuuagaauugguuuacuuaauacaaaaaaaaaaaaaagaauuucaaaaa

SEQ ID NO: 158644 - RNA, 64 nt, hsa
aaccuguaguuucauuaccuuuuugaauaaugucauacaaaaaauguauuuguuuuuuugugcu

SEQ ID NO: 158645 - RNA, 64 nt, hsa
uggccaacacggugaaaccccgccucuacuaaaaauacaaaaaauagccggguguggugguggg

SEQ ID NO: 158646 - RNA, 64 nt, hsa
gacaaaacauagugaaaccccgucucuacuaaaaauacaaaaauuagcugggcguggugguggg

SEQ ID NO: 158647 - RNA, 64 nt, hsa
cuguucacuacuguguaaaguaaaaacuaaaaaaauacaaaauacaaaacacacacacacacac

SEQ ID NO: 158648 - RNA, 64 nt, hsa
cuacuguguaaaguaaaaacuaaaaaaauacaaaauacaaaacacacacacacacacacacaca

SEQ ID NO: 158649 - RNA, 64 nt, hsa
uggccaacaugaugaaacccugucucuacuaaaaauacaaaaauuagccgggcaugguggugca

SEQ ID NO: 158650 - RNA, 64 nt, hsa
ccugggcaacauggcacaauugucucuacaaaaaauacaaaaauuagccaggcaugguggcaug

SEQ ID NO: 158651 - RNA, 64 nt, hsa
agaagaaugaaacuagacccccaucucuuagcauauacaaaaaucaaaauuaauuaaaaaguua

SEQ ID NO: 158652 - RNA, 64 nt, hsa
acucugccucaaaaaaaaauuaaaauaaauuuaaauacaaaaaaaaauagccagguguggggug

SEQ ID NO: 158653 - RNA, 64 nt, hsa
cuggccaacguggugaaacgcugucucuacuaaaauacaaaaaaauagggcugggcgcgguugc

SEQ ID NO: 158654 - RNA, 64 nt, hsa
gugaccagccugggcaacccugucucuacaaaaaauacaaaaauuaaccaggcaugguggcaug

SEQ ID NO: 158655 - RNA, 64 nt, hsa
uggccaacauggugaaacccugucucuacuaaaaauacaaaaauagcugggcaugguggcacgc

SEQ ID NO: 158656 - RNA, 64 nt, hsa
uggguaauauggcaagagcccaacucuacuaaaaauacaaaaagaaaagaaaacagccaagcuu

SEQ ID NO: 158657 - RNA, 64 nt, hsa
aguuuuuacagauauacaauauggagugacuuauauacaaaaugaccuuaaaaauauauuaaac

SEQ ID NO: 158658 - RNA, 64 nt, hsa
cucauuaacaggcaguccuuuaguaugcugauuuauacaaaaugcugaaaagaagagaaauacc

SEQ ID NO: 158659 - RNA, 64 nt, hsa
aaauauauacaagcacuuuguaaauuguaaaaugauacaaaauuuaaaguuuauagagccaguu

SEQ ID NO: 158660 - RNA, 64 nt, hsa
uggccaacauggugaaaccccgucucuacuaaaaauacaaaaauuagacgagcgugguggugga

SEQ ID NO: 158661 - RNA, 64 nt, hsa
uggcuaacaaggcgaaauccugucuguacuaaaaauacaaaaaucagccagacaugguggcaug

SEQ ID NO: 158662 - RNA, 64 nt, hsa
ucgccaacauggugaaaccguaucucuaauaaaaauacaaaaauuagcugggcauggugcgggc

SEQ ID NO: 158663 - RNA, 64 nt, hsa
ugguuugagcacuggguucuuuuagccaaauuccauacaaaaagaauuuggauguuuuccagca

SEQ ID NO: 158664 - RNA, 64 nt, hsa
uuaccauuguuauagguaaaaucccauuacaaaaauacaaaaauauuuuuuguaacaguuauuu

SEQ ID NO: 158665 - RNA, 64 nt, hsa
uaaaagucagccuaaagaauguaaagguaucuauauacaaaaggcuaccuuuucuaaaaucugu

SEQ ID NO: 158666 - RNA, 64 nt, hsa
uaacaggguccauacacaucuucugguuuacuauauacaaaaacuguaguugaaaaaagaugac

SEQ ID NO: 158667 - RNA, 64 nt, hsa
agcuuggccaaggugauaaaacccgucucuacuaauacaaaaaaaauuagcuggguauguuggu

SEQ ID NO: 158668 - RNA, 64 nt, hsa
uggccaacauggcgaaaccccaucucuacuaaaaauacaaaaauuagccgggcgugguggcuua

SEQ ID NO: 158669 - RNA, 64 nt, hsa
auuucaugcacugauuaaaauaggauuauuuuaaauacaaaaggcauuuuauaugaauuauaaa

SEQ ID NO: 158670 - RNA, 64 nt, hsa
auuauaaacugaagagcuuaaagauaguuacaaaauacaaaaguucaaccucuuacaauaagcu

SEQ ID NO: 158671 - RNA, 64 nt, hsa
cuuggcccaaagaauaggaacuuagcuagcauguauacaaaauauauuugagguuacuaaauga

SEQ ID NO: 158672 - RNA, 64 nt, hsa
ggaaauuaauacugauaaagacuaucaguaucugauacaaaagggaaccaaacgauauuuaagu

SEQ ID NO: 158673 - RNA, 64 nt, hsa
uugaaugagacaguuuuuaaaaguugauuuauaaauacaaaaauacauucuccaaagauaguau

SEQ ID NO: 158674 - RNA, 64 nt, hsa
uggccaacaugguaaaacgccgucucuacuaaaaauacaaaaacuuagcuggguguaacggcgg

SEQ ID NO: 158675 - RNA, 64 nt, hsa
ugggcaacauggcaaaaccccaucucuacaaaaaauacaaaaaguaggccgggcacggugguuc

SEQ ID NO: 158676 - RNA, 64 nt, hsa
uggccaacaugguggaacccaaucucuacuaaaaauacaaaaaaacuagccggauaugguggcg

SEQ ID NO: 158677 - RNA, 64 nt, hsa
uugacaaaagcaaaguaaucuuacaacuaugugcauacaaaagcaauacuauuuugugacuaaa

SEQ ID NO: 158678 - RNA, 64 nt, hsa
cuguugaaaaaaacugguucuccaccccucccccauacaaaauccacaacaaagcgcagugguc

SEQ ID NO: 158679 - RNA, 64 nt, hsa
uggccaacauagugaaaccccgucucuauuaaaaauacaaaaauuagcuggguguggugguaug

SEQ ID NO: 158680 - RNA, 64 nt, hsa
uggccaacauggcaaaaccccgucucuacuaaaaauacaaaaagccgggcguggugggcgccug

SEQ ID NO: 158681 - RNA, 64 nt, hsa
cuggccaacauggugaaaccccgucucuacuaaaauacaaaaaauuagcugggcaugguggcgc

SEQ ID NO: 158682 - RNA, 64 nt, hsa
ugaccaacuuggugaaaucccaucucuacuaaaaauacaaaaauuagcugggugcaguggcgca

SEQ ID NO: 158683 - RNA, 64 nt, hsa
uggcuaacacggugaaaccccgucuuuacuaaaaauacaaaaaaaauuagccgggcgugguggc

SEQ ID NO: 158684 - RNA, 64 nt, hsa
cagacuagaauaggguucuuaaaaucaaguaucaauacaaaauagaacacaauuaaaaucuuaa

SEQ ID NO: 158685 - RNA, 64 nt, hsa
uggcaaacauggugaaaccccgucucuauuaaaaauacaaaaauuagcugggcgugguggcgug

SEQ ID NO: 158686 - RNA, 64 nt, hsa
caaggcaacauagugaggccccaucuuuacaaaaauacaaaaauuagcuggacguguaguccca

SEQ ID NO: 158687 - RNA, 64 nt, hsa
uggccaguauggugaaacccugucucuccuaaaaauacaaaaauuagccgggcaugguggaaug

SEQ ID NO: 158688 - RNA, 64 nt, hsa
ugucuaacacggugaaaccccaucucuacuaaaaauacaaaaaaauuagucggacaugguggca

SEQ ID NO: 158689 - RNA, 64 nt, hsa
uggccaacauggugaaaccccaucucuacuaaaaauacaaaaauuagcuaggcgggguagugca

SEQ ID NO: 158690 - RNA, 64 nt, hsa
ucagccaagacauaaaaacuaggacucagagcacauacaaaaccaguuauguuucggaaagagg

SEQ ID NO: 158691 - RNA, 64 nt, hsa
uugaaauugggccuaaggagugagaacuacaaaaauacaaaaugcuuguccaggacucagccau

SEQ ID NO: 158692 - RNA, 64 nt, hsa
uggcuaacacggugaaaccccgucucuacuaaaaauacaaaaaaauuagucgggcgugguggcg

SEQ ID NO: 158693 - RNA, 64 nt, hsa
uggccaacauggugaaaccccaucuuuacuaaaaauacaaaaaacuagccaggcgugguggugg

SEQ ID NO: 158694 - RNA, 64 nt, hsa
agacuccgucucaaaaaaaaaaaaaaaaaaaaaaauacaaaaauuagccgggcgugguggccca

SEQ ID NO: 158695 - RNA, 64 nt, hsa
uggccaacaugaugaaaccccaucucuacuaaaaauacaaaaaauuagccgggcgugguagcgg

SEQ ID NO: 158696 - RNA, 64 nt, hsa
uggccaacaaggcaaaaccccgucucuacuaaaaauacaaaaauuagccgggcaugguggugug

SEQ ID NO: 158697 - RNA, 64 nt, hsa
acucagggaacaaugagcacuugaagauuuuuuuauacaaaaggccacagugaggccaccuuga

SEQ ID NO: 158698 - RNA, 64 nt, hsa
uggccaacauggugaaaccucaucucuacuaaaaauacaaaaauuagccaggcgugguggcagg

SEQ ID NO: 158699 - RNA, 64 nt, hsa
uggugaacauggcgaaaccccgucucuaauaaaaauacaaaaauuagccgggcaugguggugca

SEQ ID NO: 158700 - RNA, 64 nt, hsa
ugagcaacaugguaaaaccccaucucuaccaaaaauacaaaaauuagcugggcuugguggcugg

SEQ ID NO: 158701 - RNA, 64 nt, hsa
uggcuaacauggugaaauccuaucucuaccaaaaauacaaaaauuagccaggcguggugguggg

SEQ ID NO: 158702 - RNA, 64 nt, hsa
ggagguuuguuuaacacuaucuauauuuaagcuuauacaaaaugggcaaaauauagaauauuug

SEQ ID NO: 158703 - RNA, 64 nt, hsa
uggccaauauggugaaaccccaucucuacuaaaaauacaaaaauuagccgggugugguggcgug

SEQ ID NO: 158704 - RNA, 64 nt, hsa
uagaucugauaaacaacuucaaaaaaguuucaggauacaaaaucuguguacaaaaauuaguugc

SEQ ID NO: 158705 - RNA, 64 nt, hsa
aggauauugaaacuggaccccuauccuucacgauauacaaaaaucaacucaagauggauuaaag

SEQ ID NO: 158706 - RNA, 64 nt, hsa
uggguaacauggcaaaauccugucuuuacaaaaaauacaaaaauuagccuagcaugguggcgca

SEQ ID NO: 158707 - RNA, 64 nt, hsa
uggcuaauauggugaaacccugucucuacuaaaaauacaaaaaaauuagcuaggcaugguggcg

SEQ ID NO: 158708 - RNA, 64 nt, hsa
uuuaaaacuuucuaucaugaaaaaauuugaacauauacaaaaauacacagaaucuuauauugaa

SEQ ID NO: 158709 - RNA, 64 nt, hsa
uggccaacauggugaaaccucaucucuacuaaaaauacaaaaaauuagcaacagagcgcgauuc

SEQ ID NO: 158710 - RNA, 64 nt, hsa
cauucaaaauauguuaaauuucugacaauuccuaauacaaaaaugacccgauuaaaagauucug

SEQ ID NO: 158711 - RNA, 64 nt, hsa
ugaccaacacugagaaaccccaucucuauuaaagauacaaaauuagccaggcaugguggugcau

SEQ ID NO: 158712 - RNA, 64 nt, hsa
ugguuaacauggugaaacccugucuguacuaaaaauacaaaauuuagccaggcaugguggcaca

SEQ ID NO: 158713 - RNA, 64 nt, hsa
aggagaaaaauuuuagcuuucuacuuuauaucauauacaaaaauaaaauccaacuaaagaccag

SEQ ID NO: 158714 - RNA, 64 nt, hsa
aauaaaucaagcaguaguaagauagugagcauucauacaaaaauccaagaagauacaggaauuc

SEQ ID NO: 158715 - RNA, 64 nt, hsa
ugaccaucauggugaaaccucaucuccacuaaaaauacaaaaauuagccaggcguggucacaug

SEQ ID NO: 158716 - RNA, 64 nt, hsa
caggagaugauauaucuggaauguccuuuuguucauacaaaagaaaaaugaggaugaauaacaa

SEQ ID NO: 158717 - RNA, 64 nt, hsa
uggccaacaugaugaaacccuaucucuacuaaaaauacaaaaauuagccgggcaugguggugca

SEQ ID NO: 158718 - RNA, 64 nt, hsa
uggcuaacacggugaaaccccaucucuacuaaaaauacaaaaaccaaaaaaaauuagccaggcg

SEQ ID NO: 158719 - RNA, 64 nt, hsa
uggcuaacacggugaaaccccgucucuacuaaaaauacaaaaaaauuagccgggugcgguggcg

SEQ ID NO: 158720 - RNA, 64 nt, hsa
ugggcaacauggugagaccccaucucuacaaaaaauacaaaaauuagcugagugugguggcaca

SEQ ID NO: 158721 - RNA, 64 nt, hsa
uggccaacguggugaaacacugucucuacuaaaaauacaaaaaugagcugggugugaugauaca

SEQ ID NO: 158722 - RNA, 64 nt, hsa
uggcuaacacggugaaaccccgucuuuacuaaaaauacaaaaaaaauuagcugggcgugguggc

SEQ ID NO: 158723 - RNA, 64 nt, hsa
uggccaacauggcgaaaccccuucucuacuaaaaauacaaaaauuagcugggcgugguagugca

SEQ ID NO: 158724 - RNA, 64 nt, hsa
ggcaaacacuuucaaauauaauuuccuucagugaauacaaaauguugauaucauaggugaugua

SEQ ID NO: 158725 - RNA, 64 nt, hsa
uggccaacauggcaaaacccccaucucuacuaaaauacaaaaauuaggugugguggcgggcacc

SEQ ID NO: 158726 - RNA, 64 nt, hsa
ucugggaaacguggugagaccucaucucuacaaaauacaaaaaaauuagccgggcaugguggca

SEQ ID NO: 158727 - RNA, 64 nt, hsa
uggccaacauggugaaaccccaucucuacuaaaaauacaaaaauuagcugggcguaguggcgcg

SEQ ID NO: 158728 - RNA, 64 nt, hsa
cuggccaacauagcaaaaccucaucucuacuaaaauacaaaaauuagccgggcgugguggugcg

SEQ ID NO: 158729 - RNA, 64 nt, hsa
uggccaacauggugaaaccccaucucuaucagaaauacaaaaaauuagcugggcgugguggugg

SEQ ID NO: 158730 - RNA, 64 nt, hsa
uacauuuguauuuauguggcuguaaugacaaaagauacaaaagcuuuuuaaaauuuagaguagg

SEQ ID NO: 158731 - RNA, 64 nt, hsa; identical to SEQ ID NO: 158491

SEQ ID NO: 158732 - RNA, 64 nt, hsa; identical to SEQ ID NO: 158492

SEQ ID NO: 158733 - RNA, 64 nt, hsa; identical to SEQ ID NO: 158493

SEQ ID NO: 158734 - RNA, 64 nt, hsa; identical to SEQ ID NO: 158494

SEQ ID NO: 158735 - RNA, 64 nt, hsa; identical to SEQ ID NO: 158495

SEQ ID NO: 158736 - RNA, 64 nt, hsa; identical to SEQ ID NO: 158496

SEQ ID NO: 158737 - RNA, 64 nt, hsa; identical to SEQ ID NO: 158497

SEQ ID NO: 158738 - RNA, 64 nt, hsa; identical to SEQ ID NO: 158498

SEQ ID NO: 158739 - RNA, 64 nt, hsa; identical to SEQ ID NO: 158499

SEQ ID NO: 158740 - RNA, 64 nt, hsa; identical to SEQ ID NO: 158500

SEQ ID NO: 158741 - RNA, 64 nt, hsa; identical to SEQ ID NO: 158501

SEQ ID NO: 158742 - RNA, 64 nt, hsa; identical to SEQ ID NO: 158502

SEQ ID NO: 158743 - RNA, 64 nt, hsa; identical to SEQ ID NO: 158503

SEQ ID NO: 158744 - RNA, 64 nt, hsa; identical to SEQ ID NO: 158504

SEQ ID NO: 158745 - RNA, 64 nt, hsa; identical to SEQ ID NO: 158505

SEQ ID NO: 158746 - RNA, 64 nt, hsa; identical to SEQ ID NO: 158506

SEQ ID NO: 158747 - RNA, 64 nt, hsa; identical to SEQ ID NO: 158507

SEQ ID NO: 158748 - RNA, 64 nt, hsa; identical to SEQ ID NO: 158508

SEQ ID NO: 158749 - RNA, 64 nt, hsa; identical to SEQ ID NO: 158509

SEQ ID NO: 158750 - RNA, 64 nt, hsa; identical to SEQ ID NO: 158510

SEQ ID NO: 158751 - RNA, 64 nt, hsa; identical to SEQ ID NO: 158511

SEQ ID NO: 158752 - RNA, 64 nt, hsa; identical to SEQ ID NO: 158512

SEQ ID NO: 158753 - RNA, 64 nt, hsa; identical to SEQ ID NO: 158513

SEQ ID NO: 158754 - RNA, 64 nt, hsa; identical to SEQ ID NO: 158514

SEQ ID NO: 158755 - RNA, 64 nt, hsa; identical to SEQ ID NO: 158515

SEQ ID NO: 158756 - RNA, 64 nt, hsa; identical to SEQ ID NO: 158516

SEQ ID NO: 158757 - RNA, 64 nt, hsa; identical to SEQ ID NO: 158517

SEQ ID NO: 158758 - RNA, 64 nt, hsa; identical to SEQ ID NO: 158518

SEQ ID NO: 158759 - RNA, 64 nt, hsa; identical to SEQ ID NO: 158519

SEQ ID NO: 158760 - RNA, 64 nt, hsa; identical to SEQ ID NO: 158520

SEQ ID NO: 158761 - RNA, 64 nt, hsa; identical to SEQ ID NO: 158521

SEQ ID NO: 158762 - RNA, 64 nt, hsa; identical to SEQ ID NO: 158522

SEQ ID NO: 158763 - RNA, 64 nt, hsa; identical to SEQ ID NO: 158523

SEQ ID NO: 158764 - RNA, 64 nt, hsa; identical to SEQ ID NO: 158524

SEQ ID NO: 158765 - RNA, 64 nt, hsa; identical to SEQ ID NO: 158525

SEQ ID NO: 158766 - RNA, 64 nt, hsa; identical to SEQ ID NO: 158526

SEQ ID NO: 158767 - RNA, 64 nt, hsa; identical to SEQ ID NO: 158527

SEQ ID NO: 158768 - RNA, 64 nt, hsa; identical to SEQ ID NO: 158528

SEQ ID NO: 158769 - RNA, 64 nt, hsa; identical to SEQ ID NO: 158529

SEQ ID NO: 158770 - RNA, 64 nt, hsa; identical to SEQ ID NO: 158530

SEQ ID NO: 158771 - RNA, 64 nt, hsa; identical to SEQ ID NO: 158531

SEQ ID NO: 158772 - RNA, 64 nt, hsa; identical to SEQ ID NO: 158532

SEQ ID NO: 158773 - RNA, 64 nt, hsa; identical to SEQ ID NO: 158533

SEQ ID NO: 158774 - RNA, 64 nt, hsa; identical to SEQ ID NO: 158534

SEQ ID NO: 158775 - RNA, 64 nt, hsa; identical to SEQ ID NO: 158535

SEQ ID NO: 158776 - RNA, 64 nt, hsa; identical to SEQ ID NO: 158536

SEQ ID NO: 158777 - RNA, 64 nt, hsa; identical to SEQ ID NO: 158537

SEQ ID NO: 158778 - RNA, 64 nt, hsa; identical to SEQ ID NO: 158538

SEQ ID NO: 158779 - RNA, 64 nt, hsa; identical to SEQ ID NO: 158539

SEQ ID NO: 158780 - RNA, 64 nt, hsa; identical to SEQ ID NO: 158540

SEQ ID NO: 158781 - RNA, 64 nt, hsa; identical to SEQ ID NO: 158541

SEQ ID NO: 158782 - RNA, 64 nt, hsa; identical to SEQ ID NO: 158542

SEQ ID NO: 158783 - RNA, 64 nt, hsa; identical to SEQ ID NO: 158543

SEQ ID NO: 158784 - RNA, 64 nt, hsa; identical to SEQ ID NO: 158544

SEQ ID NO: 158785 - RNA, 64 nt, hsa; identical to SEQ ID NO: 158545

SEQ ID NO: 158786 - RNA, 64 nt, hsa; identical to SEQ ID NO: 158546

SEQ ID NO: 158787 - RNA, 64 nt, hsa; identical to SEQ ID NO: 158547

SEQ ID NO: 158788 - RNA, 64 nt, hsa; identical to SEQ ID NO: 158548

SEQ ID NO: 158789 - RNA, 64 nt, hsa; identical to SEQ ID NO: 158549

SEQ ID NO: 158790 - RNA, 64 nt, hsa; identical to SEQ ID NO: 158550

SEQ ID NO: 158791 - RNA, 64 nt, hsa; identical to SEQ ID NO: 158551

SEQ ID NO: 158792 - RNA, 64 nt, hsa; identical to SEQ ID NO: 158552

SEQ ID NO: 158793 - RNA, 64 nt, hsa; identical to SEQ ID NO: 158553

SEQ ID NO: 158794 - RNA, 64 nt, hsa; identical to SEQ ID NO: 158554

SEQ ID NO: 158795 - RNA, 64 nt, hsa; identical to SEQ ID NO: 158555

SEQ ID NO: 158796 - RNA, 64 nt, hsa; identical to SEQ ID NO: 158556

SEQ ID NO: 158797 - RNA, 64 nt, hsa; identical to SEQ ID NO: 158557

SEQ ID NO: 158798 - RNA, 64 nt, hsa; identical to SEQ ID NO: 158558

SEQ ID NO: 158799 - RNA, 64 nt, hsa; identical to SEQ ID NO: 158559

SEQ ID NO: 158800 - RNA, 64 nt, hsa; identical to SEQ ID NO: 158560

SEQ ID NO: 158801 - RNA, 64 nt, hsa; identical to SEQ ID NO: 158561

SEQ ID NO: 158802 - RNA, 64 nt, hsa; identical to SEQ ID NO: 158562

SEQ ID NO: 158803 - RNA, 64 nt, hsa; identical to SEQ ID NO: 158563

SEQ ID NO: 158804 - RNA, 64 nt, hsa; identical to SEQ ID NO: 158564

SEQ ID NO: 158805 - RNA, 64 nt, hsa; identical to SEQ ID NO: 158565

SEQ ID NO: 158806 - RNA, 64 nt, hsa; identical to SEQ ID NO: 158566

SEQ ID NO: 158807 - RNA, 64 nt, hsa; identical to SEQ ID NO: 158567

SEQ ID NO: 158808 - RNA, 64 nt, hsa; identical to SEQ ID NO: 158568

SEQ ID NO: 158809 - RNA, 64 nt, hsa; identical to SEQ ID NO: 158569

SEQ ID NO: 158810 - RNA, 64 nt, hsa; identical to SEQ ID NO: 158570

SEQ ID NO: 158811 - RNA, 64 nt, hsa; identical to SEQ ID NO: 158571

SEQ ID NO: 158812 - RNA, 64 nt, hsa; identical to SEQ ID NO: 158572

SEQ ID NO: 158813 - RNA, 64 nt, hsa; identical to SEQ ID NO: 158573

SEQ ID NO: 158814 - RNA, 64 nt, hsa; identical to SEQ ID NO: 158574

SEQ ID NO: 158815 - RNA, 64 nt, hsa; identical to SEQ ID NO: 158575

SEQ ID NO: 158816 - RNA, 64 nt, hsa; identical to SEQ ID NO: 158576

SEQ ID NO: 158817 - RNA, 64 nt, hsa; identical to SEQ ID NO: 158577

SEQ ID NO: 158818 - RNA, 64 nt, hsa; identical to SEQ ID NO: 158578

SEQ ID NO: 158819 - RNA, 64 nt, hsa; identical to SEQ ID NO: 158579

SEQ ID NO: 158820 - RNA, 64 nt, hsa; identical to SEQ ID NO: 158580

SEQ ID NO: 158821 - RNA, 64 nt, hsa; identical to SEQ ID NO: 158581

SEQ ID NO: 158822 - RNA, 64 nt, hsa; identical to SEQ ID NO: 158582

SEQ ID NO: 158823 - RNA, 64 nt, hsa; identical to SEQ ID NO: 158583

SEQ ID NO: 158824 - RNA, 64 nt, hsa; identical to SEQ ID NO: 158584

SEQ ID NO: 158825 - RNA, 64 nt, hsa; identical to SEQ ID NO: 158585

SEQ ID NO: 158826 - RNA, 64 nt, hsa; identical to SEQ ID NO: 158586

SEQ ID NO: 158827 - RNA, 64 nt, hsa; identical to SEQ ID NO: 158587

SEQ ID NO: 158828 - RNA, 64 nt, hsa; identical to SEQ ID NO: 158588

SEQ ID NO: 158829 - RNA, 64 nt, hsa; identical to SEQ ID NO: 158589

SEQ ID NO: 158830 - RNA, 64 nt, hsa; identical to SEQ ID NO: 158590

SEQ ID NO: 158831 - RNA, 64 nt, hsa; identical to SEQ ID NO: 158591

SEQ ID NO: 158832 - RNA, 64 nt, hsa; identical to SEQ ID NO: 158592

SEQ ID NO: 158833 - RNA, 64 nt, hsa; identical to SEQ ID NO: 158593

SEQ ID NO: 158834 - RNA, 64 nt, hsa; identical to SEQ ID NO: 158594

SEQ ID NO: 158835 - RNA, 64 nt, hsa; identical to SEQ ID NO: 158595

SEQ ID NO: 158836 - RNA, 64 nt, hsa; identical to SEQ ID NO: 158596

SEQ ID NO: 158837 - RNA, 64 nt, hsa; identical to SEQ ID NO: 158597

SEQ ID NO: 158838 - RNA, 64 nt, hsa; identical to SEQ ID NO: 158598

SEQ ID NO: 158839 - RNA, 64 nt, hsa; identical to SEQ ID NO: 158599

SEQ ID NO: 158840 - RNA, 64 nt, hsa; identical to SEQ ID NO: 158600

SEQ ID NO: 158841 - RNA, 64 nt, hsa; identical to SEQ ID NO: 158601

SEQ ID NO: 158842 - RNA, 64 nt, hsa; identical to SEQ ID NO: 158602

SEQ ID NO: 158843 - RNA, 64 nt, hsa; identical to SEQ ID NO: 158603

SEQ ID NO: 158844 - RNA, 64 nt, hsa; identical to SEQ ID NO: 158604

SEQ ID NO: 158845 - RNA, 64 nt, hsa; identical to SEQ ID NO: 158605

SEQ ID NO: 158846 - RNA, 64 nt, hsa; identical to SEQ ID NO: 158606

SEQ ID NO: 158847 - RNA, 64 nt, hsa; identical to SEQ ID NO: 158607

SEQ ID NO: 158848 - RNA, 64 nt, hsa; identical to SEQ ID NO: 158608

SEQ ID NO: 158849 - RNA, 64 nt, hsa; identical to SEQ ID NO: 158609

SEQ ID NO: 158850 - RNA, 64 nt, hsa; identical to SEQ ID NO: 158610

SEQ ID NO: 158851 - RNA, 64 nt, hsa; identical to SEQ ID NO: 158611

SEQ ID NO: 158852 - RNA, 64 nt, hsa; identical to SEQ ID NO: 158612

SEQ ID NO: 158853 - RNA, 64 nt, hsa; identical to SEQ ID NO: 158613

SEQ ID NO: 158854 - RNA, 64 nt, hsa; identical to SEQ ID NO: 158614

SEQ ID NO: 158855 - RNA, 64 nt, hsa; identical to SEQ ID NO: 158615

SEQ ID NO: 158856 - RNA, 64 nt, hsa; identical to SEQ ID NO: 158616

SEQ ID NO: 158857 - RNA, 64 nt, hsa; identical to SEQ ID NO: 158617

SEQ ID NO: 158858 - RNA, 64 nt, hsa; identical to SEQ ID NO: 158618

SEQ ID NO: 158859 - RNA, 64 nt, hsa; identical to SEQ ID NO: 158619

SEQ ID NO: 158860 - RNA, 64 nt, hsa; identical to SEQ ID NO: 158620

SEQ ID NO: 158861 - RNA, 64 nt, hsa; identical to SEQ ID NO: 158621

SEQ ID NO: 158862 - RNA, 64 nt, hsa; identical to SEQ ID NO: 158622

SEQ ID NO: 158863 - RNA, 64 nt, hsa; identical to SEQ ID NO: 158623

SEQ ID NO: 158864 - RNA, 64 nt, hsa; identical to SEQ ID NO: 158624

SEQ ID NO: 158865 - RNA, 64 nt, hsa; identical to SEQ ID NO: 158625

SEQ ID NO: 158866 - RNA, 64 nt, hsa; identical to SEQ ID NO: 158626

SEQ ID NO: 158867 - RNA, 64 nt, hsa; identical to SEQ ID NO: 158627

SEQ ID NO: 158868 - RNA, 64 nt, hsa; identical to SEQ ID NO: 158628

SEQ ID NO: 158869 - RNA, 64 nt, hsa; identical to SEQ ID NO: 158629

SEQ ID NO: 158870 - RNA, 64 nt, hsa; identical to SEQ ID NO: 158630

SEQ ID NO: 158871 - RNA, 64 nt, hsa; identical to SEQ ID NO: 158631

SEQ ID NO: 158872 - RNA, 64 nt, hsa; identical to SEQ ID NO: 158632

SEQ ID NO: 158873 - RNA, 64 nt, hsa; identical to SEQ ID NO: 158633

SEQ ID NO: 158874 - RNA, 64 nt, hsa; identical to SEQ ID NO: 158634

SEQ ID NO: 158875 - RNA, 64 nt, hsa; identical to SEQ ID NO: 158635

SEQ ID NO: 158876 - RNA, 64 nt, hsa; identical to SEQ ID NO: 158636

SEQ ID NO: 158877 - RNA, 64 nt, hsa; identical to SEQ ID NO: 158637

SEQ ID NO: 158878 - RNA, 64 nt, hsa; identical to SEQ ID NO: 158638

SEQ ID NO: 158879 - RNA, 64 nt, hsa; identical to SEQ ID NO: 158639

SEQ ID NO: 158880 - RNA, 64 nt, hsa; identical to SEQ ID NO: 158640

SEQ ID NO: 158881 - RNA, 64 nt, hsa; identical to SEQ ID NO: 158641

SEQ ID NO: 158882 - RNA, 64 nt, hsa; identical to SEQ ID NO: 158642

SEQ ID NO: 158883 - RNA, 64 nt, hsa; identical to SEQ ID NO: 158643

SEQ ID NO: 158884 - RNA, 64 nt, hsa; identical to SEQ ID NO: 158644

SEQ ID NO: 158885 - RNA, 64 nt, hsa; identical to SEQ ID NO: 158645

SEQ ID NO: 158886 - RNA, 64 nt, hsa; identical to SEQ ID NO: 158646

SEQ ID NO: 158887 - RNA, 64 nt, hsa; identical to SEQ ID NO: 158647

SEQ ID NO: 158888 - RNA, 64 nt, hsa; identical to SEQ ID NO: 158648

SEQ ID NO: 158889 - RNA, 64 nt, hsa; identical to SEQ ID NO: 158649

SEQ ID NO: 158890 - RNA, 64 nt, hsa; identical to SEQ ID NO: 158650

SEQ ID NO: 158891 - RNA, 64 nt, hsa; identical to SEQ ID NO: 158651

SEQ ID NO: 158892 - RNA, 64 nt, hsa; identical to SEQ ID NO: 158652

SEQ ID NO: 158893 - RNA, 64 nt, hsa; identical to SEQ ID NO: 158653

SEQ ID NO: 158894 - RNA, 64 nt, hsa; identical to SEQ ID NO: 158654

SEQ ID NO: 158895 - RNA, 64 nt, hsa; identical to SEQ ID NO: 158655

SEQ ID NO: 158896 - RNA, 64 nt, hsa; identical to SEQ ID NO: 158656

SEQ ID NO: 158897 - RNA, 64 nt, hsa; identical to SEQ ID NO: 158657

SEQ ID NO: 158898 - RNA, 64 nt, hsa; identical to SEQ ID NO: 158658

SEQ ID NO: 158899 - RNA, 64 nt, hsa; identical to SEQ ID NO: 158659

SEQ ID NO: 158900 - RNA, 64 nt, hsa; identical to SEQ ID NO: 158660

SEQ ID NO: 158901 - RNA, 64 nt, hsa; identical to SEQ ID NO: 158661

SEQ ID NO: 158902 - RNA, 64 nt, hsa; identical to SEQ ID NO: 158662

SEQ ID NO: 158903 - RNA, 64 nt, hsa; identical to SEQ ID NO: 158663

SEQ ID NO: 158904 - RNA, 64 nt, hsa; identical to SEQ ID NO: 158664

SEQ ID NO: 158905 - RNA, 64 nt, hsa; identical to SEQ ID NO: 158665

SEQ ID NO: 158906 - RNA, 64 nt, hsa; identical to SEQ ID NO: 158666

SEQ ID NO: 158907 - RNA, 64 nt, hsa; identical to SEQ ID NO: 158667

SEQ ID NO: 158908 - RNA, 64 nt, hsa; identical to SEQ ID NO: 158668

SEQ ID NO: 158909 - RNA, 64 nt, hsa; identical to SEQ ID NO: 158669

SEQ ID NO: 158910 - RNA, 64 nt, hsa; identical to SEQ ID NO: 158670

SEQ ID NO: 158911 - RNA, 64 nt, hsa; identical to SEQ ID NO: 158671

SEQ ID NO: 158912 - RNA, 64 nt, hsa; identical to SEQ ID NO: 158672

SEQ ID NO: 158913 - RNA, 64 nt, hsa; identical to SEQ ID NO: 158673

SEQ ID NO: 158914 - RNA, 64 nt, hsa; identical to SEQ ID NO: 158674

SEQ ID NO: 158915 - RNA, 64 nt, hsa; identical to SEQ ID NO: 158675

SEQ ID NO: 158916 - RNA, 64 nt, hsa; identical to SEQ ID NO: 158676

SEQ ID NO: 158917 - RNA, 64 nt, hsa; identical to SEQ ID NO: 158677

SEQ ID NO: 158918 - RNA, 64 nt, hsa; identical to SEQ ID NO: 158678

SEQ ID NO: 158919 - RNA, 64 nt, hsa; identical to SEQ ID NO: 158679

SEQ ID NO: 158920 - RNA, 64 nt, hsa; identical to SEQ ID NO: 158680

SEQ ID NO: 158921 - RNA, 64 nt, hsa; identical to SEQ ID NO: 158681

SEQ ID NO: 158922 - RNA, 64 nt, hsa; identical to SEQ ID NO: 158682

SEQ ID NO: 158923 - RNA, 64 nt, hsa; identical to SEQ ID NO: 158683

SEQ ID NO: 158924 - RNA, 64 nt, hsa; identical to SEQ ID NO: 158684

SEQ ID NO: 158925 - RNA, 64 nt, hsa; identical to SEQ ID NO: 158685

SEQ ID NO: 158926 - RNA, 64 nt, hsa; identical to SEQ ID NO: 158686

SEQ ID NO: 158927 - RNA, 64 nt, hsa; identical to SEQ ID NO: 158687

SEQ ID NO: 158928 - RNA, 64 nt, hsa; identical to SEQ ID NO: 158688

SEQ ID NO: 158929 - RNA, 64 nt, hsa; identical to SEQ ID NO: 158689

SEQ ID NO: 158930 - RNA, 64 nt, hsa; identical to SEQ ID NO: 158690

SEQ ID NO: 158931 - RNA, 64 nt, hsa; identical to SEQ ID NO: 158691

SEQ ID NO: 158932 - RNA, 64 nt, hsa; identical to SEQ ID NO: 158692

SEQ ID NO: 158933 - RNA, 64 nt, hsa; identical to SEQ ID NO: 158693

SEQ ID NO: 158934 - RNA, 64 nt, hsa; identical to SEQ ID NO: 158694

SEQ ID NO: 158935 - RNA, 64 nt, hsa; identical to SEQ ID NO: 158695

SEQ ID NO: 158936 - RNA, 64 nt, hsa; identical to SEQ ID NO: 158696

SEQ ID NO: 158937 - RNA, 64 nt, hsa; identical to SEQ ID NO: 158697

SEQ ID NO: 158938 - RNA, 64 nt, hsa; identical to SEQ ID NO: 158698

SEQ ID NO: 158939 - RNA, 64 nt, hsa; identical to SEQ ID NO: 158699

SEQ ID NO: 158940 - RNA, 64 nt, hsa; identical to SEQ ID NO: 158700

SEQ ID NO: 158941 - RNA, 64 nt, hsa; identical to SEQ ID NO: 158701

SEQ ID NO: 158942 - RNA, 64 nt, hsa; identical to SEQ ID NO: 158702

SEQ ID NO: 158943 - RNA, 64 nt, hsa; identical to SEQ ID NO: 158703

SEQ ID NO: 158944 - RNA, 64 nt, hsa; identical to SEQ ID NO: 158704

SEQ ID NO: 158945 - RNA, 64 nt, hsa; identical to SEQ ID NO: 158705

SEQ ID NO: 158946 - RNA, 64 nt, hsa; identical to SEQ ID NO: 158706

SEQ ID NO: 158947 - RNA, 64 nt, hsa; identical to SEQ ID NO: 158707

SEQ ID NO: 158948 - RNA, 64 nt, hsa; identical to SEQ ID NO: 158708

SEQ ID NO: 158949 - RNA, 64 nt, hsa; identical to SEQ ID NO: 158709

SEQ ID NO: 158950 - RNA, 64 nt, hsa; identical to SEQ ID NO: 158710

SEQ ID NO: 158951 - RNA, 64 nt, hsa; identical to SEQ ID NO: 158711

SEQ ID NO: 158952 - RNA, 64 nt, hsa; identical to SEQ ID NO: 158712

SEQ ID NO: 158953 - RNA, 64 nt, hsa; identical to SEQ ID NO: 158713

SEQ ID NO: 158954 - RNA, 64 nt, hsa; identical to SEQ ID NO: 158714

SEQ ID NO: 158955 - RNA, 64 nt, hsa; identical to SEQ ID NO: 158715

SEQ ID NO: 158956 - RNA, 64 nt, hsa; identical to SEQ ID NO: 158716

SEQ ID NO: 158957 - RNA, 64 nt, hsa; identical to SEQ ID NO: 158717

SEQ ID NO: 158958 - RNA, 64 nt, hsa; identical to SEQ ID NO: 158718

SEQ ID NO: 158959 - RNA, 64 nt, hsa; identical to SEQ ID NO: 158719

SEQ ID NO: 158960 - RNA, 64 nt, hsa; identical to SEQ ID NO: 158720

SEQ ID NO: 158961 - RNA, 64 nt, hsa; identical to SEQ ID NO: 158721

SEQ ID NO: 158962 - RNA, 64 nt, hsa; identical to SEQ ID NO: 158722

SEQ ID NO: 158963 - RNA, 64 nt, hsa; identical to SEQ ID NO: 158723

SEQ ID NO: 158964 - RNA, 64 nt, hsa; identical to SEQ ID NO: 158724

SEQ ID NO: 158965 - RNA, 64 nt, hsa; identical to SEQ ID NO: 158725

SEQ ID NO: 158966 - RNA, 64 nt, hsa; identical to SEQ ID NO: 158726

SEQ ID NO: 158967 - RNA, 64 nt, hsa; identical to SEQ ID NO: 158727

SEQ ID NO: 158968 - RNA, 64 nt, hsa; identical to SEQ ID NO: 158728

SEQ ID NO: 158969 - RNA, 64 nt, hsa; identical to SEQ ID NO: 158729

SEQ ID NO: 158970 - RNA, 64 nt, hsa; identical to SEQ ID NO: 158730

SEQ ID NO: 158971 - RNA, 64 nt, hsa
accuuuccaagugcuaggcaggagaacugaagaacucuuucagugaagugagucagccuagaag

SEQ ID NO: 158972 - RNA, 64 nt, hsa
acuuugggccuguucuguugcuccugccuuauuucucuuucaacccuguacaugacucguguuc

SEQ ID NO: 158973 - RNA, 64 nt, hsa
ggcugcuggagauccaaugccugcugccuccagacucuuucaugagcgccaaucucugccaggg

SEQ ID NO: 158974 - RNA, 64 nt, hsa
guaccugacuuggccaggaaugaucucuguuccucucuuucacuaaguuaguucuucuucaccc

SEQ ID NO: 158975 - RNA, 64 nt, hsa
gugaugccacugaaaugagaugggaaugauccagcucuuucagcaucuugguugaacuugcuuu

SEQ ID NO: 158976 - RNA, 64 nt, hsa
cagacuccucaaggagagauaaagaggaaagcaccucuuucauuuuuuagugugagcuaauucc

SEQ ID NO: 158977 - RNA, 64 nt, hsa
aguccucgagauucuuaugaguuuuguuugaaaacucuuucacuauauuuguuguaaagagguu

SEQ ID NO: 158978 - RNA, 64 nt, hsa
ggccuggacuucccuggggugcuccaggccagagcucuuucauuggggcgaguguggugagggg

SEQ ID NO: 158979 - RNA, 64 nt, hsa
uaagcccacuguuaauauucuauuaacuuuaauucucuuucaaagcuaaauuccacacuaccac

SEQ ID NO: 158980 - RNA, 64 nt, hsa
aaugcucuggggucuuuuuaugcauuugcauuugcucuuucaucucugcuuggauuauuuuaaa

SEQ ID NO: 158981 - RNA, 64 nt, hsa
gccugugccauaaaguuccgaaucccccaugugucucuuucagagcuggccagaccggaaauaa

SEQ ID NO: 158982 - RNA, 64 nt, hsa
guaaaaaggaaauagugauguaaauaaacauguucucuuucaaguaugcuugucugucucuauc

SEQ ID NO: 158983 - RNA, 64 nt, hsa
gugcuccugcuacacugacagacugauugcguggcucuuucagaagacccaggaagggcagcuc

SEQ ID NO: 158984 - RNA, 64 nt, hsa
gguuuaaaucaaagugauucugggggaagcuaugcucuuucaguggauaauaaaauugguaacu

SEQ ID NO: 158985 - RNA, 64 nt, hsa
cuuaguucaucauuguuuucccucacagacauuucucuuucaugccugcuugacugauaagcca

SEQ ID NO: 158986 - RNA, 64 nt, hsa
cugcaacuaaugggagcaagauaguacacuuuaacucuuucagacaacuugcauucuguggaug

SEQ ID NO: 158987 - RNA, 64 nt, hsa
ugagaaugauaauaaucauuauaugcagaccuuccucuuucaucuuacagaggcuuagugaggc

SEQ ID NO: 158988 - RNA, 64 nt, hsa
uaucuauugacucuuucucucucucuuucugucucucuuucaccuugcaccucucccuaaugcu

SEQ ID NO: 158989 - RNA, 64 nt, hsa
uugcaguauggauaucuuucacccucccaggaaacucuuucaaaccuaaucuguacuuuugcau

SEQ ID NO: 158990 - RNA, 64 nt, hsa
uggguuuccacauuuuuauuccguagauguuaaucucuuucaugugcaaucuuugcuucuugua

SEQ ID NO: 158991 - RNA, 64 nt, hsa
cauaaguucuaaauuagagacacauauaguuucucucuuucagcaccagcucuugccccuaugc

SEQ ID NO: 158992 - RNA, 64 nt, hsa
uggaugugaagauaugguaccuucucaaguguagcucuuucaaauauagucaaugcugggaaau

SEQ ID NO: 158993 - RNA, 64 nt, hsa
gaacauaagauguauuucugacuaaaacaaauggcucuuucacaugugcuuuauuagacucugg

SEQ ID NO: 158994 - RNA, 64 nt, hsa
ccuucuucagaagcucacugcuuuggcccccuuacucuuucauugacugcagugugaauauugg

SEQ ID NO: 158995 - RNA, 64 nt, hsa
uuauauuacauuguagaucauucuuuuuuccccccucuuucacuucuaaauauuuugcuuucua

SEQ ID NO: 158996 - RNA, 64 nt, hsa
gauuauuuuagguuuucguaaauaauuuuuuugccucuuucaaaagguuaacaauuaagcauac

SEQ ID NO: 158997 - RNA, 64 nt, hsa
aauguuaacaacuaucacauuuuacucaucaagucucuuucauuucggcaguuuaaagacacaa

SEQ ID NO: 158998 - RNA, 64 nt, hsa
ugacccaggcccaaagggggcugccuguucccaacucuuucacucuguaacccauuuuaaaaug

SEQ ID NO: 158999 - RNA, 64 nt, hsa
gguagacacugauuuuuccccccuaauaucugcucucuuucaaaaggaauaauucaaaagacuu

SEQ ID NO: 159000 - RNA, 64 nt, hsa
ucaaucucucucugucuccucccaaccucucucucucuuucauccccuucucucccuaucucuc

SEQ ID NO: 159001 - RNA, 64 nt, hsa
acucgcccucgcuccaucuaccugcccccgcugccucuuucaggaaggagccccuuaggaggac

SEQ ID NO: 159002 - RNA, 64 nt, hsa
uggcaacaacuuauaccgucugacaguucaaaaucucuuucagcugcgcucuucccaccgagcc

SEQ ID NO: 159003 - RNA, 64 nt, hsa
gauagggccucccuuccccucuucuuucuuuguucucuuucauuaaaccccuuccccaguuuuu

SEQ ID NO: 159004 - RNA, 64 nt, hsa
aaucucugugguauauaccuggggccauucuaggcucuuucaagugacuuuuggaaaucaaccu

SEQ ID NO: 159005 - RNA, 64 nt, hsa
uuacuguaaaucuuuaaaauaacagaauucagugcucuuucauuuguuaaugcuguccagauuu

SEQ ID NO: 159006 - RNA, 64 nt, hsa
uuaagaaguuuaauuuuuuguaauuuuuaauaugcucuuucaguguaucucagcggguacucca

SEQ ID NO: 159007 - RNA, 64 nt, hsa
ccccccccgccacccucucggacaguuauucauucucuuucaaucucucucucuccaucucucu

SEQ ID NO: 159008 - RNA, 64 nt, hsa
uucauucucuuucaaucucucucucuccaucucucucuuucagucucucucucucaaccucuuu

SEQ ID NO: 159009 - RNA, 64 nt, hsa
ccacgaagaaugcuguucugauuuacuagagaauguucccaauuugaauuuagggugauuuuaa

SEQ ID NO: 159010 - RNA, 64 nt, hsa
guguuuauuuuuaacucuuggaagagguuuugugguucccaaugugucugucccacccugaucc

SEQ ID NO: 159011 - RNA, 64 nt, hsa
gaggaggggcacggggccuccgagcuccagcuccguucccaaggauacucgugaagaccccauc

SEQ ID NO: 159012 - RNA, 64 nt, hsa
ugguuuguuaaaagaaaacacugucaugcugucaguucccaauugacaagucacagacugggag

SEQ ID NO: 159013 - RNA, 64 nt, hsa
uuguuuuuggaaaaacaaaauuucuacaauuacaguucccaaagucaguuauucauguuuucau

SEQ ID NO: 159014 - RNA, 64 nt, hsa
uuguucuuggauaaagaaaauuucuacaauuacaguucccaaagacacaguuguucauguuauu

SEQ ID NO: 159015 - RNA, 64 nt, hsa
cuccaacaugcugaaaaagaguaucuaugcauaaguaucagagaagucccucaagcaaucagua

SEQ ID NO: 159016 - RNA, 64 nt, hsa
uaauuauuuuaaauaugcauuuacacacauuuagguaucagaagaugcuuagggaacaauggau

SEQ ID NO: 159017 - RNA, 64 nt, hsa
agucuaaucuuggugccuucuguuaaaagucaguguaucagaaaagaaagcagccauguaagag

SEQ ID NO: 159018 - RNA, 64 nt, hsa
aaaugccauacuuuguuauauauguuagugguauguaucagacauauuuucaggauggugcguc

SEQ ID NO: 159019 - RNA, 64 nt, hsa
cuuauaacacuauuuccaguaaagguggaauugaguaucagagggauuacugcgguguuaaggu

SEQ ID NO: 159020 - RNA, 64 nt, hsa
gcaagccaagugguucugcaaggucaaggcacuaguaucagauggcaagcucagugcccgggau

SEQ ID NO: 159021 - RNA, 64 nt, hsa
gucguaaguggaguccuggaauuuggacaagugcuguugggauauagucaacuuauucuuugag

SEQ ID NO: 159022 - RNA, 64 nt, hsa
uuuuuauuaaagcauuuccuaccagcaaagcaaauguugggaaaguauuuacuuuuucgguuuc

SEQ ID NO: 159023 - RNA, 64 nt, hsa
cccaccuguaucucuuguugggagaaaagcugaguguugggagaagcugaggccgagcuugcau

SEQ ID NO: 159024 - RNA, 64 nt, hsa
cuugucuaccugucuccuacccaccuguaucucuuguugggagaaaagcugaguguugggagaa

SEQ ID NO: 159025 - RNA, 64 nt, hsa
guggcuucucuuuggcucccaaagagaaggacaguguugggaguaucugccguggcuucucuuu

SEQ ID NO: 159026 - RNA, 64 nt, hsa
guggcuucucuuuggcucccaaagagaaggacaguguugggaguaucugccggcgcuguccagg

SEQ ID NO: 159027 - RNA, 64 nt, hsa
uccccagcacagccuccugucgcugcaugcgacguguugggauuuuuggaugaaagacucuccc

SEQ ID NO: 159028 - RNA, 64 nt, hsa
gaccucgugaucugcccgccuuggccuaucaaaguguugggauuacaggcuugagccaccgcac

SEQ ID NO: 159029 - RNA, 64 nt, hsa
uaaaauaacaccugcuuguucuucaucccugggcuguugggaggaacagaugagacaguggcua

SEQ ID NO: 159030 - RNA, 64 nt, hsa
gaccucgugauccgcccgccucagccuuccaaaguguugggauuauaggcgugagccaccgcgc

SEQ ID NO: 159031 - RNA, 64 nt, hsa
acucaagggauccuccugucuugggcucccaaaguguugggauuacaggcgugagugaccaugc

SEQ ID NO: 159032 - RNA, 64 nt, hsa
agaauagucucuggguuuacaacaaacacugugauguugggaagcuauuuccuuugcgcaaacu

SEQ ID NO: 159033 - RNA, 64 nt, hsa
cagaggaggagaaaagugacagauccuccauuuuuguugggaugcgggcauuuugaaugugauc

SEQ ID NO: 159034 - RNA, 64 nt, hsa
ccugcccauccgaguucugagauugggacugugauguugggaccugaggacuggaugguagaau

SEQ ID NO: 159035 - RNA, 64 nt, hsa
gagccccuuggugguucuguccuccaaaugcugcuguugggagcgggcuuccagcucucagugg

SEQ ID NO: 159036 - RNA, 64 nt, hsa
augggggaaggcagagacuucagacuucucaguguguugggaaaaccaaaaaccacaacuacag

SEQ ID NO: 159037 - RNA, 64 nt, hsa
cucagucucacugguugugauuuggucacuuuaguguugggacaggggaaagggucugugcgug

SEQ ID NO: 159038 - RNA, 64 nt, hsa
agguuuuaugggaggcugugcauugcucaaaagcuguugggaacgccuucugaacaguugccuu

SEQ ID NO: 159039 - RNA, 64 nt, hsa
ucccccaccugucagcuagccaccugcuuguuuguguugggauauuuuuuagcaccugaagcac

SEQ ID NO: 159040 - RNA, 64 nt, hsa
ggcucugacaucucuuagaugucccaacuucagcuguugggagauggugauauuuucaacccua

SEQ ID NO: 159041 - RNA, 64 nt, hsa
uuggauagcaguugaagagguugugugggugggcuguugggagugaggauggaguguucagugc

SEQ ID NO: 159042 - RNA, 64 nt, hsa
uucaagauguuuaauguguuuaaagcugggaaccuguugggaguucacaagugcugcauauacu

SEQ ID NO: 159043 - RNA, 64 nt, hsa
cuggggggaaaaaguugaaacuacuggugaccacuguugggagaggaaacaucuguuuuauaga

SEQ ID NO: 159044 - RNA, 64 nt, hsa
ccuuaggugauccgcccgccucagccucccaaaguguugggauuacaggcaugagccacugcgc

SEQ ID NO: 159045 - RNA, 64 nt, hsa
ccucaggugauccaccugccucagccucccagacuguugggauuacaggcaugagccaccacgc

SEQ ID NO: 159046 - RNA, 64 nt, hsa
ggaaauaacccugugaugauguguuaauauaaaauguugggagggaauauucccaauaaagguc

SEQ ID NO: 159047 - RNA, 64 nt, hsa
uaaaaugaagucucuuauuucaauuaccuaguguuguugggaacuaauugaacagcuacaguaa

SEQ ID NO: 159048 - RNA, 64 nt, hsa
cacauacuguuaagauguagacuuggaacaaagcuguugggacccagagcaaugaauuuuugaa

SEQ ID NO: 159049 - RNA, 64 nt, hsa
uuggaauagcagagcaaaauauggauaaugaaaguguugggaaaaaagugaugugacagggagu

SEQ ID NO: 159050 - RNA, 64 nt, hsa; identical to SEQ ID NO: 101929

SEQ ID NO: 159051 - RNA, 64 nt, hsa; identical to SEQ ID NO: 101930

SEQ ID NO: 159052 - RNA, 64 nt, hsa; identical to SEQ ID NO: 101931

SEQ ID NO: 159053 - RNA, 64 nt, hsa; identical to SEQ ID NO: 101932

SEQ ID NO: 159054 - RNA, 64 nt, hsa; identical to SEQ ID NO: 101933

SEQ ID NO: 159055 - RNA, 64 nt, hsa; identical to SEQ ID NO: 101934

SEQ ID NO: 159056 - RNA, 64 nt, hsa; identical to SEQ ID NO: 101935

SEQ ID NO: 159057 - RNA, 64 nt, hsa; identical to SEQ ID NO: 101936

SEQ ID NO: 159058 - RNA, 64 nt, hsa; identical to SEQ ID NO: 101937

SEQ ID NO: 159059 - RNA, 64 nt, hsa; identical to SEQ ID NO: 101938

SEQ ID NO: 159060 - RNA, 64 nt, hsa; identical to SEQ ID NO: 101939

SEQ ID NO: 159061 - RNA, 64 nt, hsa; identical to SEQ ID NO: 101940

SEQ ID NO: 159062 - RNA, 64 nt, hsa; identical to SEQ ID NO: 101941

SEQ ID NO: 159063 - RNA, 64 nt, hsa; identical to SEQ ID NO: 101942

SEQ ID NO: 159064 - RNA, 64 nt, hsa; identical to SEQ ID NO: 101943

SEQ ID NO: 159065 - RNA, 64 nt, hsa; identical to SEQ ID NO: 101944

SEQ ID NO: 159066 - RNA, 64 nt, hsa; identical to SEQ ID NO: 101945

SEQ ID NO: 159067 - RNA, 64 nt, hsa; identical to SEQ ID NO: 101946

SEQ ID NO: 159068 - RNA, 64 nt, hsa; identical to SEQ ID NO: 101947

SEQ ID NO: 159069 - RNA, 64 nt, hsa
gagccguaggaagacaaaacuucccuuuuguuuuacuccucacuccucuauuuuuguuuuacuc

SEQ ID NO: 159070 - RNA, 64 nt, hsa
uuuuuguuuuacucacuucuuuauauuuuguuuuacuccucacuccuguauauuuugguuuacu

SEQ ID NO: 159071 - RNA, 64 nt, hsa
ugcacgcggcaguucuuuguuaaagaucugagggacuccucaguccuggggcgucgccgccugc

SEQ ID NO: 159072 - RNA, 64 nt, hsa
cugcauucuggcugcccagcuucggacagcgggaacuccucaggcagccacgcagcgggugugg

SEQ ID NO: 159073 - RNA, 64 nt, hsa
cgccgcugccccggagacuuuucaaucccaccccacuccucaucucaccauuuggucaaauugg

SEQ ID NO: 159074 - RNA, 56 nt, hsa
gaggcugcuacgugaugugaacccacacuccucauccacacaccuuucuuuaccca

SEQ ID NO: 159075 - RNA, 64 nt, hsa
cagaccccuuccagggguuuacagucuauuugagacuccucaguucuugccacuuuuuuuuuua

SEQ ID NO: 159076 - RNA, 64 nt, hsa
uuuaaucuccaccagucauuuuucagaccuuuuaacuccucaauuccaacacugauuuccccuu

SEQ ID NO: 159077 - RNA, 64 nt, hsa
ugcaauguuuaauuguuaaaaauaguagccacgacuuuaucaggcagccccaaacuggugcaua

SEQ ID NO: 159078 - RNA, 64 nt, hsa
agaauuauuuuucucuguagaaacacagauaccacuuuaucagggaaguuagucaaaugaaaug

SEQ ID NO: 159079 - RNA, 64 nt, hsa
uauagccccaucuugauagaagaguuacuccgagcuuuaucauggaccagaggaaaaccagaaa

SEQ ID NO: 159080 - RNA, 64 nt, hsa
guguuugcucuucagauuccuaaguagcacaagacuuuaucagaaucuauaggcauaccaaccu

SEQ ID NO: 159081 - RNA, 64 nt, hsa
uuuauuuguucuuucaucugugacugcuugcugacuuuaucauaauuuucuucaaacaaaaaaa

SEQ ID NO: 159082 - RNA, 64 nt, hsa
cugguuguuauucuuagguuauucccacacuugacuuuaucauuguuuacuacuaguaaaaagc

SEQ ID NO: 159083 - RNA, 64 nt, hsa
guucuucgggaccuaaauuuugcuuaaggaaggccuuuaucaugcugaaagcacucagacaugu

SEQ ID NO: 159084 - RNA, 64 nt, hsa
gcacugagcuugucuucaggaaaccagagcguugcuuuaucaucgcacuuuucaucuugguaau

SEQ ID NO: 159085 - RNA, 64 nt, hsa
cugagccagccagcauuaguaauuuuuaaaaacacuuuaucaguauuuuaaaaauguuaaugca

SEQ ID NO: 159086 - RNA, 64 nt, hsa
uaguuuguuuguuuguuuuugagacugagucucacuuuaucacccagacuggcgugcaguggca

SEQ ID NO: 159087 - RNA, 64 nt, hsa
ucacauuauucugggcaccacaaaauauacaaaacuuuaucagggaaacuaagauucuuuuaaa

SEQ ID NO: 159088 - RNA, 64 nt, hsa
uauauaugcacuuaauuuguuggggcuuuacauacuuuaucaaugugucuuucuaagaaaucaa

SEQ ID NO: 159089 - RNA, 64 nt, hsa
cucauucaauauagauaugagccaugguggagaacuuuaucacucaaguagacgguaaacaucc

SEQ ID NO: 159090 - RNA, 64 nt, hsa
gcuugacauagguuauuguuugaaaauauuguuacuuuaucaauaguaaucaugcauucuugug

SEQ ID NO: 159091 - RNA, 64 nt, hsa
uuaccugggauccaguaucaaauauauccacauucuuuaucagcaagcauucauggccauucag

SEQ ID NO: 159092 - RNA, 64 nt, hsa
augacuuuucaauagcucaaaucaauuucagugccuuuaucacuugaauuauuaacuuaauuug

SEQ ID NO: 159093 - RNA, 64 nt, hsa
cugcugauuugcugcccugucuucucuuacuuuacuuuaucaauaccuggcaaacugaccagaa

SEQ ID NO: 159094 - RNA, 64 nt, hsa
gacuuugaaugaauagacugcugugcugaaagagcuuuaucacacugucucaaaguauguaaag

SEQ ID NO: 159095 - RNA, 64 nt, hsa
uguaaccuauuaucauggaucuaauguacuguaacuuuaucagugaaagguaaaaucucaaaua

SEQ ID NO: 159096 - RNA, 64 nt, hsa
gcuuagcacguuuaccauacguuuaaaauccauucuuuaucaaucaguccuuuuauagcuuucu

SEQ ID NO: 159097 - RNA, 64 nt, hsa
uuugcagugucaugugagggcgucaguauagaggccuuugcaucugggccuggcacccgcucuc

SEQ ID NO: 159098 - RNA, 64 nt, hsa
uccuaagccaagacauuugaccuuugacauuugaccuuugcagugucaugugagggcgucagua

SEQ ID NO: 159099 - RNA, 64 nt, hsa
agcucaugggccugcaaagguucagacgguuucuccuuugcacccaggaggaacuuuggcugcg

SEQ ID NO: 159100 - RNA, 64 nt, hsa
uggagaaaaauaauuacacuuucaaagagaauucccuuugcaauuuuauguuuggaucaccacu

SEQ ID NO: 159101 - RNA, 64 nt, hsa
cagcuagccaccaggccugaggggggcccacugcccuuugcagcuguuuguucccaaagguugg

SEQ ID NO: 159102 - RNA, 64 nt, hsa
ucuacagagagccaugccccugaaacaucacaugccuuugcacaggccaccccccucuucaggc

SEQ ID NO: 159103 - RNA, 64 nt, hsa
cccugauugaggguggguggguggacccaggcucccuuugcacacagagcagcuacuucuaagc

SEQ ID NO: 159104 - RNA, 64 nt, hsa
uggggcagugaacagaauaacaacagcaacaaugccuuugcaggcagccugcuccccugagcgc

SEQ ID NO: 159105 - RNA, 64 nt, hsa
uaaucaaagcacauuuguuuggucuuccuccaacccuuugcauuugauuucuaaacauuccuuc

SEQ ID NO: 159106 - RNA, 64 nt, hsa
auguggaauuguacauuuaaagcuuggucggugaccuuugcauaccaucaacgagcacagcuaa

SEQ ID NO: 159107 - RNA, 64 nt, hsa
auuguucagccauaaagaaagaacaagaucaugcccuuugcagggacauggauggagcuggagg

SEQ ID NO: 159108 - RNA, 64 nt, hsa
cucaugucuccuuccacaguuuacuuccucgcucccuuugcaucuaaaccuuucuucuuuccca

SEQ ID NO: 159109 - RNA, 64 nt, hsa
uuuuugacuuuguccauuaacauuuauccauaugccuuugcaauaacuagauugugaaaagcua

SEQ ID NO: 159110 - RNA, 64 nt, hsa
cuuuccaugaaacgaaguugagaaaaugauuuucccuuugcagguugcacacaguuuuguuuau

SEQ ID NO: 159111 - RNA, 64 nt, hsa
gugcuucaccaccugcauccucuugcucagaaugccuuugcaguugaguuuucuggguuucuau

SEQ ID NO: 159112 - RNA, 64 nt, hsa
uuggacuggguaauucuuuguucugcagagcuguccuuugcacuguaggagauuuacuaauauc

SEQ ID NO: 159113 - RNA, 64 nt, hsa
caaacaaacguuuuuccaaagaauucacagugcuccuuugcaauuuauagauuucauguugaaa

SEQ ID NO: 159114 - RNA, 64 nt, hsa
auggacuaaauuuugucaauuucauguaauuuacccuuugcaauaaaaaugauucauuaaauau

SEQ ID NO: 159115 - RNA, 64 nt, hsa
uugcucccagcuugcuucccccuccucggaugucccuuugcaggccccugucguuccuccggca

SEQ ID NO: 159116 - RNA, 64 nt, hsa
uuuugggcuccagaggacuuaccuacaaaauacuccuuugcaaugauaauugugggucaggaau

SEQ ID NO: 159117 - RNA, 64 nt, hsa
ggauagguuccagugauagaguuauaauuuugcuccuuugcaaacaaaugguaucuaauuaaua

SEQ ID NO: 159118 - RNA, 64 nt, hsa
guguaaucauucugaggugaggcuuuucuuauuuccuuugcauuuugcuagagcugugcugagu

SEQ ID NO: 159119 - RNA, 64 nt, hsa
uccaaaaugaugauauucucuugaguauuacuucccuuugcaauguuuuuauuguuaauguagc

SEQ ID NO: 159120 - RNA, 64 nt, hsa
augguccacaagccuaacuuauucacucucuggcccuuugcagaaaaagugugcugccuuaguc

SEQ ID NO: 159121 - RNA, 64 nt, hsa
uuauagcuuagauauaaaaggucuccaacaaagaccuuugcaauauauuuuaauuacaaacacu

SEQ ID NO: 159122 - RNA, 64 nt, hsa
cccauuaccugcaaagaaagggcacucaggcagcccuuugcaaucgcgauggcagccacuagau

SEQ ID NO: 159123 - RNA, 64 nt, hsa
cccacaacguccccucaagccccuucucucaaucccuuugcaacgcucacugguuuuggccacc

SEQ ID NO: 159124 - RNA, 64 nt, hsa
cccgaccccauccaccuauccaccaccccacccaccuuugcagggaauaccucguuagagaaug

SEQ ID NO: 159125 - RNA, 64 nt, hsa
ucuguuugccuucugcauucugcacucugcggggccuuugcagccagacugcugugucaauguu

SEQ ID NO: 159126 - RNA, 64 nt, hsa
ugagcucuauccaccaagccagcaccccaccaucccuuugcaggggagucaaagggccagaacu

SEQ ID NO: 159127 - RNA, 64 nt, hsa
aaguccccucuguaguugguuuccuuccugugucccuuugcaagcuuccaggcgaucuaaggug

SEQ ID NO: 159128 - RNA, 64 nt, hsa
gaugugugacuguuuggcacuugagacaaaccugccuuugcagggaaagugucucucacgggca

SEQ ID NO: 159129 - RNA, 64 nt, hsa
uccacacgguuagccgugcaugcacuuuguggccccuuugcaaggggcagaggguacuggaagu

SEQ ID NO: 159130 - RNA, 64 nt, hsa
ggccaggaccaaccuucaauuccauuccaaucagccuuugcauuuguuggaucucguggcuucu

SEQ ID NO: 159131 - RNA, 64 nt, hsa
ucugccauuuucuacagcuugcugaguugucauuccuuugcaacauuaaaauacaugcugaacu

SEQ ID NO: 159132 - RNA, 63 nt, hsa
acauauuucaugaauggcauugaugcuaauaaauccuuugcacaaaaauuugaauaaacuucc

SEQ ID NO: 159133 - RNA, 64 nt, hsa
ccugggcugaggccugcagugacccacccaccuaccuuugcaucaccuaccuuugcaccaacua

SEQ ID NO: 159134 - RNA, 64 nt, hsa
gcagugacccacccaccuaccuuugcaucaccuaccuuugcaccaacuaccuuuucagauuucc

SEQ ID NO: 159135 - RNA, 64 nt, hsa
agucaucugucuuaccccccugggacagcuguuaccuuugcaguguugccgaaucacagcaguu

SEQ ID NO: 159136 - RNA, 64 nt, hsa
uuaccuuugcaguguugccgaaucacagcaguuaccuuugcaguguugccgaaucacagcaguu

SEQ ID NO: 159137 - RNA, 64 nt, hsa
gcaaaggacuuaaaauuaccaaaugcuucuaaauaugaaggagagguuggggacacgcacccua

SEQ ID NO: 159138 - RNA, 64 nt, hsa
caacuugagaagacauuuauaauacaaauaacugaugaaggauucauaaucacaaauauagaga

SEQ ID NO: 159139 - RNA, 64 nt, hsa
aaauuucuaacaaucaucaguuaggaauauuaacaugaaggauaaaccaacuuauuuguauacc

SEQ ID NO: 159140 - RNA, 64 nt, hsa
auuuuauuggucaugagaacaaauggaugugaucaugaaggaaucagauucccuauguaaagca

SEQ ID NO: 159141 - RNA, 64 nt, hsa
ccugcuggggugugagggcagagggaggguugccaugaaggaacuugggauuuucaauggaaua

SEQ ID NO: 159142 - RNA, 64 nt, hsa
ucauuuuucaaggagaagagccugcaaauggccaaugaaggagguaaauaaacuaagauauucc

SEQ ID NO: 159143 - RNA, 64 nt, hsa
aauaguucuggccagaccccguuccccuuccucuaugaaggaauaaguuggaccaagggaaguc

SEQ ID NO: 159144 - RNA, 64 nt, hsa
ugcaugacaacucguguguaugagaaggagggauaugaaggaagauggcuugcagaguaagucg

SEQ ID NO: 159145 - RNA, 64 nt, hsa
guaauuagauuauguauagggguaacuggaagccaugaaggaaggacuuaaccaggcuaccaag

SEQ ID NO: 159146 - RNA, 64 nt, hsa
aaaaaguugacucuacccccuaauuugguaggagaugaaggagaaaaggauggcauugaauuau

SEQ ID NO: 159147 - RNA, 64 nt, hsa
gaccccgauuggugagggcucugcauaugccuguaugaaggagauacaggugugugugcacaug

SEQ ID NO: 159148 - RNA, 64 nt, hsa
ccaguguguucaccucaucaaggcagcagaguggaugaaggaguaagucugcccuuugccauac

SEQ ID NO: 159149 - RNA, 64 nt, hsa
ugugcucugaaaugccacuugguagcucuggacaaugaaggacaauugacucaagggugccugg

SEQ ID NO: 159150 - RNA, 64 nt, hsa
uacagccucaguagucugcccaguguccacauuaaugaaggauccauguuuguagugagagaaa

SEQ ID NO: 159151 - RNA, 64 nt, hsa
auagaaaguuugcugaaagcaaagggcuaagcuuaugaaggaaugccuccuuuguuacacacuc

SEQ ID NO: 159152 - RNA, 64 nt, hsa
ggccauugucauccauuucccaguuagggcaacaaugaaggaggacccagccaagcuagaagga

SEQ ID NO: 159153 - RNA, 64 nt, hsa
aaagcccugggccacugccauuggguuagucaagaugaaggaggaggacuggcugccuccauuu

SEQ ID NO: 159154 - RNA, 64 nt, hsa
uuucuacaguugauauauuuguaacugguacaagaugaaggacagcagcuuuccaucccuaguu

SEQ ID NO: 159155 - RNA, 64 nt, hsa
guucaggggcaguggggggcuccaggcacggucaaugaaggaaacagugccuguccacccaccc

SEQ ID NO: 159156 - RNA, 64 nt, hsa
uagguuggaggacaccgacuaauuugggaaacggaugaaggacugagaaggcccccgcucccuc

SEQ ID NO: 159157 - RNA, 64 nt, hsa
cagcuggagaaaagaagacaagaaagucuugggcaugaaggagcuuuuugcaucuagugggugg

SEQ ID NO: 159158 - RNA, 64 nt, hsa
ugguugggaaaugucccucaaaauccugggcacuaugaaggaacccccugcccccucaccuuuu

SEQ ID NO: 159159 - RNA, 64 nt, hsa
aaauuauuucccccaagguagugaaguaauuggaaugaaggaggcugaaaguauugucuaaagu

SEQ ID NO: 159160 - RNA, 64 nt, hsa
uuauaauuauggacacugcaucaguauacauaacaugaaggaauaaaaaggauacagaauugua

SEQ ID NO: 159161 - RNA, 64 nt, hsa
uauuuagcccuuacucaaaaucagauaauuaacaaugaaggaaacucuaaacuccccuuauggu

SEQ ID NO: 159162 - RNA, 64 nt, hsa
auuuacuagaaaauaucaucuuagaagaaaccccaugaaggaaaagaauagggaaaagcuuuca

SEQ ID NO: 159163 - RNA, 64 nt, hsa
uuccagccacuuuaagccagugcugaguagggcuucugcagagccauguuugagccaaggucuu

SEQ ID NO: 159164 - RNA, 64 nt, hsa
aguucugccuggagggggacuggacccagugcccucugcagaccccucccagccgcagcaccaa

SEQ ID NO: 159165 - RNA, 64 nt, hsa
uuugaaagcaguuuuuauaaaaagaaagcccgggucugcagagaaugaaaacugguuggaaacu

SEQ ID NO: 159166 - RNA, 64 nt, hsa
aagcaucagcaauguuucucuuuucuuaguucauucugcagaauggaaacccaugccuauuaga

SEQ ID NO: 159167 - RNA, 64 nt, hsa
augaaugucgugcacuggcaaugcuauuuuagagucugcagagaagagaaagcauguugcuuaa

SEQ ID NO: 159168 - RNA, 64 nt, hsa
ugguauaauauauauacuucuccauacacagaccucugcagaaugcaaaauaaaacuugcagug

SEQ ID NO: 159169 - RNA, 64 nt, hsa
ucugcaggugcccagcaggagggcauagguggccucugcagaggggaccucagccugucacugg

SEQ ID NO: 159170 - RNA, 64 nt, hsa
uggcccugaauccuccucugcuccagggcuggccucugcagagcugauuaaacaguguugugac

SEQ ID NO: 159171 - RNA, 64 nt, hsa
uauauguacaaaggcaaacagacacauaacagucucugcagacugauuguauauaguaagaaaa

SEQ ID NO: 159172 - RNA, 64 nt, hsa
uucuguuuucauuaacaguacuaaguggaagggaucugcagauuccaaacuggaauaagcucua

SEQ ID NO: 159173 - RNA, 64 nt, hsa
uuggccagaauuacaucaugauucccaaugagauucugcagacucuacuugaccuuuucuuccc

SEQ ID NO: 159174 - RNA, 64 nt, hsa
gaacugcuuuuagugucucaccagugguuuuacaucugcagaguuuugagggcugugcugaccu

SEQ ID NO: 159175 - RNA, 64 nt, hsa
agccuccugcccucucugggucucaguugccccaucugcagagcgaggaggcccgggcugguug

SEQ ID NO: 159176 - RNA, 64 nt, hsa
gaugcucugaugcagagggcacgcccauagucccucugcagagccucgcacuggggccagggca

SEQ ID NO: 159177 - RNA, 64 nt, hsa
ugccuuuuagagauagguucuugauauucagacaucugcagaaauguucugguucccaaaguca

SEQ ID NO: 159178 - RNA, 64 nt, hsa
aaagggauaucuuuuuuauauuuuuuuccaugaaucugcagaaaauuacugagcuguuguuacc

SEQ ID NO: 159179 - RNA, 64 nt, hsa
cgggaaaggugaaccugaacaacccaagucucucucugcagagcccuguuucuaauugugguag

SEQ ID NO: 159180 - RNA, 64 nt, hsa
caccauugacauuuuggacuggguaauucuuuguucugcagagcuguccuuugcacuguaggag

SEQ ID NO: 159181 - RNA, 64 nt, hsa
augcuacucugcuguucacaauugccucauguaaucugcagauuccugccuccccacuuugguu

SEQ ID NO: 159182 - RNA, 64 nt, hsa
ucugcugagaaccuuccagugguuccccucaccuucugcagaagucuccaauauggaguacaug

SEQ ID NO: 159183 - RNA, 64 nt, hsa
ugaaguccaugcugucuguuaaauaaaaugccauucugcagaauuaaccaucccaccagagcaa

SEQ ID NO: 159184 - RNA, 64 nt, hsa
uagagauacuaacagagggcuagagaaagcaucuucugcagaggaagcacuuaugggaacaguc

SEQ ID NO: 159185 - RNA, 64 nt, hsa
uuauucccucucaacaaaacuuuauaggcagucuucugcagacuuaacguguuuucugucauag

SEQ ID NO: 159186 - RNA, 64 nt, hsa
uacuaguccaucauagccuagaaaaugaucccuaucugcagaucaagauuuucucauuagaaca

SEQ ID NO: 159187 - RNA, 64 nt, hsa
aucaggacccaacccagccacugaagagagagucucugcagagacagggcuaccugggugguug

SEQ ID NO: 159188 - RNA, 64 nt, hsa
guccugguugugauugcuggacccagaggcaagaucugcagagaugccugugagauauuugcuu

SEQ ID NO: 159189 - RNA, 64 nt, hsa
ggaugacucagcaccgccccucaacaggcaugacucugcagagaugacucagcacugucccuua

SEQ ID NO: 159190 - RNA, 64 nt, hsa
ggaugacucagcaccgccccucaacaggcaugacucugcagagaugacuuaguacugccccuca

SEQ ID NO: 159191 - RNA, 64 nt, hsa
ggaugacucagcaccgccccucaacaggcaugacucugcagagaugacucagcacugccccuca

SEQ ID NO: 159192 - RNA, 64 nt, hsa
gacgucaggcucugggugucaaccucugacuuauucugcagaugcucugugugugugugugugu

SEQ ID NO: 159193 - RNA, 64 nt, hsa
cagcacgcugccaggcggugguguucagaacccuucugcagacaggaauuugcuggaccuccuc

SEQ ID NO: 159194 - RNA, 64 nt, hsa
caccagaggacacacacaggggagaagccuuaugucugcagagagugugagcggggcuuuagcc

SEQ ID NO: 159195 - RNA, 64 nt, hsa
caccaaaggacacacacaggggggaagcccuacgucugcagagagugugggagggcuuuagccg

SEQ ID NO: 159196 - RNA, 64 nt, hsa
cuguggguuuuggugugguuugucagaggcuaauucugcagaguuuccaaaaccagaagacauc

SEQ ID NO: 159197 - RNA, 64 nt, hsa
ugggggccgugccacccgugggaaugcugcccgcucugcagacugcugcuagagccagcaacuc

SEQ ID NO: 159198 - RNA, 64 nt, hsa
uuguccaugugcaaagaugugggcaagaauggccucugcagauuuuccugaacuucugcuaacu

SEQ ID NO: 159199 - RNA, 64 nt, hsa
uuuuuuaaagaucuauuucuguuauaauuuagguucugcagaaauaugauucuuaauugaaaca

SEQ ID NO: 159200 - RNA, 64 nt, hsa
agcuuucuggaccuguggucuuagucccagcgauucugcagagcggccaucggcagcaugucaa

SEQ ID NO: 159201 - RNA, 64 nt, hsa
cguguaccugaggcccaggcagcgggaaugccuuucugcagagccggacaccugugcacucgcu

SEQ ID NO: 159202 - RNA, 64 nt, hsa; identical to SEQ ID NO: 123549

SEQ ID NO: 159203 - RNA, 64 nt, hsa; identical to SEQ ID NO: 123550

SEQ ID NO: 159204 - RNA, 64 nt, hsa; identical to SEQ ID NO: 123551

SEQ ID NO: 159205 - RNA, 64 nt, hsa; identical to SEQ ID NO: 123552

SEQ ID NO: 159206 - RNA, 64 nt, hsa; identical to SEQ ID NO: 123553

SEQ ID NO: 159207 - RNA, 64 nt, hsa; identical to SEQ ID NO: 123554

SEQ ID NO: 159208 - RNA, 64 nt, hsa; identical to SEQ ID NO: 123555

SEQ ID NO: 159209 - RNA, 64 nt, hsa; identical to SEQ ID NO: 123556

SEQ ID NO: 159210 - RNA, 64 nt, hsa; identical to SEQ ID NO: 123557

SEQ ID NO: 159211 - RNA, 64 nt, hsa; identical to SEQ ID NO: 123558

SEQ ID NO: 159212 - RNA, 64 nt, hsa; identical to SEQ ID NO: 123559

SEQ ID NO: 159213 - RNA, 64 nt, hsa; identical to SEQ ID NO: 123560

SEQ ID NO: 159214 - RNA, 64 nt, hsa; identical to SEQ ID NO: 123561

SEQ ID NO: 159215 - RNA, 64 nt, hsa; identical to SEQ ID NO: 123562

SEQ ID NO: 159216 - RNA, 64 nt, hsa; identical to SEQ ID NO: 123563

SEQ ID NO: 159217 - RNA, 64 nt, hsa; identical to SEQ ID NO: 123564

SEQ ID NO: 159218 - RNA, 64 nt, hsa; identical to SEQ ID NO: 123565

SEQ ID NO: 159219 - RNA, 64 nt, hsa; identical to SEQ ID NO: 123566

SEQ ID NO: 159220 - RNA, 64 nt, hsa; identical to SEQ ID NO: 123567

SEQ ID NO: 159221 - RNA, 64 nt, hsa; identical to SEQ ID NO: 123568

SEQ ID NO: 159222 - RNA, 64 nt, hsa; identical to SEQ ID NO: 123569

SEQ ID NO: 159223 - RNA, 64 nt, hsa; identical to SEQ ID NO: 123570

SEQ ID NO: 159224 - RNA, 64 nt, hsa; identical to SEQ ID NO: 123571

SEQ ID NO: 159225 - RNA, 64 nt, hsa; identical to SEQ ID NO: 123572

SEQ ID NO: 159226 - RNA, 64 nt, hsa; identical to SEQ ID NO: 123573

SEQ ID NO: 159227 - RNA, 64 nt, hsa; identical to SEQ ID NO: 123574

SEQ ID NO: 159228 - RNA, 64 nt, hsa; identical to SEQ ID NO: 123575

SEQ ID NO: 159229 - RNA, 64 nt, hsa; identical to SEQ ID NO: 123576

SEQ ID NO: 159230 - RNA, 64 nt, hsa; identical to SEQ ID NO: 123577

SEQ ID NO: 159231 - RNA, 64 nt, hsa; identical to SEQ ID NO: 123578

SEQ ID NO: 159232 - RNA, 64 nt, hsa; identical to SEQ ID NO: 123579

SEQ ID NO: 159233 - RNA, 64 nt, hsa; identical to SEQ ID NO: 123580

SEQ ID NO: 159234 - RNA, 64 nt, hsa; identical to SEQ ID NO: 123581

SEQ ID NO: 159235 - RNA, 64 nt, hsa; identical to SEQ ID NO: 123582

SEQ ID NO: 159236 - RNA, 64 nt, hsa; identical to SEQ ID NO: 123583

SEQ ID NO: 159237 - RNA, 64 nt, hsa; identical to SEQ ID NO: 123584

SEQ ID NO: 159238 - RNA, 64 nt, hsa; identical to SEQ ID NO: 123585

SEQ ID NO: 159239 - RNA, 64 nt, hsa; identical to SEQ ID NO: 123586

SEQ ID NO: 159240 - RNA, 64 nt, hsa; identical to SEQ ID NO: 123587

SEQ ID NO: 159241 - RNA, 64 nt, hsa; identical to SEQ ID NO: 123588

SEQ ID NO: 159242 - RNA, 64 nt, hsa; identical to SEQ ID NO: 123589

SEQ ID NO: 159243 - RNA, 64 nt, hsa; identical to SEQ ID NO: 123590

SEQ ID NO: 159244 - RNA, 64 nt, hsa; identical to SEQ ID NO: 123591

SEQ ID NO: 159245 - RNA, 64 nt, hsa; identical to SEQ ID NO: 123592

SEQ ID NO: 159246 - RNA, 64 nt, hsa; identical to SEQ ID NO: 123593

SEQ ID NO: 159247 - RNA, 64 nt, hsa; identical to SEQ ID NO: 123594

SEQ ID NO: 159248 - RNA, 64 nt, hsa; identical to SEQ ID NO: 123595

SEQ ID NO: 159249 - RNA, 64 nt, hsa; identical to SEQ ID NO: 123596

SEQ ID NO: 159250 - RNA, 64 nt, hsa; identical to SEQ ID NO: 123597

SEQ ID NO: 159251 - RNA, 64 nt, hsa; identical to SEQ ID NO: 123598

SEQ ID NO: 159252 - RNA, 64 nt, hsa; identical to SEQ ID NO: 123599

SEQ ID NO: 159253 - RNA, 64 nt, hsa; identical to SEQ ID NO: 123600

SEQ ID NO: 159254 - RNA, 64 nt, hsa; identical to SEQ ID NO: 123601

SEQ ID NO: 159255 - RNA, 64 nt, hsa
uaaaaaaucucuucuaucccagacaugggccaaggugcuguaucugagggaugugcuguaauuu

SEQ ID NO: 159256 - RNA, 64 nt, hsa
ccagacaugggccaaggugcuguaucugagggaugugcuguaauuugauuuacaugcauuagag

SEQ ID NO: 159257 - RNA, 64 nt, hsa
acuuuaccuaccccaaauucauaaaguacauuuagugcuguauagcacuaaaacuuagagauac

SEQ ID NO: 159258 - RNA, 64 nt, hsa
caugguaagcucaauggacuuugaauuguuuacagugcuguauguccaauuguuaaauguacca

SEQ ID NO: 159259 - RNA, 64 nt, hsa
gaauaucugugucuaagcacaauaucuucacacugugcuguauugcugcugaacuaaaugcacu

SEQ ID NO: 159260 - RNA, 64 nt, hsa
caggugaagauauaaaacccuagaaugcuuaaaugugcuguaaaacuauuguagaugucacugg

SEQ ID NO: 159261 - RNA, 64 nt, hsa
ccagccuuguccagaauccuccuggaauuucuuggagacgaaaguaucugggggauuguugggu

SEQ ID NO: 159262 - RNA, 64 nt, hsa
uuuaugucaaaguggccacaagauuguuuaauaggagacgaacgaauguaacuccauguuuacu

SEQ ID NO: 159263 - RNA, 64 nt, hsa
ucagcaagauaagcagggccagucucagggcccggagacgaacacggggacaauugucaaagga

SEQ ID NO: 159264 - RNA, 64 nt, hsa
cacagaagaaaacacgacgucguccauuuuggaagagacgaaagaaaggaaaauaaacucuuug

SEQ ID NO: 159265 - RNA, 64 nt, hsa
aguguacuugguaccaucccugggcucugcuggcgagacgaaacagcuguagagaugaaaacag

SEQ ID NO: 159266 - RNA, 64 nt, hsa
guggcuuuuugggagguggggcaugggaggaccagagacgaagggcuuggaaggagacccccac

SEQ ID NO: 159267 - RNA, 64 nt, hsa
aagacacacuucuaggcuggcuuguggguccccugagacgaaggcugagcagggugagccucga

SEQ ID NO: 159268 - RNA, 64 nt, hsa
agcaaacgcauuccuccucagcuccacccaccuggagacgaauguagccagagaggaggaagga

SEQ ID NO: 159269 - RNA, 64 nt, hsa
gugguggagccagucgcuguaacacugagccucagagacgaaccaaaaccagcugggcugagcu

SEQ ID NO: 159270 - RNA, 64 nt, hsa
agugugggccgcggcagccaagaguggagagcgggagacgaauguccccaucucuuucucucag

SEQ ID NO: 159271 - RNA, 64 nt, hsa
gaagcaauagaauucuaacauaaggccaagaaaugagacgaauguuugggguuuauguuuuuua

SEQ ID NO: 159272 - RNA, 64 nt, hsa
augaauuggauugaggcuugaggggaaauggugugagacgaaugggcucuggacauaugccugu

SEQ ID NO: 159273 - RNA, 64 nt, hsa
acuacgacccgcucugcucacucugcaccugccagagacgaacggugaucugugacccgguggu

SEQ ID NO: 159274 - RNA, 64 nt, hsa
acccaucugccuaucgaaauaugugcaagucagugagacgaaguauagagaacagguggcccag

SEQ ID NO: 159275 - RNA, 64 nt, hsa
uuuuguauauauuuuggaacuuuaguuccucugugagacgaaagaggagagcuauguuuugugg

SEQ ID NO: 159276 - RNA, 64 nt, hsa
caaagccaaggguggcguuuugggggcgcuucuugagacgaaaaagacccugggaagagaugau

SEQ ID NO: 159277 - RNA, 59 nt, hsa
uguaucguucaauaaggugacuuuaaaaugagacgaaaaucauuaaacguaucuuuguu

SEQ ID NO: 159278 - RNA, 64 nt, hsa
cugcgaggaagccuauggaauaguuuccuguccugagacgaaauucagauuaggagauauuuua

SEQ ID NO: 159279 - RNA, 64 nt, hsa
uuggagaugcagccuucaccauggauccuggauugagacgaaugccauuggaaccuguuaaaug

SEQ ID NO: 159280 - RNA, 58 nt, hsa
gccacuggcucaagguguagagggagcagagacgaagaccccaggaagucauccugca

SEQ ID NO: 159281 - RNA, 64 nt, hsa
cagaugcaaauccaauuaggcggccaaguagguggagacgaagcaccuuccuuuccccaucucu

SEQ ID NO: 159282 - RNA, 64 nt, hsa
gcacuauccuaguuauggcaucagguaggagaaggagacgaagaugcuuuaggaagauaaaaac

SEQ ID NO: 159283 - RNA, 64 nt, hsa
uuacuuaaaguugauuuugaacuuuuuauuugaggagacgaagugaaaacaaaucuauaaauau

SEQ ID NO: 159284 - RNA, 64 nt, hsa
gugcgugggcaaagcugaaggugaugaggaagaagagacgaacauuaaagaugucuauuuacua

SEQ ID NO: 159285 - RNA, 64 nt, hsa
guguaugauucuggaacagggugaaacucucccagagacgaagaaagaguccugggauuuguac

SEQ ID NO: 159286 - RNA, 64 nt, hsa
gugggggcagaacaugaguagcaaagaaaagggagagacgaaaaggguacaggcucacguaaag

SEQ ID NO: 159287 - RNA, 64 nt, hsa
ggcugccagaaaugucccacuagggaauuugguagagacgaagacaugcucaccggacaagggu

SEQ ID NO: 159288 - RNA, 64 nt, hsa
ucgguaauaaaauuauggauccagauuguucugagagacgaagauacuugcugcugauagaggu

SEQ ID NO: 159289 - RNA, 64 nt, hsa
cuuaaugauauuuaaguaguuuuuuuuuuuuuuugagacgaaguuuugcucuuguugcccaggc

SEQ ID NO: 159290 - RNA, 64 nt, hsa
uuuaaaccggccccacaugaagagaacaucccuugagacgaauuuggagacugggauuagagcc

SEQ ID NO: 159291 - RNA, 64 nt, hsa
gugugccucucuggccgcccacuggaugagcggugagacgaacaaaagggaaaggaaaaaaugg

SEQ ID NO: 159292 - RNA, 64 nt, hsa
uucagugaauagaaagguauccaaggugaagccugagacgaauggcuuucccaggcuaccuucc

SEQ ID NO: 159293 - RNA, 64 nt, hsa
uggagcuggccaucccaaauucaaucaguccauagagacgaacagaaugagaccuuccggccca

SEQ ID NO: 159294 - RNA, 64 nt, hsa
aaaccccacaaaauaccccaacacaggcgggggagagacgaaaaagaaaaggaaagagcaagau

SEQ ID NO: 159295 - RNA, 64 nt, hsa
uuacuugaugauuuuuaacuuuuuauuucuaaaugagacgaaaugcugauguauccuuucauuc

SEQ ID NO: 159296 - RNA, 64 nt, hsa
ggaccuaggagaguaggugagcuuuccaaagugagagacgaaucuuucuuucuuuuuuuuuuua

SEQ ID NO: 159297 - RNA, 64 nt, hsa
cgacucuggaagcuucccucuaccacugggcacugagacgaagcucccugacagccgagacugg

SEQ ID NO: 159298 - RNA, 64 nt, hsa
gcgcugggcagggcucgugguggcaucagcagcagagacgaagccuuucuguaacaugcggccg

SEQ ID NO: 159299 - RNA, 64 nt, hsa
acguucccacauucuugucaaaaggaaaauacuggagacgaacgccgggugacgcguguccccc

SEQ ID NO: 159300 - RNA, 64 nt, hsa
accgagagucacugguggguuccuuuacugaagggagacgaaggcagggguggauucucgaggu

SEQ ID NO: 159301 - RNA, 64 nt, hsa
cacuccguaaacagcccagcuguaacgccagaccgagacgaacacucugccuaacuaucaaagg

SEQ ID NO: 159302 - RNA, 64 nt, hsa
agauaaaucaccugugugauaauauuuugaaucugagacgaauacaacuuuuaaaaauuguuuu

SEQ ID NO: 159303 - RNA, 64 nt, hsa
ccccaacgguugccuggcaccaucucucucugaugagacgaaucucauuuucauuuccauuaac

SEQ ID NO: 159304 - RNA, 64 nt, hsa
agagaaucagacaggcgagaaguacgaggggagcgagacgaaaggagaacggugauuauucaug

SEQ ID NO: 159305 - RNA, 64 nt, hsa
caacacauguccauucagcccucugaauggaucugagacgaagaccuuuuuaaagauaugucug

SEQ ID NO: 159306 - RNA, 64 nt, hsa
uuuugguaaccagacaccaaucaaauaaggggaggagacgaaaauggaaugauuucuuccaugc

SEQ ID NO: 159307 - RNA, 64 nt, hsa
guucucuaggucccacccgcucccacuauggugggagacgaacggaaggguuggugggcuggcc

SEQ ID NO: 159308 - RNA, 64 nt, hsa
uuauugcauauuuauuguuuggaugucaccaucagagacgaagggaaggguagccagggaggga

SEQ ID NO: 159309 - RNA, 64 nt, hsa
ggggaaggcccaaggccgcccagggcagagagaggagacgaagaguuugggacagugggggagg

SEQ ID NO: 159310 - RNA, 64 nt, hsa
auuccaagucuccaccccuuucuagaccaauaaagagacgaauacaauuuucuaacucagcaaa

SEQ ID NO: 159311 - RNA, 64 nt, hsa
acagaaucgaacucugcacuucucucuccuuuacgagacgaaaaggaaaagcaaaccagaaucu

SEQ ID NO: 159312 - RNA, 64 nt, hsa
gccaucagaaaugucuuuucaucuuuuucuggaggagacgaaugauagggccugguuuacauuc

SEQ ID NO: 159313 - RNA, 64 nt, hsa
uacuggaucugcaaaaagcccgcagccugcuucagagacgaauaguuguuucccugcuagccuc

SEQ ID NO: 159314 - RNA, 64 nt, hsa
ucuggcugaauuuuuuuuuuuuuaauuuuuuguagagacgaaguuucaccauguuggccaggcu

SEQ ID NO: 159315 - RNA, 64 nt, hsa
aggcuccacuggcagacggcagacaaggggagaagagacgaagcagcuggacaucggagacuac

SEQ ID NO: 159316 - RNA, 64 nt, hsa
ccuccagacugcagagcucucagaacccagaacagagacgaaaaggcuaccucuccuacccaag

SEQ ID NO: 159317 - RNA, 64 nt, hsa
gaugagggaaguuuuagucuuggcggguggaaaugagacgaagccacaguuaucacacuccaga

SEQ ID NO: 159318 - RNA, 64 nt, hsa
uaaaugcgugcuuauccucuaagcuugaagaagggagacgaaaauccauuuguuuaaauucaca

SEQ ID NO: 159319 - RNA, 64 nt, hsa
cuaggcacugagagcuggagaguuggugauaagcgagacgaacacauuuccugcccucauacac

SEQ ID NO: 159320 - RNA, 64 nt, hsa
cuucuuccacaucuccagcaaguucucaagcucagagacgaacgcccagcgcuuuggaaaccac

SEQ ID NO: 159321 - RNA, 64 nt, hsa
gagaauuauuugaugcaaaaauaauauaugaaaagagacgaaaagcaccaacaaaugaagcuca

SEQ ID NO: 159322 - RNA, 64 nt, hsa
uggaggaggaugccacgcacuuccucucucggagcccucagacaucuccagugugccagacaaa

SEQ ID NO: 159323 - RNA, 64 nt, hsa
uugugggcaaaggcagggccacuuuugaagucuucccucagauuuccauuguguggccuggugg

SEQ ID NO: 159324 - RNA, 64 nt, hsa
acagaccuucaucugggaacgugcugagccagcacccucagaugauuucccuccaaacugcuga

SEQ ID NO: 159325 - RNA, 64 nt, hsa
auucuuuccuugugaucugaaugucuccuuuucccccucagagggcaaagaggugaacauaaag

SEQ ID NO: 159326 - RNA, 64 nt, hsa
guguaagccacugcuuauaauaaaaccaacaauacccucagacugaaagggcggaaguuauuau

SEQ ID NO: 159327 - RNA, 64 nt, hsa
uucagccuagaaauucugaccagcaccucaguuucccucagagggaaacagcaggaggagggau

SEQ ID NO: 159328 - RNA, 64 nt, hsa
gcacaugacaucugccugggcccugaccaauaaacccucagacccaggacccaggacccugcug

SEQ ID NO: 159329 - RNA, 64 nt, hsa
gucccucauuacccaaggcaaggggcaggacaggcccucagaagcagcucuuggaggagaugag

SEQ ID NO: 159330 - RNA, 64 nt, hsa
ggcugggaauguggaggcucugugagcccugcagcccucagaaucagggccagggaugcagaag

SEQ ID NO: 159331 - RNA, 64 nt, hsa
ucccagccuacagaacaauggccauucugagugacccucagagugggugugugggugcgucuag

SEQ ID NO: 159332 - RNA, 64 nt, hsa
gagacccaauuuuuuaagcccccagacuccuuagcccucagagccggcagcccccuacccucag

SEQ ID NO: 159333 - RNA, 64 nt, hsa
agacuccuuagcccucagagccggcagcccccuacccucagacaaggaacucucuccucucuuu

SEQ ID NO: 159334 - RNA, 64 nt, hsa
cagccuggggcucccugagucagggcugugucuccccucagacuggggcucccugaggacgggg

SEQ ID NO: 159335 - RNA, 64 nt, hsa
aaaguggggcucccucaggacagcguugugucuccccucagacugcggcucccugaggacgggg

SEQ ID NO: 159336 - RNA, 64 nt, hsa
cagacugcggcucccugaggacggggcugugucucccucagacuggggcucccugaagaaaggg

SEQ ID NO: 159337 - RNA, 64 nt, hsa
cagacuggggcucccugaagaaagggcugcuucucccucagacuggagcucccugaagaugggg

SEQ ID NO: 159338 - RNA, 64 nt, hsa
cagacuggagcucccugaagauggggcugugucccccucagacuggggcugccugaggaugagg

SEQ ID NO: 159339 - RNA, 64 nt, hsa
caauguuucaucuccaacccucugccaguuuggccccucagagcuugguggcucaagacuguua

SEQ ID NO: 159340 - RNA, 64 nt, hsa
gugagugagugguggcggggcugcuccuucccaccccucagaacagcucugauccucguuaaua

SEQ ID NO: 159341 - RNA, 64 nt, hsa
aaaaaaaaaggaaacagccucacuuuuuugugcucccucagaauugcuugcuaugucuguuaau

SEQ ID NO: 159342 - RNA, 64 nt, hsa
uguuguuguuguuguuguuguuuuaauugggcaacccucagaacugaagagguucagagaacuu

SEQ ID NO: 159343 - RNA, 64 nt, hsa
gcaacaagaaacuucucccucacccccuccuuuacccucagauuuggagaugguaaccaaagga

SEQ ID NO: 159344 - RNA, 64 nt, hsa
uugcccaucuggagacugcaggcucccuuccuuacccucagagagugcuuaugguggguguuuu

SEQ ID NO: 159345 - RNA, 64 nt, hsa
gaacuucgcucaggagggccuccccuuccccucucccucagaguuuucacugccgucucgucuu

SEQ ID NO: 159346 - RNA, 64 nt, hsa
aaucccuuucuuggugacgacuuaaaucuggguucccucagacauuggguugcaccccaacaaa

SEQ ID NO: 159347 - RNA, 64 nt, hsa
uggaggcagagauuggagugauacauugugggaacccucagaagauaggaaaaaagcauggaau

SEQ ID NO: 159348 - RNA, 64 nt, hsa
ucagaagauaggaaaaaagcauggaauagauucucccucagaguuccaguaguugccaacccug

SEQ ID NO: 159349 - RNA, 64 nt, hsa
aucagugccagccccugcuggcuggugccugagccccucagacagcccccugccccgcaggccu

SEQ ID NO: 159350 - RNA, 64 nt, hsa
uaaaaagggcagcccuccuuaccacuguggaagucccucagaggccuuggggcaugacccagug

SEQ ID NO: 159351 - RNA, 64 nt, hsa
guguaacuaauuugugguaaaguaguugauucagcccucagaagaaaacuuuuguuuagagccc

SEQ ID NO: 159352 - RNA, 64 nt, hsa
agaaaucuccuaacaaaagaacuaagaggcccagcccucagaaacccuucagugcuacauuuug

SEQ ID NO: 159353 - RNA, 64 nt, hsa
accuguuccugaggccucauuuagaaagaaaauccccucagaaggcugucuggcacccaguguc

SEQ ID NO: 159354 - RNA, 64 nt, hsa
ugcuuucugccucugguaacaggagugagugagccccucagaccugcacucugggugucuccug

SEQ ID NO: 159355 - RNA, 64 nt, hsa
acaguucuuggugacugucccaccgggagccucccccucagaugaucucuccacgguagcacuu

SEQ ID NO: 159356 - RNA, 64 nt, hsa
uuucauccaguuuguucuccggguguggccucagcccucagaacaauccgauucacguagggaa

SEQ ID NO: 159357 - RNA, 64 nt, hsa
gcaaggguaggggacaagauguaggcuccagcuccccucagaccuccucaucucaugagcuucu

SEQ ID NO: 159358 - RNA, 64 nt, hsa
auauucagagaacuauacuacccucacagugaggcccucagaccugccacagggcagagcaggu

SEQ ID NO: 159359 - RNA, 64 nt, hsa
gcuuucagaugcauugacucuucccgccuccccucccucagaaagguagugcccacacuauuuu

SEQ ID NO: 159360 - RNA, 64 nt, hsa
accgugucacagcuguguccccuugucaggaagacccucagauguggccagagcaccggccucc

SEQ ID NO: 159361 - RNA, 64 nt, hsa
uacauucauacacaagccuuuucacacagcacuccccucagacacccucagagaguucacacug

SEQ ID NO: 159362 - RNA, 64 nt, hsa
cacaagccuuuucacacagcacuccccucagacacccucagagaguucacacugaugggaaaug

SEQ ID NO: 159363 - RNA, 64 nt, hsa
cccagacccagagguccaggucccagccccuccucccucagacccagcgguccaaugccaccua

SEQ ID NO: 159364 - RNA, 64 nt, hsa
ucagacccagggguccaggcccccaaccccuccucccucagacucagagguccaggcccccaac

SEQ ID NO: 159365 - RNA, 64 nt, hsa
cagacccaggaguccagaccccccagccccuccucccucagacccaggaguccagccccuccuc

SEQ ID NO: 159366 - RNA, 64 nt, hsa
cuccucccucagacccaggaguccagccccuccucccucagacccaggaguccagaccccccag

SEQ ID NO: 159367 - RNA, 64 nt, hsa; identical to SEQ ID NO: 159365

SEQ ID NO: 159368 - RNA, 64 nt, hsa
cucaaaccaaggguacagauccccagccccuccucccucagacccaggaguccagaccccccag

SEQ ID NO: 159369 - RNA, 64 nt, hsa
ucagacccgggaguccaggcccccagccccuccucccucagacccaggaguccaggccccagcc

SEQ ID NO: 159370 - RNA, 64 nt, hsa
ucagacccaggaguccaggcccccagccccuccucccucagacccgggaguccaggcccccagc

SEQ ID NO: 159371 - RNA, 64 nt, hsa
ucaggacccaggaguccaggccccagccccuccucccucagacccaggaguccaggcccccagc

SEQ ID NO: 159372 - RNA, 64 nt, hsa
ucagacccaggauucccgggccccaguaccuccucccucagacccaggacuccaggcccccagc

SEQ ID NO: 159373 - RNA, 64 nt, hsa
ucagauccaggagucuaguccuccagcuccuccucccucagacccaggauucccgggccccagu

SEQ ID NO: 159374 - RNA, 64 nt, hsa
gcaguuugguuucuagcaugaagacagagccccacccucagaugcacaugagcuggcgggauug

SEQ ID NO: 159375 - RNA, 64 nt, hsa
gaugcugucuucguacugggaaagggauuuucagcccucagaaucgcuccaccuugcagcucuc

SEQ ID NO: 159376 - RNA, 64 nt, hsa
cucugagcccaggccugcagggguggagggcagucccucagaaucccagaggcagucccagccu

SEQ ID NO: 159377 - RNA, 64 nt, hsa
ugcccuccccuuccucccauccuuguccuucucucccucagaagccucaggacccaacaggugg

SEQ ID NO: 159378 - RNA, 64 nt, hsa
guggcuuuguuccgugccucccugcccccaucgucacuaccaggucugguacggagucggugcu

SEQ ID NO: 159379 - RNA, 64 nt, hsa
ccucugaaagggauggagaugcugaugagaacaacacuaccacuugaaggugaacauucccugu

SEQ ID NO: 159380 - RNA, 64 nt, hsa
ccacuccauugucacuaacguccggcuccaucggcacuaccaccccgcuccaucaucacuaugu

SEQ ID NO: 159381 - RNA, 64 nt, hsa
cccgcuccaucaucacuauguccagcuccgucggcacuaccacccugcuccaucaucacuacgu

SEQ ID NO: 159382 - RNA, 64 nt, hsa; identical to SEQ ID NO: 97332

SEQ ID NO: 159383 - RNA, 64 nt, hsa; identical to SEQ ID NO: 97333

SEQ ID NO: 159384 - RNA, 64 nt, hsa; identical to SEQ ID NO: 97334

SEQ ID NO: 159385 - RNA, 64 nt, hsa; identical to SEQ ID NO: 97335

SEQ ID NO: 159386 - RNA, 64 nt, hsa; identical to SEQ ID NO: 97336

SEQ ID NO: 159387 - RNA, 64 nt, hsa; identical to SEQ ID NO: 97337

SEQ ID NO: 159388 - RNA, 64 nt, hsa; identical to SEQ ID NO: 97338

SEQ ID NO: 159389 - RNA, 64 nt, hsa; identical to SEQ ID NO: 97339

SEQ ID NO: 159390 - RNA, 64 nt, hsa; identical to SEQ ID NO: 97340

SEQ ID NO: 159391 - RNA, 64 nt, hsa; identical to SEQ ID NO: 97341

SEQ ID NO: 159392 - RNA, 64 nt, hsa; identical to SEQ ID NO: 97342

SEQ ID NO: 159393 - RNA, 64 nt, hsa; identical to SEQ ID NO: 97343

SEQ ID NO: 159394 - RNA, 64 nt, hsa; identical to SEQ ID NO: 97344

SEQ ID NO: 159395 - RNA, 64 nt, hsa; identical to SEQ ID NO: 97345

SEQ ID NO: 159396 - RNA, 64 nt, hsa; identical to SEQ ID NO: 97346

SEQ ID NO: 159397 - RNA, 64 nt, hsa; identical to SEQ ID NO: 97347

SEQ ID NO: 159398 - RNA, 64 nt, hsa; identical to SEQ ID NO: 97348

SEQ ID NO: 159399 - RNA, 64 nt, hsa; identical to SEQ ID NO: 97349

SEQ ID NO: 159400 - RNA, 64 nt, hsa; identical to SEQ ID NO: 97350

SEQ ID NO: 159401 - RNA, 64 nt, hsa; identical to SEQ ID NO: 97351

SEQ ID NO: 159402 - RNA, 64 nt, hsa; identical to SEQ ID NO: 97352

SEQ ID NO: 159403 - RNA, 64 nt, hsa; identical to SEQ ID NO: 97353

SEQ ID NO: 159404 - RNA, 64 nt, hsa; identical to SEQ ID NO: 97354

SEQ ID NO: 159405 - RNA, 64 nt, hsa; identical to SEQ ID NO: 97355

SEQ ID NO: 159406 - RNA, 64 nt, hsa; identical to SEQ ID NO: 97356

SEQ ID NO: 159407 - RNA, 64 nt, hsa; identical to SEQ ID NO: 97357

SEQ ID NO: 159408 - RNA, 64 nt, hsa; identical to SEQ ID NO: 97358

SEQ ID NO: 159409 - RNA, 64 nt, hsa; identical to SEQ ID NO: 97359

SEQ ID NO: 159410 - RNA, 64 nt, hsa; identical to SEQ ID NO: 97360

SEQ ID NO: 159411 - RNA, 64 nt, hsa; identical to SEQ ID NO: 97361

SEQ ID NO: 159412 - RNA, 64 nt, hsa; identical to SEQ ID NO: 97362

SEQ ID NO: 159413 - RNA, 64 nt, hsa; identical to SEQ ID NO: 97363

SEQ ID NO: 159414 - RNA, 64 nt, hsa; identical to SEQ ID NO: 97364

SEQ ID NO: 159415 - RNA, 64 nt, hsa; identical to SEQ ID NO: 97365

SEQ ID NO: 159416 - RNA, 64 nt, hsa; identical to SEQ ID NO: 97366

SEQ ID NO: 159417 - RNA, 64 nt, hsa; identical to SEQ ID NO: 97367

SEQ ID NO: 159418 - RNA, 64 nt, hsa; identical to SEQ ID NO: 97368

SEQ ID NO: 159419 - RNA, 64 nt, hsa; identical to SEQ ID NO: 97369

SEQ ID NO: 159420 - RNA, 64 nt, hsa; identical to SEQ ID NO: 97370

SEQ ID NO: 159421 - RNA, 64 nt, hsa; identical to SEQ ID NO: 97371

SEQ ID NO: 159422 - RNA, 64 nt, hsa; identical to SEQ ID NO: 97372

SEQ ID NO: 159423 - RNA, 64 nt, hsa; identical to SEQ ID NO: 97373

SEQ ID NO: 159424 - RNA, 64 nt, hsa; identical to SEQ ID NO: 97374

SEQ ID NO: 159425 - RNA, 64 nt, hsa; identical to SEQ ID NO: 97375

SEQ ID NO: 159426 - RNA, 64 nt, hsa; identical to SEQ ID NO: 97376

SEQ ID NO: 159427 - RNA, 64 nt, hsa; identical to SEQ ID NO: 97377

SEQ ID NO: 159428 - RNA, 64 nt, hsa; identical to SEQ ID NO: 97378

SEQ ID NO: 159429 - RNA, 64 nt, hsa; identical to SEQ ID NO: 97379

SEQ ID NO: 159430 - RNA, 64 nt, hsa; identical to SEQ ID NO: 97380

SEQ ID NO: 159431 - RNA, 64 nt, hsa; identical to SEQ ID NO: 97381

SEQ ID NO: 159432 - RNA, 64 nt, hsa; identical to SEQ ID NO: 97382

SEQ ID NO: 159433 - RNA, 64 nt, hsa; identical to SEQ ID NO: 97383

SEQ ID NO: 159434 - RNA, 64 nt, hsa; identical to SEQ ID NO: 97384

SEQ ID NO: 159435 - RNA, 64 nt, hsa; identical to SEQ ID NO: 97385

SEQ ID NO: 159436 - RNA, 64 nt, hsa; identical to SEQ ID NO: 97386

SEQ ID NO: 159437 - RNA, 64 nt, hsa; identical to SEQ ID NO: 97387

SEQ ID NO: 159438 - RNA, 64 nt, hsa; identical to SEQ ID NO: 97388

SEQ ID NO: 159439 - RNA, 64 nt, hsa; identical to SEQ ID NO: 97389

SEQ ID NO: 159440 - RNA, 64 nt, hsa; identical to SEQ ID NO: 97390

SEQ ID NO: 159441 - RNA, 64 nt, hsa; identical to SEQ ID NO: 97391

SEQ ID NO: 159442 - RNA, 64 nt, hsa; identical to SEQ ID NO: 97392

SEQ ID NO: 159443 - RNA, 64 nt, hsa; identical to SEQ ID NO: 97393

SEQ ID NO: 159444 - RNA, 64 nt, hsa; identical to SEQ ID NO: 97394

SEQ ID NO: 159445 - RNA, 64 nt, hsa
uucucaggaugcuucuuaccugucagaggaggugacaaggcagucucuugcucucuuggacuca

SEQ ID NO: 159446 - RNA, 64 nt, hsa
ucucuggaaguggucguauuugagcaggaugugcacaaggcaauugaaaugcccauaauuaguu

SEQ ID NO: 159447 - RNA, 64 nt, hsa
uagcuagcuuaguguugaacuaaauuuuuuuuaaacaaggcaaggucuaaugcuguuuugagau

SEQ ID NO: 159448 - RNA, 64 nt, hsa
guuauuuuuaucauaaagccacaaauguauuauaacaaggcaaauuguaauauauauaauccug

SEQ ID NO: 159449 - RNA, 64 nt, hsa
augacauccguauacuuguacuguauuuuguacuacaaggcagcuguuuuucaauaauguccug

SEQ ID NO: 159450 - RNA, 64 nt, hsa
ugagguaggcacaagaaaaagucaggcauaaagcacaaggcagacuguuugaguggauugguug

SEQ ID NO: 159451 - RNA, 64 nt, hsa
uucccaugacccucucuucccugugucuccccuaacaaggcaaucuggaagcagaaaugcaaac

SEQ ID NO: 159452 - RNA, 64 nt, hsa
caccugggauguggaagcugaggaccagaugcacacaaggcauugcucuguuugcuguucuagu

SEQ ID NO: 159453 - RNA, 64 nt, hsa
auuuauugagugccuaccagaugccagucaccacacaaggcacuggguauaugguauccccaaa

SEQ ID NO: 159454 - RNA, 64 nt, hsa
uuuuucuauaaaaagaaaaaaauggaaaaaaauuacaaggcaauggaaacuauuauaaggccau

SEQ ID NO: 159455 - RNA, 64 nt, hsa
guuauucauacaaauaaugagcccuacacagggaacaaggcaggaaguuagcuguuaacuccuu

SEQ ID NO: 159456 - RNA, 64 nt, hsa
auucggaggucaagaaagcaguauauauucuuucacaaggcauccauacuguuuaauauuuaua

SEQ ID NO: 159457 - RNA, 63 nt, hsa
agagaccaacucccugggcuucauacuggccuuccucuacaauggccuccucuccaucagugc

SEQ ID NO: 159458 - RNA, 63 nt, hsa
ucuuguucauguagccgaggggcaggcgggggaccucuacaccucugcugugggcacggggcu

SEQ ID NO: 159459 - RNA, 63 nt, hsa
guggcccgucucaucugugaacuugacucugucccucuacaugucucuuuaauggggugaggg

SEQ ID NO: 159460 - RNA, 63 nt, hsa
ucagcugggggcucucaccagcccuccuuucagccucuacaacagagcagcuucccagacuuc

SEQ ID NO: 159461 - RNA, 63 nt, hsa
cagaugcuggccccuuggucuugaauuuccuagccucuacaacuaagccaaauaaauuucugu

SEQ ID NO: 159462 - RNA, 63 nt, hsa
gaauggcuuagaauaaguauacacuugaaaucuccucuacaugaucuuuguucuuuaacagug

SEQ ID NO: 159463 - RNA, 63 nt, hsa
uggcuguaagggagacucagucccagccucuccccucuacaacuccugccacuguuggccaug

SEQ ID NO: 159464 - RNA, 63 nt, hsa
aauggacuuccauaguauugacuguagaaggagccucuacaauauugacuauauauuuuuaua

SEQ ID NO: 159465 - RNA, 63 nt, hsa
uggauggaauccgcgagcuggccaccuggccacccucuacacggcuccacccugccauggccg

SEQ ID NO: 159466 - RNA, 63 nt, hsa
ccaauuauauuuuuaacauuuaaaaaccaaaguccucuacacuugauuuauauuauauguggc

SEQ ID NO: 159467 - RNA, 63 nt, hsa
ugagaccagccugggcaacauggcaaaaacccaccucuacaaaaaguacaaaaauuagucggg

SEQ ID NO: 159468 - RNA, 63 nt, hsa
agugacucucuaggcuucggacacaaauaggcuccucuacaccugaagacaaaggcaaaguca

SEQ ID NO: 159469 - RNA, 63 nt, hsa
cacaagaacaacggcaagacagugccuauacugccucuacaguuaauaggaaaaacggaagaa

SEQ ID NO: 159470 - RNA, 63 nt, hsa
uuguacuuguggaugguugagcacaaaaaaccaccucuacauuucucuuaaagguagguuggc

SEQ ID NO: 159471 - RNA, 63 nt, hsa
uguccuuccuugaaauugcugauuguucugcucccucuacagauauuuauaucaauuccuaca

SEQ ID NO: 159472 - RNA, 63 nt, hsa
aaccaacuaauauuuauugaagaccuacuuuguccucuacauaggguagcuucugucagggaa

SEQ ID NO: 159473 - RNA, 63 nt, hsa
agcuugcugacugcagaucuugagauaugucagccucuacagucacaagagcuaauucauucu

SEQ ID NO: 159474 - RNA, 63 nt, hsa
acuucuuccuaaugacacgcgaccguccuggugccucuacaugguugaugcgggcaguguggg

SEQ ID NO: 159475 - RNA, 63 nt, hsa
aaucuggugaauguuauuauuaggaguguucugccucuacaguggcauauuccaugacauuaa

SEQ ID NO: 159476 - RNA, 63 nt, hsa
auuguuauuuaauaaauauuucaggauauuuuuccucuacaauaaaguaacaauuaacuuaug

SEQ ID NO: 159477 - RNA, 63 nt, hsa
aaugugugccaagagggucuccuuuccugucuuccucuacagagaaugcugcucgguccuccu

SEQ ID NO: 159478 - RNA, 63 nt, hsa
gggaagggcuuucuugguaauuuagaugugaaaccucuacagagcuaucauguaaaaacuaca

SEQ ID NO: 159479 - RNA, 63 nt, hsa
cgguggccuucaagguccuuuaugaguguuaccccucuacacguccacaccacucaccacaca

SEQ ID NO: 159480 - RNA, 63 nt, hsa
agagggggcagaaaugaaugaccagguuaaaucccucuacaugugguuucuguuugaaaaaaa

SEQ ID NO: 159481 - RNA, 63 nt, hsa
guaggaaacuugauuuuuuuguuuugaucauggccucuacaugcaccuuuccagaguggucuc

SEQ ID NO: 159482 - RNA, 63 nt, hsa
cuacccggucacggaggccggccaccugcagagccucuacacagguagugccccgaggggcug

SEQ ID NO: 159483 - RNA, 63 nt, hsa
ggcgcuguuggggcugcucauguuggggcucuuccucuacagccucccuggcuacauggucaa

SEQ ID NO: 159484 - RNA, 63 nt, hsa
ggguggcacagcagugccccccugcagccuuccccucuacacaggacaugcacacacaaguaa

SEQ ID NO: 159485 - RNA, 63 nt, hsa
accuuucccuaugacuuggcaguaugugaauauccucuacacuuaguuauugauaaacuucuu

SEQ ID NO: 159486 - RNA, 63 nt, hsa
guuugcaucauacaucuucucuuuccuuguuuuccucuacaauuggaggagaaacaaauauau

SEQ ID NO: 159487 - RNA, 63 nt, hsa
uuuucagaaacuuuccaaacugcuuuacauagaccucuacaaguagggaauguuuucugaagc

SEQ ID NO: 159488 - RNA, 57 nt, hsa
cuggaccugguuaucgauaaggaggcuccucuacaccaauuaauguagcugcuagcu

SEQ ID NO: 159489 - RNA, 63 nt, hsa
cugguuuuuguuugguuuucguuuugcuuuuagccucuacaugcuaggaucacaggaagacuu

SEQ ID NO: 159490 - RNA, 63 nt, hsa
cuaguaguuauuuuuccuuuuucuuuuuguguaccucuacagagaccaaaacucauucucuua

SEQ ID NO: 159491 - RNA, 63 nt, hsa
uaauuuuuagaagcaagaagaaagccauuguguccucuacaauuaacaaaacuuaucucugau

SEQ ID NO: 159492 - RNA, 63 nt, hsa
cuuucauuuacauaggguguaaccaucaagaaaccucuacaggguacuuaagccccagaagau

SEQ ID NO: 159493 - RNA, 63 nt, hsa
aaagauaugaagaacuauuauauugaggccuguccucuacauaccacacuuaaaagaugguga

SEQ ID NO: 159494 - RNA, 63 nt, hsa
gaauagaauacauuauaccucauaggugucuagccucuacaguucuggcuguaguuaugaccu

SEQ ID NO: 159495 - RNA, 63 nt, hsa
uuggaaauuccuccaaaguuugccuucaucucuccucuacaguuuggaggugauggugcagca

SEQ ID NO: 159496 - RNA, 63 nt, hsa
ugaaccuaauacccugcccuugacaucuggaaaccucuacauauuuauauaacgugauacauu

SEQ ID NO: 159497 - RNA, 63 nt, hsa
cccaccuccuggugguaccauuauuauagaagcccucuacagccugacuuucucuccagcggu

SEQ ID NO: 159498 - RNA, 63 nt, hsa
guaugcgauguaauuaaagaaauuauuggauaaccucuacaaauaaagauaggggaacucuga

SEQ ID NO: 159499 - RNA, 63 nt, hsa
uuuuaaaugucuuuauugacuuuaaauucauugccucuacauuauucauuaguucuucuuuuc

SEQ ID NO: 159500 - RNA, 63 nt, hsa
aacccaguugaauaggauccaaucccugguuagccucuacacaauaauagggagacaaggauu

SEQ ID NO: 159501 - RNA, 63 nt, hsa
auuugggcuaucagagguaccccugggcaggagccucuacauccccuucccccuccucucucc

SEQ ID NO: 159502 - RNA, 63 nt, hsa
gacugaauagugugguucagugagcugcacugaccucuacauuuuguaugauauguaaaacag

SEQ ID NO: 159503 - RNA, 63 nt, hsa
gccugggccucggcgucaaucaucgauaagaagccucuacagcaccccugcccccuaauuuau

SEQ ID NO: 159504 - RNA, 63 nt, hsa
uugguuccugagaggucugagggccagagcugcccucuacauuaacaugcugucucuaagggu

SEQ ID NO: 159505 - RNA, 63 nt, hsa
gguguaauuacagaauuuacgaaauguaaauggccucuacagaguuuuauggaauaccuggua

SEQ ID NO: 159506 - RNA, 55 nt, hsa
uuuauggcuucggcggcugagcuuaccucuacaguacacuaccgcaaaaccaacg

SEQ ID NO: 159507 - RNA, 63 nt, hsa
uaauucuuuuuagaacugaagcauccuaggaugccucuacauguauuucauuccccucaucuu

SEQ ID NO: 159508 - RNA, 63 nt, hsa
acauaggcuccaucuauuuuguggcucugccacccucuacagccuucaugccccaugcauuag

SEQ ID NO: 159509 - RNA, 63 nt, hsa
uaagucaaguuucacuggcucuauaacagucuaccucuacacuaagagaacuauaacaugaac

SEQ ID NO: 159510 - RNA, 63 nt, hsa
uaggagacuucaucuaaagcaugaaaccuagcuccucuacacacaaauuccuauggaaauacc

SEQ ID NO: 159511 - RNA, 63 nt, hsa
cuaaguggucucuguucuacacuuuaaugucacccucuacaucaucuuaccuagcccacccaa

SEQ ID NO: 159512 - RNA, 63 nt, hsa
gaugaaggacgugucucaggagcuugauccagaccucuacaagcaaauggagaaguucaggaa

SEQ ID NO: 159513 - RNA, 63 nt, hsa
cuugguagcucugggauuugccuuccuucauguccucuacacacuugugauuccuauucgaua

SEQ ID NO: 159514 - RNA, 63 nt, hsa
agccuuccagcuguuccugcuuccacucuugcuccucuacaauucauucugcacgcagaaguc

SEQ ID NO: 159515 - RNA, 63 nt, hsa
uaccucauuuaaucuguaaagguuugucguaauccucuacaaagcuacucccuguuauugugu

SEQ ID NO: 159516 - RNA, 63 nt, hsa
gggcggcuggcuggaaagccacgcguaugcugcccucuacaggcugcucggccucccugcagc

SEQ ID NO: 159517 - RNA, 63 nt, hsa
guuguaaaagcugaugaaccugaaauuguguagccucuacaggcugcugagguucuaaauaaa

SEQ ID NO: 159518 - RNA, 63 nt, hsa
gcacagaaaaacacgcauugaaugugugucgaaccucuacauugugaaguugcacuauguacc

SEQ ID NO: 159519 - RNA, 63 nt, hsa
ugauagaaauugagauucuugcugucuuuugugccucuacaagcuacuacucauuccagaauu

SEQ ID NO: 159520 - RNA, 63 nt, hsa
cugugccuucuuuucuuucuuucuuuuuuuuaaccucuacagacacaauccucaaaccaacaa

SEQ ID NO: 159521 - RNA, 63 nt, hsa
uaaacagaagcaacagaagggacaagaggcuggccucuacaucacucucaccuuccaaaucuu

SEQ ID NO: 159522 - RNA, 63 nt, hsa
uuucaggaaccaaggacugccagaaaauauuagccucuacauuacgcaugcauuuagaagcuu

SEQ ID NO: 159523 - RNA, 63 nt, hsa
uggacaggaugacagacagggacgaagcagagaccucuacagacccaagucaccaaguggagc

SEQ ID NO: 159524 - RNA, 63 nt, hsa
ugcccucuucuuaccccaauuuucuuguauuacccucuacaauauacuuuuuauugagcacuu

SEQ ID NO: 159525 - RNA, 63 nt, hsa
acagcauugaucuccuggaggcugguucugcugccucuacacaggggcccuguacagugaaug

SEQ ID NO: 159526 - RNA, 63 nt, hsa
ggaugcccugcccuguauccacuugggagagagccucuacaacaugcuggcaacuucccccuc

SEQ ID NO: 159527 - RNA, 63 nt, hsa
guuggaccuccauggagccacuaggccuggccuccucuacacauccccagggcuaucugguua

SEQ ID NO: 159528 - RNA, 63 nt, hsa
uucuguuugucaguucauuccuguguguucuuaccucuacaaaguaaauuacacauuuaguuu

SEQ ID NO: 159529 - RNA, 63 nt, hsa
uuguuugaaugauuccggcuuguaauauaucagccucuacaaugaaaugcagaagaguucauu

SEQ ID NO: 159530 - RNA, 63 nt, hsa
uuccagcuggaugagaauuugagugcucugaucccucuacagagcuucccugacucauucuga

SEQ ID NO: 159531 - RNA, 55 nt, hsa
caaagcuuccaaaaaucuaacucuuccucuacaucuuacuguucugcccgggauu

SEQ ID NO: 159532 - RNA, 63 nt, hsa
uauuuaagacuuuaagacuuaaaaggcuuacugccucuacauuucacucagacuaguacaucu

SEQ ID NO: 159533 - RNA, 63 nt, hsa
uuugcccccccaguggcccugggcugggccuggccucuacagagccuuuuagggggagggggu

SEQ ID NO: 159534 - RNA, 63 nt, hsa
gugauuccaaugcaggugucuucauuaccauuaccucuacacugcagaagaagcaaaacuccu

SEQ ID NO: 159535 - RNA, 63 nt, hsa
uuggaagcaggcucccaauagggagggggcugcccucuacagucucuuugacuguaagacagg

SEQ ID NO: 159536 - RNA, 63 nt, hsa
ucaggguucuaaccuuucuaacccacuaaguaaccucuacaggcauuuaacugccuuacagac

SEQ ID NO: 159537 - RNA, 63 nt, hsa
gguccauggucuauuuauucucgcccagcucacccucuacacagacacuguccugggugcaca

SEQ ID NO: 159538 - RNA, 63 nt, hsa
cucccucucugcucuccugucccuugagcccuuccucuacagguggggcagagaggguggugg

SEQ ID NO: 159539 - RNA, 63 nt, hsa
agauggcaguguucuccucuggggccugauccaccucuacaccagcccaggaagccccaucug

SEQ ID NO: 159540 - RNA, 63 nt, hsa
cucacuuuaauaccucuuaggaaccaaagaaugccucuacaagcaaaaagauaguugaaaaua

SEQ ID NO: 159541 - RNA, 63 nt, hsa
gauaaccaaguagccauuuuccucuuaagguuuccucuacaaccccaaggacuuucaugauua

SEQ ID NO: 159542 - RNA, 63 nt, hsa
gccgcucugcgugugcgugugcgcgugugugagccucuacacauauauauacguacagagccu

SEQ ID NO: 159543 - RNA, 63 nt, hsa
cuuggaguuagaucuagguccuucuaucucgucccucuacagauguauuuuccacuugcauaa

SEQ ID NO: 159544 - RNA, 63 nt, hsa
auaaauaauuauaaauugagcacugauggaaucccucuacaggucaagaaauagcgcaguguc

SEQ ID NO: 159545 - RNA, 63 nt, hsa
agcugaaaaggggauccuugaaaacacugaaaaccucuacaacaaucuucaggaagccugcua

SEQ ID NO: 159546 - RNA, 63 nt, hsa
uguucgagcacagaacggauauaaucagucuggccucuacaacaaguuuugcauuguagaauu

SEQ ID NO: 159547 - RNA, 63 nt, hsa
uccuaagcaguccuggcuuuuccucaucacuccccucuacagugccugguagacaagugcuac

SEQ ID NO: 159548 - RNA, 63 nt, hsa
uaauuuucuuuuuuggcccuaggcugguugggaccucuacagcuucauucuuucaccauuaaa

SEQ ID NO: 159549 - RNA, 63 nt, hsa
gcagauccccagccucuggccuccuguucgccuccucuacaauuugccauuguuucuccuggg

SEQ ID NO: 159550 - RNA, 63 nt, hsa
uggaccagugggaaggauaggauuagcacugcaccucuacauccaucaagagagacagagcgc

SEQ ID NO: 159551 - RNA, 51 nt, hsa
gagaagauuaugccgaauagaccucuacauccugugcuuuucuccuaguuu

SEQ ID NO: 159552 - RNA, 63 nt, hsa
gagcaaagugaccugguuaaacaaaccagaaucccucuacauggacucagagaaaagagauug

SEQ ID NO: 159553 - RNA, 63 nt, hsa
augccccggcaccucugcccugugucuuucauaccucuacaugucugcuugagauauuuccuc

SEQ ID NO: 159554 - RNA, 63 nt, hsa
cuaagggauuccugggugccacugcucucuuuuccucuacagcuccaucuuguuucacccacc

SEQ ID NO: 159555 - RNA, 63 nt, hsa
cuuuacuaacauucauguuauggcaagaguuguccucuacauuggaaagcuaauccuaccuug

SEQ ID NO: 159556 - RNA, 63 nt, hsa
aguugggaggggcaccguccggaggagaccaggccucuacacaccccccacucuacuuaucau

SEQ ID NO: 159557 - RNA, 63 nt, hsa
gcuugcccuuguccgugugcccccaggacuuugccucuacagcauuuucuuacacccccuccc

SEQ ID NO: 159558 - RNA, 63 nt, hsa
acugcagaccaacuaccccuccucagacaacagccucuacaccaacgccaagggcagcaccau

SEQ ID NO: 159559 - RNA, 63 nt, hsa
cgccacaacauggcucuuugugagccuguggcuccucuacauacucuuugccacacuagaggc

SEQ ID NO: 159560 - RNA, 63 nt, hsa
auuaagggcaaaucuauuacuuuugcaaacuguccucuacaucaauuaacaucgugggucacu

SEQ ID NO: 159561 - RNA, 63 nt, hsa
gguugcugaugagagaaccugaaaaaaccuacaccucuacagcaggucgaauucaugaccuga

SEQ ID NO: 159562 - RNA, 63 nt, hsa
gaacauccuguuugugaauucugaguuugaaacccucuacaaugagcacaagguauugguggg

SEQ ID NO: 159563 - RNA, 63 nt, hsa
uuauuucuguaguuggaaucuguaccuucugaaccucuacaccaauaacugcugcagguguga

SEQ ID NO: 159564 - RNA, 63 nt, hsa
acaccaaagaggaagaagagcuguggaggccacccucuacaaagcuuuauagaacuucuggau

SEQ ID NO: 159565 - RNA, 63 nt, hsa
gucucggcuguaggaaucaacagaaggagacguccucuacauaaaagcuccaugugaaaagcu

SEQ ID NO: 159566 - RNA, 63 nt, hsa
cguccuggaggaggugaugcuggucccuggccaccucuacagcccugaacucuugagacaacu

SEQ ID NO: 159567 - RNA, 63 nt, hsa
ucugaggcugagaggacaccuauaugcguauuuccucuacacacaucaccccccuucuauaau

SEQ ID NO: 159568 - RNA, 63 nt, hsa
uauggcacucuccgaauccuccugaaggcauuuccucuacagacauaguguuacaggaaguga

SEQ ID NO: 159569 - RNA, 63 nt, hsa
acuuuaaauugcaaagucuuccgggccuauuuuccucuacauuuuuguaauuaacucuggggg

SEQ ID NO: 159570 - RNA, 63 nt, hsa
gcagcagggcuccauucucuggccuggcccaggccucuacauacuuacuccagccauuugggg

SEQ ID NO: 159571 - RNA, 63 nt, hsa
uggagaacauugcauaggaaugucuggaaaaagccucuacaacuuguuacagccuucacauuu

SEQ ID NO: 159572 - RNA, 63 nt, hsa
gagcaugcucacccagcucugcuccaaggccuuccucuacaccuucugccaccaccugcaccu

SEQ ID NO: 159573 - RNA, 63 nt, hsa
cuucccucccgauuucccgauucccccacccucccucuacacuugaggaccacaguugggggu

SEQ ID NO: 159574 - RNA, 63 nt, hsa
gcugcaaggggaaucgucagaguccaaugugugccucuacaguaaugucggaaauaaauacca

SEQ ID NO: 159575 - RNA, 63 nt, hsa
gaagagugaaagaacuccugccaagagcccagaccucuacaaacguuguauguccuuuuuuaa

SEQ ID NO: 159576 - RNA, 63 nt, hsa
gcaaaagagguaagcagaucacaccucuuucugccucuacauauggccuauucugggcuagac

SEQ ID NO: 159577 - RNA, 63 nt, hsa
gcacugcaggccaggccaggaugcccaccccgcccucuacacggccccuuggggccugcgccc

SEQ ID NO: 159578 - RNA, 63 nt, hsa
gcaggagccugagccuugggaacaugcgugugaccucuacagcuaccucuucuauggacuggu

SEQ ID NO: 159579 - RNA, 63 nt, hsa
uugcccacccccgauccccgugcgcuccucaccccucuacagacaggggcgcugcugcagaug

SEQ ID NO: 159580 - RNA, 63 nt, hsa
gaaaaaugcuaagucccagcuauggauuucaggccucuacacuucugcuuacuggugugggca

SEQ ID NO: 159581 - RNA, 63 nt, hsa
caggaggcguucggaggaggaguuccgccccacccucuacagccuuccucaggccccugucuc

SEQ ID NO: 159582 - RNA, 63 nt, hsa
agggagagccauacugcacggacguagcguuucccucuacaagcacuaggagcaccuuucuca

SEQ ID NO: 159583 - RNA, 63 nt, hsa
uuucugagaaagguuuggaugacugaaauauuuccucuacagucaaggacuuuggcauguggu

SEQ ID NO: 159584 - RNA, 63 nt, hsa
acauauuuucuucauagucccuaauauagucauccucuacagaguuggcgugcugugugcacu

SEQ ID NO: 159585 - RNA, 63 nt, hsa
uuaauugacacagaauacauuucacauauuuaaccucuacaauaaguucugacacauuuucca

SEQ ID NO: 159586 - RNA, 63 nt, hsa
gcugucuaggacucacgggguucggaagccacaccucuacaugucuaaaacaaaaaacaacaa

SEQ ID NO: 159587 - RNA, 63 nt, hsa
ccaacucuucaugccccugccguuguaguggaaccucuacauguuuuaguuugcuucaccuaa

SEQ ID NO: 159588 - RNA, 63 nt, hsa
ugcauggcauccuccagccccuguagaacucaaccucuacaggguuagaguuuggagagagca

SEQ ID NO: 159589 - RNA, 63 nt, hsa
agggucgggggaggggggagccuuguagggaggccucuacacagaagaaagcagcccccaugu

SEQ ID NO: 159590 - RNA, 63 nt, hsa
caagagcaucaggcucagcuagaagauccacauccucuacaggucggggaccaaaggcugauu

SEQ ID NO: 159591 - RNA, 63 nt, hsa
ccaagcguuccuggccuucugaacuccauacagccucuacagccgucccgcguucaagacuug

SEQ ID NO: 159592 - RNA, 63 nt, hsa
ugauucugagauggcuuuugcugcucuguucucccucuacauuucucugcagaacucgcguua

SEQ ID NO: 159593 - RNA, 63 nt, hsa
gcugcccccacccgaaagacccuccacgcucguccucuacagaguccggcuucgggaagugcc

SEQ ID NO: 159594 - RNA, 63 nt, hsa
aagaaaagaaaaaaaaaaaaaagaaacaaaccaccucuacauauuauggaaagaaaauauuuu

SEQ ID NO: 159595 - RNA, 63 nt, hsa
ccuaguccuggccagaaggaugaucucgcuuuuccucuacaggccuauaagaagcagguacuu

SEQ ID NO: 159596 - RNA, 63 nt, hsa
cacuuaagaccccuccucuacuuccuucugaguccucuacaaagacauccggguacuacauuu

SEQ ID NO: 159597 - RNA, 63 nt, hsa
acgcccaguggaugauccuacugcucccagcaaccucuacauccaggaaugagucccuagggg

SEQ ID NO: 159598 - RNA, 63 nt, hsa
uuugagaccacccugggcaacauagcgagacuaccucuacaaaaaaaaaaaaaaauaauaaua

SEQ ID NO: 159599 - RNA, 63 nt, hsa
cccacgcgcaccaccucuccggucgcguggcugccucuacagccuaccuauacgucccuuuuu

SEQ ID NO: 159600 - RNA, 63 nt, hsa
agauaccccuucuccucacagucagaacagcagccucuacacauguuguccugccccuggcaa

SEQ ID NO: 159601 - RNA, 63 nt, hsa
gggaguggaaauucagccugcuuagaggacugaccucuacaguucauauuugcagugacauaa

SEQ ID NO: 159602 - RNA, 63 nt, hsa
cguggcuauaacaucuauaacaaaacgacgauuccucuacaagaggcuguuucucacugcuaa

SEQ ID NO: 159603 - RNA, 63 nt, hsa
gcuagauuguaagcuccuggaggacagggaccaccucuacaaaaaauaaaaaaaguaccuccc

SEQ ID NO: 159604 - RNA, 63 nt, hsa
ucacucacaaaccucuuaucucuucuucuccuuccucuacauuuuaaagggggagagggaaaa

SEQ ID NO: 159605 - RNA, 63 nt, hsa
aagcuaucucugggaugccucuaggcccccuucccucuacacaccucugggaaaagauuacac

SEQ ID NO: 159606 - RNA, 63 nt, hsa
auguggcuacaaagugaggagaagcuagccagcccucuacaagcugucuucuugcacacgcug

SEQ ID NO: 159607 - RNA, 63 nt, hsa
uuuuggauucuuauggacugugaguuagucuucccucuacacggagucacaggaaggguauaa

SEQ ID NO: 159608 - RNA, 63 nt, hsa
uuccaagcuagcugcugccuccuuacuccuggcccucuacaugaagaagcucggauacugggu

SEQ ID NO: 159609 - RNA, 63 nt, hsa
cgagaccagccuggccaacauggugaaaccccaccucuacaaaaaauacaaaaauuagccggg

SEQ ID NO: 159610 - RNA, 63 nt, hsa
uacuguaaacaucuuugcaugucaauaaauaugccucuacaacauauuuuugaaucacuuaau

SEQ ID NO: 159611 - RNA, 63 nt, hsa
aaugccaccuaggaggauccaaagucugaaucuccucuacaauguuuccuuucucccaaaaca

SEQ ID NO: 159612 - RNA, 63 nt, hsa
uguucauuguuccugguuuuuuccagccagcagccucuacacuccaucauaggacaucgaguc

SEQ ID NO: 159613 - RNA, 63 nt, hsa
uaucgccuuuuaugaugcuuugaacuccauccaccucuacaccuucgacgucgcauuugcgca

SEQ ID NO: 159614 - RNA, 63 nt, hsa
uaaccuuguggaaagacauguucauaugucacuccucuacacuaacugagauguguuaaauaa

SEQ ID NO: 159615 - RNA, 63 nt, hsa
agguuaggaaaggauucagcacuacagcauaccccucuacaacauacagcccugucacauuga

SEQ ID NO: 159616 - RNA, 63 nt, hsa
uuucaaacacauauuaguccuaccaccuuaguuccucuacagcaaaagaggcuuuucuucuua

SEQ ID NO: 159617 - RNA, 64 nt, hsa
uggggacuacucagaggcaaagaggagcugcuccugccuccaugguugcuggccacucccacca

SEQ ID NO: 159618 - RNA, 64 nt, hsa
aaucaaaagaaagaacaaggacucugguuacccuugccuccacccaugugucauaagaguaggc

SEQ ID NO: 159619 - RNA, 64 nt, hsa
caacucuguaucuguuggcuucaagagaauauuuugccuccacauauguaccccuucuccuuuu

SEQ ID NO: 159620 - RNA, 64 nt, hsa
uucuccuuuuuuuaaagauggauuuaaaccaagaugccuccaggaaagaggacgaaaugaguau

SEQ ID NO: 159621 - RNA, 64 nt, hsa
augacagcaccugacauucugcaccagcuaccucugccuccauggcagagaaaaggccauaaga

SEQ ID NO: 159622 - RNA, 64 nt, hsa
ucccuguucuuggaucugccauggagggaucuggugccuccagacgugugcacauaaauccaua

SEQ ID NO: 159623 - RNA, 64 nt, hsa
uaccuaaaacugagguggggauggggagaggcuuugccuccaccauucccaccccacccucccc

SEQ ID NO: 159624 - RNA, 64 nt, hsa
gcccaggaacaugacaacgugaccacaccacacaugccuccaacacacacccacagucuaaaca

SEQ ID NO: 159625 - RNA, 64 nt, hsa
cuuuuaagccagugguucuucagaaucaccuagaugccuccacccuccagagauccugagucca

SEQ ID NO: 159626 - RNA, 64 nt, hsa
accagauaaucuucugaaaguguaacucagaugaugccuccaacccuguggcugcccuucacac

SEQ ID NO: 159627 - RNA, 64 nt, hsa
aaccaucuuucuguuugucgucuuguugauuugcugccuccacacugucagcuccuugggaaca

SEQ ID NO: 159628 - RNA, 64 nt, hsa
gccuccagcagccaugcaugugcgcccgcagcccugccuccacagcucgccacacacucacgcu

SEQ ID NO: 159629 - RNA, 64 nt, hsa
cacacucacgcuucgccagagacaggaagugcgcugccuccacggccccuugcccuugcucagg

SEQ ID NO: 159630 - RNA, 64 nt, hsa
aacgacaaacuugaguguuucccugccacuucugugccuccacagccugcuccaguuccgcagc

SEQ ID NO: 159631 - RNA, 64 nt, hsa
cagccaaagcaugccguucugcacccuacccaguugccuccagggccucuccuuggaaggucuu

SEQ ID NO: 159632 - RNA, 64 nt, hsa
ugggaaagccugagaagucacuuuggaacuaaauugccuccauuuuauuuuguacgaguaaggg

SEQ ID NO: 159633 - RNA, 64 nt, hsa
accauuuugaugaucaugaaacgcugaugaaaaaugccuccaaacauuuuucuguacucauacu

SEQ ID NO: 159634 - RNA, 64 nt, hsa
ggagcacccuagugagaguugaaccccuuccuucugccuccagggccugucugccuccacauca

SEQ ID NO: 159635 - RNA, 64 nt, hsa
guugaaccccuuccuucugccuccagggccugucugccuccacaucacucugaggacagggaca

SEQ ID NO: 159636 - RNA, 64 nt, hsa
ucuaggaugcagcugccagauccacucacucugcugccuccagcaggacccaaggccacuuuca

SEQ ID NO: 159637 - RNA, 64 nt, hsa
cuucacagcucacaggggcaggaggcagcuccccugccuccaggacccuguugcuauggugaca

SEQ ID NO: 159638 - RNA, 64 nt, hsa
aggagccccuggacaugccuguccugaaagcggcugccuccauuauccauucccaagaugccug

SEQ ID NO: 159639 - RNA, 64 nt, hsa
gcugccagagaagucuggucagagccacagggucugccuccagccaaacgggagcuuuugguga

SEQ ID NO: 159640 - RNA, 64 nt, hsa
gggcuuugaacucuccuagcuccugucccagcccugccuccagggcuccugggcugccagggac

SEQ ID NO: 159641 - RNA, 64 nt, hsa
ccucgccaagccucuaugcaccccacaaaguuucugccuccaugccguccacagcgccucuucc

SEQ ID NO: 159642 - RNA, 64 nt, hsa
gucuguugggagcagaugugcucacugacguuugugccuccagggcagauuccuaagcagcugg

SEQ ID NO: 159643 - RNA, 64 nt, hsa
cuccuguggaagaggguggugggccuuggaacgcugccuccacugaggcgggcacacaaggcgg

SEQ ID NO: 159644 - RNA, 64 nt, hsa
cagccaucauaggaagggaccaaggcaaggcaggugccuccaggugugcacguggcauguggcc

SEQ ID NO: 159645 - RNA, 64 nt, hsa
uggccugugucccaugacccaccccugugcuccgugccuccaccaccacuggccaccaggcugg

SEQ ID NO: 159646 - RNA, 64 nt, hsa
uaccuaaaacugagguggggauggggagagccuuugccuccaccauucccacccacccuccccu

SEQ ID NO: 159647 - RNA, 64 nt, hsa
cuguccccaacagaucugccauggagggaucuggugccuccagacaugugcacaugaauccaua

SEQ ID NO: 159648 - RNA, 64 nt, hsa
cugggcaguugaggaaaggacagccccugguuggugccuccaaaggaagguggacuuuuuuggu

SEQ ID NO: 159649 - RNA, 64 nt, hsa
gaaaccugugaagaguggauucugccuccaucucugccuccauggcuaccuuuaggagacagag

SEQ ID NO: 159650 - RNA, 64 nt, hsa
auguucuauguggaaaccugugaagaguggauucugccuccaucucugccuccauggcuaccuu

SEQ ID NO: 159651 - RNA, 64 nt, hsa
gaagcccugggucacccccacucugccucauuucugccuccaggaugccacugccucugcuucc

SEQ ID NO: 159652 - RNA, 64 nt, hsa
ugacucaaaagaguuucuggcugaucuguggcuuugccuccaccaucccuaaccaaccucucau

SEQ ID NO: 159653 - RNA, 64 nt, hsa
ucaagucgcggcugcaggauccuugccuccaacgugccuccagcacaugcggcuuccgagggca

SEQ ID NO: 159654 - RNA, 64 nt, hsa
acccaugcgauucaagucgcggcugcaggauccuugccuccaacgugccuccagcacaugcggc

SEQ ID NO: 159655 - RNA, 64 nt, hsa
aacaucaagcaggaaacagacgacugagccuuccugccuccagccuggcuucuagcuggaagcc

SEQ ID NO: 159656 - RNA, 64 nt, hsa
aagccagcccagcguuucucuaccaccaccaccaugccuccaccugacuuuggcuuggagacug

SEQ ID NO: 159657 - RNA, 64 nt, hsa
ugucuguccgucugugcuuguggcuaugagcgugugccuccacccaccccacgacccgugacua

SEQ ID NO: 159658 - RNA, 64 nt, hsa
ccuggcccaggaggccaggaaggagggcccugucugccuccaccucugggugcacccccugccu

SEQ ID NO: 159659 - RNA, 64 nt, hsa
gaaugccagccaccuuguaaaacugcugggagaaaagcaugauucccacaaggacuaaguauca

SEQ ID NO: 159660 - RNA, 64 nt, hsa
guagacaagaguuaacugaguagcaugcuuuauuaagcaugagaaagaaucuuaagaauuguca

SEQ ID NO: 159661 - RNA, 64 nt, hsa
ucccauugcuguuaguuuuagaacuauacccgugaagcaugacuuauuguaagauguuggcuga

SEQ ID NO: 159662 - RNA, 64 nt, hsa
cgugaagcaugacuuauuguaagauguuggcugaaagcaugaacuugcagaacucccucggaga

SEQ ID NO: 159663 - RNA, 64 nt, hsa
cucgcccccuugucuuggcauaaaaacaccuuuaaagcaugagccaugugcuucuuugcccuuc

SEQ ID NO: 159664 - RNA, 64 nt, hsa
ugcugggauuccucccuuaggacucggauuucacaagcaugaccagccugcuuacagggagcgu

SEQ ID NO: 159665 - RNA, 64 nt, hsa
gacaggcacuauaauuucuguaacacacuaacaaaagcaugaaaaauaggaaccacaccaaugc

SEQ ID NO: 159666 - RNA, 64 nt, hsa
uaugaaacuuuccuuugucauuauuagucuucaaaagcaugauuuuuaauaguuguugaguauu

SEQ ID NO: 159667 - RNA, 64 nt, hsa
gacaugaaggcaagaaacagcaaaacaaauacugaagcaugaagauuccugggguggggggaaa

SEQ ID NO: 159668 - RNA, 64 nt, hsa
uugguguagucaugggauuuaggcacugcuaaucaagcaugaagaggaacagaggugauguuag

SEQ ID NO: 159669 - RNA, 64 nt, hsa; identical to SEQ ID NO: 68831

SEQ ID NO: 159670 - RNA, 64 nt, hsa; identical to SEQ ID NO: 68832

SEQ ID NO: 159671 - RNA, 64 nt, hsa; identical to SEQ ID NO: 68833

SEQ ID NO: 159672 - RNA, 64 nt, hsa; identical to SEQ ID NO: 68834

SEQ ID NO: 159673 - RNA, 64 nt, hsa; identical to SEQ ID NO: 68835

SEQ ID NO: 159674 - RNA, 64 nt, hsa; identical to SEQ ID NO: 68836

SEQ ID NO: 159675 - RNA, 64 nt, hsa; identical to SEQ ID NO: 68837

SEQ ID NO: 159676 - RNA, 64 nt, hsa; identical to SEQ ID NO: 68838

SEQ ID NO: 159677 - RNA, 64 nt, hsa; identical to SEQ ID NO: 68839

SEQ ID NO: 159678 - RNA, 64 nt, hsa; identical to SEQ ID NO: 68840

SEQ ID NO: 159679 - RNA, 64 nt, hsa; identical to SEQ ID NO: 68841

SEQ ID NO: 159680 - RNA, 64 nt, hsa; identical to SEQ ID NO: 68842

SEQ ID NO: 159681 - RNA, 64 nt, hsa; identical to SEQ ID NO: 68843

SEQ ID NO: 159682 - RNA, 64 nt, hsa; identical to SEQ ID NO: 68844

SEQ ID NO: 159683 - RNA, 64 nt, hsa; identical to SEQ ID NO: 68845

SEQ ID NO: 159684 - RNA, 64 nt, hsa; identical to SEQ ID NO: 68846

SEQ ID NO: 159685 - RNA, 64 nt, hsa; identical to SEQ ID NO: 68847

SEQ ID NO: 159686 - RNA, 64 nt, hsa; identical to SEQ ID NO: 68848

SEQ ID NO: 159687 - RNA, 64 nt, hsa; identical to SEQ ID NO: 68849

SEQ ID NO: 159688 - RNA, 64 nt, hsa; identical to SEQ ID NO: 68850

SEQ ID NO: 159689 - RNA, 64 nt, hsa; identical to SEQ ID NO: 68851

SEQ ID NO: 159690 - RNA, 64 nt, hsa; identical to SEQ ID NO: 68852

SEQ ID NO: 159691 - RNA, 64 nt, hsa; identical to SEQ ID NO: 68853

SEQ ID NO: 159692 - RNA, 64 nt, hsa; identical to SEQ ID NO: 68854

SEQ ID NO: 159693 - RNA, 64 nt, hsa; identical to SEQ ID NO: 68855

SEQ ID NO: 159694 - RNA, 64 nt, hsa; identical to SEQ ID NO: 68856

SEQ ID NO: 159695 - RNA, 64 nt, hsa; identical to SEQ ID NO: 68857

SEQ ID NO: 159696 - RNA, 64 nt, hsa; identical to SEQ ID NO: 68858

SEQ ID NO: 159697 - RNA, 64 nt, hsa; identical to SEQ ID NO: 68859

SEQ ID NO: 159698 - RNA, 64 nt, hsa; identical to SEQ ID NO: 68860

SEQ ID NO: 159699 - RNA, 64 nt, hsa; identical to SEQ ID NO: 68861

SEQ ID NO: 159700 - RNA, 64 nt, hsa; identical to SEQ ID NO: 68862

SEQ ID NO: 159701 - RNA, 64 nt, hsa; identical to SEQ ID NO: 68863

SEQ ID NO: 159702 - RNA, 64 nt, hsa; identical to SEQ ID NO: 68864

SEQ ID NO: 159703 - RNA, 64 nt, hsa; identical to SEQ ID NO: 68865

SEQ ID NO: 159704 - RNA, 64 nt, hsa; identical to SEQ ID NO: 68866

SEQ ID NO: 159705 - RNA, 64 nt, hsa; identical to SEQ ID NO: 68867

SEQ ID NO: 159706 - RNA, 64 nt, hsa; identical to SEQ ID NO: 68868

SEQ ID NO: 159707 - RNA, 64 nt, hsa; identical to SEQ ID NO: 68869

SEQ ID NO: 159708 - RNA, 64 nt, hsa; identical to SEQ ID NO: 68870

SEQ ID NO: 159709 - RNA, 64 nt, hsa; identical to SEQ ID NO: 68871

SEQ ID NO: 159710 - RNA, 64 nt, hsa; identical to SEQ ID NO: 68872

SEQ ID NO: 159711 - RNA, 64 nt, hsa; identical to SEQ ID NO: 68873

SEQ ID NO: 159712 - RNA, 64 nt, hsa; identical to SEQ ID NO: 68874

SEQ ID NO: 159713 - RNA, 64 nt, hsa; identical to SEQ ID NO: 68875

SEQ ID NO: 159714 - RNA, 64 nt, hsa; identical to SEQ ID NO: 68876

SEQ ID NO: 159715 - RNA, 64 nt, hsa; identical to SEQ ID NO: 68877

SEQ ID NO: 159716 - RNA, 64 nt, hsa; identical to SEQ ID NO: 68877

SEQ ID NO: 159717 - RNA, 64 nt, hsa; identical to SEQ ID NO: 68879

SEQ ID NO: 159718 - RNA, 64 nt, hsa; identical to SEQ ID NO: 68880

SEQ ID NO: 159719 - RNA, 64 nt, hsa; identical to SEQ ID NO: 68881

SEQ ID NO: 159720 - RNA, 64 nt, hsa; identical to SEQ ID NO: 68882

SEQ ID NO: 159721 - RNA, 64 nt, hsa; identical to SEQ ID NO: 68883

SEQ ID NO: 159722 - RNA, 64 nt, hsa; identical to SEQ ID NO: 68884

SEQ ID NO: 159723 - RNA, 64 nt, hsa; identical to SEQ ID NO: 68885

SEQ ID NO: 159724 - RNA, 64 nt, hsa; identical to SEQ ID NO: 68886

SEQ ID NO: 159725 - RNA, 64 nt, hsa; identical to SEQ ID NO: 68887

SEQ ID NO: 159726 - RNA, 64 nt, hsa; identical to SEQ ID NO: 68888

SEQ ID NO: 159727 - RNA, 64 nt, hsa; identical to SEQ ID NO: 68889

SEQ ID NO: 159728 - RNA, 64 nt, hsa; identical to SEQ ID NO: 68890

SEQ ID NO: 159729 - RNA, 64 nt, hsa; identical to SEQ ID NO: 68891

SEQ ID NO: 159730 - RNA, 64 nt, hsa; identical to SEQ ID NO: 68892

SEQ ID NO: 159731 - RNA, 64 nt, hsa; identical to SEQ ID NO: 68893

SEQ ID NO: 159732 - RNA, 64 nt, hsa; identical to SEQ ID NO: 68894

SEQ ID NO: 159733 - RNA, 64 nt, hsa; identical to SEQ ID NO: 68895

SEQ ID NO: 159734 - RNA, 64 nt, hsa; identical to SEQ ID NO: 68896

SEQ ID NO: 159735 - RNA, 64 nt, hsa; identical to SEQ ID NO: 68897

SEQ ID NO: 159736 - RNA, 64 nt, hsa; identical to SEQ ID NO: 68898

SEQ ID NO: 159737 - RNA, 64 nt, hsa; identical to SEQ ID NO: 68899

SEQ ID NO: 159738 - RNA, 64 nt, hsa; identical to SEQ ID NO: 68900

SEQ ID NO: 159739 - RNA, 64 nt, hsa; identical to SEQ ID NO: 68901

SEQ ID NO: 159740 - RNA, 64 nt, hsa; identical to SEQ ID NO: 68902

SEQ ID NO: 159741 - RNA, 64 nt, hsa; identical to SEQ ID NO: 68903

SEQ ID NO: 159742 - RNA, 64 nt, hsa; identical to SEQ ID NO: 68904

SEQ ID NO: 159743 - RNA, 64 nt, hsa; identical to SEQ ID NO: 68905

SEQ ID NO: 159744 - RNA, 64 nt, hsa; identical to SEQ ID NO: 68906

SEQ ID NO: 159745 - RNA, 64 nt, hsa; identical to SEQ ID NO: 68907

SEQ ID NO: 159746 - RNA, 64 nt, hsa; identical to SEQ ID NO: 68908

SEQ ID NO: 159747 - RNA, 64 nt, hsa; identical to SEQ ID NO: 68909

SEQ ID NO: 159748 - RNA, 64 nt, hsa; identical to SEQ ID NO: 68910

SEQ ID NO: 159749 - RNA, 64 nt, hsa; identical to SEQ ID NO: 68911

SEQ ID NO: 159750 - RNA, 64 nt, hsa; identical to SEQ ID NO: 68912

SEQ ID NO: 159751 - RNA, 64 nt, hsa; identical to SEQ ID NO: 68913

SEQ ID NO: 159752 - RNA, 64 nt, hsa; identical to SEQ ID NO: 68914

SEQ ID NO: 159753 - RNA, 64 nt, hsa; identical to SEQ ID NO: 68915

SEQ ID NO: 159754 - RNA, 64 nt, hsa; identical to SEQ ID NO: 68916

SEQ ID NO: 159755 - RNA, 64 nt, hsa; identical to SEQ ID NO: 68917

SEQ ID NO: 159756 - RNA, 64 nt, hsa; identical to SEQ ID NO: 68918

SEQ ID NO: 159757 - RNA, 64 nt, hsa; identical to SEQ ID NO: 68919

SEQ ID NO: 159758 - RNA, 64 nt, hsa; identical to SEQ ID NO: 68920

SEQ ID NO: 159759 - RNA, 64 nt, hsa; identical to SEQ ID NO: 68921

SEQ ID NO: 159760 - RNA, 64 nt, hsa; identical to SEQ ID NO: 68922

SEQ ID NO: 159761 - RNA, 64 nt, hsa; identical to SEQ ID NO: 68923

SEQ ID NO: 159762 - RNA, 64 nt, hsa; identical to SEQ ID NO: 68924

SEQ ID NO: 159763 - RNA, 64 nt, hsa; identical to SEQ ID NO: 68925

SEQ ID NO: 159764 - RNA, 64 nt, hsa; identical to SEQ ID NO: 68926

SEQ ID NO: 159765 - RNA, 64 nt, hsa; identical to SEQ ID NO: 68927

SEQ ID NO: 159766 - RNA, 64 nt, hsa; identical to SEQ ID NO: 68928

SEQ ID NO: 159767 - RNA, 64 nt, hsa; identical to SEQ ID NO: 68929

SEQ ID NO: 159768 - RNA, 64 nt, hsa; identical to SEQ ID NO: 68930

SEQ ID NO: 159769 - RNA, 64 nt, hsa; identical to SEQ ID NO: 68931

SEQ ID NO: 159770 - RNA, 64 nt, hsa; identical to SEQ ID NO: 68932

SEQ ID NO: 159771 - RNA, 64 nt, hsa; identical to SEQ ID NO: 68933

SEQ ID NO: 159772 - RNA, 64 nt, hsa; identical to SEQ ID NO: 68934

SEQ ID NO: 159773 - RNA, 64 nt, hsa; identical to SEQ ID NO: 68935

SEQ ID NO: 159774 - RNA, 64 nt, hsa
uucagcuagggaaagcaguugcgggcaggggguggggggagauuauauucacuccugccaagga

SEQ ID NO: 159775 - RNA, 64 nt, hsa
agccuccuacuucugggauugcagaucagggguggggggagaauguugcauguuguuuucuggu

SEQ ID NO: 159776 - RNA, 64 nt, hsa
ugggcuagggcaggggaggagggagagcaggguugggggagaggcugaggagagugugacaugu

SEQ ID NO: 159777 - RNA, 64 nt, hsa
uaaaaauuguguaagagccaaagaauugguaguagggggagaacagagaggagcugggcuaugg

SEQ ID NO: 159778 - RNA, 64 nt, hsa
uccuaucuccacaucucugaagaaguugaggggugggggagagaaugacuucugccuucaucug

SEQ ID NO: 159779 - RNA, 64 nt, hsa
ggaaaauuuauuuauuuauuguuuauuaguuauggggggagaggggagauuuaaaggaccaggg

SEQ ID NO: 159780 - RNA, 64 nt, hsa
gggcugaagcugcuccaccucauccuugcugagugggggagacauuuucccugaaagucagaag

SEQ ID NO: 159781 - RNA, 64 nt, hsa
aggccuagagcagacccuuuagaaaucagcccaagggggagagcaagagaaaacacucuaggga

SEQ ID NO: 159782 - RNA, 64 nt, hsa
ggucagcacuugggcccacugacagugacugacugggggagaagguccugcagcccccuucccc

SEQ ID NO: 159783 - RNA, 64 nt, hsa
uuccugcaccucaggaugggcgagggugggcauugggggagagggggaccugggaccugcggcu

SEQ ID NO: 159784 - RNA, 64 nt, hsa
gauagauuacagauauaauaaccauguugacuaugggggagagacgcugcauuccagaaacguc

SEQ ID NO: 159785 - RNA, 64 nt, hsa
ugugcuacugaagggaacugccuuucccccuucugggggagacuuaacagagcguggaaggggg

SEQ ID NO: 159786 - RNA, 64 nt, hsa
gauuugcugcaaaaugacccagaggcaggggucagggggagagguagagaugagacaagaggua

SEQ ID NO: 159787 - RNA, 64 nt, hsa
ggugcagggccuaggucucuuccaggugggggaggggggagagucaggaauaaggggaucccca

SEQ ID NO: 159788 - RNA, 64 nt, hsa
cuuuugcccugcgcacaauugcaucugaaugugcgggggagagggcugggggccggagggcagg

SEQ ID NO: 159789 - RNA, 64 nt, hsa
agucuguccgacaggaagcugcuggguggggguggggggagaaaaggcagauaauuaaaccauc

SEQ ID NO: 159790 - RNA, 64 nt, hsa
cagaggcugcugccaccuacuucuuaucaaagaagggggagaacaguucaucugagucagugca

SEQ ID NO: 159791 - RNA, 64 nt, hsa
cagcuaugcuuuuggaguccuggaugggaaucuggggggagagaggaaggacaggucaggucuc

SEQ ID NO: 159792 - RNA, 64 nt, hsa
uuucuuguaagccaucagaaguuacuuuuaggaugggggagaggggcgagaaggggaaaaaugg

SEQ ID NO: 159793 - RNA, 64 nt, hsa
gaguccuuaagacggaaguaaauuaugauguccagggggagaaggaagauaggacguauuuaua

SEQ ID NO: 159794 - RNA, 64 nt, hsa
ccgcgugcuggagaauugacugaagcacagcaccgggggagagggacacuccuccucggaagag

SEQ ID NO: 159795 - RNA, 64 nt, hsa
gagcagggugcugugggugauauggacagcagaagggggagaccaagguuccagcucaaccaau

SEQ ID NO: 159796 - RNA, 64 nt, hsa
cugagaccccccaccaccagccgguaccugggaagggggagagugcaggccugcucagggacug

SEQ ID NO: 159797 - RNA, 64 nt, hsa
auggaccuacauccccagcagauggggguggcaagggggagacgggugggggucgcugacuaua

SEQ ID NO: 159798 - RNA, 64 nt, hsa
gaugaccgcgauggccugcagcaacucuaugguagggggagagggaccugccgcgaaaccauca

SEQ ID NO: 159799 - RNA, 64 nt, hsa
uuuguuaaaucaaauuagcuggucucugaauuaagggggagacgaccuucucuaagaugaacag

SEQ ID NO: 159800 - RNA, 64 nt, hsa
aggaauccuggucucaggaccucauggaagaagagggggagagaguuacagguuggacaugaug

SEQ ID NO: 159801 - RNA, 64 nt, hsa
aacaacaaaaugagaagaagagguuccucgaaaggggggagaagaaauuuugagaauggaaaaa

SEQ ID NO: 159802 - RNA, 64 nt, hsa
uccagcuucuucccccagcugcucccgaccaggagggggagagcagccuccacuuaccccaccc

SEQ ID NO: 159803 - RNA, 64 nt, hsa
ccuccuuggcuuggcuuugcugcugcuuguaguugggggagaggugccccccuccuccuugaga

SEQ ID NO: 159804 - RNA, 64 nt, hsa
agauggguccccugggguagaugcauuguggguggggggagaaagcuuguggcuccuguccgag

SEQ ID NO: 159805 - RNA, 64 nt, hsa
ccuaaaaagcauguagaugggggagaaauggguggggggagaggaacagccauuaacacaguau

SEQ ID NO: 159806 - RNA, 64 nt, hsa
aaggggagagguuuggccuaaaaagcauguagaugggggagaaauggguggggggagaggaaca

SEQ ID NO: 159807 - RNA, 64 nt, hsa
uuauaugggcuuuuaaguaaagcuuagaacccuggggggagaaaagcagucaggugagguuuga

SEQ ID NO: 159808 - RNA, 64 nt, hsa
ccaguaauccucuucuguggugggaugggagggugggggagagggguggaauggagaggaaaca

SEQ ID NO: 159809 - RNA, 64 nt, hsa
gagagauacagagccggcuuagagaacagcuguugggggagaagagggcaccccucaucuugga

SEQ ID NO: 159810 - RNA, 64 nt, hsa
cucccuggcuugggagaccgcucucugcaagggagggggagagaagcagagggagagagaaggu

SEQ ID NO: 159811 - RNA, 64 nt, hsa
gagggcaggagggcucggccugagcagggugcuggggggagagcgcaauaccucacgcgggcug

SEQ ID NO: 159812 - RNA, 64 nt, hsa
gccaccucguugcacuggaucccaguggcugcuugggggagaggcguuugccaucacugguguu

SEQ ID NO: 159813 - RNA, 64 nt, hsa
gagggagccgcacacuuggacuugagaguuugccagcagcgagcucggaugcaucucuccaaaa

SEQ ID NO: 159814 - RNA, 64 nt, hsa
agaugaguuccgacacugucacggcuguguucccagcagcgaaggccucugcggagcugccagu

SEQ ID NO: 159815 - RNA, 64 nt, hsa
aacucuggcuggacaagggucagucuucggggucagcagcgagauugcucugcagccagugagg

SEQ ID NO: 159816 - RNA, 64 nt, hsa
uuugguguguaugcaccuuggcagccagcaggaaagcagcgaagagccgcgcgcccucuggccu

SEQ ID NO: 159817 - RNA, 64 nt, hsa
ggaaaacgacauuauaugugacuuaaaaccuagaagaaauaaauaaaacuauugaucaauuuua

SEQ ID NO: 159818 - RNA, 64 nt, hsa
guauaaaaacaacuguauugaguugaggcuguggagaaauaaggacacauauaugggaauggaa

SEQ ID NO: 159819 - RNA, 64 nt, hsa
acuccgucucgaaaaaaaaaaaaaguauaaggagagaaauaacuuuaaaguuuauuagacaaaa

SEQ ID NO: 159820 - RNA, 64 nt, hsa
cccagguagcagaacucacguucccacuauagcaagaaauaaaggcaaaagagaacaucuuuuu

SEQ ID NO: 159821 - RNA, 64 nt, hsa
ccaguuuucuaucacuuuaaauuuuacuauggaaagaaauaacaaaugacaugugggaauugca

SEQ ID NO: 159822 - RNA, 64 nt, hsa
guugauacuuuaaaucucuucagcauguaucuguagaaauaacuuuuuaguuaauggaagaauu

SEQ ID NO: 159823 - RNA, 64 nt, hsa
aagccugugagucaagcaucaagugguguuuguuagaaauaaacuagagauuuuuaaacucuga

SEQ ID NO: 159824 - RNA, 64 nt, hsa
ucaucccauucugguucccguucaaguucaaaaaagaaauaauguauuaaaauuuacaucuuaa

SEQ ID NO: 159825 - RNA, 64 nt, hsa
uaaugguuuauuauagaauaccaauguauagcuuagaaauaaaacuuugaauauuucaagaaua

SEQ ID NO: 159826 - RNA, 64 nt, hsa
aguuuaagcuuuauucauucaugcaauacuaaagagaaauaagaauacugcaauuuugugcugg

SEQ ID NO: 159827 - RNA, 64 nt, hsa
gugacgacaaagauucuguuucaaauauagccacagaaauaaaggagggaccaauaucugggac

SEQ ID NO: 159828 - RNA, 64 nt, hsa
gugacgagaaagauucuguuucaaauauagccacagaaauaaagaagggacaacaaucugggac

SEQ ID NO: 159829 - RNA, 64 nt, hsa
gugacaagacagauucugcuuugaauauagcuacagaaauaaaggauggacuacagugugggac

SEQ ID NO: 159830 - RNA, 64 nt, hsa
cugacgaggaagacucuguuucgaauauagccacagaaauaaaggauggagaaaaaucugggac

SEQ ID NO: 159831 - RNA, 64 nt, hsa
cugaugagaaagauucuguuucgaacauagccacagaaauaaaggauggagaaaaaucugggac

SEQ ID NO: 159832 - RNA, 64 nt, hsa
aaugaucaguaugcugugccagcuucauuuggggagaaauaacuaguagaaaguucugggugug

SEQ ID NO: 159833 - RNA, 64 nt, hsa
guaccuacuugaaaggaucauugugcggauuaaaagaaauaauauauguaaagcacuuuaacac

SEQ ID NO: 159834 - RNA, 64 nt, hsa
cuguaaauacucuugcuguguuauaaauauggcaagaaauaaacaugaccaauaucaauagacu

SEQ ID NO: 159835 - RNA, 64 nt, hsa
aucaauagacuucuugaggcuacuauaaguuuugagaaauaagguucaaaaaauaagaaugcua

SEQ ID NO: 159836 - RNA, 64 nt, hsa
cgucgcauuuaauaacaagcaacacacggcauauagaaauaacuuuaauuaaaaaacuuacaua

SEQ ID NO: 159837 - RNA, 64 nt, hsa
ugcaugaguauaacaauuuugauacugcucauuuagaaauaaaucaucugguuguuccuccagg

SEQ ID NO: 159838 - RNA, 61 nt, hsa
auaaaaaauucaguaguuaggggcagggaggagaaauaaaguggugauagucugguguuac

SEQ ID NO: 159839 - RNA, 64 nt, hsa
gaguauauuuucaagccaagaaccaguagaaaacagaaauaauggugcucccaaauauucagua

SEQ ID NO: 159840 - RNA, 64 nt, hsa
accaguuggguuuuuugcguccuuuuggaaucacagaaauaaacaaguagguuucaguugucuu

SEQ ID NO: 159841 - RNA, 64 nt, hsa
acuugagggggacgucccaaaauuaaaggaauggagaaauaaucaaaaucauguauaccaucuu

SEQ ID NO: 159842 - RNA, 64 nt, hsa
gugagcaguagaagagaccacauuuacagucaauagaaauaaugaaaaaaaauuagguguuuag

SEQ ID NO: 159843 - RNA, 64 nt, hsa
aaaccuuuauuuuaaagucaaguugugagcaaauagaaauaaaagacaaaaggacaucacucuu

SEQ ID NO: 159844 - RNA, 64 nt, hsa
auuuaugaauuauaaauaugaauuuaauuacuaaagaaauaaaaauaaugguguaaagccaacu

SEQ ID NO: 159845 - RNA, 64 nt, hsa
gaaucugaauaagcuuccaaaauuuuuuuuuuuaagaaauaaagggagcuguguagugggucag

SEQ ID NO: 159846 - RNA, 64 nt, hsa
guuccacauuuggaagacaauuuaaugauggugaagaaauaauaaaccucacuuuacuuguuaa

SEQ ID NO: 159847 - RNA, 64 nt, hsa
auauauauauauauauaugucugcaacuucagggagaaauaagauuguguuugaauauuguagg

SEQ ID NO: 159848 - RNA, 64 nt, hsa
agacauaauaagagguguaaaaacuaucacaggaagaaauaaaaacagauuuuugaaggugaga

SEQ ID NO: 159849 - RNA, 64 nt, hsa
uccaaagaaagcagaaagaaggaaagccuagaacagaaauaaaugaaauagagaauagaaaagc

SEQ ID NO: 159850 - RNA, 64 nt, hsa
gaaacaaaagucaagauuuuauuaccaaacuuauagaaauaaaaauuauuagaaagaaauacua

SEQ ID NO: 159851 - RNA, 64 nt, hsa
cuguaaagucuauucuguuuaacaauaagaaauaagaaauaauuuuuuucaaauaagaaaauug

SEQ ID NO: 159852 - RNA, 64 nt, hsa
guuguuacuguaaagucuauucuguuuaacaauaagaaauaagaaauaauuuuuuucaaauaag

SEQ ID NO: 159853 - RNA, 64 nt, hsa
uccauacaauggacuauauuauucagccauaaaaagaaauaaagggccaggcacaguggcucac

SEQ ID NO: 159854 - RNA, 64 nt, hsa
uuuccucuucuggucuuuccucuucuguuuauggagaaauaauagaaaguaguaagucguuaac

SEQ ID NO: 159855 - RNA, 64 nt, hsa
uuaagaauacuaaaguauuuuuaaaaaucaaggaagaaauaaauguuacacaauuugcauugga

SEQ ID NO: 159856 - RNA, 64 nt, hsa
uaccaguaauacacuaaauuuucaagguguguagagaaauaauauggaauuagcagcuaugacu

SEQ ID NO: 159857 - RNA, 64 nt, hsa
uggcuuacugugucugaagauacugacaugcagaagaaauaagugcauucuucugcuuuucacc

SEQ ID NO: 159858 - RNA, 64 nt, hsa
ggguugauuuuuuugcucuccauuuugacuugcaagaaauaauaccucaagauaaucugauuua

SEQ ID NO: 159859 - RNA, 64 nt, hsa
uggagauguugaaaaucauuuucccuucuuaaacagaaauaaauauuuggaaugaaggggaaug

SEQ ID NO: 159860 - RNA, 64 nt, hsa
ccuugaaaaacaaagaccuaaaaagccuuuuuuaagaaauaaauuuuuuguucacaugaccaaa

SEQ ID NO: 159861 - RNA, 64 nt, hsa
cacaguggaacgcaggcugagaacgcagggaaggagaaauaaagaguaaagccagaggccauua

SEQ ID NO: 159862 - RNA, 64 nt, hsa
gugauuuaaaacguuuguugagauuuucaaacauagaaauaaagcuguagcauauucacuaaac

SEQ ID NO: 159863 - RNA, 64 nt, hsa
gccuguuuuguaauucagggccuauuaugauuuuagaaauaagauaaucaacguacaacucuuu

SEQ ID NO: 159864 - RNA, 64 nt, hsa
aagucacuaucuuauguuuucuuuuggauuggaaagaaauaaagcuccuaguaaaguuauucau

SEQ ID NO: 159865 - RNA, 64 nt, hsa
acuucuuuggugauacacuguagccacuagaaagagaaauaaacccaauggcauguguuuacag

SEQ ID NO: 159866 - RNA, 64 nt, hsa
aaccuaacuuuaguagcaaaucuugauuaauugaagaaauaaaauauuucggauaagguuucau

SEQ ID NO: 159867 - RNA, 64 nt, hsa
ccccaucuacuauaaagaaaugucuucgagauguagaaauaaggaauauucugaaaauaaaaau

SEQ ID NO: 159868 - RNA, 64 nt, hsa
cugcaggagugcccugcauuguuuucuuuuaauuagaaauaaaaaguauuagucuaaauguggu

SEQ ID NO: 159869 - RNA, 64 nt, hsa
uuuugaucacuucaaauacauacucuucaagucaagaaauaaauuucuuuacauagaaaaggau

SEQ ID NO: 159870 - RNA, 64 nt, hsa
uuaucguauucauacuacuguucaaucuuuauuuagaaauaaacuuuaucuaugauuucauuuu

SEQ ID NO: 159871 - RNA, 64 nt, hsa
aggauaauacaguccaugcaaaguagggucauagagaaauaaaagcaugcccucagcuuuuaau

SEQ ID NO: 159872 - RNA, 64 nt, hsa
ucuuacaauuauuaauuauuuuauuuucauguuuagaaauaaucacaccccaauaguuuccuag

SEQ ID NO: 159873 - RNA, 64 nt, hsa
caaggcacugauaaaaccgcaacaaaaacauguaagaaauaaaauagaaaugcuuuauauaauu

SEQ ID NO: 159874 - RNA, 64 nt, hsa
ucuuuuuguguuuggaguguaguccauuugcaauagaaauaaaaaaauccgucaccaaauugua

SEQ ID NO: 159875 - RNA, 64 nt, hsa
cauugcuaaaauaaaaaauacaccuuaauuuuuaagaaauaauuuaaaugaaacaauuuccauu

SEQ ID NO: 159876 - RNA, 64 nt, hsa
uuuuuauauauugguguaaacauaauauucuucaagaaauaauguugaaagccuacucaggaau

SEQ ID NO: 159877 - RNA, 64 nt, hsa
acugucuggggaugugugguuauaguucugugggagaaauaauuuugucaguguucaccagcuu

SEQ ID NO: 159878 - RNA, 64 nt, hsa
uaauuuugaaccaauuuauuauuguguacugaggagaaauaauguauaguagaggacagccuug

SEQ ID NO: 159879 - RNA, 64 nt, hsa
auuauuuuauguugugccagugaauccaguugccagaaauaagucugaauguuuucaugcaucu

SEQ ID NO: 159880 - RNA, 64 nt, hsa
uguaaugugacccuagaaaacuguagcaagcuucagaaauaaaucuuuugaucuuucccuaucu

SEQ ID NO: 159881 - RNA, 64 nt, hsa
ccuugaucuuggacuuccagccuccaaaacuaugagaaauaaauuucuauuguuuaagucaccc

SEQ ID NO: 159882 - RNA, 64 nt, hsa
auaucaaauaaguaucacaaaucuuuuacgcagaagaaauaaaaacuacggguagaaaacauaa

SEQ ID NO: 159883 - RNA, 64 nt, hsa
aaagaguauugaaggaacaacaaauaacaauagcagaaauaacagugugacauaaagugcccuu

SEQ ID NO: 159884 - RNA, 64 nt, hsa
acaaacaaacaaacaaaaaacaaccuuagcauuaagaaauaaaaacaaaaaacaagaagcaagu

SEQ ID NO: 159885 - RNA, 64 nt, hsa
gaaaaugaagagagaggguuuuaccauccugagaagaaauaaugauggaaacauguuuaauguu

SEQ ID NO: 159886 - RNA, 64 nt, hsa
auaacacugaccucuggaaaauauuuuguucacaagaaauaauaaaguauaaugauuuguugca

SEQ ID NO: 159887 - RNA, 64 nt, hsa
ccaagccagauagucucgugaacagugacaauacagaaauaagguguuauuucuguucagaucu

SEQ ID NO: 159888 - RNA, 64 nt, hsa
aaccaguuaaguuauaccuguugcuauuuugcaaagaaauaauuauaguuuuuauuuacccauu

SEQ ID NO: 159889 - RNA, 64 nt, hsa
uuacaccaacugugcaaaugaacuuugauaaaauagaaauaaucuacauuggccuuugugaaau

SEQ ID NO: 159890 - RNA, 64 nt, hsa
guagaauaacuccugaguuuauaucaaauccugaagaaauaagccucaguuuuccaucuguuuu

SEQ ID NO: 159891 - RNA, 64 nt, hsa
uuugaaucugucuuagccaguuccuguagaacugagaaauaagauugacuuugaaucugcaaca

SEQ ID NO: 159892 - RNA, 64 nt, hsa
auuugaaauaauuguauuucucugaauucagugaagaaauaauucaugauucaacugcaucucc

SEQ ID NO: 159893 - RNA, 64 nt, hsa
auucaguacaagagaaguacuguaagcaguaccuagaaauaaucucuaaaauugcuauccugau

SEQ ID NO: 159894 - RNA, 64 nt, hsa
aaugugguauucauucacuuaaagguaccucuguagaaauaaccuaaaacugcagaaggaucug

SEQ ID NO: 159895 - RNA, 64 nt, hsa
cacuuuucuuucuccacccacucaguugucuagaagaaauaacacuguaaggaaauuuaaaaaa

SEQ ID NO: 159896 - RNA, 64 nt, hsa
acaugaaaauauuccuuaguagaauguauauuuaagaaauaaaacaacaaaggggaacuauauc

SEQ ID NO: 159897 - RNA, 64 nt, hsa
ugcagaaaaguugauugcaaagugugguagaaaaagaaauaaugguagcaguagagaauuuaua

SEQ ID NO: 159898 - RNA, 64 nt, hsa
ggugcgcgccaggauguggacuacugagcccugaagaaauaaguccuuccacuuugaccccaug

SEQ ID NO: 159899 - RNA, 64 nt, hsa
aagagcaaacacauucaaaagcuagcagaaggcaagaaauaacuaagauccgagcagaacugaa

SEQ ID NO: 159900 - RNA, 64 nt, hsa
ugaaugaguacuggguacauaacgaaaugaaggcagaaauaaagauauucucugaaagcaauga

SEQ ID NO: 159901 - RNA, 64 nt, hsa
aaaggcgaacucugccuuggagagguagaugauaagaaauaaaaagguguuuauaacuauuuug

SEQ ID NO: 159902 - RNA, 64 nt, hsa
guguuucaggaugauacaaagaaaaauauagaauagaaauaagugcaggcuuggaaucagcuac

SEQ ID NO: 159903 - RNA, 64 nt, hsa
cuguugucuaaagccaaggagucauaaaaccaugagaaauaaauaggaaucaauaguuaguagu

SEQ ID NO: 159904 - RNA, 64 nt, hsa
aagacaaaaugcuaugacuuugaaauucacagaaagaaauaacaguuuagauuaggucuucagg

SEQ ID NO: 159905 - RNA, 64 nt, hsa
acugguguuaagauauauuuugaguggauggaggagaaauaaacuuauuccuccuuaaaaaaaa

SEQ ID NO: 159906 - RNA, 64 nt, hsa
cugaccugcugugcaccuuacauuccuagagagcagaaauaaaaagcaugacuauuuccaccau

SEQ ID NO: 159907 - RNA, 64 nt, hsa
augcuuacugcguagaauuuuaucuacuuguuccagaaauaauacauuaaccaaaaaggauuua

SEQ ID NO: 159908 - RNA, 64 nt, hsa
cuauccauaaugggauucaccuccaaauuaucaaagaaauaacucagaguaauuugacaccagc

SEQ ID NO: 159909 - RNA, 64 nt, hsa
cccgacucaacccggccguugcuucuguauauagagaaauaaguuauuggccgcgcgccucccu

SEQ ID NO: 159910 - RNA, 64 nt, hsa
aggcggcugcucucauauuuucagauguugcuguagaaauaaagacgguuuaaaucugagcugg

SEQ ID NO: 159911 - RNA, 64 nt, hsa
auuuuuucuuucuguacagaaauagaaaagcauuagaaauaacuucuaaccauccucugaaaaa

SEQ ID NO: 159912 - RNA, 64 nt, hsa
cugggauggcucucucaucauacucuuguuucuuagaaauaagcaagacagagcaggaaaugga

SEQ ID NO: 159913 - RNA, 64 nt, hsa
cagaaucaugugagaacucaggaagagguagagcagaaauaaaaaggaagaaaauguagauuag

SEQ ID NO: 159914 - RNA, 64 nt, hsa
ggcaagaucaaagcauacauuggaaauaaacaguagaaauaagcaaacaauauaaagagacacg

SEQ ID NO: 159915 - RNA, 64 nt, hsa
uauuagugcaauaaggugaaggcugucugcccagagaaauaaguaauuuauauaagaaaauaaa

SEQ ID NO: 159916 - RNA, 64 nt, hsa
acaaaugagcaaaagaugaguccuugcuucccucagaaauaaaaggagcucagcugcagcguug

SEQ ID NO: 159917 - RNA, 64 nt, hsa
uugagagguuuccuuuuauuaacuuuuaaaauaaagaaauaaguaguuucauuacgauuauuuu

SEQ ID NO: 159918 - RNA, 64 nt, hsa
aaucuaaaacugcgaagaauacuaaauguaguugagaaauaauugauggcgagaguuugcuagu

SEQ ID NO: 159919 - RNA, 64 nt, hsa
ucauuauuuuaaguugaauuugaauaaagauuccagaaauaaacauggagcucaguauucagga

SEQ ID NO: 159920 - RNA, 64 nt, hsa
ggagagcuuauuggugagagaggauggagcuaagagaaauaagaucaaauauuaaaauuaggaa

SEQ ID NO: 159921 - RNA, 64 nt, hsa
aagauguaugcaguuguccuaucacaguuauauuagaaauaacaacuaguguggaaaguaaccc

SEQ ID NO: 159922 - RNA, 64 nt, hsa
caccuggcagaaaaguaacugccaaguaagauuaagaaauaaguugagcauuucuggaguauau

SEQ ID NO: 159923 - RNA, 64 nt, hsa
uuuuuuuugguauuaaaaaaaucauaaaaauaaaagaaauaaugcaauuuaaccuucacaguua

SEQ ID NO: 159924 - RNA, 64 nt, hsa
agucaucagaaaaauacauuaggaaaauguguuuagaaauaaaagcacaaggcagggcagugcu

SEQ ID NO: 159925 - RNA, 64 nt, hsa
auucuuuaucagcaagcauucauggccauucagaagaaauaaauuagguaacuugauaauaagg

SEQ ID NO: 159926 - RNA, 64 nt, hsa
uucaauauucaaguuacaaauguauaaggcaguuagaaauaauacagucacaugucacuuaaug

SEQ ID NO: 159927 - RNA, 64 nt, hsa
aaaaugcuuugagagguaauuacuugcauaugagagaaauaaaacauuuggcacauuguuuaca

SEQ ID NO: 159928 - RNA, 64 nt, hsa
uguaacauuuugauuugauuuaaucuccagggacagaaauaauucauugguaaaguguaauaau

SEQ ID NO: 159929 - RNA, 64 nt, hsa
uguuuccaauucagguacaaguauguuuuaaagaagaaauaaguuucccaaucagccaauuuaa

SEQ ID NO: 159930 - RNA, 64 nt, hsa
uuaguuuuaacuuuucaaaguuuggccuccuauuagaaauaaucaugucucagaugaguaaugu

SEQ ID NO: 159931 - RNA, 64 nt, hsa
uggaaguccucgccacagcaaucaggcaagagaaagaaauaaaaggcaaccaaaaagaaaggaa

SEQ ID NO: 159932 - RNA, 64 nt, hsa
gacacauagaucaauggaacagaauagagggcccagaaauaaagcuacacaccuacaaccaucu

SEQ ID NO: 159933 - RNA, 64 nt, hsa
aacccccauucccugguguccuucuuagagaugaagaaauaauaaggaaacaucuuucauagcc

SEQ ID NO: 159934 - RNA, 64 nt, hsa
auaagaacccugaaauuuauauaggugagacaauagaaauaaaaagaucuucagccaggccuuu

SEQ ID NO: 159935 - RNA, 64 nt, hsa
uuuuugguauauugcuguaucuacuuuaacuuccagaaauaaacguuauauaggaaccgucuga

SEQ ID NO: 159936 - RNA, 64 nt, hsa
ggacuaucuaagcccuagguuucuuuuuaaauuaagaaauaauaacaauuaaagggcaaaaaac

SEQ ID NO: 159937 - RNA, 64 nt, hsa
caugauugaagccuuuggcugaaacuuuauacauagaaauaaugauuugcucauaacagguauc

SEQ ID NO: 159938 - RNA, 64 nt, hsa
uuuuaugaaaauuaaguacagaggcugcgaucuuagaaauaaugaaggugccauuuggcugcuc

SEQ ID NO: 159939 - RNA, 64 nt, hsa
cauauccagccaaacuaagcuucauaagugaaggagaaauaaaauacuuuacagacaagcaaau

SEQ ID NO: 159940 - RNA, 64 nt, hsa
aagagcaaacacagucaaaaacuagcagaaggcaagaaauaacuaaaaucagcagaacucaagg

SEQ ID NO: 159941 - RNA, 64 nt, hsa
gagauauagaucaauagaacagaacagagcccucagaaauaaugccacauaucuacaacuaucu

SEQ ID NO: 159942 - RNA, 64 nt, hsa
gaaaacaguauggcagauccccagauuaaaauauagaaauaacauaugaucagcauuuccauuu

SEQ ID NO: 159943 - RNA, 64 nt, hsa
cuugauauuggacuucccagccucccaaaccaugagaaauaaauguuuguugauuaauuaagcu

SEQ ID NO: 159944 - RNA, 64 nt, hsa
gauuacauggauguuaaauuauauggagacgcuaagaaauaauugauggagccauugaugcaaa

SEQ ID NO: 159945 - RNA, 64 nt, hsa
uuuaagcuuguuuuaauggucaaaaaauuaggacagaaauaauauggacauuuauuaguaucuu

SEQ ID NO: 159946 - RNA, 64 nt, hsa
auuuauauugguaaaauagccaguagaauaugaaagaaauaagguuaguagugaaauucauucu

SEQ ID NO: 159947 - RNA, 64 nt, hsa
cuugaucuuggacuucucagccuccagaauugugagaaauaaauuucuguuguugauaaaccac

SEQ ID NO: 159948 - RNA, 64 nt, hsa
ugaagucauagaaaauagguaacuaucuaauuagagaaauaauuguuguauuuuaagaucugag

SEQ ID NO: 159949 - RNA, 64 nt, hsa
agaauuuauaugaaagauuuguaucauuagagccagaaauaauuuuauauuaauauauaauaca

SEQ ID NO: 159950 - RNA, 64 nt, hsa
cuuuuuacuuuaauaguuuaguguaaaguacaucagaaauaaagcuguaucugccauuuuaagc

SEQ ID NO: 159951 - RNA, 64 nt, hsa
caucaaacagaauuuuaaggaaaaaugcagagggagaaauaaggcacaugacugcuucuugcag

SEQ ID NO: 159952 - RNA, 64 nt, hsa
cuuuuuacuuuaauaguuuaguguaaaguacaucagaaauaaaacuguaucugacauuuuaagc

SEQ ID NO: 159953 - RNA, 64 nt, hsa; identical to SEQ ID NO: 159951

SEQ ID NO: 159954 - RNA, 64 nt, hsa
aggaaggaggcagagcuguccgugggagguggaggccgaggacauuuuccugaagggcaggggu

SEQ ID NO: 159955 - RNA, 64 nt, hsa
cuacucaggaggcugaggugggaggaucccuugagccgaggaguuugagucugcagugagcuau

SEQ ID NO: 159956 - RNA, 64 nt, hsa
ucugcagucccuuccccgcccgcccugccagaaggccgaggaggcacguggagggccuccuucc

SEQ ID NO: 159957 - RNA, 64 nt, hsa
accacuguccacugaccagaaaccuggcugcagggccgaggacugguuuggggacuggagggcu

SEQ ID NO: 159958 - RNA, 64 nt, hsa
ugggcuuggacacuugccguggugccccuggcuggccgaggagacuggcucuggccaggggccc

SEQ ID NO: 159959 - RNA, 64 nt, hsa
ugggcucucagcuauuucuaguugcuucccagaagccgaggagcagaaggagcugugagagcuu

SEQ ID NO: 159960 - RNA, 64 nt, hsa; identical to SEQ ID NO: 108616

SEQ ID NO: 159961 - RNA, 64 nt, hsa; identical to SEQ ID NO: 108617

SEQ ID NO: 159962 - RNA, 64 nt, hsa; identical to SEQ ID NO: 108618

SEQ ID NO: 159963 - RNA, 64 nt, hsa; identical to SEQ ID NO: 108619

SEQ ID NO: 159964 - RNA, 64 nt, hsa; identical to SEQ ID NO: 108620

SEQ ID NO: 159965 - RNA, 64 nt, hsa; identical to SEQ ID NO: 108621

SEQ ID NO: 159966 - RNA, 64 nt, hsa; identical to SEQ ID NO: 108622

SEQ ID NO: 159967 - RNA, 64 nt, hsa; identical to SEQ ID NO: 108623

SEQ ID NO: 159968 - RNA, 61 nt, hsa; identical to SEQ ID NO: 108624

SEQ ID NO: 159969 - RNA, 64 nt, hsa; identical to SEQ ID NO: 108625

SEQ ID NO: 159970 - RNA, 64 nt, hsa; identical to SEQ ID NO: 108626

SEQ ID NO: 159971 - RNA, 64 nt, hsa; identical to SEQ ID NO: 108627

SEQ ID NO: 159972 - RNA, 64 nt, hsa; identical to SEQ ID NO: 108628

SEQ ID NO: 159973 - RNA, 64 nt, hsa; identical to SEQ ID NO: 108629

SEQ ID NO: 159974 - RNA, 64 nt, hsa; identical to SEQ ID NO: 108630

SEQ ID NO: 159975 - RNA, 64 nt, hsa; identical to SEQ ID NO: 108631

SEQ ID NO: 159976 - RNA, 64 nt, hsa; identical to SEQ ID NO: 108632

SEQ ID NO: 159977 - RNA, 64 nt, hsa; identical to SEQ ID NO: 108633

SEQ ID NO: 159978 - RNA, 64 nt, hsa; identical to SEQ ID NO: 108634

SEQ ID NO: 159979 - RNA, 64 nt, hsa; identical to SEQ ID NO: 108635

SEQ ID NO: 159980 - RNA, 64 nt, hsa; identical to SEQ ID NO: 108636

SEQ ID NO: 159981 - RNA, 64 nt, hsa; identical to SEQ ID NO: 108637

SEQ ID NO: 159982 - RNA, 64 nt, hsa; identical to SEQ ID NO: 108638

SEQ ID NO: 159983 - RNA, 64 nt, hsa; identical to SEQ ID NO: 108639

SEQ ID NO: 159984 - RNA, 64 nt, hsa; identical to SEQ ID NO: 108640

SEQ ID NO: 159985 - RNA, 64 nt, hsa; identical to SEQ ID NO: 108641

SEQ ID NO: 159986 - RNA, 64 nt, hsa; identical to SEQ ID NO: 108642

SEQ ID NO: 159987 - RNA, 64 nt, hsa; identical to SEQ ID NO: 108643

SEQ ID NO: 159988 - RNA, 64 nt, hsa; identical to SEQ ID NO: 108644

SEQ ID NO: 159989 - RNA, 64 nt, hsa; identical to SEQ ID NO: 108645

SEQ ID NO: 159990 - RNA, 64 nt, hsa; identical to SEQ ID NO: 108646

SEQ ID NO: 159991 - RNA, 64 nt, hsa; identical to SEQ ID NO: 108647

SEQ ID NO: 159992 - RNA, 64 nt, hsa; identical to SEQ ID NO: 108648

SEQ ID NO: 159993 - RNA, 64 nt, hsa; identical to SEQ ID NO: 108649

SEQ ID NO: 159994 - RNA, 64 nt, hsa; identical to SEQ ID NO: 108650

SEQ ID NO: 159995 - RNA, 64 nt, hsa; identical to SEQ ID NO: 108651

SEQ ID NO: 159996 - RNA, 64 nt, hsa; identical to SEQ ID NO: 108652

SEQ ID NO: 159997 - RNA, 64 nt, hsa; identical to SEQ ID NO: 108653

SEQ ID NO: 159998 - RNA, 64 nt, hsa; identical to SEQ ID NO: 108654

SEQ ID NO: 159999 - RNA, 64 nt, hsa; identical to SEQ ID NO: 108655

SEQ ID NO: 160000 - RNA, 64 nt, hsa; identical to SEQ ID NO: 108656

SEQ ID NO: 160001 - RNA, 64 nt, hsa; identical to SEQ ID NO: 108657

SEQ ID NO: 160002 - RNA, 64 nt, hsa; identical to SEQ ID NO: 108658

SEQ ID NO: 160003 - RNA, 64 nt, hsa; identical to SEQ ID NO: 108659

SEQ ID NO: 160004 - RNA, 64 nt, hsa; identical to SEQ ID NO: 108660

SEQ ID NO: 160005 - RNA, 64 nt, hsa; identical to SEQ ID NO: 108661

SEQ ID NO: 160006 - RNA, 64 nt, hsa; identical to SEQ ID NO: 108662

SEQ ID NO: 160007 - RNA, 64 nt, hsa; identical to SEQ ID NO: 108663

SEQ ID NO: 160008 - RNA, 64 nt, hsa; identical to SEQ ID NO: 108664

SEQ ID NO: 160009 - RNA, 64 nt, hsa; identical to SEQ ID NO: 108665

SEQ ID NO: 160010 - RNA, 64 nt, hsa; identical to SEQ ID NO: 108666

SEQ ID NO: 160011 - RNA, 64 nt, hsa; identical to SEQ ID NO: 108667

SEQ ID NO: 160012 - RNA, 64 nt, hsa; identical to SEQ ID NO: 108668

SEQ ID NO: 160013 - RNA, 64 nt, hsa; identical to SEQ ID NO: 108669

SEQ ID NO: 160014 - RNA, 64 nt, hsa; identical to SEQ ID NO: 108670

SEQ ID NO: 160015 - RNA, 64 nt, hsa; identical to SEQ ID NO: 108671

SEQ ID NO: 160016 - RNA, 64 nt, hsa; identical to SEQ ID NO: 108672

SEQ ID NO: 160017 - RNA, 64 nt, hsa; identical to SEQ ID NO: 108673

SEQ ID NO: 160018 - RNA, 64 nt, hsa; identical to SEQ ID NO: 108674

SEQ ID NO: 160019 - RNA, 64 nt, hsa; identical to SEQ ID NO: 108675

SEQ ID NO: 160020 - RNA, 64 nt, hsa; identical to SEQ ID NO: 108676

SEQ ID NO: 160021 - RNA, 64 nt, hsa; identical to SEQ ID NO: 108677

SEQ ID NO: 160022 - RNA, 64 nt, hsa; identical to SEQ ID NO: 108678

SEQ ID NO: 160023 - RNA, 64 nt, hsa; identical to SEQ ID NO: 108679

SEQ ID NO: 160024 - RNA, 64 nt, hsa; identical to SEQ ID NO: 108680

SEQ ID NO: 160025 - RNA, 64 nt, hsa; identical to SEQ ID NO: 108681

SEQ ID NO: 160026 - RNA, 64 nt, hsa; identical to SEQ ID NO: 108682

SEQ ID NO: 160027 - RNA, 64 nt, hsa; identical to SEQ ID NO: 108683

SEQ ID NO: 160028 - RNA, 64 nt, hsa; identical to SEQ ID NO: 108684

SEQ ID NO: 160029 - RNA, 64 nt, hsa; identical to SEQ ID NO: 108685

SEQ ID NO: 160030 - RNA, 64 nt, hsa; identical to SEQ ID NO: 108686

SEQ ID NO: 160031 - RNA, 64 nt, hsa; identical to SEQ ID NO: 108687

SEQ ID NO: 160032 - RNA, 64 nt, hsa; identical to SEQ ID NO: 108688

SEQ ID NO: 160033 - RNA, 64 nt, hsa; identical to SEQ ID NO: 108689

SEQ ID NO: 160034 - RNA, 64 nt, hsa; identical to SEQ ID NO: 108690

SEQ ID NO: 160035 - RNA, 64 nt, hsa; identical to SEQ ID NO: 108691

SEQ ID NO: 160036 - RNA, 64 nt, hsa; identical to SEQ ID NO: 108692

SEQ ID NO: 160037 - RNA, 64 nt, hsa; identical to SEQ ID NO: 108693

SEQ ID NO: 160038 - RNA, 64 nt, hsa; identical to SEQ ID NO: 108694

SEQ ID NO: 160039 - RNA, 64 nt, hsa; identical to SEQ ID NO: 108695

SEQ ID NO: 160040 - RNA, 64 nt, hsa; identical to SEQ ID NO: 108696

SEQ ID NO: 160041 - RNA, 64 nt, hsa; identical to SEQ ID NO: 108697

SEQ ID NO: 160042 - RNA, 64 nt, hsa; identical to SEQ ID NO: 108698

SEQ ID NO: 160043 - RNA, 64 nt, hsa; identical to SEQ ID NO: 108699

SEQ ID NO: 160044 - RNA, 64 nt, hsa; identical to SEQ ID NO: 108700

SEQ ID NO: 160045 - RNA, 64 nt, hsa; identical to SEQ ID NO: 108701

SEQ ID NO: 160046 - RNA, 64 nt, hsa; identical to SEQ ID NO: 108702

SEQ ID NO: 160047 - RNA, 64 nt, hsa; identical to SEQ ID NO: 108703

SEQ ID NO: 160048 - RNA, 64 nt, hsa; identical to SEQ ID NO: 108704

SEQ ID NO: 160049 - RNA, 64 nt, hsa; identical to SEQ ID NO: 108705

SEQ ID NO: 160050 - RNA, 64 nt, hsa; identical to SEQ ID NO: 108706

SEQ ID NO: 160051 - RNA, 64 nt, hsa; identical to SEQ ID NO: 108707

SEQ ID NO: 160052 - RNA, 64 nt, hsa; identical to SEQ ID NO: 108708

SEQ ID NO: 160053 - RNA, 64 nt, hsa; identical to SEQ ID NO: 108709

SEQ ID NO: 160054 - RNA, 64 nt, hsa; identical to SEQ ID NO: 108710

SEQ ID NO: 160055 - RNA, 64 nt, hsa; identical to SEQ ID NO: 108711

SEQ ID NO: 160056 - RNA, 64 nt, hsa; identical to SEQ ID NO: 108712

SEQ ID NO: 160057 - RNA, 64 nt, hsa; identical to SEQ ID NO: 108713

SEQ ID NO: 160058 - RNA, 64 nt, hsa; identical to SEQ ID NO: 108714

SEQ ID NO: 160059 - RNA, 64 nt, hsa; identical to SEQ ID NO: 108715

SEQ ID NO: 160060 - RNA, 64 nt, hsa; identical to SEQ ID NO: 108716

SEQ ID NO: 160061 - RNA, 64 nt, hsa; identical to SEQ ID NO: 108717

SEQ ID NO: 160062 - RNA, 64 nt, hsa; identical to SEQ ID NO: 108718

SEQ ID NO: 160063 - RNA, 64 nt, hsa; identical to SEQ ID NO: 108719

SEQ ID NO: 160064 - RNA, 64 nt, hsa; identical to SEQ ID NO: 108720

SEQ ID NO: 160065 - RNA, 64 nt, hsa; identical to SEQ ID NO: 108721

SEQ ID NO: 160066 - RNA, 64 nt, hsa; identical to SEQ ID NO: 108722

SEQ ID NO: 160067 - RNA, 64 nt, hsa; identical to SEQ ID NO: 108723

SEQ ID NO: 160068 - RNA, 64 nt, hsa; identical to SEQ ID NO: 108724

SEQ ID NO: 160069 - RNA, 64 nt, hsa; identical to SEQ ID NO: 108725

SEQ ID NO: 160070 - RNA, 64 nt, hsa; identical to SEQ ID NO: 108726

SEQ ID NO: 160071 - RNA, 64 nt, hsa; identical to SEQ ID NO: 108727

SEQ ID NO: 160072 - RNA, 64 nt, hsa; identical to SEQ ID NO: 108728

SEQ ID NO: 160073 - RNA, 64 nt, hsa; identical to SEQ ID NO: 108729

SEQ ID NO: 160074 - RNA, 64 nt, hsa; identical to SEQ ID NO: 108730

SEQ ID NO: 160075 - RNA, 64 nt, hsa; identical to SEQ ID NO: 108731

SEQ ID NO: 160076 - RNA, 64 nt, hsa; identical to SEQ ID NO: 108732

SEQ ID NO: 160077 - RNA, 64 nt, hsa; identical to SEQ ID NO: 108733

SEQ ID NO: 160078 - RNA, 64 nt, hsa; identical to SEQ ID NO: 108734

SEQ ID NO: 160079 - RNA, 64 nt, hsa; identical to SEQ ID NO: 108735

SEQ ID NO: 160080 - RNA, 64 nt, hsa; identical to SEQ ID NO: 108736

SEQ ID NO: 160081 - RNA, 64 nt, hsa; identical to SEQ ID NO: 108737

SEQ ID NO: 160082 - RNA, 64 nt, hsa; identical to SEQ ID NO: 108738

SEQ ID NO: 160083 - RNA, 64 nt, hsa; identical to SEQ ID NO: 108739

SEQ ID NO: 160084 - RNA, 64 nt, hsa; identical to SEQ ID NO: 108740

SEQ ID NO: 160085 - RNA, 64 nt, hsa; identical to SEQ ID NO: 108741

SEQ ID NO: 160086 - RNA, 64 nt, hsa; identical to SEQ ID NO: 108742

SEQ ID NO: 160087 - RNA, 64 nt, hsa; identical to SEQ ID NO: 108743

SEQ ID NO: 160088 - RNA, 64 nt, hsa; identical to SEQ ID NO: 108744

SEQ ID NO: 160089 - RNA, 64 nt, hsa; identical to SEQ ID NO: 108745

SEQ ID NO: 160090 - RNA, 64 nt, hsa; identical to SEQ ID NO: 108746

SEQ ID NO: 160091 - RNA, 64 nt, hsa; identical to SEQ ID NO: 108747

SEQ ID NO: 160092 - RNA, 64 nt, hsa; identical to SEQ ID NO: 108748

SEQ ID NO: 160093 - RNA, 64 nt, hsa; identical to SEQ ID NO: 108749

SEQ ID NO: 160094 - RNA, 64 nt, hsa; identical to SEQ ID NO: 108750

SEQ ID NO: 160095 - RNA, 64 nt, hsa; identical to SEQ ID NO: 108751

SEQ ID NO: 160096 - RNA, 64 nt, hsa; identical to SEQ ID NO: 108752

SEQ ID NO: 160097 - RNA, 64 nt, hsa; identical to SEQ ID NO: 108753

SEQ ID NO: 160098 - RNA, 64 nt, hsa; identical to SEQ ID NO: 108754

SEQ ID NO: 160099 - RNA, 64 nt, hsa; identical to SEQ ID NO: 108755

SEQ ID NO: 160100 - RNA, 64 nt, hsa; identical to SEQ ID NO: 108756

SEQ ID NO: 160101 - RNA, 64 nt, hsa; identical to SEQ ID NO: 108757

SEQ ID NO: 160102 - RNA, 64 nt, hsa; identical to SEQ ID NO: 108758

SEQ ID NO: 160103 - RNA, 64 nt, hsa; identical to SEQ ID NO: 108759

SEQ ID NO: 160104 - RNA, 64 nt, hsa; identical to SEQ ID NO: 108760

SEQ ID NO: 160105 - RNA, 64 nt, hsa; identical to SEQ ID NO: 108761

SEQ ID NO: 160106 - RNA, 64 nt, hsa; identical to SEQ ID NO: 108762

SEQ ID NO: 160107 - RNA, 64 nt, hsa; identical to SEQ ID NO: 108763

SEQ ID NO: 160108 - RNA, 64 nt, hsa; identical to SEQ ID NO: 108764

SEQ ID NO: 160109 - RNA, 64 nt, hsa; identical to SEQ ID NO: 108765

SEQ ID NO: 160110 - RNA, 64 nt, hsa
uaaacuuuaaguaauaauaaagaaucccauccauauauccaauuugcaauugaguuuugcaugg

SEQ ID NO: 160111 - RNA, 64 nt, hsa
uaacuuauugccuagccuauaaauaaauuccaaaauauccaauucauuucuucuugaaauggug

SEQ ID NO: 160112 - RNA, 64 nt, hsa
gaaaaguagccucacucuuauuccucaagaauuaauauccaauguuuaugagucuugcaaucaa

SEQ ID NO: 160113 - RNA, 64 nt, hsa
aggauuaaauaaauaauauggauuguuuuaaaaaauauccaaggaucagagucucuuucuaagc

SEQ ID NO: 160114 - RNA, 64 nt, hsa; identical to SEQ ID NO: 55166

SEQ ID NO: 160115 - RNA, 64 nt, hsa; identical to SEQ ID NO: 55167

SEQ ID NO: 160116 - RNA, 64 nt, hsa; identical to SEQ ID NO: 55168

SEQ ID NO: 160117 - RNA, 64 nt, hsa; identical to SEQ ID NO: 55169

SEQ ID NO: 160118 - RNA, 64 nt, hsa; identical to SEQ ID NO: 55170

SEQ ID NO: 160119 - RNA, 64 nt, hsa; identical to SEQ ID NO: 55171

SEQ ID NO: 160120 - RNA, 64 nt, hsa; identical to SEQ ID NO: 55172

SEQ ID NO: 160121 - RNA, 64 nt, hsa; identical to SEQ ID NO: 55173

SEQ ID NO: 160122 - RNA, 64 nt, hsa; identical to SEQ ID NO: 55174

SEQ ID NO: 160123 - RNA, 64 nt, hsa; identical to SEQ ID NO: 55175

SEQ ID NO: 160124 - RNA, 64 nt, hsa; identical to SEQ ID NO: 55176

SEQ ID NO: 160125 - RNA, 64 nt, hsa; identical to SEQ ID NO: 55177

SEQ ID NO: 160126 - RNA, 64 nt, hsa
aaggccuggaucacuuuaggaucaauauuuugacacgggagaaggcagcucagaaaggauuaag

SEQ ID NO: 160127 - RNA, 64 nt, hsa
ccugcuccauacauuggguguauauuuauucugaacgggagaaguuauauuguuaaaaguguaa

SEQ ID NO: 160128 - RNA, 64 nt, hsa
gcggguaccguaauccuagcuacucgggagacugacgggagaaucgcuugaacccaggaggcgg

SEQ ID NO: 160129 - RNA, 64 nt, hsa
auuugagaagugcugcuguaauuccccuuaaaggacgggagaaagggccccggccaucuugcag

SEQ ID NO: 160130 - RNA, 64 nt, hsa
gguuagcacacucagcgcugugagucgugaagacacgggagaaaauccaccauaauaaaacuga

SEQ ID NO: 160131 - RNA, 64 nt, hsa
cuggggcggucuuggaggccuggucucugccucgacgggagauccccgaucacuggcauucacc

SEQ ID NO: 160132 - RNA, 64 nt, hsa
uuggcugaaacaaagaauuuguccuguauggaaaacgggagacuuuguacaguggccucucuaa

SEQ ID NO: 160133 - RNA, 64 nt, hsa
gccagcuacccugcugcaggaccacgguggacccacgggagaagcuggaggugcuggagaggac

SEQ ID NO: 160134 - RNA, 64 nt, hsa
gcccccacaucccaguggggcauaacuaggggucacgggagagcagucucgucuccugugugua

SEQ ID NO: 160135 - RNA, 64 nt, hsa
gaaaaaaugagcaaacaaaaaaaucgaaagacaaacgggagagaaaaagaggaagggaacuuau

SEQ ID NO: 160136 - RNA, 64 nt, hsa
aauuuuuaaauauaaggauuuuccuagauauugcacgggagaauauacaaauagcaaaauugag

SEQ ID NO: 160137 - RNA, 64 nt, hsa
caccaagucucacuggcugucaguaugacauuucacgggagauuucuuguugcucaaaaaauga

SEQ ID NO: 160138 - RNA, 64 nt, hsa
cccugagaccacuggucacaguuggccaccuccaacgggagaccuuguccuuggccuagagucc

SEQ ID NO: 160139 - RNA, 64 nt, hsa
acuuuuucugucccacgcgcguuuguucuugcgcacgggagaguuuguggcggcgauuaugcag

SEQ ID NO: 160140 - RNA, 64 nt, hsa
auuaauuaggcaauuuaugucugugauaauucuuacgggagaaagaggauuugauuggaaagca

SEQ ID NO: 160141 - RNA, 64 nt, hsa
ggguuuguaaucaaaacauauuugauaggaggcuacgggagaguugucuagaagagguaagacc

SEQ ID NO: 160142 - RNA, 64 nt, hsa
cuguguuccuacaauuggcccagcacccuggggcacgggagaaggguggggaccguugcuguca

SEQ ID NO: 160143 - RNA, 54 nt, hsa
gagugaugagaaauaauuaauuggacgggagacagagugacgcacugacucacc

SEQ ID NO: 160144 - RNA, 54 nt, hsa
gaaugaugagaaauaauuaauuggacgggagacagagugaagcaucaaccuacu

SEQ ID NO: 160145 - RNA, 64 nt, hsa
aaccaccugcagagguccccagacccaaagcaggacgggagacaacugcuuggaggagcgaaga

SEQ ID NO: 160146 - RNA, 64 nt, hsa
guaauuuuuaugaaauacugcgugugauaagcaaacgggagaaauuuauaucagauucuuggcu

SEQ ID NO: 160147 - RNA, 64 nt, hsa
guuugggcaggugcagauccaagggcugugguaaacgggagagcuuguguuuuugaaguggaaa

SEQ ID NO: 160148 - RNA, 64 nt, hsa
cagcagugccgggcugggcucugcggugcgguccacgggagagcaggccuccagcuggaaaggc

SEQ ID NO: 160149 - RNA, 64 nt, hsa
gggacugucuucaacccugcccugcaccuugggcacgggagagcgccacccgcccgcccccgcc

SEQ ID NO: 160150 - RNA, 64 nt, hsa
acugguuucuaagacaaccgugggaaccacugugacgggagaaaccgcuugugcuucgcgcaug

SEQ ID NO: 160151 - RNA, 64 nt, hsa
cugacucccagaacaaagaacuugggagaacaguacgggagacugagcagaaaggauggguuug

SEQ ID NO: 160152 - RNA, 64 nt, hsa
agugccgagauagauagccaugucugccuugggcacgggagagggaaguggcagcaugcaugcu

SEQ ID NO: 160153 - RNA, 64 nt, hsa
ugcagagggugggggucucagggucuuaggugauacgggagagaaagaacgugccaggcaggag

SEQ ID NO: 160154 - RNA, 64 nt, hsa
uuuuucccacaccgaucaagucaacucaguacucacgggagaaaaauagacuuuauuuacaagu

SEQ ID NO: 160155 - RNA, 58 nt, hsa
accccuugaggacacugugagggccuggacgggagaugccagccaucacucacugcca

SEQ ID NO: 160156 - RNA, 64 nt, hsa
ggcugcuuguuuuuuuauugccaaagucaaauaaacgggagacugucaugcucaugcaugaaua

SEQ ID NO: 160157 - RNA, 64 nt, hsa
cucucuucucgguagcuuugaaucuuaagcuucuacgggagagugguagaacuggaucauuucc

SEQ ID NO: 160158 - RNA, 64 nt, hsa
acucgccagggcacggagccgucaguccacuguuacgggagaauguugauuucgcgggugcgag

SEQ ID NO: 160159 - RNA, 64 nt, hsa
cuugugauaacccugucaucaagguccugugagaacgggagaggcaguuccuaccuugggaaug

SEQ ID NO: 160160 - RNA, 64 nt, hsa
agagcuuccuaaccuaguaaaaugucaagaacagacgggagauauuagugucuuucccucuauc

SEQ ID NO: 160161 - RNA, 64 nt, hsa
cugcagggagagggcaggcggcugcugcuguugcacgggagaacuuuccucacccgccccugcc

SEQ ID NO: 160162 - RNA, 64 nt, hsa
ccucacucagugugaccuggagggggucagacagacgggagaguccagaaacagacccagggcu

SEQ ID NO: 160163 - RNA, 64 nt, hsa
gggaguucccgaggggccccagcuuucaagggcgacgggagagacacaggauaaaagguuaaaa

SEQ ID NO: 160164 - RNA, 64 nt, hsa
ggguggugggccgacuugaaccuuagcaguccccacgggagauggcagggcaccuuggggaagg

SEQ ID NO: 160165 - RNA, 64 nt, hsa
cucagacccuaaaucaauaaucacaaaccccaaaacgggagagagcagugaaaacaugcagggc

SEQ ID NO: 160166 - RNA, 64 nt, hsa
gcaugauguuuggaugcuagacuaguugcaucugacgggagaaguuuguguuguaccagcgcau

SEQ ID NO: 160167 - RNA, 64 nt, hsa
caugagggacuuggagggagcugggaguucauccacgggagacccugccccgaugagaaggggc

SEQ ID NO: 160168 - RNA, 64 nt, hsa
uuaggcacacgucacgggugcgggagacccgggcacgggagacccgggccgccuucaggccgcu

SEQ ID NO: 160169 - RNA, 64 nt, hsa
ggagaccaagagcacagcaggacugaaauuuuggacgggagagaggggcuauuccaucuugcuu

SEQ ID NO: 160170 - RNA, 64 nt, hsa
ccggggcccugccucggagcucugugguggaaggacgggagagggccccggacacgcgcguuuu

SEQ ID NO: 160171 - RNA, 64 nt, hsa
gggucccuguguccucuuccagggguccaagggaacgggagaggucacugggccuguuuucucc

SEQ ID NO: 160172 - RNA, 64 nt, hsa
uacguacccacaugcaggaccugaaggaugugacacgggagacacauuaugagaacuaccgggc

SEQ ID NO: 160173 - RNA, 64 nt, hsa
uuaaugauggccacaucugggcugcucugcacccacgggagaggcuggcccagcugcagacugc

SEQ ID NO: 160174 - RNA, 64 nt, hsa
ucaugacaacagaagggagguggccgggcugagcacgggagacccaccgugcaggggccuuuca

SEQ ID NO: 160175 - RNA, 64 nt, hsa
ucucucucuuugaucccauaaagcuacgagggggacgggagagggcagugcaaugggaaguaaa

SEQ ID NO: 160176 - RNA, 64 nt, hsa
ucagaagucagcgcaggaagagccugcuuuggacacgggagaaaagaagccauugcuaacuacu

SEQ ID NO: 160177 - RNA, 64 nt, hsa
ccgcaggacuggagggccaggccccgccacccccacgggagacccgggacagggcgucuuccua

SEQ ID NO: 160178 - RNA, 64 nt, hsa
cugagguuggccacgggggagcuggccuccagggacgggagagauugugucaugugccacacga

SEQ ID NO: 160179 - RNA, 58 nt, hsa
uagaugagaaauccuuuuaguggaagcaacgggagaagcuuucuguugucccacuucc

SEQ ID NO: 160180 - RNA, 64 nt, hsa
ugcauuucuuggagccucuccgagcagcaaccagacgggagauuuuuauuuuaagcuguucaug

SEQ ID NO: 160181 - RNA, 64 nt, hsa
ucuugcguaugccugcccaguuuucagccucuuaacgggagacucaagcacauugguauuguau

SEQ ID NO: 160182 - RNA, 64 nt, hsa
uucuguuacguaacgaaaaggauaaacaucucccacgggagaggccacagauggccacuuccag

SEQ ID NO: 160183 - RNA, 64 nt, hsa
aguuccaucaggcuguuuccuaaaggaugugugaacgggagaugaugcacuguguuuugaaagu

SEQ ID NO: 160184 - RNA, 64 nt, hsa
cccacuucaaaugacaaguucauauauagaauuuacgggagaaacuugagaccauuuacgggga

SEQ ID NO: 160185 - RNA, 64 nt, hsa
gaagaccagguuugcugggcauaagcuucacaggacgggagaaccugcccaugguggacugucg

SEQ ID NO: 160186 - RNA, 64 nt, hsa
aacgcucuacuucguaaaagcauuauacaaagucacgggagaaaaauaugggacauuucuugau

SEQ ID NO: 160187 - RNA, 64 nt, hsa
gaggggagcgacccucaaggccacccagcuggacacgggagacuugagcccagccuucugacug

SEQ ID NO: 160188 - RNA, 64 nt, hsa
gcaaccuuccaagugcggagugucaaccaacuggacgggagagaguacugcuccuacuccagga

SEQ ID NO: 160189 - RNA, 64 nt, hsa
ugugugcacacgccacacacugggcguucccggcacgggagaggcccagaguuuccuucacccu

SEQ ID NO: 160190 - RNA, 64 nt, hsa
gcauccucucccccacaagagccccaaagaucccacgggagaggggagagggacgcacagcacu

SEQ ID NO: 160191 - RNA, 64 nt, hsa
uucuucuuuucaucucagucauaacccaaaagcuacgggagaaaaagcagaaguguaaucucug

SEQ ID NO: 160192 - RNA, 64 nt, hsa
uccugagccgguuuaagucuguggaaaaggaagcacgggagaaauccacguaaccuuugcuuuc

SEQ ID NO: 160193 - RNA, 64 nt, hsa
aggcaccagccucugcagcaaugggucccucuagccuguggacaccagcugggggauccagggu

SEQ ID NO: 160194 - RNA, 64 nt, hsa
caucucgggcuuggcuggucugcgaggccuugccccuguggaacucuggguuccuguuuucuca

SEQ ID NO: 160195 - RNA, 64 nt, hsa
uuagaaaagaaagcaaacuuaagaaacacugacuccuguggagaugacuuggcaccacucuccu

SEQ ID NO: 160196 - RNA, 64 nt, hsa
agacguaaaaagaaaaaaaccauaggcugcucugccuguggaguagccauucuuuauucuuuua

SEQ ID NO: 160197 - RNA, 64 nt, hsa
ucugugaaagcuacagagcaccaaccagcagaagccuguggacaccaaguacgguguacagaaa

SEQ ID NO: 160198 - RNA, 64 nt, hsa
gcaguggaccucauaccugucuccagcucccagcccuguggauccccguggauguagacauugc

SEQ ID NO: 160199 - RNA, 59 nt, hsa
uccggaggucugggccauagcauggcugcccuguggaugccuugucagugccgccagcc

SEQ ID NO: 160200 - RNA, 64 nt, hsa
agaaaccuucuuaucccccucaucucuggggcccccuguggaucuggcauacccaaguucagua

SEQ ID NO: 160201 - RNA, 64 nt, hsa
aagcuuuuaaaauguagaaacuuaaacacaccuuccuguggaggcugagaugaaaacuagggcu

SEQ ID NO: 160202 - RNA, 64 nt, hsa
aguaugugcaggggggcgaucugggaaucaguccccuguggauaccaagguacaacuguauuua

SEQ ID NO: 160203 - RNA, 64 nt, hsa
ugauguugacuuaauuccaaaugggaucuccauaccuguggaccaaaccaacaaguaaguuuug

SEQ ID NO: 160204 - RNA, 64 nt, hsa
ggcucuugagccacuugcucuagcccacucccacccuguggaauguacuuucacuuuugcugcu

SEQ ID NO: 160205 - RNA, 64 nt, hsa
uagugacgcuguugggauggcacaguccaggaggccuguggacugcagccugcugugcugagcc

SEQ ID NO: 160206 - RNA, 64 nt, hsa
gcuguguuuccugggaaguggugcuuuacuuagcccuguggacaacuucucuaugcaucugugu

SEQ ID NO: 160207 - RNA, 64 nt, hsa
cccacgaagauacugcacggagagcagugccaagccuguggaucaggaauaucaacagccccca

SEQ ID NO: 160208 - RNA, 64 nt, hsa
ugcgccauggccuggaucugcugcaguguccuuuccuguggaggcuccacucaaagcuggcauc

SEQ ID NO: 160209 - RNA, 64 nt, hsa
uauaucuaguaccauacugaguuauugguaugacccuguggaaacacacauuauuuuauguaaa

SEQ ID NO: 160210 - RNA, 64 nt, hsa
uccaucuucggacguugauucuuacugaagacaaccuguggaauagaagcuggauuccaucaga

SEQ ID NO: 160211 - RNA, 64 nt, hsa
gguugcccagccuggagcggagcuugccugccugccuguggagacagcccugccuauccucugu

SEQ ID NO: 160212 - RNA, 64 nt, hsa
gaguaggaaaggaauaaggauguuguuaugaucgccuguggauuuuguccauucaucucaugcu

SEQ ID NO: 160213 - RNA, 64 nt, hsa
aagguuugacaggcuuaaugugggcauccaguggccuguggaccccccccugccaccacgacug

SEQ ID NO: 160214 - RNA, 64 nt, hsa
gugaggcagggggcggaggcugccgaggccagggccuguggaggugccagggcccaccaugucg

SEQ ID NO: 160215 - RNA, 64 nt, hsa
aauucugucuuggaggaagaagcuggacauucagccuguggagucugaguuuugaaggauguag

SEQ ID NO: 160216 - RNA, 64 nt, hsa
agacucucccuccuguccuguacauagccaccucccuguggagaggacacuuaggguccccucc

SEQ ID NO: 160217 - RNA, 64 nt, hsa
gaagcugaagucagugucucuggugcucagaaacccuguggauuucccucugaaccaagauuuu

SEQ ID NO: 160218 - RNA, 64 nt, hsa
ccaaaauucagagauggcuuuggggcaagugcuaccuguggaauaaaccuguuuuccagguguc

SEQ ID NO: 160219 - RNA, 64 nt, hsa
acauuuuccaugguagaaaggaaguucagucaguccuguggaaugaaaccaucuccuaaaauuc

SEQ ID NO: 160220 - RNA, 64 nt, hsa
uuuggugaacuucaaacucuguucuuuuuggucaccuguggaaugaaugcaagcaugauuuugg

SEQ ID NO: 160221 - RNA, 64 nt, hsa
ccccacauuccgacaaccgaugcuccagccaaccccuguggagcccgcacccccacccuuuggg

SEQ ID NO: 160222 - RNA, 64 nt, hsa
caaccaccgcuccccagcccaggguucccccagcccuguggaagggacuaggagcacuguagua

SEQ ID NO: 160223 - RNA, 64 nt, hsa
gauggcugcuuguuuaggaggccaucaguuccuuccuguggagaagggucugaaauggaaguca

SEQ ID NO: 160224 - RNA, 64 nt, hsa
ucuggaaaccaacaacuuuugagauuucccuugcccuguggacgcccagcuccugucauccuuc

SEQ ID NO: 160225 - RNA, 64 nt, hsa
ugggcagguggcucggggccacuggcggagccagccuguggauccaagagacaguccccaccug

SEQ ID NO: 160226 - RNA, 64 nt, hsa
acuugcgucccccaugccugcuggguggcuggguccuguggaggccagcagcgguguggccccc

SEQ ID NO: 160227 - RNA, 64 nt, hsa
ugcugcggacuccuccgcgagccccaucgucgcgccuguggacgccuaggcaagagcggcccuc

SEQ ID NO: 160228 - RNA, 64 nt, hsa
gacagccggagcucggccugcggugggggcgcuuccuguggacgcugcgccucccaucgcccgg

SEQ ID NO: 160229 - RNA, 64 nt, hsa
acagucuacucugucucugcugcuagagaagccaccuguggaggacugggcugugguugggccu

SEQ ID NO: 160230 - RNA, 64 nt, hsa
ccuguggaggacugggcugugguugggccugaggccuguggaggaggugaguguagccagcagc

SEQ ID NO: 160231 - RNA, 64 nt, hsa
aaaagaagcggauaguguuuauggagaauggguuccuguggagaaaaauggugaagaaaacaaa

SEQ ID NO: 160232 - RNA, 64 nt, hsa
ugauaauguuuucagcagcaauuugcccucagagccuguggacaucucuacagcaaugagugaa

SEQ ID NO: 160233 - RNA, 64 nt, hsa
ugaagaguuuacaaagaaauauggggaaaagcgaccuguggacuaaaaucugccacgauugguu

SEQ ID NO: 160234 - RNA, 64 nt, hsa
ggcuucccuucuuggcucuugggggggacuagauccuguggagaagaugacuuaaacuuugcuu

SEQ ID NO: 160235 - RNA, 64 nt, hsa
ggcaggaaucaccacccaucuccagcuguggagcccuguggaggggaaggggaagcuugggguu

SEQ ID NO: 160236 - RNA, 64 nt, hsa
aaccuaaaugccacagcuggggcugagcuguauuccuguggagggaccucugccgugccucucu

SEQ ID NO: 160237 - RNA, 64 nt, hsa
agcacauucaguuauguacaguauguaauacugauaaugacaauaaaugacaccgguuugugua

SEQ ID NO: 160238 - RNA, 64 nt, hsa
cugguuuugcagaagauuacaguuauguacugcauaaugacauauacaauaguggucccauaaa

SEQ ID NO: 160239 - RNA, 64 nt, hsa
aaucacaguagcguaaacgagaggccuuccuuucuaaugacaaugacagguauuggugaaggag

SEQ ID NO: 160240 - RNA, 64 nt, hsa
uccaugaagaaaaauauauguucuuuugaauacuuaaugacagaacaaauacuuggcaaacucc

SEQ ID NO: 160241 - RNA, 64 nt, hsa
uuccuuuguuuugaauccaaaucuuuuucauagguaaugacagaugccuuaaugugaagcuuau

SEQ ID NO: 160242 - RNA, 64 nt, hsa
acaaaaacuuaacauuuaaaacugauaauaucuguaaugacaucagaaugaaagaaaaaaaauu

SEQ ID NO: 160243 - RNA, 64 nt, hsa
uggaucuuuugcuagugugaaaacauugggaauuuaaugacauuauugagcugaaagaaauuac

SEQ ID NO: 160244 - RNA, 64 nt, hsa
guaucuuuuauaaucauaucgguuucugcuguauuaaugacaauuauucaugaaaauaaaaaau

SEQ ID NO: 160245 - RNA, 64 nt, hsa
cuugccuaaagauaucugggaccucuacuggcuuuaaugacaaauaauguuauguugagguuau

SEQ ID NO: 160246 - RNA, 64 nt, hsa
gaauggaaaauugugguuaauucugaauuucauguaaugacaacauauucuuucauaaaacuau

SEQ ID NO: 160247 - RNA, 64 nt, hsa
cuuuaagaacauguggaauaaguuuuuuagcugcuaaugacaaaacaaauccuguaacuaccca

SEQ ID NO: 160248 - RNA, 64 nt, hsa
guuugugugcagagaaguauaugauccaccaugcuaaugacacuugccuuuuuuuccaccauua

SEQ ID NO: 160249 - RNA, 64 nt, hsa
aaaccagacaacacauguauugguuuaaacucgauaaugacaggaaaauuccaaacuagagcag

SEQ ID NO: 160250 - RNA, 64 nt, hsa
ucugccaguaaaaaguaaugaaauuguaccuuucuaaugacaucuaugcagcaggggucuaucg

SEQ ID NO: 160251 - RNA, 64 nt, hsa
ccaucuuggcucacugcaaccucuaccuccuggguucaagcaaaucuccugccucagccuccaa

SEQ ID NO: 160252 - RNA, 64 nt, hsa
caaucucggcucacugcaaccuccgccucccagguucaagcaauucuccugccucagccucccg

SEQ ID NO: 160253 - RNA, 64 nt, hsa
aauauuucuaacauccuuaaauauacaaucggaauucaagcaucucccauugucccacaaaugu

SEQ ID NO: 160254 - RNA, 64 nt, hsa
ggcuguuuuuguaguuggauuguuuguauuaggauucaagcaaggcccauauauugcauuuauu

SEQ ID NO: 160255 - RNA, 64 nt, hsa
auuuguacgcacaacauuaaaucaagggcuacaauucaagcacuuuuauucguaucauuggccu

SEQ ID NO: 160256 - RNA, 64 nt, hsa
ugugugcuuccagaaagcuuacagauaaauggguuucaagcacaagaauaugacuagauuucag

SEQ ID NO: 160257 - RNA, 64 nt, hsa
ugaucucggcucacugcaaccucugccucccggguucaagcaauucuccugccucagccaccca

SEQ ID NO: 160258 - RNA, 64 nt, hsa
aauugggagccaucauaugucacaguguucagaauucaagcauauuuaagggcauuuucuuuga

SEQ ID NO: 160259 - RNA, 64 nt, hsa
ugaucucagcucacugcaaccuccgucucuuagguucaagcaauucuccugccucagccucccg

SEQ ID NO: 160260 - RNA, 64 nt, hsa
caaucucggcucacugcaaccuccaccucccagguucaagcaauucuccugccucagucuccug

SEQ ID NO: 160261 - RNA, 64 nt, hsa
uuucuacccuuggcaugaggggaaaugauugauauucaagcaaguucucuaggaaaaaaaaaaa

SEQ ID NO: 160262 - RNA, 64 nt, hsa
uuacgacccucuccagaccagaccuggaguccucuucaagcagcaauccaacccagagcagggg

SEQ ID NO: 160263 - RNA, 64 nt, hsa
cgaucucggcucaccacaaucgcugccuccuggguucaagcaauucuccugccucagccucccg

SEQ ID NO: 160264 - RNA, 64 nt, hsa
uaaucauaccucauugcagccucagacuccuggguucaagcaauccuccugccucagccuccca

SEQ ID NO: 160265 - RNA, 64 nt, hsa
ugaucucggcucacugcaaccucugccucccgaguucaagcaauucuccugccucagccuccug

SEQ ID NO: 160266 - RNA, 64 nt, hsa
guaaaggagaauuuuuuggacucaagcugucaucuucaagcacgccaacuucaggcaguguuuu

SEQ ID NO: 160267 - RNA, 64 nt, hsa
agcagagugagaaguuaaaauacccuuaaggagguucaagcagagugagaaguuaaaauacccu

SEQ ID NO: 160268 - RNA, 64 nt, hsa
gcucccugaauccuugcgucccgaaggacggagguucaagcagagugagaaguuaaaauacccu

SEQ ID NO: 160269 - RNA, 64 nt, hsa
cuuugaaaaaaaagaugcuuacuguauacuuguuuucaagcauccucuaaaaucaaagguuuug

SEQ ID NO: 160270 - RNA, 64 nt, hsa
uccagugaaacaaaguucauaucauccauuguuuuucaagcacgugacaccagccucaaaguaa

SEQ ID NO: 160271 - RNA, 64 nt, hsa
uuaaacuuuugguuauuguguucacaucauaguauucaagcaucauuuauaguuugguuuugag

SEQ ID NO: 160272 - RNA, 64 nt, hsa
acaucacugauuauuuggguuaaacuggacucauuucaagcaguuugcuuuuguucaaaucgug

SEQ ID NO: 160273 - RNA, 64 nt, hsa
gcuaugucguccaggcuggucuugaacuccugaguucaagcaguccuccugcuucaacauacag

SEQ ID NO: 160274 - RNA, 64 nt, hsa
cgaucuuggcucacugcaaccucugccuccuggguucaagcaauucuccugccucagccuccag

SEQ ID NO: 160275 - RNA, 64 nt, hsa
uuuuaaugagacccaaaugacucucucuuaacaauucaagcaguagacaaaguugcucacaaau

SEQ ID NO: 160276 - RNA, 64 nt, hsa
aaaaauaauaugucaugggauuaaaauguuuguuuucaagcauuuuuaacaguuuuacacacuu

SEQ ID NO: 160277 - RNA, 64 nt, hsa
cugugugggaaaacuuacuugucuccuuuagguuuucaagcacaugaaaguacucacacuggag

SEQ ID NO: 160278 - RNA, 64 nt, hsa
caauguggaaaaaccuacauaucuucuguagguuuucaagcacaugaaagaacucacacuggag

SEQ ID NO: 160279 - RNA, 64 nt, hsa
caaucuuggcucacugcaaccuccacuucucagguucaagcaauucuccugccucagccuccug

SEQ ID NO: 160280 - RNA, 64 nt, hsa
aguggugugauccuggcucacuguaaccucuggguucaagcaauucuucugccucagccuucca

SEQ ID NO: 160281 - RNA, 64 nt, hsa
cgaucgcggcucaccgcaaccuccgccucccggauucaagcaauucuccugccgcagccuccca

SEQ ID NO: 160282 - RNA, 64 nt, hsa
cgaucucagcucacugcaaccuccuccucccagguucaagcaauucuccugccucagucuccca

SEQ ID NO: 160283 - RNA, 64 nt, hsa
agccuugaccugaguuuguugauuuaacauugauuucaagcauuaauugccauuaaacuguuua

SEQ ID NO: 160284 - RNA, 64 nt, hsa
uguccccagaccugccgccuggcuucuggagugcuucaagcagagcauggugggucauugagga

SEQ ID NO: 160285 - RNA, 64 nt, hsa
uugaucucggcucacugcaaccucgccucccggguucaagcaauucucugccgcagccuccaga

SEQ ID NO: 160286 - RNA, 64 nt, hsa
aucuugaccauaacauauucaucaaaccauuuucuucaagcaaaguacaugacuguuggaccug

SEQ ID NO: 160287 - RNA, 64 nt, hsa
aaauaaacugggaaaagaguuugaaaauagaauuuucaagcaacucaaagauuaucuauacaca

SEQ ID NO: 160288 - RNA, 64 nt, hsa
ggcaguuguuucaccguaaccucugccuccugacuucaagcaauucuccugccucagccuccca

SEQ ID NO: 160289 - RNA, 64 nt, hsa
cagucuuggcucacugcaaccuccaccuccuggguucaagcaauucuccuucuucagccucccg

SEQ ID NO: 160290 - RNA, 64 nt, hsa
cgaucuuggcucacugcaaccuccaccucccggguucaagcaauucuccuucuucagccucccg

SEQ ID NO: 160291 - RNA, 58 nt, hsa
gugcugcggggugcugcugagagugcccgcugggcagugaacagaccacuagccccgg

SEQ ID NO: 160292 - RNA, 64 nt, hsa
aacuccaaggucccuuaaaaagugccuuuuagaggcugggcaugguggcucacgcuuguaaucc

SEQ ID NO: 160293 - RNA, 64 nt, hsa
gccaggggcgcccgagcccucuccuggggggccugcugggcaggcgaccugcugacccacgguc

SEQ ID NO: 160294 - RNA, 64 nt, hsa
cccaugggaggcggcgcugcucuccccgagggcggcugggcagagcacaucccccaggacuuga

SEQ ID NO: 160295 - RNA, 64 nt, hsa
gagaaaccccgucucuucuaaaaauacaaaauuagcugggcaugguggugcaugccuguaauuc

SEQ ID NO: 160296 - RNA, 64 nt, hsa
uggaaguuauucuucauaaaaaauguuaacgugggcugggcaugguggcucaugccuguaaucc

SEQ ID NO: 160297 - RNA, 64 nt, hsa
auguaaauguugcaaaaagaguuuuccaaguagagcugggcacuacguaaucagccccacaagu

SEQ ID NO: 160298 - RNA, 64 nt, hsa
ccucuacuaaaaauacaaaaaaaaaaaaaaauuagcugggcaugguggcacacaccuguagucc

SEQ ID NO: 160299 - RNA, 64 nt, hsa
gcaaaacccugugucuacaaaaaauaaaaaauuagcugggcaugacggccagagcccauggucc

SEQ ID NO: 160300 - RNA, 64 nt, hsa
cuuugaucugguuuuugaagucucuuaauuauuggcugggcauggugacucaugccuguaaucc

SEQ ID NO: 160301 - RNA, 64 nt, hsa
uagugagacuccgucucuacaaaaaauaaauuuagcugggcaugguggugcacaucuguagucc

SEQ ID NO: 160302 - RNA, 64 nt, hsa
gccucacccaacaccaguggaacuggagccucuggcugggcacaguggcucacuuugggaggcu

SEQ ID NO: 160303 - RNA, 64 nt, hsa
ccucccuuggggaaagaggugcuucuggggaagugcugggcauucacucuauugaccaaacauu

SEQ ID NO: 160304 - RNA, 64 nt, hsa
ucccugcugucauuggcucucccuccaggcugcugcugggcaugucauagaugggaugaaugac

SEQ ID NO: 160305 - RNA, 64 nt, hsa
cugucuuuaggaguagggugggauggggagggaggcugggcaucagggaucacaucacucuuaa

SEQ ID NO: 160306 - RNA, 64 nt, hsa
ucggggccaggcaggccagcccagcccacgccgagcugggcagcgucugcucugguaggacugu

SEQ ID NO: 160307 - RNA, 64 nt, hsa
cggucagggccugccgagcugccugccccuuccagcugggcagaguccccugcaaggaggcagg

SEQ ID NO: 160308 - RNA, 64 nt, hsa
guggauguagggauagcugauuuuaaaacacucggcugggcacaguggcucacaccuguaaucc

SEQ ID NO: 160309 - RNA, 64 nt, hsa
ugaaacccugucucuacaaaaaauacaaaaauuagcugggcaugguggugcgugccugaagucc

SEQ ID NO: 160310 - RNA, 64 nt, hsa
acgcaggacgccgccucacgcaagcugggacacugcugggcacggcccuggcguucggcacuag

SEQ ID NO: 160311 - RNA, 64 nt, hsa
uaggaacaguugacuucccagaaugcagugggcugcugggcaccccucucacgguuggggagga

SEQ ID NO: 160312 - RNA, 64 nt, hsa
uguguguacugcaugcccacccggguagcaggcugcugggcaguucugcucuguggaggggcgg

SEQ ID NO: 160313 - RNA, 64 nt, hsa
uggccccacgaagcccccaguggcuggcuguccagcugggcaaacaguggcaccccucccagcu

SEQ ID NO: 160314 - RNA, 64 nt, hsa
uccuucuguuucaacaacuccuccacugggcagagcugggcaucuggcagggcuggcucugucc

SEQ ID NO: 160315 - RNA, 64 nt, hsa
gggggaacacaggaaccuaggggaggaggggagcgcugggcauccucaggcuggcggccaaggc

SEQ ID NO: 160316 - RNA, 64 nt, hsa
guccugugggucccugcagucgacaucauguuuggcugggcaucgaugccuccuuucugggacu

SEQ ID NO: 160317 - RNA, 64 nt, hsa
agccuggaaaaugugaaacugucuccugcaaccugcugggcaugugggccuggcuguguucaau

SEQ ID NO: 160318 - RNA, 64 nt, hsa
gccuguaagucuguucauuuuaacaacauacagggcugggcacgguggcucacgccuguaaucc

SEQ ID NO: 160319 - RNA, 64 nt, hsa
caaaaccccgucucuaugaaaaauauaaaaauuagcugggcaugguggcaggcaccuguaaucc

SEQ ID NO: 160320 - RNA, 64 nt, hsa
gaguugaauccauaguguggggcccaugacucuagcugggcaccuuggaccuccagcuggccaa

SEQ ID NO: 160321 - RNA, 64 nt, hsa
uauaguaaguccucuuccaaagagauggcaauaugcugggcaucuacuuuaaaacaaaguuguc

SEQ ID NO: 160322 - RNA, 64 nt, hsa
ccacucuccccaccccuggcccacuguggugugugcugggcaaauguggccugaaugcuaggua

SEQ ID NO: 160323 - RNA, 64 nt, hsa
cugcucugccugggacugagcgaguggacuuagggcugggcaggcaguagccaccagagggcag

SEQ ID NO: 160324 - RNA, 64 nt, hsa
aaauagagaucuccucugcaguguagagaccagagcugggcagugcagggcauggagaccugca

SEQ ID NO: 160325 - RNA, 64 nt, hsa
ucaaaaaauaauaauaauaacaauauaagaacuagcugggcaugguggcgcaugcauguagucc

SEQ ID NO: 160326 - RNA, 64 nt, hsa
ugaaacuccaucucuacuaaaaguacaaaaauuagcugggcaugauggcacgcaccugcagucc

SEQ ID NO: 160327 - RNA, 64 nt, hsa
gcaccugcagaguccagugaaaugauauauucuggcugggcacaguggcucacaccuguaaucc

SEQ ID NO: 160328 - RNA, 64 nt, hsa
ggcagcaaugcugaguucaagaaaaguacuucaggcugggcacaguggcucaugccugaaaucc

SEQ ID NO: 160329 - RNA, 64 nt, hsa
gaaaccccaucgcuacuaaaaauauaaaaaauuagcugggcaugguggcgcacgccuguaguuc

SEQ ID NO: 160330 - RNA, 64 nt, hsa
ucauccaccucgcuuuaaaaauaagcacaugauggcugggcaccguggcucacgccuguaaucc

SEQ ID NO: 160331 - RNA, 64 nt, hsa
auuuuggaauuuccuggaugagaaggaagucugggcugggcaugguggcucacgccuguaaccc

SEQ ID NO: 160332 - RNA, 64 nt, hsa
caaaaccccauuucuacaaaaaauacaaaaauuagcugggcaugguggcacccgccuguagucc

SEQ ID NO: 160333 - RNA, 64 nt, hsa
cccauuguucuggaaaucuccaggcugcugggcagcugggcagagcucugggaagugaagucau

SEQ ID NO: 160334 - RNA, 64 nt, hsa
accuacuccccauuguucuggaaaucuccaggcugcugggcagcugggcagagcucugggaagu

SEQ ID NO: 160335 - RNA, 64 nt, hsa
ugaaaugccgucucuacuaaaaauacaaaaauuagcugggcaugauggcgagugucuguaaucc

SEQ ID NO: 160336 - RNA, 64 nt, hsa
gauuuaaauaauuucuuuaaaagcguaagcuuuggcugggcaugguggcuuaugccuguaaucc

SEQ ID NO: 160337 - RNA, 64 nt, hsa
ggauguggcagugagggacgauggggugaagucagcugggcauucaaagaagcuagacugagaa

SEQ ID NO: 160338 - RNA, 64 nt, hsa
ugaaaccccaugucuacuaaaaauacaaaaauuagcugggcaugguggcacacacuuguagucc

SEQ ID NO: 160339 - RNA, 64 nt, hsa
cuuccaguuuuguuauuuuaacaaauuucucuaggcugggcaugguggcucaugccuauaaucc

SEQ ID NO: 160340 - RNA, 64 nt, hsa
aagaccuuaucucuacaaaaaaauuuagaaauuagcugggcaugguggcacccaucuguagucc

SEQ ID NO: 160341 - RNA, 64 nt, hsa
ugaaaccccaucucuacuaaaaauacaaaaauuggcugggcaugguggcgggugccuguaaucc

SEQ ID NO: 160342 - RNA, 64 nt, hsa
cgguagggggcaggaagaggagcagaaaagaagggcugggcaaggcauaguggcuuaugccugu

SEQ ID NO: 160343 - RNA, 64 nt, hsa
gugaaauccugucucuacuaaaaauauaaaauuagcugggcaugguggugcacaccugucgucu

SEQ ID NO: 160344 - RNA, 64 nt, hsa
acggcuaugacagugaugaggagguggacagcgagcugggcaccugggagcaccagcugcggcg

SEQ ID NO: 160345 - RNA, 64 nt, hsa
cuucuccaccuucucuccacagaauguuugcagagcugggcaguugaggaaaggacagccccug

SEQ ID NO: 160346 - RNA, 64 nt, hsa
gcccugggacuccuaucaggaagcuugacaggcagcugggcaucagugcagcugauaucguuug

SEQ ID NO: 160347 - RNA, 64 nt, hsa
aguaccaggcuucgugggcacagacaccuccugggcugggcagagugacagugcuagaagaccc

SEQ ID NO: 160348 - RNA, 64 nt, hsa
gucuggccggugugcuggaugcaugcccaagggugcugggcaucacugguccuugugaggaugc

SEQ ID NO: 160349 - RNA, 64 nt, hsa
ucucugcugccacaugccguucccaugcccggcugcugggcaccugggagagcuuccagaaucc

SEQ ID NO: 160350 - RNA, 64 nt, hsa
guucugccacagcccugcauacugaccccgggaggcugggcagguggacagccccagccaccac

SEQ ID NO: 160351 - RNA, 64 nt, hsa
uacccacucccugcacgccugccgucccugccccgcugggcagcccuucaguguggcuggcguu

SEQ ID NO: 160352 - RNA, 64 nt, hsa
agggcaaccguugucaaggcuaugcucacgggaggcugggcaccacaguguuuccaagagcaag

SEQ ID NO: 160353 - RNA, 64 nt, hsa
auuccaagagagcuuaggaugacagcaccccugagcugggcaaagguacucaggaccucauagg

SEQ ID NO: 160354 - RNA, 64 nt, hsa
cuugggauuguuuuacaccauccuuuacuucccuugcucagaccucucuguuucaccauugcuc

SEQ ID NO: 160355 - RNA, 64 nt, hsa
gcaaaauauggccucaccaccagccccaaaucagugcucagacccucucugugucugugugccc

SEQ ID NO: 160356 - RNA, 64 nt, hsa
uacauguggcuaccccagcaacaagcgcauccugugcucagauaagcugcaugguugggagugu

SEQ ID NO: 160357 - RNA, 64 nt, hsa
uugaggcuuaguggagaugggcaccacugccauuugcucagaagaaggcuggucugguccuaac

SEQ ID NO: 160358 - RNA, 64 nt, hsa
gaugggaugguugcuaugccaagccuuguuucucugcucagaagaaguagagaagcuauuauca

SEQ ID NO: 160359 - RNA, 64 nt, hsa
ucuuaaucaagaauuaagcuugcaacauuggcuuugcucagaugcagauggaagugugaucaca

SEQ ID NO: 160360 - RNA, 64 nt, hsa
ggcagcucuuuucuucugcucagacccuuccccgugcucagacagugcaccgcugucccaucua

SEQ ID NO: 160361 - RNA, 64 nt, hsa
cucauuccaugcaucuuuggcagcucuuuucuucugcucagacccuuccccgugcucagacagu

SEQ ID NO: 160362 - RNA, 64 nt, hsa
aggcaucuaaagagaaacuguuuucagauccaagugcucagaucuaaagccucugcaacaaguc

SEQ ID NO: 160363 - RNA, 64 nt, hsa
gagcagauuuuaaaaaaaagauaugacugagcauugcucagaucacuguggccacacuuugcug

SEQ ID NO: 160364 - RNA, 64 nt, hsa
cagcgucaggugggaguacugcaaccugacgcgaugcucagacagaagggacuguggucgcucc

SEQ ID NO: 160365 - RNA, 64 nt, hsa
gugugugaggugggaguacugcaaccugacacaaugcucagaaacagaaucaguguccuagaga

SEQ ID NO: 160366 - RNA, 64 nt, hsa
caaagucagaugggaguacugcaaccugacacgaugcucagacacagaagggacugcagucgug

SEQ ID NO: 160367 - RNA, 64 nt, hsa
caaagucaggugggaguacugcaaccugacaggaugcucagacaagaauagggcuguggccgcg

SEQ ID NO: 160368 - RNA, 64 nt, hsa
gagagcucagaccacugcucagagcaguaaucccugcucagaaugcucccaguucccucguccc

SEQ ID NO: 160369 - RNA, 64 nt, hsa
cuccuaaggcuaagauguugagagcucagaccacugcucagagcaguaaucccugcucagaaug

SEQ ID NO: 160370 - RNA, 64 nt, hsa
uaacccaccuugaccauaaauuggcuuuucauagugcucagauguuucauaauucuucccccaa

SEQ ID NO: 160371 - RNA, 64 nt, hsa
cguguggaauuuuccacuucuggcaucacgucagugcucagaaauuuucugaucucagagcauu

SEQ ID NO: 160372 - RNA, 64 nt, hsa
cucauaggugcccagccagccucccagcuaaaggugcucagagccccacugcccccucucucug

SEQ ID NO: 160373 - RNA, 64 nt, hsa
ccucaaacugugcauguaagccuuuguuuuguucugcucagauauucuggauauuaccucuucu

SEQ ID NO: 160374 - RNA, 64 nt, hsa
gugcagauauugcacugugucaccucuggaucucugcucagaagcagaacaagugaugaccuaa

SEQ ID NO: 160375 - RNA, 64 nt, hsa
agucaccuccaguaacaagauggcaaaccaaguaugcucagauaagcuuuuuucauaauucagg

SEQ ID NO: 160376 - RNA, 64 nt, hsa
uccaaaggguacuugcgaugccggauuuaaaacuugcucagagccacuuagccacuugagaacc

SEQ ID NO: 160377 - RNA, 64 nt, hsa
caucucucagaccagcucacugaggcagaggaguugcucagaggcucacaugggcacccccauu

SEQ ID NO: 160378 - RNA, 64 nt, hsa
ugccucccgaguucaagcgauucuccugccucagccucccgaguagcuggaauuauaggcgugc

SEQ ID NO: 160379 - RNA, 64 nt, hsa
gcaguggcaccaucucaguucacugcaacuucugccucccgaguucaagcgauucuccugccuc

SEQ ID NO: 160380 - RNA, 64 nt, hsa
cgccucccggguucucaccauucuccugccucagccucccgaguagcugggacuacaggcgccc

SEQ ID NO: 160381 - RNA, 64 nt, hsa
ugccuccuggguucaagugauucuccagccucagccucccgaguagcugggauuaugggcgccc

SEQ ID NO: 160382 - RNA, 64 nt, hsa
cagcuccuaaccgcgagugauccgccagccucggccucccgaggugccgggauugcagacggag

SEQ ID NO: 160383 - RNA, 64 nt, hsa
gcuacaaccuccaccucccagcugccugccuuggccucccgaagugccaagagugcagccucug

SEQ ID NO: 160384 - RNA, 64 nt, hsa
cuucuccuggguccaagcaauuauugugccucagccucccgaguagcugagacuucaggugcau

SEQ ID NO: 160385 - RNA, 64 nt, hsa
ugccucccagguucaagcgauucuucugccucagccucccgaguagcugggaccacaggugccu

SEQ ID NO: 160386 - RNA, 64 nt, hsa
ccucaggugcuacacaguauaguucuaggguuucccucccgauaucaaaaagacuguggccugc

SEQ ID NO: 160387 - RNA, 64 nt, hsa
cgccucucuaguucaagcgauuuuccugccucagccucccgaguagcugggauuccaggcgccc

SEQ ID NO: 160388 - RNA, 64 nt, hsa
agcaugaagaaggagccaugaggaguucccaugaccucccgagacuugccauaaguguucuagu

SEQ ID NO: 160389 - RNA, 64 nt, hsa
gaauuccucaccucaggucauccgccugucucggccucccgaagugcugggauuauagguguga

SEQ ID NO: 160390 - RNA, 64 nt, hsa
caccuuccagguucaagugauucuccugccucagccucccgaguagcugggacuacgggcacgc

SEQ ID NO: 160391 - RNA, 64 nt, hsa
gcuguggugcaaucucggcucacugcaaccucugccucccgaguucaagcaauucuccugccuc

SEQ ID NO: 160392 - RNA, 64 nt, hsa
ugccucccgaguucaagcaauucuccugccucagccucccgaguagcugggauuacaggcgacc

SEQ ID NO: 160393 - RNA, 64 nt, hsa
cgucuccuggguucaagugauucuucugccucagccucccgagcagcugggauuacaggcgccc

SEQ ID NO: 160394 - RNA, 64 nt, hsa
ucaaucucuugaccucuugauccacccgacuuggccucccgaagugaugagauuauaggcguga

SEQ ID NO: 160395 - RNA, 64 nt, hsa
cgccucuuggguucaagcgauucuucugcuucagccucccgaguagcugggacuacaggcaccc

SEQ ID NO: 160396 - RNA, 64 nt, hsa
caaccuccugggcuaagugauccucccaccucagccucccgaauagcugggacuacagguguga

SEQ ID NO: 160397 - RNA, 64 nt, hsa
cgccucccgaguucaagcaauucuccugccucagccucccgaguagcugggauuacaggugccu

SEQ ID NO: 160398 - RNA, 64 nt, hsa
gcaguggcgcgaucuuggcucacugcaagcuccgccucccgaguucaagcaauucuccugccuc

SEQ ID NO: 160399 - RNA, 64 nt, hsa
ugccucccgaguucaagggauucuccugccucagccucccgaguagcugggauuacaggcgccc

SEQ ID NO: 160400 - RNA, 64 nt, hsa
gcaguggcgccaucucagcucacugcaacuucugccucccgaguucaagggauucuccugccuc

SEQ ID NO: 160401 - RNA, 64 nt, hsa
ggacuccugaucucaggugaccugcccaccucggccucccgaagugcugggauuacaaggguga

SEQ ID NO: 160402 - RNA, 64 nt, hsa
ccccuuccggguucaugccauucuccugccucagccucccgaguagcugggacuacaggcacgu

SEQ ID NO: 160403 - RNA, 64 nt, hsa
caccuccuggguucaagcaauucuccuucuucagccucccgaguagcugggauuacaggcaugc

SEQ ID NO: 160404 - RNA, 64 nt, hsa
caccucccggguucaagcaauucuccuucuucagccucccgaguagcugagauuauaggcgugc

SEQ ID NO: 160405 - RNA, 64 nt, hsa
guuauugccaauauuguuguuggucaauggcuugaagauaaacuuucuaauaauuauuauuucu

SEQ ID NO: 160406 - RNA, 64 nt, hsa
cauucccaguuucagccacaauuuagccaagaauaagauaaaaacuugaauaagaaguaaguag

SEQ ID NO: 160407 - RNA, 64 nt, hsa
cucaauuuugcugugaaccuaaaacugccauauaaagauaaagucuaggccaggcaugguggcu

SEQ ID NO: 160408 - RNA, 64 nt, hsa
uaucuuuuaaaaccucaaggcccuccacuguccuaagauaaagccucucauaggcacuggggac

SEQ ID NO: 160409 - RNA, 64 nt, hsa
ccaggcacugaaugucuaggacaugcuguggaugaagauaaagaugguggaauagguuuuauca

SEQ ID NO: 160410 - RNA, 64 nt, hsa
agaggcacaucuauggcuacuguucaaauacauaaagauaaauuuauuuucacacaguccacaa

SEQ ID NO: 160411 - RNA, 64 nt, hsa
uuauggccacucgagucaggaugcucuauuuauaaagauaaauguaauauauaaagggugagga

SEQ ID NO: 160412 - RNA, 64 nt, hsa
agacggcugaaagacagguuuuuuggaaacuguuaagauaaacuguaauccagacaccuaauuc

SEQ ID NO: 160413 - RNA, 64 nt, hsa
gucagaagaccaccugugcccuuuucucucguggaagauaaaaccuggacucagggagcaacca

SEQ ID NO: 160414 - RNA, 64 nt, hsa
aauuuuguuccuuuucaucauagaaaacauguuuaagauaaaauacaaacuuuaccuaccccaa

SEQ ID NO: 160415 - RNA, 64 nt, hsa
auuguagagcuugguggcugagcuuggcccuauuaagauaaauagaguuccaaauaaggauuug

SEQ ID NO: 160416 - RNA, 64 nt, hsa
uagggcagucaguaguauucuaaagcuuucugacaagauaaaggaagucaccaaaauuucuuuu

SEQ ID NO: 160417 - RNA, 64 nt, hsa
uuaguaagaugguuuuucagcaaauggcauucccaagauaaagcuguugugcuuuaacucauuu

SEQ ID NO: 160418 - RNA, 64 nt, hsa
ccaauuauuuugaugcaaaagaaauucaguuuauaagauaaaucugaaaaauccauaaugaaau

SEQ ID NO: 160419 - RNA, 64 nt, hsa
agggaugccugagauggcaguucaugaagcacagaagauaaagaagaagucuuucaucuuuacu

SEQ ID NO: 160420 - RNA, 64 nt, hsa
ggaauucuucaaguuuaaaucuggacacaaaaauaagauaaauguauggcaucauuuagggaug

SEQ ID NO: 160421 - RNA, 64 nt, hsa
uauacuugcauccaccuacaaauauaaccuuuucaagauaaaucgcuuaugauuucaauaguca

SEQ ID NO: 160422 - RNA, 64 nt, hsa
aguuacauuugcauuuaauuaaucuuaaaguugcaagauaaacagcuguaauucggacaaacau

SEQ ID NO: 160423 - RNA, 64 nt, hsa
uaauuuuguggcucccuaaugcaauaauguacagaagauaaaaaaauuuauaauugaacaauuu

SEQ ID NO: 160424 - RNA, 64 nt, hsa
aaaguagcuuugaauuuucucuguaagagaauaaaagauaaaauaauguauuuucuuuauuuca

SEQ ID NO: 160425 - RNA, 64 nt, hsa
ggcuaaaauaaacagguuguggcugaugguguugaagauaaauaagcuuaaacaaauaacuuug

SEQ ID NO: 160426 - RNA, 64 nt, hsa
acucugucucaaaaaaaaaaaaaaagaaaagaaaaagauaaagggauugugaaaagagcauuua

SEQ ID NO: 160427 - RNA, 64 nt, hsa
uacugaaguuaagugcauuguuuucaggaaucaaaagauaaaggggccgggugugguggcucac

SEQ ID NO: 160428 - RNA, 64 nt, hsa
auaacuacauaaagcagugaagcaaaggcaaauuaagauaaagcuagaaagucugaacauuuua

SEQ ID NO: 160429 - RNA, 64 nt, hsa
aucacggaauuuauguauaguuucucuaauauagaagauaaaauugguguccucauaacuuuaa

SEQ ID NO: 160430 - RNA, 64 nt, hsa
ugaagaaauugauuacaguuccacuaaauuguugaagauaaauuauuuuuaaagguuaugaaaa

SEQ ID NO: 160431 - RNA, 61 nt, hsa
auauuucaggaggagaaugaguauguuaaugaagauaaaaagaagugacaucucuuguaca

SEQ ID NO: 160432 - RNA, 64 nt, hsa
uuuuuucacguuagaagacaugaagaaauuuuaaaagauaaacaucuauauugugaaccaucag

SEQ ID NO: 160433 - RNA, 64 nt, hsa
agauaaacaucuauauugugaaccaucagcugaaaagauaaauuuguguucaauauauaggcag

SEQ ID NO: 160434 - RNA, 64 nt, hsa
cagcuuuggcucuggcugcuuuuuagaauaaugcaagauaaaaaucacaccugagggcugaaaa

SEQ ID NO: 160435 - RNA, 64 nt, hsa
ccccgaagacacuccuuccccaaguaauuguaggaagauaaaaaaacuguuaccagauaacaaa

SEQ ID NO: 160436 - RNA, 64 nt, hsa
ccugggucccucccacaacaugugggaauuccagaagauaaauucaaguugcaauuucaguggg

SEQ ID NO: 160437 - RNA, 64 nt, hsa
guuaauuugaggacugggcugucuuggggcucagaagauaaagaacuauuugagcagaugugug

SEQ ID NO: 160438 - RNA, 64 nt, hsa
agacuccaucucaaaaaaaaaaaaaaaaaaaaaaaagauaaaaagucagaaaucugaaaagugg

SEQ ID NO: 160439 - RNA, 64 nt, hsa
agggccugaugacauccaauacagaguucugguaaagauaaaauuugauacagguuugguguca

SEQ ID NO: 160440 - RNA, 64 nt, hsa
gagaagggagcugaggccauucccuguaggaguaaagauaaaaggauaggaaaagauucaaagc

SEQ ID NO: 160441 - RNA, 64 nt, hsa
guaaaguugaggggagaggaaaucuuaagauuacaagauaaaaaacgaauccccuaaacaaaaa

SEQ ID NO: 160442 - RNA, 64 nt, hsa
gggucuuggcugaaaaaaaaaaaugcuuuuaaaaaagauaaaaugaaaaggagagcucucuuuu

SEQ ID NO: 160443 - RNA, 64 nt, hsa
cacccuguguggcucauucccacccaggaaacugaagauaaaagauuugggaaaacacaccaag

SEQ ID NO: 160444 - RNA, 64 nt, hsa
cagaaaguuaaguguauacuacaaacucuaauuaaagauaaaaaucuuuucuacuuuucuuugu

SEQ ID NO: 160445 - RNA, 64 nt, hsa
augcuuuuuuauguguuuuuacauuuuuugaaagaagauaaaugguucauccagagcuuuauua

SEQ ID NO: 160446 - RNA, 64 nt, hsa
cauacuuauccucugaacacauaaauaagugaauaagauaaaaauaucuuuaccuuauuaauau

SEQ ID NO: 160447 - RNA, 64 nt, hsa
guuuuugugauuuaugcgauuaaacgaaaugauaaagauaaaaccauauuauuaaauaccuaua

SEQ ID NO: 160448 - RNA, 64 nt, hsa
cauugauaagaguccuauaaauaagauaaauacgaagauaaagcuuuauucuuuaguguuaaaa

SEQ ID NO: 160449 - RNA, 64 nt, hsa
uacaaaguucuucauugauaagaguccuauaaauaagauaaauacgaagauaaagcuuuauucu

SEQ ID NO: 160450 - RNA, 64 nt, hsa
cguauauuaaaccuguugaaaugauaauuauguaaagauaaauauucuagguuagucaagauuu

SEQ ID NO: 160451 - RNA, 64 nt, hsa
uuugugugcuugcguugaugacuuuuuuaacuucaagauaaaucaaaguaauaaguuuaacgua

SEQ ID NO: 160452 - RNA, 64 nt, hsa
gccuuagugauaagcuuucauggcagagcacgucaagauaaauggguauacuggaauccgaugc

SEQ ID NO: 160453 - RNA, 64 nt, hsa
acucuucaugugaaucuuaacuugcaaaaggagaaagauaaaauacagaagacuggccccagag

SEQ ID NO: 160454 - RNA, 64 nt, hsa
gaguuugguuaucaauauaacuuucggauuaguuaagauaaaagcauacauuguccacagguga

SEQ ID NO: 160455 - RNA, 64 nt, hsa
uugauuuacauauaguuaaauauauguuagucuaaagauaaaccuuaaguguaagaaaauuaua

SEQ ID NO: 160456 - RNA, 64 nt, hsa
uuuuuaaaaucguucauagacuucuguaaaaugcaagauaaauuaaaguuauuauaacagugau

SEQ ID NO: 160457 - RNA, 64 nt, hsa
gccaucagaguggauauaccguuguauuaaaaacaagauaaaaaagcugccaagauuuuuggcg

SEQ ID NO: 160458 - RNA, 64 nt, hsa
acuuugaauguuuuaacagcaagaauuuuaagaaaagauaaacaccauuuuauuuauuuauaaa

SEQ ID NO: 160459 - RNA, 64 nt, hsa
aacaguucuccagagcaucuugaacaggaauauuaagauaaaugugaaucugcaauggcugaaa

SEQ ID NO: 160460 - RNA, 64 nt, hsa
uaguuuuaauuaucauugcuaucaaauaauuucuaagauaaaagccugaauuugaaauauuuuu

SEQ ID NO: 160461 - RNA, 64 nt, hsa
ucuaaccaauagucacuacaucucauacauuggcaagauaaauaguugucauauuuguuggguc

SEQ ID NO: 160462 - RNA, 64 nt, hsa
gagaugccaguaguguucaaaguuguauuuuuaaaagauaaauauuccuuuuuauaccucaguu

SEQ ID NO: 160463 - RNA, 64 nt, hsa
uaaugcaagcauacccucccuugagucucaauugaagauaaaagaauguacugagcaagcaaag

SEQ ID NO: 160464 - RNA, 64 nt, hsa
ccuaaaucucuuugccuaacaacuugggauccugaagauaaauauguguuggacaagcauagaa

SEQ ID NO: 160465 - RNA, 64 nt, hsa
aaucucaggugggacuuggcgcucucucuuuucugcaugucaaguucugagcgcggacauguuu

SEQ ID NO: 160466 - RNA, 64 nt, hsa
gaggccuuguuggcacuagauuuggguauuuucugcaugucauaacauauccuaacugcuauuu

SEQ ID NO: 160467 - RNA, 64 nt, hsa
ccaccugccccauguccacugggcugcccaagcugcaugucaccugagggcuggcaggaagggg

SEQ ID NO: 160468 - RNA, 64 nt, hsa
ugguaauagguaucagagcagucuagagacaauugcaugucaaaaaauguacauucauuuuuag

SEQ ID NO: 160469 - RNA, 64 nt, hsa
uacuauauagcaagauacagagaaaauuguuuuggcaugucagagccuuauuugguuagcagac

SEQ ID NO: 160470 - RNA, 64 nt, hsa
ccaaagugaaagggaagcccccgucucucuaacugcaugucaucaggggugagccugccuuucc

SEQ ID NO: 160471 - RNA, 64 nt, hsa
gcagggcaccacagcgcccccuacugaaccaucagcaugucaguggcauuuaaagccaugcagc

SEQ ID NO: 160472 - RNA, 64 nt, hsa
ugauuccugcuucgucuguauccgcagaguaguugcaugucauuuggccuguuuucuaaauaau

SEQ ID NO: 160473 - RNA, 64 nt, hsa
ucaucaucaucaucucugcuacagucauguuucugcaugucagcgagcgacacugucccugccu

SEQ ID NO: 160474 - RNA, 64 nt, hsa
gcagccuccagcaugggcgucauagccaucacgagcaugucacagugcugcagagauuuuguuu

SEQ ID NO: 160475 - RNA, 64 nt, hsa
caagguucucuucuguucccauggauccugcagagcaugucaggagugaaaccauccauaacug

SEQ ID NO: 160476 - RNA, 64 nt, hsa
uuaaaaaaauuaacuauacaguuaaugguuuagaacuuagaacuacuuagaauuaaugcuaaag

SEQ ID NO: 160477 - RNA, 64 nt, hsa
uaacuauacaguuaaugguuuagaacuuagaacuacuuagaauuaaugcuaaagugucaggaag

SEQ ID NO: 160478 - RNA, 64 nt, hsa
uacguagguagagaauacaacaaagaguucuaagacuuagaaaagacaauuuuguggugucauu

SEQ ID NO: 160479 - RNA, 64 nt, hsa
ccuauaauauacaaauuuuccuguaauaaagucaacuuagaaacuccaaggagguuacauguuu

SEQ ID NO: 160480 - RNA, 64 nt, hsa
caaugaauacguaaacauacagugacaacauuaaacuuagaaaaguuuuaaaacuuaauggauc

SEQ ID NO: 160481 - RNA, 64 nt, hsa
auuucuucgcacuucugagacggcaaagccaaccacuuagaagccuuccacaucuuugucaccu

SEQ ID NO: 160482 - RNA, 64 nt, hsa
auuauaaaacccuucauaaaucaagaaggccaucacuuagaacgaaccccaaacaaaaaugcca

SEQ ID NO: 160483 - RNA, 64 nt, hsa
caaaucuaagcaaucauuuuuccccccagaaguuacuuagaaggagaacugggaacacuugggg

SEQ ID NO: 160484 - RNA, 64 nt, hsa
gaacucagucuugauaacugaaaugacuuauuucacuuagaauacauuucucccuucucugcca

SEQ ID NO: 160485 - RNA, 64 nt, hsa
uuaaauagcauuuuugcaccaguaaaaauagauaacuuagaacucagucuugauaacugaaaug

SEQ ID NO: 160486 - RNA, 64 nt, hsa
auuuuuauguuuauaaaguguaauuuuuagguucacuuagaauauauuuuauuuaauaaguuaa

SEQ ID NO: 160487 - RNA, 64 nt, hsa
caaauucuuauuuuuguacaguuuugaaguuuauacuuagaacugaccaccuccccggccacgc

SEQ ID NO: 160488 - RNA, 64 nt, hsa
cgguaccaauccuaggaacuguauacuaguuccuacuuagaacaaaaguaucaaguuugcacac

SEQ ID NO: 160489 - RNA, 64 nt, hsa
uucuaaguacuuuacuuguauuaucccauuuaauacuuagaacaaccccgugagauaaguaguu

SEQ ID NO: 160490 - RNA, 64 nt, hsa
augacucuugggugagcaacggcaccuauuuggaacuuagaaaagaucuugguuuuuccaaacu

SEQ ID NO: 160491 - RNA, 64 nt, hsa
uuuccucgaugccucagguuucuagaggaagggaacuuagaagaagcugaaauacaaaagcaga

SEQ ID NO: 160492 - RNA, 64 nt, hsa
uuguuacucugguuguugugccaaauugugguacacuuagaaaauucuacagucgucgauuuuu

SEQ ID NO: 160493 - RNA, 64 nt, hsa
ccacaaggaggaaggaagggcaaccuaaaagcccacuuagaaacuuuuuggauaugccacugca

SEQ ID NO: 160494 - RNA, 64 nt, hsa
accacuaauagcagucauagugaagauuagcacuacuuagaauuaaauuaggaagucuuuuauc

SEQ ID NO: 160495 - RNA, 64 nt, hsa
aggauuuagauguauagaaaaguaagaaaaucuuacuuagaaaaaagccccuugaaacuugcag

SEQ ID NO: 160496 - RNA, 64 nt, hsa
ucagauuaucucuuuuuuucuaaaggagagaaagacuuagaacauacacagauccuaaguagaa

SEQ ID NO: 160497 - RNA, 64 nt, hsa
gacuugagaauguuuuucucuaaaugagagaaagacuuagaauguacacagauccaaaauagaa

SEQ ID NO: 160498 - RNA, 64 nt, hsa
uugcucugugguaagagauaugcucauuauuaccacuuagaagauguuguuaaaaacaugugaa

SEQ ID NO: 160499 - RNA, 64 nt, hsa
uaguaucacugcuuuuuccuuagcuuaaugacuuacuuagaauuuauccuuuauuuuaaaugau

SEQ ID NO: 160500 - RNA, 64 nt, hsa
caguugauuaauuuugcguuaaagacugacacagacuuagaaucaaauuuauuuuucuggaauu

SEQ ID NO: 160501 - RNA, 64 nt, hsa
gaaacugacuuuaaaagccuccuugaaguuuuuuacuuagaaauauaaggaauaagucuuugaa

SEQ ID NO: 160502 - RNA, 64 nt, hsa
guaagugacaaguauuuuuucugaacagaaguuuacuuagaaauaccaugcacuuggggguacc

SEQ ID NO: 160503 - RNA, 64 nt, hsa
uauuauucauuacugcauccccaguaaugaaaguacuuagaaaauaauuauugaaugaaugaaa

SEQ ID NO: 160504 - RNA, 64 nt, hsa
ucaccauggaugaaacuauaacuuaaagaauaauacuuagaaggguuaauuggaaaucagaguu

SEQ ID NO: 160505 - RNA, 64 nt, hsa
aaugcuucauccuguugcuggcagugggauguggacuuagaaaaucaaguucuagcauuuuagu

SEQ ID NO: 160506 - RNA, 64 nt, hsa
agacaucucuuuuaaaaaagugccagaugccccagugccagagcugcgaacgugaacacagugg

SEQ ID NO: 160507 - RNA, 64 nt, hsa
uucaucuagaggcagagacaucucuuuuaaaaaagugccagaugccccagugccagagcugcga

SEQ ID NO: 160508 - RNA, 64 nt, hsa
aaaagaaaugggagcuggucacacagggccuugugugccagacuaagggguuuguaguauauau

SEQ ID NO: 160509 - RNA, 64 nt, hsa
ggagaggacccucagugucauaucaggaagcccagugccagaggacagacagguucaaaacugg

SEQ ID NO: 160510 - RNA, 64 nt, hsa
cuauccugggcugcucaguguucccaggcccugugugccagaggccaggucucuccaagugcau

SEQ ID NO: 160511 - RNA, 64 nt, hsa
gcugcucccucgugcacagcgcaggggaggaugggugccagagggugggagugggugcgcgugu

SEQ ID NO: 160512 - RNA, 64 nt, hsa
agagaugaaacucccuaaaaugccugagauggcugugccagagguucgacuccccgaggugcag

SEQ ID NO: 160513 - RNA, 64 nt, hsa
agaggugcggcuuccagaggugcagcugccgaaagugccagagaugaaagucccugagaugaag

SEQ ID NO: 160514 - RNA, 64 nt, hsa
agagaugaaacucccagaggugucagagguggcugugccagaggugcggcuuccagaggugcag

SEQ ID NO: 160515 - RNA, 64 nt, hsa
gcugcugaaagugucggagaugaaacucccaaaggugccagagauggcugugccggaggugcgg

SEQ ID NO: 160516 - RNA, 64 nt, hsa
gcugcccaaagugucagagaugaaacucccaaaggugccagagauggcugugccggaggugcgg

SEQ ID NO: 160517 - RNA, 64 nt, hsa
gcuccccaaggugucagagaugaaacucccaaaggugccagagauggcugugccggaggugcgg

SEQ ID NO: 160518 - RNA, 63 nt, hsa
aucccaguccggcuaagcuugguggagcauuuucccauugagagccuuccaugggaacucaau

SEQ ID NO: 160519 - RNA, 63 nt, hsa
auuugaggguacucugacugcaacaucuuucaccccauugaucgccaggauugauuugguuga

SEQ ID NO: 160520 - RNA, 63 nt, hsa
ggguuucuagcggugccugaggcaucacucuggcccauugacagaugagaggucugaagccuu

SEQ ID NO: 160521 - RNA, 63 nt, hsa
ccgcugcgguacacuggaugguucugaagcuggcccauugaaagagccucuuaaggcagcugg

SEQ ID NO: 160522 - RNA, 62 nt, hsa
agccgcggcaucgcuucugauggccccgaauccccauugagcagcacaaagcccguuugggg

SEQ ID NO: 160523 - RNA, 63 nt, hsa
ccucuggaugcacucugaugauaccaugguuaccccauugagcucuguuuaaauaaauauugu

SEQ ID NO: 160524 - RNA, 63 nt, hsa
uagugaugugacuuccaaguagaauuuaaucuccccauugagugugucaugguacaaaucacu

SEQ ID NO: 160525 - RNA, 64 nt, hsa
cugcaaugagcuggguagaagagguuaguuuuauagacaggaaggggcugucaaaggcagaaag

SEQ ID NO: 160526 - RNA, 64 nt, hsa
agaacaaaaaaaaagauugauuuuuuuuuuuuugagacaggaucucacucugucauccaggcug

SEQ ID NO: 160527 - RNA, 64 nt, hsa
cucacacuuguaaucccagcaauuugggaggcugagacaggaggauugccugaggccaggaguu

SEQ ID NO: 160528 - RNA, 64 nt, hsa
uccauggggcuauaguagagaguuaguggaauauagacaggacucugaaaacacaacuuccagc

SEQ ID NO: 160529 - RNA, 64 nt, hsa
cgcuaaggcuaagguaggagccagagagcuguagagacaggaccaccaggaugcuucaugucca

SEQ ID NO: 160530 - RNA, 64 nt, hsa
uagaaacucagccaaggagaccugacuuuaucugagacaggaaggcagugguuaaaagaauuaa

SEQ ID NO: 160531 - RNA, 64 nt, hsa
cagugauuagacaggaaggaagacauuagugauuagacaggagggaagauauuagugauuagac

SEQ ID NO: 160532 - RNA, 64 nt, hsa
aguaaaugacuauuuuucccuuaacucagugauuagacaggaaggaagacauuagugauuagac

SEQ ID NO: 160533 - RNA, 64 nt, hsa
cggccagugcagugaugccuggcgcuuccagcugagacaggaguccggacagaggugggcaggg

SEQ ID NO: 160534 - RNA, 64 nt, hsa
ugucuaucccagccggauuuaaagcagucacuucagacaggagccacagggagccugugaggga

SEQ ID NO: 160535 - RNA, 64 nt, hsa
agcagugaguuacagcgagaggcagagaaagaagagacaggagggcaagggccaugcugaaggg

SEQ ID NO: 160536 - RNA, 64 nt, hsa
cgggcgccuguagucccagccacucgggaggcugagacaggagaaucgcuuaaaccugggaggc

SEQ ID NO: 160537 - RNA, 64 nt, hsa
aaucagagagcucacuaaaaugcuaauuaggcaaagacaggagguaaagaaauagccaaucauc

SEQ ID NO: 160538 - RNA, 64 nt, hsa
cacuuagguuuuccuguugagaugggggacugagagacaggacuagcuggauuuccuaggcuga

SEQ ID NO: 160539 - RNA, 64 nt, hsa
acaaaugagggccagggaggaaccggaaaaugggagacaggauuuucuaaaagcuagaaaaaaa

SEQ ID NO: 160540 - RNA, 64 nt, hsa
aauccccucacagugggcgacagaucugaagugaagacaggagaugaugagaaaagcucaccgc

SEQ ID NO: 160541 - RNA, 64 nt, hsa
aguccaaaaagcacccacagagaggcaaugggugagacaggaauccccucacagugggcgacag

SEQ ID NO: 160542 - RNA, 64 nt, hsa
aaagggaacaucagggucaaauggaaaucaccugagacaggaaacagggaguucauuuggccac

SEQ ID NO: 160543 - RNA, 64 nt, hsa
ugcacugggggacuggaugcuagccaucuccaggagacaggaucaguuuuacggaaacaacuca

SEQ ID NO: 160544 - RNA, 64 nt, hsa
ugggcaccuuggaccuccagcuggccaauagaagagacaggagacaggaagccuucccauuuuu

SEQ ID NO: 160545 - RNA, 64 nt, hsa
cuuggaccuccagcuggccaauagaagagacaggagacaggaagccuucccauuuuuucaaagu

SEQ ID NO: 160546 - RNA, 64 nt, hsa
cuuucuuauacagaugguguccauuugcuccaccagacaggaguuaaaaaccuuuaaagagcau

SEQ ID NO: 160547 - RNA, 64 nt, hsa
cguuuguauacagaugguguccauuugcucaaccagacaggaguuaacuuguauuagaauuguu

SEQ ID NO: 160548 - RNA, 64 nt, hsa
gacuacaggugugagucaccacuguauuuuuugcagacaggaucucccuguuuccuaggcuggu

SEQ ID NO: 160549 - RNA, 64 nt, hsa
acuuuucuuucuuuuuuuuucggggagggguuaaagacaggaucucacucuggcgcucuggagu

SEQ ID NO: 160550 - RNA, 64 nt, hsa
ccccaaaaugcaagauuuuccacaagauucccagagacaggaaaauccucuggcuggcuaacug

SEQ ID NO: 160551 - RNA, 64 nt, hsa
ugccuaaguggcugcugacugauguugagggaacagacaggagaaaugcauccauuccucaggg

SEQ ID NO: 160552 - RNA, 64 nt, hsa
cagcacgcccagcuaauuuuuguauuuuuaguagagacaggauuucaccauguuggccaggcug

SEQ ID NO: 160553 - RNA, 64 nt, hsa
cgcugccaggcggugguguucagaacccuucugcagacaggaauuugcuggaccuccucucagc

SEQ ID NO: 160554 - RNA, 62 nt, hsa
guguacauaucuuaggaggguuaucuauguuaucugaguauauguuuggguaaccaaauugg

SEQ ID NO: 160555 - RNA, 62 nt, hsa
aggaauguguuuucauuguuuuaaguuuuucuucugaguaaaacaaaauuauagaaaacaaa

SEQ ID NO: 160556 - RNA, 62 nt, hsa
uggaagaccuuuuaaagcauuguuuuagaaugucugaguauuaagauacagauuaauuggga

SEQ ID NO: 160557 - RNA, 62 nt, hsa
cugaguauuaagauacagauuaauugggaauaucugaguauuaaguacuuucuucagaguau

SEQ ID NO: 160558 - RNA, 62 nt, hsa
uaaccugaaauauauaguuguuucugaguaguucugaguaggaaagaaccaaauguaaauuu

SEQ ID NO: 160559 - RNA, 62 nt, hsa
ugugcucagauaaccugaaauauauaguuguuucugaguaguucugaguaggaaagaaccaa

SEQ ID NO: 160560 - RNA, 62 nt, hsa
cacauccauuuuguuuuugcuuuaauuuguguucugaguauuuggugcacaauggaaauuau

SEQ ID NO: 160561 - RNA, 62 nt, hsa
ucugagacuuuucuuuguuuagcaccccguuuucugaguacauacugaucuuucauaaucca

SEQ ID NO: 160562 - RNA, 62 nt, hsa
uuugaugggaacagagguguuuagagaaagccucugaguaugccuuucagauuuugaacaag

SEQ ID NO: 160563 - RNA, 62 nt, hsa
gugcuguguuacauacacauacuuucuuggcuucugaguagcucagguguggcuuuuggcug

SEQ ID NO: 160564 - RNA, 62 nt, hsa
ccucccggguucaagcaguucugucucagccuucugaguagcugggacuacaggugcaugcc

SEQ ID NO: 160565 - RNA, 62 nt, hsa
aguaguuacuaaguuaacuaguuauucuugcuucugaguauaacgaauugggaugucuaaac

SEQ ID NO: 160566 - RNA, 62 nt, hsa
acuuugccgaccugggcauguuuccaccguuuucugaguagcugcggccagagugaggcucc

SEQ ID NO: 160567 - RNA, 62 nt, hsa
uccagcucuguccuaggagcauaggcgggaaaucugaguagagucugacugcaguuuuugcu

SEQ ID NO: 160568 - RNA, 62 nt, hsa
aucacguuguacugaucccagguuuuuuacuuucugaguaguuguccaucacuuugaggacu

SEQ ID NO: 160569 - RNA, 62 nt, hsa
ucucucucucucucucucucucgccauaccucucugaguauuuagcuauuguucuauauacu

SEQ ID NO: 160570 - RNA, 64 nt, hsa
uuacugaaaccaaaauauauuugcuucaucugccccuacuaaccaucccccugccugcugccuc

SEQ ID NO: 160571 - RNA, 64 nt, hsa
cugcccugcgugcugguuccuucagaccccuaacccuacuaaccagcaggcucaucucaccucc

SEQ ID NO: 160572 - RNA, 64 nt, hsa
uguaggaccucugaguggcuguauaauuguuaauucaaaugaaauucauuuaaacaguugacaa

SEQ ID NO: 160573 - RNA, 64 nt, hsa
uuaaaaaaucacguuagccuccaaaccauuuaauucaaaugaacccaucaacuggaugccaacu

SEQ ID NO: 160574 - RNA, 64 nt, hsa
uauuuuauucuuuaauggaaaaagccauuaauauucaaaugaagggaucacauuaaaaaaaacc

SEQ ID NO: 160575 - RNA, 64 nt, hsa
ucuugagaugcaaaaguucacuguugcaguguuuucaaaugaccaaucaaguacuacuucuugg

SEQ ID NO: 160576 - RNA, 64 nt, hsa
ccauguuggccaggcugguuucaaacuccugagcucaaaugauccuccugccuuggccucccaa

SEQ ID NO: 160577 - RNA, 64 nt, hsa
auucauagcaaagggcagccagugugugcagaaaucaaaugacagagaggaagugagagagaga

SEQ ID NO: 160578 - RNA, 64 nt, hsa
ugaaaugaaauucauuuauuugucuugacaauguucaaaugauguagauugucuuagaaugaau

SEQ ID NO: 160579 - RNA, 64 nt, hsa
ucgucucauauuugccucauucauccuauuaauuucaaaugauacugugggggaaaaacagggu

SEQ ID NO: 160580 - RNA, 64 nt, hsa
cagugggaugucucucugugagcacaaaggcuuaucaaaugacacuaaaaauaaguucaacaac

SEQ ID NO: 160581 - RNA, 64 nt, hsa
gugggggaggaaggcagcagcugaagaaaaaagcucaaaugaucuagucacuuucgauacugua

SEQ ID NO: 160582 - RNA, 64 nt, hsa
auuucccagccuuucuucacaacacuuucuaacaucaaaugacucucaucaucaacaaauugua

SEQ ID NO: 160583 - RNA, 64 nt, hsa
gaauuuggggaaaauauccugaaacucacuuuggucaaaugauuauuguguugucacuggaagu

SEQ ID NO: 160584 - RNA, 64 nt, hsa
uuagagcuauguaggaacauagagguaucugugaucaaaugacuugucauuggcacuuucaguc

SEQ ID NO: 160585 - RNA, 64 nt, hsa
agcagugaugauauucagauuguuuuauuuugauucaaaugaugaaucuguugacaccuuauaa

SEQ ID NO: 160586 - RNA, 64 nt, hsa
cagcucucagugauguuagauggaaacuuauaucucaaaugauaggauugugaugcuuuuuuug

SEQ ID NO: 160587 - RNA, 64 nt, hsa
gaucuuggcucacugcaaccuccaucucccggguucaaaugauucuccugccucagccucuuga

SEQ ID NO: 160588 - RNA, 64 nt, hsa
gcaauaugcuuucccuuuacacccuguaauuuauucaaaugauauuaaaauacaagaccauugc

SEQ ID NO: 160589 - RNA, 64 nt, hsa
uaauguaauaggucaaaaaucagauuauuuucauucaaaugaggaugaugagucacuguaauau

SEQ ID NO: 160590 - RNA, 64 nt, hsa
gaccuaaguuauuuugcugucccguuuuuguaaaucaaaugaaauuauaaaagaggauucugac

SEQ ID NO: 160591 - RNA, 64 nt, hsa
cagaaaagugaacugaguuuucguaguuaagaccucaaaugaggggagucagcagugaucaugg

SEQ ID NO: 160592 - RNA, 64 nt, hsa
uuuccaaaacuguggcagcuaacuuuuuaaaaucucaaaugacaugcagugugaguagaaggaa

SEQ ID NO: 160593 - RNA, 64 nt, hsa
ggugcuaagaauuucaggauuauuguauuuacguucaaaugaagauggcuuuuguacuuccugu

SEQ ID NO: 160594 - RNA, 64 nt, hsa
uuugaaagauuucauuaagacugauggguaacuuucaaaugagggucauguacaaauauuggga

SEQ ID NO: 160595 - RNA, 64 nt, hsa
auuuuucaugacguuucaugauuugcuguugguuucaaaugaaacuacaaaucuggcauguuuu

SEQ ID NO: 160596 - RNA, 64 nt, hsa
ugaacaguauuaggcaacuuuucauuuuugcuuuucaaaugacauuggucuuuauuuccaguag

SEQ ID NO: 160597 - RNA, 64 nt, hsa
uauguucgguuugccuucaccugguguaguaaaaucaaaugagauuauuugguauguguuuugc

SEQ ID NO: 160598 - RNA, 64 nt, hsa
auaugaugagaagcaacaacauauuguauauuguucaaaugaucuucuaggagauuuguuuggc

SEQ ID NO: 160599 - RNA, 64 nt, hsa
ggaauaagcccugcccaguauguagacaaccaauucaaaugauugugcuaacuuauuuccccua

SEQ ID NO: 160600 - RNA, 64 nt, hsa
uaauagaaugggcauguauuguaacaguuuuaugucaaaugaucugugcuguagaaaaacauua

SEQ ID NO: 160601 - RNA, 64 nt, hsa
ucaaguuacaguggcuuauguuuuucauaguaauucaaaugaacuuccuauuuuugauaguaaa

SEQ ID NO: 160602 - RNA, 64 nt, hsa
cccgugugacccguuccagguccccugggcucccucaaaugacagaccuaacuauuccugugua

SEQ ID NO: 160603 - RNA, 64 nt, hsa
caaaaucauuucuuuagagggaaggaauaaucauucaaaugaacuuuaaaaaagcaaauuucau

SEQ ID NO: 160604 - RNA, 64 nt, hsa
uuaaacuuuuugcaugcuucuauguagaaaauaaucaaaugauaauagauacuuauaaugaaac

SEQ ID NO: 160605 - RNA, 51 nt, hsa
uccauuacagucaaggcuaagucaaaugaaacugaauuuuaaacuuuuugc

SEQ ID NO: 160606 - RNA, 64 nt, hsa
cauguggaccaugaacaguauucauucuacuuuuucaaaugauaugcuguagaaaauauuccuu

SEQ ID NO: 160607 - RNA, 64 nt, hsa
ucaugcaguuuguuugaaguuaaguggaauccuuucaaaugacgagcugcagagaacucagcac

SEQ ID NO: 160608 - RNA, 64 nt, hsa
gaagauagaggauaugaaaugccauaagacccaaucaaaugaagaaauaaacccagcacaaccu

SEQ ID NO: 160609 - RNA, 64 nt, hsa
aagcauguguaauuucuugugaagaagccaacacucaaaugacuuuuaaaguuguuuacuuuuu

SEQ ID NO: 160610 - RNA, 64 nt, hsa
ccuucccuccucagugucuuucaaaugacuuucaucaaaugacuuucaaaauaaaaccuuauuu

SEQ ID NO: 160611 - RNA, 64 nt, hsa
ugggucuuaggccuccuucccuccucagugucuuucaaaugacuuucaucaaaugacuuucaaa

SEQ ID NO: 160612 - RNA, 64 nt, hsa
guauuaaccagcaggagaggugaugagccauuuuucaaaugaaauaccuuuuauuuccauauaa

SEQ ID NO: 160613 - RNA, 64 nt, hsa
aauaaagaaagugugaggucuacuuuaaaaaaauucaaaugaagagaaaaagaaaaacagcauu

SEQ ID NO: 160614 - RNA, 64 nt, hsa
aucaaauaauauucaugaagaguuguuuauaaugucaaaugaaaccuacaggaaucucugauua

SEQ ID NO: 160615 - RNA, 64 nt, hsa
cuaaagaccauuuaaucuugaaggaacacaaagaucaaaugaaaaguaaaacacucuaaauaaa

SEQ ID NO: 160616 - RNA, 64 nt, hsa
auuauagugacugaagaaagaauaggcaaacuuuucaaaugaaaauggauauuuaguguauuuu

SEQ ID NO: 160617 - RNA, 64 nt, hsa
acaguuugcuugaguuauagaaaccagccugucaucaaaugauucuaguucuaggacuuuguag

SEQ ID NO: 160618 - RNA, 64 nt, hsa
gcuauuugagggacuaagggauggagauauucugucaaaugaaucucuucaguauaccaguuug

SEQ ID NO: 160619 - RNA, 64 nt, hsa
aaaauguguggcaagaugauacagcuacacaguaucaaaugaaugggucaauucagcaccccca

SEQ ID NO: 160620 - RNA, 64 nt, hsa
uucucuuauggauuuuaauaagcuccaguauuauucaaaugaucaaaaauauaguuauaauuuu

SEQ ID NO: 160621 - RNA, 64 nt, hsa
uuucaccaucugaaaauucacaaaacuucuugcuucaaaugaaaaaaucccaacuauugagcau

SEQ ID NO: 160622 - RNA, 64 nt, hsa
cgauuuugugcauaguaaugacacagcaccauuccugagaaauaggaaauauauguguguggua

SEQ ID NO: 160623 - RNA, 64 nt, hsa
gguucugugcguguaccauguugccugacacguccugagaaaucuucuuaaacucugaguuuau

SEQ ID NO: 160624 - RNA, 64 nt, hsa
gucuucucagaaaccaccaaccuugaagugucuucugagaaaccaccaggcuugaagguaauga

SEQ ID NO: 160625 - RNA, 64 nt, hsa
aacaaggauggagaaaaaucuaggacagugucuucugagaaaccaccaggcuugaagguaauga

SEQ ID NO: 160626 - RNA, 64 nt, hsa
gcagggugucaugcaugggugcagaggauggaggcugagaaagguagacagcuacccaugaucu

SEQ ID NO: 160627 - RNA, 64 nt, hsa
acuugagauguauaaaacuagagcugaaaagaagcugagaaaucaccuugucuggugauuuucu

SEQ ID NO: 160628 - RNA, 64 nt, hsa
gcucaucccuuauuaagcaucagaaaauucauaccugagaaaaaccugugaauguggguaaugu

SEQ ID NO: 160629 - RNA, 64 nt, hsa
ggaucugccaaguggauacuggggugccacuccccugagaaaagacugagccaggaacuacaag

SEQ ID NO: 160630 - RNA, 64 nt, hsa
aggggcauugaggagcuuccucauucugggaaaacugagaaaacccauauucuccuaauacaac

SEQ ID NO: 160631 - RNA, 64 nt, hsa
cgaccuuaauuuaacuuuccagucuuagcugaggcugagaaagcuaaaguuugguuuugacagg

SEQ ID NO: 160632 - RNA, 64 nt, hsa
acuuucuauuuuuaugaugacaaucaaagccggccugagaaacacuauuugugacuuuuuaaac

SEQ ID NO: 160633 - RNA, 54 nt, hsa
gucaagaaucauggaaguaaacaucugagaaaccuguugaagauuauuucauuc

SEQ ID NO: 160634 - RNA, 64 nt, hsa
aacucuucaguuaauucuuagauacacuaaaaaucugagaaacucuacauguaacuauuucuuc

SEQ ID NO: 160635 - RNA, 64 nt, hsa
ugggagcacaguacugggaaaugggcauacaguacugagaaaugggagcacacaguacugggaa

SEQ ID NO: 160636 - RNA, 64 nt, hsa
ugggagcacaguacugagaaaugggaguacacuacugagaaaugggagcacaguacugggaaau

SEQ ID NO: 160637 - RNA, 64 nt, hsa
ugggagcacaguacugagaagugggagcacaguacugagaaaugggaguacacuacugagaaau

SEQ ID NO: 160638 - RNA, 64 nt, hsa
aauaauguggugacagucacuagauccucacaugcugagaaacagccucuacucucucugcccc

SEQ ID NO: 160639 - RNA, 64 nt, hsa
aacuguacagacuguuuacuaaggagcuaaaccacugagaaaacguuauuaaaauuguaauacc

SEQ ID NO: 160640 - RNA, 64 nt, hsa
gauuuguguacaauauacccauugaauguauauccugagaaaaauuggggccaaagaagcagga

SEQ ID NO: 160641 - RNA, 64 nt, hsa
uauaugucagugagaacaauuuauaugucuuacacugagaaauaaaacugcucauaagugaaaa

SEQ ID NO: 160642 - RNA, 64 nt, hsa
gagacuaccguaauugagacuacuguagugacaucugagaaaugggauggaagagugaccaugu

SEQ ID NO: 160643 - RNA, 64 nt, hsa
caaaacuguaaaaaucauggaaaauaagggaauccugagaaacaaucacagaccacaugagacu

SEQ ID NO: 160644 - RNA, 64 nt, hsa
gauuuggcaucuacuuagauuuaacauauacuagcugagaaauuguaggcauguuugauacaca

SEQ ID NO: 160645 - RNA, 64 nt, hsa
uucuauauaggugauuuuaccagguuuaguuauccugagaaaacaucuggacuuaagaguuucu

SEQ ID NO: 160646 - RNA, 64 nt, hsa
cgucuucuuauguugacuaaaauuauaguuagagcugagaaaaaaaaaauagcaucuaguccaa

SEQ ID NO: 160647 - RNA, 64 nt, hsa
guaauauaauucauauuuuuaugauauuggcacacugagaaauucauuuuguagagcuauggau

SEQ ID NO: 160648 - RNA, 64 nt, hsa
aaaucauuucugcauuguuguuccagagaauuugcugagaaaucaaagccauggucaucuggug

SEQ ID NO: 160649 - RNA, 64 nt, hsa
acacauuugggaguauuuaaucagguguggcuaucugagaaaucaacuuugggggaaauguaag

SEQ ID NO: 160650 - RNA, 64 nt, hsa
cucucucucuguuuuguucuagccaugaauuugccugagaaacuuguaaccuaugugccucaau

SEQ ID NO: 160651 - RNA, 64 nt, hsa
aaucaaccaacauaucugaaaaggaucaugaaaccugagaaaugcuaauggagauuugcuggua

SEQ ID NO: 160652 - RNA, 64 nt, hsa
aauucagaguauuagacaguuuuaaggcauucaacugagaaaacuuuauuugucaaagucagaa

SEQ ID NO: 160653 - RNA, 64 nt, hsa
uuguacugucauugaagguguuuuauagagaaaucugagaaaucacauucacaaauuagaaguc

SEQ ID NO: 160654 - RNA, 64 nt, hsa
aaaggaagaaaauguagauuagaaaauaagacuucugagaaaaaguucaaggaauaaagauugu

SEQ ID NO: 160655 - RNA, 64 nt, hsa
uuaucaaaccuuuuauuacagaaaaaaaucugaacugagaaaggagcucugaauuuauuugaca

SEQ ID NO: 160656 - RNA, 64 nt, hsa
uuuggcuugcagacugccuucuaucccagaacagcugagaaaucuaugaagcugagauucugaa

SEQ ID NO: 160657 - RNA, 64 nt, hsa
ggggguguugugguuuuuuguuuuuguuuugcuucugagaaagcauuugccuuucuuccucucc

SEQ ID NO: 160658 - RNA, 64 nt, hsa
cauauauuuguguguuuauaugcucacagguggacugagaaaucaguuacaucuuaagugaccu

SEQ ID NO: 160659 - RNA, 64 nt, hsa
uguaaguuuaaagagcuaaagcucuaaaacuguucugagaaacaaugaauaguacauguauaug

SEQ ID NO: 160660 - RNA, 64 nt, hsa
gguaggauuagaggcuucccacuuaaaacuauuucugagaaaucuuagguuuuaucacugcuau

SEQ ID NO: 160661 - RNA, 64 nt, hsa
acuuugaaggugcuuugugagguuuggacucaugcugagaaacccacaggaaagcacuguccag

SEQ ID NO: 160662 - RNA, 64 nt, hsa
ccuuugaacagaagggccuggaaggccccuggggcugagaaaggguccgcccgguggccuggag

SEQ ID NO: 160663 - RNA, 64 nt, hsa
uucuguuccggugccuuuccuauccaggcaccaccugagaaaguugucauuugaggucgcacuu

SEQ ID NO: 160664 - RNA, 64 nt, hsa
ucuagugaauguauuuuaaccacaguguccuaaacugagaaaacuagagaggaaaaagugggug

SEQ ID NO: 160665 - RNA, 64 nt, hsa
ggacaccauaggguaggaauagccuuuccucagucugagaaauuggucucuuuuaaaagacgaa

SEQ ID NO: 160666 - RNA, 64 nt, hsa
auuauucacugccugucacaagccucaguguggccugagaaaucccuauguaccuuugugaaau

SEQ ID NO: 160667 - RNA, 64 nt, hsa
aacucagauucauuucaaaaggacagugaacaagcugagaaauuauuuuaucaaagggcugagu

SEQ ID NO: 160668 - RNA, 64 nt, hsa
cauuggaagguuaacuuuaaaaugagcccuaucacugagaaauacguguuucaugauuuaacuc

SEQ ID NO: 160669 - RNA, 64 nt, hsa
cuugugagucuguaacaguucuuaaaaagaauaucugagaaacuacucuguuuuagaccuuuga

SEQ ID NO: 160670 - RNA, 64 nt, hsa
cucauacccaccugcugaaucuucucuucacuugcugagaaagucagaggaggggauccaguag

SEQ ID NO: 160671 - RNA, 64 nt, hsa
ugguagugagccucccaggaucacucaugcuguccugagaaaugagauucaaaagcugcauucc

SEQ ID NO: 160672 - RNA, 64 nt, hsa
caucagagaacagucauguaugcaaguuuugugacugagaaauuucugugcuuccaauccacaa

SEQ ID NO: 160673 - RNA, 64 nt, hsa
aagauucgucaacuuucuuagcucaagagagaggcugagaaaugcagagaagaauaagacauaa

SEQ ID NO: 160674 - RNA, 64 nt, hsa
aaagaucacaccaauuuagaaugaauauuaaagucugagaaauuuacaaaagggacucuaugga

SEQ ID NO: 160675 - RNA, 64 nt, hsa
cacauggcacuuggaagaaaaagacccacugaaucugagaaaguacuuucugguggcaaaugaa

SEQ ID NO: 160676 - RNA, 64 nt, hsa
aacaucaccaacuuaauuuucuuccauagcaaaacugagaaaauaccuuguuucaguauaacac

SEQ ID NO: 160677 - RNA, 64 nt, hsa
auuaugucacacacacaaaaaauccuuuucaauccugagaaaauuaaaggcguuuuacucacau

SEQ ID NO: 160678 - RNA, 64 nt, hsa
caagcaagaacacauauccaaauggaauuuuacccugagaaauuaucauuuuaaagggcauagc

SEQ ID NO: 160679 - RNA, 64 nt, hsa
gcaaaucaaagaagauaauauuggaaaucagcugcugagaaagauggguuggacuggugguggu

SEQ ID NO: 160680 - RNA, 64 nt, hsa
aacaucaccaacuugauuuucuuccauagcaaaacugagaaaauaccuuguuucaguauaacac

SEQ ID NO: 160681 - RNA, 64 nt, hsa
uuaugucacacacacaaaaaaauccuuuucaauccugagaaaauuaaagguguuuuacucacau

SEQ ID NO: 160682 - RNA, 64 nt, hsa
uuuugcuguauuucaaaauuuuccuucuguuaaaggaaaauauugugaauaaccacuggugugu

SEQ ID NO: 160683 - RNA, 64 nt, hsa
gcauaauuuaaaaaaucaguguuuuuaggauuugggaaaauaaacuguaaauguuuauuugaua

SEQ ID NO: 160684 - RNA, 64 nt, hsa
cugccccucaggggaauucggagcuagaggacauggaaaauaaagccaggaaagucaaaaaaac

SEQ ID NO: 160685 - RNA, 64 nt, hsa
aaaaagcgcaaagaggagaaugaagauccagaaaggaaaauaaagaagaagggcuucggcgcca

SEQ ID NO: 160686 - RNA, 64 nt, hsa
gcaucaguuugcuacagugagcucagaucaaauaggaaaauacuugaaaugcaugucucaagcu

SEQ ID NO: 160687 - RNA, 64 nt, hsa
uucaaugaagucuucuguucaucuguugaaacuaggaaaauacccaaacuuaaauggaagaauu

SEQ ID NO: 160688 - RNA, 64 nt, hsa
gguacuauguggaaaauauuagaaacuucuauguggaaaauauuagaaacuacagaguuugcga

SEQ ID NO: 160689 - RNA, 64 nt, hsa
ucauaucuuggauuugcagcuguugguacuauguggaaaauauuagaaacuucuauguggaaaa

SEQ ID NO: 160690 - RNA, 64 nt, hsa
gggcaaacaggugggacuguuagugacccauuugggaaaauagagcaucucagagaaggaggug

SEQ ID NO: 160691 - RNA, 64 nt, hsa
uuuccuccuccccuuuccccuucuccccaccaaaggaaaauaucccucuuaaugauuucguagu

SEQ ID NO: 160692 - RNA, 64 nt, hsa
agcauuugugguaguaaaggaaaaccaacccucuggaaaauacauuuugagaaucucaaacauc

SEQ ID NO: 160693 - RNA, 64 nt, hsa
aauugauauauaauaaccguucuaaccucuuccaggaaaauauuuuuagaacuacuagcuuuuc

SEQ ID NO: 160694 - RNA, 64 nt, hsa
auuaagaaguuuugauguuagaauaauugcuuuuggaaaauaccaaaugaacguacaguacaac

SEQ ID NO: 160695 - RNA, 64 nt, hsa
uguagggcuaucuuuuuaaaaaaugucaacaaagggaaaauaaacuaucagcuuggauggucac

SEQ ID NO: 160696 - RNA, 64 nt, hsa
gucaugcuaagguauguguuacauauggccaaguggaaaauauaucugaagaggggcuuucaua

SEQ ID NO: 160697 - RNA, 64 nt, hsa
aaaaacaaaaacaagcagcuuuugugacuaagaaggaaaauaugcauauaguggcauauuuuua

SEQ ID NO: 160698 - RNA, 64 nt, hsa
uauauuugaagagagaauacauuuuauauaaacaggaaaauacauuugacacuuuauggaauuu

SEQ ID NO: 160699 - RNA, 64 nt, hsa
uguuuuuugugugcaaaauacugaguaaccacugggaaaauauuucagaugaaagggaugacaa

SEQ ID NO: 160700 - RNA, 64 nt, hsa
uuguguugaugagagaauaaucuugggcagucugggaaaauaaggaaggcaucuccuucuuacu

SEQ ID NO: 160701 - RNA, 64 nt, hsa
guaucauuaauaaauauaccuuugcucuuuucagggaaaauaacaaccacccuuacugauaguu

SEQ ID NO: 160702 - RNA, 64 nt, hsa
ccuacagaguaauauaugugaugcaguguaagaaggaaaauacucaucucuaacauuaugguaa

SEQ ID NO: 160703 - RNA, 64 nt, hsa
aaaaguauuguuaguaaguggccaagagacuugaggaaaauacagauuuuuuguuuaccuuggu

SEQ ID NO: 160704 - RNA, 64 nt, hsa
agcuggauaaauuaaaaucugagguuaaugaaauggaaaauaaucuaacucgaaggcgccugaa

SEQ ID NO: 160705 - RNA, 64 nt, hsa
agcaucucuuuauuuugaugauauauuuuuguaaggaaaauauucagaugaucaggaauguaua

SEQ ID NO: 160706 - RNA, 64 nt, hsa
ucugcuaaagguaaaagaaaagaaaaaaauaguuggaaaauaagacaugcaacuugaugugcuu

SEQ ID NO: 160707 - RNA, 64 nt, hsa
acauacucuccuaagugguuguaggaaauugcaaggaaaauagaaggucuguucuugcucucaa

SEQ ID NO: 160708 - RNA, 64 nt, hsa
uucagacgaggcuguaguuuaaauaccaaaagagggaaaauaaaaaagaaccuuuguaaaauau

SEQ ID NO: 160709 - RNA, 64 nt, hsa
uauagcauauauuuuauuuuuaaaaaaacuagggggaaaauagcaaccuuccauuugguuuccc

SEQ ID NO: 160710 - RNA, 64 nt, hsa
aaacauuuuacauaaaaugcuaaaauuuauuauaggaaaauaaaucaaacccaaagaaaguuua

SEQ ID NO: 160711 - RNA, 64 nt, hsa
aacuaaauauuugguaacugaagcaauaggcagaggaaaauagcuuuucuaugacacaagucau

SEQ ID NO: 160712 - RNA, 64 nt, hsa
acugacaaaaagggaaaauacgaaacacagaaagggaaaauaaacugacuuuuauaaugaaucu

SEQ ID NO: 160713 - RNA, 64 nt, hsa
ccaaucaguguauugcucauuuacugacaaaaagggaaaauacgaaacacagaaagggaaaaua

SEQ ID NO: 160714 - RNA, 64 nt, hsa
cucagguugucagguucugccuucaaggguuguuggaaaauaguccccaucuaauauguauagg

SEQ ID NO: 160715 - RNA, 64 nt, hsa
aauccaggaauauuaggcucuuugucaucuuauaggaaaauauaugaagaacccaucauuuuau

SEQ ID NO: 160716 - RNA, 64 nt, hsa
acccuuucaaaaguguuuguaaaccaaguucaaaggaaaauagacagaaugauuuccaaaauug

SEQ ID NO: 160717 - RNA, 51 nt, hsa
agaugaaugccagacugugaaggaaaauauaaaaaaaaagucgacugcuau

SEQ ID NO: 160718 - RNA, 64 nt, hsa
uugauaacuagcuuuccagguggacuuagccauaggaaaauauuacuaauguaauuuaacaaau

SEQ ID NO: 160719 - RNA, 64 nt, hsa
cuugcugaacauauuuuauucucuuuucagagaaggaaaauaaaaaggauucuaaaaguuugau

SEQ ID NO: 160720 - RNA, 64 nt, hsa
ugugcuauccugaauggaaaauagaggauacaauggaaaauagaggauaccaacuguaugcuac

SEQ ID NO: 160721 - RNA, 52 nt, hsa
ggacaauugugcuauccugaauggaaaauagaggauacaauggaaaauagag

SEQ ID NO: 160722 - RNA, 64 nt, hsa
auuuuuuguucugauuuuuuuucuaauauuuuuaggaaaauauuaagcuuuauaaaauagcaau

SEQ ID NO: 160723 - RNA, 64 nt, hsa
uguaaaaauaauaaugcagugguuguuucugucaggaaaauaaaucuuacagaacaacuggugg

SEQ ID NO: 160724 - RNA, 64 nt, hsa
gaacuguagccauuucauugccuuaauuuuaagaggaaaauacaaaaacagcugauuuguuuua

SEQ ID NO: 160725 - RNA, 64 nt, hsa
ucacuaaucauacucugaugccugaacuugaggaggaaaauacauguauauuuuuguuccguaa

SEQ ID NO: 160726 - RNA, 64 nt, hsa
guuagauaugcaaauugauaaggaucuaacacuaggaaaauaaaggcgaguuuugguuugguug

SEQ ID NO: 160727 - RNA, 64 nt, hsa
aacaaaaacaaaacccuuugcuguaucacuguguggaaaauaccuccaaagcugaaagagccag

SEQ ID NO: 160728 - RNA, 64 nt, hsa
ccauacacugaggcagaaacuugugucaguuggaggaaaauagacuugaguagucuuuggucca

SEQ ID NO: 160729 - RNA, 64 nt, hsa
uauuuguaagaaaaaacuuucauuuuccuacagaggaaaauagaacaauuuuagaagcaaggaa

SEQ ID NO: 160730 - RNA, 64 nt, hsa
uuuauacuuuauaguaaugcacaacauuuuuauaggaaaauauuuguaucauuuccuuuuuaga

SEQ ID NO: 160731 - RNA, 64 nt, hsa
aaaucuuagaaguuauaaggaaacucucacuagaggaaaauaaugaacaaaugaaaguguucau

SEQ ID NO: 160732 - RNA, 64 nt, hsa
uguauuuuauguauguuuacacugucaaacaucuggaaaauaaaaggucuaugcucauaacugu

SEQ ID NO: 160733 - RNA, 64 nt, hsa
acuaaugaaagcacuccucccugauguacaguugggaaaauauguccauaucuaaccagugauu

SEQ ID NO: 160734 - RNA, 64 nt, hsa
gcuuaaaaaaaauguauuuauuuuauggcaaguuggaaaauauguaacuggaaucucaaaaguu

SEQ ID NO: 160735 - RNA, 64 nt, hsa
gagcuuaaaaaaaaaguauacaugacuuuaaugaggaaaauaaaaaugaauauugaaauguugu

SEQ ID NO: 160736 - RNA, 64 nt, hsa
auuuacagggugagcucagccugucaugagcagaggaaaauauuauuaaugcucucugagucuu

SEQ ID NO: 160737 - RNA, 64 nt, hsa
caucuucucuaagccaagcaauuauuuuauggagggaaaauaaggccagaaacuucugagcaga

SEQ ID NO: 160738 - RNA, 64 nt, hsa
uugaguucuacugaguagggcuuccuuaaguuuaggaaaauagaaauuacuuugugugaaauuc

SEQ ID NO: 160739 - RNA, 64 nt, hsa
auugcaaaaaagcaucuauauauggaggagggugggaaaauagagguaggaaauaguagccuaa

SEQ ID NO: 160740 - RNA, 64 nt, hsa
cuaguccaaauauaagaaacugucauguuuugugggaaaauaauuuuauaauccauuuaaagug

SEQ ID NO: 160741 - RNA, 64 nt, hsa
uguuaagaguacaauugcaaaucuuaucuauauaggaaaauagcuaaaugucauucuccaucuc

SEQ ID NO: 160742 - RNA, 64 nt, hsa
uuuuucaauggauugcuuuaaagagaaugaguagggaaaauaguaguuaauuuuagguuauguu

SEQ ID NO: 160743 - RNA, 64 nt, hsa
aauuaacagaaaugacacugugaacaauguaguuggaaaauagguauguguauaugcauuauuu

SEQ ID NO: 160744 - RNA, 64 nt, hsa
gcucucugcucacugguuuucaauaccaccaagaggaaaauauugacaaguuuaaaggcugugu

SEQ ID NO: 160745 - RNA, 64 nt, hsa
cugugacuuaugugcagcuuuccaguugagcagaggaaaauaguggcaggacugucccccagga

SEQ ID NO: 160746 - RNA, 64 nt, hsa
ccuguagacuguuaauuacuuaauaaucucauugggaaaauacuaguaguuuuauauuuggaug

SEQ ID NO: 160747 - RNA, 64 nt, hsa
ugcaucccggagguugaaguuggaguuugagguuggaaaauaucuuugaaggcagaaucaguug

SEQ ID NO: 160748 - RNA, 64 nt, hsa
agugcccuccacagccgcagccucccucugaccugcaggccaagagcagaggcagcgaguugug

SEQ ID NO: 160749 - RNA, 64 nt, hsa
cauggugugaaagucagaugcccagagggcccaggcaggccaccauauucagugcuguggccug

SEQ ID NO: 160750 - RNA, 64 nt, hsa
gcuguccuagcagugcacuggcgggucucuccaugcaggccacaacacagggucaguguucacc

SEQ ID NO: 160751 - RNA, 64 nt, hsa
gaggaccccagaaucuggaccccagagucuggaagcaggccagaaaggauaaggcaaaugacug

SEQ ID NO: 160752 - RNA, 64 nt, hsa
cagucaacaggaugggccuggagauccgugaacugcaggccacguacccaugacguaaacggcg

SEQ ID NO: 160753 - RNA, 64 nt, hsa
cuucuaacuucugugguuugagaggaugaacccugcaggccauguccacaguucugagaggcca

SEQ ID NO: 160754 - RNA, 64 nt, hsa
ucagaucuguaauucucccaggagcugugauagagcaggccacacaaagucccuacgccucccu

SEQ ID NO: 160755 - RNA, 64 nt, hsa
ucugguggcaggagaagagaggcccagcacagcagcaggccaggccuuccuguccaggucugca

SEQ ID NO: 160756 - RNA, 64 nt, hsa
auauucuccucugaaccacuagagggcaggccaggcaggccaggcgggcccgugcagcuugugg

SEQ ID NO: 160757 - RNA, 64 nt, hsa
ccacugugaauauucuccucugaaccacuagagggcaggccaggcaggccaggcgggcccgugc

SEQ ID NO: 160758 - RNA, 64 nt, hsa
cacacagaaacauacauucgugccuggagacccugcaggccagaguccaaauauuuaacaauca

SEQ ID NO: 160759 - RNA, 64 nt, hsa
uuccccaggaggaacgaggagagguggccacguggcaggccacagugcccuaugggcuuuucug

SEQ ID NO: 160760 - RNA, 64 nt, hsa
gccgagaucuucuaccagcguagaguugacagaagcaggccagcgaggaggugugggacauaau

SEQ ID NO: 160761 - RNA, 64 nt, hsa
uguguuugugccagagggauacacauauuaaacugcaggccaccuuccugguccagacuguacu

SEQ ID NO: 160762 - RNA, 64 nt, hsa
ccagccugggacaggcccccuuuccccucucucugcaggccaggagggccuccuuccugccacg

SEQ ID NO: 160763 - RNA, 64 nt, hsa
cugcggggcgccugcccgggcgaggucggaagcugcaggccagcugggcccgggccggagcgug

SEQ ID NO: 160764 - RNA, 64 nt, hsa
gggucaagccagcauccccuugguaaagacccccgcaggccaccaggcauucuggacacgcaca

SEQ ID NO: 160765 - RNA, 64 nt, hsa
cacacacacacacacacacacacaaaacuucacagcaggccagcugcagugacuugucaucaag

SEQ ID NO: 160766 - RNA, 64 nt, hsa
aagagcagaggugaggaccugggaccccugaggggcaggccaggaggagcucgggcgcaggcca

SEQ ID NO: 160767 - RNA, 64 nt, hsa
gaccccugaggggcaggccaggaggagcucgggcgcaggccaggcccccuuggugaagcagagg

SEQ ID NO: 160768 - RNA, 64 nt, hsa
ggguggggccagaaggccugauagaagggucagggcaggccagggggguggggggccgcccuca

SEQ ID NO: 160769 - RNA, 64 nt, hsa
ccuuuccucuucccugccccacccccuggccgcagcaggccagcacugcagaguuugggugcug

SEQ ID NO: 160770 - RNA, 64 nt, hsa
cgccagcuccucggaggccagacccaggauggcugcaggccagguuuggggggccucaacccuc

SEQ ID NO: 160771 - RNA, 61 nt, hsa
ugacaggcugcugaggguaagcgccaucccugcaggccagggcacacggugcgcccgccgc

SEQ ID NO: 160772 - RNA, 64 nt, hsa
uuucaguucaagugcucuucagcacugucuugucucccaauauaccaacccacuggcacauuuu

SEQ ID NO: 160773 - RNA, 64 nt, hsa
guggaguugucuccagauaagaggagaugugccuucccaauaacucuuuuuuuuuuuccuuuca

SEQ ID NO: 160774 - RNA, 64 nt, hsa
gccuguggugaugguuugcauccuuccuccuuugucccaauaaaguaugggaguugaaugugug

SEQ ID NO: 160775 - RNA, 64 nt, hsa
ucgucugcagugagggaagguggguggguauucuucccaauaaagacuuagagccccucucuuc

SEQ ID NO: 160776 - RNA, 64 nt, hsa
aaaagucuagguuuuaaggcugugccagaacccaucccaauaaagagaccgagucugaagucac

SEQ ID NO: 160777 - RNA, 64 nt, hsa
accaaccgauugccuuuauuuugcuuccacauuuucccaauaaauacuugccugugacauuuug

SEQ ID NO: 160778 - RNA, 64 nt, hsa
uuccuucccagcccuuguggcucuguccaccugaucccaauaccagcuucccccagccccugcc

SEQ ID NO: 160779 - RNA, 64 nt, hsa
ugagacuguguuguacagcuagaaaaggccuucuucccaauagcaaggcugugcaucuagccuc

SEQ ID NO: 160780 - RNA, 64 nt, hsa
auuugugcaagucaguguuuuugaaaauucagugucccaauaaaaaguggacugcacacuaagg

SEQ ID NO: 160781 - RNA, 64 nt, hsa
uauauuuagugggucagugccaagugcuaccacuucccaauaaaggaauggggacccagaggcu

SEQ ID NO: 160782 - RNA, 64 nt, hsa
uuguaaauauugauagcacuggcuuccuccaaagucccaauacucuagccccgcucucuucccc

SEQ ID NO: 160783 - RNA, 64 nt, hsa
auugguuuuauuugauguacccaagucuuacguuucccaauaaagaaaaaaaaucuccauaaaa

SEQ ID NO: 160784 - RNA, 64 nt, hsa
uuggccggcccaccuguuuaacucuguauuuauuucccaauaaagaagggcuuccaaaggcaug

SEQ ID NO: 160785 - RNA, 64 nt, hsa
uccucccaaucuuuugacuuaugcacauauuuuuucccaauauggagaucauauggaauguacu

SEQ ID NO: 160786 - RNA, 64 nt, hsa
auuugggcacugguuuggccaaguguacaaugggucccaauaucagaaacaaccauccuagcuu

SEQ ID NO: 160787 - RNA, 64 nt, hsa
auauuugggcauuggucuggccaagucuacaaugucccaauaucaaggacaaccacccuagcuu

SEQ ID NO: 160788 - RNA, 64 nt, hsa
caagaccccugucuuugcugagagcuuuccuuuuucccaauaaauucuacucugcccuacucac

SEQ ID NO: 160789 - RNA, 64 nt, hsa
acguauuauugauauuauugucuguuuuccuucuucccaauagaagaauaagucauggagccug

SEQ ID NO: 160790 - RNA, 64 nt, hsa
agcuaaucauuuauccaaaggcuuuccauucuucucccaauauuuuuuuacuuuaauuuuuccc

SEQ ID NO: 160791 - RNA, 64 nt, hsa
guaaauucacauuuuccuuccuccuguuacauuuucccaauaucuuuucuauuccuuggaccaa

SEQ ID NO: 160792 - RNA, 64 nt, hsa
gacgugccucuccuacuguguaggagccuccgcuucccaauacagccgugucugcagccacugc

SEQ ID NO: 160793 - RNA, 64 nt, hsa
ggcuucaccucccuaugugaacuguagacucagaucccaauaaagugcuguugcagcuaugaug

SEQ ID NO: 160794 - RNA, 64 nt, hsa
uguggggcugugaauucuuucuucauccccgcauucccaauauacccaggccacaagaguggac

SEQ ID NO: 160795 - RNA, 64 nt, hsa
ccauucuccucuccacuucucguggaccgcguguucccaauauucauuaacauuugcagccauu

SEQ ID NO: 160796 - RNA, 64 nt, hsa
gauuacaugcccaucccaguguccuaggaccuuuucccaauacuagccccccaguggugaacag

SEQ ID NO: 160797 - RNA, 64 nt, hsa
aagcuaugaugauauaaauaaaaacagcucucuaucccaauacgcaccuuuguauuuucaagaa

SEQ ID NO: 160798 - RNA, 64 nt, hsa
uggcuuggcaacaaugacauugucaugcuuauugucccaauauccauccugucguagaucuuaa

SEQ ID NO: 160799 - RNA, 64 nt, hsa
uuuauuugcugcuguuuaaguugccaaccuccccucccaauaaaaauucacuuacaccuccugc

SEQ ID NO: 160800 - RNA, 64 nt, hsa
auucccauuugucccagugcugacaacccaaucuucccaauacuuucaggccugcucuacaaaa

SEQ ID NO: 160801 - RNA, 64 nt, hsa
gagaggaggucccgcuauguuguccaggcuacuuucccaauauuugagaauaaagucgagacuc

SEQ ID NO: 160802 - RNA, 64 nt, hsa
aauauagguuaaaacaaugauuuaaauauguuucucccaauaauuaucucuuucccuggaauca

SEQ ID NO: 160803 - RNA, 64 nt, hsa
uguguauuacaugggacugucuagagguuccauuucccaauaggguggguugccuuuccuuguc

SEQ ID NO: 160804 - RNA, 64 nt, hsa
uuugagaugguguguccuggauuaauacuuugucucccaauaucacagaaaaauacaugccagu

SEQ ID NO: 160805 - RNA, 64 nt, hsa
aauuacccuuuuguugggggggguggggcaguggucccaauaggagacaaaggagagugauuga

SEQ ID NO: 160806 - RNA, 64 nt, hsa
auguacccaauguguauauuuuucuuuuuaaucuucccaauagcugaauaaaguauagauacua

SEQ ID NO: 160807 - RNA, 64 nt, hsa
ccacaugagaaaauuuuuguacuccaaauuuacuucccaauaaauauucagcaaaguaguaaaa

SEQ ID NO: 160808 - RNA, 64 nt, hsa
ucucugcuggcuucuuuuuccaugcguuaacuuuucccaauagcagaggaggcaaauaugagca

SEQ ID NO: 160809 - RNA, 64 nt, hsa
uaugguuucauaggcaaaaauaauggucuaagccucccaauagggauaaauuuagggugacugu

SEQ ID NO: 160810 - RNA, 64 nt, hsa
cgaaaaaaaaaaacagaaaaaucuaccgguaauuucccaauagcuuugaauauucacagcagag

SEQ ID NO: 160811 - RNA, 64 nt, hsa
gaaccagccauuuuuaaaaagguuauuauugacaucccaauauuuugucuuggugggcuuacuc

SEQ ID NO: 160812 - RNA, 64 nt, hsa
uuuuucuucucauccuggagcguauucaagaucuucccaauacaagaaaauuaauaaaaaauuu

SEQ ID NO: 160813 - RNA, 64 nt, hsa
caugacagaccuccagcauccacgcaucucuuggucccaauaacugccucuagauacauagcca

SEQ ID NO: 160814 - RNA, 64 nt, hsa
ucaaugaucaaaaaaugcugcagauuuuuugaguucccaauacguuucauagaaaauaaguaag

SEQ ID NO: 160815 - RNA, 64 nt, hsa
ccugaaaaucauuuguguccuacuauuggacuuaucccaauacagauguguguguuuuucugga

SEQ ID NO: 160816 - RNA, 64 nt, hsa
augccaaagacuacguuuugcaguuuugcuuuccucccaauaaauauuaauguauguaauucua

SEQ ID NO: 160817 - RNA, 64 nt, hsa
auucuuuuuagacaucagaaauguuaaaguugauucccaauauuuguuguacuuuuuuguagca

SEQ ID NO: 160818 - RNA, 64 nt, hsa
accauccuauugcaaagguuccaacuguauauauucccaauagcaacguagcuucuaccaugaa

SEQ ID NO: 160819 - RNA, 64 nt, hsa
ucagugauuuuuauuuuggucauuauuucuaucuucccaauaacccagagguacaucaaguaaa

SEQ ID NO: 160820 - RNA, 64 nt, hsa
auccucucagcucucuucccugggggcagauauuucccaauacauaccacuuugaauaggauga

SEQ ID NO: 160821 - RNA, 64 nt, hsa
ugcaaaggcuuccucagacaugccacucuguggcucccaauauagggugcagacaagagcaauc

SEQ ID NO: 160822 - RNA, 64 nt, hsa
aacaucaucaggccgggugcaguggcuccuauaaucccaauauuuugggaggccgaggagagag

SEQ ID NO: 160823 - RNA, 64 nt, hsa
gacuuuucacagucguuaaauguguauggcucuuucccaauaugaauuuuuuugauguuaacua

SEQ ID NO: 160824 - RNA, 64 nt, hsa
uucaucuuaaccccgcaaacaagaauuaagaugaucccaauaaaagaaaaauugcucaggaaac

SEQ ID NO: 160825 - RNA, 64 nt, hsa
aaauaaccccauucuuugcuugaacacaguauuuucccaauagcacuuucauugccagugucuu

SEQ ID NO: 160826 - RNA, 64 nt, hsa
caccuucacccucaccuguguucucuucccucucucccaauaaaagggcucccauuauaaaugc

SEQ ID NO: 160827 - RNA, 64 nt, hsa
gaucaaaaagggaauaagaaacccuucuucuguaucccaauaauccaccaggauaaaggagaaa

SEQ ID NO: 160828 - RNA, 64 nt, hsa
auuaauuugaauguuuuuuacacuaacuaacuuuucccaauaaaguccacuaugaaaccacgac

SEQ ID NO: 160829 - RNA, 64 nt, hsa
aucacuggagucacaggacccugcccaccugaguucccaauaaagaaaaaccuccccuucugag

SEQ ID NO: 160830 - RNA, 64 nt, hsa
auguucacuccgggucaaguugugauaaauuugaucccaauagaauaccucccucauuuaagaa

SEQ ID NO: 160831 - RNA, 64 nt, hsa
cuggcuggagagcugcuaugcuaaaccuccugccucccaauaccagcaggagguucugggccuc

SEQ ID NO: 160832 - RNA, 64 nt, hsa
aagcauuauaagcaucaaauuuacaacauugguuucccaauauuuaauauaaauauaccauaua

SEQ ID NO: 160833 - RNA, 64 nt, hsa
aaacccaauuaauuugauaagcuuggggacaacaucccaauagauaaaaauuuuuaagggaauu

SEQ ID NO: 160834 - RNA, 64 nt, hsa
cagccuccuggguuuccccaguccucauuuuuccucccaauacccacccuucucucucgaggga

SEQ ID NO: 160835 - RNA, 64 nt, hsa
auaaacugagccuguucauucugauguccauuugucccaauagcucuacugcccuccccuuccc

SEQ ID NO: 160836 - RNA, 64 nt, hsa
aucccaaacuucggaaacaaguuauucucuucacucccaauaacuaaugcuaagaaaugcugaa

SEQ ID NO: 160837 - RNA, 64 nt, hsa
agaguuggccagguguggugacucacaccuauaaucccaauacuuugggaggccaaggcaggag

SEQ ID NO: 160838 - RNA, 64 nt, hsa
caauuuguugugauuuucagcaccugggaaguaaucccaauaauacuuuagaaaaucuaagaca

SEQ ID NO: 160839 - RNA, 64 nt, hsa
caaugcuuaagguggacuuuguucguaaacaauaucccaauagauuuguugacuugaggucugg

SEQ ID NO: 160840 - RNA, 64 nt, hsa
uuuauggauauugacuauauguaaugcagugcuaucccaauauuuucaauaaaggacuuuaugc

SEQ ID NO: 160841 - RNA, 64 nt, hsa
auggauaauucucaauauguuaacaccuagguguucccaauaccuuuuuccccucaugucacua

SEQ ID NO: 160842 - RNA, 64 nt, hsa
gggcucaagucaagcagucggugacagauuucauucccaauaacagaaucgguuugcaugacuc

SEQ ID NO: 160843 - RNA, 64 nt, hsa
aucccugugugcugcagcaucaccacggccuacuucccaauauccacaaagcuucgccuuugcu

SEQ ID NO: 160844 - RNA, 64 nt, hsa
cuuuacuaaguaaucucacagcauuugccaagucucccaauauccaauuuuaaaaugaaaugca

SEQ ID NO: 160845 - RNA, 64 nt, hsa
aaugaguggcagcuggcgccagggaacgauggccucccaauagauaggaaacaccugaagcugg

SEQ ID NO: 160846 - RNA, 64 nt, hsa
aauacauagauaaaaacauguuugcugccaaaguucccaauaagaugcuuccuguguuuuuugg

SEQ ID NO: 160847 - RNA, 64 nt, hsa
gaaaaagcuaauuguaguuuucauuaugaaguuuucccaauaaaccagguauucuaaacuuguu

SEQ ID NO: 160848 - RNA, 64 nt, hsa
auacagaugguccucgauuuacauugugguuaauucccaauaaacccaucauaaguuaaaaaug

SEQ ID NO: 160849 - RNA, 64 nt, hsa
gcacgucgccucuugaaacucgagauuucuuaaaucccaauauaaaaaugauaaccaguuacuu

SEQ ID NO: 160850 - RNA, 64 nt, hsa
cagaguauuucccuuggccgagauggaaguuuugucccaauagaugagcugcugagcaucaaca

SEQ ID NO: 160851 - RNA, 64 nt, hsa
caagaaaaaaaauagaaaagcacuugaagaauauucccaauauucccggucagcaguaucaagg

SEQ ID NO: 160852 - RNA, 64 nt, hsa
aucuuguagauuacauugagcaguauagacaucuucccaauauuucaacuuuugaacaaaagca

SEQ ID NO: 160853 - RNA, 64 nt, hsa
agaaugagagcggcggagacaagccccccaucgaucccaauaacccagcagccaacuggcuuca

SEQ ID NO: 160854 - RNA, 64 nt, hsa
gaacacaauucguuuuuucauuugaauuggcauuucccaauauuugcuaaacauuugcuggaga

SEQ ID NO: 160855 - RNA, 64 nt, hsa; identical to SEQ ID NO: 160850

SEQ ID NO: 160856 - RNA, 64 nt, hsa
ucgcauugauguauuaaauuuauaauuuuagcauucccaauagauccuaucauuccuuaaacau

SEQ ID NO: 160857 - RNA, 64 nt, hsa
ccacuguacuccugccuuaaaaaaaaaaaaaaaaucccaauaguccaugaaggcuuugaucucu

SEQ ID NO: 160858 - RNA, 64 nt, hsa
gccugcauaggagccucgcuuccgauuauucccuucccaauauuauucauccagacuuagccac

SEQ ID NO: 160859 - RNA, 64 nt, hsa
cuccuuuccaauagaaagaaacuaaacagaaaacucccaauacaaagaugacuggucccucaua

SEQ ID NO: 160860 - RNA, 64 nt, hsa
acuccugacgucaagugaucugccugccuuggucucccaauacaggcaugaaccacugcaccca

SEQ ID NO: 160861 - RNA, 64 nt, hsa
ugaacuaagggaauuuaaggcauaagaaccauuaucccaauaaaaucuuacauuccaaauaaag

SEQ ID NO: 160862 - RNA, 64 nt, hsa
ccagaggccaagccacagagaggauaauaguucuucccaauaaaggugauauuaaucagacuaa

SEQ ID NO: 160863 - RNA, 64 nt, hsa
aaaaauaacuuuaggaaccaccauauuauaucacucccaauagcacugaccuggugaucaaaaa

SEQ ID NO: 160864 - RNA, 64 nt, hsa
uguguguguauguauauauauauauaaauaucuuucccaauaugccccguugacaguguuuaaa

SEQ ID NO: 160865 - RNA, 64 nt, hsa
uccuuuuucauuaggcucauaguuuguggaaaaaucccaauaugccguuuauucagguggggcu

SEQ ID NO: 160866 - RNA, 64 nt, hsa
agcguuccuggaauuaauuuauaaauuuaauaaaucccaauauaaucccagcuagugcuuuuuc

SEQ ID NO: 160867 - RNA, 64 nt, hsa
caguucccuuguccugaucucauccucucuggucucccaauaacucacccuugggauguguuua

SEQ ID NO: 160868 - RNA, 64 nt, hsa
aggccucugccccuaaccacugugccauaccaccucccaauaaucaacagcaaaauuauagguc

SEQ ID NO: 160869 - RNA, 64 nt, hsa
cacuacugcagucgguacagaacaguuccuucacucccaauagcucucuuaugcugucccuuug

SEQ ID NO: 160870 - RNA, 64 nt, hsa
uguccaaaugccugugucaucuugucccguuuccucccaauauuccuucucaaacuuggagagg

SEQ ID NO: 160871 - RNA, 64 nt, hsa
ucuauuccccagacuccucauuauucaguacauuucccaauaaucucuuuuucucaucucuugc

SEQ ID NO: 160872 - RNA, 64 nt, hsa
auucucaaacacaguuacacuugugcacccucuaucccaauaggcagacuggguuucuagccca

SEQ ID NO: 160873 - RNA, 64 nt, hsa
gaaccaauccgucucucuuucuuuucuuugaaguucccaauaaaaugaaaacaggaaauguauu

SEQ ID NO: 160874 - RNA, 64 nt, hsa
auuuauggggauuuuaauugaaaauaaacuugagucccaauagagcuguuuuuuucucacuucc

SEQ ID NO: 160875 - RNA, 64 nt, hsa; identical to SEQ ID NO: 160870

SEQ ID NO: 160876 - RNA, 64 nt, hsa
ggauucauuccucagccucugcuucucccuuuuaucccaauaaguuauugcuacugcugugagg

SEQ ID NO: 160877 - RNA, 64 nt, hsa
uuuuuuacuacaucaaaaggauggugguucaaguucccaauauguggguggcacuucuuaaaaa

SEQ ID NO: 160878 - RNA, 64 nt, hsa
aagcagacuggcuccaauagauaucaggcagcaaucccaauaaauucugacauguccuuggcaa

SEQ ID NO: 160879 - RNA, 64 nt, hsa
gaaagaauuauuuuuguguuucuaaaacuaugguucccaauaaaagugacucucagcgagccuc

SEQ ID NO: 160880 - RNA, 64 nt, hsa
gcucucaauggugcucacuugcuuggaagcaggcucccaauagggagggggcugcccucuacag

SEQ ID NO: 160881 - RNA, 64 nt, hsa
ggguuccucugcccuggaagggcuccaggacccgucccaauaaccacccacggccaggagggcc

SEQ ID NO: 160882 - RNA, 64 nt, hsa
uuaacagauaauucagcauuggcguauuugcuugucccaauacaagaaugccaaaggaggaaac

SEQ ID NO: 160883 - RNA, 64 nt, hsa
ccucaugccuggccccccuccaggcaugcuggccucccaauaaagcuggacaagaagcugcuau

SEQ ID NO: 160884 - RNA, 64 nt, hsa
ugauguguuaauauaaaauguugggagggaauauucccaauaaaggucuuaagagaaaagucac

SEQ ID NO: 160885 - RNA, 64 nt, hsa
ucucaugaccuaaucaccucccaaaggccccaccucccaauaccaucacauuagggguuaggau

SEQ ID NO: 160886 - RNA, 64 nt, hsa
agauacagucuucaggacaccauuagaugggcuuucccaauaggccaaaaaaaugcugcgcaua

SEQ ID NO: 160887 - RNA, 64 nt, hsa
cuguaaagugauaucuuucauacuugaccaaaguucccaauaacuucccaaccacuguucaaaa

SEQ ID NO: 160888 - RNA, 64 nt, hsa
cccuaauagaguaaaauuugguuuugguccaaguucccaauaauguauuuaauguuucuguugu

SEQ ID NO: 160889 - RNA, 64 nt, hsa
uuccauucucuuuuuuagggaacauuaagcaaaaucccaauacacagagucugucacagacagg

SEQ ID NO: 160890 - RNA, 64 nt, hsa
gggauuacaggcgugagccaccgugcccggccucucccaauaggucuuuauuccucaauccucc

SEQ ID NO: 160891 - RNA, 64 nt, hsa
cucgcgccaccagaacgcgccgcccgcgccggccucccaauagccgccgcccgcugccugcacu

SEQ ID NO: 160892 - RNA, 64 nt, hsa
cucuaggguagccaugcagaggagggcuucauauucccaauaaaccccacguuguggcaggugc

SEQ ID NO: 160893 - RNA, 64 nt, hsa
gauagauagaaaaacggaaggguucagcugcugcucccaauaccucagcaugguaaggggacag

SEQ ID NO: 160894 - RNA, 64 nt, hsa
uucaccgccuuccucacuccauauagaacaccuuucccaauaggaaaccccaacagguaaacua

SEQ ID NO: 160895 - RNA, 64 nt, hsa
gaagcaagccagacaugguggcucacaccuguaaucccaauacugggaagccaaggugggagua

SEQ ID NO: 160896 - RNA, 64 nt, hsa
ucauuuugugcugcuccaacaccagcaggguaucucccaauaaaguguuccuaagcagccugua

SEQ ID NO: 160897 - RNA, 64 nt, hsa
ucuauuuucuuuaccagaaauguugcuaaguaauucccaauagaaagcugcuuauuuucauuaa

SEQ ID NO: 160898 - RNA, 64 nt, hsa
aaagguacuaugugauaugguacugaaauuuugaucccaauagaauucauuucucuuacguuga

SEQ ID NO: 160899 - RNA, 64 nt, hsa
aaauuaagaaugucaauuuaaguuaauaaaaaucucccaauaugauuuggguucauggcuuuug

SEQ ID NO: 160900 - RNA, 64 nt, hsa
ggguggccuguuggucacugugcagcagucugcuucccaauaaagcgugcucuuucacaaacac

SEQ ID NO: 160901 - RNA, 64 nt, hsa
cccuucucuuugauagcaguuauaaugcccuuguucccaauaaaacugggcagauggaauccua

SEQ ID NO: 160902 - RNA, 64 nt, hsa
auaacuaaacauaguauaguccaacauucguugaucccaauacaggcaaacaaccuggucaacc

SEQ ID NO: 160903 - RNA, 64 nt, hsa
ucaauauuaauaacacugaaacaggaaaucuaacucccaauauuggaauuuugguacuuuuuuu

SEQ ID NO: 160904 - RNA, 64 nt, hsa
uuguacauagcauaaaaacucugcagagaaguauucccaauaaggaaauagcauugaaauguua

SEQ ID NO: 160905 - RNA, 64 nt, hsa
uaguguucagcugcuucagcaguguccccaaccaucccaauagggugggggccugugggccaga

SEQ ID NO: 160906 - RNA, 64 nt, hsa
uguaaggcuuuuuuauuuuaaaaaaacagaguuaucccaauacauuauccugugauuuaccuua

SEQ ID NO: 160907 - RNA, 64 nt, hsa
ucaugguuccaagcaaugaguguaauguauuuucucccaauaguaauuguuuauauucauaauu

SEQ ID NO: 160908 - RNA, 64 nt, hsa
accuuaggccucagcuggagggcugcagagccccucccaauauugggagaauauugacccagac

SEQ ID NO: 160909 - RNA, 64 nt, hsa
uuuuguuucucuggggaaauccgccucagcucauucccaauaaauuaauacucuugauagcuua

SEQ ID NO: 160910 - RNA, 64 nt, hsa
uauccgagacgcgauuauugcuaauuggaaauuuucccaauaccccaccgugaugacuugaaau

SEQ ID NO: 160911 - RNA, 64 nt, hsa
cgacgcuucuguucggcccgaccuccaccccggcucccaauaaaauuuaacugaucuuuguuuc

SEQ ID NO: 160912 - RNA, 64 nt, hsa
agacucaaguggacccuacaaugaagccuacacaucccaauagaagccccuucuuaugcugagg

SEQ ID NO: 160913 - RNA, 64 nt, hsa
cuaggcacucacgcuguuuccuccucccuccucuucccaauacuauucccacuccuccagaugc

SEQ ID NO: 160914 - RNA, 64 nt, hsa
ccccucucaaauacccuuauuuuauuuauguuucucccaauaaaaacccagccugugugccagc

SEQ ID NO: 160915 - RNA, 64 nt, hsa
gaaauuggaggccauuuuucagucaauuucccuuucccaauaaaagccuuuaguuguguacugg

SEQ ID NO: 160916 - RNA, 64 nt, hsa
caagaaauucuucacuucucacuucuucacuucuucccaauauacaguaaguacgugagccagu

SEQ ID NO: 160917 - RNA, 64 nt, hsa
ggagagcuggcagugugcggagcugauaacauuuucccaauauugagcaguucccaaggacagu

SEQ ID NO: 160918 - RNA, 64 nt, hsa
uaaauaauucauuucugggcuaauuucaaaagaaucccaauauugcuguauagaaagagaacua

SEQ ID NO: 160919 - RNA, 64 nt, hsa
cugaacuuggauuucuaguucaugaagaaaucucucccaauacccauuuauccuauuuuuagca

SEQ ID NO: 160920 - RNA, 64 nt, hsa
aauaauauuuccaccggggaugcaucauuuuuacucccaauauucuguagagagggagucagga

SEQ ID NO: 160921 - RNA, 64 nt, hsa
cgaacauuucuauuuuccguauuuugagcucucuucccaauauuuccuuuuggugugagucugg

SEQ ID NO: 160922 - RNA, 64 nt, hsa
cuccgggggcucccuggaggcaccccucccccauucccaauaucuucgcugagguuuccuccuc

SEQ ID NO: 160923 - RNA, 64 nt, hsa
uucucuggaaugcaaggaggagacuucauuuacuucccaauaaacuucauuucucuggcauaau

SEQ ID NO: 160924 - RNA, 64 nt, hsa
cuucaaagagcaucuccacaacccacagccuucuucccaauaguguuaacucugcauuuuuaca

SEQ ID NO: 160925 - RNA, 64 nt, hsa
gccacucaguucuuccuccaccuccacccagugaucccaauaaacgaauucugucuccccgugc

SEQ ID NO: 160926 - RNA, 64 nt, hsa
guuucuugguagauuauucauaaugugagaugguucccaauaucaugugauuuuuuuuuuccuc

SEQ ID NO: 160927 - RNA, 64 nt, hsa
gacacuggaauaacagcacagaaaaaucuaugacucccaauaucuucuagaauaaagaauuuuc

SEQ ID NO: 160928 - RNA, 64 nt, hsa
aagaaagguggcaagguaaacuaacagcucaaauucccaauauaaguggaccaguuccucauaa

SEQ ID NO: 160929 - RNA, 64 nt, hsa
uauauucauauauuuuggauacgcaccccccaacucccaauacuggcucugucugaguaagaaa

SEQ ID NO: 160930 - RNA, 64 nt, hsa
gaugagugauucuugggaagauaaauguuaauguucccaauagucaagcuuguuuugcaguagu

SEQ ID NO: 160931 - RNA, 64 nt, hsa
ccacugggcugugggggaaggggucaaggccauaucccaauacguguagggcgagggucccugc

SEQ ID NO: 160932 - RNA, 64 nt, hsa
ucaguagccugggcauaguggcucacaccuguaaucccaauacuuuagaaggccaaggcuggag

SEQ ID NO: 160933 - RNA, 64 nt, hsa
cuggaauucacccucucauguuucccuacuaacaucccaauaaaguccucuucccuaccaggcc

SEQ ID NO: 160934 - RNA, 64 nt, hsa
ugaaggugggggguagguugguuguucagagucuucccaauaaagaugaguuuuugagccuccg

SEQ ID NO: 160935 - RNA, 64 nt, hsa
ugcaccuaagaauaaaugguauuugggcauguauucccaauauguguauauuuauuuauaaaua

SEQ ID NO: 160936 - RNA, 64 nt, hsa
acaccugggacuuuccccuucugguuccugugucucccaauaaacucucugaccaacccuagcu

SEQ ID NO: 160937 - RNA, 64 nt, hsa
caccuccacugacagaggcggccccucccacggcucccaauaaaaaugugaaaaccaacccccg

SEQ ID NO: 160938 - RNA, 64 nt, hsa
acuacuucguaucaaggguuguauuuucuuuauuucccaauagcauguuccucauuccccaaug

SEQ ID NO: 160939 - RNA, 64 nt, hsa
accacuuuauaucaaggguugucuuuucuucauuucccaauagcauguuccucauuccccaaug

SEQ ID NO: 160940 - RNA, 64 nt, hsa
cuugcuucacaucacaaggcaaggugaacucaacucccaauaaacugcuugcuggagccuccga

SEQ ID NO: 160941 - RNA, 62 nt, hsa
cuggggcacccagcuccugaggcuuugucccuucccaauaaagccugcuaccuggcaguacc

SEQ ID NO: 160942 - RNA, 64 nt, hsa
gccaccacucccuuagucuuucccaggcuuacucucccaauaaaugugcuagagcucugccaac

SEQ ID NO: 160943 - RNA, 64 nt, hsa
gugggcaaagggggcuccccuggguuauuuauuuucccaauaauuuugugugagcuacagaaga

SEQ ID NO: 160944 - RNA, 64 nt, hsa
auagacacacuaguggucauggcauguccucaucucccaauaaacaugacuuuagccucugcug

SEQ ID NO: 160945 - RNA, 64 nt, hsa
ggaaauguggcucucuccaucuugcauacagggcucccaauagaaaugaacacagagauauugc

SEQ ID NO: 160946 - RNA, 64 nt, hsa; identical to SEQ ID NO: 160945

SEQ ID NO: 160947 - RNA, 64 nt, hsa
ugucucugugacuguaaauccugcccugccccacucccaauaaaagcuuugguguauaggcuca

SEQ ID NO: 160948 - RNA, 64 nt, hsa
cuuggccuaugacaggucaccguguguaaaucuuucccaauaaaguguugcacaaaggcauccu

SEQ ID NO: 160949 - RNA, 64 nt, hsa
gugcccggcacgagcugaaccucauguguuccacucccaauaaaagguugacaggggcuucucc

SEQ ID NO: 160950 - RNA, 64 nt, hsa
cugcuccugccccugaaccuaugacauacccaagucccaauacuuucgagccaucugccacugc

SEQ ID NO: 160951 - RNA, 64 nt, hsa
agcugggaaaguuuuacauugucuguuuuucuucucccaauagcuuucaauuguucuuucugga

SEQ ID NO: 160952 - RNA, 64 nt, hsa
uuuacauagcauuuguguaaagacuaugaucucaucccaauaaaaugauauauuaaaccuucag

SEQ ID NO: 160953 - RNA, 64 nt, hsa
ccagcauagacuguaugauuucugcuauuuugcaucccaauauaggaguagaauaauaucuacu

SEQ ID NO: 160954 - RNA, 64 nt, hsa
uguucuucuaaagugucaucuucugcccucccugucccaauagggaccacaucuuauuugucuc

SEQ ID NO: 160955 - RNA, 64 nt, hsa
guguucaguggcacccccagccuggguccccuccucccaauagaggcugagccggagccagggc

SEQ ID NO: 160956 - RNA, 64 nt, hsa
ucuuccuaaauuucauuguguugauuucuuuccuucccaauaggugaucuuaauuacuuucaga

SEQ ID NO: 160957 - RNA, 64 nt, hsa
ucuugucgccgcccaggauugaccuguguguaagucccaauaaacucaccuacucaucaagcug

SEQ ID NO: 160958 - RNA, 64 nt, hsa
cugaucaccugacagggcaccccaaacccccaacucccaauaaaagccgugacguucggacaaa

SEQ ID NO: 160959 - RNA, 64 nt, hsa
ggugccucuggcuggaggcucccucccuuggccgucccaauagagcccggggcuacuuccacug

SEQ ID NO: 160960 - RNA, 64 nt, hsa
uccugucgcugcccaggauugaccuguguguaagucccaauaaacucaccuacucaccaagcug

SEQ ID NO: 160961 - RNA, 64 nt, hsa
caagcguugagccacuaagcagaggaccuuggguucccaauacaaaaauaccuacugcugagag

SEQ ID NO: 160962 - RNA, 64 nt, hsa
uuguguccauucuuacaagcccuggucagucaagucccaauaaauggucagcacaaaaaagaua

SEQ ID NO: 160963 - RNA, 64 nt, hsa
ugcuccuauguuggaaauuuguucauuaaaauucucccaauaaagcuuuacagccuucugcaaa

SEQ ID NO: 160964 - RNA, 64 nt, hsa; identical to SEQ ID NO: 160963

SEQ ID NO: 160965 - RNA, 64 nt, hsa
ugcuccuauguuggaaaauucuucauugaaguucucccaauaaagcuuuacagccuucugcaaa

SEQ ID NO: 160966 - RNA, 64 nt, hsa
cagaaggcucgccucuccccguggacccuguuaaucccaauaaaauucugagcaaguucagagu

SEQ ID NO: 160967 - RNA, 64 nt, hsa
ccacccucuaguguauuucacagaaaacaaaaccucccaauaaaacgguugaaaccugaaucuc

SEQ ID NO: 160968 - RNA, 64 nt, hsa
ugcuccuguguuggaaauuugaccauuaaaauucucccaauaaagcuuuacagccuucugcaaa

SEQ ID NO: 160969 - RNA, 64 nt, hsa
caggccagucaacugcacaauacacaacuguauuucccaauacacuugagcaguugccugugaa

SEQ ID NO: 160970 - RNA, 64 nt, hsa
uguaacuugcauuuaugugcacucugcauagguuucccaauaauacuguaauguugcugaacac

SEQ ID NO: 160971 - RNA, 64 nt, hsa
cucgggggguaauuuccggaagggcuccauacugucccaauaaggugaggccaguagcaggaau

SEQ ID NO: 160972 - RNA, 64 nt, hsa
aaguccuuugucacuucucuugccuuagugugccucccaauacucccuucuuccugcccccaca

SEQ ID NO: 160973 - RNA, 64 nt, hsa; identical to SEQ ID NO: 106190

SEQ ID NO: 160974 - RNA, 64 nt, hsa; identical to SEQ ID NO: 106191

SEQ ID NO: 160975 - RNA, 64 nt, hsa; identical to SEQ ID NO: 106192

SEQ ID NO: 160976 - RNA, 64 nt, hsa; identical to SEQ ID NO: 106193

SEQ ID NO: 160977 - RNA, 64 nt, hsa; identical to SEQ ID NO: 106194

SEQ ID NO: 160978 - RNA, 64 nt, hsa; identical to SEQ ID NO: 106195

SEQ ID NO: 160979 - RNA, 64 nt, hsa
cucguguccccagggacuucuaaagcuuggggcuccaggaaaucauccaguagaguuggagauu

SEQ ID NO: 160980 - RNA, 64 nt, hsa
aaagccagugucuuucugagguaaauaauuucugccaggaaacuucccagccccaccagcagcc

SEQ ID NO: 160981 - RNA, 64 nt, hsa
cuuuuuuuaaagauggauuuaaaccaagaugccuccaggaaagaggacgaaaugaguauauuca

SEQ ID NO: 160982 - RNA, 64 nt, hsa
cugacuuucuaguucuagaaguuccgcugcaaggccaggaaagcuugagaaagguauuguggaa

SEQ ID NO: 160983 - RNA, 64 nt, hsa
ggggaggaugacaagccgcugcccaccuccaagcccaggaaacaguacaagauggcuaaggaga

SEQ ID NO: 160984 - RNA, 64 nt, hsa
ggccaaggaggagcggcgcauggaccagaugaugccaggaaagaccaaagcagaugcugcugac

SEQ ID NO: 160985 - RNA, 64 nt, hsa
cugggccagagaagauaauguucuuuaauguuguccaggaaacccuggcuugcuugccgagccu

SEQ ID NO: 160986 - RNA, 64 nt, hsa
ugucucuuguagaagauggacucugaaaaacauuccaggaaaccauggcagcauggagagccuc

SEQ ID NO: 160987 - RNA, 64 nt, hsa
uaggguggguaagaguccaugggggugcccagucccaggaaaggggacaaugaagggacaggcc

SEQ ID NO: 160988 - RNA, 64 nt, hsa
cuuuacuccccagcccagagagacgcugcuuuuaccaggaaagacuauugaaagauguuuuauu

SEQ ID NO: 160989 - RNA, 64 nt, hsa
cuuauuuuucuaauaaauaggaccauuauuacuaccaggaaagucuuauuuauuuugccugaaa

SEQ ID NO: 160990 - RNA, 64 nt, hsa
cugcaacugaagaacugcagccaagaccuuaauuccaggaaagcacagaggacaaaguuaauuc

SEQ ID NO: 160991 - RNA, 64 nt, hsa
caaaagcuggagugugaggcaggaggcuggaaacccaggaaagcugauggugcaagguccaguc

SEQ ID NO: 160992 - RNA, 64 nt, hsa
aagagagcuaugauguccuaggacugagaguaccccaggaaagaauacccuugaaagggucucc

SEQ ID NO: 160993 - RNA, 64 nt, hsa
cuuaguuaaauuggauugagaaugccuuuuguuuccaggaaaauauugaucaccaugaaagaag

SEQ ID NO: 160994 - RNA, 64 nt, hsa
uuuucucucuuagaauuggaggauuugccauuguccaggaaagaaacuugcagcuuuaaccugc

SEQ ID NO: 160995 - RNA, 64 nt, hsa
gcggcaaaaauagacccagcuucugcaagguuuuccaggaaaaucugcuuggggcagcauuugu

SEQ ID NO: 160996 - RNA, 64 nt, hsa
auagagagcccuauucaucgcugcccaggccuucccaggaaaaucauuuuuucugggcugaugu

SEQ ID NO: 160997 - RNA, 64 nt, hsa
uagggaccucagggagccccagcuucuuacccacccaggaaacccuugguccagagaggacagg

SEQ ID NO: 160998 - RNA, 64 nt, hsa
uaagcccuaagggugguaggaacccaggagggacccaggaaacuaagauuugagauucagugcc

SEQ ID NO: 160999 - RNA, 64 nt, hsa
cucagugguuugcccuuggcuaaaugaagcagagccaggaaaaacagacuacauauuuuucaug

SEQ ID NO: 161000 - RNA, 64 nt, hsa
cucagggagguugaggcagcaggauugcuggagcccaggaaauugaggcugcagugagccauga

SEQ ID NO: 161001 - RNA, 64 nt, hsa
ucuucuuaacugcccaagugaaaagcaaccaaguccaggaaauuacaauagcuguuaaggaaag

SEQ ID NO: 161002 - RNA, 64 nt, hsa
gacccaagcuuguggcaccaggcaucugauggugccaggaaagccacuggaauugucacacggc

SEQ ID NO: 161003 - RNA, 64 nt, hsa
acucucccuguuuuagcacugaaagucucuugccccaggaaaccccaucagucccaggcagauu

SEQ ID NO: 161004 - RNA, 64 nt, hsa
cguccccaaagugucagcaacuuugaggagggcaccaggaaacaaagaugccuccccagcccug

SEQ ID NO: 161005 - RNA, 64 nt, hsa
ggguuucugaaauauuuuauggacuuauuucuccccaggaaaugauucuuacggaaaaaaauug

SEQ ID NO: 161006 - RNA, 64 nt, hsa
agguauaaaccucuguaugaagagaagauuucucccaggaaaucuuuguacagcuuuaaguugu

SEQ ID NO: 161007 - RNA, 64 nt, hsa
ugccagagggaccucaggguguggcauuauagggccaggaaaagaaaaucgguguauccuaucu

SEQ ID NO: 161008 - RNA, 64 nt, hsa
gaacaugagaugagccagccgagccagacugugaccaggaaacagcucaucccagagaaggaga

SEQ ID NO: 161009 - RNA, 64 nt, hsa
ggcucccagacaccucaagcccuauucacaggcaccaggaaaccccacacaggaauucccaucc

SEQ ID NO: 161010 - RNA, 64 nt, hsa
ggaaucccaaauuugaaaauccaaucccaaguccccaggaaacccaaucaugagguccuugugc

SEQ ID NO: 161011 - RNA, 64 nt, hsa
caggcagcccggcuggccgccgccgcuccuccccccaggaaagccaagguggaggcugaggugg

SEQ ID NO: 161012 - RNA, 64 nt, hsa
gcuugcuagggguccugaaccaggcuacuucgaaccaggaaagccagauuccagccugagugcu

SEQ ID NO: 161013 - RNA, 64 nt, hsa
gcaaucugcuuuuuuucuaaaaucugauuugcagccaggaaagaauuuucucacccaaggaaca

SEQ ID NO: 161014 - RNA, 64 nt, hsa
gugguucauucucaggcugggguggacucagaugccaggaaagggacagccucccauugucagg

SEQ ID NO: 161015 - RNA, 64 nt, hsa
uguuuggggaagaugcaaggaaguaaugagaagcccaggaaauuucuccaccuguguuuauggc

SEQ ID NO: 161016 - RNA, 64 nt, hsa
accagugcccaggaauuugaacauuuuccuuuacccaggaaaucuccggagccaacaccaccac

SEQ ID NO: 161017 - RNA, 64 nt, hsa
uucagauauauuuuaguaacacauucccagcuccccaggaaagccagucucaucuaauuucuua

SEQ ID NO: 161018 - RNA, 64 nt, hsa
ugggaagcccauccugaccagcugcuccgaggacccaggaaaggcaggauugaaaauguccagg

SEQ ID NO: 161019 - RNA, 64 nt, hsa
uccgaggacccaggaaaggcaggauugaaaauguccaggaaaguggccaagaagcaguggccuu

SEQ ID NO: 161020 - RNA, 64 nt, hsa
agcaggugccucgauucccugcccuugugaccucccaggaaacagaacugaucugggacacuau

SEQ ID NO: 161021 - RNA, 64 nt, hsa
ggcucccuccuccccaucaagcacaagagagggcccaggaaaaaagguuucacauaaguguaga

SEQ ID NO: 161022 - RNA, 64 nt, hsa
augaacccuuggguagcuugauucugccuaccauccaggaaaacuugugcuggaauugcugaug

SEQ ID NO: 161023 - RNA, 64 nt, hsa
uucugcccagaggggcuggggaaagggaugggagccaggaaagauuuaggggcaggagacagac

SEQ ID NO: 161024 - RNA, 64 nt, hsa
augaaggaaggggcuauccugggaccuccccagcccaggaaaaacuggaagccuucccccagca

SEQ ID NO: 161025 - RNA, 64 nt, hsa
aucaggccucaccccuccccugggacuuucccacccaggaaaggaggaccagucaggaugaggc

SEQ ID NO: 161026 - RNA, 64 nt, hsa
aaauuguucuugucaccagauguguucagacauugcugugcaauuguuggggaggguaggggga

SEQ ID NO: 161027 - RNA, 64 nt, hsa
uaggcucagagugagucagcuguuugaacccaaagcugugcagucaggcacccuggcugagcua

SEQ ID NO: 161028 - RNA, 64 nt, hsa
caggagcugacgaaccacgaaugcuucugccugugcugugcauucccaggcccgcagcucccgg

SEQ ID NO: 161029 - RNA, 64 nt, hsa
guguuuuccagucugccuggagcagcgagaagcagcugugcagacugguggcggugggaggguu

SEQ ID NO: 161030 - RNA, 64 nt, hsa
aaagacuuggcagcuuccugauaaagcgugcugugcugugcaguaggaacacauccuauuuauu

SEQ ID NO: 161031 - RNA, 64 nt, hsa
auagccgcaucaccaccagcagcucuugcccagagcugugcagugcaguggcugauucuauuag

SEQ ID NO: 161032 - RNA, 64 nt, hsa
gaaauucaggacacauacauuuauagagugugaggcugugcauacguacauucaucccuuaaug

SEQ ID NO: 161033 - RNA, 64 nt, hsa
aacuacggagcccaugcccuggaggaacucuguagcugugcaucauggaacgccacaggauuuu

SEQ ID NO: 161034 - RNA, 64 nt, hsa
gcguccacugcagcacaggaucagauggccgugugcugugcaugcaggagccucgccuucugug

SEQ ID NO: 161035 - RNA, 50 nt, hsa
auucacccccagcucugugagcugugcauagaggcgcuggagcggcacgu

SEQ ID NO: 161036 - RNA, 64 nt, hsa
ucagagcacccugaaguuuuugcuccugaauccagcugugcacuuugcccaaguggugaaggaa

SEQ ID NO: 161037 - RNA, 64 nt, hsa
ggaggucaaagcuaccuuuggccccgccauugcugcugugcagaaggucaguccuaccuuuuuc

SEQ ID NO: 161038 - RNA, 64 nt, hsa
cauguaaucagaauucuaaacgcacaacucgggagcugugcacggcuucucaagugauucaguu

SEQ ID NO: 161039 - RNA, 64 nt, hsa
gccagcucacagcccccaccccagggcccuguaagcugugcagugugagggccuggcuuccccg

SEQ ID NO: 161040 - RNA, 64 nt, hsa
caugcguuacguguacccguguauauguggggaggcugugcacacgagcgaggggugaguggcc

SEQ ID NO: 161041 - RNA, 64 nt, hsa
ugcacgagggccuaaaacagugggcucagcuuuggcugugcauuggaaucaccuggggagauuu

SEQ ID NO: 161042 - RNA, 64 nt, hsa
acacugugauuguguugaugcagcuggcuccacagcugugcauuccacagagauucagaaggca

SEQ ID NO: 161043 - RNA, 64 nt, hsa
agccuaaagcccaagucgagcagcucccagcacugcugugcagaccuagagguccuuagaacau

SEQ ID NO: 161044 - RNA, 64 nt, hsa
uaaagguuuugguuuuguggauuaccaucuccgugcugugcaucugaaggccagugcugugcug

SEQ ID NO: 161045 - RNA, 64 nt, hsa
uaaaugugcauccgugaaugcucccuugaauguggcugugcaggauucaggguuugcagaaauu

SEQ ID NO: 161046 - RNA, 64 nt, hsa
gaacgugugacaggguccuaugguguuacucaaagcugugcaggguaaaugaugacauauuuau

SEQ ID NO: 161047 - RNA, 64 nt, hsa
uguggccugcuggcccuguggcucuguguacagcgcugugcauguuacauuugcucuggaaaca

SEQ ID NO: 161048 - RNA, 64 nt, hsa
cuaaaagaccucgggcaagucucacagaaacugagcugcagacggggaguagcuuuguggaaac

SEQ ID NO: 161049 - RNA, 64 nt, hsa
agccaauuuaagaagacccuuauggagaccugaggcugcagaaacugguagguuucaucaggug

SEQ ID NO: 161050 - RNA, 64 nt, hsa
aauggcagagucucuagagguagaaauuugccuugcugcagagagagaaggaauggcgugggau

SEQ ID NO: 161051 - RNA, 64 nt, hsa
agcuauuucaucuuccagcucagcuccacacaaagcugcagaaggacgaaaugaaaagcauuug

SEQ ID NO: 161052 - RNA, 64 nt, hsa
ggucugggggccucucauccggcaccgggcccuggcugcagagaccuucagugccauccugacu

SEQ ID NO: 161053 - RNA, 64 nt, hsa
caguccaggagauggacuggcuggugcugggggagcugcagauggcccuggagugggcaggcag

SEQ ID NO: 161054 - RNA, 64 nt, hsa
gcccugggcugggugcccgaggggcucauaugcugcugcagaaugagcucuuccugaacguggg

SEQ ID NO: 161055 - RNA, 64 nt, hsa
uacaaaaaaauaaaaauuaaaaaaaaauuauuaggcugcagaggcaagaggauccccugagccc

SEQ ID NO: 161056 - RNA, 64 nt, hsa
aguacacccauugcuccuacuuguuacuauuauugcugcagaucugccuccaagguugaaaagg

SEQ ID NO: 161057 - RNA, 64 nt, hsa
gcccucggcuccaaauucuggccucucaucccaggcugcagacccuucugccccaugacaggcc

SEQ ID NO: 161058 - RNA, 64 nt, hsa
cacagggcuccuucuggagcauuugguggggacagcugcagagaagaggccuggaacucgggca

SEQ ID NO: 161059 - RNA, 64 nt, hsa
cugagcauguggagcgagagggaggcagguggacgcugcagaccccagguucagugcggccccu

SEQ ID NO: 161060 - RNA, 64 nt, hsa
uguggggagggugucuggggacguugcugagccagcugcagaaggguggggauaucagggcaca

SEQ ID NO: 161061 - RNA, 64 nt, hsa
aaaggggcaggcuugcguuauuggccuagauuuugcugcagauuaaauccuuugaggauucucu

SEQ ID NO: 161062 - RNA, 64 nt, hsa
cgcagacagggcccagaagcuuuagagguaugaggcugcagaaccggagagauuuuccucugug

SEQ ID NO: 161063 - RNA, 64 nt, hsa
agggcucgcacgccugggagguggcccuuggggggcugcagagcuggagggugggcgugguacg

SEQ ID NO: 161064 - RNA, 64 nt, hsa
aggagacggaggugcuggcacaugagaucgagcggcugcagauggagaugaaggaggacgacgu

SEQ ID NO: 161065 - RNA, 64 nt, hsa
uaugucucagaagagcugggaccuccuuccagcugcugcagaugcugacaggcccugggaggcu

SEQ ID NO: 161066 - RNA, 64 nt, hsa
ucuuggcuucugaguagcucagguguggcuuuuggcugcagauguuaaauuuugauaccaugua

SEQ ID NO: 161067 - RNA, 64 nt, hsa
auguggggagucuggaaacacccggcccacgcgugcugcagauguggggagcccggaaacaccu

SEQ ID NO: 161068 - RNA, 64 nt, hsa
auguggggagccuggaaacacccggcccacgcgugcugcagauguggggagucuggaaacaccc

SEQ ID NO: 161069 - RNA, 64 nt, hsa
auguggggagccuggaaacacccggcccacgcgugcugcagauguggggagccuggaaacaccc

SEQ ID NO: 161070 - RNA, 64 nt, hsa
acguggggagccuggaaacacccggcccacgcgugcugcagauguggggagccuggaaacaccc

SEQ ID NO: 161071 - RNA, 64 nt, hsa
aauuggucauggccuugguuucccucaaaacaacgcugcagauuuaucugcacaaacaucucca

SEQ ID NO: 161072 - RNA, 64 nt, hsa
ugucuuguuuaguguagaagggaagagaauuggugcugcagaaguguacccgccaugaagccga

SEQ ID NO: 161073 - RNA, 64 nt, hsa
accugacucaauuauuugcauauuuugagaaacugcugcagauuaguucuuuuugccaguuuuc

SEQ ID NO: 161074 - RNA, 64 nt, hsa
gaccauauuaccuggauuaccagggacuaucuuugcugcagagaucaaggguuaagaucuaugg

SEQ ID NO: 161075 - RNA, 64 nt, hsa
uaguuuacauaaaaaugauguuuuccacuugauugcugcagauaucaagaguuuguuauuuuca

SEQ ID NO: 161076 - RNA, 64 nt, hsa
aaauguauacaccuaacauagaaaauuaaagauagcugcagaccauuagaaauaauacaauugu

SEQ ID NO: 161077 - RNA, 62 nt, hsa
uccucgagaucaaacacuaaggcacggggcuggcugcagagcagccuuaggacccugggacc

SEQ ID NO: 161078 - RNA, 64 nt, hsa
ucugcccuuuggcugcauuggaauuucagagaaggcugcagaggccuggguuacacagccugag

SEQ ID NO: 161079 - RNA, 64 nt, hsa
cccuccauugccucgccucuauuccagaaucaaugcugcagaauguguuagcugcagauaggca

SEQ ID NO: 161080 - RNA, 64 nt, hsa
cucuauuccagaaucaaugcugcagaauguguuagcugcagauaggcauggucucagguaugaa

SEQ ID NO: 161081 - RNA, 64 nt, hsa
guggguggccauccauuuugagcaccucugccaggcugcagaccuggaggcgaagggagugugg

SEQ ID NO: 161082 - RNA, 64 nt, hsa
auuaauuauauguuuaaaaguuaaagaaaaaagagcugcagaguauuuauaaaacugucuuuua

SEQ ID NO: 161083 - RNA, 64 nt, hsa
ucaugggaugugcugggccugccuuuggcgccaugcugcagacuccagugggccugguuucugc

SEQ ID NO: 161084 - RNA, 64 nt, hsa
ugggccugguuucugcagaauguccaugguggccgcugcagaguugcagaggucccuguagaga

SEQ ID NO: 161085 - RNA, 64 nt, hsa
acacucucaguuuacagaggccacugggccucuggcugcagaauacaaagucccgggcuguuag

SEQ ID NO: 161086 - RNA, 64 nt, hsa
auuaguucuuuucuucugacucguggggcucccugcugcagagagcacagcccuugccuggagc

SEQ ID NO: 161087 - RNA, 64 nt, hsa
uggacccagugccccucacggcugccgcaagucugcugcagaugaccucaugaacuggaagggg

SEQ ID NO: 161088 - RNA, 64 nt, hsa
cugccaggguuggccccagggacccugggacgaggcugcagaagcucucccucccuacucccug

SEQ ID NO: 161089 - RNA, 64 nt, hsa
gucuccgcccgcagcugaggcgcaugcaggagaugcugcagaggaugaagcagcagaugcagga

SEQ ID NO: 161090 - RNA, 64 nt, hsa
uucccaggauccugggucuguucccugccccagugcugcagaacggacuugggagcccuccuuu

SEQ ID NO: 161091 - RNA, 64 nt, hsa
ucgggccugcgucugagguggcccaggaccccaagcugcagagcccagggaagagcagcuccag

SEQ ID NO: 161092 - RNA, 64 nt, hsa
gagaaagcaccuaccugucuucugugcagcuagggcugcagagcuguauucagguccaagguuc

SEQ ID NO: 161093 - RNA, 64 nt, hsa
ugccugggcuggguguggggcagggccuggcacagcugcagagugcacagggagggucagaagu

SEQ ID NO: 161094 - RNA, 64 nt, hsa
ggucugguuaagagucucacuagggccaaggcaggcugcagaacuuucccucuuccucucauug

SEQ ID NO: 161095 - RNA, 64 nt, hsa
gcagugaggaaacgggguaaaguggaccaugcaggcugcagagggugggccuugggcuggccgg

SEQ ID NO: 161096 - RNA, 64 nt, hsa
acaaggaaguccuggccacaggaguccccuacuggcugcagaggacgaagcaggaagcaugccg

SEQ ID NO: 161097 - RNA, 64 nt, hsa
uaaaaauggcauuuuuuuaguaaauuaagagcauaaacaauauugcuagagguggcauguuuag

SEQ ID NO: 161098 - RNA, 64 nt, hsa
aauauugcuagagguggcauguuuagucuaccaaaaacaauacuuuucaggcacuuuagaaaua

SEQ ID NO: 161099 - RNA, 64 nt, hsa
cagucuuacagauaacuaaggcaaaaagcuaaauaaacaauauguaaccucuaacauuugguaa

SEQ ID NO: 161100 - RNA, 64 nt, hsa
aaaauacuagggccaugguauguaauaaaauuugaaacaauaauuucaaauaauaaagauugaa

SEQ ID NO: 161101 - RNA, 64 nt, hsa
aaggcagaauggaacuaauauauguaacagagaaaaacaauaaauuuuaugaacuuguuuuaua

SEQ ID NO: 161102 - RNA, 64 nt, hsa
caaaacauuaaaaguccuuaugucuuugguaaugaaacaauaacacucaaugaaggauguauua

SEQ ID NO: 161103 - RNA, 64 nt, hsa
acauggccaaaauaauuuaguuacuaccucauacaaacaauauaaugguuacuacacaucacag

SEQ ID NO: 161104 - RNA, 64 nt, hsa
gcagaauccuguaagauugcuugucuuugcuuaaaaacaauaccuuugaacauuuuugaaucac

SEQ ID NO: 161105 - RNA, 64 nt, hsa
uguggcuauauuacaaaaugggaugcuggcaaugaaacaauacauuuaacacuauuguauuuuu

SEQ ID NO: 161106 - RNA, 64 nt, hsa
acacagcuucuuagcaauuuuuuuuuuuuugccgaaacaauaaauugccuuuagcagcaguuua

SEQ ID NO: 161107 - RNA, 64 nt, hsa
uagucaaaagaccagacaaguuacaaacuaagagaaacaauauuucacaacacaguaaagugug

SEQ ID NO: 161108 - RNA, 64 nt, hsa
uaaugaugucugauauuuaaauaggaaaucagacaaacaauauucagaaaguuuaagcauauaa

SEQ ID NO: 161109 - RNA, 64 nt, hsa
aaugaauccagaguucucauauuaauagguagugaaacaauaaggcuuuuuagagcagacuuug

SEQ ID NO: 161110 - RNA, 64 nt, hsa
aauugcagacauuuaauuucacuugucugagguaaaacaauaaacuaaaauacaugggcaugca

SEQ ID NO: 161111 - RNA, 64 nt, hsa
ugauuuuugacagauacggcaagcucuauggggaaaacaauauguacuaccuuauacccuuccc

SEQ ID NO: 161112 - RNA, 64 nt, hsa
uuacuuggaaaaugacaggucaugcauuauccaaaaacaauaccaaaaagacauauuuuauaaa

SEQ ID NO: 161113 - RNA, 64 nt, hsa
aagauuuuuaugaucauagaaacaucuauuuucaaaacaauauaaauuaagcuuuuccccuuga

SEQ ID NO: 161114 - RNA, 64 nt, hsa
aauauagguguuuuguagauucuugugucacugcaaacaauaugaacuccuuuuucguauugcc

SEQ ID NO: 161115 - RNA, 64 nt, hsa
uuagaggagagagagaaauauuaaaagagaaaugaaacaauagaguauuuuggguuuuuaauua

SEQ ID NO: 161116 - RNA, 64 nt, hsa
acauauuuuagacacuucccugcauuaacugcacaaacaauauguuugcaaacuuguuagauca

SEQ ID NO: 161117 - RNA, 64 nt, hsa
gugccagaugcuccgcuaggcaccagagggauaaaaacaauacuuauaguauaccacuaauuuu

SEQ ID NO: 161118 - RNA, 64 nt, hsa
auggcaaggugcuuguuaugucuagaaaguaagaaaacaauaugaggagacauucugucuuuca

SEQ ID NO: 161119 - RNA, 64 nt, hsa
uuguucucuuauucccuagucuguguggcaaauuaaacaauauaagaaggaaaaauuugaagua

SEQ ID NO: 161120 - RNA, 64 nt, hsa
uguuuuguuccugcugaauuuuacagacucagcuaaacaauaaguuauuaguagucacuuguuu

SEQ ID NO: 161121 - RNA, 64 nt, hsa
uggauuuugugauuauauuugagugaauaggagaaaacaauauauaacacacagagaauuaaga

SEQ ID NO: 161122 - RNA, 64 nt, hsa
ucucacaguauagaagagaacuuaaagagggaaaaaacaauaugaagauagggaaugcaggaaa

SEQ ID NO: 161123 - RNA, 64 nt, hsa
auacuagagauugguugugccuugucacaacugcaaacaauaccugaguggaguauucaaaaac

SEQ ID NO: 161124 - RNA, 64 nt, hsa
aagcauacauuggaaauaaacaguagaaauaagcaaacaauauaaagagacacgggaaaugcuu

SEQ ID NO: 161125 - RNA, 64 nt, hsa
uauguauuuaaaauucugauguuuacugaacauaaaacaauaguggcaacacuccuauuggcuu

SEQ ID NO: 161126 - RNA, 64 nt, hsa
cuugauuuuuuuaaaaauuagguuauuaaaauuaaaacaauaugcuagaagacauuuuggcaga

SEQ ID NO: 161127 - RNA, 64 nt, hsa
uuauuaacuucaguaggaaaguuacaucugcaucaaacaauauggcaacaucuauuuauuaacc

SEQ ID NO: 161128 - RNA, 64 nt, hsa
uaaauaauggcuaaagauuuuccaaaucuggugaaaacaauacccccacauauucaagaagcuc

SEQ ID NO: 161129 - RNA, 64 nt, hsa
cauggcaguuccuagguugcaguucagggaagggaaacaauaaaucucgcugaauugaagagac

SEQ ID NO: 161130 - RNA, 64 nt, hsa
gauugaaucgguaaaaacaaccucagggguccauaaacaauaucugccaacucaaccuguuguc

SEQ ID NO: 161131 - RNA, 64 nt, hsa
gcuuucuuuucaccaugacuuuauaaugucuaguaaacaauauuucuacuucccacaucuuugc

SEQ ID NO: 161132 - RNA, 64 nt, hsa
uuucuucauccaaaacaaggugaugggaagacaaaaacaauagcuacuacaaacaauaggaguu

SEQ ID NO: 161133 - RNA, 64 nt, hsa
aaggugaugggaagacaaaaacaauagcuacuacaaacaauaggaguuuauaauuaugugcuga

SEQ ID NO: 161134 - RNA, 64 nt, hsa
uuaaacugcacuuuugacuuuuuuuaugguauaaaaacaauaauuuauaaacauaaaagcucau

SEQ ID NO: 161135 - RNA, 64 nt, hsa
uuaaaccaaucaaggaacuuacucuauucaguggaaacaauaaucaucucuauugcuugguguc

SEQ ID NO: 161136 - RNA, 64 nt, hsa
guauuuugacauguuauaauacgcaaguaaaauaaaacaauaguuuacucagcucauguuacua

SEQ ID NO: 161137 - RNA, 64 nt, hsa
acauaaauuaaaacucaaaugccaggacaaaauaaaacaauauaccagauggagaggaugcccg

SEQ ID NO: 161138 - RNA, 64 nt, hsa
agauggaagucuggggggcacagacaaccuuaucaaacaauauaaaagccaauauaaauucuca

SEQ ID NO: 161139 - RNA, 64 nt, hsa
cagguuuguuguuucaugucauauuacucagucuaaacaauaaauauuucauaauuuacaaagg

SEQ ID NO: 161140 - RNA, 64 nt, hsa
uuagguaaaagcuguccuaccaaagagucuagcaaaacaauauaguauuuuuuugcagaggcau

SEQ ID NO: 161141 - RNA, 64 nt, hsa
uuauggaauaaagucacuugaucagaaggaauugaaacaauagaucauuuuguuaccuacugga

SEQ ID NO: 161142 - RNA, 64 nt, hsa
cccuagucaaugcucugaaaaugugucacauuauaaacaauacagaaggagagauagaugagag

SEQ ID NO: 161143 - RNA, 64 nt, hsa
gucagugcucugaagaugugucacauuauauuauaaacaauacggaaggggagauaggugagau

SEQ ID NO: 161144 - RNA, 64 nt, hsa
uuccuuucccacuggcucuguauaaaaaacuucuggaccaaaagccaucauuggaagauuuaaa

SEQ ID NO: 161145 - RNA, 64 nt, hsa
gagaugcgcucugcauacgcuuuucuauacacugggaccaaaaugauguugacuuaauuccaaa

SEQ ID NO: 161146 - RNA, 64 nt, hsa
uugacuuaauuccaaaugggaucuccauaccuguggaccaaaccaacaaguaaguuuugacagc

SEQ ID NO: 161147 - RNA, 64 nt, hsa
gacucucuccccuacacccacuaccuggcauccaggaccaaauaccuggacuaucaaccuuguu

SEQ ID NO: 161148 - RNA, 64 nt, hsa
aacuuuaccacuuggaggacacgggguuaguccaggaccaaagaggccaauggauuuuucaaag

SEQ ID NO: 161149 - RNA, 64 nt, hsa
uuaacccucagaggccuucaaguccuuuccaccucucacccauugcccaccauuaauaagcuua

SEQ ID NO: 161150 - RNA, 64 nt, hsa
uggaauagugaacuggggccaugucaguuugucacucacccaaacugaccaauaaaaccuuuau

SEQ ID NO: 161151 - RNA, 64 nt, hsa
aaggaggguccuacagacaagguggcaucucaaccucacccaagaaacccccgggacuuuaccc

SEQ ID NO: 161152 - RNA, 64 nt, hsa
uauuccccagucacgaaagggcugguccccagagcucacccagaaagcaucuugccgggggcag

SEQ ID NO: 161153 - RNA, 64 nt, hsa
cuucccuuccccauggcugggggcugggguaggacucacccauucuaauuuauuuugucuuuug

SEQ ID NO: 161154 - RNA, 64 nt, hsa
augugagggauggaaaugaccuccuggcaccaggcucacccacccaaggcccccugccccagca

SEQ ID NO: 161155 - RNA, 64 nt, hsa
cuugcaugccaaauuguaguucuugucugauuggcucacccaagcaaggccaaaauuaccaaaa

SEQ ID NO: 161156 - RNA, 64 nt, hsa
gcucagcccugacuggugcuauaggcuggagaagcucacccaauaaacauuaagauugaggccu

SEQ ID NO: 161157 - RNA, 64 nt, hsa
ucagggaucuugcauucccaguggucaaaccgcacucacccaugugccaaggugggguauuuac

SEQ ID NO: 161158 - RNA, 64 nt, hsa
uggauccacucacaugcugcaggcaugcaguagacucacccacagcccacucucuggacaccaa

SEQ ID NO: 161159 - RNA, 64 nt, hsa
gucugccaccagcccaccccacccugcccccacccucacccacgcuucugcucauuggucucaa

SEQ ID NO: 161160 - RNA, 64 nt, hsa
aagccuggcaaagcugcccaaccggguagugccccucacccaucggaucacugccuucuuccuc

SEQ ID NO: 161161 - RNA, 64 nt, hsa
ggugggggccguuuguucaguuaccugggggaaccucacccagcacccugccccgcuucccagg

SEQ ID NO: 161162 - RNA, 64 nt, hsa
guauguaugagguccauccuggcaugagcaguggcucacccaccggccuugaagaggugagcuu

SEQ ID NO: 161163 - RNA, 64 nt, hsa
uggggaggacgcagcgugcaucgccuacauccgccucacccaguacaucgacgggcagggucgg

SEQ ID NO: 161164 - RNA, 64 nt, hsa
uguuccccauuuuuuuuugaaccacagucucacucucacccaggcuggagugcaguggcacaau

SEQ ID NO: 161165 - RNA, 64 nt, hsa
guuguuaaaauguuaccuaugguaaugagcaaagcucacccaaacugugccccagauggaguaa

SEQ ID NO: 161166 - RNA, 64 nt, hsa
ucgguggccagagccgaggguccucccacacgugcucacccacccgcagccuaggcaggcucug

SEQ ID NO: 161167 - RNA, 64 nt, hsa
gagaacaguaagaggagcugcucuccuaucugcacucacccaggccuucacccagacuuuacca

SEQ ID NO: 161168 - RNA, 64 nt, hsa
gagauuacagacaugagccuccgcgccuugccuccucacccaccucuucacucugaauccucau

SEQ ID NO: 161169 - RNA, 64 nt, hsa
gaggcuucucagcccuggauuuccugcugccauccucacccagcacccacaacuagcgccuggg

SEQ ID NO: 161170 - RNA, 64 nt, hsa
ccagagccccacagccccaucugcgggggcagugcucacccacaccauaagcuacugccauccu

SEQ ID NO: 161171 - RNA, 64 nt, hsa
cacuggcaaacagggccucugcggagcacacuggcucacccaguccugcccgccaccguuaucg

SEQ ID NO: 161172 - RNA, 64 nt, hsa
cccuuuccuuccugggggucuguuccuuccuaugcucacccagagaacucucugaugugccagu

SEQ ID NO: 161173 - RNA, 64 nt, hsa
uggcuggaguugcccgcguaaggcagccaagaaacucacccaaagccuguagccuccccaacua

SEQ ID NO: 161174 - RNA, 64 nt, hsa
cugggggagcucuggcggggaccacgggccacugcucacccacuggccccgagggggguguaga

SEQ ID NO: 161175 - RNA, 64 nt, hsa
caggccugcagacccagacuccagccagaccugccucacccaccaaugcagccggggcuggcga

SEQ ID NO: 161176 - RNA, 64 nt, hsa
uccguggaaacacagccuucugcugcagcagaggcucacccagcgugaacugcccccagggaac

SEQ ID NO: 161177 - RNA, 64 nt, hsa
aggcggaugaggucccuacucccgagcccccagccucacccacugcagggccaggcucucaguc

SEQ ID NO: 161178 - RNA, 64 nt, hsa
uauugggauacuauagugagcccaugcagcaccucucacccacccagagauggagcugcucugc

SEQ ID NO: 161179 - RNA, 64 nt, hsa
ugaucuaguugagaugaggucauuggggugggcccucacccaauaugacuggaguccuuaucgg

SEQ ID NO: 161180 - RNA, 64 nt, hsa
guaaaagccuagugacucccuccuuggccaggcccucacccaguucagauccacggccuccacc

SEQ ID NO: 161181 - RNA, 64 nt, hsa
cagguaccuuggcugcaccgguguguggcccgcucucacccaggcacagccccgccaccaugga

SEQ ID NO: 161182 - RNA, 64 nt, hsa
gcucaggucugggaugagaagggcacugcccucccucacccauauugcaugcccccccgccauu

SEQ ID NO: 161183 - RNA, 64 nt, hsa
acccccaccacccccagucaccauugucaccacacucacccaucccaccccaccccuccuaucc

SEQ ID NO: 161184 - RNA, 64 nt, hsa
uuuuaaaagagauguagcagaauaauucuuccagugcaacaaaaucaauuuuuugcuaaacgac

SEQ ID NO: 161185 - RNA, 64 nt, hsa
uaaaaacaaaaagacagugugugugucuguugagugcaacaagagcaaaaugaugcuuuccgca

SEQ ID NO: 161186 - RNA, 64 nt, hsa
aauacugggcagccuuuuuuuuuuuuuuuuuaauugcaacaaugcaaaagccaagaaaguauaa

SEQ ID NO: 161187 - RNA, 64 nt, hsa
uucccucugauaagcuguucugguggcaguaacaugcaacaaaaaugugggugucuccaggcac

SEQ ID NO: 161188 - RNA, 64 nt, hsa
uuuuuuuuuuguuccuguguauucucauugggguugcaacaauaauucaucaaguaaucauggc

SEQ ID NO: 161189 - RNA, 60 nt, hsa
ggacaauucauaugggauagaaacuacaaaugcaacaaaugcgucaaagaauuuagugug

SEQ ID NO: 161190 - RNA, 64 nt, hsa
ggaaaagacuuaaugaugaacaccccaaagcaauugcaacaaaaacaaaaauugacaaguggga

SEQ ID NO: 161191 - RNA, 64 nt, hsa
aaguuccugaaagcuuuucuguggcaggaaagaaugcaacaaaaaaguuaaccaccaccaucuc

SEQ ID NO: 161192 - RNA, 64 nt, hsa
aggaguuguugaacccacugcuaggaagcaaggaugcaacaagaugaugcugagcgugaacaca

SEQ ID NO: 161193 - RNA, 64 nt, hsa
caaaagcugccacugugugguauucgaggauuauugcaacaaagccaguaguuaaaccaaacua

SEQ ID NO: 161194 - RNA, 64 nt, hsa
caucucuaguuuuuccacgucugucugaaguucuugcaacaaauucugcaugguccagcgcucc

SEQ ID NO: 161195 - RNA, 64 nt, hsa
gaagcacuugugauaaagacaggcuccugagaaaugcaacaaguggucuuacauauacaugaga

SEQ ID NO: 161196 - RNA, 64 nt, hsa
guguccaacaaggaauucacaccucugccuccuuugcaacaacaacauuuacacaguugguaag

SEQ ID NO: 161197 - RNA, 64 nt, hsa
ugagaugggcgcucccgacacagcgcagacccaccaggaggaaagaggcccagcucucagcuga

SEQ ID NO: 161198 - RNA, 64 nt, hsa
aguuagcugcgggcugcccugugggcuggugcuucaggaggaauccagagaaguguucagaugc

SEQ ID NO: 161199 - RNA, 64 nt, hsa
ccuccuccccagcugaccagaaccaggcugagcgcaggaggacaggcaccaccggaugccacac

SEQ ID NO: 161200 - RNA, 64 nt, hsa
caggaggacaggcaccaccggaugccacaccaggcaggaggagguguggacagugaugguacgg

SEQ ID NO: 161201 - RNA, 64 nt, hsa
gugccuguggucccagcuacucaggaggcugaggcaggaggaucacuugagcacaggaguuuga

SEQ ID NO: 161202 - RNA, 64 nt, hsa
uuuggaaggcugaggcagguggaucaccugaggucaggaggaguucaagaccagccuggccaac

SEQ ID NO: 161203 - RNA, 64 nt, hsa
gcccugggaggaagggggagucauuuauauucugcaggaggaaggggccccagcugucgccuuu

SEQ ID NO: 161204 - RNA, 64 nt, hsa
gccuggucugacugcaguguagggaauaggucaccaggaggagcccuucauccuggcaggccgg

SEQ ID NO: 161205 - RNA, 64 nt, hsa
augccuguaaucccgacacuuugggaggccaaggcaggaggauggcuugaagccaguaguucaa

SEQ ID NO: 161206 - RNA, 64 nt, hsa
acaccuguaguccuagcuacuugggaggcugaggcaggaggaucccuugaguccaggagguuga

SEQ ID NO: 161207 - RNA, 64 nt, hsa
uauccaucccuccccuccuuuucagguaaggagacaggaggaguaggaggaggcagggccucuc

SEQ ID NO: 161208 - RNA, 64 nt, hsa
cagcgcaauacuugaaccuucucccagguaggggcaggaggagccacaugagagagggagaagg

SEQ ID NO: 161209 - RNA, 64 nt, hsa
ggccguguagacacuaaaccucaugcccuaaggacaggaggaaagacccucuguuuggagcauu

SEQ ID NO: 161210 - RNA, 64 nt, hsa
caaguuggguggacauaaaugagucaagugacaacaggaggaaauagacuuagacgaaagaaag

SEQ ID NO: 161211 - RNA, 64 nt, hsa
ggacacucucgggguugucugcaggagagcaagccaggaggacaugggccuggacgacacggcc

SEQ ID NO: 161212 - RNA, 64 nt, hsa
gggugucauccugugaagggacacagagaacaggcaggaggaaaggcaggagccaguccgugca

SEQ ID NO: 161213 - RNA, 64 nt, hsa
ugugccuauagucccacuacuuguggggcuaaggcaggaggaucacuugagccccggaggucga

SEQ ID NO: 161214 - RNA, 64 nt, hsa
acaccuguaauccuugcauuuuggaaggcugaggcaggaggaucacuuuaggccugguguguuc

SEQ ID NO: 161215 - RNA, 64 nt, hsa
gggguccugucaucacauccccugggaggggaggcaggaggaggccgagggccccaggaugucu

SEQ ID NO: 161216 - RNA, 64 nt, hsa
ccaguggacagcguggugagccguggccggacggcaggaggagaggggagcccccucuggcugu

SEQ ID NO: 161217 - RNA, 64 nt, hsa
ccuguaaucccaacacuuuguugggaggccaaagcaggaggauagcuugaggccaggaguucca

SEQ ID NO: 161218 - RNA, 64 nt, hsa
acgccuguguucccagcuacucaggaggcugaagcaggaggauagcuugagcccaggaguuuga

SEQ ID NO: 161219 - RNA, 64 nt, hsa
ugacccccauacauuccucccugcuccccacugccaggaggaccacuguccccagccagccaaa

SEQ ID NO: 161220 - RNA, 64 nt, hsa
uccuguccaugcgcuuccagggccccacgguccccaggaggacgcuuccuggccaaagccccaa

SEQ ID NO: 161221 - RNA, 64 nt, hsa
aagggagaguaggagagaccaugaguauguguaacaggaggacacagcauuauucuagugcugu

SEQ ID NO: 161222 - RNA, 64 nt, hsa
agacaaagcauuuguucauuuggagcuuagaguccaggaggaauacauuagauaaugacacaau

SEQ ID NO: 161223 - RNA, 64 nt, hsa
ugcuucacuccuggcucuguucagggaggcugcccaggaggaagacuggccauuaugcaucccc

SEQ ID NO: 161224 - RNA, 64 nt, hsa
ucagacagguacuauucguaggcaguguagacagcaggaggagcaccgggcuugggcuuccucu

SEQ ID NO: 161225 - RNA, 64 nt, hsa
auggcaguccucacccccaccucucuaaaagacacaggaggaugacacagaaacaccguaagug

SEQ ID NO: 161226 - RNA, 64 nt, hsa
augcuuguggucccagcuguucaggaggaugaggcaggaggaucucuugagcccaggaggucaa

SEQ ID NO: 161227 - RNA, 64 nt, hsa
ggcgugguggcucaugcuuguggucccagcuguucaggaggaugaggcaggaggaucucuugag

SEQ ID NO: 161228 - RNA, 64 nt, hsa
cacugcuggcagccugggcaaaccgggugagcaacaggaggacgaggggccggggcggugccag

SEQ ID NO: 161229 - RNA, 64 nt, hsa
ccaugcaaucuagcgaguccauggagcugagcagcaggaggaggagccgugacccuguggaagg

SEQ ID NO: 161230 - RNA, 64 nt, hsa
uagagauuuugauaucauuuggcuuauaaauccacaggaggagauaauguauggaaaacauuua

SEQ ID NO: 161231 - RNA, 64 nt, hsa
augccuauagucccagcuacuugagaggcugaggcaggaggauuguugagcccaggaguuugag

SEQ ID NO: 161232 - RNA, 64 nt, hsa
gcaugugcagucccagcuacucaggaggcugaggcaggaggaucacagugaccuauaaugagcc

SEQ ID NO: 161233 - RNA, 60 nt, hsa
cuguaaucccagcauuuuaggaggccaaggcaggaggaucacuuggagccaggaguuuga

SEQ ID NO: 161234 - RNA, 64 nt, hsa
ugggauaaggggaaggagaagagggagaauggagcaggaggaaaagcagaguuggucuagagag

SEQ ID NO: 161235 - RNA, 64 nt, hsa
cagcccugguuuccugucacucagagcugauucacaggaggaggggagguuggggggcgggaga

SEQ ID NO: 161236 - RNA, 64 nt, hsa
gaugauuuagauuuugauauugauuuagaagacacaggaggagaccaucaaaugaauuaauauc

SEQ ID NO: 161237 - RNA, 64 nt, hsa
augccuguaaucccagcuacucaggaggcugaggcaggaggauugcuugaacccuggaggcgga

SEQ ID NO: 161238 - RNA, 64 nt, hsa
cagggagcacuuggcuccuggcagagggagaggacaggaggaggagccuuccccaggaggaacg

SEQ ID NO: 161239 - RNA, 64 nt, hsa
ggcagagggagaggacaggaggaggagccuuccccaggaggaacgaggagagguggccacgugg

SEQ ID NO: 161240 - RNA, 64 nt, hsa
caugguggcccuguucugggggagcaggguaaggcaggaggaagugggugagcuccgagaugau

SEQ ID NO: 161241 - RNA, 64 nt, hsa
ggcuccuguggcucugcuggcucagugugggcugcaggaggacugcagacucagcugcaauucu

SEQ ID NO: 161242 - RNA, 64 nt, hsa
cuuggggugcugaggcgggaggauuacuugagcccaggaggauuacuucaaccugggagguuga

SEQ ID NO: 161243 - RNA, 64 nt, hsa
caugcauguaauucuagcacuuuggaggccaaggcaggaggacugcuugagcccaggaguuuga

SEQ ID NO: 161244 - RNA, 64 nt, hsa
uugauuuuagccaugccugcuccucugccuggaccaggaggagggccccuggggcagaaguuag

SEQ ID NO: 161245 - RNA, 64 nt, hsa
ccaggcccugcagggcuggucagggugucuggggcaggaggaggccaacucacugaacuagugc

SEQ ID NO: 161246 - RNA, 64 nt, hsa
ccugcuuaggccacucgagcaucagagcuuccagcaggaggaagggcuguaggaauggaagcuu

SEQ ID NO: 161247 - RNA, 64 nt, hsa
ucacaccuguagucccggccacucggggcugaggcaggaggaucacuggaaccugggagguugc

SEQ ID NO: 161248 - RNA, 64 nt, hsa
accccuauaaucccaggacuuugggaggccaaggcaggaggaucacuugaguccagaaauucaa

SEQ ID NO: 161249 - RNA, 64 nt, hsa
uggucugcggggauccuguuacaaaggugaaacccaggaggagaguguggaguccagagugcug

SEQ ID NO: 161250 - RNA, 64 nt, hsa
gggaucuucugccaccaucagggacaaacgggggcaggaggaaagucacugaugcccagauguu

SEQ ID NO: 161251 - RNA, 64 nt, hsa
ccaacugcaggaagcccaggaggcugaugccugccaggaggagcuggcacugaagguggaacag

SEQ ID NO: 161252 - RNA, 64 nt, hsa
gcggauccagcugcaagaccguguaaaugagcuccaggaggaagcccaggaggcugaugccugc

SEQ ID NO: 161253 - RNA, 64 nt, hsa
cgcgggcccuaggacccuaggaugccauucuugccaggaggaggaaugagagugauguuggcca

SEQ ID NO: 161254 - RNA, 64 nt, hsa
guaggccugccuguguucucauguggauuuagaacaggaggauauucuauguguauguauaugu

SEQ ID NO: 161255 - RNA, 64 nt, hsa
auagaggagaccagucaguacuucuuggagggggcaggaggagagaggaaaagggagggcgaga

SEQ ID NO: 161256 - RNA, 64 nt, hsa
ccaaacccacccgcgcccugggacgcagccacgccaggaggaggacacggccgccgagagcaag

SEQ ID NO: 161257 - RNA, 64 nt, hsa
cuggacagaucugaggaaggccguaaaauggggacaggaggauucagcucaggaguaagggaag

SEQ ID NO: 161258 - RNA, 64 nt, hsa
gagccacagggcuagaagcacaggcccgucaccccaggaggaaaagcccagggucuggggcagc

SEQ ID NO: 161259 - RNA, 64 nt, hsa
ucgugagaaagagagcuucaaccucaagagggcucaggaggacaucucacggcugcggcgcaag

SEQ ID NO: 161260 - RNA, 64 nt, hsa
gguggaggucuacgcagaugccgacgaaauccuccaggaggagaucaaggaguacaaggugggg

SEQ ID NO: 161261 - RNA, 64 nt, hsa
aggggccagagccuuggaggacacuaagaggaggcaggaggagcaacucaaauccccaagaaca

SEQ ID NO: 161262 - RNA, 64 nt, hsa
auggaauggcagcaugcaaacuuggaucagauagcaggaggaacuuucaaaagucuggcccacu

SEQ ID NO: 161263 - RNA, 64 nt, hsa
acgccuguagucccagguacuugggagccugaggcaggaggauugcuugagcucaggaguucaa

SEQ ID NO: 161264 - RNA, 64 nt, hsa
gcaccuguagucccagcuacuagggaggcugagccaggaggaucacuugagcccgggagguuga

SEQ ID NO: 161265 - RNA, 64 nt, hsa
cacaccuauaaucgagcacuuugggaggccaagacaggaggaucacuugaggccaggagucuga

SEQ ID NO: 161266 - RNA, 64 nt, hsa
augccuguagucccagccacucagaaggcugaggcaggaggaucgcuugagaccaagaguuuga

SEQ ID NO: 161267 - RNA, 64 nt, hsa
caccggaagaccuugccucugugccgcggagguccaggaggaaacggggcggccgcuaggccuc

SEQ ID NO: 161268 - RNA, 64 nt, hsa
gaaggcacacgcucaaugccccacgugccuucuccaggaggaacgaagcaggguuugaggguug

SEQ ID NO: 161269 - RNA, 64 nt, hsa
ggggcgggggcagcugugucaucuuucuggggcccaggaggaucugggcugguuugucugggga

SEQ ID NO: 161270 - RNA, 64 nt, hsa
augacuauaaucccagcuguuugagaggccaaugcaggaggaugguugagcucaggaguucgag

SEQ ID NO: 161271 - RNA, 64 nt, hsa
acgcuugcaaucccagugcuuugggagacugaggcaggaggaucacuuaaggccaggaguucga

SEQ ID NO: 161272 - RNA, 64 nt, hsa
augccuguaauccgagugcuuugggaggcugaggcaggaggaucacucgagcucaagaauucaa

SEQ ID NO: 161273 - RNA, 64 nt, hsa
accugaucucauguuaggccuaagaggcuuucuccaggaggauuagcuuggaguucucuauacu

SEQ ID NO: 161274 - RNA, 64 nt, hsa
gucuauaaauguaucuuauaauaaaaaggaaggacaggaggaagacaggcaaauguacuucuca

SEQ ID NO: 161275 - RNA, 64 nt, hsa
ugaacuuggccgaguaggggugggggugggauggcaggaggagccgcaggaggaaggagguugu

SEQ ID NO: 161276 - RNA, 64 nt, hsa
aguaggggugggggugggauggcaggaggagccgcaggaggaaggagguugugcagggucugga

SEQ ID NO: 161277 - RNA, 64 nt, hsa
cugugaagaagaaaaaaaccccuggccuuugggccaggaggaaucuguuacucgaauccaccca

SEQ ID NO: 161278 - RNA, 64 nt, hsa
cugugaacucugaagucacuaguccagcugggugcaggaggacuucaaguguguggacgaaaga

SEQ ID NO: 161279 - RNA, 64 nt, hsa
ugggccuugggcuccgugugggagaccggccugccaggaggacccagggcucuguaaguagaug

SEQ ID NO: 161280 - RNA, 63 nt, hsa
gacccagggcucuguaaguagaugcauuuggguccaggaggaagcguggacaccucguaggga

SEQ ID NO: 161281 - RNA, 64 nt, hsa
ggaugaagaccuagacuuaccugaaggaucuucacaggaggauaaagacguagaauuaccugaa

SEQ ID NO: 161282 - RNA, 64 nt, hsa
ggauaaagacguagaauuaccugaaggaucuucacaggaggaugaagaccuagagaaaaagcga

SEQ ID NO: 161283 - RNA, 64 nt, hsa
ggaugaagaccuacaauuaccugaaggaucuucacaggaggaugaagaccuaggguuaucugaa

SEQ ID NO: 161284 - RNA, 64 nt, hsa
uccaguccaagaggaggaggacgaaggauccucacaggaggaugaagaccuagacucaucugca

SEQ ID NO: 161285 - RNA, 65 nt, hsa
acuuuugggauagggugcuggcagcugucccaagcaauggguaaugaugauggcaaaaagggugu

SEQ ID NO: 161286 - RNA, 65 nt, hsa
agauuuacuuauggucaugugcucagaaaugcucaaauggguacaaccaucaccaagggugggau

SEQ ID NO: 161287 - RNA, 65 nt, hsa
cccacccccaacaaagcacuaucauuuucauuuggaauggguauuuucuguuucaugauguauuu

SEQ ID NO: 161288 - RNA, 65 nt, hsa
ugaaucaucaccuuaaauauuuaaagguguuaauuaauggguauaaaauuuaaaucaguauuacu

SEQ ID NO: 161289 - RNA, 65 nt, hsa
uuauaccugaugaagaaauggcaacagcugacagaaauggguacagcucaucaaaaaugugcagc

SEQ ID NO: 161290 - RNA, 65 nt, hsa
cagacaugagacauagggauuuggaggccccuuagaauggguagaugguguuauguucccuuucu

SEQ ID NO: 161291 - RNA, 65 nt, hsa
gugagugggugggauggggacauuugaacauguuuaauggguaugcucaggucaacugaccugac

SEQ ID NO: 161292 - RNA, 65 nt, hsa
ucugaaaaguaguuaaugcuuuuugguauugaaguaauggguaacuaaaauggacuuccauagua

SEQ ID NO: 161293 - RNA, 65 nt, hsa
cguuuucaggaggaaccugggauguccugaugcucaauggguagaugccuuccaggcugcaguca

SEQ ID NO: 161294 - RNA, 65 nt, hsa
aaugaauguaaagcacuuaguacaguauaugaaauaauggguauucaauaaaugauaguuucuac

SEQ ID NO: 161295 - RNA, 65 nt, hsa
ugugaaaugggagccuaccagcugguauagaagggaauggguaggaggcacugggugcugacuca

SEQ ID NO: 161296 - RNA, 65 nt, hsa
gaaugugcuguggcagagggggucuugguuucauaaauggguauauacagccugaacucaggagg

SEQ ID NO: 161297 - RNA, 65 nt, hsa
gguuuuucaauaccaauuacauggaacuuuucuguaauggguacaaugaagaaguuucuaaaaac

SEQ ID NO: 161298 - RNA, 65 nt, hsa
cacacgcuuauggauguguguaccauugagaugagaauggguagauggaacggagaccaucaagc

SEQ ID NO: 161299 - RNA, 65 nt, hsa
ccuucacuaaaagggcucuuaccaagaucaaaucuaauggguacauuuuaguuccuaugugauuu

SEQ ID NO: 161300 - RNA, 65 nt, hsa
uuccacguaagggagaccuuugcaaagggcauccaaauggguaggcaggugacagccgccguauu

SEQ ID NO: 161301 - RNA, 65 nt, hsa
caccuuucuccuguccaacuucaccaccaccugauaauggguauauaacaggaagcugaagguac

SEQ ID NO: 161302 - RNA, 65 nt, hsa
auaaaaaauagucccacaaaauaccuuuugugacuaauggguagcaaucguauuauuugcuggcc

SEQ ID NO: 161303 - RNA, 65 nt, hsa
ugguguacucauuuaugcauagagacucguuuaugaauggguagagccacagaacguauagaguu

SEQ ID NO: 161304 - RNA, 65 nt, hsa
aucgcuguuuaguuacuagaugaacaaauccacagaauggguaaagaguagaaucugaacuauau

SEQ ID NO: 161305 - RNA, 65 nt, hsa
uaauaauacagccaaagauaaucucucagcuuuuaaauggguagagaaacacuaaagcauucaau

SEQ ID NO: 161306 - RNA, 65 nt, hsa
uucugcauuuaguuucuaucuuuccaggcaaaacaaauggguauucuuuucauacaaccauuuuc

SEQ ID NO: 161307 - RNA, 65 nt, hsa
ucauuugcauauugauuucaagucuccuaauuuggaauggguaaaguacaaauguuaaugcaaca

SEQ ID NO: 161308 - RNA, 65 nt, hsa
aaauugcucaucccuaauccugaaaaacaggccagaauggguaaagacuugucaaagcuugcaac

SEQ ID NO: 161309 - RNA, 65 nt, hsa
ggcuuuaaugaauaaacauuuguagcauccucuuuaauggguaaacagcauccgauuuugguugu

SEQ ID NO: 161310 - RNA, 65 nt, hsa
uuuuuuuaauucuauggcuuccuaucuggcagcuuaauggguaauuuuugagguauguauuuaac

SEQ ID NO: 161311 - RNA, 65 nt, hsa
gaaaaucaguucgccuggccuccaagucgugaggaaauggguaugcaaggcugagauuucuacag

SEQ ID NO: 161312 - RNA, 65 nt, hsa
uauuucagaaagcugagagaguuuuauacauggaaaauggguaugcuuaaagauugcaggguagg

SEQ ID NO: 161313 - RNA, 65 nt, hsa
uuucauagugugguaagaccuuaaguaaaaggcacaauggguacuacagaauuaaaauguagguc

SEQ ID NO: 161314 - RNA, 65 nt, hsa
uuucaucucccaugaacucauuuccccauaaaugaaauggguaaauaaugccccauuuguagaag

SEQ ID NO: 161315 - RNA, 65 nt, hsa
ugcuacuuguugguaaaaauugguggacugguuucaauggguaaauguguuguggcaaauuaaug

SEQ ID NO: 161316 - RNA, 65 nt, hsa
ugauaauucaguuuauauucaccacaugaaagaaaaauggguaacagaagaacccuuaaaacagg

SEQ ID NO: 161317 - RNA, 65 nt, hsa
uuuuacuuucccuucccccauaaguuggaggauaaaauggguaucaaugcuaauauuuccaggga

SEQ ID NO: 161318 - RNA, 65 nt, hsa
cgguuuucuuguaacaauaaauauuuugaguaaauaauggguacauuuuaacaaacucaguagua

SEQ ID NO: 161319 - RNA, 65 nt, hsa
aacuuuaacaaagaaaacccucaguccuauuuauuaauggguagaauuaaauauauaauuuuaua

SEQ ID NO: 161320 - RNA, 65 nt, hsa
gcuguaaucaaccuucuagguuucucuugucuuaaaauggguauucaaaaauggggaucuguggu

SEQ ID NO: 161321 - RNA, 65 nt, hsa
auguugcauagauuucaaaacauaauuuuauguucaauggguauuuuuuuacauauacauacuca

SEQ ID NO: 161322 - RNA, 65 nt, hsa
uugggggugaugaauggggaguacaggauucaucuaauggguacaggauuucuuuaugguucaug

SEQ ID NO: 161323 - RNA, 65 nt, hsa
gacuuaaaauuuuauguauuauuaaauguuagauaaauggguaguaccauacuacaaauauuuaa

SEQ ID NO: 161324 - RNA, 65 nt, hsa
agaaagguggcaaugaacugugcauguaaauuuuaaauggguacuuugugcaauucguuaaaaga

SEQ ID NO: 161325 - RNA, 65 nt, hsa
acuguaaaagauaaaucaggagauggcugauucauaauggguaauaaaauaaauagcacuuucga

SEQ ID NO: 161326 - RNA, 65 nt, hsa
ucuagaagauaucaugauuuuauguaaagucucucaauggguaaccauuaagaaauguuuuuauu

SEQ ID NO: 161327 - RNA, 65 nt, hsa
aacagaaacuuguuaugcacucaucaaaauguacuaauggguacucugaacucauuaacauugac

SEQ ID NO: 161328 - RNA, 65 nt, hsa
cucuccucaugucuccucaugucuuauuguucagaaauggguaauguggccauuucaccagucac

SEQ ID NO: 161329 - RNA, 65 nt, hsa
cuagugguauuucacaaugaauaucaugaacucucaauggguagguuucauccuacccauugcca

SEQ ID NO: 161330 - RNA, 65 nt, hsa
uagugcuucauccccauuuaaaaaaacacaguacuaauggguaacacauauggagguuugcugcc

SEQ ID NO: 161331 - RNA, 65 nt, hsa
uuggaggguuggcagggggcgaugauaauuuacuuaauggguacaauguacauuauucagggggu

SEQ ID NO: 161332 - RNA, 65 nt, hsa
aaauaucaaguguugggaaagaaaaaaggaaguggaauggguaacucuucuugauuaaaaguuau

SEQ ID NO: 161333 - RNA, 65 nt, hsa; identical to SEQ ID NO: 161332

SEQ ID NO: 161334 - RNA, 65 nt, hsa
uguucugguucaaggcuccaccucagaaauucugaaauggguaguaagagcaaauuuucauuuua

SEQ ID NO: 161335 - RNA, 65 nt, hsa
gagaggcagauaagcugccuggggggcuguuagcuaauggguacaaggacacccccucccgagaa

SEQ ID NO: 161336 - RNA, 65 nt, hsa
ccucuggaugucucgucugugguugaguuuaugguaauggguacaugggucaggccauguauuaa

SEQ ID NO: 161337 - RNA, 65 nt, hsa
uagugggacaaaagggagaaaaaggaagcaagauaaauggguauguaggaugaaggguuauuuaa

SEQ ID NO: 161338 - RNA, 65 nt, hsa
ucccagugugaauuggcuugaagagccaugggcuaaauggguacuagaacaacaacugccccuca

SEQ ID NO: 161339 - RNA, 65 nt, hsa
caugacgauuccauaaaauaaacuugagguuaaauaauggguaguaaauuauagaauguauaaga

SEQ ID NO: 161340 - RNA, 65 nt, hsa
guauucucaccacucaauuuguuuuuuagcaguuuaauggguacauuuuagagucuuccauuuug

SEQ ID NO: 161341 - RNA, 65 nt, hsa
agaagagcucacagagaaaaaacuaccaaauauccaauggguaagcccaugauguagccacuagu

SEQ ID NO: 161342 - RNA, 65 nt, hsa
aauauaauuaauguaagugggcaaguuguauggggaauggguagucuaaauugcucauuuuagcc

SEQ ID NO: 161343 - RNA, 65 nt, hsa
auuuuuguuaaucuuaauucuugaagagaauuuuuaauggguauuuaauuuuagggagagauuuu

SEQ ID NO: 161344 - RNA, 65 nt, hsa
agcagcugcuccugccugauucaacuguagccuguaauggguaaaagccacauuuaggagguggu

SEQ ID NO: 161345 - RNA, 65 nt, hsa
aaaugcugugaauuacucuuccuccccuucucugaaauggguaaaggacaaauuguguaaaaaaa

SEQ ID NO: 161346 - RNA, 65 nt, hsa
uggaaauauaggcuauguaauguaaauacaucaaaaauggguaauuuucuuugacucugucacac

SEQ ID NO: 161347 - RNA, 65 nt, hsa
gucuauuucuauuuuaguuguggcuuugcucuaagaauggguaauaguuguacuacagacugcua

SEQ ID NO: 161348 - RNA, 65 nt, hsa
ucuuaggugcuggcuuguggagacaaaaggagggaaauggguagagccuguuugucuugcuuccc

SEQ ID NO: 161349 - RNA, 65 nt, hsa
cagauuuuucacucccacgagugccaagacggugcaauggguaguccccuagaugugaaaaugaa

SEQ ID NO: 161350 - RNA, 65 nt, hsa
gaaguaaaugauuguaucaguuuauuucuaguauaaauggguaccuguaauaauacugagcucuu

SEQ ID NO: 161351 - RNA, 65 nt, hsa
ucuuaaggcuagcggaauauccuuccugguucuuuaauggguagucuauaguauauuauacuaca

SEQ ID NO: 161352 - RNA, 65 nt, hsa
acauccaguccugcugacuauuugacccccacaacaauggguauccuuaauagaggagcugcuug

SEQ ID NO: 161353 - RNA, 65 nt, hsa
cccaccaaugcacugcugaugcaugccauauaauuaauggguaacuuuuauucuuuaugaugucu

SEQ ID NO: 161354 - RNA, 65 nt, hsa
gaacuggaaugcaaagugcauacuuuuucauucaaaauggguauucuugauuuccucagaacuga

SEQ ID NO: 161355 - RNA, 65 nt, hsa
agcagccuggucaucaucugcuugugggagugggaaauggguauuuuagacccaacacagguucu

SEQ ID NO: 161356 - RNA, 65 nt, hsa
uuguuaaguacagggauuuaauauauuuugaauauaauggguauguucuaaauuugaacuuugag

SEQ ID NO: 161357 - RNA, 65 nt, hsa
agcacucugguucucucucugccugugagaagcggaauggguacugucuaggaggacugggcagg

SEQ ID NO: 161358 - RNA, 65 nt, hsa
aagccacgcugugucccucaauuacagaggguaggaauggguauaccucuaacugugcaaagcag

SEQ ID NO: 161359 - RNA, 65 nt, hsa
acagcucacaucacugaauguuacacaugaguuuaaauggguaauauacagguuuuguuauaaua

SEQ ID NO: 161360 - RNA, 65 nt, hsa
ccguaagaagcaggaaaugcagcccaaguuuuacaaauggguaaacagaggcacugagagauaga

SEQ ID NO: 161361 - RNA, 65 nt, hsa
uaaucuauuauuuggagccugccaagagguacuguaauggguaauucugacgucagcgcaccaaa

SEQ ID NO: 161362 - RNA, 65 nt, hsa
ugggauuacaggcgugagccaccgugcccagccagaauggguaguuuuuauucucuccaaacacu

SEQ ID NO: 161363 - RNA, 65 nt, hsa
gggaacuguguuuauugccuauaauggguccccaaaauggguaaccuagacuucagagagaauga

SEQ ID NO: 161364 - RNA, 65 nt, hsa
agggaagcacgcuguuuggaggaaggagcauacuuaauggguaguauugaggaugaaagggaauu

SEQ ID NO: 161365 - RNA, 65 nt, hsa
gacuggacuuugaugagauauaaucucauuauuugaauggguagaaaaugaauuugcuagaacac

SEQ ID NO: 161366 - RNA, 65 nt, hsa
aaguguucauuuaaaaugcguaaugcuuuggaaauaauggguaacagauagcgagaggauauguu

SEQ ID NO: 161367 - RNA, 65 nt, hsa
cuuugaccaaaaauuuuacaguaaaaauuguuagaaauggguaaaaaaaaaaaaaaaaaaaaaac

SEQ ID NO: 161368 - RNA, 65 nt, hsa
agaagcaaaugcaaguuauuuuaauguacaaacuaaauggguaagagguaaaaucuucauuuaaa

SEQ ID NO: 161369 - RNA, 65 nt, hsa
ugccucucugcguuuccagguggaguagagacaguaauggguagagacuuuaggaaauguuuugg

SEQ ID NO: 161370 - RNA, 65 nt, hsa
guuuaagaaaucauuggccccuucccagcacauugaauggguaagcagacaggccaugauuuagu

SEQ ID NO: 161371 - RNA, 65 nt, hsa
cauucacacgcuuaaaagcaauggugugaguuauuaauggguaaacuaagaaguguuauaggcaa

SEQ ID NO: 161372 - RNA, 65 nt, hsa
auuccucaaauuuguguguuccaguccuggccuggaauggguaauggggugaguuaacccaccgc

SEQ ID NO: 161373 - RNA, 65 nt, hsa
aggauguuuuguacuauugcuagacccucuucuguaauggguaaugcguuugauuguuugagauu

SEQ ID NO: 161374 - RNA, 65 nt, hsa
aaagacuugaaaacaaaaaacaguuacuuauagucaauggguaagcagagucugaauuuauacua

SEQ ID NO: 161375 - RNA, 65 nt, hsa
uguugcuuacaccccugaaagucuguuuuuaagcaaauggguaauaguagaaaauagguuagaau

SEQ ID NO: 161376 - RNA, 65 nt, hsa
ucuaagccaucaucuccuccuaauccucccauaacaauggguauaaguuaugaagguggguuaga

SEQ ID NO: 161377 - RNA, 65 nt, hsa
aaauaacuuuggaaacaugggaaggugccacugguaauggguaagguucuaauaggccauguuua

SEQ ID NO: 161378 - RNA, 65 nt, hsa
aaaaaugauauauauaggcauuaaccacacacuuuaauggguauaauuuccuggcugccucccuu

SEQ ID NO: 161379 - RNA, 65 nt, hsa
ugcgaagugaaauaagccacccuguggggauggagaauggguaguuagugcauaauggauacaaa

SEQ ID NO: 161380 - RNA, 65 nt, hsa
aguuugacuugguuucucuuccuguucaaaggaagaauggguagaauaaagauuugauguggucu

SEQ ID NO: 161381 - RNA, 65 nt, hsa
gcccagucguccgcucagccaaggagucagauggcaauggguacuccagcagguaggggcacagu

SEQ ID NO: 161382 - RNA, 65 nt, hsa
gauuuuggagacuuaaaaccagguuaauggcuaagaauggguaacaugacucuuguuggauuguu

SEQ ID NO: 161383 - RNA, 65 nt, hsa
ucagggcagggauacaaagcggggagaggguacacaauggguaucuaauaaauacuuaagaggug

SEQ ID NO: 161384 - RNA, 65 nt, hsa
cauugcauagaaugaauuaaauauccaguuacuugaauggguauaacgcaugaauauuugugugu

SEQ ID NO: 161385 - RNA, 65 nt, hsa
ccugaagcagaaccacuuuggccuccccugcccaaaauggguagugucuacacguccccgggcuc

SEQ ID NO: 161386 - RNA, 65 nt, hsa
auuuuugcguauguuuauauuguauuguucuaaauaauggguagccugugaaauaagaucuugcc

SEQ ID NO: 161387 - RNA, 65 nt, hsa
uggcuuggggggugggggagauaaaaagaacuuaaaauggguaaaguaagaaauguuaaaaaguc

SEQ ID NO: 161388 - RNA, 65 nt, hsa
uacguacaguuuucucuaauuaggugacuguucauaauggguauauuuggaauuuagaagaaaua

SEQ ID NO: 161389 - RNA, 65 nt, hsa
gucuaauucguagggaugugagguucugcugaggaaauggguaugaaugugccuugaacacaaag

SEQ ID NO: 161390 - RNA, 65 nt, hsa
uugcaacugugccucccucugucuguuuucacuugaauggguaaauaaccagcagcuagguuuug

SEQ ID NO: 161391 - RNA, 65 nt, hsa
ugaauuugugugguaugucacucagaaagaaucguaauggguauauugauaaauuuuaaaauugg

SEQ ID NO: 161392 - RNA, 65 nt, hsa
uuuuguaaaaucaucuacuacugcacuugagcaugaauggguaguagccaaacucacaaauugga

SEQ ID NO: 161393 - RNA, 65 nt, hsa
ugaggguuguuuuucuuucucugaaaccuacaguaaauggguaugauuguagcuuccucagaaau

SEQ ID NO: 161394 - RNA, 65 nt, hsa
gagaaaucauaguuuuauauuuuaguuucuccuacaauggguauguuaaauaacuauaucuauac

SEQ ID NO: 161395 - RNA, 65 nt, hsa
cuuagauuucuagguaagucuuuccacauuucaauaauggguaagaguagaaccagggccgggua

SEQ ID NO: 161396 - RNA, 65 nt, hsa
uacaaugcugugaaaaaaguucugcuucuuaggugaauggguacuuucuauuuuguuucuaaacg

SEQ ID NO: 161397 - RNA, 65 nt, hsa
agaauuggagacacuucuuuacuguucaccaaagaaauggguaaucugugcugaucuccuuauuu

SEQ ID NO: 161398 - RNA, 65 nt, hsa
ugauauggagcccuguaauuuuuuucuuauauaaaaauggguaucuauauucauaagacuagguc

SEQ ID NO: 161399 - RNA, 65 nt, hsa
ucccuucacagaaaucagcagugagcagucaaguuaauggguagccuucaguuucaaaaaaauug

SEQ ID NO: 161400 - RNA, 65 nt, hsa
ucacuuacccgugcuucuguuuacuguguaauuaaaauggguaguacuguuuaccuaacuaccuc

SEQ ID NO: 161401 - RNA, 65 nt, hsa
gcuguuggugguacaaguuugauauuuagcuugagaauggguauggaaugaaucaaauacuucau

SEQ ID NO: 161402 - RNA, 65 nt, hsa
ggcaaaucugaauauuguuuuaugagaggccuggcaauggguaaaacaccaaacuugaaaucaga

SEQ ID NO: 161403 - RNA, 65 nt, hsa
cuggccuccccugugucauuuuaaauggcuaaguaaauggguauauguguuugaauggggcaugu

SEQ ID NO: 161404 - RNA, 65 nt, hsa
gcaaaaaaaaacuuaauuucuaguaaaucuauaaaaauggguaagucccuaaauuacaaaugaga

SEQ ID NO: 161405 - RNA, 65 nt, hsa
gcccuuuucauaccuuaaauauauucugcacaacaaauggguauuguuagucuccauuucauaga

SEQ ID NO: 161406 - RNA, 65 nt, hsa
agacuuuaaauuuuaaaaaaggaaguuuuauagugaauggguauaaaaacaaauuuguggcauuu

SEQ ID NO: 161407 - RNA, 65 nt, hsa
gcauugaagggauggggagggaagugagguugauuaauggguacgaaaauauaguuagaacgaau

SEQ ID NO: 161408 - RNA, 65 nt, hsa
acagucuuuagcuauggugacuauuguuuauuuuuaauggguauuucagauuccaaguguauuua

SEQ ID NO: 161409 - RNA, 65 nt, hsa
agcaguucacauuuuuccacaguauaauggaaaauaauggguaggggugcauugcuuauugaagu

SEQ ID NO: 161410 - RNA, 65 nt, hsa
uauuuauccaaauauauuaacuauagacuuuuaccaauggguagcuauaagguuacagcuuauuu

SEQ ID NO: 161411 - RNA, 65 nt, hsa
uaaugauucuuaaaugcuguaugguuuauuauuuaaauggguaaagccauuuacauaauauagaa

SEQ ID NO: 161412 - RNA, 65 nt, hsa
uacaccaaaaaucuguaguuuagaguguaagaaguaauggguacagagaaaaaaaauuuaagacc

SEQ ID NO: 161413 - RNA, 65 nt, hsa
uuugaguuauuuugauguggcuuuuuaaaaaaguuaauggguagcuaauguuguauuguuuuauu

SEQ ID NO: 161414 - RNA, 65 nt, hsa
cugcccuaaacauccucugcaaaugcaacuauuuuaauggguaccaaagaaguaaauguauuuac

SEQ ID NO: 161415 - RNA, 65 nt, hsa
uuauuaggcucagugacauaaaaaggauccagguaaauggguauaggauuugcuggauuuacuaa

SEQ ID NO: 161416 - RNA, 65 nt, hsa
auauaacuuacaaauaaguacuuaaaacagagcuuaauggguaaagcaacagcuguguaaucaca

SEQ ID NO: 161417 - RNA, 65 nt, hsa
gguucauaagacaugugaagcaaauucauauuugcaauggguaaaaaguauuaaagccuuucucu

SEQ ID NO: 161418 - RNA, 65 nt, hsa
aaccugugacuuuaauaagcuggaacaguccacugaauggguauaaugaauugcaguauauacgu

SEQ ID NO: 161419 - RNA, 65 nt, hsa
cauugugauuuguacagccuacgcugggguaaggaaauggguauccaagguccuacuuuuuuaau

SEQ ID NO: 161420 - RNA, 65 nt, hsa
ugugacauggcccccaagcagagcggguaaagugcaauggguaagggagggaaggggaauggaag

SEQ ID NO: 161421 - RNA, 65 nt, hsa
uauagaaugcagagauuuuuuuuuccauuaaaauaaauggguauuggugguuaaaacugcuggac

SEQ ID NO: 161422 - RNA, 65 nt, hsa
ccaccuccucucugagccugucucccacuccgugaaauggguaacaucaccucgaagguuuacuc

SEQ ID NO: 161423 - RNA, 65 nt, hsa
aagccuggagcgaggaaggaaagcacagcgaacccaauggguaacgugguuuacucucccggacg

SEQ ID NO: 161424 - RNA, 65 nt, hsa
ggccaauggagacagaggcuuagugcagagcagccaauggguacugagcuggcugagccuauggc

SEQ ID NO: 161425 - RNA, 65 nt, hsa
aacacauaauugcuuauguaugccuauucagaauaaauggguaacacugauuacuuuugggaggg

SEQ ID NO: 161426 - RNA, 65 nt, hsa
uaucagcuauucagucuuaauuucacuaguaguauaauggguauacauuuuuguaaauagcaucc

SEQ ID NO: 161427 - RNA, 65 nt, hsa
aucccagugggaaccuucaugccuuauuuauuucuaauggguaaagggguuuucuuaccaagcau

SEQ ID NO: 161428 - RNA, 65 nt, hsa
uucuuucuuuggcaaugacccucaugacauguauaaauggguaugacuaagaagaggcugugauc

SEQ ID NO: 161429 - RNA, 65 nt, hsa
guacuuucuccugaaguauugaaaccuauugauucaauggguagagauuugcuaaguaugaugug

SEQ ID NO: 161430 - RNA, 65 nt, hsa
cuugaccuuuccagccuauauuuccucuucuguaaaauggguauauugaugauaauacccacauu

SEQ ID NO: 161431 - RNA, 65 nt, hsa
cuacuaccuuggugccucaguuuacccaucuguaaaauggguaagcauagccacuggugggauau

SEQ ID NO: 161432 - RNA, 65 nt, hsa
gucuguauugcugcuacaaggguaaaaccaggaccaauggguaaaaguaacaggcgggcagauuu

SEQ ID NO: 161433 - RNA, 65 nt, hsa
aguauaacuauaaaacuaauuuuucuuacacacuaaauggguauuuguucaaaauaaugaaguua

SEQ ID NO: 161434 - RNA, 65 nt, hsa
agugauaagcuuucauggcagagcacgucaagauaaauggguauacuggaauccgaugccguuuc

SEQ ID NO: 161435 - RNA, 65 nt, hsa
guuucugacacuuguuguugaacauggcuaaauacaauggguaucgcugagacuaaguuguagaa

SEQ ID NO: 161436 - RNA, 65 nt, hsa
agucugagggcggcgacggcuaccuggcuccggagaauggguauuugauggaggcugcgccggag

SEQ ID NO: 161437 - RNA, 65 nt, hsa
aaugggcagacacagguguaugccaauguuucugaaauggguauaauuucguccucuccuucgga

SEQ ID NO: 161438 - RNA, 65 nt, hsa
aaagccacaaugagauaccaucucagaccugucugaauggguauuaucagaauggguauuauuaa

SEQ ID NO: 161439 - RNA, 65 nt, hsa
uaccaucucagaccugucugaauggguauuaucagaauggguauuauuaaaaaaucaaaacauag

SEQ ID NO: 161440 - RNA, 65 nt, hsa
uaacgccuccauggccucaguuuccccaucugaagaauggguacaggaaaggauuguccuugagg

SEQ ID NO: 161441 - RNA, 65 nt, hsa
uuaauggaauaauggguccagaaaacaugaucuucaauggguacuacaacuaauaggugaaauau

SEQ ID NO: 161442 - RNA, 65 nt, hsa
ccgugcccggccugauguuuuugaaugauuaugaaaauggguauacagcauuaaaaccuuagacu

SEQ ID NO: 161443 - RNA, 65 nt, hsa
aguugcaaaaauuaacaaauaugcugcuugauuaaaauggguaggcuucucauguggcucauucu

SEQ ID NO: 161444 - RNA, 65 nt, hsa
ugcccacgagcuagagcggggaaauguugagcucaaauggguaaauugagaccagaaaauuauuu

SEQ ID NO: 161445 - RNA, 65 nt, hsa
acaggccucucuuucuuucuagguugcuggggagaaauggguacccuaugaucccccuccccuuc

SEQ ID NO: 161446 - RNA, 65 nt, hsa
uuaaugcuuuguguaauugguuugaaaaacagugaaauggguaaacgcaaaacuuuuguacuuua

SEQ ID NO: 161447 - RNA, 65 nt, hsa
uacauaucuaucaauaucagagauuuggguaaaagaauggguaauguuuaaacauguggaggcau

SEQ ID NO: 161448 - RNA, 65 nt, hsa
ugaccgauguaucuuuuccuuaaaguuauuauaauaauggguaauuugucaauaaagcauuccuu

SEQ ID NO: 161449 - RNA, 65 nt, hsa
agccacggaaggagccucucuuguuuuuucuauaaaauggguaggcaggagaaaagcaggugccc

SEQ ID NO: 161450 - RNA, 65 nt, hsa
gcacaccacaauguuucccucagugcccuuucucaaauggguacaauguucccuuguggccaaau

SEQ ID NO: 161451 - RNA, 65 nt, hsa
ggaauuguuggaagaagaguuugcagaagguuaggaauggguagauagcuaaguccuaaucuaug

SEQ ID NO: 161452 - RNA, 65 nt, hsa
aacuagaaccaccugcaccuugagauguuucuguaaauggguacuugugaucacacuacgggaau

SEQ ID NO: 161453 - RNA, 65 nt, hsa
auuucaucgugugugucuaauuuuuuuuccuguugaauggguaaaaacaaaacaaaacuuuuuuu

SEQ ID NO: 161454 - RNA, 65 nt, hsa
uuuugcagacaguccuuaaugcugaaaacacagagaauggguaauucaagaggccuuucuuuuaa

SEQ ID NO: 161455 - RNA, 65 nt, hsa
aggcagggggagaguggcauggggagugacuucuuaauggguaaggggcugcuuacuucuggggu

SEQ ID NO: 161456 - RNA, 65 nt, hsa
aaugccagacuucuaaaauaaauguuuuggaauucaauggguaaauaaaugcugcuuuggggaua

SEQ ID NO: 161457 - RNA, 65 nt, hsa
ugccugaaaauaaaucaauaaauaaacucaaccgaaauggguaugaaaguugaaauggguaugua

SEQ ID NO: 161458 - RNA, 65 nt, hsa
uaaauaaacucaaccgaaauggguaugaaaguugaaauggguauguaaguugaaaaccagaaguu

SEQ ID NO: 161459 - RNA, 65 nt, hsa
uguuguuuucucguguccacccuguggcccuuugcaauggguaggagaucuggggaggcccugcc

SEQ ID NO: 161460 - RNA, 65 nt, hsa
gcaggauuguggacauuugguuaguaguuuuuuugaauggguaugucagaaaaggaugaguuugu

SEQ ID NO: 161461 - RNA, 65 nt, hsa
uucacacagugagaaauagagcaggcugccccauaaauggguaacauauuccuaaucugagugug

SEQ ID NO: 161462 - RNA, 65 nt, hsa
acuuuuuauucaucuuuguguuuuuauuuaucuaaaauggguauugauuuuuaggacgguuuuga

SEQ ID NO: 161463 - RNA, 65 nt, hsa
uuugcagauucccuucauaguguuccaguugcacaaauggguaacuaucaggaauaucugaagac

SEQ ID NO: 161464 - RNA, 65 nt, hsa
ggaaggccuguugcugcaaucauuguacagggggaaauggguaugagagacugaggcuugaguga

SEQ ID NO: 161465 - RNA, 65 nt, hsa
uuggcaaacccacugcagccccugagaggaggucgaauggguaaaggagcauuuuuuuauucagc

SEQ ID NO: 161466 - RNA, 65 nt, hsa
uuucgucugcacuaccaauucaaugcccuucauccaauggguaucuauuuuugugugugauuaua

SEQ ID NO: 161467 - RNA, 64 nt, hsa
aauucuugcaacaugcauucuugauuaccuacugugugccaaacaagauuuuguagaauauugc

SEQ ID NO: 161468 - RNA, 64 nt, hsa
gaucccaacaaugaauaggaggcauggaaguagaugugccaauggggagggaugaggagugaac

SEQ ID NO: 161469 - RNA, 64 nt, hsa
gaccaaucgcaugguucuccuggcaggccugcugugugccaaaaacucccacccaaggucccuc

SEQ ID NO: 161470 - RNA, 64 nt, hsa
cuuucucuuucccauauuccuuuucuuuuucucuugugccaaacugacagaaaccgucaccaca

SEQ ID NO: 161471 - RNA, 64 nt, hsa
cauuaaaaacaaacuggcuugcagaaggguccgaugugccaagugaucaugauucugcuggaaa

SEQ ID NO: 161472 - RNA, 64 nt, hsa
uuuauugccuuuugagauucuccaacuugacaaaugugccaaagaucaacagacagaaaauauc

SEQ ID NO: 161473 - RNA, 64 nt, hsa
uuauaaugcaucuaaaccaccuguccccaguuaaugugccaaaaugucaauuuuuaacuuaucu

SEQ ID NO: 161474 - RNA, 64 nt, hsa
aaaccugugcuuucauguuuaagaaaugagaaauugugccaaagauagcagaagaguagauaag

SEQ ID NO: 161475 - RNA, 64 nt, hsa
gaacuagcaacuagccuuuuccaccuuuaaaaguugugccaagucauaaucauauuguguauaa

SEQ ID NO: 161476 - RNA, 64 nt, hsa
caaaaaagaaaaaaaguaccccauguucagccccugugccaaauuugccuagguuuuccagcug

SEQ ID NO: 161477 - RNA, 64 nt, hsa
gugugguagcaaaaggagggagaggaguccuuuuugugccaaaucccuaagugccguucggggg

SEQ ID NO: 161478 - RNA, 64 nt, hsa
ccagcuuuggccauauuucaggagaauguuuccaugugccaaaucuuagucccaugaucugucc

SEQ ID NO: 161479 - RNA, 64 nt, hsa
uuucuuacccuugcccuagauugcucaguaaauuugugccaagauaggagaaaaccaaucuuuu

SEQ ID NO: 161480 - RNA, 64 nt, hsa
aacuccugguaaauacuguguauucaaguaaucaugugccaaagccagggcagagcuucuaguu

SEQ ID NO: 161481 - RNA, 64 nt, hsa
gcuucaaagaccccugagcugccaaccacggagaugugccaagcaucucaucucuccugcacac

SEQ ID NO: 161482 - RNA, 64 nt, hsa
augcuccucuuggcuaauuuucuuuugacuuuaaugugccaauguaacuuccuuuaaaggaucu

SEQ ID NO: 161483 - RNA, 64 nt, hsa
uuuccuuacauugucuugacaagauuaaaaugucugugccaaaauuuuguauuuuauuuggaga

SEQ ID NO: 161484 - RNA, 64 nt, hsa
auuguguauaucuuugugugucuuccuguuuaugugugccaagggaguauuuucacaaaguuca

SEQ ID NO: 161485 - RNA, 64 nt, hsa
uagugaucacagcagcuucuacgguguaugguucugugccaauguauugauaagagggcacaca

SEQ ID NO: 161486 - RNA, 64 nt, hsa
cccagcauuuuacugauucauacauuaucucacuugugccaacacucaagaagcaggcuacacu

SEQ ID NO: 161487 - RNA, 64 nt, hsa
caucuccucugccugugucugcgacccccauccaugugccaaagugucccuugggucacacagc

SEQ ID NO: 161488 - RNA, 64 nt, hsa
cauugcaggcacucugccgcccgaccuugagggcugugccaauccuagugaaccaaaaugcaaa

SEQ ID NO: 161489 - RNA, 64 nt, hsa
gggaugggcaccucaugccugucucgccaccuccugugccaaugucccacccuccaccuggggg

SEQ ID NO: 161490 - RNA, 64 nt, hsa
ccccagcaucccagcugggccagagagagccgagugugccaacaaggacuggggccugcccggc

SEQ ID NO: 161491 - RNA, 64 nt, hsa
cccccguggcucccggucuccugugggccugcugugugccaaaccugagcuaccugcacccgag

SEQ ID NO: 161492 - RNA, 64 nt, hsa
acaagcaaucauguuugcguccccguccgucacaugugccaaaucccuggcaggcagauggcuc

SEQ ID NO: 161493 - RNA, 64 nt, hsa
aggcgacugucccauggaggcauccaaggcuuucugugccaagaaucccaagugacuggggcug

SEQ ID NO: 161494 - RNA, 64 nt, hsa
cuugggaaucugaggcagaggagggugaggccugugugccaaccuuguucacauaccaccuucg

SEQ ID NO: 161495 - RNA, 64 nt, hsa
cggcugcuggggccaggacaggcgucuccuagguugugccaaaccagccuacagauguuccugc

SEQ ID NO: 161496 - RNA, 64 nt, hsa
ucugagguccacaucauggcaguucauuuacucuugugccaaauggcaacaccacgucuaaagc

SEQ ID NO: 161497 - RNA, 64 nt, hsa
uuucaaaggguauauauaaaagguaaaaaacuagugugccaaaugguauaggaacaacuguacu

SEQ ID NO: 161498 - RNA, 64 nt, hsa
auaaaagcuauaaaguauauauuaggaucugcaaacaaugaagaauuauguaauauauuguaca

SEQ ID NO: 161499 - RNA, 64 nt, hsa
ggcacuuaagugcacuuuuuuaugaagaaaaaguacaaugaacugcuuuuccucaagcaauaau

SEQ ID NO: 161500 - RNA, 64 nt, hsa
auauaaaccuugauguacauguugagauauuuggacaaugaaaaugccuuaaaaggaaugcaua

SEQ ID NO: 161501 - RNA, 64 nt, hsa
aucacugugcauauuauagaguuguagccaccucacaaugaaguacuacagccugugcugucuu

SEQ ID NO: 161502 - RNA, 64 nt, hsa
uguuacaaauuggaccuuuauacauuuucugaaaacaaugaaaagaguauauuuaaccuuuucu

SEQ ID NO: 161503 - RNA, 64 nt, hsa
uaaagcuuaaauuuaugaaccaccuuugugguaaacaaugaauuaugaauaccgcagggcagcc

SEQ ID NO: 161504 - RNA, 64 nt, hsa
aauugaaauggaaaauguuaguggccauuuugcaacaaugaagaggauagcacuuuaucuagau

SEQ ID NO: 161505 - RNA, 64 nt, hsa
ggcagacaaagucaagaggaggaaguuuuuguggacaaugaaaaguuauuuucguaccuuucua

SEQ ID NO: 161506 - RNA, 64 nt, hsa
caaugaauccaagugacugugaaaaggucucauuacaaugaaaccaauccuaaauaauuacacc

SEQ ID NO: 161507 - RNA, 64 nt, hsa
ucuaauaagcugagugacucuuuaauauauuuacacaaugaauccaagugacugugaaaagguc

SEQ ID NO: 161508 - RNA, 64 nt, hsa
acccccuggcccugccagcugguaguccaucagcacaaugaaggagacuuggagaagaggaaga

SEQ ID NO: 161509 - RNA, 64 nt, hsa
cgaagcagcuguaauggucugagcggauuuauugacaaugaauaaagggcacgaaggccaggcc

SEQ ID NO: 161510 - RNA, 64 nt, hsa
uuagauaacauuuucucccaacucaaagaucccaacaaugaauaggaggcauggaaguagaugu

SEQ ID NO: 161511 - RNA, 64 nt, hsa
gcucuggacucuauccaagcuuaugauaauucacacaaugaauuucauaccuagcguggagcua

SEQ ID NO: 161512 - RNA, 64 nt, hsa
ucucuuuagcacuauuuuaaguuugaaaacuuuaacaaugaaggggaaggggaagauuuccacc

SEQ ID NO: 161513 - RNA, 64 nt, hsa
ugaaaugaccauucuguguagucauaaaagaaacacaaugaaguguauggccucuggaguuagu

SEQ ID NO: 161514 - RNA, 64 nt, hsa
aaauuacccauaacuuucauuuguuuuuauaucgacaaugaagaugaucauauuucauuuugca

SEQ ID NO: 161515 - RNA, 64 nt, hsa
aaauauuaauugaccacuuccuuggcccccagcuacaaugaaaaagaagaauuaugcacacauc

SEQ ID NO: 161516 - RNA, 64 nt, hsa
uggauucuccuagcauucaugauuuuuuuuucauacaaugaauuaaaauugcuaaaaucaugga

SEQ ID NO: 161517 - RNA, 64 nt, hsa
cauuuuuacucaacuaccucagguauucaguaauacaaugaaaagcaaaauuguuccuuuuuuu

SEQ ID NO: 161518 - RNA, 64 nt, hsa
aagugaugagaccccacacuuuacacucguggugacaaugaagcuauuaaguaacagcuucuca

SEQ ID NO: 161519 - RNA, 64 nt, hsa
cuaaacauaaacuacguuuaggcugauauuucagacaaugaaaccuuugagugcccguagcggg

SEQ ID NO: 161520 - RNA, 64 nt, hsa
acuucuaggugggauuuuuuuguuuuaccaagagacaaugaaauccugaaguuuaugcuuuucc

SEQ ID NO: 161521 - RNA, 64 nt, hsa
uagguuccacacuaaauuaagugggucaguaccaacaaugaacacauuauuuccuggucuacug

SEQ ID NO: 161522 - RNA, 64 nt, hsa
caugaggguaaauggagaaaauauuucugggauuacaaugaauguaagcccaaauuguggaauu

SEQ ID NO: 161523 - RNA, 64 nt, hsa
ugaaaacaaaaaacaaaaaaacgaaagcaucuucacaaugaagcuuccagauagcaccguuuug

SEQ ID NO: 161524 - RNA, 64 nt, hsa
ccuaucccuaggcacuuaaccaagacaaaaagccacaaugaacaucccuuuuucaaugaauuuu

SEQ ID NO: 161525 - RNA, 64 nt, hsa
ucuucucuguugucguaaagauuugggugaacaaacaaugaaaacucuuugcugcugcccaugu

SEQ ID NO: 161526 - RNA, 64 nt, hsa
uauuuucaagucauguggaaagcccaaagucaucacaaugaagagaacaggugcacagcacugu

SEQ ID NO: 161527 - RNA, 64 nt, hsa
uguagauaaggacugugccauuggaaauuucauuacaaugaagugccaaacucacuacaccaua

SEQ ID NO: 161528 - RNA, 64 nt, hsa
auaauacauuuuuaaacaugucaacauugauaauacaaugaagauuuaccauaaaaaguaucau

SEQ ID NO: 161529 - RNA, 64 nt, hsa
cgauuugaaugcacaguaaguggauaaucugaguacaaugaaauuucuuaaguuuuagaacaug

SEQ ID NO: 161530 - RNA, 64 nt, hsa
gccuuugcucucacgcagaggaaggcuuggauguacaaugaaacugccuggaacuaaaagcagu

SEQ ID NO: 161531 - RNA, 64 nt, hsa
gccuuugcucagagccuccuccugugacaugugaacaaugaagaggccugcgccuccugccuug

SEQ ID NO: 161532 - RNA, 64 nt, hsa
aauauugaagugguuguaacaauuuguuaaaacaacaaugaaauuuaccacauuaacugacgcu

SEQ ID NO: 161533 - RNA, 64 nt, hsa
cacagccuagauccagaguucagaagaccuugagacaaugaaaauaaacuugguaauaaucuuu

SEQ ID NO: 161534 - RNA, 64 nt, hsa
uucuuccagaugugaugcuugauauuuucuauaugcgaguuagccauccacacccaggcauagc

SEQ ID NO: 161535 - RNA, 64 nt, hsa
aaaaauagagacuauugguauguucuccccaucagcgaguuauuguaacuggucaccacuggac

SEQ ID NO: 161536 - RNA, 64 nt, hsa
auacauuccuuuuagaguuaagaacuaugacguagcgaguuagugagacuagacauaguaccga

SEQ ID NO: 161537 - RNA, 64 nt, hsa
uucugcucuacuaacuguagauauuuaugacucugcgaguuaucuauuuuuauaaccaccugug

SEQ ID NO: 161538 - RNA, 64 nt, hsa
agaccgaugcugcaagcagaccauaugcagaugugcgaguuauugacuguggaguacuugccac

SEQ ID NO: 161539 - RNA, 64 nt, hsa
ugcacagugauuacaaccuuuaaagcaagaggaggcgaguuaauuuggaugagugugauuuugc

SEQ ID NO: 161540 - RNA, 64 nt, hsa
agcuuccggacuugucugcacccccagcaagaaggcgaguuaguuuucuagagacuugaaggag

SEQ ID NO: 161541 - RNA, 64 nt, hsa
ugcagguguuaguggugugcuaaaagcaaggaaagcgaguuagucuuuucagugucuuuugcaa

SEQ ID NO: 161542 - RNA, 64 nt, hsa
uuggauuaucaccagauuaaugcaaaauaacagagcgaguuaucaguuugaauuucaacacugc

SEQ ID NO: 161543 - RNA, 64 nt, hsa
cccggacggacuccuucaccgacugcacccccgggcgaguuacgcggccucucugugccgcuuc

SEQ ID NO: 161544 - RNA, 64 nt, hsa
aaaugucggcaaaaugacuauuuuauuguuugaagcgaguuaauauucucaguugucuuuaaaa

SEQ ID NO: 161545 - RNA, 64 nt, hsa
gaagcugaaauucguacuauauuggccaaagugagcgaguuaggugaucuugguuucaauuucc

SEQ ID NO: 161546 - RNA, 64 nt, hsa
agaauauuguuuugaacauccuuguaaaagauuugcgaguuaaacuauuuuauuuacugucugu

SEQ ID NO: 161547 - RNA, 64 nt, hsa
aaaaggcuuuagcaugaaauaucuuucugagcuggcgaguuagaagaauggaagguaaggggaa

SEQ ID NO: 161548 - RNA, 64 nt, hsa
ugggaaugagaaacagaagaagugguauuugcuggcgaguuaaauaggcaagguacccagugau

SEQ ID NO: 161549 - RNA, 64 nt, hsa
ugcgugugguccguauggaaagccugguagcccugcgaguuaaguacugcuuccauucauuguu

SEQ ID NO: 161550 - RNA, 64 nt, hsa
uccuagaauuuauuuauuuccugacuuacagcaagcgaguuaucgucuucuguauuuuguagac

SEQ ID NO: 161551 - RNA, 64 nt, hsa
ucuguaaauauccaaguauaaagcccaggaacuucuagaauaacccagaugcgcuuuaauuuuu

SEQ ID NO: 161552 - RNA, 64 nt, hsa
uaauuuuuuuuaauauguuuugaucacagaacuucuagaauaacccagaugcucuuucauauuc

SEQ ID NO: 161553 - RNA, 64 nt, hsa
uugaaauauugaaacauauuaaauugugcaacaccuagaauagugcuagacauacaguaaguac

SEQ ID NO: 161554 - RNA, 64 nt, hsa
ugguuuuguuugacuaaagaauaaucucauauaacuagaauacuuguggcuuuuauuaucuuua

SEQ ID NO: 161555 - RNA, 64 nt, hsa
guuucauuuuaugaauggaggcacuuuacuaggucuagaauauuuuuuuaaaagccucugaacu

SEQ ID NO: 161556 - RNA, 64 nt, hsa
gcugcgucugacuuuaauacaggcagugcucaaacuagaauaagcacuaauuaaaggaauuguu

SEQ ID NO: 161557 - RNA, 64 nt, hsa
acaucuuuugauauucuuauaaauggaacuuacacagaagaaauagggauaugauaaccacuaa

SEQ ID NO: 161558 - RNA, 64 nt, hsa
cagagaacaguuaaucccuaaggucuugacaaaacagaagaaaaacaagccuccucguccuagu

SEQ ID NO: 161559 - RNA, 64 nt, hsa
ucaagggucacaugccaauaaacaauaaauuuuccagaagaaaugaaauccaacuagacaaaua

SEQ ID NO: 161560 - RNA, 64 nt, hsa
uaguaacugcuacuguauuuagugggguggaauucagaagaaauuugaagaccagaucaugggu

SEQ ID NO: 161561 - RNA, 64 nt, hsa
auuagauuucugacuugcaaauauguuuguacuccagaagaauuagaggaaaagcagauacuag

SEQ ID NO: 161562 - RNA, 64 nt, hsa
ucucaauuuuagucuggucuuuuguacuuuucuucagaagaaaugaauuaaaggguacaguugc

SEQ ID NO: 161563 - RNA, 64 nt, hsa
uguguucagguuuagaucauaugacacucgagcacagaagaauaauuucaaggaggucaucuug

SEQ ID NO: 161564 - RNA, 64 nt, hsa
ucccagaguacaaagggguauguagaaaggauuccagaagaaguaauacuuuauucucuaaugu

SEQ ID NO: 161565 - RNA, 64 nt, hsa
ccauucuuaguggcacuggggaaaucuuggcacccagaagaauucaacugcgcucacugcaaaa

SEQ ID NO: 161566 - RNA, 64 nt, hsa
aguuaauccugugaaauaaauauugaacauaauccagaagaaucucucuguuucccuuggggaa

SEQ ID NO: 161567 - RNA, 64 nt, hsa
uacucauuuuucaugauaaugaacagaacauagacagaagaaacaagguuuucaguccccacag

SEQ ID NO: 161568 - RNA, 64 nt, hsa
ccucucugaguggacuggccucaaagcaagcauucagaagaaaaagaagcaaccucaguaauuu

SEQ ID NO: 161569 - RNA, 64 nt, hsa
aaguugggacucuggagagcggaggagagagaggcagaagaacccuggccugagaagguuuggu

SEQ ID NO: 161570 - RNA, 64 nt, hsa
ggacgcuuugggagaaugucaguucauguauguucagaagaaauucugucauagaaagugccag

SEQ ID NO: 161571 - RNA, 64 nt, hsa
uuguuuugaacuauacugcuuugagaucucauuucagaagaacggcaugaacagucuucagcca

SEQ ID NO: 161572 - RNA, 64 nt, hsa
uuuuuuaccagguuucuaagcaugaauugaggaacagaagaagcagagcagaugaucggagcag

SEQ ID NO: 161573 - RNA, 64 nt, hsa
uucauauuuauggccuuuggaauccaaagaaaaacagaagaauaauucauggauuuguucauug

SEQ ID NO: 161574 - RNA, 64 nt, hsa
uuuguccacaagaugguguuuaaaacaauuuguucagaagaacugagcaaacuaacagaaauac

SEQ ID NO: 161575 - RNA, 64 nt, hsa
uucugagcaggaaauuuauaagaaauugaaagagcagaagaauuacagcccugucacaugugcc

SEQ ID NO: 161576 - RNA, 64 nt, hsa
auauggagugccauccugcuaggugaguacagaccagaagaaaauuuaguugggaaaauacuug

SEQ ID NO: 161577 - RNA, 64 nt, hsa
ccccuauuaccuuuguagcagccacaucagaaagcagaagaaaacaguauuucugaaggcauug

SEQ ID NO: 161578 - RNA, 64 nt, hsa
ggacaacucuuuacaagcuaagaagagagggccucagaagaaaccaacccugccaacaccuuga

SEQ ID NO: 161579 - RNA, 64 nt, hsa
aauuauaucaaauaaguaucacaaaucuuuuacgcagaagaaauaaaaacuacggguagaaaac

SEQ ID NO: 161580 - RNA, 64 nt, hsa
cacuauguccaugaaaaacagcagaguaaaauuacagaagaagcuccugaaucccuuucaguuu

SEQ ID NO: 161581 - RNA, 64 nt, hsa
aaguuuuuuucaaaguccaacuacagccaaauugcagaagaaacuccuggaucccuuucacuau

SEQ ID NO: 161582 - RNA, 64 nt, hsa
aaacacagauaaauggaaaccauucuuuucaaugcagaagaaaucuagauauccccuacuguga

SEQ ID NO: 161583 - RNA, 64 nt, hsa
uagauuuaaugaauuucacucgaaaauaaaugaucagaagaauuuucaucuaaggcauagagug

SEQ ID NO: 161584 - RNA, 64 nt, hsa
ccuuugggauaauuuauuuccuguggcaucuagccagaagaaauugaggauguuuccuuucaca

SEQ ID NO: 161585 - RNA, 64 nt, hsa
uucugcaccaccauuuccagcagcaaucggcucucagaagaaguuuagccgcccacuucugccu

SEQ ID NO: 161586 - RNA, 64 nt, hsa
gagacuccugaaugauuuagacaacuucaaaauacagaagaaaagcaaaugacuaguaaacaug

SEQ ID NO: 161587 - RNA, 64 nt, hsa
aucgaggaaaucuaccaagacuaguaggguaguccagaagaagcuguuucagggccuguugcca

SEQ ID NO: 161588 - RNA, 64 nt, hsa
aggggacccacaaacaagagugcucuuguauguccagaagaaagagaaagaccaucaaucaggg

SEQ ID NO: 161589 - RNA, 64 nt, hsa
ggggucaggggaaggcaugggggggaccagaaaccagaagaacaaucaagacugcaaugaaaaa

SEQ ID NO: 161590 - RNA, 64 nt, hsa
auaaauggugcugggaaaacuggauauccauaugcagaagaaugaaacuagacccccaucucuu

SEQ ID NO: 161591 - RNA, 64 nt, hsa
uggguugucucaaauccuguccacaaggcaacuccagaagaaagaagcccuuuacauuuccaua

SEQ ID NO: 161592 - RNA, 64 nt, hsa
cacagcccugauuuggaccagaaucucagaugcucagaagaaagauccuguuuagugaugaccc

SEQ ID NO: 161593 - RNA, 64 nt, hsa
augauggcugcacacgaugacucauuggaugggacagaagaagaggaugaggaugagauggaag

SEQ ID NO: 161594 - RNA, 64 nt, hsa
agcuuccuuucuucauucuguccuucagggaaggcagaagaaacauuggaaagcaucuagucca

SEQ ID NO: 161595 - RNA, 64 nt, hsa
gccugaugcccauggucaacccacgcagaagaaacagaagaacucaugcugccagauagauaga

SEQ ID NO: 161596 - RNA, 64 nt, hsa
aucucugaugccugaugcccauggucaacccacgcagaagaaacagaagaacucaugcugccag

SEQ ID NO: 161597 - RNA, 64 nt, hsa
aagccuguaaucccagcuacucaggaggcugaggcagaagaauugaacccaggagguggagguu

SEQ ID NO: 161598 - RNA, 64 nt, hsa
acccaaggaggaaaaacagacaaaaacagccucacagaagaauaugacagcugucccugucacc

SEQ ID NO: 161599 - RNA, 64 nt, hsa
gcgccuguaaucccagcuacucaggaggcugagacagaagaaucgcuugaaccugugaggcaga

SEQ ID NO: 161600 - RNA, 64 nt, hsa
gugugguuuuccuuuggggacgugguuaacgguccagaagaaucccuucuagaaagcauuuuag

SEQ ID NO: 161601 - RNA, 64 nt, hsa
uucccgggcccagaaacucuggaaagauuuuguccagaagaauucaccguguguacugagugca

SEQ ID NO: 161602 - RNA, 64 nt, hsa
cucucucccuuauauuuuacuacucgaagaaaggcagaagaaguuacaaauaguucugaacauu

SEQ ID NO: 161603 - RNA, 64 nt, hsa
uuguacaaauuaaaaauaaccauaagggagaaaccagaagaauuccucugaccacuuacaauua

SEQ ID NO: 161604 - RNA, 64 nt, hsa
uuacauuuguuggcauacgaaaccuuaguggcuacagaagaaaguugaccuugugucacuauuu

SEQ ID NO: 161605 - RNA, 64 nt, hsa
uggggaccugucugcauauacacacggggaaugccagaagaaggcccagucugcaccaggcguc

SEQ ID NO: 161606 - RNA, 64 nt, hsa
aacaacccauaguaucucauucugucaucagauccagaagaaauauccugguuuuccagcaugu

SEQ ID NO: 161607 - RNA, 64 nt, hsa
gggacaaucagccucaugaaaaauugauguaaaucagaagaauacccuagaaugaggccuugug

SEQ ID NO: 161608 - RNA, 64 nt, hsa
gcacuaaucucugggauuuuuaaggauugcacuacagaagaauguacccugauguaaaucucug

SEQ ID NO: 161609 - RNA, 64 nt, hsa
gagcagcgugggaagaagacucugucaagacucucagaagaaccuggaguaauugugccugaag

SEQ ID NO: 161610 - RNA, 64 nt, hsa
gccugaagcucagcgugaagucugaaauaugcaacagaagaaauauaucucuaucucucuacuc

SEQ ID NO: 161611 - RNA, 64 nt, hsa
uucuccccacuuuacugcaagguagacugaaguucagaagaaauacugaauuucugcucccaga

SEQ ID NO: 161612 - RNA, 64 nt, hsa
cugaaguucagaagaaauacugaauuucugcucccagaagaauaguuucucuggcucacaggcc

SEQ ID NO: 161613 - RNA, 64 nt, hsa
aucuccugggagaggcagacgagugaguuucacacagaagaauuucaugugaauggggccagca

SEQ ID NO: 161614 - RNA, 64 nt, hsa
gaguuacagaaaugggagacuguuucucuggccucagaagaagcgagcacaggcugggguggau

SEQ ID NO: 161615 - RNA, 64 nt, hsa
aauugccagcugucuacacaaagaauaugcaggccagaagaaaaguugcuuuucaaagaggaag

SEQ ID NO: 161616 - RNA, 64 nt, hsa
auuuccccccaaaguagagaugcuaagccaaauccagaagaacccauagaugaagaugaagaua

SEQ ID NO: 161617 - RNA, 64 nt, hsa
agaaugaacuuuuuuuuagauauucuggacucagcagaagaauucucggcaaaaguugauaucg

SEQ ID NO: 161618 - RNA, 64 nt, hsa
gagugguuugaucuauauacacugugacgauggacagaagaaaauugugaaaguucaaauucga

SEQ ID NO: 161619 - RNA, 64 nt, hsa
uggauuuagggauauuuuccagccagaauggauccagaagaauugaauggugcuuaaauugaga

SEQ ID NO: 161620 - RNA, 64 nt, hsa
gcgccuguagucccagcuacucgggaggcugaagcagaagaaucgcuugaacccgggaggcgga

SEQ ID NO: 161621 - RNA, 64 nt, hsa
aauucagguucugcuguuggcuucagaacaugagcagaagaaucguuuuaugcuaguuauugca

SEQ ID NO: 161622 - RNA, 64 nt, hsa
uacagaaguugaggccaagggagaaugguaggcacagaagaaacauggcaaacugcucugugcu

SEQ ID NO: 161623 - RNA, 64 nt, hsa; identical to SEQ ID NO: 90267

SEQ ID NO: 161624 - RNA, 64 nt, hsa; identical to SEQ ID NO: 90268

SEQ ID NO: 161625 - RNA, 64 nt, hsa; identical to SEQ ID NO: 90269

SEQ ID NO: 161626 - RNA, 64 nt, hsa; identical to SEQ ID NO: 90270

SEQ ID NO: 161627 - RNA, 64 nt, hsa; identical to SEQ ID NO: 90271

SEQ ID NO: 161628 - RNA, 64 nt, hsa; identical to SEQ ID NO: 90272

SEQ ID NO: 161629 - RNA, 64 nt, hsa; identical to SEQ ID NO: 90273

SEQ ID NO: 161630 - RNA, 64 nt, hsa; identical to SEQ ID NO: 90274

SEQ ID NO: 161631 - RNA, 64 nt, hsa; identical to SEQ ID NO: 90275

SEQ ID NO: 161632 - RNA, 64 nt, hsa; identical to SEQ ID NO: 90276

SEQ ID NO: 161633 - RNA, 64 nt, hsa; identical to SEQ ID NO: 90277

SEQ ID NO: 161634 - RNA, 64 nt, hsa; identical to SEQ ID NO: 90278

SEQ ID NO: 161635 - RNA, 64 nt, hsa; identical to SEQ ID NO: 90279

SEQ ID NO: 161636 - RNA, 64 nt, hsa; identical to SEQ ID NO: 90280

SEQ ID NO: 161637 - RNA, 64 nt, hsa; identical to SEQ ID NO: 90281

SEQ ID NO: 161638 - RNA, 64 nt, hsa; identical to SEQ ID NO: 90282

SEQ ID NO: 161639 - RNA, 64 nt, hsa; identical to SEQ ID NO: 90283

SEQ ID NO: 161640 - RNA, 64 nt, hsa; identical to SEQ ID NO: 90284

SEQ ID NO: 161641 - RNA, 64 nt, hsa; identical to SEQ ID NO: 90285

SEQ ID NO: 161642 - RNA, 64 nt, hsa; identical to SEQ ID NO: 90286

SEQ ID NO: 161643 - RNA, 64 nt, hsa; identical to SEQ ID NO: 90287

SEQ ID NO: 161644 - RNA, 64 nt, hsa
guccuucaauggaaaaguaacauuuaaaaauccuuuggguaauucgaauuacagauuuaaaaga

SEQ ID NO: 161645 - RNA, 64 nt, hsa
aaaaauaacauuggaauacaggacuuguugccaauuggguaauuuucauuaguuguuuuguuug

SEQ ID NO: 161646 - RNA, 64 nt, hsa
acuuaagugaucaugagguccuuccauauuuagauuggguaagcaugaauguguauuuucuaca

SEQ ID NO: 161647 - RNA, 64 nt, hsa
ccaucaagaugaccuggagcagagagcaugggccuuggguaaagcaggcccaggucaaggucuu

SEQ ID NO: 161648 - RNA, 64 nt, hsa
auuguuuaaagcugcauucaacgucaaaauuaccuuggguaacuuuugauaacuuacaugugug

SEQ ID NO: 161649 - RNA, 64 nt, hsa
aguagccauaguacacacacaacacgcuaucagcuuggguaaggacagugggauuuaugugaac

SEQ ID NO: 161650 - RNA, 64 nt, hsa; identical to SEQ ID NO: 51559

SEQ ID NO: 161651 - RNA, 64 nt, hsa; identical to SEQ ID NO: 51560

SEQ ID NO: 161652 - RNA, 64 nt, hsa; identical to SEQ ID NO: 51561

SEQ ID NO: 161653 - RNA, 64 nt, hsa; identical to SEQ ID NO: 51562

SEQ ID NO: 161654 - RNA, 64 nt, hsa; identical to SEQ ID NO: 51563

SEQ ID NO: 161655 - RNA, 64 nt, hsa; identical to SEQ ID NO: 51564

SEQ ID NO: 161656 - RNA, 64 nt, hsa; identical to SEQ ID NO: 51565

SEQ ID NO: 161657 - RNA, 64 nt, hsa; identical to SEQ ID NO: 51566

SEQ ID NO: 161658 - RNA, 64 nt, hsa; identical to SEQ ID NO: 51567

SEQ ID NO: 161659 - RNA, 64 nt, hsa; identical to SEQ ID NO: 51568

SEQ ID NO: 161660 - RNA, 64 nt, hsa; identical to SEQ ID NO: 51569

SEQ ID NO: 161661 - RNA, 64 nt, hsa; identical to SEQ ID NO: 51570

SEQ ID NO: 161662 - RNA, 64 nt, hsa; identical to SEQ ID NO: 51571

SEQ ID NO: 161663 - RNA, 64 nt, hsa; identical to SEQ ID NO: 51572

SEQ ID NO: 161664 - RNA, 64 nt, hsa; identical to SEQ ID NO: 51573

SEQ ID NO: 161665 - RNA, 64 nt, hsa; identical to SEQ ID NO: 51574

SEQ ID NO: 161666 - RNA, 64 nt, hsa; identical to SEQ ID NO: 51575

SEQ ID NO: 161667 - RNA, 64 nt, hsa; identical to SEQ ID NO: 51576

SEQ ID NO: 161668 - RNA, 64 nt, hsa; identical to SEQ ID NO: 51577

SEQ ID NO: 161669 - RNA, 64 nt, hsa; identical to SEQ ID NO: 51578

SEQ ID NO: 161670 - RNA, 64 nt, hsa
gagcugaagagucuugagaggggcugucaucuguagcugccaucacagugaguuggcagaagug

SEQ ID NO: 161671 - RNA, 64 nt, hsa
ccccagccccugugccaggcuaagcugguacaagagcugccaaccucacagaguguuugcuagg

SEQ ID NO: 161672 - RNA, 64 nt, hsa
cuucauccuccucagaucuucuguggguuucuaaagcugccagccgagauagccaaggccaaag

SEQ ID NO: 161673 - RNA, 64 nt, hsa
cguccccuguccccgcacugggcuuggggaccagagcugccaccugccuguugggccaggagcc

SEQ ID NO: 161674 - RNA, 64 nt, hsa
auaguguacacccaccugccucucuggcuccagaagcugccagagugcacuggggggaauguuc

SEQ ID NO: 161675 - RNA, 64 nt, hsa
ugauacgagcauugcagauugcaguaggggucccagcugccaaguaggacaugacuaggagugu

SEQ ID NO: 161676 - RNA, 64 nt, hsa
auacucauugauuaaaauggaauaaagaaagagcagcugccacuuuuaaacaacauaaaggaau

SEQ ID NO: 161677 - RNA, 64 nt, hsa
cugauuaaaagauagucaagaaauucugcaauauagcugccaaaauagacagcuacauuuuuau

SEQ ID NO: 161678 - RNA, 64 nt, hsa
ccuggcaacuggacugaggggagugugcccaggcagcugccaagcacucccucccuggcuucag

SEQ ID NO: 161679 - RNA, 64 nt, hsa
gacacuuagaccucaaacuuuagcaucucuguggagcugccauccacuguauaauuucgccugg

SEQ ID NO: 161680 - RNA, 64 nt, hsa
uccucccuggaggccagcucugccccaggggcugagcugccaccagagguccugggacccucac

SEQ ID NO: 161681 - RNA, 64 nt, hsa
uuucuguggcugucggccagagggaauguucuggagcugccaaggagggaggagacucggguug

SEQ ID NO: 161682 - RNA, 64 nt, hsa
cugcugcucucucaggaccauccgaucaagcugcagcugccacccucaccuagaaacaugccuu

SEQ ID NO: 161683 - RNA, 64 nt, hsa
gucuuuuggaauguccuggucacagggucaugucagcugccaguucucgucucccguccuggag

SEQ ID NO: 161684 - RNA, 64 nt, hsa
uaggaccccacgauuuaggguaacuguuaucaucagcugccauuucugauagggucuaccacau

SEQ ID NO: 161685 - RNA, 64 nt, hsa
auaguccugugucaucacugcagcgguccucaggagcugccagggccaauugcuacagaguguc

SEQ ID NO: 161686 - RNA, 64 nt, hsa
ccugagggcagacacagcuccagggacccaggccagcugccacacccccgacacuccugcuguc

SEQ ID NO: 161687 - RNA, 64 nt, hsa
ggcuggauguucugggggaggaggcaaucgcuguagcugccaggccagccccaucuggaaggag

SEQ ID NO: 161688 - RNA, 64 nt, hsa
cacauccucucacucacuucuccacccgccaggcagcugccacaggccuaaggcugagugaggu

SEQ ID NO: 161689 - RNA, 64 nt, hsa
uccccugcgcuccugcgagaccagauauaaaacuagcugccaacccagccuguggccaggucac

SEQ ID NO: 161690 - RNA, 64 nt, hsa
acagacuccuuugugcuggaaccugggcuccuccagcugccaggcaggagucgguaggacugug

SEQ ID NO: 161691 - RNA, 64 nt, hsa
aaacgaugccagcccgaggcacugcuacgccagcagcugccacaugggaugguggcucaggcgc

SEQ ID NO: 161692 - RNA, 64 nt, hsa
ucugcccuuuuccaccucccccuuccaucccaccagcugccaguggcucccagaaagccuuauu

SEQ ID NO: 161693 - RNA, 64 nt, hsa
auaagccaagauggcuguaaacacagagcauuugagcugccacucuuggagcacauugauuuuu

SEQ ID NO: 161694 - RNA, 64 nt, hsa
ccuccagagauggccccuccucaccugggacggaagcugccagcucgcuucccccaagcugccu

SEQ ID NO: 161695 - RNA, 64 nt, hsa
cuuucucugugucucagauggcgauuuugcugacagcugccaagaaaaugcuucacucaacagu

SEQ ID NO: 161696 - RNA, 64 nt, hsa
ccugguuuggugugguguuugccauugcagagcaagcugccacgaagaccccugggcaugauuu

SEQ ID NO: 161697 - RNA, 64 nt, hsa
cagcugaagaaggcaugggauggagcccuggcauagcugccaccaugccuaugugcccaagagc

SEQ ID NO: 161698 - RNA, 64 nt, hsa
aucucaaacagcaaagucagcauuugcuguauagagcugccacccaacucuaagcaggagaaac

SEQ ID NO: 161699 - RNA, 64 nt, hsa
gccagaauuugaccucccagagccaguuuccauuagcugccaugcucugcugccucuaauucac

SEQ ID NO: 161700 - RNA, 64 nt, hsa
ggggccuggcccccucagccaucucagggugaggagcugccagucauguccagauggaaugacu

SEQ ID NO: 161701 - RNA, 64 nt, hsa
uggaugggaagaugugcauccguggucaaaagucagcugccagcccugcggaaccagagccuca

SEQ ID NO: 161702 - RNA, 64 nt, hsa
cccuucaguuaugucccauuuuuaugaugccaaaagcugccacugugugguauucgaggauuau

SEQ ID NO: 161703 - RNA, 64 nt, hsa
gcaacuccacccgaccccagcaguggugcaggacagcugccagcacccaccuggcccuccuccu

SEQ ID NO: 161704 - RNA, 64 nt, hsa
gacucaaggugugugaaagauguuauacaccaggagcugccacugcaugucccaaccagacugu

SEQ ID NO: 161705 - RNA, 64 nt, hsa
uuguaucuucaguucauuccacuuuaggaaacagagcugccaauugaaacagaagaagaaaaaa

SEQ ID NO: 161706 - RNA, 64 nt, hsa
cuaaacacccugaaauugugacccccugggggacagcugccagacacagcuggcggcagcacca

SEQ ID NO: 161707 - RNA, 64 nt, hsa
ccuccagaggucaugaagggaccucuguggcuccagcugccaacccuggagcccagaccgaggu

SEQ ID NO: 161708 - RNA, 64 nt, hsa
auaaaaguuuccuuuuuuauucucucaagccaccagcugccagccaccagcagccagcugccag

SEQ ID NO: 161709 - RNA, 64 nt, hsa
cucucaagccaccagcugccagccaccagcagccagcugccagccuagcuuuuuuuuuuuuuuu

SEQ ID NO: 161710 - RNA, 64 nt, hsa; identical to SEQ ID NO: 143960

SEQ ID NO: 161711 - RNA, 64 nt, hsa; identical to SEQ ID NO: 143961

SEQ ID NO: 161712 - RNA, 64 nt, hsa; identical to SEQ ID NO: 143962

SEQ ID NO: 161713 - RNA, 64 nt, hsa; identical to SEQ ID NO: 143963

SEQ ID NO: 161714 - RNA, 64 nt, hsa; identical to SEQ ID NO: 143964

SEQ ID NO: 161715 - RNA, 54 nt, hsa; identical to SEQ ID NO: 143965

SEQ ID NO: 161716 - RNA, 64 nt, hsa; identical to SEQ ID NO: 143966

SEQ ID NO: 161717 - RNA, 64 nt, hsa; identical to SEQ ID NO: 143967

SEQ ID NO: 161718 - RNA, 64 nt, hsa; identical to SEQ ID NO: 143968

SEQ ID NO: 161719 - RNA, 64 nt, hsa; identical to SEQ ID NO: 143969

SEQ ID NO: 161720 - RNA, 64 nt, hsa; identical to SEQ ID NO: 143970

SEQ ID NO: 161721 - RNA, 64 nt, hsa; identical to SEQ ID NO: 143971

SEQ ID NO: 161722 - RNA, 64 nt, hsa; identical to SEQ ID NO: 143972

SEQ ID NO: 161723 - RNA, 64 nt, hsa; identical to SEQ ID NO: 143973

SEQ ID NO: 161724 - RNA, 64 nt, hsa; identical to SEQ ID NO: 143974

SEQ ID NO: 161725 - RNA, 64 nt, hsa; identical to SEQ ID NO: 143975

SEQ ID NO: 161726 - RNA, 64 nt, hsa; identical to SEQ ID NO: 143976

SEQ ID NO: 161727 - RNA, 64 nt, hsa; identical to SEQ ID NO: 143977

SEQ ID NO: 161728 - RNA, 64 nt, hsa; identical to SEQ ID NO: 143978

SEQ ID NO: 161729 - RNA, 64 nt, hsa; identical to SEQ ID NO: 143979

SEQ ID NO: 161730 - RNA, 64 nt, hsa; identical to SEQ ID NO: 143980

SEQ ID NO: 161731 - RNA, 64 nt, hsa; identical to SEQ ID NO: 143981

SEQ ID NO: 161732 - RNA, 64 nt, hsa; identical to SEQ ID NO: 143982

SEQ ID NO: 161733 - RNA, 64 nt, hsa; identical to SEQ ID NO: 143983

SEQ ID NO: 161734 - RNA, 64 nt, hsa; identical to SEQ ID NO: 143984

SEQ ID NO: 161735 - RNA, 64 nt, hsa; identical to SEQ ID NO: 143985

SEQ ID NO: 161736 - RNA, 64 nt, hsa; identical to SEQ ID NO: 143986

SEQ ID NO: 161737 - RNA, 64 nt, hsa; identical to SEQ ID NO: 143987

SEQ ID NO: 161738 - RNA, 64 nt, hsa; identical to SEQ ID NO: 143988

SEQ ID NO: 161739 - RNA, 64 nt, hsa; identical to SEQ ID NO: 143989

SEQ ID NO: 161740 - RNA, 64 nt, hsa; identical to SEQ ID NO: 143990

SEQ ID NO: 161741 - RNA, 64 nt, hsa; identical to SEQ ID NO: 143991

SEQ ID NO: 161742 - RNA, 64 nt, hsa; identical to SEQ ID NO: 143992

SEQ ID NO: 161743 - RNA, 64 nt, hsa; identical to SEQ ID NO: 143993

SEQ ID NO: 161744 - RNA, 64 nt, hsa; identical to SEQ ID NO: 143994

SEQ ID NO: 161745 - RNA, 64 nt, hsa; identical to SEQ ID NO: 143995

SEQ ID NO: 161746 - RNA, 64 nt, hsa; identical to SEQ ID NO: 143996

SEQ ID NO: 161747 - RNA, 64 nt, hsa; identical to SEQ ID NO: 143997

SEQ ID NO: 161748 - RNA, 64 nt, hsa; identical to SEQ ID NO: 143998

SEQ ID NO: 161749 - RNA, 64 nt, hsa; identical to SEQ ID NO: 143999

SEQ ID NO: 161750 - RNA, 64 nt, hsa; identical to SEQ ID NO: 144000

SEQ ID NO: 161751 - RNA, 64 nt, hsa; identical to SEQ ID NO: 144001

SEQ ID NO: 161752 - RNA, 64 nt, hsa; identical to SEQ ID NO: 144002

SEQ ID NO: 161753 - RNA, 64 nt, hsa; identical to SEQ ID NO: 144003

SEQ ID NO: 161754 - RNA, 64 nt, hsa; identical to SEQ ID NO: 144004

SEQ ID NO: 161755 - RNA, 64 nt, hsa; identical to SEQ ID NO: 144005

SEQ ID NO: 161756 - RNA, 64 nt, hsa; identical to SEQ ID NO: 144006

SEQ ID NO: 161757 - RNA, 64 nt, hsa; identical to SEQ ID NO: 144007

SEQ ID NO: 161758 - RNA, 64 nt, hsa
agagaaacuguccuaguuguccagagauaaaaaucauauagaccaauugaagcaugaacgugga

SEQ ID NO: 161759 - RNA, 64 nt, hsa
ccaccagcgaacucucagaaauaaaucacagaugcauauagacacacauacauaaugguacucc

SEQ ID NO: 161760 - RNA, 64 nt, hsa
uucuagcauauagacuauauaaucagauugacagcauauagaauauauuaucagacaagaugag

SEQ ID NO: 161761 - RNA, 64 nt, hsa
ucuugguggcagaaugaaaaucagcaacuucuagcauauagacuauauaaucagauugacagca

SEQ ID NO: 161762 - RNA, 64 nt, hsa
uuuucuuaaagaaaggaugauuuauuuucagcaacauauagaaauauacuauaaauauuaauaa

SEQ ID NO: 161763 - RNA, 64 nt, hsa
uuugugacguguauuuuuugugacuugaagcuaucauauagauccuguauuucugauagaccau

SEQ ID NO: 161764 - RNA, 64 nt, hsa
uggauggaaagacaaacugcacaggcagauguuugccucauaauagucguaaguggaguccugg

SEQ ID NO: 161765 - RNA, 64 nt, hsa
aacccagucacacuguggccaguaaaauacuauugccucauauuguccucugcaagcuucuugc

SEQ ID NO: 161766 - RNA, 64 nt, hsa
ucuagaauuuaauuuucacaucacuguacauaauguaucauacuauagucuugaacacuguuaa

SEQ ID NO: 161767 - RNA, 64 nt, hsa
ugauaucaagucaaaaucaguuugaaaagaagguguaucauauuuuauauugucacuagaaucu

SEQ ID NO: 161768 - RNA, 64 nt, hsa
uuauuuuuuaaaacucaaagagggaaagagccuuguaucauaugugaacauuguaucauaggua

SEQ ID NO: 161769 - RNA, 64 nt, hsa
agagggaaagagccuuguaucauaugugaacauuguaucauagguaauguuguacagacccuuu

SEQ ID NO: 161770 - RNA, 64 nt, hsa
uugccuaauaaacauccuucaagaacucugggcugcuacccagaaaucauuuuacccuuggcuc

SEQ ID NO: 161771 - RNA, 64 nt, hsa
cucuaugccagcucagucccaucagagagcgagcgcuacccacuucuaaauagcaauuucgccg

SEQ ID NO: 161772 - RNA, 64 nt, hsa; identical to SEQ ID NO: 156330

SEQ ID NO: 161773 - RNA, 64 nt, hsa; identical to SEQ ID NO: 156331

SEQ ID NO: 161774 - RNA, 64 nt, hsa; identical to SEQ ID NO: 156332

SEQ ID NO: 161775 - RNA, 64 nt, hsa; identical to SEQ ID NO: 156333

SEQ ID NO: 161776 - RNA, 64 nt, hsa; identical to SEQ ID NO: 156334

SEQ ID NO: 161777 - RNA, 64 nt, hsa; identical to SEQ ID NO: 156335

SEQ ID NO: 161778 - RNA, 64 nt, hsa; identical to SEQ ID NO: 156336

SEQ ID NO: 161779 - RNA, 64 nt, hsa; identical to SEQ ID NO: 156337

SEQ ID NO: 161780 - RNA, 64 nt, hsa; identical to SEQ ID NO: 156338

SEQ ID NO: 161781 - RNA, 64 nt, hsa; identical to SEQ ID NO: 156339

SEQ ID NO: 161782 - RNA, 64 nt, hsa; identical to SEQ ID NO: 156340

SEQ ID NO: 161783 - RNA, 64 nt, hsa; identical to SEQ ID NO: 156341

SEQ ID NO: 161784 - RNA, 64 nt, hsa
gauucaaauaggcaguucucuuauuuggucgacuuuugugaaugugugacauaaacagauguaa

SEQ ID NO: 161785 - RNA, 64 nt, hsa
ggaaaauguauucuguauguaguguagauaauacuuugugaauggacaacaguuacauaguguc

SEQ ID NO: 161786 - RNA, 64 nt, hsa
caaauaucucaguuacauuuaccauacaguuuccuuugugaaagaacaguaggggaggaaauaa

SEQ ID NO: 161787 - RNA, 64 nt, hsa
uuaagauaauaucaagagucuagaugugaggcuuuuugugaaagagaagccuaaauucagcauc

SEQ ID NO: 161788 - RNA, 64 nt, hsa
cuaccccauguuuuauaaggaauuuuguacagucuuugugaaauaaaauaacgugcuucauuug

SEQ ID NO: 161789 - RNA, 64 nt, hsa
gacacauacagaccucaagccugaaaauauucuguuugugaauucagacuaugagcucaccuac

SEQ ID NO: 161790 - RNA, 64 nt, hsa
uuuccugacaacgaaagugaagaguaucacagaauuugugaauuacuuucugacuacaaagaaa

SEQ ID NO: 161791 - RNA, 64 nt, hsa
ucuagugacgaacaaaaugauacucagaagcaauuuugugaagaacagaacacuggaauauuac

SEQ ID NO: 161792 - RNA, 64 nt, hsa
cauaauccuacuaauuucuuugcagcuuauuaauuuugugaaauuuguauauaugaagaauuug

SEQ ID NO: 161793 - RNA, 64 nt, hsa
ccccauuuuuugaaauagagaauauuuuauuauuuuugugaaaauagaguuuugguaaucacuu

SEQ ID NO: 161794 - RNA, 64 nt, hsa
ucaguucuucagagagcuuccaccagcugcugaguuugugaagacaguggaguucacaagacua

SEQ ID NO: 161795 - RNA, 64 nt, hsa
agcagaagucaacuuuugggccgagacccugaucuuugugaaauaccucugcaagcaccucuuc

SEQ ID NO: 161796 - RNA, 64 nt, hsa
aagaacuuguggaugacuuuugucccauguggcuuuugugaaguauggcaaagguuuuucauga

SEQ ID NO: 161797 - RNA, 64 nt, hsa
aggagugcacagcuccugcugauguauuuuucuuuuugugaaggcaaagggacaauuaucacug

SEQ ID NO: 161798 - RNA, 64 nt, hsa
gagugacauguucgaaaccuguccauaaaguaauuuugugaaagaaggagcaagagaacauucc

SEQ ID NO: 161799 - RNA, 64 nt, hsa
uaugcuaagcaguagucgucaaguugcagaucuuuuugugaaauucaaccugugucuuauaggu

SEQ ID NO: 161800 - RNA, 64 nt, hsa
uuugagaucgccaccagaaccauuugugaacugauuugugaaggaaaagucagucuuacuccaa

SEQ ID NO: 161801 - RNA, 64 nt, hsa
cauguuugucucuuugagaucgccaccagaaccauuugugaacugauuugugaaggaaaaguca

SEQ ID NO: 161802 - RNA, 64 nt, hsa
auauuuauacaugagaaacagccuucaacaaguauuugugaagugacugagaaucuagcacuuc

SEQ ID NO: 161803 - RNA, 64 nt, hsa
uaguucuuaucaaccuugaaugacuacagauuauuuugugaaggaggaugaaguaauguguguu

SEQ ID NO: 161804 - RNA, 64 nt, hsa
uguacuugaguauaaauguacaccaguuuuuguauuugugaacucaucugugggaggaguaaag

SEQ ID NO: 161805 - RNA, 64 nt, hsa
ucuuuaguugacaguucacaaacuuguguaaagguuugugaaaugcaucuucuuacugcaucag

SEQ ID NO: 161806 - RNA, 64 nt, hsa
gauccauaugcauaagauuguacaaggcuauucauuugugaaacaaauauacauaucgaagaca

SEQ ID NO: 161807 - RNA, 64 nt, hsa
uugaaaguuuaauucuuuaaauuugucucuuaguuuugugaauuuugaauaauaauguuuaaau

SEQ ID NO: 161808 - RNA, 64 nt, hsa
accauuucuccauggugucuuuauacuuuacugguuugugaauuuuauacaauugaaagucuuu

SEQ ID NO: 161809 - RNA, 64 nt, hsa
aauauuuaauauaaauauaccauauaauauauuguuugugaauuauugagaaauguaacauuca

SEQ ID NO: 161810 - RNA, 64 nt, hsa
auuuguaaagaaaacaacagaaaucuuuaugcaauuugugaauuuuguauauuagggaggaaaa

SEQ ID NO: 161811 - RNA, 64 nt, hsa
uagaaaguauuuggcucuaggaaacauuuacuuguuugugaaaacaauaccccaagguaauagg

SEQ ID NO: 161812 - RNA, 64 nt, hsa
uccagcuccccuaacagacagcugcugcuucuauuuugugaagggacuauauuuuuugagaaag

SEQ ID NO: 161813 - RNA, 64 nt, hsa
uuuuuugagaaaggaaaaucucaguuagauauauuuugugaacccuugauuagacauauuaaaa

SEQ ID NO: 161814 - RNA, 64 nt, hsa
cagucuuaaguugauauuuauagaaaugaauaccuuugugaaccuagacuuagaacaaauccug

SEQ ID NO: 161815 - RNA, 64 nt, hsa
uacuuccuuuacauuauucuccuauuuuagacauuuugugaaagagaacaaauuguccaguggc

SEQ ID NO: 161816 - RNA, 64 nt, hsa
gaaagaguccugggauuuguacuucaugaagacuuuugugaaagaauagguguccuuaugaaca

SEQ ID NO: 161817 - RNA, 64 nt, hsa
cucugaacauauuuuauuuuuuaaaaaaacuauguuugugaauuuugcguauacuggcaagcuu

SEQ ID NO: 161818 - RNA, 64 nt, hsa
aauauauuccaaaacauuuuugugaauaucuaaguuugugaaacuacuagggcaugauacagua

SEQ ID NO: 161819 - RNA, 64 nt, hsa
cuucacauucccaaggaauauauuccaaaacauuuuugugaauaucuaaguuugugaaacuacu

SEQ ID NO: 161820 - RNA, 64 nt, hsa
cuacccccuuuuuuaacaaaaagaaacuaguacauuugugaaaauuguguuguguuguccauug

SEQ ID NO: 161821 - RNA, 64 nt, hsa
uugucugccauuguugauaaacuguucuaauugguuugugaaagaacucugagaauuagcuaaa

SEQ ID NO: 161822 - RNA, 64 nt, hsa
uuggaaauguaaaagaaaaaaguaaagcuccauuuuugugaauugcauuguuucuaaaggaagu

SEQ ID NO: 161823 - RNA, 64 nt, hsa
auaaaccaguaucguuacuggcaccugaaauuaauuugugaauuugcaacaguaaucagaguua

SEQ ID NO: 161824 - RNA, 64 nt, hsa
guauucuccauccucccaggaaccgaacauaucauuugugaagaauuauucagugaauuugucc

SEQ ID NO: 161825 - RNA, 64 nt, hsa
guuugcuuucuguuguuuuguuuauugguugguuuuugugaaguuuauuuuuuuuugguauuug

SEQ ID NO: 161826 - RNA, 64 nt, hsa
ggagaccacagccuuaguaugacauccugcacaauuugugaagcauuuauucuacugaaggcac

SEQ ID NO: 161827 - RNA, 64 nt, hsa
ggaccaugcaacauuugugaacuguuugcaacacuuugugaacuauugcauccuugauuucuug

SEQ ID NO: 161828 - RNA, 64 nt, hsa
gacaggugaacucugggaauuggaccaugcaacauuugugaacuguuugcaacacuuugugaac

SEQ ID NO: 161829 - RNA, 64 nt, hsa
cagucucuguuucauggcaacacuggauaauggcuuugugaaauuuaaaaaauuuuuguagcga

SEQ ID NO: 161830 - RNA, 64 nt, hsa
aacaaccauugcauguuugcuuuugauguaucccuuugugaaauuagcacuuuuggggccaaug

SEQ ID NO: 161831 - RNA, 64 nt, hsa
uuguuuuauaccauauaagacucuguacaguauguuugugaaagauugaacuagaauaaugaaa

SEQ ID NO: 161832 - RNA, 64 nt, hsa
aaaagaaacaaaaaggaacuucuuauaguugucuuuugugaacuuuaagguuuugaaagaaucu

SEQ ID NO: 161833 - RNA, 64 nt, hsa
ugaaaauaauguauuuauaaguauuuucuuaagguuugugaagaguauuugcauugugucuuca

SEQ ID NO: 161834 - RNA, 64 nt, hsa
uuuuuauugguaguaacugaacaguguuuugcaauuugugaaacaguguauuguguuuuguaaa

SEQ ID NO: 161835 - RNA, 56 nt, hsa
uggacacguuugauaguuaacauuucuuugugaaagguaauggacucacaagggga

SEQ ID NO: 161836 - RNA, 64 nt, hsa
acaugcugagaauggaaagucuaccggcccuuucuuugugaacgucacauuggccgagccgugu

SEQ ID NO: 161837 - RNA, 64 nt, hsa
cucccuuuuuucaaaauugaaguuggguuggcucuuugugaaccucucauccccacagcagaau

SEQ ID NO: 161838 - RNA, 64 nt, hsa
ggggguggauguagcugcagaaagcaugcacaacuuugugaaagaggcccugccuugugcaugu

SEQ ID NO: 161839 - RNA, 64 nt, hsa
caauucaggaugagauguuuagguaaguauuuuauuugugaaaugauugcuauacauacucauu

SEQ ID NO: 161840 - RNA, 64 nt, hsa
guuuuuuuccuuuugguccuuucuacuuaucuauuuugugaauucuaaaguuacauuuguaaga

SEQ ID NO: 161841 - RNA, 64 nt, hsa
gcuagaaaucuguggguuauacauagggcagcucuuugugaaagugguuuauuccacuggagaa

SEQ ID NO: 161842 - RNA, 64 nt, hsa
guuacagauuuuagccagucuuugcuuuuauacuuuugugaaauuuaauuucucucuauagcac

SEQ ID NO: 161843 - RNA, 64 nt, hsa
ccuaagacgauuggcgaaaacuuuucugaaaaccuuugugaauuacuucguuucuccaggauuc

SEQ ID NO: 161844 - RNA, 51 nt, hsa
ggcugcggaaaaugagaugaguuugugaaaaaaugcaauaagcccgggggu

SEQ ID NO: 161845 - RNA, 64 nt, hsa
uauugccaccaagacuuuccaggcucuucgcauauuugugaacaaugagcucaaugaacucuac

SEQ ID NO: 161846 - RNA, 64 nt, hsa
cauuguauaaauuucucuuugcauauaauacauauuugugaaugagacauauucccaaaaaauu

SEQ ID NO: 161847 - RNA, 64 nt, hsa
uucauguacuucccuaggacuagaugcauaccguuuugugaaaaccagccauaggaaaacaugu

SEQ ID NO: 161848 - RNA, 64 nt, hsa
ggggguaaacaggccagaagagugugccaaguuguuugugaaucauuccaagcaccucagauga

SEQ ID NO: 161849 - RNA, 64 nt, hsa
uaagagugauaaaagugggaagacauaaagagccuuugugaauuaaaguggaagagaauaacac

SEQ ID NO: 161850 - RNA, 64 nt, hsa
acuaugucuguguuucuuaggaauguugaagcuuuuugugaaaacuguacuguauacauauaua

SEQ ID NO: 161851 - RNA, 64 nt, hsa
gauaacaucauacauaagucauuuaguaacagccuuugugaaaugaacuuguuuacuauuggag

SEQ ID NO: 161852 - RNA, 64 nt, hsa
auuuuugacuuuauauuuccugagcucuccugacuuugugaaaaaggguggaugaaaaugcauu

SEQ ID NO: 161853 - RNA, 64 nt, hsa
gagcaaaaagugacuucuuuuugugaauguaaaauuugugaaacuugaguuuuuccaaugugcu

SEQ ID NO: 161854 - RNA, 64 nt, hsa
uccgugugugacuuugagcaaaaagugacuucuuuuugugaauguaaaauuugugaaacuugag

SEQ ID NO: 161855 - RNA, 64 nt, hsa
uuuuucaaaucuguucugagccuauaguguuugcuuugugaacauguguauuguauauauucug

SEQ ID NO: 161856 - RNA, 64 nt, hsa
uuauagcauugugauucuuucugggcacuggcauuuugugaaacucucaagggaaggugaugca

SEQ ID NO: 161857 - RNA, 64 nt, hsa
cuagguagccuauuuuaauauuuaaauauauauauuugugaaagaacuuuuagaacagaccuuu

SEQ ID NO: 161858 - RNA, 64 nt, hsa
auuucaaaaucaucucaugacccuugugugccucuuugugaagcccuauuuagcaauuucaggg

SEQ ID NO: 161859 - RNA, 64 nt, hsa
cuuuaauagaaagcugcuauuauguauauugucauuugugaaggaaguuggagagucacagcuu

SEQ ID NO: 161860 - RNA, 64 nt, hsa
auaccaauuuaaaaauauaaauuuuugccacuguuuugugaacggaggauuuguacgcuaaauu

SEQ ID NO: 161861 - RNA, 64 nt, hsa
cuagugauugccuacuuucacauuuauuuaaauuuuugugaaagaaaauacaguuuuaaaggcu

SEQ ID NO: 161862 - RNA, 64 nt, hsa
uuuuugcauguacaguuuuuacaagaauuacaguuuugugaaguugugucuaaauuaaagcauu

SEQ ID NO: 161863 - RNA, 64 nt, hsa
auauauacaacuaugugacuuagugcacaacacauuugugaaauaaccuacuccuauauacuga

SEQ ID NO: 161864 - RNA, 64 nt, hsa
acguugccacacaaggugcacaggcuggaagucuuuugugaaauucccaguuaaauauauacaa

SEQ ID NO: 161865 - RNA, 64 nt, hsa
cugaaggaaacucuguaucauuuugucuuuugaauuugugaauauacuuguuaacacaucuaaa

SEQ ID NO: 161866 - RNA, 64 nt, hsa
aaucuuuccuuauuucaacaagaucuuuaaaauuuuugugaauacuuaaaaguccuuucuuuuu

SEQ ID NO: 161867 - RNA, 64 nt, hsa
uaauuaugcagaauaagcucuuuauuaggaauuuuuugugaagcuauuaaauacuugaguuaag

SEQ ID NO: 161868 - RNA, 64 nt, hsa
uaaugaguauauaucaguuauuguacaugauugcuuugugaaaugugcaaaugauaucaccuau

SEQ ID NO: 161869 - RNA, 64 nt, hsa
uacacuggaagcguggggggaacacaugacaugauuugugaauaucaucaucuuugccagacaa

SEQ ID NO: 161870 - RNA, 64 nt, hsa
agucacuucaccucccugagccccaauucccaaguuugugaaauggcaacaauaccuauguguc

SEQ ID NO: 161871 - RNA, 64 nt, hsa
gauuuguuuucuaaaguugauacuguggguuauuuuugugaacagccugauguuugggaccuuu

SEQ ID NO: 161872 - RNA, 64 nt, hsa
guggggcaguucaacacaaauguaacaauguauuuuugugaaugagaguuggcaugucaaaugc

SEQ ID NO: 161873 - RNA, 64 nt, hsa
gacauuaucauggcaugacuuaagggaacauugguuugugaaggaaaaacagauuaucuaaagc

SEQ ID NO: 161874 - RNA, 64 nt, hsa
uucugcuuuuuagaagccugcacuuaagcuuagauuugugaagggagaguagaaggggagaagu

SEQ ID NO: 161875 - RNA, 64 nt, hsa
ucuugagguggggaaggaggugaugaaacauuaguuugugaaauccaaggcccuggcuugcuuu

SEQ ID NO: 161876 - RNA, 64 nt, hsa
uuuuuuaaaaggagcaguguggauuuucgcacccuuugugaacuaaguucaaugcgcucuaucc

SEQ ID NO: 161877 - RNA, 64 nt, hsa
cgaauucaccaaccagggguuucuuucccuacccuuugugaaaaccaaucaauuacuagaugag

SEQ ID NO: 161878 - RNA, 64 nt, hsa
ugccuccacccaggagacugaugcacaagaucuguuugugaaagccugauuuaaaaagaaaaaa

SEQ ID NO: 161879 - RNA, 64 nt, hsa
aucuauaccuuacugcaauuugguaaagcagacuuuugugaacaaaaauuauaacauuuacuuu

SEQ ID NO: 161880 - RNA, 64 nt, hsa
ggacugucuaugaacuugcaaacaggcugauaccuuugugaaguugcccaccaaaacacagaag

SEQ ID NO: 161881 - RNA, 64 nt, hsa
gaaugacaucuuaaagccaccauugcguuccucauuugugaacugucuucucauauuuuaaguc

SEQ ID NO: 161882 - RNA, 64 nt, hsa
auguuuucuuggauuguugucuuuaaaaaggauuuuugugaagcaauugauuuaucaaagcaaa

SEQ ID NO: 161883 - RNA, 64 nt, hsa
uaaaucuguaauagauuuuagaauugaaaaauucuuugugaaggucuucuaaaaguguuccaau

SEQ ID NO: 161884 - RNA, 64 nt, hsa
aaacauuagguuaguuuguaaugaaagcaaaaaauuugugaauacuggaaguaacguggaaauc

SEQ ID NO: 161885 - RNA, 64 nt, hsa
caacuucaacugaauucugcagaaauaaugguuauuugugaacuugucugaugaucucuuccca

SEQ ID NO: 161886 - RNA, 64 nt, hsa
uuccauuucuggacaugacgucugugguuuaagcuuugugaaagaaugugcuuugauucgaagg

SEQ ID NO: 161887 - RNA, 64 nt, hsa
uuagauaucuagacaauuucuucuaauaaagucauuugugaaaggguacuacagcuuauugaca

SEQ ID NO: 161888 - RNA, 64 nt, hsa
uauaaguaaaauaucaauuauaguaauaaaauguuuugugaaaaaaaugcuguugcuguauugu

SEQ ID NO: 161889 - RNA, 64 nt, hsa
ugaauaugucaagauuacuauuuuguuauugcccuuugugaauuuccuugucuauuuugcucgc

SEQ ID NO: 161890 - RNA, 64 nt, hsa
caaacucucuagugcaggaaaaggcugcagcuaauuugugaaaguggcaagcucuucauugcac

SEQ ID NO: 161891 - RNA, 64 nt, hsa
uucuguaauucuucuccuuugucaaaugguauuuuuugugaaugguugcaaaguguugucuuau

SEQ ID NO: 161892 - RNA, 50 nt, hsa
cuuacuguuccucuccuugauuugugaaguugugccuaauuauguaaaaa

SEQ ID NO: 161893 - RNA, 64 nt, hsa
cuccucccaaccccugauuggggaaaagguugaauuugugaaacaaucugcuccaaccuucuau

SEQ ID NO: 161894 - RNA, 64 nt, hsa
guugauuuuaaagugaauuuacagugaugagaaauuugugaaaaauauauuguauuucuuuuga

SEQ ID NO: 161895 - RNA, 64 nt, hsa
auucuccuagguagagccuccaucuucaguuguguuugugaagguauuuuuugcuuuuuaaaua

SEQ ID NO: 161896 - RNA, 64 nt, hsa
guugaggaauagguuuuuacucaaaaucuggccauuugugaauccuguaaaccuugugaucuuc

SEQ ID NO: 161897 - RNA, 64 nt, hsa
ccaauguuaauaugauuaauuuaugcuauuuaauuuugugaaacuuaaucaucuuuuaaaaugu

SEQ ID NO: 161898 - RNA, 64 nt, hsa
ccuuuuuugugcgggagagcagguguugcucuucaguauguagccuaaaaaaaucuuaauuauu

SEQ ID NO: 161899 - RNA, 64 nt, hsa
agcugaugcuugaucuugcacaauuuuuaugucuaguauguaugcuugagugaaugugcgagua

SEQ ID NO: 161900 - RNA, 64 nt, hsa
uuuuaucaaaaugucaaaauaacauacuuggagaaguauguaauuuugucuuuggaaaauuaca

SEQ ID NO: 161901 - RNA, 64 nt, hsa
uagaguaugcuacagucacuuaagcauaagcuacaguauguaaacuaaaagggggaauauaugc

SEQ ID NO: 161902 - RNA, 64 nt, hsa
guuguauaaaaguacagcacauucaguuauguacaguauguaauacugauaaugacaauaaaug

SEQ ID NO: 161903 - RNA, 64 nt, hsa
ggucauauccuuugucaggaaauauaaacuugaaaguauguagucagcucuuguaauacucaua

SEQ ID NO: 161904 - RNA, 64 nt, hsa
aaugcagauuuggugaauauuuaauauauauuuuaguauguauuucacuuuaugacugacaauu

SEQ ID NO: 161905 - RNA, 64 nt, hsa
auguugugguugcaccccucacaaauggcagaacaguauguaaagcugguaacaccucgguuuc

SEQ ID NO: 161906 - RNA, 64 nt, hsa
ucuugcagauaugaaguauucuuggaaugcaauaaguauguauugaacuguacuguaaaguagc

SEQ ID NO: 161907 - RNA, 64 nt, hsa
ucuguuggagugggaugcuuuuagacauauauuaaguauguacauguuuaauauguauauuuaa

SEQ ID NO: 161908 - RNA, 64 nt, hsa
agagcauaauacacuguuuuucucaacaaggagcaguauguacacagucauaaugaugugacug

SEQ ID NO: 161909 - RNA, 64 nt, hsa
ugaaugccaaacacuuaaagcaauucgauguuuaaguauguaaguucuuuuuuuuuuagacagc

SEQ ID NO: 161910 - RNA, 64 nt, hsa
ucuaguuuaaguuguucccccucccucugaaaaaaguauguauuuuuacauuagaaaagguuuu

SEQ ID NO: 161911 - RNA, 64 nt, hsa
uuuacucaaucuccccuugcacuaaaguauguaaaguauguaaacaggagacaggaagguggug

SEQ ID NO: 161912 - RNA, 64 nt, hsa
cagguuuaguuuacucaaucuccccuugcacuaaaguauguaaaguauguaaacaggagacagg

SEQ ID NO: 161913 - RNA, 64 nt, hsa
auccauuguagaauucauguaaauagaauacuguaguauguacuuugccuucuuccucucugca

SEQ ID NO: 161914 - RNA, 64 nt, hsa
ggcaccaggugugaucuaccacaccugucuaaaaaguauguauuuuuaaauuuuuuuguagaga

SEQ ID NO: 161915 - RNA, 64 nt, hsa
uucacagaugcauuuuugaaauguaguauguaaaaguauguaacgugcuguuuauuaacaaaag

SEQ ID NO: 161916 - RNA, 64 nt, hsa
uaucauauuauucacagaugcauuuuugaaauguaguauguaaaaguauguaacgugcuguuua

SEQ ID NO: 161917 - RNA, 64 nt, hsa
aaaaaaauaauuaaauccucauggccucuaaauuaguauguagaacacugaaaaguucuuaaca

SEQ ID NO: 161918 - RNA, 64 nt, hsa
auaaaaguucuaagaaaacauuuuugcuauuuuaaguauguaagggaagagaggaguguuuuua

SEQ ID NO: 161919 - RNA, 64 nt, hsa
uacugauuuguuuccaugcugauuguguggaaccaguauguagcaaauggaaagccuagaaaua

SEQ ID NO: 161920 - RNA, 64 nt, hsa
uuucuagcuaugguauuacuauaucacacuugugaguauguauucaaauacuaaguaucuuaua

SEQ ID NO: 161921 - RNA, 64 nt, hsa
ggcaaaacacuauguauagucugagccagaucaaaguauguauguuuuuaauaugcauagaaca

SEQ ID NO: 161922 - RNA, 64 nt, hsa
cuuuuuucauuuuguucuguucgaauuuuuuauaaguauguauuacuuuuguaaucagaauuuu

SEQ ID NO: 161923 - RNA, 64 nt, hsa
aaaaauuaaauaaugacugcccuguuucuguuuuaguauguaaauccucaguucuucaccuuug

SEQ ID NO: 161924 - RNA, 64 nt, hsa; identical to SEQ ID NO: 161919

SEQ ID NO: 161925 - RNA, 64 nt, hsa; identical to SEQ ID NO: 161920

SEQ ID NO: 161926 - RNA, 63 nt, hsa
augauguaccgggagccagcacgaugguccuacacauuccagacauuuuccuuuuugagccgc

SEQ ID NO: 161927 - RNA, 63 nt, hsa
cuucuuauaggcuccacuuugaggcucugaugaacauuccagugcugguguuggaugucaaug

SEQ ID NO: 161928 - RNA, 63 nt, hsa
aagacagaggauuguccuuaagucccugcuaaaacauuccauuguuaaaauuugcacuuugaa

SEQ ID NO: 161929 - RNA, 63 nt, hsa
aguuuuguacaaugaaaauuacuaauuuguuugacauuccauguuaaacuacggucauguuca

SEQ ID NO: 161930 - RNA, 63 nt, hsa
ucaaggucaaagugcauggccagcuccauugagacauuccauuucaaagcaccgugcugacag

SEQ ID NO: 161931 - RNA, 63 nt, hsa
cuuugacugucuuauuuauuauaaccuuucagcacauuccaagguuuuaguuacucaggaagg

SEQ ID NO: 161932 - RNA, 63 nt, hsa
aaagcaccuuuaaaaaaaauacauuuuaaaaaaacauuccaagccaauuggaagacaucauug

SEQ ID NO: 161933 - RNA, 63 nt, hsa
gcuaccuagaaaucuuuuccauuccucuuucauacauuccaacccacuggaagucuuuagagg

SEQ ID NO: 161934 - RNA, 63 nt, hsa
aguugccaguggcacauuacaccaguacagagcacauuccaaaggagacauuggaccaguuaa

SEQ ID NO: 161935 - RNA, 63 nt, hsa
ugucauucacaucucacaaaaucuugacaucuuacauuccaauacauuaucaagcaagcacaa

SEQ ID NO: 161936 - RNA, 63 nt, hsa
ccacugaaucaaguguauuucaggcuuauuucaacauuccaaugcccugguuuuccugcuuga

SEQ ID NO: 161937 - RNA, 63 nt, hsa
gggcccccacuuuuuaccaaacuaguaaaccugacauuccaggcccaugaggggaaagaggau

SEQ ID NO: 161938 - RNA, 63 nt, hsa
uaaguccagagaguaaacuugaauggaauaacgacauuccagaaguuaaucauuugaauucug

SEQ ID NO: 161939 - RNA, 63 nt, hsa
uuuguaaacuaauaaagguaaucacagccaccaacauuccaagcuacccuggguaccuuugug

SEQ ID NO: 161940 - RNA, 63 nt, hsa
uugaaccuagccgacgguuauggaaacccauugacauuccaaaacaauauauacacauaacua

SEQ ID NO: 161941 - RNA, 63 nt, hsa
caaaagucuagaagauggguaucaaaacagaagacauuccaggagcuagcaauuuuaagaggu

SEQ ID NO: 161942 - RNA, 63 nt, hsa
auuuaauuugugauaccuuuguauguaugagacacauuccaaagagcucuaacuaugauaggu

SEQ ID NO: 161943 - RNA, 63 nt, hsa
uacccaucuucagugucuuacuuguacuguaucacauuccauacccucauuuaauucuuaaua

SEQ ID NO: 161944 - RNA, 63 nt, hsa
uuccauuucagauuugucaaccagcgauaggccacauuccaguaagaacucaauuugucuccc

SEQ ID NO: 161945 - RNA, 63 nt, hsa
ggagggcggaaagggaggcacugccauuuggagacauuccauuucagauuugucaaccagcga

SEQ ID NO: 161946 - RNA, 63 nt, hsa
ucugaacccgcagcgcccccaucugucuucagcacauuccacggcaucgcauccguccugggc

SEQ ID NO: 161947 - RNA, 63 nt, hsa
cacauccuccugcccagcuccucacauacccacacauuccagggcuggggugagccugacugc

SEQ ID NO: 161948 - RNA, 63 nt, hsa
gguaaauuuuuagagacccagaucucggaggcuacauuccauuuuuuggucuuuuugucuuuu

SEQ ID NO: 161949 - RNA, 63 nt, hsa
cauuccacguguguauauauuccacauauguauacauuccauguauguaugcauauauguauu

SEQ ID NO: 161950 - RNA, 63 nt, hsa
cauuccacguguguauauaguccccauauguauacauuccacguguguauauauuccacauau

SEQ ID NO: 161951 - RNA, 63 nt, hsa
uguauuccacauguauauauuccacauauguauacauuccacguguguauauaguccccauau

SEQ ID NO: 161952 - RNA, 64 nt, hsa
cuccuuggcucuggagcuaugaaaggccccacuuucaagucacccuugccacugaggaccgagg

SEQ ID NO: 161953 - RNA, 64 nt, hsa
auugcugaugaggccucuucccaauuuaaacaacucaagucagaaaucaguucacucccuggaa

SEQ ID NO: 161954 - RNA, 64 nt, hsa
gguguuuagauuuaugguuguuaaaaaugucaucucaagucaagucacuggucuguuugcauuu

SEQ ID NO: 161955 - RNA, 64 nt, hsa
uuagauuuaugguuguuaaaaaugucaucucaagucaagucacuggucuguuugcauuugauac

SEQ ID NO: 161956 - RNA, 64 nt, hsa
ccuuuuuuccuugacauuaauuuuagagaagucaucaagucaugugauuuguuuagcacauagg

SEQ ID NO: 161957 - RNA, 64 nt, hsa
ucuucuagaaguuguacagaaggacuaaagcuuaucaagucaacaaagaacuuaccuuggagga

SEQ ID NO: 161958 - RNA, 64 nt, hsa
aaaaacacaguaacaggaugaauauuaucugauaucaagucaaaaucaguuugaaaagaaggug

SEQ ID NO: 161959 - RNA, 64 nt, hsa
aacaacuuugaaggcaacagaagacacuguuuauucaagucaguucuuugucagguuccugcug

SEQ ID NO: 161960 - RNA, 64 nt, hsa
ccuuuuuagugaugcagauuugucuguuuguuuuucaagucauaucagaucguuggcaacucgu

SEQ ID NO: 161961 - RNA, 64 nt, hsa
auuuuccaauaggauuuaaauagaaaugcuauucucaagucaucuuucuugcuggguuuuaaug

SEQ ID NO: 161962 - RNA, 64 nt, hsa; identical to SEQ ID NO: 57312

SEQ ID NO: 161963 - RNA, 64 nt, hsa; identical to SEQ ID NO: 57313

SEQ ID NO: 161964 - RNA, 64 nt, hsa; identical to SEQ ID NO: 57330

SEQ ID NO: 161965 - RNA, 64 nt, hsa; identical to SEQ ID NO: 57331

SEQ ID NO: 161966 - RNA, 64 nt, hsa; identical to SEQ ID NO: 57340

SEQ ID NO: 161967 - RNA, 64 nt, hsa; identical to SEQ ID NO: 57341

SEQ ID NO: 161968 - RNA, 64 nt, hsa; identical to SEQ ID NO: 57362

SEQ ID NO: 161969 - RNA, 64 nt, hsa; identical to SEQ ID NO: 57363

SEQ ID NO: 161970 - RNA, 64 nt, hsa; identical to SEQ ID NO: 57401

SEQ ID NO: 161971 - RNA, 64 nt, hsa; identical to SEQ ID NO: 57402

SEQ ID NO: 161972 - RNA, 64 nt, hsa; identical to SEQ ID NO: 57403

SEQ ID NO: 161973 - RNA, 64 nt, hsa; identical to SEQ ID NO: 57404

SEQ ID NO: 161974 - RNA, 64 nt, hsa; identical to SEQ ID NO: 57405

SEQ ID NO: 161975 - RNA, 64 nt, hsa; identical to SEQ ID NO: 57406

SEQ ID NO: 161976 - RNA, 64 nt, hsa
cacagucgcccaucgaauaagcaaauuuguuuuugagaauaaacugguaaccaguuugugauga

SEQ ID NO: 161977 - RNA, 64 nt, hsa
aaaauucaaaguauguuauuaugauugguuacaagagaauaauguuacauguuuaauuguaaua

SEQ ID NO: 161978 - RNA, 64 nt, hsa
ugcaaaucauugaacacuuuaacgaaguauuguagagaauaaaucauaauggauaaaaaucguu

SEQ ID NO: 161979 - RNA, 64 nt, hsa
agauggaggggucguuucgugauuuccugcugcugagaauaaaugucuuguuaaaaacguggca

SEQ ID NO: 161980 - RNA, 64 nt, hsa
uugcugcuauucugggagaauaaacuuguauauggagaauaaacuaauaaacuuguaucgagga

SEQ ID NO: 161981 - RNA, 64 nt, hsa
cauccaauucaaguuuuauuugcugcuauucugggagaauaaacuuguauauggagaauaaacu

SEQ ID NO: 161982 - RNA, 64 nt, hsa
ggaauaaaacaaucucagagcagcuccuaaacaagagaauaaaaaugggccaucccagcacuua

SEQ ID NO: 161983 - RNA, 64 nt, hsa
uuugugcuucucuuuuuaauggagauugaaaagggagaauaaugugaauaucacggcuuauauu

SEQ ID NO: 161984 - RNA, 64 nt, hsa
acacauauaagcaaguggccgugcuaccuuuuuagagaauaaagaaacagacuuuugaguuuau

SEQ ID NO: 161985 - RNA, 64 nt, hsa
uuguuuugcugaagauuucuccauuccuggugcugagaauaaaggcaaccaguagccaaugucc

SEQ ID NO: 161986 - RNA, 64 nt, hsa
cucuuuccuaaaacauggcaaaugaauagauguagagaauaacaauauuacuuacaagaugaaa

SEQ ID NO: 161987 - RNA, 64 nt, hsa
ugugagcuuggcucuagucccaagaagggugagggagaauaaggguaagggaguauucuaggca

SEQ ID NO: 161988 - RNA, 64 nt, hsa
uaacccacaccaucagcagggggaaagccaagcugagaauaaacccagagacaaagaacccucg

SEQ ID NO: 161989 - RNA, 64 nt, hsa
auuuuggccucucauaguuuucucucucuuuaaagagaauaaauagagggccaggugugguggc

SEQ ID NO: 161990 - RNA, 64 nt, hsa
uaaaaaaaaaaaaaaaaaaaaaaaaagagagagagagaauaaauagaaaagaauguggcuggga

SEQ ID NO: 161991 - RNA, 64 nt, hsa
cuuuuuauacaacuuuccaucccccacacaguuggagaauaauuuguagaccauggcaguuaaa

SEQ ID NO: 161992 - RNA, 64 nt, hsa
gugcucugcugcauuuauaggguuuugggcugcugagaauaauugaugcugauuaaggugcaaa

SEQ ID NO: 161993 - RNA, 64 nt, hsa
agguaguaggucucuuucaacugagugcaacauugagaauaaugauuugguucagggcaacuac

SEQ ID NO: 161994 - RNA, 64 nt, hsa
gacacugucaggcaaauuugaaaauauacacauugagaauaauuuuuuauuauuauauccuauu

SEQ ID NO: 161995 - RNA, 64 nt, hsa
aaguuuuccagaucauuccuacaaaguaaacugggagaauaauaagucugaaagaguguggagu

SEQ ID NO: 161996 - RNA, 64 nt, hsa
cacauuaugaucuugacaggugcacuuuacuggggagaauaaaaaggaccauacgguaaagcug

SEQ ID NO: 161997 - RNA, 64 nt, hsa
uaaaaaauauucagaaauguauugggggguggaggagaauaagaggcagagcaagagcuagaga

SEQ ID NO: 161998 - RNA, 64 nt, hsa
uccccccgaaaaauugaaauguaaagaugaggcagagaauaaaguguucuaugaaauucagaac

SEQ ID NO: 161999 - RNA, 64 nt, hsa
ucucuuccuaauugugcuguaauaaccuguguaugagaauaaaaugauuuccaccaucaggauu

SEQ ID NO: 162000 - RNA, 64 nt, hsa
aagauuucaagaaaggacaacucacuguacacuugagaauaauaccuacagagguucauacuga

SEQ ID NO: 162001 - RNA, 64 nt, hsa
cuacacuuaagaagucuuagcugucuaauuuuuagagaauaagauuguucauugcauuucugag

SEQ ID NO: 162002 - RNA, 64 nt, hsa
uuucucuucaaggcgagaugauccuuacuggagcgagaauaaaaaguugucucuagauacagau

SEQ ID NO: 162003 - RNA, 64 nt, hsa
guauuaaccauuauugagaauaaauuuuuuuauugagaauaaauuuucuaaaauuacauguuuc

SEQ ID NO: 162004 - RNA, 64 nt, hsa
augcuguuucugaguuauuguauuaaccauuauugagaauaaauuuuuuuauugagaauaaauu

SEQ ID NO: 162005 - RNA, 64 nt, hsa
gaagucuguuuuucugggucaguuuuuuuugccugagaauaacaaauugcugcugucuaccuuu

SEQ ID NO: 162006 - RNA, 64 nt, hsa
acgcccuccaucucacagucaagauaaaggccucgagaauaaagagccagcccccuuccauuua

SEQ ID NO: 162007 - RNA, 64 nt, hsa
uauguaaaauauuaaagcauuaauauaaauaugugagaauaaaaacaaucuaaauccagaaaau

SEQ ID NO: 162008 - RNA, 64 nt, hsa
gauucguguagguggcaaagcuagaugaggacaugagaauaauucaggagaacaaaaggaaaca

SEQ ID NO: 162009 - RNA, 64 nt, hsa; identical to SEQ ID NO: 21544

SEQ ID NO: 162010 - RNA, 55 nt, hsa; identical to SEQ ID NO: 21545

SEQ ID NO: 162011 - RNA, 64 nt, hsa; identical to SEQ ID NO: 21546

SEQ ID NO: 162012 - RNA, 64 nt, hsa; identical to SEQ ID NO: 21547

SEQ ID NO: 162013 - RNA, 64 nt, hsa; identical to SEQ ID NO: 21548

SEQ ID NO: 162014 - RNA, 64 nt, hsa; identical to SEQ ID NO: 21549

SEQ ID NO: 162015 - RNA, 64 nt, hsa; identical to SEQ ID NO: 21550

SEQ ID NO: 162016 - RNA, 64 nt, hsa; identical to SEQ ID NO: 21551

SEQ ID NO: 162017 - RNA, 64 nt, hsa; identical to SEQ ID NO: 21552

SEQ ID NO: 162018 - RNA, 64 nt, hsa; identical to SEQ ID NO: 21553

SEQ ID NO: 162019 - RNA, 64 nt, hsa; identical to SEQ ID NO: 21554

SEQ ID NO: 162020 - RNA, 64 nt, hsa; identical to SEQ ID NO: 21555

SEQ ID NO: 162021 - RNA, 64 nt, hsa; identical to SEQ ID NO: 21556

SEQ ID NO: 162022 - RNA, 64 nt, hsa; identical to SEQ ID NO: 21557

SEQ ID NO: 162023 - RNA, 64 nt, hsa; identical to SEQ ID NO: 21558

SEQ ID NO: 162024 - RNA, 64 nt, hsa; identical to SEQ ID NO: 21559

SEQ ID NO: 162025 - RNA, 64 nt, hsa
uuacaggaagaccgucucuuucgaaugaaucaagcagcagaauuguacuugauucaaauuauug

SEQ ID NO: 162026 - RNA, 64 nt, hsa
cccauaaaaacauaaauggccuuauugaugcuuucagcagaauuucaucuagaaguggcagcau

SEQ ID NO: 162027 - RNA, 64 nt, hsa
ugcggcuauagcagauggccauggcagucaguggcagcagaaagaggcagcagaaggugaagag

SEQ ID NO: 162028 - RNA, 64 nt, hsa
gauggccauggcagucaguggcagcagaaagaggcagcagaaggugaagagguuauaggugguc

SEQ ID NO: 162029 - RNA, 64 nt, hsa
ggguccuagaauuuuucugauuucuauaauccuucagcagaauauuaagaaauaaagcaugauc

SEQ ID NO: 162030 - RNA, 64 nt, hsa
ucaugcugaaagcacucagacaugucuguccucacagcagaauguagaagucauaugaaugagg

SEQ ID NO: 162031 - RNA, 64 nt, hsa
gaaauccuggugaagagcaaagcagaagaaaugacagcagaagccauggcacagacuuguauag

SEQ ID NO: 162032 - RNA, 64 nt, hsa
cagagaagagaggcucugaaagaaaggaggggagcagcagaagccacggcagggaggaaaggag

SEQ ID NO: 162033 - RNA, 64 nt, hsa
gaggcagaauuaaagcuaaucuagggacucaaaucagcagaaugggggagacaaagcccggucu

SEQ ID NO: 162034 - RNA, 64 nt, hsa
acauuacuuuuuaaagacauuuuacauuauuguccagcagaaaaaggcugucuuggaccaugaa

SEQ ID NO: 162035 - RNA, 64 nt, hsa
guggccuuuccugcugacacuccacgagcugacccagcagaauucucuguguaggaagcaucgg

SEQ ID NO: 162036 - RNA, 64 nt, hsa
ucucuccuucccugacucaugacacucuuccugacagcagaaugacugugugaccuugaacuuc

SEQ ID NO: 162037 - RNA, 64 nt, hsa
agaccgaccaccagcacaguagggcagaucuggacagcagaauguuauaacgcaaguucaugug

SEQ ID NO: 162038 - RNA, 64 nt, hsa
ucagagacacaaaaauacuguaagucucaauuaacagcagaaucucagagaaaagcuguuugca

SEQ ID NO: 162039 - RNA, 64 nt, hsa
cagcauucacucucccugucuuuuccccuucccucagcagaaacguguuuaucagcaagucgug

SEQ ID NO: 162040 - RNA, 64 nt, hsa
caaaaaaaaaaaacagccucuucuuggaaagugacagcagaagguggcauggagcuuguguccu

SEQ ID NO: 162041 - RNA, 64 nt, hsa
aagaauagaaaacuggguaugcguuucauguagccagcagaacugaagugugcugugacaagcc

SEQ ID NO: 162042 - RNA, 64 nt, hsa
uagacaguuagagacucugucacccuagcuauaccagcagaaaaccuguucaggcaggcuuucu

SEQ ID NO: 162043 - RNA, 64 nt, hsa
gccucuuguucaugucagcuuauaugugacacugcagcagaaaggcucugaagguccaaagagu

SEQ ID NO: 162044 - RNA, 64 nt, hsa
aacuagaggcuggcuucacuagagagaguccauucagcagaaagucccaggccucugccuuggu

SEQ ID NO: 162045 - RNA, 64 nt, hsa
auugcagugggggcuaaggcauccauuaugaauacagcagaacauuugcuggcgagaguccugu

SEQ ID NO: 162046 - RNA, 64 nt, hsa
acaacccugugagggcaguauuaaugcccccuuacagcagaagacacugcagcucgaagacagc

SEQ ID NO: 162047 - RNA, 64 nt, hsa
uagaacccaaggacuucuggguacugagaagcagcagcagaaugaggccaaaugcagagaugag

SEQ ID NO: 162048 - RNA, 64 nt, hsa
uggaguuuguucagugguacgguguccaagcaaacagcagaaugcaacuuucuaaacagcccca

SEQ ID NO: 162049 - RNA, 64 nt, hsa
gcagaaugcaacuuucuaaacagccccaagcaaacagcagaauucaacuuuuuaaacaauaaac

SEQ ID NO: 162050 - RNA, 64 nt, hsa
cuggcucugcccagguggggugggguggcccaggcagcagaagguucccugaggucccagagcc

SEQ ID NO: 162051 - RNA, 64 nt, hsa
accaggacucccaggaggccguguccaugugugacagcagaaccacaugccccaagaccccagg

SEQ ID NO: 162052 - RNA, 64 nt, hsa
ccaacagcccaggagcuuuucagaauagcgucugcagcagaaccaguuuccauucagagcgcgu

SEQ ID NO: 162053 - RNA, 64 nt, hsa
ucucucugguuguuucuguuucugaguggaccaacagcagaacccacgaggauuuguuuugagu

SEQ ID NO: 162054 - RNA, 64 nt, hsa
uuguuguggggucugaggcacaugggagugggaccagcagaaaagauacucaggucaguuaacu

SEQ ID NO: 162055 - RNA, 64 nt, hsa
cuggcagugagggacagagcuaguggggugggcucagcagaagugggugcauuucugcaaagga

SEQ ID NO: 162056 - RNA, 64 nt, hsa
aaaauauguauauuauuguaaauagaaaugaccacagcagaaugucacacauggcuguucugga

SEQ ID NO: 162057 - RNA, 64 nt, hsa
ggguugggucugauuguacacuguugcacgcaugcagcagaaaaauauguauauuauuguaaau

SEQ ID NO: 162058 - RNA, 64 nt, hsa
cuuuucucuccucaugauguaccuuauuuucuuagguaaauaauuccaaacucucaucggguca

SEQ ID NO: 162059 - RNA, 64 nt, hsa
uuuaacuggucagucauucacaauaagcuaugaggguaaauaaauauguguuauaacaaguaaa

SEQ ID NO: 162060 - RNA, 64 nt, hsa
aaguacccucuugagguaggaaaugcucugugaugguaaauaaaauuggagcagacagaaaaga

SEQ ID NO: 162061 - RNA, 64 nt, hsa
aguucugcugcuguuauuuauaugcaauucuucugguaaauagcaauagaauaaaacauauuuc

SEQ ID NO: 162062 - RNA, 64 nt, hsa
cuuaauuguuuccaaguugcaucaaagaugaauugguaaauaauggaaaugaguagugauauga

SEQ ID NO: 162063 - RNA, 64 nt, hsa
uacguaccccaguaaaaccauucaaucaauaauugguaaauaauauuuuaaaauuguuuuuaau

SEQ ID NO: 162064 - RNA, 64 nt, hsa
aggaaccuucauuugaagguguguuagaggaugggguaaauacccgauagcugucuuuuuggug

SEQ ID NO: 162065 - RNA, 64 nt, hsa
aggcugcuuguucagcuuuccuuuaacaccuguugguaaauacuaaugggaguagacagaguug

SEQ ID NO: 162066 - RNA, 64 nt, hsa
ggcauuuuuaaaauucuaaaugcacaccuccuaagguaaauagucuuucaaaaauaucaggcgu

SEQ ID NO: 162067 - RNA, 64 nt, hsa
ugagagauucaaaaauaucagaaaaguuggccaugguaaauaauuuucagaauucuuuuuuaaa

SEQ ID NO: 162068 - RNA, 64 nt, hsa
ucagaggcauuauagaauaauguguaauuauauagguaaauauagugauuuauaccaauaauua

SEQ ID NO: 162069 - RNA, 64 nt, hsa
ucacugaacguaucagaauacauggaugaauugggguaaauaagguuuuaauucagaucuagaa

SEQ ID NO: 162070 - RNA, 64 nt, hsa
uggguuauaugccuaaacccuuaugccacauagugguaaauaauuaugaaaaauggucuguuca

SEQ ID NO: 162071 - RNA, 64 nt, hsa
cuggugugacacuuuggagcaaaaaccuugcagugguaaauaaaaaauuuccaacagggucagc

SEQ ID NO: 162072 - RNA, 64 nt, hsa
acugugccucccucugucuguuuucacuugaauggguaaauaaccagcagcuagguuuugaauu

SEQ ID NO: 162073 - RNA, 64 nt, hsa
uuauaaucguuuaugccaugauaaauacaagauugguaaauaaauacauugauugguaaauuau

SEQ ID NO: 162074 - RNA, 64 nt, hsa
uuuuaaccccuagaauuuaauauuuguagaugcagguaaauauauauacuuacguguauaucag

SEQ ID NO: 162075 - RNA, 64 nt, hsa
agaugccaauguugaaugaagucugaaacucuaguaugugcauaguuugacgugcagcaugcac

SEQ ID NO: 162076 - RNA, 64 nt, hsa
acuaguuaaaaugccacaagcaugagugugauuguaugugcacuguguguauauauauaaauau

SEQ ID NO: 162077 - RNA, 64 nt, hsa
uaaccauucuaaauaaagagaacuccaguguugcuaugugcaagauccucucuuggagcuuuuu

SEQ ID NO: 162078 - RNA, 64 nt, hsa
auucguuuuuuaccuguuuguggauguguguuuguaugugcauacguaugagauaggcacaugc

SEQ ID NO: 162079 - RNA, 64 nt, hsa
gcuuuuuagcuguuucagucaccagugaagagccuaugugcauuuuguaguagauaauguaaaa

SEQ ID NO: 162080 - RNA, 64 nt, hsa
ugaguuugagagagaaaauuguuuuuuaaaaauauaugugcauugaaaugauggcaaugcuuau

SEQ ID NO: 162081 - RNA, 64 nt, hsa
gacuguggcugaaagaauugcauuuaaaaauauuuaugugcaccuuguuacuuucuacucugca

SEQ ID NO: 162082 - RNA, 64 nt, hsa
aacaguauuuaucauguguuaaagucaugggucuuaugugcagauuuuuuuaaugccucuaaaa

SEQ ID NO: 162083 - RNA, 64 nt, hsa
uuagucuggcuauaaaugcuuuguuugauauauauaugugcacauauauauauuacuuaaccau

SEQ ID NO: 162084 - RNA, 64 nt, hsa
caagaagcacagagauuuauaguauucuuaauaguaugugcagaaguuacaucauuuaaaaaac

SEQ ID NO: 162085 - RNA, 64 nt, hsa
auuuuccuccauuaucagccagaagugcaacauguaugugcaaaagcuaaaauggcuuaacauc

SEQ ID NO: 162086 - RNA, 64 nt, hsa
uugccuuuccauaucugcuggggguggagacccuuaugugcagcacucaaucccacuggaagcc

SEQ ID NO: 162087 - RNA, 64 nt, hsa
aaaaauauauuuuucuugaguuuaggcuuuuccauaugugcagcuguguuuaccuaacccagcc

SEQ ID NO: 162088 - RNA, 64 nt, hsa
cggagacgguaguuuaguauuugagccacgaguuuaugugcacaaguguuuuggguuguggacu

SEQ ID NO: 162089 - RNA, 64 nt, hsa
auuuuaaauuguugccuaguccugccaagguuauuaugugcaucuguuauuuuuccaauacaug

SEQ ID NO: 162090 - RNA, 64 nt, hsa
ggggaacuggaguuugugagugagcagagcagguuaugugcagacagggaaacgagaacuuugg

SEQ ID NO: 162091 - RNA, 64 nt, hsa
ccuucuuguauccucuuaacuggccauuaucuuguaugugcacauuuuauaaauguacagaaac

SEQ ID NO: 162092 - RNA, 64 nt, hsa
gaaacaguaacaaaaaaaucugcucagaaaaauguaugugcacaaauaaaaaaaauuaauggca

SEQ ID NO: 162093 - RNA, 64 nt, hsa
ccuucuuuuauccucuuaacuggccauuaucuuguaugugcacauuuuauaaauguacagaaac

SEQ ID NO: 162094 - RNA, 64 nt, hsa; identical to SEQ ID NO: 162092

SEQ ID NO: 162095 - RNA, 64 nt, hsa
guccuguggcaccuccauccuccugcccagccggcugugucacacucaucuuuuuaaggucagg

SEQ ID NO: 162096 - RNA, 64 nt, hsa
cacagaguuucccacgggggcugcaguggauucacugugucagggaugagccuggcuugggggu

SEQ ID NO: 162097 - RNA, 64 nt, hsa
uguucuaguuccuacauaauuguaggaaaaugagcugugucaucucugagucccuugguaauuc

SEQ ID NO: 162098 - RNA, 64 nt, hsa
gauucccugugagcacgaugcugaugcaauaguccugugucaucacugcagcgguccucaggag

SEQ ID NO: 162099 - RNA, 64 nt, hsa
uuacaacaagaggguaaaguucauacauggcgaccugugucaaauccguccauugaucugcccu

SEQ ID NO: 162100 - RNA, 64 nt, hsa
aagacagaaauauguacagggcagagaggcugcacugugucauuuaaucacgaagacucuguua

SEQ ID NO: 162101 - RNA, 64 nt, hsa
caacaagaaggaaagcagggaggaagggagaccacugugucaccuggaggagaagucaucucau

SEQ ID NO: 162102 - RNA, 64 nt, hsa
aggggacugucauugaaaaggaaacguuugaugucugugucagcugucuuuguaguuaggaaau

SEQ ID NO: 162103 - RNA, 61 nt, hsa
uacagcaggacuuuguaugaccagaaaugaacugugucaaguauaagguuuuucagcagga

SEQ ID NO: 162104 - RNA, 64 nt, hsa
uauaauacagauuaacauuauauauaauauguaccugugucacuucugacaugagccuguaaac

SEQ ID NO: 162105 - RNA, 64 nt, hsa
cuuccaaguggacggcagaccugggaggggacgccugugucacgagcccuuuuagaugcuuagg

SEQ ID NO: 162106 - RNA, 64 nt, hsa
ugaacugacuuuuuuuuuuuuuuuuuugccaacccugugucacuuagugaggaccugacacaau

SEQ ID NO: 162107 - RNA, 64 nt, hsa
ccaggaggguggcggaggaacuccugccacgccacugugucaugaaggaaagugaaagggaacg

SEQ ID NO: 162108 - RNA, 64 nt, hsa
caagcccuauuaaguaguaauguggggaaacccacugugucagugcaggaagcccuagacaaau

SEQ ID NO: 162109 - RNA, 64 nt, hsa; identical to SEQ ID NO: 162075

SEQ ID NO: 162110 - RNA, 64 nt, hsa; identical to SEQ ID NO: 162076

SEQ ID NO: 162111 - RNA, 64 nt, hsa; identical to SEQ ID NO: 162077

SEQ ID NO: 162112 - RNA, 64 nt, hsa; identical to SEQ ID NO: 162078

SEQ ID NO: 162113 - RNA, 64 nt, hsa; identical to SEQ ID NO: 162079

SEQ ID NO: 162114 - RNA, 64 nt, hsa; identical to SEQ ID NO: 162080

SEQ ID NO: 162115 - RNA, 64 nt, hsa; identical to SEQ ID NO: 162081

SEQ ID NO: 162116 - RNA, 64 nt, hsa; identical to SEQ ID NO: 162082

SEQ ID NO: 162117 - RNA, 64 nt, hsa; identical to SEQ ID NO: 162083

SEQ ID NO: 162118 - RNA, 64 nt, hsa; identical to SEQ ID NO: 162084

SEQ ID NO: 162119 - RNA, 64 nt, hsa; identical to SEQ ID NO: 162085

SEQ ID NO: 162120 - RNA, 64 nt, hsa; identical to SEQ ID NO: 162086

SEQ ID NO: 162121 - RNA, 64 nt, hsa; identical to SEQ ID NO: 162087

SEQ ID NO: 162122 - RNA, 64 nt, hsa; identical to SEQ ID NO: 162088

SEQ ID NO: 162123 - RNA, 64 nt, hsa; identical to SEQ ID NO: 162089

SEQ ID NO: 162124 - RNA, 64 nt, hsa; identical to SEQ ID NO: 162090

SEQ ID NO: 162125 - RNA, 64 nt, hsa; identical to SEQ ID NO: 162091

SEQ ID NO: 162126 - RNA, 64 nt, hsa; identical to SEQ ID NO: 162092

SEQ ID NO: 162127 - RNA, 64 nt, hsa; identical to SEQ ID NO: 162093

SEQ ID NO: 162128 - RNA, 64 nt, hsa; identical to SEQ ID NO: 162092

SEQ ID NO: 162129 - RNA, 64 nt, hsa; identical to SEQ ID NO: 162095

SEQ ID NO: 162130 - RNA, 64 nt, hsa; identical to SEQ ID NO: 162096

SEQ ID NO: 162131 - RNA, 64 nt, hsa; identical to SEQ ID NO: 162097

SEQ ID NO: 162132 - RNA, 64 nt, hsa; identical to SEQ ID NO: 162098

SEQ ID NO: 162133 - RNA, 64 nt, hsa; identical to SEQ ID NO: 162099

SEQ ID NO: 162134 - RNA, 64 nt, hsa; identical to SEQ ID NO: 162100

SEQ ID NO: 162135 - RNA, 64 nt, hsa; identical to SEQ ID NO: 162101

SEQ ID NO: 162136 - RNA, 64 nt, hsa; identical to SEQ ID NO: 162102

SEQ ID NO: 162137 - RNA, 61 nt, hsa; identical to SEQ ID NO: 162103

SEQ ID NO: 162138 - RNA, 64 nt, hsa; identical to SEQ ID NO: 162104

SEQ ID NO: 162139 - RNA, 64 nt, hsa; identical to SEQ ID NO: 162105

SEQ ID NO: 162140 - RNA, 64 nt, hsa; identical to SEQ ID NO: 162106

SEQ ID NO: 162141 - RNA, 64 nt, hsa; identical to SEQ ID NO: 162107

SEQ ID NO: 162142 - RNA, 64 nt, hsa; identical to SEQ ID NO: 162108

SEQ ID NO: 162143 - RNA, 64 nt, hsa
gcccuggucccagucccugccuggggccauguguccccccuauuccugugggcuuuucauacuu

SEQ ID NO: 162144 - RNA, 64 nt, hsa
augggacccugagagagccagggguccccugaggccccccuaggggcuuucugucugccccagg

SEQ ID NO: 162145 - RNA, 64 nt, hsa
agaagugagccccccccuuaaagggaauucgaugccccccuagaauaaucucauccccccaccc

SEQ ID NO: 162146 - RNA, 64 nt, hsa
ugcuccugccaaccacaauucaaugaauccccgaccccccuaccccaugcuguacuugugguuc

SEQ ID NO: 162147 - RNA, 64 nt, hsa; identical to SEQ ID NO: 93643

SEQ ID NO: 162148 - RNA, 64 nt, hsa; identical to SEQ ID NO: 93644

SEQ ID NO: 162149 - RNA, 64 nt, hsa; identical to SEQ ID NO: 93645

SEQ ID NO: 162150 - RNA, 64 nt, hsa; identical to SEQ ID NO: 93646

SEQ ID NO: 162151 - RNA, 64 nt, hsa; identical to SEQ ID NO: 93647

SEQ ID NO: 162152 - RNA, 64 nt, hsa; identical to SEQ ID NO: 93648

SEQ ID NO: 162153 - RNA, 64 nt, hsa; identical to SEQ ID NO: 93649

SEQ ID NO: 162154 - RNA, 64 nt, hsa; identical to SEQ ID NO: 93650

SEQ ID NO: 162155 - RNA, 64 nt, hsa; identical to SEQ ID NO: 93651

SEQ ID NO: 162156 - RNA, 64 nt, hsa; identical to SEQ ID NO: 93652

SEQ ID NO: 162157 - RNA, 64 nt, hsa; identical to SEQ ID NO: 93653

SEQ ID NO: 162158 - RNA, 64 nt, hsa; identical to SEQ ID NO: 93654

SEQ ID NO: 162159 - RNA, 64 nt, hsa; identical to SEQ ID NO: 93655

SEQ ID NO: 162160 - RNA, 64 nt, hsa; identical to SEQ ID NO: 93656

SEQ ID NO: 162161 - RNA, 64 nt, hsa; identical to SEQ ID NO: 93657

SEQ ID NO: 162162 - RNA, 64 nt, hsa; identical to SEQ ID NO: 93658

SEQ ID NO: 162163 - RNA, 64 nt, hsa; identical to SEQ ID NO: 93659

SEQ ID NO: 162164 - RNA, 64 nt, hsa; identical to SEQ ID NO: 93660

SEQ ID NO: 162165 - RNA, 64 nt, hsa; identical to SEQ ID NO: 93661

SEQ ID NO: 162166 - RNA, 64 nt, hsa; identical to SEQ ID NO: 93662

SEQ ID NO: 162167 - RNA, 64 nt, hsa; identical to SEQ ID NO: 93663

SEQ ID NO: 162168 - RNA, 64 nt, hsa; identical to SEQ ID NO: 93664

SEQ ID NO: 162169 - RNA, 64 nt, hsa; identical to SEQ ID NO: 126281

SEQ ID NO: 162170 - RNA, 64 nt, hsa; identical to SEQ ID NO: 126282

SEQ ID NO: 162171 - RNA, 64 nt, hsa; identical to SEQ ID NO: 126283

SEQ ID NO: 162172 - RNA, 64 nt, hsa; identical to SEQ ID NO: 126284

SEQ ID NO: 162173 - RNA, 64 nt, hsa; identical to SEQ ID NO: 126285

SEQ ID NO: 162174 - RNA, 64 nt, hsa; identical to SEQ ID NO: 126286

SEQ ID NO: 162175 - RNA, 64 nt, hsa; identical to SEQ ID NO: 126287

SEQ ID NO: 162176 - RNA, 64 nt, hsa; identical to SEQ ID NO: 126288

SEQ ID NO: 162177 - RNA, 64 nt, hsa; identical to SEQ ID NO: 126289

SEQ ID NO: 162178 - RNA, 64 nt, hsa; identical to SEQ ID NO: 126290

SEQ ID NO: 162179 - RNA, 64 nt, hsa; identical to SEQ ID NO: 126291

SEQ ID NO: 162180 - RNA, 64 nt, hsa; identical to SEQ ID NO: 126292

SEQ ID NO: 162181 - RNA, 64 nt, hsa; identical to SEQ ID NO: 126293

SEQ ID NO: 162182 - RNA, 64 nt, hsa; identical to SEQ ID NO: 126294

SEQ ID NO: 162183 - RNA, 64 nt, hsa; identical to SEQ ID NO: 126295

SEQ ID NO: 162184 - RNA, 64 nt, hsa; identical to SEQ ID NO: 126296

SEQ ID NO: 162185 - RNA, 64 nt, hsa; identical to SEQ ID NO: 126297

SEQ ID NO: 162186 - RNA, 64 nt, hsa; identical to SEQ ID NO: 126298

SEQ ID NO: 162187 - RNA, 64 nt, hsa; identical to SEQ ID NO: 126299

SEQ ID NO: 162188 - RNA, 64 nt, hsa; identical to SEQ ID NO: 126300

SEQ ID NO: 162189 - RNA, 64 nt, hsa; identical to SEQ ID NO: 126301

SEQ ID NO: 162190 - RNA, 64 nt, hsa; identical to SEQ ID NO: 126302

SEQ ID NO: 162191 - RNA, 64 nt, hsa; identical to SEQ ID NO: 126303

SEQ ID NO: 162192 - RNA, 64 nt, hsa; identical to SEQ ID NO: 126304

SEQ ID NO: 162193 - RNA, 64 nt, hsa; identical to SEQ ID NO: 126305

SEQ ID NO: 162194 - RNA, 64 nt, hsa; identical to SEQ ID NO: 126306

SEQ ID NO: 162195 - RNA, 64 nt, hsa; identical to SEQ ID NO: 126307

SEQ ID NO: 162196 - RNA, 64 nt, hsa; identical to SEQ ID NO: 126308

SEQ ID NO: 162197 - RNA, 64 nt, hsa; identical to SEQ ID NO: 126309

SEQ ID NO: 162198 - RNA, 64 nt, hsa; identical to SEQ ID NO: 126310

SEQ ID NO: 162199 - RNA, 64 nt, hsa; identical to SEQ ID NO: 126311

SEQ ID NO: 162200 - RNA, 64 nt, hsa; identical to SEQ ID NO: 126312

SEQ ID NO: 162201 - RNA, 64 nt, hsa; identical to SEQ ID NO: 126313

SEQ ID NO: 162202 - RNA, 64 nt, hsa; identical to SEQ ID NO: 126314

SEQ ID NO: 162203 - RNA, 64 nt, hsa; identical to SEQ ID NO: 126315

SEQ ID NO: 162204 - RNA, 64 nt, hsa; identical to SEQ ID NO: 126316

SEQ ID NO: 162205 - RNA, 64 nt, hsa; identical to SEQ ID NO: 126317

SEQ ID NO: 162206 - RNA, 64 nt, hsa; identical to SEQ ID NO: 126318

SEQ ID NO: 162207 - RNA, 64 nt, hsa; identical to SEQ ID NO: 126319

SEQ ID NO: 162208 - RNA, 64 nt, hsa; identical to SEQ ID NO: 126320

SEQ ID NO: 162209 - RNA, 64 nt, hsa; identical to SEQ ID NO: 126321

SEQ ID NO: 162210 - RNA, 64 nt, hsa; identical to SEQ ID NO: 126322

SEQ ID NO: 162211 - RNA, 64 nt, hsa; identical to SEQ ID NO: 126323

SEQ ID NO: 162212 - RNA, 64 nt, hsa; identical to SEQ ID NO: 126324

SEQ ID NO: 162213 - RNA, 64 nt, hsa; identical to SEQ ID NO: 126325

SEQ ID NO: 162214 - RNA, 64 nt, hsa; identical to SEQ ID NO: 126326

SEQ ID NO: 162215 - RNA, 64 nt, hsa; identical to SEQ ID NO: 126327

SEQ ID NO: 162216 - RNA, 64 nt, hsa; identical to SEQ ID NO: 126328

SEQ ID NO: 162217 - RNA, 64 nt, hsa; identical to SEQ ID NO: 126329

SEQ ID NO: 162218 - RNA, 64 nt, hsa; identical to SEQ ID NO: 126330

SEQ ID NO: 162219 - RNA, 64 nt, hsa; identical to SEQ ID NO: 126331

SEQ ID NO: 162220 - RNA, 64 nt, hsa; identical to SEQ ID NO: 126332

SEQ ID NO: 162221 - RNA, 64 nt, hsa; identical to SEQ ID NO: 126333

SEQ ID NO: 162222 - RNA, 64 nt, hsa; identical to SEQ ID NO: 126334

SEQ ID NO: 162223 - RNA, 64 nt, hsa; identical to SEQ ID NO: 126335

SEQ ID NO: 162224 - RNA, 64 nt, hsa; identical to SEQ ID NO: 126336

SEQ ID NO: 162225 - RNA, 64 nt, hsa; identical to SEQ ID NO: 126337

SEQ ID NO: 162226 - RNA, 64 nt, hsa; identical to SEQ ID NO: 126338

SEQ ID NO: 162227 - RNA, 64 nt, hsa; identical to SEQ ID NO: 126339

SEQ ID NO: 162228 - RNA, 64 nt, hsa; identical to SEQ ID NO: 126340

SEQ ID NO: 162229 - RNA, 64 nt, hsa; identical to SEQ ID NO: 126341

SEQ ID NO: 162230 - RNA, 64 nt, hsa; identical to SEQ ID NO: 126342

SEQ ID NO: 162231 - RNA, 64 nt, hsa; identical to SEQ ID NO: 126343

SEQ ID NO: 162232 - RNA, 64 nt, hsa; identical to SEQ ID NO: 126344

SEQ ID NO: 162233 - RNA, 64 nt, hsa; identical to SEQ ID NO: 126345

SEQ ID NO: 162234 - RNA, 64 nt, hsa; identical to SEQ ID NO: 126346

SEQ ID NO: 162235 - RNA, 64 nt, hsa; identical to SEQ ID NO: 126347

SEQ ID NO: 162236 - RNA, 64 nt, hsa; identical to SEQ ID NO: 126348

SEQ ID NO: 162237 - RNA, 64 nt, hsa; identical to SEQ ID NO: 126349

SEQ ID NO: 162238 - RNA, 64 nt, hsa; identical to SEQ ID NO: 126350

SEQ ID NO: 162239 - RNA, 64 nt, hsa; identical to SEQ ID NO: 126351

SEQ ID NO: 162240 - RNA, 64 nt, hsa; identical to SEQ ID NO: 126352

SEQ ID NO: 162241 - RNA, 64 nt, hsa; identical to SEQ ID NO: 126353

SEQ ID NO: 162242 - RNA, 64 nt, hsa; identical to SEQ ID NO: 126354

SEQ ID NO: 162243 - RNA, 64 nt, hsa; identical to SEQ ID NO: 126355

SEQ ID NO: 162244 - RNA, 64 nt, hsa; identical to SEQ ID NO: 126356

SEQ ID NO: 162245 - RNA, 64 nt, hsa; identical to SEQ ID NO: 126357

SEQ ID NO: 162246 - RNA, 64 nt, hsa; identical to SEQ ID NO: 126358

SEQ ID NO: 162247 - RNA, 64 nt, hsa; identical to SEQ ID NO: 126359

SEQ ID NO: 162248 - RNA, 64 nt, hsa; identical to SEQ ID NO: 126360

SEQ ID NO: 162249 - RNA, 64 nt, hsa; identical to SEQ ID NO: 126361

SEQ ID NO: 162250 - RNA, 64 nt, hsa; identical to SEQ ID NO: 126362

SEQ ID NO: 162251 - RNA, 64 nt, hsa; identical to SEQ ID NO: 126363

SEQ ID NO: 162252 - RNA, 64 nt, hsa; identical to SEQ ID NO: 126364

SEQ ID NO: 162253 - RNA, 64 nt, hsa; identical to SEQ ID NO: 126365

SEQ ID NO: 162254 - RNA, 64 nt, hsa; identical to SEQ ID NO: 126366

SEQ ID NO: 162255 - RNA, 64 nt, hsa; identical to SEQ ID NO: 126367

SEQ ID NO: 162256 - RNA, 64 nt, hsa; identical to SEQ ID NO: 126368

SEQ ID NO: 162257 - RNA, 64 nt, hsa; identical to SEQ ID NO: 126369

SEQ ID NO: 162258 - RNA, 64 nt, hsa; identical to SEQ ID NO: 126370

SEQ ID NO: 162259 - RNA, 64 nt, hsa; identical to SEQ ID NO: 126371

SEQ ID NO: 162260 - RNA, 64 nt, hsa; identical to SEQ ID NO: 126372

SEQ ID NO: 162261 - RNA, 64 nt, hsa; identical to SEQ ID NO: 126373

SEQ ID NO: 162262 - RNA, 64 nt, hsa; identical to SEQ ID NO: 126374

SEQ ID NO: 162263 - RNA, 64 nt, hsa; identical to SEQ ID NO: 126375

SEQ ID NO: 162264 - RNA, 64 nt, hsa; identical to SEQ ID NO: 126376

SEQ ID NO: 162265 - RNA, 64 nt, hsa; identical to SEQ ID NO: 126377

SEQ ID NO: 162266 - RNA, 64 nt, hsa; identical to SEQ ID NO: 126378

SEQ ID NO: 162267 - RNA, 64 nt, hsa; identical to SEQ ID NO: 126379

SEQ ID NO: 162268 - RNA, 64 nt, hsa; identical to SEQ ID NO: 126380

SEQ ID NO: 162269 - RNA, 64 nt, hsa; identical to SEQ ID NO: 126381

SEQ ID NO: 162270 - RNA, 64 nt, hsa; identical to SEQ ID NO: 126382

SEQ ID NO: 162271 - RNA, 64 nt, hsa; identical to SEQ ID NO: 126383

SEQ ID NO: 162272 - RNA, 64 nt, hsa; identical to SEQ ID NO: 126384

SEQ ID NO: 162273 - RNA, 64 nt, hsa; identical to SEQ ID NO: 126385

SEQ ID NO: 162274 - RNA, 64 nt, hsa; identical to SEQ ID NO: 126386

SEQ ID NO: 162275 - RNA, 64 nt, hsa; identical to SEQ ID NO: 126387

SEQ ID NO: 162276 - RNA, 64 nt, hsa; identical to SEQ ID NO: 126388

SEQ ID NO: 162277 - RNA, 64 nt, hsa; identical to SEQ ID NO: 126389

SEQ ID NO: 162278 - RNA, 64 nt, hsa; identical to SEQ ID NO: 126390

SEQ ID NO: 162279 - RNA, 64 nt, hsa; identical to SEQ ID NO: 126391

SEQ ID NO: 162280 - RNA, 64 nt, hsa; identical to SEQ ID NO: 126392

SEQ ID NO: 162281 - RNA, 64 nt, hsa; identical to SEQ ID NO: 38325

SEQ ID NO: 162282 - RNA, 64 nt, hsa; identical to SEQ ID NO: 38326

SEQ ID NO: 162283 - RNA, 64 nt, hsa; identical to SEQ ID NO: 38327

SEQ ID NO: 162284 - RNA, 64 nt, hsa; identical to SEQ ID NO: 38328

SEQ ID NO: 162285 - RNA, 64 nt, hsa; identical to SEQ ID NO: 38329

SEQ ID NO: 162286 - RNA, 64 nt, hsa; identical to SEQ ID NO: 38330

SEQ ID NO: 162287 - RNA, 64 nt, hsa; identical to SEQ ID NO: 38331

SEQ ID NO: 162288 - RNA, 64 nt, hsa; identical to SEQ ID NO: 38332

SEQ ID NO: 162289 - RNA, 64 nt, hsa; identical to SEQ ID NO: 38333

SEQ ID NO: 162290 - RNA, 64 nt, hsa; identical to SEQ ID NO: 38334

SEQ ID NO: 162291 - RNA, 64 nt, hsa; identical to SEQ ID NO: 38335

SEQ ID NO: 162292 - RNA, 64 nt, hsa; identical to SEQ ID NO: 38336

SEQ ID NO: 162293 - RNA, 64 nt, hsa; identical to SEQ ID NO: 38337

SEQ ID NO: 162294 - RNA, 64 nt, hsa; identical to SEQ ID NO: 38338

SEQ ID NO: 162295 - RNA, 64 nt, hsa; identical to SEQ ID NO: 38339

SEQ ID NO: 162296 - RNA, 64 nt, hsa; identical to SEQ ID NO: 38340

SEQ ID NO: 162297 - RNA, 64 nt, hsa; identical to SEQ ID NO: 38341

SEQ ID NO: 162298 - RNA, 64 nt, hsa; identical to SEQ ID NO: 38342

SEQ ID NO: 162299 - RNA, 64 nt, hsa; identical to SEQ ID NO: 38343

SEQ ID NO: 162300 - RNA, 64 nt, hsa; identical to SEQ ID NO: 38344

SEQ ID NO: 162301 - RNA, 64 nt, hsa; identical to SEQ ID NO: 38345

SEQ ID NO: 162302 - RNA, 64 nt, hsa; identical to SEQ ID NO: 38346

SEQ ID NO: 162303 - RNA, 64 nt, hsa; identical to SEQ ID NO: 38347

SEQ ID NO: 162304 - RNA, 64 nt, hsa; identical to SEQ ID NO: 38348

SEQ ID NO: 162305 - RNA, 64 nt, hsa; identical to SEQ ID NO: 38349

SEQ ID NO: 162306 - RNA, 64 nt, hsa; identical to SEQ ID NO: 38350

SEQ ID NO: 162307 - RNA, 64 nt, hsa; identical to SEQ ID NO: 38351

SEQ ID NO: 162308 - RNA, 64 nt, hsa; identical to SEQ ID NO: 38352

SEQ ID NO: 162309 - RNA, 64 nt, hsa; identical to SEQ ID NO: 38353

SEQ ID NO: 162310 - RNA, 64 nt, hsa; identical to SEQ ID NO: 38354

SEQ ID NO: 162311 - RNA, 64 nt, hsa; identical to SEQ ID NO: 38355

SEQ ID NO: 162312 - RNA, 64 nt, hsa; identical to SEQ ID NO: 38356

SEQ ID NO: 162313 - RNA, 64 nt, hsa; identical to SEQ ID NO: 38357

SEQ ID NO: 162314 - RNA, 64 nt, hsa; identical to SEQ ID NO: 38358

SEQ ID NO: 162315 - RNA, 64 nt, hsa; identical to SEQ ID NO: 38359

SEQ ID NO: 162316 - RNA, 64 nt, hsa; identical to SEQ ID NO: 38360

SEQ ID NO: 162317 - RNA, 64 nt, hsa; identical to SEQ ID NO: 38361

SEQ ID NO: 162318 - RNA, 64 nt, hsa; identical to SEQ ID NO: 38362

SEQ ID NO: 162319 - RNA, 64 nt, hsa; identical to SEQ ID NO: 38363

SEQ ID NO: 162320 - RNA, 64 nt, hsa; identical to SEQ ID NO: 38364

SEQ ID NO: 162321 - RNA, 64 nt, hsa; identical to SEQ ID NO: 38365

SEQ ID NO: 162322 - RNA, 64 nt, hsa; identical to SEQ ID NO: 38366

SEQ ID NO: 162323 - RNA, 64 nt, hsa; identical to SEQ ID NO: 38367

SEQ ID NO: 162324 - RNA, 64 nt, hsa; identical to SEQ ID NO: 38368

SEQ ID NO: 162325 - RNA, 64 nt, hsa; identical to SEQ ID NO: 38369

SEQ ID NO: 162326 - RNA, 64 nt, hsa; identical to SEQ ID NO: 38370

SEQ ID NO: 162327 - RNA, 64 nt, hsa; identical to SEQ ID NO: 38371

SEQ ID NO: 162328 - RNA, 64 nt, hsa; identical to SEQ ID NO: 38372

SEQ ID NO: 162329 - RNA, 64 nt, hsa; identical to SEQ ID NO: 38373

SEQ ID NO: 162330 - RNA, 64 nt, hsa; identical to SEQ ID NO: 38374

SEQ ID NO: 162331 - RNA, 64 nt, hsa; identical to SEQ ID NO: 38375

SEQ ID NO: 162332 - RNA, 64 nt, hsa; identical to SEQ ID NO: 38376

SEQ ID NO: 162333 - RNA, 64 nt, hsa; identical to SEQ ID NO: 38377

SEQ ID NO: 162334 - RNA, 64 nt, hsa; identical to SEQ ID NO: 38378

SEQ ID NO: 162335 - RNA, 64 nt, hsa; identical to SEQ ID NO: 38379

SEQ ID NO: 162336 - RNA, 64 nt, hsa; identical to SEQ ID NO: 38380

SEQ ID NO: 162337 - RNA, 64 nt, hsa; identical to SEQ ID NO: 38381

SEQ ID NO: 162338 - RNA, 64 nt, hsa; identical to SEQ ID NO: 38382

SEQ ID NO: 162339 - RNA, 64 nt, hsa; identical to SEQ ID NO: 38383

SEQ ID NO: 162340 - RNA, 64 nt, hsa; identical to SEQ ID NO: 38384

SEQ ID NO: 162341 - RNA, 64 nt, hsa
caaaaagacaucaagucuucuuaauucaacccauaaucauuaaguacuuaacaaagaauauuuu

SEQ ID NO: 162342 - RNA, 64 nt, hsa
aauuaauauuuuugauacagugauuucauauuggaaucauuauuugugcaaagggacagacaga

SEQ ID NO: 162343 - RNA, 64 nt, hsa
uucuuuaaauuuccuuauagaaccauuaauagaaaaucauuacauuuaaaauauaccuuacagc

SEQ ID NO: 162344 - RNA, 64 nt, hsa
uugaacaaaauuuguuuuguguguuagaguuauaaaucauuaaucuuuauuucgggugguuuac

SEQ ID NO: 162345 - RNA, 64 nt, hsa
caaauccaugaaaacgcuuagugaauauauucuuaaucauuaauaaauuagcccauuauauuuu

SEQ ID NO: 162346 - RNA, 64 nt, hsa
uaguuuagugauacaaaugauugcaauuuuucuaaaucauuaaauuauuugguuugguggagug

SEQ ID NO: 162347 - RNA, 64 nt, hsa
uugcccaagugccauuggcuugucugcauuucaaaaucauuaaaaccagguauggaagccuacg

SEQ ID NO: 162348 - RNA, 64 nt, hsa
caugaaaccguuuggguucauuuaaauuugucugaaucauuagucuugacuugaagugaacaaa

SEQ ID NO: 162349 - RNA, 64 nt, hsa
aagcuuugcucuuuaggcaggaaugaucuuuucaaaucauuagcacaauauuuaaauaucuaaa

SEQ ID NO: 162350 - RNA, 64 nt, hsa
uguaguccugucauuuaaguuauguaaaaaauuuaaucauuauuuugaugcuuuaaacauucuc

SEQ ID NO: 162351 - RNA, 64 nt, hsa
uaagauaacgcugaccauaguaaaauuguuaguaaaucauuagguaacaucuugugguaggaaa

SEQ ID NO: 162352 - RNA, 64 nt, hsa
uuaguaaaucauuagguaacaucuugugguaggaaaucauuagguaacaucaauccuaacuaga

SEQ ID NO: 162353 - RNA, 64 nt, hsa
agaaaagacuuaaaacuggagugacaggacaaauaaucauuacuuucaauucaugacugcuuua

SEQ ID NO: 162354 - RNA, 64 nt, hsa
aauuauuuggacuacacauaaacuccuaauauugaaucauuaccuaucagguauuaucuuuaug

SEQ ID NO: 162355 - RNA, 64 nt, hsa
gaccuuagcugugggguuccuuuacuauugggugaaucauuagguauaaaaaauaaucaucaac

SEQ ID NO: 162356 - RNA, 64 nt, hsa
uuuuagucagcaguuuuguaaacucuguauauaaaaucauuaaccacacauugugggugauggg

SEQ ID NO: 162357 - RNA, 64 nt, hsa
uaguguucuuuuucuccagaaaaaugcuugugagaaucauuaaaacaugugacaauuuagagau

SEQ ID NO: 162358 - RNA, 64 nt, hsa
acuaauuuugaaaauuaccagugugauacauaggaaucauuauucagaauguagucuggucuuu

SEQ ID NO: 162359 - RNA, 64 nt, hsa
uuuauuucguauuuucuuuaaggagugcuuucucaaucauuaauagaguuguuucugggaggga

SEQ ID NO: 162360 - RNA, 64 nt, hsa
ggcagauguagcaaaaacuucacaacaauucagcaaucauuagcucgggucacuuagaguaagg

SEQ ID NO: 162361 - RNA, 64 nt, hsa
uucuaguauaacagaaauuuuuguagaugaaaaaaaucauuauguuuagaggucuaaugcuaug

SEQ ID NO: 162362 - RNA, 64 nt, hsa
uucuaauaccuauauuuucaaguuaugucaauuaaaucauuaucagguuauuuccuaauguaag

SEQ ID NO: 162363 - RNA, 64 nt, hsa
ugaaguaacuuuguaauuauuugaacauuguuuuaaucauuaggaaacacugauuaacugcaag

SEQ ID NO: 162364 - RNA, 64 nt, hsa
cccaguggauggcugaagguguuaaaugugcuauaaucauuaagaauacuguguucuguguuau

SEQ ID NO: 162365 - RNA, 64 nt, hsa
uucugauacauaaaauuauuuuaagcauuuuaucaaucauuaaaauuuacugccaguugugagu

SEQ ID NO: 162366 - RNA, 64 nt, hsa
uuccaaaauaacuaggaucugcauuuagaacaagaaucauuauuuguccugaccuuuucagucc

SEQ ID NO: 162367 - RNA, 64 nt, hsa
cacacaaauauuauuagacaaauuagaugacaaaaaucauuaagaaguccaaacuuuuuuuuua

SEQ ID NO: 162368 - RNA, 64 nt, hsa
uacagcuuauuaccuucaucauguccgugagucuaaucauuaguacguguggcagaaguuuauu

SEQ ID NO: 162369 - RNA, 64 nt, hsa
uuuaauuggauauuggacucugcucauauaagcuacagacaaaagccaaaagacucucgcuguc

SEQ ID NO: 162370 - RNA, 64 nt, hsa
gccugggcaacauggugaaacccgucucuaccaaacagacaaaaagcagccaggcgugguggca

SEQ ID NO: 162371 - RNA, 64 nt, hsa
gaaugugggaguaugucugccgguuucaacacacacagacaaacacagccacacgcgcacacaa

SEQ ID NO: 162372 - RNA, 64 nt, hsa
cauacuuucuuuuuucuuuuccuuuuuucccuccacagacaauguccucuguucaauuccuaac

SEQ ID NO: 162373 - RNA, 64 nt, hsa
aaaagaguuaucggcccauagcuaauaaguagugacagacaaccaagcuucaauauuuuucuaa

SEQ ID NO: 162374 - RNA, 64 nt, hsa
auuuuucuuuuccgcacuaccugaacauuguaauacagacaaacuugauuucuucuagaagaua

SEQ ID NO: 162375 - RNA, 64 nt, hsa
uuuucucugcccuuuuuuuguuguucuauuuuguacagacaaguuggaaaaacaacagcgacaa

SEQ ID NO: 162376 - RNA, 64 nt, hsa
aaaaauauauauuuuaaguuuaaaaaacagaaaaacagacaaaacaauccccaucagguagcug

SEQ ID NO: 162377 - RNA, 64 nt, hsa
uauuacaacauuuaugugagguaauuauugcucaacagacaauuagaaaaaaguccacacuuga

SEQ ID NO: 162378 - RNA, 64 nt, hsa
guccuggcccuggcccuuacuauuaggaaaauaaacagacaaaaacaaguaaauauauaugguc

SEQ ID NO: 162379 - RNA, 64 nt, hsa
uaauuaaaacacaacaucuuuuucuacucgaguuacagacaaagcgugguggacaugcacagcu

SEQ ID NO: 162380 - RNA, 64 nt, hsa
cauggaaguacuauaauuuaccugaagucuuuguacagacaacaaaccuguuucugcagccacu

SEQ ID NO: 162381 - RNA, 64 nt, hsa
uagaauucugccaauagguggauuuuacaaaaccacagacaaccucugaaagauucugagaccc

SEQ ID NO: 162382 - RNA, 64 nt, hsa
guuaaaauucacaauaauguagauagaacaaauuacagacaaggaaagaaaaaacuugaaugaa

SEQ ID NO: 162383 - RNA, 64 nt, hsa
guugucaaacaucuucagggaaaucaacaagccaacagacaagaaggagcgaaagugaguaucu

SEQ ID NO: 162384 - RNA, 64 nt, hsa
ucugagagucuuccacgaccggcugaucagugaaacagacaagcagcuggucaguacauccaau

SEQ ID NO: 162385 - RNA, 64 nt, hsa
cccagccccaccaacccaccuguucauuuauucaacagacaaugacagcugauauuuauuggac

SEQ ID NO: 162386 - RNA, 64 nt, hsa
cggcaugcaccaguuccacacaccaucccauuuuacagacaaggacgcugaggccugcagcagc

SEQ ID NO: 162387 - RNA, 64 nt, hsa
cuguaguauuuaugauguuaagauaaugcggguaacagacaauauaauagccccgaccuuaaac

SEQ ID NO: 162388 - RNA, 64 nt, hsa
uguggucuguagcccaauaacuggggaacgaguuacagacaaacaucaccguaaaugacucaca

SEQ ID NO: 162389 - RNA, 64 nt, hsa
cuuuguggcaacugaagauggaagucuggggggcacagacaaccuuaucaaacaauauaaaagc

SEQ ID NO: 162390 - RNA, 64 nt, hsa
aguguaaugauauuugagugaauuaaaaugcaugacagacaagguacaacaugguugcagaaua

SEQ ID NO: 162391 - RNA, 64 nt, hsa
acaugaaaauagcaauauucuuggagauugauaaccauagcauuaauacgcccauuauggucau

SEQ ID NO: 162392 - RNA, 64 nt, hsa
cugcuguuggaugcagcaauaauuucuguaugguccauagcacuguauauuauggaucgauauu

SEQ ID NO: 162393 - RNA, 64 nt, hsa
agaaagucaccugcccaagaaacaccgagugaggccauagcaacuccccuacaucaaaugcuca

SEQ ID NO: 162394 - RNA, 64 nt, hsa
auuaagaaaaagucgcccgaaacaccaagugaggccauagcaauuccccuacaucaaaugcuca

SEQ ID NO: 162395 - RNA, 64 nt, hsa
uuuguuuuguguuuuucuguaauaauuuaauguuacuuauuaucagaauuucugaaaccuuuac

SEQ ID NO: 162396 - RNA, 64 nt, hsa
auuuauaaaugugaagcuuuuugaugccaucaaaacuuauuaaaaaauaggauuuacuuuuuuc

SEQ ID NO: 162397 - RNA, 64 nt, hsa
aaaauguuaguuuacuaguaauuuuucuaagucuacuuauuaaauaacuuaagggaaacuguaa

SEQ ID NO: 162398 - RNA, 64 nt, hsa
aauuuguugauguuuuuugaagcauuaagucauuacuuauuagcaaguuacuauuuuguuuuuu

SEQ ID NO: 162399 - RNA, 64 nt, hsa
uccacaagcuuaccuaauuguuuauauacuuuauacuuauuaaaguauacauuuuuaaauguua

SEQ ID NO: 162400 - RNA, 64 nt, hsa
uaaugucugagagccucauaaaaucaacauauuuacuuauuaagcaguuuaugaaacuuuaaug

SEQ ID NO: 162401 - RNA, 64 nt, hsa
acacacacacagaaugcacauuucacacacauauacuuauuauucaaguugaaacugcacucua

SEQ ID NO: 162402 - RNA, 64 nt, hsa
ucaagauuauaaauacucaugaucagaaaauaguacuuauuagcaauuaaagggaggaaaagaa

SEQ ID NO: 162403 - RNA, 64 nt, hsa
uugaguuugcuuucucaacauuauuguauuuuccacuuauuauuacuguauaacauaugcuagu

SEQ ID NO: 162404 - RNA, 64 nt, hsa
cauuuguauugucucuucuuaaacuaucuuauugacuuauuauuuaagccuuuuaauacuaagu

SEQ ID NO: 162405 - RNA, 64 nt, hsa
auuaaugcuaucaucucgaccaagcucaaagccuacuuauuagaaacaaugaaguucacaauag

SEQ ID NO: 162406 - RNA, 64 nt, hsa
uuuuaacucaugauuuuuacacacacaauccagaacuuauuauauagccucuaagucuuuauuc

SEQ ID NO: 162407 - RNA, 64 nt, hsa
cuuaccuuauaaguaaaaagguuaauaucaaguaacuuauuagcucuuaaaguaaaauugaacu

SEQ ID NO: 162408 - RNA, 64 nt, hsa
ucaaguaacuuauuagcucuuaaaguaaaauugaacuuauuaaaagcuaucuaugauuuaauag

SEQ ID NO: 162409 - RNA, 64 nt, hsa
uccauauucgacagcauuuuaguuuuuuaauaguacuuauuagcaucaaccaucuugauaauca

SEQ ID NO: 162410 - RNA, 64 nt, hsa
cuguguuacaucaucuuuacgcuuugguauuugaacuuauuacagaauuuuuucucuaaauugg

SEQ ID NO: 162411 - RNA, 64 nt, hsa
uuauuccagguaugguuaaguagugagaaaaaucacuuauuaauuuucaagaacuuugagacua

SEQ ID NO: 162412 - RNA, 64 nt, hsa
agcauugaggcaagaggauguaauugauagcauuacuuauuacaucccuauuuauguucaaccg

SEQ ID NO: 162413 - RNA, 64 nt, hsa; identical to SEQ ID NO: 85676

SEQ ID NO: 162414 - RNA, 64 nt, hsa; identical to SEQ ID NO: 85677

SEQ ID NO: 162415 - RNA, 64 nt, hsa; identical to SEQ ID NO: 85678

SEQ ID NO: 162416 - RNA, 64 nt, hsa; identical to SEQ ID NO: 85679

SEQ ID NO: 162417 - RNA, 64 nt, hsa; identical to SEQ ID NO: 85680

SEQ ID NO: 162418 - RNA, 64 nt, hsa; identical to SEQ ID NO: 85681

SEQ ID NO: 162419 - RNA, 64 nt, hsa; identical to SEQ ID NO: 85682

SEQ ID NO: 162420 - RNA, 64 nt, hsa; identical to SEQ ID NO: 85683

SEQ ID NO: 162421 - RNA, 64 nt, hsa; identical to SEQ ID NO: 85684

SEQ ID NO: 162422 - RNA, 64 nt, hsa; identical to SEQ ID NO: 85685

SEQ ID NO: 162423 - RNA, 64 nt, hsa; identical to SEQ ID NO: 85686

SEQ ID NO: 162424 - RNA, 64 nt, hsa; identical to SEQ ID NO: 85687

SEQ ID NO: 162425 - RNA, 64 nt, hsa; identical to SEQ ID NO: 85688

SEQ ID NO: 162426 - RNA, 64 nt, hsa; identical to SEQ ID NO: 85689

SEQ ID NO: 162427 - RNA, 64 nt, hsa; identical to SEQ ID NO: 85690

SEQ ID NO: 162428 - RNA, 64 nt, hsa; identical to SEQ ID NO: 85691

SEQ ID NO: 162429 - RNA, 64 nt, hsa; identical to SEQ ID NO: 85692

SEQ ID NO: 162430 - RNA, 64 nt, hsa; identical to SEQ ID NO: 85693

SEQ ID NO: 162431 - RNA, 64 nt, hsa; identical to SEQ ID NO: 85694

SEQ ID NO: 162432 - RNA, 64 nt, hsa; identical to SEQ ID NO: 85695

SEQ ID NO: 162433 - RNA, 64 nt, hsa; identical to SEQ ID NO: 85696

SEQ ID NO: 162434 - RNA, 64 nt, hsa; identical to SEQ ID NO: 85697

SEQ ID NO: 162435 - RNA, 64 nt, hsa; identical to SEQ ID NO: 85698

SEQ ID NO: 162436 - RNA, 64 nt, hsa; identical to SEQ ID NO: 85699

SEQ ID NO: 162437 - RNA, 64 nt, hsa; identical to SEQ ID NO: 85700

SEQ ID NO: 162438 - RNA, 64 nt, hsa; identical to SEQ ID NO: 85701

SEQ ID NO: 162439 - RNA, 64 nt, hsa; identical to SEQ ID NO: 85702

SEQ ID NO: 162440 - RNA, 64 nt, hsa; identical to SEQ ID NO: 85703

SEQ ID NO: 162441 - RNA, 64 nt, hsa; identical to SEQ ID NO: 85704

SEQ ID NO: 162442 - RNA, 64 nt, hsa; identical to SEQ ID NO: 85705

SEQ ID NO: 162443 - RNA, 64 nt, hsa; identical to SEQ ID NO: 85706

SEQ ID NO: 162444 - RNA, 64 nt, hsa; identical to SEQ ID NO: 85707

SEQ ID NO: 162445 - RNA, 64 nt, hsa; identical to SEQ ID NO: 85708

SEQ ID NO: 162446 - RNA, 64 nt, hsa; identical to SEQ ID NO: 85709

SEQ ID NO: 162447 - RNA, 64 nt, hsa; identical to SEQ ID NO: 85710

SEQ ID NO: 162448 - RNA, 64 nt, hsa; identical to SEQ ID NO: 85711

SEQ ID NO: 162449 - RNA, 64 nt, hsa; identical to SEQ ID NO: 85712

SEQ ID NO: 162450 - RNA, 64 nt, hsa; identical to SEQ ID NO: 85713

SEQ ID NO: 162451 - RNA, 64 nt, hsa; identical to SEQ ID NO: 85714

SEQ ID NO: 162452 - RNA, 64 nt, hsa; identical to SEQ ID NO: 85715

SEQ ID NO: 162453 - RNA, 64 nt, hsa; identical to SEQ ID NO: 85716

SEQ ID NO: 162454 - RNA, 64 nt, hsa; identical to SEQ ID NO: 85717

SEQ ID NO: 162455 - RNA, 64 nt, hsa; identical to SEQ ID NO: 85718

SEQ ID NO: 162456 - RNA, 64 nt, hsa; identical to SEQ ID NO: 85719

SEQ ID NO: 162457 - RNA, 64 nt, hsa; identical to SEQ ID NO: 85720

SEQ ID NO: 162458 - RNA, 64 nt, hsa; identical to SEQ ID NO: 85721

SEQ ID NO: 162459 - RNA, 64 nt, hsa; identical to SEQ ID NO: 85722

SEQ ID NO: 162460 - RNA, 64 nt, hsa; identical to SEQ ID NO: 85723

SEQ ID NO: 162461 - RNA, 64 nt, hsa; identical to SEQ ID NO: 85724

SEQ ID NO: 162462 - RNA, 64 nt, hsa; identical to SEQ ID NO: 85725

SEQ ID NO: 162463 - RNA, 64 nt, hsa; identical to SEQ ID NO: 85726

SEQ ID NO: 162464 - RNA, 64 nt, hsa; identical to SEQ ID NO: 85727

SEQ ID NO: 162465 - RNA, 64 nt, hsa; identical to SEQ ID NO: 85728

SEQ ID NO: 162466 - RNA, 64 nt, hsa; identical to SEQ ID NO: 85729

SEQ ID NO: 162467 - RNA, 64 nt, hsa; identical to SEQ ID NO: 85730

SEQ ID NO: 162468 - RNA, 64 nt, hsa; identical to SEQ ID NO: 85731

SEQ ID NO: 162469 - RNA, 64 nt, hsa; identical to SEQ ID NO: 85732

SEQ ID NO: 162470 - RNA, 64 nt, hsa; identical to SEQ ID NO: 85733

SEQ ID NO: 162471 - RNA, 64 nt, hsa; identical to SEQ ID NO: 85734

SEQ ID NO: 162472 - RNA, 64 nt, hsa; identical to SEQ ID NO: 85735

SEQ ID NO: 162473 - RNA, 64 nt, hsa; identical to SEQ ID NO: 85736

SEQ ID NO: 162474 - RNA, 64 nt, hsa; identical to SEQ ID NO: 85737

SEQ ID NO: 162475 - RNA, 64 nt, hsa; identical to SEQ ID NO: 85738

SEQ ID NO: 162476 - RNA, 64 nt, hsa; identical to SEQ ID NO: 85739

SEQ ID NO: 162477 - RNA, 64 nt, hsa; identical to SEQ ID NO: 85740

SEQ ID NO: 162478 - RNA, 64 nt, hsa; identical to SEQ ID NO: 85741

SEQ ID NO: 162479 - RNA, 64 nt, hsa; identical to SEQ ID NO: 85742

SEQ ID NO: 162480 - RNA, 64 nt, hsa; identical to SEQ ID NO: 85743

SEQ ID NO: 162481 - RNA, 60 nt, hsa
cccuucagagcuccuuuccaacagcaucucucugucgaagaaagaagcucugucaaguua

SEQ ID NO: 162482 - RNA, 60 nt, hsa
aguuaagcuaaaguuuuaaaguggcaguuuucugucgaugacuuuuucaagugcuaacac

SEQ ID NO: 162483 - RNA, 60 nt, hsa
aaagauuuuccuucucuuggaaugugaagaucugucgauucaucuccaaucauaugcauu

SEQ ID NO: 162484 - RNA, 60 nt, hsa
aguacuuucaguuuggcgagccgugaggucucugucgaaacuacucaacucugccguccu

SEQ ID NO: 162485 - RNA, 60 nt, hsa
uugaaugaaaugggcacuguugauuccacuucugucgaggagcuucggggcucagagagg

SEQ ID NO: 162486 - RNA, 60 nt, hsa
uuggccuuuucagcuuucuucuugcccagcucugucgaauucaugggugugugugcacau

SEQ ID NO: 162487 - RNA, 60 nt, hsa
uaucugaagcacaaggcccacccucaccuaucugucgaccccauuuccuaccaccuuugu

SEQ ID NO: 162488 - RNA, 60 nt, hsa
caguuugccagccaggccccaccuacagcgucugucgaacaaacagaggucuggugguuu

SEQ ID NO: 162489 - RNA, 60 nt, hsa
uccacauccuccucccugucuggugucuggucugucgacugcccccagcugcugucuaaa

SEQ ID NO: 162490 - RNA, 60 nt, hsa
aaaguuuaaucagaggaaauucuuucccagucugucgauuuaugccucagccacuugccu

SEQ ID NO: 162491 - RNA, 60 nt, hsa
ggacgugcucggagggaaagauuuauggccucugucgagggaccugcagcgugagagcca

SEQ ID NO: 162492 - RNA, 50 nt, hsa
ugaaggagauaacuuauuaaucugucgaaggcuuaugccgagccagaagc

SEQ ID NO: 162493 - RNA, 60 nt, hsa
gccagcccggcgcccuagcagaugcacgugucugucgaaucgcugccuccgagcccaccc

SEQ ID NO: 162494 - RNA, 60 nt, hsa
uagagaugauaggccuaaagggaacugucuucugucgagaaguaaaggaaacuucaugaa

SEQ ID NO: 162495 - RNA, 60 nt, hsa
gcuucucaggggcagaacccgcucgugccaucugucgauucagaggcacgcacacaugcu

SEQ ID NO: 162496 - RNA, 60 nt, hsa
agaugcucucgagcguugagcaggcacagcucugucgaggucccugucccccaccugugg

SEQ ID NO: 162497 - RNA, 60 nt, hsa
aggucagagggucacauguuaacacuagagucugucgagagguaggauuugacacugguu

SEQ ID NO: 162498 - RNA, 60 nt, hsa
ccuggauaaaugcucuuaauuauaaaaaauucugucgaggaguguuccauaguuuauugu

SEQ ID NO: 162499 - RNA, 60 nt, hsa
uuuggaguuugcaaccacaguauuccuuugucugucgaggcugggaggguagccgugagc

SEQ ID NO: 162500 - RNA, 60 nt, hsa
caccugaacuugcuauuuuaaacaaauaguucugucgacaccuaaaauauaaucuggcuu

SEQ ID NO: 162501 - RNA, 60 nt, hsa
ggaagaugagaaaguaauuugagauuuuacucugucgaauuuuagaguauuugaagugau

SEQ ID NO: 162502 - RNA, 60 nt, hsa
gguucgauccucuccccuuccugccuuccuucugucgauuuucaaugucuugaugguguc

SEQ ID NO: 162503 - RNA, 60 nt, hsa
ggucacccagcgagugcugagaccccauuuucugucgaggcgggccgagucuucccuuau

SEQ ID NO: 162504 - RNA, 60 nt, hsa
caagccaaaaagccgggaccuuugcgcagcucugucgacucugguggguccccacuccug

SEQ ID NO: 162505 - RNA, 60 nt, hsa
uugcaggagaggguuggugccugcucaguuucugucgagggaaugggagucuccucggcu

SEQ ID NO: 162506 - RNA, 60 nt, hsa
cugagacauagcagcaguauccucuccggaucugucgauuuggagaccuuccgagagaga

SEQ ID NO: 162507 - RNA, 60 nt, hsa
cuuggaguuuucugccccccaccccaaacuucugucgaggagcaaggcuugccagcaagu

SEQ ID NO: 162508 - RNA, 64 nt, hsa
cugacaauuaugaaaaaauguucaaauucacguucuagugaaacugcauuauuuguugacuaga

SEQ ID NO: 162509 - RNA, 64 nt, hsa
uggugacaguuuccagaugcuaucacagacucugcuagugaaaagaacuaguuucuaggagcac

SEQ ID NO: 162510 - RNA, 64 nt, hsa
cuuugcucucaacauuuaaaauaaugcaguugcucuagugaauggggcguuaggggccugucuc

SEQ ID NO: 162511 - RNA, 64 nt, hsa
ccagcugcaaagacaauguugcucuccgccuacacuagugaauuaaucugaaaggcacuguguc

SEQ ID NO: 162512 - RNA, 64 nt, hsa
uuggauaaaaaaaaaacucgcugacauaaucucccuagugaaaacuuggguaauauauguaaga

SEQ ID NO: 162513 - RNA, 64 nt, hsa
aaaauguuacacaaagcaguaaaguuuuugagaacuagugaaguacuaauuaucaaggacauuu

SEQ ID NO: 162514 - RNA, 64 nt, hsa
guuuuuguuuguuuauuuguuuuugagauggagucucuacuaaaaauacaaaaaauuagccagg

SEQ ID NO: 162515 - RNA, 64 nt, hsa
caagaccagccuggccaauauggugaaaccccaucucuacuaagaauacaaaaaauuagcugag

SEQ ID NO: 162516 - RNA, 64 nt, hsa
caagaccagccuggccaauaugaugaaaccccgucucuacuaaaaauacaaaauuagucgggua

SEQ ID NO: 162517 - RNA, 64 nt, hsa
ugagaccagccuggccaacauggugaaaccccgucucuacuaaaaauacaaaaaguagccaggc

SEQ ID NO: 162518 - RNA, 64 nt, hsa
caagaacauccuggcuaacacggugaaacuccaucucuacuaaaaauacaaaaaauuggccggg

SEQ ID NO: 162519 - RNA, 64 nt, hsa
uaagaucauccuggccaacauggugacaccccgucucuacuaaaaauacaaaaauuacccaggc

SEQ ID NO: 162520 - RNA, 64 nt, hsa
cgagaccauccuggcuaacauggugaaacccugucucuacuaaaaauacaaaaaaaauuagcca

SEQ ID NO: 162521 - RNA, 64 nt, hsa
cgagaccauccuggcgaacacggugaaaccccgucucuacuaaaaaaaauacaaaaaaauuagc

SEQ ID NO: 162522 - RNA, 64 nt, hsa
cgagaccagccugaccaacauggcgaaaccccaucucuacuaaaaauacaaaaauuagccuggc

SEQ ID NO: 162523 - RNA, 64 nt, hsa
caagaucagucugggcaacacgaugaaacuccgucucuacuaaaauacaaaaaauuauccaggc

SEQ ID NO: 162524 - RNA, 64 nt, hsa
caagaccagccugaccaacacggagaaaccccgucucuacuaaaaauacagaauuagucaggcg

SEQ ID NO: 162525 - RNA, 64 nt, hsa
caagaucaaccuggccaacauacugaaaccccgucucuacuaaaaauaagaaaaauuagcuggg

SEQ ID NO: 162526 - RNA, 64 nt, hsa
cgagaccaaccuggucagcauggcaaaaccccgucucuacuaaaaguacaaaaauuagccaggc

SEQ ID NO: 162527 - RNA, 64 nt, hsa
cgagaccagccuggccaacauggugaaacccugucucuacuaaaaauacaaaaauuagccaggu

SEQ ID NO: 162528 - RNA, 64 nt, hsa
ggagaccauccuggcuaacauggugaaaccccgucucuacuaaaaauacaaaaaauuagccagg

SEQ ID NO: 162529 - RNA, 64 nt, hsa
ugagaccagccugacuaacauggugaaaucccgucucuacuaaaaauacaaaaaaaaaaaaaaa

SEQ ID NO: 162530 - RNA, 64 nt, hsa
caagaccauccuggccaacauggugaaauccugccucuacuaaaaauacaaaaaaaaaaaaaaa

SEQ ID NO: 162531 - RNA, 64 nt, hsa
cgagaccagccuggccaacauagcaaaacccugucucuacuaaaaauacaaaaauuagaugggu

SEQ ID NO: 162532 - RNA, 64 nt, hsa
uuuggaguuaggugguuuuggguuugaauuccagcucuacuauuuuugguugugugauagaguu

SEQ ID NO: 162533 - RNA, 64 nt, hsa
uuuuaacacuaaaaauacaauucaaauuuauuagcucuacuacuugaaugauuuuggaauuuua

SEQ ID NO: 162534 - RNA, 64 nt, hsa
cgaggcugguuuggccagcauggcgaaaccccaucucuacuaaaaauacaaaaaauuagcuggg

SEQ ID NO: 162535 - RNA, 64 nt, hsa
ugagaucagccuggccaacauggugaaaccccaucucuacuaaaaauacaaaaauuagccggac

SEQ ID NO: 162536 - RNA, 64 nt, hsa
caagaucauccuggccaacauggugaaacccugucucuacuaaaaauacaaaaaugagcugggc

SEQ ID NO: 162537 - RNA, 64 nt, hsa
cgagaccagccugaccaacauggagaaaccccgucucuacuaaaaauacaaaaauauuagccgg

SEQ ID NO: 162538 - RNA, 64 nt, hsa
cgagaucacccuggcccacauggugagaccccaacucuacuaaaaauacaaaaauuagcugggu

SEQ ID NO: 162539 - RNA, 64 nt, hsa
uuugagaccagccuggccaacauggcaaaaccaucucuacuaaaaauagaaaaauuagccaggc

SEQ ID NO: 162540 - RNA, 64 nt, hsa
ucaggaguuucagaccaauauggugaaaccccaucucuacuaaaauuacaaaaaaaauuaucca

SEQ ID NO: 162541 - RNA, 64 nt, hsa
aaugucaugaacccgaaaaaagcuucagucuggacucuacuauugaugcagaucagagaguucu

SEQ ID NO: 162542 - RNA, 64 nt, hsa
cgagaccauccuggccaacauggugaaaccccgucucuacuaaaaauacaaaaguuagccgggu

SEQ ID NO: 162543 - RNA, 64 nt, hsa
caagaccagccuggccaacauggugaaaccuugucucuacuaaaaauacaaaaauuagccaggc

SEQ ID NO: 162544 - RNA, 64 nt, hsa
cgagaccagccugaccaacacggagaaacccuaucucuacuaaaaauacaaaaguagccgggcg

SEQ ID NO: 162545 - RNA, 64 nt, hsa
caagacuagccuggccaacauggugaaaccccgucucuacuaaaaauacaaaaauuagccgggc

SEQ ID NO: 162546 - RNA, 64 nt, hsa
ugagaccaggcugggcaucauagcaagaccucaucucuacuaaaauucaaaaacaaaauuagcc

SEQ ID NO: 162547 - RNA, 64 nt, hsa
aagaccagccuguccaacauggugaaacccccaucucuacuaaaaauaccaaaaauuagccgag

SEQ ID NO: 162548 - RNA, 64 nt, hsa
cgagaccauccuggccaacauggugaaaccccgucucuacuaaaaauacaaaaauuagcugggc

SEQ ID NO: 162549 - RNA, 64 nt, hsa
caagaccagccuggccaacauggcaaaaucccaucucuacuaaaaauacaaaaauucacagggu

SEQ ID NO: 162550 - RNA, 64 nt, hsa
cgagaccauccugaccaacguggugaaaccccaucucuacuaaaaauagaaaaaucagcugggu

SEQ ID NO: 162551 - RNA, 64 nt, hsa
cgagaccagccuggucaagauggugaaaccccaucucuacuaaaauuacaaaaauuagccgggu

SEQ ID NO: 162552 - RNA, 64 nt, hsa
ugaaaccagccuggccaacauggugaaaccccaucucuacuaaaaaaacaaaacuagcuggggg

SEQ ID NO: 162553 - RNA, 64 nt, hsa
cgagaccagccuggccaacauggcaaaaccccgucucuacuaaaaaauacagaaauuagcuggg

SEQ ID NO: 162554 - RNA, 64 nt, hsa
cgagaccagccugaccaacauggcgaaaccccaucucuacuaaaaauacaaaaauuagcuuggc

SEQ ID NO: 162555 - RNA, 64 nt, hsa
ggagaccagccugacuaacauggagaaaccccaucucuacuaaaaauacaaaaugagcugggcg

SEQ ID NO: 162556 - RNA, 64 nt, hsa
cgagaccauccuggccaacauggugaaaccccgucucuacuaaaauacaaaaaauuagcugggu

SEQ ID NO: 162557 - RNA, 64 nt, hsa
cgagaccagucuggccaacauggggaaaccccgucucuacuaaaaauacaaaaauuagccgggc

SEQ ID NO: 162558 - RNA, 64 nt, hsa
ugagaccagccuggccaauguggugaaaccccaucucuacuaaaaauacaaaaauuagcugggc

SEQ ID NO: 162559 - RNA, 64 nt, hsa
cgagaccagccuggccaacacggugaaaccccgccucuacuaaaaauacaaaaaauagccgggu

SEQ ID NO: 162560 - RNA, 64 nt, hsa
gagaccagccugacaaaacauagugaaaccccgucucuacuaaaaauacaaaaauuagcugggc

SEQ ID NO: 162561 - RNA, 64 nt, hsa
ggagaccagccuggccaacauggcgaagccccgucucuacuaaaaauacaaaaauuagccgggu

SEQ ID NO: 162562 - RNA, 64 nt, hsa
uaaugagaugcaaagucuuuuggaccgaugaugucucuacuacuggaucuaucuguauuaacag

SEQ ID NO: 162563 - RNA, 64 nt, hsa
ugagaccagccuggccaacauggugaaaccccaucucuacuaaacaugcaaaaauuaccugggc

SEQ ID NO: 162564 - RNA, 64 nt, hsa
cgagaccagccuggccaacguggugaaacgcugucucuacuaaaauacaaaaaaauagggcugg

SEQ ID NO: 162565 - RNA, 64 nt, hsa
aguugaaaguaauuaaugauuuuauguuugguuacucuacuagauuugauaaaaauugugccuu

SEQ ID NO: 162566 - RNA, 64 nt, hsa
caagaccauccuggccaacauggugaaacccugucucuacuaaaaauacaaaaauagcugggca

SEQ ID NO: 162567 - RNA, 64 nt, hsa
caagaccagccuggguaauauggcaagagcccaacucuacuaaaaauacaaaaagaaaagaaaa

SEQ ID NO: 162568 - RNA, 64 nt, hsa
caagaccagacuggccaacauggugaaaccccgucucuacuaaaaaaaaaaaauagacaaaaau

SEQ ID NO: 162569 - RNA, 64 nt, hsa
ugagacccuccuggcuaacaccgugaaaccccgucucuacuaaaaauacaaaaaauuagccggg

SEQ ID NO: 162570 - RNA, 64 nt, hsa
cgagaccagccuggccaacacggugaaaccccaucucuacuaaaaaaaaauacaaaaauuagcc

SEQ ID NO: 162571 - RNA, 64 nt, hsa
ccuuucucuuugcuccccaaaauaaacugguuaucucuacuauuggauuuacaacauuguauua

SEQ ID NO: 162572 - RNA, 64 nt, hsa
caagaccagccuggccaacauggugaaaccccaucucuacuaaaaaaaaaaaaaaaauuagucg

SEQ ID NO: 162573 - RNA, 64 nt, hsa
caaaaccagccugaccaacauggugaaacccugucucuacuaaauauuagcggggugugguggc

SEQ ID NO: 162574 - RNA, 64 nt, hsa
agagaccaucauugcuaacauggugaaaccccgucucuacuaaaaauacaaaaaaaaaaaaaaa

SEQ ID NO: 162575 - RNA, 64 nt, hsa
cgagaccagccugaccaacauggagaaacccugucucuacuaaaaauacaaaauuagccaggcg

SEQ ID NO: 162576 - RNA, 64 nt, hsa
ucaagaccagcuuggccaaggugauaaaacccgucucuacuaauacaaaaaaaauuagcugggu

SEQ ID NO: 162577 - RNA, 64 nt, hsa
ccagaccagccuggccaacauggcgaaaccccaucucuacuaaaaauacaaaaauuagccgggc

SEQ ID NO: 162578 - RNA, 64 nt, hsa
cgagaccagccuggccaauauggugaaaccccaucucuacuaaaaauauaaaaaucagcaaaaa

SEQ ID NO: 162579 - RNA, 64 nt, hsa
ugagacccuccuggccaacauggugaaaccccgucucuacuaaaauacaaaaaauuagcugggc

SEQ ID NO: 162580 - RNA, 64 nt, hsa
caagaccacccugaccaacuuggugaaaucccaucucuacuaaaaauacaaaaauuagcugggu

SEQ ID NO: 162581 - RNA, 64 nt, hsa
aauauaaucccacaaaaccaacaauuuuauuugccucuacuacgucaggcagaauucuucaauu

SEQ ID NO: 162582 - RNA, 64 nt, hsa
cgagaccagccugaccaacauggagaaacuccaucucuacuaaaaauacaaaauuagccaggug

SEQ ID NO: 162583 - RNA, 64 nt, hsa
cgagaccauccugucuaacacggugaaaccccaucucuacuaaaaauacaaaaaaauuagucgg

SEQ ID NO: 162584 - RNA, 64 nt, hsa
caagaccagccuggccaacauggugaaaccccaucucuacuaaaaauacaaaaauuagcuaggc

SEQ ID NO: 162585 - RNA, 64 nt, hsa
caagaccagccuggccaacauggugaaaccccaucucuacuaaaaaauacaaaaauuagccagg

SEQ ID NO: 162586 - RNA, 64 nt, hsa
aagaccagccuggccaacaugaugagaccuccgucucuacuaaaauacauaaauuagccgggug

SEQ ID NO: 162587 - RNA, 64 nt, hsa
gcaaacaccccaucucuacuaagcgaaaacccaucucuacuaaaauuacaaaaauuagcugggc

SEQ ID NO: 162588 - RNA, 64 nt, hsa
caggaguucgggaccagccuggcaaacaccccaucucuacuaagcgaaaacccaucucuacuaa

SEQ ID NO: 162589 - RNA, 64 nt, hsa
ugagaccacccuggccaacauggugaaaccccaucucuacuaaaacaaaaauuagccaggcaug

SEQ ID NO: 162590 - RNA, 64 nt, hsa
cgagaccagccuggccaacauagugaaaccccaucucuacuaaaaauacagaaauuagccgggc

SEQ ID NO: 162591 - RNA, 64 nt, hsa
uaagaccagccuggccaacauggugaaauccugucucuacuaaaaauauaaaauuagcugggca

SEQ ID NO: 162592 - RNA, 64 nt, hsa
cagauuuuugcacgauaagaauagcagggaauuccucuacuacaggaagaagguggcugagaua

SEQ ID NO: 162593 - RNA, 64 nt, hsa
cgagaccauccuggccaacaugaugaaacccuaucucuacuaaaaauacaaaaauuagccgggc

SEQ ID NO: 162594 - RNA, 64 nt, hsa
ugagaccauccuggcuaacacggugaaaccccaucucuacuaaaaauacaaaaaccaaaaaaaa

SEQ ID NO: 162595 - RNA, 64 nt, hsa
caagagcacccuggcuaacauggugaaaccccaucucuacuaaaaauacaaaaguuagccgggg

SEQ ID NO: 162596 - RNA, 64 nt, hsa
cgagaccguccuggcuaacacggugaaaccccaucucuacuaaaaauauaaaauauuagccagg

SEQ ID NO: 162597 - RNA, 64 nt, hsa
caagaccagccuggccaacauggugaaaccccaucucuacuaaaaauacaaaaauuagcugggc

SEQ ID NO: 162598 - RNA, 64 nt, hsa
gagaacuggccuggccaacauagcaaaaccucaucucuacuaaaauacaaaaauuagccgggcg

SEQ ID NO: 162599 - RNA, 64 nt, hsa
cgagaccauccuggccaacauggugaaaccccgucucuacuaaaaauauaaaaauuagcugggu

SEQ ID NO: 162600 - RNA, 64 nt, hsa
agagaccagccuggccaacaaggcaaaaccccgucucuacuaaaaauaugaaaauuagcugggc

SEQ ID NO: 162601 - RNA, 64 nt, hsa
caaacuccugaccucaggugauccgcccaccucagccucccaaagugcugggaugacaggugug

SEQ ID NO: 162602 - RNA, 64 nt, hsa
ccgccucucagguucaagugguucuccuuccucagccucccaaguagcugggauuacaggcacc

SEQ ID NO: 162603 - RNA, 64 nt, hsa
ugcaguggugcaaucuuggcucacuguaaccuccgccucccagguucaagugauucuucugccu

SEQ ID NO: 162604 - RNA, 64 nt, hsa
cgaacuccugaccucaggugauccacccgccugagccucccaaagugcugggauuacaggcaug

SEQ ID NO: 162605 - RNA, 64 nt, hsa
caaacuccugaccucaagugaucugcccgccucggccucccaaagugcuggaaccacaggccug

SEQ ID NO: 162606 - RNA, 64 nt, hsa
ugcagugccgcaaucucggcucacugcaaccuccgccucccagguucaagcaauucuccugccu

SEQ ID NO: 162607 - RNA, 64 nt, hsa
caggaucucuuggccucaugaucagccugccucggccucccaaagugcugggauuacaggugug

SEQ ID NO: 162608 - RNA, 64 nt, hsa
ugcaguggcacaaucuuggcucagagcaaccucugccucccaggcucaagcaauccucccacuu

SEQ ID NO: 162609 - RNA, 64 nt, hsa
ugaacaccggggcucaaggaaucugcccaucuucgccucccaaaguucugagauagcaggugug

SEQ ID NO: 162610 - RNA, 64 nt, hsa
ccgccuccuggguucaagcaguucucuugccucagccucccaaguagcugggaugacaggcgca

SEQ ID NO: 162611 - RNA, 64 nt, hsa
cgaacuccugaccucaggugauccacccaccuuggccucccaaagugcugggauuacaggugug

SEQ ID NO: 162612 - RNA, 64 nt, hsa
ccucugccucccggguucaagccauucugccucagccucccaaguagcugggaguacaggcguc

SEQ ID NO: 162613 - RNA, 64 nt, hsa
cucgauauccugaucucgugauccgccugccucugccucccaaagugcugggauuacaggugug

SEQ ID NO: 162614 - RNA, 64 nt, hsa
ugaacuccuaaccucgggugauccacccaccuuggccucccaaaguguuaggauuacaggcaug

SEQ ID NO: 162615 - RNA, 64 nt, hsa
cuugaucucuugaccucgugauccguccaccucagccucccaaagugcugggauuacaggugug

SEQ ID NO: 162616 - RNA, 64 nt, hsa
uggacuccugaccucaggucauccuccugccucggccucccaaagugcugagacuacaggugug

SEQ ID NO: 162617 - RNA, 64 nt, hsa
caaacuccuggccucaggugauccucuugucucagccucccaaagugcugggauuacaggcaug

SEQ ID NO: 162618 - RNA, 64 nt, hsa
cugccucuuggguucaagcgauucuccugccucagccucccaaguagcugggauuacaggcaua

SEQ ID NO: 162619 - RNA, 64 nt, hsa
ugaacuccugaccucaaguaaucugcccaccucggccucccaaagugcuaggauuacaggagug

SEQ ID NO: 162620 - RNA, 64 nt, hsa
cugcccuccagguucaagugauucuccucccucagccucccaaguagcugggauuacaggcacc

SEQ ID NO: 162621 - RNA, 64 nt, hsa
cgaauuccagaccucaggugauccacccgccucggccucccaaagugcugggauuacaggugcg

SEQ ID NO: 162622 - RNA, 64 nt, hsa
gugcaguggugcuaucuuggcucacugcaaacccgccucccagguuuaagcgauucucaugccu

SEQ ID NO: 162623 - RNA, 64 nt, hsa
ccgccucccagguuuaagcgauucucaugccucagccucccaguagcugggauuagaggcaugu

SEQ ID NO: 162624 - RNA, 64 nt, hsa
cgaacuucuggccucuagcgaucugcccgccucggccucccaaagugcugggaugaccagcauc

SEQ ID NO: 162625 - RNA, 64 nt, hsa
caaauuccuacuucgacauaugucuuuucaaaaagccucccagacacaagacaucuuaaccguc

SEQ ID NO: 162626 - RNA, 64 nt, hsa
cuaccucccagguucaagcuauucuacugccucagccucccaaguagcugggguuacaggcauu

SEQ ID NO: 162627 - RNA, 64 nt, hsa
cugccuccugggcucaagcaauccucccacuucagccucccaaauagcuggggcuaccauggua

SEQ ID NO: 162628 - RNA, 64 nt, hsa
caaacuccuggccucaugugaucugcccaccucagccucccaaaguacagggauuagaguugug

SEQ ID NO: 162629 - RNA, 64 nt, hsa
uugaacuccugaccucaagugauccaccaccucggccucccaaaguguugagaugacaggcacg

SEQ ID NO: 162630 - RNA, 64 nt, hsa
ugcaguggccugaucucggcucacugcaaccucugccucccagguucaagcgauucuucugccu

SEQ ID NO: 162631 - RNA, 64 nt, hsa
cgaacuccugaccucaggugauccgcccgccucggccucccaaagugcugggauuacaggcgug

SEQ ID NO: 162632 - RNA, 64 nt, hsa
ccaccucccggguucaagugauucuccugccucagccucccaaguagcugggauuacaggcacc

SEQ ID NO: 162633 - RNA, 64 nt, hsa
cugcaguugcagggggcgccauggggcuauaggagccucccacuuucaccagagcagccucacu

SEQ ID NO: 162634 - RNA, 64 nt, hsa
auccccagucuaccuccuuccuucuacccucacugccucccagucaggagagugagcucucaga

SEQ ID NO: 162635 - RNA, 64 nt, hsa
ugaacuccugaccucaggugaucugcccgucucggccucccaaagugcugggauuaccggcaug

SEQ ID NO: 162636 - RNA, 64 nt, hsa
guaaaauggugcgaucucggcucacugcaccuccgccucccagguucaagcgauuuuccugccu

SEQ ID NO: 162637 - RNA, 64 nt, hsa
ucccaccccgcugccugggcccugugguugcugggccucccaccucaaggaggggaagguugua

SEQ ID NO: 162638 - RNA, 64 nt, hsa
ucgggaucggguccccagagccaccaucuccugagccucccaccccgcugccugggcccugugg

SEQ ID NO: 162639 - RNA, 64 nt, hsa
aaacagaaccuccaggcugacgaggcaagacaaagccucccaccagacuuggagauugaaguuc

SEQ ID NO: 162640 - RNA, 64 nt, hsa
cucgaacuccugaccucaugauccacccaccucagccucccaaagugcugggauuacaggugug

SEQ ID NO: 162641 - RNA, 64 nt, hsa
ugaacuccuggacucaagcaaccuacccagcguggccucccaaagugcugggauuacagacacg

SEQ ID NO: 162642 - RNA, 64 nt, hsa
ugcaguggcgcauucuaggcucacugcaacuucugccucccaugcuuacgugauccucucaccu

SEQ ID NO: 162643 - RNA, 64 nt, hsa
ugaacuccuggccucaagugguccuccugccucagccucccaaaguguggggauuacaggugcg

SEQ ID NO: 162644 - RNA, 64 nt, hsa
cgaacuccuaaccucaagugauccacccgccucagccucccaaagugcugggauuacaggugug

SEQ ID NO: 162645 - RNA, 64 nt, hsa
ugcuguggugugaucuuagcucacugcaaccuccgccucccagguucaagcaauuuuccugccu

SEQ ID NO: 162646 - RNA, 64 nt, hsa
cucgaacuccugaccucguaaucugcccaccucggccucccaaaguucugggauuacaggugug

SEQ ID NO: 162647 - RNA, 64 nt, hsa
ugcagugacgcgaucucgacucacugcaaccuccgccucccagguucaagcgauucuccugcuu

SEQ ID NO: 162648 - RNA, 64 nt, hsa
cucgaucuccugaccucgugauccgccugccucugccucccaaagugcugggauuacaggcgug

SEQ ID NO: 162649 - RNA, 64 nt, hsa
ugcaguggcgcaaucucggcucacugcaaccuccgccucccagguugacaccauucuccugccu

SEQ ID NO: 162650 - RNA, 64 nt, hsa
auggagaacaagcaaaguaugcaggcccccugcagccucccaggacaggcuggcaagggaggag

SEQ ID NO: 162651 - RNA, 64 nt, hsa
ccugcuggaugcuguucgugccugucccugcucugccucccacccaguugccugaaucauccca

SEQ ID NO: 162652 - RNA, 64 nt, hsa
ugcaauggcgcaaucucgacucaccacaaccuccgccucccagguucaagcaauucuccugccu

SEQ ID NO: 162653 - RNA, 64 nt, hsa
ugaacuccugaccucaggugauccgccugccucggccucccaaagugcugggauuacaggcaua

SEQ ID NO: 162654 - RNA, 64 nt, hsa
ugaacuccuggccucaagcaauccucucuccucagccucccaaagugcugggauuacaagugug

SEQ ID NO: 162655 - RNA, 64 nt, hsa
caaacuccuggguucaagcaauccucccaccucggccucccaaagugcugggauugcaggcaug

SEQ ID NO: 162656 - RNA, 64 nt, hsa
cucuucuaccuccugcaacccacccauccuauuagccucccacauucaaggcccgugauacagg

SEQ ID NO: 162657 - RNA, 64 nt, hsa
cucgaucuccucaccucgugauccgcccgccucggccucccaaagugcugggauuacaggcaug

SEQ ID NO: 162658 - RNA, 64 nt, hsa
cugcaacccccagagcucuuugacaggcucccaggccucccaguccuggacaagcaugugcagu

SEQ ID NO: 162659 - RNA, 64 nt, hsa
agcucagcucaggccagggcugggcugugcaccugccucccacugacccagacccacuuccucc

SEQ ID NO: 162660 - RNA, 64 nt, hsa
cugccucccggguucaagcgauucuccugccccagccucccauauagcugggauuauaggugcc

SEQ ID NO: 162661 - RNA, 64 nt, hsa
caaacuccuaggcuuaagugauccucccgccuuagccucccaagugcuaggauuacaggcauca

SEQ ID NO: 162662 - RNA, 64 nt, hsa
ugcaguggcgugaucuuggcucacugcaaccucugccucccagcuucaagcgauucuccuguau

SEQ ID NO: 162663 - RNA, 64 nt, hsa
cugccucccagcuucaagcgauucuccuguaucagccucccaaguagcugggauuauaggcaug

SEQ ID NO: 162664 - RNA, 64 nt, hsa
cugccucccggauucaagugauucuccugucucagccucccaaguagcugggauuacagugccu

SEQ ID NO: 162665 - RNA, 64 nt, hsa
cucgaacuccugaccucaugagccgcccgccuuggccucccaaagugcugggacgugacaggag

SEQ ID NO: 162666 - RNA, 64 nt, hsa
uaaacuccugggcucaagugaucccccugccuuggccucccaaacuggugagauuacaggcaug

SEQ ID NO: 162667 - RNA, 64 nt, hsa
cauggcucacugaagucuugaccccgcugccucagccucccaaauaacuggggccacaggugug

SEQ ID NO: 162668 - RNA, 64 nt, hsa
cgaacucgugaccgcaggugauccucccgccucggccucccaaagugcugggauuacaggcaug

SEQ ID NO: 162669 - RNA, 64 nt, hsa
acaauggcgugaucucggcucacugcaaaucuccgccucccagguucaagcgauucuccugccu

SEQ ID NO: 162670 - RNA, 64 nt, hsa
caaacucuugacuucaagugauccgcccgccucagccucccaaagugcugggauuacaggugug

SEQ ID NO: 162671 - RNA, 64 nt, hsa
ccaccuccuggguucaagugauucuugugccucagccucccaaguagcugggauuaaaggcacg

SEQ ID NO: 162672 - RNA, 64 nt, hsa
caaacuccugacuucaggugaucugucugccucggccucccaaagagcugagauuacaggcgug

SEQ ID NO: 162673 - RNA, 64 nt, hsa
ucaccuccugaguucaagccauucuccuaccucagccucccaaguagcugggacuaugggugca

SEQ ID NO: 162674 - RNA, 64 nt, hsa
caaacucccgaucucaggugaucugcccgccucggccucccaaagugcugggauuacaggcaug

SEQ ID NO: 162675 - RNA, 64 nt, hsa
gagacuggcgcaaucuuggcucaccgcaaccuccgccucccagguucaagcaauucuccugcuu

SEQ ID NO: 162676 - RNA, 64 nt, hsa
cgaacuccugaccucaagcgauccacccaccucggccucccaaagugcugggauuacaggcgug

SEQ ID NO: 162677 - RNA, 64 nt, hsa
ugcaguggcgccaucuuggcucacugcaaccucugccucccagguucaagcgauucuccugccu

SEQ ID NO: 162678 - RNA, 64 nt, hsa
ccucccccuggguugaagcaauucucaugccucagccucccaaguagccaggacuauaggcacc

SEQ ID NO: 162679 - RNA, 64 nt, hsa
cucgaucucuugaccuugggauccacccgccuuggccucccaaagugcugggauuacaggugug

SEQ ID NO: 162680 - RNA, 64 nt, hsa
ggaaacccuuggcucaagcaauuugccugccucagccucccaaagugcugggauuacaggcgug

SEQ ID NO: 162681 - RNA, 64 nt, hsa
ccaccuccuggguucaugccauucuucugccucagccucccaaguagcugggacuacaggugcc

SEQ ID NO: 162682 - RNA, 64 nt, hsa
cucgaucuccugaccuugugauccaccugucucggccucccaaagugcugggauuacaggccuc

SEQ ID NO: 162683 - RNA, 64 nt, hsa
ugcaguggugugaucuugggucacugcaaacuccgccucccagguucacgccauucuccugccu

SEQ ID NO: 162684 - RNA, 64 nt, hsa
cucgaucuccugaccucaugauccgcccgccucggccucccaaagugcugggauuacaggcgug

SEQ ID NO: 162685 - RNA, 64 nt, hsa
caacuccuggacuuaacgccauccaccugccacagccucccaaagugcuaggaauacaggagug

SEQ ID NO: 162686 - RNA, 64 nt, hsa
uccgccuccugggucaaaugauucuccugcuuuagccucccaaguagcugggacuacaggugua

SEQ ID NO: 162687 - RNA, 64 nt, hsa
caaacuccugagcucaagugauccucccgucucagccucccaaagggcugagauuacaggugug

SEQ ID NO: 162688 - RNA, 64 nt, hsa
ugcaguggcaugaucucggcucacugcaagcuccgccucccagguucaugccauucuccuaccu

SEQ ID NO: 162689 - RNA, 64 nt, hsa
caaacuccugagcucaaaugauccuccugccuuggccucccaaagugcuggaauuacaggcaug

SEQ ID NO: 162690 - RNA, 64 nt, hsa
ugcaauggcgcgaucucagcucacugcagccacugccucccagguucaagugauucuccugccu

SEQ ID NO: 162691 - RNA, 64 nt, hsa
auguucgacaggcuggucucgaacucccaccucagccucccaaacugcugggauuacaggugug

SEQ ID NO: 162692 - RNA, 64 nt, hsa
caaccuccccggcucaagugauccuccugccucagccucccaaguagcugggacuacaggcguu

SEQ ID NO: 162693 - RNA, 64 nt, hsa
cgaacuccuggacucaaaguauccucccgccucggccucccaaaguguugggauuauaggagug

SEQ ID NO: 162694 - RNA, 64 nt, hsa
ugcaguggcaugaucucggcuuacugcaaccuuugccucccagguucaagcgauucuucugccu

SEQ ID NO: 162695 - RNA, 64 nt, hsa
ugcuaccucuaccaugagcaauucuccugccucagccucccaaguagcuggaacuacaggcuca

SEQ ID NO: 162696 - RNA, 64 nt, hsa
uucaaacuccugacuuugugauccacccgccucggccucccaaagugcugggauuacaggcaug

SEQ ID NO: 162697 - RNA, 64 nt, hsa
cucgaucuccugaccucgugauccacccgccucggccucccaaagugccgggauuacaggcgug

SEQ ID NO: 162698 - RNA, 64 nt, hsa
ugcaguggcaugaucucggcucacugcaagcuccgccucccagguucaugccauucuccugccu

SEQ ID NO: 162699 - RNA, 64 nt, hsa
cucgaucuccugacgucgugauccacccgccucggccucccaaaaugcugggauuacaggugug

SEQ ID NO: 162700 - RNA, 64 nt, hsa
caaacuccugggcucaagcaauccacccaccucugccucccaaagugcugggauuacaggcgug

SEQ ID NO: 162701 - RNA, 64 nt, hsa
caaccuccugggcucaagcaauccuccugccucggccucccaaagugcugggauuacagaugug

SEQ ID NO: 162702 - RNA, 64 nt, hsa
cugccuccugggcucaagcaauucucccaccucagccucccaaauagcugggaucacuggcaca

SEQ ID NO: 162703 - RNA, 64 nt, hsa
cugccucccagguucaagugguucuccugccucagccucccaaguagcugggauuauaggugug

SEQ ID NO: 162704 - RNA, 64 nt, hsa
ugcgguggcgcgaucuuggcuuacugcacccucugccucccagguucaagugguucuccugccu

SEQ ID NO: 162705 - RNA, 64 nt, hsa
cuugaucuccugaccucaugaucugccugccucagccucccaaagugcugggauuacaggcuug

SEQ ID NO: 162706 - RNA, 64 nt, hsa
uggaguacaguggugcaaucucacugcaagcucugccucccagguucacaccauucuccugccu

SEQ ID NO: 162707 - RNA, 64 nt, hsa
cucgaacucuggguucaagaaauccucccaccuugccucccaaagugcugggauuacaggugug

SEQ ID NO: 162708 - RNA, 64 nt, hsa
cugccuucuggauucaagugauucuugugccuuagccucccaaguagcugggauuacaggcgug

SEQ ID NO: 162709 - RNA, 64 nt, hsa
ccgccucccagguucaagcaauucuccugccucagccucccaaguaggugggacuacaggugcc

SEQ ID NO: 162710 - RNA, 64 nt, hsa
ugcaauggcgugaucucggcucaccgcaaccuccgccucccagguucaagcaauucuccugccu

SEQ ID NO: 162711 - RNA, 64 nt, hsa
ugaacuccugaccucaggugauccaccugccucagccucccaaagugcugggauuacaggcaug

SEQ ID NO: 162712 - RNA, 64 nt, hsa
cugccucccgaguucaagcaauucuccugccucagccucccaaguagcugggacuacaggugca

SEQ ID NO: 162713 - RNA, 64 nt, hsa
cucgaucuccugaccucgugaucccccugccucggccucccaaagugcugggauuacaggcgug

SEQ ID NO: 162714 - RNA, 64 nt, hsa
ccggcgggggccgcagacugggagcucccgguccgccucccagcaucccugcgagcguucaugg

SEQ ID NO: 162715 - RNA, 64 nt, hsa
ugaacuccuggccacaagugaucugcccgccuuggccucccaaagugcugggauuacaggcgua

SEQ ID NO: 162716 - RNA, 64 nt, hsa
gugcagugggccgucucaguucacugcagccuccgccucccagguucaagugauucucaugccu

SEQ ID NO: 162717 - RNA, 64 nt, hsa
cgaacuccugaccucaggugaucugcccaccuuggccucccaaagugcugggauuacaggcaug

SEQ ID NO: 162718 - RNA, 64 nt, hsa
acccgaagcccagcuggggcccugguccagccucgccucccagacucugcaccugcuagcacag

SEQ ID NO: 162719 - RNA, 64 nt, hsa
ugaacuccugaccucaacugauccgcccaccuuggccucccaagugcugggauuacaggcgcga

SEQ ID NO: 162720 - RNA, 64 nt, hsa
ccaccuccuggguucaagcauuucuccugccucagccucccaaguagcugggauuacaggcagc

SEQ ID NO: 162721 - RNA, 64 nt, hsa
caaacuccugaccucaagugauccgcccuccccagccucccaaagugcugggauuacaggugug

SEQ ID NO: 162722 - RNA, 64 nt, hsa
ugcaguggcgcaaucucgggucacugcaagcucugccucccaaguucaugccauucuccugccu

SEQ ID NO: 162723 - RNA, 64 nt, hsa
cugccucccaaguucaugccauucuccugccucagccucccaaguagcugggacuacaggcacc

SEQ ID NO: 162724 - RNA, 64 nt, hsa
ggucuugaucugaccucgugauccgccgaccucggccucccaaagugcuggaauuacaggcgug

SEQ ID NO: 162725 - RNA, 64 nt, hsa
uguucuaguuuugguuccuuuugcagagugaaaugccucccaggaaaaaaauacauauguauuu

SEQ ID NO: 162726 - RNA, 64 nt, hsa
cgagcuccugggcucaagugauccucccaccucagccucccaaagugcugggauuacaggugug

SEQ ID NO: 162727 - RNA, 64 nt, hsa
ugugguggcacagucucagcucacugcaaccucugccucccaguucaagcaauucuucugccuc

SEQ ID NO: 162728 - RNA, 64 nt, hsa
ucugccucccaguucaagcaauucuucugccucagccucccaaguagcugggauuacaggcacc

SEQ ID NO: 162729 - RNA, 64 nt, hsa
caaacuucugaccucaagugaucugcccaccuuggccucccaaagugcugggauuacaggugua

SEQ ID NO: 162730 - RNA, 64 nt, hsa
ccaccucccagguucaagcaauucuucugccucagccucccaaguagcugggauuacaggugcc

SEQ ID NO: 162731 - RNA, 64 nt, hsa
caaacuccugaccucaagugauccaccugccucagccucccaaagugcugggauuauagucgug

SEQ ID NO: 162732 - RNA, 64 nt, hsa
cuugaucucuugaccucgugaucugccugccucggccucccaaagugcuggcauuacaggcaug

SEQ ID NO: 162733 - RNA, 64 nt, hsa
ccaccucccggguucaagugauucucuggccucagccucccaaguagcugggacuacaggugug

SEQ ID NO: 162734 - RNA, 64 nt, hsa
caaacuccugaccuccagugaucugcccaccucggccucccaaagugcugggauuacaggugug

SEQ ID NO: 162735 - RNA, 64 nt, hsa
cucaaucuccugaccuugugaaccacccgucucggccucccaaagugcugggauuacaggugug

SEQ ID NO: 162736 - RNA, 64 nt, hsa
cugcuucccagguucacgccauucuccuggcucagccucccaaguagcugggacuacaggcacc

SEQ ID NO: 162737 - RNA, 64 nt, hsa
cucaaucucuugaccucgugaucugccugccuuggccucccaaagugcugggauuacaggugug

SEQ ID NO: 162738 - RNA, 64 nt, hsa
gcacaaucucggcucucggcucacugcaaccucugccucccagguucaagcgauucuccugccu

SEQ ID NO: 162739 - RNA, 64 nt, hsa
gaaacccuugagcucaagugaucuucccacaccagccucccaaaauacugggauuacaggcuug

SEQ ID NO: 162740 - RNA, 64 nt, hsa
ugaccuccuugacucaauugauccucccaucucagccucccaaguagcuaggacuacagacaug

SEQ ID NO: 162741 - RNA, 64 nt, hsa
ugaacucccaaccucaggugauccacccuccucagccucccaaagugcugggauuacaggcaug

SEQ ID NO: 162742 - RNA, 64 nt, hsa
ugcauuggcgcgaucucggcucaccgcaaaguccgccucccaggcgauucuccugccucagccu

SEQ ID NO: 162743 - RNA, 64 nt, hsa
guuggccucgaacucaggugaucugccagccuccgccucccaacgugcugggauuacaggcaug

SEQ ID NO: 162744 - RNA, 64 nt, hsa
cugcuuccuggguucaaacaauucucaugccucagccucccaagcagcugggacuacaggcaug

SEQ ID NO: 162745 - RNA, 63 nt, hsa
ucgaucuccugaccucaugauccacccgccucagccucccaaaguguugggauuacaggcgug

SEQ ID NO: 162746 - RNA, 64 nt, hsa
cugccuccuggguucaagcgauucuccugccucugccucccaaguagcugggauuacaggcacc

SEQ ID NO: 162747 - RNA, 64 nt, hsa
ccaccuuccugguucaagggauucuccugccucagccucccaaguagcugggauuacaggcaug

SEQ ID NO: 162748 - RNA, 64 nt, hsa
cgaacuucugaccucaggugaucugcccaccucggccucccaaagugcugggauuacaggcgug

SEQ ID NO: 162749 - RNA, 64 nt, hsa
ugcagugguaugaucucggcucacuguaaccuccgccucccagguucaggugauucuccugccu

SEQ ID NO: 162750 - RNA, 64 nt, hsa
cucgaacuccugaccucgugauccgccugccucagccucccaaagugcugggauuacaggcaug

SEQ ID NO: 162751 - RNA, 64 nt, hsa
ggaacuccugggcucaagugauccuccugccuuggccucccaaaaugcugggauuacaggcaug

SEQ ID NO: 162752 - RNA, 64 nt, hsa
ccgccucccggguucaagcaauucuccugccucagccucccaaguagcugggauuacagguguc

SEQ ID NO: 162753 - RNA, 64 nt, hsa
cgaacuccugaccucaggugauccacccgccucagccucccaaagugcugggauuacaggcaaa

SEQ ID NO: 162754 - RNA, 64 nt, hsa
cucgaacuccugaccuugugaugcucccaccucggccucccaaagugcugggauuaaagcugug

SEQ ID NO: 162755 - RNA, 64 nt, hsa
cucgaucuccugaccucaugauccucccgccucagccucccaaaaugcugggauuacaggcgug

SEQ ID NO: 162756 - RNA, 64 nt, hsa
cugccuccugggcucaacggauccuuccaccucagccucccaaguagcuuggacuauaggugca

SEQ ID NO: 162757 - RNA, 64 nt, hsa
ugaacuccugggcucaagccauccucccuccucagccucccaaaauucugggauuacaggcaua

SEQ ID NO: 162758 - RNA, 64 nt, hsa
ugcaguggcgcgaucucagcucacugcaaccuccgccucccagguucaagcgauucuccugccu

SEQ ID NO: 162759 - RNA, 64 nt, hsa
gucuaucucuugaccucgugauccaccccacucagccucccaaauugcugggauuuacaggcau

SEQ ID NO: 162760 - RNA, 64 nt, hsa
uuuaaacucuugaccucauguuccacccgccacggccucccaaagugcugugauuaccggugug

SEQ ID NO: 162761 - RNA, 64 nt, hsa
uuaacuucugagcucaagagaugcacuccccucagccucccaaagugcugggauuacaggcggc

SEQ ID NO: 162762 - RNA, 64 nt, hsa
caacugauguuuguuuuuuaaaggguaagaugcugccucccaaugggugaugccaucugacugg

SEQ ID NO: 162763 - RNA, 64 nt, hsa
ccaccucccagguucaagugauucuccugucucagccucccaaguagcugggacuacaggcaug

SEQ ID NO: 162764 - RNA, 64 nt, hsa
uggacuccugguuucaagugauccucucaucuuggccucccaaagugcugggauuacagggacg

SEQ ID NO: 162765 - RNA, 64 nt, hsa
ggucucgaacucgaccucgugauccgccgccucggccucccaaagugcuaggauuacaggcgug

SEQ ID NO: 162766 - RNA, 64 nt, hsa
ugaccaaucaguggcccaaauuuuccagccccuugccucccagaaccccagcccagaacucuuc

SEQ ID NO: 162767 - RNA, 64 nt, hsa
caaacuucugaucucaagugauccaucugccuuggccucccaaagugcugggauuacaggcaug

SEQ ID NO: 162768 - RNA, 64 nt, hsa
ugaacuccuggucucgagugaucuuccuaucucagccucccaaagugcugggacuacaggcaug

SEQ ID NO: 162769 - RNA, 64 nt, hsa
ccaacuccugggcucaagcaauccugcugucucagccucccaaguaacuaagacuacaggcaug

SEQ ID NO: 162770 - RNA, 64 nt, hsa
ugaacuccugaccucaagugaucuuccggccucagccucccaaagugcuggauuacaggcguga

SEQ ID NO: 162771 - RNA, 64 nt, hsa
ucuuggcucauugcaaccucugccucccaggucagccucccaaguagcugggauuacaccacca

SEQ ID NO: 162772 - RNA, 64 nt, hsa
ugcaguggcacuaucuuggcucauugcaaccucugccucccaggucagccucccaaguagcugg

SEQ ID NO: 162773 - RNA, 64 nt, hsa
ccgccucccagguucaagcgauucuccugccucagccucccaauuuacugggauuacaggcacc

SEQ ID NO: 162774 - RNA, 64 nt, hsa
ugcaguggcacgaucucggcucacuacaaccuccgccucccagguucaagcgauucuccugccu

SEQ ID NO: 162775 - RNA, 64 nt, hsa
ugaacuccugaccucaagugauucaccugccucggccucccaaagugcugggauuacaggcgug

SEQ ID NO: 162776 - RNA, 64 nt, hsa
cuaccuccuggguucaagcaagucuccugucucagccucccaaguagcugggauuacaggcaug

SEQ ID NO: 162777 - RNA, 64 nt, hsa
gaacuuccugaccucagguuauccacccaccucagccucccaaagugcugggauuacaggugug

SEQ ID NO: 162778 - RNA, 64 nt, hsa
ccaccuccuggguucaagugauucucgugccucagccucccaaguagcugggguuacaggcgcc

SEQ ID NO: 162779 - RNA, 64 nt, hsa
cucaaucuccugaccucgugauccacccgccuuggccucccaaagugcugggauuacaggcgug

SEQ ID NO: 162780 - RNA, 64 nt, hsa
uacaguggcgcgaucucagcucacugcaagcuccgccucccaaguucacuccauucuccugccu

SEQ ID NO: 162781 - RNA, 64 nt, hsa
caaacuccugaccucaggugauccacuugccucggccucccaaagugcugagauuacaagugug

SEQ ID NO: 162782 - RNA, 64 nt, hsa
ccaccuccuggguucaagcgauucuucugccucagccucccaaguagcuaggauuacaagugcc

SEQ ID NO: 162783 - RNA, 64 nt, hsa
ugaacucccgaccucaggugauccacccaccccggccucccaaaaugcugggaucacaggcgug

SEQ ID NO: 162784 - RNA, 64 nt, hsa
caaacuccuaggcucaggcgauccucuugcccuggccucccauguagcugcaacuauaggugug

SEQ ID NO: 162785 - RNA, 64 nt, hsa
gaacuccugggcucagaugauccuccuguccucagccucccaaaaugcugggagccaccaggca

SEQ ID NO: 162786 - RNA, 64 nt, hsa
gugaugcgauugaucauggcucacuguaaccucugccucccaggcucgauccucccaugucagc

SEQ ID NO: 162787 - RNA, 64 nt, hsa
accucugccucccaggcucgauccucccaugucagccucccaaguagcugggacuacaugcaca

SEQ ID NO: 162788 - RNA, 64 nt, hsa
ugcagugaugcuaucucggcucacugcaaccuuugccucccagguucaagugauucuccugccu

SEQ ID NO: 162789 - RNA, 64 nt, hsa
uugccucccagguucaagugauucuccugccucagccucccaaguagcugggauuacaggcgug

SEQ ID NO: 162790 - RNA, 64 nt, hsa
cgaacucccgaccucaggugauccgccagccucagccucccaaagugcugggauuacaggcgug

SEQ ID NO: 162791 - RNA, 64 nt, hsa
caaccuucccagcucaagugauccuccuaccucagccucccaaguaguugggaccacaggugug

SEQ ID NO: 162792 - RNA, 64 nt, hsa
cagacugcugggcucaagcgauccucacaccucagccucccagagugcugggauuacaguugug

SEQ ID NO: 162793 - RNA, 64 nt, hsa
caaauuccugaccucaagugauccaccugccuuagccucccaaagugcugggauuacaggcaug

SEQ ID NO: 162794 - RNA, 64 nt, hsa
ugcaguggugcgaucuuggcucauggcaaccucugccucccagguucaagcgauuguccugccu

SEQ ID NO: 162795 - RNA, 64 nt, hsa
cucgaucucuugaccuuguguuccacccgccuuggccucccaaagugcuggaauuacaggcaug

SEQ ID NO: 162796 - RNA, 64 nt, hsa
cugccuccuggauucaagcgauucuccugucccagccucccagguagcugggacuauaggcacg

SEQ ID NO: 162797 - RNA, 64 nt, hsa
cuagaucuccugaccuugugaucugccugccucggccucccaaagugcugggauuacaggcgug

SEQ ID NO: 162798 - RNA, 64 nt, hsa
cugacuccaggguucaggugauuauuuugccucagccucccaagcagcugggauuauagacacc

SEQ ID NO: 162799 - RNA, 64 nt, hsa
ugaacuccugaccucaggugauccgcccgccucggccucccaaagugcugggauuacagacgug

SEQ ID NO: 162800 - RNA, 64 nt, hsa
ugaacuccuggccucaagcgauccgccuaccucagccucccaaagugcuaggauuacaggcaua

SEQ ID NO: 162801 - RNA, 64 nt, hsa
ccuccuccuggauucaagcaauucucuugcuucagccucccaaguagcugagacuacaagcacc

SEQ ID NO: 162802 - RNA, 64 nt, hsa
gucgaucuccugaccucgugauccacccgccucggccucccaaagugcugggauuacaggcuug

SEQ ID NO: 162803 - RNA, 64 nt, hsa
caaacuccugaguucaagcaauccaccuuccucggccucccaaaguacuaggaguacaggcaua

SEQ ID NO: 162804 - RNA, 64 nt, hsa
caacgucccccgcucaggugguccuuccaccucagccucccaaguagcugggaccacaagugug

SEQ ID NO: 162805 - RNA, 64 nt, hsa
cgagcuccugaccucaggugaucuacccaccucggccucccaaagugcugggauuacaggcgug

SEQ ID NO: 162806 - RNA, 64 nt, hsa
ugcaauggugcaaucucagcucacugcaaccucugccucccagguucaggugauucuccugccu

SEQ ID NO: 162807 - RNA, 64 nt, hsa
cucgaacuccugaccuugugaucugcccaccuuggccucccaaaguucagggauuacaggcaug

SEQ ID NO: 162808 - RNA, 64 nt, hsa
ugcaauggcacgaucucggcucacugcaaccuccgccucccagguucaagugauucuccugucu

SEQ ID NO: 162809 - RNA, 64 nt, hsa
cucgaucuccugaccuugugaucugcccgccucggccucccaaagugcugggauuacaggcgug

SEQ ID NO: 162810 - RNA, 64 nt, hsa
cucgaucuccuaaccuggugauccgcccgccucggccucccaaaguauugggauuacccgcgug

SEQ ID NO: 162811 - RNA, 64 nt, hsa
ccgccucucggguucacgccauucuccugccucagccucccaaguagcucggacuacaggcguc

SEQ ID NO: 162812 - RNA, 64 nt, hsa
ugaauuccugaccucaggugaucugcccaccucagccucccaaagugcugggauuacaggcgug

SEQ ID NO: 162813 - RNA, 64 nt, hsa
gccaaccagccacuggcuuuccugcccaggcuuggccucccaggacaucuggccugaggggauu

SEQ ID NO: 162814 - RNA, 62 nt, hsa
ccaggaaagauuauaccuagugacucggcucugccucccaguccgcacaccucucccaucca

SEQ ID NO: 162815 - RNA, 64 nt, hsa
agacuauuuuuaaacacacaccucuaaggaagaagccucccauauagacuugaucucaaagaag

SEQ ID NO: 162816 - RNA, 64 nt, hsa
cucgaucuccugaccucgugauccgcccaccuuggccucccagagugcugggauuacaggcgug

SEQ ID NO: 162817 - RNA, 64 nt, hsa
cgaacuccugaccacagguaaucagcccgccucggccucccaaagugcugggauuacaggcgug

SEQ ID NO: 162818 - RNA, 64 nt, hsa
ggucuugaacugaccucaugauccaccugccucagccucccaaaaugcugggauuacaggcuug

SEQ ID NO: 162819 - RNA, 64 nt, hsa
caaacuccugaccucaggugguccuucugccuuggccucccaaagugcugggauuacaggcgug

SEQ ID NO: 162820 - RNA, 64 nt, hsa
cucgaucuccugaccucgugaucugcccgccucagccucccaaagugcugggauuacaggagug

SEQ ID NO: 162821 - RNA, 64 nt, hsa
ugcaauggcgugaucucagcucaccgcaaccucugccucccagauucaagcaauucuccugccu

SEQ ID NO: 162822 - RNA, 64 nt, hsa
caaacucccaaccucaggugauaugcccgccucggccucccaaaauguugggauuacaggcaug

SEQ ID NO: 162823 - RNA, 64 nt, hsa
uuuuuuuuuuauuuugagcaauucuccugccucagccucccaaauagcugggauuacaggugca

SEQ ID NO: 162824 - RNA, 64 nt, hsa
caaacuccugaccucagaugauccgccugccuuggccucccaaagugcugggauuacaggugug

SEQ ID NO: 162825 - RNA, 64 nt, hsa
ucaggcggaggugaccaugcccuucaccaaagcugccucccaguggccacacagaacucucccu

SEQ ID NO: 162826 - RNA, 64 nt, hsa
ggcagaugaaugucuugaaagcucccgggccucagccucccaucuccucuccuucccaggaauc

SEQ ID NO: 162827 - RNA, 64 nt, hsa
ugaacuccugaccucaggugauacacccaucucggccucccaaagugcugggauuacaggcuug

SEQ ID NO: 162828 - RNA, 64 nt, hsa
auacaggcuggccucaagugauccucuuaccuuggccucccaaacaccgggauuauaggcguga

SEQ ID NO: 162829 - RNA, 64 nt, hsa
ugaacucccgacgucaggugaucuaccugccucggccucccaaagugcugggauuacaggcgug

SEQ ID NO: 162830 - RNA, 64 nt, hsa
cuuggacuccugaccucgugauccacccaccuuggccucccaaaguucuaggauuacaggugug

SEQ ID NO: 162831 - RNA, 64 nt, hsa
cuugaucuccugaccuugugauccgccugccucagccucccaaagugcugggauuacaggcuug

SEQ ID NO: 162832 - RNA, 64 nt, hsa
ugcaguggcgcggucucggcucacugcaagcucugccucccagguucacgccauucuccugccu

SEQ ID NO: 162833 - RNA, 64 nt, hsa
cuugaacuccugaccucgugauccacccgccuuggccucccaaagugcugggauuacaggcaug

SEQ ID NO: 162834 - RNA, 64 nt, hsa
ucugccucccggguucaagcaauucucugccucagccucccaaguaguugggauuacaggcacc

SEQ ID NO: 162835 - RNA, 64 nt, hsa
ugaacuccucaccucaggugauccacaugacucugccucccaaagugcugccauuacaggcgug

SEQ ID NO: 162836 - RNA, 64 nt, hsa
ugcaguggcaugaucucggcucacugcaaccucugccucccagguucaagcgauucuccugccu

SEQ ID NO: 162837 - RNA, 64 nt, hsa
uaaggaguccuucuacagaauaggucagaucuuggccucccaaaccccuuauuuuuaaaauacu

SEQ ID NO: 162838 - RNA, 64 nt, hsa
caaacuccugagcucaggcaaucugcccgccuuggccucccaaagugcuaggauuacagguaug

SEQ ID NO: 162839 - RNA, 64 nt, hsa
cgaacuccugaccucaagugauccacccaccucggccucccaaagugcuaggauuacaggcccg

SEQ ID NO: 162840 - RNA, 64 nt, hsa
cugccucuuggguucaagugauucuuccaccucagccucccagguagcugggauuacaggcacc

SEQ ID NO: 162841 - RNA, 64 nt, hsa
gaccaccgggugacauccgucccacaucagggcggccucccaggucccauaaggguagcccccu

SEQ ID NO: 162842 - RNA, 64 nt, hsa
cucgaucuccugaccucgugaugggcccgccucggccucccaaagugcugggauuaaggcguga

SEQ ID NO: 162843 - RNA, 64 nt, hsa
ccgccucccggguucacgccauucuccugccucagccucccauagcugggacuacaggcgcccg

SEQ ID NO: 162844 - RNA, 64 nt, hsa
gcuuugaaugcuggaaauggcuucauagugaagugccucccacagggcgggugggucagcguug

SEQ ID NO: 162845 - RNA, 64 nt, hsa
cugacuccugacuaaaagugaucugcccaccucggccucccaaaguucugggauuacgggcgug

SEQ ID NO: 162846 - RNA, 64 nt, hsa
ccuccaccucccaggcucaagagauccucccacagccucccagguagcugggacuacaggcgug

SEQ ID NO: 162847 - RNA, 64 nt, hsa
uacuccuagcuaguaaggaauggaucuacagccugccucccagguuucuggcuuguggggggca

SEQ ID NO: 162848 - RNA, 64 nt, hsa
ugcaguggcgcaauuucagcucacugcaaccucugccucccagguucaagugauucuccugccu

SEQ ID NO: 162849 - RNA, 64 nt, hsa
cuccaacuccugacuucaugauccacccaccucggccucccaaagugcugagauuacagacgug

SEQ ID NO: 162850 - RNA, 64 nt, hsa
ugcaguagcacaaucacggcucacugcaaucucugccucccaguuucaagugauucugcugucu

SEQ ID NO: 162851 - RNA, 64 nt, hsa
cugccucccaguuucaagugauucugcugucucagccucccaaguagcugggacuacaggcaug

SEQ ID NO: 162852 - RNA, 64 nt, hsa
cuccaucucuugacauugugauccaccugccucggccucccaaagugcugggauuacaggcaug

SEQ ID NO: 162853 - RNA, 64 nt, hsa
auuccugggcuccagggauccacagucccccuuggccucccaaaguguugggauuacaugcaug

SEQ ID NO: 162854 - RNA, 64 nt, hsa
cuugaacuccugagcucaugauccacccgccucagccucccaaagugcugggauuacaggcccc

SEQ ID NO: 162855 - RNA, 64 nt, hsa
ugcgguggcgcugucucagcucacugcaaccuccgccucccagguucaagugauucuccugccu

SEQ ID NO: 162856 - RNA, 64 nt, hsa
caaacuccuaaccucaacugauccaccugccucagccucccaaagugccgccgggauuacaggc

SEQ ID NO: 162857 - RNA, 64 nt, hsa
gccauuucccuguuguccugaggaggaacuccaggccucccaucgugugcccuaaggccuccug

SEQ ID NO: 162858 - RNA, 64 nt, hsa
gugugcccuaaggccuccugcguccuggagcccugccucccacugccugacuuccugccacacg

SEQ ID NO: 162859 - RNA, 64 nt, hsa
cgaacuccugaccucaagugauccacucaccucggccucccaaagugcugggauuacaggugug

SEQ ID NO: 162860 - RNA, 64 nt, hsa
ugcaguggugcaaucucagcucacugcaaccuccgccucccagguucaagcgauuucgugccuc

SEQ ID NO: 162861 - RNA, 64 nt, hsa
ggaaccccuaggcucaaaugaugugcccaacucggccucccaaagugcugggauuacaggcaug

SEQ ID NO: 162862 - RNA, 64 nt, hsa
cccaggcucaggcucaggugauccucacaccuuagccucccaaguaccugggacuacaggcacg

SEQ ID NO: 162863 - RNA, 64 nt, hsa
aguuucccgcaaagugccucugggggaccccccagccucccacccuggucccagguuccacaag

SEQ ID NO: 162864 - RNA, 64 nt, hsa
ccaggauguccuggcucacuccgcaagccccccagccucccacccuggucccaguuucccgcaa

SEQ ID NO: 162865 - RNA, 64 nt, hsa
ugcaauggcgcgaucuuggcucaccauaaccuccgccucccagguucaagcaauucuccugccu

SEQ ID NO: 162866 - RNA, 64 nt, hsa
caaacuccugaccucaggugaucugcccgccucagccucccaaagugcuggaauuacaggcgug

SEQ ID NO: 162867 - RNA, 64 nt, hsa
ugcaguggugugaucucgucucacugcaaccuccgccucccagauucaagcgauucuccugucu

SEQ ID NO: 162868 - RNA, 64 nt, hsa
ugaacuccugaccucaggugauccacccgccucagccucccaaagugcugggauuacagguggg

SEQ ID NO: 162869 - RNA, 64 nt, hsa
cgaacuccugaccuuaggugauccgcccgccucagccucccaaaguguugggauuacaggcaug

SEQ ID NO: 162870 - RNA, 64 nt, hsa
caaacuccugaccucaggugauccaccugccucagccucccagacuguugggauuacaggcaug

SEQ ID NO: 162871 - RNA, 64 nt, hsa
cucaaucuccugaccucgugaucugcccgccucggccucccaaagugcugggauuacaggcgug

SEQ ID NO: 162872 - RNA, 64 nt, hsa
ugcaauggugcaaucucggcucacugcgaccucugccucccagguucaagcaguucuccugccu

SEQ ID NO: 162873 - RNA, 64 nt, hsa
caaacuccugaccucaggugauccgcccgccucagccucccaaagugcugagauuacaggugug

SEQ ID NO: 162874 - RNA, 64 nt, hsa
ccaccuccuggguuccagcgauucuccugccucagccucccaaauagcugugauuacaggcgug

SEQ ID NO: 162875 - RNA, 64 nt, hsa
ccccuccucugacacagggcuggcccgccagguggccucccagcaagccagccuuuuuuguaag

SEQ ID NO: 162876 - RNA, 64 nt, hsa
gccagggcgucaagggagggcuggugccuucggagccucccacugccgaccgcacagcucccuc

SEQ ID NO: 162877 - RNA, 64 nt, hsa
ccaccucccagguucaagcaauucuccugccucagccucccaaguagcugggauuacaggcacc

SEQ ID NO: 162878 - RNA, 64 nt, hsa
cgaacuucugaccucaggugauccaccugccucagccucccaaauugcugggauuacaggcgug

SEQ ID NO: 162879 - RNA, 64 nt, hsa
guaaccaguccugucccauuuccucagucccugggccucccagccuucaggcuguagggcugcc

SEQ ID NO: 162880 - RNA, 64 nt, hsa
uucucaccaggccuccuuuccuaugggcauuggugccucccagagguuucuugggcugcuggcu

SEQ ID NO: 162881 - RNA, 64 nt, hsa
cgaacuccugacuucaggugauccacccaucucagccucccaaagugcugggauuacaggcgug

SEQ ID NO: 162882 - RNA, 64 nt, hsa
aacaugucuucuuucagaaugggaauauaugugugccucccaacauuuacuguuaaaguguguu

SEQ ID NO: 162883 - RNA, 64 nt, hsa
cucgaucuccugaccucaugaucuacccgccucggccucccaaagugcugggauuacaggcgug

SEQ ID NO: 162884 - RNA, 64 nt, hsa
caaauuccuggccucaggugauccaccugccucagccucccaaagugcugggauuacaggcaug

SEQ ID NO: 162885 - RNA, 64 nt, hsa
ccaccucccagguucaagcgauucuccugccucagccucccaaguagcugggauuacuggcgcc

SEQ ID NO: 162886 - RNA, 64 nt, hsa
ggucucaaucugaccuugugaucugcccaccucggccucccaaagugcuaggauuacuggcgug

SEQ ID NO: 162887 - RNA, 64 nt, hsa
uuugaucuccugaccucgugauccgcccgccuuggccucccaaaagugcugggauuauaggcgu

SEQ ID NO: 162888 - RNA, 64 nt, hsa
cuuugugcaagaaauuugaaacuuauugggaaaagccucccaguagauuaauuguucauaucag

SEQ ID NO: 162889 - RNA, 64 nt, hsa
ugaugacaaguagagacgagcaguggaggaaacagccucccaaaaggacagagaacuaaaaaau

SEQ ID NO: 162890 - RNA, 64 nt, hsa
uucuuuugcugcugccauguaagaagugccuuuugccucccaccaugauucugaggcuuuccca

SEQ ID NO: 162891 - RNA, 64 nt, hsa
caaacuccuggccuuaugcauuccucccacccuggccucccagagugcugggauuacaggugug

SEQ ID NO: 162892 - RNA, 64 nt, hsa
caaacuccuggccucaagugguccuccugccuuggccucccaaaauguugcaauuacaggcaug

SEQ ID NO: 162893 - RNA, 64 nt, hsa
cacuuugggaggccgaguugguuuugaacuccuggccucccaaggugcugauaguacaggcaug

SEQ ID NO: 162894 - RNA, 64 nt, hsa
ccgccucccugguucaagugauucuccuaucucagccucccaaguagcugggacuauaggcaca

SEQ ID NO: 162895 - RNA, 64 nt, hsa
caaacuccugaccucaggugauccaccugccucagccucccaaagugcugggauuacaggcgug

SEQ ID NO: 162896 - RNA, 64 nt, hsa
cucaaacuucugaccucauaauccacccaccuuggccucccaaagugcuaggauuacaggcaug

SEQ ID NO: 162897 - RNA, 64 nt, hsa
ugcuauggugacacagcguuucuaggacagaggggccucccagucuccccccaccacccgugca

SEQ ID NO: 162898 - RNA, 64 nt, hsa
ggcuuccacccuuguuaaugaugcuccugccucugccucccagccccucacccagcacagcucu

SEQ ID NO: 162899 - RNA, 64 nt, hsa
caggcaccaucuccuuguucccccucucucuuuugccucccacugacugcccuuuuccaugugu

SEQ ID NO: 162900 - RNA, 64 nt, hsa
ggaggcggcagaggacugggccaagccccaaccugccucccagccaggcuccuccaggccucug

SEQ ID NO: 162901 - RNA, 64 nt, hsa
uacaauaguaugaucucggcucacugcaacuucugccucccaguuucaagggauucucgugccu

SEQ ID NO: 162902 - RNA, 64 nt, hsa
cugccucccaguuucaagggauucucgugccucagccucccagguagcugguacuacaggcacg

SEQ ID NO: 162903 - RNA, 64 nt, hsa
ugaacuuuugagcucgagugauccacccaccucagccucccaaaaugcugggauuacagaugug

SEQ ID NO: 162904 - RNA, 64 nt, hsa
agaaccucugaccucaggugauccacccgccucggccucccaaagugcugggauuacaggcgug

SEQ ID NO: 162905 - RNA, 64 nt, hsa
ccaccucucagauucaagcaauucuccugccucagccucccaaguagcugggauuacaggugcc

SEQ ID NO: 162906 - RNA, 64 nt, hsa
cucaaacaccugaccuugugauccguccgccuuggccucccaaagugcugggauuacaggcgug

SEQ ID NO: 162907 - RNA, 64 nt, hsa
ccucugccucccaggaucaagcaauucugacucagccucccaaguagcugggauuacaggcgca

SEQ ID NO: 162908 - RNA, 64 nt, hsa
ugcaguggugugaucacugcucagugcaaccucugccucccaggaucaagcaauucugacucag

SEQ ID NO: 162909 - RNA, 64 nt, hsa
cucgaucuccugaccucgugauucgcccgccucggccucccaaagugcuggaauuacuggcgug

SEQ ID NO: 162910 - RNA, 64 nt, hsa
cacugcagccugaaacuccuuggcuuccaccucagccucccaaagcauuaggauuauaggcgug

SEQ ID NO: 162911 - RNA, 64 nt, hsa
ucaacuccagaucucaggugaucuacccuccucggccucccaaaguacugggauuacaggccug

SEQ ID NO: 162912 - RNA, 64 nt, hsa
ugcaguggcacgaucucggcucacugcaaccuccgccucccaaguucaagcgauucuccucucu

SEQ ID NO: 162913 - RNA, 64 nt, hsa
cucgaucuccugaccucgugauccacccgccucagccucccaaagugcugggauuacaggcuug

SEQ ID NO: 162914 - RNA, 64 nt, hsa
ugcaguggcgcaauuucagcucacugcaaccucugccucccagguucaagcgauuccuuuuuuu

SEQ ID NO: 162915 - RNA, 64 nt, hsa
cucgaucuccugaccucgugauccaccugccuaggccucccaaaguguugggauuacaggcgug

SEQ ID NO: 162916 - RNA, 64 nt, hsa
uucaguggcacaaucucggcucacugcaagcucugccucccagguucaugccguucuccugccu

SEQ ID NO: 162917 - RNA, 64 nt, hsa
cucgaacuccugaccuugugaucugcccgccucagccucccaaaguacugggauuauaggcaug

SEQ ID NO: 162918 - RNA, 64 nt, hsa
cagcuucccuaauagcuaggauuacagguguguggccucccaccccaccccacccuucacaccu

SEQ ID NO: 162919 - RNA, 64 nt, hsa
cccgucuccaggggugccccagacccagagauuagccucccacuucggcgcagaaaacaaaagc

SEQ ID NO: 162920 - RNA, 64 nt, hsa
guaucuuuaagcugugauguuguauauauacaaugccucccagcuagacuguaagcccuuuggg

SEQ ID NO: 162921 - RNA, 64 nt, hsa
cuaccuccuggguucaagggauucuccugccucagccucccaaguagcugggauuacaggcgcc

SEQ ID NO: 162922 - RNA, 64 nt, hsa
caaacuccugaccugaggcgaucugcccaccucggccucccaaagugcugggauuacaggcgug

SEQ ID NO: 162923 - RNA, 53 nt, hsa
gcaggagugcccgcgacugagccgccucccaccacuccacuccuccagccacc

SEQ ID NO: 162924 - RNA, 64 nt, hsa
caccacccacaaucacaagaagauucccaccccugccucccaugccuggucccaagacagugag

SEQ ID NO: 162925 - RNA, 64 nt, hsa
cugccucccggguucgcaccauucuccugccucagccucccaauuagcuuggccuacagucauc

SEQ ID NO: 162926 - RNA, 64 nt, hsa
cucgaucuccugaccucgugauccgcccaccucggccucccaaagugcugggauuacaggcaug

SEQ ID NO: 162927 - RNA, 64 nt, hsa
cucgaucucuugaccucaugaucuacccgccuuggccucccaaagugcugagauuacaggcgug

SEQ ID NO: 162928 - RNA, 64 nt, hsa
cagacuccuggguucaagcaauccuccugccucagccucccaaguagcugagacuacaggcacg

SEQ ID NO: 162929 - RNA, 64 nt, hsa
ugaacucuuggccucaaguaauccuccugccucagccucccaaaguguugggauugcagauaug

SEQ ID NO: 162930 - RNA, 64 nt, hsa
ccucaaccuggguucaagugauccucucaccucagccucccaaguaguugugccuccuaggcac

SEQ ID NO: 162931 - RNA, 64 nt, hsa
cgaacaccugggcucaacugauccgccugccucggccucccaaagugcugggauuacaggugug

SEQ ID NO: 162932 - RNA, 64 nt, hsa
ugcaguggugcaaucucugcucacugcaacaucugccucccagguccaagcgauucuccugccu

SEQ ID NO: 162933 - RNA, 64 nt, hsa
ugaacuccuggccucaagugaucugcccaccucggccucccaaagugcugggauuacagacuug

SEQ ID NO: 162934 - RNA, 64 nt, hsa
ccgccucccggguucaagugauucuccugccucagccucccaaguaggugggauuacaggcgcc

SEQ ID NO: 162935 - RNA, 64 nt, hsa
cucgaacuccugaccucgugauuggcccaccucagccucccaaagugcugguauuacagaugug

SEQ ID NO: 162936 - RNA, 64 nt, hsa
cgaacuccugaccgcaagugauccacccgccuccgccucccaaagugcugggauuacaggcgug

SEQ ID NO: 162937 - RNA, 64 nt, hsa
ccaccuccuggguucaagugauuuuccugccucagccucccaaguagcugggaauacaggcacg

SEQ ID NO: 162938 - RNA, 64 nt, hsa
cgaacuccugaccucaagugaucugccugccucggccucccaagugcugggauuacaggcguga

SEQ ID NO: 162939 - RNA, 64 nt, hsa
ccgcccccuggguucaagcaauucuccugccucagccucccaaguagcugggauuacagucagg

SEQ ID NO: 162940 - RNA, 64 nt, hsa
cuaacuccugggcuuaagugaucugcccgccuuggccucccaaagugcugggauuacagaugug

SEQ ID NO: 162941 - RNA, 64 nt, hsa
cgaacuccugaccucaagugaucuguccaccucggccucccagagugcugggauuacaggcgug

SEQ ID NO: 162942 - RNA, 64 nt, hsa
ucuugaacugggcucaagugauccucacgccuuggccucccaaagugcugggauuauaggcaug

SEQ ID NO: 162943 - RNA, 64 nt, hsa
uuaacuccugaccucaggugauccaccuuucucggccucccaaagugcugggauuacgggugug

SEQ ID NO: 162944 - RNA, 64 nt, hsa
ccaccuccuggguuccagcaguucuccugccucagccucccaaguagcugagauuacaggcgcc

SEQ ID NO: 162945 - RNA, 64 nt, hsa
cuugaacuccugaccuugugauccacccaccucggccucccagagugcugggauuacaggcaug

SEQ ID NO: 162946 - RNA, 64 nt, hsa
agcggagaaggggccucccacccuuguccgaguugccucccacuggaggucaggagucuacacu

SEQ ID NO: 162947 - RNA, 64 nt, hsa
acucuugggcuuucuuggugggagcggagaaggggccucccacccuuguccgaguugccuccca

SEQ ID NO: 162948 - RNA, 64 nt, hsa
ucuugaucuccugacuugugauccgccugccucggccucccaaagugcuuggauuacaggugua

SEQ ID NO: 162949 - RNA, 64 nt, hsa
cgagcuccugaccucaggugauccgccugccuuggccucccaaaguggugggaucacaggcgug

SEQ ID NO: 162950 - RNA, 64 nt, hsa
cacucuccugaccucaagcaaucugccugucucagccucccaaagugcugggauuacaggcgug

SEQ ID NO: 162951 - RNA, 64 nt, hsa
cagccuccuggauucaggcaacacuccugccucagccucccacguggcugggauuacaggugcc

SEQ ID NO: 162952 - RNA, 64 nt, hsa
cgaacuccugaccucagaugauccgcccacauuggccucccaaagugcugggauuacaggugug

SEQ ID NO: 162953 - RNA, 64 nt, hsa
ugcaguggcaugaucucggcucacugcaacuucugccucccagguucaagccauucuccugccu

SEQ ID NO: 162954 - RNA, 64 nt, hsa
cugccuccuagauucaagcaauucuccugucucagccucccaaguagcugggauuacaggugcg

SEQ ID NO: 162955 - RNA, 64 nt, hsa
ccgccucccagauucaagcgauuuuccugccucagccucccaaguagcugggauuacaggugcc

SEQ ID NO: 162956 - RNA, 64 nt, hsa
cgcaguggcaccaucucggcucacuacaaccuccgccucccagauucaagcgauuuuccugccu

SEQ ID NO: 162957 - RNA, 64 nt, hsa
cgaacuucugaccucagaugaucugcccgccucagccucccaaagugcugggauuacaggcaug

SEQ ID NO: 162958 - RNA, 64 nt, hsa
ugaacucccgaccucagguaauccgcccgccucggccucccaaaaugcugggauuagaggugug

SEQ ID NO: 162959 - RNA, 64 nt, hsa
ccgccuccuggguucaagugauucuccugccacagccucccaaguagcugggauuacaggugcc

SEQ ID NO: 162960 - RNA, 64 nt, hsa
cgaacuccugaccucaguugauccgccugccucagccucccaaagugcugggcuuacaggccug

SEQ ID NO: 162961 - RNA, 64 nt, hsa
cuuccuccaggguucaagugauucucccaccucagccucccaaguagcugggacuacgggcaca

SEQ ID NO: 162962 - RNA, 64 nt, hsa
caaacuccugaccucaagcgauccacccaccuaggccucccaaagugcugggauuacaggcaug

SEQ ID NO: 162963 - RNA, 64 nt, hsa
caaacucccgaccucaggugauccgcccgccugggccucccaaagugcugggauuacaggcgug

SEQ ID NO: 162964 - RNA, 64 nt, hsa
cuugaucuccugaccucaugauccgcccaccuuggccucccaaagugcugggauuauaggcaug

SEQ ID NO: 162965 - RNA, 64 nt, hsa
ugcaauggcgcaaucucagcucacugcaagcuccgccucccagguucaugccauucuccugccu

SEQ ID NO: 162966 - RNA, 64 nt, hsa
uuaacuccuaggcucaagugauccucccaccucagccucccaaagugcuuggaugacaggugcg

SEQ ID NO: 162967 - RNA, 64 nt, hsa
caaucuccugggcucaaaugauccuuccaccucagccucccauguggcugggacuauaggugca

SEQ ID NO: 162968 - RNA, 64 nt, hsa
cagccuccuggauuuaagugauucuccugccucagccucccaaguagcugggauuacaggugug

SEQ ID NO: 162969 - RNA, 64 nt, hsa
cucgaacuccugaccucgugauccgccugccucagccucccaaagugcugggauuacaggugug

SEQ ID NO: 162970 - RNA, 64 nt, hsa
cugccuccuggguucaagcaauucucccaccucagccucccaaguagcugggauuacagacgug

SEQ ID NO: 162971 - RNA, 64 nt, hsa
ugaacuccugaccucaggugauccuccugccucggccucccaaagugcugggauuacaggcaug

SEQ ID NO: 162972 - RNA, 64 nt, hsa
ccgccuccuggguucaggcaauuuuccugccucagccucccaaguagcugggauuacaggcacc

SEQ ID NO: 162973 - RNA, 64 nt, hsa
ugaacuccugaccucaggugauccuccugcauuggccucccaaagugcuggaauuccaggcaug

SEQ ID NO: 162974 - RNA, 64 nt, hsa
ccaccucgcagguucaagcaauccucccacuucagccucccaagcaccugggauuacaagcaug

SEQ ID NO: 162975 - RNA, 64 nt, hsa
ugcaguggcgcgaucucagcucacuacaaccuccgccucccauguucaagcgauucuccugccu

SEQ ID NO: 162976 - RNA, 64 nt, hsa
cuccaucucuugaccucgugauccacccgccucagccucccaaagugcugggauuaacagguau

SEQ ID NO: 162977 - RNA, 64 nt, hsa
ugcaguggcaucaucucagcucacugcaaccucugccucccagguucaagugcuucuccagccu

SEQ ID NO: 162978 - RNA, 64 nt, hsa
cugccucccagguucaagugcuucuccagccucagccucccaaguagcugagacuacaggcaca

SEQ ID NO: 162979 - RNA, 64 nt, hsa
agcggaaaaagcugagcucauaggugcccagccagccucccagcuaaaggugcucagagcccca

SEQ ID NO: 162980 - RNA, 64 nt, hsa
cugccuggggguuauucgggaugguucagccagggccucccaggaagagugcuguggagccacg

SEQ ID NO: 162981 - RNA, 64 nt, hsa
ugaacuccugaacucaagcaauccuccugccucagccucccaaagugcugggauuacuggugug

SEQ ID NO: 162982 - RNA, 64 nt, hsa
caacuuccugggcucaagugauccuuccacuucagccucccaaguagcugggacuacaggcaug

SEQ ID NO: 162983 - RNA, 64 nt, hsa
cgaacuccugaccucaggugauccacucgccucggccucccaaagugcugggauuauaggcaug

SEQ ID NO: 162984 - RNA, 64 nt, hsa
cugccuccuggguucaagcaguucuccugccucagccucccaaguagcugggauuacaggcguc

SEQ ID NO: 162985 - RNA, 64 nt, hsa
cucgaacuccugaccuugugaucugcccaccucagccucccaaagugcuaugauuacagacgug

SEQ ID NO: 162986 - RNA, 64 nt, hsa
uccaguggcacuaucucagcucacugcaaccuccgccucccagguucaagcaauucuccugccu

SEQ ID NO: 162987 - RNA, 64 nt, hsa
ugcaguggcgcgaucuuagcucacugcaagcuccgccucccagguucacaccauucuccugccu

SEQ ID NO: 162988 - RNA, 64 nt, hsa
caaacuccagggcucaagcaguccucccaccucagccucccaaagugcugggaucacaggcaug

SEQ ID NO: 162989 - RNA, 64 nt, hsa
caaacucuugaccucaggugauccacccaccucagccucccaaagugcugggauuacaagcgug

SEQ ID NO: 162990 - RNA, 64 nt, hsa
ugaacuccuggccucaagugauucuccugccucagccucccaaagugcugggauuacaggugug

SEQ ID NO: 162991 - RNA, 64 nt, hsa
gcuccgccucccggguucacgccauucugcgucagccucccaaguagcugggacuacaggcacc

SEQ ID NO: 162992 - RNA, 64 nt, hsa
cuugaucuccugaccgcauaauccacccaccucggccucccaaagugcugggauuacaggcgug

SEQ ID NO: 162993 - RNA, 64 nt, hsa
ccaacucccagguucaagugagucucgugccucagccucccaaguagcugggauuacaggcacc

SEQ ID NO: 162994 - RNA, 64 nt, hsa
caaacuccugaccucaggugcuccaccugccuuggccucccaaagugcugggauuacaggcgug

SEQ ID NO: 162995 - RNA, 64 nt, hsa
accuccugggcucaaaugaucuccucccaccucagccucccaaguagcugagacuacagguuca

SEQ ID NO: 162996 - RNA, 64 nt, hsa
ugcaguggcgugaucucagcucacugcaacccccgccucccagguucgagcacuuuucaugccu

SEQ ID NO: 162997 - RNA, 64 nt, hsa
caaacuccugaccucaggugauccaccugccucggccucccagagugcugggauuacaggcaug

SEQ ID NO: 162998 - RNA, 64 nt, hsa
cgaacuccuguccucagguaauccgcccaccucagccucccaaagugcugggauuacaggcgug

SEQ ID NO: 162999 - RNA, 64 nt, hsa
cgaccuccuggguucaagcgauucucccaccccagccucccaaguagcugggauuacaggugug

SEQ ID NO: 163000 - RNA, 64 nt, hsa
caaacuccugggcucaagcgauccuccuggcucagccucccaaagugcugggauuacaggcgug

SEQ ID NO: 163001 - RNA, 64 nt, hsa
gaccauucuccaccugccagggacagaggggguggccucccaacucaccccagccccaaaacuc

SEQ ID NO: 163002 - RNA, 64 nt, hsa
gcccaggcuuagucacugagacagcccgggcucugccucccaucacccgcuaagagggagggag

SEQ ID NO: 163003 - RNA, 64 nt, hsa
uguccucccaggcucaagcuauccuugcaccucagccucccaaguagcugggaccacaggcaug

SEQ ID NO: 163004 - RNA, 64 nt, hsa
caaacuccugggcucaagugauccucccaucuuggccucccagaguauugggauuacagacaug

SEQ ID NO: 163005 - RNA, 64 nt, hsa
caaacuccugaccucaggugaugcacccaccucagccucccaaagugcagggauuacaggcaug

SEQ ID NO: 163006 - RNA, 64 nt, hsa
gagugcaguggugcaaucuuggcucgcaaccuccgccucccagguucaagagauucuccugccu

SEQ ID NO: 163007 - RNA, 64 nt, hsa
cgaacuccugaccucaggugauccacccgccucagccucccaaagugcugggauuacaggcaug

SEQ ID NO: 163008 - RNA, 64 nt, hsa
cccugccugccccccggguggggcugcggcucuggccucccaggcccauccucaacagcuaccc

SEQ ID NO: 163009 - RNA, 64 nt, hsa
uggcaggcucuggcacccugggccuccuccgggagccucccaucugggcaguggagccauaaac

SEQ ID NO: 163010 - RNA, 64 nt, hsa
caaacuccugaccucaggugauccgccuaccucagccucccaaagugcugggauuacaggcgug

SEQ ID NO: 163011 - RNA, 64 nt, hsa
ugcaguggugugaucucggcucacugcaaccucugccucccagguuccagcaauucuccugccu

SEQ ID NO: 163012 - RNA, 64 nt, hsa
cgaaugccugaccucaggugauccacccgccuuggccucccaaagugcuggaauuacaggugug

SEQ ID NO: 163013 - RNA, 64 nt, hsa
cugccuccuggguucaauccauucuccugccucagccucccaaguagcugggauuacaggcaca

SEQ ID NO: 163014 - RNA, 64 nt, hsa
caaacuccuagccuugauugauccuccugccuuggccucccaaagugcugggacuacaggugca

SEQ ID NO: 163015 - RNA, 64 nt, hsa
gaaggagccaccucucagugccucaccucccccugccucccagccuccgcagaugagguuccug

SEQ ID NO: 163016 - RNA, 64 nt, hsa
gacaaagagcucucgcaagaagagacagcgugaugccucccacaguccaccccagacccugggg

SEQ ID NO: 163017 - RNA, 64 nt, hsa
ugcaguggcuugaucuuggcucacugcaaccuccgccucccagguucaagcaauucuccugccu

SEQ ID NO: 163018 - RNA, 64 nt, hsa
cgaacuccuggccucaagugaucugcccgccucggccucccaaagugcugggauuacaggcgug

SEQ ID NO: 163019 - RNA, 64 nt, hsa
cagcaugccccuacggccaggggacugucugccagccucccaggcccaugcccuccuggugccc

SEQ ID NO: 163020 - RNA, 64 nt, hsa
gccucuguuagcugggugggugucaucagccccugccucccaggccagaaccugagaacgggcc

SEQ ID NO: 163021 - RNA, 64 nt, hsa
ugcaguggugugaucuuggcucacugcaaccucugccucccagguucaagcaauucuccugccu

SEQ ID NO: 163022 - RNA, 64 nt, hsa
cugccucccagguucaagcaauucuccugccucagccucccaaguagcugggacuacaggcaca

SEQ ID NO: 163023 - RNA, 64 nt, hsa
cuccaucucuugaccuugugauccacccaccucagccucccaaagugcugggauuacaggcaug

SEQ ID NO: 163024 - RNA, 64 nt, hsa
ccaacuccugaccuaaagugaucugcccgccuuggccucccaaagugcugggauuacagacaug

SEQ ID NO: 163025 - RNA, 64 nt, hsa
cgugcaauggcgcaguugacucacuacagccucugccucccagguucaagcgauucucaugccu

SEQ ID NO: 163026 - RNA, 64 nt, hsa
cugccucccagguucaagcgauucucaugccuuagccucccaaguagcugggauuacaggugug

SEQ ID NO: 163027 - RNA, 64 nt, hsa
ugcgaggugaugggggcuggggccccaggcgucagccucccagagggacagcugagcccccugc

SEQ ID NO: 163028 - RNA, 64 nt, hsa
caugccugccacccuggcaucggcuuucugugccgccucccacacaaaucagccccagaaggcc

SEQ ID NO: 163029 - RNA, 64 nt, hsa
cgaacucuugaccucaggugaucugcccgccuuggccucccaaagugcugggauuacaggugug

SEQ ID NO: 163030 - RNA, 64 nt, hsa
cgaacuccugaccucaggugauccgcccaccucggccucccaaagugcugggauuacaggugug

SEQ ID NO: 163031 - RNA, 64 nt, hsa
caaacuccugggcucaggcgauccaccugucucagccucccagagugcugggauuacaauugug

SEQ ID NO: 163032 - RNA, 64 nt, hsa
acugacauucuccacuucuuguuccccacugacagccucccacccccaucucucccuccccugc

SEQ ID NO: 163033 - RNA, 64 nt, hsa
caaacuccugaccucaggugauccacccaccucagccucccaaagugcugggauuacaagcgug

SEQ ID NO: 163034 - RNA, 64 nt, hsa
aaacuccuuggagagacgacuaggaggacagcuugccucccaggccccuuguggacuuagacuc

SEQ ID NO: 163035 - RNA, 64 nt, hsa
auggugccuugggccccuuagccccagcgccagggccucccagcugaggccacaggacaagcac

SEQ ID NO: 163036 - RNA, 64 nt, hsa
cacacuccgaguccugggucccaguccagcugcugccucccaacccaugcccgcuagaaaccug

SEQ ID NO: 163037 - RNA, 64 nt, hsa
caaaccccugggcucaagcaagccuccugccuuggccucccaaagugcugggauuacaggugug

SEQ ID NO: 163038 - RNA, 64 nt, hsa
ggaccucccaagcucaagcaauccuccugccucugccucccaaguagcugggaccacagguggg

SEQ ID NO: 163039 - RNA, 64 nt, hsa
cgaacuccugaccucaggugauccaccugccucggccucccaaagugcuaggauuacaggcgug

SEQ ID NO: 163040 - RNA, 64 nt, hsa
cgaacuccugaccucaggugauccgcccaccuuggccucccaaagugcugggauuacacgcgug

SEQ ID NO: 163041 - RNA, 64 nt, hsa
uuuuuacaccaauuugguaaaaaugcugcucucagccucccacaauuaaaccgcaugugaucuc

SEQ ID NO: 163042 - RNA, 64 nt, hsa
gauguagguguuaggcaugucccacccacccgccgccucccacggcaccucggggacaccagag

SEQ ID NO: 163043 - RNA, 64 nt, hsa
ugaauaguuugguuauaguguuuaggcuagaaaugccucccacauugguaauaaacauuacaaa

SEQ ID NO: 163044 - RNA, 64 nt, hsa
ggcugggcucaaacuccugaauccgccugccucggccucccaaagugcugggauuacaggugug

SEQ ID NO: 163045 - RNA, 64 nt, hsa
ggaacuccuuggcucaagcaauccugcugccuuggccucccaaguauguaggacuacagguacu

SEQ ID NO: 163046 - RNA, 64 nt, hsa
caaacuccugggcugaaacaauccucccgccuuggccucccaaagugcugggauuauaggcaca

SEQ ID NO: 163047 - RNA, 64 nt, hsa; identical to SEQ ID NO: 162809

SEQ ID NO: 163048 - RNA, 64 nt, hsa
ugcaguggcgcgaucucggcucacugcaagcucugccucccagguucacaccauucuccugccu

SEQ ID NO: 163049 - RNA, 64 nt, hsa
cugccucccguguucaagcaguucuccugccucagccucccaaauagcugggauuacaguugcc

SEQ ID NO: 163050 - RNA, 64 nt, hsa
cgaacuccugaccucaagugauccacccgccuuggccucccaaagugcugggauaauagguguc

SEQ ID NO: 163051 - RNA, 64 nt, hsa
ccuagagcgugauucucccaucugaggcaaucuugccucccaggggaaauuuugcaauguuugg

SEQ ID NO: 163052 - RNA, 64 nt, hsa
guuagagcagaggaggucccagauaccaaguggcgccucccaggaaaggcugggagaagaggug

SEQ ID NO: 163053 - RNA, 64 nt, hsa
ccgccuccugcguucaagugauuguccugucucagccucccaaguagcugggauuacaggcacc

SEQ ID NO: 163054 - RNA, 64 nt, hsa
ugaacuccuaaccucaggugauccacccgccucggccucccaaagugcugggauuacaggcccg

SEQ ID NO: 163055 - RNA, 64 nt, hsa
gagugcaguggugugacggcucacugcagccugcgccucccagcguccagcaauucuuguuucu

SEQ ID NO: 163056 - RNA, 64 nt, hsa
gcgccucccagcguccagcaauucuuguuucucggccucccaaguagcugggacuauaggugcg

SEQ ID NO: 163057 - RNA, 64 nt, hsa
ucaccuaccgaguucaagugauuuuccugccuuggccucccaaguagcugggauuacaggugug

SEQ ID NO: 163058 - RNA, 64 nt, hsa
aaaacuccugaccucaagugaucugcccaccucagccucccaaagugcugagauuacaggcaug

SEQ ID NO: 163059 - RNA, 64 nt, hsa
ugcaguggcaugaucuuggcucacugcagccuccgccucccagguucaagcgauucuccugccu

SEQ ID NO: 163060 - RNA, 64 nt, hsa
cucaaacuccugaccucaugauccgccuuccucggccucccaaagugcugggauuacagguguu

SEQ ID NO: 163061 - RNA, 64 nt, hsa
ccaacuccugaccucaagugauauguucaccucagccucccaaagugcugggauuacaggcaug

SEQ ID NO: 163062 - RNA, 64 nt, hsa
ccgccucccggguucaagcaauucuccugccucagccucccaaguagcugggauuacaggcgug

SEQ ID NO: 163063 - RNA, 64 nt, hsa
gaaccucuuggguucaagugauucuugugccucagccucccaaguagcuggaauuacaggcaca

SEQ ID NO: 163064 - RNA, 64 nt, hsa
cgaacuccugaccucaggugauccacccaccuuggccucccaaagugcugagauuauaggcaug

SEQ ID NO: 163065 - RNA, 64 nt, hsa
ugcaguggcacaaucauggcucacugcagucucugccucccaggcucaagugauccucccaccu

SEQ ID NO: 163066 - RNA, 64 nt, hsa
ugaccuccugagcucaagcaguccaucugccucagccucccaaagugcugggacuacagacaug

SEQ ID NO: 163067 - RNA, 64 nt, hsa
ccgccucccggguucacgccauucuccugccucagccucccaaguagcugggacuacaggcacc

SEQ ID NO: 163068 - RNA, 64 nt, hsa
cucgaucuccugaccucgugauccgcccgccucagccucccaaagugcugggauuacaggcgug

SEQ ID NO: 163069 - RNA, 64 nt, hsa
cugccucccggguucaugccauucuccugccucagccucccaaguagcugggacuacaggcgcc

SEQ ID NO: 163070 - RNA, 64 nt, hsa
cucgaucuccugaccucgugauccacccgccucggccucccaaagugcugggauuacaggcgug

SEQ ID NO: 163071 - RNA, 64 nt, hsa
cuugaucuccugaccuugugauccaccagccucagccucccaaagugcugggauuacaggcgug

SEQ ID NO: 163072 - RNA, 64 nt, hsa
ugcaguggugggaucucggcucacugcaagcuccgccucccagauucacgccauucuccugccu

SEQ ID NO: 163073 - RNA, 64 nt, hsa
ccaccuccuggguucaagugauucuccugcuucagccucccaaguagcugggauuacaggugug

SEQ ID NO: 163074 - RNA, 64 nt, hsa
ugaacuccuggccuccagugauccuccauccucggccucccaaagugcuggaaucacaggggug

SEQ ID NO: 163075 - RNA, 64 nt, hsa
cuccaucuccugaguuugugaucugcccgccuuggccucccaaagugcugggauuacaggugug

SEQ ID NO: 163076 - RNA, 64 nt, hsa
cuccugaccucaggugauccacccgcccgccuuggccucccaaagugcuaggauuccaggcgug

SEQ ID NO: 163077 - RNA, 64 nt, hsa
cuugaucuccugaccucgugauccgcccuccucggccucccaaagugcugggauuauaggcgug

SEQ ID NO: 163078 - RNA, 64 nt, hsa
ugaacuccugaccucagguaauccaccugccuuggccucccaaagugcugggauuacaggcgug

SEQ ID NO: 163079 - RNA, 64 nt, hsa
uugccuaggcuggagugaaaguggcgcaaccucugccucccaggucaaagcaauccugccucag

SEQ ID NO: 163080 - RNA, 64 nt, hsa
uaaacucuugaccucaaaugauccacccaccuuggccucccaaauuguucguuuuacuuuuuuu

SEQ ID NO: 163081 - RNA, 64 nt, hsa
caaacuccugaccucaggugaucugccugccucggccucccaaagugcugggauuacaggugug

SEQ ID NO: 163082 - RNA, 64 nt, hsa
ccgccucccggauucaagcaauucuccugccgcagccucccaagaagcugggauuacaggcaug

SEQ ID NO: 163083 - RNA, 64 nt, hsa
caaacuccugaccucauaugauccaccugccucagccucccaaagugcuuggauuacaggcaua

SEQ ID NO: 163084 - RNA, 64 nt, hsa
cugccuuccagguucaagcaauuauccugccucagccucccaaguagcugggauuacaggcacc

SEQ ID NO: 163085 - RNA, 64 nt, hsa
cgaaauccugaccucaaaugauccacccaccucagccucccaaagugcugggauuacaggcaug

SEQ ID NO: 163086 - RNA, 64 nt, hsa
ccgcccccugggaucaagcgauucuccuaccucagccucccaaauagcugggacuacaaggugc

SEQ ID NO: 163087 - RNA, 64 nt, hsa
cucgauuuccugaccuugugaucccccugccucggccucccaaagugcugggauuacaggcaug

SEQ ID NO: 163088 - RNA, 64 nt, hsa
caaacucccgaccucaggugauccacccgccucagccucccaaagugcugggauuacaggcaug

SEQ ID NO: 163089 - RNA, 64 nt, hsa
ugcaguggcgcagucuuggcucaccucaaccucugccucccagguucaggcuauucuccugcuc

SEQ ID NO: 163090 - RNA, 64 nt, hsa
ucaacuccugggcucaagcaguccucccaccuuggccucccagaaugcuggguuuauagaugug

SEQ ID NO: 163091 - RNA, 64 nt, hsa
cucgaucuccugaccucgugaucugcccaccucggccucccacagugcugggauuaccggcgug

SEQ ID NO: 163092 - RNA, 64 nt, hsa
cucgaucuccugaccuugucauccaccugucuuggccucccaaagugcugggauuacuggcaug

SEQ ID NO: 163093 - RNA, 64 nt, hsa
cagacuccugggcucaagcaaucugcccgccucugccucccaaagugcugggauuacagacgug

SEQ ID NO: 163094 - RNA, 64 nt, hsa
caaccugccagguugaagugagccucccauuucagccucccaaguagcugggacuacaauugug

SEQ ID NO: 163095 - RNA, 64 nt, hsa
cucacuguagccucaaccugccagguugaagugagccucccauuucagccucccaaguagcugg

SEQ ID NO: 163096 - RNA, 64 nt, hsa
ugaacgccugaccucagaugauccacccaccuuggccucccaaagugcugggauuacaggcaug

SEQ ID NO: 163097 - RNA, 64 nt, hsa
ccgccuccuggguucaagugauucucgugcuucagccucccaaguaccugggacuacaggugug

SEQ ID NO: 163098 - RNA, 64 nt, hsa
cucgaacuccugaccucgugauccgcccgccucagccucccaaaguguuaggauuaggggcaug

SEQ ID NO: 163099 - RNA, 64 nt, hsa
cugccucccagguucaagcaauucuccugccucagccucccaaguagccaggauuacaggcacg

SEQ ID NO: 163100 - RNA, 64 nt, hsa
ugcaguggggcaaucucggcucacugcaaccucugccucccagguucaagcaauucuccugccu

SEQ ID NO: 163101 - RNA, 64 nt, hsa
gggccucccagguucaagugauucuccuaccucagccucccaaggagcugagauuacgaguaca

SEQ ID NO: 163102 - RNA, 64 nt, hsa
ugcaguggugcaaucuuggcucacugcaacuugggccucccagguucaagugauucuccuaccu

SEQ ID NO: 163103 - RNA, 64 nt, hsa
cuugaacuccugaccucaugauccgcccaccucagccucccaaaguguugggauuacaggcaug

SEQ ID NO: 163104 - RNA, 64 nt, hsa
ugcaguggcaugaucuccacucacagcaaccucugccucccagguucaagcaguucuccugccu

SEQ ID NO: 163105 - RNA, 64 nt, hsa
ccaacuccugagcucaagugauccacccgccucagccucccaaagugcugggauuacaggggug

SEQ ID NO: 163106 - RNA, 64 nt, hsa
cccaguccagggugguagugcugggcuguucccagccucccacagcagagcuggacgcugugga

SEQ ID NO: 163107 - RNA, 64 nt, hsa
ugaacucuugggcucaagugauccucccgccucagccucccaaaguguugggauuacaggugug

SEQ ID NO: 163108 - RNA, 64 nt, hsa
ugaccucccaggcucaagcgauccuccugccucagccucccaaguagcugggagccugggcaug

SEQ ID NO: 163109 - RNA, 64 nt, hsa
aaaacuccugggcucaagugauccuccugccucagccucccaaagcguugggauuauaggcgug

SEQ ID NO: 163110 - RNA, 64 nt, hsa
cgacuucuuaggcucaggugauccucccaccucagccucccaagcagcugggaugacagacuug

SEQ ID NO: 163111 - RNA, 64 nt, hsa
ggcugggguggacucagaugccaggaaagggacagccucccauugucaggcagaagcugcccaa

SEQ ID NO: 163112 - RNA, 64 nt, hsa
uuuauggugcucuguauucuggcauuaugcagcagccucccagaagcucucuucugcuucaaaa

SEQ ID NO: 163113 - RNA, 64 nt, hsa
ugcaacggcaugauuuuggcucacugcagccucugccucccaggcucaagcacuuuuccugucu

SEQ ID NO: 163114 - RNA, 64 nt, hsa
ugaacuccugaccucaggugauccacccaccugggccucccauagugcugggauucaauuuuuu

SEQ ID NO: 163115 - RNA, 64 nt, hsa
cgaacuccugacaucaggugauccaccugccucggccucccaaagugcugggauuacaggugug

SEQ ID NO: 163116 - RNA, 64 nt, hsa
caucacucauaucccuuucagaauguuaggaacugccucccacauucuucccugucuuuuuggg

SEQ ID NO: 163117 - RNA, 64 nt, hsa
ugcaaucgcgcaaucucggcucacgguaaccucugccucccagguucaagcgagucuccugccu

SEQ ID NO: 163118 - RNA, 64 nt, hsa
caaaccccggaccucaggugauccccccaccuuggccucccaaagugccaggauuacaggcaug

SEQ ID NO: 163119 - RNA, 64 nt, hsa
ugaacuccugaccucaggugauccacccgccucagccucccacacugcugggauuacaggcaug

SEQ ID NO: 163120 - RNA, 64 nt, hsa
ugcaguggcgccaucucggcucacugcaaccuccgccucccagguucaagcaauucuccugccu

SEQ ID NO: 163121 - RNA, 64 nt, hsa
ccgccucccagguucaagcaauucuccugccucagccucccagguagcugccacuacaggugcu

SEQ ID NO: 163122 - RNA, 64 nt, hsa
cuugaacuccugaccuugugauccacccgccucggccucccaaagugcugggauuacaggcgug

SEQ ID NO: 163123 - RNA, 64 nt, hsa
ugaacucccgaccucaggugauccaccugucuuggccucccaaagugcugggauuacaggcaug

SEQ ID NO: 163124 - RNA, 64 nt, hsa
uuucuccuuccaccaugguuguaaguuuccugaggccucccagucaugcuuccuguuaagccug

SEQ ID NO: 163125 - RNA, 64 nt, hsa
cuugaacuccugaccucgugauccacccgccuaggccucccaaaguguugggauuacaggcgug

SEQ ID NO: 163126 - RNA, 64 nt, hsa
ccgccucugggguucaagugauucuccugucucagccucccaaguagcuggaauuacagggacc

SEQ ID NO: 163127 - RNA, 64 nt, hsa
ccacuuugauuuaauccuuuggcugugggcugaggccucccagggaagcuggguggggugggug

SEQ ID NO: 163128 - RNA, 64 nt, hsa
ccaguucacauucaccccacaagaguuucaggaggccucccacggugccugugcuggguggcgg

SEQ ID NO: 163129 - RNA, 64 nt, hsa
cucgaacuccugaccucgugauuugccugccugggccucccaaagugcuaggauuacaggcaug

SEQ ID NO: 163130 - RNA, 64 nt, hsa
cuugaucuccugagcucgugaucugcccgccucggccucccaaagugcugggauuacaggugug

SEQ ID NO: 163131 - RNA, 64 nt, hsa
cucgccucugcccagccugccccagccugccccagccucccagcuuucugugugcacaguuggc

SEQ ID NO: 163132 - RNA, 64 nt, hsa
ugaacuccugaccucaagugaucugcccaccucagccucccaaagugcugggauuacaggugug

SEQ ID NO: 163133 - RNA, 64 nt, hsa
ugcaguggcgcuaucuuggcucacugcaacguccgccucccagguucaagcgauucucaugccu

SEQ ID NO: 163134 - RNA, 64 nt, hsa
aaccucuccagauucaagugauccucccaucucagccucccaaguagcugggacuacaguugug

SEQ ID NO: 163135 - RNA, 64 nt, hsa
caaacuccugggcuccaacgaucugcccaccuuggccucccaaagugcugagauuacaggcgug

SEQ ID NO: 163136 - RNA, 64 nt, hsa
ccacuucuuggguucaagugauucuccugucucagccucccaaguagcugggauuacaggcaug

SEQ ID NO: 163137 - RNA, 64 nt, hsa
ugaacuccugaccucaggugauccacccgccuuggccucccaaagugcugggauuacaggcgug

SEQ ID NO: 163138 - RNA, 64 nt, hsa
ccgccuccuggguucaagugauucucccaccucagccucccaaguaggugggauuacagguacu

SEQ ID NO: 163139 - RNA, 64 nt, hsa
cgaacuccugaccucagauggucugcccaccuccgccucccaaagugcugggauuacaggcgug

SEQ ID NO: 163140 - RNA, 64 nt, hsa
ugccccagggcgaucucagcucacugcaaccuuugccucccaggcucaaucacuucugcugccu

SEQ ID NO: 163141 - RNA, 64 nt, hsa
cgaacuguuggccucaagugauccgcccgccucagccucccaaagugcugggauuacaggcguc

SEQ ID NO: 163142 - RNA, 64 nt, hsa
guccuccaacaccaagcacagcagccuggggcuggccucccaaaugagccaugagaugauacau

SEQ ID NO: 163143 - RNA, 64 nt, hsa
gagauucaagggacccaugaguuggggucuggcagccucccauccagggcccccaucucaugcc

SEQ ID NO: 163144 - RNA, 64 nt, hsa
ugaaauccugggcucaagugauccuccugcuuuggccucccaaaaugcugggauuauaggcaug

SEQ ID NO: 163145 - RNA, 64 nt, hsa
ggucuuccucucucgcccaaguucucaugccucagccucccaaauagcugggacuacaggcaca

SEQ ID NO: 163146 - RNA, 64 nt, hsa
ugaacuccuagacucaagugauccuccugucuuggccucccaaagugcugagauuacaggugug

SEQ ID NO: 163147 - RNA, 64 nt, hsa
cuugaacuccugaccucgugacccacccgccuuggccucccaaagugcugggauuacaggugug

SEQ ID NO: 163148 - RNA, 64 nt, hsa
cgaacuccugaccucaggugauccacccaccuuggccucccagcgugcugggauuauaggcaug

SEQ ID NO: 163149 - RNA, 64 nt, hsa
uccaccuccugguucaagcgauucuccugccucagccucccaaguagcugggauuacaggcacg

SEQ ID NO: 163150 - RNA, 64 nt, hsa
ccgccuccugaguucaagcgauucuccugccucagccucccaaguagcugggacugcaggcgcg

SEQ ID NO: 163151 - RNA, 64 nt, hsa
aaacuccugacuucaggugauccacccgccuucagccucccaacgugcugggauuacagccgug

SEQ ID NO: 163152 - RNA, 64 nt, hsa
ugcaauggcguaaucucggcucagugcaaccucugccucccagguugaagcgauucuccugccu

SEQ ID NO: 163153 - RNA, 64 nt, hsa
cugccucccagguugaagcgauucuccugccucagccucccaaguagcugggauuacaggcaug

SEQ ID NO: 163154 - RNA, 64 nt, hsa
cucgaugaucugaccucgugaucugcccgccucggccucccaaagugcugggauuacaggccug

SEQ ID NO: 163155 - RNA, 64 nt, hsa
ccaccuccugaguucaagcaauucuccugccucagccucccaaguagcugggacuacaggcaug

SEQ ID NO: 163156 - RNA, 64 nt, hsa
ugcagugucacgaucucagcucacugcaaccuccgccucccagguacaagagauucuccugccu

SEQ ID NO: 163157 - RNA, 64 nt, hsa
ugaacuccuggacucaaucgauccucccaccucugccucccaaguaacugggacuauagcaugc

SEQ ID NO: 163158 - RNA, 64 nt, hsa
ugaacuccuggacucaauugauccucccacuucugccucccaaguaacugggacuauagcaugc

SEQ ID NO: 163159 - RNA, 64 nt, hsa
gugaaagacugagaugaaugucuuuccucucccugccucccaccagacuuccuccuggaaaacg

SEQ ID NO: 163160 - RNA, 64 nt, hsa
caaguucucgcuuccuccuuugggcaucucuucugccucccaaucaaggaagcuccaugcucag

SEQ ID NO: 163161 - RNA, 64 nt, hsa
cugccucccguguucaagcgauucuccugccuuggccucccaaguagcugggacuacaggcgcc

SEQ ID NO: 163162 - RNA, 64 nt, hsa
cucgaucuccugaccucuugaucugcccaccuuggccucccaaagugcugggauuacaggcgug

SEQ ID NO: 163163 - RNA, 64 nt, hsa
cuggccguuaacucagcacccaggccaagcccccgccucccacuugaagcccccucuuacaacu

SEQ ID NO: 163164 - RNA, 64 nt, hsa
cuuugguggguuuccuggauggaugugaaguugggccucccaugggcccaagggaguaggaagc

SEQ ID NO: 163165 - RNA, 64 nt, hsa
uuuggggaggugaagcugccaggugugcacaggggccucccaggcuccuggcuccaccagccaa

SEQ ID NO: 163166 - RNA, 64 nt, hsa
accagacuucucuggucccacaggacagccaguggccucccaacuugguucugggcccccgccu

SEQ ID NO: 163167 - RNA, 64 nt, hsa; identical to SEQ ID NO: 162657

SEQ ID NO: 163168 - RNA, 64 nt, hsa
cucuucuaccuccugcaacccacccauccuauuagccucccacauucuaggcccgugauacagg

SEQ ID NO: 163169 - RNA, 64 nt, hsa
cgaacucuugaccucaagugauccacucgcuucggccucccaaagugcugggauuauaggcgug

SEQ ID NO: 163170 - RNA, 64 nt, hsa
cucgaacuccugaccucaugauccuccugccucggccucccaaagugcugggauuauaggcaug

SEQ ID NO: 163171 - RNA, 64 nt, hsa
gcucaaaagaccuuaaaggucuguaggguucccugccucccaucuuuccacuguuguaaaaagu

SEQ ID NO: 163172 - RNA, 64 nt, hsa
uaaacuccuaaccucaggugauccacccgccuuggccucccaaagugcugggauuacaggugug

SEQ ID NO: 163173 - RNA, 64 nt, hsa
aagaccucuauauccuggugccuaagaaacuucugccucccacagacaacuaagugcuuauuca

SEQ ID NO: 163174 - RNA, 64 nt, hsa
cgaacuccugaccucaagugauccgccugccucagccucccacagugcugggauuacaggcgug

SEQ ID NO: 163175 - RNA, 64 nt, hsa
cugccuccugacuucaagcaauucuccugccucagccucccaaagugcugggauuacaggugug

SEQ ID NO: 163176 - RNA, 64 nt, hsa
caaacuccugaccucaguugauccacccgccucagccucccaaagugcuaggauuacaggcaug

SEQ ID NO: 163177 - RNA, 64 nt, hsa
cuugaacuccugaccucgugaucugcccgccuuggccucccaaaguacugggauuacaggcgug

SEQ ID NO: 163178 - RNA, 64 nt, hsa
ugcaguggcgcaaucuuggcucacugcaaccuccgccucccagguucaggcgauucuccugccu

SEQ ID NO: 163179 - RNA, 64 nt, hsa
caccucccggguuccagcaaauucuccugccucagccucccaaguagcugggauugcaggcgcc

SEQ ID NO: 163180 - RNA, 64 nt, hsa
cgaucuccugaccucaggugauccacccgccucggccucccaaagugcugggaugacaggcgug

SEQ ID NO: 163181 - RNA, 64 nt, hsa
caggggccgggcucuccuccaccgcucccccggagccucccaggcagcaauaaggaaauaguuc

SEQ ID NO: 163182 - RNA, 64 nt, hsa
cgaacuccugaccucaggugaucugcccgccucggccucccaacgugcccccaguuuuauaaac

SEQ ID NO: 163183 - RNA, 64 nt, hsa
cgaacuccugaccucaggugauccaccugccucggccucccaaagugcugggauuacaggcuug

SEQ ID NO: 163184 - RNA, 64 nt, hsa
uugccucccgggcucaagcgauucuccugccucagccucccaaguagcugggauuacaggcacc

SEQ ID NO: 163185 - RNA, 64 nt, hsa
gggcugcccugccacuuugguacauggccagugugaucccaagugccagucuugugucugcguc

SEQ ID NO: 163186 - RNA, 64 nt, hsa
cuguggggccuugguucccuuguguguguguguugaucccaagacaaugaaaguuugcacugua

SEQ ID NO: 163187 - RNA, 64 nt, hsa
agauccuguggaaggcccuugguguuacacgauggaucccaaagucagaugggaguacugcaac

SEQ ID NO: 163188 - RNA, 64 nt, hsa
ggauuguucggcaggcccuugguguuauacaacggaucccaaagucaggugggaguacugcaac

SEQ ID NO: 163189 - RNA, 64 nt, hsa
uuaugcuccaagcauguaaagaaaagaucgcaggaauguggagagcuuccaaaaagagauugcu

SEQ ID NO: 163190 - RNA, 64 nt, hsa
gaggacuguccugcugggacaacuaagaagagagaauguggacucugaaucccuuuuucaacuu

SEQ ID NO: 163191 - RNA, 64 nt, hsa
auucauacuggagaaaaacccuacaaauguaaagaauguggaaaagcuuuucaccgauacucaa

SEQ ID NO: 163192 - RNA, 64 nt, hsa
cauaagaaaauucauacuggggagaaaccccacaaauguggagaaugcggaaaagccuuuaacu

SEQ ID NO: 163193 - RNA, 64 nt, hsa
auucauuucagagaaaagcccuauacguguagugaauguggaaaagacuucagauugaauucac

SEQ ID NO: 163194 - RNA, 64 nt, hsa
auucacacaggagagaaagcacaugaauguaaugaauguggaaaagcuuucagucaaaccucau

SEQ ID NO: 163195 - RNA, 64 nt, hsa
guaagacuuaagcaaagccuuuuucauauuugaaaauguggaaagaaaagauguuccuaaaagg

SEQ ID NO: 163196 - RNA, 64 nt, hsa
gaguuacuuuguggaucuuguccaaauuuagugaaauguggaagucaaccagaccaaugaugga

SEQ ID NO: 163197 - RNA, 64 nt, hsa
acucauauaagacagaaacccuauggguguaaugaauguggaaaaucauucugugugaagucaa

SEQ ID NO: 163198 - RNA, 64 nt, hsa
guguugaguugcaggauaucuagcaauuuaagaaaauguggaaaaaauauuuuuauugagaaau

SEQ ID NO: 163199 - RNA, 64 nt, hsa
cuauauuccaguaguaccguuguguguuuucugcaauguggaguugacuuagcuuggcauuuua

SEQ ID NO: 163200 - RNA, 64 nt, hsa
uucauaugcauggggucugaucgcaaauacacuaaauguggaguguaggaaccaaaaugaaacc

SEQ ID NO: 163201 - RNA, 64 nt, hsa
caaauguggaggcggccagggcaguuguugggugaauguggagagcacauggccaugucuugcc

SEQ ID NO: 163202 - RNA, 64 nt, hsa
cugggggucauggagaccaugucuucuuagagcaaauguggaggcggccagggcaguuguuggg

SEQ ID NO: 163203 - RNA, 64 nt, hsa
caauguggagucucccucugauugguuuuggggaaauguggagaagagugcccugcuuugcaaa

SEQ ID NO: 163204 - RNA, 64 nt, hsa
cuuugauaauuguuugaggggaggagauggaaacaauguggagucucccucugauugguuuugg

SEQ ID NO: 163205 - RNA, 64 nt, hsa
aaugauaggugauaggcccacaaggaggacuuacaauguggaacuuagucucuuucccucacuc

SEQ ID NO: 163206 - RNA, 64 nt, hsa
cuauugagaauuuacaauuuuuugucauuuuuuuaauguggaguucacguaacuuugaagauag

SEQ ID NO: 163207 - RNA, 64 nt, hsa
ucaacuggggagcucacuugagcucuugauaagaaauguggagaaaaguaaaaaccaagcuuug

SEQ ID NO: 163208 - RNA, 64 nt, hsa
uuuuggagagcuuaaugggauucugaauauuugcaauguggaguuuccgccccgaucucacguc

SEQ ID NO: 163209 - RNA, 64 nt, hsa
gagacuucugaauuguaaaugaacuuaaaaauagaauguggaugcaaaauaucacauaagacau

SEQ ID NO: 163210 - RNA, 64 nt, hsa
gaauagccauaagaaaaccaggccaagauugaaaaauguggaucggaguagugcucagcauuug

SEQ ID NO: 163211 - RNA, 64 nt, hsa
ccuuugagauaauacguuacacuaagaaaaggaaaauguggauaguaaaacccaccucucucau

SEQ ID NO: 163212 - RNA, 64 nt, hsa
uugaauuuauuuuaaaauuuuaauagccaccaagaauguggacauaugaaaauucaagaaccua

SEQ ID NO: 163213 - RNA, 64 nt, hsa
gacaggggaccuugaaaaucacuaaguuauuaaaaauguggaugugcuagaauuggauaugucc

SEQ ID NO: 163214 - RNA, 64 nt, hsa
aagccaguuugaauauuauguaacuuauuuuuuuaauguggacaggggaccuugaaaaucacua

SEQ ID NO: 163215 - RNA, 64 nt, hsa
uauuaugaccagugugucuggccgcauuccccccaauguggagaagucuaucaagaaggaaaug

SEQ ID NO: 163216 - RNA, 64 nt, hsa
agugccuggaggaccaaacaacaacaacuaugcaaauguggaauuaauucuugauauugcuaaa

SEQ ID NO: 163217 - RNA, 64 nt, hsa
agcgccuuuuccagaaaguucccauugcucaauaaauguggaucaucagagacauuuaugaaca

SEQ ID NO: 163218 - RNA, 64 nt, hsa
uaugaacaaugacagaagaaaaauuacccaaauaaauguggaagcaagcaaaagagaacagugu

SEQ ID NO: 163219 - RNA, 64 nt, hsa
augaauucacaguggagaagacccugcaucagggaauguggaaaugacuuugcugaauucucaa

SEQ ID NO: 163220 - RNA, 64 nt, hsa
aaaacucacuggggagaaacccuaugaauguaaaaauguggaagcaacuuuguaucucaggucu

SEQ ID NO: 163221 - RNA, 64 nt, hsa
auucauacuggagagaaacccuaugaauguaaagaauguggaaaacccuucaguuuccuuacag

SEQ ID NO: 163222 - RNA, 64 nt, hsa
acucacacuggagauaaacccuuugaguguaaaaaauguggaaaagcauuuagauacuacuacu

SEQ ID NO: 163223 - RNA, 64 nt, hsa
aaucacacuguacagaaacgcuaugaauguaaacaauguggaaaaaccuacauaucuucuguag

SEQ ID NO: 163224 - RNA, 64 nt, hsa
acucacacuggagauaaacccuuuaaguguaaagaauguggaaaagcauuccgauaccaccaau

SEQ ID NO: 163225 - RNA, 64 nt, hsa
uguugcaggaggcauggugaacucugccuuauguaauguggaugcugggcacagagcugccauc

SEQ ID NO: 163226 - RNA, 64 nt, hsa
uggauuuaucccacugaacaauuugaaugaagacaauguggaauggcuuugagauacaguucag

SEQ ID NO: 163227 - RNA, 64 nt, hsa
gaaaguaaaauuguuccgaacaugcuaucaaauaaauguggaacaccuuuagcaaacuaucaac

SEQ ID NO: 163228 - RNA, 64 nt, hsa
ucugucaaugaaaauacguugaauaaacuauauuaauguggagauguuuugagcaauaauuucu

SEQ ID NO: 163229 - RNA, 64 nt, hsa
guauggaugaucaugacaaacaaucacugcgcaaaauguggaggaaaauucauuaccauaauca

SEQ ID NO: 163230 - RNA, 64 nt, hsa
aauaacucaguggaaaaugauguucagauggugaaauguggaaauguuuuagacaacucuauuu

SEQ ID NO: 163231 - RNA, 64 nt, hsa
auaauccauuuaggugcugaguuacggucccaucucuucacaggcauggauucuaaucccacug

SEQ ID NO: 163232 - RNA, 64 nt, hsa
gguuauugcaaugagggccuugaacaagucauuuucuucacauucucaucuguaaaauggagau

SEQ ID NO: 163233 - RNA, 64 nt, hsa
uugcugucuagugcauucaaaggucacuuuuuguucuucacagaucuuuuuaauguucuuuccc

SEQ ID NO: 163234 - RNA, 64 nt, hsa
ccugcugucggcguuugaccuuccacgugacaguucuucacaauuccuuucaucauuuuuuaaa

SEQ ID NO: 163235 - RNA, 64 nt, hsa
ucucucuuacugcuucauguaauuuuguaucaccucuucacaauuuaguucguaccuggcuuga

SEQ ID NO: 163236 - RNA, 64 nt, hsa
uccauguucaccaagauuugguggguccacacggucuucacaaagaaggaagaaaagaaggagu

SEQ ID NO: 163237 - RNA, 64 nt, hsa
aauaagcacccccaccccaucugccuucaggucuucuucacagccugcacugcccagugggcca

SEQ ID NO: 163238 - RNA, 64 nt, hsa
acuucccaacagcagggcuuuggccaagcccuugucuucacaaauucgcaacacaacaaucaga

SEQ ID NO: 163239 - RNA, 64 nt, hsa
aauuuauaucuaauuauuuccacuugcccuguucucuucacaccaaggaagcuccagauccagu

SEQ ID NO: 163240 - RNA, 64 nt, hsa
uuugacuuucaaaauauauuuuguauuguuaauaucuucacauugugugaauacuggaagcugc

SEQ ID NO: 163241 - RNA, 64 nt, hsa
aaccaguuuuauccaucuuaaaacgccaggcaccucuucacaggugguaaacauuuaggggaag

SEQ ID NO: 163242 - RNA, 64 nt, hsa
ccuuccaguagcaagcugguagagcuguacuuuuucuucacagcuuuuaccaugguuuauaauu

SEQ ID NO: 163243 - RNA, 64 nt, hsa
acuguacagagccuuuggcuuuauguguuuauguucuucacaugcauauguguguaugugugua

SEQ ID NO: 163244 - RNA, 64 nt, hsa
aacggggcaggcccuaggugagggugggcugcccucuucacauggggcaccaggaacaccgucu

SEQ ID NO: 163245 - RNA, 64 nt, hsa
gcugccuugucccuggugagggcaagggucacugucuucacagaaaaaguuugcugacuuguga

SEQ ID NO: 163246 - RNA, 64 nt, hsa
auauuuugaucagauggacucaugaucacagaugucuucacaugccuaugacuaauuuguacac

SEQ ID NO: 163247 - RNA, 64 nt, hsa
aaagcaggaugaagaccuagacuuaccugaaggaucuucacaggaggauaaagacguagaauua

SEQ ID NO: 163248 - RNA, 64 nt, hsa
acaggaggauaaagacguagaauuaccugaaggaucuucacaggaggaugaagaccuagagaaa

SEQ ID NO: 163249 - RNA, 64 nt, hsa
acaggaggaugaagaccuaggguuaucugaaggaucuucacaagaggaugaagaccuagacuca

SEQ ID NO: 163250 - RNA, 64 nt, hsa
aaagcaggaugaagaccuacaauuaccugaaggaucuucacaggaggaugaagaccuaggguua

SEQ ID NO: 163251 - RNA, 64 nt, hsa; identical to SEQ ID NO: 84879

SEQ ID NO: 163252 - RNA, 56 nt, hsa; identical to SEQ ID NO: 84880

SEQ ID NO: 163253 - RNA, 64 nt, hsa; identical to SEQ ID NO: 84881

SEQ ID NO: 163254 - RNA, 64 nt, hsa; identical to SEQ ID NO: 84882

SEQ ID NO: 163255 - RNA, 64 nt, hsa; identical to SEQ ID NO: 84883

SEQ ID NO: 163256 - RNA, 64 nt, hsa; identical to SEQ ID NO: 84884

SEQ ID NO: 163257 - RNA, 64 nt, hsa; identical to SEQ ID NO: 84885

SEQ ID NO: 163258 - RNA, 64 nt, hsa; identical to SEQ ID NO: 84886

SEQ ID NO: 163259 - RNA, 64 nt, hsa; identical to SEQ ID NO: 84887

SEQ ID NO: 163260 - RNA, 64 nt, hsa; identical to SEQ ID NO: 84888

SEQ ID NO: 163261 - RNA, 64 nt, hsa; identical to SEQ ID NO: 84889

SEQ ID NO: 163262 - RNA, 64 nt, hsa
uuuuuuccauguaaaucaacuaucuuuguuaucacuaagugauaauuaauuuuuaacuuaugug

SEQ ID NO: 163263 - RNA, 64 nt, hsa
auuuuuuaauuucacugccaaguuugcagugguucuaagugaaucugugggcauuuuagccugu

SEQ ID NO: 163264 - RNA, 64 nt, hsa
gguggggaugauaagaaaugcuaauauaaaaaugcuaagugaaaaaaagacuuggccaggagaa

SEQ ID NO: 163265 - RNA, 64 nt, hsa
uuuguaccagccuuuuaaaaaguuuuaguuuuuccuaagugauuuugcucucuuccaaucuaaa

SEQ ID NO: 163266 - RNA, 64 nt, hsa
caguuuucucaucuguaaaaucaggaagauuggacuaagugauccugaaauguauuuuuuagca

SEQ ID NO: 163267 - RNA, 64 nt, hsa
ucugggcaaccugguuuuccaaauaucauuugaccuaagugaauguugauacuagcuaaagauu

SEQ ID NO: 163268 - RNA, 64 nt, hsa
aacccuuauuguccuggguggaccaauccaaaggcuaagugauagugacucaucaauguugggu

SEQ ID NO: 163269 - RNA, 64 nt, hsa
cacguccuggagcccgaguggaccaaucggaagccuaagugacgaugacccucgcauguccuag

SEQ ID NO: 163270 - RNA, 64 nt, hsa
aagcugaugggcgaggaggcccuggcggggggcgacaagucagacccgaaccuuaauaaccccg

SEQ ID NO: 163271 - RNA, 64 nt, hsa
uauuucuagauucuccuuuguacagagucacuucacaagucaagcuacuguuuuacaggugcuc

SEQ ID NO: 163272 - RNA, 64 nt, hsa
agcaauaggcagaggaaaauagcuuuucuaugacacaagucauaagaaguccauauacugaaga

SEQ ID NO: 163273 - RNA, 64 nt, hsa
aauaugaaaguauuguuuauagauaauuuaucucacaagucaaaaaugaagauuuugcagcacu

SEQ ID NO: 163274 - RNA, 64 nt, hsa
agugguggacuuuaaaaccguaagagguaucauuacaagucaccuggaacagacucaaagaaca

SEQ ID NO: 163275 - RNA, 64 nt, hsa
aaugccacaaaauaagggcuauagagagauuuuuacaagucagauuuuuuguuccccaaaucuu

SEQ ID NO: 163276 - RNA, 64 nt, hsa
cugucccccuacgccaucccgacacguccccguucccccgaaaccuggcucagugcaauacucc

SEQ ID NO: 163277 - RNA, 64 nt, hsa
gacccagagccgagcuccacuucugcuccggcugcccccgaaggcgcugcccaccccgcugagg

SEQ ID NO: 163278 - RNA, 64 nt, hsa
aaaggacuggccuuuccagaaaacgcuuuggaucugagcagaguagucaguuucucagacacuc

SEQ ID NO: 163279 - RNA, 64 nt, hsa
agcugccccccaucaccacgccaucacaccccucugagcagaagcaaaucugaggcugaagaau

SEQ ID NO: 163280 - RNA, 64 nt, hsa
aacacagggaaggucugguacauauuggaaauuaugagcagaacaaauacucaacuaaaugcac

SEQ ID NO: 163281 - RNA, 64 nt, hsa
agggagguuuauucagaucgcuggcagccucggcugagcagaugcacagaggggaucacugugc

SEQ ID NO: 163282 - RNA, 64 nt, hsa
caaaugacuaucaguggcaaaaaagaacaaaaucugagcagagaugauuuugaaccagauauuu

SEQ ID NO: 163283 - RNA, 64 nt, hsa
agaaucgcuugaacccuggagauggagguugcagugagcagagaucgcaccacugcacuccagc

SEQ ID NO: 163284 - RNA, 64 nt, hsa
ggcaacucgcaaagaugagauggaagaaggcacgugagcagaggaggcagcucccaaagagagg

SEQ ID NO: 163285 - RNA, 64 nt, hsa
uugaaaacaacuuugguacacaaaggcagcuuugugagcagagcuccuuccccucuccccggga

SEQ ID NO: 163286 - RNA, 64 nt, hsa
acacaccuucccugagcuuacaucacugcccuuuugagcagaaagucuaaauuccuuccaagac

SEQ ID NO: 163287 - RNA, 64 nt, hsa
uuguggaacucacugccucaguuuggguaaaggaugagcagacaagucaacuaaagaaaaaaga

SEQ ID NO: 163288 - RNA, 64 nt, hsa
gcggccacagcuccguggaaggacucccccuaccugagcagagcagaagccccagggcggagcu

SEQ ID NO: 163289 - RNA, 64 nt, hsa
agugucuguggggguuucucugccagcagggggcugagcagagcccauccaggacacuccacac

SEQ ID NO: 163290 - RNA, 64 nt, hsa
cggcggguccugcugugccaucucccugugcgccugagcagaucaauccaccagugcaaaacag

SEQ ID NO: 163291 - RNA, 64 nt, hsa
gccccgaccaguggggacacuccucccuccccagugagcagaaggcaccguggugguggcucug

SEQ ID NO: 163292 - RNA, 64 nt, hsa
ucagagccaaauacucuuugugcaagugccuuccugagcagaagaacuggagaaagggaaccac

SEQ ID NO: 163293 - RNA, 64 nt, hsa
ggagaaagggaaccacagagccaggaggaaugucugagcagagucaagcaacuggcuugaccac

SEQ ID NO: 163294 - RNA, 64 nt, hsa
uuaaguggacaggcccacaagaugaccuugcaugugagcagauggcagagaugggugugugagg

SEQ ID NO: 163295 - RNA, 64 nt, hsa
gggagagggguggggagcgagucacugccuccucugagcagagauucagaguaggaucacauga

SEQ ID NO: 163296 - RNA, 64 nt, hsa
cucuucgcaggggcugaugcacuggguguggagcugagcagagaggccuaaccaggaucaggca

SEQ ID NO: 163297 - RNA, 64 nt, hsa
cccauuaaugauuuuguuucaggagaggugagaaugagcagauuuaauuaaugucuguuauguu

SEQ ID NO: 163298 - RNA, 64 nt, hsa
cugaggcauuugugagucuuccuuauaaaccugaugagcagaucucaacuaucuagcuugugug

SEQ ID NO: 163299 - RNA, 64 nt, hsa
ucuaugucuuguccugauucacugucauaaagcaugagcagaggcuagaaguaucaucuggauu

SEQ ID NO: 163300 - RNA, 64 nt, hsa
gugcgagggccgggagacagauacuuggcugugaugagcagacauccucuguccccguggaggg

SEQ ID NO: 163301 - RNA, 64 nt, hsa
ucacaccaaagaugaggguagcgagcaacuggcuugagcagacagaacggggaagacuccacuc

SEQ ID NO: 163302 - RNA, 64 nt, hsa
uagaaguguuggcacgcacagccauggacccagcugagcagagcagacgcuuugcaggcugccc

SEQ ID NO: 163303 - RNA, 64 nt, hsa
gagagagagucuaggagcaaacacaucaccacccugagcagauacaggaguggggagggggcug

SEQ ID NO: 163304 - RNA, 64 nt, hsa
cuuagacagcagggcucucuguaucagucuuucuugagcagaugauuccccuaguugaguagcc

SEQ ID NO: 163305 - RNA, 64 nt, hsa
uaaaaggaacaaagggauguucacuguaugccucugagcagagagcagcagcagcagguaccag

SEQ ID NO: 163306 - RNA, 64 nt, hsa
uccugccuguacugaaguucacagcccaccugacugagcagacucuuccuguuccuuucucuac

SEQ ID NO: 163307 - RNA, 64 nt, hsa
guuuaacacagcagaguacagaagggugaagaagugagcagaggcuuaugaagauauucagaua

SEQ ID NO: 163308 - RNA, 64 nt, hsa
agugcacccacucugcuuugacugagcagacuggugagcagacuggugggaucugugcccagag

SEQ ID NO: 163309 - RNA, 64 nt, hsa
cacguccaccccagugcacccacucugcuuugacugagcagacuggugagcagacuggugggau

SEQ ID NO: 163310 - RNA, 64 nt, hsa
ccacagccccucaaagacuuuuuuuuguuuguuuugagcagacaggcuaaaaugugaacguggg

SEQ ID NO: 163311 - RNA, 64 nt, hsa
uguucacagucucuggaaaagcugggguaguuggugagcagagcgggacucuguccaacaagcc

SEQ ID NO: 163312 - RNA, 64 nt, hsa
uggguagcugauaagccagugccagcauccagcaugagcagaugucggggagacugggaagucu

SEQ ID NO: 163313 - RNA, 64 nt, hsa
ucccuucaugauaagccagugccagcauccagcgugagcagacgucggggagacugggaagucu

SEQ ID NO: 163314 - RNA, 64 nt, hsa
cccaccccauuuacagggugagcucagccugucaugagcagaggaaaauauuauuaaugcucuc

SEQ ID NO: 163315 - RNA, 64 nt, hsa
uauuuuauggagggaaaauaaggccagaaacuucugagcagauaacuccacaaauggaaauuua

SEQ ID NO: 163316 - RNA, 64 nt, hsa
gggcagcccucgcaugcuggggucgggccagcucuccccgaaaggucuugaccugaaugauggc

SEQ ID NO: 163317 - RNA, 64 nt, hsa
uuauccugcagaaaaucaagcccugacucugcacuccccgaaguagugauguuaauuaacaacu

SEQ ID NO: 163318 - RNA, 64 nt, hsa
cugagaggccccugccggugggugauggauaucauccccgaacaggugaagggacaacugacua

SEQ ID NO: 163319 - RNA, 64 nt, hsa
gacagcauucggcguauaccuaaggagaguuuuuuccccgaacugacagcaacgauuccaacca

SEQ ID NO: 163320 - RNA, 64 nt, hsa
ucugaaucccuccuauucaccuugcugcuguuauuccccgaaugcgcaacauaccccccaucaa

SEQ ID NO: 163321 - RNA, 64 nt, hsa
uggggacugcaccagaaagugucuaaccuuguguuccccgaaauccuuucucugacuuaggaac

SEQ ID NO: 163322 - RNA, 64 nt, hsa
gccccccugcggggaggagguggagcagcgggcguccccgaagugagggccaggcccuucccgg

SEQ ID NO: 163323 - RNA, 64 nt, hsa
accccaccugcccaggcagccccucgucaccuacuccccgaaguuaccagcucagcucgagucu

SEQ ID NO: 163324 - RNA, 64 nt, hsa
ugugggcucuaggacugacuggguucuuccucccuccccgaagcccagacaguucaguugggcu

SEQ ID NO: 163325 - RNA, 64 nt, hsa
gguggacuuagaaagcaggggcuacaagagggaauccccgaaggugcuggaggugggagcagga

SEQ ID NO: 163326 - RNA, 64 nt, hsa
gaauuaaaucaguaaagcaaucuguuauuuccuauccccgaauuaccuuuucuaugccaaaaca

SEQ ID NO: 163327 - RNA, 64 nt, hsa
gaaacugaccugugauauuuuacuugaauuugucuccccgaaagggacacaauguggcaugacu

SEQ ID NO: 163328 - RNA, 64 nt, hsa
aagagcucugcacagggacccaucccaugguuucuccccgaaagccgcucucuucccucuucgc

SEQ ID NO: 163329 - RNA, 64 nt, hsa
acuaauugggauuauuuuuuaaaagaggucuuucuccccgaaauacaaguuuuagaaaaucuua

SEQ ID NO: 163330 - RNA, 64 nt, hsa
ucugucaaugaugcacuaaccucccaaccugauuuccccgaaucugagggaaggugagggagug

SEQ ID NO: 163331 - RNA, 64 nt, hsa
ccagacauccccagacuccacagauguaaugaaguccccgaauguaucuguuucuaaggagccu

SEQ ID NO: 163332 - RNA, 64 nt, hsa
ggauuggacaucaccgaggaacagcgggauugccuccccgaaugccucccugggaggcacacug

SEQ ID NO: 163333 - RNA, 64 nt, hsa
agugacaucugaugcuugcugugaacuuuuaagauccccgaauccugagcaccucaaucuuuaa

SEQ ID NO: 163334 - RNA, 64 nt, hsa
ccuuucacacuguggugucucuuggggaaggaucuccccgaaucucaauaaaccagugaacagu

SEQ ID NO: 163335 - RNA, 64 nt, hsa
gaggccaggugaaugggaggccagggccccagacuccccgaaguuggccugcccggccuuuggg

SEQ ID NO: 163336 - RNA, 64 nt, hsa
cccaagccugucaguggcccucccuggugcacuguccccgaaaccccugcuugggaagggaagc

SEQ ID NO: 163337 - RNA, 64 nt, hsa
auuucgggagccuugucagugugucaguuuuuccuccccgaagacacuccuuccccaaguaauu

SEQ ID NO: 163338 - RNA, 64 nt, hsa
augugugaucucgucuuccagcgugccgcucaguuccccgaauccgugugcacacgugugaucu

SEQ ID NO: 163339 - RNA, 64 nt, hsa
caacgggggugccaggagccccaggcugagggcuuccccgaaagucugggaccagguccaggug

SEQ ID NO: 163340 - RNA, 64 nt, hsa
uagcagcagugcaugggcgcuggucuagcugggguccccgaaguccuugcucccgcuccugcgg

SEQ ID NO: 163341 - RNA, 64 nt, hsa
cauuuauacuauuauuuguuacguucaaucagaauccccgaaaccuccuauaaagcuuagcugc

SEQ ID NO: 163342 - RNA, 64 nt, hsa
ggacacuuaauggaaccaagcuaaccaaaguaucuccccgaaguuucaugauaucuaguccauu

SEQ ID NO: 163343 - RNA, 64 nt, hsa
ggggcuucuccugacccaguccccgugccccgccuccccgaaacaggcuacucuccucggcccc

SEQ ID NO: 163344 - RNA, 64 nt, hsa
aacucugaugcucugcgugggaccaugccugaacuccccgaauaacugaaaaauggcugaauau

SEQ ID NO: 163345 - RNA, 64 nt, hsa
aacaggguguucccagaaggcaggucccucauuguccccgaagccucuccuggaccuguggcga

SEQ ID NO: 163346 - RNA, 64 nt, hsa
guaugcauucacauugaguguggcucauuuucuuuccccgaacgccaugacuguucagaagcac

SEQ ID NO: 163347 - RNA, 64 nt, hsa
cgacacagacguuaggcauuuccugcugaacguuuccccgaagagucagccccgacuuccugac

SEQ ID NO: 163348 - RNA, 64 nt, hsa
cauccuucuuccacugucucauccacauaagcacuccccgaagaauuaaggggguucuguuuuc

SEQ ID NO: 163349 - RNA, 64 nt, hsa
aauaauggaaugcuacuaagauacuccauauucuuccccgaaucacacagacaguuucugacag

SEQ ID NO: 163350 - RNA, 64 nt, hsa
ugcagcacaggaggcuccgugagcccuugguuccuccccgaaaacccccagcauuacgaucccc

SEQ ID NO: 163351 - RNA, 64 nt, hsa
ugcuacaaguguuuuagauguuacuaccuuauuuuccccgaauucuauuuuuguccuugcagac

SEQ ID NO: 163352 - RNA, 64 nt, hsa
gcugcagaagaagcugaaggcugacuuuguccccuccccgaaaaaggguguuuugaugccucag

SEQ ID NO: 163353 - RNA, 64 nt, hsa
ccagcggcgcggagcuguaaccccuaccccugccuccccgaagccucccuggggccccuucagg

SEQ ID NO: 163354 - RNA, 64 nt, hsa
auugugggcucuggaaaccacauggcuucaccuguccccgaaacuaccagcccuacaccauucc

SEQ ID NO: 163355 - RNA, 64 nt, hsa
cuggccuggggagggcuugggccugugaggauucuccccgaaggugcccucggaggcagcaggu

SEQ ID NO: 163356 - RNA, 64 nt, hsa
ugccaaggaagcuggaggaaucccugacucaacuuccccgaaggaggccucuguggcggccagg

SEQ ID NO: 163357 - RNA, 64 nt, hsa
cauuguugccaggggugaggccgugccccaggccuccccgaaaccaaaggggaaggcaggggug

SEQ ID NO: 163358 - RNA, 64 nt, hsa
uuuaucuugaccauaauuugucauucuuuuauaauccccgaaguuaaaucuugcuguuauggug

SEQ ID NO: 163359 - RNA, 64 nt, hsa
ggccagccaagcccugccgaucagacaugugggcuccccgaagcccagccagagacugccgugc

SEQ ID NO: 163360 - RNA, 64 nt, hsa
cccguguauggccccccugcaccuccuugucucauccccgaagauccgucccccuggccccuca

SEQ ID NO: 163361 - RNA, 64 nt, hsa
gggaggcgucuccaaggaggugacacuuaagccauccccgaaagaggugaaagagaucacuuug

SEQ ID NO: 163362 - RNA, 64 nt, hsa
ccuggccuaccacucacuggccucgcucccccuguccccgaaucucagccaccgugucacucug

SEQ ID NO: 163363 - RNA, 64 nt, hsa
ucccuacccugacucaccgccauggagaucacccuccccgaagcugucgccagggugacccaac

SEQ ID NO: 163364 - RNA, 64 nt, hsa
gcuuggagacccacaaagagagugcgcccugcacuccccgaacccgaguccgcgcugggggagc

SEQ ID NO: 163365 - RNA, 64 nt, hsa
guuuucauugagcauuucucuauuuuuccaguuauccccgaaauuucuauguauuauauuuuuu

SEQ ID NO: 163366 - RNA, 64 nt, hsa
agggauuaagaaggaacccggugugcacagcagauccccgaaauuggugggcuugaccuccugg

SEQ ID NO: 163367 - RNA, 64 nt, hsa
gggcgagggcuugcucuggacucagucugucaaguccccgaagcuuccugcagcuccaccuugu

SEQ ID NO: 163368 - RNA, 64 nt, hsa
cgacguaccccagugcgccucggcacaccauugcuccccgaaacugggguguccaggcggaaca

SEQ ID NO: 163369 - RNA, 64 nt, hsa
ggcuguaggaucccccuugaugcaagagguaggcuccccgaaagacccuggaaagucccugcca

SEQ ID NO: 163370 - RNA, 64 nt, hsa
ccuggcaacaggcucagugggggucagguccagguccccgaagaggugcuggagaggaaagcag

SEQ ID NO: 163371 - RNA, 64 nt, hsa
gcaucauaacuuuacagaauugaaucuagagucuuccccgaaaagcccagaaacuucucugcag

SEQ ID NO: 163372 - RNA, 64 nt, hsa
cucagggccagagaaagucagaacaaagaaaauguccccgaaacgaauuuucuuacaaaagccu

SEQ ID NO: 163373 - RNA, 64 nt, hsa
cucgaaacacagaaaccuuuuuaaaaauagacacuccccgaagucuuuuguucgcauggucaca

SEQ ID NO: 163374 - RNA, 64 nt, hsa
guucccagugggcuuagagggaggaccugaugacugauuccaggauacuuguacuucuaauaac

SEQ ID NO: 163375 - RNA, 64 nt, hsa
gagcauaacaacgaaaggcauccagcugacuuuuugauuccaagauuauugauuggauugacuu

SEQ ID NO: 163376 - RNA, 64 nt, hsa
aaguaaauaaauaaauagcaaccaguacuccaggugauuccagcauaacuuauccaugguuugu

SEQ ID NO: 163377 - RNA, 64 nt, hsa
ugacuuguccaggggcagacaccaaaugggaaucugauuccaguggaugucucuuuucagugca

SEQ ID NO: 163378 - RNA, 64 nt, hsa
augcagauuguugggaaaucuguaaggaaguaacugauuccaggcaaauuguuuucuuccuucu

SEQ ID NO: 163379 - RNA, 64 nt, hsa
uuucaggcucauuugcuuuugcuuuuuuguugaaugauuccaaucguaaauaaagcuuuuaaua

SEQ ID NO: 163380 - RNA, 64 nt, hsa
cuggcggcuccagcgcaggcugucccugcugcuuugauuccaggugauuuuauuuuuuuuauuu

SEQ ID NO: 163381 - RNA, 64 nt, hsa
gcugggauuauaggcgugagccaccgcccccagcugauuccaggcgaauucuucucugaugggc

SEQ ID NO: 163382 - RNA, 64 nt, hsa
uuuggugucugcuucaagaggggguuuuacacucugauuccaggacaagcacucugaggcgggu

SEQ ID NO: 163383 - RNA, 64 nt, hsa
cucagagcagagaagggcucuccccacugcuucgugauuccagggccagagccaugcaguccca

SEQ ID NO: 163384 - RNA, 64 nt, hsa
gucuccucaguaaucuaggauucaaugauagguaugauuccaguuuauuauccaucaaaggcuc

SEQ ID NO: 163385 - RNA, 64 nt, hsa
aaagugauauaugaguuaaaugaccaagcagacuugauuccaggaauguuaaggaauguucauu

SEQ ID NO: 163386 - RNA, 64 nt, hsa
cuaggacauugucauuauucuuccuccaucuaucugauuccauuccuuccacacccagcuaaag

SEQ ID NO: 163387 - RNA, 64 nt, hsa
agcuccauggcucuucauucaaaagggaaaauaaugauuccacguugcuuuuuagaguucaaau

SEQ ID NO: 163388 - RNA, 64 nt, hsa
cugucccagcaccgagacucacuccuaagucuucugauuccaugagcagucccccuucccccau

SEQ ID NO: 163389 - RNA, 64 nt, hsa
cuauguguagaagcuaggguucaaggcagaucugugauuccagaagcuguucucuaaaccacua

SEQ ID NO: 163390 - RNA, 64 nt, hsa
uaacccuaaaauuuuaaggccacggccuugugucugauuccauauggaggccugaaaauuguag

SEQ ID NO: 163391 - RNA, 64 nt, hsa
gccacucuuccucuuggggacaacaggaagugucugauuccagucugccuaguacguugguaca

SEQ ID NO: 163392 - RNA, 64 nt, hsa
cugugcugcacuuuuuauagagcugcauugucggugauuccaauuuaaaaauccauauucaaaa

SEQ ID NO: 163393 - RNA, 64 nt, hsa
uuaaggaccauggugugauagaucccauuucaaaugauuccauaugauugucaguguguguguc

SEQ ID NO: 163394 - RNA, 64 nt, hsa
uggccucuucacauaacaagaugagcuggaaugaugauuccaugacucccaccuaugcagccuu

SEQ ID NO: 163395 - RNA, 64 nt, hsa
ucaggugugcccacagaugcggaggcgaggugagugauuccaucauuucaguucucaccugcag

SEQ ID NO: 163396 - RNA, 64 nt, hsa
auauagauuuuauaccucaguggggaaaaauaacugauuccaaugacauucauuuuguuuucau

SEQ ID NO: 163397 - RNA, 64 nt, hsa
uuuucacagcaauaaaucuucaguucuuuguuuaugauuccacuuaacaaaaggccugcagaag

SEQ ID NO: 163398 - RNA, 64 nt, hsa
cuccccugccugccugauuccauggcuguugugcugauuccaaugcuuucacguugguuccugg

SEQ ID NO: 163399 - RNA, 64 nt, hsa
ucagaaggacacagcccguccuccccugccugccugauuccauggcuguugugcugauuccaau

SEQ ID NO: 163400 - RNA, 64 nt, hsa
uguagcauuuggugcuugacguauuauuguccuuugauuccaaauaauauguuuccuucccuca

SEQ ID NO: 163401 - RNA, 64 nt, hsa
ccaguagcaggcccgaaagaggcacccuuccaucugauuccagcacaaccuucaagcugcuuuu

SEQ ID NO: 163402 - RNA, 64 nt, hsa
gagaaagacaaacuugucuggaaaccagaguugcugauuccacccggggggcccggcugacucg

SEQ ID NO: 163403 - RNA, 64 nt, hsa
ccaauuuguggagaggccgggugccuuucugucuugauuccagggggcugguucacacuguucu

SEQ ID NO: 163404 - RNA, 64 nt, hsa; identical to SEQ ID NO: 106196

SEQ ID NO: 163405 - RNA, 64 nt, hsa; identical to SEQ ID NO: 106197

SEQ ID NO: 163406 - RNA, 64 nt, hsa; identical to SEQ ID NO: 106198

SEQ ID NO: 163407 - RNA, 64 nt, hsa; identical to SEQ ID NO: 106199

SEQ ID NO: 163408 - RNA, 64 nt, hsa
gaacauauugcuuaguaacaaaugaaggacaagcauacuacauaauauaauccauacaauucuc

SEQ ID NO: 163409 - RNA, 64 nt, hsa
ccauacaauucucuucaguuaguguaaacugcaaauacuacagauaauucugauaauaaaauga

SEQ ID NO: 163410 - RNA, 64 nt, hsa
uuucauuuuuauugcuauauaguauuauauaaauauacuacaacuuauucauucuugauggaca

SEQ ID NO: 163411 - RNA, 64 nt, hsa
uuacauuuucacucuuuuuuuaaugaaguauuucauacuacaaaaauacauaaacguauauaua

SEQ ID NO: 163412 - RNA, 64 nt, hsa
uuauuuaaauuacuaaggucuagguuuacaaagcauacuacaggacccuuuucuaugcaauauc

SEQ ID NO: 163413 - RNA, 64 nt, hsa
uuuuuuugugauuaugcuugugagaaauuuuguaauacuacauucuaguucuguuuucguuuau

SEQ ID NO: 163414 - RNA, 64 nt, hsa
aacucuuguugucucuuccucuucagaacucuuguccccccaggcuccccaccucugcaagaug

SEQ ID NO: 163415 - RNA, 64 nt, hsa
cacagaacuaguuuuuuaauccucaggcagugcauccccccacccuacaacugagcacaaccuc

SEQ ID NO: 163416 - RNA, 64 nt, hsa
gcaccauacaucuguguccgcccccucuaccccuuccccccacguagggcacuguaguggacca

SEQ ID NO: 163417 - RNA, 64 nt, hsa
accuuucccugacuccuggugcccucucccuuuguccccccagagagacauaugcccccagaga

SEQ ID NO: 163418 - RNA, 64 nt, hsa
agggaccucaggggcaccuccggcugccuagcccuccccccagcucccugcaccgccgcagaag

SEQ ID NO: 163419 - RNA, 64 nt, hsa
guggccaagccugcuguguccuuccuccacaagguccccccaccgcucagugucagcgggugac

SEQ ID NO: 163420 - RNA, 64 nt, hsa
aucguaagagcuuugaauuugaagugaguuuuuuuccccccauaaguuauuuauuccuuuuuuc

SEQ ID NO: 163421 - RNA, 64 nt, hsa
augauaaaggcuuucuacauucuaauuuacuuuuuccccccacuugaauguguuuuaaaggcua

SEQ ID NO: 163422 - RNA, 64 nt, hsa
cucagacaggacuuucuaugcauguuuucccuccuccccccaauucccccccccaucaccuuau

SEQ ID NO: 163423 - RNA, 64 nt, hsa
gagagaugaggcccgucagagucaagagaugucauccccccagggucuccaaggcauuuccaca

SEQ ID NO: 163424 - RNA, 64 nt, hsa
uuaccugggaccugccccccaugagccaggacgguccccccacagucagccugugcaaaggccc

SEQ ID NO: 163425 - RNA, 64 nt, hsa
uuaauugugagcucauuuuucuuuguuacuuuuguccccccagauuugggggacaaaauaaaau

SEQ ID NO: 163426 - RNA, 64 nt, hsa
aaaauaaagaaauguguuuuuaucguaauuuauuuccccccagccauugcucacucugucuaga

SEQ ID NO: 163427 - RNA, 64 nt, hsa
ggccugccccccaacccugaggaugccccugccauccccccaaccuccucauauugccucugaa

SEQ ID NO: 163428 - RNA, 64 nt, hsa
uguuuaugcauagccuugauuuguuugacuccccuccccccauuuacaugcaugcaaucagaca

SEQ ID NO: 163429 - RNA, 64 nt, hsa
ugacauccugagggucauucaucccaugcccaguuccccccauccuacuccuaacagaugugac

SEQ ID NO: 163430 - RNA, 64 nt, hsa
cuaggagacaggaguccuggguuugagcccugccuccccccacugccuaaugugggaacccaag

SEQ ID NO: 163431 - RNA, 64 nt, hsa
uugcauuuugcucaaacuguagaaugcccuacauuccccccaccccaauuugcuauuuccuuau

SEQ ID NO: 163432 - RNA, 64 nt, hsa
cauuaagcuauuucauaauaaauucuguacaguuuccccccaaaaaagagauuuauuuaugaaa

SEQ ID NO: 163433 - RNA, 64 nt, hsa
ucuggcaacaaaagccagaguguugugggccaaguccccccacagggccucugcagggcauggc

SEQ ID NO: 163434 - RNA, 64 nt, hsa
ccccgagguggggacagugagugaguucucuuaguccccccagagcugguuguuaaagagccug

SEQ ID NO: 163435 - RNA, 64 nt, hsa
guggcuggcaguguuggccacguaggggcucccauccccccaccauugugucacaugggcugcc

SEQ ID NO: 163436 - RNA, 64 nt, hsa
ugggcucugggcaucccuguuccccccucuuucuuccccccacucuucuggggucggggguucc

SEQ ID NO: 163437 - RNA, 64 nt, hsa
ugugguucauucuuagaaccaagggaaauacugcuccccccauuugcugacguagugcucucau

SEQ ID NO: 163438 - RNA, 64 nt, hsa
acacaaaauuucaaccauucuuaauguuacguccuccccccacccccuucuuucagugguaugc

SEQ ID NO: 163439 - RNA, 64 nt, hsa
cuccuacccccuacucuggggcuugggggucaacuccccccaggacuuaccuuccaaaacaaac

SEQ ID NO: 163440 - RNA, 64 nt, hsa
guuaauaucuugaauuuagucccuccauccuuaauccccccaucccuccccaucaugcaaccag

SEQ ID NO: 163441 - RNA, 64 nt, hsa
ugggccugggaaaccacuuccccaggcuucucccuccccccacccccauaggaacaggauuugg

SEQ ID NO: 163442 - RNA, 64 nt, hsa
aagccaggauuccauuuguguugcugcuguauuuuccccccacuucucuauguaacgauauaag

SEQ ID NO: 163443 - RNA, 64 nt, hsa
ccgcugccccccacccacccugcaccccucgcccuccccccaccacagaaucuaagaccuuuca

SEQ ID NO: 163444 - RNA, 64 nt, hsa
ccguggccucaagggcucccagggcaaaccuaauuccccccaaaacgugaagucggggaagcug

SEQ ID NO: 163445 - RNA, 64 nt, hsa
cuugagcuugccccaggccuugggcauaauuauuuccccccaaaaaaggcacaaaaauagguuu

SEQ ID NO: 163446 - RNA, 64 nt, hsa
aggauggcucuagaacacucuguccaugcgucacuccccccaguuuuauuuuuagcuuuggcuu

SEQ ID NO: 163447 - RNA, 64 nt, hsa
cuaggagguccauccccagcaaauguuuuggagguccccccagagagcagagugggccauggca

SEQ ID NO: 163448 - RNA, 64 nt, hsa
agaagggaccccuuggacuuuuucucgccaucccuccccccagcgcaggggcacaagcugagcu

SEQ ID NO: 163449 - RNA, 64 nt, hsa
uaaccugccacgggagggggcccccaaacuuucuuccccccacacuucugguuuucugugugga

SEQ ID NO: 163450 - RNA, 64 nt, hsa
acugccuuggggaggaguggggcagggcagagaauccccccaauuccugccugaaaucucuggc

SEQ ID NO: 163451 - RNA, 64 nt, hsa
auuagccaguggacaccccauuuccuucaccagguccccccacggccauagcccuugcagccaa

SEQ ID NO: 163452 - RNA, 64 nt, hsa
aggcccagggcucaacuucauggccccagcuauauccccccaguuccacacuaaaccagggagg

SEQ ID NO: 163453 - RNA, 64 nt, hsa
aauuccgccuagggccacaaggccuucccuguuuuccccccaagggaggcugcugcugcucuug

SEQ ID NO: 163454 - RNA, 64 nt, hsa
ccaaaggacgcacugagcaacgcuauuccagcuguccccccacucccucacaaguggguacccc

SEQ ID NO: 163455 - RNA, 64 nt, hsa
aaugcaggcuuuuuagccaacaacaaaaguguuuuccccccacccccacucgcccaccagggug

SEQ ID NO: 163456 - RNA, 64 nt, hsa
gaaauccagagugugggagacaucacugcaucuguccccccagcuucugugaagggaagcugug

SEQ ID NO: 163457 - RNA, 64 nt, hsa
cacugacuguaauccagggggacugggaccugccuccccccaaccucuggcucccacaaggccc

SEQ ID NO: 163458 - RNA, 64 nt, hsa
cuccgcaggggccccggcccucccuggcuccccuuccccccaccaccccaucgcuggguuucgg

SEQ ID NO: 163459 - RNA, 64 nt, hsa
ggcaucccugcaaaagggaacagaagaggccaaguccccccaagccacggcccgggguucaagg

SEQ ID NO: 163460 - RNA, 64 nt, hsa
gccccaagcccaagucuuuccucccagcagcguuuccccccaacuccuuaauuuuauucuccgc

SEQ ID NO: 163461 - RNA, 64 nt, hsa
ccucccuccuuccucuacucccaccccucccauguccccccauuccucaaauccauuuuaaaga

SEQ ID NO: 163462 - RNA, 64 nt, hsa
gaggcugucagaggccgucucagcucccagcccuuccccccagcccucagggagcuccgcucag

SEQ ID NO: 163463 - RNA, 64 nt, hsa
cggcugcaccugcucuuggacccuggucuccuuuuccccccagacucggccuccucuccuggga

SEQ ID NO: 163464 - RNA, 64 nt, hsa
gaggggguguccccaagacacugggcuucaaaucuccccccaagcccucccuccuacgaucaag

SEQ ID NO: 163465 - RNA, 64 nt, hsa
agaccucgcgagacuuucggucccccccgccccuuccccccagguuagcaauugggaauggcug

SEQ ID NO: 163466 - RNA, 64 nt, hsa
ccugugugccaaccuuguucacauaccaccuucguccccccaggccccggccccacuccuggcu

SEQ ID NO: 163467 - RNA, 64 nt, hsa
gaccuguggggugaggcagccaagguuccuuccauccccccaguuguggagacacagggcugcc

SEQ ID NO: 163468 - RNA, 64 nt, hsa
accuacuaauccucucugcaagucggucuccuuauccccccaaauggaaauuguauuugccuuc

SEQ ID NO: 163469 - RNA, 64 nt, hsa
aucuuuaaugcuggggcccaaguaagggcacagauccccccacaaaguggaugccugcugcauc

SEQ ID NO: 163470 - RNA, 64 nt, hsa
uggcaaacugcucugugcuuucaaaccaaaguguuccccccaaccccaaauuugucuaagcacu

SEQ ID NO: 163471 - RNA, 64 nt, hsa
uuuuuuccuuuuuucuuuuuuuuuuuuuaauuuuuccccccaaccaucgugauuugucuuuuca

SEQ ID NO: 163472 - RNA, 64 nt, hsa
uuggcaccuccccaagagcuuccacuugguuugguccccccacccgcugcucaguggcucugac

SEQ ID NO: 163473 - RNA, 64 nt, hsa
uccgcugucaccacauccugagcacucggccccauccccccacaggagggaagcuguggucuga

SEQ ID NO: 163474 - RNA, 64 nt, hsa
cccucacaccccgcacucaccccuuccacccaccuccccccauggcccgcugcacgccucuggg

SEQ ID NO: 163475 - RNA, 64 nt, hsa
ucacccaucccaccccaccccuccuauccaccccuccccccacccuccccucacaccccgcacu

SEQ ID NO: 163476 - RNA, 64 nt, hsa
ccuccucuccugacaauacuguaugucgucgagcuccccccaggucuaccccucccggcccugc

SEQ ID NO: 163477 - RNA, 64 nt, hsa
gugccaucagugccccgucuacagcucccccagcuccccccaccucccccacucccaaccacgu

SEQ ID NO: 163478 - RNA, 64 nt, hsa
gucccuacugugcgucagaauccaccuugcgugcugugcguaucugugaaccuggagcgguuac

SEQ ID NO: 163479 - RNA, 64 nt, hsa
ugugcgaggcuguggagugcaggccagagcagggugugcguagcccccagcacccagguucuuc

SEQ ID NO: 163480 - RNA, 64 nt, hsa
ucuugagcaacagugaagcugccauaaauauuucucaacugagguucuugggauacagaucuca

SEQ ID NO: 163481 - RNA, 64 nt, hsa
ggacauuugaacauguuuaauggguaugcucaggucaacugaccugaccccauuccugauccca

SEQ ID NO: 163482 - RNA, 64 nt, hsa
agcucuuucuuauucuacuacacaagccgccaacucaacugagagcuaaagagacuagaaaaga

SEQ ID NO: 163483 - RNA, 64 nt, hsa
gcuaaagagacuagaaaagagauaagcugccaacucaacugagaacaagaaacuagaagagauu

SEQ ID NO: 163484 - RNA, 64 nt, hsa
gcuauuuaaggcaaaagcuaaaauaguucacuccucaacugagacccaaagaauuauagauauu

SEQ ID NO: 163485 - RNA, 64 nt, hsa
ggugugccugucuuaaauuccaaagcuuuacauuucaacugaaaaagaaacuagaaauguccua

SEQ ID NO: 163486 - RNA, 64 nt, hsa
ggaaccaugccuucauaauucuagaaaguuauuuucaacugauaaaucuauauucacccaaaua

SEQ ID NO: 163487 - RNA, 64 nt, hsa
uaauauuuauuaaagaugaagauccacauacccuucaacugagcaguuucacuaguggaaauac

SEQ ID NO: 163488 - RNA, 64 nt, hsa
cuggaaauucauuuuccuuacucgauguuuucuuucaacugagaagccuaaaacaaacaaaaac

SEQ ID NO: 163489 - RNA, 64 nt, hsa
cucuaugauggucauucaagguaguaggucucuuucaacugagugcaacauugagaauaaugau

SEQ ID NO: 163490 - RNA, 64 nt, hsa
cucugcucugcucagcugcgcccccuucuuugcagcugcccagccccuccucccugcccucggg

SEQ ID NO: 163491 - RNA, 64 nt, hsa
agggaaagguaggaagagagguccagccccccaggcugcccagagcugcuggucucauuugggg

SEQ ID NO: 163492 - RNA, 64 nt, hsa
acgugcggcaccugaagggggaggaugacaagccgcugcccaccuccaagcccaggaaacagua

SEQ ID NO: 163493 - RNA, 64 nt, hsa
ccugggcagcaagcgcagccuggaggaagagggugcugcccacagugggaagagacugcgggcc

SEQ ID NO: 163494 - RNA, 64 nt, hsa
accccgucugggaagugaggagcgucucugccuggcugcccauugucugggacgugagcagccc

SEQ ID NO: 163495 - RNA, 64 nt, hsa
ccauugucugggacgugagcagccccucugccuggcugcccagucuggaaagugaggagcgucu

SEQ ID NO: 163496 - RNA, 64 nt, hsa
ggacuccggacuauccauggcuccgaaucuaagugcugcccacucccaugcucacacccacaga

SEQ ID NO: 163497 - RNA, 64 nt, hsa
gccaugcuuuggaagggacaagacuaugugcuccgcugcccaccuucagccugcaaugagggac

SEQ ID NO: 163498 - RNA, 64 nt, hsa
ugcucuguccccaggaaccaggcuuugcugaggugcugcccaaccugacaguccaggagaugga

SEQ ID NO: 163499 - RNA, 64 nt, hsa
gugaucugugacccgguggugugcccaccgcccagcugcccacacccggugcaggcucccgacc

SEQ ID NO: 163500 - RNA, 64 nt, hsa
gcacggugucgaggguauugggccgggaguacaagcugcccauggacgaccugcugccacuucu

SEQ ID NO: 163501 - RNA, 64 nt, hsa
accuccaggugcauggauuggugcugccccucaugcugcccagcuucuacucagagcucuucac

SEQ ID NO: 163502 - RNA, 64 nt, hsa
agacuagggcuggcauugcuguagagugacggcugcugcccagagcgugucccagacaucacag

SEQ ID NO: 163503 - RNA, 64 nt, hsa
gcagacacaccugucccccagugaugccgcccaagcugcccauggggcuuccuacggaaguuuc

SEQ ID NO: 163504 - RNA, 64 nt, hsa
uccaucacuggccucuguccuuggcagagaccuugcugcccaggcccaggggcaggcucuuggc

SEQ ID NO: 163505 - RNA, 64 nt, hsa
acaggcaacgccaggucugcaggccaggagagaugcugcccaggccuccugguuuccaagcugg

SEQ ID NO: 163506 - RNA, 64 nt, hsa
accagcugucugcuggguucuuuucucaaguccugcugcccaggcccaggugagacaggcaacg

SEQ ID NO: 163507 - RNA, 64 nt, hsa
gccucaguggucacuugaccaccauugucucagagcugcccacuuugugugugucacaugcugc

SEQ ID NO: 163508 - RNA, 64 nt, hsa
accccccagguuccuucuugcacaaauccacucugcugcccaccuucccuggcauuuuaaacag

SEQ ID NO: 163509 - RNA, 64 nt, hsa
aucaucaggggaagaucaaacacaggugcacucagcugcccagggccucugggacacuugccuu

SEQ ID NO: 163510 - RNA, 64 nt, hsa
cagaggacuccaccuccuggcugguuuaccugcugcugcccauuuucucuggguacugcuggcc

SEQ ID NO: 163511 - RNA, 64 nt, hsa
cccuugcuucucaacuaaagaauagugccucagcgcugcccacaccaccgcccuccucgcugug

SEQ ID NO: 163512 - RNA, 64 nt, hsa
ccccuccagugcuuggcugccccacaggccacacgcugcccaggcucugcugacuucugagcag

SEQ ID NO: 163513 - RNA, 64 nt, hsa
cccuggcacagccaacccuguugcccccagugccgcugcccagcuucggccauccagguggugg

SEQ ID NO: 163514 - RNA, 64 nt, hsa
cagagccgggaggucacacauguacauccuggaagcugcccaagguguggccacuuguagggca

SEQ ID NO: 163515 - RNA, 64 nt, hsa
agggccccccaacugugguagcuccagcgauggugcugcccaggccucucggugcuccaucucc

SEQ ID NO: 163516 - RNA, 64 nt, hsa
cccgccucccuaguuagcauccaggcuggccagugcugcccaugagcaagccuagguacgaaga

SEQ ID NO: 163517 - RNA, 64 nt, hsa
gagagagacccgggaugugugugcuguaccccaagcugcccacugucuugcccgggcugagguc

SEQ ID NO: 163518 - RNA, 64 nt, hsa
accgugugcacauccugcaggugcuacugagacugcugcccaacaugagcagugaucuccaagg

SEQ ID NO: 163519 - RNA, 64 nt, hsa
accagccuguuuagccaaguagcuuugggcauaggcugcccaaucugagcaaacaccagugagg

SEQ ID NO: 163520 - RNA, 64 nt, hsa
auccagcacaacucagucugugggagcucagcucgcugcccagggauagguaugaccuaugucu

SEQ ID NO: 163521 - RNA, 64 nt, hsa
ugcccaccuccuccaccugcuucaaccugcucaagcugcccaacuacagcaagaagagcguccu

SEQ ID NO: 163522 - RNA, 64 nt, hsa
cacagcgccucuucccagacagccaggcccaucugcugcccagggaagcgcaggcgccugcuag

SEQ ID NO: 163523 - RNA, 64 nt, hsa
cugagucugcaaaaucccaggaaacuugggucuugcugcccauccuuccucagcacagggaacc

SEQ ID NO: 163524 - RNA, 64 nt, hsa
cuuggaaggguuccaaccccaagucagucaggaagcugcccauuuuuuugcaaggcauuuuaau

SEQ ID NO: 163525 - RNA, 64 nt, hsa
cucauacacucauguugauggauaguauagauuugcugcccacaccagauaucuguaaggcauc

SEQ ID NO: 163526 - RNA, 64 nt, hsa
cacaggccucaaccacugggugcgggcccugguggcugcccagagcuaccuguacagcggcucc

SEQ ID NO: 163527 - RNA, 64 nt, hsa
cucggcgagccucccucuacucggcacuguccuugcugcccagccccucucugggugccaggua

SEQ ID NO: 163528 - RNA, 64 nt, hsa
ccaggguccugugggcugagcggcuggggcuggggcugcccacguguggccuccgcuggcucug

SEQ ID NO: 163529 - RNA, 64 nt, hsa
uuuuuuuuuuuuuuugagauggaguuucacucuugcugcccaggcuggagugcaguggcucaau

SEQ ID NO: 163530 - RNA, 64 nt, hsa
cauugcuaccacagacuugcacugaagccggacagcugcccagacacaugggcuugugacauuc

SEQ ID NO: 163531 - RNA, 64 nt, hsa
gaacccacuccgguuccccgcaacccacagcucagcugcccaucccagucccucgccgucccuc

SEQ ID NO: 163532 - RNA, 64 nt, hsa
gacccugcccccggcccaggugucucggaggguggcugcccacggccuggguguggcuggaaug

SEQ ID NO: 163533 - RNA, 64 nt, hsa
ggccucaggaaaccaccaagugccucggaugguggcugcccacggcgcuucugcugagacccug

SEQ ID NO: 163534 - RNA, 64 nt, hsa
uugugagucagucucaguagccaucagccuggcagcugcccaucccauaaccaaagagcucaau

SEQ ID NO: 163535 - RNA, 64 nt, hsa
gcguugcggauagugccucaccauugcccacccugcugcccaacuccugugagagaaaaaccaa

SEQ ID NO: 163536 - RNA, 64 nt, hsa
gccuggugggagaggccagcuugagccagacagcgcugcccagggguggccgccuaguacacac

SEQ ID NO: 163537 - RNA, 64 nt, hsa
uccugcuggagggcccugaacccugcacugcguggcugcccagccagcugccuccuguccuggg

SEQ ID NO: 163538 - RNA, 64 nt, hsa
cccccccaaaacccgcagguccucauguccagacgcugcccaguccuguccugaaaacagcacg

SEQ ID NO: 163539 - RNA, 64 nt, hsa
accugguggggcccggggccaagccugcauucuggcugcccagcuucggacagcgggaacuccu

SEQ ID NO: 163540 - RNA, 64 nt, hsa
ccgacgugcaucuuccgaaggcaccagaggugaagcugcccagggcuccggaggugcagcuaaa

SEQ ID NO: 163541 - RNA, 64 nt, hsa
uggccgugcccgaugugcaccucccagaggugcagcugcccaaagucugugaaaugaaaguccc

SEQ ID NO: 163542 - RNA, 64 nt, hsa
uggcugugccggaggugcggcuuccagagguagagcugcccaaagugucagagaugaaacuccc

SEQ ID NO: 163543 - RNA, 64 nt, hsa
ccgcugcuccugaaguuguagagagcaagcugaagcugcccaccaucaagaugcccucccuugg

SEQ ID NO: 163544 - RNA, 64 nt, hsa
uugcuggagggguuuccuggguauaacccauugggcugcccaaggccagccagccugagcucuc

SEQ ID NO: 163545 - RNA, 64 nt, hsa
aaggguacaguuugacacugaucugguccaugaggcugcccagagaaagcacugcuucuguaug

SEQ ID NO: 163546 - RNA, 64 nt, hsa
cagggacuuuugcccacagcacaugacaccgacagcugcccagccuguucacaugcuggggacc

SEQ ID NO: 163547 - RNA, 64 nt, hsa
uuaaaggucaccuuccugaaagaugaaugagaaagcugcccauucucaagacucaucugccuag

SEQ ID NO: 163548 - RNA, 64 nt, hsa
ugugcuccaaagcaacgggcuggggcagccugcagcugcccacccaaccuggucuucacaccag

SEQ ID NO: 163549 - RNA, 64 nt, hsa
cacugucaugcccagcuuggagugccacauggccgcugcccacgucccgggcacugucaugccc

SEQ ID NO: 163550 - RNA, 64 nt, hsa
ugcugucaugcccagcuuggagugccacguggccgcugcccacgucccgggcacugucaugccc

SEQ ID NO: 163551 - RNA, 64 nt, hsa
acuucccugcaaggugcaccugccccaggcucaggcugcccagcggcucuuccuggacagugag

SEQ ID NO: 163552 - RNA, 64 nt, hsa
uugugauuauaucuguaucaggucagcagaagaaggaacugagcaguugaacucugaguucauc

SEQ ID NO: 163553 - RNA, 64 nt, hsa
ccagagauggcuuuuccaacacauuuuaauuaaaggaacugaguacauuacccugaugucuaaa

SEQ ID NO: 163554 - RNA, 64 nt, hsa
ugccaggagccugugacacccccaggaaggggguggaacugaggaagagcgaggauaugcaggc

SEQ ID NO: 163555 - RNA, 64 nt, hsa
ccgcccggaguccuagcacagcaaaccaggagguggaacugaaucagccuggaauggcugcuga

SEQ ID NO: 163556 - RNA, 64 nt, hsa
ggucucccggugucuaaauagcagagcuggaaugggaacugagaaccgauucuuuccacaaccg

SEQ ID NO: 163557 - RNA, 64 nt, hsa
acaggguuagcuaucacuguccaguuuggugggaggaacugaaugcauguaggcacauggaccc

SEQ ID NO: 163558 - RNA, 64 nt, hsa
ugcacccgguggaagcugaaauccaucugugaauggaacugaagugaacgugaauaugcugacu

SEQ ID NO: 163559 - RNA, 64 nt, hsa
gacggacaacuugagaaaagcagucaaguuccaaggaacugacagcaaccugcaaagaggaaaa

SEQ ID NO: 163560 - RNA, 64 nt, hsa
guugauauucugggggaggucacugcagaaggauggaacugaccuuuauuccccagugggcagu

SEQ ID NO: 163561 - RNA, 64 nt, hsa
ugcacaaggaaugaggaagaucagggacaaccugggaacugaauaacuuucaaagccagugcuc

SEQ ID NO: 163562 - RNA, 64 nt, hsa
accaucaccgcugcugcaaagaggcaauaauaaaggaacugaagacagcuguauuugggagaag

SEQ ID NO: 163563 - RNA, 64 nt, hsa
gcauugaauugggauuaaauaaagauguugggcaggaacugaacacugcuaauaugaugauaaa

SEQ ID NO: 163564 - RNA, 64 nt, hsa
cagggccccucucuccucccaccuggacuuggggggaacugagaaacacuuuccuggagcugcu

SEQ ID NO: 163565 - RNA, 64 nt, hsa
gaaugcauguuuuuuuccugguuggaauugaguaggaacugaggcugugcuucagguaugguac

SEQ ID NO: 163566 - RNA, 64 nt, hsa
gcuaugugaaaacagacaauauuaguuuaggucgggaacugagauauuguaaucaaauaguuaa

SEQ ID NO: 163567 - RNA, 64 nt, hsa
uacugugauggacacagaaauguagcuguguucuggaacugaaucuuacaugguauacuuagug

SEQ ID NO: 163568 - RNA, 64 nt, hsa
gggugguggggaagcuuucaaauauaauuuuacuggaacugauuaaaggccaaguauuuuauua

SEQ ID NO: 163569 - RNA, 64 nt, hsa
guuagacaucagaaaagggauugagaaaagggauggaacugauuugaggcuaaacuggauuagc

SEQ ID NO: 163570 - RNA, 64 nt, hsa
aguuaaacuuuuguuuguacuaccuguuuucugcggaacugacggaucacaaagaacugaaucu

SEQ ID NO: 163571 - RNA, 64 nt, hsa
uacacuuaaaaguacuucagauugucugacagcaggaacugagagaagcaguccaaagaugucu

SEQ ID NO: 163572 - RNA, 64 nt, hsa
caauuaagugaauugagucccuggucuagccucaggaacugaaacuucuuuggggcuugucuug

SEQ ID NO: 163573 - RNA, 64 nt, hsa
aauuaacucuucgguuaaugggucaguucuccuuggaacugaaucaguggaaagagaaugcuuc

SEQ ID NO: 163574 - RNA, 64 nt, hsa
ucuccucuacaauguuuccuuucucccaaaacagggaacugacugucugguagugaagacaagc

SEQ ID NO: 163575 - RNA, 64 nt, hsa
acucgcuuaagaaauuuuaagcuauuuaaucuugggaacugaagccagucauguaaacauacua

SEQ ID NO: 163576 - RNA, 64 nt, hsa
uguuccucacacuggagggugauagaccccaaggggaacugaagaguggagcucaguuuccucu

SEQ ID NO: 163577 - RNA, 64 nt, hsa
gacuccacaauugggaugccgacacaccuugcuaggaacugacaacaacuucaguauggucugg

SEQ ID NO: 163578 - RNA, 64 nt, hsa
gcaugcuguuccuuuucuuuucuucuuuuagccauuuugcuaagagacacagucuucucaucac

SEQ ID NO: 163579 - RNA, 64 nt, hsa
uuuauccuugugcacugcaggccugguacucagauuuugcuaugagguuaaugaaguaccaagc

SEQ ID NO: 163580 - RNA, 64 nt, hsa
guaguauguaguguguuucuuagguaaagucucuuuuugcuacugaaagggaaauggucucuaa

SEQ ID NO: 163581 - RNA, 64 nt, hsa
gagcuguuauuuaugcuguagaaaacgaaaaugguuuugcuaccugauaagcuucagauuagau

SEQ ID NO: 163582 - RNA, 64 nt, hsa
aauggaagaaaugcacuacaaaguuaagacagauuuuugcuaagugcaggaggcccuuuauuau

SEQ ID NO: 163583 - RNA, 64 nt, hsa
gacauuacacuaguugaggcuaccgaaccuuacauuuugcuagagcucaaguaauagaaacuua

SEQ ID NO: 163584 - RNA, 64 nt, hsa
ugagcucuuauaugcagaacacauuucaaaugaguuuugcuaugggcugcccccaggguggcaa

SEQ ID NO: 163585 - RNA, 64 nt, hsa
uuuuuuucuguaaagcaaaagaucccuuuuucuguuuugcuaggaauuuggugaucuaauccua

SEQ ID NO: 163586 - RNA, 64 nt, hsa
cacaguguaucccccugcuucuguuuuuguauauuuuugcuacuugguuuuucuugaucauagc

SEQ ID NO: 163587 - RNA, 64 nt, hsa
aauaaaguguucuauuaaccugaucucuuugcccuuuugcuaugugaggagugaaugaguggcc

SEQ ID NO: 163588 - RNA, 64 nt, hsa
uaugccaaaaacauuaaacagaagaaaucauuuuuuuugcuauguaauaccucgcaacuuugcu

SEQ ID NO: 163589 - RNA, 64 nt, hsa
uaguauucaaauuauuaaugcucauguaccaagguuuugcuauaaaaguuuugucuguaugaau

SEQ ID NO: 163590 - RNA, 64 nt, hsa
gguagugcaaauucaacuucaaauaugguguagguuuugcuagauuccauauuuuuuucuugga

SEQ ID NO: 163591 - RNA, 64 nt, hsa
agguuuugcuagauuccauauuuuuuucuuggauuuuugcuaauuauuuuuagcaaaaaauuuu

SEQ ID NO: 163592 - RNA, 64 nt, hsa
ccaugccuucccuauucauucucuguccagaguuuuuugcuaaagauagaauuauuaaugauac

SEQ ID NO: 163593 - RNA, 64 nt, hsa
acugggauucuuuauuaauuauuugagaauguuauuuugcuaguucuuaagguuaaguuuuuca

SEQ ID NO: 163594 - RNA, 64 nt, hsa
uguuuagcacuuugauauuaaaauuuugcuuauguuuugcuaaauucgaauaauguuugaagau

SEQ ID NO: 163595 - RNA, 64 nt, hsa
uauacucuguaucaagucaaaauaucuuuggccauuuugcuaagaaacaaacuuugaaugucaa

SEQ ID NO: 163596 - RNA, 64 nt, hsa
caaguuugcaaaucaguuuuuagcaagaaaacauuuuugcuauacaaacauuuugcuaagucug

SEQ ID NO: 163597 - RNA, 64 nt, hsa
uuuuuagcaagaaaacauuuuugcuauacaaacauuuugcuaagucugcccaaagcccccccaa

SEQ ID NO: 163598 - RNA, 64 nt, hsa
guaaggucuguaaaucagggcuucggcaaugccauuuugcuauagacucauucauguuuuuuag

SEQ ID NO: 163599 - RNA, 64 nt, hsa
aggcuauaggcaaagcgucuaggagcuuguuguuuuuugcuauggaaggccagcuuugggaucu

SEQ ID NO: 163600 - RNA, 64 nt, hsa
ccccacaucgcuccccuuuuuuuaaaaaggacuguuuugcuagugugauaaugaauagguaaga

SEQ ID NO: 163601 - RNA, 64 nt, hsa
gaauuguuaaaauucagaacauucaaaauaacuguuuugcuacaacccaugauuauuuuccugu

SEQ ID NO: 163602 - RNA, 54 nt, hsa
ucaaaauaucaguuauauaaaacguuuugcuaagaguuuaaaaucuuaaaaccc

SEQ ID NO: 163603 - RNA, 64 nt, hsa
ugacuuucagaggccuuuuuuuguuuguuuuaauuuuugcuagauugauauuaaaaacucaugu

SEQ ID NO: 163604 - RNA, 64 nt, hsa
cuauuguugacucacauuuagauugauuccauguuuuugcuauugugaauagugcugcaaugaa

SEQ ID NO: 163605 - RNA, 64 nt, hsa
ccucuucccagaauuuacaaagcaauucacuaccuuuugcuacauuugccucauuuuuuagugu

SEQ ID NO: 163606 - RNA, 64 nt, hsa
cacaacagaguaacuaucgaaaugacgguguuaauuuugcuaacuggguuaaauauuuugcuaa

SEQ ID NO: 163607 - RNA, 64 nt, hsa
augacgguguuaauuuugcuaacuggguuaaauauuuugcuaacugguuaaacauuaauauuua

SEQ ID NO: 163608 - RNA, 64 nt, hsa
aauguuuugcuauguagggaaauuuugaaguaguuuuugcuaaaaaauuauuucuagaguugug

SEQ ID NO: 163609 - RNA, 64 nt, hsa
ccaaaagcauuaaaaaucuauuuccagaggaauguuuugcuauguagggaaauuuugaaguagu

SEQ ID NO: 163610 - RNA, 64 nt, hsa
ugcuaguagcauuucaaguuaaaaucugguuugauuuugcuacccaugaaauacaguucggccc

SEQ ID NO: 163611 - RNA, 64 nt, hsa
uuacccaccucuaaagauauuuguuucugugaccuuuugcuaguagcauuucaaguuaaaaucu

SEQ ID NO: 163612 - RNA, 63 nt, hsa
aacccuuuuuucuacggcagcauuaaaauugucuuuuugcuauaauuuuguguugcguucaca

SEQ ID NO: 163613 - RNA, 64 nt, hsa
gaaacauuaucugaaagcaaaguaugauaguuuguuuugcuauacaguacaucuauauugauag

SEQ ID NO: 163614 - RNA, 64 nt, hsa
ugugccuggcccccucaucugauagaaaauuagauuuugcuaugagccauuuccugagggccaa

SEQ ID NO: 163615 - RNA, 64 nt, hsa
ccagacacacagugggguugagggagcuaggcuguuuugcuagagauaauugcaaggcacgugg

SEQ ID NO: 163616 - RNA, 64 nt, hsa
uguuucuuguuauagaaucauuauccaugcucauuuuugcuaggggaaauauaugaagagggaa

SEQ ID NO: 163617 - RNA, 64 nt, hsa
aguuugauuuggcuuuuauauuuuuuaaaaucccuuuugcuaccccaucugguuuuauaaacug

SEQ ID NO: 163618 - RNA, 64 nt, hsa
guacgauauugcuuauugugacuuuggcauguauuuuugcuagcaaaaugcuguaagauuuaua

SEQ ID NO: 163619 - RNA, 64 nt, hsa
agcaaaaugcuguaagauuuauaccauugaucuuuuuugcuauauuuguauacaguacaguaag

SEQ ID NO: 163620 - RNA, 64 nt, hsa
guuguuucacauguagcauuugccacaauuuaaguuuugcuaauugcaucccuaugguaauguu

SEQ ID NO: 163621 - RNA, 64 nt, hsa
cauuacuuccguuuuaaaaguuuuugccagagaguuuugcuaaauacucucuuauuugcucuag

SEQ ID NO: 163622 - RNA, 64 nt, hsa
caccaccccucacccuaugcaaucaaucaaucaaucaucuuaaguuaaagauauuuguugucuu

SEQ ID NO: 163623 - RNA, 64 nt, hsa
guugauucuguaguucuuuaaauaauaaugaagcucaucuuauacauuuugcuuucaccaauug

SEQ ID NO: 163624 - RNA, 64 nt, hsa
auuucugcuuggcacgcuacccucaucaucuuacucaucuuaagcccgagccauggaucaacua

SEQ ID NO: 163625 - RNA, 64 nt, hsa
ucugaagugauuucugcuuggcacgcuacccucaucaucuuacucaucuuaagcccgagccaug

SEQ ID NO: 163626 - RNA, 64 nt, hsa
gggccacauauuaaauuacuucugaauggugaauucaucuuacaaaauguuccaaguuuuggac

SEQ ID NO: 163627 - RNA, 64 nt, hsa
aguuauaaucaggcuacauucacauuuucuuuucucaucuuaaaacccuuuauguucaaaauac

SEQ ID NO: 163628 - RNA, 64 nt, hsa
gguuucaacacagagguuucaaguggaaagccauucaucuuaaaagcugaacagaaaaauuaaa

SEQ ID NO: 163629 - RNA, 64 nt, hsa
guuuugaccucccaggcaucugaacaggaugacaucaucuuauuauaucuuacuuuacacauac

SEQ ID NO: 163630 - RNA, 64 nt, hsa
auugagcugccuuauuucuaaugaacacuccucuucaucuuauuaagucuucacaguuuuucca

SEQ ID NO: 163631 - RNA, 64 nt, hsa
gacaauuugccauagcagugcuaggauaaaccaaucaucuuaacuuggcuaacauagcacagua

SEQ ID NO: 163632 - RNA, 64 nt, hsa
uucucucaucucaccucucuguguugauuacuaaucaucuuagauauuauugcuaguggaugua

SEQ ID NO: 163633 - RNA, 64 nt, hsa
gugaagguccuacauguaaugcauaugugaugcaucaucuuaucauauauuccuuccuauacau

SEQ ID NO: 163634 - RNA, 64 nt, hsa
aaauagcugagugcaguccuugcucauauuuccuucaucuuaaccccgcaaacaagaauuaaga

SEQ ID NO: 163635 - RNA, 64 nt, hsa
guugcuuuuuaaaaugucagcaagaaggccugccucaucuuaacaaagcaaaaaaaaaugcuuu

SEQ ID NO: 163636 - RNA, 64 nt, hsa
uggaagauugaaauccacagauaauucaugacccucaucuuaucacuuuacuccaucuuuuuau

SEQ ID NO: 163637 - RNA, 64 nt, hsa
aggaaccaaaggcuuaugauguaggacaaagaaaucaucuuagaacugucaagcauauuuucac

SEQ ID NO: 163638 - RNA, 64 nt, hsa
aaugacaauuucuaguuuaguuaauuucuacaaaucaucuuauguuauuagcaagguuaagaca

SEQ ID NO: 163639 - RNA, 64 nt, hsa
agaaaacuuuauuugucaaagucagaaaacauuuucaucuuauugagagauauguuuuuaaacu

SEQ ID NO: 163640 - RNA, 64 nt, hsa
gugguuuuaauuuuuuaaauggugauuaguguuaaaaaucaauuuaaaucaugacuaauauggu

SEQ ID NO: 163641 - RNA, 64 nt, hsa
gaaaacaguuuguagacaaugauucuuuuuuaauaaaaucaaauaauucuaaaagugcuagaga

SEQ ID NO: 163642 - RNA, 64 nt, hsa
acagagcgaaacuccgucucaaaaaaaaaaaaaaaaaaucaacucauaacuuagaaaccgaugu

SEQ ID NO: 163643 - RNA, 64 nt, hsa
ggccugggccugccuggccuaaacccaguaguuaaaaaucaacucauugccuguaaucccagca

SEQ ID NO: 163644 - RNA, 64 nt, hsa
uugauguucugguuacuucuaguaaauuccugucaaaaucaauucagaaauucuaacuuggaga

SEQ ID NO: 163645 - RNA, 64 nt, hsa
gguauuuuuguaguuucuuuguagagagauaauaaaaaucaaaauauuuaaugaaaauggacuu

SEQ ID NO: 163646 - RNA, 64 nt, hsa
auuacuauguggcuuagggauuuauuuguuuuuuaaaaucaaccauguuagcugggauuagacu

SEQ ID NO: 163647 - RNA, 64 nt, hsa
caguaaaauuugacuguuuaaaauguuggccaaaaaaaucaagauuuaauuuuuuuauuuguac

SEQ ID NO: 163648 - RNA, 64 nt, hsa
uugaaagaagaggcuuaauuugggggugguaacuaaaaucaaaagaaaugauugacuugagggu

SEQ ID NO: 163649 - RNA, 64 nt, hsa
gucacuuuuucucauguucuaauuauaaaugaccaaaaucaagauugcucaaaaggguaaauga

SEQ ID NO: 163650 - RNA, 64 nt, hsa
uacauuuuucuguguuacacucaaggauaaaggcaaaaucaauuuuguaauuuguuuagaagcc

SEQ ID NO: 163651 - RNA, 64 nt, hsa
uauuauguugcacauuuuugcauguguucugauaaaaaucaauucuagcacugugaagcuucag

SEQ ID NO: 163652 - RNA, 64 nt, hsa
gcaauaagauuugaugugugaguagcuuugauuuaaaaucaaugcaaaaagcacaacuaauaaa

SEQ ID NO: 163653 - RNA, 64 nt, hsa
uggggaaguuucacccucucccuaucugaagaaaaaaaucaaaaacaaauguccccggaucuuu

SEQ ID NO: 163654 - RNA, 64 nt, hsa
auuguggccuuggaguuugcuaaauccaaauaugaaaaucaaaagcuuuaguauuccucaucuu

SEQ ID NO: 163655 - RNA, 64 nt, hsa
gccccguuaguuucaaaccguuucuaaagagauaaaaaucaaacuucuuuuaaaacaauaucca

SEQ ID NO: 163656 - RNA, 64 nt, hsa
agugaauaggggaaaaauaaacacagugaaaaaaaaaaucaaacaguggagucuucuuuagugc

SEQ ID NO: 163657 - RNA, 64 nt, hsa
acaauuuugugguuaaaacuggauuuuaaauuuaaaaaucaauaaaaauuucaaauguuuauua

SEQ ID NO: 163658 - RNA, 64 nt, hsa
ggaaguuaccugguagaucaagcauuacacacaaaaaaucaaguugaucagaguauggguucuc

SEQ ID NO: 163659 - RNA, 64 nt, hsa
aaauaaauaacauuuaauuugacggaaaauucuaaaaaucaacauuugguaacuuaaauauuca

SEQ ID NO: 163660 - RNA, 64 nt, hsa
guuuuuggcaugaacaaaagaaacaagagagaaaaaaaucaaaauaauuaaaauaaauuguuag

SEQ ID NO: 163661 - RNA, 64 nt, hsa
guuugaaaagucauacuuugcagauaugaaccugaaaaucaaagugccauuguuaaaucauccu

SEQ ID NO: 163662 - RNA, 62 nt, hsa
aauugaaauuauauuaguaauaaauguaacuugaaaaaucaaguuuaggagccucuucauuu

SEQ ID NO: 163663 - RNA, 64 nt, hsa
uguauucaauauugucacauuucucucugguagaaaaaucaaauaccuuagagauuaugaaguc

SEQ ID NO: 163664 - RNA, 64 nt, hsa
uuacuguucucuaaaauaauuaugagaagcaaauaaaaucaaaagucauguuuaaagacguguu

SEQ ID NO: 163665 - RNA, 64 nt, hsa
aguaguccacuuuaugcuuaaaauaaaaucauaaaaaaucaaguuuuaagguuauauuuuuuaa

SEQ ID NO: 163666 - RNA, 64 nt, hsa
uaugacugaauugcaaucuauauuuuuaaaaagaaaaaucaaaauacauuaggguuuacuuggu

SEQ ID NO: 163667 - RNA, 64 nt, hsa
aauaucuuuugaagaacuaugcuuuuucaaaagcaaaaucaacucuguauaauagcacauucuc

SEQ ID NO: 163668 - RNA, 64 nt, hsa
uaaauauuaugugugugauaguauucaauaaaguaaaaucaaauugucuuuggguuguaugugu

SEQ ID NO: 163669 - RNA, 64 nt, hsa
aaagaaaaagaaaagaagagaaaaaauuaagaaaaaaaucaaaaaaggaagaaaacuaaaaaaa

SEQ ID NO: 163670 - RNA, 64 nt, hsa
aaaaaucaaaaaaggaagaaaacuaaaaaaaaaaaaaaucaaaucaccuugugauucaguguau

SEQ ID NO: 163671 - RNA, 64 nt, hsa
uuaacuguagcauuccucuaauuauaaacagugaaaaaucaaaaucaguccagaguucuuuugu

SEQ ID NO: 163672 - RNA, 64 nt, hsa
uggugaaaaauaguuuuugaaaacaucagauuauaaaaucaagauaguccggacgcgguggcac

SEQ ID NO: 163673 - RNA, 64 nt, hsa
cugggcgacagagcgagacuccaccucaaaaaauaaaaucaagauaaccucuugaauguaauag

SEQ ID NO: 163674 - RNA, 64 nt, hsa
auggccauguauaaccaauuaauucugaguuuccaaaaucaaagauuugaccuuaagagggaag

SEQ ID NO: 163675 - RNA, 64 nt, hsa
uaauuuuacuauuucuuuuaaaaguauguuuuggaaaaucaaugauuuuaaugcauagcaguau

SEQ ID NO: 163676 - RNA, 64 nt, hsa
uguuauuuucagaauggcuuuuuuuuuucuauucaaaaucaaaucgagauuuaauguuugguac

SEQ ID NO: 163677 - RNA, 64 nt, hsa
uucagagcaguguccuccugggguucccacgugcaaaaucaacaucaggaacccagcuucaggg

SEQ ID NO: 163678 - RNA, 64 nt, hsa
aagggggggaaaggaccuuagaacuuuuuaagguaaaaucaaauauagcuacagcauaagagaa

SEQ ID NO: 163679 - RNA, 64 nt, hsa
aguuuguauuaauuuguaauagcucuguuuagaaaaaaucaaagaccaugauuuaugaaacuaa

SEQ ID NO: 163680 - RNA, 64 nt, hsa
ugaaauauauagauuauuguaaccuuucaaccugaaaaucaagcaguaugagaguuuaguuauu

SEQ ID NO: 163681 - RNA, 64 nt, hsa
caacagaguaagacaaaaaaauauauauauauugaaaaucaaaggaggcaaaauuuugacaggg

SEQ ID NO: 163682 - RNA, 64 nt, hsa
cuuuucucuucugcccuccuugugggcagucaugaaaaucaauucagacuguguugauuagcag

SEQ ID NO: 163683 - RNA, 64 nt, hsa
uuguacuuuucucauacaccaaaaacacaccaaaaaaaucaauaaaauaagcaaucuucuauuc

SEQ ID NO: 163684 - RNA, 64 nt, hsa
acagcuaucugucuuuuagugccacaaauaaaagaaaaucaaaucuuagcuguugugugaauuu

SEQ ID NO: 163685 - RNA, 64 nt, hsa
gucacaguccaugaucugaccaacuaagcuuuuaaaaaucaacuauuaccacccagaaaacagu

SEQ ID NO: 163686 - RNA, 64 nt, hsa
gaggggcauagugaaaaaggaacagccaugccucaaaaucaaaucauuugcauucccacagcau

SEQ ID NO: 163687 - RNA, 64 nt, hsa
ucuuuguuaauuguacacugaauaaugccuuuuaaaaaucaaaauaaaauuaacaaauaauggu

SEQ ID NO: 163688 - RNA, 64 nt, hsa
cuucgguuccucugauuucaaggccauauuuuaaaaaaucaaaaggcacugugaacuauuuuga

SEQ ID NO: 163689 - RNA, 64 nt, hsa
uuauagaauaauuucuccucauuuaauauuuuucaaaaucaaaguuaugguuuccucauuuuac

SEQ ID NO: 163690 - RNA, 64 nt, hsa
uucaucaaguaaucauggccagcgauuauugaucaaaaucaaaagguaaugcacauccucauuc

SEQ ID NO: 163691 - RNA, 64 nt, hsa
ggacccacuggggcauauaaaaaagucaaaaaucaaaaucaaacaacaaguucugaguuacuua

SEQ ID NO: 163692 - RNA, 64 nt, hsa
agaccaggacccacuggggcauauaaaaaagucaaaaaucaaaaucaaacaacaaguucugagu

SEQ ID NO: 163693 - RNA, 64 nt, hsa
gcagcuuuccuucuuuucaacagugauaccuacgaaaaucaaaauaaaugcaagcugagguuuu

SEQ ID NO: 163694 - RNA, 64 nt, hsa
gagcauccaagcaugauuuugcugugacaaaucuaaaaucaaccaggcuacuuaagucugcucu

SEQ ID NO: 163695 - RNA, 64 nt, hsa
uagaauuguuuuuuucuaaaguuauguuaccugaaaaaucaaggagugcaccugauuuacuguu

SEQ ID NO: 163696 - RNA, 64 nt, hsa
augaauuucuuucuuuuauaaauuuucucauuuaaaaaucaaaaaucuugcaaaacaaaaacca

SEQ ID NO: 163697 - RNA, 64 nt, hsa
cuuaaugccagugugaauuugcagauguuuucagaaaaucaagucacaguaacaauuugccacu

SEQ ID NO: 163698 - RNA, 64 nt, hsa
auaaaauauaaaguaacauagcucuaaaaggcuuaaaaucaaacacagguguuauuugucugcc

SEQ ID NO: 163699 - RNA, 64 nt, hsa
uuagugauuaaaaucuugccccagcacaguaauaaaaaucaagauuuguuaguaacaaucuuga

SEQ ID NO: 163700 - RNA, 64 nt, hsa
ucaaaaugaaggucuucauacgcuguacuugcuaaaaaucaacugugcgcuugaaagaccucuu

SEQ ID NO: 163701 - RNA, 64 nt, hsa
uuuuagauacucaugcaacauagccuacuuuuauaaaaucaaaaugaaggucuucauacgcugu

SEQ ID NO: 163702 - RNA, 64 nt, hsa
ucaaaaacuacucccuuggaaaaaauaucuuucgaaaaucaaauuuaaacauuucacucugugc

SEQ ID NO: 163703 - RNA, 64 nt, hsa
cugugaaggugaucaguguagcaguaagacaucuaaaaucaagacaaugacaugggggcuuugu

SEQ ID NO: 163704 - RNA, 64 nt, hsa
uggaaaguuuagacuacauuuagaaucucuauucaaaaucaaaaugcugcucaaaugaauuuaa

SEQ ID NO: 163705 - RNA, 64 nt, hsa
ggccaagcccaucuauuuacaaaaggugaacagcaaaaucaagcacugcuuuaugggcaggaac

SEQ ID NO: 163706 - RNA, 64 nt, hsa
ucugauaaacaacuucagcuaacuuucaggagacaaaaucaauauacaaaauaugguagcauuu

SEQ ID NO: 163707 - RNA, 64 nt, hsa
auugaaacugaaccacuuccuuacaccauaugcaaaaaucaacucaagauggauuaaagacuua

SEQ ID NO: 163708 - RNA, 64 nt, hsa
uuguaaaacuuuugauauuucuguauacauuuaaaaaaucaauugccacuacaguaguuccuua

SEQ ID NO: 163709 - RNA, 64 nt, hsa
uuugaauuuuaaaacuaaucuauuuuauuuaaaaaaaaucaaguacuuuggaagugaauaaagu

SEQ ID NO: 163710 - RNA, 64 nt, hsa
ucaauucacuuuguaagaaaacucucggagaaauaaaaucaauaaaaagcaaaguucccaggcc

SEQ ID NO: 163711 - RNA, 64 nt, hsa
augaacccaugacagcaccugcugcuucaaaaucaaaaucaauuuagggauacagcaggggcug

SEQ ID NO: 163712 - RNA, 64 nt, hsa
acaagaaugaacccaugacagcaccugcugcuucaaaaucaaaaucaauuuagggauacagcag

SEQ ID NO: 163713 - RNA, 64 nt, hsa
uuaucccaggaauucaagguugguucaacaucuaaaaaucaaauaagcuaauauacagucaguu

SEQ ID NO: 163714 - RNA, 64 nt, hsa
uuagguuaggaauucaagguuuguucaacaucuaaaaaucaaauaagcuaauaaagaaaagagg

SEQ ID NO: 163715 - RNA, 64 nt, hsa
uuguggaugacaguaagaaacaacaaauacugauaaaaucaauauuuugcugaaaugaguugau

SEQ ID NO: 163716 - RNA, 64 nt, hsa
auaccaauggcuuugcaagaagaugacauuucagaaaaucaaacaaaucuauauuuaauggaug

SEQ ID NO: 163717 - RNA, 64 nt, hsa
aaaacacaaagcacaggucaggauccucugagagaaaaucaacauugcaccacguagggguggg

SEQ ID NO: 163718 - RNA, 64 nt, hsa
uuuuagaguuuaaaaaaaacaccucgacauuuaaaaaaucaaccaacacaagaucaaaaaggaa

SEQ ID NO: 163719 - RNA, 64 nt, hsa
ucugaaaaucuauagacugaaugcaguuccaaacaaaaucaacuaagaauuuucuaggaucuuu

SEQ ID NO: 163720 - RNA, 64 nt, hsa
gagaaaauaaaauuacaacauuacgacauacuaaaaaaucaauauucuuuuuuuuuuuuuuuuu

SEQ ID NO: 163721 - RNA, 64 nt, hsa
guaacauggauaguuaaaacaauguugaaugaaaaaaaucaaaauacaaaugaaacauugugua

SEQ ID NO: 163722 - RNA, 64 nt, hsa
auugaaacuggaccccuauccuucacgauauacaaaaaucaacucaagauggauuaaagacuua

SEQ ID NO: 163723 - RNA, 64 nt, hsa
ucugaauggguauuaucagaauggguauuauuaaaaaaucaaaacauagaugcuagugaggcug

SEQ ID NO: 163724 - RNA, 64 nt, hsa
auagaaaauauaaagaaucccucaaguugaaaaaaaaaucaauuuaaaggggagaaaacuucag

SEQ ID NO: 163725 - RNA, 64 nt, hsa
uaauacaauuauuauuugucaaucaaauauuaauaaaaucaaagaugagcaggucucuuuguug

SEQ ID NO: 163726 - RNA, 64 nt, hsa
uagaaacaauuuugaaagccccuugaggaaaauaaaaaucaagaagaacacuuuucucccuuuu

SEQ ID NO: 163727 - RNA, 64 nt, hsa
cuauauaauggagaagaauuugaaaaugcacaaaaaaaucaaucuacauuaucagaaccugcag

SEQ ID NO: 163728 - RNA, 64 nt, hsa
aagcagaaaggguuuuuucagcuguuaaauccuaaaaaucaauauaauuuauuuauguaagaaa

SEQ ID NO: 163729 - RNA, 64 nt, hsa
caucucaaagaagucuguuaaaucaugacugaaaaaaaucaaucagauguaucuucaaaaagug

SEQ ID NO: 163730 - RNA, 64 nt, hsa
aaaacuguucuaggucgacugcggggacagaacaaaaaucaaaacaaagaaccugcucugauga

SEQ ID NO: 163731 - RNA, 64 nt, hsa
uuauaggaaugacucuggcugcuauguggggaauaaaaucaagacgugcaagaguggaagaaga

SEQ ID NO: 163732 - RNA, 64 nt, hsa
aacuguugguuauuuguguuauucuggauguauaaaaaucaauggaaaaaaauaaacuuucaaa

SEQ ID NO: 163733 - RNA, 64 nt, hsa
uuaccagcauauauaguauuuaauuguuucaaaaaaaaucaaacuguaguuguuuuggcgauag

SEQ ID NO: 163734 - RNA, 64 nt, hsa
ucuuuuuucuccugugguggauaaaucugccuuaaaaaucaauguaacuugggggcugggggcu

SEQ ID NO: 163735 - RNA, 64 nt, hsa
ugggaauacagagaaacaggauuguuugagaaccaaaaucaagaggaacagaaaucuuaacuug

SEQ ID NO: 163736 - RNA, 64 nt, hsa
uuuauuuaaaaaaacaaaaaacaaaaaaaaucaaaaaaucaaaaaaauaauaaacuucauuuua

SEQ ID NO: 163737 - RNA, 64 nt, hsa
caaacaguuuuauuuaaaaaaacaaaaaacaaaaaaaaucaaaaaaucaaaaaaauaauaaacu

SEQ ID NO: 163738 - RNA, 64 nt, hsa
cucaaggaccccaucaaguguacacagcagcagcaaaaucaagggaugacccuccucuggggcc

SEQ ID NO: 163739 - RNA, 64 nt, hsa
auccauaacuacuauucuuuuuucacuguuuucuaaaaucaaaaaggguuuguaacuuuuuacu

SEQ ID NO: 163740 - RNA, 64 nt, hsa
uuaauuguaaagauaaggaaugcauuaugggucaaaaaucaaacauuccucucauguuauguau

SEQ ID NO: 163741 - RNA, 64 nt, hsa
uuucuuguauuuauauguuaaaaucaaaaauguuaaaaucaaugaaauaaauuugcaguuaaga

SEQ ID NO: 163742 - RNA, 64 nt, hsa
ucugauuuauuuaauuuucuuguauuuauauguuaaaaucaaaaauguuaaaaucaaugaaaua

SEQ ID NO: 163743 - RNA, 64 nt, hsa
ccaauuuuaccuuuuacacaaugugagauguaugaaaaucaacucauuuuauucucggcaacau

SEQ ID NO: 163744 - RNA, 62 nt, hsa
acuuuauugagcaaaugugauuccuuucuucuaaaaucaaagcaugaugcuugacaguguga

SEQ ID NO: 163745 - RNA, 64 nt, hsa
acuuaaauguuauguauauggugguaauaagggaaaaaucaaguauuauaaacaagaaugaagg

SEQ ID NO: 163746 - RNA, 64 nt, hsa
cuugaaggaaaaauucaauaguaauauaauacacaaaaucaaauaauaccuuagaagguauuaa

SEQ ID NO: 163747 - RNA, 64 nt, hsa; identical to SEQ ID NO: 85756

SEQ ID NO: 163748 - RNA, 64 nt, hsa; identical to SEQ ID NO: 85757

SEQ ID NO: 163749 - RNA, 64 nt, hsa; identical to SEQ ID NO: 85758

SEQ ID NO: 163750 - RNA, 64 nt, hsa; identical to SEQ ID NO: 85759

SEQ ID NO: 163751 - RNA, 64 nt, hsa; identical to SEQ ID NO: 85760

SEQ ID NO: 163752 - RNA, 64 nt, hsa; identical to SEQ ID NO: 85761

SEQ ID NO: 163753 - RNA, 64 nt, hsa; identical to SEQ ID NO: 85762

SEQ ID NO: 163754 - RNA, 64 nt, hsa; identical to SEQ ID NO: 85763

SEQ ID NO: 163755 - RNA, 64 nt, hsa; identical to SEQ ID NO: 85764

SEQ ID NO: 163756 - RNA, 64 nt, hsa; identical to SEQ ID NO: 85765

SEQ ID NO: 163757 - RNA, 64 nt, hsa; identical to SEQ ID NO: 85766

SEQ ID NO: 163758 - RNA, 64 nt, hsa; identical to SEQ ID NO: 85767

SEQ ID NO: 163759 - RNA, 64 nt, hsa; identical to SEQ ID NO: 85768

SEQ ID NO: 163760 - RNA, 64 nt, hsa; identical to SEQ ID NO: 85769

SEQ ID NO: 163761 - RNA, 64 nt, hsa; identical to SEQ ID NO: 106040

SEQ ID NO: 163762 - RNA, 64 nt, hsa; identical to SEQ ID NO: 106041

SEQ ID NO: 163763 - RNA, 64 nt, hsa; identical to SEQ ID NO: 106042

SEQ ID NO: 163764 - RNA, 64 nt, hsa; identical to SEQ ID NO: 106043

SEQ ID NO: 163765 - RNA, 64 nt, hsa; identical to SEQ ID NO: 106044

SEQ ID NO: 163766 - RNA, 64 nt, hsa; identical to SEQ ID NO: 106045

SEQ ID NO: 163767 - RNA, 64 nt, hsa; identical to SEQ ID NO: 106046

SEQ ID NO: 163768 - RNA, 64 nt, hsa; identical to SEQ ID NO: 106047

SEQ ID NO: 163769 - RNA, 64 nt, hsa; identical to SEQ ID NO: 106048

SEQ ID NO: 163770 - RNA, 64 nt, hsa; identical to SEQ ID NO: 106049

SEQ ID NO: 163771 - RNA, 64 nt, hsa; identical to SEQ ID NO: 106050

SEQ ID NO: 163772 - RNA, 64 nt, hsa; identical to SEQ ID NO: 106051

SEQ ID NO: 163773 - RNA, 64 nt, hsa; identical to SEQ ID NO: 106052

SEQ ID NO: 163774 - RNA, 64 nt, hsa; identical to SEQ ID NO: 106053

SEQ ID NO: 163775 - RNA, 64 nt, hsa; identical to SEQ ID NO: 106054

SEQ ID NO: 163776 - RNA, 64 nt, hsa; identical to SEQ ID NO: 106055

SEQ ID NO: 163777 - RNA, 64 nt, hsa; identical to SEQ ID NO: 106056

SEQ ID NO: 163778 - RNA, 64 nt, hsa; identical to SEQ ID NO: 106057

SEQ ID NO: 163779 - RNA, 64 nt, hsa; identical to SEQ ID NO: 106058

SEQ ID NO: 163780 - RNA, 64 nt, hsa; identical to SEQ ID NO: 106059

SEQ ID NO: 163781 - RNA, 64 nt, hsa; identical to SEQ ID NO: 106060

SEQ ID NO: 163782 - RNA, 64 nt, hsa; identical to SEQ ID NO: 106061

SEQ ID NO: 163783 - RNA, 64 nt, hsa; identical to SEQ ID NO: 106062

SEQ ID NO: 163784 - RNA, 64 nt, hsa; identical to SEQ ID NO: 106063

SEQ ID NO: 163785 - RNA, 64 nt, hsa; identical to SEQ ID NO: 106064

SEQ ID NO: 163786 - RNA, 64 nt, hsa; identical to SEQ ID NO: 106065

SEQ ID NO: 163787 - RNA, 64 nt, hsa; identical to SEQ ID NO: 106066

SEQ ID NO: 163788 - RNA, 64 nt, hsa; identical to SEQ ID NO: 106067

SEQ ID NO: 163789 - RNA, 64 nt, hsa; identical to SEQ ID NO: 106068

SEQ ID NO: 163790 - RNA, 64 nt, hsa; identical to SEQ ID NO: 106069

SEQ ID NO: 163791 - RNA, 64 nt, hsa; identical to SEQ ID NO: 106070

SEQ ID NO: 163792 - RNA, 64 nt, hsa; identical to SEQ ID NO: 106071

SEQ ID NO: 163793 - RNA, 64 nt, hsa; identical to SEQ ID NO: 106072

SEQ ID NO: 163794 - RNA, 64 nt, hsa; identical to SEQ ID NO: 106073

SEQ ID NO: 163795 - RNA, 64 nt, hsa; identical to SEQ ID NO: 106074

SEQ ID NO: 163796 - RNA, 64 nt, hsa; identical to SEQ ID NO: 106075

SEQ ID NO: 163797 - RNA, 64 nt, hsa; identical to SEQ ID NO: 106076

SEQ ID NO: 163798 - RNA, 64 nt, hsa; identical to SEQ ID NO: 106077

SEQ ID NO: 163799 - RNA, 64 nt, hsa; identical to SEQ ID NO: 106078

SEQ ID NO: 163800 - RNA, 64 nt, hsa; identical to SEQ ID NO: 106079

SEQ ID NO: 163801 - RNA, 64 nt, hsa; identical to SEQ ID NO: 106080

SEQ ID NO: 163802 - RNA, 64 nt, hsa; identical to SEQ ID NO: 106081

SEQ ID NO: 163803 - RNA, 64 nt, hsa; identical to SEQ ID NO: 106082

SEQ ID NO: 163804 - RNA, 64 nt, hsa; identical to SEQ ID NO: 106083

SEQ ID NO: 163805 - RNA, 64 nt, hsa; identical to SEQ ID NO: 106084

SEQ ID NO: 163806 - RNA, 64 nt, hsa; identical to SEQ ID NO: 106085

SEQ ID NO: 163807 - RNA, 64 nt, hsa; identical to SEQ ID NO: 106086

SEQ ID NO: 163808 - RNA, 64 nt, hsa; identical to SEQ ID NO: 106087

SEQ ID NO: 163809 - RNA, 64 nt, hsa; identical to SEQ ID NO: 106088

SEQ ID NO: 163810 - RNA, 64 nt, hsa
ggcauguggugagaggaugagggggagggagccaacgccucagguggagugggcagaggugcaa

SEQ ID NO: 163811 - RNA, 64 nt, hsa
aaugccccaugcggugagaggaugaggggagccuacgccucaggcauguggugagaggaugagg

SEQ ID NO: 163812 - RNA, 64 nt, hsa; identical to SEQ ID NO: 85859

SEQ ID NO: 163813 - RNA, 64 nt, hsa; identical to SEQ ID NO: 85860

SEQ ID NO: 163814 - RNA, 54 nt, hsa; identical to SEQ ID NO: 85861

SEQ ID NO: 163815 - RNA, 64 nt, hsa; identical to SEQ ID NO: 85862

SEQ ID NO: 163816 - RNA, 64 nt, hsa; identical to SEQ ID NO: 85863

SEQ ID NO: 163817 - RNA, 64 nt, hsa; identical to SEQ ID NO: 85864

SEQ ID NO: 163818 - RNA, 64 nt, hsa; identical to SEQ ID NO: 85865

SEQ ID NO: 163819 - RNA, 64 nt, hsa; identical to SEQ ID NO: 85866

SEQ ID NO: 163820 - RNA, 63 nt, hsa; identical to SEQ ID NO: 85867

SEQ ID NO: 163821 - RNA, 64 nt, hsa; identical to SEQ ID NO: 85868

SEQ ID NO: 163822 - RNA, 64 nt, hsa; identical to SEQ ID NO: 85869

SEQ ID NO: 163823 - RNA, 64 nt, hsa; identical to SEQ ID NO: 85870

SEQ ID NO: 163824 - RNA, 64 nt, hsa; identical to SEQ ID NO: 85871

SEQ ID NO: 163825 - RNA, 64 nt, hsa; identical to SEQ ID NO: 85872

SEQ ID NO: 163826 - RNA, 64 nt, hsa
auaagaaauaaccaaagaugaagcuggucaaauauuuucauaacuugcuucuguugauuuuuuu

SEQ ID NO: 163827 - RNA, 64 nt, hsa
ccuauucaaagaccuuuuccuguugauuaaucuauuuucauauuuauaaaggagucuuaauguu

SEQ ID NO: 163828 - RNA, 64 nt, hsa
guuacugaaccagcuaaaaauuuugcugauguauuuuucauauacuucucuccugacacgcaau

SEQ ID NO: 163829 - RNA, 64 nt, hsa
uaacuauuugaacagucugcuuauaugagacaguuuuucauaguaucauuuguauaauuugauu

SEQ ID NO: 163830 - RNA, 64 nt, hsa
uaaucccacugcauagaaauaacaagcguuaacauuuucauauuuuuuucuuucagucauuuuu

SEQ ID NO: 163831 - RNA, 64 nt, hsa
uuaagccugucucuauuguuggaauuucaggucauuuucauaaauauuguugcaauaaauaucc

SEQ ID NO: 163832 - RNA, 64 nt, hsa
uuaguguaucaugaauauuugguaucuuuguggcuuuucauauuuuuagugcuucaugaauauu

SEQ ID NO: 163833 - RNA, 64 nt, hsa
uuauggcaauacaacugugaaauaauaaggccgauuuucauauaaauguaugaaaaucaaccau

SEQ ID NO: 163834 - RNA, 64 nt, hsa
guuuugaagaaauagucucccuucaauuaagaaauuuucauaauggaaugauuuaaauugaagu

SEQ ID NO: 163835 - RNA, 64 nt, hsa
cuaaaauauauuuuucucauaccuguuuucuucauuuucauaaugaagcacuuugcuauguagc

SEQ ID NO: 163836 - RNA, 64 nt, hsa
uauagucaaggaccguagaggaagaaaaacuuuuuuuucauaccaugcacuauguaaacagaca

SEQ ID NO: 163837 - RNA, 64 nt, hsa
gugugggugggaaucgguaagaaaugcaccuagcuuuucauauuguguuuauucuccaggcuau

SEQ ID NO: 163838 - RNA, 64 nt, hsa
uuauauaugugauuaauuuuuaaaaggacaauuguuuucauaaaaugcaaaacuauuuuuuaca

SEQ ID NO: 163839 - RNA, 64 nt, hsa
auuagauguuauguuucauauuauuugauauuuauuuucauauuuaggauaagaaucauuuuua

SEQ ID NO: 163840 - RNA, 64 nt, hsa
aggauccuguaugguuaucaaugugaugccuugcuuuucauaaaauagguauaauugggucaua

SEQ ID NO: 163841 - RNA, 64 nt, hsa
aaacccauuccuauuuuuguacauuaccaaaaguuuuucauauaccuacagagcuaacuaauua

SEQ ID NO: 163842 - RNA, 64 nt, hsa
auacucuuuguauacaaguguuuauuaguauugcuuuucauaauucugucucacugaaaaccuu

SEQ ID NO: 163843 - RNA, 64 nt, hsa
ggauugggaauauguaaacucaacuggagauuuuuuuucauaaaaauuuauauaguuccagccc

SEQ ID NO: 163844 - RNA, 64 nt, hsa
gcauauauauuuuuuugcaccugaaucacccagcuuuucauaagugguauguuuaauuggucau

SEQ ID NO: 163845 - RNA, 64 nt, hsa
aaaguaacauaaagcuaguauucaauguagaguauuuucauauguuuuucacagcccguuacaa

SEQ ID NO: 163846 - RNA, 64 nt, hsa
ggagaauaaauaacuguuuuguguugguuggugguuuucauaaucuuauuucuguacuggaacu

SEQ ID NO: 163847 - RNA, 64 nt, hsa
aauuauucugcaauauuguaauucauaguuugacuuuucauaagcaaauaaaucccuaggaugu

SEQ ID NO: 163848 - RNA, 64 nt, hsa
cuucugcaacugaaauuacauauugcaggagacauuuucauaucaucaaugugacauuuacacc

SEQ ID NO: 163849 - RNA, 64 nt, hsa
cucaccauuccucuuggcuuggaaaggcuuuauuuuuucauauacauuucuagaaauauugcua

SEQ ID NO: 163850 - RNA, 64 nt, hsa
gacuggucagggcugcuuuguugaaaugugaugauuuucauaugccuucuuucucuuucucucu

SEQ ID NO: 163851 - RNA, 64 nt, hsa
aucagaauaguguaacaccaaaugagaacauguguuuucauaaagggguugaggccaccaguac

SEQ ID NO: 163852 - RNA, 64 nt, hsa
uaaaaaugaauguuuuuauaaguaaauaacuuauuuuucauauggcuaaagaugguaaaaugac

SEQ ID NO: 163853 - RNA, 64 nt, hsa
guuguucuucaaagaagcaagcagccgaucccuguuuucauaaagcuaauacuucaguuggaaa

SEQ ID NO: 163854 - RNA, 64 nt, hsa
uuagauauuuaauuucgcagauuuuuaaacuuuauuuucauaauuucugcuuaauguuuaaaau

SEQ ID NO: 163855 - RNA, 64 nt, hsa
uuuauuuuaauaguaguaaaauacuuggaauaauuuuucauauucuugucauuaauauuauuuu

SEQ ID NO: 163856 - RNA, 64 nt, hsa
auagauuugggucauuuagaagccugacaacucauuuucauauuguaaucuauguuuauaauac

SEQ ID NO: 163857 - RNA, 64 nt, hsa
aucucaaugcaagccccaacuuucuuauccaacuuuuucauaguaagugcgaagacugagccag

SEQ ID NO: 163858 - RNA, 64 nt, hsa
aguuugguuuaaaagaacuauaucuauauguauauuuucauauauaugacagaacaagaauaug

SEQ ID NO: 163859 - RNA, 64 nt, hsa
uauaauuuaaaaauguauagccugccaaauguuguuuucauaaccaugauauuguuuugaaaaa

SEQ ID NO: 163860 - RNA, 64 nt, hsa
gcagagggcaaagucauugaaucucuuaugccaguuuucauaaaacccaaaccacauaugaaaa

SEQ ID NO: 163861 - RNA, 64 nt, hsa
uuguucagggaugggacaaagccuucuucaauccuuuucauacuacuuaaugauuuuggugcag

SEQ ID NO: 163862 - RNA, 64 nt, hsa
ucuaccauuaguucauauguuuuuguagcacaucuuuucauaacauacugaaauuuuaauguuu

SEQ ID NO: 163863 - RNA, 64 nt, hsa
accuaccucuuaggacucagcuucagugauucuguuuucauaggcuuuuuaaagcccuuuucag

SEQ ID NO: 163864 - RNA, 64 nt, hsa
gaagcugcuauaucaucuuuauuuauucaggguauuuucauauuggaagccuuggcuagucugc

SEQ ID NO: 163865 - RNA, 64 nt, hsa
aaauauuucugggcuuccagcuuugguuuuguuauuuucauaacuguacacaacuuagaacaga

SEQ ID NO: 163866 - RNA, 64 nt, hsa
aagcuaaauauuuuauauguuuucaaagauuauuuuuucauauuaauagguuguuuaucuuuuu

SEQ ID NO: 163867 - RNA, 64 nt, hsa
uuagaaacacuguuuuuuuuaaguaccguuuuuauuuucauaacacuaauaauacacugggauu

SEQ ID NO: 163868 - RNA, 64 nt, hsa
cauaacaugauaguuuccuaaccuuuucauaaccuuuucauaacaugauaguuuccauaacaga

SEQ ID NO: 163869 - RNA, 64 nt, hsa
uauuagcuuuucauaacaugauaguuuccuaaccuuuucauaaccuuuucauaacaugauaguu

SEQ ID NO: 163870 - RNA, 64 nt, hsa
aaguucaguuguuuuuaaaagauucaauauuagcuuuucauaacaugauaguuuccuaaccuuu

SEQ ID NO: 163871 - RNA, 64 nt, hsa
aaagguuuaaaacuaguuagauucacuuugacacuuuucauaucauuucuuaacccaagugacg

SEQ ID NO: 163872 - RNA, 64 nt, hsa
auucauucauacuuaaaaauuuauuagcccugcauuuucauaggaagacacauuaucuucugga

SEQ ID NO: 163873 - RNA, 64 nt, hsa
uaccuaggauucucauuauagaugcuuaucuagguuuucauaaaugggaauguaacaauaucuu

SEQ ID NO: 163874 - RNA, 64 nt, hsa
uaaaaauauauuagugagacauuuuacauucucuuuuucauacuaagcuuucgaaaucuggugu

SEQ ID NO: 163875 - RNA, 64 nt, hsa
aucuugguugaaaauaaaaagaucacuuucucaguuuucauaaguauuaugucucuucugagcu

SEQ ID NO: 163876 - RNA, 64 nt, hsa
ggggacuuuucuuaaaccuucaguuaugauuuuuuuuucauacacuuauuggaacucugcuuga

SEQ ID NO: 163877 - RNA, 64 nt, hsa
uacugugucugugaaaacugugcuuuaaauuauauuuucauauguuuuguuggggacagagcac

SEQ ID NO: 163878 - RNA, 64 nt, hsa
aagaaagaauguuuaacauaauaugcuaaaaauauuuucauauuuaaauaacauacguaaaggu

SEQ ID NO: 163879 - RNA, 64 nt, hsa
ugaaauagaauaagaaguaaaauacaucagcagauuuucauacuaguauguuguaaugcugucu

SEQ ID NO: 163880 - RNA, 64 nt, hsa
guuuacaauuuggggacaaaaaggcaggcuucauuuuucauauguuugaugaaaacuggcucaa

SEQ ID NO: 163881 - RNA, 64 nt, hsa
ugugcugggucauguaaaauauuagacacuaauauuuucauagaaauuaggcuggagaaagaag

SEQ ID NO: 163882 - RNA, 64 nt, hsa
gguauggaucguaaaauuuuaagcacuaaaaauuuuuucauaaccuuucauaauaaaguuuaau

SEQ ID NO: 163883 - RNA, 64 nt, hsa
ucagcaaaauaguuuccuuauuucucauguaucauuuucauauaauuccaugguuucacuaaua

SEQ ID NO: 163884 - RNA, 64 nt, hsa
uagaauaaaaaacugaaaccaagauucccaacguuuuucauagcagccgggcacacuuugguga

SEQ ID NO: 163885 - RNA, 64 nt, hsa
cuccugggaacccuaguuccacaggauaauagguuuuucauaaagaaacguaggguguguaugu

SEQ ID NO: 163886 - RNA, 64 nt, hsa
gguuuugugccugcuuuuugcugugguccuguuuuuuucauaacaauauacugguauagcuucc

SEQ ID NO: 163887 - RNA, 64 nt, hsa
gcacugauuauuucagcaaaagaaaucuaguauguuuucauacaucugauguauaaauuugcug

SEQ ID NO: 163888 - RNA, 64 nt, hsa
uugcugaacuuugaguuaguuuucuuaagauaauuuuucauauuaagaaaauuuuccuuuucua

SEQ ID NO: 163889 - RNA, 64 nt, hsa
ccagcccauauacagaaacuaucacuaucuacauuuuucauauguguucagacagagccuauua

SEQ ID NO: 163890 - RNA, 64 nt, hsa
auacgaacuauuguuaugcuuuauggagaguauauuuucauaugaaacugauaaauauauaugu

SEQ ID NO: 163891 - RNA, 64 nt, hsa
aguugaucuggaugaguuauacaugauauuugacuuuucauaaguaguggaagguuucacuaag

SEQ ID NO: 163892 - RNA, 64 nt, hsa
gguugaucuagaugaguuauaaaugguauuugacuuuucauaaguaguggaagguuucacuaag

SEQ ID NO: 163893 - RNA, 64 nt, hsa
uuucacucauuaccuagaguaaacuuauugcauauuuucauaaucagucaaaauaauaaaacua

SEQ ID NO: 163894 - RNA, 64 nt, hsa
agcauuuguuuuugucugguaguauuauugagucuuuucauacacuucuuaaaaugugaaaauc

SEQ ID NO: 163895 - RNA, 64 nt, hsa
uguaagaacauacauuuugaaauuaugaacauuuuuuucauaaaaauuaaaugcuuuaagaaau

SEQ ID NO: 163896 - RNA, 64 nt, hsa
ucagaaguacgugaguuguuccucaggaauagauuuuucauaaagcagaauugauccuguggcu

SEQ ID NO: 163897 - RNA, 64 nt, hsa
gccauuggucauaaccagacagaauuuggaaacauuuucauaaagcuccauggagaguuuuaaa

SEQ ID NO: 163898 - RNA, 64 nt, hsa
auuuaaaagaagaucgguuuuuaauaauuuuuuauuuucauaggaugaaguuagagaaaauauu

SEQ ID NO: 163899 - RNA, 64 nt, hsa
cuagugguggauuccaugacauauauuguaauucuuuucauaggaaaugucauuacaguaugaa

SEQ ID NO: 163900 - RNA, 64 nt, hsa
uagaauucacugagaauaauaauacuuccaauuuuuuucauaguuguauaaucagaauuucaau

SEQ ID NO: 163901 - RNA, 64 nt, hsa
ccccgucccaaccaucucugucaaaaauauaccuuuuucauaugauauucugagcuaaucugau

SEQ ID NO: 163902 - RNA, 64 nt, hsa
uuaauuucaagauagcagucaauucgauaaggcauuuucauagaggaaaguuuacagaaacagu

SEQ ID NO: 163903 - RNA, 64 nt, hsa
uuucaaguaccaaaacguugaauugaugaugcaguuuucauauaucgagauguucgcucgugca

SEQ ID NO: 163904 - RNA, 64 nt, hsa
uugugguaauauaguaaguuuuuuuagaagacaauuuucauaacuugauaaauuauaguuuugu

SEQ ID NO: 163905 - RNA, 64 nt, hsa
aaaugugcugcauugccgaguucuuauuuucaccuuuucauaaucccaacuacaauaacaagaa

SEQ ID NO: 163906 - RNA, 64 nt, hsa
guggcucccuugcuccaggaacugaacgaggcccuuuucauaccuuaaauauauucugcacaac

SEQ ID NO: 163907 - RNA, 64 nt, hsa
uuuugaaaaggugcucaagcucugacauuuuugguuuucauagucgugaaguauuuaucauuug

SEQ ID NO: 163908 - RNA, 64 nt, hsa
agagggugaaaaaaaaaaaaaagauugauaguauuuuucauaaugaaaaaacugaagagauacg

SEQ ID NO: 163909 - RNA, 64 nt, hsa
uuugcaauuagguuuuugacuguuaaaauggauauuuucauaaaaaugguguucugaauuuugc

SEQ ID NO: 163910 - RNA, 64 nt, hsa
uaacccuuuuggguuauccacuuaaauuuagguauuuucauauuacucagguaaagauggaaau

SEQ ID NO: 163911 - RNA, 64 nt, hsa
uauccuccaugggcuaaauccagauguccaccuguuuucauaaauaacguuuuauuggagcaua

SEQ ID NO: 163912 - RNA, 64 nt, hsa
uuuuuguuuauugaauuuaagagauugguauuaguuuucauagcuguaguccauucuaauaauu

SEQ ID NO: 163913 - RNA, 64 nt, hsa
gacauuucucaguaacuacccggcaaaauauauauuuucauaauguugaauuugccuuuuagga

SEQ ID NO: 163914 - RNA, 64 nt, hsa
uguuaaacuuuauugccacauuuaaaggacuguauuuucauacuuuuuugcauuuuaccuuuca

SEQ ID NO: 163915 - RNA, 64 nt, hsa
aaugcauucuacugcgggacagucaguaggaucauuuucauaaagcaaggacaucauauguuuc

SEQ ID NO: 163916 - RNA, 64 nt, hsa
gcauauccuauugaccauugguauagucaucacuuuuucauauuuuaguguaguuagaagaauu

SEQ ID NO: 163917 - RNA, 64 nt, hsa
aaauacauuuccuggguaacuuaggaaauuaaguuuuucauaaggcaacagaugguuaaacuga

SEQ ID NO: 163918 - RNA, 64 nt, hsa
uuuuuauguaaccuguuacaaaauagacuugacuuuuucauaauggacuuuuguauuauacaag

SEQ ID NO: 163919 - RNA, 64 nt, hsa
aaggaccaguuuuucaugguacuugucuugaucuuuuucauaguguucaaaucuguauuuuugu

SEQ ID NO: 163920 - RNA, 64 nt, hsa
uugcugaugggauuuagggccaggucagaguuucuuuucauaacugccugaaaagagagauggu

SEQ ID NO: 163921 - RNA, 64 nt, hsa
ugauuggcuggcuauaaccaccccaguuaaaccauuuucauaauuaguagugccagcaauagug

SEQ ID NO: 163922 - RNA, 64 nt, hsa
uucucaaaaacaucaauguccaaacaucuaccuuuuuucauaggaguagacacuagcaagcugg

SEQ ID NO: 163923 - RNA, 64 nt, hsa
aguaaauuauuaagcagacuggaaaagugauguauuuucauagugaccuguguuucacuuaaug

SEQ ID NO: 163924 - RNA, 64 nt, hsa
uuuuuauuucugauuucauaauucagaacuaaauuuuucauagaaguguugagccaugcuacag

SEQ ID NO: 163925 - RNA, 64 nt, hsa
acuuuuauaauucccauccuaaaaauucuuaauauuuucauaaaauuuguauuuuuaaaugaaa

SEQ ID NO: 163926 - RNA, 64 nt, hsa
ucuuuccugacauuguuuucagaauaaagaauauuuuucauaauauuuuaagauacauacuauc

SEQ ID NO: 163927 - RNA, 64 nt, hsa
uuuucauaucaccaauuuguagcaaaauugaauuuuuucauaaacuagaauguuagacacauuu

SEQ ID NO: 163928 - RNA, 64 nt, hsa
uaaaacuuacucagcugguugcaaauaaagggaguuuucauaucaccaauuuguagcaaaauug

SEQ ID NO: 163929 - RNA, 64 nt, hsa
ggaaaauaaccacuccuggucgucuuuucauaaauuuucauauuuuugaagcugucuuugguac

SEQ ID NO: 163930 - RNA, 64 nt, hsa
uaguagaaauggaaaauaaccacuccuggucgucuuuucauaaauuuucauauuuuugaagcug

SEQ ID NO: 163931 - RNA, 64 nt, hsa
auggggaaauaguuauagaaaaugucacugaauuuuuucauauuuauaauuagucauuuacaua

SEQ ID NO: 163932 - RNA, 64 nt, hsa
uuuuaacuuuauacucaguugcauuaucauaaaauuuucauauaugccuagauaauggggaaaa

SEQ ID NO: 163933 - RNA, 64 nt, hsa
aagccagaccuucaguucaacaugcuuccuuagcuuuucauaguugucugacauuuccaugaaa

SEQ ID NO: 163934 - RNA, 64 nt, hsa
aguaaagggaaauaucagacaauauuuuauuauuuuuucauagauguucugccacacaaagaac

SEQ ID NO: 163935 - RNA, 64 nt, hsa
gaaagggaucauuuaugaauaacaaucugaagucuuuucauaaaaaaaauuaauaaacuuuagu

SEQ ID NO: 163936 - RNA, 64 nt, hsa
cuucucauaguaaaaagcugaauguuacuaauauuuuucauaucuaaaaaaaaauucuuagcaa

SEQ ID NO: 163937 - RNA, 64 nt, hsa
uugagaacuagauaacaugguaacagagaauugauuuucauaugaaucuuaacuccacaguaaa

SEQ ID NO: 163938 - RNA, 64 nt, hsa
aauucuugguuugccuaauucguuuuccuauuucuuuucauacaaauaaaggauaccuggauuu

SEQ ID NO: 163939 - RNA, 64 nt, hsa
cugucaguuuuauuaccuuauauacaaaucuucauuuucauacauaguacaauguaaauauaua

SEQ ID NO: 163940 - RNA, 64 nt, hsa
auaccacaauuaauauuuucaauguguaaauaucuuuucauaauuuuuccuacguauacacaaa

SEQ ID NO: 163941 - RNA, 64 nt, hsa
ucagagucaucagcaaacuguccaaguaggcuaggcuccagauuuaugaggaaagaaagggaca

SEQ ID NO: 163942 - RNA, 64 nt, hsa
uguuuuuccagggcugcugauccuuuuccagauagcuccagaguaugaugaccccagccccauc

SEQ ID NO: 163943 - RNA, 64 nt, hsa
ccuccaccagaaagggggagcuccuuccgcugcggcuccagauagauggggaugccgggcucca

SEQ ID NO: 163944 - RNA, 64 nt, hsa
cguggcccgugggagcaguuacaucgggucuggugcuccagaccuagggcccagcacuuucauc

SEQ ID NO: 163945 - RNA, 64 nt, hsa
gcagggcuuugaucauucaaaaguaacuaaaguagcuccagaaugccaaguauucguguaaauu

SEQ ID NO: 163946 - RNA, 64 nt, hsa
uuuuuuaaacaaugugaucucaaauuuaaagacugcuccagauagccugcauuugcaauggaau

SEQ ID NO: 163947 - RNA, 64 nt, hsa
gauaaagcuggcuguuaucucaacaucuucaucagcuccagacugagacucagugucuaagucu

SEQ ID NO: 163948 - RNA, 64 nt, hsa
cuagucccggcauccugauggcuccgacaggccugcuccagagcacggcugaccauuucugcuc

SEQ ID NO: 163949 - RNA, 64 nt, hsa
ccugggagguggucgcccugcagugcaagcugcugcuccagagcguaccguggcccagacugau

SEQ ID NO: 163950 - RNA, 64 nt, hsa
gcagggaggcagucgcccugcggugcaagcugcugcuccagagcauaccguggcccagguggua

SEQ ID NO: 163951 - RNA, 64 nt, hsa
uucugguucucacacagaucuauggcuaugacgagcuccagaugcugcagucacggcugccagu

SEQ ID NO: 163952 - RNA, 62 nt, hsa
uuuugucugcuuagcauugaucugguagccuugcuccagaagccuguuccucacagucaagc

SEQ ID NO: 163953 - RNA, 64 nt, hsa
cugacuugaacgauggcuucuccucaagcuguaggcuccagagcuuccuaaccuaguaaaaugu

SEQ ID NO: 163954 - RNA, 64 nt, hsa
aguagcaaacuguacauuccuucuuccucccccugcuccagaaggugccgguacugaagaugcu

SEQ ID NO: 163955 - RNA, 64 nt, hsa
cagcugccuccgcgugaucaaagccacacucugggcuccagaguggggaugacaugcacucagc

SEQ ID NO: 163956 - RNA, 64 nt, hsa
gaaaagcagcucuccccucagagugcaagccccugcuccagaagauagcuucaccccaauccca

SEQ ID NO: 163957 - RNA, 64 nt, hsa
agccagcuccacugcccaggcccccaagagggcagcuccagaagcugcccagggcuccgggacc

SEQ ID NO: 163958 - RNA, 64 nt, hsa
aacgccaccuuacacucugcaggcugcagcggcagcuccagauggccuccugagcuggacgacc

SEQ ID NO: 163959 - RNA, 64 nt, hsa
cacuccagaauccacaaagccgugccuuucucuggcuccagaauaugcauaaucagcgcccugg

SEQ ID NO: 163960 - RNA, 64 nt, hsa
agaggaugcagaggggugcugcuccuaaacccccgcuccagaucugcacuggguguggccccgc

SEQ ID NO: 163961 - RNA, 64 nt, hsa
gccccaccacacuccccgccuguccugccucucugcuccagagagaggaugcagaggggugcug

SEQ ID NO: 163962 - RNA, 64 nt, hsa
aaaaaaugcaauuuucuggccacaagggcauagugcaguucacuuacguguugauguaguuuau

SEQ ID NO: 163963 - RNA, 64 nt, hsa
ugaauugcuuaaguauaauuuauagaauuucagugcaguucauucuuaauggaaaaucugaaac

SEQ ID NO: 163964 - RNA, 64 nt, hsa
uagguguuuaauuuucacucuucauguucaauuagcaguucaaauuaaagaagaugguuauugg

SEQ ID NO: 163965 - RNA, 64 nt, hsa
gccacuaccaugcuguccauggaaggaauaaucagcaguucaguugucacaagccgcccuugaa

SEQ ID NO: 163966 - RNA, 64 nt, hsa
uaaacacaaauuugcugcacagaauaucaccauugcaguucaaaacaaaacaaaacaaaaaguc

SEQ ID NO: 163967 - RNA, 64 nt, hsa
guuuuauauuauaacucugaagcaugauaaaggggcaguucacaauuuucaccauuuaaacaca

SEQ ID NO: 163968 - RNA, 64 nt, hsa
uggugcaggggcaauuaccauggcagcugcucaagcaguucaggcuacagcucagguaaaaagu

SEQ ID NO: 163969 - RNA, 64 nt, hsa
uuagucuuucuauguuucugcauccagauagagugcaguucaugagggagggggcgggggacug

SEQ ID NO: 163970 - RNA, 64 nt, hsa
agcuaccgaagucacccagccauucccaugagcagcaguucauuuaauugucacagcgucgcca

SEQ ID NO: 163971 - RNA, 64 nt, hsa
ucuucaucuauuccuguacuaaugguuucucuuugcaguucacagagaauuuggggcucucuuc

SEQ ID NO: 163972 - RNA, 64 nt, hsa
gaucucggcucacuucagccuccgccaccucaaggcaguucaagcaauucuccugccucagccu

SEQ ID NO: 163973 - RNA, 64 nt, hsa
uuccaagaaauuaagcauaacagucucaucuacggcaguucauuacacugucaauguuaacauc

SEQ ID NO: 163974 - RNA, 64 nt, hsa
guguauauuuguuugucaggcguuguguugaggagcaguucacgcacuggcugugucuauuccu

SEQ ID NO: 163975 - RNA, 64 nt, hsa
ucugcccaggugucucuguuugcugcccaaggcagcaguucaugucucguccauguccauguuc

SEQ ID NO: 163976 - RNA, 64 nt, hsa
agcucuuugaaauagucugugugaaggugaaagugcaguucaguaauaaacuguguuuacucag

SEQ ID NO: 163977 - RNA, 64 nt, hsa
ggaagcaccccaugccaaagcuaggguggcccuugcaguucagcaccacccuagucccuucccc

SEQ ID NO: 163978 - RNA, 64 nt, hsa; identical to SEQ ID NO: 81090

SEQ ID NO: 163979 - RNA, 64 nt, hsa; identical to SEQ ID NO: 81091

SEQ ID NO: 163980 - RNA, 64 nt, hsa; identical to SEQ ID NO: 81092

SEQ ID NO: 163981 - RNA, 64 nt, hsa; identical to SEQ ID NO: 81093

SEQ ID NO: 163982 - RNA, 64 nt, hsa; identical to SEQ ID NO: 81094

SEQ ID NO: 163983 - RNA, 64 nt, hsa; identical to SEQ ID NO: 81095

SEQ ID NO: 163984 - RNA, 64 nt, hsa; identical to SEQ ID NO: 81096

SEQ ID NO: 163985 - RNA, 64 nt, hsa; identical to SEQ ID NO: 81097

SEQ ID NO: 163986 - RNA, 64 nt, hsa; identical to SEQ ID NO: 81098

SEQ ID NO: 163987 - RNA, 64 nt, hsa; identical to SEQ ID NO: 81099

SEQ ID NO: 163988 - RNA, 64 nt, hsa; identical to SEQ ID NO: 81100

SEQ ID NO: 163989 - RNA, 64 nt, hsa; identical to SEQ ID NO: 81101

SEQ ID NO: 163990 - RNA, 64 nt, hsa; identical to SEQ ID NO: 81102

SEQ ID NO: 163991 - RNA, 64 nt, hsa; identical to SEQ ID NO: 81103

SEQ ID NO: 163992 - RNA, 64 nt, hsa; identical to SEQ ID NO: 81104

SEQ ID NO: 163993 - RNA, 64 nt, hsa; identical to SEQ ID NO: 81105

SEQ ID NO: 163994 - RNA, 64 nt, hsa; identical to SEQ ID NO: 81106

SEQ ID NO: 163995 - RNA, 64 nt, hsa; identical to SEQ ID NO: 81107

SEQ ID NO: 163996 - RNA, 64 nt, hsa; identical to SEQ ID NO: 81108

SEQ ID NO: 163997 - RNA, 64 nt, hsa; identical to SEQ ID NO: 81109

SEQ ID NO: 163998 - RNA, 64 nt, hsa; identical to SEQ ID NO: 81110

SEQ ID NO: 163999 - RNA, 64 nt, hsa; identical to SEQ ID NO: 81111

SEQ ID NO: 164000 - RNA, 64 nt, hsa; identical to SEQ ID NO: 81112

SEQ ID NO: 164001 - RNA, 64 nt, hsa; identical to SEQ ID NO: 81113

SEQ ID NO: 164002 - RNA, 64 nt, hsa; identical to SEQ ID NO: 81114

SEQ ID NO: 164003 - RNA, 64 nt, hsa; identical to SEQ ID NO: 81115

SEQ ID NO: 164004 - RNA, 64 nt, hsa; identical to SEQ ID NO: 81116

SEQ ID NO: 164005 - RNA, 64 nt, hsa; identical to SEQ ID NO: 81117

SEQ ID NO: 164006 - RNA, 64 nt, hsa; identical to SEQ ID NO: 81118

SEQ ID NO: 164007 - RNA, 64 nt, hsa; identical to SEQ ID NO: 81119

SEQ ID NO: 164008 - RNA, 64 nt, hsa; identical to SEQ ID NO: 81120

SEQ ID NO: 164009 - RNA, 64 nt, hsa; identical to SEQ ID NO: 81121

SEQ ID NO: 164010 - RNA, 64 nt, hsa; identical to SEQ ID NO: 81122

SEQ ID NO: 164011 - RNA, 64 nt, hsa; identical to SEQ ID NO: 81123

SEQ ID NO: 164012 - RNA, 64 nt, hsa; identical to SEQ ID NO: 81124

SEQ ID NO: 164013 - RNA, 64 nt, hsa; identical to SEQ ID NO: 81125

SEQ ID NO: 164014 - RNA, 64 nt, hsa; identical to SEQ ID NO: 81126

SEQ ID NO: 164015 - RNA, 64 nt, hsa; identical to SEQ ID NO: 81127

SEQ ID NO: 164016 - RNA, 64 nt, hsa; identical to SEQ ID NO: 81128

SEQ ID NO: 164017 - RNA, 64 nt, hsa; identical to SEQ ID NO: 81129

SEQ ID NO: 164018 - RNA, 64 nt, hsa; identical to SEQ ID NO: 81130

SEQ ID NO: 164019 - RNA, 64 nt, hsa; identical to SEQ ID NO: 81131

SEQ ID NO: 164020 - RNA, 64 nt, hsa; identical to SEQ ID NO: 81132

SEQ ID NO: 164021 - RNA, 64 nt, hsa; identical to SEQ ID NO: 81133

SEQ ID NO: 164022 - RNA, 61 nt, hsa
gcuggaaacccucccugacccccacccuggccccccguauccccagcccuuggcaacacug

SEQ ID NO: 164023 - RNA, 61 nt, hsa
cuaaagagaauuacuuucauucauuucauuucccccguagcagauggaaggagaaaccucu

SEQ ID NO: 164024 - RNA, 61 nt, hsa
uguuauccaacauugcuucaaagaugcccaacccccguaguagcaggcaguucccaagugg

SEQ ID NO: 164025 - RNA, 61 nt, hsa
ucaucccaauucuaguuagaacaaaguuaaacccccguaaucuuaaagagaaaaucuuugg

SEQ ID NO: 164026 - RNA, 61 nt, hsa
acuugcaacagucuuucaugauaugaggaugcccccguauuaccacucugauuauaguucu

SEQ ID NO: 164027 - RNA, 61 nt, hsa
ccuugagagugcagcucggacccaccggcggcccccguagcagguggugugggugcucggg

SEQ ID NO: 164028 - RNA, 61 nt, hsa
gugcuguguccacgcgcuaaggcgacccccucccccguacugacuucuccuauaagcgcuu

SEQ ID NO: 164029 - RNA, 61 nt, hsa
gcaaugggguccacuucccccucuucagcaucccccguaccccacuuucugcugaaagaac

SEQ ID NO: 164030 - RNA, 61 nt, hsa
aaggaacagcauuucucugcuccucagucaacccccguagccuagagcagugucacaagcu

SEQ ID NO: 164031 - RNA, 61 nt, hsa
ucuucucacugugaguggaagcuggaucgggcccccguaguccuggcagcccuguugucug

SEQ ID NO: 164032 - RNA, 61 nt, hsa
ucaggcuggugacuagcagagguccaccugacccccguaagcugcugaacaaguagggcug

SEQ ID NO: 164033 - RNA, 61 nt, hsa
cuuuuaaauaaaaaguuaaauugcuuaauuucccccguauuccuggccugucugccccuuu

SEQ ID NO: 164034 - RNA, 61 nt, hsa
ccuggcacagcggggcgugcacugccccagccccccguagcaggggcaugacuguuuccca

SEQ ID NO: 164035 - RNA, 61 nt, hsa
agagagcagaucucuuauuccucacuuuccacccccguauuuuguaaugaccaugagcaau

SEQ ID NO: 164036 - RNA, 61 nt, hsa
auguggaauuucccgugaacgucuccuuccucccccguaucugccgccugucacuucgcca

SEQ ID NO: 164037 - RNA, 61 nt, hsa
aacccuuggaucacaugggggcuucugggaacccccguauucuucccccucacccaagggc

SEQ ID NO: 164038 - RNA, 61 nt, hsa
gauuuccacucugcugucacaaacauuuuuccccccguaaaaugucuuaaugcuguccuac

SEQ ID NO: 164039 - RNA, 61 nt, hsa
uugcuccagccugacaacagccugagaaauccccccguaacuuauuaucacuuugggguuc

SEQ ID NO: 164040 - RNA, 61 nt, hsa
gaggccauccugauaaaauucggcgcuauugcccccguagcucuggagcucuaaaccgucu

SEQ ID NO: 164041 - RNA, 61 nt, hsa
aagacaugggguaaugugagagaguagaacacccccguaccuaauaaaaaucuuuauuuuu

SEQ ID NO: 164042 - RNA, 61 nt, hsa
ccgcucccuuuuucuucugccucacuugaaucccccguaaacaccagacgauugagucuac

SEQ ID NO: 164043 - RNA, 61 nt, hsa
ggcaaguaaugguagugggcuuuuaaacugccccccguauguuuuaagaccuaauccccac

SEQ ID NO: 164044 - RNA, 61 nt, hsa
cuccccgcugaccgcuccuccagccccgccucccccguacaggcagagcgcccgcccaccu

SEQ ID NO: 164045 - RNA, 61 nt, hsa
gaggccauggccggggccuacgacgcgccaccccccguacgacacgcguccucgggcgcca

SEQ ID NO: 164046 - RNA, 61 nt, hsa
cuugaaggcugagccccacaucuccagguuccccccguauccacuccuucaguccucauuu

SEQ ID NO: 164047 - RNA, 51 nt, hsa
gccgaggcaccaaguucugaucccccguagaaaucccccuuucucuaauag

SEQ ID NO: 164048 - RNA, 64 nt, hsa; identical to SEQ ID NO: 92187

SEQ ID NO: 164049 - RNA, 64 nt, hsa; identical to SEQ ID NO: 92188

SEQ ID NO: 164050 - RNA, 64 nt, hsa; identical to SEQ ID NO: 92189

SEQ ID NO: 164051 - RNA, 64 nt, hsa; identical to SEQ ID NO: 92190

SEQ ID NO: 164052 - RNA, 64 nt, hsa; identical to SEQ ID NO: 92191

SEQ ID NO: 164053 - RNA, 64 nt, hsa; identical to SEQ ID NO: 92192

SEQ ID NO: 164054 - RNA, 64 nt, hsa; identical to SEQ ID NO: 92193

SEQ ID NO: 164055 - RNA, 64 nt, hsa; identical to SEQ ID NO: 92194

SEQ ID NO: 164056 - RNA, 64 nt, hsa; identical to SEQ ID NO: 92195

SEQ ID NO: 164057 - RNA, 64 nt, hsa; identical to SEQ ID NO: 92196

SEQ ID NO: 164058 - RNA, 64 nt, hsa; identical to SEQ ID NO: 92197

SEQ ID NO: 164059 - RNA, 64 nt, hsa; identical to SEQ ID NO: 92198

SEQ ID NO: 164060 - RNA, 64 nt, hsa; identical to SEQ ID NO: 92199

SEQ ID NO: 164061 - RNA, 64 nt, hsa; identical to SEQ ID NO: 92200

SEQ ID NO: 164062 - RNA, 64 nt, hsa; identical to SEQ ID NO: 92201

SEQ ID NO: 164063 - RNA, 64 nt, hsa; identical to SEQ ID NO: 92202

SEQ ID NO: 164064 - RNA, 64 nt, hsa; identical to SEQ ID NO: 92203

SEQ ID NO: 164065 - RNA, 64 nt, hsa; identical to SEQ ID NO: 92204

SEQ ID NO: 164066 - RNA, 64 nt, hsa; identical to SEQ ID NO: 92205

SEQ ID NO: 164067 - RNA, 64 nt, hsa; identical to SEQ ID NO: 92206

SEQ ID NO: 164068 - RNA, 64 nt, hsa; identical to SEQ ID NO: 92207

SEQ ID NO: 164069 - RNA, 64 nt, hsa; identical to SEQ ID NO: 92208

SEQ ID NO: 164070 - RNA, 64 nt, hsa; identical to SEQ ID NO: 92209

SEQ ID NO: 164071 - RNA, 64 nt, hsa; identical to SEQ ID NO: 92210

SEQ ID NO: 164072 - RNA, 64 nt, hsa
uaaaaggcagcucaccauuugcugguaacuuaaugugagagaauccauaucugcgugaaaacac

SEQ ID NO: 164073 - RNA, 64 nt, hsa
cagaacuuggcauuuccaacuucuuccuuuccgggugagagaagaagcggagaaggguucagug

SEQ ID NO: 164074 - RNA, 64 nt, hsa
uaguuugcagaggagcaaauugagguucagcaaggugagagagguacccaaggucacauagcua

SEQ ID NO: 164075 - RNA, 64 nt, hsa
ccaggucagaaaccauuguucagaagaccucccugugagagaguugcuccucagggucccucag

SEQ ID NO: 164076 - RNA, 64 nt, hsa
auguacuaagagggaaaauguauuuaaguuaagggugagagacuuaaguuauaggugaccuuag

SEQ ID NO: 164077 - RNA, 64 nt, hsa
agacuuaaguuauaggugaccuuagagaccuaaggugagagacuugacacauggaaggaguaac

SEQ ID NO: 164078 - RNA, 64 nt, hsa
aaagaaaucaaguauaugaggagagcgagcgagcgugagagaacacccgugagagagacuugaa

SEQ ID NO: 164079 - RNA, 64 nt, hsa
uaugaggagagcgagcgagcgugagagaacacccgugagagagacuugaaacugcuguccuuua

SEQ ID NO: 164080 - RNA, 64 nt, hsa
cugucuuaucaggccccaaaaaaccuguucugcagugagagauuuaauugugggugagaaucua

SEQ ID NO: 164081 - RNA, 64 nt, hsa
cauacaagugggaaaccuuagaaaugcacugagugugagagagcuuucuacuaaugcucagccc

SEQ ID NO: 164082 - RNA, 64 nt, hsa
gcagauggacuuuuccaugggucaaauuuuuugugugagagauagagguacaugucuucugaug

SEQ ID NO: 164083 - RNA, 64 nt, hsa
aaacaaaaacuaguuugaggcacccaagcauuuagugagagauugagaaugaugcuuaauggau

SEQ ID NO: 164084 - RNA, 64 nt, hsa
ugaggaaggaaagguuucaaauuuaggggcagaagugagagaaugagccaacccauguaccugc

SEQ ID NO: 164085 - RNA, 64 nt, hsa
uucagauuggagaccagccugggacuucccugcagugagagagcaucucccccugguccaugcc

SEQ ID NO: 164086 - RNA, 64 nt, hsa; identical to SEQ ID NO: 164080

SEQ ID NO: 164087 - RNA, 64 nt, hsa; identical to SEQ ID NO: 164081

SEQ ID NO: 164088 - RNA, 64 nt, hsa
gaguccaaaauagcaaggaaguggugggaagaaggugagagaaaagggugggagggugagagag

SEQ ID NO: 164089 - RNA, 64 nt, hsa
uggugggaagaaggugagagaaaagggugggagggugagagaggggagggaggggaauaaggug

SEQ ID NO: 164090 - RNA, 64 nt, hsa
gccuguguguguguguuugugugugugugugugugugagagagagagagagagagagagagacc

SEQ ID NO: 164091 - RNA, 64 nt, hsa
gaauauucccuuggguuuggacccauggucccaggugagagaaggaagugaggccauagaugca

SEQ ID NO: 164092 - RNA, 64 nt, hsa
uccagagagccagagagugagagagagaaagagagugagagagagagagaaagagagagagaga

SEQ ID NO: 164093 - RNA, 64 nt, hsa
ggaagagaguaaccaguuuccagagagccagagagugagagagagaaagagagugagagagaga

SEQ ID NO: 164094 - RNA, 64 nt, hsa
gugaacgccauucaaccgaacauucuucccaagcgugagagagugacugacacuugguuccauc

SEQ ID NO: 164095 - RNA, 64 nt, hsa
gagccuucagugggugcaaggcgccauacuugcugugagagagcugaguagaguguugguuuuu

SEQ ID NO: 164096 - RNA, 64 nt, hsa
gacagagugagagaagucagcugucacggggaaggugagagagaggaugcuaagcuuccuacuc

SEQ ID NO: 164097 - RNA, 64 nt, hsa
cucuccgcuuguccucuugugauguuaggacagagugagagaagucagcugucacggggaaggu

SEQ ID NO: 164098 - RNA, 64 nt, hsa
aggcccagcugccagggaagacagagcaggcuuugugagagaggaccuccaugcccccgccacc

SEQ ID NO: 164099 - RNA, 64 nt, hsa
cuuccuugcgaccaccaacacacaggaacucugugugagagagagggcgcccagcccaggccug

SEQ ID NO: 164100 - RNA, 64 nt, hsa
gccaguugacaagauuuuuccacccucgagcagcgugagagaugccucuuuaacacuugaaauu

SEQ ID NO: 164101 - RNA, 64 nt, hsa
uaaggugugaaaugcuccucaacacgauggauaagugagagagagucagguugcauguucacug

SEQ ID NO: 164102 - RNA, 64 nt, hsa
auguaauaaguauauaauaugugagaauauuauauaugacuauuacuuauacaugcacaugcac

SEQ ID NO: 164103 - RNA, 64 nt, hsa
uugugucuucaacugaaaaauacaaucuguggauuaugacuaccagcaauuuuuuucuaggaaa

SEQ ID NO: 164104 - RNA, 64 nt, hsa
auuaaaugagaacauggaugaguggacuucauauuaugacuagcuuuacuauuuuaauucaccu

SEQ ID NO: 164105 - RNA, 64 nt, hsa
auaagcuauguguucagacugaaacuggagaaauuaugacuauuuuauuuauaguaguaguuaa

SEQ ID NO: 164106 - RNA, 64 nt, hsa
aggauaucagaaaacuaaauauauggaguugcuuuaugacuauuacauguuaaauaaaaauagc

SEQ ID NO: 164107 - RNA, 64 nt, hsa
cuuuccugaauauuuaaauguguuuguaugguguuaugacuaauuguuacugauuuagagacua

SEQ ID NO: 164108 - RNA, 64 nt, hsa
cauauuuaaacuuuauccuaaaguuuaaaucuaacagaacaacugaaauacuugaaauagaccu

SEQ ID NO: 164109 - RNA, 64 nt, hsa
uuugcuaaugaucuucagauuuuaucuuugucuacagaacaauuaguaauacccaaguaauauu

SEQ ID NO: 164110 - RNA, 64 nt, hsa
ccuuacugggaugggcucugucuacagcaaugugcagaacaagcauucccacuuuuccucaaga

SEQ ID NO: 164111 - RNA, 64 nt, hsa
uuuccuguugaauguauuuuuaugagauuuuaaccagaacaaaggcagauaaacaggcauucca

SEQ ID NO: 164112 - RNA, 64 nt, hsa
ugucuguucuuaaagauuucaugguuggcucagacagaacaaucaucuguuugacuucuuuggu

SEQ ID NO: 164113 - RNA, 64 nt, hsa
agucagugccguugccuuuucuucauuagagacacagaacaauguauuagaauuuccagcugug

SEQ ID NO: 164114 - RNA, 64 nt, hsa
cccaaauauaaccauuuaaagaaagaaugcauuccagaacaaauuguuuacauaaguuccuaua

SEQ ID NO: 164115 - RNA, 64 nt, hsa
uuaaccacuugccucuuucuccagcagcugauuccagaacaaaucauuauguuuccuaacugug

SEQ ID NO: 164116 - RNA, 64 nt, hsa
uccgaucaagcuuuuauuuuuuuaaaagucaaaacagaacaaaacaaaguaugcagagacagag

SEQ ID NO: 164117 - RNA, 64 nt, hsa
gucacauguuuuucuuccuuguccccacggcccccagaacaacauucucccugcuggcagcccu

SEQ ID NO: 164118 - RNA, 64 nt, hsa
uuggaccaguuaauucccauacaagucaagguaacagaacaaaagggaauccugaugcccuuuu

SEQ ID NO: 164119 - RNA, 64 nt, hsa
uuaaaauggaaaaauacuuaauaucacuaaauaucagaacaauguaacauuuacaaaugacaua

SEQ ID NO: 164120 - RNA, 64 nt, hsa
ugugaucccacuacugcauuccagccuggguggacagaacaaggcccugucucuauuuuaaaau

SEQ ID NO: 164121 - RNA, 64 nt, hsa
guuuugcaagccaaaucauuauuaaaagugcgggcagaacaacuggucugguuuccacuggagu

SEQ ID NO: 164122 - RNA, 64 nt, hsa
uaccauccuuuaaucauaacuaaaacauugaaaacagaacaaaugagaaaagaaaaaaaaccug

SEQ ID NO: 164123 - RNA, 64 nt, hsa
uuuguuucaaagaggucugcauguugggcgaaaacagaacaacuguguuuccuuuuacuuguuc

SEQ ID NO: 164124 - RNA, 64 nt, hsa
aaaacuagacaaauaaagacaaacuaaaacaaaacagaacaaaagcaaaggaaaaugcuuuaga

SEQ ID NO: 164125 - RNA, 64 nt, hsa
cauuucauguggccauggguaccuagaaagacaucagaacaagucggucaaauuaaaaguagaa

SEQ ID NO: 164126 - RNA, 64 nt, hsa
ccaucuuaguaaaaauuuugaaaggaugaccacucagaacaacucucuugaugaccauucuguc

SEQ ID NO: 164127 - RNA, 64 nt, hsa
aaacaaacaaaaaaaaaaacacacaaaacaaaaacagaacaaaagaagagagaaggaaauuuua

SEQ ID NO: 164128 - RNA, 64 nt, hsa
guacuucggagacaccugucugcaucugacugagcagaacaaaucgucaggugccuggagcaaa

SEQ ID NO: 164129 - RNA, 64 nt, hsa
ccaagagugauguacagucuauuccauagaaucacagaacaauccugaaccaggccugucaccu

SEQ ID NO: 164130 - RNA, 64 nt, hsa
ccagagggcagcgucagacacccagaguuggagacagaacaacagagucucagggaaagagaac

SEQ ID NO: 164131 - RNA, 64 nt, hsa
acaguaaguuauagacuugcugaguuuggcauagauagugcacucauuuaaucugugccucuca

SEQ ID NO: 164132 - RNA, 64 nt, hsa
cuucauugacuuuucuuuaguuaaugaguauuaaauagugcauauucuguagacuauaggguuu

SEQ ID NO: 164133 - RNA, 64 nt, hsa
gcuucauucuguggaauuuugugcuugcuacuguauagugcaugugguguagguuacucuaacu

SEQ ID NO: 164134 - RNA, 64 nt, hsa
uugcaggaaaaugauuauaacuaaaagcucucugauagugcagagacuuaccagaagacacaag

SEQ ID NO: 164135 - RNA, 64 nt, hsa
ugauaaugauaaaacaccucacaccucacucuuuauagugcacaaaaugaaugaggucugggcu

SEQ ID NO: 164136 - RNA, 64 nt, hsa
ggauuaugggcuggaaagcauuuguuauaaaccuauagugcacauuuuaacugcccccuaaauu

SEQ ID NO: 164137 - RNA, 64 nt, hsa
cagaaacgagaucgggaagcagaaauauagugcaauagugcaacaucucugaauccuuuuaauc

SEQ ID NO: 164138 - RNA, 64 nt, hsa
cuaggacucagaaacgagaucgggaagcagaaauauagugcaauagugcaacaucucugaaucc

SEQ ID NO: 164139 - RNA, 64 nt, hsa
caguuaaaugauauuuaacaccugggaaaacaggacagcucagauugucgaguuaguaaacaug

SEQ ID NO: 164140 - RNA, 64 nt, hsa
gaaaacaggaaaauaaaagagaaauuuagaaaauacagcucauuacaauaaaauuguuggauuu

SEQ ID NO: 164141 - RNA, 64 nt, hsa
aacucaaaggacugugauauaauccauuuauaucacagcucacaguuucugaaaauguauaaaa

SEQ ID NO: 164142 - RNA, 64 nt, hsa
gguaugacagcauaccauuaaauacauuuacaucacagcucaaaggacugugauauaauccauu

SEQ ID NO: 164143 - RNA, 64 nt, hsa
aaauaacgggcugcccucagcucacagaaauaccacagcucagccacugugaugcagagcccca

SEQ ID NO: 164144 - RNA, 64 nt, hsa
cuaaugugugauguugacgccuaacugaauuugaacagcucaccacugugccuacauuuaaaaa

SEQ ID NO: 164145 - RNA, 64 nt, hsa
ggaccggcucuuccuggauggguccaagaauuggacagcucagauggagugagggccuauuuuc

SEQ ID NO: 164146 - RNA, 64 nt, hsa
gaugcacccccaggcuucaaaccaccuggaaugcacagcucagggaagcugguggaugccuaga

SEQ ID NO: 164147 - RNA, 64 nt, hsa
cagagcaccuaggauaaagugcagugaugcaaucacagcucaccucagugcggccuugaacucc

SEQ ID NO: 164148 - RNA, 64 nt, hsa
uuuuguagagguggggaagugcagugaugcaaucacagcucaccucagugcggccuugaacucc

SEQ ID NO: 164149 - RNA, 64 nt, hsa
auuuugucugaucuaccauuucuaugguuuaugguaauaguauucccuuuaucccucccuuuug

SEQ ID NO: 164150 - RNA, 64 nt, hsa
cugugaagacagaagaguaucaagauuaauauauuaauaguauagcucugacugguaaauuucu

SEQ ID NO: 164151 - RNA, 64 nt, hsa
auuggaaaaaaauguuaaagguuuaggacacaccuaauaguauguccuuugaaugggaaguguu

SEQ ID NO: 164152 - RNA, 64 nt, hsa
aacucuaauugcuauuagucuacauguauuucuguaauaguauugugucauaucaauuuuuaag

SEQ ID NO: 164153 - RNA, 64 nt, hsa
uggacuaauuucgguuuuuauacaaguaaagauuuaauaguauaaggauuuuuuugcauuucuu

SEQ ID NO: 164154 - RNA, 64 nt, hsa
aaaagcauacuauaguuguaaaaacaaauaauuuuaauaguauauucaguggcugaagugauag

SEQ ID NO: 164155 - RNA, 64 nt, hsa
aguacuauuacuaguacuaguacuaugacacuguuaauaguacuauuaacaacccauaggcacu

SEQ ID NO: 164156 - RNA, 64 nt, hsa
uuuuauuuuaaaauaaaauuuaccuuuaaaauaauaauaguacuauugcuaguacuaguacuau

SEQ ID NO: 164157 - RNA, 64 nt, hsa
uguuaguauuaacuauuaguauuauuaacacuaauaauaguacuauuacuauuacuauuuuuau

SEQ ID NO: 164158 - RNA, 64 nt, hsa
uacauuugcguugcuuucuacauagagacuuguauaauaguauuaauaguagcucauucucucu

SEQ ID NO: 164159 - RNA, 64 nt, hsa
guugcuuucuacauagagacuuguauaauaguauuaauaguagcucauucucucuaaaaauuua

SEQ ID NO: 164160 - RNA, 64 nt, hsa
uuuaaaaaaauuaauauggcagaauacgagcuauuaauaguaucagauacagaacccucauaau

SEQ ID NO: 164161 - RNA, 64 nt, hsa
ccacuuaauuguggccaaagcuauucagcugugauaauaguaucucacagggaaacauuuucuu

SEQ ID NO: 164162 - RNA, 64 nt, hsa
cugaaauauauuauuaagggcaauggagauaaauuaauaguagaugugguucccagaaaauaua

SEQ ID NO: 164163 - RNA, 64 nt, hsa
uguaacuggaacuaaaucaaaugauuacuaguguuaauaguagauaacuuguuuuuauuguugg

SEQ ID NO: 164164 - RNA, 64 nt, hsa
aacacgauacagaucagugcauauaguauauuacuaauaguaugcuguuaauuguguaagaaag

SEQ ID NO: 164165 - RNA, 64 nt, hsa
agcguuugcucuaaugugagcuauggacuuuaguuaauaguaacgugucaauauugguucauca

SEQ ID NO: 164166 - RNA, 64 nt, hsa
uuuaacuagagcaugauauuuuaaauguuaagguguaacauauguuaaauaaaacuguuauuuu

SEQ ID NO: 164167 - RNA, 64 nt, hsa
auucugccaaacuauuacuuauauguacuauuguguaacauacuuucuugaaauauuuuuguuu

SEQ ID NO: 164168 - RNA, 64 nt, hsa
caaguauauaaaguuuugccccaugauaaaauaaguaacauauaaauuaauacauaaguuaaua

SEQ ID NO: 164169 - RNA, 64 nt, hsa
acauauauuuuauuuucauacuuuugauaugauuguaacauauuucuugaguaauuuaaaugcu

SEQ ID NO: 164170 - RNA, 64 nt, hsa
cagaguugaaagccacagaguuaagugaccucagguaacauaauggugaugguuggccauuuga

SEQ ID NO: 164171 - RNA, 64 nt, hsa
auguuaguccucuuagaugacugcuuauuuauguguaacauaaaucccacauauucuaaugaca

SEQ ID NO: 164172 - RNA, 64 nt, hsa
uugugguagcauuaucuuagacauuaaauuugaaguaacauauauccuguaguaacauagaccc

SEQ ID NO: 164173 - RNA, 64 nt, hsa
uagacauuaaauuugaaguaacauauauccuguaguaacauagacccaaaguuacuauagucaa

SEQ ID NO: 164174 - RNA, 64 nt, hsa
guaagugaacaauuuuaaauuuauuuuuuauuauguaacauacuuuuauuaaaauauauacuua

SEQ ID NO: 164175 - RNA, 64 nt, hsa
guguacguaaaacaugguaacaguauacuauuugguaacauaauggauuaacaucucuaguaau

SEQ ID NO: 164176 - RNA, 64 nt, hsa
acuuaaggagacggguaaaggaucuuaaauuuuuuucuaauagaaagaugugcuacacuguauu

SEQ ID NO: 164177 - RNA, 64 nt, hsa
uaacuuccugauuggaguguguaagcugagcgauuucuaauaaaauuuuaguuguacacuuuua

SEQ ID NO: 164178 - RNA, 64 nt, hsa
auguacauuuuaguucuuaacuuuuuuuuaugguuucuaauauguaugaccaauguagccauug

SEQ ID NO: 164179 - RNA, 64 nt, hsa
gaggaggcuucuaauuagcuggaaaagaguauuuuucuaauacguugcaaggauuagccaaauc

SEQ ID NO: 164180 - RNA, 64 nt, hsa
uguuucauuuauauaaaagcaaaagaacuuagaguucuaauaaaugggaugucuaauaaauuau

SEQ ID NO: 164181 - RNA, 64 nt, hsa
aauauaaugugagccccauauacaauuuuuacauuucuaauauauuuuaaacaagugaaguuaa

SEQ ID NO: 164182 - RNA, 64 nt, hsa
acuaucaguauguugaauuuauuauguauauuauuucuaauauccgaaacuaaauacuugauuu

SEQ ID NO: 164183 - RNA, 64 nt, hsa
aaagauggagaaacaugccauuuuucagugaagauucuaauauuuuaucuauuuuguucauuga

SEQ ID NO: 164184 - RNA, 64 nt, hsa
ucuuccuucacaguuuuaucucacaaaaccauuuuucuaauaagagacaucauguuggaaagau

SEQ ID NO: 164185 - RNA, 64 nt, hsa
ucuaagaacuaagcuuugaguauuauuuaauaauuucuaauaacacucauuccucaagugauau

SEQ ID NO: 164186 - RNA, 64 nt, hsa
aauuauccagaagggguacuuuuccauuguaucuuucuaauaaggguuuaaaaugguacuauua

SEQ ID NO: 164187 - RNA, 64 nt, hsa
ccaagugacuccauuugacuugcaaaccagccuuuucuaauaggcuaauauugcugaggccuua

SEQ ID NO: 164188 - RNA, 64 nt, hsa
auuuuaaaucuguauguaucuguuugauuuuuuuuucuaauauuucaguugagcugcuguuuuc

SEQ ID NO: 164189 - RNA, 64 nt, hsa
uacugggauuccugaucaaguaagccucuucccuuucuaauaaaauauacaccuuauacccaag

SEQ ID NO: 164190 - RNA, 64 nt, hsa
ugcuuacuacaugcaaggcacucugcuaguuauauucuaauaaugcagagauaauuagacaugg

SEQ ID NO: 164191 - RNA, 64 nt, hsa
guaauuacauuauuuaggucuuaauccaacuuuuuucuaauauaucuaaacaauugaaagggaa

SEQ ID NO: 164192 - RNA, 64 nt, hsa
uuauuugucuuaaaaaaugugaaaugcuuuuauauucuaauaguuuuucacuuuguguauuaaa

SEQ ID NO: 164193 - RNA, 64 nt, hsa
uccccuucucaucgaagggauuguguaucugugcuucuaauauuaguuggcuuucauaaaucau

SEQ ID NO: 164194 - RNA, 64 nt, hsa
uuuccaguuagaaggagguucuaauauucacauguucuaauacuuuguuuauuguaaaacagcu

SEQ ID NO: 164195 - RNA, 64 nt, hsa
gcuuacugaagaaaucuuuccaguuagaaggagguucuaauauucacauguucuaauacuuugu

SEQ ID NO: 164196 - RNA, 64 nt, hsa
uguauuuguggaggaaaguccucucuuuugcauauucuaauaaaugagccgcguuugcuccucc

SEQ ID NO: 164197 - RNA, 64 nt, hsa
ucuauuuuuuauuuuaauagguuuggugcuuaucuucuaauaagauuuaaaugucacaaacugu

SEQ ID NO: 164198 - RNA, 64 nt, hsa
uaauuuuaguguugauaccguauguguauuuuuauucuaauaaacuuuuguguuccagauugaa

SEQ ID NO: 164199 - RNA, 64 nt, hsa
cagauccuaaguagaaccagguaauugucucuuuuucuaauaaggaauuuggguaauuuuuaau

SEQ ID NO: 164200 - RNA, 64 nt, hsa
auuuauacuaaacauauggacauuuuaaauguguuucuaauauuuuugauuaucuauaaugugc

SEQ ID NO: 164201 - RNA, 64 nt, hsa
cacuagcagaagcaugcaugaagagaugaguguguucuaauaagucucugaaagccaguggcuu

SEQ ID NO: 164202 - RNA, 64 nt, hsa
uaaagaauaugacaaggucuucaaacacaaguuuuucuaauaacucauuagagaauuuauacug

SEQ ID NO: 164203 - RNA, 64 nt, hsa
cuccucccuaucugauucuaugaggccagcaucauucuaauaccaaaaccugacaggcacaaug

SEQ ID NO: 164204 - RNA, 64 nt, hsa
uuuucccuccucacagauaaaugaaaaguaaguauucuaauauaaaaguucuaauacaaaagag

SEQ ID NO: 164205 - RNA, 64 nt, hsa
agauaaaugaaaaguaaguauucuaauauaaaaguucuaauacaaaagaguagagaagguucuu

SEQ ID NO: 164206 - RNA, 64 nt, hsa
aaagaauggcuacuuuuuucuaugcuggaguauuuucuaauaauccugcuugacccuuaucuga

SEQ ID NO: 164207 - RNA, 64 nt, hsa
ugguuaucugagauaggagauacaaacuuuguaauucuaauaaugcacucaguuuacucucucc

SEQ ID NO: 164208 - RNA, 64 nt, hsa; identical to SEQ ID NO: 46532

SEQ ID NO: 164209 - RNA, 64 nt, hsa; identical to SEQ ID NO: 46533

SEQ ID NO: 164210 - RNA, 64 nt, hsa; identical to SEQ ID NO: 46534

SEQ ID NO: 164211 - RNA, 64 nt, hsa; identical to SEQ ID NO: 46535

SEQ ID NO: 164212 - RNA, 64 nt, hsa; identical to SEQ ID NO: 46536

SEQ ID NO: 164213 - RNA, 64 nt, hsa; identical to SEQ ID NO: 46537

SEQ ID NO: 164214 - RNA, 64 nt, hsa; identical to SEQ ID NO: 46538

SEQ ID NO: 164215 - RNA, 64 nt, hsa; identical to SEQ ID NO: 46539

SEQ ID NO: 164216 - RNA, 64 nt, hsa; identical to SEQ ID NO: 46540

SEQ ID NO: 164217 - RNA, 64 nt, hsa; identical to SEQ ID NO: 46541

SEQ ID NO: 164218 - RNA, 64 nt, hsa; identical to SEQ ID NO: 46542

SEQ ID NO: 164219 - RNA, 64 nt, hsa; identical to SEQ ID NO: 46543

SEQ ID NO: 164220 - RNA, 64 nt, hsa; identical to SEQ ID NO: 46544

SEQ ID NO: 164221 - RNA, 64 nt, hsa; identical to SEQ ID NO: 46545

SEQ ID NO: 164222 - RNA, 64 nt, hsa; identical to SEQ ID NO: 46546

SEQ ID NO: 164223 - RNA, 64 nt, hsa; identical to SEQ ID NO: 46547

SEQ ID NO: 164224 - RNA, 64 nt, hsa; identical to SEQ ID NO: 46548

SEQ ID NO: 164225 - RNA, 64 nt, hsa; identical to SEQ ID NO: 46549

SEQ ID NO: 164226 - RNA, 64 nt, hsa; identical to SEQ ID NO: 46550

SEQ ID NO: 164227 - RNA, 64 nt, hsa; identical to SEQ ID NO: 46551

SEQ ID NO: 164228 - RNA, 64 nt, hsa; identical to SEQ ID NO: 46552

SEQ ID NO: 164229 - RNA, 64 nt, hsa; identical to SEQ ID NO: 46553

SEQ ID NO: 164230 - RNA, 64 nt, hsa; identical to SEQ ID NO: 46554

SEQ ID NO: 164231 - RNA, 64 nt, hsa; identical to SEQ ID NO: 46555

SEQ ID NO: 164232 - RNA, 64 nt, hsa; identical to SEQ ID NO: 46556

SEQ ID NO: 164233 - RNA, 64 nt, hsa; identical to SEQ ID NO: 46557

SEQ ID NO: 164234 - RNA, 64 nt, hsa; identical to SEQ ID NO: 46558

SEQ ID NO: 164235 - RNA, 64 nt, hsa; identical to SEQ ID NO: 46559

SEQ ID NO: 164236 - RNA, 64 nt, hsa; identical to SEQ ID NO: 46560

SEQ ID NO: 164237 - RNA, 64 nt, hsa; identical to SEQ ID NO: 46561

SEQ ID NO: 164238 - RNA, 64 nt, hsa; identical to SEQ ID NO: 46562

SEQ ID NO: 164239 - RNA, 64 nt, hsa; identical to SEQ ID NO: 46563

SEQ ID NO: 164240 - RNA, 64 nt, hsa; identical to SEQ ID NO: 46564

SEQ ID NO: 164241 - RNA, 64 nt, hsa; identical to SEQ ID NO: 46565

SEQ ID NO: 164242 - RNA, 64 nt, hsa; identical to SEQ ID NO: 46566

SEQ ID NO: 164243 - RNA, 64 nt, hsa; identical to SEQ ID NO: 46567

SEQ ID NO: 164244 - RNA, 64 nt, hsa; identical to SEQ ID NO: 46568

SEQ ID NO: 164245 - RNA, 64 nt, hsa; identical to SEQ ID NO: 46569

SEQ ID NO: 164246 - RNA, 64 nt, hsa; identical to SEQ ID NO: 46570

SEQ ID NO: 164247 - RNA, 64 nt, hsa; identical to SEQ ID NO: 46571

SEQ ID NO: 164248 - RNA, 64 nt, hsa; identical to SEQ ID NO: 46572

SEQ ID NO: 164249 - RNA, 64 nt, hsa; identical to SEQ ID NO: 46573

SEQ ID NO: 164250 - RNA, 64 nt, hsa; identical to SEQ ID NO: 46574

SEQ ID NO: 164251 - RNA, 64 nt, hsa; identical to SEQ ID NO: 46575

SEQ ID NO: 164252 - RNA, 64 nt, hsa; identical to SEQ ID NO: 46576

SEQ ID NO: 164253 - RNA, 64 nt, hsa; identical to SEQ ID NO: 46577

SEQ ID NO: 164254 - RNA, 64 nt, hsa; identical to SEQ ID NO: 46578

SEQ ID NO: 164255 - RNA, 64 nt, hsa; identical to SEQ ID NO: 46579

SEQ ID NO: 164256 - RNA, 64 nt, hsa; identical to SEQ ID NO: 46580

SEQ ID NO: 164257 - RNA, 64 nt, hsa; identical to SEQ ID NO: 46581

SEQ ID NO: 164258 - RNA, 64 nt, hsa; identical to SEQ ID NO: 46582

SEQ ID NO: 164259 - RNA, 64 nt, hsa; identical to SEQ ID NO: 46583

SEQ ID NO: 164260 - RNA, 64 nt, hsa; identical to SEQ ID NO: 46584

SEQ ID NO: 164261 - RNA, 64 nt, hsa; identical to SEQ ID NO: 46585

SEQ ID NO: 164262 - RNA, 64 nt, hsa; identical to SEQ ID NO: 46586

SEQ ID NO: 164263 - RNA, 64 nt, hsa; identical to SEQ ID NO: 46587

SEQ ID NO: 164264 - RNA, 64 nt, hsa; identical to SEQ ID NO: 46588

SEQ ID NO: 164265 - RNA, 64 nt, hsa; identical to SEQ ID NO: 46589

SEQ ID NO: 164266 - RNA, 64 nt, hsa; identical to SEQ ID NO: 46590

SEQ ID NO: 164267 - RNA, 64 nt, hsa; identical to SEQ ID NO: 46591

SEQ ID NO: 164268 - RNA, 64 nt, hsa; identical to SEQ ID NO: 46592

SEQ ID NO: 164269 - RNA, 64 nt, hsa; identical to SEQ ID NO: 46593

SEQ ID NO: 164270 - RNA, 64 nt, hsa; identical to SEQ ID NO: 46594

SEQ ID NO: 164271 - RNA, 64 nt, hsa; identical to SEQ ID NO: 46595

SEQ ID NO: 164272 - RNA, 64 nt, hsa; identical to SEQ ID NO: 46596

SEQ ID NO: 164273 - RNA, 64 nt, hsa; identical to SEQ ID NO: 46597

SEQ ID NO: 164274 - RNA, 64 nt, hsa; identical to SEQ ID NO: 46598

SEQ ID NO: 164275 - RNA, 64 nt, hsa; identical to SEQ ID NO: 46599

SEQ ID NO: 164276 - RNA, 64 nt, hsa; identical to SEQ ID NO: 46600

SEQ ID NO: 164277 - RNA, 64 nt, hsa; identical to SEQ ID NO: 46601

SEQ ID NO: 164278 - RNA, 64 nt, hsa; identical to SEQ ID NO: 46602

SEQ ID NO: 164279 - RNA, 64 nt, hsa; identical to SEQ ID NO: 46603

SEQ ID NO: 164280 - RNA, 64 nt, hsa; identical to SEQ ID NO: 46604

SEQ ID NO: 164281 - RNA, 64 nt, hsa; identical to SEQ ID NO: 46605

SEQ ID NO: 164282 - RNA, 64 nt, hsa; identical to SEQ ID NO: 46606

SEQ ID NO: 164283 - RNA, 64 nt, hsa; identical to SEQ ID NO: 46607

SEQ ID NO: 164284 - RNA, 64 nt, hsa; identical to SEQ ID NO: 46608

SEQ ID NO: 164285 - RNA, 64 nt, hsa; identical to SEQ ID NO: 46609

SEQ ID NO: 164286 - RNA, 64 nt, hsa; identical to SEQ ID NO: 46610

SEQ ID NO: 164287 - RNA, 64 nt, hsa; identical to SEQ ID NO: 46611

SEQ ID NO: 164288 - RNA, 64 nt, hsa; identical to SEQ ID NO: 46612

SEQ ID NO: 164289 - RNA, 64 nt, hsa; identical to SEQ ID NO: 46613

SEQ ID NO: 164290 - RNA, 64 nt, hsa; identical to SEQ ID NO: 46614

SEQ ID NO: 164291 - RNA, 64 nt, hsa; identical to SEQ ID NO: 46615

SEQ ID NO: 164292 - RNA, 64 nt, hsa; identical to SEQ ID NO: 46616

SEQ ID NO: 164293 - RNA, 64 nt, hsa; identical to SEQ ID NO: 46617

SEQ ID NO: 164294 - RNA, 64 nt, hsa; identical to SEQ ID NO: 46618

SEQ ID NO: 164295 - RNA, 64 nt, hsa; identical to SEQ ID NO: 46619

SEQ ID NO: 164296 - RNA, 64 nt, hsa; identical to SEQ ID NO: 46620

SEQ ID NO: 164297 - RNA, 64 nt, hsa; identical to SEQ ID NO: 46621

SEQ ID NO: 164298 - RNA, 64 nt, hsa; identical to SEQ ID NO: 46622

SEQ ID NO: 164299 - RNA, 64 nt, hsa; identical to SEQ ID NO: 46623

SEQ ID NO: 164300 - RNA, 64 nt, hsa; identical to SEQ ID NO: 46624

SEQ ID NO: 164301 - RNA, 64 nt, hsa; identical to SEQ ID NO: 46625

SEQ ID NO: 164302 - RNA, 64 nt, hsa; identical to SEQ ID NO: 46626

SEQ ID NO: 164303 - RNA, 64 nt, hsa; identical to SEQ ID NO: 46626

SEQ ID NO: 164304 - RNA, 64 nt, hsa; identical to SEQ ID NO: 46628

SEQ ID NO: 164305 - RNA, 64 nt, hsa
acccuaacugaucaauguacuuuguaaucucccccacccuuaagaagguacuuuguaaucuucc

SEQ ID NO: 164306 - RNA, 64 nt, hsa
ccccacccuuaagaagguacuuuguaaucuuccccacccuuaagaagguucuuuguaauucucc

SEQ ID NO: 164307 - RNA, 64 nt, hsa
cagagauuucucauugacuuuuauaaagcauguucacccuuauagucuaagacuauauauauaa

SEQ ID NO: 164308 - RNA, 64 nt, hsa
gugucucauggauuuggcacuagccaaagcgaggcacccuuacuggcuuaccuccucauggcag

SEQ ID NO: 164309 - RNA, 64 nt, hsa
cagagaccaacucccugggcuucauacuggccuuccucuacaauggccuccucuccaucagugc

SEQ ID NO: 164310 - RNA, 64 nt, hsa
gucuuguucauguagccgaggggcaggcgggggaccucuacaccucugcugugggcacggggcu

SEQ ID NO: 164311 - RNA, 64 nt, hsa
gguggcccgucucaucugugaacuugacucugucccucuacaugucucuuuaauggggugaggg

SEQ ID NO: 164312 - RNA, 64 nt, hsa
uucagcugggggcucucaccagcccuccuuucagccucuacaacagagcagcuucccagacuuc

SEQ ID NO: 164313 - RNA, 64 nt, hsa
ucagaugcuggccccuuggucuugaauuuccuagccucuacaacuaagccaaauaaauuucugu

SEQ ID NO: 164314 - RNA, 64 nt, hsa
ggaauggcuuagaauaaguauacacuugaaaucuccucuacaugaucuuuguucuuuaacagug

SEQ ID NO: 164315 - RNA, 64 nt, hsa
cuggcuguaagggagacucagucccagccucuccccucuacaacuccugccacuguuggccaug

SEQ ID NO: 164316 - RNA, 64 nt, hsa
aaauggacuuccauaguauugacuguagaaggagccucuacaauauugacuauauauuuuuaua

SEQ ID NO: 164317 - RNA, 64 nt, hsa
cuggauggaauccgcgagcuggccaccuggccacccucuacacggcuccacccugccauggccg

SEQ ID NO: 164318 - RNA, 64 nt, hsa
uccaauuauauuuuuaacauuuaaaaaccaaaguccucuacacuugauuuauauuauauguggc

SEQ ID NO: 164319 - RNA, 64 nt, hsa
uugagaccagccugggcaacauggcaaaaacccaccucuacaaaaaguacaaaaauuagucggg

SEQ ID NO: 164320 - RNA, 64 nt, hsa
aagugacucucuaggcuucggacacaaauaggcuccucuacaccugaagacaaaggcaaaguca

SEQ ID NO: 164321 - RNA, 64 nt, hsa
ucacaagaacaacggcaagacagugccuauacugccucuacaguuaauaggaaaaacggaagaa

SEQ ID NO: 164322 - RNA, 64 nt, hsa
auuguacuuguggaugguugagcacaaaaaaccaccucuacauuucucuuaaagguagguuggc

SEQ ID NO: 164323 - RNA, 64 nt, hsa
cuguccuuccuugaaauugcugauuguucugcucccucuacagauauuuauaucaauuccuaca

SEQ ID NO: 164324 - RNA, 64 nt, hsa
aaaccaacuaauauuuauugaagaccuacuuuguccucuacauaggguagcuucugucagggaa

SEQ ID NO: 164325 - RNA, 64 nt, hsa
cagcuugcugacugcagaucuugagauaugucagccucuacagucacaagagcuaauucauucu

SEQ ID NO: 164326 - RNA, 64 nt, hsa
cacuucuuccuaaugacacgcgaccguccuggugccucuacaugguugaugcgggcaguguggg

SEQ ID NO: 164327 - RNA, 64 nt, hsa
uaaucuggugaauguuauuauuaggaguguucugccucuacaguggcauauuccaugacauuaa

SEQ ID NO: 164328 - RNA, 64 nt, hsa
uauuguuauuuaauaaauauuucaggauauuuuuccucuacaauaaaguaacaauuaacuuaug

SEQ ID NO: 164329 - RNA, 64 nt, hsa
aaaugugugccaagagggucuccuuuccugucuuccucuacagagaaugcugcucgguccuccu

SEQ ID NO: 164330 - RNA, 64 nt, hsa
agggaagggcuuucuugguaauuuagaugugaaaccucuacagagcuaucauguaaaaacuaca

SEQ ID NO: 164331 - RNA, 64 nt, hsa
ccgguggccuucaagguccuuuaugaguguuaccccucuacacguccacaccacucaccacaca

SEQ ID NO: 164332 - RNA, 64 nt, hsa
aagagggggcagaaaugaaugaccagguuaaaucccucuacaugugguuucuguuugaaaaaaa

SEQ ID NO: 164333 - RNA, 64 nt, hsa
cguaggaaacuugauuuuuuuguuuugaucauggccucuacaugcaccuuuccagaguggucuc

SEQ ID NO: 164334 - RNA, 64 nt, hsa
gcuacccggucacggaggccggccaccugcagagccucuacacagguagugccccgaggggcug

SEQ ID NO: 164335 - RNA, 64 nt, hsa
uggcgcuguuggggcugcucauguuggggcucuuccucuacagccucccuggcuacauggucaa

SEQ ID NO: 164336 - RNA, 64 nt, hsa
uggguggcacagcagugccccccugcagccuuccccucuacacaggacaugcacacacaaguaa

SEQ ID NO: 164337 - RNA, 64 nt, hsa
gaccuuucccuaugacuuggcaguaugugaauauccucuacacuuaguuauugauaaacuucuu

SEQ ID NO: 164338 - RNA, 64 nt, hsa
uguuugcaucauacaucuucucuuuccuuguuuuccucuacaauuggaggagaaacaaauauau

SEQ ID NO: 164339 - RNA, 64 nt, hsa
uuuuucagaaacuuuccaaacugcuuuacauagaccucuacaaguagggaauguuuucugaagc

SEQ ID NO: 164340 - RNA, 57 nt, hsa; identical to SEQ ID NO: 159488

SEQ ID NO: 164341 - RNA, 64 nt, hsa
ccugguuuuuguuugguuuucguuuugcuuuuagccucuacaugcuaggaucacaggaagacuu

SEQ ID NO: 164342 - RNA, 64 nt, hsa
ucuaguaguuauuuuuccuuuuucuuuuuguguaccucuacagagaccaaaacucauucucuua

SEQ ID NO: 164343 - RNA, 64 nt, hsa
guaauuuuuagaagcaagaagaaagccauuguguccucuacaauuaacaaaacuuaucucugau

SEQ ID NO: 164344 - RNA, 64 nt, hsa
ucuuucauuuacauaggguguaaccaucaagaaaccucuacaggguacuuaagccccagaagau

SEQ ID NO: 164345 - RNA, 64 nt, hsa
aaaagauaugaagaacuauuauauugaggccuguccucuacauaccacacuuaaaagaugguga

SEQ ID NO: 164346 - RNA, 64 nt, hsa
ugaauagaauacauuauaccucauaggugucuagccucuacaguucuggcuguaguuaugaccu

SEQ ID NO: 164347 - RNA, 64 nt, hsa
cuuggaaauuccuccaaaguuugccuucaucucuccucuacaguuuggaggugauggugcagca

SEQ ID NO: 164348 - RNA, 64 nt, hsa
uugaaccuaauacccugcccuugacaucuggaaaccucuacauauuuauauaacgugauacauu

SEQ ID NO: 164349 - RNA, 64 nt, hsa
ucccaccuccuggugguaccauuauuauagaagcccucuacagccugacuuucucuccagcggu

SEQ ID NO: 164350 - RNA, 64 nt, hsa
aguaugcgauguaauuaaagaaauuauuggauaaccucuacaaauaaagauaggggaacucuga

SEQ ID NO: 164351 - RNA, 64 nt, hsa
guuuuaaaugucuuuauugacuuuaaauucauugccucuacauuauucauuaguucuucuuuuc

SEQ ID NO: 164352 - RNA, 64 nt, hsa
gaacccaguugaauaggauccaaucccugguuagccucuacacaauaauagggagacaaggauu

SEQ ID NO: 164353 - RNA, 64 nt, hsa
cauuugggcuaucagagguaccccugggcaggagccucuacauccccuucccccuccucucucc

SEQ ID NO: 164354 - RNA, 64 nt, hsa
ugacugaauagugugguucagugagcugcacugaccucuacauuuuguaugauauguaaaacag

SEQ ID NO: 164355 - RNA, 64 nt, hsa
agccugggccucggcgucaaucaucgauaagaagccucuacagcaccccugcccccuaauuuau

SEQ ID NO: 164356 - RNA, 64 nt, hsa
guugguuccugagaggucugagggccagagcugcccucuacauuaacaugcugucucuaagggu

SEQ ID NO: 164357 - RNA, 64 nt, hsa
agguguaauuacagaauuuacgaaauguaaauggccucuacagaguuuuauggaauaccuggua

SEQ ID NO: 164358 - RNA, 55 nt, hsa; identical to SEQ ID NO: 159506

SEQ ID NO: 164359 - RNA, 64 nt, hsa
uuaauucuuuuuagaacugaagcauccuaggaugccucuacauguauuucauuccccucaucuu

SEQ ID NO: 164360 - RNA, 64 nt, hsa
gacauaggcuccaucuauuuuguggcucugccacccucuacagccuucaugccccaugcauuag

SEQ ID NO: 164361 - RNA, 64 nt, hsa
auaagucaaguuucacuggcucuauaacagucuaccucuacacuaagagaacuauaacaugaac

SEQ ID NO: 164362 - RNA, 64 nt, hsa
uuaggagacuucaucuaaagcaugaaaccuagcuccucuacacacaaauuccuauggaaauacc

SEQ ID NO: 164363 - RNA, 64 nt, hsa
ccuaaguggucucuguucuacacuuuaaugucacccucuacaucaucuuaccuagcccacccaa

SEQ ID NO: 164364 - RNA, 64 nt, hsa
ggaugaaggacgugucucaggagcuugauccagaccucuacaagcaaauggagaaguucaggaa

SEQ ID NO: 164365 - RNA, 64 nt, hsa
gcuugguagcucugggauuugccuuccuucauguccucuacacacuugugauuccuauucgaua

SEQ ID NO: 164366 - RNA, 64 nt, hsa
aagccuuccagcuguuccugcuuccacucuugcuccucuacaauucauucugcacgcagaaguc

SEQ ID NO: 164367 - RNA, 64 nt, hsa
auaccucauuuaaucuguaaagguuugucguaauccucuacaaagcuacucccuguuauugugu

SEQ ID NO: 164368 - RNA, 64 nt, hsa
agggcggcuggcuggaaagccacgcguaugcugcccucuacaggcugcucggccucccugcagc

SEQ ID NO: 164369 - RNA, 64 nt, hsa
aguuguaaaagcugaugaaccugaaauuguguagccucuacaggcugcugagguucuaaauaaa

SEQ ID NO: 164370 - RNA, 64 nt, hsa
ugcacagaaaaacacgcauugaaugugugucgaaccucuacauugugaaguugcacuauguacc

SEQ ID NO: 164371 - RNA, 64 nt, hsa
uugauagaaauugagauucuugcugucuuuugugccucuacaagcuacuacucauuccagaauu

SEQ ID NO: 164372 - RNA, 64 nt, hsa
acugugccuucuuuucuuucuuucuuuuuuuuaaccucuacagacacaauccucaaaccaacaa

SEQ ID NO: 164373 - RNA, 64 nt, hsa
guaaacagaagcaacagaagggacaagaggcuggccucuacaucacucucaccuuccaaaucuu

SEQ ID NO: 164374 - RNA, 64 nt, hsa
auuucaggaaccaaggacugccagaaaauauuagccucuacauuacgcaugcauuuagaagcuu

SEQ ID NO: 164375 - RNA, 64 nt, hsa
auggacaggaugacagacagggacgaagcagagaccucuacagacccaagucaccaaguggagc

SEQ ID NO: 164376 - RNA, 64 nt, hsa
cugcccucuucuuaccccaauuuucuuguauuacccucuacaauauacuuuuuauugagcacuu

SEQ ID NO: 164377 - RNA, 64 nt, hsa
gacagcauugaucuccuggaggcugguucugcugccucuacacaggggcccuguacagugaaug

SEQ ID NO: 164378 - RNA, 64 nt, hsa
uggaugcccugcccuguauccacuugggagagagccucuacaacaugcuggcaacuucccccuc

SEQ ID NO: 164379 - RNA, 64 nt, hsa
aguuggaccuccauggagccacuaggccuggccuccucuacacauccccagggcuaucugguua

SEQ ID NO: 164380 - RNA, 64 nt, hsa
guucuguuugucaguucauuccuguguguucuuaccucuacaaaguaaauuacacauuuaguuu

SEQ ID NO: 164381 - RNA, 64 nt, hsa
auuguuugaaugauuccggcuuguaauauaucagccucuacaaugaaaugcagaagaguucauu

SEQ ID NO: 164382 - RNA, 64 nt, hsa
uuuccagcuggaugagaauuugagugcucugaucccucuacagagcuucccugacucauucuga

SEQ ID NO: 164383 - RNA, 55 nt, hsa; identical to SEQ ID NO: 159531

SEQ ID NO: 164384 - RNA, 64 nt, hsa
auauuuaagacuuuaagacuuaaaaggcuuacugccucuacauuucacucagacuaguacaucu

SEQ ID NO: 164385 - RNA, 64 nt, hsa
auuugcccccccaguggcccugggcugggccuggccucuacagagccuuuuagggggagggggu

SEQ ID NO: 164386 - RNA, 64 nt, hsa
ugugauuccaaugcaggugucuucauuaccauuaccucuacacugcagaagaagcaaaacuccu

SEQ ID NO: 164387 - RNA, 64 nt, hsa
cuuggaagcaggcucccaauagggagggggcugcccucuacagucucuuugacuguaagacagg

SEQ ID NO: 164388 - RNA, 64 nt, hsa
uucaggguucuaaccuuucuaacccacuaaguaaccucuacaggcauuuaacugccuuacagac

SEQ ID NO: 164389 - RNA, 64 nt, hsa
ggguccauggucuauuuauucucgcccagcucacccucuacacagacacuguccugggugcaca

SEQ ID NO: 164390 - RNA, 64 nt, hsa
acucccucucugcucuccugucccuugagcccuuccucuacagguggggcagagaggguggugg

SEQ ID NO: 164391 - RNA, 64 nt, hsa
aagauggcaguguucuccucuggggccugauccaccucuacaccagcccaggaagccccaucug

SEQ ID NO: 164392 - RNA, 64 nt, hsa
ccucacuuuaauaccucuuaggaaccaaagaaugccucuacaagcaaaaagauaguugaaaaua

SEQ ID NO: 164393 - RNA, 64 nt, hsa
ugauaaccaaguagccauuuuccucuuaagguuuccucuacaaccccaaggacuuucaugauua

SEQ ID NO: 164394 - RNA, 64 nt, hsa
ugccgcucugcgugugcgugugcgcgugugugagccucuacacauauauauacguacagagccu

SEQ ID NO: 164395 - RNA, 64 nt, hsa
acuuggaguuagaucuagguccuucuaucucgucccucuacagauguauuuuccacuugcauaa

SEQ ID NO: 164396 - RNA, 64 nt, hsa
aauaaauaauuauaaauugagcacugauggaaucccucuacaggucaagaaauagcgcaguguc

SEQ ID NO: 164397 - RNA, 64 nt, hsa
aagcugaaaaggggauccuugaaaacacugaaaaccucuacaacaaucuucaggaagccugcua

SEQ ID NO: 164398 - RNA, 64 nt, hsa
guguucgagcacagaacggauauaaucagucuggccucuacaacaaguuuugcauuguagaauu

SEQ ID NO: 164399 - RNA, 64 nt, hsa
cuccuaagcaguccuggcuuuuccucaucacuccccucuacagugccugguagacaagugcuac

SEQ ID NO: 164400 - RNA, 64 nt, hsa
uuaauuuucuuuuuuggcccuaggcugguugggaccucuacagcuucauucuuucaccauuaaa

SEQ ID NO: 164401 - RNA, 64 nt, hsa
agcagauccccagccucuggccuccuguucgccuccucuacaauuugccauuguuucuccuggg

SEQ ID NO: 164402 - RNA, 64 nt, hsa
auggaccagugggaaggauaggauuagcacugcaccucuacauccaucaagagagacagagcgc

SEQ ID NO: 164403 - RNA, 51 nt, hsa; identical to SEQ ID NO: 159551

SEQ ID NO: 164404 - RNA, 64 nt, hsa
agagcaaagugaccugguuaaacaaaccagaaucccucuacauggacucagagaaaagagauug

SEQ ID NO: 164405 - RNA, 64 nt, hsa
caugccccggcaccucugcccugugucuuucauaccucuacaugucugcuugagauauuuccuc

SEQ ID NO: 164406 - RNA, 64 nt, hsa
ccuaagggauuccugggugccacugcucucuuuuccucuacagcuccaucuuguuucacccacc

SEQ ID NO: 164407 - RNA, 64 nt, hsa
ccuuuacuaacauucauguuauggcaagaguuguccucuacauuggaaagcuaauccuaccuug

SEQ ID NO: 164408 - RNA, 64 nt, hsa
caguugggaggggcaccguccggaggagaccaggccucuacacaccccccacucuacuuaucau

SEQ ID NO: 164409 - RNA, 64 nt, hsa
ggcuugcccuuguccgugugcccccaggacuuugccucuacagcauuuucuuacacccccuccc

SEQ ID NO: 164410 - RNA, 64 nt, hsa
aacugcagaccaacuaccccuccucagacaacagccucuacaccaacgccaagggcagcaccau

SEQ ID NO: 164411 - RNA, 64 nt, hsa
ucgccacaacauggcucuuugugagccuguggcuccucuacauacucuuugccacacuagaggc

SEQ ID NO: 164412 - RNA, 64 nt, hsa
gauuaagggcaaaucuauuacuuuugcaaacuguccucuacaucaauuaacaucgugggucacu

SEQ ID NO: 164413 - RNA, 64 nt, hsa
ggguugcugaugagagaaccugaaaaaaccuacaccucuacagcaggucgaauucaugaccuga

SEQ ID NO: 164414 - RNA, 64 nt, hsa
agaacauccuguuugugaauucugaguuugaaacccucuacaaugagcacaagguauugguggg

SEQ ID NO: 164415 - RNA, 64 nt, hsa
auuauuucuguaguuggaaucuguaccuucugaaccucuacaccaauaacugcugcagguguga

SEQ ID NO: 164416 - RNA, 64 nt, hsa
uacaccaaagaggaagaagagcuguggaggccacccucuacaaagcuuuauagaacuucuggau

SEQ ID NO: 164417 - RNA, 64 nt, hsa
ugucucggcuguaggaaucaacagaaggagacguccucuacauaaaagcuccaugugaaaagcu

SEQ ID NO: 164418 - RNA, 64 nt, hsa
ccguccuggaggaggugaugcuggucccuggccaccucuacagcccugaacucuugagacaacu

SEQ ID NO: 164419 - RNA, 64 nt, hsa
uucugaggcugagaggacaccuauaugcguauuuccucuacacacaucaccccccuucuauaau

SEQ ID NO: 164420 - RNA, 64 nt, hsa
uuauggcacucuccgaauccuccugaaggcauuuccucuacagacauaguguuacaggaaguga

SEQ ID NO: 164421 - RNA, 64 nt, hsa
uacuuuaaauugcaaagucuuccgggccuauuuuccucuacauuuuuguaauuaacucuggggg

SEQ ID NO: 164422 - RNA, 64 nt, hsa
ggcagcagggcuccauucucuggccuggcccaggccucuacauacuuacuccagccauuugggg

SEQ ID NO: 164423 - RNA, 64 nt, hsa
guggagaacauugcauaggaaugucuggaaaaagccucuacaacuuguuacagccuucacauuu

SEQ ID NO: 164424 - RNA, 64 nt, hsa
agagcaugcucacccagcucugcuccaaggccuuccucuacaccuucugccaccaccugcaccu

SEQ ID NO: 164425 - RNA, 64 nt, hsa
ccuucccucccgauuucccgauucccccacccucccucuacacuugaggaccacaguugggggu

SEQ ID NO: 164426 - RNA, 64 nt, hsa
ugcugcaaggggaaucgucagaguccaaugugugccucuacaguaaugucggaaauaaauacca

SEQ ID NO: 164427 - RNA, 64 nt, hsa
agaagagugaaagaacuccugccaagagcccagaccucuacaaacguuguauguccuuuuuuaa

SEQ ID NO: 164428 - RNA, 64 nt, hsa
ggcaaaagagguaagcagaucacaccucuuucugccucuacauauggccuauucugggcuagac

SEQ ID NO: 164429 - RNA, 64 nt, hsa
ggcacugcaggccaggccaggaugcccaccccgcccucuacacggccccuuggggccugcgccc

SEQ ID NO: 164430 - RNA, 64 nt, hsa
agcaggagccugagccuugggaacaugcgugugaccucuacagcuaccucuucuauggacuggu

SEQ ID NO: 164431 - RNA, 64 nt, hsa
cuugcccacccccgauccccgugcgcuccucaccccucuacagacaggggcgcugcugcagaug

SEQ ID NO: 164432 - RNA, 64 nt, hsa
agaaaaaugcuaagucccagcuauggauuucaggccucuacacuucugcuuacuggugugggca

SEQ ID NO: 164433 - RNA, 64 nt, hsa
gcaggaggcguucggaggaggaguuccgccccacccucuacagccuuccucaggccccugucuc

SEQ ID NO: 164434 - RNA, 64 nt, hsa
aagggagagccauacugcacggacguagcguuucccucuacaagcacuaggagcaccuuucuca

SEQ ID NO: 164435 - RNA, 64 nt, hsa
uuuucugagaaagguuuggaugacugaaauauuuccucuacagucaaggacuuuggcauguggu

SEQ ID NO: 164436 - RNA, 64 nt, hsa
gacauauuuucuucauagucccuaauauagucauccucuacagaguuggcgugcugugugcacu

SEQ ID NO: 164437 - RNA, 64 nt, hsa
uuuaauugacacagaauacauuucacauauuuaaccucuacaauaaguucugacacauuuucca

SEQ ID NO: 164438 - RNA, 64 nt, hsa
agcugucuaggacucacgggguucggaagccacaccucuacaugucuaaaacaaaaaacaacaa

SEQ ID NO: 164439 - RNA, 64 nt, hsa
gccaacucuucaugccccugccguuguaguggaaccucuacauguuuuaguuugcuucaccuaa

SEQ ID NO: 164440 - RNA, 64 nt, hsa
cugcauggcauccuccagccccuguagaacucaaccucuacaggguuagaguuuggagagagca

SEQ ID NO: 164441 - RNA, 64 nt, hsa
aagggucgggggaggggggagccuuguagggaggccucuacacagaagaaagcagcccccaugu

SEQ ID NO: 164442 - RNA, 64 nt, hsa
acaagagcaucaggcucagcuagaagauccacauccucuacaggucggggaccaaaggcugauu

SEQ ID NO: 164443 - RNA, 64 nt, hsa
cccaagcguuccuggccuucugaacuccauacagccucuacagccgucccgcguucaagacuug

SEQ ID NO: 164444 - RNA, 64 nt, hsa
cugauucugagauggcuuuugcugcucuguucucccucuacauuucucugcagaacucgcguua

SEQ ID NO: 164445 - RNA, 64 nt, hsa
ggcugcccccacccgaaagacccuccacgcucguccucuacagaguccggcuucgggaagugcc

SEQ ID NO: 164446 - RNA, 64 nt, hsa
aaagaaaagaaaaaaaaaaaaaagaaacaaaccaccucuacauauuauggaaagaaaauauuuu

SEQ ID NO: 164447 - RNA, 64 nt, hsa
cccuaguccuggccagaaggaugaucucgcuuuuccucuacaggccuauaagaagcagguacuu

SEQ ID NO: 164448 - RNA, 64 nt, hsa
ccacuuaagaccccuccucuacuuccuucugaguccucuacaaagacauccggguacuacauuu

SEQ ID NO: 164449 - RNA, 64 nt, hsa
cacgcccaguggaugauccuacugcucccagcaaccucuacauccaggaaugagucccuagggg

SEQ ID NO: 164450 - RNA, 64 nt, hsa
guuugagaccacccugggcaacauagcgagacuaccucuacaaaaaaaaaaaaaaauaauaaua

SEQ ID NO: 164451 - RNA, 64 nt, hsa
acccacgcgcaccaccucuccggucgcguggcugccucuacagccuaccuauacgucccuuuuu

SEQ ID NO: 164452 - RNA, 64 nt, hsa
cagauaccccuucuccucacagucagaacagcagccucuacacauguuguccugccccuggcaa

SEQ ID NO: 164453 - RNA, 64 nt, hsa
ggggaguggaaauucagccugcuuagaggacugaccucuacaguucauauuugcagugacauaa

SEQ ID NO: 164454 - RNA, 64 nt, hsa
acguggcuauaacaucuauaacaaaacgacgauuccucuacaagaggcuguuucucacugcuaa

SEQ ID NO: 164455 - RNA, 64 nt, hsa
agcuagauuguaagcuccuggaggacagggaccaccucuacaaaaaauaaaaaaaguaccuccc

SEQ ID NO: 164456 - RNA, 64 nt, hsa
uucacucacaaaccucuuaucucuucuucuccuuccucuacauuuuaaagggggagagggaaaa

SEQ ID NO: 164457 - RNA, 64 nt, hsa
uaagcuaucucugggaugccucuaggcccccuucccucuacacaccucugggaaaagauuacac

SEQ ID NO: 164458 - RNA, 64 nt, hsa
gauguggcuacaaagugaggagaagcuagccagcccucuacaagcugucuucuugcacacgcug

SEQ ID NO: 164459 - RNA, 64 nt, hsa
cuuuuggauucuuauggacugugaguuagucuucccucuacacggagucacaggaaggguauaa

SEQ ID NO: 164460 - RNA, 64 nt, hsa
cuuccaagcuagcugcugccuccuuacuccuggcccucuacaugaagaagcucggauacugggu

SEQ ID NO: 164461 - RNA, 64 nt, hsa
ucgagaccagccuggccaacauggugaaaccccaccucuacaaaaaauacaaaaauuagccggg

SEQ ID NO: 164462 - RNA, 64 nt, hsa
auacuguaaacaucuuugcaugucaauaaauaugccucuacaacauauuuuugaaucacuuaau

SEQ ID NO: 164463 - RNA, 64 nt, hsa
aaaugccaccuaggaggauccaaagucugaaucuccucuacaauguuuccuuucucccaaaaca

SEQ ID NO: 164464 - RNA, 64 nt, hsa
auguucauuguuccugguuuuuuccagccagcagccucuacacuccaucauaggacaucgaguc

SEQ ID NO: 164465 - RNA, 64 nt, hsa
cuaucgccuuuuaugaugcuuugaacuccauccaccucuacaccuucgacgucgcauuugcgca

SEQ ID NO: 164466 - RNA, 64 nt, hsa
auaaccuuguggaaagacauguucauaugucacuccucuacacuaacugagauguguuaaauaa

SEQ ID NO: 164467 - RNA, 64 nt, hsa
cagguuaggaaaggauucagcacuacagcauaccccucuacaacauacagcccugucacauuga

SEQ ID NO: 164468 - RNA, 64 nt, hsa
cuuucaaacacauauuaguccuaccaccuuaguuccucuacagcaaaagaggcuuuucuucuua

SEQ ID NO: 164469 - RNA, 64 nt, hsa; identical to SEQ ID NO: 144190

SEQ ID NO: 164470 - RNA, 64 nt, hsa; identical to SEQ ID NO: 144191

SEQ ID NO: 164471 - RNA, 64 nt, hsa; identical to SEQ ID NO: 144192

SEQ ID NO: 164472 - RNA, 64 nt, hsa; identical to SEQ ID NO: 144193

SEQ ID NO: 164473 - RNA, 64 nt, hsa; identical to SEQ ID NO: 144194

SEQ ID NO: 164474 - RNA, 64 nt, hsa; identical to SEQ ID NO: 144195

SEQ ID NO: 164475 - RNA, 64 nt, hsa; identical to SEQ ID NO: 144196

SEQ ID NO: 164476 - RNA, 64 nt, hsa; identical to SEQ ID NO: 144197

SEQ ID NO: 164477 - RNA, 64 nt, hsa; identical to SEQ ID NO: 144198

SEQ ID NO: 164478 - RNA, 64 nt, hsa; identical to SEQ ID NO: 144199

SEQ ID NO: 164479 - RNA, 64 nt, hsa; identical to SEQ ID NO: 144200

SEQ ID NO: 164480 - RNA, 64 nt, hsa; identical to SEQ ID NO: 144201

SEQ ID NO: 164481 - RNA, 64 nt, hsa; identical to SEQ ID NO: 144202

SEQ ID NO: 164482 - RNA, 64 nt, hsa; identical to SEQ ID NO: 144203

SEQ ID NO: 164483 - RNA, 64 nt, hsa; identical to SEQ ID NO: 144204

SEQ ID NO: 164484 - RNA, 64 nt, hsa; identical to SEQ ID NO: 144205

SEQ ID NO: 164485 - RNA, 64 nt, hsa; identical to SEQ ID NO: 144206

SEQ ID NO: 164486 - RNA, 64 nt, hsa; identical to SEQ ID NO: 144207

SEQ ID NO: 164487 - RNA, 64 nt, hsa; identical to SEQ ID NO: 144208

SEQ ID NO: 164488 - RNA, 64 nt, hsa; identical to SEQ ID NO: 144209

SEQ ID NO: 164489 - RNA, 64 nt, hsa; identical to SEQ ID NO: 144210

SEQ ID NO: 164490 - RNA, 64 nt, hsa; identical to SEQ ID NO: 144211

SEQ ID NO: 164491 - RNA, 64 nt, hsa; identical to SEQ ID NO: 144212

SEQ ID NO: 164492 - RNA, 64 nt, hsa; identical to SEQ ID NO: 144213

SEQ ID NO: 164493 - RNA, 64 nt, hsa; identical to SEQ ID NO: 144214

SEQ ID NO: 164494 - RNA, 64 nt, hsa; identical to SEQ ID NO: 144215

SEQ ID NO: 164495 - RNA, 64 nt, hsa; identical to SEQ ID NO: 144216

SEQ ID NO: 164496 - RNA, 64 nt, hsa; identical to SEQ ID NO: 144217

SEQ ID NO: 164497 - RNA, 64 nt, hsa; identical to SEQ ID NO: 144218

SEQ ID NO: 164498 - RNA, 64 nt, hsa; identical to SEQ ID NO: 144219

SEQ ID NO: 164499 - RNA, 64 nt, hsa; identical to SEQ ID NO: 144220

SEQ ID NO: 164500 - RNA, 64 nt, hsa; identical to SEQ ID NO: 144221

SEQ ID NO: 164501 - RNA, 64 nt, hsa; identical to SEQ ID NO: 144222

SEQ ID NO: 164502 - RNA, 64 nt, hsa; identical to SEQ ID NO: 144223

SEQ ID NO: 164503 - RNA, 64 nt, hsa; identical to SEQ ID NO: 144224

SEQ ID NO: 164504 - RNA, 64 nt, hsa; identical to SEQ ID NO: 144225

SEQ ID NO: 164505 - RNA, 64 nt, hsa; identical to SEQ ID NO: 144226

SEQ ID NO: 164506 - RNA, 64 nt, hsa; identical to SEQ ID NO: 144227

SEQ ID NO: 164507 - RNA, 64 nt, hsa; identical to SEQ ID NO: 144228

SEQ ID NO: 164508 - RNA, 64 nt, hsa; identical to SEQ ID NO: 144229

SEQ ID NO: 164509 - RNA, 64 nt, hsa; identical to SEQ ID NO: 144230

SEQ ID NO: 164510 - RNA, 64 nt, hsa; identical to SEQ ID NO: 144231

SEQ ID NO: 164511 - RNA, 64 nt, hsa; identical to SEQ ID NO: 144232

SEQ ID NO: 164512 - RNA, 64 nt, hsa; identical to SEQ ID NO: 144233

SEQ ID NO: 164513 - RNA, 64 nt, hsa; identical to SEQ ID NO: 144234

SEQ ID NO: 164514 - RNA, 64 nt, hsa; identical to SEQ ID NO: 144235

SEQ ID NO: 164515 - RNA, 64 nt, hsa; identical to SEQ ID NO: 144236

SEQ ID NO: 164516 - RNA, 64 nt, hsa; identical to SEQ ID NO: 144237

SEQ ID NO: 164517 - RNA, 64 nt, hsa; identical to SEQ ID NO: 144238

SEQ ID NO: 164518 - RNA, 64 nt, hsa; identical to SEQ ID NO: 144239

SEQ ID NO: 164519 - RNA, 64 nt, hsa; identical to SEQ ID NO: 144240

SEQ ID NO: 164520 - RNA, 64 nt, hsa; identical to SEQ ID NO: 144241

SEQ ID NO: 164521 - RNA, 64 nt, hsa; identical to SEQ ID NO: 144242

SEQ ID NO: 164522 - RNA, 64 nt, hsa; identical to SEQ ID NO: 144243

SEQ ID NO: 164523 - RNA, 64 nt, hsa; identical to SEQ ID NO: 144244

SEQ ID NO: 164524 - RNA, 64 nt, hsa; identical to SEQ ID NO: 144245

SEQ ID NO: 164525 - RNA, 64 nt, hsa; identical to SEQ ID NO: 144246

SEQ ID NO: 164526 - RNA, 64 nt, hsa; identical to SEQ ID NO: 144247

SEQ ID NO: 164527 - RNA, 64 nt, hsa; identical to SEQ ID NO: 144248

SEQ ID NO: 164528 - RNA, 64 nt, hsa; identical to SEQ ID NO: 144249

SEQ ID NO: 164529 - RNA, 64 nt, hsa; identical to SEQ ID NO: 144250

SEQ ID NO: 164530 - RNA, 64 nt, hsa; identical to SEQ ID NO: 144251

SEQ ID NO: 164531 - RNA, 64 nt, hsa; identical to SEQ ID NO: 144252

SEQ ID NO: 164532 - RNA, 64 nt, hsa; identical to SEQ ID NO: 144253

SEQ ID NO: 164533 - RNA, 64 nt, hsa; identical to SEQ ID NO: 144254

SEQ ID NO: 164534 - RNA, 64 nt, hsa; identical to SEQ ID NO: 144255

SEQ ID NO: 164535 - RNA, 64 nt, hsa
acuucaguguggaauuuccucuuugaggagccugggcuuggaucuauccugaucuggugaugaa

SEQ ID NO: 164536 - RNA, 64 nt, hsa
gugaugaagccaugauuacuuuagaccuagcccaggcuuggaggccagcuggaggaagaagggu

SEQ ID NO: 164537 - RNA, 64 nt, hsa
cccgaagagcucccaccuucucuggaugugccugggcuuggacuggcuagaaucuuucucugga

SEQ ID NO: 164538 - RNA, 64 nt, hsa
accccagaguggaaaggugaacaccugcagcugaggcuuggaaacguuucuuguguugcccuga

SEQ ID NO: 164539 - RNA, 64 nt, hsa
cucucucuucuagagaagagguuuucaauaacagggcuuggaaaugaacuagaauaggaaauag

SEQ ID NO: 164540 - RNA, 64 nt, hsa
ggaguacccauuccugccguugcuuccuauccugggcuuggaagaauccugguagaaaggccag

SEQ ID NO: 164541 - RNA, 64 nt, hsa
gauaccuacacaccaugaugccccaccccugccaggcuuggaucggaggagugaaccugggcua

SEQ ID NO: 164542 - RNA, 64 nt, hsa
cuccaagucccccccauguuggaaagaggaacagggcuuggauugauguuuauacccucugaau

SEQ ID NO: 164543 - RNA, 64 nt, hsa
cagagaggcuuggaauugggccuggcccccauggggcuuggaggaccgagccacugacagguau

SEQ ID NO: 164544 - RNA, 64 nt, hsa
ggaggacuaagaaagcuaccacccuaaccagagaggcuuggaauugggccuggcccccaugggg

SEQ ID NO: 164545 - RNA, 64 nt, hsa
gggucauguuuuugcuguggugacacaugguacaggcuuggagcuugcaggucccuuucuacug

SEQ ID NO: 164546 - RNA, 64 nt, hsa
gggcuuggguccaguggaggaagaaggaaggagaggcuuggaaagccuugugucuugggaacaa

SEQ ID NO: 164547 - RNA, 64 nt, hsa
gccagccccaccuugaaagcagcauacaggggaaggcuuggaccaagcugggcgaccaagcaca

SEQ ID NO: 164548 - RNA, 64 nt, hsa
aaacugauggccaaccuagagcagcaaggagcagggcuuggagcucgggugguggagaugacaa

SEQ ID NO: 164549 - RNA, 64 nt, hsa
gcuuuugacuaucuuaugcaugguuuauuccucuggcuuggaugacaacaauacccauagucaa

SEQ ID NO: 164550 - RNA, 64 nt, hsa
aggcuuggcaaguuuugucuaaaaacaucuuuuuggcuuggaaagggaucugggaagccaggua

SEQ ID NO: 164551 - RNA, 64 nt, hsa
gcugcugcuugaggaagcagaacacacagcuggaggcuuggaacaugugggucccuaugagugu

SEQ ID NO: 164552 - RNA, 64 nt, hsa
uguuuaaggauuuagggugggagaguuucuuagaggcuuggacugcuucuguguuuuuuuuguu

SEQ ID NO: 164553 - RNA, 64 nt, hsa
ccucuaggcacaggcgggcccagaccggcuucucggcuuggauccugggcuggguggccccugu

SEQ ID NO: 164554 - RNA, 64 nt, hsa
gcccaaggccacggagcaguucagaguggaggcgggcuuggaacccggugcucccucugucauc

SEQ ID NO: 164555 - RNA, 64 nt, hsa
aaggcguuugugggguggaguugagugugcucugggcuuggacacuugccguggugccccuggc

SEQ ID NO: 164556 - RNA, 64 nt, hsa
ccagcagacguggugugagagggacagcucacgaggcuuggaccugcuguggagggugcccagc

SEQ ID NO: 164557 - RNA, 64 nt, hsa
ugcccggcagacgugugagagggacgguucacaaggcuuggaccugccauggagggugcccagc

SEQ ID NO: 164558 - RNA, 64 nt, hsa
ccagcagacgugguaugagagggauggcucacgaggcuuggaccugguggagggugcccggcag

SEQ ID NO: 164559 - RNA, 64 nt, hsa
ccggcagauguggugggagagagauggcucaugaggcuuggaccugccguggagggugcccagc

SEQ ID NO: 164560 - RNA, 64 nt, hsa
ccagcagacguggugugagagggacggcucacagggcuuggaccugccauggagggugcccggc

SEQ ID NO: 164561 - RNA, 64 nt, hsa
ccggcagacguggcgugagagggacggcucacgaggcuuggaccugcuguggagggugcccagc

SEQ ID NO: 164562 - RNA, 64 nt, hsa
cccacuugaagcccccucuuacaacuguuuugggggcuuggagcagaagacacccuuguagaca

SEQ ID NO: 164563 - RNA, 64 nt, hsa
gccaggguguucuucugcacccuggggugaggacggcuuggagggagaccagcaguuaacggug

SEQ ID NO: 164564 - RNA, 64 nt, hsa
cuuggauugguaccagagccuauggaaaggguguggcuuggaacauuugggagacugagcuuga

SEQ ID NO: 164565 - RNA, 64 nt, hsa
aaggagaggagugcgcuagagcauucugggguggggcuuggaagggcgcugagggcaggguucu

SEQ ID NO: 164566 - RNA, 64 nt, hsa; identical to SEQ ID NO: 60311

SEQ ID NO: 164567 - RNA, 64 nt, hsa; identical to SEQ ID NO: 60312

SEQ ID NO: 164568 - RNA, 64 nt, hsa; identical to SEQ ID NO: 60313

SEQ ID NO: 164569 - RNA, 64 nt, hsa; identical to SEQ ID NO: 60314

SEQ ID NO: 164570 - RNA, 64 nt, hsa; identical to SEQ ID NO: 60315

SEQ ID NO: 164571 - RNA, 64 nt, hsa; identical to SEQ ID NO: 60316

SEQ ID NO: 164572 - RNA, 64 nt, hsa; identical to SEQ ID NO: 60317

SEQ ID NO: 164573 - RNA, 64 nt, hsa; identical to SEQ ID NO: 60318

SEQ ID NO: 164574 - RNA, 64 nt, hsa; identical to SEQ ID NO: 60319

SEQ ID NO: 164575 - RNA, 64 nt, hsa; identical to SEQ ID NO: 60320

SEQ ID NO: 164576 - RNA, 64 nt, hsa; identical to SEQ ID NO: 60321

SEQ ID NO: 164577 - RNA, 64 nt, hsa; identical to SEQ ID NO: 60322

SEQ ID NO: 164578 - RNA, 64 nt, hsa; identical to SEQ ID NO: 60323

SEQ ID NO: 164579 - RNA, 64 nt, hsa; identical to SEQ ID NO: 60324

SEQ ID NO: 164580 - RNA, 64 nt, hsa; identical to SEQ ID NO: 60325

SEQ ID NO: 164581 - RNA, 64 nt, hsa; identical to SEQ ID NO: 60326

SEQ ID NO: 164582 - RNA, 64 nt, hsa; identical to SEQ ID NO: 60327

SEQ ID NO: 164583 - RNA, 64 nt, hsa; identical to SEQ ID NO: 60328

SEQ ID NO: 164584 - RNA, 64 nt, hsa; identical to SEQ ID NO: 60329

SEQ ID NO: 164585 - RNA, 64 nt, hsa; identical to SEQ ID NO: 60330

SEQ ID NO: 164586 - RNA, 64 nt, hsa; identical to SEQ ID NO: 92427

SEQ ID NO: 164587 - RNA, 64 nt, hsa; identical to SEQ ID NO: 92428

SEQ ID NO: 164588 - RNA, 64 nt, hsa; identical to SEQ ID NO: 92429

SEQ ID NO: 164589 - RNA, 64 nt, hsa; identical to SEQ ID NO: 92430

SEQ ID NO: 164590 - RNA, 64 nt, hsa; identical to SEQ ID NO: 92431

SEQ ID NO: 164591 - RNA, 64 nt, hsa; identical to SEQ ID NO: 92432

SEQ ID NO: 164592 - RNA, 64 nt, hsa; identical to SEQ ID NO: 92433

SEQ ID NO: 164593 - RNA, 64 nt, hsa; identical to SEQ ID NO: 92434

SEQ ID NO: 164594 - RNA, 64 nt, hsa; identical to SEQ ID NO: 92435

SEQ ID NO: 164595 - RNA, 64 nt, hsa; identical to SEQ ID NO: 92436

SEQ ID NO: 164596 - RNA, 64 nt, hsa; identical to SEQ ID NO: 92437

SEQ ID NO: 164597 - RNA, 64 nt, hsa; identical to SEQ ID NO: 92438

SEQ ID NO: 164598 - RNA, 64 nt, hsa; identical to SEQ ID NO: 92439

SEQ ID NO: 164599 - RNA, 64 nt, hsa; identical to SEQ ID NO: 92440

SEQ ID NO: 164600 - RNA, 64 nt, hsa; identical to SEQ ID NO: 92441

SEQ ID NO: 164601 - RNA, 64 nt, hsa; identical to SEQ ID NO: 92442

SEQ ID NO: 164602 - RNA, 64 nt, hsa; identical to SEQ ID NO: 92443

SEQ ID NO: 164603 - RNA, 64 nt, hsa; identical to SEQ ID NO: 92444

SEQ ID NO: 164604 - RNA, 64 nt, hsa; identical to SEQ ID NO: 92445

SEQ ID NO: 164605 - RNA, 64 nt, hsa; identical to SEQ ID NO: 92446

SEQ ID NO: 164606 - RNA, 64 nt, hsa; identical to SEQ ID NO: 92447

SEQ ID NO: 164607 - RNA, 64 nt, hsa; identical to SEQ ID NO: 92448

SEQ ID NO: 164608 - RNA, 64 nt, hsa; identical to SEQ ID NO: 92449

SEQ ID NO: 164609 - RNA, 64 nt, hsa; identical to SEQ ID NO: 92450

SEQ ID NO: 164610 - RNA, 64 nt, hsa; identical to SEQ ID NO: 92451

SEQ ID NO: 164611 - RNA, 64 nt, hsa; identical to SEQ ID NO: 92452

SEQ ID NO: 164612 - RNA, 64 nt, hsa; identical to SEQ ID NO: 92453

SEQ ID NO: 164613 - RNA, 64 nt, hsa; identical to SEQ ID NO: 92454

SEQ ID NO: 164614 - RNA, 64 nt, hsa; identical to SEQ ID NO: 92455

SEQ ID NO: 164615 - RNA, 64 nt, hsa; identical to SEQ ID NO: 92456

SEQ ID NO: 164616 - RNA, 64 nt, hsa; identical to SEQ ID NO: 92457

SEQ ID NO: 164617 - RNA, 64 nt, hsa; identical to SEQ ID NO: 92458

SEQ ID NO: 164618 - RNA, 64 nt, hsa; identical to SEQ ID NO: 92459

SEQ ID NO: 164619 - RNA, 64 nt, hsa; identical to SEQ ID NO: 92460

SEQ ID NO: 164620 - RNA, 64 nt, hsa; identical to SEQ ID NO: 92461

SEQ ID NO: 164621 - RNA, 64 nt, hsa; identical to SEQ ID NO: 92462

SEQ ID NO: 164622 - RNA, 64 nt, hsa; identical to SEQ ID NO: 92463

SEQ ID NO: 164623 - RNA, 64 nt, hsa; identical to SEQ ID NO: 92464

SEQ ID NO: 164624 - RNA, 64 nt, hsa; identical to SEQ ID NO: 92465

SEQ ID NO: 164625 - RNA, 64 nt, hsa; identical to SEQ ID NO: 92466

SEQ ID NO: 164626 - RNA, 64 nt, hsa; identical to SEQ ID NO: 92463

SEQ ID NO: 164627 - RNA, 64 nt, hsa; identical to SEQ ID NO: 92464

SEQ ID NO: 164628 - RNA, 64 nt, hsa
uuaucuaacacauuuuuuacauguacauuuuaauuugauucagcuggucugaaucucugaauuu

SEQ ID NO: 164629 - RNA, 64 nt, hsa
cauaccauaaagcaucugcuaaugcuuuaauggauugauucaauuaagaccugagugacacuau

SEQ ID NO: 164630 - RNA, 64 nt, hsa
uuggcugucucugguccuugauucaagauguauuuugauucauccaaggguuuccaaacuuguc

SEQ ID NO: 164631 - RNA, 64 nt, hsa
uuucuuuucuuuuguuuuuggcugucucugguccuugauucaagauguauuuugauucauccaa

SEQ ID NO: 164632 - RNA, 64 nt, hsa
uaugggugaaguaagguauggcuuuaccauaaccuugauucauucacccuugauucauuucucg

SEQ ID NO: 164633 - RNA, 64 nt, hsa
guauggcuuuaccauaaccuugauucauucacccuugauucauuucucgcccccgucacugauu

SEQ ID NO: 164634 - RNA, 64 nt, hsa
acacaucuguggggucuccuggguucagcggcuguugauucaaggucaacauugaccauuggag

SEQ ID NO: 164635 - RNA, 64 nt, hsa
uuuaagcuguuuuaugaaaaagaccuagaaguucuugauucauuuuuaccauucuuuccauagg

SEQ ID NO: 164636 - RNA, 64 nt, hsa
accugccuguuuuuguuggugcacagagauugacuugauucagagagacaauucacuccauccc

SEQ ID NO: 164637 - RNA, 64 nt, hsa
ugcugcugagccucuauuuucuuucuuugauguuuugauucaguauucuuuuaucauaaauuuu

SEQ ID NO: 164638 - RNA, 64 nt, hsa
cauccauacacuaaggccuaguugagaaaaaccuuugauucaggauggcuggguuacuaaccuu

SEQ ID NO: 164639 - RNA, 64 nt, hsa
ccuuuagauuggaggaaguggauaugaagauggauugauucagcucaccuuccaugauugcuuu

SEQ ID NO: 164640 - RNA, 64 nt, hsa
ccauuuuccugcuaugaaauauaucaccaccagcuugauucaaccuuaaaaauaaggucaucag

SEQ ID NO: 164641 - RNA, 64 nt, hsa
ccauguaauauuuuacaucaugaagcuuucauccuugauucaaauccucugauuauggacaugu

SEQ ID NO: 164642 - RNA, 64 nt, hsa
ucucagaacuuguguuaaguagauaguaaacagauugauucaugauaauuguccuugacuaaga

SEQ ID NO: 164643 - RNA, 64 nt, hsa
gccauuccuaacuuguuugugccugaagauggacuugauucaaaugguuuacauauuuaguggg

SEQ ID NO: 164644 - RNA, 64 nt, hsa
agaagagaguuuuaaaaaacaaaacaauguaaguaaaggauauuucugaaucuuaaaauucauc

SEQ ID NO: 164645 - RNA, 64 nt, hsa
cauaaacucauaaaaauaauuuuaagaugucggaaaaggauacuuugauuaaauaaaaacacuc

SEQ ID NO: 164646 - RNA, 64 nt, hsa
acguguacucacagagggagagaaagauguguacaaaggauauguauaaauauucuauuuaguc

SEQ ID NO: 164647 - RNA, 64 nt, hsa
uaucaauuucuggauucauaauagcaagauuagcaaaggauaaaugccgaaggucacuucauuc

SEQ ID NO: 164648 - RNA, 64 nt, hsa
cugaacauuaagcagauuggcucagacacaaugaaaaggauaauccaauguacgugcuggugca

SEQ ID NO: 164649 - RNA, 64 nt, hsa
cuaaaguucucuccuuccugccuccccuaaagaaaaaggauauuagauugcacacuauaauuuu

SEQ ID NO: 164650 - RNA, 64 nt, hsa
uauugauguauguauguucauucaaagaaugggaaaaggauaugacauauauuugccaguacuu

SEQ ID NO: 164651 - RNA, 64 nt, hsa
aggugaggcccagcuaguaaucccuuuuagugggaaaggauauguucuaggagaaacaagcaau

SEQ ID NO: 164652 - RNA, 64 nt, hsa
uccucccccagcuaucuauauggaauugcuuaccaaaggauagugcgauguuucaggaggcugg

SEQ ID NO: 164653 - RNA, 64 nt, hsa
uaauuuuuuuauguuuuguuucugaaaauuccagaaaggauauuuaagaaaauacaauaaacua

SEQ ID NO: 164654 - RNA, 64 nt, hsa
agugacuguuuuucaagaagaaauguguuucauaaaaggauauuuauaucucuguugcuuugac

SEQ ID NO: 164655 - RNA, 64 nt, hsa
uuuuaugucucuuuuguuaacagaaaccacuuuuaaaggauaguaauuauucuuguuuauaaca

SEQ ID NO: 164656 - RNA, 64 nt, hsa
guauguaugcaguaugccuuacuuaaaaagauuaaaaggauacuaauguuaaaucuucuaggaa

SEQ ID NO: 164657 - RNA, 64 nt, hsa
uucauuuauauacaggcuucccuuuuuuauuuuuaaaggauacguuucacuuaauaaacacguu

SEQ ID NO: 164658 - RNA, 64 nt, hsa
aucauuuguuuuuccugaccaguauuuaaaaccaaaaggauauucugaaaaauggccaacaauu

SEQ ID NO: 164659 - RNA, 64 nt, hsa
ggggcaucauuuuguuuugucuuucguagcagggaaaggauaugacaauggggaggacaguucu

SEQ ID NO: 164660 - RNA, 64 nt, hsa
auacauuuacacucccaaauugcaggcuuuauuuaaaggauaaaauuuaaaggauaaaaaaaca

SEQ ID NO: 164661 - RNA, 64 nt, hsa
ccaaauugcaggcuuuauuuaaaggauaaaauuuaaaggauaaaaaaacagucacucuguuaag

SEQ ID NO: 164662 - RNA, 64 nt, hsa
acaugaagcaaaauacuaaucuaauuguguaaagaaaggauauuuuaauaaguucuuucugcuu

SEQ ID NO: 164663 - RNA, 64 nt, hsa
auaugaacuuuaaaugauuauauggauuucuuuaaaaggauaugcccauuugauccuaaccuuu

SEQ ID NO: 164664 - RNA, 64 nt, hsa
agguggaagggaaauguuaccaagcaugguaguuaaaggauacuucaauuuuguaucuauuucu

SEQ ID NO: 164665 - RNA, 64 nt, hsa
auggauaaauuauguaaaacuaaagaauggauugaaaggauauguauauacucaguucccaaaa

SEQ ID NO: 164666 - RNA, 64 nt, hsa
guugaggugagggcugugguccugaaagggacgccuuugacaucguggcuguccaguugggcug

SEQ ID NO: 164667 - RNA, 64 nt, hsa
agcugcccaucuccugugauugcacaaccaagcacuuugacauuugcaccuuaggagaggcaga

SEQ ID NO: 164668 - RNA, 64 nt, hsa
gcacuggggacacaaaggggacagagccauccuccuuugacaccuggucuucaguucugugccc

SEQ ID NO: 164669 - RNA, 64 nt, hsa
ccgcgcccggcuauauuuuaucuuuuaucuuuuucuuugacauuuaccaaucaccaagcaugca

SEQ ID NO: 164670 - RNA, 64 nt, hsa
uauuuuaaacccugucuccaugacuucauuugcacuuugacagagcagaggcagaguauuuguc

SEQ ID NO: 164671 - RNA, 64 nt, hsa
uucucgacauaucuagacagggguuaaaggguuucuuugacacauucggaaccguucacccaug

SEQ ID NO: 164672 - RNA, 64 nt, hsa
cacaggaugagaacaucaugagguccaugcagcucuuugacaaugucaucuagcccccaggaga

SEQ ID NO: 164673 - RNA, 64 nt, hsa
acuccagcaccuaugccacuuuucucuucaaugccuuugacaccaaccaugauggcucggucag

SEQ ID NO: 164674 - RNA, 64 nt, hsa
uugugagccaggcaggguagggauuagugucccccuuugacaaaugacagaacugaggguugca

SEQ ID NO: 164675 - RNA, 64 nt, hsa
cgcauccguauagcacuuuaaaguuucugcaguccuuugacacauaggaucucauggagccuca

SEQ ID NO: 164676 - RNA, 64 nt, hsa
auguacugauaaaaacaaacaugguuuuccuuuacuuugacaaaguaauguaauuuuuaccuua

SEQ ID NO: 164677 - RNA, 64 nt, hsa
uauuuuaauccuuuuacauaaaauaaucugaacucuuugacaaauugcacagagcucuuuggca

SEQ ID NO: 164678 - RNA, 64 nt, hsa
cuuuuacuguguugaagcuaaaaaaauaauggcucuuugacaaaacuuguuauguugaucgcgg

SEQ ID NO: 164679 - RNA, 64 nt, hsa
aaagaagaacguaaguuguacaaagauauuuguacuuugacaaacugaauuuaaauaaacuuua

SEQ ID NO: 164680 - RNA, 64 nt, hsa
aaguaggauguuguugccuuuaacuuuucuuauccaggggaaaauugccauuuuagggucagca

SEQ ID NO: 164681 - RNA, 64 nt, hsa
cccuggaagcagcauugugugauauucucagaggcaggggaaaauagagggaaaaauagagacu

SEQ ID NO: 164682 - RNA, 64 nt, hsa
acuggcucuggccucagguggggcgcaggagagccaggggaaaagugccucauaguuaggaaag

SEQ ID NO: 164683 - RNA, 64 nt, hsa
aggcccacccaacugaaggcauggcggcggggugcaggggaaaguuaaaggugaugacgaucau

SEQ ID NO: 164684 - RNA, 64 nt, hsa
gggcacugaguggccuggcucugaggaagggagucaggggaagccugucccgggaaggcccagg

SEQ ID NO: 164685 - RNA, 64 nt, hsa
gcuccaaccacugccaagugaucacucuuaggcccaggggaacacaaugacuaucauuacugau

SEQ ID NO: 164686 - RNA, 64 nt, hsa
uugcuggaagcugucuuaggcugugagacaggagcaggggaaccacagccuauggggaacugcc

SEQ ID NO: 164687 - RNA, 64 nt, hsa
gaccucaagauuccuggaaagaagccccagcccccaggggaaaccuccagaggaacaaggucaa

SEQ ID NO: 164688 - RNA, 64 nt, hsa
ugcucauuuagucccgucuuccucaccgccccagcaggggaacgcucaagccugguugaaaugc

SEQ ID NO: 164689 - RNA, 64 nt, hsa
acugccacacagaagcugaagacaacaccugcuucaggggaacacaggcgcuugaaaaagaaaa

SEQ ID NO: 164690 - RNA, 64 nt, hsa
guucuuccuuccccaucugggccuucauaaaaugcaggggaagccagacuggucucaggagcgc

SEQ ID NO: 164691 - RNA, 64 nt, hsa
aggcccccgccagccccaccuugaaagcagcauacaggggaaggcuuggaccaagcugggcgac

SEQ ID NO: 164692 - RNA, 64 nt, hsa
ugaaagcuuaagugggaaaaaggaagaugauugucaggggaaaaacuuacaaaaugcuacagug

SEQ ID NO: 164693 - RNA, 64 nt, hsa
agacuugguuuuuagaauucauaaaacugacaggcaggggaaucuuccugagugacagcuuggu

SEQ ID NO: 164694 - RNA, 64 nt, hsa
cucuuccugccccuaguauuugauuacaaggaaccaggggaaaaaaacuuucuuagacacacug

SEQ ID NO: 164695 - RNA, 64 nt, hsa
uuccuaccuucucugggggauuugaggguagaggcaggggaagaucuguuguugcagcugcuuc

SEQ ID NO: 164696 - RNA, 64 nt, hsa
cggaggaacaggccuugggcuguuuccgugugaccaggggaauguguggcccgcuggcagccag

SEQ ID NO: 164697 - RNA, 64 nt, hsa
cccccagcaucuccuggggcccccauggcuggggcaggggaaagagagcccucaaaggccucuu

SEQ ID NO: 164698 - RNA, 64 nt, hsa
caccugugucccagcccucugaugguggugagaccaggggaaaggccagcucagagggugguca

SEQ ID NO: 164699 - RNA, 64 nt, hsa
ccucacuugauccuuuugccaaacuugucaaacucaggggaacuggcuucccaguugccccuuu

SEQ ID NO: 164700 - RNA, 64 nt, hsa
ucccaggauccuggagagggagaacuccuggccccaggggaaagaggggggggucucccguuuc

SEQ ID NO: 164701 - RNA, 64 nt, hsa
aggccacugugaggagagggguugccccagaaggcaggggaaggaccugaugagaacagaauag

SEQ ID NO: 164702 - RNA, 64 nt, hsa
guuaagggaugaaggcaaggcugcaggucuggcccaggggaauuaaaagccagccacuccagug

SEQ ID NO: 164703 - RNA, 64 nt, hsa
aauaaaaauuuuagaaaacuauugaaagaaaucacaggggaaacugcacuuagacugacagaau

SEQ ID NO: 164704 - RNA, 64 nt, hsa
uuuguagcagggccacaaaacaaagugaaacguccaggggaacccaacaguccuaugucaucua

SEQ ID NO: 164705 - RNA, 64 nt, hsa
guuuccccaccccagaaacauguaacgguugguaccaugcuaagcccuugccaugcuaagcccu

SEQ ID NO: 164706 - RNA, 64 nt, hsa
aacauguaacgguugguaccaugcuaagcccuugccaugcuaagcccuuuacagucauauccua

SEQ ID NO: 164707 - RNA, 64 nt, hsa
uaaugacuuuggggaaaagaugauucugggucuuucccuugacuucuuguuucaauuacaaacu

SEQ ID NO: 164708 - RNA, 64 nt, hsa
uggcucagaaguagagggagaagaggaacccaguucccuugacuucccuuuugagagcacacgu

SEQ ID NO: 164709 - RNA, 64 nt, hsa
agcaugugcguguucuguuggcaagccacagugcucccuugacugaagacauuuccagguagau

SEQ ID NO: 164710 - RNA, 64 nt, hsa
uuuuucucugaacuugauauaaagauuuuauuugucccuugaaaaaguaacaaaugugcauaga

SEQ ID NO: 164711 - RNA, 64 nt, hsa
gaggccagcgucacacucccucucugcucuccugucccuugagcccuuccucuacagguggggc

SEQ ID NO: 164712 - RNA, 64 nt, hsa
ucacguccuuaacugugcucucccuccuuuccucucccuugagcuugguucugcccagcacucg

SEQ ID NO: 164713 - RNA, 64 nt, hsa
ggcuaguuggccuccucauuuuauuuggucagcaucccuugacucaagaguacuugcuuucaag

SEQ ID NO: 164714 - RNA, 64 nt, hsa
cucuacugaauauucugacucugaaagaagacagucccuugacuugaaguaaugguacagacug

SEQ ID NO: 164715 - RNA, 64 nt, hsa
cugugguuuauuucuuuuuucuauugcuucuuucucccuugagucccuugaaggcagggaauag

SEQ ID NO: 164716 - RNA, 64 nt, hsa
auuucuuuuuucuauugcuucuuucucccuugagucccuugaaggcagggaauagacuucuaga

SEQ ID NO: 164717 - RNA, 64 nt, hsa
uagaugaagagccaacuugaugaaugugcuauucauaagcuagaaacuacaguuuuuccaaacu

SEQ ID NO: 164718 - RNA, 64 nt, hsa
uguaauauaccaauuaguuuuauauaauauccucauaagcuauucuaauuuuugagagaaacac

SEQ ID NO: 164719 - RNA, 64 nt, hsa
ggaauucaagguugguucaacaucuaaaaaucaaauaagcuaauauacagucaguucucauuau

SEQ ID NO: 164720 - RNA, 64 nt, hsa
ggaauucaagguuuguucaacaucuaaaaaucaaauaagcuaauaaagaaaagagguuuauacu

SEQ ID NO: 164721 - RNA, 64 nt, hsa
uuguauacacauuugcauauacccacauggggacauaagcuaauuuuuuuacaggacacagaau

SEQ ID NO: 164722 - RNA, 64 nt, hsa
caaagcgaugucagagggcgguuuugagcuuucuauaagcuauagcuuuguuuauuucacccgu

SEQ ID NO: 164723 - RNA, 64 nt, hsa
uuaaaaacaaacaaacaaaaaaaaaaucuguuagauaagcuaucaaaaugcagcuguuguuuug

SEQ ID NO: 164724 - RNA, 64 nt, hsa
aaacagagucucaagacccccgcucuggacugucauaagcuagcacccgugguaagcgggacga

SEQ ID NO: 164725 - RNA, 64 nt, hsa
uuggugaguuuaguugugcaugccuuuguuguauauaagcuaaauucuagugacccauguguca

SEQ ID NO: 164726 - RNA, 64 nt, hsa
aacucauuuuauucucggcaacaucuggagaagcauaagcuaauuaagggcgaugauuauuauu

SEQ ID NO: 164727 - RNA, 64 nt, hsa
ucuguuauuucuucaucugcuggggggaaaaaguaaauuacaaacaaacaaacaaagcagaacu

SEQ ID NO: 164728 - RNA, 64 nt, hsa
uuaaguuugcaauuucccaaacaauacaaaaagcaaauuacacacccucaccacuguucuuauc

SEQ ID NO: 164729 - RNA, 64 nt, hsa
ccaaaaacuuuuuaaaagguaaaaaaauaaaauaaaauuacaacaugaagauucagauuuuuuu

SEQ ID NO: 164730 - RNA, 64 nt, hsa
aaccuugaugaauuguauaaagagagaauuuaaaaaauuacauucuuuauuuucuauuagcugu

SEQ ID NO: 164731 - RNA, 64 nt, hsa
ccugguacuuuggacuuccauggcuuguuauauaaaauuacauuuuuacauguaaaaauaaacu

SEQ ID NO: 164732 - RNA, 64 nt, hsa
uguagaagcuaaauugaucuuuauaauuaagcagaaauuacaaaacuaggaauaaucaacauug

SEQ ID NO: 164733 - RNA, 64 nt, hsa
auacuuucuuuuuucuuggagagaaccguuuaaaaaauuacaagauauauuuaaaaaguaacca

SEQ ID NO: 164734 - RNA, 64 nt, hsa
auuuaagugccugggggaaggauacaauuuuuagaaauuacauauugggucaguuuuguuuugu

SEQ ID NO: 164735 - RNA, 64 nt, hsa
cauacuuggagaaguauguaauuuugucuuuggaaaauuacaacacugccuuugcaacacugca

SEQ ID NO: 164736 - RNA, 64 nt, hsa
augauuuccagaguuuuugagcuagaaggagaucaaauuacauuuauguuccuauauauuacaa

SEQ ID NO: 164737 - RNA, 64 nt, hsa
aauauaaauccauucaggugacaacccaucaucaaaauuacaaauuuucugauugaacucaucu

SEQ ID NO: 164738 - RNA, 64 nt, hsa
uggaauuacaaccauuguauuuuguuuguggcauaaauuacagucaucugucuuucacuggaau

SEQ ID NO: 164739 - RNA, 64 nt, hsa
uuuuuuuuguuaggcuguaaagaauuuaagcuguaaauuacauaaguuagaacaagcccaaauu

SEQ ID NO: 164740 - RNA, 64 nt, hsa
ugacagacaaccaagcuucaauauuuuucuaaagaaauuacaggugggauaugcuagaaaaggc

SEQ ID NO: 164741 - RNA, 64 nt, hsa
caguuucauuauucucauaauccuucugcaacugaaauuacauauugcaggagacauuuucaua

SEQ ID NO: 164742 - RNA, 64 nt, hsa
gacagauaguuuuuacuguggggcaaauagguuaaaauuacacuauguuaguugcauuuagguu

SEQ ID NO: 164743 - RNA, 52 nt, hsa
ugcaaaagacagacaacugaacaaauuacaaaugaacuuucuugcacuugcu

SEQ ID NO: 164744 - RNA, 64 nt, hsa
uuuaaagccaugcuaaaauuaaaaagaaaauauuaaauuacacaauuacacuugucuuuacugg

SEQ ID NO: 164745 - RNA, 64 nt, hsa
agaaguuauuuccaaguuuguguauauauuauaaaaauuacauauauaaaacuaaggcuuuuau

SEQ ID NO: 164746 - RNA, 64 nt, hsa
gcagaaacuauacaaugaaggaagaauucuauggaaauuacaaauccaaaacucuaugaugaug

SEQ ID NO: 164747 - RNA, 64 nt, hsa
ugagcuagaagaaauagcugauuauuguauaugcaaauuacaugcauuuuuaaaaacuauucuu

SEQ ID NO: 164748 - RNA, 64 nt, hsa
auauuuacauucagaguacacuuuucuuuggaaaaaauuacagguuuuuugaaaagugaauaau

SEQ ID NO: 164749 - RNA, 64 nt, hsa
auggacuacaggguuauuuuuauggucauaauaaaaauuacaaaaguaugaauaaaauacauac

SEQ ID NO: 164750 - RNA, 64 nt, hsa
cacaagagcaauauugaauuguucauucuaucuaaaauuacauguauauaaaauauauaauuua

SEQ ID NO: 164751 - RNA, 64 nt, hsa
aaugauuuugugugcaucuuuaaucuuucaagccaaauuacagcuauuucagguuuccuguguu

SEQ ID NO: 164752 - RNA, 64 nt, hsa
auaccuagaucaggaauacucuuccaggaguacaaaauuacauuauugauaguuaagcucuuaa

SEQ ID NO: 164753 - RNA, 64 nt, hsa
aucuagaugcaauuaauuuuauuccuuccaacuaaaauuacaauauuuuuagguuaaaauuauu

SEQ ID NO: 164754 - RNA, 64 nt, hsa
aaaauaaugaauucucacuguaaauuucaaaaaaaaauuacaaaaguaugugaauuuaaaaaug

SEQ ID NO: 164755 - RNA, 64 nt, hsa
aagaucaauuuagcuacuuuguauuuucagagucaaauuacagacgguuuccaaaggucuugag

SEQ ID NO: 164756 - RNA, 64 nt, hsa
uuggaacucaauguggaacuuuaaacauuuugcaaaauuacauuuagagaaacccaauuuuuca

SEQ ID NO: 164757 - RNA, 64 nt, hsa
uacagauaaucagaagaugauacugaauagauauaaauuacauguacacauguauucacuuuuu

SEQ ID NO: 164758 - RNA, 64 nt, hsa
auauugucauaucuggcccuuugaugagaaaaggaaauuacaauaauaaaguuuuaugauuuua

SEQ ID NO: 164759 - RNA, 64 nt, hsa
uauuucauguuuuggccaaaaauuuuuaaaaaauaaauuacaauuguucucuauuagucauuuu

SEQ ID NO: 164760 - RNA, 64 nt, hsa
gugcuugaaguauuucuucucugguuguaauucuaaauuacagagucauuugagcuuucucccc

SEQ ID NO: 164761 - RNA, 64 nt, hsa
gagcaguagaggauguauaauuuugggcgaaguuaaauuacaauuuauuugagguuauuccuaa

SEQ ID NO: 164762 - RNA, 64 nt, hsa
guuuguaauaguaagaacugucccauauguuaguaaauuacauauguacaaauugaaacuguaa

SEQ ID NO: 164763 - RNA, 64 nt, hsa
aguaauauauuaaagugaauguaaauggugguuaaaauuacauuacugugaaauucaucuucca

SEQ ID NO: 164764 - RNA, 64 nt, hsa
aaaaauccuuguugaaguuuuuuuaaaaaaagcuaaauuacauagacuuaggcauuaacauguu

SEQ ID NO: 164765 - RNA, 64 nt, hsa
uauauuuuuucuauaaaaagaaaaaaauggaaaaaaauuacaaggcaauggaaacuauuauaag

SEQ ID NO: 164766 - RNA, 64 nt, hsa
ccauuauuccagagauucaguauuaaaaaaaaaaaaauuacacugugguaguggcauuuaaaca

SEQ ID NO: 164767 - RNA, 64 nt, hsa
aaaauuuucaguguguaguuggcagauauuuucaaaauuacaaugcauuuauggugucuggggg

SEQ ID NO: 164768 - RNA, 64 nt, hsa
auauuuccucuugaacguuauguucagaaaaugcaaauuacacuauaauauaaaaccugauaua

SEQ ID NO: 164769 - RNA, 64 nt, hsa
aggaggcuuuuucagugaucuucacuguauauguaaauuacaaauguggcuguaaaacuuauuc

SEQ ID NO: 164770 - RNA, 64 nt, hsa
aaaccuaauguuuaaauuacacauuguugaaauuaaauuacacauuguugacaugcuucucucc

SEQ ID NO: 164771 - RNA, 64 nt, hsa
auuuguuaccaguuguuauccaaaccuaauguuuaaauuacacauuguugaaauuaaauuacac

SEQ ID NO: 164772 - RNA, 64 nt, hsa
augcuucaguuucuguugcaaauuggugauugugaaauuacagaaagugauuuucuagucugcu

SEQ ID NO: 164773 - RNA, 64 nt, hsa
gaugcuguuuggaggacaggaaaauuuaucgggaaaauuacauaaucccucugauuccacuauc

SEQ ID NO: 164774 - RNA, 64 nt, hsa
aaaauacgggcaagcucuuaacuauuuaaaaaugaaauuacaggcccgggcacgguggcucaca

SEQ ID NO: 164775 - RNA, 64 nt, hsa
aaaaauguaacuaggaagaaaaacccaauuuaagaaauuacauaaugcuuuccaaaggcaccua

SEQ ID NO: 164776 - RNA, 64 nt, hsa
aaaaaguauauagugacauuuuuaguaugaaaccaaauuacacuaaggucuuuuguuggccaua

SEQ ID NO: 164777 - RNA, 64 nt, hsa
agaaccagugaaacagaaaaguuaaucugcuuucaaauuacaauggugggaacaggcauaggau

SEQ ID NO: 164778 - RNA, 64 nt, hsa
uguuuuucauuuuguacaacuuucuugaauuuagaaauuacaucuuugcaguucuguuaggugc

SEQ ID NO: 164779 - RNA, 64 nt, hsa
uaguuuaauuggcauugcuuguuuuuugaaacugaaauuacaugaguuucauuuuuucuuugaa

SEQ ID NO: 164780 - RNA, 64 nt, hsa
cuccucuguggugucugccuguugcgugacacucuccuugcaguucuugaguugcggcagaaca

SEQ ID NO: 164781 - RNA, 64 nt, hsa
ggcugcgcuuccuauuucuagggcugggaaacacuccuugcaucaaggggucacuuacagaaca

SEQ ID NO: 164782 - RNA, 64 nt, hsa
aacgcacauagcucaaucacacuggaaauguuuguccuugcaccugagccuguucccacucagc

SEQ ID NO: 164783 - RNA, 64 nt, hsa
gcccuucuauuuauuugacugauuauugcuucuuuccuugcauuaaaggagaucuuccccuaac

SEQ ID NO: 164784 - RNA, 64 nt, hsa
uaaacaaauuaauucuaaaggcccaggccuccaguccuugcaugaaaggcauuugccuucauaa

SEQ ID NO: 164785 - RNA, 64 nt, hsa
aggagauuuugaacuuaacuuacacaacauuaaauccuugcacaaucaaauuaauguuacuuau

SEQ ID NO: 164786 - RNA, 64 nt, hsa
gugaaccaggagauuuagugcuuuuauauucauuuccuugcauuuaagaaaauaugaaagcuua

SEQ ID NO: 164787 - RNA, 64 nt, hsa
uagacacucuugagcuggacuuagauuuuauucuuccuugcagaguaguguuagaauagauggc

SEQ ID NO: 164788 - RNA, 64 nt, hsa
gaccugcuugacagacucacucggccucacuucauccuugcaaagagaauccuguacuucaucc

SEQ ID NO: 164789 - RNA, 64 nt, hsa
cacuucauccuugcaaagagaauccuguacuucauccuugcaaagagaauccuguacuucacuc

SEQ ID NO: 164790 - RNA, 64 nt, hsa
ugacugagaacuauuuaaagacgcaaucccagguuccuugcacaccauggcagccucuccuugc

SEQ ID NO: 164791 - RNA, 64 nt, hsa
caaucccagguuccuugcacaccauggcagccucuccuugcaccuucuccugccucuccacacu

SEQ ID NO: 164792 - RNA, 64 nt, hsa
uguagaguguuguaaaauauuuuggaugugaauguccuugcaggccgguuagucuccaguuucc

SEQ ID NO: 164793 - RNA, 64 nt, hsa
uuuuggaaaucaguguuuuccaugugacccucuuuccuugcaucccuauuccuugucccccacc

SEQ ID NO: 164794 - RNA, 64 nt, hsa
gggguguguacagaugaagucaguggcuugucugugagcugaagagucuugagaggggcuguca

SEQ ID NO: 164795 - RNA, 64 nt, hsa
ugccugguguccacgggggagggccaaggccugcugagcugauucuccagcugcugccccagcc

SEQ ID NO: 164796 - RNA, 64 nt, hsa
ggccacacgccuggccagccugcuggcuccugggugagcugaagaaccuugccuguggcacuuu

SEQ ID NO: 164797 - RNA, 64 nt, hsa
uuaaaauaugaaguugguuuuguuggauggcuccugagcugacugacugaugucugaaguuuga

SEQ ID NO: 164798 - RNA, 64 nt, hsa
gcugauacuaucucuugucauauaaaccugauguugagcugaguuccuuauaagaauuaaucuu

SEQ ID NO: 164799 - RNA, 64 nt, hsa
ucaucuucaaccuuaaggacuuagcuggccacagugagcugaugugcccaccaccgugucauga

SEQ ID NO: 164800 - RNA, 64 nt, hsa
aggaagagugcaaaacauugaagagagagcugagugagcugaagagugaggauaugaguagccc

SEQ ID NO: 164801 - RNA, 64 nt, hsa
agaaucgcuugaacccaggaggcagagguugcagugagcugagaucgugccacugcacucuagc

SEQ ID NO: 164802 - RNA, 64 nt, hsa
agaauugcuuuaaccuuggaggcggagguugcauugagcugagaucaugcuagugcgcuccagc

SEQ ID NO: 164803 - RNA, 64 nt, hsa
agaaucacuugaacccaggaggcagagguuggagugagcugagaucgcgccaccgcacuccagc

SEQ ID NO: 164804 - RNA, 64 nt, hsa
gagugcaguuuccaaucccauagaugggucuggcugagcugaacccauuuugagugacucgagg

SEQ ID NO: 164805 - RNA, 64 nt, hsa
gcauggugcaguugacagcaggugggaaaugguaugagcugaggggggccgugcccaggggccc

SEQ ID NO: 164806 - RNA, 64 nt, hsa
cccaugaagaccaaaagcugcaagaggucaaauuugagcugauugugucagaggccuccuaccu

SEQ ID NO: 164807 - RNA, 64 nt, hsa
cagcaagccuaagucuucucugagaggaguuucgugagcugaagaacaagcugcucauggcaag

SEQ ID NO: 164808 - RNA, 64 nt, hsa
agaaucacuugaacccgggagaugaagguugcagugagcugaggucgugcuacugcacucccgc

SEQ ID NO: 164809 - RNA, 64 nt, hsa
cuccagcguuuugggaaggaaagagauguuccccugagcugauucccagugacagugcagcaag

SEQ ID NO: 164810 - RNA, 64 nt, hsa
gcagcuucaggucccuaugggcgcagcugcuccgugagcugagucucccacugcccugcacacc

SEQ ID NO: 164811 - RNA, 64 nt, hsa
ccaccccgccucugcccagccugucuacaccgugugagcugaaucgugacuugcuucccaccuc

SEQ ID NO: 164812 - RNA, 64 nt, hsa
caauuaugggucuucauuuugagaucguuuucuaugagcugaacugaggauaucaaugguuauc

SEQ ID NO: 164813 - RNA, 64 nt, hsa
aaccgcccugacuuuacagggggaacacucaugcugagcugagaaagcagagaaguggcguggg

SEQ ID NO: 164814 - RNA, 64 nt, hsa
cugucucaaaaaaaaaaaauaauaauaaaauaagugagcugaacucaccugaagugguuuacuu

SEQ ID NO: 164815 - RNA, 64 nt, hsa
uuuugagaaauagagcacaacagcacuuucgucaugagcugacaguagugucaagaaagucaaa

SEQ ID NO: 164816 - RNA, 64 nt, hsa
uuuaaacgcaaagcuuuguaaaagccacaaggucugagcugaaccccuccuuuuugaacuuacu

SEQ ID NO: 164817 - RNA, 64 nt, hsa
gggcugccagucacuggucugggggguggaggccugagcugagggcagggugccugaccugugu

SEQ ID NO: 164818 - RNA, 64 nt, hsa
cugucaugugaggagaugcucacuguggucuuguugagcugauggccuugguugagcugaugga

SEQ ID NO: 164819 - RNA, 64 nt, hsa
cucacuguggucuuguugagcugauggccuugguugagcugauggacaagugaaggaggccaug

SEQ ID NO: 164820 - RNA, 64 nt, hsa
aggaaccuugccugcgaccaaucauggagccacgugagcugaucguggcugcaccuggggggag

SEQ ID NO: 164821 - RNA, 64 nt, hsa
uguauuuagcagaguauuuucaacuugagugaucugagcugaauuugaagacuauuaauaaguu

SEQ ID NO: 164822 - RNA, 64 nt, hsa
agaauggcgugaacccaggaggcggagcuugcagugagcugagaucacgccacugcacuccagc

SEQ ID NO: 164823 - RNA, 64 nt, hsa
agaaucgcuugaacccgggaggcagagguagcagugagcugaagucccgccacugcacuccagc

SEQ ID NO: 164824 - RNA, 64 nt, hsa
uucuggaaugaauugagaagguggcgugcuggccugagcugauggaccacuugguguuuugcgu

SEQ ID NO: 164825 - RNA, 64 nt, hsa
agaauaacuuaaacccgggaggcggagguuacagugagcugagaucgugccacugcacuccagc

SEQ ID NO: 164826 - RNA, 64 nt, hsa
auuuugguucuccucuguugcccuuccuaaaaaaugagcugaagaugacaguauuuuucuuuac

SEQ ID NO: 164827 - RNA, 64 nt, hsa
gaccccugccugugacguggaggaucccagccucugagcugaguugguuuuaugaaaagcuagg

SEQ ID NO: 164828 - RNA, 64 nt, hsa
agaaucacuugaacccaggaggcggagguugcggugagcugagauugcaccauuucauuccagc

SEQ ID NO: 164829 - RNA, 64 nt, hsa; identical to SEQ ID NO: 97957

SEQ ID NO: 164830 - RNA, 64 nt, hsa; identical to SEQ ID NO: 97958

SEQ ID NO: 164831 - RNA, 64 nt, hsa; identical to SEQ ID NO: 97959

SEQ ID NO: 164832 - RNA, 64 nt, hsa; identical to SEQ ID NO: 97960

SEQ ID NO: 164833 - RNA, 64 nt, hsa; identical to SEQ ID NO: 97961

SEQ ID NO: 164834 - RNA, 64 nt, hsa; identical to SEQ ID NO: 97962

SEQ ID NO: 164835 - RNA, 64 nt, hsa; identical to SEQ ID NO: 97963

SEQ ID NO: 164836 - RNA, 64 nt, hsa; identical to SEQ ID NO: 97964

SEQ ID NO: 164837 - RNA, 64 nt, hsa; identical to SEQ ID NO: 97965

SEQ ID NO: 164838 - RNA, 64 nt, hsa; identical to SEQ ID NO: 97966

SEQ ID NO: 164839 - RNA, 64 nt, hsa; identical to SEQ ID NO: 97967

SEQ ID NO: 164840 - RNA, 64 nt, hsa; identical to SEQ ID NO: 97968

SEQ ID NO: 164841 - RNA, 64 nt, hsa; identical to SEQ ID NO: 97969

SEQ ID NO: 164842 - RNA, 64 nt, hsa; identical to SEQ ID NO: 97970

SEQ ID NO: 164843 - RNA, 64 nt, hsa; identical to SEQ ID NO: 97971

SEQ ID NO: 164844 - RNA, 64 nt, hsa; identical to SEQ ID NO: 97972

SEQ ID NO: 164845 - RNA, 64 nt, hsa; identical to SEQ ID NO: 97973

SEQ ID NO: 164846 - RNA, 64 nt, hsa; identical to SEQ ID NO: 97974

SEQ ID NO: 164847 - RNA, 64 nt, hsa; identical to SEQ ID NO: 97975

SEQ ID NO: 164848 - RNA, 64 nt, hsa; identical to SEQ ID NO: 97976

SEQ ID NO: 164849 - RNA, 64 nt, hsa; identical to SEQ ID NO: 97977

SEQ ID NO: 164850 - RNA, 64 nt, hsa; identical to SEQ ID NO: 97978

SEQ ID NO: 164851 - RNA, 64 nt, hsa; identical to SEQ ID NO: 97979

SEQ ID NO: 164852 - RNA, 64 nt, hsa; identical to SEQ ID NO: 97980

SEQ ID NO: 164853 - RNA, 64 nt, hsa; identical to SEQ ID NO: 97981

SEQ ID NO: 164854 - RNA, 64 nt, hsa; identical to SEQ ID NO: 97982

SEQ ID NO: 164855 - RNA, 64 nt, hsa; identical to SEQ ID NO: 97983

SEQ ID NO: 164856 - RNA, 64 nt, hsa; identical to SEQ ID NO: 97984

SEQ ID NO: 164857 - RNA, 64 nt, hsa; identical to SEQ ID NO: 97985

SEQ ID NO: 164858 - RNA, 64 nt, hsa; identical to SEQ ID NO: 97986

SEQ ID NO: 164859 - RNA, 64 nt, hsa
ugccuaaagagagugaugcuaacacuccaucugcccuguccauugccuucauauacagucuacu

SEQ ID NO: 164860 - RNA, 64 nt, hsa
ugugaagucaggaggguuucuggcauuuuccacaccuguccacuccuuggagcugguuucucuc

SEQ ID NO: 164861 - RNA, 64 nt, hsa
gaaacccaggauguagauagagggccacacccacccuguccagaguagagggcaccuguccacg

SEQ ID NO: 164862 - RNA, 64 nt, hsa
agggccacacccacccuguccagaguagagggcaccuguccacguggccagggcccaugcugcc

SEQ ID NO: 164863 - RNA, 64 nt, hsa
ccaaucuaaaggcauugucauguggccugccuuuccuguccacauccccaccucugaugcucaa

SEQ ID NO: 164864 - RNA, 64 nt, hsa
uccccaaugcacgaguccucucucucuccuugucccuguccaccaaguaguuggaccauucugg

SEQ ID NO: 164865 - RNA, 64 nt, hsa
cagaacgguuuuugcugaggugccccugcccagcccuguccagccuuguccacacacacaucuc

SEQ ID NO: 164866 - RNA, 64 nt, hsa
agagauugcagagguguguccugccuaccaucugccuguccagcuugguggggguccgggucac

SEQ ID NO: 164867 - RNA, 64 nt, hsa
ccagucccccgagucccugccgcgcgcccucgcgccuguccacaucccucugcccauccgagac

SEQ ID NO: 164868 - RNA, 64 nt, hsa
cgguaccccggaaucccugccgcggccccucgggccuguccacaucccucugccccucccagac

SEQ ID NO: 164869 - RNA, 64 nt, hsa
auuuauguggggccgugcaggcaugggcccacugccuguccauccuguuucucuuauuuauuga

SEQ ID NO: 164870 - RNA, 64 nt, hsa
gcccuucccagcuuauccgccuguuccacuuguaccuguccagcccugcccuguguugggcacc

SEQ ID NO: 164871 - RNA, 64 nt, hsa
gcugccaggugggccccugccagggguccucaccccuguccacccugugccuggcugucccugc

SEQ ID NO: 164872 - RNA, 64 nt, hsa
auuucagcaggccaccuccccucaucuuccccgcccuguccagcgcccuggcaaaggcugacaa

SEQ ID NO: 164873 - RNA, 64 nt, hsa
gaugucuaggaaugacugaaagaaaccaaaacagccuguccacugcugcugugggauggaggag

SEQ ID NO: 164874 - RNA, 64 nt, hsa
ccaggagaugaaggaguucaguagcaaagucacaccuguccaauucccugagcuuugcucacuc

SEQ ID NO: 164875 - RNA, 64 nt, hsa
ccgaggucugggcguguuugggccggugcuggagccuguccagcuggcccgggcccuggccugg

SEQ ID NO: 164876 - RNA, 64 nt, hsa
gggcaguuaucacuggggaagagaggaccggccaccuguccagcaugggcuccagagccuuccu

SEQ ID NO: 164877 - RNA, 64 nt, hsa
ccugagugccagccccccaccccgccugccgcccccuguccagguucccuccccgccacaguga

SEQ ID NO: 164878 - RNA, 64 nt, hsa
acccugcccugcgcuccccaacucccccaggcucccuguccacugcccucccuggucuggcccc

SEQ ID NO: 164879 - RNA, 64 nt, hsa
cucuggcugcugggagcccaucucucggagaaacccuguccacccaaccccgagagcccuagcg

SEQ ID NO: 164880 - RNA, 64 nt, hsa
ugcugagggcccccccgugcaguccgcauaccccccuguccagcagggcacuguggguggcuca

SEQ ID NO: 164881 - RNA, 64 nt, hsa
aaggagguucauauuccccagauguguccacaaaccuguccaggaguugugucuuaaaauugau

SEQ ID NO: 164882 - RNA, 64 nt, hsa
acccaaagugcaaucucacggccagguucuaugcccuguccaagcguaaacccucuuggaaacu

SEQ ID NO: 164883 - RNA, 64 nt, hsa
acucccuguccacacacucccuguccacacacucccuguccacaacugcagccgggcccucugc

SEQ ID NO: 164884 - RNA, 64 nt, hsa
gcucccuguccacacacucccuguccacacacucccuguccacacacucccuguccacaacugc

SEQ ID NO: 164885 - RNA, 64 nt, hsa
ggaaaggccggccacgcucccuguccacacacucccuguccacacacucccuguccacacacuc

SEQ ID NO: 164886 - RNA, 64 nt, hsa
uccuacagcugccuaggaaaggccggccacgcucccuguccacacacucccuguccacacacuc

SEQ ID NO: 164887 - RNA, 64 nt, hsa
uuucccauuguaaauaaacauuacauugacagguauugacuacuaacaccucuaaaaaguacuu

SEQ ID NO: 164888 - RNA, 64 nt, hsa
aguuuuauugucacaugcuaaauauugcaugcauauugacuaauuggaauaaccauuuacucaa

SEQ ID NO: 164889 - RNA, 64 nt, hsa
uguugagcuguagucuuguagccauaaugagcaaauugacuaagagaagcaaagguuucuuggg

SEQ ID NO: 164890 - RNA, 64 nt, hsa
gaacauggcugaagauuuuucuaguauauuaauaauugacuaggaagaugaacuuuuuuucaga

SEQ ID NO: 164891 - RNA, 64 nt, hsa
aauuuauuccucagguguggaaauuucuacugcaauugacuacguuugauuauuuugagcuugu

SEQ ID NO: 164892 - RNA, 64 nt, hsa
caaaagggaagggaaggaaacuuagcagagugcuauugacuauagauucacauauuagcaacaa

SEQ ID NO: 164893 - RNA, 64 nt, hsa
ccauaaagccacauugaguagucuaucccauaggauugacuacugcagagucuagugcagaccc

SEQ ID NO: 164894 - RNA, 64 nt, hsa
ccauaguauugacuguagaaggagccucuacaauauugacuauauauuuuuauaaacuacuggc

SEQ ID NO: 164895 - RNA, 64 nt, hsa
uucauauggggaauccugucagguguuugguuauauugacuauuuauuaauaguauuagaacuc

SEQ ID NO: 164896 - RNA, 64 nt, hsa
uuagggguagcggggguaggaugguugggaccagauugacuacccuguacccuuccuucuuccc

SEQ ID NO: 164897 - RNA, 64 nt, hsa
auuuuauuacacauaacauguacuauuuuuuuuaauugacuaauugcccugcuguuuuacuggu

SEQ ID NO: 164898 - RNA, 64 nt, hsa
ucagaaaagagaugagaugagauaagacuuguuuauugacuagccaauaugucauuaaaauuaa

SEQ ID NO: 164899 - RNA, 64 nt, hsa
uuaacuuggggcaggaagaagggagcagcagagaauugacuagauauagcaccuauuaaaagag

SEQ ID NO: 164900 - RNA, 64 nt, hsa
ucuauaacaaaggauacuuauuuaaauagaugacauugacuauuuuuguuuuuauuaaaaggaa

SEQ ID NO: 164901 - RNA, 64 nt, hsa
caaguuuuuauacuuucugaaaugaaaacauaggauugacuaguuuacugguuuuuauucccau

SEQ ID NO: 164902 - RNA, 64 nt, hsa
auaaaaauuuuacuuaaaaucuguaacgcuagauauugacuauccuuaguugagucacugaggu

SEQ ID NO: 164903 - RNA, 64 nt, hsa
uucuuaaauucuagucacuagucauuaugagaguauugacuaaauauuuucacaaucuaaauau

SEQ ID NO: 164904 - RNA, 64 nt, hsa
aaauuacuuuugugggggaaugccuaauaaauacauugacuauauauaaaaugaauauauacau

SEQ ID NO: 164905 - RNA, 64 nt, hsa
uuuauuuuuucuuuucuuuacaaaccauuuuguuauugacuaacaggccaaagagucuccaguu

SEQ ID NO: 164906 - RNA, 64 nt, hsa
cugaaaaaauuaagucagcucagcacgaguugaaauugacuacauuaauuucuuuccaccuaga

SEQ ID NO: 164907 - RNA, 64 nt, hsa
cucauuagguaaugauaaauauuucccuuaaauaauugacuauuuugcuguguuuuaaaaauga

SEQ ID NO: 164908 - RNA, 64 nt, hsa
uuaauuguuuuaagaagaaaacagugucucauaaauugacuauccuggcaucacauuuaacaug

SEQ ID NO: 164909 - RNA, 64 nt, hsa
ucaugaaaucucccuuuuacuggaaaacaggaauauugacuaccaaaucacaaugcaauugaag

SEQ ID NO: 164910 - RNA, 64 nt, hsa
aauuaguuuucuuuccuuuauuugauugauggucauugacuacugaaauaaaauaugcauuuua

SEQ ID NO: 164911 - RNA, 64 nt, hsa
auuuauaaaccaauuccuguuggaauuugggugaauugacuagaaagucuacuugagcauguug

SEQ ID NO: 164912 - RNA, 64 nt, hsa
uuacauuggaagggagcuuucaagaugguaggauauugacuaacugagcuccuucacuuaaaaa

SEQ ID NO: 164913 - RNA, 64 nt, hsa
uucacaggacagagcagagccauggagacuaagcauugacuaccuugaguucuccuagugagga

SEQ ID NO: 164914 - RNA, 64 nt, hsa
uuaguggauuuuuucugauaaauuagagcauuuaauugacuauuuuauucagguugaucuguug

SEQ ID NO: 164915 - RNA, 64 nt, hsa
aggauaugaagauuugagaacuuuuuaacuauucauugacuaaaaaugaacauuaauguuaaag

SEQ ID NO: 164916 - RNA, 64 nt, hsa
gaauucaucuguuuauacaagucuaccacugccgauugacuaaaaaauacauuaucccaugcau

SEQ ID NO: 164917 - RNA, 64 nt, hsa
uuuugaggcuucuguuccucucuuuuccuguuguauugacuauuuucguucauuacuugauuaa

SEQ ID NO: 164918 - RNA, 64 nt, hsa
guuuagagauuuuaaguuggaacaguauuuucccauugacuacuuuucauucuucacuguaguu

SEQ ID NO: 164919 - RNA, 64 nt, hsa
acguagugaguacuagagaguucuguauuuuauuauugacuauaauaauuaguuuaauuagcuu

SEQ ID NO: 164920 - RNA, 64 nt, hsa
auuaauuaccaguggauugguagaacugcuuuuuauugacuaguaaaaguuacugccuaugcuu

SEQ ID NO: 164921 - RNA, 64 nt, hsa
uuacagagguauuaaaacuaaauuucacuacuagauugacuaacucaaauacacauuugcuacu

SEQ ID NO: 164922 - RNA, 64 nt, hsa
uaugacacaggaugaggaagauuaaggauaaucaauugacuaauuucauuuagaauauuaucaa

SEQ ID NO: 164923 - RNA, 64 nt, hsa
aggagcuccuauugggagacaugaaacauauguaauugacuaccauguaauagaacaaacccug

SEQ ID NO: 164924 - RNA, 64 nt, hsa
ucuucaguuacaaaugggcauuuaguauaguuauauugacuauaacauguaaguaaauagcuuu

SEQ ID NO: 164925 - RNA, 64 nt, hsa
caccaaauuaucgguauuuuaacugaauuuacccauugacuaagaaugaaccagauuugguggu

SEQ ID NO: 164926 - RNA, 64 nt, hsa
aacuuauugcuauuuugguauauaauguuaauuuauugacuaguuugaaauaaugugaaguguu

SEQ ID NO: 164927 - RNA, 64 nt, hsa
gcacaugcaaaaggacucggcuauuuaccugaagauugacuagcuacacuaaagaaaaugaacu

SEQ ID NO: 164928 - RNA, 64 nt, hsa
uuauuuuaucugcuaugcuauugaaguuuuggcaauugacuauagugugagccaggaaucacug

SEQ ID NO: 164929 - RNA, 64 nt, hsa
aaacacuucguugauccauccagcccuaaaguucauugacuaauagcucaugcaucuuauuaaa

SEQ ID NO: 164930 - RNA, 64 nt, hsa
aaaaaucuguaauuuuugcugaugaaagugcuucauugacuaaacaguauuaguuuguggcuau

SEQ ID NO: 164931 - RNA, 64 nt, hsa
cuacuuguauguucggagaguguuuuuguacuauauugacuacuuaaaauagagaaugagacua

SEQ ID NO: 164932 - RNA, 64 nt, hsa
uguauuuguagcacuaagagaauuauuauuaaggauugacuagaaccuuaaaagauauaugugg

SEQ ID NO: 164933 - RNA, 64 nt, hsa
uaugagcucggcaggaucuguucuugucauagccauugacuauacauuugcuacuggugauuca

SEQ ID NO: 164934 - RNA, 64 nt, hsa
acacugggggaggggacauugaacaaguuguuucauugacuaucaaacugaagccagaaauaaa

SEQ ID NO: 164935 - RNA, 64 nt, hsa
uaggacuggacacaaggaaaauaaucucuaaacuauugacuaaauuccagugagaguaugaaug

SEQ ID NO: 164936 - RNA, 64 nt, hsa
uggagcaagaccucgucucagaaaauuggaaacuauugacuaagagaaguuucuagguuugcac

SEQ ID NO: 164937 - RNA, 64 nt, hsa
uuuaaugcuaguaguaaaguugguuucugcuuucauugacuauuuucaucauaauuucaucauu

SEQ ID NO: 164938 - RNA, 64 nt, hsa
aaaagucuguuugggggcauacuuuucauaucuuauugacuaaagcccuugagccaggaaaaaa

SEQ ID NO: 164939 - RNA, 64 nt, hsa
agagagaguuugccagaucugaagcauauaccucauugacuaggcuguuacuuugggauagguu

SEQ ID NO: 164940 - RNA, 64 nt, hsa
auacagauaaggaaacuggggugcagaaaagugaauugacuacaaaguagacaugacuaguuaa

SEQ ID NO: 164941 - RNA, 64 nt, hsa
uugucucaaguucacacucuuagcauagaauauuauugacuaggcuguaugacauuuugagcuc

SEQ ID NO: 164942 - RNA, 64 nt, hsa
guguucucuccuuguagaacaucagagaaggcacauugacuagcaaacagcacuuuaggaaaag

SEQ ID NO: 164943 - RNA, 64 nt, hsa
ccauucagaaaugugugacccuucauuuauggauauugacuauauguaaugcagugcuauccca

SEQ ID NO: 164944 - RNA, 64 nt, hsa
uuggacagaaagaaaagaaacuugguguuagguaauugacuaugcacuaguauuucagacuuuu

SEQ ID NO: 164945 - RNA, 64 nt, hsa
uacaguguuauuugauauuuuaauuuauuuuuugauugacuagaaaaaucauuuuaauuucacu

SEQ ID NO: 164946 - RNA, 64 nt, hsa
gcuguaacuucacaucaucagcuugcaguuuguaauugacuaaagcauuccaguguccucuuuc

SEQ ID NO: 164947 - RNA, 64 nt, hsa
auaucuucuccagaaguccuagaaacaucucaucauugacuaugauugaauuuuauuuauuaau

SEQ ID NO: 164948 - RNA, 64 nt, hsa
acucuuguauauuuuuuugucucuuguuugcuggauugacuauaacuuaagugcugauugugau

SEQ ID NO: 164949 - RNA, 64 nt, hsa
gaacuuaggaaauaaggagggaaguacaaagauuauugacuauacaaccuaccagcugaaagaa

SEQ ID NO: 164950 - RNA, 64 nt, hsa
uuccuuagcaaaauguuggaaucccuguugcuacauugacuaaaaggucaugaugaauggaaua

SEQ ID NO: 164951 - RNA, 64 nt, hsa
uauguuauaauuauuagacaguggaaaagccuuuauugacuaauugauuuaaccucaguccaaa

SEQ ID NO: 164952 - RNA, 64 nt, hsa
cuuaccuagcccacccaaccuuauaaacaugauaauugacuacuuuccugagcuaaauuaacuu

SEQ ID NO: 164953 - RNA, 64 nt, hsa
gagcaaggaauacaagacaaaacuuccucaaugcauugacuauuucuucagacucaaaacacuc

SEQ ID NO: 164954 - RNA, 64 nt, hsa
uuugcuuuaccguauguuuauaucuaauugacauauugacuaauguuugaaagaauucaaccau

SEQ ID NO: 164955 - RNA, 64 nt, hsa
gcgagauggguuuguucggugccagccgaccaagauugacuaguuuguuggacuuaaacgacga

SEQ ID NO: 164956 - RNA, 64 nt, hsa
acugaagggcacuaauguuucccccaggauuucuauugacuagucaggaguaacagguucacag

SEQ ID NO: 164957 - RNA, 64 nt, hsa
cuguguguugagcuaaaaauauaauuuuuuaaaaauugacuagcaaaaucuauggccacacuga

SEQ ID NO: 164958 - RNA, 64 nt, hsa
auaaauaauuacuguuuaugauauagacauugauauugacuauuuagagaaccguuguuaauuu

SEQ ID NO: 164959 - RNA, 64 nt, hsa
cuuucuccugaaacaauuuagaaaauaguuauccauugacuagaaauuaguacaugcccacagc

SEQ ID NO: 164960 - RNA, 64 nt, hsa
uuggaaacacugcucuugcugaacugucuugaccauugacuaugacacaguuucuuauuuaugu

SEQ ID NO: 164961 - RNA, 64 nt, hsa
ugaaacaaagaaaacuacaagcuggaguguaggaauugacuauagcaauuugauacauuuuuaa

SEQ ID NO: 164962 - RNA, 64 nt, hsa
agucucaagcuaugccucuaauuucaccagggauauugacuaagaagacaauaaaaucuuuuuc

SEQ ID NO: 164963 - RNA, 64 nt, hsa
uaaauaaguuuuacaaaauuuuccucuuuuguuuauugacuagauuguauauaauuuucuuuuu

SEQ ID NO: 164964 - RNA, 64 nt, hsa
gaaugaaaccuguuucaacauggaaaugaucuguauugacuaauacaccaguccacacuucuau

SEQ ID NO: 164965 - RNA, 64 nt, hsa
gauugaaaccugguucaacauggaaaugauccugauugacuaauacauuaucucacacuuucau

SEQ ID NO: 164966 - RNA, 64 nt, hsa
gauugaaaacugguucaucauggaaaugauucucauugacuaaugcaucaucucacacuuucau

SEQ ID NO: 164967 - RNA, 64 nt, hsa
gauugaaaacugguucaacauggcaaugauccugauugacuaauacauuaucucacacuuucau

SEQ ID NO: 164968 - RNA, 64 nt, hsa; identical to SEQ ID NO: 164967

SEQ ID NO: 164969 - RNA, 64 nt, hsa
gauugaaaacugguucaucauggaaaugauucucauugacuaauacaucaucucacacuuucau

SEQ ID NO: 164970 - RNA, 64 nt, hsa
auguugcacaucauucauucacuguauaguaaucauugacuaaagccauuugucuguguuuucu

SEQ ID NO: 164971 - RNA, 64 nt, hsa
ccauucauuacauaguauaaggaauucacaguauauugacuauauagugucuaaugaucuuggg

SEQ ID NO: 164972 - RNA, 64 nt, hsa
aauucacaauuuugauuuuccuggcuuuucaggaauugacuaacuguaaaagagucuugaaagu

SEQ ID NO: 164973 - RNA, 64 nt, hsa
auuguuuuuauuucuguaacaauugcuuccaaauauugacuacuaaaggcaguucugcaagaug

SEQ ID NO: 164974 - RNA, 64 nt, hsa
uugucuuccuaauugggauaauuuaauuaacaagauugacuagaagugaaacugcaacacuaac

SEQ ID NO: 164975 - RNA, 64 nt, hsa
cuugauaaucauauuauaauuuuuuaucaugauuauugacuauauuuuuggagucccauuguuu

SEQ ID NO: 164976 - RNA, 64 nt, hsa
uguuggguacauuguuuugugugugucaggugacauugacuaauccuguugcucagagcuccug

SEQ ID NO: 164977 - RNA, 64 nt, hsa
auucacauucucuuauaguuuggaugggaagacuauugacuauuucagaaacagacuuauuuca

SEQ ID NO: 164978 - RNA, 64 nt, hsa
cacauuuccuagucuuaacuuucaggaguuuacaauugacuaacacuccaugauugauucaguc

SEQ ID NO: 164979 - RNA, 64 nt, hsa
gagaaaaggugucuuuccagccugaauuuuucagauugacuagaccaagcagaaucucucaacc

SEQ ID NO: 164980 - RNA, 64 nt, hsa
ggaucugugccacaggggauuuaugcugcuuuacauugacuaugcaguugaagaguugcacauc

SEQ ID NO: 164981 - RNA, 64 nt, hsa
gcugcuaugcugaaaugaacuuuuauaaaguauuauugacuauagccaacuacagauggcauau

SEQ ID NO: 164982 - RNA, 64 nt, hsa
uccugccaacaugguuuggagucgacuuugguauauugacuagauuugaaaauacaagauugau

SEQ ID NO: 164983 - RNA, 64 nt, hsa
aucucuuuuauuucacucaauuuauauuuucaucauugacuacauauuucuuauacacaacaca

SEQ ID NO: 164984 - RNA, 64 nt, hsa
uaguguaaaauggaucuuuacauguugcaguaacauugacuauguuucaaaacucagaugcaua

SEQ ID NO: 164985 - RNA, 64 nt, hsa
gugauuccuaauauuuuguacucacagagaacuaauugacuaaacaacuugaacgcuagugguu

SEQ ID NO: 164986 - RNA, 64 nt, hsa
ccuggccagcauuguggcuugucaugucagccccauugacuaccuucucaugcucugagguacu

SEQ ID NO: 164987 - RNA, 64 nt, hsa
cuuaggcguucuaaucaugagaucuuggggacaaauugacuaugucacagguugcucuccuugu

SEQ ID NO: 164988 - RNA, 64 nt, hsa
aaagauugccucuugaauuaaaaaaaaaaacuagauugacuauuuauacaaaugggggcggcug

SEQ ID NO: 164989 - RNA, 64 nt, hsa
auacacugaaauacuccugaagaugguggugcuuauugacuacaagaggaaauucuacaggauu

SEQ ID NO: 164990 - RNA, 64 nt, hsa
ggaaguuuagguccuuuaaaaaaacauauuaaucauugacuacaucuaugauaaaagugcuuau

SEQ ID NO: 164991 - RNA, 64 nt, hsa
ucauacaccuucuggguagggaaacaaccaacuaauugacuaacaccaccaacaacaaaaaaca

SEQ ID NO: 164992 - RNA, 64 nt, hsa
cuaauuauuaaccuauauucuugccaagcuaacuauugacuauagguuugccuuuccuggagaa

SEQ ID NO: 164993 - RNA, 64 nt, hsa
uaaacagaagcccuggccauccauguauuuugcaauugacuagaucaagaacuguuuauagcuu

SEQ ID NO: 164994 - RNA, 64 nt, hsa
uugcaucuaauuccaggagcauuguuuuaaguugauugacuaguuauuauguacauuucagaau

SEQ ID NO: 164995 - RNA, 64 nt, hsa
uaugugauacaaagcaaauauuuucuaaauauucauugacuaaacagccaucaagaugaaacag

SEQ ID NO: 164996 - RNA, 64 nt, hsa
aaaccuuacaaauaauaaggaaacauguucacuuauugacuauuauagaauggaacucaaggaa

SEQ ID NO: 164997 - RNA, 64 nt, hsa
gugaagucacaucuaccuauuacucccagcauugauugacuauaagaaaggaugcaccuguacu

SEQ ID NO: 164998 - RNA, 64 nt, hsa
uaaguggcccacaucauggggaaggagugcugugauugacuaguaauggcuaccacgggaaagg

SEQ ID NO: 164999 - RNA, 64 nt, hsa
cuguagcacaaauaauauaauuuauaauuuacaaauugacuaaaauuggguauaguaugguauu

SEQ ID NO: 165000 - RNA, 64 nt, hsa
cuguguguguuaauauguuuuucuuguagcauagauugacuauuugcaauaguauuaguauuua

SEQ ID NO: 165001 - RNA, 64 nt, hsa
uguggucacaugcuuuagccauacacaugguaacauugacuauggagucuugugaaaguguaau

SEQ ID NO: 165002 - RNA, 64 nt, hsa
acauuuuuuaaaaaaagaaaauggaugaccauuaauugacuagcauuuuagaauugaucagaca

SEQ ID NO: 165003 - RNA, 64 nt, hsa
uuuucauaaucccaacuacaauaacaagaauuuuauugacuaauaagggaauauguauggaaga

SEQ ID NO: 165004 - RNA, 64 nt, hsa
aacgugaugagacaaacugaaaauuauugcaagcauugacuauaauuaugcaguacguucucag

SEQ ID NO: 165005 - RNA, 64 nt, hsa
cuuguccaucugucuguguuucuuuuugccagcuauugacuaaucuuugcugaagcugagcuag

SEQ ID NO: 165006 - RNA, 64 nt, hsa
ggguacucugccauagaaauggcagauuaagaagauugacuauaccaaacauuauauuaaaaac

SEQ ID NO: 165007 - RNA, 64 nt, hsa
uuucugugccuauuuaaagucuccuaaagguguaauugacuaggaaggauguaguucuacacug

SEQ ID NO: 165008 - RNA, 64 nt, hsa
agggcuuauuucugaggaaugaaagguucccaucauugacuauggauguggaaaaccuuuccua

SEQ ID NO: 165009 - RNA, 64 nt, hsa
gacuguuggcaagaguagcaagaugcugcagcacauugacuauagaaugagauguauccugcaa

SEQ ID NO: 165010 - RNA, 64 nt, hsa
cacagggaccccagugcaucagcugaacgagaccauugacuacaacgagcaguucaccuggcgu

SEQ ID NO: 165011 - RNA, 64 nt, hsa
uuuccaaaggauacuuccuuggcccuuuuucuuuauugacuagaccaccagaggaggaugugug

SEQ ID NO: 165012 - RNA, 64 nt, hsa
agggcuuauuucugaggaaugaaagguucccaucauugacuacgguuguggaaaaccuuuccua

SEQ ID NO: 165013 - RNA, 64 nt, hsa
uuacaaauaggcaaacaacauaacuuugcccuggauugacuacauauuuuuaaaccuucaaguc

SEQ ID NO: 165014 - RNA, 64 nt, hsa
aaagcuuguuuuauuucaccacuguaggaaaaugauugacuaugcccaucccuggggguaauuu

SEQ ID NO: 165015 - RNA, 64 nt, hsa
cgugugauggugagugcaaugaggaaggguggauauugacuaaagacugguuguuguuguuguu

SEQ ID NO: 165016 - RNA, 64 nt, hsa
ugggugaaugagcuugucaaugugauuuuaaaaaauugacuaccuggaggaaugauuaggaauc

SEQ ID NO: 165017 - RNA, 64 nt, hsa
auacagguaguuuuaaaaguacccuuuugugugaauugacuaccguuguuugcaaacccgaaaa

SEQ ID NO: 165018 - RNA, 64 nt, hsa
gacaaugcaaaauuuguaguuaaauuugaccucaauugacuacaaaauuuguaguuaaauuuga

SEQ ID NO: 165019 - RNA, 64 nt, hsa
aacuuuggucuucuguauuuuggacuaaauacuaauugacuagagugcuguaaacuugcuguaa

SEQ ID NO: 165020 - RNA, 64 nt, hsa
guugggauuauuguuggcauuacagauguaaaagauugacuagcccauaggccaaaggccuguu

SEQ ID NO: 165021 - RNA, 64 nt, hsa
aacauuauuuacucggauucuaauuuaaugugacauugacuauaagaaggucugauaaacugau

SEQ ID NO: 165022 - RNA, 64 nt, hsa
uaagaaaccagaauagucaacaguguucaaaagaauugacuaguuaucccugaggcccuuucaa

SEQ ID NO: 165023 - RNA, 64 nt, hsa
uuuucacugugcaaagggagauuucuagccaggcauugacuauuacaauuucauuuugguggag

SEQ ID NO: 165024 - RNA, 64 nt, hsa
auucaauaaccuuguccauuuucauauuuuuuuuauugacuauuugaugguaaguuacauuuuu

SEQ ID NO: 165025 - RNA, 64 nt, hsa
acccugccaaguuauuuuaaaauguaccauuauuauugacuauagucaccugguuguguuauca

SEQ ID NO: 165026 - RNA, 64 nt, hsa
uuaucaaaccacagccaugcuuacuuguuuagcuauugacuauggcugcuuuagacaacuguga

SEQ ID NO: 165027 - RNA, 64 nt, hsa
gauauauauuaaacagaaaucuaaguagaacugcauugacuaaccagucccucuggaugguggu

SEQ ID NO: 165028 - RNA, 64 nt, hsa
cuaccuacauacugccacuccauuucauuaagcuauugacuagcacauccaucucggccuauag

SEQ ID NO: 165029 - RNA, 64 nt, hsa
gcccccguggucgccugguggcuggacccccgggauugacuagagaccggccguacaccuucug

SEQ ID NO: 165030 - RNA, 64 nt, hsa
aaucauguuaguuaauccauuagguuaguuccuaauugacuaugacuguguccuuagaaaaaug

SEQ ID NO: 165031 - RNA, 64 nt, hsa
ucggccgcacacuuccagacagugugcuguuugaauugacuauuugcacucaaagucuggguau

SEQ ID NO: 165032 - RNA, 64 nt, hsa
gucauuuauuaccuaggguacaguccuugacagaauugacuauaacguugaacaguccuguauc

SEQ ID NO: 165033 - RNA, 64 nt, hsa
cuauaauuacaagguuuuauuccuauuuaauguuauugacuauagcagauuuuggaaaucagug

SEQ ID NO: 165034 - RNA, 64 nt, hsa
uauccauguguaugugguuagacauuuuuauuucauugacuaacccaggacaguuucagugaug

SEQ ID NO: 165035 - RNA, 64 nt, hsa
uuuaguuuaaacccaagaagggcacuaaacucagauugacuaaauaaaaaguacaaagggcaca

SEQ ID NO: 165036 - RNA, 64 nt, hsa
accauguaccauguguuagaguuggcaaaaugugauugacuagagauggacaugaauugauaug

SEQ ID NO: 165037 - RNA, 64 nt, hsa
gguauuuuguagaugugacagaaguccauucccaauugacuaaguaagugagauuaucucagau

SEQ ID NO: 165038 - RNA, 64 nt, hsa
ggcccuacuagaugcagagaccccgcagagcugcauugacuaccagauuuauuuuuuaaaccag

SEQ ID NO: 165039 - RNA, 64 nt, hsa
ugaaauacuguacguacgcuuaaucuaaauuugcauugacuauguuuuaguguauuuauaaaug

SEQ ID NO: 165040 - RNA, 64 nt, hsa
aauauuuuauuuuggaguggcuguguacucucccauugacuagauggaccauugugccaguugc

SEQ ID NO: 165041 - RNA, 64 nt, hsa
agccaaauuccauauguaaugccauugggagaguauugacuaaaauaucauucgucagggaaau

SEQ ID NO: 165042 - RNA, 64 nt, hsa
ccuuuucccccgcuugcugugaaagcacagauucauugacuacaguacacuguuguucagaaaa

SEQ ID NO: 165043 - RNA, 64 nt, hsa
ccuuguuuaacuuggaaucuauuauuauuaaucaauugacuauuaaaucugguuaaauaguuca

SEQ ID NO: 165044 - RNA, 64 nt, hsa
agcacagcaaucugcaacaauauguaaaguugauauugacuacaauaaaaauccagucuuaauu

SEQ ID NO: 165045 - RNA, 64 nt, hsa
augggucagcaugaccauuaauuacugaguagaaauugacuaaacuuugauuuccuuuuuuuaa

SEQ ID NO: 165046 - RNA, 64 nt, hsa
uaacuugauaaucuuauuuuggcauucuuuucccauugacuauauacaucucuauuucucaaau

SEQ ID NO: 165047 - RNA, 64 nt, hsa
uugguuaguccaaacuugcuaacauacgaaaauucacuuggaacaugaugagagauuucuuauu

SEQ ID NO: 165048 - RNA, 64 nt, hsa
ugauuccccagcucaucucccugguugcauggcccacuuggagcugaggucucauacaaggaua

SEQ ID NO: 165049 - RNA, 64 nt, hsa
gggcggaaacaucacacacaagguuuccacuucacacuuggaggguugcauggcggcugggcaa

SEQ ID NO: 165050 - RNA, 64 nt, hsa
ccucucugcucauugggccuuacaugaugggugacacuuggaguggcacaaguugggggaaagc

SEQ ID NO: 165051 - RNA, 64 nt, hsa
ugcucagucaaggggcugccaggcccccagaaaacacuuggagccaucggguagcgauggucua

SEQ ID NO: 165052 - RNA, 64 nt, hsa
gccccaggccuccccagucccagugugcgagccccacuuggacacaaguguucagagagguccc

SEQ ID NO: 165053 - RNA, 64 nt, hsa
auggugacuggaacuaaggcuacacagagggucgcacuuggacucugaggguuggguguggaag

SEQ ID NO: 165054 - RNA, 64 nt, hsa
uuuguaauaaauguaauuucuuuccuuuuuuggacacuuggaucuaaaugauguaaagcaaaac

SEQ ID NO: 165055 - RNA, 64 nt, hsa
ccagggcagggaggcuuccagccuguguuccccucacuuggaggaaccagcacucuccauccuu

SEQ ID NO: 165056 - RNA, 64 nt, hsa
ggaagggcugggaagagacagccuccaaggucaacacuuggagaggguuucacuugcucugaag

SEQ ID NO: 165057 - RNA, 64 nt, hsa
uaauaaucagcaagaauuugaucguuccaguucccacuuggaggccuuucaucccucgggugug

SEQ ID NO: 165058 - RNA, 64 nt, hsa
auacuuuuuucccuuuauuacuguuguagucccucacuuggauauaccucuguuuucacgauag

SEQ ID NO: 165059 - RNA, 64 nt, hsa
guguacaccuggcaucuguggcauguguucuggucacuuggagaagggcauguguggggugugu

SEQ ID NO: 165060 - RNA, 64 nt, hsa
guggugugggcgcgucugugguguguguccuagucacuuggagaagggugugugugggaugcgu

SEQ ID NO: 165061 - RNA, 64 nt, hsa
agcuucugucccucaugccugagggcacgggggacacuuggaggcugcugucaccacugugcgu

SEQ ID NO: 165062 - RNA, 64 nt, hsa
cccagggucagccaggaccuguuacagcccuggucacuuggaacugacagcugugugaggccug

SEQ ID NO: 165063 - RNA, 64 nt, hsa
ggaaccaauuauguauuuguuuccuccuacaguggagcagcauucaaaucaaauauuuacauau

SEQ ID NO: 165064 - RNA, 64 nt, hsa
gaaaaagugaaaaacuugaguuggcaaagaugcagagcagcagugcagauggcaaugaacucuc

SEQ ID NO: 165065 - RNA, 64 nt, hsa
cccugggaccaagagcucucccgccuucucccucgagcagcagcaaggacccugacgcuguccc

SEQ ID NO: 165066 - RNA, 64 nt, hsa
aagaggccaaagcaagagcagauucccuaggcaagagcagcagcacaacuaggaaaccccaaag

SEQ ID NO: 165067 - RNA, 64 nt, hsa
cauggaugccaagcggaggccugcguggccuccugagcagcagcugaccgcccgucucaugcug

SEQ ID NO: 165068 - RNA, 64 nt, hsa
cagggacgccgugcggaggccuacguggcugccugagcagcagcugaccgcccgucucacuguu

SEQ ID NO: 165069 - RNA, 64 nt, hsa
uacccuagggaagagccggugacgugcacaggccgagcagcacggcuggugagcugcaggcugc

SEQ ID NO: 165070 - RNA, 64 nt, hsa
cccacuucccagcagcucugugguaguggggcgggagcagcagggacguaccuuaagauuucuc

SEQ ID NO: 165071 - RNA, 64 nt, hsa
uucgagaaccagaggagaagagcauagggucauggagcagcagccucgucuuacagcgugacug

SEQ ID NO: 165072 - RNA, 64 nt, hsa
agcuguugagcaacaccuuuaugaaauguugccagagcagcaacacuucccugugggcacagcc

SEQ ID NO: 165073 - RNA, 64 nt, hsa
aaaaagcuuaaacauuucaccagaaaucuuaauugagcagcagucauaucgccacagcuuugug

SEQ ID NO: 165074 - RNA, 64 nt, hsa
caauggcgcugugcggccucaccaggcccacgaggagcagcagcgcucggcccggagcagcagg

SEQ ID NO: 165075 - RNA, 64 nt, hsa
accaggcccacgaggagcagcagcgcucggcccggagcagcaggaaggccccucuguggagcgc

SEQ ID NO: 165076 - RNA, 64 nt, hsa
caguugcccgaaacuaagccaggccuggcuggaggagcagcagcuuggggagagggauuucccu

SEQ ID NO: 165077 - RNA, 64 nt, hsa
accugcucuguccccaaaggacgccugcaggagagagcagcacuccgcaucaccucaccaagga

SEQ ID NO: 165078 - RNA, 64 nt, hsa
cuuaguguucuccaggcucuguggcccaggcugagagcagcaggguagaaaagaccaagauuug

SEQ ID NO: 165079 - RNA, 64 nt, hsa
acuccucccucagugguaguguccaggugccguggagcagcaggcuggcuuugguaggggcacc

SEQ ID NO: 165080 - RNA, 64 nt, hsa
uccccaggcccucacugggagcccuugguguucugagcagcagggcccaggcagcacaugagca

SEQ ID NO: 165081 - RNA, 64 nt, hsa
acuggcgccaucagggccucccuugcccgccugagagcagcagcagucucugucaucccgucgc

SEQ ID NO: 165082 - RNA, 64 nt, hsa
cucuugaccuuccacccacuccccuccagggagagagcagcagagaccucaucagcagaccaag

SEQ ID NO: 165083 - RNA, 64 nt, hsa
uccccucauccacuugagggcgccugagggccaggagcagcaggcaaggagccugggucuaggc

SEQ ID NO: 165084 - RNA, 64 nt, hsa
ccggcugccgggggggacucaacagcagagcucugagcagcagcaggcaacuucgagaacggau

SEQ ID NO: 165085 - RNA, 64 nt, hsa
caagauuuuacuucaaauuacaccuucaaaacuggagcagcauauagccgaaaaggagcacaac

SEQ ID NO: 165086 - RNA, 64 nt, hsa
auauaagaguacucauguuuauuuauuuccaacugagcagcaaccuccuuuguuucacuuaugu

SEQ ID NO: 165087 - RNA, 64 nt, hsa
uccagaccccccuccccgcugccugcaccgccuggagcagcaugggggucagaccccugcucca

SEQ ID NO: 165088 - RNA, 64 nt, hsa
agucuccagcccacccuccgcaccguccccuccugagcagcacucggcgccagcagccucugcc

SEQ ID NO: 165089 - RNA, 64 nt, hsa
caaaaugcgggcugggcaggcagcucggggcagggagcagcagugcaggccuggccuguguccc

SEQ ID NO: 165090 - RNA, 64 nt, hsa
ccuggccuguguccccgugcccagcgggcucccggagcagcauuccagagccuccugcagagcc

SEQ ID NO: 165091 - RNA, 64 nt, hsa
guaauagcuuauuugcccuauaagaaccuucccagagcagcagaggcccuucuacucccucuug

SEQ ID NO: 165092 - RNA, 64 nt, hsa
uacccuccaauucagacucagcugacuguugagagagcagcacaucauuuuaucauuuuaucuu

SEQ ID NO: 165093 - RNA, 64 nt, hsa
cagccagcagcacagucucuauggugcugaggaagagcagcagcagcaggauggugaaguagua

SEQ ID NO: 165094 - RNA, 64 nt, hsa
aggccugugcccacugcugcuccauguguaccaagagcagcagggcagaagggcccucccucca

SEQ ID NO: 165095 - RNA, 64 nt, hsa
gacuuugggggacaggcuucuccugugagcagcagagcagcacaauaaaugaggccacugugcc

SEQ ID NO: 165096 - RNA, 64 nt, hsa
aggaagaggacuuugggggacaggcuucuccugugagcagcagagcagcacaauaaaugaggcc

SEQ ID NO: 165097 - RNA, 64 nt, hsa
gucuccgaggcccucugggagggccccacaucuggagcagcaccucagaguggacagaaagcau

SEQ ID NO: 165098 - RNA, 64 nt, hsa
uugcgucaggcaaggucaccugcauuuauuuauugagcagcagugcugugucaggcccagggac

SEQ ID NO: 165099 - RNA, 64 nt, hsa
aggaaggggacucugggggacuggcuuccccugugagcagcagagcagcacaauaaaugaggcc

SEQ ID NO: 165100 - RNA, 64 nt, hsa
gacucugggggacuggcuuccccugugagcagcagagcagcacaauaaaugaggccacugugcc

SEQ ID NO: 165101 - RNA, 64 nt, hsa
aggaaggggacucugggggaccggcuuccccugugagcagcagagcagcacaauaaaugaggcc

SEQ ID NO: 165102 - RNA, 64 nt, hsa
gacucugggggaccggcuuccccugugagcagcagagcagcacaauaaaugaggccacugugcc

SEQ ID NO: 165103 - RNA, 64 nt, hsa
gacuuugggggacgggcuuccccugugagcagcagagcagcauaauaaaugaggccacugugcc

SEQ ID NO: 165104 - RNA, 64 nt, hsa
aggaagaggacuuugggggacgggcuuccccugugagcagcagagcagcauaauaaaugaggcc

SEQ ID NO: 165105 - RNA, 64 nt, hsa
cauucuaucagugcugccuuuagcuauacucagagagcagcaguugaggaauagguuuuuacuc

SEQ ID NO: 165106 - RNA, 64 nt, hsa
aaacugccaaaguuuggguuuauaucuucccuuugagcagcauucuaucagugcugccuuuagc

SEQ ID NO: 165107 - RNA, 64 nt, hsa
uaauaggaaaauguauuucuguauaagaguucuuugcuuucauuaacuuggauucauuuaaaaa

SEQ ID NO: 165108 - RNA, 64 nt, hsa
guaaguaaccagaagaccuuucagaugguuuauuugcuuucagcagagaauuuauuucauacag

SEQ ID NO: 165109 - RNA, 64 nt, hsa
uggcuacgugauauuugaagggaaggauaaguguugcuuucaguaguuauugccaauauuguug

SEQ ID NO: 165110 - RNA, 64 nt, hsa
ugugagccuaggguaggggcacugcugcaacuucugcuuucaucccaugccucaucaaugagga

SEQ ID NO: 165111 - RNA, 64 nt, hsa
cuggaaugucuucacugcagcugcuggaaaucacugcuuucauucccacaaaaccaguauuacu

SEQ ID NO: 165112 - RNA, 64 nt, hsa
uuguuuuccuguuuaggcuuugcacaaauacaauugcuuucaggaauccuaaagcagcauuuua

SEQ ID NO: 165113 - RNA, 64 nt, hsa
acacagccacacucauucauuuauuuucugugguugcuuucaagcuacaauuguagaguugggu

SEQ ID NO: 165114 - RNA, 64 nt, hsa
uaguuugagaucucucaaaaauaaaaauaaaaauugcuuucagagaguagcccaugaaauuucc

SEQ ID NO: 165115 - RNA, 64 nt, hsa
cuuguuucccagccugcaccuuagaagccgaaggugcuuucaucagaacccuaaaauggucguu

SEQ ID NO: 165116 - RNA, 64 nt, hsa
gagaaggaaggggauaggcagcuuugacaggugcugcuuucaauuccucugcaacuccuccccc

SEQ ID NO: 165117 - RNA, 64 nt, hsa
uuccauaauauaugucacucaaaaguuacaugguugcuuucacuuaaggaucauuguggaguuu

SEQ ID NO: 165118 - RNA, 64 nt, hsa
cugauaggagguguugggugguguuauuccgcagugcuuucagucuuccaugugagcucgugcu

SEQ ID NO: 165119 - RNA, 64 nt, hsa
aauguaagugauaagaauaagauuagacagauuuugcuuucacaguagagucucauuauagucc

SEQ ID NO: 165120 - RNA, 64 nt, hsa
gauuaacguugauuucauuccaugcacuuagaguugcuuucaguaacauuuuaccccuacuccc

SEQ ID NO: 165121 - RNA, 64 nt, hsa
auguccuuccaaaaauguuguuguguacaaaccaugcuuucaauguuggcuuccaaguuuuuua

SEQ ID NO: 165122 - RNA, 64 nt, hsa
gucucauacuaaccaagaagcaagaaaagccccaugcuuucauuuuucacuuggagugacaaug

SEQ ID NO: 165123 - RNA, 64 nt, hsa
cacaugguuggauuuuuuuuuuuuuuuugaguugugcuuucacaaaaccuugucaaagaccuca

SEQ ID NO: 165124 - RNA, 64 nt, hsa
cuaggcaaagcaauacaucgguccaaggauuuucugcuuucauuucuuuaaaaguuuuuuguua

SEQ ID NO: 165125 - RNA, 64 nt, hsa
uuucacucugggaggagaggguggagaaagcacuugcuuucauccucuggcaucggaaacuccc

SEQ ID NO: 165126 - RNA, 64 nt, hsa
gaggcugguuguacaaugcccacgccugccuggcugcuuucaccugggagugcuuucgaugugg

SEQ ID NO: 165127 - RNA, 64 nt, hsa
gacuggcuccguugaguuaaugacuagaauauagugcuuucacuacuugauuguuaaccuguuu

SEQ ID NO: 165128 - RNA, 64 nt, hsa
guggccgcugccccagcuacagagacggccgaaaugcuuucacuccuuagcuuugccaacucca

SEQ ID NO: 165129 - RNA, 64 nt, hsa
aaauguuaaaucaauauguuguugcaauuuagcuugcuuucaagcuucaccccuugcacuuaac

SEQ ID NO: 165130 - RNA, 64 nt, hsa
uuuauuuauuuucaagagggaaaguggucuguacugcuuucauccuugccacugucuugcuuuu

SEQ ID NO: 165131 - RNA, 64 nt, hsa
ucagagagguuuuauuucaauuaauuuguucuagugcuuucaagagcaaguacaucaaaaugua

SEQ ID NO: 165132 - RNA, 64 nt, hsa
ugaagcugauccuauuuaguuaaaaagauaauuuugcuuucaacuguagguccagaaaacuaau

SEQ ID NO: 165133 - RNA, 64 nt, hsa
uuuaauguaugcauaguuucauauuuaaugaauaugcuuucauuaaauagggagguagauuuga

SEQ ID NO: 165134 - RNA, 64 nt, hsa
ugccacguuagccacuaaaucugaacuuuuacccugcuuucaucauggauuuuuuuguguaacc

SEQ ID NO: 165135 - RNA, 64 nt, hsa
auauacaaagcugucacucacaaaaggcuggaugugcuuucauccaacuggaaggcuuuauucu

SEQ ID NO: 165136 - RNA, 64 nt, hsa
guuucugcaguauucuguagccaacuuaaaccugugcuuucauguuuaagaaaugagaaauugu

SEQ ID NO: 165137 - RNA, 64 nt, hsa
gaagauugucaaaaccagaagcugugggaugaagugcuuucacaucuuguggaaggaccaguau

SEQ ID NO: 165138 - RNA, 64 nt, hsa
cuucccuggcuacagcaaaggacgaugaucugccugcuuucacuguguuguucaugguggcuuu

SEQ ID NO: 165139 - RNA, 64 nt, hsa
ugugcuuucauuauuauagaugcaucaugucuucugcuuucacgugucugggauggggucagaa

SEQ ID NO: 165140 - RNA, 64 nt, hsa
agcuguucacggugugauaauacucuuuagauugugcuuucauuauuauagaugcaucaugucu

SEQ ID NO: 165141 - RNA, 64 nt, hsa
uaguuuuggggauacguccaucuuuuuaagggauugcuuucaucuaauucuggcaggaccucac

SEQ ID NO: 165142 - RNA, 64 nt, hsa
uaauuuucaccgagcagagguggaaaaauacuuuugcuuucagggaaaaugguauaacguuaau

SEQ ID NO: 165143 - RNA, 64 nt, hsa
caacuugagauucuuccuagccuaguagcugcugugcuuucaugcuuuggauaucagauaucuu

SEQ ID NO: 165144 - RNA, 64 nt, hsa
cauaucauauucacuuugagaaucgguuugacuuugcuuucaaacaaaacaaaaaccucuugcu

SEQ ID NO: 165145 - RNA, 64 nt, hsa
cuugcuguauuucuuauaccauuuauuaaaaagcugcuuucacgguaaaauuauguugguuuga

SEQ ID NO: 165146 - RNA, 64 nt, hsa
aguacaaacauugauguauaaugacaguauaaaaugcuuucauguuugugaugucuagugaugu

SEQ ID NO: 165147 - RNA, 64 nt, hsa
cugcaaguaaaaguaaauccuguguugugacuggugcuuucauauauuugugacaauuuuugag

SEQ ID NO: 165148 - RNA, 64 nt, hsa
uuucagucaaagagggccucucuuacaucuuguuugcuuucaaauccccaaauaucaucuccau

SEQ ID NO: 165149 - RNA, 64 nt, hsa
ggaggagucagucgugguuggagguucauugccgugcuuucaugcagaguguuuugccuucaug

SEQ ID NO: 165150 - RNA, 64 nt, hsa
caguuuuuuaaaaagagacuguauacacuugauuugcuuucaaaauaaauaaggucagcuaguc

SEQ ID NO: 165151 - RNA, 64 nt, hsa
aucaucuguguaagugaagggacucauuuuucuuugcuuucagcccauguaaauaaauaauaca

SEQ ID NO: 165152 - RNA, 64 nt, hsa
uuuggcuugcagggguggguuuagauuugaaguuugcuuucaguuuacuaucagggauuucuuu

SEQ ID NO: 165153 - RNA, 64 nt, hsa
gcaucuuuggcuucucauaauuuuaaacagucauugcuuucaagaucaugcuaaacaagaauua

SEQ ID NO: 165154 - RNA, 64 nt, hsa
auuguaugauuuuaucuaaaguaaaauucuagacugcuuucacuuauuucauuuccuccccaua

SEQ ID NO: 165155 - RNA, 64 nt, hsa
ccuuuuuuuagaccaaugccuaugccauccuccaugcuuucaguuugaguuuuauuauuuauua

SEQ ID NO: 165156 - RNA, 64 nt, hsa
agaaagaggugauuauggagggaaucaaaaauacugcuuucaguuaguagcuagcuuuaaguca

SEQ ID NO: 165157 - RNA, 64 nt, hsa
agcauccaaucgugaagaacucgggagaggguggaguccacaucuaggguuguccugccccuug

SEQ ID NO: 165158 - RNA, 64 nt, hsa
gaugcuguggccuguggaaggcaccugguaguugaguccacacauuauagucaugugccaccac

SEQ ID NO: 165159 - RNA, 64 nt, hsa
ccaagcuagugaugggccauuuacccuugaccccaguccacaguggucacagguaguaccuggu

SEQ ID NO: 165160 - RNA, 64 nt, hsa
aaaaacacacacagaaaucgcuugagugaggaaaaguccacauggcagagacagguauggucca

SEQ ID NO: 165161 - RNA, 64 nt, hsa
guauaucgauuagcugugucacuuuuaaauaagaaguccacacaagcaagccaaauuuuuagau

SEQ ID NO: 165162 - RNA, 64 nt, hsa
cagacaacacacuuccugacguaaugcaauaggaaguccacaccaccaucuacaaagccuuauu

SEQ ID NO: 165163 - RNA, 64 nt, hsa
ucaccuucuacugguagaaguaaguuacuaggauaguccacacucaagagaacgggaugauaca

SEQ ID NO: 165164 - RNA, 64 nt, hsa
ucaacccugcuguucagacuugauaagaucucagaguccacaggaaagaagucacuguugcaau

SEQ ID NO: 165165 - RNA, 64 nt, hsa
ucugucuggaaacaggacacaucuugccaccacaaguccacaccuggccuuggcugcugcccgc

SEQ ID NO: 165166 - RNA, 64 nt, hsa
cccaacagcugucuccaguucuaguuccuugguuuucaggcacagugggggauguucugcaccc

SEQ ID NO: 165167 - RNA, 64 nt, hsa
ggccaaggcuucucccugucggugaaggaucauguucaggcacuccaagugaaccaccccucuu

SEQ ID NO: 165168 - RNA, 64 nt, hsa
auauauagcuugaaagcaguuaaacugauuaguauucaggcacugagaaugauaguaauaggau

SEQ ID NO: 165169 - RNA, 64 nt, hsa
uuaaaaaugcacaccucaugagucuaccugagcauucaggcagcacugacaauaguuaugccug

SEQ ID NO: 165170 - RNA, 64 nt, hsa
cagacauucuuuaucaagaggucggcccuucuuuuucaggcacauaagccaaaugcaggccugu

SEQ ID NO: 165171 - RNA, 64 nt, hsa
acauaccuuaauaguuuuauaaaauuguugacauuucaggcaaauuuggccaauauuaucauug

SEQ ID NO: 165172 - RNA, 64 nt, hsa
caucugugcuuagucucugacauaggaagcuugcuucaggcaauggcuuuggauugaguuugag

SEQ ID NO: 165173 - RNA, 64 nt, hsa
acuccuaagaaacgaaagauuccuucaaagccuuuucaggcacaugguuucaacaaagccuggc

SEQ ID NO: 165174 - RNA, 64 nt, hsa
cauaaauaaugcuauuguuuaugauuugaaaacuuucaggcaaaauccaauuuacauuuuuccc

SEQ ID NO: 165175 - RNA, 64 nt, hsa
uugauuuaaaugaugugugagauguuucaccauuuucaggcacuguguaauucuauuguaauaa

SEQ ID NO: 165176 - RNA, 64 nt, hsa
cuuuuuauacucuuguuaucaaaauggcuuauuuuucaggcacuaaggauuguuaagagaaaag

SEQ ID NO: 165177 - RNA, 64 nt, hsa
cgaucucggcucacugcaacuucagccuccuggauucaggcaacacuccugccucagccuccca

SEQ ID NO: 165178 - RNA, 64 nt, hsa
ggcauauguaugcaauggaaagccacuagaaaucuucaggcacacagauaaugacaaugcaggu

SEQ ID NO: 165179 - RNA, 64 nt, hsa
ccaguuuccauugguaggaaauuuuuuagguaaguucaggcauauguaugcaauggaaagccac

SEQ ID NO: 165180 - RNA, 64 nt, hsa
agugagggaaugggagcagcugugggcgccucauuucaggcaaguccuccccaaaccuucagau

SEQ ID NO: 165181 - RNA, 64 nt, hsa
aauuaccagcaagugucuuuccugcggcaccggguucaggcagcuacuccugccccagagauga

SEQ ID NO: 165182 - RNA, 64 nt, hsa
agggaacaugggaaggaaucaaagguaaagcccauucaggcauuauugacaagagggcuuuaaa

SEQ ID NO: 165183 - RNA, 64 nt, hsa
ccugcaaucuggaaguaaacagucugcuugcuucuucaggcacgugacagugacaacacaguga

SEQ ID NO: 165184 - RNA, 64 nt, hsa
uugugggaauuaacacaucaauggugguuaugggaacuaccaauggguuccuacaauuuuuauc

SEQ ID NO: 165185 - RNA, 64 nt, hsa
agaaaauacgagauuugcaggggaaacaucaguaaacuaccauuaaugucaaugcccaguuuug

SEQ ID NO: 165186 - RNA, 64 nt, hsa
cuuuugaaagcaaagcucuggcucacaggccccaaacuaccagccguaucuagcauauccccac

SEQ ID NO: 165187 - RNA, 64 nt, hsa
accaggaggcuuccuuccagcccccuauucugguaacuaccaaaaucccucgggugcaagugua

SEQ ID NO: 165188 - RNA, 64 nt, hsa
cccaggaggcuuccuuccagcccccuauucugguaacuaccaggaggcuuccuuccagcccccu

SEQ ID NO: 165189 - RNA, 64 nt, hsa
aagggaauaucaucacugaucccacagaaauacaaacuaccaucagagaauacuacaaacaccu

SEQ ID NO: 165190 - RNA, 64 nt, hsa
uaauuaaacuaaagaccuucugcacagcaaaagaaacuaccaucagagucaacaggcaaccuac

SEQ ID NO: 165191 - RNA, 64 nt, hsa
aaucccauucaugaguucuccacccacauuaccuaacuaccacccaaaggcuccaccuccuaau

SEQ ID NO: 165192 - RNA, 64 nt, hsa
gaagguucugccauccaucccagccaucccaaacaacuaccagaauaauggauuaaaacguuaa

SEQ ID NO: 165193 - RNA, 64 nt, hsa
caucuucccacuccccugcuccacaugagccaugcaugcuuagcaauccaagugcagagcucuu

SEQ ID NO: 165194 - RNA, 64 nt, hsa
ugauggcuuccuugcacaccacauauacagugcgcaugcuuacagccgggcuucuggagcacca

SEQ ID NO: 165195 - RNA, 64 nt, hsa
aaaauggcaacaauuuacagaaaucccaccuuuccaugcuuaagacaaaaaugucuuaaauaua

SEQ ID NO: 165196 - RNA, 64 nt, hsa
uauuuaagccaguuuaagugcuuuguguugaugccaugcuuaucaaauacaugcacaagcuaaa

SEQ ID NO: 165197 - RNA, 64 nt, hsa
ucaguccaacauuauuugaauugagcaccucaagcaugcuuagcaauguucuaaucacuaugga

SEQ ID NO: 165198 - RNA, 64 nt, hsa
uuuauuuuagacacaaagcuuuauuuuuccacaucaugcuuacaaaaaagaauaaugcaaauag

SEQ ID NO: 165199 - RNA, 64 nt, hsa
gauuaguugaaaaacuguaugaaugugaagaucacaugcuuagucauuuuuauguucauuccac

SEQ ID NO: 165200 - RNA, 64 nt, hsa
uaagauuugacuugagguuuuugacacuuaaguacaugcuuaaugauauauuuucaaaagucau

SEQ ID NO: 165201 - RNA, 64 nt, hsa
auucuguacagauuuuucucuaaggagaauaugacaugcuuaugcuuaccaagaucaagugcau

SEQ ID NO: 165202 - RNA, 64 nt, hsa
ugcagugaacugccagaagguaaccagucucaaacaugcuuaucccauuaucaacccugaaagu

SEQ ID NO: 165203 - RNA, 64 nt, hsa; identical to SEQ ID NO: 154522

SEQ ID NO: 165204 - RNA, 64 nt, hsa; identical to SEQ ID NO: 154523

SEQ ID NO: 165205 - RNA, 64 nt, hsa; identical to SEQ ID NO: 154524

SEQ ID NO: 165206 - RNA, 64 nt, hsa; identical to SEQ ID NO: 154525

SEQ ID NO: 165207 - RNA, 64 nt, hsa; identical to SEQ ID NO: 154526

SEQ ID NO: 165208 - RNA, 64 nt, hsa; identical to SEQ ID NO: 154527

SEQ ID NO: 165209 - RNA, 64 nt, hsa; identical to SEQ ID NO: 154528

SEQ ID NO: 165210 - RNA, 64 nt, hsa; identical to SEQ ID NO: 154529

SEQ ID NO: 165211 - RNA, 64 nt, hsa; identical to SEQ ID NO: 154530

SEQ ID NO: 165212 - RNA, 64 nt, hsa; identical to SEQ ID NO: 154531

SEQ ID NO: 165213 - RNA, 64 nt, hsa; identical to SEQ ID NO: 154532

SEQ ID NO: 165214 - RNA, 64 nt, hsa; identical to SEQ ID NO: 154533

SEQ ID NO: 165215 - RNA, 64 nt, hsa; identical to SEQ ID NO: 154534

SEQ ID NO: 165216 - RNA, 64 nt, hsa; identical to SEQ ID NO: 154535

SEQ ID NO: 165217 - RNA, 64 nt, hsa; identical to SEQ ID NO: 154536

SEQ ID NO: 165218 - RNA, 64 nt, hsa; identical to SEQ ID NO: 154537

SEQ ID NO: 165219 - RNA, 64 nt, hsa; identical to SEQ ID NO: 154538

SEQ ID NO: 165220 - RNA, 64 nt, hsa; identical to SEQ ID NO: 154539

SEQ ID NO: 165221 - RNA, 64 nt, hsa; identical to SEQ ID NO: 154540

SEQ ID NO: 165222 - RNA, 64 nt, hsa; identical to SEQ ID NO: 154541

SEQ ID NO: 165223 - RNA, 64 nt, hsa; identical to SEQ ID NO: 154542

SEQ ID NO: 165224 - RNA, 64 nt, hsa; identical to SEQ ID NO: 154543

SEQ ID NO: 165225 - RNA, 64 nt, hsa; identical to SEQ ID NO: 154544

SEQ ID NO: 165226 - RNA, 64 nt, hsa; identical to SEQ ID NO: 154545

SEQ ID NO: 165227 - RNA, 64 nt, hsa; identical to SEQ ID NO: 154546

SEQ ID NO: 165228 - RNA, 64 nt, hsa; identical to SEQ ID NO: 154547

SEQ ID NO: 165229 - RNA, 64 nt, hsa; identical to SEQ ID NO: 154548

SEQ ID NO: 165230 - RNA, 64 nt, hsa; identical to SEQ ID NO: 154549

SEQ ID NO: 165231 - RNA, 64 nt, hsa; identical to SEQ ID NO: 154550

SEQ ID NO: 165232 - RNA, 64 nt, hsa; identical to SEQ ID NO: 154551

SEQ ID NO: 165233 - RNA, 64 nt, hsa; identical to SEQ ID NO: 154552

SEQ ID NO: 165234 - RNA, 64 nt, hsa; identical to SEQ ID NO: 154553

SEQ ID NO: 165235 - RNA, 64 nt, hsa; identical to SEQ ID NO: 154554

SEQ ID NO: 165236 - RNA, 64 nt, hsa; identical to SEQ ID NO: 154555

SEQ ID NO: 165237 - RNA, 64 nt, hsa; identical to SEQ ID NO: 154522

SEQ ID NO: 165238 - RNA, 64 nt, hsa; identical to SEQ ID NO: 154523

SEQ ID NO: 165239 - RNA, 64 nt, hsa; identical to SEQ ID NO: 154524

SEQ ID NO: 165240 - RNA, 64 nt, hsa; identical to SEQ ID NO: 154525

SEQ ID NO: 165241 - RNA, 64 nt, hsa; identical to SEQ ID NO: 154526

SEQ ID NO: 165242 - RNA, 64 nt, hsa; identical to SEQ ID NO: 154527

SEQ ID NO: 165243 - RNA, 64 nt, hsa; identical to SEQ ID NO: 154528

SEQ ID NO: 165244 - RNA, 64 nt, hsa; identical to SEQ ID NO: 154529

SEQ ID NO: 165245 - RNA, 64 nt, hsa; identical to SEQ ID NO: 154530

SEQ ID NO: 165246 - RNA, 64 nt, hsa; identical to SEQ ID NO: 154531

SEQ ID NO: 165247 - RNA, 64 nt, hsa; identical to SEQ ID NO: 154532

SEQ ID NO: 165248 - RNA, 64 nt, hsa; identical to SEQ ID NO: 154533

SEQ ID NO: 165249 - RNA, 64 nt, hsa; identical to SEQ ID NO: 154534

SEQ ID NO: 165250 - RNA, 64 nt, hsa; identical to SEQ ID NO: 154535

SEQ ID NO: 165251 - RNA, 64 nt, hsa; identical to SEQ ID NO: 154536

SEQ ID NO: 165252 - RNA, 64 nt, hsa; identical to SEQ ID NO: 154537

SEQ ID NO: 165253 - RNA, 64 nt, hsa; identical to SEQ ID NO: 154538

SEQ ID NO: 165254 - RNA, 64 nt, hsa; identical to SEQ ID NO: 154539

SEQ ID NO: 165255 - RNA, 64 nt, hsa; identical to SEQ ID NO: 154540

SEQ ID NO: 165256 - RNA, 64 nt, hsa; identical to SEQ ID NO: 154541

SEQ ID NO: 165257 - RNA, 64 nt, hsa; identical to SEQ ID NO: 154542

SEQ ID NO: 165258 - RNA, 64 nt, hsa; identical to SEQ ID NO: 154543

SEQ ID NO: 165259 - RNA, 64 nt, hsa; identical to SEQ ID NO: 154544

SEQ ID NO: 165260 - RNA, 64 nt, hsa; identical to SEQ ID NO: 154545

SEQ ID NO: 165261 - RNA, 64 nt, hsa; identical to SEQ ID NO: 154546

SEQ ID NO: 165262 - RNA, 64 nt, hsa; identical to SEQ ID NO: 154547

SEQ ID NO: 165263 - RNA, 64 nt, hsa; identical to SEQ ID NO: 154548

SEQ ID NO: 165264 - RNA, 64 nt, hsa; identical to SEQ ID NO: 154549

SEQ ID NO: 165265 - RNA, 64 nt, hsa; identical to SEQ ID NO: 154550

SEQ ID NO: 165266 - RNA, 64 nt, hsa; identical to SEQ ID NO: 154551

SEQ ID NO: 165267 - RNA, 64 nt, hsa
accccugugcaccacccaagaaagaggaaaacuuugccuacaacuuuggaaaugcugggguccc

SEQ ID NO: 165268 - RNA, 64 nt, hsa
agguguaccuccaacccuagccuucucccacagcugccuacaacagagucucccagccuucuca

SEQ ID NO: 165269 - RNA, 64 nt, hsa
ccuaggcuacgcuccaugcucccccagcaaucucugccuacaccuccugcggcgccuugcccuc

SEQ ID NO: 165270 - RNA, 64 nt, hsa
gcauagcucaccccaccucaucaugagccucaacugccuacaucuggggcaagcagcacaccgg

SEQ ID NO: 165271 - RNA, 64 nt, hsa
cacugaaaucagcuggggugggggguguggaaaaugccuacauccuggcuccaucucccgaagu

SEQ ID NO: 165272 - RNA, 64 nt, hsa
agcgugggagccaggaucagcgcccccugccaugugccuacaaaugucaguugugauuuccacu

SEQ ID NO: 165273 - RNA, 64 nt, hsa
ccccagcugccccagcacgcgggacccauagcacaccccuuagcgcuugccuagguugcugaaa

SEQ ID NO: 165274 - RNA, 64 nt, hsa
aaucugcuuauucuucagcuucaccucugcacuaaccccuuacccuuaugguacgucaggauuu

SEQ ID NO: 165275 - RNA, 64 nt, hsa
cccauauaaacuauuuucacagaucucaacuaaaaccccuuacuucacaaaugauuguguugug

SEQ ID NO: 165276 - RNA, 64 nt, hsa
gugccugugcuugaagguugcuguagagcaucugaccccuuauuaccaccuuaagcaauguaua

SEQ ID NO: 165277 - RNA, 64 nt, hsa
uuuccucuaguacuaccaguauucauaaauguauaccccuuacuguaauuuguuccucuuagaa

SEQ ID NO: 165278 - RNA, 64 nt, hsa
uaauguaagucuagcuaccuauccaauacuaaauaccccuuaaaguauuaaaugcacuaucugc

SEQ ID NO: 165279 - RNA, 64 nt, hsa
cucugaaacaagggucacacuacucagagggauaaccccuuacaguggucugaggaguaacuau

SEQ ID NO: 165280 - RNA, 64 nt, hsa
aaauuguucccaaaugaaaacuuguuuuaaguccaccccuuaguuuccuuauuuuacaaggucu

SEQ ID NO: 165281 - RNA, 64 nt, hsa
guuugagaucgugcuggggaggaacauggccacuaccccuuaucccaucggccaugugggaggu

SEQ ID NO: 165282 - RNA, 64 nt, hsa
ggugcuuuucuuuacaggauucaaaagccaaauaaccccuuauggaauucaacucaagguuuga

SEQ ID NO: 165283 - RNA, 64 nt, hsa
ccauaagagaagcaaaucugagaguaaaacccuuaccccuuauucuuaagaauagugcuuguuu

SEQ ID NO: 165284 - RNA, 64 nt, hsa
aaacagcagggugacuuuagaggcaugggcuccaaccccuuagcucugucugagaauuaugguu

SEQ ID NO: 165285 - RNA, 64 nt, hsa
gaacuccuuguucuccccucugcugccucuccccaccccuuaaagcaguugguagaaggaaugg

SEQ ID NO: 165286 - RNA, 64 nt, hsa
acgucagcugcugagaggagcaagcgguaguaccaccccuuaguugagggagucagcacagucc

SEQ ID NO: 165287 - RNA, 64 nt, hsa
uauuuccuacgucuguucacugaaauaauuaccaaccccuuagcaauaagcacuccuugcagag

SEQ ID NO: 165288 - RNA, 64 nt, hsa
gcgcgcugcuacagagcuucacgcucuccgcuccaccccuuagccugggaacccaccgcaggug

SEQ ID NO: 165289 - RNA, 64 nt, hsa
accaagcuaggaacaucagccuggugcccuguuaaccccuuaaagcugugguuuacaacuuuuc

SEQ ID NO: 165290 - RNA, 64 nt, hsa
cagaugugguuucaaaguaaaggccuccucccccaccccuuaggccccguggugacauuuccca

SEQ ID NO: 165291 - RNA, 64 nt, hsa
aaggcugacuuguugacugaagccuuuuucccagaccccuuauuucgaauccccaagcuucagu

SEQ ID NO: 165292 - RNA, 64 nt, hsa
cagacccccgccagacagacucccaaccagacugaccccuuacuauucacacagccugccgagu

SEQ ID NO: 165293 - RNA, 64 nt, hsa
cagugagaaaucuuuacaguugacaggaaccuggaccccuuaccccaacuuuaugaguaaugcu

SEQ ID NO: 165294 - RNA, 64 nt, hsa
cuagauugagcuuagauugccucucuagacaacuaccccuuaguuauaauucuguguccccucu

SEQ ID NO: 165295 - RNA, 64 nt, hsa
ucagcugcuuugcacaaagguccuucuuguccacaccccuuauccccaggcuggugccccggga

SEQ ID NO: 165296 - RNA, 64 nt, hsa
aggagauggagaccauccuggcuaacacggugaaaccccuuaucuaugcgccuguagucccagc

SEQ ID NO: 165297 - RNA, 64 nt, hsa
gagaccuguugcugcauagaacucucccugcccuaccccuuaacuccaccuuagugccagggcc

SEQ ID NO: 165298 - RNA, 64 nt, hsa
ggagagccuucagccaaaccucauugcuuuauaaaccccuuagaacucucccuacuagcuggaa

SEQ ID NO: 165299 - RNA, 64 nt, hsa
cccagucacauccauuuuguggaagauuaacccaaccccuuacacuacacugaacacuaaagaa

SEQ ID NO: 165300 - RNA, 64 nt, hsa
uauacuguuauauccucaacuuggauuuaugguaaccccuuauaguucauggagaccaaaauuu

SEQ ID NO: 165301 - RNA, 64 nt, hsa
cucuacucggucauucuccccauuuccauccauuaccccuuagccauugagacuaaaggaaaua

SEQ ID NO: 165302 - RNA, 64 nt, hsa
acuacaacauaaauaauuugaguuuaggugauccaccccuuaauuguacccccgaugguauauu

SEQ ID NO: 165303 - RNA, 64 nt, hsa
ccaaacuacuuacuugcucuaaacaguuacuuguaccccuuaaccugucuucaaaaguugcaua

SEQ ID NO: 165304 - RNA, 64 nt, hsa
aaaaaucgucucucccucccuuugaaaugaauauaccccuuaguguuuggguauauucauuuca

SEQ ID NO: 165305 - RNA, 64 nt, hsa
cccuuuugucucugggaccagacuuguuggugcuaccccuuacuccccucugcaacccccauuu

SEQ ID NO: 165306 - RNA, 64 nt, hsa
ccagaaaaaccagcuuaucaucuaucaagcuccaaccccuuauacagcuccucugguggaaucc

SEQ ID NO: 165307 - RNA, 64 nt, hsa
cggcaugcauuuugcauugguccagcccuuugaaaccccuuagagagaagcauauauggccaca

SEQ ID NO: 165308 - RNA, 64 nt, hsa
caaaauguucuggaugcaucaucuccaaccaaggaccccuuauuuaucaugccuuuguucucuu

SEQ ID NO: 165309 - RNA, 64 nt, hsa
ugguuuucccuuggccacuagcccaucuucaaugaccccuuaaucugcagcagcucacaggcug

SEQ ID NO: 165310 - RNA, 64 nt, hsa
guuuacacuguugggaguaaaggagcauuuuuacaccccuuaagggugcuuaauucuguugaaa

SEQ ID NO: 165311 - RNA, 64 nt, hsa
aggaaaagcugacacccagacaaucacuuaagaaaccccuuauugauguauuucauggcacugc

SEQ ID NO: 165312 - RNA, 64 nt, hsa
auuaccacauaaucuuuuaaacaauaaaacaaauaccccuuagaaagucuucugcaaacccauu

SEQ ID NO: 165313 - RNA, 64 nt, hsa
cagaaggaugcccagacaucagccuccuucuuucaccccuuaccccaaagagaaagaguuugaa

SEQ ID NO: 165314 - RNA, 64 nt, hsa
uugcccacuguuucuuccuuucugugccuuugagaccccuuaagguuuucccucaugcgauuac

SEQ ID NO: 165315 - RNA, 64 nt, hsa
ccagcugugagguggcuucagcggaagucugcugaccccuuauauuccccgagaguauaaagag

SEQ ID NO: 165316 - RNA, 64 nt, hsa
ugccuugaaaaucacaucaaguaguuaauuaucuaccccuuaccuguguuuauaacuuccaggu

SEQ ID NO: 165317 - RNA, 50 nt, hsa
uuuuuuuucugauaaaguaaaccccuuaacauuggagccgacuuugucuu

SEQ ID NO: 165318 - RNA, 64 nt, hsa
ucaggcacuccaagugaaccaccccucuugguucaccccuuacucacuuaucucaucacagagc

SEQ ID NO: 165319 - RNA, 64 nt, hsa
uuucucaggguguucuuguccucaucuacccucuaccccuuacugugcaaccacugaggcaaag

SEQ ID NO: 165320 - RNA, 64 nt, hsa
gacagugcauuuucaauaucuaacuuaacaugccaccccuuagcagugcaagcuuauuuaucuc

SEQ ID NO: 165321 - RNA, 64 nt, hsa
cccucccuucccgaccccaacaaaacguuuucaaaccccuuacaguuccuggggcaggcggaaa

SEQ ID NO: 165322 - RNA, 64 nt, hsa
cuuaugucaccucagcccucaucucaaugcccaaaccccuuacacacaccuucaguuagcuuca

SEQ ID NO: 165323 - RNA, 64 nt, hsa
cagcccagauguucaguucucuuggccccucucuaccccuuacugggauccgguuuucauuuuc

SEQ ID NO: 165324 - RNA, 64 nt, hsa
uauauuugggauaucuauugaagaaaaaaagaaaaccccuuaaagauaauguacaugcuucaug

SEQ ID NO: 165325 - RNA, 64 nt, hsa
uuagccugguuuuaugugacacugauacacacacaccccuuauaugggacuaauuuuacacuuu

SEQ ID NO: 165326 - RNA, 64 nt, hsa
ccauuccaccacagugccccucagccagaucaccaccccuuacaauucccucuacuguguggaa

SEQ ID NO: 165327 - RNA, 64 nt, hsa
auagagaccuguugguugcuaggguaguccagacaccccuuagaugucuucauaauaguccuau

SEQ ID NO: 165328 - RNA, 64 nt, hsa
ugcagcgugaguagcucuuuuguuuacuguuuacaccccuuauuggcaugucaacuccuguacu

SEQ ID NO: 165329 - RNA, 64 nt, hsa
uauauaaaugcauuauuacacauacauuucucucaccccuuaaugcauuuuucucaaugcagaa

SEQ ID NO: 165330 - RNA, 64 nt, hsa
guaaaaaauguggcaacacuuuuaauaaaugcucaccccuuauugcacaggaaagcauuuauac

SEQ ID NO: 165331 - RNA, 64 nt, hsa
agguaucuccaggauugaagagcauugcauggacaccccuuauccaggacucugucaauuuccc

SEQ ID NO: 165332 - RNA, 64 nt, hsa
uuuuuauauauuuuuucugacuccuauuuaaagaaccccuuagguuucuaaguacccauuucuu

SEQ ID NO: 165333 - RNA, 64 nt, hsa
cucccagccccuucucccaggguccagagccaggaccccuuaaucuagguaaauugacagaaau

SEQ ID NO: 165334 - RNA, 64 nt, hsa
ugugaaagcagcuuuuaguuuaacuuauucacagaccccuuauaauuaccauguuuuuuuuuuu

SEQ ID NO: 165335 - RNA, 64 nt, hsa
cuucuacagaauaggucagaucuuggccucccaaaccccuuauuuuuaaaauacuuugcgccuu

SEQ ID NO: 165336 - RNA, 64 nt, hsa
auggcagcccuucccuagcacacugguggaagagaccccuuaagaaccugaccccagugaauga

SEQ ID NO: 165337 - RNA, 64 nt, hsa
agccccuuccccagaccccucuccagucuccugcaccccuuagcccucccugcuuugccuggcc

SEQ ID NO: 165338 - RNA, 64 nt, hsa
uugaaacauagagggagagagggagagagccuauaccccuuacuuagcaugcacaaaguguauu

SEQ ID NO: 165339 - RNA, 64 nt, hsa
aauguauccagauuuaaaccuaccaguuuguccuaccccuuaagcguuuaaaauaaaauaugca

SEQ ID NO: 165340 - RNA, 64 nt, hsa
uuuuuggauugucggauuuccucccucacaugauaccccuuaucuuuuauaaugucuuaugccu

SEQ ID NO: 165341 - RNA, 64 nt, hsa
gacuuggaaggggccuggucugucaacuaguccaaccccuuaaaauucauagaggagcaaacug

SEQ ID NO: 165342 - RNA, 64 nt, hsa
aggaguucgagagcagccuggccaacauggcaaaaccccuuauuuacuaaaaauacaaaaauua

SEQ ID NO: 165343 - RNA, 64 nt, hsa
ugacucugcggcccuccaggacggacaccgggugaccccuuagggcacccaggcaagaucccua

SEQ ID NO: 165344 - RNA, 64 nt, hsa
cuuuguugcacugaaauggaauucccaugccccuaccccuuaccccaguuuuuugaacauggaa

SEQ ID NO: 165345 - RNA, 64 nt, hsa
aaaauacuaagugguuuucuugcucccacucccuaccccuuaguuaaauaggguuuauuuucca

SEQ ID NO: 165346 - RNA, 64 nt, hsa
guauugaauacuuacauucucuaauaagaaaaccaccccuuagauugaaguaaacugcaguccu

SEQ ID NO: 165347 - RNA, 64 nt, hsa
ggucuggugucuucagcuccugaaaugcuaauuuaccccuuaccuaaggaguguaguuauaaua

SEQ ID NO: 165348 - RNA, 64 nt, hsa
gagcaaggaucuggccuggagaggcccauccuauaccccuuauuagagccaugacagccuacag

SEQ ID NO: 165349 - RNA, 64 nt, hsa
ccaaccccauugucagcaccccagccaugcggccaccccuuagcacaccugcucgucccauuua

SEQ ID NO: 165350 - RNA, 64 nt, hsa
uaguaucaauauuucugucauugaauuuuuucucaccccuuauuauuucucacuuacaauuucu

SEQ ID NO: 165351 - RNA, 64 nt, hsa
uucccucuacgucucucuagaaugacaucuuuaaaccccuuacacucuuuggucuuacacaucc

SEQ ID NO: 165352 - RNA, 64 nt, hsa
cucuugaacagguauuacaaaggaagaaaacuucaccccuuauccuuaacauauauaguauauu

SEQ ID NO: 165353 - RNA, 64 nt, hsa
caaacagacacaucaacgcaccccacucacagacaccccuuaccccacccccacuguacagaga

SEQ ID NO: 165354 - RNA, 64 nt, hsa
ucacagugaagcaaaggacacaacuuuuuauuguaccccuuaauugucaacaggaguuaacuga

SEQ ID NO: 165355 - RNA, 64 nt, hsa
uccccuuuuuaugccccaccgauacacugggaccaccccuuaccccggacaggaugaauggauc

SEQ ID NO: 165356 - RNA, 64 nt, hsa
cagcccccuucccuggcucugcagcggcugggucaccccuuacgcuggugaucaggaaagcccg

SEQ ID NO: 165357 - RNA, 64 nt, hsa
uaggauuccgccgcuggaagccuucuguucagacaccccuuaugcuccaaggccugaugugagc

SEQ ID NO: 165358 - RNA, 64 nt, hsa
ccugguuacggcccagggggaagaugccaagggcaccccuuaauggaaacacgagaucaguagu

SEQ ID NO: 165359 - RNA, 64 nt, hsa
ggaauuuguuuugugauuaguucgccccuuccccaccccuuaccagauguuaagcagcuaugaa

SEQ ID NO: 165360 - RNA, 61 nt, hsa
accagagaguggccagcuaagagccugccucaccccuuaccaaugagggcaggggaagacc

SEQ ID NO: 165361 - RNA, 64 nt, hsa
aacaaagcgaauaggcaguuagcacagcacagcuaccccuuaccaagcagucuauggaaacaac

SEQ ID NO: 165362 - RNA, 64 nt, hsa
aucaggcacccggggccagagacauaugggccauaccccuuaaccccgggaugcaagguagcau

SEQ ID NO: 165363 - RNA, 64 nt, hsa
uuacacaauggcuuuguuuugcuuuuucagccacaccccuuaugugaacuagugccuuugggua

SEQ ID NO: 165364 - RNA, 64 nt, hsa
gacggucuccagcuccccuuucugccaggaagccaccccuuagcacucccccgauuauucugcc

SEQ ID NO: 165365 - RNA, 64 nt, hsa
cccuugacugcagagcagguuccuccacugccccaccccuuagacaccaugaccccaucagguu

SEQ ID NO: 165366 - RNA, 64 nt, hsa
aucccucccucacuuucacuguggauuuggaucgaccccuuacaucuugauuucccuuaaacga

SEQ ID NO: 165367 - RNA, 56 nt, hsa
caaauagguugcccaagugaggacggaccccuuaccgaucugugcucuccuagccc

SEQ ID NO: 165368 - RNA, 64 nt, hsa
ucuacuggccuugucaacauacagacuucaaaauaccccuuaugagaauccaaagaaugaugug

SEQ ID NO: 165369 - RNA, 64 nt, hsa
gauacagcaacaaucauugcuacugacuuguucaaccccuuaguuacacuguaugaucaacaua

SEQ ID NO: 165370 - RNA, 64 nt, hsa
aauaacugugagcucgcacaaccgaaagggccugaccccuuacuuagcucccuccuugaaacaa

SEQ ID NO: 165371 - RNA, 64 nt, hsa
gaaaaaguuugugacauuguaguagggaguguguaccccuuacuccccaucaaaaaaaaaaaug

SEQ ID NO: 165372 - RNA, 64 nt, hsa
ggccagcagcuuccuccuucagccaccuggccauaccccuuaaauaagccccucaccuugcugc

SEQ ID NO: 165373 - RNA, 64 nt, hsa
gauaaagagauuuugauuuuugaaaugccacaaaaccccuuaaaguggucaaguaccuaaggua

SEQ ID NO: 165374 - RNA, 64 nt, hsa
uccucuccauuuuagcccaguguuuucuuugaggaccccuuaaucuugcuuucuuuagaauuuu

SEQ ID NO: 165375 - RNA, 64 nt, hsa
gcucccuguuucucaugcuuucucuaacuuccucaccccuuaaccaaaaagguguguuuucuuu

SEQ ID NO: 165376 - RNA, 64 nt, hsa
cuccaagaggggcccagcauuguauuucccugugaccccuuacucuccuggccagaacuugagc

SEQ ID NO: 165377 - RNA, 64 nt, hsa
ucgggcccagcucaagcccccuuccuugcucuggaccccuuagguauacccuggaagagcuggg

SEQ ID NO: 165378 - RNA, 64 nt, hsa
cccccuguuuucagggaccucugccuucucccacaccccuuacacuagugaggacuccuucggc

SEQ ID NO: 165379 - RNA, 64 nt, hsa
uugugcugcuugcacaacugagcugcugguguguaccccuuagcagggugucuggggacuuacg

SEQ ID NO: 165380 - RNA, 64 nt, hsa
cccguccauccauccauccacucuuccacccucuaccccuuaccuuauucuaaaaagaacuuag

SEQ ID NO: 165381 - RNA, 64 nt, hsa
uggcaacauccaugccuucucauucucuuuccugaccccuuaggagcgccuggaagcagaacca

SEQ ID NO: 165382 - RNA, 64 nt, hsa
caggcagcugugccccuggccugcccuucccgggaccccuuauuccaacucagcuccucuuugc

SEQ ID NO: 165383 - RNA, 64 nt, hsa
ccuuuugguggagaggcccggccucucacaaaagaccccuuaccacugcucugaugaagaggag

SEQ ID NO: 165384 - RNA, 64 nt, hsa
uuuaccaguaaauuauguuucuguauguaaaauaaccccuuauuagagagacaguguuauaugu

SEQ ID NO: 165385 - RNA, 64 nt, hsa
ugacucugccccucagcagggcuuacuaagcacuaccccuuaacagggaugacuccgcacugcc

SEQ ID NO: 165386 - RNA, 64 nt, hsa
cccagagaaccagccuaggaacacucgggaugacaccccuuaucacaccaaggacagcaaguuu

SEQ ID NO: 165387 - RNA, 64 nt, hsa
ccagcucugagguggcuucagcgaaagucugcuaaccccuuacauuccccgagaguguaaagag

SEQ ID NO: 165388 - RNA, 64 nt, hsa
uucuccauuugagaggagagugcuuggggcuugaaccccuuaccccacugcugcugacugggca

SEQ ID NO: 165389 - RNA, 64 nt, hsa
guggggacaagccccucuuggucucagccacagcaccccuuauuccagcugcccugcccaaccu

SEQ ID NO: 165390 - RNA, 64 nt, hsa
cccuucuuucuaaacucaacccauuucccucccuaccccuuaucuucaggacucuucagagcua

SEQ ID NO: 165391 - RNA, 64 nt, hsa
ggguccuugccucucguguacccccucaaggcugaccccuuagauggcccaggaauggcaggug

SEQ ID NO: 165392 - RNA, 64 nt, hsa
acaaaccauuuuauuuuuugggccauuaccccauaccccuuauugcugccaaaaccacaugggc

SEQ ID NO: 165393 - RNA, 64 nt, hsa
gcuugggccuuuucucucaaccuuggcugagccuaccccuuacuuugccaaagacuugaggacc

SEQ ID NO: 165394 - RNA, 64 nt, hsa
aaagucuguuuuuuuuuuuucuuucuucuuccccaccccuuaauuuuaacuuugugguaacuga

SEQ ID NO: 165395 - RNA, 64 nt, hsa
cuggaaguuaagagaguggcauccacuugugguaaccccuuacgaugaugacaucccacacacu

SEQ ID NO: 165396 - RNA, 64 nt, hsa
aaacgaugggugcugugguccucugcaggcccucaccccuuaacuuccucauacagacuggcac

SEQ ID NO: 165397 - RNA, 64 nt, hsa
accuuagggacagguggaggugugggccgaucuaaccccuuacccaucucucuacugcuggacu

SEQ ID NO: 165398 - RNA, 64 nt, hsa
acuaaucauaugugcucagacacagcucaagcacaccccuuaguuaagaaagaaccuccauaua

SEQ ID NO: 165399 - RNA, 64 nt, hsa
gcuccagugccgaccgcugagccuccuggcccggaccccuuacacccugcauuccagauggggg

SEQ ID NO: 165400 - RNA, 64 nt, hsa
auauuauuuuuucuucaauauaacacuggaggaaaccccuuaugaggaugccaucugccuaaau

SEQ ID NO: 165401 - RNA, 64 nt, hsa
caggugugaccucaggugugugaguaucccucauaccccuuaucaucacugccuauucgcucuu

SEQ ID NO: 165402 - RNA, 64 nt, hsa
aaggaaccaaauuuaagacucucgcaucuucccaaccccuuaagcccuggcccccugaguuucc

SEQ ID NO: 165403 - RNA, 64 nt, hsa
ccuacauuaacauggaugcagaauaauuucagaaaccccuuaaauaauuccuuaacaucucuau

SEQ ID NO: 165404 - RNA, 64 nt, hsa
gaacaacugaccuguuuccuccaccuccacccccaccccuuaacuuggguaccccucuggcccu

SEQ ID NO: 165405 - RNA, 64 nt, hsa
cucaagaccggaggcacagagggcaggagcacagaccccuuaaaccggcauuguauuccaaaga

SEQ ID NO: 165406 - RNA, 64 nt, hsa
ucuagcacugagucaagcaaucagcaggcugggcaccccuuagccauaaguuuucaggaaauaa

SEQ ID NO: 165407 - RNA, 64 nt, hsa
cauguguuugcagaccggcugggauagccuccccaccccuuaucagagccaagacaccugcugc

SEQ ID NO: 165408 - RNA, 64 nt, hsa
aucuuggauugugaugcuauugguacuugagaauaccccuuaucugaguauaaagaauccuuga

SEQ ID NO: 165409 - RNA, 64 nt, hsa
ggcaggagggcccuaccugauuggugcaacccuuaccccuuagccucccugaaaauguuuuucu

SEQ ID NO: 165410 - RNA, 64 nt, hsa
uguuugaggaaagcaagaaucagagaaggaacauaccccuuacaaaugaaaaauuccacucaaa

SEQ ID NO: 165411 - RNA, 64 nt, hsa
ggcccuucagucugcuccaccaaggggcucuugaaccccuuauuaaggccccagaugaucccag

SEQ ID NO: 165412 - RNA, 64 nt, hsa
agggcccugcaaagcacccaaguguguuucacucaccccuuaccgcucgcccaccggccuguga

SEQ ID NO: 165413 - RNA, 64 nt, hsa
uaucugauauggucauuuguuuuaaauaacacccaccccuuauuuuccguaaauacacacacaa

SEQ ID NO: 165414 - RNA, 64 nt, hsa
aggccggucuaaagugagcucuaugggcagaucuaccccuuacuuauuauuccagaucugcagu

SEQ ID NO: 165415 - RNA, 64 nt, hsa
uccucauuuccuucuuuuauuccuccccaccccaaccccuuaaaaaaaaggucagaaggacaaa

SEQ ID NO: 165416 - RNA, 64 nt, hsa
cucagggguaagggaaggaagccagccuuucagcaccccuuacccuccacaguucugugauuuc

SEQ ID NO: 165417 - RNA, 64 nt, hsa
guuuuucacucuuaugucagagcaguuggguuuuaccccuuaguuuuuaugccuguuaagcuuu

SEQ ID NO: 165418 - RNA, 64 nt, hsa
cccgcgguuugucagggggcccaccuucuagaugaccccuuaauaaagugauggccccacagaa

SEQ ID NO: 165419 - RNA, 64 nt, hsa
auccuggaggguccccuagaggcaguauccccaguggaaagagcgugggccucaaggucagaca

SEQ ID NO: 165420 - RNA, 64 nt, hsa
cuuuuuuuuucuucaccugggacccucuagagguuggaaagagaagagaggcugggagcggaug

SEQ ID NO: 165421 - RNA, 64 nt, hsa
ccagggaagauuuuauauuuuuuuguagaguuuuuggaaagauauuuacucaaaauaacuaugc

SEQ ID NO: 165422 - RNA, 64 nt, hsa
gaagaaaugcuaucagaaauagauuuccuuccaguggaaagaaaggaggaagggagaauugaga

SEQ ID NO: 165423 - RNA, 64 nt, hsa
ugaaauaccuauuaauucuuaauauuaccucucuuggaaagacacaaaaaaagagcuguuauuu

SEQ ID NO: 165424 - RNA, 64 nt, hsa
uuguugagagauggacuaggaaguggaagcaggcuggaaagacacauauggcgaaagucaagua

SEQ ID NO: 165425 - RNA, 64 nt, hsa
acaaaaccagccuuuaaaauaucauguccaggccuggaaagaauacaaauccagugcaaaauua

SEQ ID NO: 165426 - RNA, 64 nt, hsa
aggagcaguccccagggucagggagccccugguguggaaagaggccccaagguaguaaacccug

SEQ ID NO: 165427 - RNA, 64 nt, hsa
cugccauaccuagacuguguguuucauauuuuuuuggaaagagaagugaacauccagccccaau

SEQ ID NO: 165428 - RNA, 64 nt, hsa
cccuccgguuauguugcuccaguaaaaucuugccuggaaagaggcagucuucuuagcaugguga

SEQ ID NO: 165429 - RNA, 64 nt, hsa
uuccuccuggcuuccagggggcagcccaguggaauggaaagaaugugggauuuggagucagaca

SEQ ID NO: 165430 - RNA, 64 nt, hsa
uccccccaaaccccgcccgccccacuacagguuauggaaagaaucauggcauuacugaggagua

SEQ ID NO: 165431 - RNA, 64 nt, hsa
uguaugcuaucauugauauucccaguggugcccguggaaagagggagaaagagaagcugaacag

SEQ ID NO: 165432 - RNA, 64 nt, hsa
cauguauccuggagacccucccaauggaugagaguggaaagacaucaguacaacuggacuuggc

SEQ ID NO: 165433 - RNA, 64 nt, hsa
auaggcucuuuuugcugccugugagcagucccucuggaaagaaacaugugaguaagugagagag

SEQ ID NO: 165434 - RNA, 64 nt, hsa
uccacuguuugccuuggauaguauggcuuguuuuuggaaagaaauucugaagagaguggaggag

SEQ ID NO: 165435 - RNA, 64 nt, hsa
cuuuaaugucgguguggagauccaaaguggguuguggaaagagcguccauaggagaagugagaa

SEQ ID NO: 165436 - RNA, 64 nt, hsa
ggcaguggcaaauaaauaaauacuuuuuuuuaaauggaaagacuugaucuaugguaauaaauga

SEQ ID NO: 165437 - RNA, 64 nt, hsa
cuacaugauacaguggaccuggagaccauccccuuggaaagacaacccagagauguucagcauc

SEQ ID NO: 165438 - RNA, 64 nt, hsa
agccgccugguggauuccuaugacacagggggccuggaaagaaagggaaaguggauuuaaaaua

SEQ ID NO: 165439 - RNA, 64 nt, hsa
gcccuggggaccccugacccaucccaaaacacuguggaaagaagggccucuucuccguggggac

SEQ ID NO: 165440 - RNA, 64 nt, hsa
acucuccccauuuuccuguucgacugggagguucuggaaagaaagagagagagagaaaagaggu

SEQ ID NO: 165441 - RNA, 64 nt, hsa
agaugaugaugacagcagugaaacuccuccucacuggaaagaggaaaugcagagauuaagagca

SEQ ID NO: 165442 - RNA, 64 nt, hsa
cagucagcccaggaaaaagagaagcagggccaaauggaaagaacacauaauaaacaagaaaaaa

SEQ ID NO: 165443 - RNA, 64 nt, hsa
aggaaauuuaaacaaagaaacacuugaaagaaacuggaaagaaaaauaauuuuuuuaugugaac

SEQ ID NO: 165444 - RNA, 64 nt, hsa
cuuccucuaaucuuggcaaaugaccuuuaccuuuuggaaagauuucauauugcuuccuccuccc

SEQ ID NO: 165445 - RNA, 64 nt, hsa
aaauuggaaagaaauuaaagaaggcuuaaauaaauggaaagacauccuguguucauggaucaga

SEQ ID NO: 165446 - RNA, 64 nt, hsa
aacaaaacaagugcaagacugaaaacuacaaaauuggaaagaaauuaaagaaggcuuaaauaaa

SEQ ID NO: 165447 - RNA, 64 nt, hsa
aaugauucugggcauauacuaagaagagcagguauggaaagaucuauugucagggaaucuuaga

SEQ ID NO: 165448 - RNA, 64 nt, hsa
uccugcuccuucguauguaggugagaaacuuagcuggaaagacauacaaauuuagacucucguu

SEQ ID NO: 165449 - RNA, 64 nt, hsa
uaauaagauugaaacuuuaguauuuaguggggaauggaaagaguugcccuuguugcaaguaaug

SEQ ID NO: 165450 - RNA, 64 nt, hsa
agcuuauucugauacaagaaugcuugggugcauauggaaagauugugaaagagugugucuugca

SEQ ID NO: 165451 - RNA, 64 nt, hsa
uuuaacagcaauggaggaaguuaacaauuuuuaauggaaagagcauguuagagcaaacaaaugc

SEQ ID NO: 165452 - RNA, 64 nt, hsa
agugaaugaauuuagcauuuuaugagagugcuguuggaaagacuugauaauucaccccuuuugu

SEQ ID NO: 165453 - RNA, 64 nt, hsa
aggaaaaacuaagagaaugaaaaguauuugccucuggaaagaacaacuggcaggacuguuguuu

SEQ ID NO: 165454 - RNA, 64 nt, hsa
aaaaauaauaacuuauugccagauuuggggcauuuggaaagaaguucauugaagauaaagcaaa

SEQ ID NO: 165455 - RNA, 64 nt, hsa
cuuaacccuuaacuguagauaagaaaauucauacuggaaagaaacccuacaaaugugaagucug

SEQ ID NO: 165456 - RNA, 64 nt, hsa
ucucaacucuuacuacauguaagaguauuuauacuggaaagaaacccuacaaauguaaaaaacg

SEQ ID NO: 165457 - RNA, 64 nt, hsa
uucacugauuugugaugucaauaggauggcaccuuggaaagaaaaaugaagaacaacuuuauca

SEQ ID NO: 165458 - RNA, 64 nt, hsa
aaggguccgaugugccaagugaucaugauucugcuggaaagaggauuuuaaauauugugggagu

SEQ ID NO: 165459 - RNA, 64 nt, hsa
agccuaguugaagugcuauuaugagugugggcuauggaaagacagcuuuuccuacacugauaaa

SEQ ID NO: 165460 - RNA, 64 nt, hsa
gugggcaauauugcaauauuugaaaugguaaaaauggaaagaagaacaaaauaugaugagaggu

SEQ ID NO: 165461 - RNA, 64 nt, hsa
augggagaagagggcccucucaacgcuccaagcuuggaaagagcuguguuuugguucaaagaca

SEQ ID NO: 165462 - RNA, 64 nt, hsa
ucuuccucauccaccacuucugguuccuuucaucuggaaagaagaccucuuccaucuuccaugc

SEQ ID NO: 165463 - RNA, 64 nt, hsa
aacaugcgugugccagacaccgggcaguacacuuuggaaagaaugugaaauccuuuuaauuuuu

SEQ ID NO: 165464 - RNA, 64 nt, hsa
cccuuggugcuggcaguguuuggggacauuaugcuggaaagagcuccuagcaucagaggauuaa

SEQ ID NO: 165465 - RNA, 63 nt, hsa
ugaauaagauuuaccuaugaguagaagcuuaauuggaaagaagagaagaauuacugacguaau

SEQ ID NO: 165466 - RNA, 64 nt, hsa
cacauaauccuuauguuauagagguucacagaaauggaaagauaccuguuucccuuuaaucaau

SEQ ID NO: 165467 - RNA, 64 nt, hsa
uuacuccagcccuggcccaaggaggcccagaaguuggaaagagauggaauguggcugggaacau

SEQ ID NO: 165468 - RNA, 64 nt, hsa
ggauccuccacuccuggggauuaugaagauauucuggaaagauuugugcuucagagguagacug

SEQ ID NO: 165469 - RNA, 64 nt, hsa
gcaggacauggacaaggaugaucuaggaagacuuuggaaagaguaggaagacuuuggaaagacu

SEQ ID NO: 165470 - RNA, 64 nt, hsa
aucuaggaagacuuuggaaagaguaggaagacuuuggaaagacuuuuccaacccucaucaccaa

SEQ ID NO: 165471 - RNA, 64 nt, hsa
gagcauuaagacaauguaauucuuuauuucuggguggaaagauauaccggauuaaauuuaucug

SEQ ID NO: 165472 - RNA, 64 nt, hsa
acaacacacauuauugugugucgagaggcagcauuggaaagagccugauuuucuaaaauaugca

SEQ ID NO: 165473 - RNA, 64 nt, hsa
acuccucaaaucgaauuauuuucuuuuuaaauuuuggaaagaguaaauugacguacuugcaguu

SEQ ID NO: 165474 - RNA, 64 nt, hsa
acuaggucauuucauuugaaaucuaggagucaaauggaaagauccccuaauaauacaccuauuu

SEQ ID NO: 165475 - RNA, 64 nt, hsa
uuuccauuagaauaacuuauucuaaggucaaaaguggaaagacacuguugguuuuuauuuugau

SEQ ID NO: 165476 - RNA, 64 nt, hsa
ugucugcagccagaaagaaucugaauuuaugaauuggaaagauauauauaguguauuugugaaa

SEQ ID NO: 165477 - RNA, 64 nt, hsa
cacaagaaugacuuucacaagggcaggaacauuguggaaagacugcaucauucugaugaggcaa

SEQ ID NO: 165478 - RNA, 64 nt, hsa
acagacgcgggcagugaugagcccuguucuggaguggaaagagcacgauagagcaccaggcuaa

SEQ ID NO: 165479 - RNA, 64 nt, hsa
agaagaagcugcucuggggagacgaggguaugaguggaaagaggaugggcgaggaggccgggcu

SEQ ID NO: 165480 - RNA, 64 nt, hsa
gagcagggagggguaggguggacaggcgaugccguggaaagacgucucgguggaaacugccaug

SEQ ID NO: 165481 - RNA, 64 nt, hsa
uugugugaaaaaggaauaaauuguuccaugcugguggaaagauagagauuguuuuuagagguug

SEQ ID NO: 165482 - RNA, 64 nt, hsa
ugauagaauacuaucgagccaacauguacugacauggaaagaugucaaagauauguuaagugua

SEQ ID NO: 165483 - RNA, 64 nt, hsa
auguauguuuuuaauaugcauagaacaaaagauuuggaaagauauacaccaaacuguuaaaugu

SEQ ID NO: 165484 - RNA, 64 nt, hsa
ucugggagguaagauauucuuuuuaauaaccuuguggaaagacauguucauaugucacuccucu

SEQ ID NO: 165485 - RNA, 64 nt, hsa
aaaauagaagacaaucugcuuguuucugaauguauggaaagacauuuugguuauacauuuuaaa

SEQ ID NO: 165486 - RNA, 64 nt, hsa
uguaugucaaggcuuacuacugcuuuccaauccuuggugauaugaagacagauaagcacgcugc

SEQ ID NO: 165487 - RNA, 64 nt, hsa
uauuggaugauagaagauauuuaagauaucuagauggugauauuuuccuuacaagauggguacc

SEQ ID NO: 165488 - RNA, 64 nt, hsa
agaguauuuuuuucaagacauuuauuuuucagaguggugauacuuuuacuuuggauacucugug

SEQ ID NO: 165489 - RNA, 64 nt, hsa
gaacaaguagacacacugugggaggaucugagcuuggugauauuuuauccccaagauaugacac

SEQ ID NO: 165490 - RNA, 53 nt, hsa
caagaacuagaaauaaauaaggauggugauagagagguauaccuucauauuca

SEQ ID NO: 165491 - RNA, 64 nt, hsa
uagaaaaccugacuaauggugucacugcuggcaauggugauaauggauuaauuccucaaaggaa

SEQ ID NO: 165492 - RNA, 64 nt, hsa
agaaaagaucucaagaaccagaaauaaauaaggauggugauagagagguauaccuuuauauuca

SEQ ID NO: 165493 - RNA, 64 nt, hsa
aagccaaggugucauuuaugugucaguucauuuguggugauauagaauuagcuuuuucaucccc

SEQ ID NO: 165494 - RNA, 64 nt, hsa
ccccgucucuguuccaugucuccuuuaagagcucuggugauaaggacaugaugcuuuuacugaa

SEQ ID NO: 165495 - RNA, 64 nt, hsa
aaagcgacagcucuacuuccacuuggccuuagaucucugcuauacccugccauagccuugaugc

SEQ ID NO: 165496 - RNA, 64 nt, hsa
uaaauucaaucaccaacugugcugucgucccugacucugcuacucccguucuuccugcuuuccu

SEQ ID NO: 165497 - RNA, 64 nt, hsa
uggccaaggagaauuucugcggugggaggcagugcucugcuagucaggauugauaaacagcugg

SEQ ID NO: 165498 - RNA, 64 nt, hsa
cgagaccauccuggcuaacauggugaaaccccgucucugcuaaaaauacaaaaaauuagccaga

SEQ ID NO: 165499 - RNA, 64 nt, hsa
cuucugauuuuuuuuuacuuucugcuccuuacuucucugcuauuuucauugccacuuuuuaaug

SEQ ID NO: 165500 - RNA, 64 nt, hsa
uaaucuaccaagugucccccuaaccuccuuuccucucugcuaauagauuuuuugugguuguugu

SEQ ID NO: 165501 - RNA, 64 nt, hsa
gggcggggcgucaacggcacugcuucaggacgcgcuugcugaaacgacuccaacagcuaguuca

SEQ ID NO: 165502 - RNA, 64 nt, hsa
uauuuacccaacucugaucuugcgugcagggaugcuugcugauggaugaaagaccacaauaaaa

SEQ ID NO: 165503 - RNA, 64 nt, hsa
ucucggggccuggaaguggcagccaucaguugcucuugcugaccccucggagcaagcgccgcac

SEQ ID NO: 165504 - RNA, 64 nt, hsa
ccucugcugugcuggcuucccaugaccaccuccucuugcugaaauauuacugcuugaaucugga

SEQ ID NO: 165505 - RNA, 64 nt, hsa
uccccuugcuggcgggcgcugcgugggcccugcacuugcugagguuccccaucaugggcaagga

SEQ ID NO: 165506 - RNA, 64 nt, hsa
agaaacacgaaggaucaugugguaacugcgagagcuugcugaggggugggagagccagcugugg

SEQ ID NO: 165507 - RNA, 64 nt, hsa
uggagggauugggcugaagcugcuccaccucauccuugcugagugggggagacauuuucccuga

SEQ ID NO: 165508 - RNA, 64 nt, hsa
acugauggagcaucagcuguggcccacagagagccuugcugagaagggggcagguaaagcagag

SEQ ID NO: 165509 - RNA, 64 nt, hsa
gcucugagacacuugcagaucuuaaggucugagacuugcugauuuucugguuggaguguuuuuu

SEQ ID NO: 165510 - RNA, 64 nt, hsa
uguaacugccugcuagccauagauuccuuucagccuugcugacuucucccuauaaaaguaaagc

SEQ ID NO: 165511 - RNA, 64 nt, hsa
uggugggaggggaucaccuggguuccaggccauccuugcugagcaucuuugagccugccuuccg

SEQ ID NO: 165512 - RNA, 64 nt, hsa
ugagccuugcagcucuuccagcuggggacuggugcuugcugaaacccaggagcugaacagugag

SEQ ID NO: 165513 - RNA, 64 nt, hsa
uugaggaggcaccucugacucccacacucgcggucuugcugaucgcaccuggcuccuaccugga

SEQ ID NO: 165514 - RNA, 64 nt, hsa
cuaggcugugcgugagccgggacuguacccacagcuugcugagggcugcucuucuugggccagg

SEQ ID NO: 165515 - RNA, 64 nt, hsa
aaaaauccuuuagaguucagcucuaaccagaaaucuugcugaaguaugucagcaccuuuucuca

SEQ ID NO: 165516 - RNA, 64 nt, hsa
gugucuggcggggagccaggugacaucauaaauacuugcugaaugaaugcagaaaucagcggua

SEQ ID NO: 165517 - RNA, 64 nt, hsa
ucuccaacaaauggaguagcaucccccuggggcacuugcugaggccaagccacucacauccuca

SEQ ID NO: 165518 - RNA, 64 nt, hsa
agccacucacauccucacuuugcugccccaccaucuugcugacaacuuccagagaagccauggu

SEQ ID NO: 165519 - RNA, 64 nt, hsa
auauuccuuguucuuaccaaguguacauuuaacucuugcugacauguucaguguauuuuauuac

SEQ ID NO: 165520 - RNA, 64 nt, hsa
auauucugaagcaaaaacugucaucuaaauuuuucuugcugauuuuuuuuaacuucccuauuuu

SEQ ID NO: 165521 - RNA, 64 nt, hsa
ucaucaucaucaucaucauugucgucgucaucaucuugcugagugucucuugaaguacaggcug

SEQ ID NO: 165522 - RNA, 64 nt, hsa
ucauuaucaucaucaucauugucgucgucaucaucuugcugagucaucaucaucaucaucauca

SEQ ID NO: 165523 - RNA, 64 nt, hsa
gcugacuuacagacacaggcuguuuacaaaaugcuagcuggaaagucuguaauguucaugucau

SEQ ID NO: 165524 - RNA, 64 nt, hsa
aaacacauauuagaggccuuugcugaugacacauuagcuggaucuuagccaccccagaaagggu

SEQ ID NO: 165525 - RNA, 64 nt, hsa
guguuugagcuuucaugaguuucccagagagacauagcuggaaaauuccuauugauuuucucua

SEQ ID NO: 165526 - RNA, 64 nt, hsa
accaugagcaauucuccugccucagccucccaaguagcuggaacuacaggcucaugccacugcg

SEQ ID NO: 165527 - RNA, 64 nt, hsa
gguucaagcuauucuccugccucagccucccaaguagcuggauuacaggcauacaccaccacgc

SEQ ID NO: 165528 - RNA, 64 nt, hsa
ggcucaagugauucucccaccucaggcacccaaauagcuggaacuacaggcauauaccgccaca

SEQ ID NO: 165529 - RNA, 64 nt, hsa
guccaacucuuuccaacagcccauuagacaccacuagcuggauauuucacaggcaucuuugauu

SEQ ID NO: 165530 - RNA, 64 nt, hsa
gguucaagcaauucuccugccucagccucccgaguagcuggaacuacaggcacacacugccgcg

SEQ ID NO: 165531 - RNA, 64 nt, hsa
accuacugaggaguacuuuucucuaguuguuaaauagcuggaguuuuucuuauucagguuuaau

SEQ ID NO: 165532 - RNA, 64 nt, hsa
ucuugaucuucaaugaacuuuuaaauaaugcauuuagcuggaaaacaagacuuucccagcuugu

SEQ ID NO: 165533 - RNA, 64 nt, hsa
cagcucucuacaccucuauauauuauauuacuauauagccgagcuguucuuccuuccuauggaa

SEQ ID NO: 165534 - RNA, 64 nt, hsa
agaaaaggaacaaucagaaguugcaaaagaugguauagccgaauauaauggaaauaggaaaaau

SEQ ID NO: 165535 - RNA, 64 nt, hsa
uuguacacaccuuauauuuacguaugagacguuuauagccgaaaugaucuuuucaaguuaaauu

SEQ ID NO: 165536 - RNA, 64 nt, hsa
cccagccgguacccaccaaaggagagaagaagcaauagccgaggaacuuggggggauggcgaau

SEQ ID NO: 165537 - RNA, 64 nt, hsa
gccuauuacggagcccucuucccagacuaaauucauagccgagagcucggggggaugguagagu

SEQ ID NO: 165538 - RNA, 64 nt, hsa
ugcacccucuucuccucuggcuucccucucugaaauagccgaacuccaggcugggcugagccaa

SEQ ID NO: 165539 - RNA, 56 nt, hsa
augcugcaggguacccauagcaaguuauagccgagcaaaugaaccguccuccugcc

SEQ ID NO: 165540 - RNA, 64 nt, hsa
aacuuuacucuugguucugagucuccaaauaauaauagccgacguuuauugagcacuuacuaug

SEQ ID NO: 165541 - RNA, 64 nt, hsa
ggggggagggccaugggagggguacaucgucaacauagccgauccuguuacauuuaagaguagc

SEQ ID NO: 165542 - RNA, 64 nt, hsa
aucauaguuucucuaaaaagaaaacuuggggaucauagccgauagagagacuugcuaaaauaua

SEQ ID NO: 165543 - RNA, 64 nt, hsa
uagaaagaauauuaaagaguagguugaacucuuuauagccgaauacagccuuaaauaugcuugu

SEQ ID NO: 165544 - RNA, 64 nt, hsa
acuucaaauuacaccuucaaaacuggagcagcauauagccgaaaaggagcacaacugagcacuu

SEQ ID NO: 165545 - RNA, 64 nt, hsa
acugcuggcagaaagggggcacccacacgcuuagauagccgaugucuuauuagagggcaguuug

SEQ ID NO: 165546 - RNA, 64 nt, hsa
accaucagucugaauccaggucgugggggcugucauagccgaacuccuucugcacauccagagg

SEQ ID NO: 165547 - RNA, 64 nt, hsa
gggcuucuagcugacuugcacagggauucucacaauagccgauaucagaauuuguguugaagga

SEQ ID NO: 165548 - RNA, 64 nt, hsa
ucucugccgucucuccugcucucauaaugaagacauagccgauucucugcccgggccccuugcu

SEQ ID NO: 165549 - RNA, 64 nt, hsa
auaugcauuuaauacaccuacccugcugaacaucauagccgaucuugccuucagaaugcucaga

SEQ ID NO: 165550 - RNA, 64 nt, hsa
acugaggcacacggccuggccuggcuucacacacauagccgacucaggagagggaugcccaugg

SEQ ID NO: 165551 - RNA, 64 nt, hsa
ccaccagagucacuggugaccccagaaaauggauauagccgaaaucugccuuuccccuuuuuca

SEQ ID NO: 165552 - RNA, 64 nt, hsa
gcuccggcuaaugauucgacagaggcuggaggagauagccgagaccccagcaacaaucugagcc

SEQ ID NO: 165553 - RNA, 64 nt, hsa
aagcagcaagaauggaccugaugucuuuaaaagcauagccgacaaugguagcuucucaaguuau

SEQ ID NO: 165554 - RNA, 64 nt, hsa
augugaacagggcacgcggugggcuggugguuucauagccgacacacagcgccuaccaugugca

SEQ ID NO: 165555 - RNA, 64 nt, hsa
agaaauacaucuguguccugaaaaccuuagauacauagccgacuguauacagagguucaucuca

SEQ ID NO: 165556 - RNA, 64 nt, hsa
gagucuaaaaugauacccuggguggagugggggagcugagcaggaggccagguggcaaccagua

SEQ ID NO: 165557 - RNA, 64 nt, hsa
caccaagagugguuuccaugccugcugggaauaggcugagcaugcaaugacaugagggccaagg

SEQ ID NO: 165558 - RNA, 64 nt, hsa
gccugggugggcaggaacugcaguauggccaugggcugagcaggcugagcaccucagccuuuag

SEQ ID NO: 165559 - RNA, 64 nt, hsa
ggcaggaacugcaguauggccaugggcugagcaggcugagcaccucagccuuuagggcuuaugg

SEQ ID NO: 165560 - RNA, 64 nt, hsa
cuccggauguccucuuugcccgucuucucccuuggcugagcaaagccauccccucaauucaggg

SEQ ID NO: 165561 - RNA, 64 nt, hsa
cauuguccccuggaaaccuguguggcuaaagucugcugagcaggcagcagccucugcucugugg

SEQ ID NO: 165562 - RNA, 64 nt, hsa
cugguagccuggccuuuccuggacagacugaagagcugagcagggcacugccagccugucccuc

SEQ ID NO: 165563 - RNA, 64 nt, hsa
aacaaugaaccagaggcuuggucagugugcagcugcugagcaaaaggguuagaggguggggagg

SEQ ID NO: 165564 - RNA, 64 nt, hsa
uccuaacguuugucauuccaguuugaguuaaugugcugagcauuuuuuuaaaagaagcuuugua

SEQ ID NO: 165565 - RNA, 64 nt, hsa
aaagcacaugagaaugcuagcaggcuguggggcagcugagcagcuuuucuccccucauaucugc

SEQ ID NO: 165566 - RNA, 64 nt, hsa
gccagcccagcccuguccucaccuuccagccccagcugagcagccccuccccacaucaucuuca

SEQ ID NO: 165567 - RNA, 64 nt, hsa
gcugguguuuaucgaugcuacgugccagaauggggcugagcacggcgccucacuguauccuaac

SEQ ID NO: 165568 - RNA, 64 nt, hsa
acggaggaagccgcuuauccuguuuucauggacagcugagcacuaaaggaauuucuaaggacau

SEQ ID NO: 165569 - RNA, 64 nt, hsa
uccuggccugagcgcagcgccuccacccugcccugcugagcacagacggaggaagccgcuuauc

SEQ ID NO: 165570 - RNA, 64 nt, hsa
ugggguaguaguguguuguagucguacuuaccaagcugagcaaccucuucagcugggaaggccg

SEQ ID NO: 165571 - RNA, 64 nt, hsa
cugggaguccugucagcuuccccaggagcucucugcugagcagcccagcacaacccccaggaaa

SEQ ID NO: 165572 - RNA, 64 nt, hsa
ggcucagaucagagcuccgaagcggucaaagugagcugagcaggacaggcccagccuuucucca

SEQ ID NO: 165573 - RNA, 64 nt, hsa
cgggcaaaauacgugcucuccucucuccuugucagcugagcaaacccagggaauagcccuccuc

SEQ ID NO: 165574 - RNA, 64 nt, hsa
augcuaacagaucccccugagggauucuugaugggcugagcagcuggcuggagcuaguacugac

SEQ ID NO: 165575 - RNA, 64 nt, hsa
ccugaggaaguacugaccaugcccacagccaccggcugagcaaagaagcucauuucaugugagu

SEQ ID NO: 165576 - RNA, 64 nt, hsa
gccagggucacugaaggccuggcccacagcaggugcugagcaaagggaacagugaggugcccag

SEQ ID NO: 165577 - RNA, 64 nt, hsa
cuuaaggggcagcuucuauuagccagucuuuacagcugagcacauucuggcucagggagguuaa

SEQ ID NO: 165578 - RNA, 64 nt, hsa
ccucuccagaauggcgacuguccccauccgccuggcugagcaggagagagggagcuggcggugc

SEQ ID NO: 165579 - RNA, 64 nt, hsa
ggcugaggucaauaccgcagaccuuggggaggaagcugagcaucccccgggaugucuccagucc

SEQ ID NO: 165580 - RNA, 64 nt, hsa
uggagggcccuacuccacacccuagagcugugaugcugagcaaggugccuguggcggaaggaac

SEQ ID NO: 165581 - RNA, 64 nt, hsa
gcagccuuuccuguugucacauggguucagagcagcugagcagggaacacguccuaggcagguc

SEQ ID NO: 165582 - RNA, 64 nt, hsa
uugaguucuucuuuucauggcuuuuauucacugugacuaauaagcuuccuaauaaauccuugcc

SEQ ID NO: 165583 - RNA, 64 nt, hsa
gaagagguaacuaaaucucacaugcaggucuaaugacuaauaauuggaguacggcugcuagaca

SEQ ID NO: 165584 - RNA, 64 nt, hsa
cgggaacuuauccccgacagugacugaacucacugacuaauaacuucauuuaugaaucuucuca

SEQ ID NO: 165585 - RNA, 64 nt, hsa
uuggaauucacuauucuggcaauaaauuuugguagacuaauacaguacagcuagacccagaaau

SEQ ID NO: 165586 - RNA, 64 nt, hsa
auggugauuaguguuaaaaaucaauuuaaaucaugacuaauaugguaaaaagauaaagcaucaa

SEQ ID NO: 165587 - RNA, 64 nt, hsa
aauuguggucucucuuaacuugagguucucuuuugacuaauagagcuccauuuccccucuuaaa

SEQ ID NO: 165588 - RNA, 64 nt, hsa
ugggugugcccuggcucccaagggaggcccaugugacuaauaaaaaacugugaacccuguggag

SEQ ID NO: 165589 - RNA, 64 nt, hsa
aaauacuugcaauauauuuuuccuuuauuuuuaugacuaauauaaaucaagaaaauuuguuguu

SEQ ID NO: 165590 - RNA, 64 nt, hsa
ccuuuccccuuaagagacaguuggaauaccaguugacuaauauuacaagcucuuguagggggaa

SEQ ID NO: 165591 - RNA, 64 nt, hsa
gucccauccuuuuaaucaaggugauugugauuuugacuaauaaaaaagaauuuguaauuguggg

SEQ ID NO: 165592 - RNA, 64 nt, hsa
gaaugugcauuucuugacuucacagcagccacuugacuaauaccuuguguuccgggaauaacau

SEQ ID NO: 165593 - RNA, 64 nt, hsa
uaugcucucauuccucagguguuuugagaaacaugacuaauaaccacacaauuaaguagaguca

SEQ ID NO: 165594 - RNA, 64 nt, hsa
agauguuugcuaacuucaaaacugugcuugaauagacuaauaauauaugcucauaucagauguc

SEQ ID NO: 165595 - RNA, 64 nt, hsa
acagcuacaccaaaacucuucuuguaagaauacugacuaauaugccauguuaaucuggcuagau

SEQ ID NO: 165596 - RNA, 64 nt, hsa
cucccuuuuuauuuugccugcagaaucguugagagacuaauaaggcuuaauauuuaauugauuu

SEQ ID NO: 165597 - RNA, 64 nt, hsa
acugauguaacuuucuagacuggacaacaaagaugacuaauaguaaucacuccaaguugauguu

SEQ ID NO: 165598 - RNA, 64 nt, hsa
ccgcauuuuuaaaugguugggaaaagaaaucaaagacuaauaauucaugacgugaaaauuauca

SEQ ID NO: 165599 - RNA, 64 nt, hsa
guguuuuggggcauuuguggaacuuacccauggggacuaauauggaaaaggucuguccauagug

SEQ ID NO: 165600 - RNA, 54 nt, hsa
uuuggcaaugcaaagaaugaagaugacuaauaguacuuguacuucccaccacug

SEQ ID NO: 165601 - RNA, 64 nt, hsa
cugaacugcuaauguggcugcuuuguagggaauggacuaauaucaguguguuagaucuuaaggu

SEQ ID NO: 165602 - RNA, 64 nt, hsa
uacgauucaguauguuccuguggaugucugcugugacuaauauaaauuucuugcagaaucagcu

SEQ ID NO: 165603 - RNA, 64 nt, hsa
cugaccuguuuuugguccacuuuugcccuuccaugacuaauaaggaagauauguguguauuuca

SEQ ID NO: 165604 - RNA, 64 nt, hsa
uauagcauugauacuaggugaacagaaauuaccugacuaauaauuugucuaacaucauauauca

SEQ ID NO: 165605 - RNA, 64 nt, hsa
guaaguucggcauuuguuacauguauagagagaagacuaauaaucucuauuuauaacuaaauca

SEQ ID NO: 165606 - RNA, 64 nt, hsa
aaaaaaaaaguaaauauccagggaacccugcccagacuaauacuguugguggcauaagagaauc

SEQ ID NO: 165607 - RNA, 64 nt, hsa
gcuuugauuucucccaaagaauaacuuggagguugacuaauaagaaaguuggcauaaacuuuca

SEQ ID NO: 165608 - RNA, 64 nt, hsa
accugcugggguccuuuguuaggucauuuucagugacuaauagggauaauccagguaacuuuga

SEQ ID NO: 165609 - RNA, 64 nt, hsa
uccuuugcaaauggcucagugacuggaagaggcggacuaauagccagaguuaaauauaaauaca

SEQ ID NO: 165610 - RNA, 64 nt, hsa
ucaaauugauaaaauauuuagguacaaauaacaagacuaauaauauuuucuuauuuaaaaaaag

SEQ ID NO: 165611 - RNA, 64 nt, hsa
acaaaugauugcaugaggccauguuuauaugugugacuaauaaggcuugucaugauuaacauaa

SEQ ID NO: 165612 - RNA, 64 nt, hsa
cuuuggcuguguuuuaucuuuaaugaacguuucugacuaauauuuuguuguaaaccauuaagua

SEQ ID NO: 165613 - RNA, 64 nt, hsa
aaguaauuuuuaaauauuuguaauauuguugacugacuaauaaacuauuaaguuauuggcauag

SEQ ID NO: 165614 - RNA, 64 nt, hsa
cugaacauuuuugcuuugcugccagaguaacccugacuaauaauacaauaacagcaauuuuuuu

SEQ ID NO: 165615 - RNA, 64 nt, hsa
gaacuccugacuaccauucuaugacugaucaaaagacuaauaguuaaaaaccucagcaggccuu

SEQ ID NO: 165616 - RNA, 64 nt, hsa
ugauagugguguucacuaggagacguggaauugagacuaauaacuuggauguuaacacuguuua

SEQ ID NO: 165617 - RNA, 64 nt, hsa
ggcgcaggauccaggcgcugcccgugcguucagugacuaauaaaaugacccuuagggccaggaa

SEQ ID NO: 165618 - RNA, 64 nt, hsa
cauuaaauuugguuuguuuugcuauguacagucugacuaauaacugcuaauuugugauccaaca

SEQ ID NO: 165619 - RNA, 64 nt, hsa
cacuucguugauccauccagcccuaaaguucauugacuaauagcucaugcaucuuauuaaaugg

SEQ ID NO: 165620 - RNA, 64 nt, hsa
uuuauguauugauggggacuuuuccaccucauuagacuaauacucauucaaaaagaguuugguu

SEQ ID NO: 165621 - RNA, 64 nt, hsa
uauggauauaaauguaggcaaaaugaaagauuaugacuaauauucagauuccauuuucaauaag

SEQ ID NO: 165622 - RNA, 64 nt, hsa
uauauuaagugcacuugaguggaauucaacauuugacuaauaaaaugaguucaucauguuggca

SEQ ID NO: 165623 - RNA, 64 nt, hsa
uagauaaauucccagguguagcauuacagcuucugacuaauauagcugccauucagacaauuaa

SEQ ID NO: 165624 - RNA, 64 nt, hsa
ugcuuauauuggccaaaauauggacacaaauauagacuaauauggguaauuacccuuugguuua

SEQ ID NO: 165625 - RNA, 64 nt, hsa
aaagggaauuauuucucagucuuucaaggcuugagacuaauauaggccauugugauucaggaag

SEQ ID NO: 165626 - RNA, 64 nt, hsa
guuaauuacaugucagacuccuagagggccuccagacuaauaggaagcauuucuguaaccaacc

SEQ ID NO: 165627 - RNA, 64 nt, hsa
uuuuaaguuugauuuccugucuguaauuuucaaggacuaauauagcaaauuuuucuucugccau

SEQ ID NO: 165628 - RNA, 64 nt, hsa
agaagauauguuuuaucuuuuuuuaacuuuauuugacuaauaugacugucaauacuaaaauuua

SEQ ID NO: 165629 - RNA, 64 nt, hsa
ugaaauagccaggaaacuucuuugaauggaauuugacuaauauguguguuuucuuuucuuuugu

SEQ ID NO: 165630 - RNA, 64 nt, hsa
cugccauuaacacaucugguuacugcuguaacaugacuaauaaaaccgaacgccuguuccccuu

SEQ ID NO: 165631 - RNA, 64 nt, hsa
auaucauauugauuuugucucucuggagaacccugacuaauaaaaugaggcaucuaaaauucua

SEQ ID NO: 165632 - RNA, 64 nt, hsa
uauagaaaccaaauauuuuacuguuucuuuuaaggacuaauauugucaaaaacugcuguuauua

SEQ ID NO: 165633 - RNA, 64 nt, hsa
gccuaguccagugguucucaaagugugauccauagacuaauagcauagcauuaccugagaacuu

SEQ ID NO: 165634 - RNA, 64 nt, hsa
auaguguucaguaaaaugaagcagucuuaagagugacuaauaauuucaaagugauuuuucgucu

SEQ ID NO: 165635 - RNA, 64 nt, hsa
uaaucaugugaaacuuuuccuagaugcaaaugcugacuaauaaagacaaagccacccugaaccu

SEQ ID NO: 165636 - RNA, 64 nt, hsa
ggaucagcaggagcuuuauaaaugacuuuacagagacuaauaagggauuugaucuuucuuuuuu

SEQ ID NO: 165637 - RNA, 64 nt, hsa
uacauauuccacauauguauuuaguauaaucugugacuaauaaagacauuuuaaaaaaccaugc

SEQ ID NO: 165638 - RNA, 64 nt, hsa
uuucguguggauguacuccaaguaaagcuccagugacuaauauguauaaauguuaaaugauauu

SEQ ID NO: 165639 - RNA, 64 nt, hsa
aaggcaacacaacuaaugucaucuuuucauuaaagacuaauagaaauuuagaaaucauuguguu

SEQ ID NO: 165640 - RNA, 64 nt, hsa
uuugacauuaugugaauauuuuacuggaaaauaagacuaauaaauuguuaaaaguuuuuaaaau

SEQ ID NO: 165641 - RNA, 64 nt, hsa
uaucacuauguauuuuaugaacagaauugacugggacuaauaucacaggaucaaucaucucaga

SEQ ID NO: 165642 - RNA, 64 nt, hsa
gugcuucuugcagcagguggucaaagaaaagcaugacuaauacgaccuauuagaguaaucuaca

SEQ ID NO: 165643 - RNA, 64 nt, hsa
uuuguuuuuguuguuggauaacaagaaaugucuagacuaauauucaucaguuuuacaaacauaa

SEQ ID NO: 165644 - RNA, 64 nt, hsa
uggacucuaaagaccaauguuuggccacuaacuggacuaauauguaucuuucugugauuucauc

SEQ ID NO: 165645 - RNA, 64 nt, hsa
aauguaugucuagcaucaaaugaguauuguaaaagacuaauauaaaaugguuuauaagacugau

SEQ ID NO: 165646 - RNA, 64 nt, hsa
auuuaggauuugccgcuuccauaaaucaaagcaugacuaauagggggucucugaaauguaaggg

SEQ ID NO: 165647 - RNA, 64 nt, hsa
ggaucagaaaauauacacuauauuuauuagagaagacuaauaaauggacacuuaauucaaaaau

SEQ ID NO: 165648 - RNA, 64 nt, hsa
uagcacuauuuaaaauaagcacaccaaguuauaugacuaauauaacuugaaaauuuuuuauacu

SEQ ID NO: 165649 - RNA, 64 nt, hsa
ccaaguggugccuaaaguuuaaccaaaaagaccagacuaauauauuaauauauaucugcugucc

SEQ ID NO: 165650 - RNA, 64 nt, hsa
ugagaccugguacaacacggaaaugauucuuauagacuaauacagcagcucacacuucgacaag

SEQ ID NO: 165651 - RNA, 64 nt, hsa
gucaugggcaguccuuuacagcagcaugagaauggacuaauacacuccucaaauguuuugaaga

SEQ ID NO: 165652 - RNA, 64 nt, hsa
ucaaaaucaacacaauguguucugaaacuuucgugacuaauaccaugcaucugugaucaaugaa

SEQ ID NO: 165653 - RNA, 64 nt, hsa
cuuuauuuuaauagugaucuugauccuguugugggacuaauacaagaucuauauuuaaguuuua

SEQ ID NO: 165654 - RNA, 64 nt, hsa
ugaaaccuguuucaacauggaaaugaucuguauugacuaauacaccaguccacacuucuaugac

SEQ ID NO: 165655 - RNA, 64 nt, hsa
ugaaaccugguucaacauggaaaugauccugauugacuaauacauuaucucacacuuucaugag

SEQ ID NO: 165656 - RNA, 64 nt, hsa
ugaaaacugguucaacauggcaaugauccugauugacuaauacauuaucucacacuuucaugag

SEQ ID NO: 165657 - RNA, 64 nt, hsa; identical to SEQ ID NO: 165656

SEQ ID NO: 165658 - RNA, 64 nt, hsa
ugaaaacugguucaucauggaaaugauucucauugacuaauacaucaucucacacuuucaugag

SEQ ID NO: 165659 - RNA, 64 nt, hsa
aguaaccaguaguucaucaaaaccaacuuguacagacuaauaaaucuuuuucacaguauucagu

SEQ ID NO: 165660 - RNA, 64 nt, hsa
gauccccaguguuuggaacauaagucacuaugcagacuaauaaacaucaacuagagagaacucc

SEQ ID NO: 165661 - RNA, 64 nt, hsa
uauuacugcuaccacuaacagguuguaaauagaagacuaauacuuaauuaaagucaccuuccua

SEQ ID NO: 165662 - RNA, 64 nt, hsa
guuucagugcagcaugguuacuaacgcuaugucagacuaauauuaaaaucagaaaauuuaaaug

SEQ ID NO: 165663 - RNA, 64 nt, hsa
auauuuugcacuacacaaacgauaacauuuuaaggacuaauauugcugauacuugaauaaucaa

SEQ ID NO: 165664 - RNA, 64 nt, hsa
auuuuaaacacuuuuccaaagugauucuuauccagacuaauauuugagaaguacuguauuaaau

SEQ ID NO: 165665 - RNA, 64 nt, hsa
ucacaaaauauauuuuaucugugauuagccauuugacuaauaauacuggcuaacagauguugaa

SEQ ID NO: 165666 - RNA, 64 nt, hsa
aaauuaaagaauaaaguuagacaagcaacugguugacuaauacauuaagcguuugagucuaaga

SEQ ID NO: 165667 - RNA, 64 nt, hsa
ggaguacccccagcccaagagaugaacaucuggggacuaauaucauagacccaucuggaggcuc

SEQ ID NO: 165668 - RNA, 64 nt, hsa
cuguaaaugggggcuccauuaguucugcugccgagacuaauaaagauuugguuggcucuagcag

SEQ ID NO: 165669 - RNA, 64 nt, hsa
cauuugauuauuuucacuauuaguuauuauguaugacuaauaaaagcucucggcuuaaaauuau

SEQ ID NO: 165670 - RNA, 64 nt, hsa
gcugaacuaguagccacaucuuguucaucacauagacuaauagaaaggaggcuguggcuaaagc

SEQ ID NO: 165671 - RNA, 64 nt, hsa
uaaaauguuguagugaagcccacaauugaccuuugacuaauaggaguuuuaaguauguuaaaaa

SEQ ID NO: 165672 - RNA, 64 nt, hsa
agaaucguuccuuccuugcugcauuuccuccuuagacuaauagacguuuuggaaaguucggcua

SEQ ID NO: 165673 - RNA, 64 nt, hsa
gaauuaacauuuggugauuaugccuagcuuuuuugacuaauauaaagaucauagcuccccuuca

SEQ ID NO: 165674 - RNA, 64 nt, hsa
uaacuguuagucuuaaauaguugggacaucagcugacuaauagaccucagccucaaaaggcuug

SEQ ID NO: 165675 - RNA, 64 nt, hsa
auggaaaguaauugguauucuuaauauccugggugacuaauauccaggcagagaagcuccugga

SEQ ID NO: 165676 - RNA, 64 nt, hsa
aucuuaaacccuacaaauuguucuuguuaaaaaugacuaauacugggggugcucaauaugcaua

SEQ ID NO: 165677 - RNA, 64 nt, hsa
ucauaaucccaacuacaauaacaagaauuuuauugacuaauaagggaauauguauggaagaagg

SEQ ID NO: 165678 - RNA, 64 nt, hsa
gagagagacucaaagagacuccaagauucaaagagacuaauagagacacagagauggaauagaa

SEQ ID NO: 165679 - RNA, 64 nt, hsa
uagaaucaaacauuuugaaagucuguccuugaaggacuaauagaaaaguauguucuaaccuuua

SEQ ID NO: 165680 - RNA, 64 nt, hsa
uuguuuuuuuuucuuuuguacugagcucagcauagacuaauacuaccuuaauguuaaaaucuga

SEQ ID NO: 165681 - RNA, 64 nt, hsa
aaucaugucauacauuuuugguuuucuaagcagagacuaauacaaaugcagccacauaaaggca

SEQ ID NO: 165682 - RNA, 56 nt, hsa
ccuuaagugcugggcaguaaggacuggacuaauauucaggacccacuaaaguagac

SEQ ID NO: 165683 - RNA, 64 nt, hsa
ugcauccccauccucaagacaguauauuuaccuugacuaauacagaacucuaccccaaagugaa

SEQ ID NO: 165684 - RNA, 64 nt, hsa
uuuugaaugcccaacuguugcauucaaguuuucugacuaauaagaaauuaagcauucauccuuc

SEQ ID NO: 165685 - RNA, 64 nt, hsa
guuuucaugaccaauccuaugucauuucuacuuugacuaauacccaaacccuaaaccucuucac

SEQ ID NO: 165686 - RNA, 64 nt, hsa
aauucauuagagaagaauuuuuaguagauacacagacuaauauuuguguggagguucuuuugac

SEQ ID NO: 165687 - RNA, 64 nt, hsa
gccucaguucauuuucaguuguuugauuauaugugacuaauauguauuuuuuauucaaacaaga

SEQ ID NO: 165688 - RNA, 64 nt, hsa
ggauggagaaucagcaagagaaaugcuguauuaggacuaauaauccaucuacgcugcuuaagca

SEQ ID NO: 165689 - RNA, 64 nt, hsa
aaagaaccgacuucugaaucgcagcuccacucaugacuaauaccucauuauuucagcugucugc

SEQ ID NO: 165690 - RNA, 64 nt, hsa
uacugugaauaaugugugugaaggacuuuauuccgacuaauacucuuuuugucgcauuauauac

SEQ ID NO: 165691 - RNA, 64 nt, hsa
ucaccaucaagcaauccauaguauagggaaacuugacuaauauaaugauugucacaaaguuuuc

SEQ ID NO: 165692 - RNA, 64 nt, hsa
cugggaacuugugggacucaccugacucaaagaugacuaauaucgucccauuuuggaaauaaag

SEQ ID NO: 165693 - RNA, 64 nt, hsa
acucugggacucacuagauucugcagucaaagaugacuaauauccuugcauuuuugaaaugaag

SEQ ID NO: 165694 - RNA, 64 nt, hsa
ucugcacagccuugagugauuggaguccccuaaugacuaauaaacuugaacauguaacacacac

SEQ ID NO: 165695 - RNA, 64 nt, hsa
uauuacuggguauaguaugugacuccucuucucagacuaauaaauuaucuuuugaauccuuggu

SEQ ID NO: 165696 - RNA, 64 nt, hsa
aaguggggaagacagacuuuaggaucacgugugugacuaauacagaaaggaaacauggcgucgg

SEQ ID NO: 165697 - RNA, 64 nt, hsa
agacaauuagaaacuauuuuucuuauuaacuggugacuaauauuaacaaaacuugagccaagag

SEQ ID NO: 165698 - RNA, 64 nt, hsa
guauuaaugaagugauuaauuggcuccauauuuagacuaauaaaacauuaagaaucuuccauaa

SEQ ID NO: 165699 - RNA, 64 nt, hsa
gagccccagucuauaaauacagucacacccaggagacuaauaauaguaaccccagccaccaugu

SEQ ID NO: 165700 - RNA, 64 nt, hsa
auagaaguauucgaaguauaguuccauuuuuugagacuaauaaaacauauguuuaaaaggacac

SEQ ID NO: 165701 - RNA, 64 nt, hsa
aauaaaauaagagugauacugaaagugcucagaugacuaauauuaugcuauaguuaaauggcuu

SEQ ID NO: 165702 - RNA, 64 nt, hsa
ugccaagugaucaugagugucauuuuuguucuaagacuaauauuuuuagaucuuuuuacuucac

SEQ ID NO: 165703 - RNA, 64 nt, hsa
uugcaauagaugccacugggccacggggugccuggacuaauaacuauucucacaguaaaagagg

SEQ ID NO: 165704 - RNA, 64 nt, hsa
ggagacacucagacacuugaacucaucuuuuuaugacuaauaguuuuuugauuaaaaaugugaa

SEQ ID NO: 165705 - RNA, 64 nt, hsa
cuuucauuuguagggauauuuguuuuucauaucagacuaauaaaaagaaauuagaaaccaagua

SEQ ID NO: 165706 - RNA, 61 nt, hsa
aguggggaacagggccagcaagacagaccaccagccagaaaucucugauaucaaccucaug

SEQ ID NO: 165707 - RNA, 61 nt, hsa
gggaagaaauaccccagacccaacaaaccuccagccagaaagccagcuauuuugcauuuga

SEQ ID NO: 165708 - RNA, 61 nt, hsa
agacuggaugcuggaucucauagaaaauucacagccagacaaucuucuaaucuggagucuu

SEQ ID NO: 165709 - RNA, 61 nt, hsa
cauggaccaacagugauugaggauuugugggcagccagagggagucugacugaaguuuacu

SEQ ID NO: 165710 - RNA, 61 nt, hsa
uccaucugcuuguauuuuccauacacauccccagccagaaguuaguguccgaagaccgaau

SEQ ID NO: 165711 - RNA, 61 nt, hsa
agggccuagcuuucauuugacacacagacuacagccagaagcccauggagcagggauguca

SEQ ID NO: 165712 - RNA, 61 nt, hsa
gauacaguccacagguggacaaagggauccccagccagagagagagagaccagccaacagc

SEQ ID NO: 165713 - RNA, 61 nt, hsa
agagaccagccaacagcuugauagaccagugcagccagagagaccaccaaacagagccccc

SEQ ID NO: 165714 - RNA, 61 nt, hsa
ccagcaaaucaggaccuaucuaggcagaccccagccagacccccgccagacagacucccaa

SEQ ID NO: 165715 - RNA, 61 nt, hsa
ggaugcucagggagggauaugcuggugugagcagccagagggagagugugucuccuuccug

SEQ ID NO: 165716 - RNA, 61 nt, hsa
uuuuguuucuccuggggcuguguucugcaggcagccagaaaaggaggaggcacgggugagc

SEQ ID NO: 165717 - RNA, 61 nt, hsa
accacgcaagggcagagcugggcggcauccacagccagagaggcagaggcaagagcagagc

SEQ ID NO: 165718 - RNA, 61 nt, hsa
cauggaugcaguugugacucuggggacaaugcagccagaagcugagggaccagcacuuggu

SEQ ID NO: 165719 - RNA, 61 nt, hsa
gagaugugcccacugcccgugcagccuccuucagccagagcccagagcauagacaggagug

SEQ ID NO: 165720 - RNA, 61 nt, hsa
uuuccuggagcucuuggcuucagccagcccccagccagaguccuggcuaggacagugaccu

SEQ ID NO: 165721 - RNA, 61 nt, hsa
agcccuggcuagacugaauuacacuagaaaucagccagaaggaagcguccuugggauccca

SEQ ID NO: 165722 - RNA, 61 nt, hsa
gugauucuguccucaaauaaagcccuucacucagccagaccucuccacagcucaaagcauu

SEQ ID NO: 165723 - RNA, 61 nt, hsa
cugcaucuauucuuuguaccaucugucuugccagccagaagccucugccucccuagcuuuu

SEQ ID NO: 165724 - RNA, 61 nt, hsa
agcuugagagggcaaacccaaaaccucaugacagccagagccugucuuucagcauucaguc

SEQ ID NO: 165725 - RNA, 61 nt, hsa
gcucuuucagaagacccaggaagggcagcuccagccagaggaccuuccuggcuaugcaggu

SEQ ID NO: 165726 - RNA, 61 nt, hsa
acuucagccgcccaauuccaucucuccucugcagccagauucacuggcugaugcucacugc

SEQ ID NO: 165727 - RNA, 61 nt, hsa
gucucggggguggucacaaccccacaucccacagccagaaagaacaauggucaucugagaa

SEQ ID NO: 165728 - RNA, 61 nt, hsa
ucacauagucauugucccuuacugccagacccagccagacuuugcccugacggaguggccc

SEQ ID NO: 165729 - RNA, 61 nt, hsa
ucacuaauguuagccuuauuuaggacaaagucagccagacaccuuguacugggcacgcguc

SEQ ID NO: 165730 - RNA, 61 nt, hsa
uuuucuacacaggauccaaggucacgagaagcagccagagugccccgccuccgccggcucu

SEQ ID NO: 165731 - RNA, 61 nt, hsa
cgcgguggcugggucugcacacuggccucugcagccagauuucuauauugggaguuuuuua

SEQ ID NO: 165732 - RNA, 61 nt, hsa
guggugaggccauguucucauaaucaggcuccagccagaaaaauaagaaacaccgcaacag

SEQ ID NO: 165733 - RNA, 61 nt, hsa
ucacagaagcugcgacucuagaccaggccugcagccagaacgccgauuccgggagcuuggg

SEQ ID NO: 165734 - RNA, 61 nt, hsa
cucggagggagcugcucagggccggugagcgcagccagaagcccuggccagugaggagcuc

SEQ ID NO: 165735 - RNA, 61 nt, hsa
auuggccccagccuucugaaagccggcgcugcagccagaggccgcacgcugcacugucgcg

SEQ ID NO: 165736 - RNA, 61 nt, hsa
aggaacaccaggcccagcgcccucuuugguccagccagacccugggcccucucuccucacu

SEQ ID NO: 165737 - RNA, 61 nt, hsa
cuggccugugcgucugcccccuucugagaugcagccagaagcucugugccugcugcaaaga

SEQ ID NO: 165738 - RNA, 61 nt, hsa
ggcuguuguccaaagcaugggauucuggaggcagccagagcccugcugaguuccugcuuuc

SEQ ID NO: 165739 - RNA, 61 nt, hsa
ggcuucuuccugagauauccucagguuuucucagccagagagcugccuuuagaguccaacu

SEQ ID NO: 165740 - RNA, 61 nt, hsa
ccaccucccuuucuuagcagaaucuaaauuacagccagaccucuggcugcagaggagucug

SEQ ID NO: 165741 - RNA, 61 nt, hsa
ccuuggugguaaaagaggguugcauuucuugcagccagaaggcagagaaagugaagaccaa

SEQ ID NO: 165742 - RNA, 61 nt, hsa
aggcagcuggggcugaggcccaaaggcagaacagccagagggggcaggaggggaccaaaaa

SEQ ID NO: 165743 - RNA, 61 nt, hsa
ugcccaggcagcguggaggggaaggguagggcagccagagaaaggagcagagaaggcacac

SEQ ID NO: 165744 - RNA, 58 nt, hsa
aggauggcuccugugacuagaggguggucagccagagcucaugggacagcuagccagg

SEQ ID NO: 165745 - RNA, 61 nt, hsa
auaggggcagggcacucauuaaagugcaucacagccagagccuguugugucucaguugggu

SEQ ID NO: 165746 - RNA, 61 nt, hsa
gggugacugggacccagccuuugggccuccccagccagagcagcccagcaacagugugucc

SEQ ID NO: 165747 - RNA, 61 nt, hsa
guguccucugacguaugcccccaaagcucuccagccagacugaggucacagaugugggaga

SEQ ID NO: 165748 - RNA, 61 nt, hsa
uccucccguccaccccagaggggaaguuccucagccagacucuucagccaaaugccccaac

SEQ ID NO: 165749 - RNA, 61 nt, hsa
cagaugaguugaguggggcagagggacagggcagccagaccaaggccaagccuucucaccc

SEQ ID NO: 165750 - RNA, 61 nt, hsa
aggagacccuaaggccccgggagcccagugccagccagagguugugcaggcaaggagacca

SEQ ID NO: 165751 - RNA, 61 nt, hsa
uguugauuguuaugacugguacacucuggcccagccagagcuauaauuguuuuuuaaaugu

SEQ ID NO: 165752 - RNA, 61 nt, hsa
aaaccucagugaaaucaagaaauaaugaucccagccagacugagaaaauguaagcagacag

SEQ ID NO: 165753 - RNA, 64 nt, hsa
uuuuccaucccacuccacuauguugucuauuuuuucugaggaauuaaggguuaccccacccugc

SEQ ID NO: 165754 - RNA, 64 nt, hsa
gagaccuagauaggucaugcaagugagaaagacaucugaggaaaauggaagaccuaaggcagac

SEQ ID NO: 165755 - RNA, 64 nt, hsa
cugcugaaaucgcagagacuuuugcagcaucagaucugaggaguaaaacggcaccucuggccuu

SEQ ID NO: 165756 - RNA, 64 nt, hsa
aucacugguggguugcaggaacagcacccaggacucugaggagggacagagaagcaagggggcu

SEQ ID NO: 165757 - RNA, 64 nt, hsa
ccaacuguuacaacuuaguuuggauguaagaugcucugaggacccugcccacaccccugcgugc

SEQ ID NO: 165758 - RNA, 64 nt, hsa
caagcccaggcucgcaguaucaauaaagcaguucucugaggaaugacuccugggcucuugucag

SEQ ID NO: 165759 - RNA, 64 nt, hsa
acauccucucagcuacuccagggcaccugacugcucugaggagagggaagaaggccugcugggg

SEQ ID NO: 165760 - RNA, 64 nt, hsa
uuccuguuuuaauuccuaaagauccugacuuuuaucugaggaagucuagguaguuuuccuuuug

SEQ ID NO: 165761 - RNA, 64 nt, hsa
uuagauaaggauaaaaauauauuugugaauuacuucugaggaaaugcuaacuuccacagcauug

SEQ ID NO: 165762 - RNA, 64 nt, hsa
ggcacugagccacugcgcccagccaacaauccgcucugaggaaagcguaagcaggaagaccucu

SEQ ID NO: 165763 - RNA, 64 nt, hsa
uccuaguuguguuuggaaagggagagaagagaugucugaggaaggucauguucuuucagcuuau

SEQ ID NO: 165764 - RNA, 64 nt, hsa
aaaucacugacaaauaguggauauagguuucauuucugaggaucaauaaacagcuuguaauguu

SEQ ID NO: 165765 - RNA, 64 nt, hsa
uauugcugaagccaaccagagaucuugaucucucucugaggaaaaaaccuagaaaugaugguua

SEQ ID NO: 165766 - RNA, 64 nt, hsa
gguaugcuuuggggcugggguagcauggaaucccucugaggaccuggauacugguacuacgggg

SEQ ID NO: 165767 - RNA, 64 nt, hsa
ggccggccagggcuggggcagugccagacucugaucugaggaccccgucgggguccagaucagg

SEQ ID NO: 165768 - RNA, 64 nt, hsa
aaauugcuauucuuccuguuguccaaaccauaaaucugaggauaaccugggcuuuucucuuucc

SEQ ID NO: 165769 - RNA, 64 nt, hsa
uuguguauaaaaccagauuagacuauauucuucaucugaggagcaucuauauguuuaauacacc

SEQ ID NO: 165770 - RNA, 64 nt, hsa
gaugaucccagcugugcucuggacaggcauguucucugaggacacuaaccacgcuggaccuuga

SEQ ID NO: 165771 - RNA, 64 nt, hsa
cuccccagcaagugagagcugggugucaagagggucugaggaauccagacccggcugcgugguu

SEQ ID NO: 165772 - RNA, 64 nt, hsa
cuguaaauuuaguuucuacuugggcagccaaaacucugaggaaggagauucugcuaguaaaaag

SEQ ID NO: 165773 - RNA, 64 nt, hsa
aaucucucauuacuccuggucuugggaguugccuucugaggauacuccacuggggguaccugag

SEQ ID NO: 165774 - RNA, 64 nt, hsa
ucaagcagguuaaagccauugugcuaagaucuaaucugaggacacuauaauggcccugucguca

SEQ ID NO: 165775 - RNA, 64 nt, hsa
gaguacaauauggcucauugacuuuuccauuacaucugaggauuccagaguccucuguucaucc

SEQ ID NO: 165776 - RNA, 64 nt, hsa
auguagcaggucacagaaguguucaccuguuucaucugaggauuucaguucugaagugaucuag

SEQ ID NO: 165777 - RNA, 64 nt, hsa
uuagucucuucaggaucuuuaguauuuuccugguucugaggaggcuugagacaggguuauggau

SEQ ID NO: 165778 - RNA, 64 nt, hsa
cugcacucuggagguggguggugcaggcgguggagggacacaggccagcucaagcccgcuggug

SEQ ID NO: 165779 - RNA, 64 nt, hsa
acagggcggcgggcugcggucagcacgugugcucgggacacagcggagucagggccagagcccu

SEQ ID NO: 165780 - RNA, 64 nt, hsa
gaagugugagugacacuugcuggggguggagggugggacacaugaggauguauaaguacagauu

SEQ ID NO: 165781 - RNA, 64 nt, hsa
cagagguacaggagcugggagaguccaggagcuagggacacagagggagacuauggaccaaggu

SEQ ID NO: 165782 - RNA, 64 nt, hsa
aggcggugcucagcacggggugucauccugugaagggacacagagaacaggugggugcagcagg

SEQ ID NO: 165783 - RNA, 64 nt, hsa
cauguaugucuccccacuaaccacauccuaccuagggacacacaggcagcugaagaacaucugg

SEQ ID NO: 165784 - RNA, 64 nt, hsa
ucugggagauacaauucaaguugagauuuguggggggacacaaccaaaccauaucagcauccuu

SEQ ID NO: 165785 - RNA, 64 nt, hsa
auguuggccccuuucagccauggcuggaguggcugggacacaagacaccaagucccuaggcugc

SEQ ID NO: 165786 - RNA, 64 nt, hsa
caguaugucucuuucaacucuaguuuuugagguggggacacaggagguccagugggacacagcc

SEQ ID NO: 165787 - RNA, 64 nt, hsa
cuaguuuuugagguggggacacaggagguccagugggacacagccacuccccaaagaguaagga

SEQ ID NO: 165788 - RNA, 64 nt, hsa
auuaucugucccaaacaguauaugccuuuuaucagggacacauuaaauauaaauguuuaaccaa

SEQ ID NO: 165789 - RNA, 64 nt, hsa
aaggugggaugggggaucugccugaagcagggaugggacacaaagucccuccagcuuaucuccc

SEQ ID NO: 165790 - RNA, 64 nt, hsa
cacagagagcggcuuccccauugccuucuggggagggacacagaggacagcuuccccaucgccu

SEQ ID NO: 165791 - RNA, 64 nt, hsa
cacagaggauggcuuccccauugccuucuggggagggacacagaggacggcuuccccaucgccu

SEQ ID NO: 165792 - RNA, 64 nt, hsa
gagagaagccucccgacccugugcccuggcucccgggacacauagaaaccuguaggaacccagc

SEQ ID NO: 165793 - RNA, 64 nt, hsa
caggaucggcccgagacccaggccaugcccacuggggacacacugugccgugcuccuucugccg

SEQ ID NO: 165794 - RNA, 64 nt, hsa
cggccuaggugucccaggugccccgccuuucucugggacacaguugggggcuggcuucugaggg

SEQ ID NO: 165795 - RNA, 64 nt, hsa
agcugcuggggacuccgccuacuccagcccucuugggacacacugugggauuuguggcccuucc

SEQ ID NO: 165796 - RNA, 64 nt, hsa
agagucaucaccacucccuaaucucaaguacccagggacacaaacacugcggaaggcggcaggg

SEQ ID NO: 165797 - RNA, 64 nt, hsa
gcauucauuaaagcugauugugugagagugaacugggacacaagcuagucuagcucacugcagc

SEQ ID NO: 165798 - RNA, 64 nt, hsa
uaauucaucauuaagaagcauuccugcuucucaagggacacaguggccugcaugggccagcaug

SEQ ID NO: 165799 - RNA, 64 nt, hsa
cccugggcugaucaugugcauuccugcuucucuggggacacagugggcccacaugggccagcau

SEQ ID NO: 165800 - RNA, 64 nt, hsa; identical to SEQ ID NO: 159954

SEQ ID NO: 165801 - RNA, 64 nt, hsa; identical to SEQ ID NO: 159955

SEQ ID NO: 165802 - RNA, 64 nt, hsa; identical to SEQ ID NO: 159956

SEQ ID NO: 165803 - RNA, 64 nt, hsa; identical to SEQ ID NO: 159957

SEQ ID NO: 165804 - RNA, 64 nt, hsa; identical to SEQ ID NO: 159958

SEQ ID NO: 165805 - RNA, 64 nt, hsa; identical to SEQ ID NO: 159959

SEQ ID NO: 165806 - RNA, 62 nt, hsa
cuggaaauaauccaauuauuccugcuuggauucuuccacagggccuguguaagaauggguuc

SEQ ID NO: 165807 - RNA, 62 nt, hsa
uuagacagccacaguccugucuggguuagggucuuccacauuugaggauccuuccuaucucu

SEQ ID NO: 165808 - RNA, 62 nt, hsa
uguuguugguuccuuuuagaccacggcugccccuuccacaccccaucuugcucuaaugauca

SEQ ID NO: 165809 - RNA, 62 nt, hsa
ucuguggcugucuuguuucugaaguacuuaaacuuccacaagagugaauuugaccuaggcaa

SEQ ID NO: 165810 - RNA, 62 nt, hsa
uuccagugugguuuuuaacagauaauacauuucuuccacauucagauuaguauucggacaug

SEQ ID NO: 165811 - RNA, 62 nt, hsa
uuaggaaacgaaauauuuccuaaauaaccaggcuuccacauuguacagaaugagcagucaug

SEQ ID NO: 165812 - RNA, 62 nt, hsa
augcccacaggccaggcccagucacagcugggcuuccacaggucagaauaugggacaggaca

SEQ ID NO: 165813 - RNA, 62 nt, hsa
gggugggagucuggagccagacagccaagccccuuccacaucuacagggucacugucauccu

SEQ ID NO: 165814 - RNA, 62 nt, hsa
gggcaccauuucaguguaaaagcaguccuacucuuccacacuaggaaggcuuuacuuuuuuu

SEQ ID NO: 165815 - RNA, 62 nt, hsa
cgaugaugguuacccuucauggacgucuuaaucuuccacacacauccccuuuuuuuggaaua

SEQ ID NO: 165816 - RNA, 62 nt, hsa
ccagauauucaguacucgaucucaauuccccucuuccacaagaguugggugaccagcugucc

SEQ ID NO: 165817 - RNA, 62 nt, hsa
ugucuccgauagcuccccacaucucuaauugacuuccacaaaaucgaugcguugcuuuggua

SEQ ID NO: 165818 - RNA, 62 nt, hsa
gggaucucugguaccgucacucuugcuugugccuuccacaccuucucggugcagaucccuau

SEQ ID NO: 165819 - RNA, 62 nt, hsa
ccuggcaugcaugcuggcggcggcaugccucccuuccacaagcccaugcugcugcagaggga

SEQ ID NO: 165820 - RNA, 62 nt, hsa
guaaccccucucucaccccggcacaaccugggcuuccacagucuggagcugcccuaccccca

SEQ ID NO: 165821 - RNA, 62 nt, hsa
cuuuucuccccaacccccaaacccacgacucacuuccacaccgucuuccccagcgucccccg

SEQ ID NO: 165822 - RNA, 64 nt, hsa
auucuauuaguccccacccaaacuuuauugauucaccuccuaaaacaacagauguacgacuugc

SEQ ID NO: 165823 - RNA, 64 nt, hsa
uuaagacuuaaugagacuuuaaaagcauuuuuuaaccuccuaaguaucaaguauagaaaaucuu

SEQ ID NO: 165824 - RNA, 64 nt, hsa; identical to SEQ ID NO: 111876

SEQ ID NO: 165825 - RNA, 64 nt, hsa; identical to SEQ ID NO: 111877

SEQ ID NO: 165826 - RNA, 64 nt, hsa; identical to SEQ ID NO: 111878

SEQ ID NO: 165827 - RNA, 64 nt, hsa; identical to SEQ ID NO: 111879

SEQ ID NO: 165828 - RNA, 64 nt, hsa; identical to SEQ ID NO: 111880

SEQ ID NO: 165829 - RNA, 64 nt, hsa; identical to SEQ ID NO: 111881

SEQ ID NO: 165830 - RNA, 64 nt, hsa; identical to SEQ ID NO: 147168

SEQ ID NO: 165831 - RNA, 64 nt, hsa; identical to SEQ ID NO: 147169

SEQ ID NO: 165832 - RNA, 64 nt, hsa; identical to SEQ ID NO: 147170

SEQ ID NO: 165833 - RNA, 64 nt, hsa; identical to SEQ ID NO: 147171

SEQ ID NO: 165834 - RNA, 64 nt, hsa; identical to SEQ ID NO: 147172

SEQ ID NO: 165835 - RNA, 64 nt, hsa; identical to SEQ ID NO: 147173

SEQ ID NO: 165836 - RNA, 64 nt, hsa; identical to SEQ ID NO: 147174

SEQ ID NO: 165837 - RNA, 64 nt, hsa; identical to SEQ ID NO: 147175

SEQ ID NO: 165838 - RNA, 64 nt, hsa; identical to SEQ ID NO: 147176

SEQ ID NO: 165839 - RNA, 64 nt, hsa; identical to SEQ ID NO: 147177

SEQ ID NO: 165840 - RNA, 64 nt, hsa; identical to SEQ ID NO: 147178

SEQ ID NO: 165841 - RNA, 64 nt, hsa; identical to SEQ ID NO: 147179

SEQ ID NO: 165842 - RNA, 64 nt, hsa
uguauuguacuaaccccucaugcugggaugagcgacugccuagcaagcaacccacugccuacua

SEQ ID NO: 165843 - RNA, 64 nt, hsa
augcugggaugagcgacugccuagcaagcaacccacugccuacuaacaucaagaggggcuaaau

SEQ ID NO: 165844 - RNA, 64 nt, hsa
uuggaagccucaaaaacaguccagacauuuguuucaucaggacaccaaacucuaaaaaagaagc

SEQ ID NO: 165845 - RNA, 64 nt, hsa
ccuuauuugguaucuuacacauuaauguuacuagcaucaggagcuuacuguuuuauuaugauuc

SEQ ID NO: 165846 - RNA, 64 nt, hsa
ugucugcagcaggacauggacaaauaggcucugccaucaggaaaugggaagcaagaaaacggua

SEQ ID NO: 165847 - RNA, 64 nt, hsa
uccucauccuggcacuccuccagggugucaguaacaucaggacauuggacacaccauuccggaa

SEQ ID NO: 165848 - RNA, 64 nt, hsa
cacaugaagaaguagacugaaauaucagauuugucaucaggaauacucuuugucuacugugguc

SEQ ID NO: 165849 - RNA, 64 nt, hsa
guuuucaaaaccauuauuccugugacuggagaggcaucaggagaggucucguucgucuccagcu

SEQ ID NO: 165850 - RNA, 64 nt, hsa
guguccaagaacucuaaccaguguacaggucacccaucaggaccacucaguuaaggaagauccu

SEQ ID NO: 165851 - RNA, 64 nt, hsa
guucagaaggaauaagcauuccuucuuucacaggcaucaggaauugucaaaugaugauuaugag

SEQ ID NO: 165852 - RNA, 64 nt, hsa
ucugccagucgguucccacggagccauuuuuagcucugaucagcaugggaaugugccucggccu

SEQ ID NO: 165853 - RNA, 64 nt, hsa
ucccccacucuauacuagggacuggaucucagccucugaucaguuucacaaaguuuguucccua

SEQ ID NO: 165854 - RNA, 64 nt, hsa
acgugccucaucccagaaacacggaggcuguggaucugaucaccaggcugcccaagggugcugu

SEQ ID NO: 165855 - RNA, 64 nt, hsa
uagccagugggaaagggaaccugagauggagcucucugaucacccuuucagccccagggcccgg

SEQ ID NO: 165856 - RNA, 64 nt, hsa
gaaaggaugcauuucggcuuuuaaccaguuugguucugaucauugcaaccucugugcuuuuaua

SEQ ID NO: 165857 - RNA, 64 nt, hsa
caauuugugaagcuuaugauacagcugaaaccagucugaucaauuuuaugcuaccugucaccaa

SEQ ID NO: 165858 - RNA, 64 nt, hsa
ggaagaccuuuuaaagcauuguuuuagaaugucugaguauuaagauacagauuaauugggaaua

SEQ ID NO: 165859 - RNA, 64 nt, hsa
ugaguauuaagauacagauuaauugggaauaucugaguauuaaguacuuucuucagaguauaag

SEQ ID NO: 165860 - RNA, 64 nt, hsa
aauuugcugcuucugagaggcaaugugaaagagggaguauuacuuuuauguacaaaguuauuua

SEQ ID NO: 165861 - RNA, 64 nt, hsa
uucuauacugauguuuucguuuugccaauauaaugaguauuacauuggccuugggggacagaaa

SEQ ID NO: 165862 - RNA, 64 nt, hsa
gugccugccccuccccagaguauuaacgcuccaagaguauuauuaacgcugcuguaccucgauc

SEQ ID NO: 165863 - RNA, 64 nt, hsa
gcccuagggccccccaagugccugccccuccccagaguauuaacgcuccaagaguauuauuaac

SEQ ID NO: 165864 - RNA, 64 nt, hsa
agccaggacgaucacacagagaugaauggcaucugaguauuacggcauccagagccacugcuga

SEQ ID NO: 165865 - RNA, 64 nt, hsa
ucuccuccaagacuguguugucuuuucucaccaagaguauuaacacuacuaagucuuucaccuu

SEQ ID NO: 165866 - RNA, 64 nt, hsa; identical to SEQ ID NO: 134055

SEQ ID NO: 165867 - RNA, 64 nt, hsa; identical to SEQ ID NO: 134056

SEQ ID NO: 165868 - RNA, 64 nt, hsa; identical to SEQ ID NO: 134057

SEQ ID NO: 165869 - RNA, 64 nt, hsa; identical to SEQ ID NO: 134058

SEQ ID NO: 165870 - RNA, 64 nt, hsa; identical to SEQ ID NO: 134059

SEQ ID NO: 165871 - RNA, 64 nt, hsa; identical to SEQ ID NO: 134060

SEQ ID NO: 165872 - RNA, 64 nt, hsa; identical to SEQ ID NO: 134061

SEQ ID NO: 165873 - RNA, 64 nt, hsa; identical to SEQ ID NO: 134062

SEQ ID NO: 165874 - RNA, 64 nt, hsa; identical to SEQ ID NO: 134063

SEQ ID NO: 165875 - RNA, 64 nt, hsa; identical to SEQ ID NO: 134064

SEQ ID NO: 165876 - RNA, 64 nt, hsa; identical to SEQ ID NO: 134065

SEQ ID NO: 165877 - RNA, 64 nt, hsa; identical to SEQ ID NO: 134066

SEQ ID NO: 165878 - RNA, 64 nt, hsa; identical to SEQ ID NO: 134067

SEQ ID NO: 165879 - RNA, 64 nt, hsa; identical to SEQ ID NO: 134068

SEQ ID NO: 165880 - RNA, 64 nt, hsa; identical to SEQ ID NO: 134069

SEQ ID NO: 165881 - RNA, 64 nt, hsa; identical to SEQ ID NO: 134070

SEQ ID NO: 165882 - RNA, 64 nt, hsa; identical to SEQ ID NO: 134071

SEQ ID NO: 165883 - RNA, 64 nt, hsa; identical to SEQ ID NO: 134072

SEQ ID NO: 165884 - RNA, 64 nt, hsa; identical to SEQ ID NO: 134073

SEQ ID NO: 165885 - RNA, 64 nt, hsa; identical to SEQ ID NO: 134074

SEQ ID NO: 165886 - RNA, 64 nt, hsa; identical to SEQ ID NO: 134075

SEQ ID NO: 165887 - RNA, 64 nt, hsa; identical to SEQ ID NO: 134076

SEQ ID NO: 165888 - RNA, 64 nt, hsa; identical to SEQ ID NO: 134077

SEQ ID NO: 165889 - RNA, 64 nt, hsa; identical to SEQ ID NO: 134078

SEQ ID NO: 165890 - RNA, 64 nt, hsa; identical to SEQ ID NO: 134079

SEQ ID NO: 165891 - RNA, 64 nt, hsa; identical to SEQ ID NO: 134080

SEQ ID NO: 165892 - RNA, 64 nt, hsa; identical to SEQ ID NO: 134081

SEQ ID NO: 165893 - RNA, 64 nt, hsa; identical to SEQ ID NO: 134082

SEQ ID NO: 165894 - RNA, 64 nt, hsa; identical to SEQ ID NO: 134083

SEQ ID NO: 165895 - RNA, 64 nt, hsa; identical to SEQ ID NO: 134084

SEQ ID NO: 165896 - RNA, 64 nt, hsa; identical to SEQ ID NO: 134085

SEQ ID NO: 165897 - RNA, 64 nt, hsa; identical to SEQ ID NO: 134086

SEQ ID NO: 165898 - RNA, 64 nt, hsa; identical to SEQ ID NO: 134087

SEQ ID NO: 165899 - RNA, 64 nt, hsa; identical to SEQ ID NO: 134088

SEQ ID NO: 165900 - RNA, 64 nt, hsa; identical to SEQ ID NO: 134089

SEQ ID NO: 165901 - RNA, 64 nt, hsa; identical to SEQ ID NO: 134090

SEQ ID NO: 165902 - RNA, 64 nt, hsa; identical to SEQ ID NO: 134091

SEQ ID NO: 165903 - RNA, 64 nt, hsa; identical to SEQ ID NO: 134092

SEQ ID NO: 165904 - RNA, 64 nt, hsa; identical to SEQ ID NO: 134093

SEQ ID NO: 165905 - RNA, 64 nt, hsa; identical to SEQ ID NO: 134094

SEQ ID NO: 165906 - RNA, 64 nt, hsa; identical to SEQ ID NO: 134095

SEQ ID NO: 165907 - RNA, 64 nt, hsa; identical to SEQ ID NO: 134096

SEQ ID NO: 165908 - RNA, 64 nt, hsa; identical to SEQ ID NO: 134097

SEQ ID NO: 165909 - RNA, 64 nt, hsa; identical to SEQ ID NO: 134098

SEQ ID NO: 165910 - RNA, 64 nt, hsa; identical to SEQ ID NO: 134099

SEQ ID NO: 165911 - RNA, 64 nt, hsa; identical to SEQ ID NO: 134100

SEQ ID NO: 165912 - RNA, 64 nt, hsa; identical to SEQ ID NO: 134101

SEQ ID NO: 165913 - RNA, 64 nt, hsa; identical to SEQ ID NO: 134102

SEQ ID NO: 165914 - RNA, 64 nt, hsa; identical to SEQ ID NO: 134103

SEQ ID NO: 165915 - RNA, 64 nt, hsa; identical to SEQ ID NO: 134104

SEQ ID NO: 165916 - RNA, 64 nt, hsa; identical to SEQ ID NO: 134105

SEQ ID NO: 165917 - RNA, 64 nt, hsa; identical to SEQ ID NO: 134106

SEQ ID NO: 165918 - RNA, 64 nt, hsa; identical to SEQ ID NO: 134107

SEQ ID NO: 165919 - RNA, 64 nt, hsa; identical to SEQ ID NO: 134108

SEQ ID NO: 165920 - RNA, 64 nt, hsa; identical to SEQ ID NO: 134109

SEQ ID NO: 165921 - RNA, 64 nt, hsa; identical to SEQ ID NO: 134110

SEQ ID NO: 165922 - RNA, 64 nt, hsa; identical to SEQ ID NO: 134111

SEQ ID NO: 165923 - RNA, 64 nt, hsa; identical to SEQ ID NO: 134112

SEQ ID NO: 165924 - RNA, 64 nt, hsa; identical to SEQ ID NO: 134113

SEQ ID NO: 165925 - RNA, 64 nt, hsa; identical to SEQ ID NO: 134114

SEQ ID NO: 165926 - RNA, 64 nt, hsa; identical to SEQ ID NO: 134115

SEQ ID NO: 165927 - RNA, 64 nt, hsa; identical to SEQ ID NO: 134116

SEQ ID NO: 165928 - RNA, 64 nt, hsa; identical to SEQ ID NO: 134117

SEQ ID NO: 165929 - RNA, 64 nt, hsa; identical to SEQ ID NO: 134118

SEQ ID NO: 165930 - RNA, 64 nt, hsa; identical to SEQ ID NO: 134119

SEQ ID NO: 165931 - RNA, 64 nt, hsa; identical to SEQ ID NO: 134120

SEQ ID NO: 165932 - RNA, 64 nt, hsa; identical to SEQ ID NO: 134121

SEQ ID NO: 165933 - RNA, 64 nt, hsa; identical to SEQ ID NO: 134122

SEQ ID NO: 165934 - RNA, 64 nt, hsa; identical to SEQ ID NO: 134123

SEQ ID NO: 165935 - RNA, 64 nt, hsa; identical to SEQ ID NO: 134124

SEQ ID NO: 165936 - RNA, 64 nt, hsa; identical to SEQ ID NO: 134125

SEQ ID NO: 165937 - RNA, 64 nt, hsa
auuugaacuuagggcaaaucagagucuacacagacgccuacagaaaguuucaggaagaggcaag

SEQ ID NO: 165938 - RNA, 64 nt, hsa
aucauuaucucagaaugcuuauuuccaauuaaaacgccuacagcugccuccuagaauauagacu

SEQ ID NO: 165939 - RNA, 64 nt, hsa
cccucaggugcccccacacacagccuucccuugacgccuacauuucuaggcacaugugaggcau

SEQ ID NO: 165940 - RNA, 64 nt, hsa
cuuccccagaagccugggcuuaggguggagaugccgccuacacacgauccuggcccuccaccug

SEQ ID NO: 165941 - RNA, 64 nt, hsa
cccucucccugccccagcuuuccccgaccaaucacgccuacagugcuuugaagguuuccucucc

SEQ ID NO: 165942 - RNA, 64 nt, hsa
ucccucuccugcgcuuccuccuggaguccggagccgccuacaacugcucccugcacggugcguc

SEQ ID NO: 165943 - RNA, 64 nt, hsa
ugcgggaggugaggcgggcucugcgugcgcaccgcgccuacacgcccaacgacgagugcuucuu

SEQ ID NO: 165944 - RNA, 64 nt, hsa
agguaccuugcugucuugacaaauccuaaugucacgccuacagccccaacacaagcuccagucu

SEQ ID NO: 165945 - RNA, 64 nt, hsa
aagcauugggccauaguuuguuaaucucaacuaacgccuacauuacauucuccuugaucguucu

SEQ ID NO: 165946 - RNA, 64 nt, hsa
acguccacgugauuggggaggacgcagcgugcaucgccuacauccgccucacccaguacaucga

SEQ ID NO: 165947 - RNA, 64 nt, hsa
ccuagagccugcuacuccaucuggcuccuccuggcgccuacacccccucucagccacugucuuc

SEQ ID NO: 165948 - RNA, 64 nt, hsa
gagccuucggcaccuccccuccccaacgccucugcgccuacaccaaagggccccagguggccac

SEQ ID NO: 165949 - RNA, 64 nt, hsa
acaacuccaccccuuccuuggccuugccccugcccgccuacacuccuacguguccagggcuugg

SEQ ID NO: 165950 - RNA, 64 nt, hsa
aggccugggccaggagucugccaggagccaggagcgccuacaccucccuggaggcccacacuuc

SEQ ID NO: 165951 - RNA, 64 nt, hsa
agccaggcaaucgggggccaaagaugggggugcucgccuacagucugcaucuguagugccuugu

SEQ ID NO: 165952 - RNA, 64 nt, hsa
ggcagcagggcagaggagacuauggggagcccaccgccuacacaguaggggcaguagcccccag

SEQ ID NO: 165953 - RNA, 64 nt, hsa
uaugaucuggauauauuuugcauucauuuuccaacgccuacauuuaauuccugguaagagcagu

SEQ ID NO: 165954 - RNA, 64 nt, hsa
gcucuuccccagcugcaaagacaauguugcucuccgccuacacuagugaauuaaucugaaaggc

SEQ ID NO: 165955 - RNA, 64 nt, hsa
ucgugucuuaaccuaagugcuuucuuguuugaaacgccuacaaaccuccaugugguagcuccuu

SEQ ID NO: 165956 - RNA, 64 nt, hsa
agggcagcucuggugccccuguauauguggaucucgccuacaucccgaaucauugcaguggcaa

SEQ ID NO: 165957 - RNA, 64 nt, hsa
agacucuacagaggccaugggccuccugugugugcgccuacaggagugagcacuaaggugugcu

SEQ ID NO: 165958 - RNA, 64 nt, hsa
uagaacccucaacccagggucccuuccucugcagcgccuacaugguugguugaauaaguggcug

SEQ ID NO: 165959 - RNA, 64 nt, hsa
agggcaggccuucuauaagugcgggcaccaagggcgccuacauccccaggccuugcuggggugc

SEQ ID NO: 165960 - RNA, 64 nt, hsa
ucauuguagguaagauaauucauacuggagaaaacgccuacaugugugaacaauauggcaaaac

SEQ ID NO: 165961 - RNA, 64 nt, hsa
uggaaccgcgcagccugcuggugcuccgcggccccgccuacacgcgucuucuccacggcaucgc

SEQ ID NO: 165962 - RNA, 64 nt, hsa
gaaccggaaccugagugacagccuggcccgcggccgccuacacccggaccugcaguccaaccuc

SEQ ID NO: 165963 - RNA, 64 nt, hsa
ggaggagguguugagugagcaacacgcagaagcucgccuacaguuucguuuccauucacgacgc

SEQ ID NO: 165964 - RNA, 64 nt, hsa
gucaagggaaauguaaucagauuuggccagaguucgccuacagauaagaaggcacugggccagg

SEQ ID NO: 165965 - RNA, 64 nt, hsa; identical to SEQ ID NO: 84790

SEQ ID NO: 165966 - RNA, 64 nt, hsa; identical to SEQ ID NO: 84791

SEQ ID NO: 165967 - RNA, 64 nt, hsa; identical to SEQ ID NO: 84792

SEQ ID NO: 165968 - RNA, 64 nt, hsa; identical to SEQ ID NO: 84793

SEQ ID NO: 165969 - RNA, 64 nt, hsa; identical to SEQ ID NO: 84794

SEQ ID NO: 165970 - RNA, 64 nt, hsa; identical to SEQ ID NO: 84795

SEQ ID NO: 165971 - RNA, 64 nt, hsa; identical to SEQ ID NO: 84796

SEQ ID NO: 165972 - RNA, 64 nt, hsa; identical to SEQ ID NO: 84797

SEQ ID NO: 165973 - RNA, 64 nt, hsa; identical to SEQ ID NO: 84798

SEQ ID NO: 165974 - RNA, 64 nt, hsa; identical to SEQ ID NO: 84799

SEQ ID NO: 165975 - RNA, 64 nt, hsa; identical to SEQ ID NO: 84800

SEQ ID NO: 165976 - RNA, 64 nt, hsa; identical to SEQ ID NO: 84801

SEQ ID NO: 165977 - RNA, 64 nt, hsa; identical to SEQ ID NO: 84802

SEQ ID NO: 165978 - RNA, 64 nt, hsa; identical to SEQ ID NO: 84803

SEQ ID NO: 165979 - RNA, 64 nt, hsa; identical to SEQ ID NO: 84804

SEQ ID NO: 165980 - RNA, 64 nt, hsa; identical to SEQ ID NO: 127496

SEQ ID NO: 165981 - RNA, 64 nt, hsa; identical to SEQ ID NO: 127497

SEQ ID NO: 165982 - RNA, 64 nt, hsa; identical to SEQ ID NO: 127498

SEQ ID NO: 165983 - RNA, 64 nt, hsa; identical to SEQ ID NO: 127499

SEQ ID NO: 165984 - RNA, 64 nt, hsa; identical to SEQ ID NO: 127500

SEQ ID NO: 165985 - RNA, 64 nt, hsa; identical to SEQ ID NO: 127501

SEQ ID NO: 165986 - RNA, 64 nt, hsa; identical to SEQ ID NO: 127502

SEQ ID NO: 165987 - RNA, 64 nt, hsa; identical to SEQ ID NO: 127503

SEQ ID NO: 165988 - RNA, 64 nt, hsa
gauuuuaaucauacaguuugacugggcaaacuuuacagcugauagugaauauuuugcuuuauac

SEQ ID NO: 165989 - RNA, 64 nt, hsa
ccuaguagaucucaauguuuuauaauuccuuaaaacagcugaaaauugggacaacauacuuuac

SEQ ID NO: 165990 - RNA, 64 nt, hsa
ccauccacugccggccugccugcaaccacagcugacagcugaguuaguuagguuuuccuguccc

SEQ ID NO: 165991 - RNA, 64 nt, hsa
gaaggaaccauccacugccggccugccugcaaccacagcugacagcugaguuaguuagguuuuc

SEQ ID NO: 165992 - RNA, 64 nt, hsa
ugaucaaagucauaguagguaaaugcuuuaugggacagcugacaccuuuuagacccuaccaggu

SEQ ID NO: 165993 - RNA, 64 nt, hsa
aaaagaucaggcugaaacugcagucagauuuaugacagcugacaguuuuucagaggucgcacac

SEQ ID NO: 165994 - RNA, 64 nt, hsa
gagagagaagguaaguggcuuugccagcaaugaaacagcugacauaaugguaaccagucagagg

SEQ ID NO: 165995 - RNA, 64 nt, hsa
uagucuguugaagauugaacaaugaccuugaaagacagcugaguugcuguggguauaauguaaa

SEQ ID NO: 165996 - RNA, 64 nt, hsa
ggaucucugggagcagagggcggcuguagacaucacagcugaagaggugaccucaggcccuggg

SEQ ID NO: 165997 - RNA, 64 nt, hsa
guucugagaggcugggaguucacagaccucagacacagcugaguccgacaaccauugggguggg

SEQ ID NO: 165998 - RNA, 64 nt, hsa
aauugagcaucccuaagaguagcugcuuggugggacagcugauuucuuugauucccuagcugca

SEQ ID NO: 165999 - RNA, 64 nt, hsa
uaaauaaucacagaaaagaaugaucugaacaagaacagcugaggcuaaaacccaagacugccgu

SEQ ID NO: 166000 - RNA, 64 nt, hsa
uggcuaaagaccuuaaccaauagcaaauugcacuacagcugaacuuuucaucaucucauucaca

SEQ ID NO: 166001 - RNA, 64 nt, hsa
uaaccucaggacuugguuugcauauaaaagguagacagcugauauguuuucaugaauaaauauu

SEQ ID NO: 166002 - RNA, 64 nt, hsa
uugcauuuccuguguuuguccuggguucuggggcaucagccagcuaccccuugugggcaaaggc

SEQ ID NO: 166003 - RNA, 64 nt, hsa
gcaccaaagauguccugacuuugcccccuugcccaucagccauuugccaucaccccaaacaacu

SEQ ID NO: 166004 - RNA, 64 nt, hsa
cagccugguagauuguguggguuagauagaggucaucagccagguugauugugcggguuagaua

SEQ ID NO: 166005 - RNA, 64 nt, hsa
cagccggguugauuguguggguuagacagaggucaucagccagguugauuguguggguuagaua

SEQ ID NO: 166006 - RNA, 64 nt, hsa
gaaguuucccugugaggccgugguuagcguggacaucagccagcacugcacagacagcugcgac

SEQ ID NO: 166007 - RNA, 64 nt, hsa
ucuuuguaggcgccaucagccacuuuuagaagccaucagccaguguguugggaaaagagguuug

SEQ ID NO: 166008 - RNA, 64 nt, hsa
ugaagaaaagaaugaaugauucuuuguaggcgccaucagccacuuuuagaagccaucagccagu

SEQ ID NO: 166009 - RNA, 64 nt, hsa
ggcagaacagagaaaagcuagacaaaaugauaagaucagccauauuucauuuugaaucugcagu

SEQ ID NO: 166010 - RNA, 64 nt, hsa
aacucugugagacaagguccuuaggcacccagauaucagccacuuucacauuucauuucauuuu

SEQ ID NO: 166011 - RNA, 60 nt, hsa
ucuacagggacauguacugaguuccuucagaucagccacaccuuuuccaggaguucugaa

SEQ ID NO: 166012 - RNA, 64 nt, hsa
gagugcauuucuugcuugcuggguuucaacagacaucagccaaaagaacaaaagagaugucagg

SEQ ID NO: 166013 - RNA, 64 nt, hsa
aaacaaacuaacaugacaagaaagcuauagaaaaaauaaacauugaacucaguucuucaagguu

SEQ ID NO: 166014 - RNA, 64 nt, hsa
uguuuauaagaaauuguaaacaaauguaaaacuaaauaaacauuguuaugcaacauuaauaaug

SEQ ID NO: 166015 - RNA, 64 nt, hsa
gugaucauguuuuuuuccccccuuuaaugaaaacaauaaacaucuauuugagacaauuaaaauc

SEQ ID NO: 166016 - RNA, 64 nt, hsa
ucuaauauaccauuguauucacuaacuaacucaaaauaaacacauuuaaucuugacaucucaag

SEQ ID NO: 166017 - RNA, 64 nt, hsa
auguuuuauugucuucucuaagcaaaaaguucuuaauaaacauaguauuucucucugcguccua

SEQ ID NO: 166018 - RNA, 64 nt, hsa
uuuaaauguaaugucaacucuuuauaaacuuaaaaauaaacaaguaauuaaccacucuaauugu

SEQ ID NO: 166019 - RNA, 64 nt, hsa
uugagagcuuuuacugugauucuucaauguaaaaaauaaacaacaaugucaaacuguguuuaua

SEQ ID NO: 166020 - RNA, 64 nt, hsa
gauuuguauaaagccuuuuuaagauuacuauuuaaauaaacauuauaccagagauauuuuucug

SEQ ID NO: 166021 - RNA, 64 nt, hsa
uuuuugaaauucaaguguaccugccauaacauaaaauaaacacuagacuguaucacacuucgau

SEQ ID NO: 166022 - RNA, 64 nt, hsa
uuggcauuagcacuaccauuguacccugcuguauaauaaacaaucuuagacauuuaucaacugu

SEQ ID NO: 166023 - RNA, 64 nt, hsa
uuuggucauucuuugccauagcuuacucuauucaaauaaacauauauucuugcuugcauccuag

SEQ ID NO: 166024 - RNA, 64 nt, hsa
uaauauauuagaauauacaaauauguguguauaaaauaaacauacacacacacacacaccccua

SEQ ID NO: 166025 - RNA, 64 nt, hsa
auccuaaggguccgaugugacagcaagcaagugaaauaaacaaugauuugcuuuucagugagaa

SEQ ID NO: 166026 - RNA, 64 nt, hsa
uguugccucuuuuucaaguggaauuugaauuuuaaauaaacaacuuuuuuuggcaugauaaaca

SEQ ID NO: 166027 - RNA, 64 nt, hsa
gcgaaaggaagcaagcaguucagaagagccaaggaauaaacaugcaaugaacccaaaaggguac

SEQ ID NO: 166028 - RNA, 64 nt, hsa
aaaagagaagcagggccaaauggaaagaacacauaauaaacaagaaaaaaacagaggugaagaa

SEQ ID NO: 166029 - RNA, 64 nt, hsa
acgcgcgcgcaagcacaguuaagccaccugcaggaauaaacacgcgagaacauccaccgcuucc

SEQ ID NO: 166030 - RNA, 64 nt, hsa
ugcauuucuugaugacaguuuguguuccuacaaaaauaaacaaaaugaauaaaaagggaucacc

SEQ ID NO: 166031 - RNA, 64 nt, hsa
uacauucauucagggguagacacacaaaaaaugaaauaaacagguaaaauauguagcauguuug

SEQ ID NO: 166032 - RNA, 64 nt, hsa
uaagaauaaaacccauaauuuucuucaaugaguuaauaaacagaaaucuccagaaccucugaaa

SEQ ID NO: 166033 - RNA, 64 nt, hsa
uccauuuggcauacaucguucuuuguuguaauuaaauaaacauagauaaaauuguucuuguugg

SEQ ID NO: 166034 - RNA, 64 nt, hsa
gggauuuauaauuuuaaaacaaauaugcacagaaaauaaacauuucuuaaaauauauucugggu

SEQ ID NO: 166035 - RNA, 64 nt, hsa
uaaugacugauauuuuuucuuauagauaacacauaauaaacauugugaagacuaauaaguaacu

SEQ ID NO: 166036 - RNA, 64 nt, hsa
agccaggacugacugugcaccagagaaucugcacaauaaacaugaugaauguggagaugcuugc

SEQ ID NO: 166037 - RNA, 64 nt, hsa
auuuuguauaaucacaguuguguuccugacacucaauaaacagucacuggaaagagugccaguc

SEQ ID NO: 166038 - RNA, 64 nt, hsa
ccauauuuuaaauucucauaaguagcauucauguaauaaacagguuuuuaguuuguucuucaga

SEQ ID NO: 166039 - RNA, 64 nt, hsa
aaaaaacugcaucccacguucuguuaauuuaguaaauaaacaagucaaagacuuguggaaaaua

SEQ ID NO: 166040 - RNA, 64 nt, hsa
aacaaugccuacuuuccauucacuguuaacauggaauaaacacaauucccaacaucuuagauag

SEQ ID NO: 166041 - RNA, 64 nt, hsa
gcuccuuaaacccucgcuuuguuguaaaagcuaaaauaaacagcaugcuauauuguaauuguau

SEQ ID NO: 166042 - RNA, 64 nt, hsa
auccugcuuaauccuuccagcaugucucugcacuaauaaacagcuaaauucacauaaucauccu

SEQ ID NO: 166043 - RNA, 64 nt, hsa
auuggucagugaggucaaaaggagccuugggauuaauaaacaugcacugagaagcaagaggagg

SEQ ID NO: 166044 - RNA, 64 nt, hsa
ccaucuggggaugugucuguguuccacaccuugaaauaaacagacacauacguguucucuucuu

SEQ ID NO: 166045 - RNA, 64 nt, hsa
accgaugcacagucuucccauuuuacacuuuuuuaauaaacauaauugcaauauuuuagguggg

SEQ ID NO: 166046 - RNA, 64 nt, hsa
aauguuucauguaccaagacccuuuucacaguacaauaaacagaucuauucauaaauuuuuguu

SEQ ID NO: 166047 - RNA, 51 nt, hsa
agaagaaaacuaguauauaaaaauaaacaaaaaguccuugaagcuuuacag

SEQ ID NO: 166048 - RNA, 64 nt, hsa
auugaaguguguucauaguccagguuuuuuuuuuaauaaacacaauuuugcugccaaaaauaua

SEQ ID NO: 166049 - RNA, 64 nt, hsa
cuuuacuaguuauugugagauugcuguguaagcuaauaaacacauuuguaaauacauuguuugc

SEQ ID NO: 166050 - RNA, 64 nt, hsa
uguuaacauccuuugaaugcguuggauuucagagaauaaacauuuuguaaaaaucacuugguaa

SEQ ID NO: 166051 - RNA, 64 nt, hsa
uugaauauuauuucacauuccuuuuucuuuuuuaaauaaacagguuugcuuuggaaaggcuuaa

SEQ ID NO: 166052 - RNA, 64 nt, hsa
ucaacauuacuguuaacugugcguuaaauaagcaaauaaacaguggcucauaaaaauaaaaguc

SEQ ID NO: 166053 - RNA, 64 nt, hsa
uuucucuaguguauuaucacugucuguucugcacaauaaacauaacagccucugugauccccau

SEQ ID NO: 166054 - RNA, 64 nt, hsa
caaaaagaaugauacauucugaagguauguuuauaauaaacauuuuucauauguaaaacaaugg

SEQ ID NO: 166055 - RNA, 64 nt, hsa
uuuguguuuaccuacuaaacagaaaaugccuccaaauaaacagugucacaaguacagaagagag

SEQ ID NO: 166056 - RNA, 64 nt, hsa
aauuuuuauuuucagaaccauuuuacagauuuaaaauaaacagguuugaggaauuaguuuaacu

SEQ ID NO: 166057 - RNA, 64 nt, hsa
cauuuacacaagagauggcuuuuuccuuugcuugaauaaacauuuuggaucaccuccaaagaau

SEQ ID NO: 166058 - RNA, 64 nt, hsa
acacucauggacauggucuuaaucaauggaguuaaauaaacaaauucagcaaguuauuaaaucu

SEQ ID NO: 166059 - RNA, 64 nt, hsa
gacaauggaguauuaucucuaaauuccuuaaugaaauaaacaacaaacccugcaaccuagaauu

SEQ ID NO: 166060 - RNA, 64 nt, hsa
cacauauucaagaagcucaaaugaccugaaguagaauaaacauaauuuacaucacagcagugca

SEQ ID NO: 166061 - RNA, 64 nt, hsa
auccauuagauugcaugguaauuaaaauuggcauaauaaacacagauuauugggggaaaaggaa

SEQ ID NO: 166062 - RNA, 64 nt, hsa
acagcaaaugauuaaaugucaguuccccuaaaccaauaaacauuuauacuagauuuuuuauuuc

SEQ ID NO: 166063 - RNA, 64 nt, hsa
uuauuuuaaguugaauuugaauaaagauuccagaaauaaacauggagcucaguauucaggaagc

SEQ ID NO: 166064 - RNA, 64 nt, hsa
uauuucuugucgcuuuuagcuauugucagaauccaauaaacagcuuacgcauucauuuugguaa

SEQ ID NO: 166065 - RNA, 64 nt, hsa
cugggaaaaaaagaugucucuaauuacuggcuucaauaaacacgaauccagacugcuuacaagu

SEQ ID NO: 166066 - RNA, 64 nt, hsa
ugggguuuucaagcauuggaaccaaaggccaaauaauaaacagccuuuaguuuuuaaaguaaaa

SEQ ID NO: 166067 - RNA, 64 nt, hsa
uacuagaaguaauuguuuuaucaauucauuguauaauaaacaggagugagacuucauuguauga

SEQ ID NO: 166068 - RNA, 64 nt, hsa
gcccuauguuugugccuuuuaauuaguuugucucaauaaacaaaauguagagaaaaauauguag

SEQ ID NO: 166069 - RNA, 64 nt, hsa
aggagaagucaaguguguggacaggcaagcuccuaauaaacagaguccagugggauuccuauuu

SEQ ID NO: 166070 - RNA, 64 nt, hsa
ucucuuaugaaaaaaauaagauguuaucccaucaaauaaacaaugucauggcuaucuugucuuu

SEQ ID NO: 166071 - RNA, 64 nt, hsa
uuuaaggauugcauauuguuccuaaugaggauguaauaaacaggcauuaguaccccuuucuuuu

SEQ ID NO: 166072 - RNA, 64 nt, hsa
uuuauauauauuuuguuuguaaugagccauucucaauaaacauuauucucacugcaaaauggug

SEQ ID NO: 166073 - RNA, 64 nt, hsa
ugguaggccucguggcuggcagcagugcucugggaauaaacagcugcccuagccccagagggau

SEQ ID NO: 166074 - RNA, 64 nt, hsa
cuguaguagaaacuuuaguuuugaugaugcacaaaauaaacagcagugguucucaacuagggcc

SEQ ID NO: 166075 - RNA, 64 nt, hsa
uuugguucuacuugcuauaugccuccuuuguaaaaauaaacaccgaggcuuacuguaguagaaa

SEQ ID NO: 166076 - RNA, 64 nt, hsa
uaauuaaugauaaaacauaauaauaaacauaaauaauaaacaaaauuaccgagaaccccauccc

SEQ ID NO: 166077 - RNA, 64 nt, hsa
aaaauuuauugaauaauuaaugauaaaacauaauaauaaacauaaauaauaaacaaaauuaccg

SEQ ID NO: 166078 - RNA, 64 nt, hsa; identical to SEQ ID NO: 78620

SEQ ID NO: 166079 - RNA, 64 nt, hsa; identical to SEQ ID NO: 78621

SEQ ID NO: 166080 - RNA, 64 nt, hsa; identical to SEQ ID NO: 78622

SEQ ID NO: 166081 - RNA, 64 nt, hsa; identical to SEQ ID NO: 78623

SEQ ID NO: 166082 - RNA, 64 nt, hsa; identical to SEQ ID NO: 78624

SEQ ID NO: 166083 - RNA, 64 nt, hsa; identical to SEQ ID NO: 78625

SEQ ID NO: 166084 - RNA, 64 nt, hsa; identical to SEQ ID NO: 78626

SEQ ID NO: 166085 - RNA, 64 nt, hsa; identical to SEQ ID NO: 78627

SEQ ID NO: 166086 - RNA, 64 nt, hsa; identical to SEQ ID NO: 78628

SEQ ID NO: 166087 - RNA, 64 nt, hsa; identical to SEQ ID NO: 78629

SEQ ID NO: 166088 - RNA, 64 nt, hsa; identical to SEQ ID NO: 78630

SEQ ID NO: 166089 - RNA, 64 nt, hsa; identical to SEQ ID NO: 78631

SEQ ID NO: 166090 - RNA, 64 nt, hsa; identical to SEQ ID NO: 78632

SEQ ID NO: 166091 - RNA, 64 nt, hsa; identical to SEQ ID NO: 78633

SEQ ID NO: 166092 - RNA, 64 nt, hsa; identical to SEQ ID NO: 78634

SEQ ID NO: 166093 - RNA, 64 nt, hsa; identical to SEQ ID NO: 78635

SEQ ID NO: 166094 - RNA, 64 nt, hsa; identical to SEQ ID NO: 78636

SEQ ID NO: 166095 - RNA, 64 nt, hsa; identical to SEQ ID NO: 78637

SEQ ID NO: 166096 - RNA, 64 nt, hsa; identical to SEQ ID NO: 78638

SEQ ID NO: 166097 - RNA, 64 nt, hsa; identical to SEQ ID NO: 78639

SEQ ID NO: 166098 - RNA, 64 nt, hsa; identical to SEQ ID NO: 78640

SEQ ID NO: 166099 - RNA, 64 nt, hsa; identical to SEQ ID NO: 78641

SEQ ID NO: 166100 - RNA, 64 nt, hsa; identical to SEQ ID NO: 78642

SEQ ID NO: 166101 - RNA, 64 nt, hsa; identical to SEQ ID NO: 78643

SEQ ID NO: 166102 - RNA, 64 nt, hsa; identical to SEQ ID NO: 78644

SEQ ID NO: 166103 - RNA, 64 nt, hsa; identical to SEQ ID NO: 78645

SEQ ID NO: 166104 - RNA, 64 nt, hsa; identical to SEQ ID NO: 78646

SEQ ID NO: 166105 - RNA, 64 nt, hsa; identical to SEQ ID NO: 78647

SEQ ID NO: 166106 - RNA, 64 nt, hsa; identical to SEQ ID NO: 78648

SEQ ID NO: 166107 - RNA, 64 nt, hsa; identical to SEQ ID NO: 78649

SEQ ID NO: 166108 - RNA, 64 nt, hsa; identical to SEQ ID NO: 78650

SEQ ID NO: 166109 - RNA, 64 nt, hsa; identical to SEQ ID NO: 78651

SEQ ID NO: 166110 - RNA, 64 nt, hsa; identical to SEQ ID NO: 78652

SEQ ID NO: 166111 - RNA, 64 nt, hsa; identical to SEQ ID NO: 78653

SEQ ID NO: 166112 - RNA, 64 nt, hsa; identical to SEQ ID NO: 78654

SEQ ID NO: 166113 - RNA, 64 nt, hsa; identical to SEQ ID NO: 78655

SEQ ID NO: 166114 - RNA, 64 nt, hsa; identical to SEQ ID NO: 78656

SEQ ID NO: 166115 - RNA, 64 nt, hsa; identical to SEQ ID NO: 78657

SEQ ID NO: 166116 - RNA, 64 nt, hsa; identical to SEQ ID NO: 78658

SEQ ID NO: 166117 - RNA, 64 nt, hsa; identical to SEQ ID NO: 78659

SEQ ID NO: 166118 - RNA, 64 nt, hsa; identical to SEQ ID NO: 78660

SEQ ID NO: 166119 - RNA, 64 nt, hsa; identical to SEQ ID NO: 78661

SEQ ID NO: 166120 - RNA, 64 nt, hsa; identical to SEQ ID NO: 78662

SEQ ID NO: 166121 - RNA, 64 nt, hsa; identical to SEQ ID NO: 78663

SEQ ID NO: 166122 - RNA, 64 nt, hsa; identical to SEQ ID NO: 78664

SEQ ID NO: 166123 - RNA, 64 nt, hsa
gccacccacccccuaccauugagccaccaugcccagccccaaagccucuuaauugcucuaacaa

SEQ ID NO: 166124 - RNA, 64 nt, hsa
agugcugggauuacacacgugagucaccaugcccagccccaaagccauuucuugaagaauuucu

SEQ ID NO: 166125 - RNA, 64 nt, hsa
gccggggcaagauccuuccagacucaucugucagagccccaagcccuuuagacccagagcccaa

SEQ ID NO: 166126 - RNA, 64 nt, hsa
agagcccuucccauccuuacccaccaggaacuagagccccaaccacagcagaugcuuccugggc

SEQ ID NO: 166127 - RNA, 64 nt, hsa
ccccacgguccccaggaggacgcuuccuggccaaagccccaagccuuuggugagaagccaauuc

SEQ ID NO: 166128 - RNA, 64 nt, hsa
ccuuguggcuagaguacagugggguagacccuccagccccaauagcccuaguacccagcuggca

SEQ ID NO: 166129 - RNA, 64 nt, hsa
acuuaaaacucccuugcuaccgaucuggaacucaagccccaagacauccccuuagaugaucuga

SEQ ID NO: 166130 - RNA, 64 nt, hsa
aaucacaagaagcuggggcuuccuugagaaggccagccccaaagguaccuguguuuaaaagaug

SEQ ID NO: 166131 - RNA, 64 nt, hsa
ccccugccuaguggggugguaguggcuaccucucagccccaauagucccugcuccucuuagaau

SEQ ID NO: 166132 - RNA, 64 nt, hsa
uaguggcggcugaucuguagagguaugaaaauacagccccaaagggggaauuugucauggggaa

SEQ ID NO: 166133 - RNA, 64 nt, hsa
gugcuacaaaugaaguccuucuccaaaugcauugagccccaagaaaaaucgcugauucugagga

SEQ ID NO: 166134 - RNA, 64 nt, hsa
ccgcgcagaaugugcucgcugccccgcggcuucgagccccaagcucccgaggacuuggcgcagc

SEQ ID NO: 166135 - RNA, 64 nt, hsa
cagggacagaggggguggccucccaacucaccccagccccaaaacucuccucugcugcuggcug

SEQ ID NO: 166136 - RNA, 64 nt, hsa
cuggcugguuagagguucccuuugacgccaucccagccccaaugaacaauuauuuauuaaaugc

SEQ ID NO: 166137 - RNA, 64 nt, hsa
uugccucuggcucugucggccagagccccaacucagccccaaaagcugggcuuccuggggccac

SEQ ID NO: 166138 - RNA, 64 nt, hsa
cagcccuggccuugccucuggcucugucggccagagccccaacucagccccaaaagcugggcuu

SEQ ID NO: 166139 - RNA, 64 nt, hsa
gaggucaggauggaacuaccucauucggcaaauuagccccaaauugagcgcugaaucguguccc

SEQ ID NO: 166140 - RNA, 64 nt, hsa
uguaggggucacugucacaugcuugugcccuggaagccccaaggcucuuccuccagcuggcucc

SEQ ID NO: 166141 - RNA, 64 nt, hsa
ccuccauccccaacccauccucauccccaacuacagccccaaacccagccccagacuaauccac

SEQ ID NO: 166142 - RNA, 64 nt, hsa
cagccauccccaacucauccucauccccaacugcagccccaaacccaacccagggccaucccca

SEQ ID NO: 166143 - RNA, 64 nt, hsa
gcccuggccacauccccauccucccccaaccuccagccccaacacccaucaucccccugagcuc

SEQ ID NO: 166144 - RNA, 64 nt, hsa
guguuggaagggcagcggguaagguucccaagccagccccaacacccuucccacuuggcaccca

SEQ ID NO: 166145 - RNA, 64 nt, hsa
ugguggaagcggcagccacaaguccuccucagggagccccaagggggauuuugugggaccgcug

SEQ ID NO: 166146 - RNA, 64 nt, hsa
gccuugaaccuaggaccaagagccaccuacauccagccccaaaacuggggcuucaggccagagc

SEQ ID NO: 166147 - RNA, 64 nt, hsa
aacaggacaucugugaccgcccuacccccacgccagccccaaacuaagauaucccucacaccca

SEQ ID NO: 166148 - RNA, 64 nt, hsa
ccgaagcaugaacagugcaccugggacagggagcagccccaaauugucaccugcuucucugccc

SEQ ID NO: 166149 - RNA, 64 nt, hsa
cccacccgugguggcucaagucuggccccacaccagccccaauccaaaacuggcaaggacgcuu

SEQ ID NO: 166150 - RNA, 64 nt, hsa; identical to SEQ ID NO: 155572

SEQ ID NO: 166151 - RNA, 64 nt, hsa; identical to SEQ ID NO: 155573

SEQ ID NO: 166152 - RNA, 64 nt, hsa
uuguccuaccccuuaagcguuuaaaauaaaauaugcaacaaaauggaugacuuaguggagaugg

SEQ ID NO: 166153 - RNA, 64 nt, hsa
uaauuuaaacaaucuuauucucuuaauucuuuuggcaacaaaaacuauuaguaauagcuauuug

SEQ ID NO: 166154 - RNA, 64 nt, hsa
uauuuauugccauguauagcagaaaaugaaacaugcaacaaaagcacuuugaaaaauauauaag

SEQ ID NO: 166155 - RNA, 64 nt, hsa
ucuuaccuuccucacagacuuuguacagaccaaagcaacaaauauuuauugccauguauagcag

SEQ ID NO: 166156 - RNA, 64 nt, hsa
ggggaagacccacccagggagcgguuucaguggcgcaacaaagcaccacuuuuacuguugccua

SEQ ID NO: 166157 - RNA, 64 nt, hsa
uacuuaguaaccagugcuuuugauaaugugguuggcaacaaaccagcaacuauuuagaaguguc

SEQ ID NO: 166158 - RNA, 64 nt, hsa
accaccagauggcuaccaaaugauaagaacaacagcaacaaaaggcuccaaaacacacaugccu

SEQ ID NO: 166159 - RNA, 64 nt, hsa
aaucuuuuauguauucuaacuuuaaaagacaagugcaacaaaguuagacugacuucuauaugug

SEQ ID NO: 166160 - RNA, 64 nt, hsa
aaacuacuuuuuagagaaacaaaacaacuuuguagcaacaaauuaaauauaguauuagauuguu

SEQ ID NO: 166161 - RNA, 61 nt, hsa
ggacaauucauaugggauagaaacuacaaaugcaacaaaugcgucaaagaauuuagugugc

SEQ ID NO: 166162 - RNA, 64 nt, hsa
gaaaagacuuaaugaugaacaccccaaagcaauugcaacaaaaacaaaaauugacaagugggac

SEQ ID NO: 166163 - RNA, 64 nt, hsa
guuuuuuuaagcuuuuuuugcauauguuuuguaagcaacaaauuuuuuuguauaaaagucccgu

SEQ ID NO: 166164 - RNA, 64 nt, hsa
uuuuuuuuuuccaguaaacaaaaccugaaagcaagcaacaaaacauacacuuugucagagaaga

SEQ ID NO: 166165 - RNA, 64 nt, hsa
aaaagcugccacugugugguauucgaggauuauugcaacaaagccaguaguuaaaccaaacuac

SEQ ID NO: 166166 - RNA, 64 nt, hsa
aucucuaguuuuuccacgucugucugaaguucuugcaacaaauucugcaugguccagcgcucca

SEQ ID NO: 166167 - RNA, 64 nt, hsa
uuaaaauguugccuuuguccaaguauagauuaaggcaacaaacauauuuggguguguaauuuga

SEQ ID NO: 166168 - RNA, 64 nt, hsa
cauagauauaaagacuuagggaauaaaaauagcagcaacaaauacuugauagauuuauccuacu

SEQ ID NO: 166169 - RNA, 64 nt, hsa
auauccuauauuuaaguacccauaauaaaucauuucccucuauaaguguuauugauuauuuuaa

SEQ ID NO: 166170 - RNA, 64 nt, hsa
auuaauauuuuucccuauuagaaaccacaauuacucccucuauuaacccuucacuuacuagacc

SEQ ID NO: 166171 - RNA, 64 nt, hsa
uuuuuguggcugcuuuuucuacacauccagauggucccucuaacugggcuuucucuaauuuugu

SEQ ID NO: 166172 - RNA, 64 nt, hsa
gucuuacccauccccuggauaugcucuuguuuuuucccucuaauagcuauggaaagaugcauag

SEQ ID NO: 166173 - RNA, 64 nt, hsa
gaucacuggaaaggugucucagucacaaaacuucucccucuacuacuggaugaaaugucugcau

SEQ ID NO: 166174 - RNA, 64 nt, hsa
cacucaucucugaggagcuaugaacugguuuuggucccucuaaugauccuccagccucaucuaa

SEQ ID NO: 166175 - RNA, 64 nt, hsa
uuuuuuuuaauuauuucucuuagcagaucagcaaucccucuagggaccuaaauacuaggucagc

SEQ ID NO: 166176 - RNA, 64 nt, hsa
cucuucgucuuuucuuugcuuuucuucuaacuuuucccucuagccucuccucgccacaauuugc

SEQ ID NO: 166177 - RNA, 64 nt, hsa
cagcaguucacccaguacuccucagagacugguuucccucuaaacccaucccgggcacauacca

SEQ ID NO: 166178 - RNA, 64 nt, hsa
caugcaaacugccacuuucaaccuuugccaguauucccucuacccccgugagagcuaucugggg

SEQ ID NO: 166179 - RNA, 64 nt, hsa
aaaguuugcuucucuuuucaacagugccucacccucccucuaggauuaaagugcuucugcccuu

SEQ ID NO: 166180 - RNA, 64 nt, hsa
auuuuugguguuguucaagugaaggaagagauguucccucuaauuucucucuagcccauuauaa

SEQ ID NO: 166181 - RNA, 64 nt, hsa
gugaaguaggcaagggaaucuguuuacucccucuucccucuacugaauaauuuucccucuacug

SEQ ID NO: 166182 - RNA, 64 nt, hsa
cuguuuacucccucuucccucuacugaauaauuuucccucuacugaauaauuuucccucuaaga

SEQ ID NO: 166183 - RNA, 64 nt, hsa
ucuacugaauaauuuucccucuacugaauaauuuucccucuaagaauugcuguggguaauacca

SEQ ID NO: 166184 - RNA, 64 nt, hsa
guagugcugccaacccugauauaggggaguuguauggaaaaauaguagaauuacacagcaugaa

SEQ ID NO: 166185 - RNA, 64 nt, hsa
ggccacauuuccuauauuuugacagagauacugcuggaaaaauuaaaauuaaaaugccauaaua

SEQ ID NO: 166186 - RNA, 64 nt, hsa
uaugcaauaacauuuaggauaaucuuugacauuuuggaaaaauaagaauugaggaaaaaaagug

SEQ ID NO: 166187 - RNA, 64 nt, hsa
cagccuggaugacauaaugagauucugucucuacuggaaaaaaaaaaaauuagcuggacauggu

SEQ ID NO: 166188 - RNA, 64 nt, hsa
guacuugaaagauaacacaauuuuacaaauuuguuggaaaaacaugaauucauaaauucaggaa

SEQ ID NO: 166189 - RNA, 64 nt, hsa
aaaacgaccccuuguuaccuugauucacuguauguggaaaaauaauguaaccaaaagggaagag

SEQ ID NO: 166190 - RNA, 64 nt, hsa
ucaaaaguguaaauaaccaauucagaaaacaaaauggaaaaacgaccccuuguuaccuugauuc

SEQ ID NO: 166191 - RNA, 64 nt, hsa
uuaucggcauuguccaaaauauuuuauucuuuaauggaaaaagccauuaauauucaaaugaagg

SEQ ID NO: 166192 - RNA, 64 nt, hsa
agucaucugaguguagagaaugucccuucacugcuggaaaaauccacuggcucccaagaaaaga

SEQ ID NO: 166193 - RNA, 64 nt, hsa
guuuccaggaauuuuuuucaaauggggcuguuucuggaaaaaugaaaaauucuauuggacaaug

SEQ ID NO: 166194 - RNA, 64 nt, hsa
ccugcucagaaccauucacauuuaauucaauucuuggaaaaaauuaaagcuuuuugcccacaau

SEQ ID NO: 166195 - RNA, 64 nt, hsa
aacucuuacuaaaaugaguuuuagguucuguaaguggaaaaaugugcuuuuauuuuaugggcca

SEQ ID NO: 166196 - RNA, 64 nt, hsa
aauguauguugcguaucccaaggcacugaagagguggaaaaauaaucgugucaaucuggaugau

SEQ ID NO: 166197 - RNA, 64 nt, hsa
auuguauuuguuucuggucuuuguuaaguucuauuggaaaaaccacugucuguguuuuuuuggc

SEQ ID NO: 166198 - RNA, 64 nt, hsa
cucuuaaaagguaucaauguaccuuuuuugguaguggaaaaaaaaaagacaggcugccacagua

SEQ ID NO: 166199 - RNA, 64 nt, hsa
cagacagaugacuuuaaagaaauuuuuuucaugauggaaaaaucaccucaauugauuuuuccau

SEQ ID NO: 166200 - RNA, 64 nt, hsa
aauauauuuugcaaauuguuguucaaaagauaauuggaaaaaauugaauauauuguaggauuug

SEQ ID NO: 166201 - RNA, 64 nt, hsa
aagcaacuuugcuuaaaauuguauaccugguaaguggaaaaagagggauuugaauauaggcaaa

SEQ ID NO: 166202 - RNA, 64 nt, hsa
uuaauuggauuuaauauuuguauuaaggauuaacuggaaaaaaugugucucagugcuaauucuu

SEQ ID NO: 166203 - RNA, 64 nt, hsa
ugauccuauugaucuuaagguauuuacauguauguggaaaaacaaaacacuuaacuagaauucu

SEQ ID NO: 166204 - RNA, 64 nt, hsa
aaauuaacugauuaauuucccuuauguugaggcauggaaaaaaaauuggaaaagaaaaacucag

SEQ ID NO: 166205 - RNA, 64 nt, hsa
uuuggugaucuaauccuaaauuuaaaagauuuguuggaaaaaauuuuuaggaaacucaccuucc

SEQ ID NO: 166206 - RNA, 64 nt, hsa
cuacuuuggcaacccuuuugaaaaguagcaauuauggaaaaaaaauauucaauaagagauuagg

SEQ ID NO: 166207 - RNA, 64 nt, hsa
cauagagcccuauucucucagacgguggaauauuuggaaaaauuuuaaaacaauuaaaauuuua

SEQ ID NO: 166208 - RNA, 64 nt, hsa
uuucguuaaucuugcugcuuaugugccaauuuaguggaaaaaaacaacccuugcugaaaaauuc

SEQ ID NO: 166209 - RNA, 64 nt, hsa
aaucugaagauacaugucuuucuccagggacauguggaaaaaaaaaagauguuauacaaccauc

SEQ ID NO: 166210 - RNA, 64 nt, hsa
guaaaaggguaucccaaaaauaaaacuauccuuuuggaaaaaaaaagauuuaaaauaauuccug

SEQ ID NO: 166211 - RNA, 64 nt, hsa
gcagcuugacacccaccaagcaaaaguuucagccuggaaaaaaaaugggggggaaggguggaug

SEQ ID NO: 166212 - RNA, 64 nt, hsa
guguggggugccagaaagugucugcugauauuuguggaaaaaaaaucuauuuuguuuaccuacu

SEQ ID NO: 166213 - RNA, 64 nt, hsa
gcuuuauauuaacgauacuaaaaaaaaauagcuuuggaaaaaaaacuacuguauguaacggaau

SEQ ID NO: 166214 - RNA, 64 nt, hsa
acuaucggggcgggccaaccccgagaaugaagauuggaaaaaggaaaaaaaaaaaaacacguca

SEQ ID NO: 166215 - RNA, 64 nt, hsa
uaauggcugcucauuuaucuuaucuuucaguuaguggaaaaacauuucaaccugacuaaaauuu

SEQ ID NO: 166216 - RNA, 64 nt, hsa
aggaaaauucuccuugauaacauaggacaauuaauggaaaaaaaaauucucauuauuugcaaag

SEQ ID NO: 166217 - RNA, 64 nt, hsa
uccacugugccuugguuucuccuuuauuucuaaguggaaaaaguauuagccaccaucuuaccuc

SEQ ID NO: 166218 - RNA, 64 nt, hsa
auuuauuuaagcaucaaauauuugugcaagaauuuggaaaaauagaagaugaaucauugauuga

SEQ ID NO: 166219 - RNA, 64 nt, hsa
uuuuuaaaaccuucuuaacaaaacuucuuaaaacuggaaaaaauauauauuauguaucuaugua

SEQ ID NO: 166220 - RNA, 64 nt, hsa
gaagagucucauuagacaaugauuuuuaaagcauuggaaaaauauuuugccuguaaaaguuagu

SEQ ID NO: 166221 - RNA, 64 nt, hsa
caaaaguacauugguaauuugggcacauucagaguggaaaaaauuuguucuauuuuuacaucuu

SEQ ID NO: 166222 - RNA, 64 nt, hsa
auagaacuaucauaugauccagcaauaccauuacuggaaaaaggaaaucuguauauuaaagaga

SEQ ID NO: 166223 - RNA, 64 nt, hsa
uaccauauagcuuaauauguuuauuaguucucuuuggaaaaaaacuaccacuguggucuuaaaa

SEQ ID NO: 166224 - RNA, 64 nt, hsa
aaauaauuauaucagaaacucacaaaccuagacauggaaaaacagauuacugucuauugucagc

SEQ ID NO: 166225 - RNA, 58 nt, hsa; identical to SEQ ID NO: 96080

SEQ ID NO: 166226 - RNA, 64 nt, hsa
augaggcuccaccuuguuaaauaaauuggauguauggaaaaauagacugcagaaaaggggaacu

SEQ ID NO: 166227 - RNA, 64 nt, hsa
uacugguagagucauggaggaaguaaguuaaauguggaaaaaaugcuuuaaaaguacuuacuau

SEQ ID NO: 166228 - RNA, 64 nt, hsa
aaaaguacuuacuauaaccacaucauaagaauucuggaaaaauagagaacaaaaggaaaagauu

SEQ ID NO: 166229 - RNA, 64 nt, hsa
aagacuggguucgaucagcccuccuaaagcuggcuggaaaaagaagccccagcccagccugccu

SEQ ID NO: 166230 - RNA, 64 nt, hsa
uuacaccaucugcaaccauaugcuauuaauaaaauggaaaaaaacaaaauggucauuuugcaua

SEQ ID NO: 166231 - RNA, 64 nt, hsa
gaucaaaaguaaauguucucuuugccauuuuagauggaaaaauaaaaaaaauuaaaaaguaaau

SEQ ID NO: 166232 - RNA, 64 nt, hsa
cagugcuuuucagaauguagagugagaccucugguggaaaaauuauugcccuguggacuccuuu

SEQ ID NO: 166233 - RNA, 64 nt, hsa
aacugugagauugaauaaacagucucuauuucuguggaaaaaacaacagaaaagagauauuaaa

SEQ ID NO: 166234 - RNA, 64 nt, hsa
agaauugcaucuuuacauaaugaucaagguauaauggaaaaauauaccuauucuugaaguaguu

SEQ ID NO: 166235 - RNA, 64 nt, hsa
aagugacaucuauuuuuauaaaguacuguuuaguuggaaaaaguugccuuaauguuugaaaugu

SEQ ID NO: 166236 - RNA, 64 nt, hsa
uaaauacuacuguaggaguaucugcuuguuaaaauggaaaaaugugucuuuagagcucaguauu

SEQ ID NO: 166237 - RNA, 64 nt, hsa
auuacagucugucuguauuuagauauuuuauuucuggaaaaaaugaaauguacauaaaaauaaa

SEQ ID NO: 166238 - RNA, 64 nt, hsa
ugguuuuuggauuaaauuaguuugugaaggauuauggaaaaauaaaacugucacuguuggacgu

SEQ ID NO: 166239 - RNA, 64 nt, hsa
caaaacuuuaaaccuguagaaucaauuuaaguguuggaaaaaauuugucugaaacauuucauaa

SEQ ID NO: 166240 - RNA, 64 nt, hsa
auauuggagaaaaacccuaugaguguaaugaauuuggaaaaauauuuuuuucaacaacagcuua

SEQ ID NO: 166241 - RNA, 64 nt, hsa
agagguauauuuacauucagaguacacuuuucuuuggaaaaaauuacagguuuuuugaaaagug

SEQ ID NO: 166242 - RNA, 64 nt, hsa
uuuagauuuuaagugccuuuucacugggagaaucuggaaaaaccuccauaagguauauagcaau

SEQ ID NO: 166243 - RNA, 64 nt, hsa
uauuauaauaaauuauauuaguaaaagucuuaacuggaaaaaagaaucuaaaucagaauaguga

SEQ ID NO: 166244 - RNA, 64 nt, hsa
ccaguugcgcugauuacucuuagagaagaagaaauggaaaaaugaaagaaggcaggaaggaaag

SEQ ID NO: 166245 - RNA, 64 nt, hsa
uuacuuugcuuuguuuauaaauaaauuaguagauuggaaaaacuaguguuagggaaagaaauca

SEQ ID NO: 166246 - RNA, 64 nt, hsa
caguggcuccucucugguugaggagagggaaaauuggaaaaacuggucgaguaauuaucaauaa

SEQ ID NO: 166247 - RNA, 64 nt, hsa
auuauauuuuuauauacugaacugccauagaugcuggaaaaaaggaacugauguuuucagcaua

SEQ ID NO: 166248 - RNA, 64 nt, hsa
accuaaaaccuuuuagugacaaaauccuaauauguggaaaaaagcauaugcauaaaggaauaau

SEQ ID NO: 166249 - RNA, 64 nt, hsa
guaaguuaaauauaucaagaaagaagagacuguuuggaaaaaugugguucaaguuuuaugcuau

SEQ ID NO: 166250 - RNA, 64 nt, hsa
uuugcacuuaaaguugcauugccuacuguuauacuggaaaaaauagaguucaagaauaauauga

SEQ ID NO: 166251 - RNA, 64 nt, hsa
aaaaagugugauagcgauauuagugccaaucaaauggaaaaaagguaguuuuaauaaacaagac

SEQ ID NO: 166252 - RNA, 64 nt, hsa
uguccuuuuucuuucuagcuguuaaccuacuuccuggaaaaaguaguagcucucuguagcauua

SEQ ID NO: 166253 - RNA, 64 nt, hsa
ucuaauuuuuuggaauuuuuguagacuuuacaccuggaaaaaaagauuuguaaaaucaccggaa

SEQ ID NO: 166254 - RNA, 64 nt, hsa
guuaguuucuggggaaagaauaguaaccaugcaauggaaaaaaauggacaaccucuugacuagg

SEQ ID NO: 166255 - RNA, 64 nt, hsa
auauaguuugccacuaaaaggaaccaaggcuacuuggaaaaauggaugauuccaaagcaagggc

SEQ ID NO: 166256 - RNA, 64 nt, hsa
auguugauguugaugggagucaggauguucacuauggaaaaacaaauauacaaauaugaaauga

SEQ ID NO: 166257 - RNA, 64 nt, hsa
uaguagcucuaaacuguuaacauagaauguuacuuggaaaaagucuggaauaugugguguacac

SEQ ID NO: 166258 - RNA, 64 nt, hsa
cagagggauuaaauuagaccugugagauuauauuuggaaaaauucaugucuguaacuaacccau

SEQ ID NO: 166259 - RNA, 64 nt, hsa
gagauaguagguugaaaugggagaauuucucuuuuggaaaaaaagguagauaacuguuuaaaaa

SEQ ID NO: 166260 - RNA, 64 nt, hsa
acagguaauuauuaguuguaauagcuuuaaugcauggaaaaacuucaguuacugaccagucaag

SEQ ID NO: 166261 - RNA, 64 nt, hsa
auuuggaccauacacuauguuacaaaacuaaaaguggaaaaaacuuauuggugaaugaauauag

SEQ ID NO: 166262 - RNA, 64 nt, hsa
ugaguugcaggauaucuagcaauuuaagaaaauguggaaaaaauauuuuuauugagaaauagca

SEQ ID NO: 166263 - RNA, 64 nt, hsa
ucaaucuaauagucaccuaaaauaucuuuuuuguuggaaaaaaguuuauaauaaaaaaguuugu

SEQ ID NO: 166264 - RNA, 64 nt, hsa
ccaaauguuuauuaaguagcuagaaauaauuauguggaaaaaaaugaauaauggaaaauaguga

SEQ ID NO: 166265 - RNA, 64 nt, hsa
agccauugggaaauugggagaaaugauaaacaaauggaaaaagaagaugucccuaaccuacacc

SEQ ID NO: 166266 - RNA, 64 nt, hsa
gaucuuuaagcaagaaguuaaagagugaacaugguggaaaaaauauaauuauuuucaucagacu

SEQ ID NO: 166267 - RNA, 64 nt, hsa
cccaggggacugccauuuuauaaaugucagcaguuggaaaaaucgucacgaauugacuuagagc

SEQ ID NO: 166268 - RNA, 64 nt, hsa
cuauuagaguauuucccuuccaaagagggauguuuggaaaaaacucugaaggagaggaggaauu

SEQ ID NO: 166269 - RNA, 64 nt, hsa
ccuacagccuagggcagacaauaguauagaagucuggaaaaaaacaaaaacagaauuugagaac

SEQ ID NO: 166270 - RNA, 64 nt, hsa
ucccaaggagaacaaauauucagaauauucauauuggaaaaaucacaauuuuuaauggcagcag

SEQ ID NO: 166271 - RNA, 64 nt, hsa
cuuauccauaaaaaaaaauagaugucuuuuauaguggaaaaacacauggggaaaaaaaucaucu

SEQ ID NO: 166272 - RNA, 64 nt, hsa
cauugacuuugccacauagcugaacuguguuuacuggaaaaauucagaggccuaaaguuuaaaa

SEQ ID NO: 166273 - RNA, 64 nt, hsa
aaaaagagggccaaggagguaugagccaucagacuggaaaaaaggaugacuauaugaugaggag

SEQ ID NO: 166274 - RNA, 64 nt, hsa
gggcccugagucaaaaggauagccaaggguggaguggaaaaagauauggugaaggcagaacugc

SEQ ID NO: 166275 - RNA, 64 nt, hsa
uucaauuucuccuuggaacucuaacaggacuaacuggaaaaauacuuugaccauagcucuagua

SEQ ID NO: 166276 - RNA, 64 nt, hsa
ucagauccccaccugcaucauuccgaauguguccuggaaaaaaacugguacucaaagcugcuua

SEQ ID NO: 166277 - RNA, 64 nt, hsa
gaaugacuccacuuuuaauguggacuuuuacucauggaaaaauugucuccuaauuuggggagau

SEQ ID NO: 166278 - RNA, 64 nt, hsa
caauuuuuucaggaccuuaguuccagcagcagaauggaaaaauccuugaagcccaggcugaugc

SEQ ID NO: 166279 - RNA, 64 nt, hsa
aucuuguuagagagcuuuucacugugaggaaguguggaaaaauagcucugugugugugugugug

SEQ ID NO: 166280 - RNA, 64 nt, hsa
ggaaaauaaaaaggauucuaaaaguuugaugcauuggaaaaauuuccuugaggcauuuagcaac

SEQ ID NO: 166281 - RNA, 64 nt, hsa
uucauccugaaaccacccuucacccugcagucuguggaaaaauugucuuccacaaaacuggucc

SEQ ID NO: 166282 - RNA, 64 nt, hsa
uauuauuugaagaaagaaaaaacagauuuuaggguggaaaaaacagucaacucacacaaagaau

SEQ ID NO: 166283 - RNA, 64 nt, hsa
uaggguggaaaaaacagucaacucacacaaagaauggaaaaaaauacugaguuaaauuaagcaa

SEQ ID NO: 166284 - RNA, 64 nt, hsa
uuuucaccuaucuggaaaaaaaaaaauaugagauuggaaaaaauuagacaagucuaguggaacc

SEQ ID NO: 166285 - RNA, 64 nt, hsa
uguggaaggcacacugagcaaguuuucaccuaucuggaaaaaaaaaaauaugagauuggaaaaa

SEQ ID NO: 166286 - RNA, 64 nt, hsa
ucaggguuaggguuuaaagaaaggagaaagccauuggaaaaaugaugggcuccauuaaggagac

SEQ ID NO: 166287 - RNA, 64 nt, hsa
ucauaaagcuucaaugucuuuuuuuuuuuuuucauggaaaaacucaaaccucuguuauuuggga

SEQ ID NO: 166288 - RNA, 64 nt, hsa
uguuugcauaggaauucaugaaggcgacccaaccuggaaaaagaacuauucacuuuggccaugg

SEQ ID NO: 166289 - RNA, 64 nt, hsa
uauuaauaccagaccaaagacauuuucuguuuccuggaaaaaaaaaaugaaucauguuaggcuu

SEQ ID NO: 166290 - RNA, 64 nt, hsa
uuaaaauuauuuucauugauggaacuggaguuguuggaaaaacauagauuuaaaaugauuuuug

SEQ ID NO: 166291 - RNA, 64 nt, hsa
cugccaagugcucuugauaauuucuucagauuuuuggaaaaaaacacuauauaaaugcaaucca

SEQ ID NO: 166292 - RNA, 64 nt, hsa
uauagaucacauacguuaucaaaaacuacucccuuggaaaaaauaucuuucgaaaaucaaauuu

SEQ ID NO: 166293 - RNA, 64 nt, hsa
caugggaaagcaaagcagaaaacagugccccaaauggaaaaaagauacucacacagaacaaaac

SEQ ID NO: 166294 - RNA, 64 nt, hsa
ugcacacaauggguuuggagcugacugggaacaauggaaaaaauuacauuagcugugguuguaa

SEQ ID NO: 166295 - RNA, 64 nt, hsa
gaauuucauagccuguaucuaucauuuagaugcauggaaaaaaaugggcuuugcacacaauggg

SEQ ID NO: 166296 - RNA, 64 nt, hsa
gaucagaguuugaaaugaaauguugucaggguguuggaaaaauuuuggugaguucugcacauuu

SEQ ID NO: 166297 - RNA, 64 nt, hsa
acugacucacugaugaaucagcauuugcauuuuauggaaaaauauaaauccaaagaaauaauuu

SEQ ID NO: 166298 - RNA, 64 nt, hsa
cuccuuggcgcugccaccugccccacccaguuucuggaaaaaguugaugcuaaugaggccaacc

SEQ ID NO: 166299 - RNA, 64 nt, hsa
guggugcuggggcuggccugcaggcugcagucccuggaaaaacagucacugacucaagacacug

SEQ ID NO: 166300 - RNA, 64 nt, hsa
gcacuacuaaguguguguuuuuuuaaaaaaaaaauggaaaaaaaaaagcuuuuaaacuggagag

SEQ ID NO: 166301 - RNA, 64 nt, hsa
gggcucagagggaauaucagugauccauacuguuuggaaaaacacugagcucaguuacacuuga

SEQ ID NO: 166302 - RNA, 64 nt, hsa
ucuuggcauaagcucaaaaaagccaggaucuuuauggaaaaauuuuaauacuuuguuaaaaggu

SEQ ID NO: 166303 - RNA, 64 nt, hsa
uggaauaaauggaaagaaauaccauauacauagauggaaaaacccaguauuauaaaaaccucaa

SEQ ID NO: 166304 - RNA, 64 nt, hsa
guuucaaccucauucaacaccagaaaguucacaguggaaaaaaucuugaagguaacagauggaa

SEQ ID NO: 166305 - RNA, 64 nt, hsa
uggacaguuuacaauguggacaauguagugaauauggaaaaagguuucagccaaaggccuaacc

SEQ ID NO: 166306 - RNA, 64 nt, hsa
ccgguucaugacagacccuuggacuuuacuguuguggaaaaaucuauauaaaacaguaucagug

SEQ ID NO: 166307 - RNA, 64 nt, hsa
aguucgcuaguacaaggggucuucaggaaguucauggaaaaauacauauuaugagaaaauugug

SEQ ID NO: 166308 - RNA, 64 nt, hsa
aaauuaaggaaugauugaauuuugugggucuugauggaaaaacgcuggucuucuuuuaaugugg

SEQ ID NO: 166309 - RNA, 64 nt, hsa
gucuugauggaaaaacgcuggucuucuuuuaauguggaaaaacagcuagugcuucaguccuagg

SEQ ID NO: 166310 - RNA, 64 nt, hsa
uauguacuguuauugaaaauauauuuaauaccuuuggaaaaaucuugggcaagaugaccuacua

SEQ ID NO: 166311 - RNA, 64 nt, hsa
uacauaauugcaauauuucccccuuacuacuucuuggaaaaaaauuacaaaaugaaguuuuaua

SEQ ID NO: 166312 - RNA, 64 nt, hsa
acaauuuauagaaauaguaucggguguucugauguggaaaaaagaaaugcaagguaauuuugua

SEQ ID NO: 166313 - RNA, 64 nt, hsa
gaagaaacuucuacagauauuacuaauuucaaucuggaaaaagaucgaauuucaaaagaauccg

SEQ ID NO: 166314 - RNA, 64 nt, hsa
gucaacucauuuucaucuguuuuuugaagaaaaauggaaaaauguaaaaggcagccccucccca

SEQ ID NO: 166315 - RNA, 64 nt, hsa
uuucuguugccauuuguguaaauacuagucuuuuuggaaaaaaaauaauguaaagauguuuugu

SEQ ID NO: 166316 - RNA, 64 nt, hsa; identical to SEQ ID NO: 77858

SEQ ID NO: 166317 - RNA, 64 nt, hsa; identical to SEQ ID NO: 77859

SEQ ID NO: 166318 - RNA, 64 nt, hsa; identical to SEQ ID NO: 77860

SEQ ID NO: 166319 - RNA, 64 nt, hsa; identical to SEQ ID NO: 77861

SEQ ID NO: 166320 - RNA, 64 nt, hsa; identical to SEQ ID NO: 77862

SEQ ID NO: 166321 - RNA, 64 nt, hsa; identical to SEQ ID NO: 77863

SEQ ID NO: 166322 - RNA, 64 nt, hsa; identical to SEQ ID NO: 77864

SEQ ID NO: 166323 - RNA, 64 nt, hsa; identical to SEQ ID NO: 77865

SEQ ID NO: 166324 - RNA, 64 nt, hsa; identical to SEQ ID NO: 77866

SEQ ID NO: 166325 - RNA, 62 nt, hsa; identical to SEQ ID NO: 77867

SEQ ID NO: 166326 - RNA, 64 nt, hsa; identical to SEQ ID NO: 77868

SEQ ID NO: 166327 - RNA, 64 nt, hsa; identical to SEQ ID NO: 77869

SEQ ID NO: 166328 - RNA, 64 nt, hsa; identical to SEQ ID NO: 77870

SEQ ID NO: 166329 - RNA, 64 nt, hsa; identical to SEQ ID NO: 77871

SEQ ID NO: 166330 - RNA, 64 nt, hsa; identical to SEQ ID NO: 77872

SEQ ID NO: 166331 - RNA, 64 nt, hsa; identical to SEQ ID NO: 77873

SEQ ID NO: 166332 - RNA, 64 nt, hsa; identical to SEQ ID NO: 77874

SEQ ID NO: 166333 - RNA, 64 nt, hsa; identical to SEQ ID NO: 77875

SEQ ID NO: 166334 - RNA, 64 nt, hsa; identical to SEQ ID NO: 77876

SEQ ID NO: 166335 - RNA, 64 nt, hsa
gaacacacacacacacacacacacacagguggggacugggcacagcucuucacaccauucauuc

SEQ ID NO: 166336 - RNA, 64 nt, hsa
aggauggaaacuggacucacauucgacauaccccacugggcacacgcacaaacacacacacuau

SEQ ID NO: 166337 - RNA, 64 nt, hsa
uuuuuccugguuugaaaggaccagauggaaagaaacugggcaagccaaugaaagucucugggga

SEQ ID NO: 166338 - RNA, 64 nt, hsa
aucccaaucacauuuucucuuaaucguuuauuauacugggcauugggguugcaagauaaugcac

SEQ ID NO: 166339 - RNA, 64 nt, hsa
gcauguggaagagugggaggaagcagagggagggacugggcagggacugccggccccggagucu

SEQ ID NO: 166340 - RNA, 64 nt, hsa
ugaccagaccagacuuuucagauugcuuccuggaacugggcagggacucacugugcuuuucuga

SEQ ID NO: 166341 - RNA, 64 nt, hsa
aagccaggacuuccccaugggaagugcaggggccacugggcagccugagggcugacccugcuca

SEQ ID NO: 166342 - RNA, 64 nt, hsa
ccugugagaagcggaauggguacugucuaggaggacugggcagggugggggcaacccagaggac

SEQ ID NO: 166343 - RNA, 64 nt, hsa
gcaaauauuuauugggggccagcccagggcugggacugggcaugagguggucaccaggauugag

SEQ ID NO: 166344 - RNA, 64 nt, hsa
aguuucccucuuccuugccagcccugaccuggucacugggcaggcuggcccagcagccuggggg

SEQ ID NO: 166345 - RNA, 64 nt, hsa
cggggcaugagccccugggugagcuccgucugccacugggcaccguggaucugcagcauguucu

SEQ ID NO: 166346 - RNA, 64 nt, hsa
cugggugcccgggccucggggcagccccugcagcacugggcagacaugcuggcccacgcccggc

SEQ ID NO: 166347 - RNA, 64 nt, hsa
agcacuugagguaucccgcaggccaugaggacccacugggcagcuccuggacagccucuuggcu

SEQ ID NO: 166348 - RNA, 64 nt, hsa
ucccugggcuggggacuccagggguggcugggagacugggcagccaccagcaaacagacccugu

SEQ ID NO: 166349 - RNA, 64 nt, hsa
ccaggcucugcuuuggguugugaguggacacccaacugggcacaggcucaggcacccauccuuu

SEQ ID NO: 166350 - RNA, 64 nt, hsa
cauaggucacuucagguagcaagaccccuggcaaacugggcacuuggccuauguacugauuugu

SEQ ID NO: 166351 - RNA, 64 nt, hsa
ugugaaucaguagacauuggauuggguuggugaaagaguucaguucuguaguaucugaauuugu

SEQ ID NO: 166352 - RNA, 64 nt, hsa
auauuuuccacaccuuuuuuuuuuuuucugaugcagaguucagguuaauauuuuacugcaucug

SEQ ID NO: 166353 - RNA, 64 nt, hsa
cucaggagccaggcuagugaucacaccagggguuagaguucacugcugaacucccugauggcag

SEQ ID NO: 166354 - RNA, 64 nt, hsa
agucagcuguaauuagagaaaugaugacuuccuaagaguucagccacgcauaauucuagauuuc

SEQ ID NO: 166355 - RNA, 64 nt, hsa
auauuuaucaaauucaggcuucauucagcaucugagaguucacaccagggagaaaucauguaug

SEQ ID NO: 166356 - RNA, 64 nt, hsa
gcucaaguucagggccaccaucauauaccuaacaagaguucaugauucuuuagguaaugucaaa

SEQ ID NO: 166357 - RNA, 64 nt, hsa
acauuuguucaaaaaugauagcuuagaaaacacuagaguucauacuaaaagauauuuugcaaau

SEQ ID NO: 166358 - RNA, 64 nt, hsa
gccguuaguaucugcucgcaucccacuuuacaucagaguucagacuuaauaaaguuaucauaaa

SEQ ID NO: 166359 - RNA, 64 nt, hsa
agauugguggaggagaguaaauaaucuagaggcaagaguucagugagggccaagggggaccccc

SEQ ID NO: 166360 - RNA, 64 nt, hsa
ccccuuuccuuuuuuuggaaggggguuauauaugagaguucauugaagaaguccagugaggcug

SEQ ID NO: 166361 - RNA, 64 nt, hsa
uagcuuagagcauuuguaucuauauuuuaaagucagaguucauguuaccuguuuuaaucacaug

SEQ ID NO: 166362 - RNA, 64 nt, hsa
uuucaauuugcuuagaaggcaacauuggaagguuagaguucaucagaaacagaauucuaaaaug

SEQ ID NO: 166363 - RNA, 64 nt, hsa
uuucaauuugcuuagagggcaacauuggaagguuagaguucaucagaaacagaauucuaaaaug

SEQ ID NO: 166364 - RNA, 64 nt, hsa
aauguauuuaguaaagaucauaagaaauccuuuaagaguucaaaugucccuggaacaggcauac

SEQ ID NO: 166365 - RNA, 64 nt, hsa
ugggaggccaaggugggaagaucgcuugaggccaagaguucaagaccagccugggcaacauagc

SEQ ID NO: 166366 - RNA, 64 nt, hsa
aaguaacuuccauauaaaaugguauuugaaagugagaguucaugacaacagaccguuuuccauu

SEQ ID NO: 166367 - RNA, 64 nt, hsa
acaugugugcuagagcuuacucugagaaggugacagaguucauguugugugcugggcucuggac

SEQ ID NO: 166368 - RNA, 64 nt, hsa
aauugaccugaaguccucagaccugagguucccuagaguucaaacagauacagcaugguccaga

SEQ ID NO: 166369 - RNA, 50 nt, hsa
ucacacugaauagacaucagagaguucacucuggagagaggccuuaugaa

SEQ ID NO: 166370 - RNA, 64 nt, hsa
cuuuguggacagcuguacacugaagagucaucagagaguucacacuggagaaagaccuuuugaa

SEQ ID NO: 166371 - RNA, 64 nt, hsa
uuuuauggacagcuccacacucauuagucaugagagaguucauacuggagaaaagccuuaugag

SEQ ID NO: 166372 - RNA, 64 nt, hsa
auuucgccgaagcucuucacucuugcagcaucagagaguucacacuagagaaaggccuuaugaa

SEQ ID NO: 166373 - RNA, 64 nt, hsa
cuuuagccgaaaaucuagccuuauuauacaucugagaguucacacuggagaaaggccuuaugag

SEQ ID NO: 166374 - RNA, 64 nt, hsa
cuuugcugaaaacuccagccuuauuaaacacuugagaguucacacuggagaaaggccauaugaa

SEQ ID NO: 166375 - RNA, 64 nt, hsa
auuucgccacaguucuucguuccgucgccaucagagaguucauacuggaaugaggccuuauaag

SEQ ID NO: 166376 - RNA, 64 nt, hsa
cucuugcccaggcuuuuugcuccuucaaggccagagaguucacaccagaucaagguguuaugag

SEQ ID NO: 166377 - RNA, 64 nt, hsa
acuuuuucaaaaacuacagcuuagaaaacaccagagaguucauacuaaaacauauuuuugcaga

SEQ ID NO: 166378 - RNA, 64 nt, hsa
cauuaauacaugcucacaucuuacucaacaucagagaguucauacucaauaaaaacauaagugc

SEQ ID NO: 166379 - RNA, 64 nt, hsa
ugggccagagcuucagcccuucuuuagcucagcuagaguucacaggagagccaaaaaagaaaag

SEQ ID NO: 166380 - RNA, 64 nt, hsa
accacagcugcaucuugcuugugagaaauggggaagaguucagggaggacacgugaccugcaca

SEQ ID NO: 166381 - RNA, 64 nt, hsa
ugugguguaaaaaacaaauuauggugcaaaaaguaaucacuagauugaaauacaugaagguuuu

SEQ ID NO: 166382 - RNA, 64 nt, hsa
auagauuuaagcugcuaauuuuuuuuuuuuuaguaaucacuacuauaucaugucuuuuacucug

SEQ ID NO: 166383 - RNA, 64 nt, hsa
uuuuaaauaaucacuaaaaucacuagauuuaaauaaucacuaaaaugauuugugagaaacuggc

SEQ ID NO: 166384 - RNA, 64 nt, hsa
gcaagcuaggauagugauuuuaaauaaucacuaaaaucacuagauuuaaauaaucacuaaaaug

SEQ ID NO: 166385 - RNA, 64 nt, hsa
augcuuaaugcaagcuaggauagugauuuuaaauaaucacuaaaaucacuagauuuaaauaauc

SEQ ID NO: 166386 - RNA, 64 nt, hsa
uaguaaucauuuucuaggggaaaauaaaagaauaaaucacuauacugauauuuugauacaagca

SEQ ID NO: 166387 - RNA, 64 nt, hsa
cugauauuuugauacaagcaagcacuuacaugguaaucacuauauagauccaaccuguggauuu

SEQ ID NO: 166388 - RNA, 64 nt, hsa
guucuuuauauuucuuaaaacagaaaggguggaaaaucacuauacagaagcaauauccaaagau

SEQ ID NO: 166389 - RNA, 64 nt, hsa
aaccaucuuuuauccucuauucauauuuucuaccaaucacuauguauuggggauaucuuugcag

SEQ ID NO: 166390 - RNA, 64 nt, hsa
uuauugguuuaguauucuuguuguuuacgcauggaaucacuauuccugguuaucucaccaacga

SEQ ID NO: 166391 - RNA, 64 nt, hsa
aagaagauaauagaccagcaauugcagcacuuacaaucacuaauucccuuaagguugaaacugu

SEQ ID NO: 166392 - RNA, 64 nt, hsa
gucuccaaagcccuucuucuuuccaccacaaauuaaucacuauguuuauaagguaguaucagaa

SEQ ID NO: 166393 - RNA, 64 nt, hsa
agguaguaucagaauuuuuuuaggauucacaacuaaucacuauagcacaugaccuugggauuac

SEQ ID NO: 166394 - RNA, 64 nt, hsa
aacuaguucacagacaaggaaacuucuauguaaaaaucacuaugauuucugaauugcuauguga

SEQ ID NO: 166395 - RNA, 64 nt, hsa
agaaucugacagauaccauaaagggauuugaccuaaucacuaauuuucaggugguggcugaugc

SEQ ID NO: 166396 - RNA, 64 nt, hsa
aauuuaaucuccccauugagugugucaugguacaaaucacuauucguuuuugguguuuuuuagg

SEQ ID NO: 166397 - RNA, 64 nt, hsa
gugaccaauggugugcccagagcacuacucucaaaaucacuaguguuagcaagucgucccgggc

SEQ ID NO: 166398 - RNA, 64 nt, hsa
aauuuauguuuauuggaagaacauuuuacuuaaaugauuugaggggugggagggagugaacuac

SEQ ID NO: 166399 - RNA, 64 nt, hsa
acccguagggccaccaugcccuucugccccuggcugauuugauccugugucugaucccauugca

SEQ ID NO: 166400 - RNA, 64 nt, hsa
aggaauauaagaugccucaagcauucauuauuuaugauuugaauacuguagcuauuuuuuguug

SEQ ID NO: 166401 - RNA, 64 nt, hsa
acagagcuguuaauaaugguuauguggauuacugugauuugaaaacuaaauucacaauaacuua

SEQ ID NO: 166402 - RNA, 64 nt, hsa
aauacacauuugcuacuguuguaagaauucugauugauuugauugggaugaaugccaucuaucu

SEQ ID NO: 166403 - RNA, 64 nt, hsa
accuuucucucucuaagguuuacaauaggaguggugauuugaaaaauauaaaauuaugagauug

SEQ ID NO: 166404 - RNA, 64 nt, hsa
agccuguaggacuggaugaaugggguugugaaacugauuugacaagagaauaauuuacaaaaau

SEQ ID NO: 166405 - RNA, 64 nt, hsa
gguauccauugugacagacaaguaaaauugcaggugauuugauaauuaagcacccauaccauuu

SEQ ID NO: 166406 - RNA, 64 nt, hsa
ggugugcuauuugucaguagccauuuuuuugcagugauuugaagaccaaaguuguuuuacagcu

SEQ ID NO: 166407 - RNA, 64 nt, hsa
uagcuaugguuguaacauauguauucccuuccucugauuugaaggcaaaaaucuacaguguuuc

SEQ ID NO: 166408 - RNA, 64 nt, hsa
uuuuuuuuuugaaaagauaaacuuguaaauagagugauuugaaauacuauauggcaaaguuuua

SEQ ID NO: 166409 - RNA, 64 nt, hsa
cuuggaagcaugucccucccucuugaguuggcucugauuugaaaucgggagaaacagagcugcu

SEQ ID NO: 166410 - RNA, 64 nt, hsa
ucagauaacucaguacagauagcaauuagucagcugauuugauuacaauggaguaaccgacaau

SEQ ID NO: 166411 - RNA, 64 nt, hsa
caauauucuuuuuuaaaguuuuuuuuuaaaauauugauuugaaugcaguaggcuuuuuuguaua

SEQ ID NO: 166412 - RNA, 64 nt, hsa
ucacuguuuaugcugcuggaacuuagcacugucuugauuugaagcauaugauugagagccauuu

SEQ ID NO: 166413 - RNA, 64 nt, hsa
agacacaacuugguuucagaaagaagauaaacugugauuugacaagucaagcucuuaagaaaua

SEQ ID NO: 166414 - RNA, 64 nt, hsa
acaaaacaaaaaaaccaauggauuuuaaccaaaaugauuugaaauauaggugaggauucaggag

SEQ ID NO: 166415 - RNA, 64 nt, hsa
auucagacuuugcuauuuguugucaauuuauagcugauuugaagguuuucuauuuaacacuggu

SEQ ID NO: 166416 - RNA, 64 nt, hsa
guuuuauuuuguuccauguuuaaaucauucacuuugauuugagugggaaaagccugaagccuuu

SEQ ID NO: 166417 - RNA, 64 nt, hsa
ugucagugauuuagaugauuuaaaaaugcaugugugauuugaauuuuauaauuguuuugacaag

SEQ ID NO: 166418 - RNA, 64 nt, hsa
cgauugaagccaaaucuguugucauguuaguaaaugauuugaaaacugaauguaauacuugagu

SEQ ID NO: 166419 - RNA, 64 nt, hsa
uucuuugacuuauuauuagcuuggcaguugcuuuugauuugauuguuuuaugacaugguauacu

SEQ ID NO: 166420 - RNA, 64 nt, hsa
ucuguggcuugauauuuugcugugggugaaauuuugauuugagguauuagaaaauauuuuugug

SEQ ID NO: 166421 - RNA, 64 nt, hsa
cauagguuaggagacuaaaauauaaauuaaguugugauuugaauguagauugguaucaccucca

SEQ ID NO: 166422 - RNA, 64 nt, hsa
uuacagggaggugauugaggacgucguuaugauuugauuugaccuuggcacacacugcagagcc

SEQ ID NO: 166423 - RNA, 64 nt, hsa
ccgguuuacagggaggugauugaggacgucguuaugauuugauuugaccuuggcacacacugca

SEQ ID NO: 166424 - RNA, 64 nt, hsa
cuuaaauuucaaaccauuuaccaucugaaaguuuugauuugaauguaaaacaggaaauuggaau

SEQ ID NO: 166425 - RNA, 64 nt, hsa
cugcuuugcucuacaaauaccuggggcagaaauuugauuugaaaaguauuauucucucuucucu

SEQ ID NO: 166426 - RNA, 64 nt, hsa
uauuuuguagagaaacucaggaagauuuaaauguugauuugacagcucaauaggcuguuaccaa

SEQ ID NO: 166427 - RNA, 64 nt, hsa
caaaaaaugguucuguuuuaaaaaggauuuuguuugauuugaaauuaaaacuucaagcugaaug

SEQ ID NO: 166428 - RNA, 64 nt, hsa; identical to SEQ ID NO: 166426

SEQ ID NO: 166429 - RNA, 64 nt, hsa
cgaaaaaugguucuguuuuaaaaaggauuuuguuugauuugaaauuaaaacuucaaacugaaug

SEQ ID NO: 166430 - RNA, 64 nt, hsa
cuccucugugggccuggcagacccuucaugagugggacccaagauaucacugacuucaacccag

SEQ ID NO: 166431 - RNA, 64 nt, hsa
ucaggcccagcuguccuagguugggcagguggguggacccaagcuugucugcugccugaguucc

SEQ ID NO: 166432 - RNA, 64 nt, hsa
gaagagauagaaucagggcugcccccacagagugggacccaaggggcuaauuggaggcacgagg

SEQ ID NO: 166433 - RNA, 64 nt, hsa
uccucuccccgcucuagguuucuucucccaaaggggacccaaggcugugacacuuaccuccacc

SEQ ID NO: 166434 - RNA, 64 nt, hsa
gccaguggccaccugugcucagucugaagacguuggacccaaguuaggugugacacguucacac

SEQ ID NO: 166435 - RNA, 64 nt, hsa
ggggccuccucagccucugcaacugcaagaaaggggacccaagaaaccaaagucugccgcccac

SEQ ID NO: 166436 - RNA, 64 nt, hsa
accaaagcauuucuagucccuucucucuuucuaaggacccaaauuucccugggggcauccugcu

SEQ ID NO: 166437 - RNA, 64 nt, hsa
gggaagacagauaaugaaguaggcaaagagaaaaggacccaagauagagguuuauauucagaaa

SEQ ID NO: 166438 - RNA, 64 nt, hsa
guggggauaugauuuaaaucagccguguaaccauggacccaauauuuaccagaccacaaaacuu

SEQ ID NO: 166439 - RNA, 64 nt, hsa
cacacuagcagcccugacuccacacuccuccuggggacccaagaggcaguguugcugucugcau

SEQ ID NO: 166440 - RNA, 64 nt, hsa
aaauaauuugggggugauuugcaaugaaauuuugggacccaaagaguauccacuggggauguuu

SEQ ID NO: 166441 - RNA, 64 nt, hsa
aguucugcaaagauguugauaugccuugcagcuuggacccaaugggugguggucagggccuggg

SEQ ID NO: 166442 - RNA, 64 nt, hsa
augucacucaagaccaagcggucagaaggccugaggacccaaggccccacuggagcagucuguc

SEQ ID NO: 166443 - RNA, 64 nt, hsa
augaggugccuuucccggaacccuccucucgccuggacccaagagaggcgacagcuguggcugg

SEQ ID NO: 166444 - RNA, 64 nt, hsa
ggagcuggccugagagggcucaauggacccucggggacccaaguggggcuuucaacccucuccc

SEQ ID NO: 166445 - RNA, 64 nt, hsa
ugcaggaggcuuccagaagcaguuguuguaauuaggacccaagcacugggaggggcuguuggcu

SEQ ID NO: 166446 - RNA, 64 nt, hsa
ggucugggaaaaagcuuuaaccugcagggcaccaggacccaaggcaggcuguuccuuggggcgg

SEQ ID NO: 166447 - RNA, 64 nt, hsa
gggcauguucaugaauaucaaaucuuuugaugcuggacccaagagaggaaaaguuguagcuaaa

SEQ ID NO: 166448 - RNA, 64 nt, hsa
gcagagggaugguuuuuaaaugugcuuauggaaaggacccaauaaaugaauauuccuaacuuag

SEQ ID NO: 166449 - RNA, 64 nt, hsa
agaagaucuguuucccuguguccugugaauggaaggacccaagccaauauguuccuuugaaaag

SEQ ID NO: 166450 - RNA, 64 nt, hsa
cuuucccaggccgcaccauuucugucacucacauggacccaagauaaaagaauggccaaacccu

SEQ ID NO: 166451 - RNA, 64 nt, hsa
gucacaugcuaacagagguuuguaauuaucuuuuggacccaaauuauagagacauucacgaguu

SEQ ID NO: 166452 - RNA, 64 nt, hsa
gagcagaaugagacaauuccuugggcuguaguuuggacccaacugaauccugagugcucugugg

SEQ ID NO: 166453 - RNA, 64 nt, hsa
gggacaugugguuauuuggaaauugugacugagcggacccaagaauguaaauaauauucauaaa

SEQ ID NO: 166454 - RNA, 64 nt, hsa
gcuuccugcagcucacgcccaccagcuacugaagggacccaaggcacccccugaagccagcgau

SEQ ID NO: 166455 - RNA, 64 nt, hsa
gcaauagcuggguuuacagacauuuaccaccugcggacccaaaagagaaggccuaggagaguuu

SEQ ID NO: 166456 - RNA, 64 nt, hsa
ugugucccuacucauugaaaccaaacucuggaaaggacccaauguaccaguauuuauaccucua

SEQ ID NO: 166457 - RNA, 64 nt, hsa
gucacuuccucguuuuaacucagcugaaacaccaggacccaauagagagggcaagcugagcauc

SEQ ID NO: 166458 - RNA, 64 nt, hsa
agcagucuguugcuuccuaggacaacuuauaaugggacccaaaggggaaagaggauuucccggg

SEQ ID NO: 166459 - RNA, 64 nt, hsa
cuaggauuauaaaacauuuuuuugugucuaaauuggacccaaaacauugaacaguuugggguag

SEQ ID NO: 166460 - RNA, 64 nt, hsa
cuuaaaguucauuauguaaaacuaauuauaaacaggacccaauuuauauucauagauccucuca

SEQ ID NO: 166461 - RNA, 64 nt, hsa
uuuuuguuguuauuucuuacaggcacaaaaugauggacccaaugcacacaaaacaacccuagag

SEQ ID NO: 166462 - RNA, 64 nt, hsa
uacuucccugacuggagcuaaaucccaccagccaggacccaaacucuccuuaccgagaaggacc

SEQ ID NO: 166463 - RNA, 64 nt, hsa
guccccaaccugccuucugcucugccccugcacaggacccaaaggccccaggcccugcaaggug

SEQ ID NO: 166464 - RNA, 64 nt, hsa
cccuuuuuucaguaaguaauuuguuuauuagccaggacccaagacuaaguuauuuacaugucca

SEQ ID NO: 166465 - RNA, 64 nt, hsa
gaccuuccucuuuuggagcugucccauguacaguggacccaagcucaggaccuucguggagcug

SEQ ID NO: 166466 - RNA, 64 nt, hsa
ccuaaagagcagugaaggaaaugucagguuagcaggacccaaguuuugggugugaaauguugcc

SEQ ID NO: 166467 - RNA, 64 nt, hsa
gggggccacccaagucauaguccaaucucuucaaggacccaagauagaauuuaggaauuuugug

SEQ ID NO: 166468 - RNA, 64 nt, hsa
gcuuuugaaggagguagggaaugacaucuuccuuggacccaaagcuuaaaaguaauguaugcuu

SEQ ID NO: 166469 - RNA, 64 nt, hsa
ggauuucugugcuauaaaccugauucuaaauguaggacccaaguuucuggacuacuucagaaua

SEQ ID NO: 166470 - RNA, 64 nt, hsa
acgaaguauagagaacagguggcccagauccaggggacccaacuucuggccccuuggucuguca

SEQ ID NO: 166471 - RNA, 64 nt, hsa
gacuuccccagggugcacagcgaguaacagaucaggacccaaacuugggcagucugggcuggga

SEQ ID NO: 166472 - RNA, 64 nt, hsa
guuaauauuucuauuaagaacauguugggcauguggacccaagcaccugggaaggagguggcau

SEQ ID NO: 166473 - RNA, 64 nt, hsa
aucucuuugcugaauuaaugaguucuuaacauguggacccaacugccugugugagaucuguguc

SEQ ID NO: 166474 - RNA, 64 nt, hsa
ccaacugggaaaggaggcccucugaucacacgcaggacccaaacacucagaaaucaagaaccuc

SEQ ID NO: 166475 - RNA, 64 nt, hsa
ccuggcccaauuccucagaccccagaguggccugggacccaagcugccgcagcugaguggcccc

SEQ ID NO: 166476 - RNA, 64 nt, hsa
gcaacaucaaguaaaauuuuagacgauggcuauaggacccaaaucuaaagcugucuaaauguua

SEQ ID NO: 166477 - RNA, 64 nt, hsa
aaggaacuguacuggcuauuacauaagaaacaauggacccaagagaagaaaaggaagaaagaaa

SEQ ID NO: 166478 - RNA, 64 nt, hsa
aacagauccuagccaucagugacaaaguuaaucaggacccaagucugcuucugugauauuaucu

SEQ ID NO: 166479 - RNA, 64 nt, hsa
uugaaacgacaaauccagaagcaaagagauaguaggacccaagggaaaggaagggaagagugcu

SEQ ID NO: 166480 - RNA, 64 nt, hsa
ccuuaaguuucccuguguuguuccacacccagaaggacccaagaaaaccuguuuuuaacaugug

SEQ ID NO: 166481 - RNA, 64 nt, hsa
uucugaaucugcaaucauuccuuugacaauuacuggacccaaaggaaaauucauuuucuuugca

SEQ ID NO: 166482 - RNA, 64 nt, hsa
aauuaugcaauuagccucauaguuauuauccagaggacccaacugaacugaacuaauccuucug

SEQ ID NO: 166483 - RNA, 64 nt, hsa
gggcagagccagaagaaggcucauuagaccugggggacccaaagggucuggccucuuugggcag

SEQ ID NO: 166484 - RNA, 64 nt, hsa
cgggauggccuuggguacaucacucagccuuucuggacccaauuuuuccccagugaaagccaag

SEQ ID NO: 166485 - RNA, 64 nt, hsa
uaggaaauguucaacaauucugugaaaggucacaggacccaauuggagaaaucauaugaaaagc

SEQ ID NO: 166486 - RNA, 64 nt, hsa
gggaugccgaggcaaugcuguacuugaagccagaggacccaaauugccgcccuggcugugcugc

SEQ ID NO: 166487 - RNA, 64 nt, hsa
cacccccagaguuugauacaguagaccucaggugggacccaaaaauuugcauuucuaacacauu

SEQ ID NO: 166488 - RNA, 64 nt, hsa
aauguauuuauuugggagaccgggguauccugggggacccaauguaggagcugccuuggcucag

SEQ ID NO: 166489 - RNA, 64 nt, hsa
ucuuccucacccucauccuuugggaggcugacuuggacccaaacugggcgacuagggcuuugag

SEQ ID NO: 166490 - RNA, 64 nt, hsa
cucgcaguagaggaacuccugguggugggaagagggacccaauggacaaaaccguuuuuguuuu

SEQ ID NO: 166491 - RNA, 64 nt, hsa
uccaguggccuccagcagaucaugaugacaucauggacccaauagcucauucacugccuugauu

SEQ ID NO: 166492 - RNA, 64 nt, hsa
aagagagggaguaacaugucuucucauugcccacggacccaaccucuguccaggugccccucau

SEQ ID NO: 166493 - RNA, 64 nt, hsa
ucgaucucccaggcucuuucugcagucauaccgcggacccaaugggcgcccugcacacccguuu

SEQ ID NO: 166494 - RNA, 64 nt, hsa
guuugauagcgucggcucagagcccugguaccuuggacccaagaggaggcccaucaucuuccug

SEQ ID NO: 166495 - RNA, 64 nt, hsa
cagggaaaauggagcccaaguagccucuggccagggacccaaugucccgaggaaucugccuccc

SEQ ID NO: 166496 - RNA, 64 nt, hsa
caggguggcgcggcugcugcucacugugcugcugggacccaagaguggggcgucgccccugcug

SEQ ID NO: 166497 - RNA, 64 nt, hsa
ccagggcagcuggagcuuuguuggggagacuucuggacccaaagggagcuuucccaagaagccu

SEQ ID NO: 166498 - RNA, 64 nt, hsa
aaccccucccuagcaucccaggugcccugacccaggacccaacauggucuagggaugcaggauc

SEQ ID NO: 166499 - RNA, 64 nt, hsa
agcugaugaugacagcagagaguggcagggcugaggacccaaagucauuucccaggcuggcgga

SEQ ID NO: 166500 - RNA, 64 nt, hsa
accgaagacugggaugccugucuugaguagacuuggacccaaaaaaucaucucaccuugagccc

SEQ ID NO: 166501 - RNA, 64 nt, hsa
accugaaggguuguguggagucuggaaauauuguggacccaagaaccuugaccucucggugccu

SEQ ID NO: 166502 - RNA, 50 nt, hsa
cccaaguuggccccaacugaggacccaauauuggccuguuugcaacagcu

SEQ ID NO: 166503 - RNA, 64 nt, hsa
ccauucucaccaugcaggguggguggagcaaggaggacccaaguucuucccaucucaaaaaaaa

SEQ ID NO: 166504 - RNA, 64 nt, hsa
cgguuugaauacgucacuuaccagugccauugcaggacccaaauucacaguucauaaaagaugu

SEQ ID NO: 166505 - RNA, 64 nt, hsa
auuuguccacuguuucuugucaucacgcagcccuggacccaaagggugaacuaaaguuuaagga

SEQ ID NO: 166506 - RNA, 64 nt, hsa
aaccuuugggagugccuuuuuuguuuuucaagauggacccaaaaaaguggaggaagauauuguu

SEQ ID NO: 166507 - RNA, 64 nt, hsa
cuccgccaacccauuccuaccuccucuagugcagggacccaaguuagaugaugagaaaaugcca

SEQ ID NO: 166508 - RNA, 64 nt, hsa
auuuuugauuuguaagaggccauccagguacuaaggacccaaggcauacagauucacaaaauua

SEQ ID NO: 166509 - RNA, 64 nt, hsa
gaauaaccaggacagccaagugaagcagccacagggacccaagcagucgaggucuuuaaugugc

SEQ ID NO: 166510 - RNA, 64 nt, hsa
augagaagaaaauggaaccaggcuuggaaccguaggacccaagcagagaagcucucgggcuagg

SEQ ID NO: 166511 - RNA, 64 nt, hsa
agcugaccacggagcuggggguugccauggauggggacccaaagaccugcagccaccagugcuu

SEQ ID NO: 166512 - RNA, 64 nt, hsa
cgggcuuugggggcgucaggucuuuccaagguugggacccaaggaucggggggcccagcagccc

SEQ ID NO: 166513 - RNA, 64 nt, hsa
ccaaggcaucuccuacucuccauuuauauucuauggacccaagucuaugcucaguuccacagaa

SEQ ID NO: 166514 - RNA, 64 nt, hsa
uacuaaaucuacaacagcucgccuuauuuuucuuggacccaaacugucaggguauaaacacuau

SEQ ID NO: 166515 - RNA, 64 nt, hsa
ggggaaagcuguuuggcagaaagaaaaaucaagaggacccaaggggauggagacaggaccacag

SEQ ID NO: 166516 - RNA, 64 nt, hsa
cugggcccaccuccgauucacagagguuucagggggacccaaaucacugcugguuuucaauuuu

SEQ ID NO: 166517 - RNA, 64 nt, hsa
cuugggauuuccuuuccaaagcacaaaaauacugggacccaagaagaacagcuagaggacaacu

SEQ ID NO: 166518 - RNA, 64 nt, hsa
aagccugcaaaucucccucuuguggaauuccacuggacccaaucuguuuuccauuuccauugca

SEQ ID NO: 166519 - RNA, 64 nt, hsa
gcugccagauccacucacucugcugccuccagcaggacccaaggccacuuucaacucuuauggg

SEQ ID NO: 166520 - RNA, 58 nt, hsa
gccaauucaaaagcaauuaauuggcuuaggacccaauuuccauagaugcaaauggcag

SEQ ID NO: 166521 - RNA, 64 nt, hsa
caugacuggagcacagccuccugccucccagcccggacccaaugcacuuucuugucuccucuaa

SEQ ID NO: 166522 - RNA, 64 nt, hsa
ggcaccccacacaaaccuauuuauugaaucugcuggacccaagcggcucuccagcccuuccguc

SEQ ID NO: 166523 - RNA, 64 nt, hsa
auuguaaggaaugaacaagguugccacagugcauggacccaauuguguuugccuguugacgugc

SEQ ID NO: 166524 - RNA, 64 nt, hsa
cugugacucaugccauagacaagguugagugccuggacccaaaggcaauacuguaauguaaaga

SEQ ID NO: 166525 - RNA, 64 nt, hsa
uuuucuuggcccccuucccaaggccuuaagcuuuggacccaaggaaaacugcauggagacgcau

SEQ ID NO: 166526 - RNA, 64 nt, hsa
guccuaaauacccuagaguucuuugccucaaguuggacccaagauugaaaacccaaggcagguu

SEQ ID NO: 166527 - RNA, 64 nt, hsa
uccuggggaaagugacugguccgugguagagccgggacccaauccccucucucuccucccuguu

SEQ ID NO: 166528 - RNA, 64 nt, hsa
guccuucuccacugauacuggcagcucggcuccuggacccaagaucccuugaguggaauucugc

SEQ ID NO: 166529 - RNA, 64 nt, hsa
gcaaaccuugaugaagcaccugcuggacacugagggacccaaagcucaaucagccauaaucccu

SEQ ID NO: 166530 - RNA, 64 nt, hsa
accaccuggcaauaugacucacuugaccccuaugggacccaaaugggcacuuucuugucugaga

SEQ ID NO: 166531 - RNA, 64 nt, hsa
aagccgugagugucauagaacucuacggcauccuggacccaaccacccgagacuggacagaugg

SEQ ID NO: 166532 - RNA, 64 nt, hsa
auauuuguauacacauaaugagaccuuggggaugggacccaagucugaacguggaauucaccug

SEQ ID NO: 166533 - RNA, 64 nt, hsa
ucaagaauuauacaauccuacuagcaauauauaaggacccaaaaugucuucugcuaagcucaga

SEQ ID NO: 166534 - RNA, 64 nt, hsa
acccagaaacaacacaauccguugcaaacccaaaggacccaaguacuuuccaaucucagucacu

SEQ ID NO: 166535 - RNA, 64 nt, hsa
augugugcagcaugacucucccugucuguggcagggacccaagcgcuugcuuaagccccagugc

SEQ ID NO: 166536 - RNA, 64 nt, hsa
aggagcucagacucuuagagccagcuguggcuucggacccaaggccugaccuaggcugcuaucc

SEQ ID NO: 166537 - RNA, 64 nt, hsa
cuccugaggagcuucaguugcaagucaaugccaaggacccaacugcagcauguucuggaagccu

SEQ ID NO: 166538 - RNA, 64 nt, hsa
aaagugugucucuguaccuuacaacagcgauucaggacccaagugugaacaacacucagcccgc

SEQ ID NO: 166539 - RNA, 64 nt, hsa
aaacaccaaacacacuauggaacucugcugauggggacccaagcgcccacgugcucagccaccc

SEQ ID NO: 166540 - RNA, 64 nt, hsa
guggcagccacacgcaggcggccagggcggccagggacccaaagcaggaugaccacgcaccucc

SEQ ID NO: 166541 - RNA, 64 nt, hsa
caagugucuucacuaagcguauggccaauaaaugggacccaaacguucaaucuguucaguuuac

SEQ ID NO: 166542 - RNA, 64 nt, hsa
cuauaccaaccaaaccaauucaccaacacaguugggacccaaaacacaggaagucagucacguu

SEQ ID NO: 166543 - RNA, 64 nt, hsa
gaaaaugaugcaagaaaaucaaaugggaaucuggggacccaacacaacauccugaagauuauua

SEQ ID NO: 166544 - RNA, 64 nt, hsa
uauuugcauagcauaaugagauaucuugggaaugggacccaaaucuaaacacaaaauucauuua

SEQ ID NO: 166545 - RNA, 64 nt, hsa
ucacacagaccauuucauuuuuaccagggcuuggggacccaaugcaaagaugaugacuauuuaa

SEQ ID NO: 166546 - RNA, 64 nt, hsa
gcuggagagacccaagacccuaucuguucaccagggacccaaaauccaaggggaugcuucccuc

SEQ ID NO: 166547 - RNA, 64 nt, hsa
cugagccuagccuucagcaaccaagguucuccugggacccaaaguuuaugggagaagggcaaag

SEQ ID NO: 166548 - RNA, 64 nt, hsa
gggccucccaauagacuaacaggcagugccaguuggacccaagagaagacugcagcagacuaca

SEQ ID NO: 166549 - RNA, 64 nt, hsa
uugcucuuuugaacacccuccccacugauccuugggacccaacgccgcauugccucuugcagau

SEQ ID NO: 166550 - RNA, 64 nt, hsa
agucuccugagccuguagagcccccaggagacugggacccaaagaacuucacagcacacuuacc

SEQ ID NO: 166551 - RNA, 64 nt, hsa
ggggagugugggcaugggaggggucugaaaaucaggacccaacccagccacugaagagagaguc

SEQ ID NO: 166552 - RNA, 64 nt, hsa
gccaucagaacugcccggcuuuuuuggaaacugaggacccaacaacuaaccacguuuacacgac

SEQ ID NO: 166553 - RNA, 64 nt, hsa
acugaaaacauaaauacugaccacuccuauguucggacccaagcaaguuagcuaaaccaaacca

SEQ ID NO: 166554 - RNA, 64 nt, hsa
agacuuaaaauguaucaccacuaaccugugagggggacccaaucuggacuccuuccccgccuug

SEQ ID NO: 166555 - RNA, 64 nt, hsa
augcuguuaaaagaggaggaaacuacuugaggagggacccaacuuuccgcuaucuuuuggguuc

SEQ ID NO: 166556 - RNA, 64 nt, hsa
aauaucaacaguggcaaucagcacacagaggaaaggacccaaaucacuauguagcuuaaagauu

SEQ ID NO: 166557 - RNA, 64 nt, hsa
guuggcacugcggcccucaccagguccugggcucggacccaacuccuggaccuuuccagccugu

SEQ ID NO: 166558 - RNA, 64 nt, hsa
uucccgaaggagcagcugcggacggagguggaucggacccaaggcuggugccuggggcuaaggc

SEQ ID NO: 166559 - RNA, 64 nt, hsa
aguuagaaucucugggccucuccucaacuguccuggacccaaggcuaggaaagggcugcuugag

SEQ ID NO: 166560 - RNA, 64 nt, hsa
gaggcaaugccauuucuagaguugaaaaagcccuggacccaaacugcggcacuguugaauaaag

SEQ ID NO: 166561 - RNA, 64 nt, hsa
ucccugccuagacuguugacguccccugggaaggggacccaaggaugaauuggcugugaaggau

SEQ ID NO: 166562 - RNA, 64 nt, hsa
cuguauuaggcggccgaggucacucugggccuggggacccaaacccccugcagcccaggccagu

SEQ ID NO: 166563 - RNA, 64 nt, hsa
ggaggcugagcugcaucccugcuccccacauggaggacccaacaggaggccguggcucugaugc

SEQ ID NO: 166564 - RNA, 64 nt, hsa
ccucuccgcugucgcccagugugagccuggaagaggacccaagagagugccgugcugaggcugc

SEQ ID NO: 166565 - RNA, 64 nt, hsa
uuccccacaggugaccgagauccucgauuacuggggacccaauuccggcccauugacguggcgc

SEQ ID NO: 166566 - RNA, 64 nt, hsa
gcuuauccucuaagcccugauccacaauaaaaauggacccaacucagcucugacucucuagguu

SEQ ID NO: 166567 - RNA, 64 nt, hsa
caggaagccaaucagccaaagaaaauggugaucuggacccaagagaccaguagucacccugcuu

SEQ ID NO: 166568 - RNA, 64 nt, hsa
uugaggccccaacaugacagccacugggccaccgggacccaagaagacagcccccugccccauc

SEQ ID NO: 166569 - RNA, 64 nt, hsa
uugcgucuuuugcccaccccccuggcauucagcuggacccaacuaggccaucaugaguggcuuc

SEQ ID NO: 166570 - RNA, 64 nt, hsa
cccccaucaaguuuggugggcagagcuacagaugggacccaagggaguggccgagccucacugc

SEQ ID NO: 166571 - RNA, 64 nt, hsa
ucuucuuuagaucggucugauugauuuuaaaaguggacccaaacuuagggaauucuugauuuag

SEQ ID NO: 166572 - RNA, 64 nt, hsa
ugacccugaucacccucuggguguacguguacguggacccaaacaaugugcuggacgccgagaa

SEQ ID NO: 166573 - RNA, 64 nt, hsa
aaccaccgaugccgagaggcuaguggugccccagggacccaagacuaguuccgucacuagaguc

SEQ ID NO: 166574 - RNA, 64 nt, hsa
uagaccccuguggccccugagccugggcagguggggacccaacuccaccccaccugucuucauc

SEQ ID NO: 166575 - RNA, 64 nt, hsa
ccgcauuccaagaaguagucugucgcgggcgcagggacccaacccggugucgcugcacccgccc

SEQ ID NO: 166576 - RNA, 64 nt, hsa
ugucuccuugcuccaauggaggcagaagagcccaggacccaagcgucuuggcaggggugcugug

SEQ ID NO: 166577 - RNA, 64 nt, hsa
gucaguugugcccagccuaccuucucucacagggggacccaauucucugaagucuacgauggag

SEQ ID NO: 166578 - RNA, 64 nt, hsa
cggcaguucccugcaggagagaggaggggcugcuggacccaaggcucagucccucugcucucag

SEQ ID NO: 166579 - RNA, 64 nt, hsa
acucccuuucccccucccuugccccuuccuccagggacccaagcgcuuccagaugacaauugca

SEQ ID NO: 166580 - RNA, 64 nt, hsa
cgagggccucccagcagagcuugggaagggccauggacccaacugggccccagaagagccacag

SEQ ID NO: 166581 - RNA, 64 nt, hsa
auucuuucuuucaggugaaauuuugggauugcuaggacccaauggugcuggaaaaaguucaucu

SEQ ID NO: 166582 - RNA, 64 nt, hsa
agagcaaauguguuaggagagaagguuucacaugggacccaacauccuucaucaauacuuuccu

SEQ ID NO: 166583 - RNA, 64 nt, hsa
uuuccaaauaauuugaacagcuugcugcuaaaugggacccaauuuuuggccuauagacacuuau

SEQ ID NO: 166584 - RNA, 64 nt, hsa
uccugcagccacacacccacccgggguguccuggggacccaaggggugggggggucacaccaga

SEQ ID NO: 166585 - RNA, 64 nt, hsa
ucgcugaguggccucaggcagugaccacgcucccggacccaaccuucagcuugcccaaagcaau

SEQ ID NO: 166586 - RNA, 64 nt, hsa
gagggcauagguuacacccuacagaauaaagaagggacccaaagccucuuuuugccucccggaa

SEQ ID NO: 166587 - RNA, 64 nt, hsa
ugauuuuacuuuccuuaaagacucagaaagacuuggacccaaggaguggggauacagugagaau

SEQ ID NO: 166588 - RNA, 64 nt, hsa
cuucucccaguccaagaccccaaaucaccacaaaggacccaauccccagacucaagauaugguc

SEQ ID NO: 166589 - RNA, 64 nt, hsa
cuuucuuggccgugagccuaaccaugaucuugagggacccaacauuuguaggggcacuaaucca

SEQ ID NO: 166590 - RNA, 64 nt, hsa
ugaagggacucaggacaggcucugugacuuacagggacccaaucaauucacaaugagaaauuac

SEQ ID NO: 166591 - RNA, 64 nt, hsa
guaucugaacucucagguugugagugcugcuauuggacccaaaaggaacgugucucucuccaag

SEQ ID NO: 166592 - RNA, 64 nt, hsa
gcucucuugugagcucuuggacccuccucuucacggacccaacugugccguuuguccccucucu

SEQ ID NO: 166593 - RNA, 64 nt, hsa
ucagcacacgccuuguuacgagcaagugccggcuggacccaagcccugcauccccacaugcggg

SEQ ID NO: 166594 - RNA, 64 nt, hsa
acaucgggcuguuuugcauuuagugguagcaccaggacccaaaggaaauagcaguggggaagca

SEQ ID NO: 166595 - RNA, 64 nt, hsa
uggcaauuugagagucuggcaucguuuuccgccaggacccaaagauccaggaggcacuugugac

SEQ ID NO: 166596 - RNA, 64 nt, hsa
ugccaaaggcuccaggccucuccccugcaacucaggacccaagcccagcucacucugggaacug

SEQ ID NO: 166597 - RNA, 64 nt, hsa
gcaucccaaagcuucgauggagagcagggaagggggacccaaggcaggagguacaccagcugga

SEQ ID NO: 166598 - RNA, 64 nt, hsa
aaaaaaauaguuuuuucauuaguauuucucgggaggacccaaaaguuaaggucagcuuguucac

SEQ ID NO: 166599 - RNA, 64 nt, hsa
caggaagaaaggaaggaaggaaagaaggaagggaggacccaaucuauaggagcaguggacugcu

SEQ ID NO: 166600 - RNA, 64 nt, hsa
ugcucacaaggacuuuugauuuuaguuauaaggaggacccaaaauguguguguguacaugugug

SEQ ID NO: 166601 - RNA, 62 nt, hsa
ggccagggcaagccaacuagacaggcuggccaggacccaaccccuagaucccaccaacucgg

SEQ ID NO: 166602 - RNA, 64 nt, hsa
auuaauuucuccauucuguuuauaucuuacaguuggacccaaauuccaaauuaucaguuaaucg

SEQ ID NO: 166603 - RNA, 64 nt, hsa
uuuaggaccucagaauccugcacucaagguggcaggacccaauuucuguuuuauauguucauga

SEQ ID NO: 166604 - RNA, 64 nt, hsa
aggacugcgugggcgcgggagccucagcugcuucggacccaaccacacgcuguaccccaugguc

SEQ ID NO: 166605 - RNA, 64 nt, hsa
agacccuccagcuaaaaacagagccugaguucagggacccaaguggugagcggcgucuuuuggg

SEQ ID NO: 166606 - RNA, 64 nt, hsa
ccaaccugauucugaugacugcggaugcugugacggacccaaggggcaaauagggucccagggu

SEQ ID NO: 166607 - RNA, 64 nt, hsa
cccauccuuguccuucucucccucagaagccucaggacccaacagguggcaggcaguggacagg

SEQ ID NO: 166608 - RNA, 64 nt, hsa
cuccuaagcgacuggcccccuuuugaaccucauuggacccaaccaggucccaagcuccauugga

SEQ ID NO: 166609 - RNA, 64 nt, hsa
uccccuguuugccucugaaacgucugguuaguggggacccaaagauucuagugagucaacaucc

SEQ ID NO: 166610 - RNA, 52 nt, hsa
aagaucucugcucugcuuaaugggacccaaggucucagagcacaggcauauu

SEQ ID NO: 166611 - RNA, 64 nt, hsa
gaggagagcuacuuguuuaaaaauccacauucuuggacccaauccucagaugcacggauucagu

SEQ ID NO: 166612 - RNA, 64 nt, hsa
agcaaauacuucugagaagauuaauaagagaucuggacccaaaagggggagacaugccuggacc

SEQ ID NO: 166613 - RNA, 64 nt, hsa
guggcugaagaccuuucuggcagggcauuugcaaggacccaaauccauucaacaagggugcagc

SEQ ID NO: 166614 - RNA, 64 nt, hsa
gaaaagugagccaagcagaaggaggugggaaaacggacccaaaccccagugugcccugccccau

SEQ ID NO: 166615 - RNA, 64 nt, hsa
gauugggggggcuugggguagagaggacaguuuaggacccaagguggucuuggagaggaggugu

SEQ ID NO: 166616 - RNA, 64 nt, hsa
ccucccagucaggggucguccagugcaggacgggggacccaagggucucaagccugcaagucca

SEQ ID NO: 166617 - RNA, 64 nt, hsa
ucagauaccaugcaauaauacaacuaucauaccuggacccaaagaggagagauauuuugauucu

SEQ ID NO: 166618 - RNA, 64 nt, hsa; identical to SEQ ID NO: 164780

SEQ ID NO: 166619 - RNA, 64 nt, hsa; identical to SEQ ID NO: 164781

SEQ ID NO: 166620 - RNA, 64 nt, hsa; identical to SEQ ID NO: 164782

SEQ ID NO: 166621 - RNA, 64 nt, hsa; identical to SEQ ID NO: 164783

SEQ ID NO: 166622 - RNA, 64 nt, hsa; identical to SEQ ID NO: 164784

SEQ ID NO: 166623 - RNA, 64 nt, hsa; identical to SEQ ID NO: 164785

SEQ ID NO: 166624 - RNA, 64 nt, hsa; identical to SEQ ID NO: 164786

SEQ ID NO: 166625 - RNA, 64 nt, hsa; identical to SEQ ID NO: 164787

SEQ ID NO: 166626 - RNA, 64 nt, hsa; identical to SEQ ID NO: 164788

SEQ ID NO: 166627 - RNA, 64 nt, hsa; identical to SEQ ID NO: 164789

SEQ ID NO: 166628 - RNA, 64 nt, hsa; identical to SEQ ID NO: 164790

SEQ ID NO: 166629 - RNA, 64 nt, hsa; identical to SEQ ID NO: 164791

SEQ ID NO: 166630 - RNA, 64 nt, hsa; identical to SEQ ID NO: 164792

SEQ ID NO: 166631 - RNA, 64 nt, hsa; identical to SEQ ID NO: 164793

SEQ ID NO: 166632 - RNA, 64 nt, hsa
auuuccucaaguuuccaugugcgguucuccuagcugcagcaauacuuugacauuuaaagagaaa

SEQ ID NO: 166633 - RNA, 64 nt, hsa
agaggagagaggccugagucaccuagcauaggguugcagcaagcccuggauucagaguguuaaa

SEQ ID NO: 166634 - RNA, 64 nt, hsa
cacacccaaaaucaagggccuggaugccagcagcugcagcaagcagguuuuuccucccuguuga

SEQ ID NO: 166635 - RNA, 64 nt, hsa
uauaagaucgaauuuaauuuccuuucccucauucugcagcaaucagaauacacaaucuuaacca

SEQ ID NO: 166636 - RNA, 64 nt, hsa
ugggggcugaggggcagccccuaugcccucacagugcagcaaccuugguuagcucacccaucag

SEQ ID NO: 166637 - RNA, 64 nt, hsa
cccagccacgucuccaaaugcuuccuggcccccaugcagcaacugcauuuagcugccuucccag

SEQ ID NO: 166638 - RNA, 64 nt, hsa
agcccagucccucggagcugcagacagcagguccugcagcaacaauaccugcacggcuuugcac

SEQ ID NO: 166639 - RNA, 64 nt, hsa
ggaggccuccgugcacugagagauguacuaggauugcagcaaagguggucagggugaugggccg

SEQ ID NO: 166640 - RNA, 64 nt, hsa
cuuuuuauauuaaugacuauugaaagugguaauaaaaauuuauauuauaggcuucaauguuuuc

SEQ ID NO: 166641 - RNA, 64 nt, hsa
acccaaaaagcuguguuuucuuuggucagaggucaaaauuuaugaaaaacaaaaugcuguauga

SEQ ID NO: 166642 - RNA, 64 nt, hsa
gggcccucagaaguucuccuuaaauuuuucaauaaaaauuuagcucuuaaaaaaauaacagugu

SEQ ID NO: 166643 - RNA, 64 nt, hsa
aucugacaggagcauucugaagccccauuaggaaaaaauuuaaaugguuccucuucaucgccuu

SEQ ID NO: 166644 - RNA, 64 nt, hsa
ggcagucuuaugugcaaagaucguaaaaggacaaaaaauuuaaacugcuuauaauaauccagga

SEQ ID NO: 166645 - RNA, 64 nt, hsa
auuuugcauuuaaaugauaacauaaaagauauaaaaaauuuaaaacugcuauuuuucuuauaga

SEQ ID NO: 166646 - RNA, 64 nt, hsa
aaaaaaaucuugguguguuucuguugauuguguaaaaauuuauuuucauuauauaaaugaaacu

SEQ ID NO: 166647 - RNA, 64 nt, hsa
cuuguuacauauguauaucagaauguaagaaaaaaaaauuuauuuaaaaauauuuuucgcaaaa

SEQ ID NO: 166648 - RNA, 64 nt, hsa
uuuuaucuuuagguaauauuuuauaucauagauuaaaauuuauagugaacuuuaucugugucug

SEQ ID NO: 166649 - RNA, 64 nt, hsa
aagucuaauuuuacagauagaauaauggaaauugaaaauuuaacccuuuauuccgauaaucuca

SEQ ID NO: 166650 - RNA, 64 nt, hsa
cacugcagaaauauuuaacagauuacuucuugauaaaauuuaaaugggauuauaugaauuuaua

SEQ ID NO: 166651 - RNA, 64 nt, hsa
gaacaaauguugcucagggcuggugucagugagaaaaauuuaucaaugcuuuuuaauguguuuu

SEQ ID NO: 166652 - RNA, 64 nt, hsa
aaucugacuucaagaauucugaacuauuaaauagaaaauuuaaaugcucacuugaauauuuaug

SEQ ID NO: 166653 - RNA, 64 nt, hsa
uuaacauauuuguguauauuaaauaugaauuuuuaaaauuuauaaauacuauuuuccaaaagua

SEQ ID NO: 166654 - RNA, 64 nt, hsa
ccuuucagcauuuacagugaaaagugagaauuuuaaaauuuaugaaaucuauauuccagguauu

SEQ ID NO: 166655 - RNA, 64 nt, hsa
aagacuugcuuuaaauagauuucagcuaugcagaaaaauuuagcuuaugcuuccauauuuuuaa

SEQ ID NO: 166656 - RNA, 64 nt, hsa
cuuuugaauaaaagaucauucaacuaaaaauauuaaaauuuauuucacuggaugguaauguaac

SEQ ID NO: 166657 - RNA, 64 nt, hsa
uccaauaacagaacuguaugaccccuuuagaaauaaaauuuaucaugaaaugcuaguucuuuua

SEQ ID NO: 166658 - RNA, 64 nt, hsa
uaaucuuucaggaacuaaaauagcaauuguuaauaaaauuuaguuucucauuauagucuaaaag

SEQ ID NO: 166659 - RNA, 64 nt, hsa
gguucuugcucuggaugagcagcaugacaccaucaaaauuuaagaccaugaugaaauuucaguu

SEQ ID NO: 166660 - RNA, 64 nt, hsa
augaugaaauuucaguuucauucaaauguuaccuaaaauuuauggugucagaauaaagggagau

SEQ ID NO: 166661 - RNA, 64 nt, hsa
uuguuuuauacuucuaugcuauauuuugcuauucaaaauuuagugggcauuacuuaacauuguu

SEQ ID NO: 166662 - RNA, 64 nt, hsa
aaaggcaauagccaauaaaacauuuuuaauuuuaaaaauuuacuguguuuggcuuucuguaaau

SEQ ID NO: 166663 - RNA, 64 nt, hsa
cagccacugggcucuuucacuuuuuuaguucuuaaaaauuuauuuuuaaguucuaaaauaaaau

SEQ ID NO: 166664 - RNA, 64 nt, hsa
uuuaaguucuaaaauaaaauaaaaauaaguucuuaaaauuuauuuuuuuccugaauaaauugua

SEQ ID NO: 166665 - RNA, 64 nt, hsa
auuauaagaagaucuagauccuagauauuagaauaaaauuuauuuucuacuguauccauuucaa

SEQ ID NO: 166666 - RNA, 64 nt, hsa
caaaaaaaucuucaaaacaaguauugacuuucacaaaauuuaaaucauaaacaggcaaaccaaa

SEQ ID NO: 166667 - RNA, 64 nt, hsa
auucaagaucuucccaauacaagaaaauuaauaaaaaauuuauauauaggcagcagcaaaagag

SEQ ID NO: 166668 - RNA, 64 nt, hsa
uugggcagcagggaggaaaguccccagaaauuaaaaaauuuaaaacucuuaugucaagauguug

SEQ ID NO: 166669 - RNA, 64 nt, hsa
uauuaagauugccaaaaacuguuaaaauuuaaaaaaaauuuaaaucauguguauacaauuuuuu

SEQ ID NO: 166670 - RNA, 64 nt, hsa
auauuguacuuuauuaagauugccaaaaacuguuaaaauuuaaaaaaaauuuaaaucaugugua

SEQ ID NO: 166671 - RNA, 64 nt, hsa
aguucuaaaaagauguaauaaucauuuuagaauuaaaauuuauucuacuuuuaaauaaauuaug

SEQ ID NO: 166672 - RNA, 64 nt, hsa
uuuuaaaauuuguagaauugaaaagacgcuaauaaaaauuuauuauuuauuugucaugacucaa

SEQ ID NO: 166673 - RNA, 64 nt, hsa
aaccuaaauacugacugcuggacauaaaucacagaaaauuuaacuuaagaaaauuuacaaaauu

SEQ ID NO: 166674 - RNA, 64 nt, hsa
ugcuggacauaaaucacagaaaauuuaacuuaagaaaauuuacaaaauuuauucucagguaauc

SEQ ID NO: 166675 - RNA, 64 nt, hsa
uaaaucacagaaaauuuaacuuaagaaaauuuacaaaauuuauucucagguaaucauuuuaaua

SEQ ID NO: 166676 - RNA, 64 nt, hsa
auauauauuaugcaagucaggaaucauuaauuucaaaauuuaaagccaugcuaaaauuaaaaag

SEQ ID NO: 166677 - RNA, 64 nt, hsa
uuauaauucagucauucucuauauaggacuucuuaaaauuuagaagggaaaucuagcuacuuca

SEQ ID NO: 166678 - RNA, 64 nt, hsa
gggggaaagugcugcugauaugauacaaguagacaaaauuuaaaugaaauuuugucacauucua

SEQ ID NO: 166679 - RNA, 64 nt, hsa
ggagaaacaaaauccucaggaaauuagauaaauaaaaauuuauaagcauuuguauuauuuuuua

SEQ ID NO: 166680 - RNA, 64 nt, hsa
uggagaagccccgucucuacuaaaaaugcaaaaaaaaauuuagcuaggcauggcggcgcaugcc

SEQ ID NO: 166681 - RNA, 64 nt, hsa
uuaaaauuuaaauuuucagucauuuaaaauuuuaaaaauuuaaaauuucacaaaacuaagggua

SEQ ID NO: 166682 - RNA, 64 nt, hsa
gaauaauaauguuuaaauuuuguuucagucauuuaaaauuuaaauuuucagucauuuaaaauuu

SEQ ID NO: 166683 - RNA, 64 nt, hsa
auuuaaaauuucuacuucccuuaggcauuuuauaaaaauuuaaaaauuauuuuucuauuuuguu

SEQ ID NO: 166684 - RNA, 64 nt, hsa
uauuuucuuuauuguugguaaacuccauauuuuaaaaauuuaccuguauacauagugcuuaaug

SEQ ID NO: 166685 - RNA, 64 nt, hsa
cuuuaauaaauauuaugaaaaaaaugaaauauagaaaauuuagauggacacuuguauuuccuaa

SEQ ID NO: 166686 - RNA, 64 nt, hsa
cauaauuucacuuuacuuucuguuuaggcauggaaaaauuuaucagucagaauugcuguuuuag

SEQ ID NO: 166687 - RNA, 64 nt, hsa
uuuucaaaucauuagcacaauauuuaaauaucuaaaaauuuaagagauccauacuuucuguagc

SEQ ID NO: 166688 - RNA, 64 nt, hsa
ggcauauuguaguccugucauuuaaguuauguaaaaaauuuaaucauuauuuugaugcuuuaaa

SEQ ID NO: 166689 - RNA, 64 nt, hsa
auacagcucuaccuaggauuguacaguuuaccauaaaauuuacuucaugaaagugggaaucacu

SEQ ID NO: 166690 - RNA, 64 nt, hsa
ggacagacuuugaauauacucuaaaaguggacagaaaauuuacgaaaaucuuagauuuuguuua

SEQ ID NO: 166691 - RNA, 64 nt, hsa
acuauuauuccuuccuuagaaguugauguaucagaaaauuuauaaguuauuuguauuuauauau

SEQ ID NO: 166692 - RNA, 64 nt, hsa
uacacucagguuugaacagauuauucugaauauuaaaauuuaauccauucuuaauauuuuaaaa

SEQ ID NO: 166693 - RNA, 64 nt, hsa
uaaguggguuaauugauacaaguuucugugguggaaaauuuaugcagguuuucacgaauccuuu

SEQ ID NO: 166694 - RNA, 64 nt, hsa
cuagggaucagggaguuuaguaugaagaguuaaaaaaauuuaaaaaacaguguaagcuguugaa

SEQ ID NO: 166695 - RNA, 64 nt, hsa
uuaguuucuuaagugaguuuucaggugucucugaaaaauuuauaacaaucauguauuauaugug

SEQ ID NO: 166696 - RNA, 64 nt, hsa
uuaaaaauuuuaaaaauuuaaauuaaaaaaauuaaaaauuuauagaaccauaucaacacugaca

SEQ ID NO: 166697 - RNA, 64 nt, hsa
aaaaauuuuaaauuuuaaagaauuaaaaauuuuaaaaauuuaaauuaaaaaaauuaaaaauuua

SEQ ID NO: 166698 - RNA, 64 nt, hsa
auuguaauuguguacauaauuggauauauguguuaaaauuuaacauuuagauuuacuuaauugu

SEQ ID NO: 166699 - RNA, 64 nt, hsa
gucaauauuuugagcuuagaacauuuaugguauaaaaauuuaaacuaaucaaaguugugugaug

SEQ ID NO: 166700 - RNA, 64 nt, hsa
caagcaauaacaagaaaaaaggcccacaauuagaaaaauuuacauuuaaaaaaaauguuguuuc

SEQ ID NO: 166701 - RNA, 64 nt, hsa
gaaaugggaaaagagaagacuguuuuacaccuggaaaauuuaccucgauuuuuaagaacacaca

SEQ ID NO: 166702 - RNA, 64 nt, hsa
cauuuucagcuuugaaaucuccaaaugaaacuuuaaaauuuauuuugguuuaucccaaaauaau

SEQ ID NO: 166703 - RNA, 64 nt, hsa
acaaacauauucaucacuuuaacaauaagggaacaaaauuuaguauucaagcugagugagaaua

SEQ ID NO: 166704 - RNA, 64 nt, hsa
auuuuuauauagguccaauauugagcuuuuacuuaaaauuuagauagaacuuuuuuuuggauac

SEQ ID NO: 166705 - RNA, 64 nt, hsa
acuuuaaagagacuucaaaauauugaguauuuuaaaaauuuaaaaguaggucaguuuauaacga

SEQ ID NO: 166706 - RNA, 64 nt, hsa
gaagaugugauacaucuuuaaaugaaaauauaccaaaauuuaguaggcauguuuuucuaauaaa

SEQ ID NO: 166707 - RNA, 64 nt, hsa
uuuguuguaaccugagguauccaaaugcuacagaaaaauuuaugacccaaauacaaaucucaau

SEQ ID NO: 166708 - RNA, 64 nt, hsa
uuuuaggcuauagaauaguuaagaaauuuuaaacaaaauuuaguaucuuuuggucuuucacacc

SEQ ID NO: 166709 - RNA, 64 nt, hsa
ucucaaaauauuaacucgaauuguaaauuaagcaaaaauuuaaaaaguauauguugaugggaca

SEQ ID NO: 166710 - RNA, 64 nt, hsa
gauuagacauauuaaaauauaccaauguuguaguaaaauuuaauuuuuccuuuuguuacuuuuc

SEQ ID NO: 166711 - RNA, 64 nt, hsa
agugccauccugcuaggugaguacagaccagaagaaaauuuaguugggaaaauacuuguuuuuc

SEQ ID NO: 166712 - RNA, 64 nt, hsa
auacuuuaaguuauuuugacgaaaaguaauagagaaaauuuacuuagcauuuuagauucuagag

SEQ ID NO: 166713 - RNA, 64 nt, hsa
agcacuaaauuuuuuauaaaauagaccagaugacaaaauuuauuuuauuuuuaaacagugguuu

SEQ ID NO: 166714 - RNA, 64 nt, hsa
agaggaaaaaauacacauguucuuucauauaggcaaaauuuaaccacauaaauuugcacugcaa

SEQ ID NO: 166715 - RNA, 64 nt, hsa
auugaaaauaaauaccauuaaacugugaucaguuaaaauuuaaaagaaaaaucagcacaaaagg

SEQ ID NO: 166716 - RNA, 64 nt, hsa
uucaccuguaacuguuuaagccaauaaacuuuucaaaauuuauguaauguggggcuuuuaugua

SEQ ID NO: 166717 - RNA, 64 nt, hsa
gacaagagaaauaauuguaaaaucgucuuaaaggaaaauuuaauuuuuacuccuguuuauggga

SEQ ID NO: 166718 - RNA, 64 nt, hsa
uuuugauucucuuguggguugauaaugucuccccaaaauuuacauguugaagcaccucagaaug

SEQ ID NO: 166719 - RNA, 64 nt, hsa
aaaaacuacggguagaaaacauaagaacuaucauaaaauuuacuuacaaggaggcugcucuugu

SEQ ID NO: 166720 - RNA, 64 nt, hsa
cauugauuugagcauagacgcagagacugaaaaaaaaauuuacuuugaucucuguuuuugaauu

SEQ ID NO: 166721 - RNA, 64 nt, hsa
auaacaaccuucauucuucuaauacagcaaaauaaaaauuuaacaaccaaggaauaguauuuaa

SEQ ID NO: 166722 - RNA, 64 nt, hsa
gcuguauauagcuugugagaaaccucuuuucuuuaaaauuuacauaaucacaagaaaggaaaga

SEQ ID NO: 166723 - RNA, 64 nt, hsa
gaaucaucuugaaaauaagauuccaaccacaaaaaaaauuuagccauuucuuuacuaaaaaaaa

SEQ ID NO: 166724 - RNA, 64 nt, hsa
gucaaaaugauaauuuuguuauguuagccucuagaaaauuuaaguucagaaaaaugcacuauga

SEQ ID NO: 166725 - RNA, 64 nt, hsa
gccucuauuuccuugucuccaaaaugagaauaauaaaauuuaggucaggauuacuauauaaacu

SEQ ID NO: 166726 - RNA, 64 nt, hsa
gucaaagcagauaaauucuuguugaaacuugacuaaaauuuauuugauuuguuguuuuacuccc

SEQ ID NO: 166727 - RNA, 64 nt, hsa
gcuuucuagccagaaucuggaccuauaccaugggaaaauuuaggggugcugggaaucccaaagc

SEQ ID NO: 166728 - RNA, 64 nt, hsa
uuaaccagaaaagaaacauuuuacauaaaaugcuaaaauuuauuauaggaaaauaaaucaaacc

SEQ ID NO: 166729 - RNA, 64 nt, hsa
uuguaaaaugaacaaauacauaaauauuuuaagaaaaauuuaaguuuauucagauaagucacca

SEQ ID NO: 166730 - RNA, 64 nt, hsa
agauguucugauaacauugugauuguaacucaaaaaaauuuauaguagaaacguaauugcaaug

SEQ ID NO: 166731 - RNA, 64 nt, hsa
uuuacuuuacaccaaaguugauuagaucugagacaaaauuuaaugcacaacagugaguuggauc

SEQ ID NO: 166732 - RNA, 64 nt, hsa
gaugugugaacuucaauauaaaguugcauuugccaaaauuuacccguguagccuguuaauuuuc

SEQ ID NO: 166733 - RNA, 64 nt, hsa
gcaguggcaugcuuuaaaaaaaaaaaaggcaaugaaaauuuagcaagccacugaauuugaguuu

SEQ ID NO: 166734 - RNA, 64 nt, hsa
acuccauuauaacauauguaacuccuuuguaaccaaaauuuagguaagcaggcuuccuuugcuc

SEQ ID NO: 166735 - RNA, 64 nt, hsa
aauaaauagaucuacauuuuguacauauuuauauaaaauuuaccuuuaaguauuuacuuuaaaa

SEQ ID NO: 166736 - RNA, 64 nt, hsa
uuauauaaaauuuaccuuuaaguauuuacuuuaaaaaauuuaauggcuuaacucgaacuugaag

SEQ ID NO: 166737 - RNA, 64 nt, hsa
gacccucagaaaaccaaugaagucuaagagaaauaaaauuuaguggacagguaugaaaagugua

SEQ ID NO: 166738 - RNA, 64 nt, hsa
ggguucuuaugaagguaaauuuaccagauuaauaaaaauuuaugaauauuaaaauuaucauuaa

SEQ ID NO: 166739 - RNA, 64 nt, hsa
aguacuauuacuauuacuauuuuuauuuuaaaauaaaauuuaccuuuaaaauaauaauaguacu

SEQ ID NO: 166740 - RNA, 64 nt, hsa
aauuagcuuguuacaauucuaggacaugguguuuaaaauuuaaaucugauuaauccauuuuaac

SEQ ID NO: 166741 - RNA, 64 nt, hsa
auuuuuagagauuugugauaauacaacuuguuauaaaauuuauuccucaauaaauauaauuucu

SEQ ID NO: 166742 - RNA, 64 nt, hsa
auagagaaagagcaauugauaaaguaaaugagguaaaauuuaacaauaaucugagcaaaaggua

SEQ ID NO: 166743 - RNA, 64 nt, hsa
aauaguuuaaaucagugaccaucauaauaaagauaaaauuuaguugaguuuuuaauguuuacau

SEQ ID NO: 166744 - RNA, 64 nt, hsa
uaucacaagcaguucccuccauuuagacuauucaaaaauuuagaagaguggcaaauacuauuuu

SEQ ID NO: 166745 - RNA, 64 nt, hsa
uggcagcuaaugggcucuuaccaaguuuaaacacaaaauuuaucauaacaaaaauacuacuaau

SEQ ID NO: 166746 - RNA, 64 nt, hsa
uaaccggccuuccaacuuuugucugccucauucuaaaauuuacacaguagaccauuugucaucc

SEQ ID NO: 166747 - RNA, 64 nt, hsa
uaaagccuuuauuccaucucucaagauauauuauaaaauuuauuuuuuuaauuuaagauuucug

SEQ ID NO: 166748 - RNA, 64 nt, hsa
guggagaagagguugggcuuuuuugaaagagacaaaaauuuauuauaacacuaaacacuccuuu

SEQ ID NO: 166749 - RNA, 64 nt, hsa
uaacauaaaugugugaaaaaguaaagauaacuaaaaaauuuagaaaaauaaauccaguauuugu

SEQ ID NO: 166750 - RNA, 64 nt, hsa
aaacguuuuuguuuuuuacugucacuagggcaauaaaauuuauacucaaccauauaauaacauu

SEQ ID NO: 166751 - RNA, 64 nt, hsa
uacuuuccuggaauaauugucuaccugaagaaaaaaaauuuauauauacauugugugugugugu

SEQ ID NO: 166752 - RNA, 64 nt, hsa
aaaguucagguuucagagaacugcuuuugugcagaaaauuuagguucuuuuuuccaccuuuuug

SEQ ID NO: 166753 - RNA, 64 nt, hsa
uuuuaaucugcacaguuuaucuucugccaaaauaaaaauuuacuauuuccuuuauauacuuguu

SEQ ID NO: 166754 - RNA, 64 nt, hsa
gaaucccuuuggacagucuuuauuuuucuucuuaaaaauuuauaugauucaaaaccauuucuuc

SEQ ID NO: 166755 - RNA, 64 nt, hsa
aaauuugcaauaguguucuauuguauguaauuuuaaaauuuauaagauuauccacguuggccaa

SEQ ID NO: 166756 - RNA, 64 nt, hsa
uguaucauugaaguucaguaggauguguggcuuaaaaauuuaucaggaccacaaaaaagaaaac

SEQ ID NO: 166757 - RNA, 64 nt, hsa
cuaccccuuaccccaguuuuuugaacauggaaagaaaauuuaauaacuuuuuaaagugacauaa

SEQ ID NO: 166758 - RNA, 64 nt, hsa
acauguauuaaaauguacaaaauguuuuguuaauaaaauuuaauaauguuuauaacuccgugcc

SEQ ID NO: 166759 - RNA, 64 nt, hsa
ugugucaugagaauguaagucuuuuuucuacuuuaaaauuuaguagguucacugaguaacuaaa

SEQ ID NO: 166760 - RNA, 64 nt, hsa
cuacuuuaaaauuuaguagguucacugaguaacuaaaauuuagcaaaccuguguuugcauauuu

SEQ ID NO: 166761 - RNA, 64 nt, hsa
acuuuguaccaaguuauuaaguaacauaauuuuuaaaauuuaaagaaugugucuucaacuaaaa

SEQ ID NO: 166762 - RNA, 64 nt, hsa
acauaaaauaucaaacacacaaagucauaaaaugaaaauuuacaguuuuaccuguucauaucua

SEQ ID NO: 166763 - RNA, 64 nt, hsa
auucuuaaaugcuguaugauaaugaagaaaaauaaaaauuuauuucuugcaaaguuaaauguuu

SEQ ID NO: 166764 - RNA, 64 nt, hsa
acagaaugugaauauguagguaaaugauuacagaaaaauuuaucugcuuaacaaacuuagaaug

SEQ ID NO: 166765 - RNA, 64 nt, hsa
uuaaaaaaaauacuguuuguuuaaagcaugcauaaaaauuuauguauugaaauauacuuaaaaa

SEQ ID NO: 166766 - RNA, 64 nt, hsa
uacuaacgcuaugucagacuaauauuaaaaucagaaaauuuaaaugcuggugcuggucagacuu

SEQ ID NO: 166767 - RNA, 64 nt, hsa
uuagagggagcauggccauaaaauaaaauaaaauaaaauuuagauuuaagucgagcucaguggc

SEQ ID NO: 166768 - RNA, 64 nt, hsa
acauaaacacaacaauacuuggacuuauuuauuuaaaauuuagauuuauuagagggagcauggc

SEQ ID NO: 166769 - RNA, 64 nt, hsa
uaaagauuuuuaacaugucagagagaagagaguuaaaauuuaaaaaugcaucuugggagagaaa

SEQ ID NO: 166770 - RNA, 64 nt, hsa
ucuccaaaggaccugcguuggacaacaauaaagaaaaauuuaaccuaucaugcacuguacacau

SEQ ID NO: 166771 - RNA, 64 nt, hsa
cuguacugucuaucugcaguaauugaggacccauaaaauuuagauaacuacaugucuuugcucu

SEQ ID NO: 166772 - RNA, 64 nt, hsa
caguuauuuuuaaugcuuaauacauacauggugcaaaauuuaaaaagcgcaaauagguaucuag

SEQ ID NO: 166773 - RNA, 64 nt, hsa
uuaauuuuaagaauaggauuucggaaggcgacagaaaauuuaguucuuagacauuuaaauagaa

SEQ ID NO: 166774 - RNA, 64 nt, hsa
uuccgagaggcagggcaacuaauaacuggucagaaaaauuuagacggucuucauuuuaaaauug

SEQ ID NO: 166775 - RNA, 64 nt, hsa
gaagcuuauauuaauuguugcuucaauaguuuaaaaaauuuauggagauagguaggucauuaug

SEQ ID NO: 166776 - RNA, 64 nt, hsa
aaggaggaaacaggaaaaauugccguccauuuuaaaaauuuagguuuguuguuuuaaaccauaa

SEQ ID NO: 166777 - RNA, 64 nt, hsa
aauuuguuucaagugaacuacaacuugucuuccuaaaauuuauagugauuuuaaaggauuuugc

SEQ ID NO: 166778 - RNA, 64 nt, hsa
uaucuuuucacuuaguguuucaaacauauuaggcaaaauuuaacuguagauggcauuuagaugu

SEQ ID NO: 166779 - RNA, 64 nt, hsa
guauuuucauauaauuuauauuuuuuaaaagcugaaaauuuagaagcaagaugaaaaaaaggaa

SEQ ID NO: 166780 - RNA, 64 nt, hsa
uucaguggggaggggccaaaaccguuguuguguuaaaauuuauuuuauuaaauuuugugccagu

SEQ ID NO: 166781 - RNA, 64 nt, hsa
auauuuuaaauauaauaguauuuuucuauuagauaaaauuuaagaucuuuggcaucuuaaugga

SEQ ID NO: 166782 - RNA, 64 nt, hsa
ggucauuuagaaaaaaacaauguugggcacaaagaaaauuuagaucugacaaguauaauuuucu

SEQ ID NO: 166783 - RNA, 64 nt, hsa
cagaaauuuaaauaagauuuaauucacaucaaauaaaauuuagaaaauaaaauuuaacucacac

SEQ ID NO: 166784 - RNA, 64 nt, hsa
agauuuaauucacaucaaauaaaauuuagaaaauaaaauuuaacucacacugcccaggcuggag

SEQ ID NO: 166785 - RNA, 64 nt, hsa
acuuuauauucaguucugugucuuacuuauuggaaaaauuuauuucuuagcuuucacaugaguu

SEQ ID NO: 166786 - RNA, 64 nt, hsa
aauacacuugggagaacagaaauaagaauuaaugaaaauuuaaaagauuaaaugaaugagaaga

SEQ ID NO: 166787 - RNA, 64 nt, hsa
cuucaggauuguuccacuaaaauuuauuuuucaaaaaauuuacuucacauuauucuauguaagu

SEQ ID NO: 166788 - RNA, 64 nt, hsa
uucuucugguguuauccuucaggauuguuccacuaaaauuuauuuuucaaaaaauuuacuucac

SEQ ID NO: 166789 - RNA, 64 nt, hsa
aaaaucauuuuacacaucauaccuagcagguaauaaaauuuaaaaaauaaaaauuaaauauuag

SEQ ID NO: 166790 - RNA, 64 nt, hsa
ucuuuauaaauuauauuauuauuguauuuuuugaaaaauuuauacgagaaagugguauauaagu

SEQ ID NO: 166791 - RNA, 64 nt, hsa
acccaugacaaaaugaaugugaauauucuuucuaaaaauuuagaaaauguuaucuuuuugcauu

SEQ ID NO: 166792 - RNA, 64 nt, hsa
gaaggcaguuuuaacuuucugaagaauaucugucaaaauuuaagaaaacaaauguauaaaauuc

SEQ ID NO: 166793 - RNA, 64 nt, hsa
uuuuucauuuaccaagauuuuauuuuccuacaugaaaauuuaauugaguaauaauuauucacau

SEQ ID NO: 166794 - RNA, 64 nt, hsa
ugucacugcacucuagccugggcgacagaaaaagaaaauuuagguggggaaaaaaaucagaauu

SEQ ID NO: 166795 - RNA, 64 nt, hsa
cccaucucuacuaaaaauauaaaaaucagcaaaaaaaauuuagccaggcuuggucaugcaugcc

SEQ ID NO: 166796 - RNA, 64 nt, hsa
caauauauaauacugaaaaaguauucagaaauggaaaauuuacaucauauagguuauuuaacuu

SEQ ID NO: 166797 - RNA, 64 nt, hsa
ugcuuuuuuaaacuuguuaaaaagaaauuuauauaaaauuuaaaauacaaauguuaaauuaucc

SEQ ID NO: 166798 - RNA, 64 nt, hsa
uuuucauauuacagagugaauuuguauuuaaacaaaaauuuaaauuuuggaauccucuaaacau

SEQ ID NO: 166799 - RNA, 64 nt, hsa
agcuaaaauguugcagagaaauaagugacccaacaaaauuuauucaucuguuauggguaagauc

SEQ ID NO: 166800 - RNA, 64 nt, hsa
cuauuagaagaaauaauuuuuuuuaauaauugaaaaaauuuaccacagccuugucugauuuuaa

SEQ ID NO: 166801 - RNA, 64 nt, hsa
uuaagccacuagguagauauuuaggggaauagucaaaauuuacuguugaaaaagcaguugcuau

SEQ ID NO: 166802 - RNA, 64 nt, hsa
uuuagaguguaagaaguaauggguacagagaaaaaaaauuuaagaccaauauuuuaacaggaua

SEQ ID NO: 166803 - RNA, 64 nt, hsa
uaaaccaugcuucucagcuuucaaauuucaagauaaaauuuaaguauucaguaaaaugaugguu

SEQ ID NO: 166804 - RNA, 64 nt, hsa
aaaucucuucuaacacaaguaggaaacaugaaauaaaauuuacuuuccuccacauaguucucuu

SEQ ID NO: 166805 - RNA, 64 nt, hsa
uuauucaaagacuggauuaaaaaaaaguuaagccaaaauuuaagcaguuuuuauaaugaauuaa

SEQ ID NO: 166806 - RNA, 64 nt, hsa
auuugauauugcuucagcauuucaaauauguugcaaaauuuaguauccauaugcauaagaaguu

SEQ ID NO: 166807 - RNA, 64 nt, hsa
cuccccacuccccuugcuugagaagcacuacucaaaaauuuaccagaccuuacaacugugauaa

SEQ ID NO: 166808 - RNA, 64 nt, hsa
aaaacugcuuacauaguauacaaagcucuauuuuaaaauuuaauguuuauuuuaaauaggaaag

SEQ ID NO: 166809 - RNA, 64 nt, hsa
auggaugugugcuuuaacaccacuauguugcacaaaaauuuaagucuuuaucuacaaagccaaa

SEQ ID NO: 166810 - RNA, 64 nt, hsa
auuuuacggggaugggugggcggagggacacaacaaaauuuaagaaugacuauuugggcgggcu

SEQ ID NO: 166811 - RNA, 64 nt, hsa
gaaauguagaagggauaacaguucacagccagguaaaauuuaacugguggcuuaaugacucugc

SEQ ID NO: 166812 - RNA, 64 nt, hsa
cgacagagcgagacucagucucaaaaaaaauuuaaaaauuuaaaaaaauaaaaagaauccaacc

SEQ ID NO: 166813 - RNA, 64 nt, hsa
ccacuggacgacagagcgagacucagucucaaaaaaaauuuaaaaauuuaaaaaaauaaaaaga

SEQ ID NO: 166814 - RNA, 64 nt, hsa
ugaguuuguugaagugcacauguuuuucaagaguaaaauuuaagauuaaaaauauauccuauau

SEQ ID NO: 166815 - RNA, 64 nt, hsa
uauuggguuucuuaaaaaucuugaagaaaauaauaaaauuuaucucacaauaaguuaacuugcg

SEQ ID NO: 166816 - RNA, 64 nt, hsa
ccuguuauguaugaaggaaucauuccagugcuagaaaauuuagcccuuuaaaacgucuuagagc

SEQ ID NO: 166817 - RNA, 64 nt, hsa
guauauugagaaucccuuaaaauuaccagacaaaaaaauuuaaaauuacguuuguuauuccuag

SEQ ID NO: 166818 - RNA, 64 nt, hsa
guacuaaauguuuuccauuaaagucuucuauuuuaaaauuuagagaaaaauaaaauggcuuucc

SEQ ID NO: 166819 - RNA, 64 nt, hsa
uuaagccacaauuugguaccuagggucucaaacuaaaauuuauuuuuauaaaugaauuuuaaaa

SEQ ID NO: 166820 - RNA, 64 nt, hsa
acaaagucugaaaaccauuuuaaaccaucuuuuaaaaauuuacccuuauuuccuuuuaccuaau

SEQ ID NO: 166821 - RNA, 64 nt, hsa
cagcacucaggucuuuuucuucagaaaugaagacaaaauuuaaaauaugaaaugaugcagaaua

SEQ ID NO: 166822 - RNA, 64 nt, hsa
aaaauggauaauuuguaaauaguuuuuagcuuuuaaaauuuaaaguguuuuugagugugaaaag

SEQ ID NO: 166823 - RNA, 64 nt, hsa
auuaaauaugcaaguuagaaauuaagucuacugaaaaauuuacauuuugagucagguuuugugu

SEQ ID NO: 166824 - RNA, 64 nt, hsa
agauuuaaaaacgaaaaguaugccuugccuugugaaaauuuauccauuuaucuucagguugggg

SEQ ID NO: 166825 - RNA, 64 nt, hsa
uggacaagauuuauauggacaaaauuaagucuuuaaaauuuaggcacuuuaaggagaacuaaua

SEQ ID NO: 166826 - RNA, 64 nt, hsa
caguuugucugaaacaaacacagagcacuccaucaaaauuuaccugaucuuugugauuagaaca

SEQ ID NO: 166827 - RNA, 64 nt, hsa
ucaggagacgguuuugagaucaacuggucugacuaaaauuuauuaggugggaauuuccucuucc

SEQ ID NO: 166828 - RNA, 64 nt, hsa
ugguuaguggcugccaguguggcacauucaugucaaaauuuaccagaagccaagaugauguagg

SEQ ID NO: 166829 - RNA, 64 nt, hsa
uaacauggugaaacccugucuguacuaaaaauacaaaauuuagccaggcaugguggcacacacc

SEQ ID NO: 166830 - RNA, 64 nt, hsa
ucucagaaauuauuaaacauaauuuauucuagguaaaauuuagauuguagugaauguaggaagu

SEQ ID NO: 166831 - RNA, 64 nt, hsa
uaaauggaaugcuaacacuagugggcuuauugagaaaauuuaaagguugcuguaguguuuagaa

SEQ ID NO: 166832 - RNA, 64 nt, hsa
cugggauuucuuccuuuuuauuucauucuuuuaaaaaauuuauuuuaagguaguacauguaguu

SEQ ID NO: 166833 - RNA, 64 nt, hsa
aaaguggucuagguaaccuguaaagaaaggauuaaaaauuuaagauguucuaguucugcucucu

SEQ ID NO: 166834 - RNA, 64 nt, hsa
auucuccugacuccaguuuauaacauccuuuuaaaaaauuuaaaaacaaacagccacaccccuc

SEQ ID NO: 166835 - RNA, 64 nt, hsa
agagugugacccugucucuaaagaaaaacuauagaaaauuuaaaaaauuaaaaaacggguaaca

SEQ ID NO: 166836 - RNA, 64 nt, hsa
aaugagaccuguccucuaugaaaaaacuuuuuuaaaaauuuagcuggguguggugguacgugcc

SEQ ID NO: 166837 - RNA, 64 nt, hsa
gccugggcaguauagugagaucuuuucucuacaaaaaauuuaaaaauuagccaagugugguggu

SEQ ID NO: 166838 - RNA, 64 nt, hsa
gaagaguucuaaggcuuucaaaaacacucagucaaaaauuuaaaaucuuaaauguguaagucac

SEQ ID NO: 166839 - RNA, 64 nt, hsa
cacucuuagcccaccagagucugcccuuuggcccaaaauuuaugucugucucauguguaaaaga

SEQ ID NO: 166840 - RNA, 64 nt, hsa
aaaagaaccucuacuuaaaccucacaucuuauauaaaauuuaacucaaaauguauaacggacuu

SEQ ID NO: 166841 - RNA, 64 nt, hsa
auaaaagacaaaaucugauauauuggacuucuucaaaauuuaaaaacuugugauuuaagaagag

SEQ ID NO: 166842 - RNA, 64 nt, hsa
ucuguauaggauuuuuaaaaaugacaacauucacaaaauuuauuacuuuuuaaaaaauaacaug

SEQ ID NO: 166843 - RNA, 64 nt, hsa
aauuccugaguguagaaacuucuugcacuuauuuaaaauuuaggagagaacauuuaagccacuc

SEQ ID NO: 166844 - RNA, 64 nt, hsa
aauuaacugagugaguuaagugcaagcauaaacuaaaauuuauaugacuuugaauuuaagaacc

SEQ ID NO: 166845 - RNA, 64 nt, hsa
uuucaaugugauuuuaguauuuacaguaauaaauaaaauuuauacaaaguuucagagaacuacc

SEQ ID NO: 166846 - RNA, 64 nt, hsa
caucuguugaggaugugggaacuuuucugucaggaaaauuuaguuuacagaauacuucugcaua

SEQ ID NO: 166847 - RNA, 64 nt, hsa
uggagggagcaggggaugaggcuuggcauaguccaaaauuuaagucuccaauaauuaauugcau

SEQ ID NO: 166848 - RNA, 64 nt, hsa
ggugauuuuucuuuugucuaaaaaacacaugaagaaaauuuaccaaaaaaaaaaaaaaaagcag

SEQ ID NO: 166849 - RNA, 64 nt, hsa
aguugaauaaucaaaaauauuuuauuaggcccccaaaauuuaauagauaucuauuucuguuaca

SEQ ID NO: 166850 - RNA, 64 nt, hsa
cucugauguauuucuuuuaguaguuucuaaguguaaaauuuauucuaaauguuuuuauggcuau

SEQ ID NO: 166851 - RNA, 64 nt, hsa
gguggcugagcuuaauugcuuaaauaaguucuagaaaauuuaaaaaucauuuuaguagaauuca

SEQ ID NO: 166852 - RNA, 64 nt, hsa
aaagaaacaaaacuucccuacaauuuucuucacuaaaauuuauuauauguacaguauucccacu

SEQ ID NO: 166853 - RNA, 64 nt, hsa
gaaaagggcacucauuuggauugccuuacuucucuugccuuaaauauaucccauauauuuaaua

SEQ ID NO: 166854 - RNA, 64 nt, hsa
cagugcugagauuggaaaagggcacucauuuggauugccuuacuucucuugccuuaaauauauc

SEQ ID NO: 166855 - RNA, 64 nt, hsa
uguuugaccuauguauggaacuuacuuuuacuuuuugccuuaaauuuuuaaugaaaugcaaauu

SEQ ID NO: 166856 - RNA, 64 nt, hsa
gauagagagaaauuaacuuuuccaaaugaaugucuugccuuaaacccucuauuuccuaaaauau

SEQ ID NO: 166857 - RNA, 64 nt, hsa
guagguagggaacaagagaacccaucuauuaaaauugccuuagaucugggaaaguaaccauccu

SEQ ID NO: 166858 - RNA, 64 nt, hsa
gccacagguuucuuuaaagcuguguuaacauaucuugccuuaaaauguguguguguguuuuugc

SEQ ID NO: 166859 - RNA, 64 nt, hsa
agcuaauagaaaaacagguaagaauaaagcaauguugccuuaauuucaaaagcugcuauuuuag

SEQ ID NO: 166860 - RNA, 64 nt, hsa
uaagguagauccccaauauuuuggaauaccaaaauugccuuaaaaauucccuucuguuucuuac

SEQ ID NO: 166861 - RNA, 64 nt, hsa
auguuuuuauauuaaaucauaaggaaggaacuacuugccuuaaauguuaauaucaaaagaguuu

SEQ ID NO: 166862 - RNA, 64 nt, hsa
aauuauuaguucacuucccugcugccaugaaacuuugccuuaagaaggugcuggauuccaaggu

SEQ ID NO: 166863 - RNA, 64 nt, hsa
ucugccucagacugaaaagcuaguccuaacgucuuugccuuaauucuguucauuuuuucaaguc

SEQ ID NO: 166864 - RNA, 64 nt, hsa
gauaucacaacucuauggaaaaugacauuuccauuugccuuauugcuacuucaagcucuuuaaa

SEQ ID NO: 166865 - RNA, 64 nt, hsa
auccgcccugcaaguuaaccccccauugcaaugguugccuuaagguguuugcuaguuguguaca

SEQ ID NO: 166866 - RNA, 64 nt, hsa
agccuauuuucugacguuucuuaaugcaaacucuuugccuuaaaugguagaauauuuagaaauu

SEQ ID NO: 166867 - RNA, 64 nt, hsa
uuuucauaauugcuuucuagcaaucagcuuuuauuugccuuaauauaagcuuuuaagcaguuau

SEQ ID NO: 166868 - RNA, 64 nt, hsa
uguacccagauaacuaagauauuguuucauggccuugccuuagucagaggcccuuuucucuguc

SEQ ID NO: 166869 - RNA, 64 nt, hsa
caaaacugauuucaugcagguccugaauuuuacuuugccuuaagaagugcccuccccacaaugc

SEQ ID NO: 166870 - RNA, 64 nt, hsa
ggaguuugguuaaacgacucuuuuauuuucuguuuugccuuaucuuacuaaagugaaguuuucc

SEQ ID NO: 166871 - RNA, 64 nt, hsa
gucacugguuugcugacuuacugaggauuaauuguugccuuacaauguuacugaaauaaacugu

SEQ ID NO: 166872 - RNA, 64 nt, hsa
ucuuuaucaguaauaaauuaugacuguuuucauauugccuuaggguuauuucccuguguaaacc

SEQ ID NO: 166873 - RNA, 64 nt, hsa
aaacaaaacacaacuauauauauuuucaguuuuuuugccuuauugauuuuuuuccaaaaaaaaa

SEQ ID NO: 166874 - RNA, 64 nt, hsa
ccagaaggagacaccagugguggugauuggcugguugccuuagcugauugaaacugaaaucgac

SEQ ID NO: 166875 - RNA, 64 nt, hsa
cacucugacugucuuuauugcagaagacaguguguugccuuacccagaaugagauugaauuguu

SEQ ID NO: 166876 - RNA, 64 nt, hsa
cacacacacagucuuuauugcagaagacaguguguugccuuaccagaaugagugcuuggauuac

SEQ ID NO: 166877 - RNA, 64 nt, hsa
cacacacagagucuuuauugcagaagacaguguguugccuuauaggcgugagacacacacacac

SEQ ID NO: 166878 - RNA, 64 nt, hsa
cacacacacacacacuauuucagaagacaguguguugccuuacccagaaugagugcuaggauua

SEQ ID NO: 166879 - RNA, 64 nt, hsa
cuccuugcugcuagagugggaggagaaagaugucuugccuuaaaaguuuacuguuucuucuguu

SEQ ID NO: 166880 - RNA, 64 nt, hsa
uccaaaaaccugagggggagaaaauacuuugcuuuugccuuaacacaucaucuggucacguuag

SEQ ID NO: 166881 - RNA, 64 nt, hsa
aucauuacaguuagguuuucucaaauugcaaaauuugccuuagcaauuaucuuugaacaucccg

SEQ ID NO: 166882 - RNA, 64 nt, hsa
cagggguggaauauaucaggaauuuauaauaaaauugccuuaaucucuacaacaguaucuuaau

SEQ ID NO: 166883 - RNA, 64 nt, hsa
uauccgucucuucccgucccugaugacaaagaucuugccuuacagacuuuacaggcuuggcuuu

SEQ ID NO: 166884 - RNA, 64 nt, hsa
uuucugguggcagucucaaacugagaagccacaguugccuuauuuuugaggcuguucugcccag

SEQ ID NO: 166885 - RNA, 64 nt, hsa
acaaaguguuaccaguuuacaaaaauaagucuuuuugccuuaagucauuuuggaaauaaguaau

SEQ ID NO: 166886 - RNA, 64 nt, hsa
ggcaccaccuuccuccuugagcuuugccugucucuugccuuaucaguucuuccuccaccacccu

SEQ ID NO: 166887 - RNA, 64 nt, hsa
gcgggcgugucgccgccucuggcaucgccuccgguugccuuacaccacgccuucaccugcaguc

SEQ ID NO: 166888 - RNA, 64 nt, hsa
ccgcggagccacaggggaccccacgcacauuccguugccuuacccgauggcuugugacgcggag

SEQ ID NO: 166889 - RNA, 64 nt, hsa; identical to SEQ ID NO: 77572

SEQ ID NO: 166890 - RNA, 64 nt, hsa; identical to SEQ ID NO: 77573

SEQ ID NO: 166891 - RNA, 64 nt, hsa; identical to SEQ ID NO: 77574

SEQ ID NO: 166892 - RNA, 64 nt, hsa; identical to SEQ ID NO: 77575

SEQ ID NO: 166893 - RNA, 64 nt, hsa; identical to SEQ ID NO: 77576

SEQ ID NO: 166894 - RNA, 64 nt, hsa; identical to SEQ ID NO: 77577

SEQ ID NO: 166895 - RNA, 64 nt, hsa; identical to SEQ ID NO: 77578

SEQ ID NO: 166896 - RNA, 64 nt, hsa; identical to SEQ ID NO: 77579

SEQ ID NO: 166897 - RNA, 64 nt, hsa; identical to SEQ ID NO: 77580

SEQ ID NO: 166898 - RNA, 64 nt, hsa; identical to SEQ ID NO: 77581

SEQ ID NO: 166899 - RNA, 64 nt, hsa; identical to SEQ ID NO: 77582

SEQ ID NO: 166900 - RNA, 64 nt, hsa; identical to SEQ ID NO: 77583

SEQ ID NO: 166901 - RNA, 64 nt, hsa; identical to SEQ ID NO: 77584

SEQ ID NO: 166902 - RNA, 64 nt, hsa; identical to SEQ ID NO: 77585

SEQ ID NO: 166903 - RNA, 64 nt, hsa; identical to SEQ ID NO: 77586

SEQ ID NO: 166904 - RNA, 64 nt, hsa; identical to SEQ ID NO: 77587

SEQ ID NO: 166905 - RNA, 64 nt, hsa; identical to SEQ ID NO: 77588

SEQ ID NO: 166906 - RNA, 64 nt, hsa; identical to SEQ ID NO: 77589

SEQ ID NO: 166907 - RNA, 56 nt, hsa; identical to SEQ ID NO: 77590

SEQ ID NO: 166908 - RNA, 64 nt, hsa; identical to SEQ ID NO: 77591

SEQ ID NO: 166909 - RNA, 64 nt, hsa; identical to SEQ ID NO: 77592

SEQ ID NO: 166910 - RNA, 64 nt, hsa; identical to SEQ ID NO: 77593

SEQ ID NO: 166911 - RNA, 64 nt, hsa; identical to SEQ ID NO: 77594

SEQ ID NO: 166912 - RNA, 64 nt, hsa; identical to SEQ ID NO: 77595

SEQ ID NO: 166913 - RNA, 64 nt, hsa; identical to SEQ ID NO: 77596

SEQ ID NO: 166914 - RNA, 64 nt, hsa; identical to SEQ ID NO: 77597

SEQ ID NO: 166915 - RNA, 64 nt, hsa; identical to SEQ ID NO: 77598

SEQ ID NO: 166916 - RNA, 64 nt, hsa; identical to SEQ ID NO: 77599

SEQ ID NO: 166917 - RNA, 64 nt, hsa; identical to SEQ ID NO: 77600

SEQ ID NO: 166918 - RNA, 64 nt, hsa; identical to SEQ ID NO: 77601

SEQ ID NO: 166919 - RNA, 64 nt, hsa; identical to SEQ ID NO: 77602

SEQ ID NO: 166920 - RNA, 64 nt, hsa; identical to SEQ ID NO: 77603

SEQ ID NO: 166921 - RNA, 64 nt, hsa; identical to SEQ ID NO: 77604

SEQ ID NO: 166922 - RNA, 64 nt, hsa; identical to SEQ ID NO: 77605

SEQ ID NO: 166923 - RNA, 64 nt, hsa; identical to SEQ ID NO: 77606

SEQ ID NO: 166924 - RNA, 64 nt, hsa; identical to SEQ ID NO: 77607

SEQ ID NO: 166925 - RNA, 64 nt, hsa; identical to SEQ ID NO: 77608

SEQ ID NO: 166926 - RNA, 64 nt, hsa; identical to SEQ ID NO: 77609

SEQ ID NO: 166927 - RNA, 64 nt, hsa; identical to SEQ ID NO: 77610

SEQ ID NO: 166928 - RNA, 64 nt, hsa; identical to SEQ ID NO: 77611

SEQ ID NO: 166929 - RNA, 64 nt, hsa; identical to SEQ ID NO: 77612

SEQ ID NO: 166930 - RNA, 64 nt, hsa; identical to SEQ ID NO: 77613

SEQ ID NO: 166931 - RNA, 64 nt, hsa; identical to SEQ ID NO: 77614

SEQ ID NO: 166932 - RNA, 64 nt, hsa; identical to SEQ ID NO: 77615

SEQ ID NO: 166933 - RNA, 64 nt, hsa; identical to SEQ ID NO: 77616

SEQ ID NO: 166934 - RNA, 64 nt, hsa; identical to SEQ ID NO: 77617

SEQ ID NO: 166935 - RNA, 64 nt, hsa; identical to SEQ ID NO: 77618

SEQ ID NO: 166936 - RNA, 64 nt, hsa; identical to SEQ ID NO: 77619

SEQ ID NO: 166937 - RNA, 64 nt, hsa; identical to SEQ ID NO: 77620

SEQ ID NO: 166938 - RNA, 64 nt, hsa; identical to SEQ ID NO: 77621

SEQ ID NO: 166939 - RNA, 64 nt, hsa; identical to SEQ ID NO: 77622

SEQ ID NO: 166940 - RNA, 64 nt, hsa; identical to SEQ ID NO: 77623

SEQ ID NO: 166941 - RNA, 64 nt, hsa; identical to SEQ ID NO: 77624

SEQ ID NO: 166942 - RNA, 64 nt, hsa; identical to SEQ ID NO: 77625

SEQ ID NO: 166943 - RNA, 64 nt, hsa; identical to SEQ ID NO: 77626

SEQ ID NO: 166944 - RNA, 64 nt, hsa; identical to SEQ ID NO: 77627

SEQ ID NO: 166945 - RNA, 64 nt, hsa; identical to SEQ ID NO: 77628

SEQ ID NO: 166946 - RNA, 64 nt, hsa; identical to SEQ ID NO: 77629

SEQ ID NO: 166947 - RNA, 64 nt, hsa; identical to SEQ ID NO: 77630

SEQ ID NO: 166948 - RNA, 64 nt, hsa; identical to SEQ ID NO: 77631

SEQ ID NO: 166949 - RNA, 64 nt, hsa; identical to SEQ ID NO: 77632

SEQ ID NO: 166950 - RNA, 64 nt, hsa; identical to SEQ ID NO: 77633

SEQ ID NO: 166951 - RNA, 64 nt, hsa; identical to SEQ ID NO: 77634

SEQ ID NO: 166952 - RNA, 64 nt, hsa; identical to SEQ ID NO: 77635

SEQ ID NO: 166953 - RNA, 64 nt, hsa; identical to SEQ ID NO: 77636

SEQ ID NO: 166954 - RNA, 64 nt, hsa; identical to SEQ ID NO: 77637

SEQ ID NO: 166955 - RNA, 64 nt, hsa; identical to SEQ ID NO: 77638

SEQ ID NO: 166956 - RNA, 64 nt, hsa; identical to SEQ ID NO: 77639

SEQ ID NO: 166957 - RNA, 64 nt, hsa; identical to SEQ ID NO: 77640

SEQ ID NO: 166958 - RNA, 64 nt, hsa; identical to SEQ ID NO: 77641

SEQ ID NO: 166959 - RNA, 64 nt, hsa; identical to SEQ ID NO: 77642

SEQ ID NO: 166960 - RNA, 64 nt, hsa; identical to SEQ ID NO: 77643

SEQ ID NO: 166961 - RNA, 64 nt, hsa; identical to SEQ ID NO: 77644

SEQ ID NO: 166962 - RNA, 64 nt, hsa; identical to SEQ ID NO: 77645

SEQ ID NO: 166963 - RNA, 64 nt, hsa; identical to SEQ ID NO: 77646

SEQ ID NO: 166964 - RNA, 64 nt, hsa; identical to SEQ ID NO: 77647

SEQ ID NO: 166965 - RNA, 64 nt, hsa; identical to SEQ ID NO: 77648

SEQ ID NO: 166966 - RNA, 64 nt, hsa; identical to SEQ ID NO: 77649

SEQ ID NO: 166967 - RNA, 64 nt, hsa; identical to SEQ ID NO: 77650

SEQ ID NO: 166968 - RNA, 64 nt, hsa; identical to SEQ ID NO: 77651

SEQ ID NO: 166969 - RNA, 64 nt, hsa; identical to SEQ ID NO: 77652

SEQ ID NO: 166970 - RNA, 64 nt, hsa; identical to SEQ ID NO: 77653

SEQ ID NO: 166971 - RNA, 64 nt, hsa; identical to SEQ ID NO: 77654

SEQ ID NO: 166972 - RNA, 64 nt, hsa; identical to SEQ ID NO: 77655

SEQ ID NO: 166973 - RNA, 64 nt, hsa; identical to SEQ ID NO: 77656

SEQ ID NO: 166974 - RNA, 64 nt, hsa; identical to SEQ ID NO: 77657

SEQ ID NO: 166975 - RNA, 64 nt, hsa; identical to SEQ ID NO: 77658

SEQ ID NO: 166976 - RNA, 64 nt, hsa; identical to SEQ ID NO: 77659

SEQ ID NO: 166977 - RNA, 64 nt, hsa; identical to SEQ ID NO: 77660

SEQ ID NO: 166978 - RNA, 63 nt, hsa; identical to SEQ ID NO: 77661

SEQ ID NO: 166979 - RNA, 64 nt, hsa; identical to SEQ ID NO: 77662

SEQ ID NO: 166980 - RNA, 64 nt, hsa; identical to SEQ ID NO: 77663

SEQ ID NO: 166981 - RNA, 64 nt, hsa; identical to SEQ ID NO: 77664

SEQ ID NO: 166982 - RNA, 64 nt, hsa; identical to SEQ ID NO: 77665

SEQ ID NO: 166983 - RNA, 64 nt, hsa; identical to SEQ ID NO: 77666

SEQ ID NO: 166984 - RNA, 64 nt, hsa; identical to SEQ ID NO: 77667

SEQ ID NO: 166985 - RNA, 64 nt, hsa; identical to SEQ ID NO: 77668

SEQ ID NO: 166986 - RNA, 64 nt, hsa; identical to SEQ ID NO: 77669

SEQ ID NO: 166987 - RNA, 64 nt, hsa; identical to SEQ ID NO: 77670

SEQ ID NO: 166988 - RNA, 64 nt, hsa; identical to SEQ ID NO: 77671

SEQ ID NO: 166989 - RNA, 64 nt, hsa; identical to SEQ ID NO: 77672

SEQ ID NO: 166990 - RNA, 64 nt, hsa; identical to SEQ ID NO: 77673

SEQ ID NO: 166991 - RNA, 64 nt, hsa; identical to SEQ ID NO: 77674

SEQ ID NO: 166992 - RNA, 64 nt, hsa; identical to SEQ ID NO: 77675

SEQ ID NO: 166993 - RNA, 64 nt, hsa; identical to SEQ ID NO: 77676

SEQ ID NO: 166994 - RNA, 64 nt, hsa; identical to SEQ ID NO: 77677

SEQ ID NO: 166995 - RNA, 64 nt, hsa; identical to SEQ ID NO: 77678

SEQ ID NO: 166996 - RNA, 64 nt, hsa; identical to SEQ ID NO: 77679

SEQ ID NO: 166997 - RNA, 64 nt, hsa; identical to SEQ ID NO: 77680

SEQ ID NO: 166998 - RNA, 64 nt, hsa; identical to SEQ ID NO: 77681

SEQ ID NO: 166999 - RNA, 64 nt, hsa; identical to SEQ ID NO: 77682

SEQ ID NO: 167000 - RNA, 64 nt, hsa; identical to SEQ ID NO: 77683

SEQ ID NO: 167001 - RNA, 57 nt, hsa; identical to SEQ ID NO: 77684

SEQ ID NO: 167002 - RNA, 64 nt, hsa; identical to SEQ ID NO: 77685

SEQ ID NO: 167003 - RNA, 64 nt, hsa; identical to SEQ ID NO: 77686

SEQ ID NO: 167004 - RNA, 64 nt, hsa; identical to SEQ ID NO: 77687

SEQ ID NO: 167005 - RNA, 64 nt, hsa; identical to SEQ ID NO: 77688

SEQ ID NO: 167006 - RNA, 64 nt, hsa; identical to SEQ ID NO: 77689

SEQ ID NO: 167007 - RNA, 64 nt, hsa; identical to SEQ ID NO: 77690

SEQ ID NO: 167008 - RNA, 64 nt, hsa; identical to SEQ ID NO: 77691

SEQ ID NO: 167009 - RNA, 64 nt, hsa; identical to SEQ ID NO: 77692

SEQ ID NO: 167010 - RNA, 64 nt, hsa; identical to SEQ ID NO: 77693

SEQ ID NO: 167011 - RNA, 64 nt, hsa; identical to SEQ ID NO: 77694

SEQ ID NO: 167012 - RNA, 64 nt, hsa; identical to SEQ ID NO: 77695

SEQ ID NO: 167013 - RNA, 64 nt, hsa; identical to SEQ ID NO: 77696

SEQ ID NO: 167014 - RNA, 64 nt, hsa; identical to SEQ ID NO: 77697

SEQ ID NO: 167015 - RNA, 64 nt, hsa; identical to SEQ ID NO: 77698

SEQ ID NO: 167016 - RNA, 64 nt, hsa; identical to SEQ ID NO: 77699

SEQ ID NO: 167017 - RNA, 64 nt, hsa; identical to SEQ ID NO: 77700

SEQ ID NO: 167018 - RNA, 64 nt, hsa; identical to SEQ ID NO: 77701

SEQ ID NO: 167019 - RNA, 64 nt, hsa; identical to SEQ ID NO: 77702

SEQ ID NO: 167020 - RNA, 63 nt, hsa; identical to SEQ ID NO: 77703

SEQ ID NO: 167021 - RNA, 64 nt, hsa; identical to SEQ ID NO: 77704

SEQ ID NO: 167022 - RNA, 64 nt, hsa; identical to SEQ ID NO: 77705

SEQ ID NO: 167023 - RNA, 64 nt, hsa; identical to SEQ ID NO: 77706

SEQ ID NO: 167024 - RNA, 64 nt, hsa; identical to SEQ ID NO: 77707

SEQ ID NO: 167025 - RNA, 64 nt, hsa; identical to SEQ ID NO: 77708

SEQ ID NO: 167026 - RNA, 64 nt, hsa; identical to SEQ ID NO: 77709

SEQ ID NO: 167027 - RNA, 64 nt, hsa; identical to SEQ ID NO: 77710

SEQ ID NO: 167028 - RNA, 64 nt, hsa; identical to SEQ ID NO: 77711

SEQ ID NO: 167029 - RNA, 64 nt, hsa; identical to SEQ ID NO: 77712

SEQ ID NO: 167030 - RNA, 64 nt, hsa; identical to SEQ ID NO: 77713

SEQ ID NO: 167031 - RNA, 64 nt, hsa; identical to SEQ ID NO: 77714

SEQ ID NO: 167032 - RNA, 64 nt, hsa; identical to SEQ ID NO: 77715

SEQ ID NO: 167033 - RNA, 64 nt, hsa; identical to SEQ ID NO: 77716

SEQ ID NO: 167034 - RNA, 64 nt, hsa; identical to SEQ ID NO: 77717

SEQ ID NO: 167035 - RNA, 64 nt, hsa; identical to SEQ ID NO: 77718

SEQ ID NO: 167036 - RNA, 64 nt, hsa; identical to SEQ ID NO: 77719

SEQ ID NO: 167037 - RNA, 64 nt, hsa; identical to SEQ ID NO: 77720

SEQ ID NO: 167038 - RNA, 64 nt, hsa; identical to SEQ ID NO: 77721

SEQ ID NO: 167039 - RNA, 64 nt, hsa; identical to SEQ ID NO: 77722

SEQ ID NO: 167040 - RNA, 64 nt, hsa; identical to SEQ ID NO: 77723

SEQ ID NO: 167041 - RNA, 64 nt, hsa; identical to SEQ ID NO: 77724

SEQ ID NO: 167042 - RNA, 64 nt, hsa; identical to SEQ ID NO: 77725

SEQ ID NO: 167043 - RNA, 64 nt, hsa; identical to SEQ ID NO: 77726

SEQ ID NO: 167044 - RNA, 64 nt, hsa; identical to SEQ ID NO: 77727

SEQ ID NO: 167045 - RNA, 64 nt, hsa; identical to SEQ ID NO: 77728

SEQ ID NO: 167046 - RNA, 64 nt, hsa; identical to SEQ ID NO: 77729

SEQ ID NO: 167047 - RNA, 64 nt, hsa; identical to SEQ ID NO: 77730

SEQ ID NO: 167048 - RNA, 64 nt, hsa; identical to SEQ ID NO: 77731

SEQ ID NO: 167049 - RNA, 64 nt, hsa; identical to SEQ ID NO: 77732

SEQ ID NO: 167050 - RNA, 64 nt, hsa; identical to SEQ ID NO: 77733

SEQ ID NO: 167051 - RNA, 64 nt, hsa; identical to SEQ ID NO: 77734

SEQ ID NO: 167052 - RNA, 64 nt, hsa; identical to SEQ ID NO: 77735

SEQ ID NO: 167053 - RNA, 50 nt, hsa; identical to SEQ ID NO: 77736

SEQ ID NO: 167054 - RNA, 64 nt, hsa; identical to SEQ ID NO: 77737

SEQ ID NO: 167055 - RNA, 64 nt, hsa; identical to SEQ ID NO: 77738

SEQ ID NO: 167056 - RNA, 64 nt, hsa; identical to SEQ ID NO: 77739

SEQ ID NO: 167057 - RNA, 64 nt, hsa; identical to SEQ ID NO: 77740

SEQ ID NO: 167058 - RNA, 64 nt, hsa; identical to SEQ ID NO: 77741

SEQ ID NO: 167059 - RNA, 64 nt, hsa; identical to SEQ ID NO: 77742

SEQ ID NO: 167060 - RNA, 64 nt, hsa; identical to SEQ ID NO: 77743

SEQ ID NO: 167061 - RNA, 64 nt, hsa; identical to SEQ ID NO: 77744

SEQ ID NO: 167062 - RNA, 64 nt, hsa
auacaagacaggaagcacggucuuaggcggauggaggccugacgucccuggaguugaaagccca

SEQ ID NO: 167063 - RNA, 64 nt, hsa
gguauauuugucaccagauuagagaggcgugucaaggccugaaggagcccaugugguuggauaa

SEQ ID NO: 167064 - RNA, 64 nt, hsa
cccaugccccacucugcugaggccagaggaagggaggccugaggggcagauugguucaugccug

SEQ ID NO: 167065 - RNA, 64 nt, hsa
auaugccagugacugcugcgcugugcuggucucuaggccugaacuaggugcuggcaugucuggg

SEQ ID NO: 167066 - RNA, 64 nt, hsa
cuccccggacauggcccugccccuaugggacaccaggccugacucaggcagguucugcccccca

SEQ ID NO: 167067 - RNA, 64 nt, hsa
cacacggccgccccacgugcugucgcucagcccgaggccugacuucucugggcugaggcugguc

SEQ ID NO: 167068 - RNA, 64 nt, hsa
cugcauguccggcugaaggcugaguguccggcugaggccugagcgaguguccagccaagggcug

SEQ ID NO: 167069 - RNA, 64 nt, hsa
ggcccacacccaggcccgcaccgcugggagucugaggccugagugaguguuuggccgaggccug

SEQ ID NO: 167070 - RNA, 64 nt, hsa
agggcccucggugcccacgccucugcccaucuggaggccugaguaaggaguggcucagccccac

SEQ ID NO: 167071 - RNA, 64 nt, hsa
cagugaaccccaugaagcugauggguuugcaggaaggccugaacaugugcacccucccagggac

SEQ ID NO: 167072 - RNA, 64 nt, hsa
aagggaggaaacucaaagccgaaagcaaaauuccaggccugauucuggcuuuugagguuccugg

SEQ ID NO: 167073 - RNA, 64 nt, hsa
auucuggcuuuugagguuccugguucuugaagccaggccugacccgacucucagauggggucag

SEQ ID NO: 167074 - RNA, 64 nt, hsa
auagaaugccccugaaugggaacucuaggucccaaggccugaaggguugagaacagacagcugu

SEQ ID NO: 167075 - RNA, 64 nt, hsa
uggcaguuuauugauuaguccaaaucacaggcuaaggccugaucuccaggagggguaggggaga

SEQ ID NO: 167076 - RNA, 64 nt, hsa
cucuggcuaggcucggcggccuuuuccaggcuucaggccugaacaaaacaggcuguuugcugug

SEQ ID NO: 167077 - RNA, 64 nt, hsa
gagggagaccugcuggugcccuugcaccagggugaggccugacucacgcugcuuccccccacag

SEQ ID NO: 167078 - RNA, 64 nt, hsa
agcuguagagaggccugccuccagggcuggacugaggccugagcgcuccugccgcagagcuggc

SEQ ID NO: 167079 - RNA, 64 nt, hsa
uccaaccuggggggcagugguguggagaagccacaggccugagauuucaucugcucuccuuccu

SEQ ID NO: 167080 - RNA, 64 nt, hsa
ccccaacgccggggcuuugcauggggcccaggggaggccugagcuuggauuuacacuguaauaa

SEQ ID NO: 167081 - RNA, 64 nt, hsa
ggaaggacacgaggacgucaggaguggucuucacaggccugauggucucccuccucugccuccu

SEQ ID NO: 167082 - RNA, 64 nt, hsa
ccugcgccaguccugcuaccucccuugccuuucgaggccugaagccagcugcccuaugggccug

SEQ ID NO: 167083 - RNA, 64 nt, hsa
uuauuauccuugggggcucccagggcaaggguuaaggccugaaucaugagccugcuggaagccc

SEQ ID NO: 167084 - RNA, 64 nt, hsa
uccuuuucucaucaaucacugaugcugaagcugcaggccugagcccuuugucucccuggaugcu

SEQ ID NO: 167085 - RNA, 64 nt, hsa
gcguccaggguacaggugcgggugguggggaugaaggccugaccagggagggagaagcagguuu

SEQ ID NO: 167086 - RNA, 64 nt, hsa
gccccggugggcugaggcaggggccgcugucgucaggccugagccagggugagcuggugccugc

SEQ ID NO: 167087 - RNA, 64 nt, hsa
cagccucuggggugcuuggucucugcgaagucaaaggccugacagcucuguggccugggaaucc

SEQ ID NO: 167088 - RNA, 64 nt, hsa
gggguaaagauggguuuuuaaugauacuaagauaacugaaaauaggcauauagauauauuccaa

SEQ ID NO: 167089 - RNA, 64 nt, hsa
gaccaucuggccaacauggugaaacccugucucuacugaaaauaaaaaaaacuagcugggcaug

SEQ ID NO: 167090 - RNA, 64 nt, hsa
aguaauaauagaauaaaggguugaguaacuuagaacugaaaaugaucucuuuuaaaaagaaauu

SEQ ID NO: 167091 - RNA, 64 nt, hsa
augauuaaguggggucacugaauuccauuuguggacugaaaaguauucaauccacuuuuggggu

SEQ ID NO: 167092 - RNA, 64 nt, hsa
ugggagaagagaugcugccauuuaaccccuugguacugaaaaugagaaaauccccaacuaugca

SEQ ID NO: 167093 - RNA, 64 nt, hsa
cauucugcuacuucacugucaucuucaauuuauuacugaaaaugauuccuggacaucaccaguc

SEQ ID NO: 167094 - RNA, 64 nt, hsa
cucugggucggucagugacauguagguaggaagcacugaaaauaguguucccagagcacuuugc

SEQ ID NO: 167095 - RNA, 64 nt, hsa
uaagggcauuuuacccuugcaguuuuacuaaaacacugaaaaauauuccaagcuucauauuaac

SEQ ID NO: 167096 - RNA, 64 nt, hsa
uguacuucugauuaaugcaaggggaaauuuuuauacugaaaacaaacaaacaaacuagcagcua

SEQ ID NO: 167097 - RNA, 64 nt, hsa
auuauuuuauaaaauguuuucuguauggcaauaaacugaaaacauggaucaacccuucuuuuga

SEQ ID NO: 167098 - RNA, 64 nt, hsa
aauguuagcuacuaugaauggugccagugaagacacugaaaaauaagugauuucaguaaccuuc

SEQ ID NO: 167099 - RNA, 64 nt, hsa
ucucaguugugggaauaauuaucagagacaugcaacugaaaaugucucaccuuucaucuuuuuu

SEQ ID NO: 167100 - RNA, 64 nt, hsa
aggaaacuugaaaggucugaggaugauguagauuacugaaaaaugcaaauugcaaucauauaaa

SEQ ID NO: 167101 - RNA, 64 nt, hsa
cugaaugccucccucaaaggaccugcaggcagagacugaaaauugcagacagaggggcacgucu

SEQ ID NO: 167102 - RNA, 64 nt, hsa
uagaacuccuuacucugaugucuguauauguugcacugaaaagguuaauauuuaauguuuuaau

SEQ ID NO: 167103 - RNA, 64 nt, hsa
aagaucuagugguucacacagagagagagagaguacugaaaaagcaacuccucuucuuagucuu

SEQ ID NO: 167104 - RNA, 64 nt, hsa
ucagacuucuacauuaaugauguauguguugcugacugaaaagcuauacugauuagaaaugucu

SEQ ID NO: 167105 - RNA, 64 nt, hsa
ucuuggguccccuuuccauguauguuuucuugucacugaaaacaaacaacgcugaguuuaucaa

SEQ ID NO: 167106 - RNA, 64 nt, hsa
ggcugcuucaagucugugcaguugacuuggcuguacugaaaagugaacagcauggauuaacuca

SEQ ID NO: 167107 - RNA, 64 nt, hsa
aguguuuauuuugaaucguuaacauuauuuaaagacugaaaauucauugcaauuagggaacgca

SEQ ID NO: 167108 - RNA, 64 nt, hsa
gaaugguuggagauugcuggcgaugugaugcugcacugaaaaaacuggucacacaaaauguuua

SEQ ID NO: 167109 - RNA, 64 nt, hsa
ucuuugcagguaucacagccuugcagaagaaccaacugaaaaaaaaauucucaggcuuuacagc

SEQ ID NO: 167110 - RNA, 64 nt, hsa
ccacauucuaccagcacaaggaaacauaggcagcacugaaaaaaaaaaaaaagcucauauuaau

SEQ ID NO: 167111 - RNA, 64 nt, hsa
gacuauauauaaucaauucaucaagccaguuauuacugaaaaaucauugaaaugagacaguuua

SEQ ID NO: 167112 - RNA, 64 nt, hsa
agcuguuggagaggggaaaaguugugcauaaagaacugaaaaggguucuggaguguucauucag

SEQ ID NO: 167113 - RNA, 64 nt, hsa
aaucugcccugcucagcagucaccauagcagcugacugaaaaucagcacugccugaguaguuuu

SEQ ID NO: 167114 - RNA, 64 nt, hsa
uaguuuugaucaguuuaacuugaaucacuaacugacugaaaauugaaugggcaaauaagugcuu

SEQ ID NO: 167115 - RNA, 64 nt, hsa
gcaguuaaacagcaggaaagcccauuaacuucguacugaaaaagcaacauacugugaugauacg

SEQ ID NO: 167116 - RNA, 64 nt, hsa
ccucuugcucugcuauaucuccacucugccucagacugaaaagcuaguccuaacgucuuugccu

SEQ ID NO: 167117 - RNA, 64 nt, hsa
agcuuggugauaaucaauuuugaaaauacaguggacugaaaagcaaauuuauucuuucgaagau

SEQ ID NO: 167118 - RNA, 64 nt, hsa
agugccauacauuuuauccucauggaugugaugcacugaaaaguuaguugcucuccuuuuuucu

SEQ ID NO: 167119 - RNA, 64 nt, hsa
gcagggggaaagguaggaagaagagguaauuuuuacugaaaauuagggcaauguuggucgccuu

SEQ ID NO: 167120 - RNA, 64 nt, hsa
aaauagaguugcuccauucauauuggacugauggacugaaaacauugaugugauucuugaaagg

SEQ ID NO: 167121 - RNA, 64 nt, hsa
ucauucagggcauauuuuuucuucccaggaucaaacugaaaacauguuaaggcuauaguuuagc

SEQ ID NO: 167122 - RNA, 64 nt, hsa
uuuacacuaaggucuccauauacuauuuuuuucuacugaaaacaauuuagaaagaagcuauugg

SEQ ID NO: 167123 - RNA, 64 nt, hsa
caaguagcugaugugcaguugagaaaacuagaggacugaaaaaacaaauuuuaacuagcaaaug

SEQ ID NO: 167124 - RNA, 64 nt, hsa
uaaucuagcuuauauaaggucauuacauuuuuuaacugaaaaaccuaguuaccugauuauugca

SEQ ID NO: 167125 - RNA, 64 nt, hsa
uuggacucauuugaacaaaaaucuaggccaaaauacugaaaagccuauguguuuuuuuaauugg

SEQ ID NO: 167126 - RNA, 64 nt, hsa
cuuuacguuuucaugcugcuuauuguuuuauucuacugaaaaaaaugaauuucaagauucucaa

SEQ ID NO: 167127 - RNA, 64 nt, hsa
cagaacauuuuggggcaguuuaaugugguaccaaacugaaaauaggagcuauuuauagauggag

SEQ ID NO: 167128 - RNA, 64 nt, hsa
aaaguuaacuccuggacacaaguauauacugugcacugaaaaaauauccaucuacacagcaccc

SEQ ID NO: 167129 - RNA, 64 nt, hsa
guauuacagugggcagguauuugcuuuugcuugcacugaaaauuaaauugcuaucaagaauaaa

SEQ ID NO: 167130 - RNA, 64 nt, hsa
ggcagugagcagguauguguuugcuuuugcuugcacugaaaauuaaauugcuaucaagagcaaa

SEQ ID NO: 167131 - RNA, 64 nt, hsa
auccacuggaggucauuacugccauuaaauaauaacugaaaagacuauguagugaaauguauuu

SEQ ID NO: 167132 - RNA, 64 nt, hsa
accaugcuucaaaagaucuaagaaaugcaaauauacugaaaauugacauccucugaaaauucca

SEQ ID NO: 167133 - RNA, 64 nt, hsa
uuaucucacaagucaaaaaugaagauuuugcagcacugaaaaucuauuaaagcuccaaauuuua

SEQ ID NO: 167134 - RNA, 64 nt, hsa
cauaaaaauugaauucguuucugacauaccuuagacugaaaaacuguugguucauccagaagug

SEQ ID NO: 167135 - RNA, 64 nt, hsa
auuaguuuucuguauaugauauauauuaucuuauacugaaaaaaaauuccuuucagauuggggu

SEQ ID NO: 167136 - RNA, 64 nt, hsa
caagcucuuagcgguuauccacgaacuucgaccuacugaaaaggugguguugguauccaacuau

SEQ ID NO: 167137 - RNA, 64 nt, hsa
uguguuuccugcugacuacaacccucuccuguuuacugaaaaggagucaggaaaacuacaggug

SEQ ID NO: 167138 - RNA, 64 nt, hsa
accaagugcuggugccagccuguuaccuguucucacugaaaagucuggcuaaugcucuugugua

SEQ ID NO: 167139 - RNA, 64 nt, hsa
gagaugacuauaaaauguucaugagggacugaauacugaaaacugugaaauguacuaaauaaaa

SEQ ID NO: 167140 - RNA, 64 nt, hsa
uaacugccaagcccagguugccucucaugaggcaacugaaaaaauccugugucuugauagcaug

SEQ ID NO: 167141 - RNA, 64 nt, hsa
cuucugucuaguacuugucuuauagguaaccaacacugaaaacuuuguagugaugacuaccaaa

SEQ ID NO: 167142 - RNA, 64 nt, hsa
acaagaauguguaucuguuggauauaaucagagaacugaaaaguaauuuaucaguaauuuuuaa

SEQ ID NO: 167143 - RNA, 64 nt, hsa
uaguuugaccucacagugacccuucccaaucagcacugaaaauaccaucaggccuaaucucaua

SEQ ID NO: 167144 - RNA, 64 nt, hsa
uaaucucauaccucugaccaacaggcuguucugcacugaaaagguucuucaucccuuuccaguu

SEQ ID NO: 167145 - RNA, 64 nt, hsa
agccugggugacagagugagacuccaucucaaaaacugaaaauaaaaauaaaaauauguauucu

SEQ ID NO: 167146 - RNA, 64 nt, hsa
uuauuuuuaagcugaaaaggggauccuugaaaacacugaaaaccucuacaacaaucuucaggaa

SEQ ID NO: 167147 - RNA, 64 nt, hsa
aucuccccucccuucaggaauaacuuauuggaaaacugaaaagaaucacugaauggaauguuca

SEQ ID NO: 167148 - RNA, 64 nt, hsa
gaacuugagaaaauuacuucauaaacauauggaaacugaaaauggacucucuuugugacaaaga

SEQ ID NO: 167149 - RNA, 64 nt, hsa
cgcugacuucauggaauggacauccuguauaagcacugaaaaacaacaacacaauaacacuaaa

SEQ ID NO: 167150 - RNA, 64 nt, hsa
ugaaguguaccuguguacauaacucuguaaaaacacugaaaaauuauacuaacuuauuuauguu

SEQ ID NO: 167151 - RNA, 64 nt, hsa
cacacacacauucacccuaaggauccaauggaauacugaaaagaaaucacuuccuugaaaauuu

SEQ ID NO: 167152 - RNA, 64 nt, hsa
cccuagcucucugugaauguguuuuauccauucaacugaaaauugguaucaagaaaguccacug

SEQ ID NO: 167153 - RNA, 64 nt, hsa
agccuggagccaaagaugacacaaggggaaggguacugaaaacaccauccauuugggaaagaag

SEQ ID NO: 167154 - RNA, 64 nt, hsa
aucacggagcugaccaucuuuaccugguccuggaacugaaaaacuguagcuugugugaaaauga

SEQ ID NO: 167155 - RNA, 64 nt, hsa
accagcccaaccaacauggugaaacccugucuccacugaaaauacauaaaauuagccgggugca

SEQ ID NO: 167156 - RNA, 64 nt, hsa
gaguuagguugucuccaggccaugauggccuuacacugaaaaugucacauucuauuuuggguau

SEQ ID NO: 167157 - RNA, 64 nt, hsa
ugagcccauacuuuuggcuccucuaguaagaugcacugaaaacuuagccagaguuagguugucu

SEQ ID NO: 167158 - RNA, 64 nt, hsa
cuggaguacagcgggagaaacacaaaauaguauaacugaaaacauuaacauucagacacacucc

SEQ ID NO: 167159 - RNA, 64 nt, hsa
uguuuuuuuaauguuaaauguguaacucaguauuacugaaaagguacccacauuuugaauagua

SEQ ID NO: 167160 - RNA, 64 nt, hsa
ucauuaccaaaauacuaaaacccaacaaaaugcaacugaaaaauaccuuccaaauuugccaaga

SEQ ID NO: 167161 - RNA, 64 nt, hsa
uauaucaucaggucuuaaaaaaaaauaaagguaaacugaaaagacaacuggcuacaaagaagga

SEQ ID NO: 167162 - RNA, 64 nt, hsa
aggccauagaaacguuuuaauuuucaaugaagucacugaaaauccaacuccaggagcuauggca

SEQ ID NO: 167163 - RNA, 64 nt, hsa
uuuuuuuaauucuucccuuggauuaauauuuucuacugaaaagaaaugaaaucucaguuccacu

SEQ ID NO: 167164 - RNA, 64 nt, hsa
uccuuuuaaguaaccacucaaaacuuuucauuucacugaaaaaauaugaaaaaccaugacaaua

SEQ ID NO: 167165 - RNA, 64 nt, hsa
cagauugaaaaaaaaaaagcacugaaaaccaauuacugaaaaaaaauugacagcuaguguuuuu

SEQ ID NO: 167166 - RNA, 64 nt, hsa
caucaccuucucaucagauugaaaaaaaaaaagcacugaaaaccaauuacugaaaaaaaauuga

SEQ ID NO: 167167 - RNA, 64 nt, hsa
gugaugauucauuucaaaauccugagugagucugacugaaaaauacgagagaaaagagaguggu

SEQ ID NO: 167168 - RNA, 64 nt, hsa
uaauccaaaucuauuuuucucacguguuuaaaaaacugaaaagugacuacucagauauguugga

SEQ ID NO: 167169 - RNA, 64 nt, hsa; identical to SEQ ID NO: 102259

SEQ ID NO: 167170 - RNA, 64 nt, hsa; identical to SEQ ID NO: 102260

SEQ ID NO: 167171 - RNA, 64 nt, hsa; identical to SEQ ID NO: 102261

SEQ ID NO: 167172 - RNA, 64 nt, hsa; identical to SEQ ID NO: 102262

SEQ ID NO: 167173 - RNA, 64 nt, hsa; identical to SEQ ID NO: 102263

SEQ ID NO: 167174 - RNA, 64 nt, hsa; identical to SEQ ID NO: 102264

SEQ ID NO: 167175 - RNA, 64 nt, hsa; identical to SEQ ID NO: 102265

SEQ ID NO: 167176 - RNA, 64 nt, hsa; identical to SEQ ID NO: 102266

SEQ ID NO: 167177 - RNA, 64 nt, hsa; identical to SEQ ID NO: 102267

SEQ ID NO: 167178 - RNA, 64 nt, hsa; identical to SEQ ID NO: 102268

SEQ ID NO: 167179 - RNA, 64 nt, hsa
aaguaccacuaacacagaugauugaucguuuccaggacaauaaaaguuucggaguugaacuauu

SEQ ID NO: 167180 - RNA, 64 nt, hsa
acuggacuaauugaauaguuaagguuucuauucgggacaauaaaauguauuuugaaagugcugc

SEQ ID NO: 167181 - RNA, 64 nt, hsa
uguuuugcuuucagcauugugccaugagggauuuggacaauauuuaagaacuucuuguccuaga

SEQ ID NO: 167182 - RNA, 64 nt, hsa
aucccaggaucagaagccagggcuaauugggguaggacaauauucccagccccuaagcucugua

SEQ ID NO: 167183 - RNA, 51 nt, hsa
uugugcaggaucugccauaaaggacaauaugaacugaugccuggacuauca

SEQ ID NO: 167184 - RNA, 64 nt, hsa
cuuuauucaaguaaaaaucaauacccuuugaauuggacaauaaucucacuaccuuauuaggauu

SEQ ID NO: 167185 - RNA, 64 nt, hsa
uuguugaucuuguauucagucagguuaaaacaacggacaauaaaagaaugaacacauuccucgu

SEQ ID NO: 167186 - RNA, 64 nt, hsa
caagggauuugaggugaggguuggcgcuuagagaggacaauacugggguuggacuguaagggau

SEQ ID NO: 167187 - RNA, 58 nt, hsa
cuucugcacagggccaauaauaagaaguggacaauacaguauuugcuucauugugugg

SEQ ID NO: 167188 - RNA, 64 nt, hsa
uugaggaacagcacaucagcuuugcccuugacauggacaauagguuuuuuacuuugacggugag

SEQ ID NO: 167189 - RNA, 64 nt, hsa
gcuacugauaggaccaggaagagaggaacucggaggacaauagggaggggaagucuuggaaaau

SEQ ID NO: 167190 - RNA, 64 nt, hsa
guuuacugguuuuuauucccauaugccgauucugggacaauaaaguuguuuaaagcuggcacaa

SEQ ID NO: 167191 - RNA, 64 nt, hsa
augguguguuuuacagucuaccuagaaaauagauggacaauauuuuucaacuguaugagcacgu

SEQ ID NO: 167192 - RNA, 64 nt, hsa
gugcuccuggaacaauccuuccaagcuccucuaaggacaauauuuaauucagauacuaaaggua

SEQ ID NO: 167193 - RNA, 64 nt, hsa
uucucuaucugaaguguucacacuuacacauguaggacaauaagcaggaccgucugggccgguc

SEQ ID NO: 167194 - RNA, 64 nt, hsa
ugccguaguccuuuuuguaacuacccucucaaauggacaauaccagaagugaauuaucccugcu

SEQ ID NO: 167195 - RNA, 64 nt, hsa
cucaguacugcaucacuguguugggaucauaccaggacaauagggucauuccauaugauaaaac

SEQ ID NO: 167196 - RNA, 64 nt, hsa
auuuuauacucauggaagagauaagcuaaagaggggacaauaaugagaaauguuggugugcuuu

SEQ ID NO: 167197 - RNA, 64 nt, hsa
augucagcuaccucugacccugcccuccagccugggacaauaaaagccuuuuuucuagacuguc

SEQ ID NO: 167198 - RNA, 64 nt, hsa
ugugcauuuuauuaauuccuuaggggcacaaggaggacaauaauagcugaucuuuugaaauuug

SEQ ID NO: 167199 - RNA, 64 nt, hsa
uccuuaggaaaaugcuucuguuguaauaguccauggacaauauaaacugaaaaaugucagucug

SEQ ID NO: 167200 - RNA, 64 nt, hsa
ccaguaaucccuugugucuguugcaugaggacauggacaauaaaguaguauaugauccucagau

SEQ ID NO: 167201 - RNA, 64 nt, hsa
caguuuccuuucaguaaucuuucugaaggagccaggacaauagggccuguuguuuagugaauuu

SEQ ID NO: 167202 - RNA, 64 nt, hsa
aucccugguuuuaaguaucaauccuuguucagcuggacaauaugaaucuuuuccacugaaguua

SEQ ID NO: 167203 - RNA, 64 nt, hsa
uguaauucuagaggguaaaaauguaaauagguuuggacaauauuugcacccuuguuuguguuau

SEQ ID NO: 167204 - RNA, 64 nt, hsa
cugggaagagaucaaaauggagucuccuuaccauggacaauacaugcaaagcaauaucuuguuc

SEQ ID NO: 167205 - RNA, 64 nt, hsa
aaugugauauuugaagcaucacauaaaaaugaugggacaauaaauuuugccauaaagucaaauu

SEQ ID NO: 167206 - RNA, 64 nt, hsa
uuuuugccuuacaguggaucauucuaguaggaaaggacaauaagauuuuuuaucaaaauguguc

SEQ ID NO: 167207 - RNA, 64 nt, hsa
guuuaaauauguuguauuguuuuguuuaguuacaggacaauaaugaaauggaguuuauauuugu

SEQ ID NO: 167208 - RNA, 64 nt, hsa
ugauaaccauauccccccagugcucaucaaaguaggacaauaaaaauccauccaucucagucca

SEQ ID NO: 167209 - RNA, 64 nt, hsa
gcucaucugagaagacuuaaguucuuccagcuuuggacaauaacugcuuuuagaaacuguaaag

SEQ ID NO: 167210 - RNA, 64 nt, hsa
uugguuuuuaacuuccuccauacauaagcuucaaggacaauaagauguuaaaaaggaggaaaua

SEQ ID NO: 167211 - RNA, 64 nt, hsa
uacaaaggcaacagcaacuuaaaaaagaaaaucuggacaauagauguggacuccaaggggccac

SEQ ID NO: 167212 - RNA, 64 nt, hsa
auucuuaucuuccagaggcuacaauuauuauaauggacaauacuuuuaccuuugucucuaaaga

SEQ ID NO: 167213 - RNA, 64 nt, hsa
aaagcuacugugauugauagcauuguaagaaucgggacaauauuguauucaacuguuuuauuuu

SEQ ID NO: 167214 - RNA, 64 nt, hsa
ugcaugguagacuuuguggcauuugauacaacuuggacaauaccuaguuuggagggaggggaau

SEQ ID NO: 167215 - RNA, 64 nt, hsa
aauugauaaauccuaaagaggaagaaaagagcugggacaauaaaacacuggcucuggaaucugg

SEQ ID NO: 167216 - RNA, 64 nt, hsa
gacugcuuagccccuaaauaugguaacuacucugggacaauaugggaggaaaagugaagauugu

SEQ ID NO: 167217 - RNA, 64 nt, hsa
caucuuaauuagaugcagggacagggaucagaugggacaauaucaaauuuacuuugugcccuac

SEQ ID NO: 167218 - RNA, 64 nt, hsa
agcaccuuugggcuuuguuuugguguuucuacagggacaauacagacccuggagugugugugug

SEQ ID NO: 167219 - RNA, 64 nt, hsa
aauuauguaaauuugcaaauuauguuaaaaacaaggacaauaaauauucaaaaugcaucccuaa

SEQ ID NO: 167220 - RNA, 64 nt, hsa
aauaugguuaguccaaauugagaugugcucuaaaggacaauaaaagguuaaauaucuccuaauu

SEQ ID NO: 167221 - RNA, 64 nt, hsa
ugacuaacaaugacaaaggccuuaugaacuguacggacaauacagaagacuauucuuauccuca

SEQ ID NO: 167222 - RNA, 64 nt, hsa
aagcgugcacaaucaaaaguacuaugcaauuuuaggacaauaaagaacauacaguuuuuuugug

SEQ ID NO: 167223 - RNA, 64 nt, hsa
uuagaucaaaaaggcaaaugauuuuauaaacaauggacaauauauacuuucuuaagaucuaagg

SEQ ID NO: 167224 - RNA, 64 nt, hsa
caagggaggucaaaaggagaaaaguauaggcuguggacaauaacugaugaauauagggcccaga

SEQ ID NO: 167225 - RNA, 64 nt, hsa
ugaaacacuacuugguauugaauacaccacuugaggacaauaucaugacucacgguuuaucaag

SEQ ID NO: 167226 - RNA, 64 nt, hsa
ugugaugcuggugggaauuguuugcauagaggaaggacaauaacccugccaucgugaguuaaug

SEQ ID NO: 167227 - RNA, 64 nt, hsa
uggccagucguauaccaucccuggaaggauucugggacaauauuccagggauucauugacuucu

SEQ ID NO: 167228 - RNA, 64 nt, hsa
acccuuggccucauuuuuccugucuugugaaagaggacaauaauuccuacuucucaagauuguu

SEQ ID NO: 167229 - RNA, 64 nt, hsa
gguugacuuuguuucuuuauuugugccauuguuuggacaauauuaaagcugcauguaaaagggg

SEQ ID NO: 167230 - RNA, 64 nt, hsa
gauacggaauuuacacagguagggaguguuuaguggacaauaguguagguuauggauggaggug

SEQ ID NO: 167231 - RNA, 64 nt, hsa
gagauggauaugauagauuacacaguuuauuggaggacaauaagaguuauggcaaaaagcaaaa

SEQ ID NO: 167232 - RNA, 64 nt, hsa
guggaauuguugaaguguggcgagucugugcucgggacaauaaagcuugugacagguccaggac

SEQ ID NO: 167233 - RNA, 64 nt, hsa
aguggggauuuuuuucuucuucccuuucucuuuuggacaauaguuaaauuagcaguauuaguua

SEQ ID NO: 167234 - RNA, 64 nt, hsa
caugauuuuucauugucacaccaaauaaccaguuggacaauauugcauuuucaaaauggagagu

SEQ ID NO: 167235 - RNA, 64 nt, hsa
guagcauuucacugaucuucacuccagucacuagggacaauagaaaccugcaaaacacagauuc

SEQ ID NO: 167236 - RNA, 64 nt, hsa
ggauggaaaaguuucaugucauaagucaccaccuggacaauaauugaugcccuuaaaaugcuga

SEQ ID NO: 167237 - RNA, 64 nt, hsa
agauuuuaaagugauuuuugagaagacuugggggggacaauaauagacauucaugucagauccc

SEQ ID NO: 167238 - RNA, 64 nt, hsa
auugccguggguugauagcuggaggaauuguuuuggacaauacuaacaugugaauuuaugucuu

SEQ ID NO: 167239 - RNA, 64 nt, hsa
ugaaagauacaaagugauuauaaaagaauugacaggacaauaaauacuucaaauacuuuuagga

SEQ ID NO: 167240 - RNA, 64 nt, hsa
gcuguaggaauaaccuugcugauaagaaaaaaagggacaauauuggagaaacuaccucuuguuu

SEQ ID NO: 167241 - RNA, 64 nt, hsa
ugucauucuaagauucccauaucuuuugguuaggggacaauauuagagcuuuuaaaaaggaagg

SEQ ID NO: 167242 - RNA, 64 nt, hsa
gggggggguggggggugcgucuuuaguccuaaagggacaauaacucugagcaugccccaaaaaa

SEQ ID NO: 167243 - RNA, 64 nt, hsa
gggaacaucuuaacuguauaugaacauuucacgaggacaauaaaaauaagacauugaaggacca

SEQ ID NO: 167244 - RNA, 64 nt, hsa
ccauuuuuguaagccauaaugaacuguaguacauggacaauaagugugugguagaaacaaacuc

SEQ ID NO: 167245 - RNA, 64 nt, hsa
ccugcuuucacuguguuguucaugguggcuuuuuggacaauaaagaaucuaaaaugggugggga

SEQ ID NO: 167246 - RNA, 64 nt, hsa
ucaacuuuuuuuuuuuuuuuuuuuacuuuggaaaggacaauaacuauaaaccuauauccagauu

SEQ ID NO: 167247 - RNA, 64 nt, hsa
ucagcaggaacuggucauacaggguaagcaccagggacaauaaggauuuuuauagauauaauuu

SEQ ID NO: 167248 - RNA, 64 nt, hsa
caguuucuaaaccaaaaaaugacauguuguaaaaggacaauaaacguugggucaaaauggagcc

SEQ ID NO: 167249 - RNA, 64 nt, hsa
ccaauauucaaauccagaugauuuuuacucccaaggacaauaaauccaacucaauaacuucaac

SEQ ID NO: 167250 - RNA, 64 nt, hsa
gacccacaggccaugaccuuuuugaucacucugaggacaauauuuaaaugacaggaagguauau

SEQ ID NO: 167251 - RNA, 64 nt, hsa
aguggcagcauucugaggccaagagacacucacuggacaauaucaaaccauggcuccuccucag

SEQ ID NO: 167252 - RNA, 64 nt, hsa
ccagcuuguucugggcucagggagggagggcgguggacaauaaacaucugagcagugccucgug

SEQ ID NO: 167253 - RNA, 64 nt, hsa
auuccuggcccugagaauggagcuguagccucauggacaauaaauggaugugacaccaaauacu

SEQ ID NO: 167254 - RNA, 64 nt, hsa
agacgugauaccaaaauuuuguugcaaauauaauggacaauauuuauuuauacccauauucaca

SEQ ID NO: 167255 - RNA, 64 nt, hsa
acuccucaacaggcauaaucaccagcaacacccgggacaauaauacgggggccaccuaccccca

SEQ ID NO: 167256 - RNA, 64 nt, hsa
caacaaggguuuuuagcuuuaagccugugcauguggacaauacucugagaacaugucuggaggg

SEQ ID NO: 167257 - RNA, 64 nt, hsa
ggggugugggcuggaagcacuggcucccugguagggacaauaaagguuuugggucuuucugaga

SEQ ID NO: 167258 - RNA, 64 nt, hsa
aguccuauuaagaaauauuugucuuaaauauauaggacaauacauuauauuaaaauggucucuc

SEQ ID NO: 167259 - RNA, 64 nt, hsa
caaccucaaccuaucuuuauguuuuaaauguuagggacaauaaguugaaauagcuagaggagcu

SEQ ID NO: 167260 - RNA, 64 nt, hsa
uguuuuaaggaugauaaaaaaaaauaacaacuagggacaauacagaacccauuccauuuaucuu

SEQ ID NO: 167261 - RNA, 64 nt, hsa
gccugcuguccugcgucuauccauguggaaugcuggacaauaaagcgagugcugcccacccucc

SEQ ID NO: 167262 - RNA, 63 nt, hsa
cuuucauauauauggcauaauuuugaauaucauggacaauauuuagaacccaaauuuuggagu

SEQ ID NO: 167263 - RNA, 64 nt, hsa
agugggggagggcaccucagcaaccucugaguguggacaauagcugcuuucuucucuauccaag

SEQ ID NO: 167264 - RNA, 64 nt, hsa
cuugcaggucccuuucuacugugguguuggagcaggacaauaaaguccacuagaaaugcacccc

SEQ ID NO: 167265 - RNA, 64 nt, hsa
cuuaaagaaguuaugaacuuuagaaaggaucaggggacaauaauaaucucauuuugauucuacu

SEQ ID NO: 167266 - RNA, 64 nt, hsa
ccacugaacuuucuggaaugggccauaggaugcuggacaauaggacagauuuggaaugagcagu

SEQ ID NO: 167267 - RNA, 64 nt, hsa
auuuuuuuaaauaacuggacauaugucauuuuaaggacaauagaaacacuuagacuuacuugaa

SEQ ID NO: 167268 - RNA, 64 nt, hsa
gugcaauuuaauauagaaagauuucugccuguuuggacaauagguuuuggguaguacagauuag

SEQ ID NO: 167269 - RNA, 64 nt, hsa
gaguugcuuaaaccaaugggacuaaaaccugaugggacaauaacgccuuuggaggaagcacuca

SEQ ID NO: 167270 - RNA, 64 nt, hsa
uaaaaauguauauaaagcauaugagcacacaaauggacaauaaaugccacagcgcaaaagcgug

SEQ ID NO: 167271 - RNA, 64 nt, hsa
acgcacacugccguccaauguggagagccugaugggacaauacccuguuggaagugacaacuga

SEQ ID NO: 167272 - RNA, 64 nt, hsa
cagcaguuuagugccugcugaaaagaucccugauggacaauacuucuugguggacuccagcugc

SEQ ID NO: 167273 - RNA, 64 nt, hsa
agcugccuguucaugaauuuggauaagaauaguaggacaauauucaacacaauuuaauuuuugu

SEQ ID NO: 167274 - RNA, 64 nt, hsa
auaaaagcuuucugccaccccuaaacuccaggggggacaauaugugccaaucaauagcaccccu

SEQ ID NO: 167275 - RNA, 64 nt, hsa
uaaaaagaagaauuuuuuuaaguauuaauuccauggacaauauaaaaucugugugauuguuugc

SEQ ID NO: 167276 - RNA, 64 nt, hsa
acuggacugcucuccggcuucagaagcugcuacaggacaauaacgucauguuuaauacagagcc

SEQ ID NO: 167277 - RNA, 64 nt, hsa
uuugguucauuugguuuuugucaugugcaaggaaggacaauaguccucuuuccaaguguguuag

SEQ ID NO: 167278 - RNA, 64 nt, hsa
ucucauaacagcugacagaaguacauauugaagaggacaauauggcaauguccuucaaaauuau

SEQ ID NO: 167279 - RNA, 64 nt, hsa
cagcguccaguccuccugggcggccccagguccuggacaauaagcaacagaugauauugagugu

SEQ ID NO: 167280 - RNA, 64 nt, hsa
uuuacccauaaauaacaugaaugaaaaaagauugggacaauagagacuggaagucaucaugugc

SEQ ID NO: 167281 - RNA, 64 nt, hsa
uguguggggaggggcccucagguguguguacuuuggacaauaaauggugcuaugacugccuucc

SEQ ID NO: 167282 - RNA, 64 nt, hsa
cccgccugacaaacaggcagggagccacagucagggacaauaaaaacuuggugcacucugaaag

SEQ ID NO: 167283 - RNA, 64 nt, hsa
aauuuguauauuagaaacuuauucaucccacucaggacaauaaaaacgaauguacaaaaagccc

SEQ ID NO: 167284 - RNA, 64 nt, hsa
ggacuugacuugcaauuucuaccuagaaauacauggacaauacccccaggccucagucucccuu

SEQ ID NO: 167285 - RNA, 64 nt, hsa
gaacccaggaauccuuggggguggugggaggagcggacaauaaagguguaaacacagguaccug

SEQ ID NO: 167286 - RNA, 64 nt, hsa
aauuccuuaaauacauacaguaggugaauuuucaggacaauauugccucacaacccugcuuaca

SEQ ID NO: 167287 - RNA, 64 nt, hsa
agggagcaggaaaucagugcuggggguggugggcggacaauaggaucacugccugccagaucuu

SEQ ID NO: 167288 - RNA, 64 nt, hsa
gggcugguuccugcugcagugaggggaacagaugggacaauaaagacuggagacucaguugaau

SEQ ID NO: 167289 - RNA, 64 nt, hsa
ccuccuuccccaagcugagaagcugagagcuggaggacaauauccagggacauggcucuggaaa

SEQ ID NO: 167290 - RNA, 64 nt, hsa
cagaagucagaaguuuggaauguggugggucaaaggacaauaugggugggcauucuggagaguu

SEQ ID NO: 167291 - RNA, 64 nt, hsa
cuuuguaucauucuugagcaaucgcucgguccguggacaauaaacaguauuaucaaagagaacg

SEQ ID NO: 167292 - RNA, 64 nt, hsa
gcagcaccuggggagucccugccucuccucccugggacaauagugugcaugccacccggggucc

SEQ ID NO: 167293 - RNA, 64 nt, hsa
ucaauauuuuuaaagugccaacacagucaugauaggacaauauuuuaugugugugugugcgccu

SEQ ID NO: 167294 - RNA, 64 nt, hsa
agggcgggcuagaaggccaaaagaaggaugaggaggacaauaauauuuauuuuugcauccaacc

SEQ ID NO: 167295 - RNA, 64 nt, hsa
cugcuuuuugaauugagaagagagacuugcgauaggacaauaaaaucuagaagaacuuggaugg

SEQ ID NO: 167296 - RNA, 64 nt, hsa
cuguaaaauggaccaaucagcaggacaugggcggggacaauaagggaauaaaagcuggcgagcg

SEQ ID NO: 167297 - RNA, 64 nt, hsa
guggcuuacaaggucaggaguucaagaccacccuggacaauauggugaaacccugucucuacua

SEQ ID NO: 167298 - RNA, 64 nt, hsa
agugguucuuaggcagauacucuagaugcuuuauggacaauauuauuuucauuggaugauucug

SEQ ID NO: 167299 - RNA, 64 nt, hsa
accggcgcgcucuucgcgcccgccccugcagcacggacaauaaaccuccgccaaugcacggccu

SEQ ID NO: 167300 - RNA, 64 nt, hsa
agcacaggggacgcaaugggaggcagggacaccuggacaauauuuauuuuugcugaaacccaau

SEQ ID NO: 167301 - RNA, 64 nt, hsa
caaguuuccuuccucuguaccacucugcuuccuuggacaauaucaguaauagcuuuguaaguga

SEQ ID NO: 167302 - RNA, 64 nt, hsa
acuuaccuuaugcacaaagguauucccagguaggggacaauaguagcauucgcaguggugauaa

SEQ ID NO: 167303 - RNA, 64 nt, hsa
ccagagucucuagggcaaggagaaacaacuagcuggacaauacucaauucacaacuuagcauuu

SEQ ID NO: 167304 - RNA, 64 nt, hsa
uccccuccuuguacuuuugccuuagguucucaagggacaauagucuucauguuggauucuccaa

SEQ ID NO: 167305 - RNA, 64 nt, hsa
ggaugaaacuagaguggucucagaagugccuucaggacaauaaguggaacuacauuagagcugg

SEQ ID NO: 167306 - RNA, 64 nt, hsa
gaucucuggggcuuccgggggugagauucaaguaggacaauaacaagaggcuggacacccuaca

SEQ ID NO: 167307 - RNA, 64 nt, hsa
uugcacagacacaaaaauauacagacaaucaaaacauugauauauucaaacucuccuuuaaauu

SEQ ID NO: 167308 - RNA, 64 nt, hsa
uaagcugugcagagguugacagcagggcaaguuacauugauauucauccuuuauaggcuuccug

SEQ ID NO: 167309 - RNA, 64 nt, hsa
ugucgaucuuuacuuguggcggagcuaauggucacauugauaguugauuacacuguggcacgaa

SEQ ID NO: 167310 - RNA, 64 nt, hsa
gguccuguuguuuauuaucacucuagaaguuauacauugauauuuauucuuucuguccccacgu

SEQ ID NO: 167311 - RNA, 64 nt, hsa; identical to SEQ ID NO: 93343

SEQ ID NO: 167312 - RNA, 64 nt, hsa; identical to SEQ ID NO: 93344

SEQ ID NO: 167313 - RNA, 64 nt, hsa; identical to SEQ ID NO: 93345

SEQ ID NO: 167314 - RNA, 64 nt, hsa; identical to SEQ ID NO: 93346

SEQ ID NO: 167315 - RNA, 64 nt, hsa; identical to SEQ ID NO: 93347

SEQ ID NO: 167316 - RNA, 64 nt, hsa; identical to SEQ ID NO: 93348

SEQ ID NO: 167317 - RNA, 64 nt, hsa; identical to SEQ ID NO: 93349

SEQ ID NO: 167318 - RNA, 64 nt, hsa; identical to SEQ ID NO: 93350

SEQ ID NO: 167319 - RNA, 64 nt, hsa; identical to SEQ ID NO: 93351

SEQ ID NO: 167320 - RNA, 64 nt, hsa; identical to SEQ ID NO: 93352

SEQ ID NO: 167321 - RNA, 64 nt, hsa; identical to SEQ ID NO: 93353

SEQ ID NO: 167322 - RNA, 64 nt, hsa; identical to SEQ ID NO: 93354

SEQ ID NO: 167323 - RNA, 64 nt, hsa; identical to SEQ ID NO: 93355

SEQ ID NO: 167324 - RNA, 64 nt, hsa; identical to SEQ ID NO: 93356

SEQ ID NO: 167325 - RNA, 64 nt, hsa; identical to SEQ ID NO: 93357

SEQ ID NO: 167326 - RNA, 64 nt, hsa; identical to SEQ ID NO: 93358

SEQ ID NO: 167327 - RNA, 64 nt, hsa; identical to SEQ ID NO: 93359

SEQ ID NO: 167328 - RNA, 64 nt, hsa; identical to SEQ ID NO: 93360

SEQ ID NO: 167329 - RNA, 64 nt, hsa; identical to SEQ ID NO: 93361

SEQ ID NO: 167330 - RNA, 64 nt, hsa; identical to SEQ ID NO: 93362

SEQ ID NO: 167331 - RNA, 64 nt, hsa; identical to SEQ ID NO: 93363

SEQ ID NO: 167332 - RNA, 64 nt, hsa; identical to SEQ ID NO: 93364

SEQ ID NO: 167333 - RNA, 64 nt, hsa; identical to SEQ ID NO: 93365

SEQ ID NO: 167334 - RNA, 64 nt, hsa; identical to SEQ ID NO: 93366

SEQ ID NO: 167335 - RNA, 64 nt, hsa; identical to SEQ ID NO: 93367

SEQ ID NO: 167336 - RNA, 64 nt, hsa; identical to SEQ ID NO: 93368

SEQ ID NO: 167337 - RNA, 64 nt, hsa; identical to SEQ ID NO: 93369

SEQ ID NO: 167338 - RNA, 64 nt, hsa; identical to SEQ ID NO: 93370

SEQ ID NO: 167339 - RNA, 64 nt, hsa; identical to SEQ ID NO: 93371

SEQ ID NO: 167340 - RNA, 64 nt, hsa; identical to SEQ ID NO: 93372

SEQ ID NO: 167341 - RNA, 64 nt, hsa; identical to SEQ ID NO: 93373

SEQ ID NO: 167342 - RNA, 64 nt, hsa; identical to SEQ ID NO: 93374

SEQ ID NO: 167343 - RNA, 64 nt, hsa; identical to SEQ ID NO: 93375

SEQ ID NO: 167344 - RNA, 64 nt, hsa; identical to SEQ ID NO: 93376

SEQ ID NO: 167345 - RNA, 64 nt, hsa; identical to SEQ ID NO: 93377

SEQ ID NO: 167346 - RNA, 64 nt, hsa; identical to SEQ ID NO: 93378

SEQ ID NO: 167347 - RNA, 64 nt, hsa; identical to SEQ ID NO: 93379

SEQ ID NO: 167348 - RNA, 64 nt, hsa; identical to SEQ ID NO: 93380

SEQ ID NO: 167349 - RNA, 64 nt, hsa; identical to SEQ ID NO: 93381

SEQ ID NO: 167350 - RNA, 64 nt, hsa; identical to SEQ ID NO: 93382

SEQ ID NO: 167351 - RNA, 64 nt, hsa; identical to SEQ ID NO: 93383

SEQ ID NO: 167352 - RNA, 64 nt, hsa; identical to SEQ ID NO: 93384

SEQ ID NO: 167353 - RNA, 64 nt, hsa; identical to SEQ ID NO: 93385

SEQ ID NO: 167354 - RNA, 64 nt, hsa; identical to SEQ ID NO: 93386

SEQ ID NO: 167355 - RNA, 64 nt, hsa; identical to SEQ ID NO: 93387

SEQ ID NO: 167356 - RNA, 64 nt, hsa; identical to SEQ ID NO: 93388

SEQ ID NO: 167357 - RNA, 64 nt, hsa; identical to SEQ ID NO: 93389

SEQ ID NO: 167358 - RNA, 64 nt, hsa; identical to SEQ ID NO: 93390

SEQ ID NO: 167359 - RNA, 64 nt, hsa; identical to SEQ ID NO: 93391

SEQ ID NO: 167360 - RNA, 64 nt, hsa; identical to SEQ ID NO: 93392

SEQ ID NO: 167361 - RNA, 64 nt, hsa; identical to SEQ ID NO: 93393

SEQ ID NO: 167362 - RNA, 64 nt, hsa; identical to SEQ ID NO: 93394

SEQ ID NO: 167363 - RNA, 64 nt, hsa; identical to SEQ ID NO: 93395

SEQ ID NO: 167364 - RNA, 64 nt, hsa; identical to SEQ ID NO: 93396

SEQ ID NO: 167365 - RNA, 64 nt, hsa; identical to SEQ ID NO: 93397

SEQ ID NO: 167366 - RNA, 64 nt, hsa; identical to SEQ ID NO: 93398

SEQ ID NO: 167367 - RNA, 64 nt, hsa; identical to SEQ ID NO: 93399

SEQ ID NO: 167368 - RNA, 64 nt, hsa; identical to SEQ ID NO: 93400

SEQ ID NO: 167369 - RNA, 64 nt, hsa; identical to SEQ ID NO: 93401

SEQ ID NO: 167370 - RNA, 64 nt, hsa; identical to SEQ ID NO: 93402

SEQ ID NO: 167371 - RNA, 64 nt, hsa; identical to SEQ ID NO: 93403

SEQ ID NO: 167372 - RNA, 64 nt, hsa; identical to SEQ ID NO: 93404

SEQ ID NO: 167373 - RNA, 64 nt, hsa; identical to SEQ ID NO: 93405

SEQ ID NO: 167374 - RNA, 64 nt, hsa; identical to SEQ ID NO: 93406

SEQ ID NO: 167375 - RNA, 64 nt, hsa; identical to SEQ ID NO: 93407

SEQ ID NO: 167376 - RNA, 64 nt, hsa; identical to SEQ ID NO: 93408

SEQ ID NO: 167377 - RNA, 64 nt, hsa; identical to SEQ ID NO: 93409

SEQ ID NO: 167378 - RNA, 64 nt, hsa; identical to SEQ ID NO: 93410

SEQ ID NO: 167379 - RNA, 64 nt, hsa; identical to SEQ ID NO: 93411

SEQ ID NO: 167380 - RNA, 64 nt, hsa; identical to SEQ ID NO: 93412

SEQ ID NO: 167381 - RNA, 64 nt, hsa; identical to SEQ ID NO: 93413

SEQ ID NO: 167382 - RNA, 64 nt, hsa; identical to SEQ ID NO: 93414

SEQ ID NO: 167383 - RNA, 64 nt, hsa; identical to SEQ ID NO: 93415

SEQ ID NO: 167384 - RNA, 64 nt, hsa; identical to SEQ ID NO: 93416

SEQ ID NO: 167385 - RNA, 64 nt, hsa; identical to SEQ ID NO: 93417

SEQ ID NO: 167386 - RNA, 64 nt, hsa; identical to SEQ ID NO: 93418

SEQ ID NO: 167387 - RNA, 64 nt, hsa; identical to SEQ ID NO: 93419

SEQ ID NO: 167388 - RNA, 64 nt, hsa; identical to SEQ ID NO: 93420

SEQ ID NO: 167389 - RNA, 64 nt, hsa; identical to SEQ ID NO: 93421

SEQ ID NO: 167390 - RNA, 64 nt, hsa; identical to SEQ ID NO: 93422

SEQ ID NO: 167391 - RNA, 64 nt, hsa; identical to SEQ ID NO: 93423

SEQ ID NO: 167392 - RNA, 64 nt, hsa; identical to SEQ ID NO: 93424

SEQ ID NO: 167393 - RNA, 64 nt, hsa; identical to SEQ ID NO: 93425

SEQ ID NO: 167394 - RNA, 64 nt, hsa; identical to SEQ ID NO: 93426

SEQ ID NO: 167395 - RNA, 64 nt, hsa; identical to SEQ ID NO: 93427

SEQ ID NO: 167396 - RNA, 64 nt, hsa; identical to SEQ ID NO: 93428

SEQ ID NO: 167397 - RNA, 64 nt, hsa; identical to SEQ ID NO: 93429

SEQ ID NO: 167398 - RNA, 64 nt, hsa; identical to SEQ ID NO: 93430

SEQ ID NO: 167399 - RNA, 64 nt, hsa; identical to SEQ ID NO: 93431

SEQ ID NO: 167400 - RNA, 64 nt, hsa; identical to SEQ ID NO: 93432

SEQ ID NO: 167401 - RNA, 64 nt, hsa; identical to SEQ ID NO: 93433

SEQ ID NO: 167402 - RNA, 64 nt, hsa; identical to SEQ ID NO: 93434

SEQ ID NO: 167403 - RNA, 64 nt, hsa; identical to SEQ ID NO: 93435

SEQ ID NO: 167404 - RNA, 64 nt, hsa; identical to SEQ ID NO: 93436

SEQ ID NO: 167405 - RNA, 64 nt, hsa; identical to SEQ ID NO: 93437

SEQ ID NO: 167406 - RNA, 64 nt, hsa; identical to SEQ ID NO: 93438

SEQ ID NO: 167407 - RNA, 64 nt, hsa; identical to SEQ ID NO: 93439

SEQ ID NO: 167408 - RNA, 64 nt, hsa; identical to SEQ ID NO: 93440

SEQ ID NO: 167409 - RNA, 64 nt, hsa; identical to SEQ ID NO: 93441

SEQ ID NO: 167410 - RNA, 64 nt, hsa; identical to SEQ ID NO: 93442

SEQ ID NO: 167411 - RNA, 64 nt, hsa; identical to SEQ ID NO: 93443

SEQ ID NO: 167412 - RNA, 64 nt, hsa; identical to SEQ ID NO: 93444

SEQ ID NO: 167413 - RNA, 64 nt, hsa; identical to SEQ ID NO: 93445

SEQ ID NO: 167414 - RNA, 64 nt, hsa; identical to SEQ ID NO: 93446

SEQ ID NO: 167415 - RNA, 64 nt, hsa; identical to SEQ ID NO: 93447

SEQ ID NO: 167416 - RNA, 64 nt, hsa; identical to SEQ ID NO: 93448

SEQ ID NO: 167417 - RNA, 64 nt, hsa; identical to SEQ ID NO: 93449

SEQ ID NO: 167418 - RNA, 64 nt, hsa; identical to SEQ ID NO: 93450

SEQ ID NO: 167419 - RNA, 64 nt, hsa; identical to SEQ ID NO: 93451

SEQ ID NO: 167420 - RNA, 64 nt, hsa; identical to SEQ ID NO: 93452

SEQ ID NO: 167421 - RNA, 64 nt, hsa; identical to SEQ ID NO: 93453

SEQ ID NO: 167422 - RNA, 64 nt, hsa; identical to SEQ ID NO: 93454

SEQ ID NO: 167423 - RNA, 64 nt, hsa; identical to SEQ ID NO: 93455

SEQ ID NO: 167424 - RNA, 64 nt, hsa; identical to SEQ ID NO: 93456

SEQ ID NO: 167425 - RNA, 64 nt, hsa; identical to SEQ ID NO: 93457

SEQ ID NO: 167426 - RNA, 64 nt, hsa; identical to SEQ ID NO: 93458

SEQ ID NO: 167427 - RNA, 64 nt, hsa; identical to SEQ ID NO: 93459

SEQ ID NO: 167428 - RNA, 64 nt, hsa; identical to SEQ ID NO: 93460

SEQ ID NO: 167429 - RNA, 63 nt, hsa; identical to SEQ ID NO: 93461

SEQ ID NO: 167430 - RNA, 64 nt, hsa; identical to SEQ ID NO: 93462

SEQ ID NO: 167431 - RNA, 64 nt, hsa; identical to SEQ ID NO: 93463

SEQ ID NO: 167432 - RNA, 64 nt, hsa; identical to SEQ ID NO: 93464

SEQ ID NO: 167433 - RNA, 64 nt, hsa; identical to SEQ ID NO: 93465

SEQ ID NO: 167434 - RNA, 64 nt, hsa; identical to SEQ ID NO: 93466

SEQ ID NO: 167435 - RNA, 64 nt, hsa; identical to SEQ ID NO: 93467

SEQ ID NO: 167436 - RNA, 64 nt, hsa; identical to SEQ ID NO: 93468

SEQ ID NO: 167437 - RNA, 64 nt, hsa; identical to SEQ ID NO: 93469

SEQ ID NO: 167438 - RNA, 64 nt, hsa; identical to SEQ ID NO: 93470

SEQ ID NO: 167439 - RNA, 64 nt, hsa; identical to SEQ ID NO: 93471

SEQ ID NO: 167440 - RNA, 64 nt, hsa; identical to SEQ ID NO: 93472

SEQ ID NO: 167441 - RNA, 64 nt, hsa; identical to SEQ ID NO: 93473

SEQ ID NO: 167442 - RNA, 64 nt, hsa; identical to SEQ ID NO: 93474

SEQ ID NO: 167443 - RNA, 64 nt, hsa; identical to SEQ ID NO: 93475

SEQ ID NO: 167444 - RNA, 64 nt, hsa; identical to SEQ ID NO: 93476

SEQ ID NO: 167445 - RNA, 64 nt, hsa; identical to SEQ ID NO: 93477

SEQ ID NO: 167446 - RNA, 64 nt, hsa; identical to SEQ ID NO: 93478

SEQ ID NO: 167447 - RNA, 64 nt, hsa; identical to SEQ ID NO: 93479

SEQ ID NO: 167448 - RNA, 64 nt, hsa; identical to SEQ ID NO: 93480

SEQ ID NO: 167449 - RNA, 64 nt, hsa; identical to SEQ ID NO: 93481

SEQ ID NO: 167450 - RNA, 64 nt, hsa; identical to SEQ ID NO: 93482

SEQ ID NO: 167451 - RNA, 64 nt, hsa; identical to SEQ ID NO: 93483

SEQ ID NO: 167452 - RNA, 64 nt, hsa; identical to SEQ ID NO: 93484

SEQ ID NO: 167453 - RNA, 64 nt, hsa; identical to SEQ ID NO: 93485

SEQ ID NO: 167454 - RNA, 64 nt, hsa; identical to SEQ ID NO: 93486

SEQ ID NO: 167455 - RNA, 64 nt, hsa; identical to SEQ ID NO: 93487

SEQ ID NO: 167456 - RNA, 64 nt, hsa; identical to SEQ ID NO: 93488

SEQ ID NO: 167457 - RNA, 64 nt, hsa; identical to SEQ ID NO: 93489

SEQ ID NO: 167458 - RNA, 64 nt, hsa; identical to SEQ ID NO: 93490

SEQ ID NO: 167459 - RNA, 64 nt, hsa; identical to SEQ ID NO: 93491

SEQ ID NO: 167460 - RNA, 64 nt, hsa; identical to SEQ ID NO: 93492

SEQ ID NO: 167461 - RNA, 64 nt, hsa; identical to SEQ ID NO: 93493

SEQ ID NO: 167462 - RNA, 64 nt, hsa; identical to SEQ ID NO: 93494

SEQ ID NO: 167463 - RNA, 64 nt, hsa; identical to SEQ ID NO: 93495

SEQ ID NO: 167464 - RNA, 64 nt, hsa; identical to SEQ ID NO: 93496

SEQ ID NO: 167465 - RNA, 64 nt, hsa; identical to SEQ ID NO: 93497

SEQ ID NO: 167466 - RNA, 64 nt, hsa; identical to SEQ ID NO: 93498

SEQ ID NO: 167467 - RNA, 64 nt, hsa
ucaacaacaaagugcaauacaggcugaaccuggcccaacagaaaaacccugccccaaugcaccu

SEQ ID NO: 167468 - RNA, 64 nt, hsa
agcaggguggggaggugcaguggcacccccagagccaacagagggagcaggcagaggguggggg

SEQ ID NO: 167469 - RNA, 64 nt, hsa
gggggcagggacuguguucagggaaaguaccugaccaacagaacuucaagucucuuccagagug

SEQ ID NO: 167470 - RNA, 64 nt, hsa
guccucuuuguagaugauguauuuugcuugggcaccaacagaauuaaaaacgaaaaacaaaaaa

SEQ ID NO: 167471 - RNA, 64 nt, hsa
cauggcuucucauuuacaccaacagguuucaguuccaacagaaaggucgggguagguucgugca

SEQ ID NO: 167472 - RNA, 64 nt, hsa
caguuccacagagguggcaggucuugcccuuuggccaacagauuucuuguccugccuucuagau

SEQ ID NO: 167473 - RNA, 64 nt, hsa
cucuuuuugccauggcuaaucccugcauuuccauucagggaaaaggugguagugagcauagaac

SEQ ID NO: 167474 - RNA, 64 nt, hsa
gagauggcugccuggacuggaaucaaaucuaauuucagggaaaugaagauggaauuugaagguc

SEQ ID NO: 167475 - RNA, 64 nt, hsa
cuagaaaccaguauggaagggagggguccugauuucagggaaauggaggguggggccgggugaa

SEQ ID NO: 167476 - RNA, 64 nt, hsa
cucagcaaggugugaaugaccuuaguccgcaaguucagggaagcaggcagagcggggaggugcc

SEQ ID NO: 167477 - RNA, 64 nt, hsa
aaggguagaaguuaaaggagaaucugaaggcaggucagggaaaagaagaacuggaaaugaaaca

SEQ ID NO: 167478 - RNA, 61 nt, hsa
aaaacuguaucauuucuuaauaugauugggaucagggaaugggagaagaugggagcuaaga

SEQ ID NO: 167479 - RNA, 64 nt, hsa
uucaguggcagcccagccaccuccuaucaaucaaucagggaagaaaugcaggggagacuggggc

SEQ ID NO: 167480 - RNA, 64 nt, hsa
aaggaagacacugaccuuucccaucccgguagcuucagggaagaucauaguuaauaacgucucu

SEQ ID NO: 167481 - RNA, 64 nt, hsa
aaucuugaagaaaaaucuuuugguggaggugccuucagggaaaguuuucuucacccucacucuu

SEQ ID NO: 167482 - RNA, 64 nt, hsa
agcagagccccucuuaucuugagaacuccauucuucagggaaaggaucucccuagcucagagaa

SEQ ID NO: 167483 - RNA, 64 nt, hsa
gagggggacauuuuuuggggggcagggacuguguucagggaaaguaccugaccaacagaacuuc

SEQ ID NO: 167484 - RNA, 64 nt, hsa
cucuccaggagauuucaauccaggcuaucuguguucagggaaugauuugcaagaaguugguuua

SEQ ID NO: 167485 - RNA, 50 nt, hsa
cuauucaggagcaacugugaucagggaaguugggggcauuuggccugaaa

SEQ ID NO: 167486 - RNA, 64 nt, hsa
gcaggccaccuccaccacaaccgaaaguaucaucucagggaaacuuaauuccugcccguccugc

SEQ ID NO: 167487 - RNA, 64 nt, hsa
cuugauuuuuuuaaccuucuuuuugcaaaugucuucagggaacugagcuaauacuuuuuuuuuu

SEQ ID NO: 167488 - RNA, 64 nt, hsa
aaaugcuuuguuugcccuuugcuucugcuuuuuuucagggaagcugccaaagaaugucgacguc

SEQ ID NO: 167489 - RNA, 64 nt, hsa
ucuauguuucaucuuguuuuuauaauaaaaagcuucagggaacaagcccaaagcccucaccaca

SEQ ID NO: 167490 - RNA, 64 nt, hsa
cgagacuggacagaugggguguugucaaacaucuucagggaaaucaacaagccaacagacaaga

SEQ ID NO: 167491 - RNA, 64 nt, hsa
ccgcggccacgcccugcuggucgggguagggggcucagggaagcagucucuuucgaggcuggcu

SEQ ID NO: 167492 - RNA, 64 nt, hsa
ggccauuccguucaaauccuagaucguuacagcuucagggaauucauauuuuguuauguguagg

SEQ ID NO: 167493 - RNA, 64 nt, hsa
uaaaaucugaguuuugcccagugugacaucaaacucagggaagaggaagcuaaagugacgagug

SEQ ID NO: 167494 - RNA, 64 nt, hsa
ugucagaaacucaaucucaacaaaauaauuuccaucagggaacuucaggguuucuugggggcuu

SEQ ID NO: 167495 - RNA, 64 nt, hsa
aguucauaaauuuacuugagguugccucaagaacucagggaacaauacuguaaacugucuuccu

SEQ ID NO: 167496 - RNA, 64 nt, hsa
uauuaaaauuuacaucagcaacugucuugagaauucagggaaauagaauggaauuuaaaacuuc

SEQ ID NO: 167497 - RNA, 64 nt, hsa
agcucuccagcuuggaccacacauugcccuuuucucagggaaggaaauggaaacaaaaagccaa

SEQ ID NO: 167498 - RNA, 64 nt, hsa
caguaacugugcuguacugagcacugaaccacauucagggaaauggcuuauuaaacuuugaagc

SEQ ID NO: 167499 - RNA, 64 nt, hsa
gccaugugucuuuacaccucgcuguugucacaucucagggaacugacccucaggcacaccuugc

SEQ ID NO: 167500 - RNA, 64 nt, hsa
cuuucuccccauggcacuggggaaccauggaaguucagggaacuucagggaagaggcuugguca

SEQ ID NO: 167501 - RNA, 64 nt, hsa
auggcacuggggaaccauggaaguucagggaacuucagggaagaggcuuggucaauuccugaga

SEQ ID NO: 167502 - RNA, 64 nt, hsa
uauuugguaaguuuuguacauauauuauguacacucagggaaccaauaccauaaucaugauaau

SEQ ID NO: 167503 - RNA, 64 nt, hsa
cucuccaaagaguguguccaccacuccacugugcucagggaaggcagaccucuccucucucuuu

SEQ ID NO: 167504 - RNA, 64 nt, hsa
gagcggguggagggcccugagguggcagcaggggucagggaagugggcuuccgagugcccucug

SEQ ID NO: 167505 - RNA, 64 nt, hsa
acguggcaagccaggcgaggcgggugcugaggucucagggaagcugguaacacuucccugucug

SEQ ID NO: 167506 - RNA, 64 nt, hsa
cccaaugaaagaagaguuccauggucaacuaaguucagggaacccuguuacacuauuaaaggcu

SEQ ID NO: 167507 - RNA, 64 nt, hsa
ugcacauagcaaucuggcuuccauucauaaggauucagggaauauuccagaagccauagcuucu

SEQ ID NO: 167508 - RNA, 62 nt, hsa
uaggccuuacuggaagccacugauaggggacacuucacuaccagaugugugcagugcaacag

SEQ ID NO: 167509 - RNA, 62 nt, hsa
gugaauauuuaaggucugugacuauaguuaaacuucacuaagaauuugcagaauuguuuuga

SEQ ID NO: 167510 - RNA, 62 nt, hsa
cagcaagacaaauuagccauuucacucucaaacuucacuaaugaucacauucuuuccaaaag

SEQ ID NO: 167511 - RNA, 62 nt, hsa
acacagauuguguuuuucuuugguuuuguuuucuucacuaugggaucuucugugcccagcac

SEQ ID NO: 167512 - RNA, 62 nt, hsa
uaaaaugcauuccugcaauucuguuugcagugcuucacuaaacauugaaauaaaguuguaaa

SEQ ID NO: 167513 - RNA, 62 nt, hsa
ucuguguauuaaacuacgaauuacaaauaucacuucacuaaccacuauaauuauuuuuggcu

SEQ ID NO: 167514 - RNA, 62 nt, hsa
uuggguagcuucaaacucaaauugaagagagucuucacuacaaucuucacuacaaccuuugg

SEQ ID NO: 167515 - RNA, 62 nt, hsa
aaacucaaauugaagagagucuucacuacaaucuucacuacaaccuuuggccuuccucucua

SEQ ID NO: 167516 - RNA, 62 nt, hsa
augaguuaggacaaacucuaaaaauucauauucuucacuauucuuguuuuccuuugauugau

SEQ ID NO: 167517 - RNA, 62 nt, hsa
ucucuuuuugaaaugaauuugugcuuaacugucuucacuauuaauacuauuuagaaauaagc

SEQ ID NO: 167518 - RNA, 62 nt, hsa
uaucccagcauacuuugugaaccuggcuccuucuucacuaccucagaucuaaucaauuaguc

SEQ ID NO: 167519 - RNA, 64 nt, hsa
agacacagucagacacuggacaauguaauguaugcaacugcaaacguuacaacugcagccagaa

SEQ ID NO: 167520 - RNA, 64 nt, hsa
cuggacaauguaauguaugcaacugcaaacguuacaacugcagccagaacaauggcugggugga

SEQ ID NO: 167521 - RNA, 64 nt, hsa
cuucauuugaagaaaauuuguugauaaaccauggcaacugcaagaauuggaaaaaugcugggac

SEQ ID NO: 167522 - RNA, 64 nt, hsa
uuuuacaguaaaguuauuaagguugguuuaaaaacaacugcauuagaaauaaugcguguuuggg

SEQ ID NO: 167523 - RNA, 64 nt, hsa
acaggugcuucaugacaaacauuacuagcauguucaacugcaccauguucuggcacuguauuuu

SEQ ID NO: 167524 - RNA, 64 nt, hsa
aaguccuggaauacaguuuucaguguaauuaauucaacugcacuuaacacuaauguccguguug

SEQ ID NO: 167525 - RNA, 53 nt, hsa
gcaggugugugcugcuaugaacaucucuccagagcccuuucugcacagcuggu

SEQ ID NO: 167526 - RNA, 64 nt, hsa
uuuaauaacauacuccuuuuugaaaguugccuuuucucuccacccuugaguagauccaguauuu

SEQ ID NO: 167527 - RNA, 64 nt, hsa
gggccagauguggagucugugucugcccccgucuucucuccauccucaaagcccccacuucucu

SEQ ID NO: 167528 - RNA, 64 nt, hsa
cccccgucuucucuccauccucaaagcccccacuucucuccaggcuguuucuuuuuuuaugacu

SEQ ID NO: 167529 - RNA, 64 nt, hsa
guucugucugggccagagaaccuagccuuugaaaucucuccaucauaugaaacauaacgggaug

SEQ ID NO: 167530 - RNA, 64 nt, hsa
aucaaaacugguacccacacuugcccuuucucccucucuccagcacacuccccucuaagaaagu

SEQ ID NO: 167531 - RNA, 64 nt, hsa
uuuuuuucuguucucuccaaccacacaucauccaucucuccagacucugccuccuacgaggcug

SEQ ID NO: 167532 - RNA, 64 nt, hsa
cacaggaaacagccugcaccauuuuuuuuucuguucucuccaaccacacaucauccaucucucc

SEQ ID NO: 167533 - RNA, 64 nt, hsa
cuguagcuggcucccuagccuaccucucuggugaucucuccaucugaggcuccuucacuuucuc

SEQ ID NO: 167534 - RNA, 64 nt, hsa
ucuggugaucucuccaucugaggcuccuucacuuucucuccaugggauagggguuggggguacu

SEQ ID NO: 167535 - RNA, 64 nt, hsa
ccaggaacuccagguucugcuggccguggcauccucucuccaggucugcucccuuaccggagcu

SEQ ID NO: 167536 - RNA, 64 nt, hsa
gagcugcguccacagggaacaaagcccugaccucucucuccacauuacccuuacaaaaacaggc

SEQ ID NO: 167537 - RNA, 64 nt, hsa
cucacccuguauuucuuuagcccuaaauugacacucucuccaaaaauccauuccauugucugug

SEQ ID NO: 167538 - RNA, 64 nt, hsa
agccagcauuuacuauguauuuucuccucaccugucucuccauauuuaggucacuuaccaguuu

SEQ ID NO: 167539 - RNA, 64 nt, hsa
gcagugaacaugaacauucacuuagcuuccucagucucuccaucuuaaagaucauuuaucagag

SEQ ID NO: 167540 - RNA, 64 nt, hsa
ucaaugguuaacuaauucuuggguguuuauccuaucucuccaaccagauugucagcuccuugag

SEQ ID NO: 167541 - RNA, 64 nt, hsa
ucuucuccauccuaccacaaugcagugccuuucuucucuccagugcaccugucauaugcucuga

SEQ ID NO: 167542 - RNA, 64 nt, hsa
auuuucccauuuuuauuacccuucuuuccauuucucucuccagucuuccaccuggaagcccucu

SEQ ID NO: 167543 - RNA, 64 nt, hsa
aagcccucucuggcuaaggacaggcaggugccccucucuccaucagaggacaccuguacuggag

SEQ ID NO: 167544 - RNA, 64 nt, hsa
caccauaacugcuggagugucugggauugguagcucucuccaacugccugcuugcucuuuacag

SEQ ID NO: 167545 - RNA, 64 nt, hsa
gcuugcucuuuacagccucucucugugacuggaaucucuccaccucaucguaucuaaggauaac

SEQ ID NO: 167546 - RNA, 64 nt, hsa
auccugcauugaauugaauaugaauuucucuaacucucuccagaaaauggauggagauaacuug

SEQ ID NO: 167547 - RNA, 64 nt, hsa
aaugugagauucuuuagccacuuuggggagccugucucuccagaagccuuucuuaguggugccc

SEQ ID NO: 167548 - RNA, 64 nt, hsa
cccagagugggacugugucuugcuucaugauuccucucuccauuacucucccugcccuucucug

SEQ ID NO: 167549 - RNA, 64 nt, hsa
gaggcaugaugcuuccugcucaccugggccacccucucuccaggacuugucagcuggugguuca

SEQ ID NO: 167550 - RNA, 64 nt, hsa
cugcugugagugacuuauuguacccaacucuauuucucuccauacugaaacaugucuuucauag

SEQ ID NO: 167551 - RNA, 64 nt, hsa
aacuaugaaacagcuaaaagaaaacaucggggaaucucuccaggacauuggagugggcaaagau

SEQ ID NO: 167552 - RNA, 64 nt, hsa
cccaaguugaugcgguuuguagcuuccucccuacucucuccaacaccugcaugcaaagacuacu

SEQ ID NO: 167553 - RNA, 64 nt, hsa
aaggacucuggaagucucuuccuccuccuccucuucucuccaccccuagacccuggcugacuug

SEQ ID NO: 167554 - RNA, 64 nt, hsa
agccaggauagggcgggagaggcaccagaacauuucucuccacugacuuucucacccgguuccc

SEQ ID NO: 167555 - RNA, 64 nt, hsa
agagucccuaagugcucccccacuuaucucugcaucucuccaauuuggaagccauccagcugau

SEQ ID NO: 167556 - RNA, 64 nt, hsa
ggauaauucucuacccucaccccacagagccaucucucuccagaccaaaagcuggaaggagagu

SEQ ID NO: 167557 - RNA, 64 nt, hsa
uuguuuuuacaacugcauguuuauuaugauacuuucucuccaaaggaaacuuuuaaaucaaugg

SEQ ID NO: 167558 - RNA, 64 nt, hsa
gaauaaacuccggagggucggacgggaccugggcucucuccacgauucuggcuguuugcccagg

SEQ ID NO: 167559 - RNA, 64 nt, hsa
ccugagcugaacauggagcaaggggagggugacuucucuccacauagggagggcuuagagcuca

SEQ ID NO: 167560 - RNA, 64 nt, hsa
gcuagggaaaaccccugguucuccaugccacaccucucuccaggugcccucugccucuucaccc

SEQ ID NO: 167561 - RNA, 64 nt, hsa
ucuucaccccacaagaagccuuauccuacguccuucucuccaucuaucggaccccaguuuccau

SEQ ID NO: 167562 - RNA, 64 nt, hsa
acaggcccggggggaccaggaugacaccuccauuucucuccaggaaguuuugaguuucucucca

SEQ ID NO: 167563 - RNA, 64 nt, hsa
gacaccuccauuucucuccaggaaguuuugaguuucucuccaccgugacacaauccucaaacau

SEQ ID NO: 167564 - RNA, 64 nt, hsa
gccuuccucccccaaaugugcaaccuguaaaaggucucuccacaccaggggccaggauccaguu

SEQ ID NO: 167565 - RNA, 64 nt, hsa
ggaccaaauccuuacucuggcucugcuuacacuuucucuccaucaccaaauccuuacuccaaau

SEQ ID NO: 167566 - RNA, 64 nt, hsa
agugcagaggcucacagguggcacacaggcgcugucucuccagagccauccuucagaguggacc

SEQ ID NO: 167567 - RNA, 64 nt, hsa
gacgaagcacagaucccagcacuuuucccagcuuucucuccagcaucagucccugcagcagcug

SEQ ID NO: 167568 - RNA, 64 nt, hsa
gcuggaagcugcccuuuguucuguaccaugugggucucuccacagcggggcucggagcauggca

SEQ ID NO: 167569 - RNA, 64 nt, hsa
aggcagggcuggggcuuuucuuccuccccugcucucucuccacccuccuguucugucuguaccc

SEQ ID NO: 167570 - RNA, 64 nt, hsa
aggccaacuuccucccugcccagccuuccuuguaucucuccagacucggacaaucaaagggaga

SEQ ID NO: 167571 - RNA, 64 nt, hsa
gggagacagauggaggcaguggcuggugggccacucucuccaggugccccucagccaugggccc

SEQ ID NO: 167572 - RNA, 64 nt, hsa
aguggcuggagacucuggcucagccagaguuguuucucuccacucugccucaucucuguacgaa

SEQ ID NO: 167573 - RNA, 64 nt, hsa
agcugagagcccaggcguccgcggcgacuugccgucucuccauuccacugccuguugcagaguu

SEQ ID NO: 167574 - RNA, 64 nt, hsa
cucuucccuuccuucuuuuuuuccucuacugacuucucuccauacucuuuccccucuauuucuu

SEQ ID NO: 167575 - RNA, 64 nt, hsa
cagauggcucuuaagaaucaggcagucgcccacuucucuccagaugaagggaagacauucauag

SEQ ID NO: 167576 - RNA, 64 nt, hsa; identical to SEQ ID NO: 139090

SEQ ID NO: 167577 - RNA, 64 nt, hsa; identical to SEQ ID NO: 139091

SEQ ID NO: 167578 - RNA, 64 nt, hsa; identical to SEQ ID NO: 139092

SEQ ID NO: 167579 - RNA, 64 nt, hsa; identical to SEQ ID NO: 139093

SEQ ID NO: 167580 - RNA, 64 nt, hsa; identical to SEQ ID NO: 139094

SEQ ID NO: 167581 - RNA, 64 nt, hsa; identical to SEQ ID NO: 139095

SEQ ID NO: 167582 - RNA, 64 nt, hsa; identical to SEQ ID NO: 139096

SEQ ID NO: 167583 - RNA, 64 nt, hsa; identical to SEQ ID NO: 139097

SEQ ID NO: 167584 - RNA, 64 nt, hsa; identical to SEQ ID NO: 139098

SEQ ID NO: 167585 - RNA, 64 nt, hsa; identical to SEQ ID NO: 139099

SEQ ID NO: 167586 - RNA, 64 nt, hsa; identical to SEQ ID NO: 139100

SEQ ID NO: 167587 - RNA, 64 nt, hsa; identical to SEQ ID NO: 139101

SEQ ID NO: 167588 - RNA, 64 nt, hsa; identical to SEQ ID NO: 139102

SEQ ID NO: 167589 - RNA, 64 nt, hsa; identical to SEQ ID NO: 139103

SEQ ID NO: 167590 - RNA, 64 nt, hsa; identical to SEQ ID NO: 139104

SEQ ID NO: 167591 - RNA, 64 nt, hsa; identical to SEQ ID NO: 139105

SEQ ID NO: 167592 - RNA, 64 nt, hsa; identical to SEQ ID NO: 139106

SEQ ID NO: 167593 - RNA, 64 nt, hsa; identical to SEQ ID NO: 139107

SEQ ID NO: 167594 - RNA, 64 nt, hsa; identical to SEQ ID NO: 139108

SEQ ID NO: 167595 - RNA, 64 nt, hsa; identical to SEQ ID NO: 139109

SEQ ID NO: 167596 - RNA, 64 nt, hsa; identical to SEQ ID NO: 139110

SEQ ID NO: 167597 - RNA, 64 nt, hsa; identical to SEQ ID NO: 139111

SEQ ID NO: 167598 - RNA, 64 nt, hsa; identical to SEQ ID NO: 139112

SEQ ID NO: 167599 - RNA, 64 nt, hsa; identical to SEQ ID NO: 139113

SEQ ID NO: 167600 - RNA, 64 nt, hsa; identical to SEQ ID NO: 139114

SEQ ID NO: 167601 - RNA, 64 nt, hsa; identical to SEQ ID NO: 139115

SEQ ID NO: 167602 - RNA, 52 nt, hsa; identical to SEQ ID NO: 112167

SEQ ID NO: 167603 - RNA, 64 nt, hsa; identical to SEQ ID NO: 139117

SEQ ID NO: 167604 - RNA, 64 nt, hsa; identical to SEQ ID NO: 139118

SEQ ID NO: 167605 - RNA, 64 nt, hsa; identical to SEQ ID NO: 139119

SEQ ID NO: 167606 - RNA, 64 nt, hsa; identical to SEQ ID NO: 139120

SEQ ID NO: 167607 - RNA, 64 nt, hsa; identical to SEQ ID NO: 139121

SEQ ID NO: 167608 - RNA, 64 nt, hsa; identical to SEQ ID NO: 139122

SEQ ID NO: 167609 - RNA, 64 nt, hsa; identical to SEQ ID NO: 139123

SEQ ID NO: 167610 - RNA, 64 nt, hsa; identical to SEQ ID NO: 139124

SEQ ID NO: 167611 - RNA, 64 nt, hsa; identical to SEQ ID NO: 139125

SEQ ID NO: 167612 - RNA, 64 nt, hsa; identical to SEQ ID NO: 139126

SEQ ID NO: 167613 - RNA, 64 nt, hsa; identical to SEQ ID NO: 139127

SEQ ID NO: 167614 - RNA, 64 nt, hsa; identical to SEQ ID NO: 139128

SEQ ID NO: 167615 - RNA, 64 nt, hsa; identical to SEQ ID NO: 139129

SEQ ID NO: 167616 - RNA, 64 nt, hsa; identical to SEQ ID NO: 139130

SEQ ID NO: 167617 - RNA, 64 nt, hsa; identical to SEQ ID NO: 139131

SEQ ID NO: 167618 - RNA, 64 nt, hsa; identical to SEQ ID NO: 59710

SEQ ID NO: 167619 - RNA, 64 nt, hsa; identical to SEQ ID NO: 59711

SEQ ID NO: 167620 - RNA, 64 nt, hsa; identical to SEQ ID NO: 59712

SEQ ID NO: 167621 - RNA, 64 nt, hsa; identical to SEQ ID NO: 59713

SEQ ID NO: 167622 - RNA, 64 nt, hsa; identical to SEQ ID NO: 59714

SEQ ID NO: 167623 - RNA, 64 nt, hsa; identical to SEQ ID NO: 59715

SEQ ID NO: 167624 - RNA, 64 nt, hsa; identical to SEQ ID NO: 59716

SEQ ID NO: 167625 - RNA, 64 nt, hsa; identical to SEQ ID NO: 59717

SEQ ID NO: 167626 - RNA, 64 nt, hsa; identical to SEQ ID NO: 59718

SEQ ID NO: 167627 - RNA, 64 nt, hsa; identical to SEQ ID NO: 59719

SEQ ID NO: 167628 - RNA, 64 nt, hsa; identical to SEQ ID NO: 59720

SEQ ID NO: 167629 - RNA, 64 nt, hsa; identical to SEQ ID NO: 59721

SEQ ID NO: 167630 - RNA, 64 nt, hsa; identical to SEQ ID NO: 59722

SEQ ID NO: 167631 - RNA, 64 nt, hsa; identical to SEQ ID NO: 59723

SEQ ID NO: 167632 - RNA, 64 nt, hsa; identical to SEQ ID NO: 59724

SEQ ID NO: 167633 - RNA, 64 nt, hsa; identical to SEQ ID NO: 59725

SEQ ID NO: 167634 - RNA, 64 nt, hsa; identical to SEQ ID NO: 59726

SEQ ID NO: 167635 - RNA, 64 nt, hsa; identical to SEQ ID NO: 59727

SEQ ID NO: 167636 - RNA, 64 nt, hsa; identical to SEQ ID NO: 59728

SEQ ID NO: 167637 - RNA, 64 nt, hsa; identical to SEQ ID NO: 59729

SEQ ID NO: 167638 - RNA, 64 nt, hsa; identical to SEQ ID NO: 59730

SEQ ID NO: 167639 - RNA, 64 nt, hsa; identical to SEQ ID NO: 59731

SEQ ID NO: 167640 - RNA, 64 nt, hsa; identical to SEQ ID NO: 59732

SEQ ID NO: 167641 - RNA, 64 nt, hsa; identical to SEQ ID NO: 59733

SEQ ID NO: 167642 - RNA, 64 nt, hsa; identical to SEQ ID NO: 59734

SEQ ID NO: 167643 - RNA, 64 nt, hsa; identical to SEQ ID NO: 59735

SEQ ID NO: 167644 - RNA, 64 nt, hsa; identical to SEQ ID NO: 59736

SEQ ID NO: 167645 - RNA, 64 nt, hsa; identical to SEQ ID NO: 59737

SEQ ID NO: 167646 - RNA, 64 nt, hsa; identical to SEQ ID NO: 59738

SEQ ID NO: 167647 - RNA, 64 nt, hsa; identical to SEQ ID NO: 59739

SEQ ID NO: 167648 - RNA, 64 nt, hsa; identical to SEQ ID NO: 59740

SEQ ID NO: 167649 - RNA, 64 nt, hsa; identical to SEQ ID NO: 59741

SEQ ID NO: 167650 - RNA, 64 nt, hsa; identical to SEQ ID NO: 59742

SEQ ID NO: 167651 - RNA, 64 nt, hsa; identical to SEQ ID NO: 59743

SEQ ID NO: 167652 - RNA, 64 nt, hsa; identical to SEQ ID NO: 59744

SEQ ID NO: 167653 - RNA, 64 nt, hsa; identical to SEQ ID NO: 59745

SEQ ID NO: 167654 - RNA, 64 nt, hsa; identical to SEQ ID NO: 59746

SEQ ID NO: 167655 - RNA, 64 nt, hsa; identical to SEQ ID NO: 59747

SEQ ID NO: 167656 - RNA, 64 nt, hsa; identical to SEQ ID NO: 59748

SEQ ID NO: 167657 - RNA, 64 nt, hsa; identical to SEQ ID NO: 59749

SEQ ID NO: 167658 - RNA, 64 nt, hsa; identical to SEQ ID NO: 59750

SEQ ID NO: 167659 - RNA, 64 nt, hsa; identical to SEQ ID NO: 59751

SEQ ID NO: 167660 - RNA, 64 nt, hsa; identical to SEQ ID NO: 59752

SEQ ID NO: 167661 - RNA, 64 nt, hsa; identical to SEQ ID NO: 59753

SEQ ID NO: 167662 - RNA, 64 nt, hsa; identical to SEQ ID NO: 59754

SEQ ID NO: 167663 - RNA, 64 nt, hsa; identical to SEQ ID NO: 59755

SEQ ID NO: 167664 - RNA, 64 nt, hsa; identical to SEQ ID NO: 59756

SEQ ID NO: 167665 - RNA, 64 nt, hsa; identical to SEQ ID NO: 59757

SEQ ID NO: 167666 - RNA, 64 nt, hsa; identical to SEQ ID NO: 59758

SEQ ID NO: 167667 - RNA, 64 nt, hsa; identical to SEQ ID NO: 59759

SEQ ID NO: 167668 - RNA, 64 nt, hsa; identical to SEQ ID NO: 59760

SEQ ID NO: 167669 - RNA, 64 nt, hsa; identical to SEQ ID NO: 59761

SEQ ID NO: 167670 - RNA, 64 nt, hsa; identical to SEQ ID NO: 59762

SEQ ID NO: 167671 - RNA, 64 nt, hsa; identical to SEQ ID NO: 59763

SEQ ID NO: 167672 - RNA, 64 nt, hsa; identical to SEQ ID NO: 59764

SEQ ID NO: 167673 - RNA, 64 nt, hsa; identical to SEQ ID NO: 59765

SEQ ID NO: 167674 - RNA, 64 nt, hsa; identical to SEQ ID NO: 59766

SEQ ID NO: 167675 - RNA, 64 nt, hsa; identical to SEQ ID NO: 59767

SEQ ID NO: 167676 - RNA, 64 nt, hsa; identical to SEQ ID NO: 59768

SEQ ID NO: 167677 - RNA, 64 nt, hsa; identical to SEQ ID NO: 59769

SEQ ID NO: 167678 - RNA, 64 nt, hsa; identical to SEQ ID NO: 59770

SEQ ID NO: 167679 - RNA, 64 nt, hsa; identical to SEQ ID NO: 59771

SEQ ID NO: 167680 - RNA, 64 nt, hsa; identical to SEQ ID NO: 59772

SEQ ID NO: 167681 - RNA, 64 nt, hsa; identical to SEQ ID NO: 59773

SEQ ID NO: 167682 - RNA, 64 nt, hsa; identical to SEQ ID NO: 59774

SEQ ID NO: 167683 - RNA, 64 nt, hsa; identical to SEQ ID NO: 59775

SEQ ID NO: 167684 - RNA, 64 nt, hsa; identical to SEQ ID NO: 59776

SEQ ID NO: 167685 - RNA, 64 nt, hsa; identical to SEQ ID NO: 59777

SEQ ID NO: 167686 - RNA, 64 nt, hsa; identical to SEQ ID NO: 59778

SEQ ID NO: 167687 - RNA, 64 nt, hsa; identical to SEQ ID NO: 59779

SEQ ID NO: 167688 - RNA, 64 nt, hsa; identical to SEQ ID NO: 59780

SEQ ID NO: 167689 - RNA, 64 nt, hsa; identical to SEQ ID NO: 59781

SEQ ID NO: 167690 - RNA, 64 nt, hsa; identical to SEQ ID NO: 59782

SEQ ID NO: 167691 - RNA, 64 nt, hsa; identical to SEQ ID NO: 59783

SEQ ID NO: 167692 - RNA, 64 nt, hsa; identical to SEQ ID NO: 59784

SEQ ID NO: 167693 - RNA, 64 nt, hsa; identical to SEQ ID NO: 59785

SEQ ID NO: 167694 - RNA, 64 nt, hsa; identical to SEQ ID NO: 59786

SEQ ID NO: 167695 - RNA, 64 nt, hsa; identical to SEQ ID NO: 59787

SEQ ID NO: 167696 - RNA, 64 nt, hsa; identical to SEQ ID NO: 59788

SEQ ID NO: 167697 - RNA, 64 nt, hsa; identical to SEQ ID NO: 59789

SEQ ID NO: 167698 - RNA, 64 nt, hsa; identical to SEQ ID NO: 59790

SEQ ID NO: 167699 - RNA, 64 nt, hsa; identical to SEQ ID NO: 59791

SEQ ID NO: 167700 - RNA, 64 nt, hsa; identical to SEQ ID NO: 59792

SEQ ID NO: 167701 - RNA, 64 nt, hsa; identical to SEQ ID NO: 59793

SEQ ID NO: 167702 - RNA, 64 nt, hsa; identical to SEQ ID NO: 59794

SEQ ID NO: 167703 - RNA, 64 nt, hsa; identical to SEQ ID NO: 59795

SEQ ID NO: 167704 - RNA, 64 nt, hsa; identical to SEQ ID NO: 59796

SEQ ID NO: 167705 - RNA, 64 nt, hsa; identical to SEQ ID NO: 59797

SEQ ID NO: 167706 - RNA, 64 nt, hsa; identical to SEQ ID NO: 59798

SEQ ID NO: 167707 - RNA, 64 nt, hsa; identical to SEQ ID NO: 59799

SEQ ID NO: 167708 - RNA, 64 nt, hsa; identical to SEQ ID NO: 59800

SEQ ID NO: 167709 - RNA, 64 nt, hsa; identical to SEQ ID NO: 59801

SEQ ID NO: 167710 - RNA, 64 nt, hsa; identical to SEQ ID NO: 59802

SEQ ID NO: 167711 - RNA, 64 nt, hsa; identical to SEQ ID NO: 59803

SEQ ID NO: 167712 - RNA, 64 nt, hsa; identical to SEQ ID NO: 59804

SEQ ID NO: 167713 - RNA, 64 nt, hsa; identical to SEQ ID NO: 59805

SEQ ID NO: 167714 - RNA, 64 nt, hsa; identical to SEQ ID NO: 59806

SEQ ID NO: 167715 - RNA, 64 nt, hsa; identical to SEQ ID NO: 59807

SEQ ID NO: 167716 - RNA, 64 nt, hsa; identical to SEQ ID NO: 59808

SEQ ID NO: 167717 - RNA, 64 nt, hsa; identical to SEQ ID NO: 59809

SEQ ID NO: 167718 - RNA, 64 nt, hsa; identical to SEQ ID NO: 59810

SEQ ID NO: 167719 - RNA, 64 nt, hsa; identical to SEQ ID NO: 59811

SEQ ID NO: 167720 - RNA, 64 nt, hsa; identical to SEQ ID NO: 59812

SEQ ID NO: 167721 - RNA, 64 nt, hsa; identical to SEQ ID NO: 59813

SEQ ID NO: 167722 - RNA, 64 nt, hsa; identical to SEQ ID NO: 59814

SEQ ID NO: 167723 - RNA, 64 nt, hsa; identical to SEQ ID NO: 59815

SEQ ID NO: 167724 - RNA, 64 nt, hsa; identical to SEQ ID NO: 59816

SEQ ID NO: 167725 - RNA, 64 nt, hsa; identical to SEQ ID NO: 59817

SEQ ID NO: 167726 - RNA, 64 nt, hsa; identical to SEQ ID NO: 59818

SEQ ID NO: 167727 - RNA, 64 nt, hsa
cauuuauauacaaacaaauagguuuauucauucauuaaacuacuuuggaagcgucaguggauau

SEQ ID NO: 167728 - RNA, 64 nt, hsa
ggauauauuugaaagugguaauccugaaucucuuuuaaacuauuauaugauucauaaugguucu

SEQ ID NO: 167729 - RNA, 64 nt, hsa
ucgagacaugguuuuuggcaaaaacuccaugacuuuaaacuagcucuuuuacuacugaccuuuc

SEQ ID NO: 167730 - RNA, 64 nt, hsa
ggaauuuaaucuggaagagaacauaugccaauuuuuaaacuaugacagcuuuuuuuuuucucuu

SEQ ID NO: 167731 - RNA, 64 nt, hsa
agaagcauaauagaaacauuuuucuguacagguauuaaacuacuggucuguuugacagacuuug

SEQ ID NO: 167732 - RNA, 64 nt, hsa
ggcuauuuuuauauccuugguaugaaauauguauuuaaacuauuuaaauauuuauaaagaaaug

SEQ ID NO: 167733 - RNA, 64 nt, hsa
guuaugccacagaaauuccuuuaaaauaaaauucuuaaacuaaacauaccuaaaggcaucagac

SEQ ID NO: 167734 - RNA, 55 nt, hsa
uuauaaaagaaucuuuaugaagaaauuaaacuagguugggcaugguggcucacac

SEQ ID NO: 167735 - RNA, 64 nt, hsa
aagaaugacauugaaacauuuguauugucucuucuuaaacuaucuuauugacuuauuauuuaag

SEQ ID NO: 167736 - RNA, 64 nt, hsa
aaauucauuucagcauguuauuauuggaaauuauuuaaacuaauuuagauaacuauaagauacu

SEQ ID NO: 167737 - RNA, 64 nt, hsa
guguugugaaaauuuaaucuuaaaaauuaaauuuuuaaacuaugugggucugugaauuucuuua

SEQ ID NO: 167738 - RNA, 64 nt, hsa
agcuggguuugauucaaagcccuuacuuuccuaauuaaacuaugaugcguauuuauuuuucugc

SEQ ID NO: 167739 - RNA, 64 nt, hsa
cacuuuuacccucaaguccgauuugucugugauuuuaaacuaacuguguauguauugauguuug

SEQ ID NO: 167740 - RNA, 64 nt, hsa
aaaagucagccuaaagaaguuaugguaucauauguuaaacuaagcuuucaaaaaccuuagugaa

SEQ ID NO: 167741 - RNA, 64 nt, hsa
gcaacagaagcaaaaauucacaaaugggaucuaauuaaacuaaagagcugcacagcaaaagaaa

SEQ ID NO: 167742 - RNA, 64 nt, hsa
ggaauuaacaguauuucuuuacagaauggauuuguuaaacuagcacaguaaaaguaaagacuau

SEQ ID NO: 167743 - RNA, 64 nt, hsa
uguuacgguaugaagucuucuguauaguuuguuuuuaaacuaauauuuguuucaguauuuuguc

SEQ ID NO: 167744 - RNA, 64 nt, hsa
uugaauuucuacaaauggugaaauuuaauguuuuuuaaacuaguuuauuugccuugccauaaca

SEQ ID NO: 167745 - RNA, 64 nt, hsa
guaaaaugauguguugacuauacugauacacauauuaaacuauaccuuauaguaaaccaguauc

SEQ ID NO: 167746 - RNA, 64 nt, hsa
caucuuuuuagugauaauaaaagaaagcaugguauuaaacuaucauagaaguagacagaaaaag

SEQ ID NO: 167747 - RNA, 64 nt, hsa
uaugauguuuuuaacaauaaaauuaaaacaacuguuaaacuaaaaaccacaccguuuuccagua

SEQ ID NO: 167748 - RNA, 64 nt, hsa
uuuggcaggaauucccaagauggacauugugcuuuuaaacuagaacuuguaagacauuauguga

SEQ ID NO: 167749 - RNA, 64 nt, hsa
guaaagaaacugaacagugaaguggcuugauugcuuaaacuauugacuugguaagucuacugua

SEQ ID NO: 167750 - RNA, 64 nt, hsa; identical to SEQ ID NO: 167749

SEQ ID NO: 167751 - RNA, 64 nt, hsa
uauuauuuucacaguggaaaauuugcguauaguauuaaacuauucuuuuuucugucuaccuuua

SEQ ID NO: 167752 - RNA, 64 nt, hsa
uauuauauauaaaauaauauaccuaaguguuuuuuuaaacuaugggaguguauuauaaaaucaa

SEQ ID NO: 167753 - RNA, 64 nt, hsa
gggugacagagcaagacccugucuuaaaaaaagaggauucaacacauauuuuuauauuauguua

SEQ ID NO: 167754 - RNA, 64 nt, hsa
ccuaaggacucagauuguaucuuuguacagaagaggauucaaaacgccacguguaguggcucau

SEQ ID NO: 167755 - RNA, 64 nt, hsa
gacuuugaaacaucucucucucucauaacucccuggauucaaguagcacauugguaauagguau

SEQ ID NO: 167756 - RNA, 64 nt, hsa
caaaccuucauuccuugaaucaaggagcacuacuggauucaacugccaaaauuuuuuaaagguu

SEQ ID NO: 167757 - RNA, 64 nt, hsa
uauauucauaaguucuaaaauccuucauuaugagggauucaaaguauuuauaaaaacacugccc

SEQ ID NO: 167758 - RNA, 64 nt, hsa
aacacacauugauugagugccugcuggguacaagggauucaauuuaugccuauugauaucugcg

SEQ ID NO: 167759 - RNA, 64 nt, hsa
acccagcaucaccagcuagaaaguggcagagccaggauucaacccuggcuugucuaaccccagg

SEQ ID NO: 167760 - RNA, 64 nt, hsa
ggugauccacccaccugggccucccauagugcugggauucaauuuuuuuuuuuuuuuuuucaaa

SEQ ID NO: 167761 - RNA, 64 nt, hsa
cccauuuuacuguguuugaguuaaaaaccaaacaucccuguaauuuaauuugaagauucuuuaa

SEQ ID NO: 167762 - RNA, 64 nt, hsa
uuuuguagcucugcauauuuugcccaccuugucuucccuguaaguuuaagacguuuccaaggaa

SEQ ID NO: 167763 - RNA, 64 nt, hsa
uuggggagaggcugaaaagcacaaaagauagucuucccuguacguauuggugaagaacgugcac

SEQ ID NO: 167764 - RNA, 64 nt, hsa
accauuuggguuguuuauauguugguagaaauucucccuguaugccuagaaggaucagugaaug

SEQ ID NO: 167765 - RNA, 64 nt, hsa
gcugaguccccacaucagcuuuaguucuuggacuucccuguauuaagcaagaauuaggagaaug

SEQ ID NO: 167766 - RNA, 64 nt, hsa
uuuaauacuuucuuaauccaguuuuucaaacuucucccuguagaccguaaggaugaauuccaca

SEQ ID NO: 167767 - RNA, 64 nt, hsa
cagccagcacugcacagacagcugcgaccaggacgucagccagcacugcacagacagcugcgac

SEQ ID NO: 167768 - RNA, 64 nt, hsa
uccgguuuuccaguucuugcacaagcaaguuugugucagccacgcccuggggaggauccacugg

SEQ ID NO: 167769 - RNA, 64 nt, hsa
ugaccacagcuggcagucaagccacagcuggagggucagccaccaagcugggagcugagccaga

SEQ ID NO: 167770 - RNA, 64 nt, hsa
gauuagagugagugugcucuguugcugugaugcugucagccacagcuuccugccguagagaaug

SEQ ID NO: 167771 - RNA, 64 nt, hsa
gagaaucgcuagaaccugggaggcggagguugcagucagccaagauagcaccacugcacuccag

SEQ ID NO: 167772 - RNA, 64 nt, hsa
ugagcuaugcacucuaauguggggccacucaccagucagccaaucuuuuauuguuccuuugcua

SEQ ID NO: 167773 - RNA, 64 nt, hsa
ucuaucaaauuacugaagaucucaucaugcaugugucagccacagcgaaucccaugucuugguu

SEQ ID NO: 167774 - RNA, 64 nt, hsa
caacaaccaaaauuauuaagcucugugcgaggcugucagccacacuagguaucagggaucccga

SEQ ID NO: 167775 - RNA, 64 nt, hsa
uacauccacuccccaugccacugacauccuaugggucagccaggcuugcuuugacugaggccga

SEQ ID NO: 167776 - RNA, 64 nt, hsa
gugugaaguaccuaccuccuugccuugcuggacugucagccagucgcagggccggccacaagac

SEQ ID NO: 167777 - RNA, 64 nt, hsa; identical to SEQ ID NO: 115828

SEQ ID NO: 167778 - RNA, 64 nt, hsa; identical to SEQ ID NO: 115829

SEQ ID NO: 167779 - RNA, 64 nt, hsa; identical to SEQ ID NO: 115830

SEQ ID NO: 167780 - RNA, 64 nt, hsa; identical to SEQ ID NO: 115831

SEQ ID NO: 167781 - RNA, 64 nt, hsa; identical to SEQ ID NO: 115832

SEQ ID NO: 167782 - RNA, 64 nt, hsa; identical to SEQ ID NO: 115833

SEQ ID NO: 167783 - RNA, 64 nt, hsa; identical to SEQ ID NO: 115834

SEQ ID NO: 167784 - RNA, 64 nt, hsa; identical to SEQ ID NO: 115835

SEQ ID NO: 167785 - RNA, 64 nt, hsa; identical to SEQ ID NO: 115836

SEQ ID NO: 167786 - RNA, 64 nt, hsa; identical to SEQ ID NO: 115837

SEQ ID NO: 167787 - RNA, 64 nt, hsa; identical to SEQ ID NO: 115838

SEQ ID NO: 167788 - RNA, 64 nt, hsa; identical to SEQ ID NO: 115839

SEQ ID NO: 167789 - RNA, 64 nt, hsa; identical to SEQ ID NO: 115840

SEQ ID NO: 167790 - RNA, 64 nt, hsa; identical to SEQ ID NO: 115841

SEQ ID NO: 167791 - RNA, 64 nt, hsa; identical to SEQ ID NO: 115842

SEQ ID NO: 167792 - RNA, 64 nt, hsa; identical to SEQ ID NO: 115843

SEQ ID NO: 167793 - RNA, 64 nt, hsa; identical to SEQ ID NO: 115844

SEQ ID NO: 167794 - RNA, 64 nt, hsa; identical to SEQ ID NO: 115845

SEQ ID NO: 167795 - RNA, 64 nt, hsa; identical to SEQ ID NO: 115846

SEQ ID NO: 167796 - RNA, 64 nt, hsa; identical to SEQ ID NO: 115847

SEQ ID NO: 167797 - RNA, 64 nt, hsa; identical to SEQ ID NO: 115848

SEQ ID NO: 167798 - RNA, 64 nt, hsa; identical to SEQ ID NO: 115849

SEQ ID NO: 167799 - RNA, 64 nt, hsa; identical to SEQ ID NO: 115850

SEQ ID NO: 167800 - RNA, 64 nt, hsa; identical to SEQ ID NO: 115851

SEQ ID NO: 167801 - RNA, 64 nt, hsa; identical to SEQ ID NO: 115852

SEQ ID NO: 167802 - RNA, 61 nt, hsa
gagcgacggcugcugaaagaggcuguccaccuggcggaaccaccggagcccggaggcuugg

SEQ ID NO: 167803 - RNA, 61 nt, hsa
uuuuaaugaauaaaguuuaaucaauuaguaauggcggaaacugucgcugaagcacuuaaga

SEQ ID NO: 167804 - RNA, 61 nt, hsa
cuaaacucuuggccaaaaggcgguacucacguggcggaagggaaacugcauuaaaaaaaga

SEQ ID NO: 167805 - RNA, 61 nt, hsa
uugcagaggcguaggaaugaggcuggacagauggcggaagcagagguucccugcgaagacu

SEQ ID NO: 167806 - RNA, 61 nt, hsa
ucucuuaagcacccgguggcccuccgaggccuggcggaaugguggugcccacgggguuggg

SEQ ID NO: 167807 - RNA, 61 nt, hsa
gguccgcguggcuggggaggcuucacaaucauggcggaaggugaaaggcaugucuuacgug

SEQ ID NO: 167808 - RNA, 61 nt, hsa
augcagggauauucuugaagccacacauggcuggcggaacccagagcccccaccccagccc

SEQ ID NO: 167809 - RNA, 61 nt, hsa
uguaacguuagaacuuaggcauuuuccuguguggcggaauaagaaaggauuaaacaguuac

SEQ ID NO: 167810 - RNA, 61 nt, hsa
ccuggguguguucuggggaccugugguuugcuggcggaaacaagugaugaggcugguuagc

SEQ ID NO: 167811 - RNA, 61 nt, hsa
ugcuuuuguuucucuucuguuucugccuuauuggcggaaacauaagcgugcaugccauguu

SEQ ID NO: 167812 - RNA, 61 nt, hsa
gcauagacgccccaggauggggggcccacuguggcggaagggggucccuggaaacaacucu

SEQ ID NO: 167813 - RNA, 61 nt, hsa
auuagcuuagaauaugaagcauaucuacccauggcggaaaaugaagucagaaagauuugua

SEQ ID NO: 167814 - RNA, 61 nt, hsa
accagggcagcguucagcacacuccugggcauggcggaagcaggaagcagacuccagaggg

SEQ ID NO: 167815 - RNA, 61 nt, hsa
ggucaggaguucgagaccagccuggccaacauggcggaaccccaucuccacuaaaaguaca

SEQ ID NO: 167816 - RNA, 61 nt, hsa
ucucuuuaccgggaccuucucucaauuuucauggcggaaugucucccccagcugccacaca

SEQ ID NO: 167817 - RNA, 61 nt, hsa
gaaaacuucgauauccacccugugggcagccuggcggaaaagauccaggcccuccacuucu

SEQ ID NO: 167818 - RNA, 61 nt, hsa
gggucaggguuugagaccagccuggccaacauggcggaacccugucucuaccaaaauuaca

SEQ ID NO: 167819 - RNA, 61 nt, hsa
agagagauaaagucccugccugcaugcauucuggcggaagagacaagcaagcaaugaacaa

SEQ ID NO: 167820 - RNA, 61 nt, hsa
ucagguccccacggcuguugcucaauaaaaguggcggaauaaagugcaucccuguguucac

SEQ ID NO: 167821 - RNA, 61 nt, hsa
gcacugccccccucccuagccccuuauuugguggcggaaguggccuccaccccuucccugu

SEQ ID NO: 167822 - RNA, 61 nt, hsa
uuccuaaauugcauugaauugauaggaaggauggcggaaucuuaaagugauacaugcuaac

SEQ ID NO: 167823 - RNA, 61 nt, hsa
gugccccugagccccccgcagcggcccgagcuggcggaagccccacggcggugagguccau

SEQ ID NO: 167824 - RNA, 61 nt, hsa
gccccuugccuaaaagccuguaccucuggauuggcggaaguaaaucuggaaggauucucac

SEQ ID NO: 167825 - RNA, 55 nt, hsa
gguccaacgaagccccaugagcuccuggcggaaggaacgaggcgccacaccccug

SEQ ID NO: 167826 - RNA, 61 nt, hsa
gcccucccuuggaucuccauguuuuuccagauggcggaagagcaugugccacccccuuucc

SEQ ID NO: 167827 - RNA, 61 nt, hsa
cugguucugagcgucaacucuccagcugugauggcggaacugacugcuugcugccuuuaau

SEQ ID NO: 167828 - RNA, 61 nt, hsa
acccacccugauacgugcaaucauguaguuuuggcggaaauuuccccaucauucuaggaug

SEQ ID NO: 167829 - RNA, 61 nt, hsa
uucugucugaacacaaagccuguucuaguccuggcggaacacacugggggugggggcgggg

SEQ ID NO: 167830 - RNA, 61 nt, hsa
gaggagggcgcauguguguaucacccucagcuggcggaaccuggcugcgaacugugcaguu

SEQ ID NO: 167831 - RNA, 61 nt, hsa
cgcuucuauuuugguuacuacgguaggugccuggcggaagggagugggcggagauauguaa

SEQ ID NO: 167832 - RNA, 61 nt, hsa
ugauuugugaagaauuuguacuuugauauuguggcggaaagucuagacugaguguguaugc

SEQ ID NO: 167833 - RNA, 61 nt, hsa
gggguccaggugggccacacaggggccaggauggcggaagauacggguggggagggaagau

SEQ ID NO: 167834 - RNA, 61 nt, hsa
cuugauggaauuauaucacugccagugccuguggcggaagccaucuuauugcuaccagcug

SEQ ID NO: 167835 - RNA, 61 nt, hsa
uugagcucacguggcggccaugcaugguuuguggcggaagacggggcccagcggcuccccc

SEQ ID NO: 167836 - RNA, 61 nt, hsa
gagaggggcgcagcuaagacugggggcaggauggcggaaaggaaggggcgugguggcuaga

SEQ ID NO: 167837 - RNA, 61 nt, hsa
acagugcccgccagggaccauguauguaucauggcggaagaguuggcccugaccuggaaua

SEQ ID NO: 167838 - RNA, 61 nt, hsa
cacuuugagcugagacuugaaaacgaugcuguggcggaagagcauguggggcuugguggag

SEQ ID NO: 167839 - RNA, 61 nt, hsa
cgcagagccccagcagguggugcacgacuguuggcggaaggaacgcguguucauccucagu

SEQ ID NO: 167840 - RNA, 61 nt, hsa
ccucucugggugguuuggggcuggugcugccuggcggaaggacagugagggcggcccuagc

SEQ ID NO: 167841 - RNA, 61 nt, hsa
ucagggugucccagaccccgacaccggccaguggcggaagugaccgcaccucacacuccuu

SEQ ID NO: 167842 - RNA, 61 nt, hsa
gugagcagggccguccgggcuuccuguggauuggcggaauguuuagaagcagaacaagcca

SEQ ID NO: 167843 - RNA, 61 nt, hsa
ccuagagcugugaugcugagcaaggugccuguggcggaaggaacugcccaguccucccugg

SEQ ID NO: 167844 - RNA, 61 nt, hsa
ccccguccuaggugccgaccaacccccaggauggcggaagcucaccaggccguggccuucc

SEQ ID NO: 167845 - RNA, 61 nt, hsa
gccaacggccccagcuucucagcucgcuggauggcggaagcugcuacucgugagcgccagu

SEQ ID NO: 167846 - RNA, 64 nt, hsa
ggugucagguccccucauugcucuucucagguggccacacuaugucaagaagccucuccacacu

SEQ ID NO: 167847 - RNA, 64 nt, hsa
aaacaccagacacuucuucugccccaagcacaccccacacuaauuucugcugcagcaucacgau

SEQ ID NO: 167848 - RNA, 64 nt, hsa
caugcaagauuguacuuauugggcuucagaauauccacacuagugaaagucuucugaguacagc

SEQ ID NO: 167849 - RNA, 64 nt, hsa
uacagcaaaugugugacauuauuuugcuacuacuccacacuacuuagacaucauguaguucaca

SEQ ID NO: 167850 - RNA, 64 nt, hsa
uauuuguaguggauuuccucuggagggcauguacccacacuaaauaccaacugcucuuccucag

SEQ ID NO: 167851 - RNA, 64 nt, hsa
uuucaauugcuuaguguuucuaaucauacuuaauccacacuaaugugcgcaauuauaauaaaug

SEQ ID NO: 167852 - RNA, 64 nt, hsa
caccaauccccuacuguuaaucagagaugucccacuggauaaaaaacauauaaauguaagaaau

SEQ ID NO: 167853 - RNA, 64 nt, hsa
aauagaacauguuuuaagaaguggcuauauagcucuggauaaaacgaacaaaagaauuagaauu

SEQ ID NO: 167854 - RNA, 64 nt, hsa
gaagaccuugccagaguucaucaaggauggcuccaguacguacagcaagauuccugcccacagg

SEQ ID NO: 167855 - RNA, 64 nt, hsa
augaucgaucaucuauagcaaauaggcuauguugaguacguaggcugugggaagaugaagaugg

SEQ ID NO: 167856 - RNA, 64 nt, hsa
uagggggucuuuagagugaaaugaguugcacuaaaguacguaguugaggcuccuuuuuucuuuc

SEQ ID NO: 167857 - RNA, 64 nt, hsa
uauaucuaauuacaggagaauuuacaacaucucaaguacguaaauuaaguugucauugagugaa

SEQ ID NO: 167858 - RNA, 64 nt, hsa
aguugagcaagcaauuccuuuauuuaaaaaaaaaaguacguauuuagauaaucauacuuccucu

SEQ ID NO: 167859 - RNA, 63 nt, hsa
agaggaaaaguagaacuuaaaacuccaaacuagaguacguaacauugaaaaaugaggcauaaa

SEQ ID NO: 167860 - RNA, 64 nt, hsa
uaaaauaauuugcugucaauuguacauuugcaugaguacguauguuuggcucauuacugguuua

SEQ ID NO: 167861 - RNA, 64 nt, hsa
uucugauuuuuauuuuugagguuuugucaacuggaguacguagaggaacuuuauuuacaguacu

SEQ ID NO: 167862 - RNA, 64 nt, hsa
ugugccaaauaauuacuuuuuauuuauuuuauuuaguacguaauuuugaaguacauuuuuuccu

SEQ ID NO: 167863 - RNA, 64 nt, hsa
uuaccuugaguuuagauauccuaaaaaauucuguaguacguaguuuugucuuaccuguuaacuu

SEQ ID NO: 167864 - RNA, 64 nt, hsa
aucuacuguauaggcucacguacuaauaauacuuaguacguaggcucacuccuguccuuuguca

SEQ ID NO: 167865 - RNA, 64 nt, hsa
uguuucacguauguggaugccaguuaauuaaaugaguacguaaauaaauuaauuaaaacacaua

SEQ ID NO: 167866 - RNA, 64 nt, hsa
uuguacuagugucacagcauaaaaucauauuacaaguacguaaggauucagggucucuugauag

SEQ ID NO: 167867 - RNA, 64 nt, hsa
auuuugggacauuugcauucaauuuacagguaccaguacguacauauuuuaauagaaagauaca

SEQ ID NO: 167868 - RNA, 64 nt, hsa
uucaaaagcuuguguguugacccuuuguagccuaaguacguaaacaaauuaauguuaucuaagu

SEQ ID NO: 167869 - RNA, 64 nt, hsa
uaucugcucagauuuuacucaacauuagagaguuaguacguaauaaaagcauuauaaaugcaau

SEQ ID NO: 167870 - RNA, 64 nt, hsa
gaacucauuugcucacuccuugacagcaaagcccaguacguacaauuguguugggugugggugg

SEQ ID NO: 167871 - RNA, 61 nt, hsa
aggacagcaagaagaacugaggccugucuggaguacguagaccagugucgucgugagggug

SEQ ID NO: 167872 - RNA, 64 nt, hsa
uuucuccucuccuucccauggccccuguuguugaaguacguaggaaacugaauacauaacugca

SEQ ID NO: 167873 - RNA, 64 nt, hsa
auaaauacuaugcaaaccaauagaaacauuuagcaguacguacagagccugacagcgcagcucc

SEQ ID NO: 167874 - RNA, 64 nt, hsa
aagguuuacgugucucaaagcacacugucuucccaguacguaaguuaaaaaauaccaguucacc

SEQ ID NO: 167875 - RNA, 64 nt, hsa
ccccuuguguuuggaauuauaaaauauagguaaaaguacguaauuaaauaauguuuuugguauu

SEQ ID NO: 167876 - RNA, 64 nt, hsa
uacguugguuuuccuugucccuuugcaccuugacaguacguaguauacauugugguuuaugcag

SEQ ID NO: 167877 - RNA, 64 nt, hsa
uaaagcagaaaaacuuuuaaccagcaacauuucaaguacguagugugaucaaacaugaucaucc

SEQ ID NO: 167878 - RNA, 64 nt, hsa
ggaccagguaaauaauuucauagaaguucaguauaguacguaauucuuguaagaguaucguaug

SEQ ID NO: 167879 - RNA, 64 nt, hsa
gcuagaaauucaacugaagaaaaaaagcaagucaaguacguauucagcauuaaagaugaaucuc

SEQ ID NO: 167880 - RNA, 64 nt, hsa
aguuaucuuuaaguuuaugccaucuucuuaaauaaguacguaauguuccaaucuaaauaaaaaa

SEQ ID NO: 167881 - RNA, 64 nt, hsa
cagugucugucagaacuuggcauacuuucuccauaguacguagaccuucuaauacucugcuaaa

SEQ ID NO: 167882 - RNA, 64 nt, hsa
cuuuucauaauaaucaugaauacuuuuccaggucaguacguaaagauguaacccauucuuugua

SEQ ID NO: 167883 - RNA, 64 nt, hsa
ccuguuguguggaacacuucacauauuggcgcacaguacguaaggaggucucaugugcuguagg

SEQ ID NO: 167884 - RNA, 64 nt, hsa
cuauagaacauuaaguugaagaauggaaauuaagaguacguauucaugguuuauauuucuuauu

SEQ ID NO: 167885 - RNA, 64 nt, hsa
ugcuuuccugucuguauuugaugcaggauuaaacacuucccagagaggauucuagucugguaaa

SEQ ID NO: 167886 - RNA, 64 nt, hsa
auuugagcccagcaccuaaaaguacaggaauuucacuucccaccaggacuugagcacauaacuc

SEQ ID NO: 167887 - RNA, 64 nt, hsa
ggcucugaggcugcagggcuggaaguccuugcccacuucccacucuccugccccaaucuaucua

SEQ ID NO: 167888 - RNA, 64 nt, hsa
ccacuucccacucuccugccccaaucuaucuaguacuucccaggcaaauaggccccuuugaggc

SEQ ID NO: 167889 - RNA, 64 nt, hsa
ugauuuaaagagaucuguguacuguuuacuucccacuucccagaaucccuuguaucuccuuucu

SEQ ID NO: 167890 - RNA, 64 nt, hsa
augcuccugauuuaaagagaucuguguacuguuuacuucccacuucccagaaucccuuguaucu

SEQ ID NO: 167891 - RNA, 64 nt, hsa
cucauuccacuagacugcccccugccacccuggcacuucccagggccuggcaguauggucugau

SEQ ID NO: 167892 - RNA, 64 nt, hsa
ugaugguacaugcauuuucuagaauagagcugggacuucccauguggcccacaucugaccuggc

SEQ ID NO: 167893 - RNA, 64 nt, hsa
aaacucagcuguuccagccggugccaaccugugaacuucccaccauaucccagaaucugcuauu

SEQ ID NO: 167894 - RNA, 64 nt, hsa
ccaccauaucccagaaucugcuauuccccaaaccacuucccaguuuccuuucaguaaucuuucu

SEQ ID NO: 167895 - RNA, 64 nt, hsa
uugccuaauaaauaugacauggauguucaguggaacuucccaucuauuacgccucauacugaau

SEQ ID NO: 167896 - RNA, 64 nt, hsa
cguagggaccuugauuuuggggacacacauugcaacuucccacuucugacgaaaggucuccaug

SEQ ID NO: 167897 - RNA, 64 nt, hsa
aggguugcauggcggcugggcaaaggugcuccccacuucccagauggugcggcggcuggccaga

SEQ ID NO: 167898 - RNA, 64 nt, hsa
cagauggugcggcggcuggccagaggcacucuucacuucccagacagaggggcggccgggcaga

SEQ ID NO: 167899 - RNA, 64 nt, hsa
cagacagaggggcggccgggcagaggugcuccucacuucccagagggugcaggagccagcucug

SEQ ID NO: 167900 - RNA, 64 nt, hsa
cccuccaguggucacuucccaccauugcaggcagacuucccaccauugcaggcagcugggccca

SEQ ID NO: 167901 - RNA, 64 nt, hsa
gcauugccauagaggagcccucccuccaguggucacuucccaccauugcaggcagacuucccac

SEQ ID NO: 167902 - RNA, 64 nt, hsa
uguagccuuucucaguguccguggcauuuuugugacuucccagcacuagaauaaguuuuccugc

SEQ ID NO: 167903 - RNA, 64 nt, hsa
ugagugaggcgcuuggugcccucuggacuuucccacuucccaacaugggagaauugugaacuuu

SEQ ID NO: 167904 - RNA, 64 nt, hsa
ccacccacagaccuucccuuuagcuguugacacaacuucccagcucugcaagugugcccccugg

SEQ ID NO: 167905 - RNA, 64 nt, hsa
cucugcccugcccugccuagccucugcuacucccacuucccaacuccagggaaugcauuacuuu

SEQ ID NO: 167906 - RNA, 64 nt, hsa
gucaucccugugugcugcagcaucaccacggccuacuucccaauauccacaaagcuucgccuuu

SEQ ID NO: 167907 - RNA, 64 nt, hsa
uuagcaaauggaggaaauuaagcaccgauguagcacuucccacugccuggagagaaauaaaccu

SEQ ID NO: 167908 - RNA, 64 nt, hsa
cuuuuuuucucugcauuuaaaaaaaucccccagcacuucccacagugccuauugauacuugggg

SEQ ID NO: 167909 - RNA, 64 nt, hsa
uucuuguugcuguacaaaagcaaugguugaugauacuucccacaccacaaaugggacacauggu

SEQ ID NO: 167910 - RNA, 64 nt, hsa
ucuaacuccugggcucagugauccucccguuucgacuucccaaagugcugggauuacaggugug

SEQ ID NO: 167911 - RNA, 64 nt, hsa
ucacaagcaaaaucagccagcacuuugaucacggacuucccagccucuaggacugugagcaaua

SEQ ID NO: 167912 - RNA, 64 nt, hsa
ccuaucuucucccccacgguauccuaaacuuuagacuucccacuguucugaaaggagacauugc

SEQ ID NO: 167913 - RNA, 64 nt, hsa
ggggacucaagaggaaucuguuucucugcugucaacuucccaucuggcucagcauagggucacu

SEQ ID NO: 167914 - RNA, 64 nt, hsa
agugcugggauuacaggcaugagucauugcucccagccauuagaaagauuguuaauccuaugaa

SEQ ID NO: 167915 - RNA, 64 nt, hsa
uagaugggggagaaauggguggggggagaggaacagccauuaacacaguaucauguuuaacaag

SEQ ID NO: 167916 - RNA, 64 nt, hsa
uaccaggaaagucuuauuuauuuugccugaaauuggcuuaaagaaagucucaugacgggauggg

SEQ ID NO: 167917 - RNA, 64 nt, hsa
ccuuuaccuaccaaagccacguuccacggcccgaggcuuaaacaggaccaaugagaggccacau

SEQ ID NO: 167918 - RNA, 64 nt, hsa
agcugcugugaagaagaaaaguugaauaagaguuggcuuaaauuuuaaaaaagaaaaagaaaau

SEQ ID NO: 167919 - RNA, 64 nt, hsa
aaaauaaaugaauuuucacuguuggcacauaugaggcuuaaauauaaggaacauaacacuugca

SEQ ID NO: 167920 - RNA, 64 nt, hsa
uaauacuauuuagaaauaagcuaauuggaucaguggcuuaaauaauagcugacuguguguacau

SEQ ID NO: 167921 - RNA, 64 nt, hsa
auauauucuacaguggauagaauuaggaauugauggcuuaaaaaaaaaagucuaugaagagucu

SEQ ID NO: 167922 - RNA, 64 nt, hsa
auuucaaaugaaaccagaaggugguuauguaagaggcuuaaaaugaucuuauguuuaaagagau

SEQ ID NO: 167923 - RNA, 64 nt, hsa
uuuuuaauggauugaaauuuacaguuuaguaaaaggcuuaaaauuacuuauacuuaugaaauaa

SEQ ID NO: 167924 - RNA, 64 nt, hsa
uaaacgucuuccauuugacuucucuacucggugucucagacagugucuucccagaaaaccacca

SEQ ID NO: 167925 - RNA, 64 nt, hsa
uuccccacguguaucugaacauuaagcagauuggcucagacacaaugaaaaggauaauccaaug

SEQ ID NO: 167926 - RNA, 64 nt, hsa
ucuuaaccgucacuagcccaaguguuuuguauuacucagacaccaucaugaaauaauucuguga

SEQ ID NO: 167927 - RNA, 64 nt, hsa
acacugccaggggagccucacugugaagucuaggcucagacaggcaucaacaaaccuauucacc

SEQ ID NO: 167928 - RNA, 64 nt, hsa
aggcacgcccucccccagcggcccucaggcuuuucucagacaugcgggagccaggagagcaccc

SEQ ID NO: 167929 - RNA, 64 nt, hsa
gcaccaggacgcugccuccuggucccugguuggccucagacaagcacggccucgagaaaagagc

SEQ ID NO: 167930 - RNA, 64 nt, hsa
aaacaaaaacaaaccucguaagggaaguaucacacucagacaccaccgcuuccuagagccaaau

SEQ ID NO: 167931 - RNA, 64 nt, hsa
caccaugaagaucaccagcuuggauggccgucaccucagacaucacuccagggagcacccgcag

SEQ ID NO: 167932 - RNA, 64 nt, hsa
gcgucaggugggaguacugcaaccugacgcgaugcucagacagaagggacuguggucgcuccuc

SEQ ID NO: 167933 - RNA, 64 nt, hsa
aagucagaugggaguacugcaaccugacacgaugcucagacacagaagggacugcagucgugcc

SEQ ID NO: 167934 - RNA, 64 nt, hsa
aagucaggugggaguacugcaaccugacaggaugcucagacaagaauagggcuguggccgcgcc

SEQ ID NO: 167935 - RNA, 64 nt, hsa
gcaagauggaggcagccagacaccaaacugggaacucagacacccagauucccuccauggccuc

SEQ ID NO: 167936 - RNA, 64 nt, hsa
uuucaaacuguucuuugaggaccccugagaguuucucagacacccggggugggggaagugggga

SEQ ID NO: 167937 - RNA, 64 nt, hsa
ggcaggaugcucucucuaagccagaccagagggacucagacaccaccgaucacaggcuggccca

SEQ ID NO: 167938 - RNA, 64 nt, hsa
ggcccaccugccagcagagggugugguuggaggccucagacaggucccugaaggagucugaggc

SEQ ID NO: 167939 - RNA, 64 nt, hsa
acacuucuuuucucccaucccgguugcaaucucacucagacaucacaguaccaccccaggggug

SEQ ID NO: 167940 - RNA, 64 nt, hsa
uuuuguggggugggaguggggagcaggaauugcacucagacaugacauuucaauucaucucugc

SEQ ID NO: 167941 - RNA, 64 nt, hsa
cacugauucacacccagucccugccacagaccgucucagacacgcacagugggccugcugcaug

SEQ ID NO: 167942 - RNA, 64 nt, hsa
gcaugauucacacccagucccugccacagaccgucucagacacgcacagugggccugcugcaug

SEQ ID NO: 167943 - RNA, 64 nt, hsa; identical to SEQ ID NO: 167942

SEQ ID NO: 167944 - RNA, 64 nt, hsa
uggacacacauaccuggccacgaacccacaccuccucagacacucagacaccacuccaggcuca

SEQ ID NO: 167945 - RNA, 64 nt, hsa
cauaccuggccacgaacccacaccuccucagacacucagacaccacuccaggcucauagccccg

SEQ ID NO: 167946 - RNA, 64 nt, hsa
agcagucagcuugaggaggaugaaggaaggcagccucagacaggaauuaaggcaaugcccaggc

SEQ ID NO: 167947 - RNA, 64 nt, hsa
gaggacucagaaguggccuuuccuccaaagccugcucagacacaggucuguagggccagggugu

SEQ ID NO: 167948 - RNA, 64 nt, hsa
cacuucauccugcccggaaugccagugcuccgagcucagacagaggaagcccugcagaaaguuc

SEQ ID NO: 167949 - RNA, 64 nt, hsa
uucaaggacaaccugucuuugagccagggcaggccucagacacccugccuguggccccgccucc

SEQ ID NO: 167950 - RNA, 64 nt, hsa
uuuauguaaagccuugacccaauguuuaaaaauauaauuguauuuagaucuuguuauugcucca

SEQ ID NO: 167951 - RNA, 64 nt, hsa
gcugacugacaaaacuaagcagggagaauaaagauaauuguauuuuauguuuugcacacaaacg

SEQ ID NO: 167952 - RNA, 64 nt, hsa
aauacaucucuuaguaaagugaaauauaauaauauaauuguauuuaguuacuauuguagauaac

SEQ ID NO: 167953 - RNA, 64 nt, hsa
auaauguccguccuaaugcuuuaaauauaugauuuaauuguaggaauugguuuacacagaacuu

SEQ ID NO: 167954 - RNA, 64 nt, hsa
acaguacuuuauuguacagacuguuuuacuguuuuaauuguaguucuguguacuuuuuuuggau

SEQ ID NO: 167955 - RNA, 64 nt, hsa
uuguuuuuuaaagcaagucaccuuaggguggcuuuaauuguauaagucaagcacauguaauaaa

SEQ ID NO: 167956 - RNA, 64 nt, hsa
uguguuuuuuuguuuuuaguucugcucuagaucauaauuguaaaaaauauuaagucauaaucug

SEQ ID NO: 167957 - RNA, 64 nt, hsa
uguuaaaaggcuuuuuuccccuuccuaaauguuuuaauuguaccauaguguuuugcucacugaa

SEQ ID NO: 167958 - RNA, 64 nt, hsa
aauauacaagcaagcaaaauuauuuuaaaugacuuaauuguaugcuaauacucaucugauaaua

SEQ ID NO: 167959 - RNA, 64 nt, hsa
acuugauuugaauuacguuuagacaaaaaugauuuaauuguaaauucuuaaaacuuucuaaaug

SEQ ID NO: 167960 - RNA, 64 nt, hsa
uaagaaaggaaaucugugcugcuucaguaagacuuaauuguaaaaccauauaacuugagauuua

SEQ ID NO: 167961 - RNA, 64 nt, hsa
aacuugugaacuaagaacugagaaggucaaauuuuaauuguaucaaugggcaagacuggugcug

SEQ ID NO: 167962 - RNA, 64 nt, hsa
uagucauuuaagauaaucauaaguuguaugaugauaauuguauaaaaauuuguaugaugauaau

SEQ ID NO: 167963 - RNA, 64 nt, hsa
uaugaugauaauuguauaaaaauuuguaugaugauaauuguauaauaauuauacaugaaagugc

SEQ ID NO: 167964 - RNA, 64 nt, hsa
gcacugaguuuuguaaaucaggacccuaaauguuuaauuguaaauaaguuucagauaauuauua

SEQ ID NO: 167965 - RNA, 64 nt, hsa
accuacugucuaagcaguuuuguaaauguacugguaauuguacaauacuugcauuccagaguua

SEQ ID NO: 167966 - RNA, 64 nt, hsa
gugcucuuugaugauaaaacuuguaauagagcaauaauuguaaaugguuaccauacuguaagau

SEQ ID NO: 167967 - RNA, 64 nt, hsa
uauuuuuaccauauuuuaagaacuuuaagacgauuaauuguaaauaauuuauuugauuggugca

SEQ ID NO: 167968 - RNA, 64 nt, hsa
acaaaaaaauuucacuuuugaaaugaaauuuuuauaauuguauggcaaaaggcuauguaaaaac

SEQ ID NO: 167969 - RNA, 64 nt, hsa
ucuccugcagaagucugauacaugauuuucauguuaauuguaaauguuaauucccucuugcaag

SEQ ID NO: 167970 - RNA, 64 nt, hsa
uuuaguucuaacauugaguuuggacaauuuuaucuaauuguaauucucuagggugccagagaua

SEQ ID NO: 167971 - RNA, 64 nt, hsa
ucucauugguuugcuuucccaaauccuguuugguuaauuguagccuccauacaguggggucuuc

SEQ ID NO: 167972 - RNA, 64 nt, hsa
aaaagcugauucugguuaucucuuuaaggacaauuaauuguacagacacauaauguaacauugu

SEQ ID NO: 167973 - RNA, 64 nt, hsa
agauaagaaaauacucuuaaagcugaguauuuccuaauuguauagaaucuuacagcaucuuuga

SEQ ID NO: 167974 - RNA, 64 nt, hsa
auugauuauugggcuagcuguggauagcuugcauuaauuguauauuuuggauucuguuuguguu

SEQ ID NO: 167975 - RNA, 64 nt, hsa
acaaagaagucccccauguggauauuucuuauacuaauuguaucauaaagccguuuauucuucc

SEQ ID NO: 167976 - RNA, 64 nt, hsa
uguggaaugaucauugaaauaucaaggauucuaguaauuguauuuccugaauaaauguauguuu

SEQ ID NO: 167977 - RNA, 64 nt, hsa
gagaccaaaguaguauagaaguauggacuuaauuuaauuguaaaauuauuagagguauuuguug

SEQ ID NO: 167978 - RNA, 64 nt, hsa
uauuugucgacgccaggucagucauuuuugcacuuaauuguauaugagauaacuagauguccug

SEQ ID NO: 167979 - RNA, 64 nt, hsa
ucuuaccagugguuaauaauuugaaguuugacuuuaauuguaaaagccguuaauguagaaaacu

SEQ ID NO: 167980 - RNA, 64 nt, hsa
ugaauguugaaggugcaauuaucacauuguuuauuaauuguauaacagauuauuacuagaaagg

SEQ ID NO: 167981 - RNA, 64 nt, hsa
aaaauguaaauguuuuacaaauuugaaacuuucauaauuguauuaaucagaaaacaagcacauu

SEQ ID NO: 167982 - RNA, 64 nt, hsa
gcaaagagguccucaacaggauguaaagcaaacuuaauuguaauuaauuuauucagcccauuaa

SEQ ID NO: 167983 - RNA, 64 nt, hsa
auagggaacauacauacagcuauguaacugugaauaauuguauauaucucuaguuaagaaugag

SEQ ID NO: 167984 - RNA, 64 nt, hsa
aaccugaggucuauaaacaaagucuuccuggaaguaauuguaagcauccugaaauaaaaaagca

SEQ ID NO: 167985 - RNA, 64 nt, hsa
uugaacuaguagucaguagaaaucuaagcccaccuaauuguacugaauugcaaauugauaguug

SEQ ID NO: 167986 - RNA, 64 nt, hsa
gcugggauuacaggcaugcgccaccaugcccagcuaauuguauuuuaguagauauggaguuuca

SEQ ID NO: 167987 - RNA, 64 nt, hsa
uuuguauuauugcucuuuugacuauucaguuuuuuaauuguaauauuacuucaauaucuuuucu

SEQ ID NO: 167988 - RNA, 64 nt, hsa
uguuguuuuucugucccuuuaaagucuuuacauguaauuguagcuguauaaucguuauuuuucu

SEQ ID NO: 167989 - RNA, 64 nt, hsa
guuccaauggauuauuugcuuucgguuguaaauuuaauuguacauaugguugauuuauuauuuu

SEQ ID NO: 167990 - RNA, 64 nt, hsa
acaguguuaaucuguaguugaaagaaagcuuaguagaugagagaguucuaggcuacuguggcuu

SEQ ID NO: 167991 - RNA, 64 nt, hsa
guucuaggcuacuguggcuuuuuccaguagauuuagaugagauuauguguuuugaaauguuuug

SEQ ID NO: 167992 - RNA, 64 nt, hsa
aacacaucggguguuuguuaucagaaaagagaugagaugagauaagacuuguuuauugacuagc

SEQ ID NO: 167993 - RNA, 64 nt, hsa
aauugaacacaucggguguuuguuaucagaaaagagaugagaugagauaagacuuguuuauuga

SEQ ID NO: 167994 - RNA, 64 nt, hsa
gggaaauuaagggaacagugucuguuugcauguaagaugagaugagaucaauacuacugaucca

SEQ ID NO: 167995 - RNA, 64 nt, hsa
auuaagggaacagugucuguuugcauguaagaugagaugagaucaauacuacugauccaucugu

SEQ ID NO: 167996 - RNA, 64 nt, hsa
aggacaggaguugaacaauuagguuagcagauggagaugagaggacuggguagaguaccauggc

SEQ ID NO: 167997 - RNA, 64 nt, hsa
agcagaaaauucauaaaaauguaucaucagcaggagaugagacuaugaauuggcauccagaaca

SEQ ID NO: 167998 - RNA, 64 nt, hsa
augcacacuuguuaaauaguguuaagagauguggagaugagauauaccccuuugauguagaauu

SEQ ID NO: 167999 - RNA, 64 nt, hsa
aaccaaaaauguucuucauccaggccugccguggagaugagacugaucgugggguugaccaaca

SEQ ID NO: 168000 - RNA, 64 nt, hsa
gaggagagugaugccgguaaagaaaaguugccgaagaugagacugcccacgcgcucagacauga

SEQ ID NO: 168001 - RNA, 64 nt, hsa
caacauccccugagcagugugagcucaucucaccagaugagaagaggcccugugcauuucuuuu

SEQ ID NO: 168002 - RNA, 64 nt, hsa
ugggccgauguggugugacauccccaccagccucagaugagacgggccaggacgcccagccaca

SEQ ID NO: 168003 - RNA, 64 nt, hsa
gggcacaugacauauacaugguggcagguccuagagaugagauccacauccuaaaaauaccaug

SEQ ID NO: 168004 - RNA, 64 nt, hsa
accccacgcagugucucauacaguggaauguggcagaugagacgggcuuucaggaaggaagucc

SEQ ID NO: 168005 - RNA, 64 nt, hsa
uuuagcauauuuccuuucacacuuaaaguucuuaagaugagacuguguaaaugagagaaagacu

SEQ ID NO: 168006 - RNA, 64 nt, hsa
gaggcacuagucuaaaaggcugcauugcggggagagaugagacaggcagaggagggugggguaa

SEQ ID NO: 168007 - RNA, 64 nt, hsa
aaguauacacugaaguugugucguuuuugccacuagaugagauuaaaagaagacaauuauucaa

SEQ ID NO: 168008 - RNA, 64 nt, hsa
ugggaaggcugaauugagugacuccccagaaugaagaugagaaggugaauauaaucaaugccaa

SEQ ID NO: 168009 - RNA, 64 nt, hsa
uaacugauuugcacagcugaaucaggagacacaaagaugagacuguguuugguuacauuuucca

SEQ ID NO: 168010 - RNA, 64 nt, hsa
auaugcagauuuuauucucaccugggccauuugcagaugagacuguaguuugcagaugagacug

SEQ ID NO: 168011 - RNA, 64 nt, hsa
accugggccauuugcagaugagacuguaguuugcagaugagacuguaguuugcagauggcgugg

SEQ ID NO: 168012 - RNA, 64 nt, hsa
caggaguaagggaagagguccucuggcccccugaagaugagaaucaccccucucagugcaccug

SEQ ID NO: 168013 - RNA, 64 nt, hsa
aucccaggcccugugcggagcaucgggaauacaaagaugagauaaaacauugucccugcccccg

SEQ ID NO: 168014 - RNA, 64 nt, hsa
auuccugggugagcccuugggcaggcauguuuggagaugagagaggcuucgagagggugggugc

SEQ ID NO: 168015 - RNA, 64 nt, hsa
uauuuccaguacacgucacauuauuuuaccggugagaugagaaugucacaaacauuaaaagccu

SEQ ID NO: 168016 - RNA, 64 nt, hsa
ggaggcuggaguggaaacaaagggugggcaucaaagaugagaagccaaagccccuacaacucca

SEQ ID NO: 168017 - RNA, 64 nt, hsa
ucuggauuggggauggggacaaagaaauagcaagagaugagaaacaacagaaacuuuuuucucu

SEQ ID NO: 168018 - RNA, 64 nt, hsa
ccagaugagaguacaccccaacagcacccucuccagaugagaguacaccccaacagcacccucu

SEQ ID NO: 168019 - RNA, 64 nt, hsa; identical to SEQ ID NO: 168018

SEQ ID NO: 168020 - RNA, 64 nt, hsa
uccagaugggagugcccccaacagcacccucuccagaugagaguacaccccaacagcacccucu

SEQ ID NO: 168021 - RNA, 64 nt, hsa
aucguuuugcacaaagucuugcuucgcucagaugagaugagauaugauuuccuagagauguaaa

SEQ ID NO: 168022 - RNA, 64 nt, hsa
cuuaaaucguuuugcacaaagucuugcuucgcucagaugagaugagauaugauuuccuagagau

SEQ ID NO: 168023 - RNA, 64 nt, hsa
ucaaccccaaguccuuuaugcuuugucacagugaagaugagaccucugacguccaagccuuguu

SEQ ID NO: 168024 - RNA, 64 nt, hsa
agacuccaucucaaaaaaauaauaauaaucuuaaagaugagaaaagccaccccaucuggcacca

SEQ ID NO: 168025 - RNA, 64 nt, hsa
gguugucuguuuuauuauccaggauuucauacucagaugagaauuagcaucaggaaagccugaa

SEQ ID NO: 168026 - RNA, 64 nt, hsa
cacgugaguguagucucagcuacucaggaggcugagaugagaggaucacuugagccuggggagg

SEQ ID NO: 168027 - RNA, 64 nt, hsa
guaccaacaaguuaauaacgucaccuacucuccacuaauagaugcuaugcuaagagaagugaau

SEQ ID NO: 168028 - RNA, 64 nt, hsa
ccucuguguaggugguagggagugagucaaagcacuaauagaccaggcaacuuaccacuuggag

SEQ ID NO: 168029 - RNA, 64 nt, hsa
gagugcccucuacuguccgacuccagcacugcaacagcuucaaguucaaaaccaagaggcguuu

SEQ ID NO: 168030 - RNA, 64 nt, hsa
aaugacaugagggccaaggcuugugggaaaaugacagcuucacagccccuugaggagugaccaa

SEQ ID NO: 168031 - RNA, 64 nt, hsa
ugugugugucugguguuuggaaacugggauauuucagcuucauuauuuccacuugcaggccagc

SEQ ID NO: 168032 - RNA, 64 nt, hsa
uugccuuaaguguguuguuaaaugaaaguacagacagcuucauuguuguauuguuaauaauugu

SEQ ID NO: 168033 - RNA, 64 nt, hsa
agaaagcccucccucccugaacuugcaguaaggucagcuucaggaccuguuccagugggcacug

SEQ ID NO: 168034 - RNA, 64 nt, hsa
caacuagcuccauuuacagccauuucuaaaauggcagcuucaguucuagagaagaaagaacaac

SEQ ID NO: 168035 - RNA, 64 nt, hsa
cugaggaggaggaggccgggugccuguuugguggcagcuucagccuagggauaccugaagcugu

SEQ ID NO: 168036 - RNA, 64 nt, hsa
ugcagggaaagcagcucacagacgccguuaaaaccagcuucaucuuuccuucaggaucauccuu

SEQ ID NO: 168037 - RNA, 64 nt, hsa
cgagcuggcuauggacuugggugucuggcaaacacagcuucagucucacuacuucugacacucu

SEQ ID NO: 168038 - RNA, 64 nt, hsa
gcugcagaaggacucaaccacuccccuaagacuccagcuucauagacuccucuguaucacugcc

SEQ ID NO: 168039 - RNA, 64 nt, hsa
gugaucuguauuugaugaggaggagccgaggccccagcuucauccagcuucaaccaaugccugg

SEQ ID NO: 168040 - RNA, 64 nt, hsa
uuugaugaggaggagccgaggccccagcuucauccagcuucaaccaaugccuggaccuguccac

SEQ ID NO: 168041 - RNA, 64 nt, hsa
agguggcgggcuguagcagcuucagcgagguguccagcuucaugccuauccugaaggcuguccu

SEQ ID NO: 168042 - RNA, 64 nt, hsa
gccuugcagugcaugcccagguggcgggcuguagcagcuucagcgagguguccagcuucaugcc

SEQ ID NO: 168043 - RNA, 64 nt, hsa
ugcucccccaggaguuccaggagaacucagccugcagcuucagcaccugccaccugagaagaug

SEQ ID NO: 168044 - RNA, 64 nt, hsa
cuggcuaagagugcagcagagacugaggcauagccagcuucaaaagcgaucugacaugaaaguc

SEQ ID NO: 168045 - RNA, 64 nt, hsa
aaacgagcuuguuucccugaaccucagaaauccucagcuucaaacauggggaaacaggccagag

SEQ ID NO: 168046 - RNA, 64 nt, hsa
uugggagaaugagcugcagaagaugacccgggggcagcuucaggaugaguuagagaaaggugaa

SEQ ID NO: 168047 - RNA, 64 nt, hsa
uccugacaucugcauguaccucguggaauucagccagcuucauguugcaaaucagaaagcugac

SEQ ID NO: 168048 - RNA, 64 nt, hsa
ggauuucugguuguggcccagcaauuaacaaaaacagcuucaacuguucgaauuuuaugaacca

SEQ ID NO: 168049 - RNA, 64 nt, hsa
aaaauguuuucaacucuggguccuuaccuuuuuccagcuucauauuugcaagugguaaauugga

SEQ ID NO: 168050 - RNA, 64 nt, hsa
augaccagaguuuccagaugauacacguucuuuucagcuucauuaaauaggcaacuauguuucu

SEQ ID NO: 168051 - RNA, 64 nt, hsa
cuuuacaaaauuaucuuaauaaguucuauauggucagcuucaucuuccuuuuuuuuuuuuuuga

SEQ ID NO: 168052 - RNA, 64 nt, hsa
cugggcuuacaggccugagccaccacgcucagcucagcuucacccugucugcaaagaaaaguuu

SEQ ID NO: 168053 - RNA, 64 nt, hsa
ccugcaaggcuggauuugggggccauuaucugagcagcuucaaagaccccugagcugccaacca

SEQ ID NO: 168054 - RNA, 64 nt, hsa
cuucugcaugcaguuugucuuucuguucugcaggcagcuucagaauugaggucauuugugagca

SEQ ID NO: 168055 - RNA, 64 nt, hsa
gcugcugugugccugguuuccucacauccugccucagcuucaccacccuggcuuauguggaaca

SEQ ID NO: 168056 - RNA, 64 nt, hsa
ccucugcugcagguaagucagagcagcuuuaccacagcuucaggccacgagagccccuucaccc

SEQ ID NO: 168057 - RNA, 64 nt, hsa
aaugauuuagaucuuggugcuggggcaaggccaucagcuucagagaccuugccaggcccaggcu

SEQ ID NO: 168058 - RNA, 64 nt, hsa
gggcuucggccaggggcuuuccacuugaggauagcagcuucacuaggcuggccggccagcucca

SEQ ID NO: 168059 - RNA, 64 nt, hsa
uccagcgcugccggaaccacagggaggaaggcaucagcuucagugagacagcagcagccgaugc

SEQ ID NO: 168060 - RNA, 64 nt, hsa
ccagcgccuaccaccucaacagacaccuccagcacagcuucaccaggggcuuuucaggugugcu

SEQ ID NO: 168061 - RNA, 64 nt, hsa
ucuggcuuggggaggagucccucuagguagaacacagcuucagaaacuagcuuuaagaaauaau

SEQ ID NO: 168062 - RNA, 64 nt, hsa
acugcuuauuagaggacaagaucaggacugcuuucagcuucagaacacuuuugguucagaacag

SEQ ID NO: 168063 - RNA, 64 nt, hsa
acaguccuguaucaaaacugaagaugguuugaaacagcuucacaagguaauaugucuuucaaga

SEQ ID NO: 168064 - RNA, 64 nt, hsa
uguuaauuaacacauuuagaugggccaguuaaaacagcuucauaaguuuuaaauuaauuguaaa

SEQ ID NO: 168065 - RNA, 64 nt, hsa
gggugugcgugguuccuagguccuguggacaucacagcuucaggccugaagagcagagaagccc

SEQ ID NO: 168066 - RNA, 64 nt, hsa
ccagccacccaggacucacccaugccugguguuccagcuucagggggugugcgugguuccuagg

SEQ ID NO: 168067 - RNA, 64 nt, hsa
gcguagcuauguguuggcccuggggcggcccaccccugccaagcuugccaacuucccugaggug

SEQ ID NO: 168068 - RNA, 64 nt, hsa
accuuuagugcucccugcaccaaccucccaucccccugccaagauccuugaaggacccuggaag

SEQ ID NO: 168069 - RNA, 64 nt, hsa
aacauuggagcugacuguucuugguaacugauuaccugccaauugcuaccgagaagguuggagg

SEQ ID NO: 168070 - RNA, 64 nt, hsa
uguaacagauaucagugucuccccguguccucucccugccaagucucagaagagguugggcuuc

SEQ ID NO: 168071 - RNA, 64 nt, hsa
gcucuuugucucaccagcucagccccggccacucccugccaacuccaugaccaggccaccaucu

SEQ ID NO: 168072 - RNA, 64 nt, hsa
ccccgggccaagcucugagccccuaggacucaggccugccaaugccacagccaagcccacccug

SEQ ID NO: 168073 - RNA, 64 nt, hsa
ccguuuaucuucucugaaagaacuucaaaucuuaccugccaacauauucaccauaauuuuuuua

SEQ ID NO: 168074 - RNA, 64 nt, hsa
ucuuccaggaaaaaaucccguuuggccaccgugaccugccaaaaguucucuugccccaugccug

SEQ ID NO: 168075 - RNA, 64 nt, hsa
aggagcugcaagaaguccauauuguuccuuaucaccugccaacaggaagcgaaaggggauggag

SEQ ID NO: 168076 - RNA, 64 nt, hsa
uccugcugggcccccuacccugccccaauucaauccugccaauaaauccugucuuauuuguuca

SEQ ID NO: 168077 - RNA, 64 nt, hsa
augaucauggcucacugcagccuugaccuuccagccugccaaguagcugggauuacagacaggc

SEQ ID NO: 168078 - RNA, 64 nt, hsa
ggcucgucuugagcuccuggccucaaucgaucuuccugccaagguuuuggaauuacagguguga

SEQ ID NO: 168079 - RNA, 64 nt, hsa
cugaccguuuucacuugucuccuuucugacugucccugccaaugcuccagcugucgucugacuc

SEQ ID NO: 168080 - RNA, 64 nt, hsa
gggugcgagugugagagugugagcagggcuugcuccugccaaccacaauucaaugaauccccga

SEQ ID NO: 168081 - RNA, 64 nt, hsa
cccauccccuuggccacagagccauugugauaugaggagauacuggcucuucuggaaaagagag

SEQ ID NO: 168082 - RNA, 64 nt, hsa
aaaagagaggcuuuucuucaucgagagcuaccagaggagauauuaucuguccucuguguggcac

SEQ ID NO: 168083 - RNA, 64 nt, hsa
gcgagugaaccaagaagaggaugacauuagauccaggagauacaacagaggagauaaucuccag

SEQ ID NO: 168084 - RNA, 64 nt, hsa
aagaggaugacauuagauccaggagauacaacagaggagauaaucuccaggaugccugugaaga

SEQ ID NO: 168085 - RNA, 64 nt, hsa; identical to SEQ ID NO: 168084

SEQ ID NO: 168086 - RNA, 64 nt, hsa; identical to SEQ ID NO: 168083

SEQ ID NO: 168087 - RNA, 64 nt, hsa
ccagauggggacguuugacuuggugggaggugucaggagauaggaguugguuaagaugauagau

SEQ ID NO: 168088 - RNA, 64 nt, hsa
ggccauucacaggggcccugcaaccucacgagaaaggagauaguggaagagucaggacagguug

SEQ ID NO: 168089 - RNA, 64 nt, hsa
aaaauggacuuuucccaccauucacugacucauuaggagauaggcaucuucuaaagauuuuuuu

SEQ ID NO: 168090 - RNA, 64 nt, hsa
uugugggagcuaaaaauuacaauaaucaaacuuaaggagauagagaguagaaugaugguuacca

SEQ ID NO: 168091 - RNA, 64 nt, hsa
uaaauguccuagguaauaccacuaucaggccuguaggagauacucaguggagccucugcccuuc

SEQ ID NO: 168092 - RNA, 64 nt, hsa
uacacuaacccuuaauuaucuuacuugucuaugaaggagauaaacaggguacuguacuggagaa

SEQ ID NO: 168093 - RNA, 64 nt, hsa
uucaccucugagccuaaguuuccacaucuguaaaaggagauaauaaacaccuaccuugcaguag

SEQ ID NO: 168094 - RNA, 64 nt, hsa
aguugaaucagacaugaucucuacccuccuaguaaggagauacaguggguucaugaaugacuau

SEQ ID NO: 168095 - RNA, 64 nt, hsa
aacagauggcugaggcugcagacucaggcccaggacacucaaccccaggaggggagccgcucgg

SEQ ID NO: 168096 - RNA, 64 nt, hsa
cacuucugggugcaagaggcuuucuagaccuuagacacucaagauuacggucccgggccaguaa

SEQ ID NO: 168097 - RNA, 64 nt, hsa
augcaggugaauuguggaaaaugucauguagcugacacucaagaaauagggauuccuaauaaug

SEQ ID NO: 168098 - RNA, 64 nt, hsa
gaggacacccacgaauggcaaaucuccacgcuagacacucaauacagguaaauaggccaccagu

SEQ ID NO: 168099 - RNA, 64 nt, hsa
cugaagaugaauuuuauuuuuaaaaaauacaugcacacucaaaacuuuuagcuuugaucacaag

SEQ ID NO: 168100 - RNA, 64 nt, hsa
gguaugcguaaguguguaugcuuguuuuaaacaaacacucaacguacauauguacauaaucuac

SEQ ID NO: 168101 - RNA, 64 nt, hsa
uuuuagcaucucuggucuuaucagccaugcuaaaucacuuuaauuagccuuagugauucuaugg

SEQ ID NO: 168102 - RNA, 64 nt, hsa
uaagagaauccaguugagaaaacaaacuugcuaaucacuuuaccaauguuaucaaaauuacuuu

SEQ ID NO: 168103 - RNA, 64 nt, hsa
caggucaccaagcaguggccuuuuucugagaugcucacuuuauuaucccuauuuuuaaaguaca

SEQ ID NO: 168104 - RNA, 64 nt, hsa
acuuagaaacggaaauggaauccugcucacaaaaucacuuuaagaucuuuucgaagcuguuaau

SEQ ID NO: 168105 - RNA, 64 nt, hsa
auaaaucuguauucagauuucauucuuuguuagcucacuuuauaauuuguauuuuuuuacugua

SEQ ID NO: 168106 - RNA, 64 nt, hsa
uuugauaguaaaggguuuuguuucuugaauaucuucacuuuaaacaaaaaaaaaaaacaacuuu

SEQ ID NO: 168107 - RNA, 64 nt, hsa
agaaauuuuaaacuggugauuuugguugcacugcucacuuuaagaguuaacaugcucacuuguu

SEQ ID NO: 168108 - RNA, 64 nt, hsa
uuggcucuaauaugcuacaacuguaggccaauuaucacuuuaccaauuaagaguuaggccagau

SEQ ID NO: 168109 - RNA, 64 nt, hsa
aggccccguuccugggaggggcaccccucaacugucacuuuauggacugucugugcaauuacgu

SEQ ID NO: 168110 - RNA, 64 nt, hsa
gaggcccugggggacccucugaagcauuucugccucacuuuaugucaucugcuucuccccuguu

SEQ ID NO: 168111 - RNA, 64 nt, hsa
ccacaauuaauauauucaauuucccaucaguauaucacuuuaaauuuuauguuuuucuaaggaa

SEQ ID NO: 168112 - RNA, 64 nt, hsa
ucugaagauguggauacagaauuagucacucuugucacuuuauuuauuuauugguuuuuuuuua

SEQ ID NO: 168113 - RNA, 64 nt, hsa
ccuugaauauaaacagguuauaauacuacccuguucacuuuacuaaauauaaguacaguaauga

SEQ ID NO: 168114 - RNA, 64 nt, hsa
ucagucuacuuacauaaacuuuaccuaauuuuuuucacuuuaacaaaaacauaacuaugcccuu

SEQ ID NO: 168115 - RNA, 64 nt, hsa
aaaacuugcuuauuugcuaaugccuaaaggggucucacuuuaccaauuguuacuuucaauguga

SEQ ID NO: 168116 - RNA, 64 nt, hsa
aaguuagaaagcauucagauuguuucuuuuaaacucacuuuaaaauuuuggcaaggaauucaug

SEQ ID NO: 168117 - RNA, 64 nt, hsa
uucugcucuguccaauuccagagcugucuggugaucacuuuaugucucacagggacccacaucc

SEQ ID NO: 168118 - RNA, 64 nt, hsa
aucaugggguggaauaaaggcugaguuuaguuuuucacuuuagcaaaggggcaauggggugccu

SEQ ID NO: 168119 - RNA, 64 nt, hsa
acuguuagucuuuugggacagaugggacagauguucacuuuaauguuuuacuugaaguuuuacu

SEQ ID NO: 168120 - RNA, 64 nt, hsa
uagagagagagauuagaaaacgacauuaggaauuucacuuuaaaaugcgcauuacaaacuucuu

SEQ ID NO: 168121 - RNA, 64 nt, hsa
ccagccccgaagucgccacguggccuggggcaggucacuuuaccucuguggaccuguuuucucu

SEQ ID NO: 168122 - RNA, 64 nt, hsa
gucccaaaccagacaccuggaugucugggugaccucacuuuaggcagcuguaacagcggcaggg

SEQ ID NO: 168123 - RNA, 64 nt, hsa
uuuaucugaguuauaucauugcauucucacaaaaaugguacauuuguuagcucaaauuuacaga

SEQ ID NO: 168124 - RNA, 64 nt, hsa
acaacccuaggagaaagguacagcuacuauucucaugguacaguggggaaaacugaggcacaga

SEQ ID NO: 168125 - RNA, 64 nt, hsa
auagucaguuuucuagaaccuacuuuuaggguaaaugguacauuauuuaauauuauauuaaacc

SEQ ID NO: 168126 - RNA, 64 nt, hsa
aaccuccuauagcguggauuguagaccaaaggaaaugguacaauuucugagaauauauguugau

SEQ ID NO: 168127 - RNA, 64 nt, hsa
gagcugucccacaucaacgcgcggcugaacaugggcauccuaggcugugaguauggacccgccg

SEQ ID NO: 168128 - RNA, 64 nt, hsa
caucucgacgccagaccagaccaaagucuucagugcauccuacgaccggucccucagggugcgu

SEQ ID NO: 168129 - RNA, 64 nt, hsa
gaacaaaagcaaagcauuaguggcuauggucuguaaaaugaaacaaaaaaacuuuauuucacua

SEQ ID NO: 168130 - RNA, 64 nt, hsa
aaaucagaaaauauaauaaaauugcacaaaaaaaaaaaugaaaaagaugcagacuggucuuuua

SEQ ID NO: 168131 - RNA, 64 nt, hsa
ucugaaugcuuuauauucuuucugcuguaaauuaaaaaugaagaaaauuuccccauacuacgug

SEQ ID NO: 168132 - RNA, 64 nt, hsa
ugcuaugugucacacuuugccaaacaggauguggaaaaugaauaagcgguuuucuuaggcacuu

SEQ ID NO: 168133 - RNA, 64 nt, hsa
guuuucuuaggcacuucuuaacagacaauuggucaaaaugaacuccauugcuuaagaaacacau

SEQ ID NO: 168134 - RNA, 64 nt, hsa
agguucuuuuuguuuacauaauacuugaaaaauaaaaaugaacaagcuaacaaacuaccaaguu

SEQ ID NO: 168135 - RNA, 64 nt, hsa
uggacuaaaagguuuuauugaaauaaagccucuuaaaaugaaaaaucauauacuuuuaacauca

SEQ ID NO: 168136 - RNA, 64 nt, hsa
gauauuuggaaauaccuggauauuugcuagaggaaaaaugaaagcaaaacuucguacacagugc

SEQ ID NO: 168137 - RNA, 64 nt, hsa
uuaaucagaaaaggacuagauuuguuuaagaagaaaaaugaaaccagacccagaucaauauuuu

SEQ ID NO: 168138 - RNA, 64 nt, hsa
ggaauuuugcugcucccuauugcuucuguuuacaaaaaugaauuuuuccugguuucccacuagg

SEQ ID NO: 168139 - RNA, 64 nt, hsa
aucucuguucuuucauacuacauuugaacagggcaaaaugaacuaacugccauguaggcuaaga

SEQ ID NO: 168140 - RNA, 64 nt, hsa
ccuuucuggcuuuuaagccaauauaaugggcugcaaaaugaagacaccagaguguaugcauaca

SEQ ID NO: 168141 - RNA, 64 nt, hsa
gcugccaugaugccuauuugguguguuucugauuaaaaugaaaucacaagcugccuuguuuagc

SEQ ID NO: 168142 - RNA, 64 nt, hsa
caagaaccauacuucgacauuuccucugccacaaaaaaugaacgcauuuuaaguuaggagucau

SEQ ID NO: 168143 - RNA, 64 nt, hsa
gcuguaaauuaagcaaacaugcuauaauaaaaacaaaaugaaggaaauaaugauuaacuggaau

SEQ ID NO: 168144 - RNA, 64 nt, hsa
uugagcuuucgauuaucaguguaguaccugacuaaaaaugaaguaauacccuuaaaccauuuau

SEQ ID NO: 168145 - RNA, 64 nt, hsa
uugauaaauugcugcgugacauauacuaaauaaaaaaaugaauauguugaucauuaggggugug

SEQ ID NO: 168146 - RNA, 64 nt, hsa
augagagaaaauguuuugaaaagaacaaaacaucaaaaugaauagaaagaaaaauuggaaggcg

SEQ ID NO: 168147 - RNA, 64 nt, hsa
gagagggaggaagaaagggagagagaagaaaagaaaaaugaagaaaaguaauuagaauauuuuc

SEQ ID NO: 168148 - RNA, 64 nt, hsa
aaucaccuggcuucuauaacaaauaaaugggaaaaaaaugaaauaaaaagaagagagggaggaa

SEQ ID NO: 168149 - RNA, 64 nt, hsa
ugagacucugucucaaaaaauaaauaaauaaaauaaaaugaaauagaucuuauuauucuguuac

SEQ ID NO: 168150 - RNA, 64 nt, hsa
cuccuaagagaaaccuucccagaccacucuuucuaaaaugaaucuucuaggcugggcauggugg

SEQ ID NO: 168151 - RNA, 64 nt, hsa
uuuuauuuuaucauccuagaaagccuugacuagaaaaaugaauaaauauugaggguuuccuguc

SEQ ID NO: 168152 - RNA, 64 nt, hsa
uuuaaaauuuguaaauuucuaaauccaaucauguaaaaugaaacuguugcuccauuggaguagu

SEQ ID NO: 168153 - RNA, 64 nt, hsa
uuagucgaaaauaaagguugauuuagaaaugaagaaaaugaauauauuucuuaauacaaaauaa

SEQ ID NO: 168154 - RNA, 64 nt, hsa
guaauuaaaaugagaaauacauaagaugauaaauaaaaugaaggugaagguauuccagaucuac

SEQ ID NO: 168155 - RNA, 64 nt, hsa
aauagcuuccaauaaguaacuuagaccaaaaggaaaaaugaagugccccaggagaagauacuuc

SEQ ID NO: 168156 - RNA, 64 nt, hsa
gcuugcccucuccaggccucagggccucuucuggaaaaugaagaaauucaacuaguagauuccu

SEQ ID NO: 168157 - RNA, 64 nt, hsa
cuucuacuugcucuuggccuugagaucguguaacaaaaugaaggagggcucucuucuuucuucc

SEQ ID NO: 168158 - RNA, 64 nt, hsa
ucaaauuguggagcaaaauaguaaauaaaauauaaaaaugaaaaugaagauacgugaaauucaa

SEQ ID NO: 168159 - RNA, 64 nt, hsa
uguggagcaaaauaguaaauaaaauauaaaaaugaaaaugaagauacgugaaauucaaauguca

SEQ ID NO: 168160 - RNA, 64 nt, hsa
caugccuuccuuucaucuugaauaacuuuguccuaaaaugaauuuuuuuuccccuugauuuaac

SEQ ID NO: 168161 - RNA, 64 nt, hsa
ccugaaacaaaaaauacauuugcugugaagauugaaaaugaacaaaguuagaaaaaaaaacagc

SEQ ID NO: 168162 - RNA, 64 nt, hsa
gcugaauaaauuuagagcuuucaaacuggaaaaaaaaaugaaacaaaacaaauacaccaagacc

SEQ ID NO: 168163 - RNA, 64 nt, hsa
aaacuugcaccucuucuucucuuagcuaagccccaaaaugaagauuuccuucagaagucuuguu

SEQ ID NO: 168164 - RNA, 64 nt, hsa
aguaaagaaauuuaaaagacacuguuuacaagaaaaaaugaauuuuguuuggacuucuuuuacu

SEQ ID NO: 168165 - RNA, 64 nt, hsa
ugaaauacuacuuaccauaugugcuugccucaguaaaaugaaccccacugggugggcagagguu

SEQ ID NO: 168166 - RNA, 64 nt, hsa
guauauuucuuuuuaaagaaucuuuuuaagauuaaaaaugaauaccuuaaaucucccaaaagag

SEQ ID NO: 168167 - RNA, 64 nt, hsa
aauagauuauucugccauuuuuuaaaggaaagggaaaaugaaaacagcaugucuuuuuaaacau

SEQ ID NO: 168168 - RNA, 64 nt, hsa
auaguuuuguauaauagcauagauuuuccuucaaaaaaugaacauuuauauaucuacaaaaaua

SEQ ID NO: 168169 - RNA, 64 nt, hsa
auaucuuuguggucacccacauugggugagacagaaaaugaaucuguucuaaaauuuguaauuu

SEQ ID NO: 168170 - RNA, 64 nt, hsa
uuuuguuaaaaauaaaguuaaaaguuaaaguuaaaaaaugaaguuaaaaguuucaucagaaacu

SEQ ID NO: 168171 - RNA, 64 nt, hsa
uguuuuggaaaugcacaguugacauguugaaauaaaaaugaauaccauuuuuaaauguuucuua

SEQ ID NO: 168172 - RNA, 64 nt, hsa
agugucuucuuuauauauuuauuuuuuauuagaaaaaaugaaguuugguuggugaugcaugaaa

SEQ ID NO: 168173 - RNA, 64 nt, hsa
ccuuauccuuucucccauaaccuuuguacacuaaaaaaugaaagaauuuagaauguauuugaug

SEQ ID NO: 168174 - RNA, 64 nt, hsa
aacuucacuucuuuguauauuauguauaaauuagaaaaugaaaaaugugugaauaacauuguau

SEQ ID NO: 168175 - RNA, 64 nt, hsa
uauguugacccacuuauguucagugcugaaaacuaaaaugaacaugcuauucugucagcugaau

SEQ ID NO: 168176 - RNA, 64 nt, hsa
uacaugguacaaaaauaagugguaagauaauuguaaaaugaaauggacagaauauucaauuuuc

SEQ ID NO: 168177 - RNA, 64 nt, hsa
auuuaaugauaaaauuuaagcuaaacacaagccaaaaaugaauagguuuuuuuaauuuuuauuu

SEQ ID NO: 168178 - RNA, 64 nt, hsa
cuaaaauaaaaugaaguggugagcuuaacccuggaaaaugaaucccucuaucucuaaagaaaau

SEQ ID NO: 168179 - RNA, 64 nt, hsa
uauaaucaagccuaaaauuguauagaccuaaaauaaaaugaaguggugagcuuaacccuggaaa

SEQ ID NO: 168180 - RNA, 64 nt, hsa
aauguuugacaaaaaugaauaugcuuuuccuuaaaaaaugaaaacuuuaauuuuuaccauccau

SEQ ID NO: 168181 - RNA, 64 nt, hsa
gcuuuuuaacccggauuacuguaaauguuugacaaaaaugaauaugcuuuuccuuaaaaaauga

SEQ ID NO: 168182 - RNA, 64 nt, hsa
gcaaaaucucaucucuacaaaaaguaaaaauuaaaaaaugaaauuaaaaauaaaauuaccuagg

SEQ ID NO: 168183 - RNA, 64 nt, hsa
uuggguaaaaucuguaauugauaauaggugggggaaaaugaauuuuguaugcugaauuucuaag

SEQ ID NO: 168184 - RNA, 64 nt, hsa
acaaccuuuugaucuuuguuggaauuuuaagggaaaaaugaacuaaacuucauauuuguugauu

SEQ ID NO: 168185 - RNA, 64 nt, hsa
gauaucauuaggaucacacagaguuaaauauagaaaaaugaaaccaucauuauauucuuucgug

SEQ ID NO: 168186 - RNA, 64 nt, hsa
gaguucuuuaaugggugaagaguuucaguuuugcaaaaugaaaaaguucuggagaucaguugug

SEQ ID NO: 168187 - RNA, 64 nt, hsa
ucaugauagaaaauuuggaaagugcaaauaagcaaaaaugaaaacaauuuuaaaaauguaaaac

SEQ ID NO: 168188 - RNA, 64 nt, hsa
aguccaccuuucuaggccuugguuccuugccugaaaaaugaaagaggcgcuggcuuuccacagu

SEQ ID NO: 168189 - RNA, 64 nt, hsa
guagcuacugggaaguuaaaaggaaggggcuuagaaaaugaaugggaccaaaggcaucacuucu

SEQ ID NO: 168190 - RNA, 64 nt, hsa
acaccagagaucagaaauucaaaaacucagaauaaaaaugaaaaagcuacaagcauauaugaga

SEQ ID NO: 168191 - RNA, 64 nt, hsa
aaaugaguaaaagguccaauuuugugaaagauugaaaaugaauugaaugccuaguagaguauag

SEQ ID NO: 168192 - RNA, 64 nt, hsa
agagcuaguauguuguaaaaccugccaccugaauaaaaugaaaaaaaaaguguuuuuuugagac

SEQ ID NO: 168193 - RNA, 64 nt, hsa
gggauuacaggcgugagccaccgugcccggcccuaaaaugaaauuauuaauguugguucugaaa

SEQ ID NO: 168194 - RNA, 64 nt, hsa
gauucagacucugacacagacaguagucaagaagaaaaugaagugacagaacauaccccuuuac

SEQ ID NO: 168195 - RNA, 64 nt, hsa
gacgacaaugaagauacugacaguagugaugcagaaaaugaaauuaaugaacaugaugucgugg

SEQ ID NO: 168196 - RNA, 64 nt, hsa
uuguuucuguuggaaacacugaagcagggacucuaaaaugaaagcaucucacauugguuuucuu

SEQ ID NO: 168197 - RNA, 64 nt, hsa
ucgaaauugccugugugcacauauuuuuagaugaaaaaugaaacuaccuuacaauauuauuuuu

SEQ ID NO: 168198 - RNA, 64 nt, hsa
ggucaaaggagugacgaaaauacaaagcaaggaaaaaaugaaauaucugguuuuugcugaaugc

SEQ ID NO: 168199 - RNA, 64 nt, hsa
ucacaaagauauucucacuuagucaacuccugucaaaaugaaggugaacuggcauggcccgauc

SEQ ID NO: 168200 - RNA, 64 nt, hsa
auuuugcuuuuacgucucaacuguguauguaaaaaaaaugaauauuuaaauuacaacccuagac

SEQ ID NO: 168201 - RNA, 64 nt, hsa
uaacuuuugaugcuuucuguuccccuaaaaccaaaaaaugaaccccuugugucguuguuaaccc

SEQ ID NO: 168202 - RNA, 64 nt, hsa
agagggauggagcuaaucuuuuugcuguugaaauaaaaugaauuuaugagaaacuuuauaucaa

SEQ ID NO: 168203 - RNA, 64 nt, hsa
uuugguuccacaucugucuggguaaaccaugaagaaaaugaagcugcugccucaaucgacccag

SEQ ID NO: 168204 - RNA, 64 nt, hsa
aaguuuuuaugugaggacuuuguaagucagcauaaaaaugaaaaguuguuucucaguuguuuuu

SEQ ID NO: 168205 - RNA, 64 nt, hsa
uugaacugcucugcauuaauuacagauuuaauauaaaaugaacugauuauauauuggaauuguu

SEQ ID NO: 168206 - RNA, 64 nt, hsa
uuuucacugaaugagcauggcagugccacucaagaaaaugaaucuccaaaguaucuucaaagaa

SEQ ID NO: 168207 - RNA, 64 nt, hsa
auauuuuuuuacauccuuugaagggagugcuucaaaaaugaaagcaucagaagauaaaauauuu

SEQ ID NO: 168208 - RNA, 64 nt, hsa
caauuuuuaaaacuuuuuuuuaauuacuguaaagaaaaugaauuuuuuccugcagcaggaaaca

SEQ ID NO: 168209 - RNA, 64 nt, hsa
gaaauguauugacugcugacuauauuuuaaaaacaaaaugaaauaauuugaguuguauuacaga

SEQ ID NO: 168210 - RNA, 64 nt, hsa
cacucacagauuagugauacguuuuauuuuuaacaaaaugaaaugauguguuaaguuuuuauuu

SEQ ID NO: 168211 - RNA, 64 nt, hsa
uguuguauuguccuacagugucauaaagaaccugaaaaugaacuuuuguuucuaaaguuggacc

SEQ ID NO: 168212 - RNA, 64 nt, hsa
uuuugagaaauuauucagaagccuuguuauuuuaaaaaugaaauauuucaaagacugaauauuu

SEQ ID NO: 168213 - RNA, 64 nt, hsa
aaugaaauauuucaaagacugaauauuuucaaagaaaaugaauaauucauugcccuugugauuu

SEQ ID NO: 168214 - RNA, 51 nt, hsa
agagucagaaagcuaaauaaaaaaaugaaacuuuuuugaguaauaaaaaug

SEQ ID NO: 168215 - RNA, 64 nt, hsa
gcuaaauaaaaaaaugaaacuuuuuugaguaauaaaaaugaaaagacgcuguauguaugacuuu

SEQ ID NO: 168216 - RNA, 64 nt, hsa
cagaggucugugcuaccucugugagguauauacuaaaaugaauguaaaauaaggaucguauucc

SEQ ID NO: 168217 - RNA, 64 nt, hsa
gggucaggcucuuaauuucacuauggugggggacaaaaugaacacuggcuuuuguucacuuugc

SEQ ID NO: 168218 - RNA, 64 nt, hsa
gcaaaaacuuggauucacaaaugucccugaacagaaaaugaagcucacuucagaacacacacuc

SEQ ID NO: 168219 - RNA, 64 nt, hsa
uaacccuaagguaaaaaugcauuugcaaagggagaaaaugaaggccaaacagaagcaggcucca

SEQ ID NO: 168220 - RNA, 64 nt, hsa
uucaugucuacagcuguuugugggauguuggaaaaaaaugaaacuucaaaauugaugaaaaacu

SEQ ID NO: 168221 - RNA, 64 nt, hsa
cuauuuaccugaagauugacuagcuacacuaaagaaaaugaacuccgccauccgaccuuccauc

SEQ ID NO: 168222 - RNA, 64 nt, hsa
uaugaauucuagaaacuaaaaucaagaauacagaaaaaugaaaauaacauuuuacuucugcgcu

SEQ ID NO: 168223 - RNA, 64 nt, hsa
uaacaggaaauuacaugguugagaggaaaugcauaaaaugaaagaugaaaaaucuauaguagca

SEQ ID NO: 168224 - RNA, 64 nt, hsa
cuacauaaaaucagaaacuucaagcucucuaaauaaaaugaaggacuauaucuagugguauuuc

SEQ ID NO: 168225 - RNA, 64 nt, hsa
aaacagagaaauaccuuuagaggugacuuuaaggaaaaugaagaaaaagaaccaaaaugacuuu

SEQ ID NO: 168226 - RNA, 64 nt, hsa
uguaucauucuuuucuaauguauaugaucuaacaaaaaugaaacaugaaaugcaguagcaacca

SEQ ID NO: 168227 - RNA, 64 nt, hsa
ugugacauguugggcagaucaagagacagcuacaaaaaugaagguuuucauaaugcaauguaac

SEQ ID NO: 168228 - RNA, 64 nt, hsa
uaaucaaucuaaauaauagacuuuuuuuacaggcaaaaugaaagaggaggaagucuggguuuua

SEQ ID NO: 168229 - RNA, 64 nt, hsa
uacucaacaaagguuugugggacaaagggugaauaaaaugaaugaauuacaaugaacaaagaaa

SEQ ID NO: 168230 - RNA, 64 nt, hsa
uguauauuaaacaccuuuaauaaauauuaugaaaaaaaugaaauauagaaaauuuagauggaca

SEQ ID NO: 168231 - RNA, 64 nt, hsa
aagucaaaaaguguaaaauggaaaauaagagaucaaaaugaauauagcauaggaauaaagauuu

SEQ ID NO: 168232 - RNA, 64 nt, hsa
auugagcagcuucuggaauauaaugugcauguccaaaaugaacucagcgcuucaaaaggacaaa

SEQ ID NO: 168233 - RNA, 64 nt, hsa
uauagugugagugaaauuugauuaaagauguuggaaaaugaaguuggauuuuuguauucaugua

SEQ ID NO: 168234 - RNA, 64 nt, hsa
gagacuuuuugaagggaaaauagagcaacagggaaaaaugaaagaaaugucuugguuacugagc

SEQ ID NO: 168235 - RNA, 64 nt, hsa
gcucuauauguaaaugauggguuuguugguauuuaaaaugaauacaacuugaauguaauuaaag

SEQ ID NO: 168236 - RNA, 64 nt, hsa
uuuuuggaagcgauaaacuuuaaauauacuuauuaaaaugaaauucuauuaaguuuuucagauc

SEQ ID NO: 168237 - RNA, 64 nt, hsa
cuguuuuuauuucuagucucuuccacuuuaaaacaaaaugaacacugcuugucuucuuccauug

SEQ ID NO: 168238 - RNA, 64 nt, hsa
uagagaucugauaacuugaauucagaauauuaagaaaaugaaguaacugauuuucuaaaaaaaa

SEQ ID NO: 168239 - RNA, 64 nt, hsa
aaaagaaauauuucucuacuacuaugcucaugacaaaaugaaacaaagcauauugugagcaaua

SEQ ID NO: 168240 - RNA, 64 nt, hsa
gccuuauaauugaaauaaaauuauaaucugccugaaaaugaauaaaaauaaaacauuuugaaau

SEQ ID NO: 168241 - RNA, 64 nt, hsa
acucucugaagaugaucauuugcccuuaaggacaaaaaugaacugaaguuucacaugagcuauu

SEQ ID NO: 168242 - RNA, 64 nt, hsa
ucaucuucuaggccaagcauuucuagcagugaugaaaaugaaucuucacaaaacacuucgagca

SEQ ID NO: 168243 - RNA, 64 nt, hsa
augaaacagaucuauaguuuugggacaaaauuauaaaaugaaauguguagguaaccuauuuaua

SEQ ID NO: 168244 - RNA, 64 nt, hsa
uuuauuaauguugggcaaaaauugauaugucaugaaaaugaaacagaucuauaguuuugggaca

SEQ ID NO: 168245 - RNA, 64 nt, hsa
guaaaaucuaaugcguauaggagacugauagcuaaaaaugaauggaacauuaauguacuuuuau

SEQ ID NO: 168246 - RNA, 64 nt, hsa
uuuaacagugaaauugugucaauauuuugcauuuaaaaugaauuuaauugaccgauauuuucug

SEQ ID NO: 168247 - RNA, 64 nt, hsa
aaauuuucucucugauuuuuacuuucauucaugaaaaaugaaaauucagaaauucuuuuuuucc

SEQ ID NO: 168248 - RNA, 64 nt, hsa
uucuugaaaguaaugagucaaaaugacacagcugaaaaugaauaagcaucugauuuuaugacug

SEQ ID NO: 168249 - RNA, 64 nt, hsa
gaauaaguuggaccaagggaagucggggacguaaaaaaugaagcaaaacaaugccagggugucu

SEQ ID NO: 168250 - RNA, 64 nt, hsa
uuuuucauaauguaaugccguauuuauuguuuuuaaaaugaaaggaauacuaauaagucuuaaa

SEQ ID NO: 168251 - RNA, 64 nt, hsa
cguggaauuguacuuguauaugauuaccuuaucuaaaaugaauaagaggugauggaccaguuua

SEQ ID NO: 168252 - RNA, 64 nt, hsa
uuuuaaaaguucugaaauuugggguugguauugcaaaaugaauugaacggauggugcuuuaaug

SEQ ID NO: 168253 - RNA, 64 nt, hsa
acagcauuugccaagucucccaauauccaauuuuaaaaugaaaugcauuuugcuagacaguuaa

SEQ ID NO: 168254 - RNA, 64 nt, hsa
gugauuuaggucaguagacugugauucuuagcaaaaaaugaacagugauaaguauacugggggc

SEQ ID NO: 168255 - RNA, 64 nt, hsa
caaaaugaaggguugugaguuuaguuucucuccuaaaaugaauguaugcccaccagagcagaca

SEQ ID NO: 168256 - RNA, 64 nt, hsa
uggaaggccuuccugguuuuaagauggaucccccaaaaugaaggguugugaguuuaguuucucu

SEQ ID NO: 168257 - RNA, 64 nt, hsa
agaaucuuuaaagaggagccuuuccagaacuaccaaaaugaagacacgcccgacucucuccauc

SEQ ID NO: 168258 - RNA, 64 nt, hsa
ccaugaagaugccauugacaagguguuucucuguaaaaugaacugcaguggguucuccaaacua

SEQ ID NO: 168259 - RNA, 64 nt, hsa
caaaagauugguccuuggugaaauaaacuuuucaaaaaugaauguucuuuucaaaaaauaaagu

SEQ ID NO: 168260 - RNA, 64 nt, hsa
aaguagaaaaaugcacuuacuaagaacaugaaaaaaaaugaaguaggaaaauaagaugaagacu

SEQ ID NO: 168261 - RNA, 64 nt, hsa
ccugggcaacauagcaacaccccccaugucuacaaaaaugaaaaaccaaaaagcaaaccaaaag

SEQ ID NO: 168262 - RNA, 64 nt, hsa
aaagagaugacaaaacuaaguucaggggccauggaaaaugaaaaaguccgcuauauugugauuu

SEQ ID NO: 168263 - RNA, 64 nt, hsa
uagcucagucccuaugagguagcuguaacccuuuaaaaugaaaugucaacuuuaagguauguuu

SEQ ID NO: 168264 - RNA, 64 nt, hsa
guuacauuaacuauuucaaaggacuacugcccuuaaaaugaaaaaaccuuucagcuauguuugu

SEQ ID NO: 168265 - RNA, 64 nt, hsa
cuuggauuaaaacgggaaucacaucuuaaagcuaaaaaugaaccugcaagccuucuaaaugagu

SEQ ID NO: 168266 - RNA, 64 nt, hsa
gacaaaaucaaauuguccuauugugacucuucuaaaaaugaagaugaagagcuauuuaaugaca

SEQ ID NO: 168267 - RNA, 64 nt, hsa
uuaagcaugaaacaaacagcagcuguuguccuuaaaaaugaauugaccuggccgggcgcggugg

SEQ ID NO: 168268 - RNA, 64 nt, hsa
uuaaagugcucauaaucacuugcaauuucauuguaaaaugaacaaauacauaaauauuuuaaga

SEQ ID NO: 168269 - RNA, 64 nt, hsa
aguauuguuuauagauaauuuaucucacaagucaaaaaugaagauuuugcagcacugaaaaucu

SEQ ID NO: 168270 - RNA, 64 nt, hsa
guaggcugaccucaacccuguaacguaacccauuaaaaugaauuucuuuuuuuuuaagacagag

SEQ ID NO: 168271 - RNA, 64 nt, hsa
ugagauuacagacgugagccacugcguccugccuaaaaugaauuuucuagaugauugaauaaca

SEQ ID NO: 168272 - RNA, 64 nt, hsa
gaaaaaagcauaugcauaaaggaauaauauugugaaaaugaaucuguuaugauaaagaaaaaau

SEQ ID NO: 168273 - RNA, 64 nt, hsa
guuuaaaauauguauuaauguguaaaucacaaguaaaaugaauucuaauguacaaguuuguuuu

SEQ ID NO: 168274 - RNA, 64 nt, hsa
uuuuaacauuaaaucguagguagggcaauguaguaaaaugaaagagaauuaagaaagguuuuga

SEQ ID NO: 168275 - RNA, 64 nt, hsa
ucacugguagguaagcaugaguuaaggaaagucaaaaaugaaaauauauuuugcuguguauaaa

SEQ ID NO: 168276 - RNA, 64 nt, hsa
uaaauauguaaauacaugcuuuaauuugcaauuuaaaaugaagggguuaaauaaguuagacauu

SEQ ID NO: 168277 - RNA, 64 nt, hsa
uaguauuugagaugaguuguugggacaugcaaauaaaaugaagaaugaacuuucgugucuuuuu

SEQ ID NO: 168278 - RNA, 64 nt, hsa
auauuaacugguauucaaaaaugaauaacagccaaaaaugaauaacagccauuugauuuauguu

SEQ ID NO: 168279 - RNA, 64 nt, hsa
caacuuugaaagcaguaauauuaacugguauucaaaaaugaauaacagccaaaaaugaauaaca

SEQ ID NO: 168280 - RNA, 64 nt, hsa
ggaaguuccgauuugaaauuguaucauuuccuucaaaaugaagggcagugcuuaguuaaauaaa

SEQ ID NO: 168281 - RNA, 64 nt, hsa
gaucaccaaacagaucuugccacuuugauuguuaaaaaugaaccacauucuagcccuggucugg

SEQ ID NO: 168282 - RNA, 64 nt, hsa
gucaaaaugcuacaauaaaacaaaaaagagaaagaaaaugaagagcauuugacucccgcacuua

SEQ ID NO: 168283 - RNA, 64 nt, hsa
gaaagaaaaugaagagcauuugacucccgcacuuaaaaugaaguacacauaaaguuuaaacugg

SEQ ID NO: 168284 - RNA, 64 nt, hsa
uuauguagaccagaagcugcaauauacaaugaugaaaaugaaacgaaaaggaaguccccccauc

SEQ ID NO: 168285 - RNA, 64 nt, hsa
guguugcauuaacuccauuuucuccagcagccauaaaaugaauggcguuucucuccauauuugc

SEQ ID NO: 168286 - RNA, 64 nt, hsa
guaaaauuagcucuuucaaaucuucuugucauguaaaaugaagcuagucuguuuuaaaauuuuu

SEQ ID NO: 168287 - RNA, 64 nt, hsa
aaaucuuauauaguacauuuuacaaaaauuauaaaaaaugaauuaguacuggcgaggacuaaau

SEQ ID NO: 168288 - RNA, 64 nt, hsa
ggcugggcaguguagaccugccaccgugugaagaaaaaugaaagcacagauagccuaagacugc

SEQ ID NO: 168289 - RNA, 64 nt, hsa
cuugcuuucucucgucuucaguuuccucaacuagaaaaugaacagcagcugaaauuauguugaa

SEQ ID NO: 168290 - RNA, 64 nt, hsa
uguuugccacuaaaaacauuuucaaaggaaaaauaaaaugaaaguacuuuuuacuuuuuaugau

SEQ ID NO: 168291 - RNA, 64 nt, hsa
uuaaguaaauugacauauaacuacuaugcuuauaaaaaugaaguaaggaaaacaaguaguccug

SEQ ID NO: 168292 - RNA, 64 nt, hsa
ucacuuuugcagauauucuucgguuugaauaauuaaaaugaaccagauaucagggugguuaauu

SEQ ID NO: 168293 - RNA, 64 nt, hsa
aauuaaaaugaaccagauaucagggugguuaauuaaaaugaaccagauaucagggugguuuaua

SEQ ID NO: 168294 - RNA, 64 nt, hsa
uuuuugagaccucuuaagaaaaaauaaaaaguaaaaaaugaaaggaaucuuuuuuagaaauaga

SEQ ID NO: 168295 - RNA, 64 nt, hsa
cugcuguauuaaugacaauuauucaugaaaauaaaaaaugaaauauuuuguauacuacuaccuu

SEQ ID NO: 168296 - RNA, 64 nt, hsa
ucaauauuaaaauaguuuuauauuugggaaggcaaaaaugaaucuauuguuuugcaauauaggu

SEQ ID NO: 168297 - RNA, 64 nt, hsa
gugaaaagcacuucguacauggugguggcaagagaaaaugaagaagaagcaaaaguggaaaccc

SEQ ID NO: 168298 - RNA, 64 nt, hsa
gcguguuucugcuagaauuaaaaaguuaaauuuaaaaaugaaaaugaaagacagcuucccagga

SEQ ID NO: 168299 - RNA, 64 nt, hsa
uucugcuagaauuaaaaaguuaaauuuaaaaaugaaaaugaaagacagcuucccaggaguuuug

SEQ ID NO: 168300 - RNA, 64 nt, hsa
cagcccccuacugagaaguuaauuaauucaguccaaaaugaaauuauagggcaguuuggugcaa

SEQ ID NO: 168301 - RNA, 64 nt, hsa
cucuauuuggaucagaacuacauuauuacaaaacaaaaugaacacuugaccaaaaaaccacauu

SEQ ID NO: 168302 - RNA, 64 nt, hsa
ugaagaggauggaaaaacugaauacaagauaccaaaaaugaaaaaaagugucccauuuuuaaua

SEQ ID NO: 168303 - RNA, 64 nt, hsa
ucuuuaauuauggucaaauauaauuuggucaccaaaaaugaaauaauaguuuaaaacaaguagc

SEQ ID NO: 168304 - RNA, 64 nt, hsa
ugugacacucugaagacaugaaaguagacaucggaaaaugaaaauauuuauuuuaaaaauugaa

SEQ ID NO: 168305 - RNA, 64 nt, hsa
cuuacaugucacauaaaagcuuuggaaacucuguaaaaugaacaauaaaauaaagcauauagcu

SEQ ID NO: 168306 - RNA, 64 nt, hsa
ggucaacaguaggacuggggcagaagcucugccuaaaaugaagugaaagcugcacuuaacccuu

SEQ ID NO: 168307 - RNA, 64 nt, hsa
agcugcacuuaacccuuugugauaaugaugacacaaaaugaauauuaauggaggauauuccucg

SEQ ID NO: 168308 - RNA, 64 nt, hsa
caucucauguuuuaucauuuggauggaguaauuuaaaaugaauuaaauuccagagaacaaugga

SEQ ID NO: 168309 - RNA, 64 nt, hsa
cuagguuauagauaaacaauuagguauaauagcaaaaaugaaaauuggaagaaugcaaaaugga

SEQ ID NO: 168310 - RNA, 64 nt, hsa
gauuuuuugcaaaguuagacaauggcacaaagucaaaaugaaaucaauguuuaguucacaagua

SEQ ID NO: 168311 - RNA, 64 nt, hsa
uuuuuuuuaaauauggcuggaaagcuuguuuugaaaaaugaagcuuauauuaauuguugcuuca

SEQ ID NO: 168312 - RNA, 64 nt, hsa
aaguaauuuaacaacagauuugcuaauuuaaaaaaaaaugaaaaaaaaaaucuuaccagcaguu

SEQ ID NO: 168313 - RNA, 64 nt, hsa
cuuuauaaauuuuuuuaaagcuacaguuuaauacaaaaugaauugcgguuuuauuacauuaaua

SEQ ID NO: 168314 - RNA, 64 nt, hsa
gucuaaaauggcuacugguauuuuaguuaauucaaaaaugaaacuuuucagugauucacuuuac

SEQ ID NO: 168315 - RNA, 64 nt, hsa
auauaaaauagguguugccuauugcugugcuuauaaaaugaaaaaggaaauugaggacacuuuu

SEQ ID NO: 168316 - RNA, 64 nt, hsa
guuuuguguauuggcuuugcuggaguaugauagcaaaaugaagacucuuuuacucagcucuggu

SEQ ID NO: 168317 - RNA, 64 nt, hsa
cuaacugcucaacaggaaaugaaccuagaaacagaaaaugaaaagguugauugaaauaaaacuu

SEQ ID NO: 168318 - RNA, 64 nt, hsa
guuuguuucucauuuucugcaaauucuuacuuugaaaaugaaucaccacauaguaugucccuuu

SEQ ID NO: 168319 - RNA, 64 nt, hsa
guguuauuacuugaauauagaauauauaguuuacaaaaugaaaauuacaauguucucaccaaau

SEQ ID NO: 168320 - RNA, 64 nt, hsa
agcuaaguuuacccaaguacuuucagcaagcagaaaaaugaaacucuuuguuuucuucuuuugu

SEQ ID NO: 168321 - RNA, 64 nt, hsa
aggaaaucuaagauaaaucacuucaaaaccaagcaaaaugaaguugaucaaaucugcuuuucaa

SEQ ID NO: 168322 - RNA, 64 nt, hsa
aggaaugagaaacaauuuugaugaauuuaagcagaaaaugaauuucugggaacuuuuuuggggg

SEQ ID NO: 168323 - RNA, 64 nt, hsa
ggacaaaccgagugcaaugaaugaugcuuuucugaaaaugaaauauaacaagugggugaaugug

SEQ ID NO: 168324 - RNA, 64 nt, hsa
uguguuucagugacugauaaacaaaaaugaagcuaaaaugaaucaacggcucauucauaguuac

SEQ ID NO: 168325 - RNA, 64 nt, hsa
ugguuuaguucuguguuucagugacugauaaacaaaaaugaagcuaaaaugaaucaacggcuca

SEQ ID NO: 168326 - RNA, 64 nt, hsa
agauaucacaccaaaagcucaggcaagaaaagcaaaaaugaacaagugggacuacauuaaaccc

SEQ ID NO: 168327 - RNA, 64 nt, hsa
ccaaaacuccugcacaacaaaggaaacgaucaccaaaaugaaaagguggacuguagauugggag

SEQ ID NO: 168328 - RNA, 64 nt, hsa
uagaucagcuuuacagauacaucgaucagaggcuaaaaugaaaccucagccuaaaacucauagg

SEQ ID NO: 168329 - RNA, 64 nt, hsa
cuuuauuuccucaaagucaagcagcuuucucuggaaaaugaaugcuaauuagugugaaccaaaa

SEQ ID NO: 168330 - RNA, 64 nt, hsa
uuguuugcaucccucccccacacccugguguuuuaaaaugaagaaaaaaaaccaucaccuuuug

SEQ ID NO: 168331 - RNA, 64 nt, hsa
caggcagggggccuuuuauaagccuuaggaaaagaaaaugaaacuauuucaucuuuggacuuuu

SEQ ID NO: 168332 - RNA, 64 nt, hsa
uuuuugaaaacacaucaguagaaaccaagauuuuaaaaugaagugucaagacaaaggcaaaacc

SEQ ID NO: 168333 - RNA, 64 nt, hsa
uuuagccauagggucuuuuauagacagggauaguaaaaugaaaauugagaaauauaagaugaaa

SEQ ID NO: 168334 - RNA, 64 nt, hsa
guguuacaagagugauuguuucuucaugccagagaaaaugaauugcaaucaucaaaugguguuu

SEQ ID NO: 168335 - RNA, 64 nt, hsa
uaauauaacauaaauuagaaaaaauaagugauucaaaaugaaaauauuuacuuuguagaauaug

SEQ ID NO: 168336 - RNA, 64 nt, hsa
auugccuaaaaugugaaagcauauuuuguauccuaaaaugaauguaugauauucuaaacaucug

SEQ ID NO: 168337 - RNA, 64 nt, hsa
aauauauuuagaagagccacgugaaacccaugacaaaaugaaugugaauauucuuucuaaaaau

SEQ ID NO: 168338 - RNA, 64 nt, hsa
cugaaagcauagauuuugaaauguuuuuuuaaugaaaaugaaggucagagagaauaauugcccu

SEQ ID NO: 168339 - RNA, 64 nt, hsa
ucuucuuagaaagaaagaaaaaguaugaauggucaaaaugaauacaucgagagagauaaauggc

SEQ ID NO: 168340 - RNA, 64 nt, hsa
aggccaccccacuuguguccacuguuuuuagaaaaaaaugaauggcuuccugccauuguggggc

SEQ ID NO: 168341 - RNA, 64 nt, hsa
gggggcuaugggaggauuauuuuaacagaucaagaaaaugaagccaaaucaagugaauuaaauu

SEQ ID NO: 168342 - RNA, 64 nt, hsa
accuagaauucuguuacugucaaaaacguuuucaaaaaugaaggcaaaauaaagacuguuucug

SEQ ID NO: 168343 - RNA, 64 nt, hsa
uauauguuuaacuggagucccagaaggagaggagaaaaugaagaggcaugaagaaguauuugaa

SEQ ID NO: 168344 - RNA, 64 nt, hsa
ugaucagaauuaaauuuguauagagcagaguuuuaaaaugaauguaaauagcacuaaacguuuu

SEQ ID NO: 168345 - RNA, 64 nt, hsa
acaauauuccauauaaauaaguuuagccuuuauaaaaaugaaguugcaggcugacauuacauuc

SEQ ID NO: 168346 - RNA, 64 nt, hsa
cagagcaucuuuguauauugcaauauacuugaaaaaaaugaauguauuuuuuucuccaaagaac

SEQ ID NO: 168347 - RNA, 64 nt, hsa
uuuguuguugcuauguacauauaaauauauauauaaaaugaacauaguucaugcuuucagauaa

SEQ ID NO: 168348 - RNA, 64 nt, hsa
aucugcuuuaguuucacauugcaguuagccccagaaaaugaaauccgugaagucacauuccaca

SEQ ID NO: 168349 - RNA, 64 nt, hsa
uauuuauaauagguauauagaacacaagggauauaaaaugaaagauuuuuacuaauauauauuu

SEQ ID NO: 168350 - RNA, 64 nt, hsa
uguauucuguauagcuuacucuaccugcagacagaaaaugaaagaaaaaaauggacuugccuag

SEQ ID NO: 168351 - RNA, 64 nt, hsa
aagucuagucauucugcaacgugacauaucccccaaaaugaaguuaccuuccaaguuggacacg

SEQ ID NO: 168352 - RNA, 64 nt, hsa
uugguuuccaauaaaaggaaccaggacuccuuagaaaaugaacugauucuagaacugggauaug

SEQ ID NO: 168353 - RNA, 64 nt, hsa
uacaagaugagccuagaguaucuugugccacagaaaaaugaaguacugaaauuaaaaaaaaaaa

SEQ ID NO: 168354 - RNA, 64 nt, hsa
aucaaauugaaucuuuuacuuaccucuugcaaaaaaaaugaaaaaugaaaaaacaaauucaaaa

SEQ ID NO: 168355 - RNA, 64 nt, hsa
ugaaucuuuuacuuaccucuugcaaaaaaaaugaaaaaugaaaaaacaaauucaaaaccuauuc

SEQ ID NO: 168356 - RNA, 64 nt, hsa
gguuucauuccuucagagcuccauuaauguaaucaaaaugaaauauagauuaguuuaaauguga

SEQ ID NO: 168357 - RNA, 64 nt, hsa
uucugccaugacauacacuuaaccaaaacuauucaaaaugaaaaccggauuucaaauaaccaga

SEQ ID NO: 168358 - RNA, 64 nt, hsa
uuaaaauggaaauaacaaagcagaauuucuucacaaaaugaaaaugaggcugcaacaacaguaa

SEQ ID NO: 168359 - RNA, 64 nt, hsa
uacugccaauuaacuaucaccauaaaaguaauaaaaaaugaaauuauuuagaacggggcaggca

SEQ ID NO: 168360 - RNA, 64 nt, hsa
cuaaaggaaugcuucagaaaaccuaaagugcuguaaaaugaaaucauucuacuuuguccuuucu

SEQ ID NO: 168361 - RNA, 64 nt, hsa
gccauuuuauuaaaauagcuuaaaaguuuguaaaaaaaugaaucuuuguaauuacuuaauaugu

SEQ ID NO: 168362 - RNA, 64 nt, hsa
ggaccgaugcagauuuuagagagugacgacauggaaaaugaauuuaaccacuuucuuauugggu

SEQ ID NO: 168363 - RNA, 64 nt, hsa
acaaauguagcaucaagccagacucacagguagcaaaaugaauuacacaccuacuuuuacugac

SEQ ID NO: 168364 - RNA, 64 nt, hsa
uuuuucuaugcauaguuaugcauuuauauucucaaaaaugaaaucauaauguacauugcuuugu

SEQ ID NO: 168365 - RNA, 64 nt, hsa
agaaaaugacuuauuuccagaagauaccgcucuaaaaaugaaauuguuaggugaaaguguuuuu

SEQ ID NO: 168366 - RNA, 64 nt, hsa
uauuacuugaaugcauccagaggauauuuaaaccaaaaugaaaaaccagaaggccauuuggugu

SEQ ID NO: 168367 - RNA, 64 nt, hsa
aauguuuauauaaauaccaaauugcagcauccccaaaaugaauaaagccuuuuuacuugugggu

SEQ ID NO: 168368 - RNA, 64 nt, hsa
gauaauaguccuuuacaaacauacaguccauaagaaaaugaauuuggcauauagaauuauuaca

SEQ ID NO: 168369 - RNA, 64 nt, hsa
uuuagggcuagcccugccuccaucucccuuggguaaaaugaagggugugggguaaaagaugcau

SEQ ID NO: 168370 - RNA, 64 nt, hsa
ccauaacugugcauagaaaaauaauuaucuguaaaaaaugaaggggauaauauaugauaaauua

SEQ ID NO: 168371 - RNA, 64 nt, hsa
agccuuaggcuuuacaggguuguaucauugacuuaaaaugaagaauuaacuuguguuacaucua

SEQ ID NO: 168372 - RNA, 64 nt, hsa
uuucaaaggaguuugugaaaaaaaauccauggugaaaaugaaacaaugacaugguuaaucugga

SEQ ID NO: 168373 - RNA, 64 nt, hsa
ggguuuuuuuguuguuguuguuccccuuacagacaaaaugaagacuaucaugugcaaucuuuua

SEQ ID NO: 168374 - RNA, 64 nt, hsa
agcauucacugcgucauuguaacaugaagggauaaaaaugaaggagaaggaggguuugggaugg

SEQ ID NO: 168375 - RNA, 64 nt, hsa
cugagcugcccuugcguucaguuggaagccacgcaaaaugaacugaaccaggagugagcuucgu

SEQ ID NO: 168376 - RNA, 64 nt, hsa
accaggagugagcuucguguacauuaucuauuagaaaaugaaguaccuucugguucagcuaguc

SEQ ID NO: 168377 - RNA, 64 nt, hsa
uuacaggugacggacgccucaagagagagaagagaaaaugaaagcagcugguuuugcagaagug

SEQ ID NO: 168378 - RNA, 64 nt, hsa
cccuggggucuuaccucacugggaauguguuuugaaaaugaauuugaagacaagccaacaaacc

SEQ ID NO: 168379 - RNA, 64 nt, hsa
uccucaagcuucucagacuucucuuauucuuuacaaaaugaaugcauuggcccugacaaaaagg

SEQ ID NO: 168380 - RNA, 64 nt, hsa
agccuuacuauucauagaagggcuagaauaggagaaaaugaaagguagugaguaauucuuugau

SEQ ID NO: 168381 - RNA, 64 nt, hsa
uuagugauguggaguuccuacaugcagugaguggaaaaugaaguucguuuucucuuaggaaaau

SEQ ID NO: 168382 - RNA, 64 nt, hsa
ggauaaucgguacaguuauucuuaaagauaauuaaaaaugaaacaaagugagugcucgucacug

SEQ ID NO: 168383 - RNA, 64 nt, hsa
cagaagcaucacuucuuggauaacuagcacuggaaaaaugaaaucaucuguguaagugaaggga

SEQ ID NO: 168384 - RNA, 64 nt, hsa
ugcccuaguugaauuaagaaacucuaaagguuauaaaaugaaaacaaaaaauaaaauauuuguu

SEQ ID NO: 168385 - RNA, 64 nt, hsa
gcacuuuucuaacuaaugagcucugugguaagaaaaaaugaacucuuucaauugagauuaaguc

SEQ ID NO: 168386 - RNA, 64 nt, hsa
guuuuuguauagacuucuuugguagucuguuucuaaaaugaaauguauuucaauaagcagugua

SEQ ID NO: 168387 - RNA, 64 nt, hsa
uucuacccugcaaaauaauccagaucugcuuucuaaaaugaaucaguuucuaaagugaaacaug

SEQ ID NO: 168388 - RNA, 64 nt, hsa
auaaacuaccucacuugccuuucuugggaaaaaaaaaaugaauggacuuuaacaauuguuguua

SEQ ID NO: 168389 - RNA, 64 nt, hsa
caauguauuauuuuuguagauagaagcuuuggagaaaaugaaugaagaucacguucagaagaau

SEQ ID NO: 168390 - RNA, 64 nt, hsa
acauaagucauguaauuuuuguugauauaucaugaaaaugaacagaauucuuuuuccauacuua

SEQ ID NO: 168391 - RNA, 64 nt, hsa
uccaauucuuuccuaaagaacauuuuuagcagcaaaaaugaaguaugacacuugcuguuuuucu

SEQ ID NO: 168392 - RNA, 64 nt, hsa
auaaaaacagguuccaaauauucacugcuuuguaaaaaugaacaaacaugagacuguaagaaac

SEQ ID NO: 168393 - RNA, 64 nt, hsa
aguauguggaguaauagggaaagaagaguuacagaaaaugaaaaagaaaaugaguuacacugag

SEQ ID NO: 168394 - RNA, 64 nt, hsa
cccauaucucucaugauugucccucuguaauuucaaaaugaaugaaauucaugugaauguaggu

SEQ ID NO: 168395 - RNA, 64 nt, hsa
ugucucugauaaaaagaaaaaaaaugaaaaaauaaaaaugaacagguauaaaaagagaauaugg

SEQ ID NO: 168396 - RNA, 64 nt, hsa
aacaaagaggccccugucucugauaaaaagaaaaaaaaugaaaaaauaaaaaugaacagguaua

SEQ ID NO: 168397 - RNA, 64 nt, hsa
gguagacauuucaaacugucacauuagggauacaaaaaugaacaggcugggagugguggcucag

SEQ ID NO: 168398 - RNA, 64 nt, hsa
uuaaaaaaguaauuuccuuaaauccagaaggcuaaaaaugaagcugaaacuuaaaguggcggug

SEQ ID NO: 168399 - RNA, 64 nt, hsa
gacacggcuccugccuucauggagcuuuuaggggaaaaugaaguggcucuugcagcuagaguug

SEQ ID NO: 168400 - RNA, 64 nt, hsa
gccucuccuuccuacaaagacuccuccaaaucuuaaaaugaagcaggaaaacgagccuaagagg

SEQ ID NO: 168401 - RNA, 64 nt, hsa
uauuuuagauauauugguucaaauaaaauacauuaaaaugaauaacacuuuuuuguuuuuaaaa

SEQ ID NO: 168402 - RNA, 64 nt, hsa
aagaucaaauuauccaugaaauuauagccaguuuaaaaugaauuauuuuaaaaaaaauuucugg

SEQ ID NO: 168403 - RNA, 64 nt, hsa
aaugaaaaccuaggaaaguagcaaauaugugagcaaaaugaaacaaauacuuguuguaaaaaug

SEQ ID NO: 168404 - RNA, 64 nt, hsa
aagugaucccagauuagauuuuugagauccaaaaaaaaugaaaaccuaggaaaguagcaaauau

SEQ ID NO: 168405 - RNA, 64 nt, hsa
gucaaauauauuucucuuucagggucaugaucaaaaaaugaaaagucugcuuaacuccaauuuc

SEQ ID NO: 168406 - RNA, 64 nt, hsa
aaaccaguuuaaugggauacaaccagcauuuuaaaaaaugaaauagaauacagcauggaaaaua

SEQ ID NO: 168407 - RNA, 64 nt, hsa
guguagcccuaccaaaaauagccaguaguaucugaaaaugaaaaauaaaugaaguaucucuagg

SEQ ID NO: 168408 - RNA, 64 nt, hsa
uaugcaaagcagcuuauauuccuuuguuucugauaaaaugaagacuuuaaaucagucaguagua

SEQ ID NO: 168409 - RNA, 64 nt, hsa
uuuucuucucuaaaacauuaguuuaauuuucuucaaaaugaaaauacugcuuuguaauuacaaa

SEQ ID NO: 168410 - RNA, 64 nt, hsa
auuaaaaugauugacauaaacucuuugugccuugaaaaugaaacaaauuauaaaaauguuuaaa

SEQ ID NO: 168411 - RNA, 64 nt, hsa
uucaaauuuucuuuagugcuuaaaauuaaguuuuaaaaugaaaucagacacugcagguuuguau

SEQ ID NO: 168412 - RNA, 64 nt, hsa
uuaaaaugaaaucagacacugcagguuuguauauaaaaugaaaagcuauacuacuuuuuacaaa

SEQ ID NO: 168413 - RNA, 64 nt, hsa
uagggauuaauguccuccauuuauaaugaagauuaaaaugaaggcuuuaaucagcauuguaaag

SEQ ID NO: 168414 - RNA, 64 nt, hsa
ucucacauagagacaugcuuauaugguuuuauuuaaaaugaaaugccaguccauuacacugaau

SEQ ID NO: 168415 - RNA, 64 nt, hsa
gugauaauauaaucucuauuuuuuuaggaaaacaaaaaugaaaaacuacuccauuugaggauug

SEQ ID NO: 168416 - RNA, 64 nt, hsa
uaggcuguaauauguguacauuguguuuaagagaaaaaugaaacccacaugccgccauuuuccu

SEQ ID NO: 168417 - RNA, 64 nt, hsa
gagaucugcccuguguuauccaguuaugagauaaaaaaugaauauaagagugcuugucauuaua

SEQ ID NO: 168418 - RNA, 64 nt, hsa
cuacggggaauucuuaaaacugugcucaacuauuaaaaugaaugagcuuucuuugugucugugu

SEQ ID NO: 168419 - RNA, 64 nt, hsa
uucuccuagaaucucaaguggaauuggaaucauaaaaaugaaugagauuugaaaacuuucacaa

SEQ ID NO: 168420 - RNA, 64 nt, hsa
uaaauguaguuaguuugauacuccuuagaauaaaaaaaugaaacaguaacaacuuuuauguaaa

SEQ ID NO: 168421 - RNA, 64 nt, hsa
auuauguaaaaagaauauaauaccuguggaaauaaaaaugaauuccaaguguauacuugcucgg

SEQ ID NO: 168422 - RNA, 64 nt, hsa
aaaaaacaaaaauaaaaagcaaaacaaaaaucccaaaaugaauuccauucacaaacagaauuuu

SEQ ID NO: 168423 - RNA, 64 nt, hsa
guguaucucacauuaaacaaaacaccuuuuuuucaaaaugaaauaccaauguaaagaucuaauu

SEQ ID NO: 168424 - RNA, 64 nt, hsa
caggggugagaauaaguauaaacauaaagcaacuaaaaugaaacauaaaaccuuuuauuuucuu

SEQ ID NO: 168425 - RNA, 64 nt, hsa
accuuuacuccaguucccaacaaguuccucaucuucaucugaggccaccucagccuggacuuug

SEQ ID NO: 168426 - RNA, 64 nt, hsa
ucagcauuaacgcaaaaauccacaguccaaagucucaucugagacaaggcaagucccuuccacc

SEQ ID NO: 168427 - RNA, 64 nt, hsa
aaccauuccucacugcucuaacaugcugaagaaaucaucugagggggagggagauggaugcuca

SEQ ID NO: 168428 - RNA, 64 nt, hsa
uuuuuuguuuaccucccuccauucauucacaugcucaucugagaagacuuaaguucuuccagcu

SEQ ID NO: 168429 - RNA, 64 nt, hsa
gguagcacaguuuaucacauagaaacuccauuaaucaucugauuuuccgaaucugaaaauugag

SEQ ID NO: 168430 - RNA, 64 nt, hsa
agucuuucacagauuuguauuaugcugaagaguuucaucugacaaucugcuucaagaaaucuca

SEQ ID NO: 168431 - RNA, 64 nt, hsa
ugcuuaaugguauugcuguugcuccuaauacuucucaucugagcugauuuauuuuucucuguua

SEQ ID NO: 168432 - RNA, 64 nt, hsa
accauacuguuagucacacacgcccacaugacaaucaucugaaaguccccaacuauacacauuc

SEQ ID NO: 168433 - RNA, 64 nt, hsa
ucagcauuaacccaaaaguccgcaguccaaaguuucaucugagacaaggcaagucccuuccacu

SEQ ID NO: 168434 - RNA, 64 nt, hsa
cccacucauucacucuuucagaacaaaaagacagucaucugauaagaguaugacauggaugaaa

SEQ ID NO: 168435 - RNA, 64 nt, hsa
gacauugauucagccuguuuggcguuucccagagucaucugauuggacaggcaugggugcaagg

SEQ ID NO: 168436 - RNA, 64 nt, hsa
ucuucucuucccugcgccugugaugcugggcacuucaucugaucgggggcguagcaucauagua

SEQ ID NO: 168437 - RNA, 64 nt, hsa
ccucucuguaugugccccgcgcauuuccuuggccucaucugagaucuggugucagaguucucug

SEQ ID NO: 168438 - RNA, 64 nt, hsa
gacuucuuauaaggaaagauguaucguaucgcagucaucugaguuaguuucuccuccaucaccu

SEQ ID NO: 168439 - RNA, 64 nt, hsa
agcgccgccuuuccauggagacucguaagcagcuucaucugacacgggcaucccuggcuugcuu

SEQ ID NO: 168440 - RNA, 64 nt, hsa
gucaccgauggcugacugaugaaauggacacgucucaucugacccacucuuccuuccacugaag

SEQ ID NO: 168441 - RNA, 64 nt, hsa
caucguugucugaaaaaacccaaccccaaaaccuucaucugauuggugagcugaagucuguccu

SEQ ID NO: 168442 - RNA, 64 nt, hsa
cagcucuauuuuuguuuucauuuucucuagacauucaucugaaaaucauuuuaugguucucaau

SEQ ID NO: 168443 - RNA, 64 nt, hsa
cacagaaugucagagcuggaagggacuauagagaucaucugaucugauccucuuguacggauga

SEQ ID NO: 168444 - RNA, 64 nt, hsa
aucgauggauguauugauaaauagauagaaccagucaucugaagcaacuuaagaauuguagccu

SEQ ID NO: 168445 - RNA, 64 nt, hsa
ugaaggaucuuugauggaggaagaagacccagacucaucugaaggaucgucagaggagggugag

SEQ ID NO: 168446 - RNA, 64 nt, hsa
ugaaggaucuucacaagaggaugaagaccuagacucaucugaaggaucuuugauggaggaagaa

SEQ ID NO: 168447 - RNA, 62 nt, hsa
uuuguaaagaaaguggcuugaaaucuuuuuuguucaaagauuaaugccaacucuuaagauua

SEQ ID NO: 168448 - RNA, 62 nt, hsa
ccucuacugagucccuuagccaagcaguuucuuucaaagaagccagcaggcgaaaagcaggg

SEQ ID NO: 168449 - RNA, 62 nt, hsa
uauuuuuauuaacuuuuuucaguuucuuuuuauucaaagaaacaaaauucaaucucugauaa

SEQ ID NO: 168450 - RNA, 62 nt, hsa
uccaagugacucuauugauguauguauguucauucaaagaaugggaaaaggauaugacauau

SEQ ID NO: 168451 - RNA, 62 nt, hsa
cauucuccuucacugguuggcaaccuugagaguucaaagaaaaucaaccucuguggugguca

SEQ ID NO: 168452 - RNA, 62 nt, hsa
uuggcagugcuuuuucuuuagcauucugucaauucaaagaagggauccucuuucaaaggcua

SEQ ID NO: 168453 - RNA, 62 nt, hsa
ccaaccaacugaaaaccugagauggagauauguucaaagaaugagauacaauuuuuuaguuu

SEQ ID NO: 168454 - RNA, 62 nt, hsa
guuugcugugcuuuucugaauuuuauguugcauucaaagacuguugucuuguucuuguggug

SEQ ID NO: 168455 - RNA, 62 nt, hsa
ggcuuucucuugaucuuugugucauuucagaauucaaagacugugcuacgggaguucugaac

SEQ ID NO: 168456 - RNA, 62 nt, hsa
gauauguugaaggguauuuguuaauuuuacuuuucaaagauacuuuaaaacaguagagcuag

SEQ ID NO: 168457 - RNA, 62 nt, hsa
cagaggaaagcuuauuuucugcauggugucuuuucaaagauagaauauuugaagcauguuuu

SEQ ID NO: 168458 - RNA, 62 nt, hsa
gggcaaagagcuacuuugaauacauaauucucuucaaagacuucagcagcaaaccaaaacag

SEQ ID NO: 168459 - RNA, 62 nt, hsa
gucucucauagaguauaaagcagcugucacacuucaaagagcagugagucuaauguagugaa

SEQ ID NO: 168460 - RNA, 62 nt, hsa
ggaagaagaggaccucaaauuacaauugcaacuucaaagacagagagccaugagacuuuccc

SEQ ID NO: 168461 - RNA, 62 nt, hsa
ucagaagccuuguuauuuuaaaaaugaaauauuucaaagacugaauauuuucaaagaaaaug

SEQ ID NO: 168462 - RNA, 62 nt, hsa
uuaaaaaugaaauauuucaaagacugaauauuuucaaagaaaaugaauaauucauugcccuu

SEQ ID NO: 168463 - RNA, 62 nt, hsa
gaaacuuaagaugugcaaggagauuuaaugauuucaaagaaaauaaugguucuuuguuuuua

SEQ ID NO: 168464 - RNA, 62 nt, hsa
auuuggaaaaaugaaauuuaguaguuccaaguuucaaagaaaugucaacauuuuauuccauu

SEQ ID NO: 168465 - RNA, 62 nt, hsa
uugugcugggacaggggauuacaccaucucuguucaaagagggggaaaugugccuaugccuu

SEQ ID NO: 168466 - RNA, 62 nt, hsa
gacaagccaaauggcuggcagaugauguggauuucaaagagcccagaaugaacucaucacug

SEQ ID NO: 168467 - RNA, 62 nt, hsa
guuuaaguaaaaagugauacuccaccuuguguuucaaagaauuuaguuccaccucuucauac

SEQ ID NO: 168468 - RNA, 62 nt, hsa
auacaucuuagauuccuuauaucuaauaagaguucaaagaguuaugaguugaagucuugaau

SEQ ID NO: 168469 - RNA, 53 nt, hsa
uauggaagauuaagucaugacaauucaaagaaaagaagauguagccucuuuuc

SEQ ID NO: 168470 - RNA, 62 nt, hsa
uuguaaaauaucacauaauauagaaauggcaguucaaagagaauuguggcagauguugugug

SEQ ID NO: 168471 - RNA, 62 nt, hsa
gucauugugcauguuaaauuucuuucaaugcuuucaaagauaaauuccaauuucuauuuacu

SEQ ID NO: 168472 - RNA, 62 nt, hsa
guugcaaaucagaacuaaaauucuaagcacguuucaaagaugaacacuuuuguuaagacccc

SEQ ID NO: 168473 - RNA, 62 nt, hsa
uuuauuaaugggccaaugcaaaaaaucauuuuuucaaagaaaaauuuguccauguaaagcuu

SEQ ID NO: 168474 - RNA, 62 nt, hsa
gcuucaucauaagaauaauuuauaacuugaccuucaaagagauuagagcauuuguuucaucu

SEQ ID NO: 168475 - RNA, 62 nt, hsa
uugagggaaauaugucccuagcaggaaaagaauucaaagagguucaaagaauaugucacuua

SEQ ID NO: 168476 - RNA, 62 nt, hsa
uaugucccuagcaggaaaagaauucaaagagguucaaagaauaugucacuuacuccuacuug

SEQ ID NO: 168477 - RNA, 62 nt, hsa
uucuuucuuaacuuaaaggcauugguuauaaauucaaagagcuugaaaagauugaagagggc

SEQ ID NO: 168478 - RNA, 62 nt, hsa
guuaaauauuucaguguuguuugguguaagccuucaaagaaaaaacauaaaaagugggaagg

SEQ ID NO: 168479 - RNA, 62 nt, hsa
cccaacccuguggugaucaggguuauguaauguucaaagauucagacacaccuggguuugga

SEQ ID NO: 168480 - RNA, 62 nt, hsa
ggcuuuuauaaacaucuuuuacuuuguuuugauucaaagaccaaacuagaacuuuaaaaguu

SEQ ID NO: 168481 - RNA, 62 nt, hsa
ggggagaaccacgagagaagcauuaagugacuuucaaagacuuucagaguacagccacuugg

SEQ ID NO: 168482 - RNA, 62 nt, hsa
aaugacguuuguggcucuuucccaaguuggccuucaaagagccugccugcuguugagccaga

SEQ ID NO: 168483 - RNA, 62 nt, hsa
uguaauuuuacauuucaugaaaugaugucaguuucaaagagaaaguggagaggaccuaacau

SEQ ID NO: 168484 - RNA, 62 nt, hsa
aagacuccaccugugcuuggaauuccaugggcuucaaagaacauuucuucuuuuagcuuugg

SEQ ID NO: 168485 - RNA, 62 nt, hsa
gacuagaagaaaaaggagacaauaccauguuguucaaagaaacauugaaggaaauugggaug

SEQ ID NO: 168486 - RNA, 62 nt, hsa
gcagaggggauucaaaugugugagaggcuagauucaaagacccucaguguucuauguuaucu

SEQ ID NO: 168487 - RNA, 62 nt, hsa
aauauugaaugcuuucuaacaaaacagaauauuucaaagaaauuagcaagcuucauuaaaga

SEQ ID NO: 168488 - RNA, 62 nt, hsa
accauuuucauuugugcaguguauuuuuucuauucaaagaugcuuuugccaguuacaugcau

SEQ ID NO: 168489 - RNA, 62 nt, hsa
ccaccuugggaccuguuuagagaagccggcucuucaaagacaauggaaacuguaccauacac

SEQ ID NO: 168490 - RNA, 62 nt, hsa
uuuagaaauaauugaaaggaaauguuugaguuuucaaagaucccgugaaauugaugccagug

SEQ ID NO: 168491 - RNA, 62 nt, hsa
uccacugaaaacauuuuugucauauucuuguauucaaagaaaaaggaaaaaagauuauugua

SEQ ID NO: 168492 - RNA, 62 nt, hsa
gacagauuuaaagugcccccacccccauuuguuucaaagaggucugcauguugggcgaaaac

SEQ ID NO: 168493 - RNA, 62 nt, hsa
auagauuagguuugcgggggucugagucuauguucaaagacugugaacagcuugcugucacu

SEQ ID NO: 168494 - RNA, 62 nt, hsa
auuuucaaggccuucaguuuauuuccacuauuuucaaagaaaauagauuagguuugcggggg

SEQ ID NO: 168495 - RNA, 62 nt, hsa
augugggaaagccuuuguuuauuucauuggauuucaaagacaugaaaggacucacacuaggg

SEQ ID NO: 168496 - RNA, 62 nt, hsa
augugggaaagccuucagugcuuccacuucccuucaaagacgugaaaccacucacagugcag

SEQ ID NO: 168497 - RNA, 62 nt, hsa
auguaggaaguccuucaauucuuugggaaaccuucaaagacacauggcagugcagcauggag

SEQ ID NO: 168498 - RNA, 62 nt, hsa
uaacauuaugagccuuuucugcucaaaaaauuuucaaagauuaaaacuauuauacauauaca

SEQ ID NO: 168499 - RNA, 62 nt, hsa
agucuuuuuugcaaucuugaacuuucauuagcuucaaagagaagcuguauuuacaggagaaa

SEQ ID NO: 168500 - RNA, 62 nt, hsa
uaaacuuaaauauccaaagaugccuuuugaauuucaaagauuaaaacacagcuagaguagua

SEQ ID NO: 168501 - RNA, 62 nt, hsa
uacuguauguaugaaccgaauggaggaauguuuucaaagauugauuugguguggauugcaau

SEQ ID NO: 168502 - RNA, 62 nt, hsa
acauauuacauggguguaguguguugaggcuuuucaaagaagggucuagugagcuaaguuuc

SEQ ID NO: 168503 - RNA, 62 nt, hsa
gaaagccaguuaccucaguggcuaccaacccauucaaagaggacauaugauucuuuccaaga

SEQ ID NO: 168504 - RNA, 62 nt, hsa
auuucacaagcaauggaaaagcaguuaccucauucaaagaagacauaugacucuuuccaaga

SEQ ID NO: 168505 - RNA, 62 nt, hsa
ucauuuugauuuucaaagaagccguuuugauuuucaaagaagcagguucuggugacauuauu

SEQ ID NO: 168506 - RNA, 62 nt, hsa
uuuuucagaccauacaagaagucauuuugauuuucaaagaagccguuuugauuuucaaagaa

SEQ ID NO: 168507 - RNA, 64 nt, hsa
cacugggagcguuucugauucccggccacacuuugcauuucaacacucagcccggaaagaugcu

SEQ ID NO: 168508 - RNA, 64 nt, hsa
gugcagaggugccagcugccauuugccaaacucugcauuucauuucaucuaaggcuuaaccccu

SEQ ID NO: 168509 - RNA, 64 nt, hsa
ucucauuugaaaggagaaaauuccacuuuguuuagcauuucaagcuuuuauguauccaucccau

SEQ ID NO: 168510 - RNA, 64 nt, hsa
ggaaagagaaccaccccacucugucuucauauuugcauuucauguuuaaccuccggcuggaaau

SEQ ID NO: 168511 - RNA, 64 nt, hsa
ucucuacacauggcauuucaggguauaagauguagcauuucaauguguaagauauauguacuaa

SEQ ID NO: 168512 - RNA, 64 nt, hsa
gccuaaauuuacucugcuuggcucucuacacauggcauuucaggguauaagauguagcauuuca

SEQ ID NO: 168513 - RNA, 64 nt, hsa
aaaaacaaugaaggaaaccaaaauaaauauuucugcauuucaggugagugaggcaucuuuuuua

SEQ ID NO: 168514 - RNA, 64 nt, hsa
uaaaaaucugccuuagauucuauagugaagacaagcauuucaagaaagaguuaccuggaucagc

SEQ ID NO: 168515 - RNA, 64 nt, hsa
auucacccucaccucucccugcauggaggcaacagcauuucaagauguaccuugggaagucagg

SEQ ID NO: 168516 - RNA, 64 nt, hsa
ggcuucagagucgaaguuuggauacauuucaagugcauuucaagccaccagagugucccauugc

SEQ ID NO: 168517 - RNA, 64 nt, hsa
ggaaaauguggcuuguccaacucuccuccagguugcauuucaguuucuuuccaaaacuuauuac

SEQ ID NO: 168518 - RNA, 64 nt, hsa
ucaccaaggaauucgggcuccuucccuagccccagcauuucacccagaugacaccuccccaaag

SEQ ID NO: 168519 - RNA, 64 nt, hsa
ugucaucaaauaugaggagaaaccuccaaaaccagcauuucagaaugguuccucaggauccuuu

SEQ ID NO: 168520 - RNA, 64 nt, hsa
uuuaauuauuuuaauucuuaauacuuuaauuugugcauuucauaagcccccugcucuuggacug

SEQ ID NO: 168521 - RNA, 64 nt, hsa
gaugcaaagaagaauuuggcuuuuugaaaaacaagcauuucaaaaaugaugaaggaagugaaag

SEQ ID NO: 168522 - RNA, 64 nt, hsa
ucccaugaccagcuccccaucuccauagggguaggcauuucacugguuuaugaagcucgaguuu

SEQ ID NO: 168523 - RNA, 64 nt, hsa
gugagguguccguccacuucccccauaaaggugugcauuucaguuaggcugccccgccacagag

SEQ ID NO: 168524 - RNA, 64 nt, hsa
gucauugagcaguauauauauaaagcacagauuugcauuucagaauauuagccaguaccagcuu

SEQ ID NO: 168525 - RNA, 64 nt, hsa
augauuucaaaauucuccaacagcugacucucgugcauuucaacuucucccugauuccucaucc

SEQ ID NO: 168526 - RNA, 64 nt, hsa
uuuugaaauauucacaagguugcuggcauuugcugcauuucaaguuaauucucagaagugaaaa

SEQ ID NO: 168527 - RNA, 64 nt, hsa
gcuacaaaaugugugcuuggaaaauguucugacagcauuucagcugugagcuuucugauacuua

SEQ ID NO: 168528 - RNA, 64 nt, hsa
uguaaguaucaaacuauauaaaaggaggccuugugcauuucaaguuugcaaaguaccuguguac

SEQ ID NO: 168529 - RNA, 64 nt, hsa
aaaaaaaaaaugaaaaaacacucaugagauaacugcauuucacccaacaaaagcaggguauaag

SEQ ID NO: 168530 - RNA, 64 nt, hsa
ugcagaagcagcuucugaggggcuucccaggccugcauuucacagauggggagcucagcccucg

SEQ ID NO: 168531 - RNA, 64 nt, hsa
ggcggccuuggaucagaggcucaccacaagccuggcauuucagccagggcuggagaaggcaggg

SEQ ID NO: 168532 - RNA, 64 nt, hsa
gaaaccugguuuuaugaaaccaaagacuagugcagcauuucagcauauguaaaaaaaaaaaaaa

SEQ ID NO: 168533 - RNA, 64 nt, hsa
cauaacucuccucccuuguugaugacuucuuguggcauuucacacacuguagauggucacuccc

SEQ ID NO: 168534 - RNA, 64 nt, hsa
uguaccugccucacuccuguccaguggucagguuuccccugaccuucccucacccccagaaaca

SEQ ID NO: 168535 - RNA, 64 nt, hsa
cucacaggcucagacuaaaucagaggucaaggcuuccccugaguaagguccauuucuucccagg

SEQ ID NO: 168536 - RNA, 64 nt, hsa
cugguuguugugcugaggccagucagaggaugcuuccccugagguuugcuauaacuaagcaacc

SEQ ID NO: 168537 - RNA, 64 nt, hsa
cauggggcuuggaggaccgagccacugacagguauccccugaaacugagcugagcccaguaucc

SEQ ID NO: 168538 - RNA, 64 nt, hsa
cuucccccacugucccgguccucuuccccugagguccccugauauccccuggcucaguccuaac

SEQ ID NO: 168539 - RNA, 64 nt, hsa
cacuggccaccuucccccacugucccgguccucuuccccugagguccccugauauccccuggcu

SEQ ID NO: 168540 - RNA, 64 nt, hsa
cuccugccccggcauugcaucuucccuagauagguccccugagggcugagugggagggcggccc

SEQ ID NO: 168541 - RNA, 64 nt, hsa
uaaaggucaaauggggucaucugcuccuuuuccauccccugacauaccuuaaccucugaacucu

SEQ ID NO: 168542 - RNA, 64 nt, hsa
agcugugagagcuauccacucuccugccugcauauccccugagaguuauaggaagugcccacug

SEQ ID NO: 168543 - RNA, 64 nt, hsa
aacaucggcuggcuuugggacuauuccaccuccuuccccugagcccagaucugcccccaccauc

SEQ ID NO: 168544 - RNA, 64 nt, hsa
cuacugguugcuuguccauggccaacaccagaaauccccugagcacuaccugggucucauucca

SEQ ID NO: 168545 - RNA, 64 nt, hsa
guuugggaauucaaauuguccugcagagguucauuccccugacccuuuccccacauugguaaga

SEQ ID NO: 168546 - RNA, 64 nt, hsa
aaaguaccaccuuugagaccuaaguucuuuugauaccuuugagaagagccacugagccugaguu

SEQ ID NO: 168547 - RNA, 64 nt, hsa
ucguuugauuaggaaacaguuuggccaaaguaccaccuuugagaccuaaguucuuuugauaccu

SEQ ID NO: 168548 - RNA, 64 nt, hsa
uuuaaucuuaugaguagauuguaaugaaaucauuaccuuugaaacaucaaacacuucuuuaagc

SEQ ID NO: 168549 - RNA, 64 nt, hsa
uagggauaaauguacaguuuuacuaagguuuagcaccuuugaucuuuucuaaaucaggaaaaaa

SEQ ID NO: 168550 - RNA, 64 nt, hsa
uucugaccucacaucauauuugguucuccuacugaccuuugaucuaguuugaccuuugaaauuu

SEQ ID NO: 168551 - RNA, 64 nt, hsa
auuugguucuccuacugaccuuugaucuaguuugaccuuugaaauuugcaugugaccucaucua

SEQ ID NO: 168552 - RNA, 64 nt, hsa
auuaaacuaaagaaaaaacuaagaagaacaaugaaccuuugacuuugagaaauuugguuauuca

SEQ ID NO: 168553 - RNA, 64 nt, hsa
cugauauucaugguuguuuagcacacaguucaggaccuuugagaucauguuuguauaagcacuc

SEQ ID NO: 168554 - RNA, 64 nt, hsa
ugaugcuugaacucucaccuuugaccuuguguugaccuuugaugcugauguguauuuuuauuau

SEQ ID NO: 168555 - RNA, 64 nt, hsa
cugucucuucagcuucucugaugcuugaacucucaccuuugaccuuguguugaccuuugaugcu

SEQ ID NO: 168556 - RNA, 64 nt, hsa
ccuuccccuccaugggcuuugggccacagaaugaaccuuugaggccuguaaaguggauuguaau

SEQ ID NO: 168557 - RNA, 64 nt, hsa
cugucacucaagucuuacaaauguuaucuuguaaaccuuugaggugaacuauuccacugucuug

SEQ ID NO: 168558 - RNA, 64 nt, hsa
ccagucucuucaugccuaaaagacacuaccagucaccuuugauucgcgacuuuuaauuuaugau

SEQ ID NO: 168559 - RNA, 64 nt, hsa
cucuuagugguccugcagcguauccuaaaagacuaccuuugaaacaggauucuuguauggccag

SEQ ID NO: 168560 - RNA, 64 nt, hsa
uuuauauuggaccccucccuccgagcugcaguucaccuuugaccuugccucaccuuucaccccc

SEQ ID NO: 168561 - RNA, 64 nt, hsa
uugcagaccuuccuucaccccugacuucugcuucaccuuugaccucugccccccaugaauccca

SEQ ID NO: 168562 - RNA, 64 nt, hsa
ccaucgcuucccaccuguccccucgaggcuucugaccuuugauccgcuaggccccccaucucug

SEQ ID NO: 168563 - RNA, 64 nt, hsa
uuaauuuggggaguaaagauguuuggucucaaaaaccuuugaggaauugccaagaauggcgagu

SEQ ID NO: 168564 - RNA, 64 nt, hsa
uuugugcccccuuuguguuccucaaggaagcaguaccuuugaagagaucucugcugcauuaagu

SEQ ID NO: 168565 - RNA, 64 nt, hsa
gggugaauacagcaguuaggacauacacaccaucaccuuugaaagugcuuguuugggggaggga

SEQ ID NO: 168566 - RNA, 64 nt, hsa
aucaguccaaggagcccucguguuugccaccuuuaccuuugaaccucccccugccucccugccu

SEQ ID NO: 168567 - RNA, 64 nt, hsa
uguucuuagaucagcacaaaccaugucaaaaaaaauuggagauuuuuuuccaauuuuccuucca

SEQ ID NO: 168568 - RNA, 64 nt, hsa
agaacccagccuacucuagaauuucagcagugacauuggagaauauuuuuaauuugcugcagua

SEQ ID NO: 168569 - RNA, 64 nt, hsa
uuagagucucaaaguaagauuuggggagauguccauuggagacagaaguggagagagggagaag

SEQ ID NO: 168570 - RNA, 64 nt, hsa
uuucaaaugaaacaaaauaagcaguggaucuugcauuggagauggaguuaaacuauguugccca

SEQ ID NO: 168571 - RNA, 64 nt, hsa
guugucacgcuugauuguagguaagauaauuuauauuggagaaaaauccuccaaguaugaagaa

SEQ ID NO: 168572 - RNA, 64 nt, hsa
uugcucaaacuuuguucgacaucagggaauuuguauuggagaaaaacccugcaaauguaauaaa

SEQ ID NO: 168573 - RNA, 64 nt, hsa
uccaaaauagcagaaauuguaaaaauuaugaauuauuggagaaaaugccauuacuuguauaucu

SEQ ID NO: 168574 - RNA, 64 nt, hsa
cagguccuuauugccauuauuuuuaaguaucuucauuggagaugaacacugacuuuugcauaug

SEQ ID NO: 168575 - RNA, 64 nt, hsa
ggugcuuuugcaagacuggaauuccuuggacaccauuggagaagccccgcuuuuucuggaacag

SEQ ID NO: 168576 - RNA, 64 nt, hsa
uagcauuccacugcaccugcugcauacagcuuacauuggagauguguaugucaaacgcauuuuu

SEQ ID NO: 168577 - RNA, 64 nt, hsa
gaaugcagauuacacugaucuuauguguuacaaaauuggagaaaguauuuaauaaaaccuguua

SEQ ID NO: 168578 - RNA, 64 nt, hsa
cgugcguucugccuuccuuguuaauuuuguaauaauuggagaagauuuaugucagcacacacuu

SEQ ID NO: 168579 - RNA, 64 nt, hsa
ucaguuuuuuaaaaauagacuguaguauccuuucauuggagaauuuacaaaaauaucaucuaca

SEQ ID NO: 168580 - RNA, 64 nt, hsa
acaaugcauauucuaaugaagcuacuuuauauaaauuggagagcuuauaaaaugcagaacauuu

SEQ ID NO: 168581 - RNA, 64 nt, hsa
caaaucuaggucauggcaguugaaaaagggccucauuggagauaaagucguaggauaaaauugg

SEQ ID NO: 168582 - RNA, 64 nt, hsa
cucacagaaacacugggccaaacaguggggagagauuggagagcggguguggcugcccaacccc

SEQ ID NO: 168583 - RNA, 64 nt, hsa
ggcgaagagcacuggcauuuggcauguccaugacauuggagacuccccuagcagggugccugac

SEQ ID NO: 168584 - RNA, 64 nt, hsa
uccuuccuuuggacccaucggggaaaaagucuaaauuggagauccaguuuuagaagugcuuucu

SEQ ID NO: 168585 - RNA, 64 nt, hsa
agaggauaccccuguuaaucuccuuuuuucuuggauuggagaggagagaaucuggacauggcuu

SEQ ID NO: 168586 - RNA, 64 nt, hsa
auucucauaccuuacuaaauauaagauaauucauauuggagagaaauucuacagaugugaagaa

SEQ ID NO: 168587 - RNA, 64 nt, hsa
ucacucaaacuuuguucaacaucagggaauuuauauuggagagcugucuugcaaauguaauaaa

SEQ ID NO: 168588 - RNA, 64 nt, hsa
aaaguuuucaguaaugcuacaaccauugcaaaucauuggagaauccauaaugagagaucuuaca

SEQ ID NO: 168589 - RNA, 64 nt, hsa
aaauucauaccuuguaauucaaaaggcaauucguauuggagagaaacccuacaaguguaaugaa

SEQ ID NO: 168590 - RNA, 64 nt, hsa
aaaauguuuacccaaaggucugcucuccuuggauauuggagaguucacacuagagaagaguccu

SEQ ID NO: 168591 - RNA, 64 nt, hsa
gcuuaugagugcagugaguccagucucauuaaauauuggagaauacacaccugaguaagauccu

SEQ ID NO: 168592 - RNA, 64 nt, hsa
uucuuuuauaacuuuguuagguuuuugaagcugcaaacacuacaaugcuuugagggggucugug

SEQ ID NO: 168593 - RNA, 64 nt, hsa
guuuucuuuagcuuacauuuuaaacauacacaauaaacacuaauccuccaaacuuucacuguuu

SEQ ID NO: 168594 - RNA, 64 nt, hsa
gcuauguuugugaaaaacauaucauguaauucaaaaacacuauugauauugaauaccagauacc

SEQ ID NO: 168595 - RNA, 64 nt, hsa
uucaguguuaacaacaaucaugauaauuaaauuaaaacacuaguuuguucacuuguaggacugc

SEQ ID NO: 168596 - RNA, 64 nt, hsa
ugcaagcaucaagugucaaucaaaacugaagaugaaacacuaaugaauguugaauucucaugcu

SEQ ID NO: 168597 - RNA, 64 nt, hsa
gacuucuacauaacacaaaccaguggucaaauguaaacacuauauuguagauuuacuguagguu

SEQ ID NO: 168598 - RNA, 64 nt, hsa
ugaguguguucaaagaucaacauauuuaacuuuuaaacacuaucucaaagccagcauaauuaac

SEQ ID NO: 168599 - RNA, 64 nt, hsa
cagguguucccuggaaaggucaagugagucugggaaacacuaugucuguacaccucuugaaggu

SEQ ID NO: 168600 - RNA, 64 nt, hsa
aauuuuuuucuggaaacacuagauguuaucaaucaaacacuaaaauguaccauacaaaucccuu

SEQ ID NO: 168601 - RNA, 64 nt, hsa
aucuucauuaugaacaagaugaauuuuuuucuggaaacacuagauguuaucaaucaaacacuaa

SEQ ID NO: 168602 - RNA, 64 nt, hsa
accuuaauguaauuuacuuauaaugccagaaggaaaacacuauuuucauacccuacuuuuucug

SEQ ID NO: 168603 - RNA, 64 nt, hsa
uauauauauauauauauuuuuaaggugaaauacuaaacacuacuuucugucuguggauucugua

SEQ ID NO: 168604 - RNA, 64 nt, hsa
gaaauaauuuuccacaguuccaaacgauaggcucaaacacuagagcugcuaguaaaaagaagac

SEQ ID NO: 168605 - RNA, 64 nt, hsa
aaauaaaagcagaauguauaucaucccaucugaaaaacacuaauuauugacaugugcaucugua

SEQ ID NO: 168606 - RNA, 64 nt, hsa
aucuuucuaaaauggaacuuguuaaaaaguguucaaacacuaucccuaaugccugcggcagaau

SEQ ID NO: 168607 - RNA, 64 nt, hsa
uagaaauuauuuaaauuacuuuauaguaauuauuaaacacuaauuuuuguacugucauugaagg

SEQ ID NO: 168608 - RNA, 64 nt, hsa
ccaaaaguauuugcaguacaaaagaaacuauaucaaacacuauguuaaaugacaaguguuuaug

SEQ ID NO: 168609 - RNA, 64 nt, hsa
auacacacacguauuuccuugagauaaacaagauaaacacuaggugcuuuugaauuuuuuucac

SEQ ID NO: 168610 - RNA, 64 nt, hsa
caccuuauuuugauuaaaucuuuuccaauuuugcaaacacuacaguauacugcaacacaaaaga

SEQ ID NO: 168611 - RNA, 64 nt, hsa
ccuuauuuuucuuggacccaaacugucaggguauaaacacuauuuguuucuuuuuuaaaacauc

SEQ ID NO: 168612 - RNA, 64 nt, hsa
ggacagaaggagauggaaugaucaaaucacagagaaacacuaaaauuacuaaaucuacaacagc

SEQ ID NO: 168613 - RNA, 64 nt, hsa
uuuuugcuuuuaugcuuuaaagaaugcaugcccaaaacacuacuaccaacaagaggauuuuuua

SEQ ID NO: 168614 - RNA, 64 nt, hsa
agaaauauuuagcuucaggaauacugcucguuauaaacacuacuaaaaaaacaguuuauauuuu

SEQ ID NO: 168615 - RNA, 64 nt, hsa
uuauuguuaauuguauucacccuaauaaucuaugaaacacuaggucuuacuucuucuaucuaac

SEQ ID NO: 168616 - RNA, 64 nt, hsa
auuucccaauguuuugucauggcuauuucuacucaaacacuaaucccccauucucuaaucacca

SEQ ID NO: 168617 - RNA, 64 nt, hsa
aaauugaauauugaaaaauugacaaauuguguacaaacacuaaaaaaaacuuguuuaaauugua

SEQ ID NO: 168618 - RNA, 64 nt, hsa
aauuuacagcaaaauauugaauaaccauugacaaaaacacuauuauuuuuuguaccaaaaauac

SEQ ID NO: 168619 - RNA, 64 nt, hsa
cagaauacauuuuaccagcaaaccuaaggaugacaaacacuauccacaucugaaaacuaccaca

SEQ ID NO: 168620 - RNA, 64 nt, hsa
agcuucuuaguucaaaaagaauucugaguuuuucaaacacuagucuagagguggacauugucag

SEQ ID NO: 168621 - RNA, 64 nt, hsa
ucuuggaccuuggucaguugugcuauucauuauuaaacacuaaaacuuuggcgguucuugcaua

SEQ ID NO: 168622 - RNA, 64 nt, hsa
gaucaacgacuuguaguagacucaaguuuuuaaaaaacacuauuuuacuuaaacuguuucuuau

SEQ ID NO: 168623 - RNA, 64 nt, hsa
acuuuuaauuuuauauaugacagcauuuaaaugcaaacacuaccaugaauuuaauguauaaaau

SEQ ID NO: 168624 - RNA, 64 nt, hsa
guugaagaaucauuguuagaagcauuuccaaacaaaacacuaagcaaaaugggaauuaggcuua

SEQ ID NO: 168625 - RNA, 64 nt, hsa
ccuggaaagauguuuucaaggaauuugaaccauaaaacacuaucugaugcacagaacaccucua

SEQ ID NO: 168626 - RNA, 64 nt, hsa
auuuauucauccauccauucaacaaguauuugcuaaacacuaacuuaagcuaaugcuaggguag

SEQ ID NO: 168627 - RNA, 64 nt, hsa
uuuucaguaacugaauuugugcacaaaacauucuaaacacuagugaagccuguuucguugaacu

SEQ ID NO: 168628 - RNA, 64 nt, hsa
uuaaacacaaaaauaaauuuuuuuucauuuccagaaacacuauuuauuuaugguuuuuuuuuuu

SEQ ID NO: 168629 - RNA, 64 nt, hsa
cguugaucuuuagccugucucacaccaguucagaaaacacuagacccaggauugaaaaagcaaa

SEQ ID NO: 168630 - RNA, 60 nt, hsa
uuuguagauggaguuucacuuuuguugcccaggcuggaguguaguggcgcgaucucggcu

SEQ ID NO: 168631 - RNA, 60 nt, hsa
uguuugagacagggucucacucugucgcucaggcuggagugcagugaugcaaucuuggcu

SEQ ID NO: 168632 - RNA, 60 nt, hsa
ugcauguuaugagcgugugcuuauccguuaaggcuggaggcacaugugggugauggugga

SEQ ID NO: 168633 - RNA, 60 nt, hsa
aggcucaccccuacguccccccacaccuggaggcuggagccaggggccacuucugaacug

SEQ ID NO: 168634 - RNA, 60 nt, hsa
uuuuugagacagagucucgcuuuguuucccaggcuggagugcaguggcacgaucucggcu

SEQ ID NO: 168635 - RNA, 60 nt, hsa
cgcuuguaaucccagcuacuugggaggcugaggcuggagaaucgcuugaacccaggaggu

SEQ ID NO: 168636 - RNA, 60 nt, hsa
uuuuuugagauggagucucgcucuguagccaggcuggagugcaguggcauaaucucagcu

SEQ ID NO: 168637 - RNA, 60 nt, hsa
guauuagauggaauuucacucuugucgcccaggcuggaguguaguggcgcagucucagcu

SEQ ID NO: 168638 - RNA, 60 nt, hsa
cuguucucuucggaagaccucguuuucuaaaggcuggacuaaauggcugcagaacucccu

SEQ ID NO: 168639 - RNA, 60 nt, hsa
uuuuugagacagagucuggcucugucgcccaggcuggagugcaggggcgcaaucucggcu

SEQ ID NO: 168640 - RNA, 60 nt, hsa
guuuugagauggagucuugcccugucacccaggcuggagugcaauggugcgaucucggcu

SEQ ID NO: 168641 - RNA, 60 nt, hsa
gugaagacagaagcuccgugaaccaacucgaggcuggagccaagauccugccugauaucc

SEQ ID NO: 168642 - RNA, 60 nt, hsa
gccguggcuugucuggucuucgcccacgggaggcuggacagaggcuguagccaacacaau

SEQ ID NO: 168643 - RNA, 60 nt, hsa
uuuuuugcaaacuuggcuucccccaggggcaggcuggacuuucccugcccccuaugauug

SEQ ID NO: 168644 - RNA, 60 nt, hsa
ccuggcugacauuuccccuccuuccugccaaggcuggaggccgccagguguuugcucucu

SEQ ID NO: 168645 - RNA, 60 nt, hsa
cccagacugcuggaacagccaaggacugucaggcuggacaaaaauaacugcaaggagggg

SEQ ID NO: 168646 - RNA, 60 nt, hsa
acugacuggcugcagccuucccacgccaagaggcuggaacauagugucugccucgcuucc

SEQ ID NO: 168647 - RNA, 60 nt, hsa
ugugagagacggugucuuguucugucacucaggcuggaguacaguggugccaucauugcu

SEQ ID NO: 168648 - RNA, 60 nt, hsa
ucccucagucccaaauccuucccaaguaagaggcuggaguugucacugcuuuuggccugg

SEQ ID NO: 168649 - RNA, 60 nt, hsa
uguuuuuugagaugaagucucacugcacucaggcuggagugcagugguacgaucuuggcu

SEQ ID NO: 168650 - RNA, 60 nt, hsa
uuuuuaagacagagauucagucugucacccaggcuggagugcuguggugugaucuuagcu

SEQ ID NO: 168651 - RNA, 60 nt, hsa
agaaggaaugguauuuguauggggggagggaggcuggaauggagaaucuggauucucucc

SEQ ID NO: 168652 - RNA, 60 nt, hsa
uuugggccgggaaggcagccugggaaucugaggcuggagacagggguuugaggugggggc

SEQ ID NO: 168653 - RNA, 60 nt, hsa
uuuuuggagacggagucucgcccugucgccaggcuggaguguaguggcaugaucucgacu

SEQ ID NO: 168654 - RNA, 60 nt, hsa
uugccccaugauuuuucuuuggucaguaggaggcuggauuggaguggugauuauuccccu

SEQ ID NO: 168655 - RNA, 60 nt, hsa
cuuaugugccccauugagcuucacagugucaggcuggacgccgugauuucagggaccuau

SEQ ID NO: 168656 - RNA, 60 nt, hsa
ugauccgcagauguaggggccucuuggcagaggcuggaggacucugggggcuagggaaga

SEQ ID NO: 168657 - RNA, 60 nt, hsa
caauauuccaaaggaacauuuuaacuguaaaggcuggagacaagaaaaaauaaguagauc

SEQ ID NO: 168658 - RNA, 60 nt, hsa
uuuuugagauggacucuagcucugucacccaggcuggagugcaguggugcgaucucggcu

SEQ ID NO: 168659 - RNA, 60 nt, hsa
uucggagacggaguuucacucuugcugcccaggcuggagugcaauggugcaaugaccucg

SEQ ID NO: 168660 - RNA, 60 nt, hsa
guuuugagacagggucucgcucugucacccaggcuggaguguaguggugcagucuuggcu

SEQ ID NO: 168661 - RNA, 60 nt, hsa
uuguagagacgggguuuugccauguugcccaggcuggaagugucuauguuuaacugcauc

SEQ ID NO: 168662 - RNA, 60 nt, hsa
uuuuuagauggaguuuggcucuugucacccaggcuggagugcaauggcgcaaucucagcu

SEQ ID NO: 168663 - RNA, 60 nt, hsa
auuugagacagaguuuugcucuuauugcccaggcuggagugcaguggcgugaucuuggcu

SEQ ID NO: 168664 - RNA, 60 nt, hsa
uuuuugagacggagucuugcucugucacccaggcuggagagcaguggcgugaucucggcu

SEQ ID NO: 168665 - RNA, 60 nt, hsa
uuuuugaaacggaguuuugcucugucacccaggcuggaaugcaauggcaccaucuuggcu

SEQ ID NO: 168666 - RNA, 60 nt, hsa
augagcauccuugacgccuguguacuucccaggcuggaugugaagcuacauuaccaugug

SEQ ID NO: 168667 - RNA, 60 nt, hsa
uaaauggagauagggucuuaacucuuguccaggcuggaggagugcagucguacagucaug

SEQ ID NO: 168668 - RNA, 60 nt, hsa
auaaagaaugcugagucaagauuuauauuaaggcuggaagcuguggcucacaccuguaau

SEQ ID NO: 168669 - RNA, 60 nt, hsa
gugggaggauggguugagcacaggagucagaggcuggaaugcaauggcgugaucuuggcu

SEQ ID NO: 168670 - RNA, 60 nt, hsa
uucugcucuaagggggccagacccucugccaggcuggauuguacgggccccaccuucgcu

SEQ ID NO: 168671 - RNA, 60 nt, hsa
cucacuucaggaggggccuggagcagggugaggcuggacuuuggggggcugugagggaaa

SEQ ID NO: 168672 - RNA, 60 nt, hsa
acagggucuugcucuauugcucugucacccaggcuggaaugcaguggcgagaucuccgcu

SEQ ID NO: 168673 - RNA, 60 nt, hsa
uuuugagacggagucucacucuuguugcccaggcuggacaacaauggcgcgaucucggcu

SEQ ID NO: 168674 - RNA, 60 nt, hsa
uauuagaaacagaguuucaccauguuggccaggcuggagaauugcuguaauaguuuucca

SEQ ID NO: 168675 - RNA, 60 nt, hsa
uuuuugaaacuagcucucauucugucacccaggcuggaauacagugguacagucacggcu

SEQ ID NO: 168676 - RNA, 60 nt, hsa
uuguuuuuuguagacagcacucugucacccaggcuggagugcaguggcaccaucuuggcu

SEQ ID NO: 168677 - RNA, 60 nt, hsa
uauuugagauggagucucacucugucacccaggcuggaaugcaguggugugaucuuggcu

SEQ ID NO: 168678 - RNA, 60 nt, hsa
guuuugagacagggucucacugugucccccaggcuggagugcaguggcacaaugacgacu

SEQ ID NO: 168679 - RNA, 60 nt, hsa
ucguugagauacaguuucacucugucacccaggcuggagugcaguggcaugaucucagcu

SEQ ID NO: 168680 - RNA, 60 nt, hsa
uuuuuuggagacagagucucacugucacccaggcuggagugcaguggcaugaucucaguu

SEQ ID NO: 168681 - RNA, 60 nt, hsa
cagcaggucacucucccuggcacaccuuccaggcuggauuuuuaaugaaacagacucagg

SEQ ID NO: 168682 - RNA, 60 nt, hsa
cuggggugagaggucagugcaccacagccgaggcuggagcacagggagcuucuguuguuc

SEQ ID NO: 168683 - RNA, 60 nt, hsa
uuuuugagauguagucucacccugucgcccaggcuggagugcaaugccgugaucuccgcu

SEQ ID NO: 168684 - RNA, 60 nt, hsa
gguuaagauucuccuuuuguacugggaaacaggcuggaggacuaugguccucaaguuuag

SEQ ID NO: 168685 - RNA, 60 nt, hsa
gggggggauggaguuucgcuguuguugcccaggcuggagugcaauagcacgaucuuggcu

SEQ ID NO: 168686 - RNA, 60 nt, hsa
uuuuugaaacagggucucacucuauugcccaggcuggagugcacuggcgugaucucggcu

SEQ ID NO: 168687 - RNA, 60 nt, hsa
uuuuugaaaccgugucucacucugucgcccaggcuggaggagugcaguggugugaucuca

SEQ ID NO: 168688 - RNA, 60 nt, hsa
uguuugagauggagucuugcucugucgcccaggcuggaacgcaguggugacaucucggcu

SEQ ID NO: 168689 - RNA, 60 nt, hsa
ugggucacagggaacugccagugaggcuggaggcuggagguggagauggggucaggaaca

SEQ ID NO: 168690 - RNA, 60 nt, hsa
aacaggcugggucacagggaacugccagugaggcuggaggcuggagguggagaugggguc

SEQ ID NO: 168691 - RNA, 60 nt, hsa
uuuugaaaagacaggguuuugccaucguccaggcuggagugcgcuggcuugaucuuggcu

SEQ ID NO: 168692 - RNA, 60 nt, hsa
uuuuugagacaaggucucacucugucacccaggcuggaguacaguggguugaucauggcu

SEQ ID NO: 168693 - RNA, 60 nt, hsa
uuucugagacggagucguuuucugccacccaggcuggaguacaguggcaugaucuuggcu

SEQ ID NO: 168694 - RNA, 60 nt, hsa
uuuuugagucagagucucgcucuguugcccaggcuggagugcaguggugccaucuuggcu

SEQ ID NO: 168695 - RNA, 60 nt, hsa
ggcugggugaagaaauuggcgcugagauccaggcuggauccauugcuuuuguuuacaaua

SEQ ID NO: 168696 - RNA, 60 nt, hsa
cucugaaaaagggaauuugcuggugaaaagaggcuggaucuuguggaagacugucuugga

SEQ ID NO: 168697 - RNA, 60 nt, hsa
uuuuugagauggagucucacucuguggcccaggcuggagugcaguggcgcaaucuuggcu

SEQ ID NO: 168698 - RNA, 60 nt, hsa
aaggucccgaagggcaggucagagggagagaggcuggagaccugggcuggggccuuccuc

SEQ ID NO: 168699 - RNA, 60 nt, hsa
ucucggagcuggauccccgucagcucauccaggcuggacaaaccaguuccuggguccccc

SEQ ID NO: 168700 - RNA, 60 nt, hsa
aaaacaaaagugauuaugucacgagaggagaggcuggagggccaugggaguucccagcug

SEQ ID NO: 168701 - RNA, 60 nt, hsa
uuuuugagauggagucucgcucugucacccaggcuggagugcaguggugugaucucggcu

SEQ ID NO: 168702 - RNA, 60 nt, hsa
uugaaauaggaaguucucacugaauccuggaggcuggaacagcuggcucuuuuagacuca

SEQ ID NO: 168703 - RNA, 60 nt, hsa
ucuugagacggagucuuggucuugucacccaggcuggagugcaguggcacgaucucggcu

SEQ ID NO: 168704 - RNA, 60 nt, hsa
uuuugagacagaguuucacucuuguugcccaggcuggagugcaguagcgcagucucggcu

SEQ ID NO: 168705 - RNA, 60 nt, hsa
uuuuugagauggagucucacucugucacacaggcuggaaugcagugaugccaucucagcu

SEQ ID NO: 168706 - RNA, 60 nt, hsa
uuuuuuuuuuuuugucucgcucuguugcccaggcuggaguacaguggcgcgaucucagcu

SEQ ID NO: 168707 - RNA, 60 nt, hsa
acggggauacggggucuugcucugucucccaggcuggagugcagugacacaaucucagcu

SEQ ID NO: 168708 - RNA, 60 nt, hsa
acacuaaaggaggaggagccggggacucccaggcuggagagcacugccaggacccaccac

SEQ ID NO: 168709 - RNA, 60 nt, hsa
uagggccuucaagggcuggcagucuuacagaggcuggagcggugagaaugagaggccaga

SEQ ID NO: 168710 - RNA, 60 nt, hsa
cauuuggaaggcuaaauggggccaugaagaaggcuggaagggacagggggugauggcagc

SEQ ID NO: 168711 - RNA, 60 nt, hsa
gggccugggccgggagcccaggggaaggccaggcuggaccccggcuccacacccacaucc

SEQ ID NO: 168712 - RNA, 60 nt, hsa
ccugcccucccagucucccaccccggccccaggcuggaagcccucccuccacuuaaguua

SEQ ID NO: 168713 - RNA, 60 nt, hsa
uuuuugagacagugccucacucugucacccaggcuggaguguaguggcaugaucugggcu

SEQ ID NO: 168714 - RNA, 60 nt, hsa
ucugagacgcagucuggcucucugucgcccaggcuggagugcaguggcucgaucucggcu

SEQ ID NO: 168715 - RNA, 60 nt, hsa
uuucugagacagagucucgcucuguugcccaggcuggagugcaguggcacgaucucggcu

SEQ ID NO: 168716 - RNA, 60 nt, hsa
uuuuugagacggagucucgcucugucgcccaggcuggagugcaguggcgcgaucucggcu

SEQ ID NO: 168717 - RNA, 60 nt, hsa
ccagagcacuggcuuggcguccagcaaugaaggcuggagaaugcagccuggauuccccua

SEQ ID NO: 168718 - RNA, 60 nt, hsa
gggucagccucucccaagacugaagugcagaggcuggacuuggggcucucucccccagcu

SEQ ID NO: 168719 - RNA, 60 nt, hsa
uucccacccaaaccuucucaguccagcuggaggcuggagggagacacaggccccacccag

SEQ ID NO: 168720 - RNA, 60 nt, hsa
gaggaguaagagcccagacgagaggaaggcaggcuggaucuuugccuugagagcuccgug

SEQ ID NO: 168721 - RNA, 60 nt, hsa
uuuuuugagauaauuucacucuuguugcccaggcuggagugcaauggcgugaucgcugcu

SEQ ID NO: 168722 - RNA, 60 nt, hsa
uuuuugagacauggucacgcugugucgccaaggcuggagugcaguggugcgaucucggcu

SEQ ID NO: 168723 - RNA, 60 nt, hsa
ggcuugagcucagucaaucuggugcagaugaggcuggacaacuacuaaccaauaaaauca

SEQ ID NO: 168724 - RNA, 60 nt, hsa
aaccaaaaucucguauuggcagaucuugacaggcuggaccugcaagauguggcuugaauu

SEQ ID NO: 168725 - RNA, 60 nt, hsa
uuuuagugauagagucucacucugucacccaggcuggagggcagugguacagucuuggcu

SEQ ID NO: 168726 - RNA, 60 nt, hsa
guuuuuggacggagucuuagucugucacugaggcuggaguacaguggcacgaucuuggcu

SEQ ID NO: 168727 - RNA, 60 nt, hsa
gacagaggaaagggcuggcucccccuccccaggcuggagacccccccccaacuccaggaa

SEQ ID NO: 168728 - RNA, 60 nt, hsa
uuuaugagacagggucuugcucugucccccaggcuggagugcaguggcaugaucauagcu

SEQ ID NO: 168729 - RNA, 60 nt, hsa
uuuuugagacagaaucucacucucucgcccaggcuggagugcaacgguacgaucuuggcu

SEQ ID NO: 168730 - RNA, 60 nt, hsa
gggggugcggggcaguucacucugucucccaggcuggagugcaauggugcaaucuuggcu

SEQ ID NO: 168731 - RNA, 54 nt, hsa
ucuacgacgggcugguauagucccaggcuggagcugggugagugcagacucggg

SEQ ID NO: 168732 - RNA, 60 nt, hsa
gcaaccccaccggacgggugguccggagggaggcuggagcggggaggcgaggagggggcu

SEQ ID NO: 168733 - RNA, 60 nt, hsa
auuuugagacagagucucgcucugucaccuaggcuggagugcaguggcgcaaucucaccu

SEQ ID NO: 168734 - RNA, 60 nt, hsa
auuuuuuuuuuucgagacacucugucacccaggcuggagugcaauggugcaaucucggcu

SEQ ID NO: 168735 - RNA, 60 nt, hsa
aaugaccugccucugugcgaagcuuacgggaggcuggaccucgacacagacucugcugau

SEQ ID NO: 168736 - RNA, 60 nt, hsa
ucuacguaucauuuacuuagggggaaacuuaggcuggagacagggaggccuuccacucug

SEQ ID NO: 168737 - RNA, 60 nt, hsa
gagcaggaaaaggaggcucagcacugucucaggcuggaggucagcgaaccucgugggcug

SEQ ID NO: 168738 - RNA, 60 nt, hsa
gucucucagacaggcguccuaaagaccucuaggcuggaagcuugggcuugcaaguggauc

SEQ ID NO: 168739 - RNA, 60 nt, hsa
uuuguuuuugagauagggucuuuguugcucaggcuggaguacaguggcauaaucacagcu

SEQ ID NO: 168740 - RNA, 60 nt, hsa
uuuuuuugagacagucucgcucugucccccaggcuggagugcaguggcucgaucucugcu

SEQ ID NO: 168741 - RNA, 60 nt, hsa
uuuuugagauggagucuugcucugucgcccaggcuggagugcgguggcgcgaucuaggcu

SEQ ID NO: 168742 - RNA, 60 nt, hsa
uuuugagacggaguuucccucuugucacccaggcuggagugcaauggcgugaucucggcu

SEQ ID NO: 168743 - RNA, 60 nt, hsa
ccugccagcucuucugccggcccuggggcuaggcuggagcccagggagcggaaagcagcu

SEQ ID NO: 168744 - RNA, 60 nt, hsa
gggagucugaagcagaugcaaagaggcaagaggcuggauuuugaauuuucuuuuuaauaa

SEQ ID NO: 168745 - RNA, 60 nt, hsa
cccggcccccagauguccccccauccccagaggcuggaggaacaacugggcccuggacca

SEQ ID NO: 168746 - RNA, 60 nt, hsa
ucccuggugaguguaaaccgucccgcccugaggcuggaccggccccuggacuucuacgag

SEQ ID NO: 168747 - RNA, 60 nt, hsa
ugcuugguaaacguggcagagcagaaugggaggcuggacccugaggaagggccccucucc

SEQ ID NO: 168748 - RNA, 60 nt, hsa
agacccccucaauagacacugacuaaagucaggcuggagucaugaggguagugggcuaag

SEQ ID NO: 168749 - RNA, 60 nt, hsa
uuuuugagacagagucucacucugucccccaggcuggagugcaguggcgcgaucuuggcc

SEQ ID NO: 168750 - RNA, 60 nt, hsa
uuuuuuuuuuugagucuugcucugucacugaggcuggagugcaguggcgcaauuucagcu

SEQ ID NO: 168751 - RNA, 60 nt, hsa
uuuuuuuuuuugagacucgcuuugucacccaggcuggagugcaauggcacaaucucaacu

SEQ ID NO: 168752 - RNA, 60 nt, hsa
uuuuugagacagcaucucacacugucgcccaggcuggagugcaguggugcaaucucagcu

SEQ ID NO: 168753 - RNA, 60 nt, hsa
uuuuuggagacagagucuugcuuuguugccaggcuggagugcaguggcgcgaucucggcu

SEQ ID NO: 168754 - RNA, 60 nt, hsa
uaauggagacagggucuugcacuaucacccaggcuggagugcaguggcauaaucauaccu

SEQ ID NO: 168755 - RNA, 60 nt, hsa
uuuugagacagaguuucgcucuuguugcccaggcuggagugcaacggcacgaucucggcu

SEQ ID NO: 168756 - RNA, 60 nt, hsa
uuuuugagauagggucucacuuuguuacccaggcuggagugcaguggcacaaucucgacu

SEQ ID NO: 168757 - RNA, 60 nt, hsa
uuuugagacagaguuucacucuuguugcccaggcuggagggcaauggcgcgaucucagcu

SEQ ID NO: 168758 - RNA, 60 nt, hsa
uuuugagacagaguuucgcacuucuugcccaggcuggaguacaauggugcgaucuuggcu

SEQ ID NO: 168759 - RNA, 60 nt, hsa
uuuuugagacagagucucauucugucgcccaggcuggagugcaguggugugaucuuggcu

SEQ ID NO: 168760 - RNA, 60 nt, hsa
cauccugcugcagggaagggagcuguacggaggcuggaagcugcaggguuaggcccgaga

SEQ ID NO: 168761 - RNA, 60 nt, hsa
caggcuauagcagcugagggggacccggggaggcuggacagggcgcggaacccugucaug

SEQ ID NO: 168762 - RNA, 60 nt, hsa
ugucauggaugacaaggcaagggcagcaauaggcuggagcccgaagguauuucuccagau

SEQ ID NO: 168763 - RNA, 60 nt, hsa
uuuuugagacagagucuugcucugucacccaggcuggagugcaguggugcgaucgcucac

SEQ ID NO: 168764 - RNA, 60 nt, hsa
uuuuugagauggagucucacucugucacccaggcuggagugcaguggcgugaucuuggcu

SEQ ID NO: 168765 - RNA, 60 nt, hsa
uggaaaaggguggagaacaggggaguagccaggcuggauggcucaaauauaaaugaauga

SEQ ID NO: 168766 - RNA, 60 nt, hsa
aacucucugcccuccacagagcuauggagaaggcuggagaugaaagcuuuguagugagga

SEQ ID NO: 168767 - RNA, 60 nt, hsa
gcaguguggggcauccugccagaggugcacaggcuggaguuucaggcacugcaggcugau

SEQ ID NO: 168768 - RNA, 60 nt, hsa
uuuuugacacagagucucgcucugucgcccaggcuggaaugcaguugugagaucucggcu

SEQ ID NO: 168769 - RNA, 60 nt, hsa
uuuuugagacagagacucgcucugucacccaggcuggagugcaguggcaugauuucggcu

SEQ ID NO: 168770 - RNA, 60 nt, hsa
gggcugccccuuaagugucggugaauagugaggcuggaggccggaaucucagccagccuc

SEQ ID NO: 168771 - RNA, 60 nt, hsa
cuuuugagacagaguuucgcuuugucgcccaggcuggagugcaaugcacgaucucaguuc

SEQ ID NO: 168772 - RNA, 60 nt, hsa
uuuacuguacucucuaucacugacaaaugcaggcuggauucuuauuauauacagagaugg

SEQ ID NO: 168773 - RNA, 60 nt, hsa
cucaguauuuuucuuggaugggaugacgcuaggcuggaaaguuuuuuucaucacuaugau

SEQ ID NO: 168774 - RNA, 60 nt, hsa
aaugcugaggaguucaguugugaggaaagaaggcuggagcugugagauucgcuuuucccu

SEQ ID NO: 168775 - RNA, 60 nt, hsa
uuuuuagacggaguuuugcucuuguugcccaggcuggagugcagugacacaaucucuacu

SEQ ID NO: 168776 - RNA, 60 nt, hsa
uuuugagacaaaguuuugcucuugucacccaggcuggagugcaguggugcaaucuuggcu

SEQ ID NO: 168777 - RNA, 60 nt, hsa
uuuuugagaccaaaucuugcucuguggcccaggcuggagugcaguggcacgaucucagcu

SEQ ID NO: 168778 - RNA, 60 nt, hsa
gggugcugauuaccucagccauguggaggaaggcuggagcuuguuccugccccaggaaua

SEQ ID NO: 168779 - RNA, 60 nt, hsa
caagcugcccccuccuugcccccaaggaugaggcuggacugaggcaaagggcuggccaca

SEQ ID NO: 168780 - RNA, 60 nt, hsa
ugaagaugaauuggaauggucacguuuuuuaggcuggacagcgucccgccacagcuacua

SEQ ID NO: 168781 - RNA, 60 nt, hsa
uauauucgccugaagaucaucccgcaaggcaggcuggaggugccggugggccuguguugc

SEQ ID NO: 168782 - RNA, 60 nt, hsa
gacuuccagguagggccagcucacaagcccaggcuggagauccuaacugagaauuuucua

SEQ ID NO: 168783 - RNA, 60 nt, hsa
ucuuuuuuugagacggcgcaccuaucacccaggcuggaguggaguggcacgaucuuggcu

SEQ ID NO: 168784 - RNA, 60 nt, hsa
cugugagacagaguuucacucuuguugcccaggcuggagugcaguggugugaucuuggcu

SEQ ID NO: 168785 - RNA, 60 nt, hsa
uuuugagacagaauuucacucuucucacccaggcuggaaugcaguggcacaauuuuggcu

SEQ ID NO: 168786 - RNA, 60 nt, hsa
ucguggagacggggccucacuauguugccuaggcuggaaauaggauuuugaacccaaauu

SEQ ID NO: 168787 - RNA, 60 nt, hsa
uuguuaagacagagucucacuuugacacccaggcuggagugcaguggugccaucaccacg

SEQ ID NO: 168788 - RNA, 60 nt, hsa
uguuuuugagacgaggucucacugucacccaggcuggagugcaguggugccaucaugacu

SEQ ID NO: 168789 - RNA, 60 nt, hsa
uguuugagauggagucucacucugucucccaggcuggagugcaguggcgugaucuuggcu

SEQ ID NO: 168790 - RNA, 60 nt, hsa
cugggugggggaggcuggaggucauuggagaggcuggacugcugccaccccgggugcucc

SEQ ID NO: 168791 - RNA, 60 nt, hsa
gcacagcccucccuccugccugggugggggaggcuggaggucauuggagaggcuggacug

SEQ ID NO: 168792 - RNA, 60 nt, hsa
cgagggcacacagggccggggaggaggauuaggcuggacugaucgcgggucgcaggugac

SEQ ID NO: 168793 - RNA, 60 nt, hsa
acugccgugcccgggggacauccugcgcccaggcuggaggcccugccucgcugcuugcca

SEQ ID NO: 168794 - RNA, 60 nt, hsa
uguuuaagacagcaucuugcucugucucccaggcuggagcguaguaaugcaaucauagcu

SEQ ID NO: 168795 - RNA, 60 nt, hsa
uuuuugagacagauucuugcucugucacccaggcuggagugcaguagcaugaucagggau

SEQ ID NO: 168796 - RNA, 60 nt, hsa
uaguagagaugagguuuugccauuuuggucaggcuggaauuuuuuuuuuuuuaauuuuga

SEQ ID NO: 168797 - RNA, 60 nt, hsa
uguaugggacagggucucacucugucacccaggcuggaaugacgaagugaaguagugcaa

SEQ ID NO: 168798 - RNA, 60 nt, hsa
guuuugagacagggucucacucuguugcccaggcuggagugcaguggcgugaucucggcu

SEQ ID NO: 168799 - RNA, 60 nt, hsa
uuuuugagauggagucucgcucugucgcccaggcuggagugcaguggcgcaaucucagcu

SEQ ID NO: 168800 - RNA, 60 nt, hsa
uuuuaaggacagagucucucucugucacccaggcuggagugcaauggcgcgaucuuggcu

SEQ ID NO: 168801 - RNA, 60 nt, hsa
cagcucauacgggcagacugcucaggcgugaggcuggaucguaggguucgaggcugcuug

SEQ ID NO: 168802 - RNA, 60 nt, hsa
cucugcaacugagcgaagcugcgggcuaggaggcuggaaagccauuuauccuaggacaua

SEQ ID NO: 168803 - RNA, 60 nt, hsa
cccuacccuucccuccucugucuauugcccaggcuggagugcaguggugcgaccuuggcu

SEQ ID NO: 168804 - RNA, 60 nt, hsa
uuuuugagacagagucucgcucugucacccaggcuggaguucaguggugcgaccucggcu

SEQ ID NO: 168805 - RNA, 60 nt, hsa
uuuuugagacagagucucacacuguugcccaggcuggagugcaguggcgugaucucggcu

SEQ ID NO: 168806 - RNA, 60 nt, hsa
uuuuugaaacuaagccuugcucugucucccaggcuggagugcuauggugcaauuuuuguu

SEQ ID NO: 168807 - RNA, 60 nt, hsa
caggcaugagcuacugcacccggccuaaccaggcuggagugcaguggugggaucucggcu

SEQ ID NO: 168808 - RNA, 60 nt, hsa
uguguuuuuaaaccacuuccacuuuccaggaggcuggauggcuuccagggucacuccuug

SEQ ID NO: 168809 - RNA, 60 nt, hsa
uuuuuaaagauggggucuugcucugucgccaggcuggagugcaguggcgcgaucuaggcu

SEQ ID NO: 168810 - RNA, 60 nt, hsa
uuucgagauggaguuucacucuugucgcucaggcuggagugccauggcgcgaucuuggcu

SEQ ID NO: 168811 - RNA, 60 nt, hsa
ggacuuacugguugcaagagcucauuuugcaggcuggaagcaccagggaauuaauucccc

SEQ ID NO: 168812 - RNA, 60 nt, hsa
aaacacaaauuuauauucucacauaucuggaggcuggaagucugagaucagagugccagc

SEQ ID NO: 168813 - RNA, 60 nt, hsa
uuuugagauggaguuuugcucuuguugcccaggcuggagugcaaugguaugaucuuggcu

SEQ ID NO: 168814 - RNA, 60 nt, hsa
uuuuuuuugagauggauucucacuguugccaggcuggagugcaguggcacaaucuuggcu

SEQ ID NO: 168815 - RNA, 60 nt, hsa
uuuuuuuuuuuugagacggaguccuugcccaggcuggagugcaguggcgcgaucucagcu

SEQ ID NO: 168816 - RNA, 60 nt, hsa
uuuuugagcuggagucuuacucuguugccuaggcuggagugaaaguggcgcaaccucugc

SEQ ID NO: 168817 - RNA, 60 nt, hsa
ccccaagauggugucucacucuguugccccaggcuggagugcaguggugugauccuggcu

SEQ ID NO: 168818 - RNA, 60 nt, hsa
uguugagauguaauuuugcucuuguugcccaggcuggagugcaguggugcgaucgcggcu

SEQ ID NO: 168819 - RNA, 60 nt, hsa
uuuuugagauggagucucgcucugucaucuaggcuggagugcaguggugugaucucagcu

SEQ ID NO: 168820 - RNA, 60 nt, hsa
uuucaagacagggucucaacucuguuacccaggcuggagugcaguggugcgaucucagcu

SEQ ID NO: 168821 - RNA, 60 nt, hsa
uuuugagacagaauuuugcucuuguugcccaggcuggagugcaauggcgugaucuuggcu

SEQ ID NO: 168822 - RNA, 60 nt, hsa
uuuuugagacagggucucacacugucacccaggcuggagugcaguguugcaguccggcuc

SEQ ID NO: 168823 - RNA, 60 nt, hsa
uuuuuagauggaguuuuacucuuguugcccaggcuggagugcaacggcaugauuuuggcu

SEQ ID NO: 168824 - RNA, 60 nt, hsa
uuuuugaggcagagucucauucuguugcccaggcuggagugcaguggcgugaucuuggcu

SEQ ID NO: 168825 - RNA, 60 nt, hsa
gagucagcagacuguccaaugugcucagccaggcuggaggcggcaggcggcaggcagcag

SEQ ID NO: 168826 - RNA, 60 nt, hsa
uuugagacgggaguuucucucuugucucccaggcuggagugcaaucgcgcaaucucggcu

SEQ ID NO: 168827 - RNA, 60 nt, hsa
cuuugagauggauuuucgcucuugucgcccaggcuggaguacaauggcacgaucuuggcu

SEQ ID NO: 168828 - RNA, 60 nt, hsa
uuuuugagacagagucucacucuguugcccaggcuggagugcaguggcgccaucucggcu

SEQ ID NO: 168829 - RNA, 60 nt, hsa
gggccuggggcccgggaccggaggcugacgaggcuggacuuccucgaguggccacuguga

SEQ ID NO: 168830 - RNA, 60 nt, hsa
uuuugagacggaguuucacucuuguugcccaggcuggagugcaauggcaugaucucggcu

SEQ ID NO: 168831 - RNA, 60 nt, hsa
uuuuugagacagagucugguucuguuucccaggcuggagugcaguggugggaucucagcu

SEQ ID NO: 168832 - RNA, 60 nt, hsa
cccuguacguauuggugaagaacgugcacaaggcuggauggacuucaacuuggaguugag

SEQ ID NO: 168833 - RNA, 60 nt, hsa
uacaccgugcuccggcuaaugauucgacagaggcuggaggagauagccgagaccccagca

SEQ ID NO: 168834 - RNA, 60 nt, hsa
acaguuuuuaugcuguuuuauuugacuuaaaggcuggaagacagaaacgaagugaguuca

SEQ ID NO: 168835 - RNA, 60 nt, hsa
uuuuugagacagggucuugcuuuguugcccaggcuggagugcagugacguggucauagcu

SEQ ID NO: 168836 - RNA, 60 nt, hsa
uuuuugagauggaguuucgcucuguuguccaggcuggagugcaauggcaguuguuucacc

SEQ ID NO: 168837 - RNA, 60 nt, hsa
uuuugagauggagucuugcuccuguugugcaggcuggagugcaguggcacagucuuggcu

SEQ ID NO: 168838 - RNA, 60 nt, hsa
uuuucugauacagagucucacucuguugccaggcuggagugcaguggcgcaaucuuggcu

SEQ ID NO: 168839 - RNA, 60 nt, hsa
uccuuaacccaaugacccagugaugcugcaaggcuggaacgggguccaggagacugugug

SEQ ID NO: 168840 - RNA, 60 nt, hsa
caguagcaggaauaauaaaucccacuuuguaggcuggaaaacugagcugucaaaagaauc

SEQ ID NO: 168841 - RNA, 60 nt, hsa
ugggccuuguggggcaaauauuggguccccaggcuggaaagauggacagaggcccaaugg

SEQ ID NO: 168842 - RNA, 60 nt, hsa
cuccuuggaggaggcccccaggggugguagaggcuggaaggaagccacaucaggaggacg

SEQ ID NO: 168843 - RNA, 64 nt, hsa
auccuggggaaaaagcaucugucaaauaggaaacaucacaaaacugagcacucuucugugcacu

SEQ ID NO: 168844 - RNA, 64 nt, hsa
guaguuaagaugaaauuuauaugaaagcauuuuuaucacaaaauaaaaaagguuugccaagcuc

SEQ ID NO: 168845 - RNA, 56 nt, hsa
ucauagugauugaggcauaacuaucaaucacaaaaguauauucaaaaauuauauuu

SEQ ID NO: 168846 - RNA, 64 nt, hsa
acaacucgaaucacucauuuauuuccauauuaaaaucacaaacucauccauuaauguagauaaa

SEQ ID NO: 168847 - RNA, 64 nt, hsa
auaguguggaaagccacaucacaaaaaaagccacaucacaaaaaaaagccagugccuauugagu

SEQ ID NO: 168848 - RNA, 64 nt, hsa
gauucuggacuucuacaauaguguggaaagccacaucacaaaaaaagccacaucacaaaaaaaa

SEQ ID NO: 168849 - RNA, 64 nt, hsa
gacaaagcacaauuccauaugguauguaacuuuuaucacaaaucaaauagugacaucacaaaca

SEQ ID NO: 168850 - RNA, 64 nt, hsa
gguauguaacuuuuaucacaaaucaaauagugacaucacaaacauaauguccucuuuugcacaa

SEQ ID NO: 168851 - RNA, 64 nt, hsa
ggcaauggaauauaauggaauauucuugagacugaucacaaaaaaaaaaaccuuuuuaauauuu

SEQ ID NO: 168852 - RNA, 64 nt, hsa
ucuucuaagacggacacauuugaaccucagguucaucacaaaccugguaccuguugcuucccag

SEQ ID NO: 168853 - RNA, 64 nt, hsa
acuccaaccacauuccaagcugagauaaaaucaaaucacaaauguuuaaccacuuugcugcuga

SEQ ID NO: 168854 - RNA, 64 nt, hsa
acuccacaggaaaauguaagcuacuuugucauagaucacaaaagaaucauaaugcuaacaaacu

SEQ ID NO: 168855 - RNA, 64 nt, hsa
uaauguuaaguuuguaccuaauagaaauaugucuaucacaaaucuuuauugguauuauuuuaua

SEQ ID NO: 168856 - RNA, 64 nt, hsa
uucugauuuuuuaaguguuuucauauuuauagccaucacaaaauuuugcccaaaguguauggcu

SEQ ID NO: 168857 - RNA, 64 nt, hsa
aaguguguuccuguuucuucacgagcagacucgcaucacaaagcaugaauguuaacccacagaa

SEQ ID NO: 168858 - RNA, 64 nt, hsa
caaucugugugcugguuuuguugguuauguggaaaucacaaacuccagaggagcaaagggguuu

SEQ ID NO: 168859 - RNA, 64 nt, hsa
guagaggcagaggcaaaguuaucaucauacaaaaaucacaaacaaaaaggagaucuguauucgg

SEQ ID NO: 168860 - RNA, 64 nt, hsa
ugucacugcucaucaguuacuuccuuccauuuauaucacaaauacccaaguuucaauucuaacu

SEQ ID NO: 168861 - RNA, 64 nt, hsa; identical to SEQ ID NO: 52915

SEQ ID NO: 168862 - RNA, 64 nt, hsa; identical to SEQ ID NO: 52916

SEQ ID NO: 168863 - RNA, 64 nt, hsa
gaccauacaaguggauuaugguugucuggauggcagauaccaauagcaacauugucauaugcag

SEQ ID NO: 168864 - RNA, 64 nt, hsa
auccaggccuagacucaagguauuguaaaugacaagauaccaaauacaagauuuuaaaagcaac

SEQ ID NO: 168865 - RNA, 64 nt, hsa
gcagauugcuucccagggcucccugaguguguccagauaccaagugaggaaugaggugugauuu

SEQ ID NO: 168866 - RNA, 64 nt, hsa
agucuuuggugguuguagggcugguuuuaaaaccagauaccacauuuucuuccuauugaaaaca

SEQ ID NO: 168867 - RNA, 64 nt, hsa
guuguuacuauuguguuauucaugucuuuaaaucagauaccaaauauuuuuuaggaaagaaaaa

SEQ ID NO: 168868 - RNA, 64 nt, hsa
aucuauaaaaacaagguuagcauauucucaacacagauaccaccacuuucuuuuucccauuaua

SEQ ID NO: 168869 - RNA, 64 nt, hsa
gugucugugggggauugguuccaguuaccccuauagauaccaaaaucugcagaugcucaagucc

SEQ ID NO: 168870 - RNA, 64 nt, hsa
gccauuguggaagacaguguggggauaaagacagagauaccauucaacccagcaaucucauuac

SEQ ID NO: 168871 - RNA, 64 nt, hsa
gaucauuagagaaaugcaaaucgaaacaacaacgagauaccaucucacaccaguccaaauggcu

SEQ ID NO: 168872 - RNA, 64 nt, hsa
uagagggcacuagaacuuugugccagcgcuggcgagauaccauggugccauccuccuuucuaua

SEQ ID NO: 168873 - RNA, 64 nt, hsa
ucucaugcucucugaacagaagguauaccugggaagauaccagcuuuuucucucaggguucuga

SEQ ID NO: 168874 - RNA, 64 nt, hsa
ucuguccucauuuuguuuccuaugaucauccucuagauaccagauagaggcccauuccugcauu

SEQ ID NO: 168875 - RNA, 64 nt, hsa
acaugacaggcgggaguuuuguaccacuuuuagaagauaccagaugccucuguccucauuuugu

SEQ ID NO: 168876 - RNA, 64 nt, hsa; identical to SEQ ID NO: 60066

SEQ ID NO: 168877 - RNA, 64 nt, hsa; identical to SEQ ID NO: 60067

SEQ ID NO: 168878 - RNA, 64 nt, hsa; identical to SEQ ID NO: 60068

SEQ ID NO: 168879 - RNA, 64 nt, hsa; identical to SEQ ID NO: 60069

SEQ ID NO: 168880 - RNA, 64 nt, hsa; identical to SEQ ID NO: 60070

SEQ ID NO: 168881 - RNA, 64 nt, hsa; identical to SEQ ID NO: 60071

SEQ ID NO: 168882 - RNA, 64 nt, hsa; identical to SEQ ID NO: 60072

SEQ ID NO: 168883 - RNA, 64 nt, hsa; identical to SEQ ID NO: 60073

SEQ ID NO: 168884 - RNA, 64 nt, hsa; identical to SEQ ID NO: 60074

SEQ ID NO: 168885 - RNA, 64 nt, hsa; identical to SEQ ID NO: 60075

SEQ ID NO: 168886 - RNA, 64 nt, hsa; identical to SEQ ID NO: 60076

SEQ ID NO: 168887 - RNA, 64 nt, hsa
auucaacccuauagaaggagccuggacucugaucccucuguacaggcuggauggaaggggcccu

SEQ ID NO: 168888 - RNA, 64 nt, hsa
acuuguugagagaugugacaugguucuuggauuuccucuguagcagccuccuggacuuccugag

SEQ ID NO: 168889 - RNA, 64 nt, hsa
auauuuuguauggaugucauaaaagucuauuuaaccucuguaaugaaacuaaauaaaaauguuu

SEQ ID NO: 168890 - RNA, 64 nt, hsa
auuucaagagucauccagcaaugagagaauccugccucuguagaccaacauccagugugauuuu

SEQ ID NO: 168891 - RNA, 64 nt, hsa
acaccaaaaaaguaaugaucguaaagacacaaauccucuguaugccaucuugcauuggcacuga

SEQ ID NO: 168892 - RNA, 64 nt, hsa
gccaagcaccaguccaucaccccucccaggccagccucuguaaguuggccacacuuggggagug

SEQ ID NO: 168893 - RNA, 64 nt, hsa
cauuucucuuucugcugugucuucacaucacccuccucuguauaccuaaucugccucugccucu

SEQ ID NO: 168894 - RNA, 64 nt, hsa
cacuucuuccucuguucccacacuugggccucugccucuguaccugcagcucugcucucgggau

SEQ ID NO: 168895 - RNA, 64 nt, hsa
gguaaauuagcgaaaucaacccuuccuaaguuuaagggaaaaguuauuuuuaaaaacaacuuaa

SEQ ID NO: 168896 - RNA, 64 nt, hsa
uaauacagggacagggugucuccugaagauacuuagggaaaacaggagccuaccacaaggcucc

SEQ ID NO: 168897 - RNA, 64 nt, hsa
uuaccucuugagauauauuauugaugacauuuaaagggaaaaguccuaaauuuaccuuaaauaa

SEQ ID NO: 168898 - RNA, 64 nt, hsa
guaaaacuuuuaaauucaacaccugaaaaucaugagggaaaaugauuaccucuugagauauauu

SEQ ID NO: 168899 - RNA, 64 nt, hsa
uucuugccaauuuuguuguuuaaaaaaaaaauucagggaaaauuaaaaaccuggaacuccauaa

SEQ ID NO: 168900 - RNA, 64 nt, hsa
agguugggguggccauaaugguuuguugggggugagggaaaaaacccacagggaccagaauguu

SEQ ID NO: 168901 - RNA, 64 nt, hsa
ucacaguggguaaauauaucauacaucucuugaaagggaaaauauccaugucaguuucuuucac

SEQ ID NO: 168902 - RNA, 64 nt, hsa
uccauugugggguagguggucggggaugggagaaagggaaaagucagggaaggggagaagaaag

SEQ ID NO: 168903 - RNA, 64 nt, hsa
cuaauauguaguggccuuuucaaggccuagucccagggaaaacauuuuguagaguauaggggag

SEQ ID NO: 168904 - RNA, 64 nt, hsa
gagcuguaagaagaaaauggagacaaacagaaggagggaaaaaccaaccuacucugaaagccuu

SEQ ID NO: 168905 - RNA, 64 nt, hsa
auaaugugugauuaaaugcuuuuuuaaauugcuaagggaaaauaacaaaguguuaguaaucauu

SEQ ID NO: 168906 - RNA, 64 nt, hsa
uuucaauagauuauucugccauuuuuuaaaggaaagggaaaaugaaaacagcaugucuuuuuaa

SEQ ID NO: 168907 - RNA, 64 nt, hsa
caguggaaugaagucuuugauggguaggagagagagggaaaaccucaaacuacaucauagaagu

SEQ ID NO: 168908 - RNA, 64 nt, hsa
aacauggcgagacccuguuucuacaaaaagaaaaagggaaaaaaaaagcagggacugucauucu

SEQ ID NO: 168909 - RNA, 64 nt, hsa
caaugaaaaaaggucaguugauuccagugcuaaaagggaaaaaccugugguccgcccagaagag

SEQ ID NO: 168910 - RNA, 64 nt, hsa
gcagaaaagaaaaaaagguuaagcauaaaaagaaagggaaaaagcagaaacacugcagaagaca

SEQ ID NO: 168911 - RNA, 64 nt, hsa
gagaacacaccaaaaaagugaaagagaaauugaaagggaaaaaagacaaaaagcauaaggcucc

SEQ ID NO: 168912 - RNA, 64 nt, hsa
aaaagucuguaauuucaguuuuugugucggggagagggaaaaacuauuugucuguaguugcuuu

SEQ ID NO: 168913 - RNA, 64 nt, hsa
auucuucuguaaugagaauagacuggaacaugugagggaaaaauauuuaaaaaaagauggcagu

SEQ ID NO: 168914 - RNA, 64 nt, hsa
ucgcuugaaaccuucccacacucccugcuccaggagggaaaaacagauguuguugacagauaga

SEQ ID NO: 168915 - RNA, 64 nt, hsa
aggccaggauuaaggggaggcaaucaaugcaccuagggaaaaaauuuaaggagguauucacacu

SEQ ID NO: 168916 - RNA, 64 nt, hsa
cacucuaaggccuuugacugcagaggcaccuguuagggaaaaucagaugucucauauaauaagg

SEQ ID NO: 168917 - RNA, 64 nt, hsa
aguguagggcuaucuuuuuaaaaaaugucaacaaagggaaaauaaacuaucagcuuggaugguc

SEQ ID NO: 168918 - RNA, 64 nt, hsa
cugaauacuugaaguaggaaguaggaaauccaguagggaaaauaggguccuugaaacagaaaaa

SEQ ID NO: 168919 - RNA, 64 nt, hsa
uauguggauacagucauuauuuaaagcacaugccagggaaaaagaccaaauuuugaggucuuuu

SEQ ID NO: 168920 - RNA, 64 nt, hsa
ggguagaaguuaaaggagaaucugaaggcaggucagggaaaagaagaacuggaaaugaaacaga

SEQ ID NO: 168921 - RNA, 64 nt, hsa
aaagcgcuuuuggggguggcuuaugggggagaaaagggaaaaugcugucaguagauggaggcaa

SEQ ID NO: 168922 - RNA, 64 nt, hsa
cugaaaaggguucuggaguguucauucagagugaagggaaaacuuuauccuucuauuucuuaua

SEQ ID NO: 168923 - RNA, 64 nt, hsa
aggaaugagaacuuugcaguuggaugaauagagaagggaaaaguugcuggagcacggagugaag

SEQ ID NO: 168924 - RNA, 64 nt, hsa
ucuuugaauuuaaaggguguacaggucuuucuguagggaaaauuauuccauguaaacauuucaa

SEQ ID NO: 168925 - RNA, 64 nt, hsa
ucaccacugagcuuuaaauaagaauggaaauacaagggaaaaccugcguuguaaacaugaggau

SEQ ID NO: 168926 - RNA, 64 nt, hsa
ucugccacuugcacugugcuugcuccuaagcaaaagggaaaaggagcgcgcgugauagaagaaa

SEQ ID NO: 168927 - RNA, 64 nt, hsa
gauuuuaauuugggcaucucuagagaacgcuuucagggaaaaauacuuuaauaguaaaaagauu

SEQ ID NO: 168928 - RNA, 64 nt, hsa
cauuucuagauuauaaacugacuaaacuuacaucagggaaaaauugguauuuaugcaaaaaaaa

SEQ ID NO: 168929 - RNA, 64 nt, hsa
uuagugauaagauucauacacucuguauuuggggagggaaaaccuuuuuaagcaugguggggca

SEQ ID NO: 168930 - RNA, 64 nt, hsa
cacuguuuauaaaauuuccuuagagacuuuuugaagggaaaauagagcaacagggaaaaaugaa

SEQ ID NO: 168931 - RNA, 64 nt, hsa
ccuuagagacuuuuugaagggaaaauagagcaacagggaaaaaugaaagaaaugucuugguuac

SEQ ID NO: 168932 - RNA, 64 nt, hsa
caauacacagcuacagacacacauucuguugacaagggaaaaccuucaaagcauguuucuuucc

SEQ ID NO: 168933 - RNA, 64 nt, hsa
agggucuacgaagaauagggugaaaaaccucagaagggaaaacuccaaaccaguugggagacuu

SEQ ID NO: 168934 - RNA, 64 nt, hsa
ugcccugcagggcugagauguggcaggagcucccagggaaaaacgaagugcauuugauuggugu

SEQ ID NO: 168935 - RNA, 64 nt, hsa
gcacaucauauguccaugaaacuucagauaaacuagggaaaacugggugcugaggugaaagcau

SEQ ID NO: 168936 - RNA, 64 nt, hsa
cccucagacaaggaacucucuccucucuuuuuggagggaaaaaaaaaauaucacuacacaaacc

SEQ ID NO: 168937 - RNA, 64 nt, hsa
caauggaacuggucagugauucucuaccccaaguagggaaaaccuccaucuuuucccugucuuc

SEQ ID NO: 168938 - RNA, 64 nt, hsa
cgcaucaggacugcuucaucgucuuggcugagaaagggaaaagacacacaagucgcguggguug

SEQ ID NO: 168939 - RNA, 64 nt, hsa
agcgaggcccucugcaagaagcucaaggaagcucagggaaaauggacguauucagagaguguuu

SEQ ID NO: 168940 - RNA, 64 nt, hsa
guuuccaaaaucaaagauuugaccuuaagagggaagggaaaaaagugugaaaggaugaugaaga

SEQ ID NO: 168941 - RNA, 64 nt, hsa
ucuuuugccuuuaagacgauucauucuugucuagagggaaaaucuggcugauuugggaauaaaa

SEQ ID NO: 168942 - RNA, 64 nt, hsa
uuacugacaaaaagggaaaauacgaaacacagaaagggaaaauaaacugacuuuuauaaugaau

SEQ ID NO: 168943 - RNA, 64 nt, hsa
uuccaaucaguguauugcucauuuacugacaaaaagggaaaauacgaaacacagaaagggaaaa

SEQ ID NO: 168944 - RNA, 64 nt, hsa
aaaaaaguuguuugcuuaaaaaaaauuucaugugagggaaaaaaaaaaaaccuauuccagaaua

SEQ ID NO: 168945 - RNA, 64 nt, hsa
gaaaacagaaaacaauuccacgaggccaaucuaaagggaaaaaauccuacacuacuuuuacuac

SEQ ID NO: 168946 - RNA, 64 nt, hsa
ucuucaguuuuaacgaguaauuggauaaacccugagggaaaacggagguagauucagcaccuaa

SEQ ID NO: 168947 - RNA, 64 nt, hsa
ucagacugaacugugugcaacaggaaaagucaaaagggaaaagguagcugaugagguuacaugg

SEQ ID NO: 168948 - RNA, 64 nt, hsa
caagguguuucauuuucguuuuuaugggaaaccaagggaaaagcacauugcgauccauucagug

SEQ ID NO: 168949 - RNA, 64 nt, hsa
gcaauaugcauuuaaauacagucuuccauuugcaagggaaaagucucuuguaauccgaaucucu

SEQ ID NO: 168950 - RNA, 64 nt, hsa
uccaugggagaaaauagauaagaguagaaacugcagggaaaauuauuugcauaacaauuccucu

SEQ ID NO: 168951 - RNA, 64 nt, hsa
ucacuuuguaagacccauauuuuuaacucuucccagggaaaauucauguugcugcagaaguagg

SEQ ID NO: 168952 - RNA, 64 nt, hsa
gcagauucuucacugacuugaauugagaugggcaagggaaaaggucccuggacucccuccugcc

SEQ ID NO: 168953 - RNA, 64 nt, hsa
auacauaaagugcuugagucuauuuuuaauaaaaagggaaaaagcaacuugaggcaaccugucc

SEQ ID NO: 168954 - RNA, 64 nt, hsa
cuaccccuauuuguagggaaaaggacuugagugcagggaaaacucaaaucccaggcccugggaa

SEQ ID NO: 168955 - RNA, 64 nt, hsa
gucucugaggaugaaguuuccuaccccuauuuguagggaaaaggacuugagugcagggaaaacu

SEQ ID NO: 168956 - RNA, 64 nt, hsa
ucuccuauuuuuuuuuuuaacuaccuuaaacuuaagggaaaaguucuccuaucuugauuucacu

SEQ ID NO: 168957 - RNA, 61 nt, hsa; identical to SEQ ID NO: 108347

SEQ ID NO: 168958 - RNA, 64 nt, hsa
gcaagggccaaacauucuuuaucccucccaccccagggaaaacauuuggaaaauaguccuuuuu

SEQ ID NO: 168959 - RNA, 64 nt, hsa
caccaaagacagagggagcuucacugagacucagagggaaaaggaaaagagccucaaacauuuu

SEQ ID NO: 168960 - RNA, 64 nt, hsa
auuuuuggagauaguaaaaauuuaaaaauguaauagggaaaauauuuaauuuuuaagucaaaaa

SEQ ID NO: 168961 - RNA, 64 nt, hsa
ugcugaacagaagggcaagagagguggaucugugagggaaaagacccaauaggauaacucaagu

SEQ ID NO: 168962 - RNA, 64 nt, hsa
ccucuggcuauuuaagguucaaaaucaagugccuagggaaaauuccaauggaugauuuucuggg

SEQ ID NO: 168963 - RNA, 64 nt, hsa
gaauuacuuguuuacauccaacaaaugguuagcuagggaaaacagugcaaacugaguguuagua

SEQ ID NO: 168964 - RNA, 64 nt, hsa
guugacuguccuuucaaggaaaaacuugcaauagagggaaaagccauuaaagcagcucccugcu

SEQ ID NO: 168965 - RNA, 64 nt, hsa
uccaccuccuuccugaacucuaauagagguuaaaagggaaaaaaaaaauucuguagauagcaaa

SEQ ID NO: 168966 - RNA, 64 nt, hsa
gggacaagcagguuuauguguuuaaacagaaagaagggaaaagguacuaugugauaugguacug

SEQ ID NO: 168967 - RNA, 64 nt, hsa
uuuucaugaauuuugugaacuugccaaaaggggaagggaaaaaucuuuguguuacuucacucaa

SEQ ID NO: 168968 - RNA, 64 nt, hsa
uagauacauaaagacuugagaagggaauuguuuaagggaaaagaaaagaguaauaauuuuuuuu

SEQ ID NO: 168969 - RNA, 64 nt, hsa
caaauauuaaaauuaggaauuuaggcauuaccucagggaaaagccuugacagugaaaagaaacu

SEQ ID NO: 168970 - RNA, 64 nt, hsa
aggccccugcaaagaagggagagaagguacccaaagggaaaaagagaaaagcugaugcuggcaa

SEQ ID NO: 168971 - RNA, 64 nt, hsa
uuuauuggauaaauaugaauaaauauuuucucucagggaaaauaauuuuugaaaguagggugau

SEQ ID NO: 168972 - RNA, 64 nt, hsa
uuuauuguuaugaaacuguaaggucuacauauaaagggaaaaaguuaauguggaaagcugaucu

SEQ ID NO: 168973 - RNA, 64 nt, hsa
auucccggcauaccuauuagugucuuaaaaaggaagggaaaagucuuuuguugcccucuccuau

SEQ ID NO: 168974 - RNA, 64 nt, hsa
aaaaaaaaaagaaaggacauugaguuuuaacagaagggaaaaggaaagaagaaaagauuuuugc

SEQ ID NO: 168975 - RNA, 64 nt, hsa
aaacagcacuaaauaacuugggggaaacggggggagggaaaaugaaaugaaaacccuguugcug

SEQ ID NO: 168976 - RNA, 64 nt, hsa
gcucucaccaauuguagauuggugugaauugcuaagggaaaaaccuuaugcagagaaaaguuuu

SEQ ID NO: 168977 - RNA, 64 nt, hsa
ucaucuuagaagaaaccccaugaaggaaaagaauagggaaaagcuuucagcaguuauuuagccc

SEQ ID NO: 168978 - RNA, 64 nt, hsa
gcugcgacguacugucacugaugagagacugggaagggaaaagcauauauauauagauauauag

SEQ ID NO: 168979 - RNA, 64 nt, hsa
cuacuucucugagcucagaaagugccccuugaugagggaaaaugucccacugcacugcgaauuu

SEQ ID NO: 168980 - RNA, 64 nt, hsa
ggcuuuuaucuugcggggucagagcgcccucuagagggaaaagcuagaggcacaggguuucugc

SEQ ID NO: 168981 - RNA, 64 nt, hsa
gaacaaccaccccguggcuuguguggggucucgcagggaaaagggcuggcuucuagguccccga

SEQ ID NO: 168982 - RNA, 64 nt, hsa
guuuuguaaucaagauuuuauguaacauuuguaaagggaaaauuagcacuuuugugguucuuaa

SEQ ID NO: 168983 - RNA, 64 nt, hsa
uguaaagggaaaauuagcacuuuugugguucuuaagggaaaagaaacagaccuuguggagauua

SEQ ID NO: 168984 - RNA, 64 nt, hsa
ucucucagauccauaauccauacucagugaaagcagggaaaaaauauuuucacuuauuuuauuu

SEQ ID NO: 168985 - RNA, 64 nt, hsa
accuguguaaguauugugaaaacccuuuucuuccagggaaaaauuauuggaaauuccuuaacug

SEQ ID NO: 168986 - RNA, 64 nt, hsa
cauagaacacgguuacagcugguucuguagaaagagggaaaagaugauugugacaauucagagc

SEQ ID NO: 168987 - RNA, 64 nt, hsa
agauucucuggcucagccccagccuuucugaagaagggaaaacuagggacccagaugguuuaag

SEQ ID NO: 168988 - RNA, 64 nt, hsa
uuaacuuccuauucuuucuuaaauuugauggagaagggaaaauaaauugcaguuauugauucuu

SEQ ID NO: 168989 - RNA, 64 nt, hsa
ucaguaggauauccaaaguucaauguguuucaaaagggaaaacuuuuacuugugggggugggag

SEQ ID NO: 168990 - RNA, 64 nt, hsa
uucccauccucuucuuuuagcaguaaaauagcugagggaaaagggagggaaaaggaaguuaugg

SEQ ID NO: 168991 - RNA, 64 nt, hsa
uucuuuuagcaguaaaauagcugagggaaaagggagggaaaaggaaguuaugggaauaccugug

SEQ ID NO: 168992 - RNA, 64 nt, hsa
caccauacaaguauuuguuuaucauuauuuugauauccauuacccucaccucucccuaguucau

SEQ ID NO: 168993 - RNA, 64 nt, hsa
agacauuugccuuaggaacuuaacucuuguuuguauccauuagucuaugguaaaauugguuuug

SEQ ID NO: 168994 - RNA, 64 nt, hsa
uucucuuccugccuuuccucuaucagagaaguugauccauuaaguaauuauguuuggucuauug

SEQ ID NO: 168995 - RNA, 64 nt, hsa
ccaggguuuagagugaaaacagccagucugaaguauccauuacucaagucccaaggugaccucu

SEQ ID NO: 168996 - RNA, 64 nt, hsa
cauaagaacagcuaccuucuccacuugguggcacaagagguagggaggggaguauggguucauu

SEQ ID NO: 168997 - RNA, 64 nt, hsa
aaguuaaaggaaacaaaauuuguaccauugucccaagagguauuuuacuguauauauuguggua

SEQ ID NO: 168998 - RNA, 64 nt, hsa
acaguauucugugaugucuuuuuaacuuuuuggaaagagguaucauuuguagaaaaaauuugau

SEQ ID NO: 168999 - RNA, 64 nt, hsa
agguaccauucaaagcagggggaaagguaggaagaagagguaauuuuuacugaaaauuagggca

SEQ ID NO: 169000 - RNA, 64 nt, hsa
aguuuuauuauaaaccaagaauuuuggacuugcaaagagguauuauugcaauaaugcacuuuuc

SEQ ID NO: 169001 - RNA, 64 nt, hsa
aaugggaaugauuucuguauguucccuugguaccaagagguacuaugcaaaguaaccuauuaca

SEQ ID NO: 169002 - RNA, 64 nt, hsa
uauaucuaauuaugucuaugugguaauaccuaaaaagagguagagagacucuauguucacaaaa

SEQ ID NO: 169003 - RNA, 64 nt, hsa
agaauaccccugcuauuuaaauaaagcucauaccaagagguaacauuuugccccgggccaaauu

SEQ ID NO: 169004 - RNA, 64 nt, hsa
caccagaagugccaugcucagaaauguugguuacaugaaugaaugaaccaugaaugaaugaaau

SEQ ID NO: 169005 - RNA, 64 nt, hsa
agaagugccaugcucagaaauguugguuacaugaaugaaugaaccaugaaugaaugaaaucucu

SEQ ID NO: 169006 - RNA, 64 nt, hsa
gcucagaaauguugguuacaugaaugaaugaaccaugaaugaaugaaaucucuguccgugugcu

SEQ ID NO: 169007 - RNA, 64 nt, hsa
aauauacagcuacuucccagcuaaucuccacccaaugaaugaugaugguauaguaugugcauaa

SEQ ID NO: 169008 - RNA, 64 nt, hsa
gguaaaaaaaaaaacuaaggcauuugauuaaauuaugaaugaguuuuacaaauuccuuucagag

SEQ ID NO: 169009 - RNA, 64 nt, hsa
caauuacuauuugacugacugacugaaugaaugaaugaaugaggaagaaaacuguggguaauca

SEQ ID NO: 169010 - RNA, 64 nt, hsa
ugcucaauuacuauuugacugacugacugaaugaaugaaugaaugaggaagaaaacugugggua

SEQ ID NO: 169011 - RNA, 64 nt, hsa
gaggugcucaauuacuauuugacugacugacugaaugaaugaaugaaugaggaagaaaacugug

SEQ ID NO: 169012 - RNA, 64 nt, hsa
auuuuauuguucauaauuaaugaauaaaauugauaugaaugaauauaguguucuuugaauuagu

SEQ ID NO: 169013 - RNA, 64 nt, hsa
gaagcaaggcaugaacugcuagguauuauuaagaaugaaugauuuuugcauuuaaguuguuuga

SEQ ID NO: 169014 - RNA, 64 nt, hsa
ugugguaggugcucaguaaauguguguugaauaaaugaaugaaugaaugaacaaaugaaugaau

SEQ ID NO: 169015 - RNA, 64 nt, hsa
guaggugcucaguaaauguguguugaauaaaugaaugaaugaaugaacaaaugaaugaauuugc

SEQ ID NO: 169016 - RNA, 64 nt, hsa
gugcucaguaaauguguguugaauaaaugaaugaaugaaugaacaaaugaaugaauuugcuuac

SEQ ID NO: 169017 - RNA, 64 nt, hsa
uguguguugaauaaaugaaugaaugaaugaacaaaugaaugaauuugcuuacuucaaggcaaaa

SEQ ID NO: 169018 - RNA, 64 nt, hsa
gagacuagaaauguaucuaaauugggggaacagaaugaaugaauuaaugaaugagaguuccuuu

SEQ ID NO: 169019 - RNA, 64 nt, hsa
guaucuaaauugggggaacagaaugaaugaauuaaugaaugagaguuccuuugcuuuaaccauu

SEQ ID NO: 169020 - RNA, 64 nt, hsa
cggagacucugucucaaaaaaaaaaaaaaaaaagaugaaugaaaauaugaaauauauaaacuag

SEQ ID NO: 169021 - RNA, 64 nt, hsa
acagauuauaccuggaugauucaggagaguguauaugaaugaauaaagcauccaaguauauaug

SEQ ID NO: 169022 - RNA, 64 nt, hsa
aguguauaugaaugaauaaagcauccaaguauauaugaaugaauaaaguauguaaguaucacca

SEQ ID NO: 169023 - RNA, 64 nt, hsa
aaaggaaaaaaaaggcgcaguggugaugacccucaugaaugagccacgcuucugcauucuucuu

SEQ ID NO: 169024 - RNA, 64 nt, hsa
uuauucaaaaaaauguacuggugugauaucuuguaugaaugaucauuuaaauacaguacauuac

SEQ ID NO: 169025 - RNA, 64 nt, hsa
acccaaaaggcagaagcaacccaaauguucaucaaugaaugaaugaauggcuaagcaaaaugug

SEQ ID NO: 169026 - RNA, 64 nt, hsa
aaaaggcagaagcaacccaaauguucaucaaugaaugaaugaauggcuaagcaaaaugugauau

SEQ ID NO: 169027 - RNA, 64 nt, hsa
gccuagcacacaguaggcgcucaauaaauguugaaugaaugaaugauuuaaucaagacuugauc

SEQ ID NO: 169028 - RNA, 64 nt, hsa
agcacacaguaggcgcucaauaaauguugaaugaaugaaugauuuaaucaagacuugaucaccc

SEQ ID NO: 169029 - RNA, 64 nt, hsa
uuagccagugcagggggaaaauugccucugaauaaugaaugaugaaagccugacgccgugcccc

SEQ ID NO: 169030 - RNA, 64 nt, hsa
ccccacugcccccaccuuaaugugaauuugacugaugaaugaagagcguuucuaauaaaguuug

SEQ ID NO: 169031 - RNA, 64 nt, hsa
aagccaagaacagccuuuauuggugaagaaaagaaugaaugauucuuuguaggcgccaucagcc

SEQ ID NO: 169032 - RNA, 64 nt, hsa
uucaucugccuaggccuacucauuauuuuagagaaugaaugaagcaacaaggaagagagaccau

SEQ ID NO: 169033 - RNA, 64 nt, hsa
uucccagccaagggccucggggagcguucuaaauaugaaugaaugggauauuuugaaaugaacu

SEQ ID NO: 169034 - RNA, 64 nt, hsa
auucuuugcaauacugcuuaauugcugauaccauaugaaugaaacaugggcugugauuacugca

SEQ ID NO: 169035 - RNA, 64 nt, hsa
ugcuaugauauauuuauuauaaaauagggaaugaaugaaugaauauggauugcuguuaacuaga

SEQ ID NO: 169036 - RNA, 64 nt, hsa
ucacugcuaugauauauuuauuauaaaauagggaaugaaugaaugaauauggauugcuguuaac

SEQ ID NO: 169037 - RNA, 64 nt, hsa
uguucuguaaaagauuuguccaauaaacgacuuaaugaaugauacaucagucagauuuuaggaa

SEQ ID NO: 169038 - RNA, 64 nt, hsa
aucucuaaacuauugacuaaauuccagugagaguaugaaugaagaacaacuagauauuaauguc

SEQ ID NO: 169039 - RNA, 64 nt, hsa
uacuuuagacuaauuguguuuguccguccaugccaugaaugagugggcuguaguugggccuaaa

SEQ ID NO: 169040 - RNA, 64 nt, hsa
gggauuuuuggugcaaguagcacaugguuuaaauaugaaugaacaaaccugugaucuaguccuu

SEQ ID NO: 169041 - RNA, 59 nt, hsa
ugaaguuaggaaauccuugaaagaaaaucaugaaugaacaaagguaauaugucuagcac

SEQ ID NO: 169042 - RNA, 64 nt, hsa
uucuaagugaacauuccuuauagaaaccuuucacaugaaugacuauaaacugaagcuuuaaaug

SEQ ID NO: 169043 - RNA, 64 nt, hsa
aaacaaccaauuuuuuuguuuuucaguuguugcuaugaaugauuuugagccuuuuuuuuuaagc

SEQ ID NO: 169044 - RNA, 64 nt, hsa
aaauauggaggucauuaccaagaaaugcuuugguaugaaugagagccagaucuccacuguguga

SEQ ID NO: 169045 - RNA, 64 nt, hsa
guauagcgugaaagcagcuauacacaauacagaaaugaaugagugugguuauguucuaauaaaa

SEQ ID NO: 169046 - RNA, 64 nt, hsa
ugggcuauuagaguucauggaacauagaacaaccaugaaugaguggcaugauccgugcuuaaug

SEQ ID NO: 169047 - RNA, 64 nt, hsa
aaggaauacuuuuaguuugacagccuuauaugacaugaaugaaaacugcuguuuuaaagugguu

SEQ ID NO: 169048 - RNA, 64 nt, hsa
guuuuauuacagauuuaaucacaaaucauuuuuuaugaaugauugagugaaaauaguguuuaua

SEQ ID NO: 169049 - RNA, 64 nt, hsa
ggccucuuuaagaguuaguuucuuugggauugcuaugaaugauacccugaauuuggccugcacu

SEQ ID NO: 169050 - RNA, 64 nt, hsa
gccaaacccaugaggcaaugucaggaacagaaggaugaaugaggucccaggcagagaaucauac

SEQ ID NO: 169051 - RNA, 64 nt, hsa
ccucaaagccuagcacauaguagguacugaaugaaugaaugaacaaggggugccaggagacugc

SEQ ID NO: 169052 - RNA, 64 nt, hsa
auauccucaaagccuagcacauaguagguacugaaugaaugaaugaacaaggggugccaggaga

SEQ ID NO: 169053 - RNA, 64 nt, hsa
cuuucaguaagugggugaaugaaugacugaaugaaugaaugaauggcucagcugaggaauguaa

SEQ ID NO: 169054 - RNA, 64 nt, hsa
gcagcuuucaguaagugggugaaugaaugacugaaugaaugaaugaauggcucagcugaggaau

SEQ ID NO: 169055 - RNA, 64 nt, hsa
ccuggcacuuaggcagcuuucaguaagugggugaaugaaugacugaaugaaugaaugaauggcu

SEQ ID NO: 169056 - RNA, 64 nt, hsa
agagcucggccaucacgucaagcuuuggauaacgaugaaugagccguauacaaggaauaugaca

SEQ ID NO: 169057 - RNA, 64 nt, hsa
ucugauuauacaccauuuuugagcagaucuuggaaugaaugacaugaccuuucccuagagaaua

SEQ ID NO: 169058 - RNA, 64 nt, hsa
gaaacauaaggaguggguacaaagacuucuaucuaugaaugauuaaaaaggcuagaguacgaau

SEQ ID NO: 169059 - RNA, 64 nt, hsa
uguuuauaagacauuguuccuuauacaccuguuuaugaaugaaaagaaacauaaggagugggua

SEQ ID NO: 169060 - RNA, 64 nt, hsa
ucuacugaguggccaugggcauguggauauggccaugaaugagcaagauccucucugauccugu

SEQ ID NO: 169061 - RNA, 64 nt, hsa
uauugcucucuuuauaaugauuaaucacuuuauuaugaaugaaugaaugaauuugauggauuua

SEQ ID NO: 169062 - RNA, 64 nt, hsa
gcucucuuuauaaugauuaaucacuuuauuaugaaugaaugaaugaauuugauggauuuaaaau

SEQ ID NO: 169063 - RNA, 64 nt, hsa
ucuuuauaaugauuaaucacuuuauuaugaaugaaugaaugaauuugauggauuuaaaauggcu

SEQ ID NO: 169064 - RNA, 64 nt, hsa
uugugcaguauuuaugugauugugccuaugcaugaugaaugaaugaauuucaguuguacauugc

SEQ ID NO: 169065 - RNA, 64 nt, hsa
gcaguauuuaugugauugugccuaugcaugaugaaugaaugaauuucaguuguacauugccuaa

SEQ ID NO: 169066 - RNA, 64 nt, hsa
gcacuugacuagucuuaaaacaaagaaagaacgaaugaaugaaugaaucuguggcuggaugcag

SEQ ID NO: 169067 - RNA, 64 nt, hsa
uugacuagucuuaaaacaaagaaagaacgaaugaaugaaugaaucuguggcuggaugcaguggc

SEQ ID NO: 169068 - RNA, 64 nt, hsa
gcuugccacagagcggggacucgguaagcacuuaaugaaugaaugaauucuaagucaauccaag

SEQ ID NO: 169069 - RNA, 64 nt, hsa
gccacagagcggggacucgguaagcacuuaaugaaugaaugaauucuaagucaauccaagaguc

SEQ ID NO: 169070 - RNA, 64 nt, hsa; identical to SEQ ID NO: 169065

SEQ ID NO: 169071 - RNA, 64 nt, hsa; identical to SEQ ID NO: 169064

SEQ ID NO: 169072 - RNA, 64 nt, hsa
ccugcauauauauguaugaagggcauguauauguaugaaugagcaaacauauuugaaaguuaac

SEQ ID NO: 169073 - RNA, 64 nt, hsa
aagaguauaaauagaagggagaguguauauguguaugaaugaacauacauuuccugcauauaua

SEQ ID NO: 169074 - RNA, 64 nt, hsa
ucaagcgaugaaacuggaaaacuacaagccacgaaugaaugaauuaggaaagaaaaaaaguagg

SEQ ID NO: 169075 - RNA, 64 nt, hsa
gaaugaaugaauuaggaaagaaaaaaaguaggaaaugaaugaucuuggcuuuccuauaagaaau

SEQ ID NO: 169076 - RNA, 64 nt, hsa
auugugauaugaaaacagcuauagacaaucauaaaugaaugaucauggcuauguuuuaauaaaa

SEQ ID NO: 169077 - RNA, 64 nt, hsa
acugugguaugaaaacagcuauagacaaucauaaaugaaugaucauggcuauguuuuaauaaaa

SEQ ID NO: 169078 - RNA, 64 nt, hsa
uguauauugacuuucaugucgucaugcaucugucaugaaugaaugauacuuugcacugggcugu

SEQ ID NO: 169079 - RNA, 64 nt, hsa
uauugacuuucaugucgucaugcaucugucaugaaugaaugauacuuugcacugggcuguacga

SEQ ID NO: 169080 - RNA, 64 nt, hsa
uauguauaaguguguacaagcauucaagaaacugaugaaugaugaaugaaugaaugagccaaag

SEQ ID NO: 169081 - RNA, 64 nt, hsa
aaguguguacaagcauucaagaaacugaugaaugaugaaugaaugaaugagccaaagaacaaau

SEQ ID NO: 169082 - RNA, 64 nt, hsa
guguacaagcauucaagaaacugaugaaugaugaaugaaugaaugagccaaagaacaaauaaau

SEQ ID NO: 169083 - RNA, 64 nt, hsa
acaagcauucaagaaacugaugaaugaugaaugaaugaaugagccaaagaacaaauaaaugagc

SEQ ID NO: 169084 - RNA, 64 nt, hsa
ggcagagagcggauacucaaguaaguuuuguuaaaugaaugaaugaauuuagaaccacacaaug

SEQ ID NO: 169085 - RNA, 64 nt, hsa
gagagcggauacucaaguaaguuuuguuaaaugaaugaaugaauuuagaaccacacaaugccaa

SEQ ID NO: 169086 - RNA, 64 nt, hsa
cggggaauucuuaaaacugugcucaacuauuaaaaugaaugagcuuucuuugugucuguguuac

SEQ ID NO: 169087 - RNA, 64 nt, hsa
uccuagaaucucaaguggaauuggaaucauaaaaaugaaugagauuugaaaacuuucacaaaga

SEQ ID NO: 169088 - RNA, 64 nt, hsa
aauuuacaauuuaugugcuuauaaaauuaguuuuaugaaugaacaauaaacugaugcauauaau

SEQ ID NO: 169089 - RNA, 64 nt, hsa; identical to SEQ ID NO: 72083

SEQ ID NO: 169090 - RNA, 64 nt, hsa; identical to SEQ ID NO: 72084

SEQ ID NO: 169091 - RNA, 64 nt, hsa; identical to SEQ ID NO: 72085

SEQ ID NO: 169092 - RNA, 64 nt, hsa; identical to SEQ ID NO: 72086

SEQ ID NO: 169093 - RNA, 64 nt, hsa; identical to SEQ ID NO: 72087

SEQ ID NO: 169094 - RNA, 64 nt, hsa; identical to SEQ ID NO: 72088

SEQ ID NO: 169095 - RNA, 64 nt, hsa; identical to SEQ ID NO: 72089

SEQ ID NO: 169096 - RNA, 64 nt, hsa; identical to SEQ ID NO: 72090

SEQ ID NO: 169097 - RNA, 64 nt, hsa; identical to SEQ ID NO: 72091

SEQ ID NO: 169098 - RNA, 64 nt, hsa; identical to SEQ ID NO: 72092

SEQ ID NO: 169099 - RNA, 64 nt, hsa; identical to SEQ ID NO: 72093

SEQ ID NO: 169100 - RNA, 64 nt, hsa; identical to SEQ ID NO: 72094

SEQ ID NO: 169101 - RNA, 64 nt, hsa; identical to SEQ ID NO: 72095

SEQ ID NO: 169102 - RNA, 64 nt, hsa; identical to SEQ ID NO: 72096

SEQ ID NO: 169103 - RNA, 64 nt, hsa; identical to SEQ ID NO: 72097

SEQ ID NO: 169104 - RNA, 64 nt, hsa; identical to SEQ ID NO: 72098

SEQ ID NO: 169105 - RNA, 64 nt, hsa; identical to SEQ ID NO: 72099

SEQ ID NO: 169106 - RNA, 64 nt, hsa; identical to SEQ ID NO: 72100

SEQ ID NO: 169107 - RNA, 64 nt, hsa; identical to SEQ ID NO: 72101

SEQ ID NO: 169108 - RNA, 64 nt, hsa; identical to SEQ ID NO: 72102

SEQ ID NO: 169109 - RNA, 64 nt, hsa; identical to SEQ ID NO: 72103

SEQ ID NO: 169110 - RNA, 64 nt, hsa; identical to SEQ ID NO: 72104

SEQ ID NO: 169111 - RNA, 64 nt, hsa; identical to SEQ ID NO: 72105

SEQ ID NO: 169112 - RNA, 64 nt, hsa; identical to SEQ ID NO: 72106

SEQ ID NO: 169113 - RNA, 64 nt, hsa; identical to SEQ ID NO: 72107

SEQ ID NO: 169114 - RNA, 64 nt, hsa; identical to SEQ ID NO: 72108

SEQ ID NO: 169115 - RNA, 64 nt, hsa; identical to SEQ ID NO: 72109

SEQ ID NO: 169116 - RNA, 64 nt, hsa
gcccacaaggcuaaaauauuuacauucucacccauuacagaaaaaguuugauaauuccugcuuu

SEQ ID NO: 169117 - RNA, 64 nt, hsa
guuuauuauaaauaacccagucucagauauucuguuacagaaacacaaaauggacuaagacacc

SEQ ID NO: 169118 - RNA, 64 nt, hsa
uucuaucaaaagcuaaauauggcacacuuguucuuuacagaaaaauaaagauauuuuaaacaaa

SEQ ID NO: 169119 - RNA, 64 nt, hsa
aguuuccuuuguauaggaguaugcucacuuaaauuuacagaaagaggugagcuguguuaaaccu

SEQ ID NO: 169120 - RNA, 64 nt, hsa
cuuguaaauguauuuguaaaaauuguauauauuuuuacagaaagucuauuucuuugaaacgaag

SEQ ID NO: 169121 - RNA, 64 nt, hsa
gugguuuuuguuuuuuuuuucauuuucuguuggauuacagaaaaagaaugggacccauucaggu

SEQ ID NO: 169122 - RNA, 64 nt, hsa
agaccaaaaacaagcuucuugguauaaaagacucuuacagaauauguguauuguaauuuauuga

SEQ ID NO: 169123 - RNA, 64 nt, hsa
gaaaaaugacacacaaaacaaaauaucuggaccuuuacagaagacguuugcugacccccacuuu

SEQ ID NO: 169124 - RNA, 64 nt, hsa
uuacuucuauuuuuuaaaauaauggaguaacaaauuacagaauagcuaaauaauuuuuuaaaaa

SEQ ID NO: 169125 - RNA, 64 nt, hsa
caguaacauuuugugggagaaagaggagcuggaguuacagaaaugauugucucuugguucucag

SEQ ID NO: 169126 - RNA, 64 nt, hsa
cacuuugcacgccggaacugccuugggaccacaguuacagaaaaaauguaaacucagagugauc

SEQ ID NO: 169127 - RNA, 64 nt, hsa
agguacugucucgguaucauucugcuaaucauuguuacagaauggugacuucauuugugcuaac

SEQ ID NO: 169128 - RNA, 64 nt, hsa
aaucuucauacugaauucuucuguugccuuuuucuuacagaaugacugaaaauuugaaagaaaa

SEQ ID NO: 169129 - RNA, 64 nt, hsa
uuuuagugcuaucaucauuccuaacaagacuaacuuacagaaaaauaauuauaucugacugauu

SEQ ID NO: 169130 - RNA, 64 nt, hsa
aaagaacaaccuuaaaacuuuuaacagauaaaacuuacagaaaccuaugauauagaauucauau

SEQ ID NO: 169131 - RNA, 64 nt, hsa
ucugaccaccaggcuaugacguuccugcugcgcauuacagaaagcuuuuaacugugaucaggca

SEQ ID NO: 169132 - RNA, 64 nt, hsa
uuaauaggcuuuauuuguaagagcaguuuuauguuuacagaaaaauuaggcacaaagggauucc

SEQ ID NO: 169133 - RNA, 64 nt, hsa
aauuccuguuguauaugucuauucacauugggucuuacagaaccaucuggcuucauucuucuug

SEQ ID NO: 169134 - RNA, 64 nt, hsa
gauaugacauuuauucaaaguuaaaagcaaacacuuacagaauuaugaagagguaucuguuuaa

SEQ ID NO: 169135 - RNA, 64 nt, hsa
gcaaaagaaacuaucaagagaguaaacagacagcuuacagaaugggagaaaauuguugcaaacu

SEQ ID NO: 169136 - RNA, 64 nt, hsa
aguuuuaaacucuaggggaauuaacaguauuucuuuacagaauggauuuguuaaacuagcacag

SEQ ID NO: 169137 - RNA, 64 nt, hsa
gaacaauuaaauaugguuaguuccagagugcaaauuacagaaggaagcuacuuguuuaaaauuc

SEQ ID NO: 169138 - RNA, 64 nt, hsa
uagaauuaacuaagaagccaaaaauggcaacaauuuacagaaaucccaccuuuccaugcuuaag

SEQ ID NO: 169139 - RNA, 64 nt, hsa
caagauauagcacuuucaaaaugaaucuaaaccuuuacagaaacuuucuuauagguuaugccuu

SEQ ID NO: 169140 - RNA, 64 nt, hsa
aagcuuuucaguaggauucugggacauggauucauuacagaaauguauguguagcugugcccua

SEQ ID NO: 169141 - RNA, 64 nt, hsa
aggcaggaggauugcuugaggccaggaguuuaaguuacagaacuaugaucacacugccgcacug

SEQ ID NO: 169142 - RNA, 64 nt, hsa
cauauuagaauugugucauuuaucaaaccuuuuauuacagaaaaaaaucugaacugagaaagga

SEQ ID NO: 169143 - RNA, 64 nt, hsa
aaaaagccagagaaccuagaaaacauccaguggauuacagaauuucuuccccauauucacuccu

SEQ ID NO: 169144 - RNA, 64 nt, hsa
aauuuacaaacuccaagcacuaaaaggcaguauauuacagaaacucuguagaggcugaacuguu

SEQ ID NO: 169145 - RNA, 64 nt, hsa
gauggcaaguguacaaccaaaccaauccacuugcuuacagaaagaauguuuaguguaguuaaga

SEQ ID NO: 169146 - RNA, 64 nt, hsa
acaauugagaugcuaacagggaggauuacaguguuuacagaacaaccuucagcgccgaccugga

SEQ ID NO: 169147 - RNA, 64 nt, hsa
uuuaaaugucuggacauucugaaauaauuuccgguuacagaauuacccuuuuuaggaucaucuu

SEQ ID NO: 169148 - RNA, 64 nt, hsa
ugaaucucccaucaucccaucccuuaaccccuuuuuacagaaauuuuaguuacaaucugaguaa

SEQ ID NO: 169149 - RNA, 64 nt, hsa
ucgacacccagcuucuggaauugcugcuuucuuuuuacagaaauuacuacccaacagauuucag

SEQ ID NO: 169150 - RNA, 64 nt, hsa
uaauuuucagaugaagauguuucccaaacacuguuuacagaaugagaugugacucuacagauac

SEQ ID NO: 169151 - RNA, 64 nt, hsa
uagcauucauuaccuguuuauucucugcugcaucuuacagaagaguaaacuggugagaguauau

SEQ ID NO: 169152 - RNA, 64 nt, hsa
uuuuaacuacuuuacuaaauuaauacuccuccuuuuacagaauuagaaaaguuaacauuuaucu

SEQ ID NO: 169153 - RNA, 64 nt, hsa
uuuuauuaauuuuuugaagaaguacacagaauuuuuacagaauguaguauuuugauaucauuaa

SEQ ID NO: 169154 - RNA, 64 nt, hsa
accuuggccucuaaggcuucacccacacuggacuuuacagaaagauaacgccaugcaauagaaa

SEQ ID NO: 169155 - RNA, 64 nt, hsa
auugagucucuugaaaaucaucuuucagaucuuuuuacagaaugaacuuaugcacugcuacugu

SEQ ID NO: 169156 - RNA, 64 nt, hsa
cagaagagaggacauauuuaauuaaucuugugaauuacagaacagguugugguccagacaccaa

SEQ ID NO: 169157 - RNA, 64 nt, hsa; identical to SEQ ID NO: 98813

SEQ ID NO: 169158 - RNA, 64 nt, hsa; identical to SEQ ID NO: 98814

SEQ ID NO: 169159 - RNA, 64 nt, hsa; identical to SEQ ID NO: 98815

SEQ ID NO: 169160 - RNA, 64 nt, hsa; identical to SEQ ID NO: 98816

SEQ ID NO: 169161 - RNA, 64 nt, hsa; identical to SEQ ID NO: 98817

SEQ ID NO: 169162 - RNA, 64 nt, hsa; identical to SEQ ID NO: 98818

SEQ ID NO: 169163 - RNA, 64 nt, hsa; identical to SEQ ID NO: 98819

SEQ ID NO: 169164 - RNA, 64 nt, hsa; identical to SEQ ID NO: 98820

SEQ ID NO: 169165 - RNA, 64 nt, hsa; identical to SEQ ID NO: 98821

SEQ ID NO: 169166 - RNA, 64 nt, hsa; identical to SEQ ID NO: 98822

SEQ ID NO: 169167 - RNA, 64 nt, hsa; identical to SEQ ID NO: 98823

SEQ ID NO: 169168 - RNA, 64 nt, hsa; identical to SEQ ID NO: 98824

SEQ ID NO: 169169 - RNA, 64 nt, hsa; identical to SEQ ID NO: 98825

SEQ ID NO: 169170 - RNA, 64 nt, hsa; identical to SEQ ID NO: 98826

SEQ ID NO: 169171 - RNA, 64 nt, hsa; identical to SEQ ID NO: 98827

SEQ ID NO: 169172 - RNA, 64 nt, hsa; identical to SEQ ID NO: 98828

SEQ ID NO: 169173 - RNA, 64 nt, hsa; identical to SEQ ID NO: 98829

SEQ ID NO: 169174 - RNA, 64 nt, hsa; identical to SEQ ID NO: 98830

SEQ ID NO: 169175 - RNA, 64 nt, hsa; identical to SEQ ID NO: 98831

SEQ ID NO: 169176 - RNA, 64 nt, hsa; identical to SEQ ID NO: 98832

SEQ ID NO: 169177 - RNA, 64 nt, hsa; identical to SEQ ID NO: 98833

SEQ ID NO: 169178 - RNA, 64 nt, hsa; identical to SEQ ID NO: 98834

SEQ ID NO: 169179 - RNA, 64 nt, hsa; identical to SEQ ID NO: 98835

SEQ ID NO: 169180 - RNA, 64 nt, hsa; identical to SEQ ID NO: 98836

SEQ ID NO: 169181 - RNA, 64 nt, hsa; identical to SEQ ID NO: 98837

SEQ ID NO: 169182 - RNA, 64 nt, hsa; identical to SEQ ID NO: 98838

SEQ ID NO: 169183 - RNA, 64 nt, hsa; identical to SEQ ID NO: 98839

SEQ ID NO: 169184 - RNA, 64 nt, hsa; identical to SEQ ID NO: 98840

SEQ ID NO: 169185 - RNA, 64 nt, hsa; identical to SEQ ID NO: 98841

SEQ ID NO: 169186 - RNA, 64 nt, hsa; identical to SEQ ID NO: 98842

SEQ ID NO: 169187 - RNA, 64 nt, hsa; identical to SEQ ID NO: 98843

SEQ ID NO: 169188 - RNA, 64 nt, hsa; identical to SEQ ID NO: 98844

SEQ ID NO: 169189 - RNA, 64 nt, hsa; identical to SEQ ID NO: 98845

SEQ ID NO: 169190 - RNA, 64 nt, hsa; identical to SEQ ID NO: 98846

SEQ ID NO: 169191 - RNA, 64 nt, hsa; identical to SEQ ID NO: 98847

SEQ ID NO: 169192 - RNA, 64 nt, hsa; identical to SEQ ID NO: 98848

SEQ ID NO: 169193 - RNA, 64 nt, hsa; identical to SEQ ID NO: 98849

SEQ ID NO: 169194 - RNA, 64 nt, hsa; identical to SEQ ID NO: 98850

SEQ ID NO: 169195 - RNA, 64 nt, hsa; identical to SEQ ID NO: 98851

SEQ ID NO: 169196 - RNA, 64 nt, hsa; identical to SEQ ID NO: 98852

SEQ ID NO: 169197 - RNA, 64 nt, hsa; identical to SEQ ID NO: 98853

SEQ ID NO: 169198 - RNA, 64 nt, hsa; identical to SEQ ID NO: 98854

SEQ ID NO: 169199 - RNA, 64 nt, hsa; identical to SEQ ID NO: 98855

SEQ ID NO: 169200 - RNA, 64 nt, hsa; identical to SEQ ID NO: 98856

SEQ ID NO: 169201 - RNA, 64 nt, hsa; identical to SEQ ID NO: 98857

SEQ ID NO: 169202 - RNA, 64 nt, hsa; identical to SEQ ID NO: 98858

SEQ ID NO: 169203 - RNA, 64 nt, hsa; identical to SEQ ID NO: 98859

SEQ ID NO: 169204 - RNA, 64 nt, hsa; identical to SEQ ID NO: 98860

SEQ ID NO: 169205 - RNA, 64 nt, hsa; identical to SEQ ID NO: 98861

SEQ ID NO: 169206 - RNA, 64 nt, hsa; identical to SEQ ID NO: 98862

SEQ ID NO: 169207 - RNA, 64 nt, hsa; identical to SEQ ID NO: 98863

SEQ ID NO: 169208 - RNA, 64 nt, hsa; identical to SEQ ID NO: 98864

SEQ ID NO: 169209 - RNA, 64 nt, hsa; identical to SEQ ID NO: 98865

SEQ ID NO: 169210 - RNA, 64 nt, hsa; identical to SEQ ID NO: 98866

SEQ ID NO: 169211 - RNA, 64 nt, hsa; identical to SEQ ID NO: 98867

SEQ ID NO: 169212 - RNA, 64 nt, hsa; identical to SEQ ID NO: 98868

SEQ ID NO: 169213 - RNA, 64 nt, hsa; identical to SEQ ID NO: 98869

SEQ ID NO: 169214 - RNA, 64 nt, hsa; identical to SEQ ID NO: 98870

SEQ ID NO: 169215 - RNA, 64 nt, hsa; identical to SEQ ID NO: 98871

SEQ ID NO: 169216 - RNA, 64 nt, hsa; identical to SEQ ID NO: 98872

SEQ ID NO: 169217 - RNA, 64 nt, hsa; identical to SEQ ID NO: 98873

SEQ ID NO: 169218 - RNA, 64 nt, hsa; identical to SEQ ID NO: 98874

SEQ ID NO: 169219 - RNA, 64 nt, hsa; identical to SEQ ID NO: 98875

SEQ ID NO: 169220 - RNA, 64 nt, hsa; identical to SEQ ID NO: 98876

SEQ ID NO: 169221 - RNA, 64 nt, hsa; identical to SEQ ID NO: 98877

SEQ ID NO: 169222 - RNA, 64 nt, hsa; identical to SEQ ID NO: 98878

SEQ ID NO: 169223 - RNA, 64 nt, hsa; identical to SEQ ID NO: 98879

SEQ ID NO: 169224 - RNA, 64 nt, hsa; identical to SEQ ID NO: 98880

SEQ ID NO: 169225 - RNA, 64 nt, hsa; identical to SEQ ID NO: 98881

SEQ ID NO: 169226 - RNA, 64 nt, hsa; identical to SEQ ID NO: 98882

SEQ ID NO: 169227 - RNA, 64 nt, hsa; identical to SEQ ID NO: 98883

SEQ ID NO: 169228 - RNA, 64 nt, hsa; identical to SEQ ID NO: 98884

SEQ ID NO: 169229 - RNA, 64 nt, hsa; identical to SEQ ID NO: 98885

SEQ ID NO: 169230 - RNA, 64 nt, hsa; identical to SEQ ID NO: 98886

SEQ ID NO: 169231 - RNA, 64 nt, hsa; identical to SEQ ID NO: 98887

SEQ ID NO: 169232 - RNA, 64 nt, hsa; identical to SEQ ID NO: 98888

SEQ ID NO: 169233 - RNA, 64 nt, hsa; identical to SEQ ID NO: 98889

SEQ ID NO: 169234 - RNA, 64 nt, hsa; identical to SEQ ID NO: 98890

SEQ ID NO: 169235 - RNA, 64 nt, hsa; identical to SEQ ID NO: 98891

SEQ ID NO: 169236 - RNA, 64 nt, hsa; identical to SEQ ID NO: 98892

SEQ ID NO: 169237 - RNA, 64 nt, hsa; identical to SEQ ID NO: 98893

SEQ ID NO: 169238 - RNA, 64 nt, hsa; identical to SEQ ID NO: 98894

SEQ ID NO: 169239 - RNA, 64 nt, hsa; identical to SEQ ID NO: 98895

SEQ ID NO: 169240 - RNA, 64 nt, hsa; identical to SEQ ID NO: 98896

SEQ ID NO: 169241 - RNA, 64 nt, hsa; identical to SEQ ID NO: 98897

SEQ ID NO: 169242 - RNA, 64 nt, hsa; identical to SEQ ID NO: 98898

SEQ ID NO: 169243 - RNA, 64 nt, hsa; identical to SEQ ID NO: 98899

SEQ ID NO: 169244 - RNA, 64 nt, hsa; identical to SEQ ID NO: 98900

SEQ ID NO: 169245 - RNA, 64 nt, hsa; identical to SEQ ID NO: 98901

SEQ ID NO: 169246 - RNA, 64 nt, hsa; identical to SEQ ID NO: 98902

SEQ ID NO: 169247 - RNA, 64 nt, hsa; identical to SEQ ID NO: 98903

SEQ ID NO: 169248 - RNA, 64 nt, hsa; identical to SEQ ID NO: 98904

SEQ ID NO: 169249 - RNA, 64 nt, hsa; identical to SEQ ID NO: 98905

SEQ ID NO: 169250 - RNA, 64 nt, hsa; identical to SEQ ID NO: 98906

SEQ ID NO: 169251 - RNA, 64 nt, hsa; identical to SEQ ID NO: 98907

SEQ ID NO: 169252 - RNA, 64 nt, hsa; identical to SEQ ID NO: 98908

SEQ ID NO: 169253 - RNA, 64 nt, hsa; identical to SEQ ID NO: 98909

SEQ ID NO: 169254 - RNA, 64 nt, hsa; identical to SEQ ID NO: 98910

SEQ ID NO: 169255 - RNA, 64 nt, hsa; identical to SEQ ID NO: 98911

SEQ ID NO: 169256 - RNA, 64 nt, hsa; identical to SEQ ID NO: 98912

SEQ ID NO: 169257 - RNA, 64 nt, hsa
gauucuaaucugagugaguuacugagcuuugguccacuaaaacaagcugagcuuugguccacua

SEQ ID NO: 169258 - RNA, 64 nt, hsa
gcuuugguccacuaaaacaagcugagcuuugguccacuaaaacaagaugaaaaauacaagagug

SEQ ID NO: 169259 - RNA, 64 nt, hsa
ggcucaccaggaccucaacgggcaaaguugugcacacuaaaauaucaaaucaaggugcuugguu

SEQ ID NO: 169260 - RNA, 64 nt, hsa
caacguuugccaucuggaugacaaacggaagauccacuaaaacguccacgggauuaacagaacg

SEQ ID NO: 169261 - RNA, 64 nt, hsa
gaucagccugaccaacauggugaaaugccaucuccacuaaaaauauaaaaauuagccaggcaug

SEQ ID NO: 169262 - RNA, 64 nt, hsa
uuucuacauuugacauguauucaucauugagaaacacuaaaauaacaauauuuuuagaaaacgu

SEQ ID NO: 169263 - RNA, 64 nt, hsa
uggaucuuaaccaaaaaugauucaauacuguuaucacuaaaacagcaccaagaccugaagccau

SEQ ID NO: 169264 - RNA, 64 nt, hsa
ccuuagacccuauaguguuaagagguauuuuaaacacuaaaaggacaaagcucuucccaauccu

SEQ ID NO: 169265 - RNA, 64 nt, hsa
ucuaaauuguggcuugaaggacugcacuaaaacccacuaaaaagaugcgaaaaccugaugaggg

SEQ ID NO: 169266 - RNA, 64 nt, hsa
cgaagggcaaucuaaauuguggcuugaaggacugcacuaaaacccacuaaaaagaugcgaaaac

SEQ ID NO: 169267 - RNA, 64 nt, hsa
ucugaagcaauuagugguaaaaaguauuuuuccccacuaaaaaacuuuaaaacacaaaucuuca

SEQ ID NO: 169268 - RNA, 64 nt, hsa
aauuauaaggaugaucagagacuuuugccagcuacacuaaaagaaaauggccuucuugacugug

SEQ ID NO: 169269 - RNA, 64 nt, hsa
uaaauaaucacuaaaaucacuagauuuaaauaaucacuaaaaugauuugugagaaacuggcacu

SEQ ID NO: 169270 - RNA, 64 nt, hsa
cuuaaugcaagcuaggauagugauuuuaaauaaucacuaaaaucacuagauuuaaauaaucacu

SEQ ID NO: 169271 - RNA, 64 nt, hsa
gagguagaacucaguccucucccuugugagucuucacuaaaaucagugacucacuuccaaagag

SEQ ID NO: 169272 - RNA, 64 nt, hsa
aauuuugaaaguuguauucucauaugacuaaguucacuaaaacccuggauugaaagugaaaauu

SEQ ID NO: 169273 - RNA, 64 nt, hsa
gguuuuuuaaaaaagcaauaauuaacucagaccucacuaaaaaucauuuuuguuuuuauauugu

SEQ ID NO: 169274 - RNA, 64 nt, hsa
acacacauauauauauauaaaguguaacaaggaacacuaaaacaguguugauucuugucucuga

SEQ ID NO: 169275 - RNA, 64 nt, hsa
aaaacucagguuagaacaaaaaugucauaaagggcacuaaaaguaacauuuggguuucacucca

SEQ ID NO: 169276 - RNA, 64 nt, hsa
ugaguaugcaccuaccauuuuccuuuauugugaucacuaaaaugaggccaagguuuaggaggug

SEQ ID NO: 169277 - RNA, 64 nt, hsa
ucaaauuuuuucauaauucaaacaaaaguuauuacacuaaaaguauuauaguaacguauugucc

SEQ ID NO: 169278 - RNA, 64 nt, hsa
aagcuaaaauggcuuaacaucaugcuacacuuuacacuaaaaaucuauuacugugaguggucug

SEQ ID NO: 169279 - RNA, 64 nt, hsa
aaucugagggaaaacauguucagggcuucuagaacacuaaaaaauuuggcuuaaaccaguguuc

SEQ ID NO: 169280 - RNA, 64 nt, hsa
ucagguguuucuagacccccgacuccgcaagagugaggaugaugggagcuggucaugggagcua

SEQ ID NO: 169281 - RNA, 64 nt, hsa
gaugggguauucuuucacuaguugaggaguagaagaggaugaccagcuagacucccauggaauu

SEQ ID NO: 169282 - RNA, 64 nt, hsa
aguugccuuagagcgcaagggccaggcccuggaggaggaugaagacacagagacaaggugacug

SEQ ID NO: 169283 - RNA, 64 nt, hsa
cuggagcuccaaccuucuaacuucugugguuugagaggaugaacccugcaggccauguccacag

SEQ ID NO: 169284 - RNA, 64 nt, hsa
gcaguccucacccccaccucucuaaaagacacaggaggaugacacagaaacaccguaagugucu

SEQ ID NO: 169285 - RNA, 64 nt, hsa
gugguggcucaugcuuguggucccagcuguucaggaggaugaggcaggaggaucucuugagccc

SEQ ID NO: 169286 - RNA, 64 nt, hsa
gagugggaaugagccacucccaguucuggagagugaggaugaccaucuccacuuucuggaacca

SEQ ID NO: 169287 - RNA, 64 nt, hsa
cucacugccuaaaaugguaaucccuccagccuaagaggaugauucuguuuuguugacucuugaa

SEQ ID NO: 169288 - RNA, 64 nt, hsa
caaaaccaccugcguggcuaggaugauuaauuaugaggaugaugauuuuuuuugugauaacagu

SEQ ID NO: 169289 - RNA, 64 nt, hsa
ccuuguucuccccuggguccguaacauuuuuuccgaggaugaacaggggacaucuuuagguuuc

SEQ ID NO: 169290 - RNA, 64 nt, hsa
ggggcagggaacgaacaugguggcuuugggcugagaggaugagggaggucuuucccaggucaaa

SEQ ID NO: 169291 - RNA, 64 nt, hsa
ugcacacgaugacucauuggaugggacagaagaagaggaugaggaugagauggaagaggaggag

SEQ ID NO: 169292 - RNA, 64 nt, hsa
cgaugacucauuggaugggacagaagaagaggaugaggaugagauggaagaggaggaggaggag

SEQ ID NO: 169293 - RNA, 64 nt, hsa
ccgggcccguugaggaugaggccgcuagaggccugaggaugagcuggaaggagugagaggggac

SEQ ID NO: 169294 - RNA, 64 nt, hsa
ugccacccuaccuguucagugucccgggcccguugaggaugaggccgcuagaggccugaggaug

SEQ ID NO: 169295 - RNA, 64 nt, hsa
ccuguuuaucuugccuucagcaggggaugaggaugaggaugaauccggggaggagaggcugccc

SEQ ID NO: 169296 - RNA, 64 nt, hsa
cauggaggccaucaccgucagugcagcaggggaugaggaugaggaugaauccggggaggagagg

SEQ ID NO: 169297 - RNA, 64 nt, hsa
uugguccuucugguccaggccuuggaggaaagcagaggaugaucccugccugugagccacaccu

SEQ ID NO: 169298 - RNA, 64 nt, hsa
ugaaaggacuugucugaaaucacauggugagaaggaggaugaagggaggagagagcuuuugcuc

SEQ ID NO: 169299 - RNA, 64 nt, hsa
gaugaggggagccuacgccucaggcauguggugagaggaugagggggagggagccaacgccuca

SEQ ID NO: 169300 - RNA, 64 nt, hsa
aguagaggcugggagcaaaugccccaugcggugagaggaugaggggagccuacgccucaggcau

SEQ ID NO: 169301 - RNA, 64 nt, hsa
agagggucuucagaagccccccugggagggaggggaggaugagcacgcccagcuccccuccagg

SEQ ID NO: 169302 - RNA, 64 nt, hsa
uuuuuuuuuuuuuaagucguuuuccugcguugacgaggaugaucugggguuuuuauuuguuucg

SEQ ID NO: 169303 - RNA, 64 nt, hsa
guaccucaguauucuuuuucaacauguagggcaagaggaugaaggaaggggcuauccugggacc

SEQ ID NO: 169304 - RNA, 64 nt, hsa
ccugcccugcucugcccaggcaaggaacagaagugaggaugagacccagccccuuccccuggga

SEQ ID NO: 169305 - RNA, 64 nt, hsa
ugaagaccuaggguuaucugaaggaucuucacaagaggaugaagaccuagacucaucugaagga

SEQ ID NO: 169306 - RNA, 64 nt, hsa
ugaagaccuacaauuaccugaaggaucuucacaggaggaugaagaccuaggguuaucugaagga

SEQ ID NO: 169307 - RNA, 64 nt, hsa
aguccaagaggaggaggacgaaggauccucacaggaggaugaagaccuagacucaucugcagaa

SEQ ID NO: 169308 - RNA, 64 nt, hsa
guuauaauucauugugguaagaaugauugaaaugcagauuuaacaaucuuauaaucuauugaau

SEQ ID NO: 169309 - RNA, 64 nt, hsa
guugugaagaaaguauuuaaauccaacuuuugaacagauuuaacaaacaugaggaacuuuuuua

SEQ ID NO: 169310 - RNA, 64 nt, hsa
cccuuuuguuuuuugauuuauauacucuguuuuacagauuuagcuagaaaaaaaaugucagugu

SEQ ID NO: 169311 - RNA, 64 nt, hsa
aaagcuagcuuucuuauguuuuccuuuaaauuuucagauuuaccuucauucuguuuucacugau

SEQ ID NO: 169312 - RNA, 64 nt, hsa
uguacaguauuuuuuuuuagagguuguaaugucucagauuuaguccuuuaccaucuauguugau

SEQ ID NO: 169313 - RNA, 64 nt, hsa
auucuucuucagaaauuaaaaacauaacuauugccagauuuagcucuggaauguuuagaaucag

SEQ ID NO: 169314 - RNA, 64 nt, hsa
aaaucucaugaauauaauguaagaaaacauuugucagauuuaaaugauaucacagaauuaaugu

SEQ ID NO: 169315 - RNA, 64 nt, hsa
uuuuuauuaauccgucuuaaauguguauauagcucagauuuauuuuaaugucugauauuggaag

SEQ ID NO: 169316 - RNA, 64 nt, hsa
gccacguaaucauuuucuuagacguuugcuccaccagauuuaaccaaauguaacucccacauug

SEQ ID NO: 169317 - RNA, 64 nt, hsa
guacuuauuuacuaacguauuaucuuuuucaaaccagauuuaugugcaaagguuaaacauguaa

SEQ ID NO: 169318 - RNA, 64 nt, hsa
agagauuugcugccaggaaucaauuuugaggguucagauuuagcuuggaagaaaaaaaagaaac

SEQ ID NO: 169319 - RNA, 64 nt, hsa
ucacaguauguauuuagcauuuauuuuauuacagcagauuuaaaguuuguaucuaaauaaugcc

SEQ ID NO: 169320 - RNA, 64 nt, hsa
aacuuacucuggccccaguguuaaaacgaucuuucagauuuagagugacuauguaagaauuuag

SEQ ID NO: 169321 - RNA, 64 nt, hsa
ucauuugcuuagaugguguuugugggaucaccugcagauuuaaagccuacucugccacagacuc

SEQ ID NO: 169322 - RNA, 64 nt, hsa
uggcaugaucauauugcuguaaccaacaagcuuucagauuuauggagaaugaccauguuauaga

SEQ ID NO: 169323 - RNA, 64 nt, hsa
ggagaaugaccauguuauagacuuucacuuaugucagauuuaugauaggaaaaauuccaucuuc

SEQ ID NO: 169324 - RNA, 64 nt, hsa
guuuuaauguuugcuuugaacauaauuuaagaaccagauuuauuuucuauagugauaaacccuu

SEQ ID NO: 169325 - RNA, 64 nt, hsa
gcuuucauuuguacaucccuuugaaaaaauauaacagauuuaaaauguuuugaauuuaacuugu

SEQ ID NO: 169326 - RNA, 64 nt, hsa
uauuaauuucaauuagcuagauuguacauacuugcagauuuaacaaaauuuuagggaaauugaa

SEQ ID NO: 169327 - RNA, 64 nt, hsa
cacagguggauuucucuauuuuugaauacuacaucagauuuagaugcacgacuaccuguugacu

SEQ ID NO: 169328 - RNA, 64 nt, hsa
gcugcccucugccguccagaugcugcaguguggccagauuuaccuuccaguaacauacuucuag

SEQ ID NO: 169329 - RNA, 64 nt, hsa
agcuuuuuucuauauauaaauuaugcugcuauuacagauuuaacauuuucuguuaaaggaaagu

SEQ ID NO: 169330 - RNA, 64 nt, hsa
cggcaggggugucugaggccgcccugucagcuggccgguccaagccuguggcuggagcuggugu

SEQ ID NO: 169331 - RNA, 64 nt, hsa
uggcgggggugucugaggccgcacugucagcuggccgguccaagccuguggcuggagcuggggu

SEQ ID NO: 169332 - RNA, 64 nt, hsa
uccugcggguccucggcuccaugugccagaggcuccgguccaugcaguacaauggcagcuacuu

SEQ ID NO: 169333 - RNA, 64 nt, hsa
acaucaggaaaaggccacggggcucugaacagccccgguccagacagcagccuguacauccauc

SEQ ID NO: 169334 - RNA, 64 nt, hsa
caggugagcagcuuggcaggucuccaaguggaacccgguccagacagggcugccucgacuucac

SEQ ID NO: 169335 - RNA, 64 nt, hsa
uccccagaagcagaagcauguaaagcccacagaaccgguccagucgucgaccaucgagcugcuu

SEQ ID NO: 169336 - RNA, 64 nt, hsa
aguggauaucagaugggauaucuccuuccauuccccgguccaggggagagucacuaguuguacc

SEQ ID NO: 169337 - RNA, 64 nt, hsa
gacaggaagaaaauagaacagcucauagcucgagccgguccaauuuauggcuaaauuaaaaaaa

SEQ ID NO: 169338 - RNA, 64 nt, hsa
uuccacaacucaaacucccaccgcgcucacacaaccgguccacuccugccuuuucacucacaca

SEQ ID NO: 169339 - RNA, 64 nt, hsa
ggccaucucccacugggaauauggcguaguaucuccgguccauuccuuggaugcuaaggacugc

SEQ ID NO: 169340 - RNA, 64 nt, hsa
cagccuuagaggcaccugagcaacucaaagguuuccgguccauuucugggguucccgaugggaa

SEQ ID NO: 169341 - RNA, 64 nt, hsa
uuucgaccuaacauuuuggguuuuaaccaaauaaccgguccaggagugagcagcuccguucugu

SEQ ID NO: 169342 - RNA, 64 nt, hsa
gaagagugggcucccgugggcccagagcugcacgccgguccacagacacacucacgcccgccac

SEQ ID NO: 169343 - RNA, 64 nt, hsa
cuccaggcccagaacuuccucaagucggccucccccgguccaguggcugccucccggccuccuc

SEQ ID NO: 169344 - RNA, 64 nt, hsa
acuguccccuuaggauuggaauucucaacuagaaccgguccaaaugcagaauauuaauacaucg

SEQ ID NO: 169345 - RNA, 64 nt, hsa
aaucuucaaaguuggaaggaacuuuaaaaaucauccgguccaaucucuuuccucuuucugccac

SEQ ID NO: 169346 - RNA, 64 nt, hsa
acuuaggagaaaauggugcuucacuaacccgcuuccgguccagucacaaucaucaugucacugu

SEQ ID NO: 169347 - RNA, 64 nt, hsa
gcugcgccugcccgcccgccgguuggccggcuggccgguccaccccgucccggccccgcgcgug

SEQ ID NO: 169348 - RNA, 64 nt, hsa
cugaccugggugguugaggcucaagacagcucacccgguccagaagcuccaugcuggucacuag

SEQ ID NO: 169349 - RNA, 64 nt, hsa
agaccugugggagucguagaggguacuguuagccccgguccaugcaggggguucagccgagccc

SEQ ID NO: 169350 - RNA, 64 nt, hsa
cgggcagggagcagccccaggccagagaggccucccgguccagcucagggaugcuccugccagc

SEQ ID NO: 169351 - RNA, 64 nt, hsa
agggcuggcagaucgcuucccucauccaccuccaccgguccaggucuuugcugcuguccccaga

SEQ ID NO: 169352 - RNA, 64 nt, hsa
caucacaagaaacgagccugaaaaucagguccagccgguccaagcacauggccucccaucuggg

SEQ ID NO: 169353 - RNA, 64 nt, hsa
gccacccuagccaaugucuccuccccuucccccaccgguccagcuggccuggacaguaucccac

SEQ ID NO: 169354 - RNA, 64 nt, hsa
cccagcacaacugugaaacucuguauugcuucuuccgguccacacccuauacucaugacauuaa

SEQ ID NO: 169355 - RNA, 64 nt, hsa
aggagccggcgcccaucuccacccgcacggcucgccgguccagagccaugagccaagagcccuc

SEQ ID NO: 169356 - RNA, 64 nt, hsa
ugcuuuaauaagaaauuucaaauauucucuuaucccgguccaaaaggauuaagcgauuaaagaa

SEQ ID NO: 169357 - RNA, 64 nt, hsa
cagguauguaacaacaaaagaaguugccugcaugccgguccaaauuguucuguauaaagaugcu

SEQ ID NO: 169358 - RNA, 64 nt, hsa
ggcuucuuauucgggugugagucuuuucagcaacccgguccaguacugggagauacagccaucc

SEQ ID NO: 169359 - RNA, 64 nt, hsa
cuuggacaggacaagcugaacucugaaaugggagccgguccagguggccuucagccccaccuuu

SEQ ID NO: 169360 - RNA, 64 nt, hsa
aucacugcuuuuuugccacaucacauaguaacugccgguccagaaugugacggauucgacucua

SEQ ID NO: 169361 - RNA, 64 nt, hsa
aagagccugcugucuguauggaggaggugcuagcccgguccaccgggcugcugcccaccccugc

SEQ ID NO: 169362 - RNA, 64 nt, hsa
gggaguggaggagaggagacaaggcucuggacagccgguccagccacauccagugauucagcag

SEQ ID NO: 169363 - RNA, 64 nt, hsa
cugcuuccuccucacaaccccaagagcccccagcccgguccauccacgucuggagucuggggag

SEQ ID NO: 169364 - RNA, 64 nt, hsa
caaagccaaaguugacuguguucuugucccgcagccgguccacacugugaggccaggccucaac

SEQ ID NO: 169365 - RNA, 64 nt, hsa
aagagaaaagcccaagccuuguugguuacgucagccgguccauggcgguguccugcggacccca

SEQ ID NO: 169366 - RNA, 64 nt, hsa
gacagcauuaccucacccggccccaucuguugccccgguccagcccugauggcgcgcgccuggu

SEQ ID NO: 169367 - RNA, 64 nt, hsa
uggaggcugcaggacuggcuagaccaggucccugccgguccaccaggcggaggugggacaaagg

SEQ ID NO: 169368 - RNA, 64 nt, hsa
cccagacccuggcacccuccugagccggcgugugccgguccagcccuccgagaugccacaauuc

SEQ ID NO: 169369 - RNA, 64 nt, hsa
gugggcagcccuggccucuuccuuaacgcuggccccgguccagggccggccccugugccuggcu

SEQ ID NO: 169370 - RNA, 64 nt, hsa
cgccucggccucccaaagugcugggauuacaggcccgguccaguuugauaguuuguuaucaugu

SEQ ID NO: 169371 - RNA, 64 nt, hsa
cugggccuaggaugggacguuuuucuucuugggcccgguccacagguccaaggacacccucccu

SEQ ID NO: 169372 - RNA, 64 nt, hsa
gggaccaccccucagggcgcccccccacccccgcccgguccaccuagacccccacguuuggaga

SEQ ID NO: 169373 - RNA, 64 nt, hsa
gccugcuaucccucucccacuccccaccccagcaccgguccaaccccuucauccccagcugcuc

SEQ ID NO: 169374 - RNA, 64 nt, hsa
gcggacacuccucucuuuuccuguagcguguggaccgguccacgcaauucuuuauccugugaac

SEQ ID NO: 169375 - RNA, 64 nt, hsa
gucugaccccucacuuaggcuuuccucugccaccccgguccagggaagaggcucgcucccgccc

SEQ ID NO: 169376 - RNA, 64 nt, hsa
aucccagguuuuauguugcugggcuuccggagagccgguccaagcggaggcuuucagugauuua

SEQ ID NO: 169377 - RNA, 64 nt, hsa
ccuuuaaugagcauuaauuuuugaaaguuuuacagaguuuuauuaguuuuacuacuuuaucuua

SEQ ID NO: 169378 - RNA, 64 nt, hsa
cgccaccuguguuugcugagacuggucucugagagaguuuuaugucgaucgaggccuguugcuc

SEQ ID NO: 169379 - RNA, 64 nt, hsa
aaaaaaaacuaaggcauuugauuaaauuaugaaugaguuuuacaaauuccuuucagaguuuuac

SEQ ID NO: 169380 - RNA, 64 nt, hsa
uuaaauuaugaaugaguuuuacaaauuccuuucagaguuuuacuaagaucacacaaauaacagc

SEQ ID NO: 169381 - RNA, 64 nt, hsa
ccaaguguucucaaccuccauucugcaguguucagaguuuuagggaaaggguuugggugcccca

SEQ ID NO: 169382 - RNA, 64 nt, hsa
uuauuucagguugaguuguuuguuuguccucccugaguuuuagcagggagguuguucuaguuuu

SEQ ID NO: 169383 - RNA, 64 nt, hsa
gcuacauugagauauaguucacauaaaugacuuggaguuuuauguucaugaaaaaauuagggau

SEQ ID NO: 169384 - RNA, 64 nt, hsa
uggauacuuaaguuuuagaaaugagaaaaauacagaguuuuagaaaugagaucuagagaacacg

SEQ ID NO: 169385 - RNA, 64 nt, hsa
aacacuuccagcauuuagcuggccacauggcggagaguuuuaauuuuuaacuuauugacaaccg

SEQ ID NO: 169386 - RNA, 64 nt, hsa
uuguagacuuaacacuucuuacgcaaugcuucuagaguuuuauagccuggacugcuaccuuuca

SEQ ID NO: 169387 - RNA, 64 nt, hsa
uuaugcauuuauuuacugauuguguugugaacaugaguuuuaugguauuuugugagggaugcau

SEQ ID NO: 169388 - RNA, 64 nt, hsa
accaagaauuuguaaacacaacucuaauaaaugugaguuuuaaaggauuguuauuuacuacuuu

SEQ ID NO: 169389 - RNA, 64 nt, hsa
cuuuuuaccuccuuuaaacacaucaucugagguugaguuuuaugacaguauguaguugagugga

SEQ ID NO: 169390 - RNA, 64 nt, hsa
guuuuaugacaguauguaguugaguggaggcugggaguuuuaagcauaaaucccuguuuagugu

SEQ ID NO: 169391 - RNA, 64 nt, hsa
aaaagccuuugaaaauacuuuggauaauaaauuggaguuuuaaaaaugcaaauuugcuuaguau

SEQ ID NO: 169392 - RNA, 64 nt, hsa
uuaaccuauaggauaagauuccaguauuguauaugaguuuuaacaaauuaaaaaaucaaaucau

SEQ ID NO: 169393 - RNA, 64 nt, hsa
cuuucugcugguugugagggggaaucugaaaauggaguuuuagaggaaaagucaacaucuaacu

SEQ ID NO: 169394 - RNA, 64 nt, hsa
agacacgaccuaaguugaagaguuuagacuugcugaguuuuagaagugauggaaauuaagagag

SEQ ID NO: 169395 - RNA, 64 nt, hsa
acagauuuugcauuuuuguuuacaacuauuuaaagaguuuuauguuguauuuagaauuucaacc

SEQ ID NO: 169396 - RNA, 64 nt, hsa
caugacagauacauucaugcacaauccauaauuugaguuuuacauaaaauagaaauuuguuaga

SEQ ID NO: 169397 - RNA, 64 nt, hsa
uuuuuguucuacaucacaguucuuaauuuguuuagaguuuuaugaaagaugguauaguuuuuau

SEQ ID NO: 169398 - RNA, 64 nt, hsa
ucguuuuaaaagaaagauuauuggauuaaaagaugaguuuuacaaccgcuacauaaugaaaagu

SEQ ID NO: 169399 - RNA, 64 nt, hsa
aaauagaagcuucaucagaaauguaucccacauagaguuuuaagacuuggauucucuucugccc

SEQ ID NO: 169400 - RNA, 64 nt, hsa
cacuggccuuggaucaucuccucaugcacacccggaguuuuaccugcuugcuugcuuuccugga

SEQ ID NO: 169401 - RNA, 64 nt, hsa
cccugauuucccgcucuggagauuugaagggagaguagaagagauagggggucuuuagagugaa

SEQ ID NO: 169402 - RNA, 64 nt, hsa
auucacaugcucauauguuuauaaacuguguuuuguagaagaaaaagaaucauaacaauacaaa

SEQ ID NO: 169403 - RNA, 64 nt, hsa
gacagagaaguggacuccaaaccucauuuuaguuguagaagaaaauuucuuacaaaacaaauuc

SEQ ID NO: 169404 - RNA, 64 nt, hsa
cuauaccccaugaaauguaaauacuguaucauaaguagaagaaaauaauuuuuguuuucuaaaa

SEQ ID NO: 169405 - RNA, 64 nt, hsa
ugugcaaggugauaggaaaacugaauccaucuuuguagaagagcacugggcuaauuuguauguu

SEQ ID NO: 169406 - RNA, 64 nt, hsa
acuacugcaaaaaguacauagugaauuuuaaaauguagaagaaagcaaaaaauaaaauaagucc

SEQ ID NO: 169407 - RNA, 64 nt, hsa
aaccauuuaaaaauauucuucugaacucaucaaaguagaagagcccccaaccuuuucucucugc

SEQ ID NO: 169408 - RNA, 64 nt, hsa
ccucccacccugcccaugauuaaacaucauguauguagaagaucuuaaguccauacgcauuuca

SEQ ID NO: 169409 - RNA, 64 nt, hsa
uucugccuccuccauucuuccugggugcagaacuguagaagacccugaggacuccugggcuagu

SEQ ID NO: 169410 - RNA, 64 nt, hsa
auuugacaucucucuagcccauccauugcuuacaguagaagaguggggcuguaugcuugauaau

SEQ ID NO: 169411 - RNA, 64 nt, hsa
gguaugugugcaggauuacccaagaauaacuuaaguagaagaaacaagaaagggaaucuuguau

SEQ ID NO: 169412 - RNA, 64 nt, hsa
uugacauuuuguucacaucaacuaauguucaccuguagaagagaacaaauuucgaauaauccag

SEQ ID NO: 169413 - RNA, 64 nt, hsa
gaaagcucccguauauacaugaacugagaaguguguagaagaguaaauacuguaauagguaaua

SEQ ID NO: 169414 - RNA, 64 nt, hsa
acaucugacucccaggauaaagugacugagagcaguagaagacuuguugagccuuaaggaauaa

SEQ ID NO: 169415 - RNA, 64 nt, hsa
uuagacagcugucuuccugcaguguccucacgugguagaagaggaaggcagcucuccggggucc

SEQ ID NO: 169416 - RNA, 64 nt, hsa
cugucuggaaagggagggacaaaaggacccagaaguagaagaauggggauggaguggugagaau

SEQ ID NO: 169417 - RNA, 64 nt, hsa
ugucuuuacugggaagcuggagagucacagucuaguagaagaaagguaagaaugugcuucuucc

SEQ ID NO: 169418 - RNA, 64 nt, hsa
ucauuaugaauagucaguauuuuaaaagcucaaaguagaagaggagucacuaagcccuaacagc

SEQ ID NO: 169419 - RNA, 64 nt, hsa
aauuagguggaauaaugacucgagcaggaaagcaguagaagaggauuccuucaccacaguuuca

SEQ ID NO: 169420 - RNA, 64 nt, hsa
uaaaaguaauaaugaagauuaugcaauucuaacuguagaagagauagcuauuaaaauaaucagu

SEQ ID NO: 169421 - RNA, 64 nt, hsa
accguauuuucuaggacaagaguucucagucacugugcaauaugcccccugggucccaggaggg

SEQ ID NO: 169422 - RNA, 64 nt, hsa
cugucucaguacaauccaaauuugucguagacuugugcaauauauacuguuguggguuggagaa

SEQ ID NO: 169423 - RNA, 64 nt, hsa
uacucaguaagacagugcagugcucaguaaggcagugcaauacucaguaacaguguaguacuca

SEQ ID NO: 169424 - RNA, 64 nt, hsa
gcaguacucaggaaugcagcacaguacucaggcagugcaauacucagugcgguacucaguaaca

SEQ ID NO: 169425 - RNA, 64 nt, hsa
cacggggugggggugagggccccugcaauucacggugcaauauucaccaguuuugcccucugcc

SEQ ID NO: 169426 - RNA, 64 nt, hsa
cccucccuuccccaguuuuucucuaagauauacagugcaauagcuccccaccccucaguugacg

SEQ ID NO: 169427 - RNA, 64 nt, hsa
agauggugucuaacgagcagugcaauauuaggcggugcaauagaggcccuguuggcaagaugag

SEQ ID NO: 169428 - RNA, 64 nt, hsa
ugacauggauaagugagauggugucuaacgagcagugcaauauuaggcggugcaauagaggccc

SEQ ID NO: 169429 - RNA, 64 nt, hsa
aacuaugagauuuuuaaaaaauggggccgcugaugugcaauaucaaagugaacuugugaguauu

SEQ ID NO: 169430 - RNA, 64 nt, hsa
guaccucucuuuugugacucuuguacagcuuaaugugcaauaaaggaaaaguuauaucugucuu

SEQ ID NO: 169431 - RNA, 64 nt, hsa
agcuguaagagucuggcuuagaacagaccucucugugcaauaacuuguggccacuggaaauccc

SEQ ID NO: 169432 - RNA, 64 nt, hsa
guauauuauacauacacaaguuugugugaaagaugugcaauaacaaagguguauguauguuuug

SEQ ID NO: 169433 - RNA, 64 nt, hsa
uauuauaauaaccucccaguucuaggggauauuugugcaauaaauacacaugucaacuugaugg

SEQ ID NO: 169434 - RNA, 64 nt, hsa
uaauaugucuuaauuuugaguuugaaaauguuaagugcaauaaaaacauacuaguacagauuuu

SEQ ID NO: 169435 - RNA, 64 nt, hsa
caauacuucaauacuucauuuaaaauauuuuuaugugcaauaaaauguauuuguuuguauuuug

SEQ ID NO: 169436 - RNA, 64 nt, hsa
uagguuugugacuuuccuaaaucaauucuauuacgugcaauacuucaauacuucauuuaaaaua

SEQ ID NO: 169437 - RNA, 64 nt, hsa
aauauuugcaagacauagaauaguguuggaaaaugugcaauaugugauguggcaaaucucuauu

SEQ ID NO: 169438 - RNA, 64 nt, hsa
aucacaguguuuuuauugcucgcccagacaccaugugcaauaagauugguguucguuuccauca

SEQ ID NO: 169439 - RNA, 64 nt, hsa
gggagacaaaggaggaauuuacuuucuucaccaagugcaauagauuacugaugugauauucugu

SEQ ID NO: 169440 - RNA, 64 nt, hsa
cccacaacaaaaacccaaguuuucugugcuacaugugcaauauuuguuaugaauguuaucacaa

SEQ ID NO: 169441 - RNA, 64 nt, hsa
uguuucauguccauucaagugacuuuuauucugagugcaauauuucaauagccuuguagugaua

SEQ ID NO: 169442 - RNA, 64 nt, hsa
gauguacaguauuuuuuguuguuuuuaucaucaugugcaauauuacugauuuguuuccaugcug

SEQ ID NO: 169443 - RNA, 64 nt, hsa
uucucuacucuuuaguagaguucgagacacagaagugcaauaacugcccuaauuaagcaacuau

SEQ ID NO: 169444 - RNA, 64 nt, hsa; identical to SEQ ID NO: 169442

SEQ ID NO: 169445 - RNA, 64 nt, hsa; identical to SEQ ID NO: 169443

SEQ ID NO: 169446 - RNA, 64 nt, hsa
ugaaggaccaaaaggccaaaaaacagugaaauaugaucaucaucuccuugcggacuucucugcc

SEQ ID NO: 169447 - RNA, 64 nt, hsa
ucucuuccuuuagggcuacugagucuugauuccugaucaucagaaauuucaccagaaacaacuu

SEQ ID NO: 169448 - RNA, 64 nt, hsa
ucaucagccagguugauugugcggguuagauagagaucaucagccggguugauucuacagguua

SEQ ID NO: 169449 - RNA, 64 nt, hsa
ucaucagccagguugauuguguggguuagauagagaucaucagccugguagauuguguggguua

SEQ ID NO: 169450 - RNA, 64 nt, hsa
auucuguggauugauuuaauggaguugucagcaugaucaucaucuucuagccaggggcauaguu

SEQ ID NO: 169451 - RNA, 64 nt, hsa
uggagaugggugaggaacagcacagagcagcagggaucaucacaugcagccaaacuuggccucu

SEQ ID NO: 169452 - RNA, 64 nt, hsa
ugguagugcaaaucagaucagagcaaagcaaugagaucaucaugaagacauauguccacuaagu

SEQ ID NO: 169453 - RNA, 64 nt, hsa
gucuuucaacuuuaaaauuaucaaucuuugauaugaucaucaaggucucuggagaagcauggau

SEQ ID NO: 169454 - RNA, 64 nt, hsa
agguauauguuuuauaauucauaaccauagccucgaucaucaagaaauacuuucgaaauuucau

SEQ ID NO: 169455 - RNA, 64 nt, hsa
aaaaugaugguagguagcacaguggacagucuuugaucaucauguagaauauggcuaugaauca

SEQ ID NO: 169456 - RNA, 64 nt, hsa
uaaguaugugaaugugcgcauuuugcauuccauaugaaaaaaaugccacgucuguuuaaauuau

SEQ ID NO: 169457 - RNA, 64 nt, hsa
augauuuaugguguuuuuugaaauuugucuuaauugaaaaaagaccaaauauuucaaaugagcu

SEQ ID NO: 169458 - RNA, 64 nt, hsa
uuaacaaauaaaaggcauuuaaguaaaacuaaaaugaaaaaaguaggccuucugacauugugua

SEQ ID NO: 169459 - RNA, 64 nt, hsa
auaaacacuaacauuuuccccuucuguaguuguaugaaaaaacaaauauuguuagcauaguaga

SEQ ID NO: 169460 - RNA, 64 nt, hsa
augaaccugggcuaaugggagacuguagagaaaaugaaaaaagauccaccagaggacaucuugg

SEQ ID NO: 169461 - RNA, 64 nt, hsa
guugcuacucccauggcaaagaaaaaaaaaagaaugaaaaaaagaaaaaaauuuggaaaaaaaa

SEQ ID NO: 169462 - RNA, 64 nt, hsa
cuacugaccuuucacagagaaaaaauauuucccuugaaaaaaacugggcuugucauuuuuuccc

SEQ ID NO: 169463 - RNA, 64 nt, hsa
gagugaaagggacaauuuggcugaagucuuucucugaaaaaagccaaaggguuauagggguaca

SEQ ID NO: 169464 - RNA, 64 nt, hsa
cuaaugcucaggugagaucauagcuuaaauacauugaaaaaacuaaaguaccacaauagcugua

SEQ ID NO: 169465 - RNA, 64 nt, hsa
uccuucaacacccagaaugagccagaagacaugaugaaaaaagagaaaaagucugaagcucuga

SEQ ID NO: 169466 - RNA, 64 nt, hsa
aaaaaaauccaauuuugucaguauuuucuuagucugaaaaaaacagcaguaguaaucuggugaa

SEQ ID NO: 169467 - RNA, 64 nt, hsa
aacaugauugauagcuggacagacaugcucgucaugaaaaaagaaccauuucugaagcccgauu

SEQ ID NO: 169468 - RNA, 64 nt, hsa
ucaguauuuuuuuuuaauuuugauauacauugugugaaaaaagaaaauggcuaauaaacuguau

SEQ ID NO: 169469 - RNA, 64 nt, hsa
aagcuggaacauuugauauuuuuccauuuauuuaugaaaaaauaugaaccuauuuucauuugua

SEQ ID NO: 169470 - RNA, 64 nt, hsa
uucugauucaugaagaaaagcagauagaagugguugaaaaaaugaauucugagguauuuucuuu

SEQ ID NO: 169471 - RNA, 64 nt, hsa
agagaaaagaaauauuuggaggauauugaaagugugaaaaaaaagaaugauaaucuuuuaaagg

SEQ ID NO: 169472 - RNA, 64 nt, hsa
auaaagcugaucauguuuugcuacaguuugcaggugaaaaaaaauaaauauuauaaaauaugcu

SEQ ID NO: 169473 - RNA, 64 nt, hsa
ccuggggauagagugagaucccaucucuaaaaaaugaaaaaaagaagagagguagcuuuaaagu

SEQ ID NO: 169474 - RNA, 64 nt, hsa
uuaaccuguucauacacccauuuugucccuuuauugaaaaaauaaaaaaaauuaaaguacacau

SEQ ID NO: 169475 - RNA, 64 nt, hsa
aggucuauacuuaagggaaaaguugcaagaaugcugaaaaaaaauugaacacaaucucauugag

SEQ ID NO: 169476 - RNA, 64 nt, hsa
uggauuaacccucuauagacagaauagauagcacugaaaaaaaaucucuaugagcuaaaugucu

SEQ ID NO: 169477 - RNA, 64 nt, hsa
aaacagaugaaaaaaguuaacauucaguacuuuaugaaaaaaauauauuuuucccuguuugccu

SEQ ID NO: 169478 - RNA, 64 nt, hsa
acacacuuuugcacauauauuuuuuacaaacagaugaaaaaaguuaacauucaguacuuuauga

SEQ ID NO: 169479 - RNA, 64 nt, hsa
aauuacugucaccacuaguuuuaauauaguacaaugaaaaaauaauauauauauauauaguaca

SEQ ID NO: 169480 - RNA, 64 nt, hsa
gaaaucaugaguaaaauuggaaaacacuuuuaacugaaaaaaacaaaagcacaacaaaccaaaa

SEQ ID NO: 169481 - RNA, 64 nt, hsa
uuucccucuauaaguguuauugauuauuuuaaauugaaaaaaguuucacuuggaugaaaaaagu

SEQ ID NO: 169482 - RNA, 64 nt, hsa
ugauuauuuuaaauugaaaaaaguuucacuuggaugaaaaaaguagaaaaguaggucauucuug

SEQ ID NO: 169483 - RNA, 64 nt, hsa
caucagcaaggcauugacuucugaaaaaaugaucugaaaaaaguuucaccguuugucuucuuac

SEQ ID NO: 169484 - RNA, 64 nt, hsa
auguugcgcuuugcaucagcaaggcauugacuucugaaaaaaugaucugaaaaaaguuucaccg

SEQ ID NO: 169485 - RNA, 64 nt, hsa
uuugcagguaucacagccuugcagaagaaccaacugaaaaaaaaauucucaggcuuuacagcaa

SEQ ID NO: 169486 - RNA, 64 nt, hsa
acauucuaccagcacaaggaaacauaggcagcacugaaaaaaaaaaaaaagcucauauuaauua

SEQ ID NO: 169487 - RNA, 64 nt, hsa
auuugggaguauuuuugauuuuucuacuuuuuguugaaaaaaggaauuuguacucugugcauug

SEQ ID NO: 169488 - RNA, 64 nt, hsa
auugaagaccagcuuucucauaaauuucucuuuuugaaaaaaagaaagcauuuguacuaagcuc

SEQ ID NO: 169489 - RNA, 64 nt, hsa
agaaaacugagcauacuagcaagacagcucuucuugaaaaaaaaaauauguauacacaaauaua

SEQ ID NO: 169490 - RNA, 64 nt, hsa
caguguuucuucacuucuuuucugaucuggggcaugaaaaaagcaagauugaaauuugaacuau

SEQ ID NO: 169491 - RNA, 64 nt, hsa
aguuagucauggaauaaagcacuguccuugcagaugaaaaaagucuccagagcagacuucugac

SEQ ID NO: 169492 - RNA, 64 nt, hsa
caagaaaggauugguacugcaacuguagguaaacugaaaaaaaauaagaaagaaagaguuggau

SEQ ID NO: 169493 - RNA, 64 nt, hsa
gaaagaagagguauacuuauuuaaaaaacuaagaugaaaaaagugcgcagcugggaaguucaca

SEQ ID NO: 169494 - RNA, 64 nt, hsa
gacucuugcauagaaaaaaaaaucuuguuaacaaugaaaaaaugagcaaacaaaaaaaucgaaa

SEQ ID NO: 169495 - RNA, 64 nt, hsa
uaauuuuugcuccaauauccauucuguagacuuuugaaaaaaaaguuuuuaauuugaugcccaa

SEQ ID NO: 169496 - RNA, 64 nt, hsa
auauuauuaauuuuuauuuauuuuucuugggaauugaaaaaaauugaaauaaauaaaaaugcau

SEQ ID NO: 169497 - RNA, 64 nt, hsa
uaacaugauuauuugaacuuauuuacacauaguuugaaaaaaaaaagacaaaaauaguauucag

SEQ ID NO: 169498 - RNA, 64 nt, hsa
ugucuuuuuuucaagaugcuuuguuucuuucauaugaaaaaaaugcauuuuauaaauucagaaa

SEQ ID NO: 169499 - RNA, 64 nt, hsa
acagaagagagaaugcaaauggccacuaaguauaugaaaaaagucguaucuuaacagugaacaa

SEQ ID NO: 169500 - RNA, 64 nt, hsa
cucucaagguacucacagaucuguuuaacccacuugaaaaaaaaacacuaaaaaugaagaaaug

SEQ ID NO: 169501 - RNA, 64 nt, hsa
aucuauuguuccuaguaaucuuaggggaguggucugaaaaaacaucaagcauaguaauugucug

SEQ ID NO: 169502 - RNA, 64 nt, hsa
caaaaugagucccggaaggucaguaagugcaacaugaaaaaaaucuaugaaaagauuauuugac

SEQ ID NO: 169503 - RNA, 64 nt, hsa
cccaguauaugcuauucaaugaucuuagaaguacugaaaaaaaaagacguuuuuaaaacguaga

SEQ ID NO: 169504 - RNA, 64 nt, hsa
uuucaugucauuugacauuuuuuguuugcugaagugaaaaaaaaagauaaagguuguacggugg

SEQ ID NO: 169505 - RNA, 64 nt, hsa
auuuuuaauggcuaauagcccagugccauccaguugaaaaaacaacagcaaucacaaaguagag

SEQ ID NO: 169506 - RNA, 64 nt, hsa
aaauaacuuaaaaagaacuuugaauaaaauucuaugaaaaaagacacuagaaugcuguucuuaa

SEQ ID NO: 169507 - RNA, 64 nt, hsa
uggguauccuguaauuuaguuguaacauagaaaaugaaaaaacaguuaaaaaaagugaaguagu

SEQ ID NO: 169508 - RNA, 64 nt, hsa
uuuaagaaauagucuauguaaagucacaaauuaaugaaaaaaauucgcaugaaaaugacagaua

SEQ ID NO: 169509 - RNA, 64 nt, hsa
auggucaguaaauguucuauugauuaucaaucagugaaaaaagaaaucuguuuaaaauacugaa

SEQ ID NO: 169510 - RNA, 64 nt, hsa
ugaaguguagaucauuguauucagagauuguaaaugaaaaaaauauagaaacuauuuaguuuug

SEQ ID NO: 169511 - RNA, 64 nt, hsa
aggaacaaaacaaagcuuugaaaaaacuuuaacaugaaaaaacgcacugacauuuuuuuuuauu

SEQ ID NO: 169512 - RNA, 64 nt, hsa
uguggucagcacaacaaggaacaaaacaaagcuuugaaaaaacuuuaacaugaaaaaacgcacu

SEQ ID NO: 169513 - RNA, 64 nt, hsa
gcauagccaaggcuagcgaggcauacuuuccaguugaaaaaaaucaaaauuuuuugccuuccau

SEQ ID NO: 169514 - RNA, 64 nt, hsa
cacagaacuuuuccauaaacauuguuccacauauugaaaaaacuguaaaauuauagcacuaacu

SEQ ID NO: 169515 - RNA, 64 nt, hsa
uaacacugauucuuauuguauuacaaaggaaccaugaaaaaaaacacuuuccaacuauuauaua

SEQ ID NO: 169516 - RNA, 64 nt, hsa
uuaauguacuaaauccuauguuuacauuaauaugugaaaaaagauuuagaagauauuuuggaga

SEQ ID NO: 169517 - RNA, 64 nt, hsa
uaaggaguuuacgaaaucugcuguuuuaucaaagugaaaaaaaauugcuuauuacucuucauuu

SEQ ID NO: 169518 - RNA, 64 nt, hsa
uucaugucuguacagauuauuuaaaucauggaaaugaaaaaaauguucucugcuugcuaccaaa

SEQ ID NO: 169519 - RNA, 64 nt, hsa
gggccgggggggguaggagaggagaaaaaaaaagugaaaaaaagaaacgaaaaggacagacgaa

SEQ ID NO: 169520 - RNA, 64 nt, hsa
uguguucagguuuauagcuguuguguuuaaaaauugaaaaaaguggaaaacaucuuuguacauu

SEQ ID NO: 169521 - RNA, 64 nt, hsa
gauucuuacggaaauuuuuuuaccugacuugcuaugaaaaaacucaucacacaagaagagaaac

SEQ ID NO: 169522 - RNA, 64 nt, hsa
aagaaucuuguaacuuuauucuuuuuucuccugcugaaaaaaaaaauuaaaccaaucguaugaa

SEQ ID NO: 169523 - RNA, 64 nt, hsa
agaccccuuggucaaugguguucuggcuuacuuaugaaaaaaucagagagaugaguggagucag

SEQ ID NO: 169524 - RNA, 64 nt, hsa
ugacuuccucugacagccacacaccgaaucuugaugaaaaaagagaagagcauuugccuuguua

SEQ ID NO: 169525 - RNA, 64 nt, hsa
cugcccccucuuucacuaaggaaggcaaaugaagugaaaaaaaaaaaugccauuuucaauccuu

SEQ ID NO: 169526 - RNA, 64 nt, hsa
uccaaacacaaaagacucuacuggaaaguguaggugaaaaaacuuguaacuguauugaaaauaa

SEQ ID NO: 169527 - RNA, 64 nt, hsa
uuucaaaagaagaccuacaauuggccaacaaacaugaaaaaaugcucaguaucacuaaucauca

SEQ ID NO: 169528 - RNA, 64 nt, hsa
aaucaaucuaagugcccaacaacaguaaauucaaugaaaaaaaaugugguacauagauacgaug

SEQ ID NO: 169529 - RNA, 64 nt, hsa
uauccauuuccuaugcguuuuacuccucagagaaugaaaaaaacugcaucccaucacccaaagu

SEQ ID NO: 169530 - RNA, 64 nt, hsa
aaaaugguuaccaguacagucaaaaaagagaaaaugaaaaaaauacaacuaaaaggaagaaaca

SEQ ID NO: 169531 - RNA, 64 nt, hsa
caacucuugugguacaucagggaacucacauaggugaaaaaacccauacuuaccuugagucuga

SEQ ID NO: 169532 - RNA, 64 nt, hsa
gaaaacccacccuggggagaagccccagcaagugugaaaaaagcuucuaacaaaacucugacuu

SEQ ID NO: 169533 - RNA, 64 nt, hsa
uuacguuuucaugcugcuuauuguuuuauucuacugaaaaaaaugaauuucaagauucucaacu

SEQ ID NO: 169534 - RNA, 64 nt, hsa
ugaugagauaucaagguaauuaaaauagcaugcuugaaaaaaaaauacguaaucuguuucaccu

SEQ ID NO: 169535 - RNA, 64 nt, hsa
acauagcaugacuguuuuuugaauagguuggaauugaaaaaacaauuaucaaacguuaagaaca

SEQ ID NO: 169536 - RNA, 64 nt, hsa
uuuguugacuuaaaaauaugagauacauaggaugugaaaaaaaauguuugcaguacucagcaaa

SEQ ID NO: 169537 - RNA, 64 nt, hsa
augaacucaaucuaaauuaaaaaagaaagaaauuugaaaaaacuuucucuuugccauuucuucu

SEQ ID NO: 169538 - RNA, 64 nt, hsa
cuauuuuguauaugugagauguuuaaauaaauugugaaaaaaaugaaauaaagcauguuugguu

SEQ ID NO: 169539 - RNA, 64 nt, hsa
guaauauguaaauuaaaauauuucuacauuuuauugaaaaaaaaaccuuuuuuuuugccuaaau

SEQ ID NO: 169540 - RNA, 64 nt, hsa
acacauuaauguugaauuuuacagacaguauauuugaaaaaaauugauuccauguagucuucaa

SEQ ID NO: 169541 - RNA, 64 nt, hsa
uuacaggaauuguauguucacuucgaaucauguuugaaaaaacguuguauccuuauuuuguaau

SEQ ID NO: 169542 - RNA, 64 nt, hsa
acuaaaagauauguuucugauacaauagcaaacuugaaaaaaaaaaaagaaauagaagauuccu

SEQ ID NO: 169543 - RNA, 64 nt, hsa
uuuuggucagugcuauuuuaaaggaaguaugaguugaaaaaaaauugaaauaaacuauaucaua

SEQ ID NO: 169544 - RNA, 64 nt, hsa
uaaauaagaaaauuaauaauuguauuaagugguaugaaaaaaagggggaggauuguucacucac

SEQ ID NO: 169545 - RNA, 63 nt, hsa
aaucucugcuaauuuuucagauuaaaauucucuuugaaaaaauacagucuguauucaugaauu

SEQ ID NO: 169546 - RNA, 64 nt, hsa
aauuguaacucggggccuaacuauaugagauggcugaaaaaauaccacaucgucuguuuucacu

SEQ ID NO: 169547 - RNA, 64 nt, hsa
uuuaaauaacacaaaauugaccacagugauuagaugaaaaaauuauuuguagauaggauaaucu

SEQ ID NO: 169548 - RNA, 64 nt, hsa
uaucagugcuaaaugcucuguaugucacuacauaugaaaaaacaucaaaaaacaauuagcauug

SEQ ID NO: 169549 - RNA, 64 nt, hsa
ugaauugcaucagaucauggaugcauuuuuauuaugaaaaaauaaaaugacuuuucaaauuaua

SEQ ID NO: 169550 - RNA, 64 nt, hsa
auaacucugguguguuaacauugcaaugaaaaaaugaaaaaaagaaggaaaaaagaauaagaau

SEQ ID NO: 169551 - RNA, 64 nt, hsa
aaaaucacauaacucugguguguuaacauugcaaugaaaaaaugaaaaaaagaaggaaaaaaga

SEQ ID NO: 169552 - RNA, 64 nt, hsa
auuauuuuaucugguauggugcuaauauuuuauuugaaaaaaguuacugcaacuuaacuuaaaa

SEQ ID NO: 169553 - RNA, 64 nt, hsa
guagaacugauuuuacaaauuaauauuugugcuuugaaaaaaaguuucuauuuaguuauuuaag

SEQ ID NO: 169554 - RNA, 64 nt, hsa
uuuaaaugcuuuuuaucgcuaaaugacuugcagaugaaaaaaacuaaggugacucgaguguuua

SEQ ID NO: 169555 - RNA, 64 nt, hsa
aguuuuucugucauuguuaaauacacauuaucacugaaaaaauguagcuuuuaugugauauguu

SEQ ID NO: 169556 - RNA, 64 nt, hsa
acugcuuuauuuuuauaaaacugccugacaauuaugaaaaaauguucaaauucacguucuagug

SEQ ID NO: 169557 - RNA, 64 nt, hsa
ggaugauaagaaaugcuaauauaaaaaugcuaagugaaaaaaagacuuggccaggagaaauaau

SEQ ID NO: 169558 - RNA, 64 nt, hsa
agaugcauacccguuucucaacugcuccauggauugaaaaaauaacaguuuaaaaagggaaaca

SEQ ID NO: 169559 - RNA, 64 nt, hsa
uaauuccagucauuuugggaauuccugcuuaacuugaaaaaaauaugggaaagacaugcagcuu

SEQ ID NO: 169560 - RNA, 64 nt, hsa
guccuaaaaagacacgguugcucuauauaugaagugaaaaaaggauaugguagcauuuuauagu

SEQ ID NO: 169561 - RNA, 64 nt, hsa
aagauggugggggcauuuuuagagcggcaauaauugaaaaaaaaggcgaacucugccuuggaga

SEQ ID NO: 169562 - RNA, 64 nt, hsa
ccaacuaaagaauggauuuaauuaaacuauguauugaaaaaaaaguagccuaaguguuagagau

SEQ ID NO: 169563 - RNA, 64 nt, hsa
ucuuuuuuccaccuuuuuggucaguaaaacuuaaugaaaaaagcaaagaaaaaaauauucugaa

SEQ ID NO: 169564 - RNA, 64 nt, hsa
cugaaaauguauuuaacauagcuguuuuaacaaaugaaaaaaagacguagaaaaauguuuagau

SEQ ID NO: 169565 - RNA, 64 nt, hsa
gaaauguuuguguacaauucaaaaaaaaaaaagaugaaaaaaguuccuguggauguuuugugua

SEQ ID NO: 169566 - RNA, 64 nt, hsa
cagaauaacacuugguuauggaagugacuaaugcugaaaaaauugauuauuuuuauuagauaau

SEQ ID NO: 169567 - RNA, 64 nt, hsa; identical to SEQ ID NO: 169531

SEQ ID NO: 169568 - RNA, 64 nt, hsa; identical to SEQ ID NO: 169532

SEQ ID NO: 169569 - RNA, 64 nt, hsa
uuuuuaagaauuaguaucuacuaucuuggauauuugaaaaaaaauugguugaaacuauguuuaa

SEQ ID NO: 169570 - RNA, 64 nt, hsa
ccuugagacuuucaagaaugcaggucucguuugaugaaaaaaccgacuucauaacccaauguua

SEQ ID NO: 169571 - RNA, 64 nt, hsa
gagugagacucugucucaaaaaaaaaaaaaauuaugaaaaaaguuaugggauuaaagaaaguca

SEQ ID NO: 169572 - RNA, 64 nt, hsa
aaaagguuauggguaacuuaugguauaaaaguuaugaaaaaaggccaggugcaguggcucacgc

SEQ ID NO: 169573 - RNA, 64 nt, hsa
ggaccagaaaccagaagaacaaucaagacugcaaugaaaaaaauggauacauuaggagcuucaa

SEQ ID NO: 169574 - RNA, 64 nt, hsa
aagucucauagauuuagaugcaaaauccuaaaauugaaaaaaacaucuagccauauccauaaac

SEQ ID NO: 169575 - RNA, 64 nt, hsa
agaaacaacaauuucuacuuugaagucauaccaaugaaaaaauguauaugcacuuauaauuuuc

SEQ ID NO: 169576 - RNA, 64 nt, hsa
aaaaauuaaaauccucaauccagcuauguuauauugaaaaaauagagccugagggaucuuuacu

SEQ ID NO: 169577 - RNA, 64 nt, hsa
acugccaagcccagguugccucucaugaggcaacugaaaaaauccugugucuugauagcauggg

SEQ ID NO: 169578 - RNA, 64 nt, hsa
uugccuucgaaugcauauuuaagaguuaacagaaugaaaaaaaaaagucuuguuggauaauagu

SEQ ID NO: 169579 - RNA, 64 nt, hsa
auuaacauuucacaaauguuuagugaaacauuugugaaaaaagaagacuaaauuaagaccugag

SEQ ID NO: 169580 - RNA, 64 nt, hsa
uuuuagccuaaguauaagaguccuacagauggacugaaaaaaaucagucugagaguauuaguca

SEQ ID NO: 169581 - RNA, 64 nt, hsa
ccuugcaguuagcccccaugucuuauguguguccugaaaaaauaagagccugcccaagacuuug

SEQ ID NO: 169582 - RNA, 64 nt, hsa
acuuuugcagauggaggaauuucuugauuaauguugaaaaaaaacccuugauuauacucuguug

SEQ ID NO: 169583 - RNA, 64 nt, hsa
uucccucugcccugccauuccuauuacaaugcugugaaaaaaguucugcuucuuaggugaaugg

SEQ ID NO: 169584 - RNA, 64 nt, hsa
ugcuguauuggugcaauaaugguaauuaaaaauaugaaaaaagugucucuuuuaucuuuuaauu

SEQ ID NO: 169585 - RNA, 64 nt, hsa
gaaauugaugacuuuauaaugcaaccaggaguauugaaaaaaaaguaagcaaugagcucaaaua

SEQ ID NO: 169586 - RNA, 64 nt, hsa
aaaugcugaaaagaagagaaauaccccaaguucuugaaaaaaaauuuuuugauaugacuacucu

SEQ ID NO: 169587 - RNA, 64 nt, hsa
uccacauuuguucuuccuuccucaggguuagugaugaaaaaaaguaaauaucuuuuucauaugu

SEQ ID NO: 169588 - RNA, 64 nt, hsa
guaaauaucuuuuucauauguccauuagaauguaugaaaaaaaucauuuuaacuaaaagcaaaa

SEQ ID NO: 169589 - RNA, 64 nt, hsa
cuauucucuuaaaaaguaugugaaaagaaaauuaugaaaaaauaugcauaccuaaugaaguauu

SEQ ID NO: 169590 - RNA, 64 nt, hsa
uaccauuugcauggcuccagaaaugucuaaaugcugaaaaaacaccuagcuuuauucuucagau

SEQ ID NO: 169591 - RNA, 64 nt, hsa
aguguuuguauuuguauucucugcaauuuuacugugaaaaaaaauuuguuuucaacaauuggug

SEQ ID NO: 169592 - RNA, 64 nt, hsa
aguguuuuguauuuuauagugaguugcauguuuuugaaaaaaagugcugaaaaugggaugugcu

SEQ ID NO: 169593 - RNA, 64 nt, hsa
auuuuagugauuauuaagcacuucugucagucuuugaaaaaagaacguauuuuuugugcuuuga

SEQ ID NO: 169594 - RNA, 64 nt, hsa
aaaauuguauaaggcugaaugaacuucauacaaaugaaaaaaaucucauaaaaauacauaaacu

SEQ ID NO: 169595 - RNA, 64 nt, hsa
uauuuauauaacugcauuuaagcaguaccaagacugaaaaaaaagguaauaaaugaaauguuuu

SEQ ID NO: 169596 - RNA, 64 nt, hsa
gcuugauuagcaaagguuuuugacaaacaguuuaugaaaaaauaaaacuuaaauacauuacacg

SEQ ID NO: 169597 - RNA, 64 nt, hsa
caaguguuuaauaacuggcauuaagcuuagagggugaaaaaaaaaaaaaagauugauaguauuu

SEQ ID NO: 169598 - RNA, 64 nt, hsa
aaaaaaaaaaaaagauugauaguauuuuucauaaugaaaaaacugaagagauacgugaaugaaa

SEQ ID NO: 169599 - RNA, 64 nt, hsa
gucgcuuaauaccuaauaucauaguuguacaauaugaaaaaaaagaauaaaaaguagcaguaaa

SEQ ID NO: 169600 - RNA, 64 nt, hsa
cuaaacugagugugacuauuuucacugcaacaaaugaaaaaacaaaaugugccuguuuaaagca

SEQ ID NO: 169601 - RNA, 64 nt, hsa
uagcaaaaucagaaacguuagggcaccagugaguugaaaaaacuggucuuaaguuggaaaaacu

SEQ ID NO: 169602 - RNA, 64 nt, hsa
aggauuugaaauaagacaggaauaaagaguauucugaaaaaaagaagauauggaugaagugaac

SEQ ID NO: 169603 - RNA, 64 nt, hsa
cuaaauauuuuucagugagccaagaaauucaccaugaaaaaacaagaauaacaaauagaaggga

SEQ ID NO: 169604 - RNA, 64 nt, hsa
gcugcuaugauaccacgccuuaaaaauugacaguugaaaaaaaaaagagugaccagagggcaaa

SEQ ID NO: 169605 - RNA, 64 nt, hsa
auuuuugaagccauauggugaguaaauguaaauaugaaaaaagugcuacauaaaacacuucuua

SEQ ID NO: 169606 - RNA, 64 nt, hsa
ugcugcagccgagugaccuccauaaauacuggacugaaaaaacauuguaauacuacaaguauaa

SEQ ID NO: 169607 - RNA, 64 nt, hsa
acuuaccuuccgguggguugcugaugagagaaccugaaaaaaccuacaccucuacagcaggucg

SEQ ID NO: 169608 - RNA, 64 nt, hsa
ucuuuuucugucuaucaaaacuauuugauccaagugaaaaaaaaaaaaaaacuagaaagcuacg

SEQ ID NO: 169609 - RNA, 64 nt, hsa
ugaaucccucagugcugacuuauaucuuguucuuugaaaaaaugcauugacucuuuaagacauc

SEQ ID NO: 169610 - RNA, 64 nt, hsa
cuccugauaaagaauauaaagugagccugauucuugaaaaaaucagaaccagagccuguuuugu

SEQ ID NO: 169611 - RNA, 64 nt, hsa
uagccuuauucucuugcgugugaaucucuuacccugaaaaaaagccauaaugaauuaagccaga

SEQ ID NO: 169612 - RNA, 64 nt, hsa
aagccagacugaccacuugcuuggagugugugcuugaaaaaaccagagcaauacuguuggguau

SEQ ID NO: 169613 - RNA, 64 nt, hsa
acuauuguggcagaagcgagaaaacuuuguuuauugaaaaaaaaagaaaaagaaagcaagaaaa

SEQ ID NO: 169614 - RNA, 64 nt, hsa
acaaacuaaagacuaaucgcucaauaugaaaacaugaaaaaauuuuugcuuaaaguauuaagau

SEQ ID NO: 169615 - RNA, 64 nt, hsa
aaaaaauaagacccaauauuggcaaagagacuacugaaaaaacauucccauacauugcgugugg

SEQ ID NO: 169616 - RNA, 64 nt, hsa
aaauucauaaaagaaaucugaauggauaaaaccaugaaaaaaaguaugcuucauuaguaauuaa

SEQ ID NO: 169617 - RNA, 64 nt, hsa
gacuagugcuuaaaaaaaaaaaagaaggaaaaauugaaaaaaauaaaaaaaaaaguuacagaau

SEQ ID NO: 169618 - RNA, 64 nt, hsa
uaagguugaaaauucugaauaacccuuuuagcauugaaaaaaaaaacaaaaacaaaaaauggaa

SEQ ID NO: 169619 - RNA, 64 nt, hsa
ucuccgaaaaucaugguaaagaauacugagacaaugaaaaaaaaucaacaaaauaugcuuucug

SEQ ID NO: 169620 - RNA, 64 nt, hsa
ugcuuuuauuuuccuuggggugcugaaauugagcugaaaaaaaaaggcucuuugaauauaguuu

SEQ ID NO: 169621 - RNA, 64 nt, hsa
uaugauucgguuuauacauauuaccuuguuauaaugaaaaaacucauucugagaacacugaaau

SEQ ID NO: 169622 - RNA, 64 nt, hsa
uuacuagaaacuauggaaaacuggaaaauaacuuugaaaaaauuggauaaaguauaggaggguu

SEQ ID NO: 169623 - RNA, 64 nt, hsa
uuuuuuuacaacacuggugacagucauaugguuuugaaaaaaaaaagaaauuuugcuucuuccc

SEQ ID NO: 169624 - RNA, 64 nt, hsa
ggaagagagaggaagaagucaaaccauaugaaacugaaaaaauaugacguacgaaauggacaaa

SEQ ID NO: 169625 - RNA, 64 nt, hsa
ugaggacuguaauugcauuucugugccuuucacuugaaaaaaaaaaaagaagaaaaaaaggcuu

SEQ ID NO: 169626 - RNA, 64 nt, hsa
agcugaccuuucuauagcgugcugcauugguaaaugaaaaaaaauggggcaaacguuggagucc

SEQ ID NO: 169627 - RNA, 64 nt, hsa
gauugaaaaaaaaaaagcacugaaaaccaauuacugaaaaaaaauugacagcuaguguuuuuua

SEQ ID NO: 169628 - RNA, 64 nt, hsa
acuccuuucuaauugcaucaccuucucaucagauugaaaaaaaaaaagcacugaaaaccaauua

SEQ ID NO: 169629 - RNA, 64 nt, hsa
ggcuuuguccaguuaucuucauaugacuguucucugaaaaaaggucuuacuaccugauaucaag

SEQ ID NO: 169630 - RNA, 64 nt, hsa
uuuauuggacuuuuauagacauuuuuuauuugcaugaaaaaaacucacuaaauuuacaucacua

SEQ ID NO: 169631 - RNA, 64 nt, hsa
aauauuuuuuuaugaaaaaaaaaacacuucucagugaaaaaacaagauuacaagggggaauaau

SEQ ID NO: 169632 - RNA, 64 nt, hsa
cuaucauaaaauuaucauuugaaauauuuuuuuaugaaaaaaaaaacacuucucagugaaaaaa

SEQ ID NO: 169633 - RNA, 64 nt, hsa
uucagcuucuuacaaauacauaagagacucacacugaaaaaaguuguaugaauauaaaaaugua

SEQ ID NO: 169634 - RNA, 64 nt, hsa
uucaaaaauauauauauaaugaaugugaggaauaugaaaaaacuuucuuugucuagcaaacuuu

SEQ ID NO: 169635 - RNA, 64 nt, hsa
aaggccuuuauucugccaagucauuucgaagacaugaaaaaacucacacuggagagaaacccua

SEQ ID NO: 169636 - RNA, 64 nt, hsa
aaggcuuuuauucucccacgucauuucaaagacaugaaaaaacucacacugcagagaaacccua

SEQ ID NO: 169637 - RNA, 64 nt, hsa
aagcuuucagucagagacaaaaucuucuugagcaugaaaaaauucauacuggagagaaaccauu

SEQ ID NO: 169638 - RNA, 64 nt, hsa
auuguguaacauggauaguuaaaacaauguugaaugaaaaaaaucaaaauacaaaugaaacauu

SEQ ID NO: 169639 - RNA, 64 nt, hsa
gcaucauucuaauaccaaaaccugacaggcacaaugaaaaaagaaaacuucaggcugguacucc

SEQ ID NO: 169640 - RNA, 64 nt, hsa
cucaaaagaauacauacauguggcaauaagcauaugaaaaaaaugguuaauaucgcuaaucauu

SEQ ID NO: 169641 - RNA, 64 nt, hsa
auguacacauacuccuugaaccuaaaauaaaacaugaaaaaaagcaaauuucacaccuuguaaa

SEQ ID NO: 169642 - RNA, 64 nt, hsa
ucucuagauuccuccucucugggcagcgcaucuuugaaaaaagugcagauaaaacccucaucuc

SEQ ID NO: 169643 - RNA, 64 nt, hsa
auguucuaacccaaugcaaggaagcuaagaaccuugaaaaaagguuagaggaauugcuaacuag

SEQ ID NO: 169644 - RNA, 64 nt, hsa
cucguggagaauuuuuacuggggauucuugaacuugaaaaaaaaaaacacaaaaaaagacaaaa

SEQ ID NO: 169645 - RNA, 64 nt, hsa
ggagcaggcaguggggcuggaagcagaaacaaaaugaaaaaaaaaggggggugggaggggaaga

SEQ ID NO: 169646 - RNA, 64 nt, hsa
ugcaguuauugcauucaaaguaugcuuaacuuuuugaaaaaauuagauuuuuugaaaagugagu

SEQ ID NO: 169647 - RNA, 64 nt, hsa
gcucaaacuuuguucaauaucagggaauuuauauugaaaaaaacugugcgaauguaauaaaguu

SEQ ID NO: 169648 - RNA, 64 nt, hsa
uagauacuguagugauucaaauaaguuuucuauuugaaaaaaaaaaucacuugauuguauccuu

SEQ ID NO: 169649 - RNA, 64 nt, hsa
agguaaaacugaucaaaagcauaauugaaaguucugaaaaaagaaaaauaauaauauguagaaa

SEQ ID NO: 169650 - RNA, 64 nt, hsa
cugucuaccuuuagccaggcacaggacagcccuaugaaaaaauacccaauauauauuuuuugga

SEQ ID NO: 169651 - RNA, 64 nt, hsa
uuucuuaguagugcagaccuuuaccccuagucuaugaaaaaacaaaccaaaauaugcucuugcg

SEQ ID NO: 169652 - RNA, 64 nt, hsa
gcaacagacucaugacaaaggauucaagauuguuugaaaaaaaaaaaaggggagcagggaggca

SEQ ID NO: 169653 - RNA, 64 nt, hsa
uuuacaucccagauagaaaacccuaaauuaaaggugaaaaaaccagacaccaaguggcauuuaa

SEQ ID NO: 169654 - RNA, 64 nt, hsa
uuuauuuaaagaaaaaucuuuguuacucuguaaaugaaaaaacccauuuucgcuauaaauaaaa

SEQ ID NO: 169655 - RNA, 64 nt, hsa
uucuugagguugucugagucuugggucuaugccuugaaaaaagcugaauuauuggacagucuca

SEQ ID NO: 169656 - RNA, 64 nt, hsa
agaugcuggaccugugcuaaauucuucagugauaugaaaaaaucauugagcauucauuauugcg

SEQ ID NO: 169657 - RNA, 64 nt, hsa
uaagaguuucagcaugagcuuaauuaaauucuugugaaaaaaccuguguuuuuaguuacacaca

SEQ ID NO: 169658 - RNA, 64 nt, hsa
cugucagaauuguuaacugaaacaaauauuugcuugaaaaaaaaaguucaugaaguaccaaugc

SEQ ID NO: 169659 - RNA, 64 nt, hsa
aaaucucaagaagugaagcagauucauacagccuugaaaaaaguaaaacccugaccuguaaccu

SEQ ID NO: 169660 - RNA, 64 nt, hsa; identical to SEQ ID NO: 125921

SEQ ID NO: 169661 - RNA, 64 nt, hsa; identical to SEQ ID NO: 125922

SEQ ID NO: 169662 - RNA, 64 nt, hsa; identical to SEQ ID NO: 125923

SEQ ID NO: 169663 - RNA, 64 nt, hsa; identical to SEQ ID NO: 125924

SEQ ID NO: 169664 - RNA, 64 nt, hsa; identical to SEQ ID NO: 125925

SEQ ID NO: 169665 - RNA, 64 nt, hsa; identical to SEQ ID NO: 125926

SEQ ID NO: 169666 - RNA, 64 nt, hsa; identical to SEQ ID NO: 125927

SEQ ID NO: 169667 - RNA, 64 nt, hsa; identical to SEQ ID NO: 125928

SEQ ID NO: 169668 - RNA, 64 nt, hsa; identical to SEQ ID NO: 125929

SEQ ID NO: 169669 - RNA, 64 nt, hsa; identical to SEQ ID NO: 125930

SEQ ID NO: 169670 - RNA, 64 nt, hsa; identical to SEQ ID NO: 125931

SEQ ID NO: 169671 - RNA, 64 nt, hsa; identical to SEQ ID NO: 125932

SEQ ID NO: 169672 - RNA, 64 nt, hsa
uugugaggugaaugucuuccuuuucuuucucccuaaccacuaauguuagaauugauuuccaaga

SEQ ID NO: 169673 - RNA, 64 nt, hsa
aagucucuuaauucugaugcuagguuguuuuuaaaaccacuaugcaaagaacucaccacaagcc

SEQ ID NO: 169674 - RNA, 64 nt, hsa
gcacccggcuugcaauuuagaaagggcacuuggcaaccacuaugugaagggugauuggagaagg

SEQ ID NO: 169675 - RNA, 64 nt, hsa
cuucaaagucuuauugacacaguaaagggaggccaaccacuacuaacaaguucuagaagauaua

SEQ ID NO: 169676 - RNA, 64 nt, hsa
uaaaaaucagaaaauacaagauuuacauaaaggucauuucaacuuuuaagguuaccagugauug

SEQ ID NO: 169677 - RNA, 64 nt, hsa
auaguguaugagacuuaagccaugaguuuuguaucauuucaauuagaagacuacuagcugugag

SEQ ID NO: 169678 - RNA, 64 nt, hsa
uagacauuucgucauuuaaguaagggaucgaagacauuucaaauugcuaucuccaucugggcug

SEQ ID NO: 169679 - RNA, 64 nt, hsa
uauacauuucaucauuuaaguaagggaucgaaaacauuucaaauugcucuaucugggcugauag

SEQ ID NO: 169680 - RNA, 64 nt, hsa
uccagaccuggaauccacaaaagccaaaccagcucauuucaacaaaggagcuccgaugugaggg

SEQ ID NO: 169681 - RNA, 64 nt, hsa
uuuauaguuuggcuggggagcacuuaauucuucccauuucaaaagguaauguugccuggggcuu

SEQ ID NO: 169682 - RNA, 64 nt, hsa
ccuugauuuguaaugagcucuuauaugcagaacacauuucaaaugaguuuugcuaugggcugcc

SEQ ID NO: 169683 - RNA, 64 nt, hsa
ucaaugaaugaaacuagaaagcagagauuuucaacauuucaaaaugauuuccucuguaaucuau

SEQ ID NO: 169684 - RNA, 64 nt, hsa
uuuaauaucacuuaucuacuucauugccuaaguucauuucaaagaauuuguauuuagaaaaggu

SEQ ID NO: 169685 - RNA, 64 nt, hsa
cuuuuggaaaauaccaaaugaacguacaguacaacauuucaaggaaaugaauauauuguuagac

SEQ ID NO: 169686 - RNA, 64 nt, hsa
gcucauuuaucuuaucuuucaguuaguggaaaaacauuucaaccugacuaaaauuuggaauugu

SEQ ID NO: 169687 - RNA, 64 nt, hsa
guuuauggauuaaaaagaaaauucuaauauaaagcauuucaauaggaugcauagguauauuacg

SEQ ID NO: 169688 - RNA, 64 nt, hsa
aggcucuuuugugcauaauauucuaaaaugaagacauuucaagcuauacaaauuacuuccaagu

SEQ ID NO: 169689 - RNA, 64 nt, hsa
cuauuuuuaaggauagguuaaauuugugaaugaucauuucaaauauauugaauaaaauaagcaa

SEQ ID NO: 169690 - RNA, 64 nt, hsa
acaaaguaugccaucaugcaagcugcaaaggaaacauuucaagagucuauaucuauuuucacgg

SEQ ID NO: 169691 - RNA, 64 nt, hsa
aacaguuuagcaguacaagcuucuauugcuaaaacauuucaaaaaacucagagauauuacucuu

SEQ ID NO: 169692 - RNA, 64 nt, hsa
aggucuuucuguagggaaaauuauuccauguaaacauuucaacucuguaugaaaauguuaaaua

SEQ ID NO: 169693 - RNA, 64 nt, hsa
uauaaaacuuucucaaaauaaaaaaacauugaaucauuucaauuuuugcagucccuguauuagu

SEQ ID NO: 169694 - RNA, 64 nt, hsa
uucacccucaccucucccugcauggaggcaacagcauuucaagauguaccuugggaagucagga

SEQ ID NO: 169695 - RNA, 64 nt, hsa
gcuucagagucgaaguuuggauacauuucaagugcauuucaagccaccagagugucccauugcu

SEQ ID NO: 169696 - RNA, 64 nt, hsa
auguuucugaggcuucagagucgaaguuuggauacauuucaagugcauuucaagccaccagagu

SEQ ID NO: 169697 - RNA, 64 nt, hsa
auaauuucuguuuaaaaauauugaauauuugcuucauuucaaauacucccuuuugacaaaaaaa

SEQ ID NO: 169698 - RNA, 64 nt, hsa
guacaauguuuucacauauauaguuucauuuaaucauuucaaaguuaaucucugccaucucgcu

SEQ ID NO: 169699 - RNA, 64 nt, hsa
uggccugcugggaaacagcaaucuuccuuaauagcauuucaagccgugccuucuccgcagaaug

SEQ ID NO: 169700 - RNA, 64 nt, hsa
gcugccauuuaagcauuccuguggcacccaucaccauuucaauuuaauuguuuacuuugaagcg

SEQ ID NO: 169701 - RNA, 64 nt, hsa
cuccuccucaccuacuccacucccaucuuuaugacauuucaaauguuuauuuggaaacaacagc

SEQ ID NO: 169702 - RNA, 64 nt, hsa
ggccauggaacacauaugcuggaaaucuuugaaccauuucaagucuccugcucaugcaaaauca

SEQ ID NO: 169703 - RNA, 64 nt, hsa
augcuagacuaaaauacagagucuuccaggugggcauuucaaccaacucagucaaggaacccau

SEQ ID NO: 169704 - RNA, 64 nt, hsa
ccaacucagucaaggaacccaugacaaagaaagucauuucaacucuuaccucaucaaguugaau

SEQ ID NO: 169705 - RNA, 64 nt, hsa
gcuaaccugucugaugguggcaucuuccugcagacauuucaaacauguaacuuuuauaugaaaa

SEQ ID NO: 169706 - RNA, 64 nt, hsa
guuuuuaguuuguuccuucuuuuugaagucccuucauuucaauccuugacucucucuccccuuc

SEQ ID NO: 169707 - RNA, 64 nt, hsa
uaaauuauaauguaaaguugacauuuuccccuuacauuucaaaggcaucacuauuuuuaaaugu

SEQ ID NO: 169708 - RNA, 64 nt, hsa
gaucuaaagauaaugucuuagacaauuaccuuuacauuucaagcucugggauauaaauuacgua

SEQ ID NO: 169709 - RNA, 64 nt, hsa
cuagaaggcucucauaaguuucuguuaugauugccauuucaauaaaugacauuaaaaaucuaaa

SEQ ID NO: 169710 - RNA, 64 nt, hsa
uuuauacuagcaacacuacaaaggagaaguuacucauuucaaaauggaugaauuguuauuaugu

SEQ ID NO: 169711 - RNA, 64 nt, hsa
cuuugaaguaauugguuaguuuucuuuguucagccauuucaaguuggugguugggauaucugcu

SEQ ID NO: 169712 - RNA, 64 nt, hsa
gccacauaugugacuuuaaauuuucugacagucacauuucaaaaaguaaaaagaagcaggugaa

SEQ ID NO: 169713 - RNA, 64 nt, hsa
auuuuuuuuuaacccagucuauccaaaauauuuucauuucaauauaaaaucaguauaaaaagug

SEQ ID NO: 169714 - RNA, 64 nt, hsa
auaaguacugagcaugaaguacuugucugccccucauuucaaggccagaguuauuuucuauuua

SEQ ID NO: 169715 - RNA, 64 nt, hsa
ccuaucugucuccaauucaucuccccuuuucagccauuucaacaaacuacucuuuggagcucug

SEQ ID NO: 169716 - RNA, 64 nt, hsa
aauaauaccuuagauuucuagguaagucuuuccacauuucaauaauggguaagaguagaaccag

SEQ ID NO: 169717 - RNA, 64 nt, hsa
ugcugaguuuuagaagugauggaaauuaagagagcauuucaauaaaaugugacuuggcugucuu

SEQ ID NO: 169718 - RNA, 64 nt, hsa
ggauuuuaaaaauauuuuacugcagccaaguuuucauuucaaaauguaauuucaguuuggagcu

SEQ ID NO: 169719 - RNA, 64 nt, hsa
aagggcaugaaaaacuaacugcuagcuuuccuuucauuucaaaaguccaagaauuucuaguaua

SEQ ID NO: 169720 - RNA, 64 nt, hsa
gacuuaggagaaaaugcugaauguaagauggucccauuucaauuuccaccaugggagagccuaa

SEQ ID NO: 169721 - RNA, 62 nt, hsa
aaaugucagcuuuugauagcauagcaguaauugacauuucaaaaauauauauuucuuucugu

SEQ ID NO: 169722 - RNA, 64 nt, hsa
cuauguauuuucucccgguaaaaaugaauugaaccauuucaacuauuuucuauauuuggagaaa

SEQ ID NO: 169723 - RNA, 64 nt, hsa
ugucuuuuuauauuauaagugauugaguuuaguucauuucaauacauuguacaugaaaaaauga

SEQ ID NO: 169724 - RNA, 64 nt, hsa
aaagcaaccuaaauuacuuucgcucucuaaucagcauuucaauguauuuauuuuuaaauuuucu

SEQ ID NO: 169725 - RNA, 64 nt, hsa
uaaagugaucacuguucuuuuuuuauuuuauugucauuucaauaaaaaauauuugaaagagaau

SEQ ID NO: 169726 - RNA, 64 nt, hsa
uauacaucacugauuauuuggguuaaacuggacucauuucaagcaguuugcuuuuguucaaauc

SEQ ID NO: 169727 - RNA, 64 nt, hsa
cuuugcaaaugacuaccuauagccugugaaaauacauuucaaaaaauguuaugugcaaugaaca

SEQ ID NO: 169728 - RNA, 64 nt, hsa
aggguacaaaucucccaaagaugguuugcaccgucauuucaaauguuugcacaauauaccacuu

SEQ ID NO: 169729 - RNA, 64 nt, hsa
aagacaugugggaaaggcuuuuauucucccacgucauuucaaagacaugaaaaaacucacacug

SEQ ID NO: 169730 - RNA, 64 nt, hsa
aagauaugugggaaaggcuuuuauucugccaagucauuucaaauaccugaaaaaucuuacacug

SEQ ID NO: 169731 - RNA, 64 nt, hsa
agaacagcagcagcgcuacagcccagagguuauacauuucaacagaacagggauccuuggcuac

SEQ ID NO: 169732 - RNA, 64 nt, hsa
ccagccacccccugccccacugcugaaugaaggccauuucaagcgcugcuucucacuccauucc

SEQ ID NO: 169733 - RNA, 64 nt, hsa
gugcguggccuugugcuaaccauuagcacugcaucauuucaauucuuuuauaagggcauucaau

SEQ ID NO: 169734 - RNA, 64 nt, hsa
uggccaugaugauauuauuaaacaccauuauucacauuucaaauaauaacaauacuuuuuguuu

SEQ ID NO: 169735 - RNA, 63 nt, hsa
guuuggagguuucaucaggauuuuggguuuuucacauuucacgcuaaggaguaguggcccuga

SEQ ID NO: 169736 - RNA, 63 nt, hsa
uucaaacuucugcugagaccuuggggucaaggaacauuucauugguuuuuuuuguccaccccc

SEQ ID NO: 169737 - RNA, 63 nt, hsa
cccaaaagaaaacuuacacacccacacacauacacauuucaugcuuggagugucuccacaacu

SEQ ID NO: 169738 - RNA, 63 nt, hsa
uggcuuucccaguccuugcaucaacgggaugccacauuucauaacuguuuuuaaugguaaaaa

SEQ ID NO: 169739 - RNA, 63 nt, hsa
uaaaguuguaguugcagaaucccaaacuaggcuacauuucaaaauucagggcuguuuaagauu

SEQ ID NO: 169740 - RNA, 63 nt, hsa
aauucaaaggagacgagucagccaaccacagcuacauuucaggcuuucuccccugacacuuuu

SEQ ID NO: 169741 - RNA, 63 nt, hsa
aauaucaugaauuuaauuugcuuaagauuuaguacauuucagaacuuuugaacuuuugacaaa

SEQ ID NO: 169742 - RNA, 63 nt, hsa
uuauagaauguuuuggaaacuggaaguaaugauacauuucacuucagaagcacuuguaggucu

SEQ ID NO: 169743 - RNA, 63 nt, hsa
auuacagcauaauucauuuugagcuccacuaugacauuucaaagacugcccaguuuggaaguc

SEQ ID NO: 169744 - RNA, 63 nt, hsa
aagcugugaaaaauagaaguauaauuugaaaaaacauuucacuuaucagagauuuuuauauuu

SEQ ID NO: 169745 - RNA, 63 nt, hsa
aauuagguauuuguuucauuggaguugaaauuaacauuucaaaaguuuuucguauuuuuuuau

SEQ ID NO: 169746 - RNA, 63 nt, hsa
agcugauagauggacuuuccacuguaggaguggacauuucaagccaacugagccuuuuccuca

SEQ ID NO: 169747 - RNA, 63 nt, hsa
gucuuuuaauacuucuucugucucauuaacauuacauuucaaggcugagcuuuaaugucagug

SEQ ID NO: 169748 - RNA, 63 nt, hsa
cuuaucauucauggcagauuguuugugcuuucaacauuucauuugaaaugggagaagauaaaa

SEQ ID NO: 169749 - RNA, 63 nt, hsa
ucaagagaaucauauaaauuaagcuuuauaaugacauuucaaccaucaacauaauauagugag

SEQ ID NO: 169750 - RNA, 63 nt, hsa
caugaaauguaaaagggagcccagaaauggaggacauuucauucuuuuuccugaggggaagga

SEQ ID NO: 169751 - RNA, 63 nt, hsa
ugaagacccuguuaacuuugugaaauaacuuccacauuucaacacacuucacaguacaggaaa

SEQ ID NO: 169752 - RNA, 63 nt, hsa
uaaagugcccagcacaaagcagauccucaauaaacauuucauuucccacccacacucgccagc

SEQ ID NO: 169753 - RNA, 63 nt, hsa
aucugacacaaaaaaaguugaaggccuuauucuacauuucaccuacuuuguaagugagagaga

SEQ ID NO: 169754 - RNA, 63 nt, hsa
gagaacgugcuuaagaauccacuaugaugggaaacauuucauucucaaaaaaaaaaaaaaaaa

SEQ ID NO: 169755 - RNA, 63 nt, hsa
acuauuagaaguuaaguauguuguuguuauuucacauuucauuuaauuguggauaaauguuag

SEQ ID NO: 169756 - RNA, 63 nt, hsa
guuuuauagagugcagcgcagcuuggacaaaacacauuucaagugcccaguagucagugucua

SEQ ID NO: 169757 - RNA, 63 nt, hsa
uugcccacccaguguaaugucacugcucaaauuacauuucauuaccuuaaaaagccagucucu

SEQ ID NO: 169758 - RNA, 63 nt, hsa
ccugggagggggcuauuucucuccccacugaaaacauuucaaagcugaguuacuugucugagg

SEQ ID NO: 169759 - RNA, 63 nt, hsa
uauagcuccuggugccaaagucuggaucuuuccacauuucagcagcaccaacaucugcugcua

SEQ ID NO: 169760 - RNA, 63 nt, hsa
aguuucuuaaaacguauuuucugauguggcuuuacauuucaaaagugaacuugauucaaccug

SEQ ID NO: 169761 - RNA, 63 nt, hsa
cuaaagcagguuguguuguuuacauguuucuacacauuucauccuuuaaaaaguuguugagag

SEQ ID NO: 169762 - RNA, 63 nt, hsa
gcaguggagagggacagcccacugagaagucaaacauuucaaaguuuggauuguaucaagugg

SEQ ID NO: 169763 - RNA, 63 nt, hsa
acaauuagguuuuugagauuuuuauaaccaaauacauuucaguguaacauauuagcagaaagc

SEQ ID NO: 169764 - RNA, 63 nt, hsa
auaaguguaaauagaagaguuuaaaagcaugaaacauuucagaagguaucaguuauaugauau

SEQ ID NO: 169765 - RNA, 63 nt, hsa
uuuguuauucagcaugacauuauuuccauucuaacauuucagugugugaaauuacuuuauuuu

SEQ ID NO: 169766 - RNA, 63 nt, hsa
uauuuucaacuacuuuauuacacagaugaagaaacauuucaagauauugauguaauaacauua

SEQ ID NO: 169767 - RNA, 63 nt, hsa
uaaucagaaauagcaacgagaugaauguauccaacauuucaauuugcauucggaaauccaugu

SEQ ID NO: 169768 - RNA, 63 nt, hsa
cucuaugaaacauauaagcuaacuauauaucaaacauuucauugaguuuggauguauuuucca

SEQ ID NO: 169769 - RNA, 63 nt, hsa
ucucuguuacaaaggaugaagacaaauagggauacauuucaauguaaaccauuuaugaauugg

SEQ ID NO: 169770 - RNA, 63 nt, hsa
uuuguuuagcuaucaggucuacuaccucuaaggacauuucauagcagcaucucuugaguugcc

SEQ ID NO: 169771 - RNA, 63 nt, hsa
gccggggccccucaccccaaggggucuguauauacauuucauaaggccugcccucccauguug

SEQ ID NO: 169772 - RNA, 63 nt, hsa
gucucugggcauccauaauugcugcuaaccuagacauuucauaguuacagauuaaaucuacuu

SEQ ID NO: 169773 - RNA, 63 nt, hsa
cacuaugcuggguucccugagucgucaggccagacauuucaacaaggcuguggggagcagggc

SEQ ID NO: 169774 - RNA, 63 nt, hsa
uugauuacugaaaauugaauguuuuuuggguccacauuucaaggcugaaguguauaguguaua

SEQ ID NO: 169775 - RNA, 63 nt, hsa
uuguuuuaaggcaaacuuaaaauuuuaauggaaacauuucauaugaagccaagucucacugag

SEQ ID NO: 169776 - RNA, 63 nt, hsa
uagacauuucgucauuuaaguaagggaucgaagacauuucaaauugcuaucuccaucugggcu

SEQ ID NO: 169777 - RNA, 63 nt, hsa
uauacauuucaucauuuaaguaagggaucgaaaacauuucaaauugcucuaucugggcugaua

SEQ ID NO: 169778 - RNA, 63 nt, hsa
aauggaauauccaauuuacagauaguaugauauacauuucaucauuuaaguaagggaucgaaa

SEQ ID NO: 169779 - RNA, 63 nt, hsa
aauaucagagaauacugacaucuucaaccuagcacauuucaaauggaaacuacuguucuauuu

SEQ ID NO: 169780 - RNA, 63 nt, hsa
gccucugauuagccgcacagccuugaacaaaucacauuucaucuuugaacuuaccucuacugu

SEQ ID NO: 169781 - RNA, 63 nt, hsa
aaacaucaguuuccaaguuuauaucauauuaauacauuucaguggauaauuuauuuuaaaaaa

SEQ ID NO: 169782 - RNA, 63 nt, hsa
uauacggauggaaaagcucagaacucaggugaaacauuucaacaucacaucacucaccauuuu

SEQ ID NO: 169783 - RNA, 63 nt, hsa
aggucaugugcuggaaugcuguauuuggaccacacauuucaaaguugcccuauggaaaugaau

SEQ ID NO: 169784 - RNA, 63 nt, hsa
cacucccucuugguuuuuaucaaauuugccaugacauuucaucuggguggucugaauauuaaa

SEQ ID NO: 169785 - RNA, 63 nt, hsa
augaugaaaagaauugagaaguucuaaauuaagacauuucaguuaagcucauaaaauuucauu

SEQ ID NO: 169786 - RNA, 63 nt, hsa
uacucuaaauguuagauaauaguagucuuguucacauuucaugaaaccuaugaaacuauauuu

SEQ ID NO: 169787 - RNA, 63 nt, hsa
agaaagaaaauaaucauaaaucauauuugauuaacauuucauuuaagcuuuuaaaauaucaau

SEQ ID NO: 169788 - RNA, 63 nt, hsa
ucagucggcccaagaaaucaaaauaaaggaaacacauuucauauacugcagguaacaaaaguc

SEQ ID NO: 169789 - RNA, 63 nt, hsa
ucagugcugcccagauucagaagaauauugcccacauuucacuguauuuggugcugggucauu

SEQ ID NO: 169790 - RNA, 63 nt, hsa
uaaaaaaaaaaaaguuuuuguuauaucucuagaacauuucaagucuuuuccuuuuuuucuguu

SEQ ID NO: 169791 - RNA, 63 nt, hsa
aauuaaguacucguuuaaguaugguucuuaauuacauuucauucauuuauauuagaguaaaug

SEQ ID NO: 169792 - RNA, 63 nt, hsa
auaagguacacuugaaacuagugaguguuugucacauuucacuuucaugguauauaaaaugca

SEQ ID NO: 169793 - RNA, 63 nt, hsa
guauucacauuuuuuccccauuuuucagaagcgacauuucauauauaggugccaaaagugaau

SEQ ID NO: 169794 - RNA, 63 nt, hsa
acacacugccugaguugaagagacacaggccacacauuucaggcugguugccagcggacguca

SEQ ID NO: 169795 - RNA, 63 nt, hsa
auuucaaagaagagacucuuugcaaaguugauaacauuucaaacccugaaggacagugacuua

SEQ ID NO: 169796 - RNA, 63 nt, hsa
uauaaggacaguuuagggaacaaguuaccuaccacauuucacuuuaguguaccuauuuacaga

SEQ ID NO: 169797 - RNA, 63 nt, hsa
agaaauccuuuggaaauaaaaaguuaaauguuuacauuucaugugguauuucaggucuucagg

SEQ ID NO: 169798 - RNA, 63 nt, hsa
ugcuguugcuuucuacauacaccuuauaaagugacauuucaaaagaaauaaggugccacaguu

SEQ ID NO: 169799 - RNA, 50 nt, hsa; identical to SEQ ID NO: 47113

SEQ ID NO: 169800 - RNA, 63 nt, hsa
uucuuaaauuugccagcguuaaaguagaaaauaacauuucagaagagcacaauaugcauaaaa

SEQ ID NO: 169801 - RNA, 63 nt, hsa
agcuuaggaauucgcuuccaggccgugggggccacauuucaccuccuuagucccccuggucug

SEQ ID NO: 169802 - RNA, 63 nt, hsa
uguuuaaaaaaaaaauucaauauugggguuggaacauuucaguugccauugacagaacaccca

SEQ ID NO: 169803 - RNA, 63 nt, hsa
cuggcacuugggacaaaaacaaacaaacgaaaaacauuucaaaagguauuuauugagcaccug

SEQ ID NO: 169804 - RNA, 63 nt, hsa
uuuuuuuuuuuuuguacagguucugauucuaauacauuucaacaugcuuuuguccccccucgu

SEQ ID NO: 169805 - RNA, 63 nt, hsa
uaauauaaaccgugugucaugucaaagugaaagacauuucaaaucuguagcauaggcuagugg

SEQ ID NO: 169806 - RNA, 63 nt, hsa
guuggcaugaaauuuugguaaaaucugaaaaucacauuucagaauaaaacaauugggcaaaac

SEQ ID NO: 169807 - RNA, 63 nt, hsa
auucgucagcucuguaauuauaguaucacuuagacauuucacuuggggaaauccacaagguuc

SEQ ID NO: 169808 - RNA, 63 nt, hsa
gcaaauuaaagaaugaaagaaguacuucuuuuuacauuucagcuccagcagccagcuauuuaa

SEQ ID NO: 169809 - RNA, 63 nt, hsa
aauuaauuagcauuauuaaagaguccucacuaaacauuucauaugaucacacugaagaacugu

SEQ ID NO: 169810 - RNA, 63 nt, hsa
cuuauuuauaauuuaagguaaacaucugaaagcacauuucagccuauuugcuuagugaaacau

SEQ ID NO: 169811 - RNA, 63 nt, hsa
ggguaugucacaaagagcugacagugcuucuacacauuucaucuaauuuaauauuccuggcau

SEQ ID NO: 169812 - RNA, 63 nt, hsa
cucuaaaaccauuugaaauagcuucauugaucaacauuucauaaaugcaucugugguagaggu

SEQ ID NO: 169813 - RNA, 63 nt, hsa
aaauucuuaaauauauacagaauuuuaaagaaaacauuucaucugauuuaguuagcauccaca

SEQ ID NO: 169814 - RNA, 63 nt, hsa
gucugaguuauuacgcuacaugacaacguuucgacauuucaccggcaacaccaagaggguuuu

SEQ ID NO: 169815 - RNA, 63 nt, hsa
aucuacuuucuauguaagauuaaccuacucuggacauuucauauaucuggaaucaugugauau

SEQ ID NO: 169816 - RNA, 63 nt, hsa
uuauguuuguguauugguugcuccugacacuauacauuucaaaauuuuuuauaacuugaaaaa

SEQ ID NO: 169817 - RNA, 63 nt, hsa
agcaaccccuccuuuuuauuuuuuccuuuaaaaacauuucaguuaaauuaagcuacugauuug

SEQ ID NO: 169818 - RNA, 63 nt, hsa
auacacacucuggguucaggagguuuugugcuuacauuucacuacucaaaugccuucgcaaau

SEQ ID NO: 169819 - RNA, 63 nt, hsa
uuuuauuuacuuugguauauuuuuacacuaaggacauuucaaauuaaguacuaaggcacaaag

SEQ ID NO: 169820 - RNA, 63 nt, hsa
uuaguaauuguuuucaagacaacaaaaaauaaaacauuucauuauucuuguauauugacauau

SEQ ID NO: 169821 - RNA, 63 nt, hsa
cuuuuuccaucucaaaaguauuguggcaccucaacauuucaguguuuugcuuuuuaaaaaaug

SEQ ID NO: 169822 - RNA, 63 nt, hsa
uaaccccaggaagauuucaaggcagggagaagaacauuucaaauaagauucuuguuaacccau

SEQ ID NO: 169823 - RNA, 63 nt, hsa
uuccucuugacagcugaauauuauaccagaugaacauuucaaauugaauuugcacgguuugug

SEQ ID NO: 169824 - RNA, 63 nt, hsa
aguauuuugcauucuguaaauacgaauguuaaaacauuucaggucagcaaaauuagaagucau

SEQ ID NO: 169825 - RNA, 63 nt, hsa
uaauacuaugacaguacuaaaaauauaugaauaacauuucagauaccauuauauuaaaauauu

SEQ ID NO: 169826 - RNA, 63 nt, hsa
agaauggguuuacucucaaugcauuuucaagauacauuucaucugcugcugaaacuguguacg

SEQ ID NO: 169827 - RNA, 63 nt, hsa
ccuugauuuguaaugagcucuuauaugcagaacacauuucaaaugaguuuugcuaugggcugc

SEQ ID NO: 169828 - RNA, 63 nt, hsa
ucaaugaaugaaacuagaaagcagagauuuucaacauuucaaaaugauuuccucuguaaucua

SEQ ID NO: 169829 - RNA, 63 nt, hsa
guccuguggucuccuuggaaauccgucuaguuaacauuucaagggcaauaccguguugguuuu

SEQ ID NO: 169830 - RNA, 63 nt, hsa
agacuuuucuauguuugaaagaagaauguguguacauuucaagaauuuggguuuuuuggaggg

SEQ ID NO: 169831 - RNA, 63 nt, hsa
auauguauuguaauuagaauuguuggcaugaugacauuucauuugugccaaaaauauuaaaaa

SEQ ID NO: 169832 - RNA, 63 nt, hsa
ggaagggcagagaacauaauuacaucuuaggccacauuucauucuuugcagcuuugcuaaucc

SEQ ID NO: 169833 - RNA, 63 nt, hsa
cuaugucaccaguaccaaucagucagugucaucacauuucaggccccaagcaaucucugugca

SEQ ID NO: 169834 - RNA, 63 nt, hsa
cauauaaacuguggguguggcaagaccccgaagacauuucacaucuuuaucgccucgaucaag

SEQ ID NO: 169835 - RNA, 63 nt, hsa
acuucacagacacgucugcagcagcuggacaucacauuucauguccugcauggaaccaguggc

SEQ ID NO: 169836 - RNA, 63 nt, hsa
uaaaauagaaccaggaaaggcucaggauuucagacauuucaucagccuuuucacuuucccagc

SEQ ID NO: 169837 - RNA, 63 nt, hsa
agcaccaaaggaauccuccuguccccucugggaacauuucaugcuucagagggagagguuuuu

SEQ ID NO: 169838 - RNA, 63 nt, hsa
ugaauauugugauagaaauucuuugguauucauacauuucagcugcaagucagcaauuuccca

SEQ ID NO: 169839 - RNA, 63 nt, hsa
cccacuaauacuacugcacagagucaggaucucacauuucaccccaggcucaacugaggaugu

SEQ ID NO: 169840 - RNA, 63 nt, hsa
uugugugaaauaguuuuuauugaaagucaagugacauuucaaaagaaguucuauaacaauuau

SEQ ID NO: 169841 - RNA, 63 nt, hsa
ugcagcagacagaccaggaacacaaugagacugacauuucaaaaaaacaaaacuggcuagccu

SEQ ID NO: 169842 - RNA, 63 nt, hsa
caggguagggagggauuuuccuucauccuugugacauuucauuucaguaaggaaaagauaaca

SEQ ID NO: 169843 - RNA, 63 nt, hsa
ucccaccaggccccaccuccaguauuggggauuacauuucaacuugagguuugggcgggaaca

SEQ ID NO: 169844 - RNA, 63 nt, hsa
uugcuuugccgauugucacucuucaucacaggcacauuucaaaaagagguuagacuuucagac

SEQ ID NO: 169845 - RNA, 63 nt, hsa
uuagaaggaucaaugggaaggcaaugauugaaaacauuucaaugaaccuuaauaguguuccuu

SEQ ID NO: 169846 - RNA, 63 nt, hsa
aaaaauaacuuuaaaaggaacaaagaaacuccaacauuucacauuaugcauaguuauguagcc

SEQ ID NO: 169847 - RNA, 63 nt, hsa
uaacuagauaacacauguaauacauaguagaauacauuucagaggcagaguuccucggauuau

SEQ ID NO: 169848 - RNA, 63 nt, hsa
cuuuuggaaaauaccaaaugaacguacaguacaacauuucaaggaaaugaauauauuguuaga

SEQ ID NO: 169849 - RNA, 63 nt, hsa
aaauaauauccaaaugaaauuaagucucacugaacauuucaaucaagaauggcagggaucuau

SEQ ID NO: 169850 - RNA, 63 nt, hsa
augagauuuuuuuuaaaaguuguuaccaaauacacauuucacauugaaucauguaggaucuug

SEQ ID NO: 169851 - RNA, 63 nt, hsa
ucaauugacuaauuucauuuagaauauuaucaaacauuucaacuagguaucagaaaaaggcuu

SEQ ID NO: 169852 - RNA, 63 nt, hsa
cugccucuaaaacaucucucucuaaaaauacugacauuucacacagguaccagcuuugcagag

SEQ ID NO: 169853 - RNA, 63 nt, hsa
ccauccuaauaagagcccuggauuccaucauuaacauuucagcccauuggaugaaguggugcc

SEQ ID NO: 169854 - RNA, 63 nt, hsa
gggccuggggcagaggaggcagcagaaaaccaaacauuucacugagaaagcccccucccugcu

SEQ ID NO: 169855 - RNA, 63 nt, hsa
gaggaaagaaaagcccuucuccuugccccgcacacauuucacucccacuguacugggcuucca

SEQ ID NO: 169856 - RNA, 63 nt, hsa
ugaaaggucagaauuuuguuggucugaauacaaacauuucacuucuccaacaaguaccuguga

SEQ ID NO: 169857 - RNA, 63 nt, hsa
ggagucuauaccagugcugugggaaaaaugguaacauuucagggcuucucuauuuguguuuca

SEQ ID NO: 169858 - RNA, 63 nt, hsa
ugaacauaccucacagauccucccugucaugccacauuucacugauuggaauguggaaaugga

SEQ ID NO: 169859 - RNA, 63 nt, hsa
uuguuacuuuguuuuuuuaauaguaggauguacacauuucaguauaauaaauguuuucugauu

SEQ ID NO: 169860 - RNA, 63 nt, hsa
auaacacccugggcugugacaaggcccaugaugacauuucaugaggcccagaugugggcaggc

SEQ ID NO: 169861 - RNA, 63 nt, hsa
uuuucuuuaaagcccaggccccacuuacguaaaacauuucagggucacuggaaacagugaagu

SEQ ID NO: 169862 - RNA, 63 nt, hsa
ugcaggucuccaugaagaagcugggacucauucacauuucaagauccaaaugcugugcaaaca

SEQ ID NO: 169863 - RNA, 63 nt, hsa
augauuugacacuccuggcaauauuaaaaauauacauuucauuauauauuucauauaacauau

SEQ ID NO: 169864 - RNA, 63 nt, hsa
gucacaguucuuggcauguugaauauuauuugcacauuucacuuuggaaacacaguagacucu

SEQ ID NO: 169865 - RNA, 63 nt, hsa
gauuauuugccucgcuuguucugaaaucucuacacauuucauccuuuugcuugcuuacgugga

SEQ ID NO: 169866 - RNA, 63 nt, hsa
accuuuagggaaugauuaaaauuuaaaaaaaaaacauuucacucaguugcacuuagucguaug

SEQ ID NO: 169867 - RNA, 63 nt, hsa
gcucauuuaucuuaucuuucaguuaguggaaaaacauuucaaccugacuaaaauuuggaauug

SEQ ID NO: 169868 - RNA, 63 nt, hsa
ugagaauaccugucccagcuaucaaugagcacaacauuucaguagagaagaaauagaaucuuc

SEQ ID NO: 169869 - RNA, 63 nt, hsa
gagauagagacucuuacauuuaaaaauggaaaaacauuucacaaauuaccauaaauuguaguu

SEQ ID NO: 169870 - RNA, 63 nt, hsa
cuugcuuuuuucccuuaacaaucuaucuuggagacauuucauaucaauucauaugccauuugu

SEQ ID NO: 169871 - RNA, 63 nt, hsa
cauuguacagugauaagccauuuuuaucuguauacauuucaccaauuuauuaacagguugaau

SEQ ID NO: 169872 - RNA, 63 nt, hsa
gucacaucaagggcaggaucucauagcuagggaacauuucacaaauaaggugagauuuuguaa

SEQ ID NO: 169873 - RNA, 63 nt, hsa
cuuagcugcuggguugauugaaauuugaucucuacauuucaaaaucaaacuagugaauacagu

SEQ ID NO: 169874 - RNA, 63 nt, hsa
guguuucauuggucucuaucuccugaaucuaacacauuucauagccuacauuuuaguuucuaa

SEQ ID NO: 169875 - RNA, 63 nt, hsa
aaguacugcugaacugugagugcaguauucuaaacauuucagcuaggaauaccacugauuuag

SEQ ID NO: 169876 - RNA, 63 nt, hsa
gcaauccguguccugcuggauaaccagacugugacauuucagccugaccaugaagacggcgga

SEQ ID NO: 169877 - RNA, 63 nt, hsa
ugucacuugcaaauaacaaagggacuuugagggacauuucauuaaauauaauuacugauacuu

SEQ ID NO: 169878 - RNA, 63 nt, hsa
auugacugugaauucauuuacauguaacuucugacauuucacucugugcaaauaaagaacaug

SEQ ID NO: 169879 - RNA, 63 nt, hsa
cuuguacauagucagacuauuuguauuaaauuuacauuucauucuaaguucaaaaguuugaaa

SEQ ID NO: 169880 - RNA, 63 nt, hsa
uucugggaagcuaauaauugaauuauuagaaaaacauuucagaauaggaaguaaaugauaaac

SEQ ID NO: 169881 - RNA, 63 nt, hsa
cauuuuccuugcuuaugggaaaauagcaaaacaacauuucauuuauacuuuuguuuaccccuc

SEQ ID NO: 169882 - RNA, 63 nt, hsa
uggguuguuuuguuagggguuacuuucaggggaacauuucauuuguguuauuucuuaaacuuc

SEQ ID NO: 169883 - RNA, 63 nt, hsa
gaccacaacaugacccguaagucaagaagguagacauuucauauccagcuuccuugcuuaguc

SEQ ID NO: 169884 - RNA, 63 nt, hsa
acuaucuccaaagcauuugcaucaugaccuuauacauuucaaucccuuuuaugcuggauuccg

SEQ ID NO: 169885 - RNA, 63 nt, hsa
uuaaagcuuucaauaucuuaaaauauuuauaaaacauuucacuguugcaaaaucacuuccaaa

SEQ ID NO: 169886 - RNA, 63 nt, hsa
aggcucuuuugugcauaauauucuaaaaugaagacauuucaagcuauacaaauuacuuccaag

SEQ ID NO: 169887 - RNA, 63 nt, hsa
aaaacuaguugauuuaaagaguuuuuuugcacaacauuucaauuauauuugugaacuuagaaa

SEQ ID NO: 169888 - RNA, 63 nt, hsa
aaauaugugauuauauauguuaaaguauagauaacauuucacacuuggauacauaugugcauu

SEQ ID NO: 169889 - RNA, 63 nt, hsa
cagacuagagaauaauuuuuguggcauguuguaacauuucacaguauuuacaagcuauuuuug

SEQ ID NO: 169890 - RNA, 63 nt, hsa
cggcgcaugagugacuggcguauuuagcccgucacauuucauucgcugaaggaaaggcaagag

SEQ ID NO: 169891 - RNA, 63 nt, hsa
uauucgaaaucuugacucagggguucuuaaccuacauuucaugcaaaaaauauauauauuuca

SEQ ID NO: 169892 - RNA, 63 nt, hsa
ugcaggugugccugucuuaaauuccaaagcuuuacauuucaacugaaaaagaaacuagaaaug

SEQ ID NO: 169893 - RNA, 63 nt, hsa
cauuagucccaaaacaccggcauaagaaauuugacauuucacagaugcacuuacauauuuuga

SEQ ID NO: 169894 - RNA, 63 nt, hsa
acaaaguaugccaucaugcaagcugcaaaggaaacauuucaagagucuauaucuauuuucacg

SEQ ID NO: 169895 - RNA, 63 nt, hsa
aacaguuuagcaguacaagcuucuauugcuaaaacauuucaaaaaacucagagauauuacucu

SEQ ID NO: 169896 - RNA, 63 nt, hsa
aggucuuucuguagggaaaauuauuccauguaaacauuucaacucuguaugaaaauguuaaau

SEQ ID NO: 169897 - RNA, 63 nt, hsa
ucaacaaccaucacauuggaagggagaaggcgaacauuucauguuuggcgggcaugugagugc

SEQ ID NO: 169898 - RNA, 63 nt, hsa
uaaagauaacuuauacuuuauaaaugaaaaaauacauuucaguuauacauuaagaacuacgaa

SEQ ID NO: 169899 - RNA, 63 nt, hsa
agguugcuauaagcuuggugaaaugaaaauggaacauuucaaucaaacauuuccuauauaaca

SEQ ID NO: 169900 - RNA, 63 nt, hsa
auguaacuauuuucuaaacacuuuacuagaagaacauuucaguauaaaaaaccuaauuuauuu

SEQ ID NO: 169901 - RNA, 63 nt, hsa
gaguuauuuaaaaauuguuuauuugaggagauaacauuucaacuuuguuccuaaauauauaau

SEQ ID NO: 169902 - RNA, 63 nt, hsa
auaauuuuuacuuauauaccaucuuucaacugaacauuucaguucuuccaagagcuucuuaga

SEQ ID NO: 169903 - RNA, 63 nt, hsa
ucacugcaccaagucucacuggcugucaguaugacauuucacgggagauuucuuguugcucaa

SEQ ID NO: 169904 - RNA, 63 nt, hsa
ucuuuuuccacugaagugugacauuuuguuaguacauuucaguguagucauucauuucuagcu

SEQ ID NO: 169905 - RNA, 63 nt, hsa
aacauccuaaauuuauauuuuauuauauuuuauacauuucaauugauuguacuauauugcagg

SEQ ID NO: 169906 - RNA, 63 nt, hsa
cuccaugucaggucagccaacugcccuaacuguacauuucacaggcuaaugggauaaaggacu

SEQ ID NO: 169907 - RNA, 63 nt, hsa
aaacacuuuuuugguuuaauauauauuuuuaaaacauuucacuagugauugaauucuacuuuu

SEQ ID NO: 169908 - RNA, 63 nt, hsa
ucuguggaaaauguuuuguccuucaccugaauuacauuucaauuuugugaaacacucuuuugu

SEQ ID NO: 169909 - RNA, 63 nt, hsa
cacuuucucuuuuauguauugagcccuguguuaacauuucacuuaagaagagcaccagugcuu

SEQ ID NO: 169910 - RNA, 63 nt, hsa
ugcaaagucuagguugguagaguuuagcccugaacauuucaugguguucaucaacagugagag

SEQ ID NO: 169911 - RNA, 63 nt, hsa
gacaugaauugugucucaacagaaacuaaaugaacauuucagaauaaauuauugcuguaugua

SEQ ID NO: 169912 - RNA, 63 nt, hsa
aaguuaaggucugagugcaugugugcauuaaaaacauuucacuaccuauucucucauggacuu

SEQ ID NO: 169913 - RNA, 63 nt, hsa
gcaguuuauuuuaaacaaacaauuugaaguuaaacauuucauuuuuaaaaacacugaauuaca

SEQ ID NO: 169914 - RNA, 63 nt, hsa
uucauuuauaauucaaggaaggauuuccugaaaacauuucaagggauuuaugucuacauauuu

SEQ ID NO: 169915 - RNA, 63 nt, hsa
caccagcagccuuuccaaaggggaacuccagagacauuucauaaugcaaacagcacuguugcu

SEQ ID NO: 169916 - RNA, 63 nt, hsa
aggaugaagaaacauuuaccccauguacucaagacauuucaguuuuaaaagucacuuuccuau

SEQ ID NO: 169917 - RNA, 63 nt, hsa
auguacagaaaauagcuuuuauugaguaauauuacauuucauuuauacuguagcaauauauuu

SEQ ID NO: 169918 - RNA, 63 nt, hsa
ucacaagcuaggccaaugaaggcugaaucaaagacauuucauccaccaauaucauguguagau

SEQ ID NO: 169919 - RNA, 63 nt, hsa
aaauuuuaaguuaugagguuuaugucaaaagcaacauuucacaaauguacuuuuaaggcauaa

SEQ ID NO: 169920 - RNA, 63 nt, hsa
aauguacaauucagucacucauucucaucaaccacauuucaagugcucaaagccacgugcugg

SEQ ID NO: 169921 - RNA, 63 nt, hsa
uguguuucuuucgaacuuuucggaaugucuggaacauuucauuuccuguuuuguuaccugugc

SEQ ID NO: 169922 - RNA, 63 nt, hsa
auaaauuuuauuuucuuauauucugcuuuuuauacauuucagugcucugcauacauuuuaaau

SEQ ID NO: 169923 - RNA, 63 nt, hsa
cuggaaccaagcauccacggauacugaggggugacauuucaugaaguguagaucauuguauuc

SEQ ID NO: 169924 - RNA, 63 nt, hsa
ccucgugugggagccucugggcucggcagguccacauuucaugagcugaggcgugggccaggg

SEQ ID NO: 169925 - RNA, 63 nt, hsa
auguuucugaggcuucagagucgaaguuuggauacauuucaagugcauuucaagccaccagag

SEQ ID NO: 169926 - RNA, 63 nt, hsa
aguuuuuuuacuuugauuugugaguauacugugacauuucauggcagucuuguuuauuugauu

SEQ ID NO: 169927 - RNA, 63 nt, hsa
uugaacucaugggaauaauugugagucagcguaacauuucaagagucuaaagguggccgggug

SEQ ID NO: 169928 - RNA, 63 nt, hsa
cacauacacacauuacacacacacacagaaugcacauuucacacacauauacuuauuauucaa

SEQ ID NO: 169929 - RNA, 63 nt, hsa
auaauccacacauuucaugcucuaauaauccacacauuucaugcucauuuuuauuguuuuuac

SEQ ID NO: 169930 - RNA, 63 nt, hsa
auuucacaagugcaugucuuucuaauaauccacacauuucaugcucuaauaauccacacauuu

SEQ ID NO: 169931 - RNA, 63 nt, hsa
uaggaaacaguuuucaagucaauaauuuuuuuaacauuucauguuaauaaaugagauugaaau

SEQ ID NO: 169932 - RNA, 59 nt, hsa
gcugcacagaggaggaaugaggggaggcuacauuucacaacccucuucccuauuucccu

SEQ ID NO: 169933 - RNA, 63 nt, hsa
guagaucgaagccaaagcagcucauuugugacaacauuucauaucaccagacacaccaggcaa

SEQ ID NO: 169934 - RNA, 63 nt, hsa
aagcgcccgggaggaacaaugagcuugguggacacauuucauugcaguguugcuccauuccua

SEQ ID NO: 169935 - RNA, 63 nt, hsa
guaucauuuuuauuugaauccaucaugcaguguacauuucagauaauuuccuucagucuccag

SEQ ID NO: 169936 - RNA, 63 nt, hsa
uaguuugauaauaaauagcaguucuaguacuucacauuucacccgugugugcaaugccuuuuu

SEQ ID NO: 169937 - RNA, 63 nt, hsa
ccacaguugugacggauguauggauguucuugaacauuucagaaggagugguagaaaaaaaca

SEQ ID NO: 169938 - RNA, 63 nt, hsa
aaggagccaugcauauuaaaugaggggcaacaaacauuucaaacgauuagauaacauuuucuc

SEQ ID NO: 169939 - RNA, 63 nt, hsa
cauucaaaacgcagcuccccaaucacacuagcaacauuucaagugcuugagagccaugcauga

SEQ ID NO: 169940 - RNA, 63 nt, hsa
acgccacuccuucucagucuucaucgaucaaugacauuucauccauguccacugagcagacgc

SEQ ID NO: 169941 - RNA, 63 nt, hsa
guguccacaagaagggguguuuauucuuccaacacauuucacuuuucuguaaauauacauaaa

SEQ ID NO: 169942 - RNA, 63 nt, hsa
ggagcuccacugccauguacccaguaggguuugacauuucauuagccaugcaacauggauaug

SEQ ID NO: 169943 - RNA, 63 nt, hsa
agggaguguuugugucugacucaggcgccuggcacauuucagggagaaacuccaaaguccaca

SEQ ID NO: 169944 - RNA, 63 nt, hsa
ggggggugagaagacaagaugaagaaaagccuuacauuucaguuucuucaucgguuggauugg

SEQ ID NO: 169945 - RNA, 63 nt, hsa
aagaauguuacauauuguauagauaaaugagugacauuucauaccauguauauauagagaugu

SEQ ID NO: 169946 - RNA, 63 nt, hsa
accuguaaaaaucaaaauacuacucuuuauaagacauuucacaaauauucacuuacauuacag

SEQ ID NO: 169947 - RNA, 63 nt, hsa
gccagauuucuauauugggaguuuuuuaaaaagacauuucauagccaacaagaaucaguagaa

SEQ ID NO: 169948 - RNA, 63 nt, hsa
gucaggaccuauuucagacuguugaugacauugacauuucauggauucggaugaugcaaggag

SEQ ID NO: 169949 - RNA, 63 nt, hsa
gauuuauuuugcuaaacaguuuacuaacacauuacauuucaaaaacuauuuugguaccuuuca

SEQ ID NO: 169950 - RNA, 63 nt, hsa
guauaguuuuuccuuuuuuguauguaacagaacacauuucagauuguauuuaauuuaaauauu

SEQ ID NO: 169951 - RNA, 63 nt, hsa
ucaaauaaaaccagugaagaucugaagaugcaaacauuucaacuaugaagauuuacauuucac

SEQ ID NO: 169952 - RNA, 63 nt, hsa
cugaagaugcaaacauuucaacuaugaagauuuacauuucacuuucuaauuuauuaaacaucu

SEQ ID NO: 169953 - RNA, 63 nt, hsa
guauuuguguugaugauggaccacuugaccaucacauuucaguauucauagaugacugucaca

SEQ ID NO: 169954 - RNA, 63 nt, hsa
caccaccgccaccccaacuugacuuucaagaacacauuucaagcucuggccagagucccguuc

SEQ ID NO: 169955 - RNA, 63 nt, hsa
ugcaucuagguugguguuugaucaucugaaaaaacauuucagugggaagaaaugcauaaaaug

SEQ ID NO: 169956 - RNA, 63 nt, hsa
ugugaaugcaguaccauauucucauuuucaaugacauuucaaccacaggcagaaaagacuguu

SEQ ID NO: 169957 - RNA, 63 nt, hsa
aaagccuggugauuauucauuuaaaugaagaucacauuucauaucaacuuuuguauccacagu

SEQ ID NO: 169958 - RNA, 63 nt, hsa
gagguucaguuugguuggguaaaucuguuguguacauuucaacaaauacuuuuacauuugaca

SEQ ID NO: 169959 - RNA, 63 nt, hsa
ugcacucaggugcccuuuguuucaugaacaaauacauuucauuguacauguuuucuguuuaaa

SEQ ID NO: 169960 - RNA, 63 nt, hsa
uuuucuuccucugacuucgaaaauuguugguauacauuucaaccaaaaugaccucauuugaaa

SEQ ID NO: 169961 - RNA, 63 nt, hsa
uugaugcuggaagcucuuggagaaaaagcuuaaacauuucaccagaaaucuuaauugagcagc

SEQ ID NO: 169962 - RNA, 63 nt, hsa
aaaaaaaagccagcuguccuuggagcagagaucacauuucagagaggugagagugaacacauu

SEQ ID NO: 169963 - RNA, 63 nt, hsa
auggcugacuugauugaucuacgcuaaguggagacauuucacauuuuuaaaaccaaauguuca

SEQ ID NO: 169964 - RNA, 63 nt, hsa
cuaaguugcuuucuuuuuuucaacacuguaacuacauuucagcucugcagaauugcugaagag

SEQ ID NO: 169965 - RNA, 63 nt, hsa
cuuuaugaaauuuagaauuguugaagaacuauaacauuucaguaggguucaagguggucccaa

SEQ ID NO: 169966 - RNA, 63 nt, hsa
auuccuuuucuuuuaaacuucuuuucuuguagaacauuucaaacauacauaaaagagaagagc

SEQ ID NO: 169967 - RNA, 63 nt, hsa
auccucaaagagccguaagcuuuuuggaaaaaaacauuucagaagugaaggcuuuugagguuu

SEQ ID NO: 169968 - RNA, 63 nt, hsa
auucaggagaggaaaaaaaggaauuuaugcuguacauuucaguucaguguaugaccaaaagca

SEQ ID NO: 169969 - RNA, 63 nt, hsa
guucuaaggggaccuacagacagacauacauagacauuucaaaauuaauagcuuuugauuagu

SEQ ID NO: 169970 - RNA, 63 nt, hsa
ugggauuuuaccagucaaacauauuugugcauuacauuucauuucuugugagcuagcuggcug

SEQ ID NO: 169971 - RNA, 63 nt, hsa
uucuuuccugaagaucaguuuuuuuauucaaacacauuucaaagaaccaaauuuuuuuuuucu

SEQ ID NO: 169972 - RNA, 63 nt, hsa
auaacuuuugauuucuaaggaaaauauuagcauacauuucaaacuaaauguuuuacaguggcu

SEQ ID NO: 169973 - RNA, 63 nt, hsa
ugaauuaguuuuuauuacuauauuaaagcaucaacauuucaugccacauaaauuauauuuaau

SEQ ID NO: 169974 - RNA, 63 nt, hsa
uaaaaccuuagugcuuucuuucuuaacauacccacauuucaauucuuuccauuauuugaacac

SEQ ID NO: 169975 - RNA, 63 nt, hsa
gugucugcuuuaugggcauauauaaaaguagacacauuucauuuguuaauuuaguugugugug

SEQ ID NO: 169976 - RNA, 63 nt, hsa
agccaaauguuuauuucacacaaaacggauguaacauuucaugugaucgugcaccacuggaac

SEQ ID NO: 169977 - RNA, 63 nt, hsa
ugauaauaggguguggaaugucgucaguggcaaacauuucacagauuuuuauuuuguuucugu

SEQ ID NO: 169978 - RNA, 63 nt, hsa
uaaccauaagagaaaguauauuuuaacagcauuacauuucaugccaauugacaaguuuugcca

SEQ ID NO: 169979 - RNA, 63 nt, hsa
ugcggacaaguugcuuuuaccugauuugaugauacauuucauuaagguuccaguuauaaauau

SEQ ID NO: 169980 - RNA, 63 nt, hsa
agccgucuggugugucagggucacgaacccguuacauuucaggacgauccuuuuuccuucagc

SEQ ID NO: 169981 - RNA, 63 nt, hsa
cgggugugccgcagucaccacaggguucugagaacauuucacagaagugccugagacgcggag

SEQ ID NO: 169982 - RNA, 63 nt, hsa
cacauauagagguacacaaacacaccgucaugcacauuucagcuugcgucuaucaugauuccu

SEQ ID NO: 169983 - RNA, 63 nt, hsa
agggugcugccacggaguggugagguaccgucuacauuucacauuauucugggcaccacaaaa

SEQ ID NO: 169984 - RNA, 63 nt, hsa
aucaauuuaaguguuggaaaaaauuugucugaaacauuucauaauuuguuuccagcaugaggu

SEQ ID NO: 169985 - RNA, 63 nt, hsa
uucaaguuaaauugaaaauuuuccugaaaccauacauuucaagugaaauaaguaauucuagau

SEQ ID NO: 169986 - RNA, 63 nt, hsa
gagggaugcagacucagguuuugcuaugugcucacauuucaacuuuaugcuuaacaugaaugg

SEQ ID NO: 169987 - RNA, 63 nt, hsa
ucauuuuaugaauugugcuuuucauaaugcaguacauuucaaaauuuuuagauuauguaugaa

SEQ ID NO: 169988 - RNA, 63 nt, hsa
acgucuagacauguuuucugaaccuuuuucaggacauuucaaccucgggacuauucauauuag

SEQ ID NO: 169989 - RNA, 63 nt, hsa
auuuuuguucaauauugauauauuuuaucaccaacauuucaaguuuguauuuguuaauaaaau

SEQ ID NO: 169990 - RNA, 63 nt, hsa
aacguuaagaacaaagacagggauaaauugcuuacauuucaaccucuggagauugagguaacu

SEQ ID NO: 169991 - RNA, 63 nt, hsa
uuugauguaacgcaaauggaaaaacucgacaccacauuucaggcuuuacccaacaucgaaaua

SEQ ID NO: 169992 - RNA, 63 nt, hsa
aaauuccauuugguuaaugacauuaaauuugguacauuucaaaacuucuagguccuccaaaga

SEQ ID NO: 169993 - RNA, 63 nt, hsa
cucuauuuaauaaagaagauugaguacucugacacauuucauuuaaauuaggaaauuuuuaau

SEQ ID NO: 169994 - RNA, 63 nt, hsa
agcucauauccuuuugaagguaguugcaaagagacauuucaaaacugcccuaggccauugcag

SEQ ID NO: 169995 - RNA, 53 nt, hsa
acuugcagaaagaaauauaaaugacauuucaaggauagaaguauaccugauuu

SEQ ID NO: 169996 - RNA, 63 nt, hsa
gagaacacuuagucuugccugucaaaaaguccaacauuucauagguaguaggggccacauauu

SEQ ID NO: 169997 - RNA, 63 nt, hsa
gcaaauggugcugaauacuuuuuuuuuaaagccacauuucauugucuuagucaaagcaggauu

SEQ ID NO: 169998 - RNA, 63 nt, hsa
uaaaaauaaaugagcuaguucuuuaguaguuaaacauuucaaauuggcuuuucuccuucugua

SEQ ID NO: 169999 - RNA, 63 nt, hsa
aauguguaaaucuuauuucuaauguauacaaccacauuucacauaaaaauaugcaauuuauau

SEQ ID NO: 170000 - RNA, 63 nt, hsa
cucggauuuacaucggaacugcucaggauugauacauuucaagucuguaaauacggacaccaa

SEQ ID NO: 170001 - RNA, 63 nt, hsa
cuccuccucaccuacuccacucccaucuuuaugacauuucaaauguuuauuuggaaacaacag

SEQ ID NO: 170002 - RNA, 63 nt, hsa
aucuuccuuugaaagagaaugaaagacccugugacauuucacuucaaaaauaagcccuguagc

SEQ ID NO: 170003 - RNA, 63 nt, hsa
aaaaaaaauauguugucaugaaucuucacaguaacauuucagaaaggugcuuuuuugguacuc

SEQ ID NO: 170004 - RNA, 63 nt, hsa
uguuauaccugcguggcaccauggcaggauuccacauuucauagaauacagguuuucaagcaa

SEQ ID NO: 170005 - RNA, 63 nt, hsa
gggcuacaauuuguuaauuccuaugaaguuggcacauuucaugaggggaaagggagaagggug

SEQ ID NO: 170006 - RNA, 63 nt, hsa
gugggggcaaguacaggguaauucaugagcaagacauuucacugcugucgaagucucugggau

SEQ ID NO: 170007 - RNA, 63 nt, hsa
aaaaaguauaaaaauuaaaguuaugcacuacuaacauuucaauauauuuucucccagauuuuc

SEQ ID NO: 170008 - RNA, 63 nt, hsa
ccuagaaaacaagauggaaagauauauaaauauacauuucacagauaaacuguaacaggugaa

SEQ ID NO: 170009 - RNA, 63 nt, hsa
uaaaaauuacucccucuuuucucuagcauuuugacauuucagacucaaugcucugaucucuag

SEQ ID NO: 170010 - RNA, 63 nt, hsa
uagucucaguuaauacgugauagcuggagcgugacauuucauuaggaacagugaggcuaguug

SEQ ID NO: 170011 - RNA, 63 nt, hsa
cauuaaacaacguguaugcaaauuguuauggauacauuucagaaucuaagaaaucaggcaagu

SEQ ID NO: 170012 - RNA, 63 nt, hsa
aaaaacuaauuuuagaaguuugaagacuuuaaaacauuucauacuacuauuguuuugcaaaga

SEQ ID NO: 170013 - RNA, 63 nt, hsa
ggcuuuccccuguauaucauaggaaacucagggacauuucaaguugcugagaguuuuguuaua

SEQ ID NO: 170014 - RNA, 63 nt, hsa
gacagagaaggggaagcccuguucugacaacagacauuucagacaaccuugcuggcuuuccac

SEQ ID NO: 170015 - RNA, 63 nt, hsa
uauacauaccuuaauaguuuuauaaaauuguugacauuucaggcaaauuuggccaauauuauc

SEQ ID NO: 170016 - RNA, 63 nt, hsa
gaucauuacuagugccauaacccugcuucuucaacauuucacagaacuucucuuuuauauaaa

SEQ ID NO: 170017 - RNA, 63 nt, hsa
ugcacccacaacauacuucuguuacacacaagaacauuucaggaaacucagccagcuuauuuu

SEQ ID NO: 170018 - RNA, 63 nt, hsa
caaaagagaauuggugugcaucugagaggucugacauuucauuauuuacuuauuuccuagcuu

SEQ ID NO: 170019 - RNA, 63 nt, hsa
gcacuuuaaugauaaaaucccauuguauuuaaaacauuucauguauuucuuuagaacaacaua

SEQ ID NO: 170020 - RNA, 63 nt, hsa
guacucacagguuugcaaaugggaaaaaaguuuacauuucaguuuaggggcauaucuaagcua

SEQ ID NO: 170021 - RNA, 63 nt, hsa
gcuauuauauuuggcaggaacccagaguccagaacauuucaucuaugauggguuagauaaugu

SEQ ID NO: 170022 - RNA, 63 nt, hsa
uuuuaauugguaauuacagccccuaaaaaaaacacauuucaaauaggcuucccacuaaacucu

SEQ ID NO: 170023 - RNA, 63 nt, hsa
guaaugagucagugaagucuagaaucauacuuaacauuucauuguacaaguauuacaaccaua

SEQ ID NO: 170024 - RNA, 63 nt, hsa
gcacagagcugggaaggccuuacagaagaggugacauuucagcugggccagagaucaguagag

SEQ ID NO: 170025 - RNA, 63 nt, hsa
acuaaucaaauaauaaucaaucaaucagcauauacauuucagccaaagccauagaagaaaaag

SEQ ID NO: 170026 - RNA, 63 nt, hsa
cuugauauugugaaaaggugaaauucuucaccaacauuucauuugcuccuuugucauauugua

SEQ ID NO: 170027 - RNA, 63 nt, hsa
uaauucuuucaacuugcaauuugcaaggauuacacauuucacugugauguauauuguguugca

SEQ ID NO: 170028 - RNA, 63 nt, hsa
uugguuccuugguauucaccgugccugaucugcacauuucaucguggcuguuucuguauagcc

SEQ ID NO: 170029 - RNA, 63 nt, hsa
caaccagcuaaacugccuuuuuggugugcacacacauuucaugugcagacgugccucugugua

SEQ ID NO: 170030 - RNA, 63 nt, hsa
uauuuuauucugcaaaucuguauccugaaguguacauuucaacccauauucuucucuguucac

SEQ ID NO: 170031 - RNA, 63 nt, hsa
aaauccuuuugggaacaucuuaacuguauaugaacauuucacgaggacaauaaaaauaagaca

SEQ ID NO: 170032 - RNA, 63 nt, hsa
cuuccccagcaggcuguaguuucuaagcugugaacauuucaagauaaauuaacagaggagagg

SEQ ID NO: 170033 - RNA, 63 nt, hsa
ucuuuuuauugcuuugucuauguuucauaugaaacauuucagaaauuauuuugauaaguguug

SEQ ID NO: 170034 - RNA, 63 nt, hsa
aaaacuuauuuuucuaguaaauauuaauguauuacauuucaaauaauggugccugacauauug

SEQ ID NO: 170035 - RNA, 63 nt, hsa
caugaaagcauuuuucguuguucccugauaguuacauuucaaccuugggauuuuuccaaauua

SEQ ID NO: 170036 - RNA, 63 nt, hsa
uaucuuagguaagacauauaacgcagucuaauuacauuucacuucaaggcucaaugcuauucu

SEQ ID NO: 170037 - RNA, 63 nt, hsa
uggcugugggcagagacuaggacccuuauggguacauuucaguaaucucucacugccuaaaau

SEQ ID NO: 170038 - RNA, 63 nt, hsa
cucaauucgcugaaaaaggaacuaccuauccuuacauuucaccuacuaaugucucuucuaaca

SEQ ID NO: 170039 - RNA, 63 nt, hsa
aauguaccuggggaaaucaacugaccucccugaacauuucacgcagucagggaacaggugagg

SEQ ID NO: 170040 - RNA, 63 nt, hsa
uucucuuccuacuauauuucauaucuaccuacuacauuucauaucauuccuacuacauuucau

SEQ ID NO: 170041 - RNA, 63 nt, hsa
uaucuaccuacuacauuucauaucauuccuacuacauuucauaucuaccuacauuuacaugua

SEQ ID NO: 170042 - RNA, 63 nt, hsa
cauaauaaauauuauuaaauaucaggaaagcuaacauuucauacaagauagcuucagaccaaa

SEQ ID NO: 170043 - RNA, 63 nt, hsa
caccacugaaauaguuuucuacugaaauacaaaacauuucauuaacugcuauaggaucugucu

SEQ ID NO: 170044 - RNA, 63 nt, hsa
caccauugaaauaguuuucuacugaaauacaaaacauuucauuaacugcucuaagaugugucu

SEQ ID NO: 170045 - RNA, 63 nt, hsa
caucucguauaauauucacacauauucuuaaugacauuucacugaugcuucuaucagguccca

SEQ ID NO: 170046 - RNA, 63 nt, hsa
caucuugucuaauuuucacacauagucuugaugacauuucacugaugcuucugucagguccca

SEQ ID NO: 170047 - RNA, 63 nt, hsa
ccuucauugcuagauccuucgaacagcacugauacauuucaaggucuuguuuuaggauaacua

SEQ ID NO: 170048 - RNA, 63 nt, hsa
acagggagucguggcugucucuacauaauacuaacauuucagugaaaaaaguacaauugguua

SEQ ID NO: 170049 - RNA, 63 nt, hsa
acaaaagggcccacaggaaucuuaccaaugccaacauuucaaagcacccuauuucacguagca

SEQ ID NO: 170050 - RNA, 63 nt, hsa
ucccauugggccccacuuccaacacuggugaucacauuucaacaugagguuuagggaaacaaa

SEQ ID NO: 170051 - RNA, 63 nt, hsa
uuaaaugugucauuggaagccaucccuuuuuuuacauuucauacaacagaaaccagaaaagca

SEQ ID NO: 170052 - RNA, 62 nt, hsa
uuucuuucccacagaguuaagcacaaaggaaaacauuucaauaaaggaucauuugacaacug

SEQ ID NO: 170053 - RNA, 63 nt, hsa
gcuaaccugucugaugguggcaucuuccugcagacauuucaaacauguaacuuuuauaugaaa

SEQ ID NO: 170054 - RNA, 63 nt, hsa
agagaaaaugaauauuuaaauuuuaaaguuugcacauuucaucuuuguccuaacaugagugcu

SEQ ID NO: 170055 - RNA, 63 nt, hsa
uuugucuucaaguaaaaugucugguugugccagacauuucacaagugugaaaggagauaggag

SEQ ID NO: 170056 - RNA, 63 nt, hsa
cuuucccagccuuuuugguuuuuuuaauugaacacauuucaucuaaguaaagcucaguucuuu

SEQ ID NO: 170057 - RNA, 63 nt, hsa
cagaguuaauccuggcugcucaggagaggcgacacauuucaaaucuccacgagauauucucca

SEQ ID NO: 170058 - RNA, 63 nt, hsa
guuuuauauguauauguuuuauacauaaauaaaacauuucaucuaauauauauaugugugugu

SEQ ID NO: 170059 - RNA, 63 nt, hsa
auguucccuuuugaacuuuuacauuuuggcaugacauuucagaguauugugggaccaugagac

SEQ ID NO: 170060 - RNA, 63 nt, hsa
uguuucauguuuguaugggaaaauuguagcuaaacauuucauuguccccagucugcaaaagaa

SEQ ID NO: 170061 - RNA, 63 nt, hsa
uaauuuaauuacauuuuacuuuaaaaacuuuacacauuucaguuucuaaaauuuuaaauuaac

SEQ ID NO: 170062 - RNA, 63 nt, hsa
uuuauuuagaacugugagaccgguauuuuggaaacauuucaaaggaaacauaugaauuuguuu

SEQ ID NO: 170063 - RNA, 63 nt, hsa
gugccacuuaaaugccaauuaaacaagaauauaacauuucaauagaaauuuuuauuucauuuu

SEQ ID NO: 170064 - RNA, 63 nt, hsa
ccaaaucuuagcagguaaaagcaauauucuuauacauuucauaauaaaauuagcucuauguau

SEQ ID NO: 170065 - RNA, 63 nt, hsa
agguccuuaggcacccagauaucagccacuuucacauuucauuucauuuuaugcuaacauuua

SEQ ID NO: 170066 - RNA, 63 nt, hsa
auuauacuguucugcagcauuuagacauuugucacauuucauuagcuuugacaaccauacugu

SEQ ID NO: 170067 - RNA, 63 nt, hsa
aggcaaagggguaccccaaauccagaggugccuacauuucaggcagccuuggaguauuuuaaa

SEQ ID NO: 170068 - RNA, 63 nt, hsa
ugacauucuuauacugcugucucaaauccaaaaacauuucagagcucuugucucagagaugug

SEQ ID NO: 170069 - RNA, 63 nt, hsa
cuuucauuggauugacccuacaacugcccugggacauuucacuguaccaguauuaacugcaaa

SEQ ID NO: 170070 - RNA, 63 nt, hsa
aggggcagcuguguucaugcccugugcuacuggacauuucacaauucuggcaccuugcgauug

SEQ ID NO: 170071 - RNA, 63 nt, hsa
cuuuccuccagaacaaaauguuaacuuucuaacacauuucaugcauagcuuggcucagaaggu

SEQ ID NO: 170072 - RNA, 63 nt, hsa
gucuuggaccugucuguuggguuuaguccguggacauuucagagggagaucccccucccauuu

SEQ ID NO: 170073 - RNA, 63 nt, hsa
acagcagcccugccugugaagcucuuguuucugacauuucacaggcagagaggugccaucagu

SEQ ID NO: 170074 - RNA, 63 nt, hsa
uacauacaaccuaguacacuugaagucagacagacauuucaguugcuuaccuccaguacugag

SEQ ID NO: 170075 - RNA, 63 nt, hsa
agcaacugugauuuuuguuuuuaagacucauggacauuucauaccugugcaauacugaagacc

SEQ ID NO: 170076 - RNA, 63 nt, hsa
ucuaccccuggcaccuccaaaucucauguccucacauuucaaaaccaaucaugccuucccaac

SEQ ID NO: 170077 - RNA, 63 nt, hsa
uccaugcugaagaaaagugacagucuccaggggacauuucagccaugcugaaagggaggcugg

SEQ ID NO: 170078 - RNA, 63 nt, hsa
caaaggguuaucugauaaccaaaaaaaaaaaagacauuucaucuaagccacuuaacaccgugu

SEQ ID NO: 170079 - RNA, 63 nt, hsa
auuuaaauaaaaaacaaaacuuguaaaguuguaacauuucacauggaaaugcugcccaaucuu

SEQ ID NO: 170080 - RNA, 63 nt, hsa
ccugcucaauuuuauuuuacuaaguauauauuuacauuucacccaggcaggccauuuucuuuu

SEQ ID NO: 170081 - RNA, 63 nt, hsa
gugcauaucugguuauuugccuguuuuccaugaacauuucaagcuuaugggggagaagacacu

SEQ ID NO: 170082 - RNA, 63 nt, hsa
ugauaucaaaaaauguuuauguuuuuagaacagacauuucagucacugcauucuuagguauuc

SEQ ID NO: 170083 - RNA, 63 nt, hsa
acucagcacucaucacuuccuaauuauuuugcuacauuucacuauuaccuuugcuguuuuacu

SEQ ID NO: 170084 - RNA, 63 nt, hsa
aagacuuuaagacuuaaaaggcuuacugccucuacauuucacucagacuaguacaucucaaug

SEQ ID NO: 170085 - RNA, 63 nt, hsa
uaaauuauaauguaaaguugacauuuuccccuuacauuucaaaggcaucacuauuuuuaaaug

SEQ ID NO: 170086 - RNA, 63 nt, hsa
gaucuaaagauaaugucuuagacaauuaccuuuacauuucaagcucugggauauaaauuacgu

SEQ ID NO: 170087 - RNA, 63 nt, hsa
ugggguaggaccuauauuuuaauacuguuccuaacauuucauuuuacuagcgagaaaucuuug

SEQ ID NO: 170088 - RNA, 63 nt, hsa
aacauauggguauuuuuuauuuuguguaauuuuacauuucaugaaaugaugucaguuucaaag

SEQ ID NO: 170089 - RNA, 63 nt, hsa
uuaagcagagaaagacaucuaaauggugucaggacauuucaguacuucugcuuauugaguacu

SEQ ID NO: 170090 - RNA, 63 nt, hsa
cugucaccuuuggguuguguuuuucaauuguugacauuucagaggggacccuccagaagccca

SEQ ID NO: 170091 - RNA, 63 nt, hsa
ggagucuuggguguuccuuaucuggggaagcaaacauuucacuagucucuuuuuuucauccuu

SEQ ID NO: 170092 - RNA, 63 nt, hsa
cuuuaccaccucuuccucccccucaaaggaaaaacauuucauccaaguaaguuaacggcauuu

SEQ ID NO: 170093 - RNA, 63 nt, hsa
auuuuuuuuuuuuuuuuuuuaacacagguugaaacauuucaucuauuaucucugccucauuuc

SEQ ID NO: 170094 - RNA, 63 nt, hsa
aauuuaacaccauuucuacgucgggaaaucuuuacauuucagucuuuuucauuuucauggagg

SEQ ID NO: 170095 - RNA, 63 nt, hsa
ugaucuguuucguuaagcugaaccagugucuuuacauuucauuuguacuucaaaaaauaugcu

SEQ ID NO: 170096 - RNA, 63 nt, hsa
agccuggcuggcggugcccacagugccccggacacauuucacaccucaggcucgugguggugc

SEQ ID NO: 170097 - RNA, 63 nt, hsa
uuccuggaaagcucauuaucucuguuugaauuaacauuucagcauggaacuaacugggcggag

SEQ ID NO: 170098 - RNA, 63 nt, hsa
augcuguucuguaaauuuauugaaaccucuggaacauuucaccuuuagagauggaggauggaa

SEQ ID NO: 170099 - RNA, 63 nt, hsa
uccauccauuuaccuaauaguaugaaacaguucacauuucaauaaaaucaaacuuuucaugua

SEQ ID NO: 170100 - RNA, 63 nt, hsa
aagaggauaaaagaagcaugaaugaaaagaaugacauuucaaaaaaaugguucaaugaaaaac

SEQ ID NO: 170101 - RNA, 63 nt, hsa
ccuuccagggagcucuuuuaaucuuaaaguucuacauuucaugcucuuagucaaauucuguua

SEQ ID NO: 170102 - RNA, 63 nt, hsa
uuaaaaacagggaaauuauaagugcagagauuaacauuucacaaauguuuagugaaacauuug

SEQ ID NO: 170103 - RNA, 63 nt, hsa
uucuccauucccgugcgcuucuauuuauccuggacauuucaaaccuccucugugccuuggcuc

SEQ ID NO: 170104 - RNA, 63 nt, hsa
ggauugugccgggagagugccucugacuuugggacauuucauccacagaaauuuccaagccaa

SEQ ID NO: 170105 - RNA, 63 nt, hsa
aaaauuuaccuuguuaacaagcaucaccaaugaacauuucagagcaaucugcauauuuaacag

SEQ ID NO: 170106 - RNA, 63 nt, hsa
gccacauaugugacuuuaaauuuucugacagucacauuucaaaaaguaaaaagaagcagguga

SEQ ID NO: 170107 - RNA, 63 nt, hsa
cagcacacuugccuucuauuuauuuaaguguaaacauuucaaagcaggccguacuccuucuga

SEQ ID NO: 170108 - RNA, 63 nt, hsa
cuugauuuugccccaagauucugacuucuggcuacauuucaccugcaguuaccugggcuaucg

SEQ ID NO: 170109 - RNA, 63 nt, hsa
aauucugugaauuaagauguaauuuauaaaauaacauuucaauggggguaaacaggccagaag

SEQ ID NO: 170110 - RNA, 63 nt, hsa
ugauagagaugaaucaugucaguaguuagaauaacauuucaacuguuuucuuugcuaaaauca

SEQ ID NO: 170111 - RNA, 63 nt, hsa
gucucucccuggcauggagagggcagacugugcacauuucacuaggguccaaauacagaaggg

SEQ ID NO: 170112 - RNA, 63 nt, hsa
uugauaccucaaauguaagaugcgugauacucaacauuucaucguccaccuucccaaccccaa

SEQ ID NO: 170113 - RNA, 63 nt, hsa
uuuuuuuuaaugugaauuuuugccuaucuuuaaacauuucaaugucagccuuuguuaaccuua

SEQ ID NO: 170114 - RNA, 63 nt, hsa
aggaguuuuuguuugcugaauuaaaguacucugacauuucaccccccuccccaacaaagaguu

SEQ ID NO: 170115 - RNA, 63 nt, hsa
gcuacagcugcaguagcuuuuaaguauguaucaacauuucauuauaaauuauagcuuccuggu

SEQ ID NO: 170116 - RNA, 51 nt, hsa; identical to SEQ ID NO: 47156

SEQ ID NO: 170117 - RNA, 63 nt, hsa
ggcccuccaacucagcacaggaaauaaguagaaacauuucagcaggccaccuccccucaucuu

SEQ ID NO: 170118 - RNA, 63 nt, hsa
caccagaaucugacucccauuaugcuucuaagcacauuucauugaccuugucucucauacuuc

SEQ ID NO: 170119 - RNA, 63 nt, hsa
cucauugugccaagccuucugugagauaaaugcacauuucagaaauuccaacuccugaugccc

SEQ ID NO: 170120 - RNA, 63 nt, hsa
caaacuuaccuuagugggacaucuucaccggacacauuucagaggagagaaaaaaaguaauau

SEQ ID NO: 170121 - RNA, 63 nt, hsa
caucaaaggaauaaaaagcuggccguacaaauuacauuucaaaacaaacccuaauaaauccac

SEQ ID NO: 170122 - RNA, 63 nt, hsa
ucuuaagcuuuauccaaauuucagcuacauaaaacauuucaggauuuaaauuaguaccauauc

SEQ ID NO: 170123 - RNA, 63 nt, hsa
ccugcuaauagcaccaucgucacuauuaagcagacauuucaguugguagaauccauguagaag

SEQ ID NO: 170124 - RNA, 63 nt, hsa
caagucugugguccaugggcuuucauuucugucacauuucauuucuuggaaaaggccuccuuc

SEQ ID NO: 170125 - RNA, 63 nt, hsa
cuguucaugacagcuacuaaccuggagacaguaacauuucauuaaccaaagaaagugggucac

SEQ ID NO: 170126 - RNA, 63 nt, hsa
auacagcagcuuuuuuugcaguuauccacacucacauuucagaguccugacucucaaggaacc

SEQ ID NO: 170127 - RNA, 63 nt, hsa
aauaauaccuuagauuucuagguaagucuuuccacauuucaauaauggguaagaguagaacca

SEQ ID NO: 170128 - RNA, 63 nt, hsa
guuuuuaucauugauuuguaccgacagaaauagacauuucaucauguaaaauuccuguuauuc

SEQ ID NO: 170129 - RNA, 63 nt, hsa
ugauaccacucauccacguguuccugauuguccacauuucaugauaaaaugagagcuccgcag

SEQ ID NO: 170130 - RNA, 63 nt, hsa
uuagaggauccuguacacaguuccacuauuaaaacauuucagguugaauucugcaguauuuuc

SEQ ID NO: 170131 - RNA, 63 nt, hsa
gggaguggggagcaggaauugcacucagacaugacauuucaauucaucucugcuaaugaaaag

SEQ ID NO: 170132 - RNA, 63 nt, hsa
uuagcuguuaaaugguaucucauuuuuuaaaacacauuucacauuuaaagucauacaugcuua

SEQ ID NO: 170133 - RNA, 63 nt, hsa
auagaaggcugucuuagugcaaaaaacauacuuacauuucagacauauccaaagggaauacuc

SEQ ID NO: 170134 - RNA, 63 nt, hsa
gauaggaccaaauauguaagugcagggggaaacacauuucagaccaggaauccacauugaaaa

SEQ ID NO: 170135 - RNA, 63 nt, hsa
agaugugacagcuuuagugguagauguagggaaacauuucaacagccauaguacuauuuguuu

SEQ ID NO: 170136 - RNA, 63 nt, hsa
gccauaguccuccaagaagaaagcaccaagacaacauuucauaugacuauaaugcauguacua

SEQ ID NO: 170137 - RNA, 63 nt, hsa
gucaggugauauucuugauugaaaaguugcuuaacauuucaguaauauaauuuuaauucuaag

SEQ ID NO: 170138 - RNA, 63 nt, hsa
uccacuuacacagugggggacucaaagucagccacauuucacauacuguuacugaagaaagca

SEQ ID NO: 170139 - RNA, 63 nt, hsa
ccucacugcccacuggguagagacaccuggaugacauuucaguacccgcuggcagcuccuccc

SEQ ID NO: 170140 - RNA, 63 nt, hsa
gaggaugccuaauccuacaaagugacccuuuauacauuucauuuuuuauuugauauuaaagua

SEQ ID NO: 170141 - RNA, 63 nt, hsa
acugccuuuaauagaaaaccuaaaugcuggggcacauuucacauaucgacuaccugagaaauu

SEQ ID NO: 170142 - RNA, 63 nt, hsa
cuguguaucccagacuguuaauacagaaaagagacauuucagcugugauuaugaccauuguuu

SEQ ID NO: 170143 - RNA, 63 nt, hsa
accaauaacaauuagguguacuucuauuuuaaaacauuucagaaaaaaauauauguuauagca

SEQ ID NO: 170144 - RNA, 63 nt, hsa
cauuguuuuaaguugauugacuaguuauuauguacauuucagaauguacacauaaauacugug

SEQ ID NO: 170145 - RNA, 63 nt, hsa
gaaugaguaaagcagaaaaacuuuuaaccagcaacauuucaaguacguagugugaucaaacau

SEQ ID NO: 170146 - RNA, 63 nt, hsa
ccaccaaucugcuguguauuucaucuauugccaacauuucauauaaauggcaucauacaauau

SEQ ID NO: 170147 - RNA, 63 nt, hsa
ugugcacugaaguaaaugggguugggggaggggacauuucauauuuauaaugugcugaaggua

SEQ ID NO: 170148 - RNA, 63 nt, hsa
ucuauaguugcaaaacacauaaaaggggacuuaacauuucacguuguaucuuacuugcaguga

SEQ ID NO: 170149 - RNA, 63 nt, hsa
acuguacauugcucauuucacacucuucagaagacauuucauaccugcccugguccugcuuga

SEQ ID NO: 170150 - RNA, 63 nt, hsa
cuuuuaauguguaaagaucuacaugaaugcaaaacauuucauuaugaggucagacuaggauaa

SEQ ID NO: 170151 - RNA, 63 nt, hsa
caccaggacagucacccccaaacuugacccccaacauuucaaugcacagaagggacuggaaag

SEQ ID NO: 170152 - RNA, 63 nt, hsa
cauguucucuuccuuucacuuuuuucaguuucuacauuucagaccgagcuugucagcuuuuuu

SEQ ID NO: 170153 - RNA, 63 nt, hsa
auuucugcaacacaauguaaugagugaaugaauacauuucaaaucaacuauuaaaaauuuucu

SEQ ID NO: 170154 - RNA, 63 nt, hsa
ccaagaaauguauugaauacucaagaaaaugccacauuucaauuacauauuuaaaacuguauc

SEQ ID NO: 170155 - RNA, 63 nt, hsa
cuuuaugcugcauaaaucacuuaucggaaaugcacauuucauagugugaagcacucauuucua

SEQ ID NO: 170156 - RNA, 63 nt, hsa
uuggacaggucuugcuauucagugaaccuuuguacauuucaaagaagacuccauggcugcucc

SEQ ID NO: 170157 - RNA, 63 nt, hsa
agaaacaguucagcagugaccaccacccacaugacauuucaaagcaccuccuuaagccagcca

SEQ ID NO: 170158 - RNA, 63 nt, hsa
gcugacaaagauguucuuccucuuccccgacccacauuucaagcggacaaagcacaaguggcg

SEQ ID NO: 170159 - RNA, 63 nt, hsa
gguagacuuucuaagcauagauauuuauugauaacauuucauuguaacugguguucuauacac

SEQ ID NO: 170160 - RNA, 63 nt, hsa
auuauaaaucccuguaucguggaccuuuugugaacauuucaaggcgcaugcacaaccuugaug

SEQ ID NO: 170161 - RNA, 63 nt, hsa
aguggggaaaaucccacagaaaucaguaaguuuacauuucaauuucuaucuuauuugacuaag

SEQ ID NO: 170162 - RNA, 63 nt, hsa
uuugauaccaccaucauguucagaccauuuuauacauuucaguggccuuuuuuuuuuuuuaag

SEQ ID NO: 170163 - RNA, 63 nt, hsa
accauaauuaaaguugcauaagauaauugcuuuacauuucacauaccuauauuuaucugagug

SEQ ID NO: 170164 - RNA, 63 nt, hsa
cuaaugaaguauugguuuuaguaagaauuaaauacauuucauugagcuuuaaaguacuuugga

SEQ ID NO: 170165 - RNA, 63 nt, hsa
caucagucuguucucuuugaccacaauuggaauacauuucaagaugguaacagccccaugaag

SEQ ID NO: 170166 - RNA, 63 nt, hsa
uuaaauaaauucauggcaauguuuuuuuaaaagacauuucagcuucuuuacucaguucugcau

SEQ ID NO: 170167 - RNA, 63 nt, hsa
ccucuuuccucccuccgcggaugaagcccagccacauuucagccgagguccaaggcaggaggc

SEQ ID NO: 170168 - RNA, 63 nt, hsa
gguucuuagcccuugggcacugcacccuguuuaacauuucaccccacucuguacagcugcucu

SEQ ID NO: 170169 - RNA, 63 nt, hsa
ugccauguucuuugauuuaggcugguaguaaacacauuucaucugcugcuucaaaaaguacuu

SEQ ID NO: 170170 - RNA, 63 nt, hsa
gauagucaugcugcuagaucuuuauuauggaaaacauuucaaguuuacuccuucuguuuugag

SEQ ID NO: 170171 - RNA, 63 nt, hsa
acauacacaauuacaacaaacuuuuuuuaaaagacauuucauuguacugcaaaaaucugaaua

SEQ ID NO: 170172 - RNA, 63 nt, hsa
accaaaacaaauggagaagaaacauccaaaagcacauuucauuucuccaaacuuuguguuuua

SEQ ID NO: 170173 - RNA, 63 nt, hsa
ccaucuuaggggauuaucuuacguuuaagcuuaacauuucauguaguaagauuuggagagcca

SEQ ID NO: 170174 - RNA, 63 nt, hsa
uguaaauacaucuugucuuguuuucauucaaaaacauuucacuuuugggguugcgugucagau

SEQ ID NO: 170175 - RNA, 63 nt, hsa
aagucgaaauuaauguaguuuucugccuugauaacauuucauaugugguauuaguuuuaaagg

SEQ ID NO: 170176 - RNA, 63 nt, hsa
uaucaguugguauaaagagagagaaagagaaaaacauuucagcccuuagaugaggucuuacac

SEQ ID NO: 170177 - RNA, 63 nt, hsa
uuaagagacuaacucuccacuuguaugggaacuacauuucacucuugguuuucaggauauaac

SEQ ID NO: 170178 - RNA, 63 nt, hsa
uuguuuuguaacaaugucaguuguuaaaccuugacauuucaauuaaaacaugaauuguaguua

SEQ ID NO: 170179 - RNA, 63 nt, hsa
uauuugacauagccuuaaugguccuuaaagaagacauuucagugugagauucagacuucagac

SEQ ID NO: 170180 - RNA, 50 nt, hsa
ucacagguuucccaagcuaaacauuucaagguaaaauguagcugcgucau

SEQ ID NO: 170181 - RNA, 63 nt, hsa
gaaauaaauuguauaguuacuuaacuaaugaagacauuucagaacucugggaugauuuuaauc

SEQ ID NO: 170182 - RNA, 63 nt, hsa
gcacccggccguucccauuuuuuauuggugccaacauuucaaaacuucauacuguuuauaaac

SEQ ID NO: 170183 - RNA, 63 nt, hsa
ggagccccuguguugucucaaguuuuuauaaauacauuucauaauguuauuaaaugucauucu

SEQ ID NO: 170184 - RNA, 63 nt, hsa
cagucuucaguuguguucuuaugcuucagugucacauuucauuucauuugaaacuaaaauuuu

SEQ ID NO: 170185 - RNA, 63 nt, hsa
auuaaaaguguaaacuauagacucuacuguaguacauuucaggaucuagaaguuuuacuuuua

SEQ ID NO: 170186 - RNA, 63 nt, hsa
uauaaagcacuagcugagaaggaacugauacuuacauuucauggacagcauuaacaagaauga

SEQ ID NO: 170187 - RNA, 63 nt, hsa
uuuuuuugucagauaaucauuucuacuucaaaaacauuucaugcaauauuagaauaaaguucc

SEQ ID NO: 170188 - RNA, 63 nt, hsa
gaugauaauaugcuaaauuuuccucuauccuguacauuucacaaaaaggcauaugcaauauuu

SEQ ID NO: 170189 - RNA, 63 nt, hsa
ggagggcagauucggaccacuaggccugaaaugacauuucacuaaaagucuccaaaacauuuc

SEQ ID NO: 170190 - RNA, 63 nt, hsa
uuaguuauuauguguauuuauguaguauuucaaacauuucaaaaugcuuucaucuauguuuau

SEQ ID NO: 170191 - RNA, 63 nt, hsa
ucacacccagcucggaauagaucuucccugaugacauuucaugcccucuaaggcaguuuuuaa

SEQ ID NO: 170192 - RNA, 63 nt, hsa
aauuauauacuuaauauguauugauuaaaagaaacauuucagaaauaaaauuucaacauuguu

SEQ ID NO: 170193 - RNA, 63 nt, hsa
uuacugacugcuuauaaacauuuaaagacaaagacauuucaaauaacugcagaaaaaauauug

SEQ ID NO: 170194 - RNA, 63 nt, hsa
ugucuuuuagaauacacaaaauauaguauaaagacauuucacaauuuccaaacaaaucuuucu

SEQ ID NO: 170195 - RNA, 63 nt, hsa
guuacaugcauuacugugagggguugaggccugacauuucauuaguggaucaggaaguaagua

SEQ ID NO: 170196 - RNA, 63 nt, hsa
ugugcugacccugugguugucgcugauguacacacauuucauuauuugccaauggugcaauaa

SEQ ID NO: 170197 - RNA, 63 nt, hsa
guguggugccuauacuuaauaaugggguauuauacauuucaaaauugauguucucaucacaga

SEQ ID NO: 170198 - RNA, 63 nt, hsa
uuggaaaaaauaucuuucgaaaaucaaauuuaaacauuucacucugugcugcauauuucuuuu

SEQ ID NO: 170199 - RNA, 63 nt, hsa
acucauauuugugcacuuuacugaaauagaugaacauuucaguagguucucaacuuaaaauua

SEQ ID NO: 170200 - RNA, 63 nt, hsa
uucuugagaaauuuguuuuuauuaugccauuugacauuucaaaucagugcucauauacaguaa

SEQ ID NO: 170201 - RNA, 63 nt, hsa
aaaauaauucaggaaaacuauggggaaauaguuacauuucacaaaagauauuuuaaacucuuu

SEQ ID NO: 170202 - RNA, 63 nt, hsa
aacuugcucucuuucaauacucccaaugaagauacauuucacucacccuccaccccugcuauu

SEQ ID NO: 170203 - RNA, 63 nt, hsa
gccaugucucacuguuuaaauaaaacuucauggacauuucaugucaggauugcaagcauuagc

SEQ ID NO: 170204 - RNA, 63 nt, hsa
caugugccaggcacugugcugagugccauacauacauuucauuuaauuauccaauaauccuac

SEQ ID NO: 170205 - RNA, 63 nt, hsa
agacgccuugguucuguuuguacacuuagccuuacauuucaggaggaggcuuuucauuagggg

SEQ ID NO: 170206 - RNA, 63 nt, hsa
cuuuacagagguucggacuaacauuucacaugcacauuucaaaacaagaugugucaugaaaac

SEQ ID NO: 170207 - RNA, 63 nt, hsa
acgcaaaaacuuccuuuacagagguucggacuaacauuucacaugcacauuucaaaacaagau

SEQ ID NO: 170208 - RNA, 63 nt, hsa
auucauacagaaaacaaguacuaugugaugaaaacauuucauuaaaagauugcugcauuuaaa

SEQ ID NO: 170209 - RNA, 62 nt, hsa; identical to SEQ ID NO: 169721

SEQ ID NO: 170210 - RNA, 63 nt, hsa
uaaagaaggcuguacucaagaggaggagcugacacauuucacuuggcugcgucuuaauaaaca

SEQ ID NO: 170211 - RNA, 63 nt, hsa
ggugacagagugagaccauguuucaaacaagaaacauuucagaggguaaguaaacagauuuga

SEQ ID NO: 170212 - RNA, 63 nt, hsa
auacccugcaauguaauugucccucuguggcucacauuucauuagugagccaugaaaucaacu

SEQ ID NO: 170213 - RNA, 63 nt, hsa
aaguggcccaaggucacgcaacucugagaugccacauuucauuugaucuuguacacauuuucu

SEQ ID NO: 170214 - RNA, 63 nt, hsa
uacuuucugugucuauggauuugccuucucuaaacauuucauauaaauggaauuacacaauga

SEQ ID NO: 170215 - RNA, 63 nt, hsa
guuuuauguuuuguuuugugggucauagggagcacauuucaccugugcaggaaaagaguuuuc

SEQ ID NO: 170216 - RNA, 63 nt, hsa
cuuccugccaccaagcaggaaacuagaaagagaacauuucaguguaaggucuguucccgacag

SEQ ID NO: 170217 - RNA, 63 nt, hsa
caugugcgaacacagugacacguuuggccagugacauuucaaucacugaaaaugugcucuaca

SEQ ID NO: 170218 - RNA, 63 nt, hsa
cagcacauagcccuguuauauuugauuuauuuuacauuucauaugaaagcauaauuuugucca

SEQ ID NO: 170219 - RNA, 63 nt, hsa
uaacaugguuaaugguuaauuacuauuuaacacacauuucaaaugaauauuauuugggggauu

SEQ ID NO: 170220 - RNA, 63 nt, hsa
cauucuauaaagauugggguuuuauuuuuauauacauuucaguuaaaaggcacacuacaguca

SEQ ID NO: 170221 - RNA, 63 nt, hsa
uagcuacuacauuugauagaacaguuuugaggaacauuucauucuugaacgcagcaucugaca

SEQ ID NO: 170222 - RNA, 63 nt, hsa
ugaauuguauaugcuagugaggaaaagauuuagacauuucaagagcaggguuggccaggcgcg

SEQ ID NO: 170223 - RNA, 63 nt, hsa
ggagucuaaaaauuauuagcuguuacaaauggaacauuucauuauaacgugaucacuuugacu

SEQ ID NO: 170224 - RNA, 63 nt, hsa
uuucuagcaugugcugcauugacucuauuaaucacauuucaaauucacccuacauuccucucc

SEQ ID NO: 170225 - RNA, 63 nt, hsa
gccacuaccacaguuuuuacauugauuauuggaacauuucagaauaaauaaagauauuuucuu

SEQ ID NO: 170226 - RNA, 63 nt, hsa
ugccuuccccuaucgaacaguuaucaguaaaagacauuucaaucuuacaaagcaacuguuaga

SEQ ID NO: 170227 - RNA, 63 nt, hsa
ucugugugcucuuaaauauauuaaaaacaauuuacauuucaggaauucugucuguaauugauu

SEQ ID NO: 170228 - RNA, 63 nt, hsa
gguacauuccagccuguuggcaacuccauaaaaacauuucagauuuuaauccgaauuuagcua

SEQ ID NO: 170229 - RNA, 63 nt, hsa
uauuauaacaaucauuggaaagcauggagagcuacauuucauaauuugagggaaaauuucuaa

SEQ ID NO: 170230 - RNA, 63 nt, hsa
uuuugagggguuggauuuucuuuuuucuggcagacauuucaguacauucacauuucucucaca

SEQ ID NO: 170231 - RNA, 63 nt, hsa
uauucuuaaaaauaaauuaaaaucuguauacuuacauuucaaaaagauauagugugguguuuc

SEQ ID NO: 170232 - RNA, 63 nt, hsa
cgugcccugcacaaaaaccaccaccagcagcucacauuucacgucucggcuuuucggccaucg

SEQ ID NO: 170233 - RNA, 63 nt, hsa
uuucacauuaagucaacaccaaacgugguugccacauuucaucagacagacaccucccucugg

SEQ ID NO: 170234 - RNA, 63 nt, hsa
gaaaaauuuuacaucagaaaaugggauaaacauacauuucacagaaaauaaucaagacuugcu

SEQ ID NO: 170235 - RNA, 63 nt, hsa
cuccacagccugucuccaaggccuccccuauguacauuucagugagcucacuuugauuuuuaa

SEQ ID NO: 170236 - RNA, 63 nt, hsa
uggaaggucauagccuggaacccaaguuugaaaacauuucauuguguucaguagugaauuucu

SEQ ID NO: 170237 - RNA, 63 nt, hsa
cuuugaaagucuaggaguagguggucaucuuguacauuucagcaaagcauccacuaggaaacc

SEQ ID NO: 170238 - RNA, 63 nt, hsa
uuuggcaggguuuaaaauauuugugagaagcccacauuucaguauacauccucacuggcuucc

SEQ ID NO: 170239 - RNA, 63 nt, hsa
agcaaggcccccaaagggcccugguuuuacauuacauuucaaacuuuauuugcuuugggguuu

SEQ ID NO: 170240 - RNA, 63 nt, hsa
aauuauuaacaacaacaaaaaacagauuauaaaacauuucauacaacacgauuguauuuuggc

SEQ ID NO: 170241 - RNA, 63 nt, hsa
caguguugagugcaucaauaacuuacugaccgaacauuucaguuauuuguuuagaagugcaaa

SEQ ID NO: 170242 - RNA, 63 nt, hsa
aauuaaaagcucaguuucucaguugcgcuaaucacauuucaagugcucagcagccacccgugu

SEQ ID NO: 170243 - RNA, 63 nt, hsa
aaugguaggaugcuucuguaguucacaaauguuacauuucagagacuuuagaggaaaaauuau

SEQ ID NO: 170244 - RNA, 63 nt, hsa
ccucaaauugcuagaaaauucacagggaagaaaacauuucaagggcuauaccucagcaucuag

SEQ ID NO: 170245 - RNA, 63 nt, hsa
gggacuuugccaccggcuugccuggugguuugcacauuucaggggggucaggagaguuaagga

SEQ ID NO: 170246 - RNA, 63 nt, hsa
augauugcuuuugagggaaaagcuacaguggccacauuucagauguucacuuuugcaauuugu

SEQ ID NO: 170247 - RNA, 63 nt, hsa
ugugugggguuuccccucaggaauuugucuaacacauuucaaggauagaaaauacuucacugc

SEQ ID NO: 170248 - RNA, 63 nt, hsa
ccuguuccuuucuuuccagccugacugcaacucacauuucaaaacaucuucuuuuuaugcauu

SEQ ID NO: 170249 - RNA, 63 nt, hsa
uggagaaauguuucaauuucuuugaauacuugcacauuucaauaauuccuuucccgaguauaa

SEQ ID NO: 170250 - RNA, 63 nt, hsa
ugaucacggcagcccuacgccgugccuggggcgacauuucaggcuuuaugauugucauccuua

SEQ ID NO: 170251 - RNA, 63 nt, hsa
aucaauaaugccugaggcugauugacgacaucuacauuucagugcuuuuucccuaagcuguuu

SEQ ID NO: 170252 - RNA, 63 nt, hsa
ggcuuaucgcuagcggauucacaccugagacagacauuucaacaaugauacaguccugucauu

SEQ ID NO: 170253 - RNA, 63 nt, hsa
aaaauuaggggggaaaugggagaaaauaaugugacauuucaaaaacagcaccaaagcagucag

SEQ ID NO: 170254 - RNA, 63 nt, hsa
uuacaauaaauauaaaaugaaauguuuauguugacauuucagugugaacuguggauugucaau

SEQ ID NO: 170255 - RNA, 63 nt, hsa
agaaaugaccacgugaaauuugccucuguccaaacauuucauccguguguauguguaugugug

SEQ ID NO: 170256 - RNA, 63 nt, hsa
guuuucugaagcaaacaucuggugccaagaucuacauuucaacccugccuuacacccagagcg

SEQ ID NO: 170257 - RNA, 63 nt, hsa
gaagccuuggaaugggcauaaguuguauguccuacauuucaucauugucccgggccugcauug

SEQ ID NO: 170258 - RNA, 63 nt, hsa
auucuaaacagcaauucuuuuguacguaauaggacauuucauccuagaaaaauaaaguaaugu

SEQ ID NO: 170259 - RNA, 63 nt, hsa
guauggagcaugaccagcgugugacucauucugacauuucagauccuaagaauucuaagaaca

SEQ ID NO: 170260 - RNA, 63 nt, hsa
uaacacaggguuuuaacuugcaauacggaaaagacauuucaguugagaaugaaaauuacuaca

SEQ ID NO: 170261 - RNA, 63 nt, hsa
aacacaaaauucaauuccucggcugaacuagccacauuucaacugcucaguagauacgugugg

SEQ ID NO: 170262 - RNA, 63 nt, hsa
uuugagagucucacuucuaaaugaaacaaugcaacauuucacuuugauuucuccacugaaauu

SEQ ID NO: 170263 - RNA, 63 nt, hsa
guuaccaaaucaggguuaagaaacaucagggccacauuucacuaccuucacagaucaaacuca

SEQ ID NO: 170264 - RNA, 63 nt, hsa
uaauuuuuguuuuuauuuugggggccuuuuuugacauuucauuaaaaauucuucuauugcaag

SEQ ID NO: 170265 - RNA, 63 nt, hsa
caauuuguagguaauguuccugaaaauugcaauacauuucaauuauacuaaaccucacaaagu

SEQ ID NO: 170266 - RNA, 63 nt, hsa
ucaugauuugaaaggggcauaucagaaaacaacacauuucauuuauuaaaguaucacaggcaa

SEQ ID NO: 170267 - RNA, 63 nt, hsa
auuaagaaugcuuuggauuaaggauuguggagcacauuucaaucauuuuaggauugucaaaag

SEQ ID NO: 170268 - RNA, 63 nt, hsa
acaucaagacaacuucagcagucgguacaagucacauuucauuuugauugaauacaugaucuu

SEQ ID NO: 170269 - RNA, 63 nt, hsa
ugaguuguucggaaccucaauuaauccuguuuuacauuucagaccuaaagcuggcaaucagga

SEQ ID NO: 170270 - RNA, 63 nt, hsa
auucagggaggccugcaacuccauccuaaggugacauuucaagaaacacauguguugaccacc

SEQ ID NO: 170271 - RNA, 63 nt, hsa
uugcacauauuuauauuuauauucagaaaagaaacauuucaguaauuuauaauaaagagcacu

SEQ ID NO: 170272 - RNA, 63 nt, hsa
uuccuccuuaaaaaaucaaacguaauauguauuacauuucaugguacauuaguaguucuuugu

SEQ ID NO: 170273 - RNA, 63 nt, hsa
aauucugccuuucagcagcaucaauugcuaggaacauuucauucauuucccuguaauauuaau

SEQ ID NO: 170274 - RNA, 63 nt, hsa
uuuauuuuuguuuuuguuggauagcuuuuaauuacauuucagagagguguaauuuuggguaga

SEQ ID NO: 170275 - RNA, 63 nt, hsa
cuaacagauccagaaaugacgcugucugggucaacauuucagggaggagucugccaccagugu

SEQ ID NO: 170276 - RNA, 63 nt, hsa
caaauuaucaacugguugauguguacacuaauuacauuucaggaggacuuaaugcuauuuaug

SEQ ID NO: 170277 - RNA, 63 nt, hsa
uuaugcacuccauccaucauaacuguaugaaacacauuucauauguaaauaaacgugggacau

SEQ ID NO: 170278 - RNA, 63 nt, hsa
cuaauuugaagaacacuuuaauugacacagaauacauuucacauauuuaaccucuacaauaag

SEQ ID NO: 170279 - RNA, 63 nt, hsa
ugcuauccacugugauuuuuaugcauuaaaagcacauuucauguguauucaacccuaaguaaa

SEQ ID NO: 170280 - RNA, 63 nt, hsa
guaggaguauuuuuaggagcagaaacugcaaacacauuucauugugagguuuuacccucugua

SEQ ID NO: 170281 - RNA, 63 nt, hsa
cuuugcaaaugacuaccuauagccugugaaaauacauuucaaaaaauguuaugugcaaugaac

SEQ ID NO: 170282 - RNA, 63 nt, hsa
cuuugucugguuggguuccucauaaaguauaaaacauuucauucucagaaaauccaaccauau

SEQ ID NO: 170283 - RNA, 63 nt, hsa
ucacaaggaaagauuuauuuaaaauauacucguacauuucaccuguggaugucuauaacuuca

SEQ ID NO: 170284 - RNA, 63 nt, hsa
cuuauuacauaccaauggcuuugcaagaagaugacauuucagaaaaucaaacaaaucuauauu

SEQ ID NO: 170285 - RNA, 63 nt, hsa
gaaaauaccuggcaugaaacuguaguuagggauacauuucagcauuuuacucacuuuauccaa

SEQ ID NO: 170286 - RNA, 63 nt, hsa
uugcagaauuuggugcucagacaauauuuaaggacauuucagcgagacaaagugcauguuuuu

SEQ ID NO: 170287 - RNA, 63 nt, hsa
aauuccugcuguaaaauaauuuuuaaaaccuugacauuucaaagacugccuugaaaggucgca

SEQ ID NO: 170288 - RNA, 63 nt, hsa
agaugacaaauuuggaaaaaccacucaucacuuacauuucaugaaguacuucuuugauaaaau

SEQ ID NO: 170289 - RNA, 63 nt, hsa
gucacugccaauuucugaggcugaagccauuucacauuucaccccuaccaccuggcaggugca

SEQ ID NO: 170290 - RNA, 63 nt, hsa
guguuuugaagggaagaauaucagaauugguagacauuucaaacugucacauuagggauacaa

SEQ ID NO: 170291 - RNA, 63 nt, hsa
uugaaaaaucgaaauugacaucacucagcuguuacauuucacauccgauucagcccccuuuua

SEQ ID NO: 170292 - RNA, 63 nt, hsa
gccagugagcucagccuccaaggcuuuaaagccacauuucagcaagagaaagcgcugagagcu

SEQ ID NO: 170293 - RNA, 63 nt, hsa
aaguaaauaccagauauauuauuucauccacagacauuucauacauaucuuuaaagcacauga

SEQ ID NO: 170294 - RNA, 63 nt, hsa
uucauacauuugugcugcccauguacucuuggcacauuucaauaaaauuguuuggaaaauaaa

SEQ ID NO: 170295 - RNA, 63 nt, hsa
ggacuuuguucauugcuagucuacaaaacuaggacauuucauaacgcaauguaggugcucagu

SEQ ID NO: 170296 - RNA, 63 nt, hsa
aaagaaagagaaaguacucagaggcugacacugacauuucacuuccucgcucuccuaaguuua

SEQ ID NO: 170297 - RNA, 63 nt, hsa
cuacaaaagauuugguuuuuaaauuaugguuacacauuucaguaacucauagcugcugugcaa

SEQ ID NO: 170298 - RNA, 63 nt, hsa
cuagaguauauauuguucaguauuucuuuggaaacauuucauuaauguacuugucuuacagaa

SEQ ID NO: 170299 - RNA, 63 nt, hsa
ucuccacgcaccuguguaugugaaagucauuuuacauuucaaagcaguguguguuucuuauuu

SEQ ID NO: 170300 - RNA, 63 nt, hsa
uaaaugccuuaagaguauuuaaaauaugcuuccacauuucaaaauauaaaauguaacaugaca

SEQ ID NO: 170301 - RNA, 63 nt, hsa
gucacgagggccucugcccaggaccuucuauucacauuucaagaaucccuuucugaaauucuc

SEQ ID NO: 170302 - RNA, 63 nt, hsa
agccucauagcucauguaucagggacuuuugccacauuucagaggcauagcaugaacaaguaa

SEQ ID NO: 170303 - RNA, 63 nt, hsa
ugucccccccgcuccgucccccaaacauguuguacauuucaccauggcccccucaucauagca

SEQ ID NO: 170304 - RNA, 63 nt, hsa
aaagaauuacuuguguuacuugccaagcagugcacauuucauaguuucaaaucuguaaucagc

SEQ ID NO: 170305 - RNA, 63 nt, hsa
gauuauuaagcugacuaagcaaugaucuaauacacauuucauauuuucuuuauaauaauuucu

SEQ ID NO: 170306 - RNA, 63 nt, hsa
cuugcaaaaguauggucaaaggaaaaaaaucccacauuucaauuaacaaguagcauggacauu

SEQ ID NO: 170307 - RNA, 63 nt, hsa
aggauguaauucuaauuaacuguugauugccaaacauuucacucugcugugccgucucuucau

SEQ ID NO: 170308 - RNA, 63 nt, hsa
ccaaauccuagaaauaaaaugaguuaacuucaaacauuucagaaaacauuuuaaugauuuuau

SEQ ID NO: 170309 - RNA, 63 nt, hsa
gaagccuaacuuuuuacacagugguuacauuucacauuucacuaauguugauauuuggcugau

SEQ ID NO: 170310 - RNA, 63 nt, hsa
uguuucagaagccuaacuuuuuacacagugguuacauuucacauuucacuaauguugauauuu

SEQ ID NO: 170311 - RNA, 63 nt, hsa
aguccauccuucaaaugaccacuccauaauauaacauuucauccaguaaacuggccucuacua

SEQ ID NO: 170312 - RNA, 63 nt, hsa
augccagggaucaugcuuggcacuuuccauaggacauuucacacaguccuuagaacccccagg

SEQ ID NO: 170313 - RNA, 63 nt, hsa
ucuaaaguugugugauuauauauuugacauuuuacauuucaaagaaagguauguugucuaaca

SEQ ID NO: 170314 - RNA, 63 nt, hsa
gcagggcauucaucuuugauguucuuccuuuucacauuucagaaucggcaaugccuggcccac

SEQ ID NO: 170315 - RNA, 63 nt, hsa
cuguuugaaucuuuaauucccaagaauaaguuuacauuucacaaugaaugaccuacaacagcu

SEQ ID NO: 170316 - RNA, 63 nt, hsa
ggagauuaugugguuggccaauaaagauagaugacauuucaaucucagugauuuaugcuugcu

SEQ ID NO: 170317 - RNA, 63 nt, hsa
ccuuuucuuuuagaaaauggaagcuaugaagcaacauuucaaaugucucuccacaaaccaaac

SEQ ID NO: 170318 - RNA, 63 nt, hsa
aacgccuucccaaaauggcaacuucccacagccacauuucagaccugcugagacugcugagug

SEQ ID NO: 170319 - RNA, 63 nt, hsa
auaauacagugagcccacccucgugguccccagacauuucaggaggucgggaaauuuuuaaac

SEQ ID NO: 170320 - RNA, 63 nt, hsa
cauuucagaaacuggccuaaauggcuauguagaacauuucauuaacccuauaagucauucagu

SEQ ID NO: 170321 - RNA, 63 nt, hsa
ucuguugucuaaaauagguuuucccuguucuggacauuucauauaaauggaaucacacaauug

SEQ ID NO: 170322 - RNA, 63 nt, hsa
ccaguucacggauggggaaacaggccugaggucacauuucacuuagugguuguguugggacca

SEQ ID NO: 170323 - RNA, 63 nt, hsa
agaacagcagcagcgcuacagcccagagguuauacauuucaacagaacagggauccuuggcua

SEQ ID NO: 170324 - RNA, 63 nt, hsa
ugcaauacccuguuauccucagcaacaaaacccacauuucauacauccuuuguguacucagga

SEQ ID NO: 170325 - RNA, 63 nt, hsa
ugaguuuaaaagugccucaaaauaauugagaucacauuucaggacauuuggaaaucaggucga

SEQ ID NO: 170326 - RNA, 63 nt, hsa
uaagauuuuaagauccucuaacacuguacuaaaacauuucaauaaaaucauucugacugcguu

SEQ ID NO: 170327 - RNA, 63 nt, hsa
uggccaugaugauauuauuaaacaccauuauucacauuucaaauaauaacaauacuuuuuguu

SEQ ID NO: 170328 - RNA, 63 nt, hsa
aauucuaaccuuugauaguaaucagaauguauuacauuucauuucugaauagcuuuugaauuu

SEQ ID NO: 170329 - RNA, 63 nt, hsa
acccugugaaguaguuuuggcaaugucuguguuacauuucauguaauuuagccaacucccauu

SEQ ID NO: 170330 - RNA, 63 nt, hsa
uuuucugagcuucuaaauguagccuuucauugcacauuucagugaucagaauagauauccuuu

SEQ ID NO: 170331 - RNA, 63 nt, hsa
uggccacagugugcagguuauaaaagcauuaauacauuucaagguaagagccuuaaaaguuaa

SEQ ID NO: 170332 - RNA, 63 nt, hsa
auuagccuguaauuucuaaauuggagauucucuacauuucacuugcaguuuccuguucuccuc

SEQ ID NO: 170333 - RNA, 63 nt, hsa
cauuccaguggguaggguuuagcugggggaaggacauuucauaaggguuaguuggacugagca

SEQ ID NO: 170334 - RNA, 63 nt, hsa
auuugaaggucuugauuuguuuuagaaugaugcacauuucauguauuccaguuuguuuauuac

SEQ ID NO: 170335 - RNA, 63 nt, hsa
guaguuuuuauuuucuuccuucuacuucucuauacauuucagauucucuacaguaagcaugug

SEQ ID NO: 170336 - RNA, 63 nt, hsa
ugauauuuuguuauuuuuguuguuauauuauuuacauuucaguaguuguuuuuuguguuucca

SEQ ID NO: 170337 - RNA, 63 nt, hsa
gcaggcgccagggcugucaucaacauggauaugacauuucacaacagugacuaguugaauccc

SEQ ID NO: 170338 - RNA, 63 nt, hsa
ugauggugugaaacccacuuuggaccaucacacacauuucagcauuugaagugacacaagcua

SEQ ID NO: 170339 - RNA, 63 nt, hsa
uugagcagugccucaaguacauccuuauuaggaacauuucaaaccccuuuuaguuaagucuuu

SEQ ID NO: 170340 - RNA, 63 nt, hsa
gagaagcugugguguguaugcuguagaguuuccacauuucacaugcaguguacuccaaaaagc

SEQ ID NO: 170341 - RNA, 63 nt, hsa
auaaugaacuuguauaguguguuuaaaugggacacauuucaaaggaaauaaaucaguguccgu

SEQ ID NO: 170342 - RNA, 63 nt, hsa
acagugugucugaugaucccuucucucccacucacauuucaaccccugcccuuguuuggagcu

SEQ ID NO: 170343 - RNA, 63 nt, hsa
ggcagggcuauguuuguuuaugaugcucugcaaacauuucauauuggccaauaaacagaaaua

SEQ ID NO: 170344 - RNA, 63 nt, hsa
auuuuuucaaugcaagaugaggaugaaaauuuuacauuucaacccaucuggcuaaaguuaaga

SEQ ID NO: 170345 - RNA, 63 nt, hsa
aguaguagugaaauuguaggccauuuucuuauaacauuucaguuacuuuucaguuaauuauuc

SEQ ID NO: 170346 - RNA, 63 nt, hsa
auugaaacauaauuacuugauagcucagggucuacauuucauucaacuuuuuacaccaaauuc

SEQ ID NO: 170347 - RNA, 63 nt, hsa
uugcucgaugcagacagggggccagaacaccacacauuucacugucugucugguccauagcug

SEQ ID NO: 170348 - RNA, 63 nt, hsa
gaugaaacuuugaaaaagauauuuaugauguuaacauuucagguuaagccucauacguuuaaa

SEQ ID NO: 170349 - RNA, 63 nt, hsa
auggaaaggaaggcaaucgacacaguuauuagcacauuucagaaaaugaacacccuugugaua

SEQ ID NO: 170350 - RNA, 63 nt, hsa
ugauggugugaaacccacuuuugaccgucacacacauuucagcauuugaagagacacaggcua

SEQ ID NO: 170351 - RNA, 63 nt, hsa
acucuacugccuuccacauauugguuccuugauacauuucauaugauaucagccaagaguuuu

SEQ ID NO: 170352 - RNA, 64 nt, hsa
ucuacagacauuaaacaauuguuguguucuuuuuaccuuuuauuuuucuauuaccuugcuacca

SEQ ID NO: 170353 - RNA, 64 nt, hsa
gaaguuuucugaauuaauaaugacuuagauugugaccuuuuagauucgguguugagcucugugu

SEQ ID NO: 170354 - RNA, 64 nt, hsa
cagucugccauuuugggugcccaccccaauuuuuaccuuuuaguaaguuggcaugaaauuuugg

SEQ ID NO: 170355 - RNA, 64 nt, hsa
gaauuauaguccuuauuuuuuuccuuugcgugaaaccuuuuauaacagauuaacaaucaacugc

SEQ ID NO: 170356 - RNA, 64 nt, hsa
agugagcacuaugauuaucaaggugacuuuggaaaccuuuuaaaaaugcauuuuugcaaaacaa

SEQ ID NO: 170357 - RNA, 64 nt, hsa
uugaaccucaaccagguauaaaagaugcauaacaaccuuuuagcaguaagugucaagugaguga

SEQ ID NO: 170358 - RNA, 64 nt, hsa
uuauucucuagguaaguauguuuuaggauuaaauaccuuuuacagauacugaaagugccuccuu

SEQ ID NO: 170359 - RNA, 64 nt, hsa
gggagugaaucaguuucuuguuuauauuuuuuucaccuuuuaaacaaaaaauucuuuaaaauau

SEQ ID NO: 170360 - RNA, 64 nt, hsa
cucuugcugugaaauugaagugcauguagaaaaaaccuuuuacuauaugaaacuuuacaacacu

SEQ ID NO: 170361 - RNA, 64 nt, hsa
aaaugacuaguaauauaggcuuucaagaguugguaccuuuuagcuauauuugcagauucucugg

SEQ ID NO: 170362 - RNA, 64 nt, hsa
uuauuuuggucauauuuuuacuuuagugucacucaccuuuuacaaagugacuuuguacucauuu

SEQ ID NO: 170363 - RNA, 64 nt, hsa
caagaaugauacaggccauaauugaaaugggaauaccuuuuaaguuucauuagggguggggugg

SEQ ID NO: 170364 - RNA, 64 nt, hsa
auugucacuaaaaaauuuuacugucuaaauaaguaccuuuuauuggagaaaaaucaaaacccca

SEQ ID NO: 170365 - RNA, 64 nt, hsa
uuucugauuuauuuucuuaagugccaaugggcccaccuuuuaaacaagaaaacguuaaauaacu

SEQ ID NO: 170366 - RNA, 64 nt, hsa
uagaguaauagagucauacuuuuuuauaacagcaaccuuuuaaaaggaaagcucuuauaaaguc

SEQ ID NO: 170367 - RNA, 64 nt, hsa
guuaccuucacauguccuauuacugaugugugcaaccuuuuauguguugaugacucacucauaa

SEQ ID NO: 170368 - RNA, 64 nt, hsa
auuuguugucccauaauugagaaagcuuaaauacaccuuuuauuaagaguuuguaaauucuagc

SEQ ID NO: 170369 - RNA, 64 nt, hsa
aaaugaaaaauauauuggcaaaauaaauguuuaaaccuuuuacguuaaaauuacuuugaaagau

SEQ ID NO: 170370 - RNA, 64 nt, hsa
uugcaaacaugccuuuuguuuucuauauacccugaccuuuuaauaaaguuucaguguauuuauc

SEQ ID NO: 170371 - RNA, 64 nt, hsa
ggcaauuuauaauagaacuuauagcuuuuaaaagaccuuuuaaagacauuaaauguaaacuuaa

SEQ ID NO: 170372 - RNA, 64 nt, hsa
aaaaaucaacaaaauaugcuuucuggagaacuguaccuuuuaugguuugcuugcacaucaguag

SEQ ID NO: 170373 - RNA, 64 nt, hsa
ugagugucaauugaaaguugucaauuaaaagguaaccuuuuaaucucguaggaggaaucucauu

SEQ ID NO: 170374 - RNA, 64 nt, hsa
ggcauuuuuuucuggauucaaacaggcaacaaugaccuuuuauuuucuguuuguccccaccucc

SEQ ID NO: 170375 - RNA, 64 nt, hsa
uuuguauuuggagagagugacuauugaacuugaaaccuuuuauuccgggcgucuugguaguuuc

SEQ ID NO: 170376 - RNA, 64 nt, hsa
aaagaaaacaaaaaaagguagugaacuuucagcuaccuuuuaaagaggcuaaguuaucuuugau

SEQ ID NO: 170377 - RNA, 64 nt, hsa
gcaugaugcuugacagugugaaauguccaauuuuaccuuuuacacaaugugagauguaugaaaa

SEQ ID NO: 170378 - RNA, 64 nt, hsa
uccuccugaggcuuuggauuugacauugcguuugaccuuuuauguaguaauugacaugugccag

SEQ ID NO: 170379 - RNA, 64 nt, hsa
aaaaacaggucuucaucgaaucuacuaauuccacaccuuuuauugacacagaaaauguugagaa

SEQ ID NO: 170380 - RNA, 64 nt, hsa
aucagggaaguuagucaaaugaaauggaaauugguaaauggacaaaagcuagcuaguaaaaagg

SEQ ID NO: 170381 - RNA, 64 nt, hsa
acaauuaagagauuucugacauuuauucuuacacuaaauggaucaacucuaggauuuaggcaug

SEQ ID NO: 170382 - RNA, 64 nt, hsa
gucaaaguggcacagcaaaucauauaaaucgaauuaaauggacaacaccguuagauguguaugu

SEQ ID NO: 170383 - RNA, 64 nt, hsa
cauuuuaaggaaaccuacuaaauccaguuaauauuaaauggacaccacucauuaagaaauuucu

SEQ ID NO: 170384 - RNA, 64 nt, hsa
guuuagaggggaaaaaaaaacaauuauuccuaaauaaauggauaaguagaauuaaugguugagg

SEQ ID NO: 170385 - RNA, 64 nt, hsa
gaagcucaacaagagacuggaaggaccauaaauuuaaauggagaaaggacccucaagacaaaug

SEQ ID NO: 170386 - RNA, 64 nt, hsa
cugcuguuuuauacauuugcaacaauuucucuuguaaauggaaugguuugggguuuuuaaauaa

SEQ ID NO: 170387 - RNA, 64 nt, hsa
uaaugcuuuuauguauuucaaaacuuucauauguuaaauggaaauuguuuuaaauguguuugag

SEQ ID NO: 170388 - RNA, 64 nt, hsa
aaagcuguacuugcauuucaaagcuuauaagauauaaauggagauuuuaaaguagaaauaaaua

SEQ ID NO: 170389 - RNA, 64 nt, hsa
uuauuccauauuuucuuuucagugaaaaauuuuuuaaauggaagacuguucuaaaaucacuuuu

SEQ ID NO: 170390 - RNA, 64 nt, hsa
uccaaaguauaacacuaucaauuugugaggauaauaaauggaaugccauuaguguagaugucug

SEQ ID NO: 170391 - RNA, 64 nt, hsa
uugccauuaauccuaauucagugcuauccaguuauaaauggaaucuugagacaaaaccuuaaca

SEQ ID NO: 170392 - RNA, 64 nt, hsa
aauuauaucauuacuguguaucuguguauuguacuaaauggacugaugcugcgcacaugagcug

SEQ ID NO: 170393 - RNA, 64 nt, hsa
caguguuuccaucucuggaaucucuguuuuaugcuaaauggauuuaggaagacuguuuuucuuu

SEQ ID NO: 170394 - RNA, 64 nt, hsa
auuuuauaacuuuuaaauggaaaaaccuauuagguaaauggaaauaauccuugaaaauaguuuu

SEQ ID NO: 170395 - RNA, 64 nt, hsa
uucuguuuucucuuuuuaaauauuuuauaacuuuuaaauggaaaaaccuauuagguaaauggaa

SEQ ID NO: 170396 - RNA, 64 nt, hsa
gacagaaauaugaaugucgaggggcuuggaauucuaaauggaagauuuuagaaggaacuuugcu

SEQ ID NO: 170397 - RNA, 64 nt, hsa
guucugugugcccugaaaauguuaccaguguuaauaaauggauacuuaucaaaaaagaauauag

SEQ ID NO: 170398 - RNA, 64 nt, hsa
agaggggguaacagucugcaucaucaucacaaccuaaauggagaaagcugugcagaggaaacuu

SEQ ID NO: 170399 - RNA, 64 nt, hsa
ccacuuaacaggaaguuuaguuuguuaugcacuuuaaauggaauaauuagcuuguuacaauucu

SEQ ID NO: 170400 - RNA, 64 nt, hsa
cuauauuuaaaucauuuuaacuucuauagguuuuuaaauggaauuuucuaauauaaugacuuau

SEQ ID NO: 170401 - RNA, 64 nt, hsa
ugcugaaauguuugggauauguuuguugacaagguaaauggaaaugagaaacuuuauacuucag

SEQ ID NO: 170402 - RNA, 64 nt, hsa
guuuuauugguggaagcugauuugcaacauuugcuaaauggauuagaugaauguacuucuuuuu

SEQ ID NO: 170403 - RNA, 64 nt, hsa
auccuuacagcuugcaugcaaucaaccucuuuuguaaauggaaaauaaagucuguuacccaaag

SEQ ID NO: 170404 - RNA, 64 nt, hsa
ggcccugagaauggagcuguagccucauggacaauaaauggaugugacaccaaauacucugcag

SEQ ID NO: 170405 - RNA, 64 nt, hsa
auauuggcuuuuguuuucaaugugaaagauacauuaaauggacacauaucuugcaaaauuuugu

SEQ ID NO: 170406 - RNA, 64 nt, hsa
auugcuaaguaaucuguuugcacucuaggaaaaguaaauggagagguaaaagaaaggcauuggg

SEQ ID NO: 170407 - RNA, 64 nt, hsa
uccuuaacugucugcagugcccccugacuucuuuuaaauggaugugaauauauguggaaaacua

SEQ ID NO: 170408 - RNA, 64 nt, hsa
aaaaugaacacuugaccaaaaaaccacauuaauuuaaauggagccuuucauuauuuucagauag

SEQ ID NO: 170409 - RNA, 64 nt, hsa
cuaugguaaugcucuuacggauauaaaccucaguuaaauggaauuaucuaugggaugugugguu

SEQ ID NO: 170410 - RNA, 64 nt, hsa
uaguaauguguuauguaguacaguuuuaaagcuauaaauggaauuuuguguaaauucacaaaaa

SEQ ID NO: 170411 - RNA, 64 nt, hsa
auuauuagaguugcagaauagaaacuugaagugcuaaauggaauaauccaaaggaaauuuuuua

SEQ ID NO: 170412 - RNA, 64 nt, hsa
cagguuauauauagaauuucuauuaaggauuuuuuaaauggacaagcaauaggggguugaagug

SEQ ID NO: 170413 - RNA, 64 nt, hsa
cuagcaugcaugcacaacaauacaauuuauaugguaaauggaaccaaauaauggcuucacugaa

SEQ ID NO: 170414 - RNA, 64 nt, hsa
ccuuuuuuuuucuauaaaucaccaaccaacuaucuaaauggacauuugggggaauucccuccca

SEQ ID NO: 170415 - RNA, 64 nt, hsa
aacaauaagucugagcccaucucaacccacuuuucuccgguagucuuuauguaucuguuagcac

SEQ ID NO: 170416 - RNA, 64 nt, hsa
uauugaaugcugucuugacaucucuugccuuguccuccgguauguucuaaagcugugucugaga

SEQ ID NO: 170417 - RNA, 64 nt, hsa
ucugcaggcuccugcgggcucaccaggcugcuggcuccgguaccauguaaaccuaggaagguaa

SEQ ID NO: 170418 - RNA, 64 nt, hsa
cuauccccgccccacagagcucaggguggcagaucuccgguauccucagcacuacccacccccg

SEQ ID NO: 170419 - RNA, 64 nt, hsa
cagaacaauggaucggcuuccuuacccagcaccccuccgguagguggguggccacguggaugcc

SEQ ID NO: 170420 - RNA, 64 nt, hsa
ugguauuucaccuuccuguccaucuguccccucccuccgguauaccuuuaucccuuugaaaggg

SEQ ID NO: 170421 - RNA, 64 nt, hsa
gaggaagagccacguccccagggauuggaggaggcuccgguacccucgacccuccuggguguug

SEQ ID NO: 170422 - RNA, 54 nt, hsa
cccugccccuaccccuaugaggggcuccgguagcaccugggcaccugccgcugg

SEQ ID NO: 170423 - RNA, 64 nt, hsa
ucaugaauucuucucaaagauuugacaugcuccacuccgguaacuuuggugaguugagagcuuu

SEQ ID NO: 170424 - RNA, 64 nt, hsa
agcacacuuugcucaggucuuaacuugagggccucuccgguacuaacauccugcgauagcuugu

SEQ ID NO: 170425 - RNA, 64 nt, hsa
uggauuccagauccaccuuacguagccgugugagcuccgguaaauuacauaacccaucaaauuu

SEQ ID NO: 170426 - RNA, 64 nt, hsa
cuguagggcaguuaccacagaaacagaaauugaccuccgguauauauaaauauuuacuuauaaa

SEQ ID NO: 170427 - RNA, 64 nt, hsa
cccaugaugugacccugaugggcuggacuugccccuccgguagccuuccuuggcccucccagcg

SEQ ID NO: 170428 - RNA, 64 nt, hsa
acagcccgagcaggucggggagcugugcuucucucuccgguacgugcccagcucaggccggcug

SEQ ID NO: 170429 - RNA, 64 nt, hsa
ucggccucgggcccugcccuguccgccguccgcccuccgguaggguucgggccuuccggaugcg

SEQ ID NO: 170430 - RNA, 64 nt, hsa
ucucuuucucccuccccuaccagccucauucuuccuccgguagccucucccaccuaaccucugc

SEQ ID NO: 170431 - RNA, 64 nt, hsa
cugcucgggcagaggcugcugcccagggcuucugcuccgguaccuugugaagcugcauucuccu

SEQ ID NO: 170432 - RNA, 64 nt, hsa
caucuaugcacgaccuugggaaaugaguugaugucuccgguaaaacaccggagacuaauuccug

SEQ ID NO: 170433 - RNA, 64 nt, hsa
uucugucuguauccaaaccagagcccagccaucccuccgguaucggggugggucagaaaaaguc

SEQ ID NO: 170434 - RNA, 64 nt, hsa
ggggugaauucuuaggucgagcugaugcaagaaacuccgguagccagccucugugaccuuguac

SEQ ID NO: 170435 - RNA, 64 nt, hsa
auuuauuucaagagacuacacaugguuauuuaaucuccgguacugaauagguuuuuuuucuucu

SEQ ID NO: 170436 - RNA, 64 nt, hsa
caaaauuucauuuuucucauaguuaauuucaucucuccgguaagauuuuauugguguuucuuuu

SEQ ID NO: 170437 - RNA, 64 nt, hsa
ucuauacuaaauuaacaguaauaccucaaaacugcuccgguaguaguuuuuaauggauugaaau

SEQ ID NO: 170438 - RNA, 64 nt, hsa
ucaguguuuucucucucucucuuucgagcuugcacuccgguacccgacccggcgcccuggccca

SEQ ID NO: 170439 - RNA, 64 nt, hsa
agccccaugccucuuccaaaacagugcaauaaaucuccgguaacccguccaccuggccgaggca

SEQ ID NO: 170440 - RNA, 64 nt, hsa; identical to SEQ ID NO: 84086

SEQ ID NO: 170441 - RNA, 64 nt, hsa; identical to SEQ ID NO: 84087

SEQ ID NO: 170442 - RNA, 64 nt, hsa; identical to SEQ ID NO: 84088

SEQ ID NO: 170443 - RNA, 64 nt, hsa; identical to SEQ ID NO: 84089

SEQ ID NO: 170444 - RNA, 64 nt, hsa; identical to SEQ ID NO: 84090

SEQ ID NO: 170445 - RNA, 64 nt, hsa; identical to SEQ ID NO: 84091

SEQ ID NO: 170446 - RNA, 64 nt, hsa; identical to SEQ ID NO: 84092

SEQ ID NO: 170447 - RNA, 64 nt, hsa; identical to SEQ ID NO: 84093

SEQ ID NO: 170448 - RNA, 64 nt, hsa; identical to SEQ ID NO: 84094

SEQ ID NO: 170449 - RNA, 64 nt, hsa; identical to SEQ ID NO: 84095

SEQ ID NO: 170450 - RNA, 64 nt, hsa; identical to SEQ ID NO: 84096

SEQ ID NO: 170451 - RNA, 64 nt, hsa; identical to SEQ ID NO: 84097

SEQ ID NO: 170452 - RNA, 64 nt, hsa; identical to SEQ ID NO: 84098

SEQ ID NO: 170453 - RNA, 64 nt, hsa; identical to SEQ ID NO: 84099

SEQ ID NO: 170454 - RNA, 64 nt, hsa; identical to SEQ ID NO: 84100

SEQ ID NO: 170455 - RNA, 64 nt, hsa; identical to SEQ ID NO: 84101

SEQ ID NO: 170456 - RNA, 64 nt, hsa; identical to SEQ ID NO: 84102

SEQ ID NO: 170457 - RNA, 64 nt, hsa; identical to SEQ ID NO: 84103

SEQ ID NO: 170458 - RNA, 64 nt, hsa; identical to SEQ ID NO: 84104

SEQ ID NO: 170459 - RNA, 64 nt, hsa; identical to SEQ ID NO: 84105

SEQ ID NO: 170460 - RNA, 64 nt, hsa; identical to SEQ ID NO: 84106

SEQ ID NO: 170461 - RNA, 64 nt, hsa; identical to SEQ ID NO: 84107

SEQ ID NO: 170462 - RNA, 64 nt, hsa; identical to SEQ ID NO: 84108

SEQ ID NO: 170463 - RNA, 64 nt, hsa; identical to SEQ ID NO: 84109

SEQ ID NO: 170464 - RNA, 64 nt, hsa; identical to SEQ ID NO: 84110

SEQ ID NO: 170465 - RNA, 64 nt, hsa; identical to SEQ ID NO: 84111

SEQ ID NO: 170466 - RNA, 64 nt, hsa; identical to SEQ ID NO: 84112

SEQ ID NO: 170467 - RNA, 64 nt, hsa; identical to SEQ ID NO: 84113

SEQ ID NO: 170468 - RNA, 64 nt, hsa; identical to SEQ ID NO: 84114

SEQ ID NO: 170469 - RNA, 64 nt, hsa; identical to SEQ ID NO: 84115

SEQ ID NO: 170470 - RNA, 64 nt, hsa; identical to SEQ ID NO: 84116

SEQ ID NO: 170471 - RNA, 64 nt, hsa; identical to SEQ ID NO: 84117

SEQ ID NO: 170472 - RNA, 64 nt, hsa; identical to SEQ ID NO: 84118

SEQ ID NO: 170473 - RNA, 64 nt, hsa; identical to SEQ ID NO: 84119

SEQ ID NO: 170474 - RNA, 64 nt, hsa; identical to SEQ ID NO: 84120

SEQ ID NO: 170475 - RNA, 64 nt, hsa; identical to SEQ ID NO: 84121

SEQ ID NO: 170476 - RNA, 64 nt, hsa; identical to SEQ ID NO: 84122

SEQ ID NO: 170477 - RNA, 64 nt, hsa; identical to SEQ ID NO: 84123

SEQ ID NO: 170478 - RNA, 64 nt, hsa; identical to SEQ ID NO: 84124

SEQ ID NO: 170479 - RNA, 64 nt, hsa; identical to SEQ ID NO: 84125

SEQ ID NO: 170480 - RNA, 64 nt, hsa; identical to SEQ ID NO: 84126

SEQ ID NO: 170481 - RNA, 64 nt, hsa; identical to SEQ ID NO: 84127

SEQ ID NO: 170482 - RNA, 64 nt, hsa; identical to SEQ ID NO: 84128

SEQ ID NO: 170483 - RNA, 64 nt, hsa; identical to SEQ ID NO: 84129

SEQ ID NO: 170484 - RNA, 64 nt, hsa; identical to SEQ ID NO: 84130

SEQ ID NO: 170485 - RNA, 64 nt, hsa; identical to SEQ ID NO: 84131

SEQ ID NO: 170486 - RNA, 64 nt, hsa
acaaggugaugcagaugugaccuaggacgauggaccgccggacucuuuucugcagcacacgccu

SEQ ID NO: 170487 - RNA, 64 nt, hsa
ccggcgugccggagaggagaaagggcccgacugcccgccggacccugcacccagcgacugggcc

SEQ ID NO: 170488 - RNA, 64 nt, hsa
cagcggagugcgcuggggcgcgccagggcuaggcccgccggaggagcgcguccccagccuuccg

SEQ ID NO: 170489 - RNA, 64 nt, hsa
caggggucacauauaaggucaguguuucucguccccgccggaucugcacugccaacugggauug

SEQ ID NO: 170490 - RNA, 64 nt, hsa
uucuccugcagucuguggagcguccuuguccccgccgccggaaugaaugagcauucugcagccc

SEQ ID NO: 170491 - RNA, 64 nt, hsa
guccguccuguguccgcgcgcgcgggugccuuucccgccggagacucggccggugugcuucgug

SEQ ID NO: 170492 - RNA, 64 nt, hsa
auggcucagccuaaccucuccuggccaaucccccccgccggagagcaggacacuagggaggacc

SEQ ID NO: 170493 - RNA, 64 nt, hsa
ugacuugugccagcagcauggacugcgugccucuccgccggaggucuagcugugggcggccaag

SEQ ID NO: 170494 - RNA, 64 nt, hsa
cccgccgcggccucaacccggguccgcggggcacccgccggaugcgcagccuggccucuacuac

SEQ ID NO: 170495 - RNA, 60 nt, hsa
ccccagccaucaucucuuaacuacggaggcccgccggaggccacaccaucccuuaguuuc

SEQ ID NO: 170496 - RNA, 64 nt, hsa
agcugggggggccucaccuguuccccugaggaccccgccggacccggaggcucacagggaacaa

SEQ ID NO: 170497 - RNA, 64 nt, hsa
agcaguuuucuaauuuugacuuuaaauuuuucauccgccggagacacugcucccauuugugggg

SEQ ID NO: 170498 - RNA, 64 nt, hsa
ccagccagcgggcaucugaagccggguccuucgcccgccggaggcugccguccgucucuccugc

SEQ ID NO: 170499 - RNA, 64 nt, hsa
gucccaucggaaguuuuggguuuuccgcccacagccgccggaaguggcuccguggccccgcccu

SEQ ID NO: 170500 - RNA, 64 nt, hsa
ucuuccucugcaagugcucagggaaauggccuucccgccggaggccagcuaucugccugacagg

SEQ ID NO: 170501 - RNA, 64 nt, hsa
agugagccccuccccagccagcccuucccuggccccgccggauguauaaauguaaaaaugaagg

SEQ ID NO: 170502 - RNA, 64 nt, hsa
uuggcauugcuccccagacugaacagaaaccuggccgccggaugggaccuccuuuggcacagac

SEQ ID NO: 170503 - RNA, 64 nt, hsa
ccggucuccacccugagggagcaccgacccggugccgccggagcuggcccugugcgcaugcuca

SEQ ID NO: 170504 - RNA, 64 nt, hsa
cacuuuccuccgcguugcuuccggacggcgccgaccgccggagcccaagugacgcggagcucgu

SEQ ID NO: 170505 - RNA, 64 nt, hsa
ugcacauuuugaaaagagcagcugcugcuuagggccgccggaagcugguguccugucauuuucu

SEQ ID NO: 170506 - RNA, 64 nt, hsa
ggcccucaggggcgauuagcuuagugagcuuaccccgccggagcgggggagcgcuagagguagu

SEQ ID NO: 170507 - RNA, 64 nt, hsa
cuuguucuuguuuuacuguauugagcggcggcacccgccggacccgcauuauggcugggggcgc

SEQ ID NO: 170508 - RNA, 64 nt, hsa
aaccgagcuuggaguucuccaaguggaguuccacccgccggacuccugacaccccugggcuagg

SEQ ID NO: 170509 - RNA, 64 nt, hsa
cugccguaguaauccaccccaacggccggaggagccgccggagcccgccugcccgcccgccgcc

SEQ ID NO: 170510 - RNA, 64 nt, hsa
cauucugggguguggcuccagccuucccuggcccccgccggaggccgggagggagcagggucuc

SEQ ID NO: 170511 - RNA, 64 nt, hsa
uugccaccacacucgcccacuugcccaccgggucccgccggauaaaugacaggcccgaggucag

SEQ ID NO: 170512 - RNA, 64 nt, hsa
cuuccuucacuuugcagaggcuggaagacggcagccgccggacugggcagauccucaagcagac

SEQ ID NO: 170513 - RNA, 64 nt, hsa
gcccgaggacgcucccugcuccacgucugcgccgccgccggaguccacucccagugcuugcaag

SEQ ID NO: 170514 - RNA, 64 nt, hsa
cugguggggcagacccgaaaauccagcgugcaccccgccggaggaaggucccauggccugcugg

SEQ ID NO: 170515 - RNA, 64 nt, hsa
agaucugguaccgcagguagcgccgccgccgccgccgccggagccugucgccguccugucccca

SEQ ID NO: 170516 - RNA, 64 nt, hsa
cagcugcggcaagccuagggaccagggugaggacccgccggaugacagccacccucaccgcggc

SEQ ID NO: 170517 - RNA, 64 nt, hsa
gccaaucggagcgcgaggacguggucuggagguaccgccggagaucugggaccacucagggcau

SEQ ID NO: 170518 - RNA, 64 nt, hsa
gugccauuccccagccacugccuucaugcugcccccgccggacuggcagagccaggggucagcc

SEQ ID NO: 170519 - RNA, 64 nt, hsa
gcccgacuagcaggcaugccgcgguagguaagggccgccggaccgcguagagagccgggccccg

SEQ ID NO: 170520 - RNA, 64 nt, hsa
uguggccugccuuugcugaccguuuugggguuccccgccggagcuacaggggcauuuucuuccc

SEQ ID NO: 170521 - RNA, 64 nt, hsa
gugagagcuguguggccccccgaugccacucugcccgccggagggaugugccugcugagccuuu

SEQ ID NO: 170522 - RNA, 64 nt, hsa
cgauccaguacaacgugguggauggccugagggaccgccggagcuuccacgggccguacacagu

SEQ ID NO: 170523 - RNA, 64 nt, hsa
guuaacuacccucaccaggacgcagccaguguguccgccggauguccagaugccccgcuugucu

SEQ ID NO: 170524 - RNA, 64 nt, hsa
cggguggcaggccgggcuccgccacugcaugcucccgccggaccgagccccagcaagggcuccu

SEQ ID NO: 170525 - RNA, 64 nt, hsa
cuggggcucuuugugagugaggguggccaaacuaccgccggaggagauggggucucagagcgag

SEQ ID NO: 170526 - RNA, 64 nt, hsa
cacucccugccuugugaguggccugcugccucaccucccgcaggccgccacacuuauugcaggu

SEQ ID NO: 170527 - RNA, 64 nt, hsa
ggcugcccguuaagaugguggcggcacacgcucccucccgcagcaccacgccagcuggugcggc

SEQ ID NO: 170528 - RNA, 64 nt, hsa
cccaccuggagcccgcuucaagcucucuguugcgcucccgcauuucucaugcuucuucucaugg

SEQ ID NO: 170529 - RNA, 64 nt, hsa
ggacccuuaccgguggcucuuccugccugggacccucccgcagagucccacuagccagcggccu

SEQ ID NO: 170530 - RNA, 64 nt, hsa
auaagguaccaggacucaggcuucucauccccuccucccgcaaagcgguuuucugacccucagg

SEQ ID NO: 170531 - RNA, 64 nt, hsa
aaaagguucuuuacaagaugauaccuuaauuacacucccgcaacacagccauuauuuuauuguc

SEQ ID NO: 170532 - RNA, 64 nt, hsa
gagggaaugacggagguagggugcagggucagggcucccgcaggggccugcaucuggccagcag

SEQ ID NO: 170533 - RNA, 64 nt, hsa
gaaaacuugaucaaugagcuuuuaaccacgauuucucccgcaauuuguuccuucuuuuuaccuu

SEQ ID NO: 170534 - RNA, 64 nt, hsa
uacugagacucuguuuaucacuagccuucugucccucccgcagaagacuguuggauugaacaaa

SEQ ID NO: 170535 - RNA, 64 nt, hsa
cucacggugacucagcagugcccaacugaccaaucucccgcagcucuccugccccugggggccc

SEQ ID NO: 170536 - RNA, 64 nt, hsa
aauugguauucagcacuauaaauguguuuuuaaccucccgcauucugugcuuauuuaaaacaag

SEQ ID NO: 170537 - RNA, 64 nt, hsa
uucccuaacauggaggcaaaauaccacauggcuucucccgcauaucgucacuggaaacuuccuc

SEQ ID NO: 170538 - RNA, 64 nt, hsa
uuucuccucccgaaggaacagcugauucaugcuccucccgcaauugucacgucugugauuuauu

SEQ ID NO: 170539 - RNA, 64 nt, hsa
caggcuuggguuccccagccuuauuggaaggcagcucccgcauaccaggauaacccccgcaaac

SEQ ID NO: 170540 - RNA, 64 nt, hsa
gcaugccagccccacacucccugggucuggcuuccucccgcaaccucacucuaguagagccugu

SEQ ID NO: 170541 - RNA, 64 nt, hsa
gcgacaaccaacacgugcucucacaaaccccugacucccgcacuuuccagugccaaaguacaaa

SEQ ID NO: 170542 - RNA, 64 nt, hsa
ugugggagggagggagggcuggcucaggcaucgucucccgcaaugggcagagagagcagagaca

SEQ ID NO: 170543 - RNA, 64 nt, hsa
aggaacacaguuggaggucaccucuccugcccagcucccgcacccugcguuuaggaguucaguc

SEQ ID NO: 170544 - RNA, 64 nt, hsa
cgggacgcaguucucggacgccgaggggcuggcgcucccgcaggacggccucuauuaccucuac

SEQ ID NO: 170545 - RNA, 64 nt, hsa
caguuuuaaaguucaugguaagauuugaccucaucucccgcaaauaaauguauuggugauuugg

SEQ ID NO: 170546 - RNA, 64 nt, hsa
aagggccaaccccuugcaacagggcagcucucgccucccgcacacggcucuccugaucacagcu

SEQ ID NO: 170547 - RNA, 64 nt, hsa
aaccuaccuuccacaagccagccccgcaucccugcucccgcaguguaagugcagagccugccuc

SEQ ID NO: 170548 - RNA, 64 nt, hsa
gccccucccagaccucuguccuuccaccaaucgccucccgcagccccgagccgccacucccagu

SEQ ID NO: 170549 - RNA, 64 nt, hsa
aagagcacauuccaaaucaaacuugcaaaugagacucccgcacgaaaacccuuaagagucccgg

SEQ ID NO: 170550 - RNA, 64 nt, hsa
ccugcuccucagacucacagccccuccauguuaccucccgcaccuccucccuggggcagcugcu

SEQ ID NO: 170551 - RNA, 53 nt, hsa
acuaugacguggugaacuaaccgcucccgcaccugucgguggcugccuuugau

SEQ ID NO: 170552 - RNA, 64 nt, hsa
aacaaaaaagagaaagaaaaugaagagcauuugacucccgcacuuaaaaugaaguacacauaaa

SEQ ID NO: 170553 - RNA, 64 nt, hsa
uccagcucuacuaccuacguuugcaccgccugcccucccgcaccuuccuccuccccgcuccguc

SEQ ID NO: 170554 - RNA, 64 nt, hsa
ccucccuggcucagcccagugcggccuggcgcuccucccgcaggcucugcccccgggcuccggu

SEQ ID NO: 170555 - RNA, 64 nt, hsa
uggggcacggucugcggccaugaggccaggccgccucccgcaccccuaccccguggcagcagca

SEQ ID NO: 170556 - RNA, 64 nt, hsa
cacccagcggggcuuccaggccagccuguguccccucccgcaggccuccuguccacaccagcgc

SEQ ID NO: 170557 - RNA, 64 nt, hsa
acacaaaggcuggccuguguguaagucaaagucacucccgcaaaccugaaucucgagcuaccua

SEQ ID NO: 170558 - RNA, 64 nt, hsa
cucgggaaaccucccccgacgcucucucucggaacucccgcacccuccuuucucaccagcccgc

SEQ ID NO: 170559 - RNA, 64 nt, hsa
cccaccaccagucacugccucgcagagcccuacacucccgcagccgcuccucagaggccugugc

SEQ ID NO: 170560 - RNA, 64 nt, hsa
ccuggaggcagcugucucgcagacucagcuuggucucccgcaggcuucagaaaaacccaauugc

SEQ ID NO: 170561 - RNA, 64 nt, hsa
ccuugucaucaucacccacugcacuggccuugcucucccgcacgaggacggagaacacaaacuc

SEQ ID NO: 170562 - RNA, 64 nt, hsa
gucuggaugccugggcuucacacaagaaccaccucucccgcaguucccaaggacuugucauuuc

SEQ ID NO: 170563 - RNA, 64 nt, hsa
ugcuucugaacucaagcugcguuuauuaaugccucucccgcaccaggccgggcuugggcccugc

SEQ ID NO: 170564 - RNA, 64 nt, hsa
gacagaucugaccucgugauccgcccaucuccaccucccgcagugcugggauuacaggcaugag

SEQ ID NO: 170565 - RNA, 64 nt, hsa
uggauggaucugcuccaugcagaucuagccaggccucccgcaugcugccugccuccggcccugc

SEQ ID NO: 170566 - RNA, 52 nt, hsa
uccucugccuuccagccugaggcucccgcagcccacccugaccgggacuggu

SEQ ID NO: 170567 - RNA, 64 nt, hsa
ccccagagauucccaagccaaaaaccuuagcucccucccgcaccccgauguggaccucuacuuu

SEQ ID NO: 170568 - RNA, 64 nt, hsa
ugccuacguccccuuagaugggcagcagaggcaacucccgcauccuuugcucugccugucagug

SEQ ID NO: 170569 - RNA, 64 nt, hsa
ggcccgaggcagaagggcccaccccgucccuccucucccgcaggucugaaguuggccccccagc

SEQ ID NO: 170570 - RNA, 64 nt, hsa
ggaucuguccagcucauacuuuccuucgcugucccucccgcacuccuuaggcaagauuucccag

SEQ ID NO: 170571 - RNA, 64 nt, hsa
cauaguguagaacagucccggucaguuggccaaccucccgcagccaaguagguucauccuuguu

SEQ ID NO: 170572 - RNA, 64 nt, hsa
ggaucccaacaggcagcaccgcaccucugcccgccucccgcacugcagcuccgcccgccgggcu

SEQ ID NO: 170573 - RNA, 64 nt, hsa
cuccucagcauggccucagugggcgcacccaugccucccgcaguccaggugagcaggggagcaa

SEQ ID NO: 170574 - RNA, 64 nt, hsa
acucucacacugucuccugcaugacggguggcgccucccgcagcuucccuucucucuccagugc

SEQ ID NO: 170575 - RNA, 64 nt, hsa
ccccucugaccccggccugggcuucagccgcuuccucccgcaagcagcccggguccgcacugcg

SEQ ID NO: 170576 - RNA, 64 nt, hsa
cuggcgacacaacugcaccuucccucauuucagucucccgcacacuuauuccuccuccccucuu

SEQ ID NO: 170577 - RNA, 64 nt, hsa
gacaguuucugacaggcgcaacuccuccauuuuccucccgcaggugagaacccuguggagauga

SEQ ID NO: 170578 - RNA, 64 nt, hsa
ugaccccucccucagcuguccugugccccgcccucucccgcacacucagucccccugccuggcg

SEQ ID NO: 170579 - RNA, 64 nt, hsa
ggguggaaacuaagacaccugaacccuccagggccucccgcaucaaggucagcaugaggacaga

SEQ ID NO: 170580 - RNA, 64 nt, hsa
ggucguaggugaugccacugggcgugaugcacggcucccgcaucagcucaaagcugaucuugcc

SEQ ID NO: 170581 - RNA, 64 nt, hsa
cuuccuucuuccccacaacagaagagaccagcgacucccgcaaagggacaagguuccucccucu

SEQ ID NO: 170582 - RNA, 64 nt, hsa
cgaacgguggguggggggcucacccuggugcugccucccgcacaaggagaccuggacacaacag

SEQ ID NO: 170583 - RNA, 64 nt, hsa
acaaauguguacuuuauugauuuucuuucuaauucucccgcauugguggcuugggacuugggag

SEQ ID NO: 170584 - RNA, 64 nt, hsa
cccugacuuuagggaaggugaauguguucccguccucccgcagucagaaaggagacucugccuc

SEQ ID NO: 170585 - RNA, 64 nt, hsa
gccuucaugcacuagccacuuccgcaggugcugacucccgcacucccuggcauuuuuugcagac

SEQ ID NO: 170586 - RNA, 64 nt, hsa
ccgcccagguccccgcuuucuuuggaggcagcagcucccgcagggcugaagucuggcguaagau

SEQ ID NO: 170587 - RNA, 64 nt, hsa
uggccuccuugaugggcaggcuuggaagggacuucucccgcaccccacucugucccaggacaua

SEQ ID NO: 170588 - RNA, 64 nt, hsa
guauuccguuuucuuccugcaugaucccugggcccucccgcaggcugagcaagucuguaaacug

SEQ ID NO: 170589 - RNA, 64 nt, hsa
acgggccaaggagacuccgggcuugagcccaggccucccgcacggcucagcugcugaauuuuuc

SEQ ID NO: 170590 - RNA, 64 nt, hsa
acccccacccagccuccagaagcuggaaccauuucucccgcaggccugaguuccuaaggaaacc

SEQ ID NO: 170591 - RNA, 64 nt, hsa
ugggccccagaagagccacaggaacaucauuccucucccgcaaccacucccaccccagggaggc

SEQ ID NO: 170592 - RNA, 64 nt, hsa
guuggucugcgggggccuuggagcuccugcucuucucccgcaccuccauggaugcacugcugcc

SEQ ID NO: 170593 - RNA, 64 nt, hsa
gcacgguacccggccgccguucugcaaugcaucacucccgcagaggggggugcagaucaggcgc

SEQ ID NO: 170594 - RNA, 64 nt, hsa
ugguuguguagcuucuguugucauugaauacggccucccgcagcaucccacccccaaaccaccg

SEQ ID NO: 170595 - RNA, 64 nt, hsa
uacaggagucuggaguccguugaaggguaaaggccucccgcaagcugccagucggcucuuuuuc

SEQ ID NO: 170596 - RNA, 64 nt, hsa
gucacugaacagaacgucgcugauggagaaagggcucccgcagaaggaacggccuguaccgugc

SEQ ID NO: 170597 - RNA, 64 nt, hsa
aggcgguuucggggcucccccuuccucucccucccucccgcagaaggggguuuuaggggccugg

SEQ ID NO: 170598 - RNA, 64 nt, hsa
gaggggcuuccgagccccugagagcggacaucuccucccgcaggccuuuacuccgcacucccca

SEQ ID NO: 170599 - RNA, 64 nt, hsa
uccggcaccccccaaucccccaacacgccugucccucccgcauggccaccaaggagcuggaccu

SEQ ID NO: 170600 - RNA, 64 nt, hsa
cuccugccacuugccccugaccccccugccgugccucccgcagcccucccaugccguuccacuc

SEQ ID NO: 170601 - RNA, 64 nt, hsa
cacacgggccaagguacccacaggaucccauccccucccgcacagcccugggccccagcaccuc

SEQ ID NO: 170602 - RNA, 64 nt, hsa
ggacggggcccgccccaggccccagcagucuccgcucccgcagcgggcgcgggacaggacuugu

SEQ ID NO: 170603 - RNA, 64 nt, hsa
uggggccuggccucgcccacgguggauccggggccucccgcacagucggccacgcccgcugcgg

SEQ ID NO: 170604 - RNA, 64 nt, hsa
caggccggggaucuggggagggcuagcccaaaaccucccgcaucgggcaggcacccccugaagu

SEQ ID NO: 170605 - RNA, 64 nt, hsa
uggccaaggaccagugccaccuuauggcaaagagcucccgcaguguuuguuagagugcacaucc

SEQ ID NO: 170606 - RNA, 64 nt, hsa
gccgccggcgccgcccgggucccugcagcgcuuccucccgcagcccccgcgaccgauccgaccg

SEQ ID NO: 170607 - RNA, 64 nt, hsa
cgagauuaacggugcuaaccccgucugcuccucccucccgcagagacuggggccuggacuggac

SEQ ID NO: 170608 - RNA, 64 nt, hsa
aagacuccugagaacaggcagcccaguccugcgacucccgcauccccaggaccagacaccuggg

SEQ ID NO: 170609 - RNA, 64 nt, hsa
cuugccucaguucuucccucugagcccccaggcccucccgcaucucagguuggggauggggaca

SEQ ID NO: 170610 - RNA, 64 nt, hsa
cuggugcgcacagcccuugucggugccccggccccucccgcagcguuacugccuguguauagua

SEQ ID NO: 170611 - RNA, 64 nt, hsa
ggccugcagcagaagugugcccagcguuucucggcucccgcaccccuuuucccuuauggcucug

SEQ ID NO: 170612 - RNA, 64 nt, hsa
aggaccagccgcgugcacuggauugcggaggagccucccgcagcacugguccgggacaagauga

SEQ ID NO: 170613 - RNA, 64 nt, hsa
gcuggccauccguggaggaggggccgguccuggacucccgcaggacuccucugaggcagggccu

SEQ ID NO: 170614 - RNA, 64 nt, hsa
accaacuacccuuaggucuacagcucucaugagucucccgcacucagccuuuagcaauucauua

SEQ ID NO: 170615 - RNA, 64 nt, hsa
uccagauugaccuuauaaauaaaagaaugcccaccagauugaaauccuagaaauacagaaaauu

SEQ ID NO: 170616 - RNA, 64 nt, hsa
uaacucacucagagacacaugguaacacauacuccagauugaccuuauaaauaaaagaaugccc

SEQ ID NO: 170617 - RNA, 64 nt, hsa
uuaauguuuaauuuaaucuuaauaccaaaacgaccagauugaaguuugacuuuuauugucacaa

SEQ ID NO: 170618 - RNA, 64 nt, hsa
uuccuucccgucuuagccucacccccuugucaaccagauugaguugcuauagcuugaugcaggg

SEQ ID NO: 170619 - RNA, 64 nt, hsa
ggcuuuacaauauacggauuggcuuuuugugacccagauugauugguugccacauguuauguuu

SEQ ID NO: 170620 - RNA, 64 nt, hsa
aagccauagcacacaucuuaccuuuccaaguaaucagauugagaaaacccuaugaguauuccag

SEQ ID NO: 170621 - RNA, 64 nt, hsa
guguguuacacaccugacuuaacaucucuaaacucagauugaaaagagaccgaaugugcagauu

SEQ ID NO: 170622 - RNA, 64 nt, hsa
caauaacacucaaugaaggauguauuaaaauuuuugacuuaauuuugaaaucguauauaugagc

SEQ ID NO: 170623 - RNA, 64 nt, hsa
ccuagcauagagaaaauacuuaauacacauuuguugacuuaaauuuaauucaaggauugaaaaa

SEQ ID NO: 170624 - RNA, 64 nt, hsa
uuguuaacuguagcuucagcgcgugccaagcaguugacuuaauaggaucaucuugugaauuugu

SEQ ID NO: 170625 - RNA, 64 nt, hsa
ugguggaaauucaaaguuaucacugaagaacaguugacuuaaaauuggaccaagacuaugaggc

SEQ ID NO: 170626 - RNA, 64 nt, hsa
aaaaaucuccaagcuugugcuuacacaugaagccugacuuaacuguaugugcaacagcaaugaa

SEQ ID NO: 170627 - RNA, 64 nt, hsa
cucuuuucuugaccuaguauaaugacaacugcagugacuuaaguuuuugcuguuuucguuuucc

SEQ ID NO: 170628 - RNA, 64 nt, hsa
ccaucuucccacacaucucauugaauuugaugguugacuuaauuggcaccauaacuuuguauga

SEQ ID NO: 170629 - RNA, 64 nt, hsa
aaucagaagacugcuuaugguuuuaaaauugcaaugacuuaaauaaugagguuguuaauuagag

SEQ ID NO: 170630 - RNA, 64 nt, hsa
ccucccuaauccuauuaucuuucaaugguuaccuugacuuaaccuauugaguuaccuggucagc

SEQ ID NO: 170631 - RNA, 64 nt, hsa
ugccagcucaaaucuacaguagccaccaaaaccaugacuuaauauuuugagcccuagaagaaag

SEQ ID NO: 170632 - RNA, 64 nt, hsa
gacuuagugcagagaagcuuggcaguacguucuuugacuuaaggauggcauaaaauaaucauuu

SEQ ID NO: 170633 - RNA, 64 nt, hsa
uugcaauucuuucuggggauauauugguacaacaugacuuaaaacuuuuuuuuuucuauuaaaa

SEQ ID NO: 170634 - RNA, 64 nt, hsa
gaacuauaguaaaaugauaaacacuaaauauacuugacuuaauaugccaaugagguaggccuga

SEQ ID NO: 170635 - RNA, 64 nt, hsa
uguuuuuuccuuugcucuuucccccuuccaucucugacuuaagcaaaagaaaaagauuacccaa

SEQ ID NO: 170636 - RNA, 64 nt, hsa
uuuguaguuuuuuuuuuuuuuaugugaucaauuuugacuuaaugugauuacugcucuauuccaa

SEQ ID NO: 170637 - RNA, 64 nt, hsa
guggugaccccucagggguuucauuguuuccuucugacuuaagcaauagagagagaauuuguuu

SEQ ID NO: 170638 - RNA, 64 nt, hsa
agcaaauggcaacaacuuagaagaaaucauuuagugacuuaauucuuucuaaagaugaaauggg

SEQ ID NO: 170639 - RNA, 64 nt, hsa
gcuguuggcugucaucuugaacucuauuugaaugugacuuaaaucacaaguaacguguuuuguu

SEQ ID NO: 170640 - RNA, 64 nt, hsa
cauucagcuguuuuaacacagaaauucaaaauagugacuuaacauggaagcuauuucucucuua

SEQ ID NO: 170641 - RNA, 64 nt, hsa
gauuuuggucguucuucagauguuuggcucugaaugacuuaagcugaaguaacuggcuccuuac

SEQ ID NO: 170642 - RNA, 64 nt, hsa
gagguuugcuuucuaaacaagugcauucugaaauugacuuaaaaauuuuuaguguggguccuaa

SEQ ID NO: 170643 - RNA, 64 nt, hsa
uuuagaguucacacaauaggauauaaguccuguaugacuuaaauagugaauuuuguccuuaaca

SEQ ID NO: 170644 - RNA, 64 nt, hsa
uguuuuuacugccauaguuuuauaaccaaaaucuugacuuaaaauuuuccggggaacuacuaaa

SEQ ID NO: 170645 - RNA, 64 nt, hsa
agccauuggauaauacugaaucuguuucccuaagugacuuaaccuuagagcaagcacaacaucc

SEQ ID NO: 170646 - RNA, 64 nt, hsa
gcugugccugugacuccagaguccuaucuuacugugacuuaaaguuugauggagagaaagcugu

SEQ ID NO: 170647 - RNA, 64 nt, hsa
cuucaucacaucuuauagguaguguguggccaauugacuuaaaaaauacaaauaacauuuagga

SEQ ID NO: 170648 - RNA, 64 nt, hsa
augcucccauggaauuuauaccaguuauaugaauugacuuaaguaucuugaaaaagaaacuuua

SEQ ID NO: 170649 - RNA, 64 nt, hsa
aauaugugagacuuuucauuuaaaaaaagucaaaugacuuaauucuguauuuuaaauucuguuu

SEQ ID NO: 170650 - RNA, 64 nt, hsa
ucagagucaaaucagcauugaccugaguuugaguugacuuaacauugauuucaagcauuaaucg

SEQ ID NO: 170651 - RNA, 64 nt, hsa
ccuguugcaggcacacugcagugguuuuccugcagcucuccaacaaacgccugagucacaggcc

SEQ ID NO: 170652 - RNA, 64 nt, hsa
cgaggcaugaagcaaagagcugagugaguccucugcucuccagaggaccaagaaauaccugugu

SEQ ID NO: 170653 - RNA, 64 nt, hsa
aggcggagguugcaugagccgagauggcgccacugcucuccagccuggacgacagagcaagacu

SEQ ID NO: 170654 - RNA, 64 nt, hsa
ccacuccaggcaaaguagugaaggaaaaaagccugcucuccaguagccuggccugucagccugg

SEQ ID NO: 170655 - RNA, 64 nt, hsa
gacaagcccgggacaacagccagugggcaucacggcucuccagcacuccuuagccggaggauac

SEQ ID NO: 170656 - RNA, 64 nt, hsa
ucaggagguggaggccggugaggucaggagcccagcucuccagggggcuucugcccugacuggg

SEQ ID NO: 170657 - RNA, 64 nt, hsa
guuauuuuguuguccuuuaugguucuuuaggaaagcucuccaagcuuggcauuugucagggugg

SEQ ID NO: 170658 - RNA, 64 nt, hsa
ugggcugacugguguagguuugguaggccucacugcucuccagaggcuaguguuccuaucccag

SEQ ID NO: 170659 - RNA, 64 nt, hsa
aggcccuggucuccuccgagucguaccugcagcggcucuccauggccuccagcggcucccucug

SEQ ID NO: 170660 - RNA, 64 nt, hsa
aggaaauccccguggugcgcaacagcaccgugcugcucuccaugacccaugaagaccaaaagcu

SEQ ID NO: 170661 - RNA, 64 nt, hsa
ccgagcagcgcuuggugacagccuguccucuccugcucuccaaaggcccugcucccuguccucu

SEQ ID NO: 170662 - RNA, 64 nt, hsa
guccucuuuucggcaaaguuggagcgagugccaagcucuccaucugugguccuuucugccaaga

SEQ ID NO: 170663 - RNA, 64 nt, hsa
cuaguucagaauccggagcaguaaguggagaagagcucuccacgagugcucagucuuagaacua

SEQ ID NO: 170664 - RNA, 64 nt, hsa
accaaauucaacagaacaccaggaaggucaagacgcucuccaaagggcaggaaguacagcacuu

SEQ ID NO: 170665 - RNA, 64 nt, hsa
ucacugcugcacuuuccaaggugcuaagauugcugcucuccaaugcuaacuuucugacacagug

SEQ ID NO: 170666 - RNA, 64 nt, hsa
uuucaaagauuaaguaggaggagagggguuucuugcucuccagagcccaaagggacaaauaggg

SEQ ID NO: 170667 - RNA, 64 nt, hsa
gagcauggagauuuuucuuaaauaauaauauugugcucuccaccucacccuuguguaaacccuc

SEQ ID NO: 170668 - RNA, 64 nt, hsa
uaaaauaggguuugaaacaugccacaggaagguugcucuccaaaaauacacagugcagugcaag

SEQ ID NO: 170669 - RNA, 64 nt, hsa
gggucaccagccaggcaccugugacacgagugcugcucuccaggaucuccacuacauguuccag

SEQ ID NO: 170670 - RNA, 64 nt, hsa
acugcuaaacaucccagagauuugcaaucuucuagcucuccaggugagcagaaagaccaaauau

SEQ ID NO: 170671 - RNA, 64 nt, hsa
gcauuccugucccccucggccccaggcuggcucagcucuccagugcugcggcgcugucuuugca

SEQ ID NO: 170672 - RNA, 64 nt, hsa; identical to SEQ ID NO: 85985

SEQ ID NO: 170673 - RNA, 64 nt, hsa; identical to SEQ ID NO: 85986

SEQ ID NO: 170674 - RNA, 64 nt, hsa; identical to SEQ ID NO: 85987

SEQ ID NO: 170675 - RNA, 64 nt, hsa; identical to SEQ ID NO: 85988

SEQ ID NO: 170676 - RNA, 64 nt, hsa; identical to SEQ ID NO: 85989

SEQ ID NO: 170677 - RNA, 64 nt, hsa; identical to SEQ ID NO: 85990

SEQ ID NO: 170678 - RNA, 64 nt, hsa
uccuaggagagccaaccucggcuugugggcuggugccccacagcuaccugagacgggcaucgca

SEQ ID NO: 170679 - RNA, 60 nt, hsa
cacgccccugccccucguaggcaccugccugccccacacggacucccgggccacgcccca

SEQ ID NO: 170680 - RNA, 64 nt, hsa
cugaaaaaaggagcccaaugaagcuaagcgccacgccccacaaggggucauauuggcuuuaguu

SEQ ID NO: 170681 - RNA, 64 nt, hsa
uuuucacaguuucauugauugacucuaccuccuugccccacaccacuuuugcaaucuuuaaacu

SEQ ID NO: 170682 - RNA, 64 nt, hsa
gucacugccacauggagucuugccaugccugugugccccacagaccuaauauauguccggacag

SEQ ID NO: 170683 - RNA, 64 nt, hsa
agccacugucaugcaggucauaucagaucugagugccccacagagucacagugugucuggacag

SEQ ID NO: 170684 - RNA, 64 nt, hsa
ugggggaagguuucagccucuccccacuccccuugccccacacccuuuacuccccagcccagag

SEQ ID NO: 170685 - RNA, 64 nt, hsa
uauccgaggccuuucccugcccagucuggugccugccccacauuguaccggacacuggauuccu

SEQ ID NO: 170686 - RNA, 64 nt, hsa
agaggugcucugacccuagguuacacgggaaagugccccacaugcaagucucccugaggguucu

SEQ ID NO: 170687 - RNA, 64 nt, hsa
cagguuucuacagugaggaacaggcguuucccaggccccacacccagauuucucuaucuuugcu

SEQ ID NO: 170688 - RNA, 64 nt, hsa
uguugggagcagaggaguccuacuccuugccucagccccacacgguuccuuagcugccgugugg

SEQ ID NO: 170689 - RNA, 64 nt, hsa
uuggcuacccuggccgugccuggcagccccucaggccccacagguggguccugguugugaagug

SEQ ID NO: 170690 - RNA, 64 nt, hsa
gcuuguagguggguggugugcauaggccacgugugccccacauaugcagggggugccccacaca

SEQ ID NO: 170691 - RNA, 64 nt, hsa
cauaggccacgugugccccacauaugcagggggugccccacacagcuagagcggccaggagagc

SEQ ID NO: 170692 - RNA, 64 nt, hsa
gucuguggccccacaacgugggcuuaaagcagaagccccacagccuggcacgaaggccccgccu

SEQ ID NO: 170693 - RNA, 64 nt, hsa
ggugauguaaaaaugcuuccacugcaagucuguggccccacaacgugggcuuaaagcagaagcc

SEQ ID NO: 170694 - RNA, 64 nt, hsa
aaccucaugaggcuguggccaaccccugccccuugccccacacagaccaggccuuaaaugucgg

SEQ ID NO: 170695 - RNA, 64 nt, hsa
ccacucugacaagucuucagcccacacccugccagccccacagauuuuauuuuugcacauaagc

SEQ ID NO: 170696 - RNA, 64 nt, hsa
agaacccgcccaagcgccaccugcuagacggccagccccacacuucgcuucagccuccggacca

SEQ ID NO: 170697 - RNA, 64 nt, hsa
aacacacauggccucgccaucguggguaaaaucggccccacagcacgucugcaccagcgggccg

SEQ ID NO: 170698 - RNA, 64 nt, hsa
ggugucuucacaccugacgaugagccaggccugagccccacacaggccagggcacauucuugga

SEQ ID NO: 170699 - RNA, 64 nt, hsa
auuguuugcuugcuugaaaccuaaucuauagacggccccacagcucgugcacacacugcuuccc

SEQ ID NO: 170700 - RNA, 64 nt, hsa
gccgucuaggagaaccuguggucacugggaacgugccccacagugacuggccaugcaaccaggu

SEQ ID NO: 170701 - RNA, 64 nt, hsa
uggagccgagucaggccacuauggggaagcaguugccccacaaaaugugguuugcugaccuauu

SEQ ID NO: 170702 - RNA, 64 nt, hsa
ggcuggccgcgcaccggggcucgggcacccucuggccccacacuggcaaugaugccacaccuug

SEQ ID NO: 170703 - RNA, 64 nt, hsa
aaaucagcuuuaaggagcuggcagaaagcccccagccccacagcccugagagaugguguugcua

SEQ ID NO: 170704 - RNA, 64 nt, hsa
uuaggacccccagagccaagguggcugggaucuggccccacagauggggaaagauggggaaggg

SEQ ID NO: 170705 - RNA, 64 nt, hsa
gcgacuccauaugcaaucaguagcgagcagccgggccccacagacccucaugcacucucuuacg

SEQ ID NO: 170706 - RNA, 64 nt, hsa
acaccccagacgagagccucacaggagggagggggccccacaggcuccccaggaggcucguguc

SEQ ID NO: 170707 - RNA, 64 nt, hsa
ggagucucaccuguuugcauggagaaaugggcuggccccacagccucacaggagcaguuugugg

SEQ ID NO: 170708 - RNA, 64 nt, hsa
gaccaucaccuggcucaucguuuccaccaagagugccccacaggagugccccacagacccgcug

SEQ ID NO: 170709 - RNA, 64 nt, hsa
cucaucguuuccaccaagagugccccacaggagugccccacagacccgcuggaccagccugcug

SEQ ID NO: 170710 - RNA, 64 nt, hsa
ugguccucaucucucccaccuccguucccucugggccccacacuagccacagcgcgggccuugu

SEQ ID NO: 170711 - RNA, 64 nt, hsa
ccucagggaccacccuccccacaguaugcacucagccccacagaacccaccagucuuucuggga

SEQ ID NO: 170712 - RNA, 64 nt, hsa
cagcuugaggccccuccuucugcugccuggccaagccccacacccgcagacccuccuucccauc

SEQ ID NO: 170713 - RNA, 64 nt, hsa
uccaggcuuugcuguuccccagcagccugcagaggccccacagacagcuugaggccccuccuuc

SEQ ID NO: 170714 - RNA, 64 nt, hsa
ugaguguaagcaaugugggaaagccuucagaugugccccacaccuucgaaggcaugguaggacu

SEQ ID NO: 170715 - RNA, 64 nt, hsa
cgaguguaagcaaugugggaaagccuucagaucugccccacaccuucgaauccaugguagaacu

SEQ ID NO: 170716 - RNA, 50 nt, hsa
ccucccagggccuggucugagccccacacggccaucugcccaguccuuga

SEQ ID NO: 170717 - RNA, 64 nt, hsa
gggggcagcagcccuucccgggggccuacccagugccccacagcagaacccgugggcgcucgug

SEQ ID NO: 170718 - RNA, 64 nt, hsa
ggcacuagaaaaggcccccacuggcugccugggagccccacaccaccgggccagugcaggcacu

SEQ ID NO: 170719 - RNA, 64 nt, hsa
cucauccacaggguuuucucacugcuaugaaccagccccacagccccaggccccugucaccugg

SEQ ID NO: 170720 - RNA, 64 nt, hsa
augccccauccaccgcaugcggugcccguggcccgccccacaccaccgccgccugcagaccucu

SEQ ID NO: 170721 - RNA, 64 nt, hsa
ccuguacuaccuccugggccaagaaacuggcacagccccacacugucagugccaagaggcugcg

SEQ ID NO: 170722 - RNA, 64 nt, hsa; identical to SEQ ID NO: 89720

SEQ ID NO: 170723 - RNA, 64 nt, hsa; identical to SEQ ID NO: 89721

SEQ ID NO: 170724 - RNA, 64 nt, hsa; identical to SEQ ID NO: 89722

SEQ ID NO: 170725 - RNA, 64 nt, hsa; identical to SEQ ID NO: 89723

SEQ ID NO: 170726 - RNA, 64 nt, hsa; identical to SEQ ID NO: 89724

SEQ ID NO: 170727 - RNA, 64 nt, hsa; identical to SEQ ID NO: 89725

SEQ ID NO: 170728 - RNA, 64 nt, hsa; identical to SEQ ID NO: 89726

SEQ ID NO: 170729 - RNA, 64 nt, hsa; identical to SEQ ID NO: 89727

SEQ ID NO: 170730 - RNA, 64 nt, hsa; identical to SEQ ID NO: 89728

SEQ ID NO: 170731 - RNA, 64 nt, hsa; identical to SEQ ID NO: 89729

SEQ ID NO: 170732 - RNA, 64 nt, hsa; identical to SEQ ID NO: 89730

SEQ ID NO: 170733 - RNA, 64 nt, hsa; identical to SEQ ID NO: 89731

SEQ ID NO: 170734 - RNA, 64 nt, hsa
uacuguagccuuuuaacagcaagucuugcuuucccaaacagaaagccauucugaaacccuacag

SEQ ID NO: 170735 - RNA, 64 nt, hsa
uuguuuguuuguuuguuuucuuaggcgggaacugcaaacagacucuuuucugagacuauuuauc

SEQ ID NO: 170736 - RNA, 64 nt, hsa
uuacuucuacggaauaguuuuugcucauggaacucaaacagaugaagcaccacuguuacagaau

SEQ ID NO: 170737 - RNA, 64 nt, hsa
caucuguacauaguuuucuaaaauguauauaauucaaacagagcaucuuguaacugaagacaca

SEQ ID NO: 170738 - RNA, 64 nt, hsa
gaugauaagccuaaaaaaagcacaauuauuaaaacaaacagauccauguuaggacauuucugaa

SEQ ID NO: 170739 - RNA, 64 nt, hsa
aaggaaucugaagcacaggagaacacagagccaacaaacagaaugaagaacaaucaucuauuuu

SEQ ID NO: 170740 - RNA, 64 nt, hsa
ucuucuuacugucccacagcuugguuucauguuacaaacagaaaagcucgaggcucccaccccg

SEQ ID NO: 170741 - RNA, 64 nt, hsa
auuaaaacaacaacaacaacaacaacaacaacaacaaacagaaggauaaacuggcuugccugug

SEQ ID NO: 170742 - RNA, 64 nt, hsa
uggggcuuuuuuucaggguccugaaacuuugugucaaacagacaaugcaggggcaggguguggu

SEQ ID NO: 170743 - RNA, 64 nt, hsa
cagcagggucuaacugugcuuacuuagcccaguucaaacagaacaaaggaaaaauauagaaagc

SEQ ID NO: 170744 - RNA, 64 nt, hsa
uugacaaucugggcaaggcuuguggggcgcuugacaaacagaaucugcccugugccgccugguu

SEQ ID NO: 170745 - RNA, 64 nt, hsa
aaucuggaauuaacuuuagccaguggaauuucuucaaacagagaaagagaggcuguucauugau

SEQ ID NO: 170746 - RNA, 64 nt, hsa
ugcucugauuaacuaguauucaaucaccaacuugcaaacagaauucauaacacuuggcacuugu

SEQ ID NO: 170747 - RNA, 64 nt, hsa
uaaccuuugaaaauauuauaacuggauauuucuucaaacagauguccuggaugaugguccauaa

SEQ ID NO: 170748 - RNA, 64 nt, hsa
gcagauguuuuuucuuuuaacaaacuggaauuuucaaacagauuaucuguauuuaaauguauag

SEQ ID NO: 170749 - RNA, 64 nt, hsa
gaccagugacaauggauagaaugggcuguguuuccaaacagauugacuugucaaagacucucuu

SEQ ID NO: 170750 - RNA, 64 nt, hsa
gaauagcuguagcaaaugacugaauacaugugaacaaacagaaggaaguucacucuggaguguc

SEQ ID NO: 170751 - RNA, 64 nt, hsa
acauguauuucuuaaaagacuagauucuauggaucaaacagagguugaugcaaaaacaccacug

SEQ ID NO: 170752 - RNA, 64 nt, hsa
augaaacuuuuucuaagcacuauucuauugcacacaaacagaaaaccaaagccuuauuagaccu

SEQ ID NO: 170753 - RNA, 64 nt, hsa
cggacagacagacacagccugaaacagacccagacaaacagacagacagacacagccugaaaca

SEQ ID NO: 170754 - RNA, 64 nt, hsa
uagacagacagacacagauugaaacagacccagacaaacagacagacacagccugaaacagacc

SEQ ID NO: 170755 - RNA, 64 nt, hsa
augcagcaggugcucagcaauauggaaaugggaccaaacagagggagucuccacagcuccccgu

SEQ ID NO: 170756 - RNA, 64 nt, hsa
ucaagucaggaaauagaaaccacacuagguauuucaaacagaggggauauaaguuagggacuga

SEQ ID NO: 170757 - RNA, 64 nt, hsa
cuuucacauaaaaucacaaaacuacaggacaguacaaacagauugccagagaaaucugggucaa

SEQ ID NO: 170758 - RNA, 64 nt, hsa
gacauuacaguuaaauuucccaauugaaaacaagcaaacagacacucaaacugguccuguaauu

SEQ ID NO: 170759 - RNA, 61 nt, hsa
aaguggauuuuuaaaaaguguuuuagcaauacuccuuaaccaaauaaaccuucggagaacg

SEQ ID NO: 170760 - RNA, 61 nt, hsa
accaauuaugaggacugacauccuggccacucuccuuaaaauaaacacugacauuuuucuu

SEQ ID NO: 170761 - RNA, 61 nt, hsa
augggcacagagcaucacaugagcuguuucucuccuuaaagaagaucccuggaaaggaugc

SEQ ID NO: 170762 - RNA, 61 nt, hsa
uaggccauaucaacuuuggccaucaauaucucuccuuaaacaauuauauuucaccuuuuag

SEQ ID NO: 170763 - RNA, 61 nt, hsa
gaaucugaaagagcauuauuccuggucaaagcuccuuaaaguucugggcagcuaaaagcau

SEQ ID NO: 170764 - RNA, 61 nt, hsa
caagaaaaaaaaaaaaucucuccccaaugcucuccuuaaccuuuaagucuuacaggaagcc

SEQ ID NO: 170765 - RNA, 61 nt, hsa
auuauugugaaaauauuauuaacacuggggacuccuuaagaguacaucagaguucucucua

SEQ ID NO: 170766 - RNA, 61 nt, hsa
uuucuuagccuccauaaucacaugagccaaucuccuuaauaaaugccugcucauagaucug

SEQ ID NO: 170767 - RNA, 61 nt, hsa
agcugcuuucuucuuacaccccggucucaugcuccuuaauggcgccaugggugcuuguugg

SEQ ID NO: 170768 - RNA, 61 nt, hsa
acuccaaccauucaaaaauuucaccccaucccuccuuaagagauuggaucaaguauuacua

SEQ ID NO: 170769 - RNA, 61 nt, hsa
agguuaagauauagcuagugucugaacgacacuccuuaaaguaaguuccaaauguaaaaca

SEQ ID NO: 170770 - RNA, 61 nt, hsa
acuccuuaaaguaaguuccaaauguaaaacacuccuuaaguuccaaauguuuuccgcuaau

SEQ ID NO: 170771 - RNA, 61 nt, hsa
ucuuuauaaaugaauuuuguguucuuuaguucuccuuaaaagaacuuuugaauuauaaaaa

SEQ ID NO: 170772 - RNA, 61 nt, hsa
uagggcugccauggucacaagcacacugaugcuccuuaagauuguuuaucuggagcccaca

SEQ ID NO: 170773 - RNA, 61 nt, hsa
auaugucacacuccuuaauagggaccugugacuccuuaauaaggaccugugacaugcccag

SEQ ID NO: 170774 - RNA, 61 nt, hsa
ucuaccaagacacucaauggaauaugucacacuccuuaauagggaccugugacuccuuaau

SEQ ID NO: 170775 - RNA, 64 nt, hsa
ucugagaauucuaggaagaauaauaaaaucucguguauuccacagcaaacuuacauaccauaaa

SEQ ID NO: 170776 - RNA, 64 nt, hsa
uaaaaugauauucuuaaaauuuuuucccaccaagguauuccaaagaaaauauuaaggucucccc

SEQ ID NO: 170777 - RNA, 64 nt, hsa
cagaucuuuauuuuaucccaccuucuugucuucuguauuccacucuucuuauguucuuucccuu

SEQ ID NO: 170778 - RNA, 64 nt, hsa
ucuauaauguaaaagaaauuuucuuucuuuugagguauuccauaaaaguaguugggaaaauuau

SEQ ID NO: 170779 - RNA, 64 nt, hsa
ugcucauguggagacuggcuauaaacugaaaaguguauuccaaauugcagaacacaucacacau

SEQ ID NO: 170780 - RNA, 64 nt, hsa
augugaguuggcaaguuccucacauagagucauuguauuccaccuguccuucaauuuaguuuuu

SEQ ID NO: 170781 - RNA, 64 nt, hsa
uuccauauaccauauauguauauauuccacauauguauuccauauauauauuccauauguauau

SEQ ID NO: 170782 - RNA, 64 nt, hsa
cauauguauacauuccauguauguaugcauauauguauuccauauauguauauauuccauauac

SEQ ID NO: 170783 - RNA, 64 nt, hsa
auauauuccacauguguauauauuccacguguauguauuccacauguauauauuccacauaugu

SEQ ID NO: 170784 - RNA, 63 nt, hsa
acggccccugccguggggcucacucugcagcuggagagacagcauaccugaaaccugcaagga

SEQ ID NO: 170785 - RNA, 63 nt, hsa
aaaacaacagaacagccaggaaaauggugcuaggagagacaguggagaggccagagaagcaaa

SEQ ID NO: 170786 - RNA, 63 nt, hsa
gaaauuucuaccaagcguuuucauggaugcuaugagagacaauccugaagcugcuguacauau

SEQ ID NO: 170787 - RNA, 63 nt, hsa
ggcgaccuuggcuaucagacuugaaauauucacgagagacaauaaacgcugaaaggccagugc

SEQ ID NO: 170788 - RNA, 63 nt, hsa
auacuuauuaaguucgaacauguuucacuuaaggagagacaccuagcuuagucauggcaaguu

SEQ ID NO: 170789 - RNA, 63 nt, hsa
ggaauauaaauauuugguaauucuguguaacaagagagacauggaaaaggaaaaaaauccacu

SEQ ID NO: 170790 - RNA, 63 nt, hsa
guugagagacacagcugcuacgugauagauguugagagacagaagccaacgaaggaggucauu

SEQ ID NO: 170791 - RNA, 63 nt, hsa
cucacugccuccagagaggugggugccuggguugagagacacagcugcuacgugauagauguu

SEQ ID NO: 170792 - RNA, 63 nt, hsa
aagguuuauggauuugacagggugcaugucacagagagacaguucucagucagcacuuccugu

SEQ ID NO: 170793 - RNA, 63 nt, hsa
uuccaagaaugugaaucuugccaagcuguccgugagagacacgggcuccccucgagggagacu

SEQ ID NO: 170794 - RNA, 63 nt, hsa
ccuugcugcaggccggguggccaauccaggugggagagacacucccagggacaagggaaggaa

SEQ ID NO: 170795 - RNA, 63 nt, hsa
uuaccugccacuuccaggagcccagagggccaagagagacauugccuccaccucuccuuggaa

SEQ ID NO: 170796 - RNA, 63 nt, hsa
ucucaaauaggcuugguggccuguggaaaagaagagagacagagagacagugucugaaacagg

SEQ ID NO: 170797 - RNA, 63 nt, hsa
aggcuugguggccuguggaaaagaagagagacagagagacagugucugaaacaggauggcaga

SEQ ID NO: 170798 - RNA, 63 nt, hsa
uguguguguguguguguguaugagagagagagagagagacaacagagacagagagaggcagag

SEQ ID NO: 170799 - RNA, 63 nt, hsa
gacaacagagacagagagaggcagagaggcauagagagacagagagagagacaagaaacagag

SEQ ID NO: 170800 - RNA, 63 nt, hsa
agagagaggcagagaggcauagagagacagagagagagacaagaaacagagauagacagaaaa

SEQ ID NO: 170801 - RNA, 63 nt, hsa
cuccggagugagaagcuuugcccuccuaagagagagagacagagagacagagagagagaaaga

SEQ ID NO: 170802 - RNA, 63 nt, hsa
ugagaagcuuugcccuccuaagagagagagacagagagacagagagagagaaagagagagugu

SEQ ID NO: 170803 - RNA, 63 nt, hsa
agagagggagagaggcagagagggagagaggcagagagacagagagggagagagggacagaga

SEQ ID NO: 170804 - RNA, 63 nt, hsa
ggagacagagagggagagagagacagagggagagagagacagaggggaagagaggcagagagg

SEQ ID NO: 170805 - RNA, 63 nt, hsa
gagggagagaaacagaggagacagagagggagagagagacagagggagagagagacagagggg

SEQ ID NO: 170806 - RNA, 63 nt, hsa
gagguggggagaggggagagagauaugaggagagagagacagaggaggcagagagggagagaa

SEQ ID NO: 170807 - RNA, 63 nt, hsa
cuuguuccagugacaguuggaaggccucugcuggagagacaccagcucucagggcagagauug

SEQ ID NO: 170808 - RNA, 63 nt, hsa
auauguccucaggccagauacugauugcuaguagagagacacccggcacccaguccgaagccc

SEQ ID NO: 170809 - RNA, 64 nt, hsa
uacacaaugccuuguacaugauauagaggcaucaagcaaguaaaauuugacagaaauuuuaaaa

SEQ ID NO: 170810 - RNA, 64 nt, hsa
uuuaaauggucacccauguauuuauuuguugccaagcaaguaaaaaaauacccuaacaaaccug

SEQ ID NO: 170811 - RNA, 64 nt, hsa
uuaaguuauauauuaaaagcuuauguaacauaaaagcaaguacauauaguagugacuauauuua

SEQ ID NO: 170812 - RNA, 64 nt, hsa
aaucuuaugaauguuaaccuuuccguuuauuacaagcaaguacuauuauuucugauuuuauaau

SEQ ID NO: 170813 - RNA, 64 nt, hsa
ggguacaaaaagcaauguguacaagaagacuuucagcaaguauacagagaguucaccucuacuc

SEQ ID NO: 170814 - RNA, 64 nt, hsa
caccucuacucugcccuccucauagucauaauguagcaaguaaagaaugagaauggauucugua

SEQ ID NO: 170815 - RNA, 64 nt, hsa
aagaaguuauguauucauccaauaauucaagccaagcaaguauauagguguuuuaauaguuuuu

SEQ ID NO: 170816 - RNA, 64 nt, hsa
gaauuuaggguugggguacaauuuguuucuauuaagcaaguaccaguuuaccaauacaugagua

SEQ ID NO: 170817 - RNA, 64 nt, hsa
uugaacaauuuuguuccauucugaguaacuuuugagcaaguaauucuaagcuuugucuuguauc

SEQ ID NO: 170818 - RNA, 64 nt, hsa
gaucuuaauguaaaauaguaaauguccauugaaaagcaaguaauacagccugugcuaauuggga

SEQ ID NO: 170819 - RNA, 64 nt, hsa
aaaagauguaaacauauauuaagcuauauuaaaucucacauacaguucuucugugcucuauuau

SEQ ID NO: 170820 - RNA, 64 nt, hsa
ugggcuggcugggaugccucuggcuggugaaguucucacauaggcugauuuaaauccagcaaag

SEQ ID NO: 170821 - RNA, 64 nt, hsa
uagcuuuuucuuucuagauguauuccccaacaugcucacauacacagaucuuucccuuuccuua

SEQ ID NO: 170822 - RNA, 64 nt, hsa
uuauguucaauggguauuuuuuuacauauacauacucacauauuauaucauggugauuaugaug

SEQ ID NO: 170823 - RNA, 64 nt, hsa
ucucugugcuggccugaaaccagugacucaucuucucacauagguguugucaagugauauuuga

SEQ ID NO: 170824 - RNA, 64 nt, hsa
uagcuuuuaaaaacugaaaaaaaaaaaugaaugacucacauagagguugagccaaugacugugg

SEQ ID NO: 170825 - RNA, 64 nt, hsa
uugucucuaguaaaaauacaaaaauauaugaaaucucacauagaugauaauauuaaguuccaaa

SEQ ID NO: 170826 - RNA, 64 nt, hsa
cauuugcauaauaagauuagggugggguggccagcucacauagggguaggcccuagguaaauca

SEQ ID NO: 170827 - RNA, 64 nt, hsa
aaagaaaaaaaauuauuaaauguuucucacauaucucacauauaauguaauuucccuaaaugaa

SEQ ID NO: 170828 - RNA, 64 nt, hsa
uuucuuaaaaaagaaaaaaaauuauuaaauguuucucacauaucucacauauaauguaauuucc

SEQ ID NO: 170829 - RNA, 64 nt, hsa
gaacaacuaucuuuguauuuuguuuuuaaaauguguuuaauaaaugauccuuuguaaauaacuu

SEQ ID NO: 170830 - RNA, 64 nt, hsa
aucguuuacacagagagaugacuauggcagugauguuuaauauuauuaaauccaggcauuucga

SEQ ID NO: 170831 - RNA, 64 nt, hsa
auaaauaaguuuaaauaucaauuuggggaguaagguuuaauauugccaucggguauugagacag

SEQ ID NO: 170832 - RNA, 64 nt, hsa
uuuugauaugcaucaaguggcauuuuguuccuguguuuaauagugaucuguauacagcugugca

SEQ ID NO: 170833 - RNA, 64 nt, hsa
agaugcauacaaagaauuauauauaaagaaggguguuuaauaaugauaguuauaauaauaaaua

SEQ ID NO: 170834 - RNA, 64 nt, hsa
uggguuugcaacagcuuucugagaaaagcuagguguuuaauaguuuaacugaaaguuuaacuau

SEQ ID NO: 170835 - RNA, 64 nt, hsa
ucugaauauacuaaaaaaauccagcuagauugcaguuuaauaauuaaacuguacauacugugca

SEQ ID NO: 170836 - RNA, 64 nt, hsa
agucgauuuggcuaaacuacuaacuaauguggggguuuaauaguaucugagggauuugguggcu

SEQ ID NO: 170837 - RNA, 64 nt, hsa
ugguuucccuuugcuucccaaccuaaaauuucaaguuuaauaaaauagcaauuagcagaaguga

SEQ ID NO: 170838 - RNA, 64 nt, hsa
ggcagaggggagcuugagggacaaugccacuauaguuuaauacucagaggggguuggguuuggg

SEQ ID NO: 170839 - RNA, 64 nt, hsa
ugcuauacagguauguucaucuuuguguacagagguuuaauaaauuaguuuucauauacauaau

SEQ ID NO: 170840 - RNA, 64 nt, hsa
ccuuucuacauuuugcuaauuauccuguauauaaguuuaauauaucacuuuuuaaaagaaaaaa

SEQ ID NO: 170841 - RNA, 64 nt, hsa
uuguggguuugguagugaucugugguucuauaggguuuaauaggaauugcuuuugauuuguuuc

SEQ ID NO: 170842 - RNA, 64 nt, hsa
guugcuugagacuuaagaggucauguugcuuuagguuuaauaaauagccuuaacuauuuggagg

SEQ ID NO: 170843 - RNA, 64 nt, hsa
agacugcaaacuggauuaguucuuuuacuucaguguuuaauaagcagauguauguaugcauggu

SEQ ID NO: 170844 - RNA, 64 nt, hsa
ugcuuuaucaaaaaccagauauugcuuuuacaugguuuaauagaauauaaaccucuugauaaaa

SEQ ID NO: 170845 - RNA, 64 nt, hsa
guuuaaagcaauaacuuucauaguuucuuucaaaguuuaauacauccaauaugucaaguuaaac

SEQ ID NO: 170846 - RNA, 64 nt, hsa
auaugucaaguuaaaccauucugggauuugcaaaguuuaauacauccaauaugucaaguuaaac

SEQ ID NO: 170847 - RNA, 64 nt, hsa; identical to SEQ ID NO: 170846

SEQ ID NO: 170848 - RNA, 64 nt, hsa
cuacuauuacaguguaaauauauaacuuaugacaguuuaauaaguuaucagcaauuuagcacuu

SEQ ID NO: 170849 - RNA, 64 nt, hsa
uucagagauguaucucucuguucuguacauuauuguuuaauauaagaaaccuacuagcauucaa

SEQ ID NO: 170850 - RNA, 64 nt, hsa
gagcagucaucauuggggugaaguguucuugacaguuuaauaugauucacuuuucuccaaagac

SEQ ID NO: 170851 - RNA, 64 nt, hsa
uuuugugucucaggugucagucuuaggaauggaaguuuaauaacaaaugggccaaacucgcagg

SEQ ID NO: 170852 - RNA, 64 nt, hsa
caggaagaaaaaaaguacucugaacugcuccaaguaacgcuaauuaaaaacuugcuuuaaagau

SEQ ID NO: 170853 - RNA, 64 nt, hsa
ugaugcucuuaguugagucuugaaaaguaaauauuaacgcuacagaaaugcaugaguuucaaua

SEQ ID NO: 170854 - RNA, 64 nt, hsa
gaaaagaaaccauuugagauuugaaucuaaugguuaacgcuauucagauuuucccaaagaucuu

SEQ ID NO: 170855 - RNA, 64 nt, hsa
aauuucugcauuuaauggucugugcuuuaaaugguaacgcuacggccccaggucacugcgaggc

SEQ ID NO: 170856 - RNA, 64 nt, hsa
ucuguuucuucauaaaaauuuuacuuaaaaucuguaacgcuagauauugacuauccuuaguuga

SEQ ID NO: 170857 - RNA, 64 nt, hsa
agcaauguccaucuguaauucuaauacccagaaauaacgcuauuuagcuuuauaauuuucgaau

SEQ ID NO: 170858 - RNA, 64 nt, hsa
cuaugcuaagccuuuuaauguaaacaagcaccucuaacgcuaaaagcacccuugcaagaaaggu

SEQ ID NO: 170859 - RNA, 50 nt, hsa
cuaggauuuccaauuguuaauaacgcuauguuagcgcgcucgaggaagaa

SEQ ID NO: 170860 - RNA, 64 nt, hsa
ugacugauaagccauuagcuagacccugacuauguaacgcuaaagauuuuaccaugccuggaaa

SEQ ID NO: 170861 - RNA, 64 nt, hsa
uuaaauauuuuucaucaaacauuggauuuuuccuuaacgcuagagauugcuacaaaucuucuga

SEQ ID NO: 170862 - RNA, 64 nt, hsa
acacaaaagauuuuuguuauccuuauuagucaaauaacgcuauucuuuugugguucuagacccu

SEQ ID NO: 170863 - RNA, 64 nt, hsa
agugugauuccaauuauuacgaagcacuaaucaguaacgcuacaaugaucauaauugcagauug

SEQ ID NO: 170864 - RNA, 64 nt, hsa
uuccauuaacaguuccagcucuauguguuuccucuaacgcuaaaggcacagcccccgggaaucu

SEQ ID NO: 170865 - RNA, 64 nt, hsa
cuaacuucuuccacuuuuuccagaauuugaauauuaacgcuaaagguguaagacuucagauuuc

SEQ ID NO: 170866 - RNA, 64 nt, hsa
uguaccauuacauguuucagugcagcaugguuacuaacgcuaugucagacuaauauuaaaauca

SEQ ID NO: 170867 - RNA, 64 nt, hsa
acccugugcaaaaccuuggacauacuucugcuauuaacgcuauagguauuuauccguuuccacu

SEQ ID NO: 170868 - RNA, 64 nt, hsa
cuguaguuucuuaauuuaaguccauccccuucauuaacgcuacaguugugacucacacugaucc

SEQ ID NO: 170869 - RNA, 64 nt, hsa
gagauaguuuauuacaugcguaagaagcacauucuaacgcuacuaaauguucaccagugcucuu

SEQ ID NO: 170870 - RNA, 64 nt, hsa
ugaacuauguaaugcuucacccugaaaggcaagcuaacgcuaacuucccaggugacaguagcag

SEQ ID NO: 170871 - RNA, 64 nt, hsa
uaccaguuuauaucacggucuucauuuuuaaaaguaacgcuaacuuuguacggacgaugucuca

SEQ ID NO: 170872 - RNA, 64 nt, hsa
uugacuaauguaaugauugucacaaagucuucaguaacgcuacaacgauugcaaaucauuggag

SEQ ID NO: 170873 - RNA, 64 nt, hsa
acuucaguucguuuuuuugacaguaauuuuaugguaacgcuaugaauugaauugucuguucuag

SEQ ID NO: 170874 - RNA, 64 nt, hsa
uugacuaauguaaugauugucacaaagucuucaguaacgcuacaaccauugcaaaucauuggag

SEQ ID NO: 170875 - RNA, 64 nt, hsa
guguguggauuuuuaaagaaauucuuuaaagguuuaacgcuagauugugaggaaugacacacca

SEQ ID NO: 170876 - RNA, 57 nt, hsa; identical to SEQ ID NO: 130560

SEQ ID NO: 170877 - RNA, 64 nt, hsa; identical to SEQ ID NO: 130561

SEQ ID NO: 170878 - RNA, 64 nt, hsa; identical to SEQ ID NO: 130562

SEQ ID NO: 170879 - RNA, 64 nt, hsa; identical to SEQ ID NO: 130563

SEQ ID NO: 170880 - RNA, 64 nt, hsa; identical to SEQ ID NO: 130564

SEQ ID NO: 170881 - RNA, 64 nt, hsa; identical to SEQ ID NO: 130565

SEQ ID NO: 170882 - RNA, 64 nt, hsa; identical to SEQ ID NO: 130566

SEQ ID NO: 170883 - RNA, 64 nt, hsa; identical to SEQ ID NO: 130567

SEQ ID NO: 170884 - RNA, 64 nt, hsa; identical to SEQ ID NO: 130568

SEQ ID NO: 170885 - RNA, 64 nt, hsa; identical to SEQ ID NO: 130569

SEQ ID NO: 170886 - RNA, 64 nt, hsa; identical to SEQ ID NO: 130570

SEQ ID NO: 170887 - RNA, 64 nt, hsa; identical to SEQ ID NO: 130571

SEQ ID NO: 170888 - RNA, 64 nt, hsa; identical to SEQ ID NO: 130572

SEQ ID NO: 170889 - RNA, 64 nt, hsa; identical to SEQ ID NO: 130573

SEQ ID NO: 170890 - RNA, 64 nt, hsa; identical to SEQ ID NO: 130574

SEQ ID NO: 170891 - RNA, 64 nt, hsa; identical to SEQ ID NO: 130575

SEQ ID NO: 170892 - RNA, 64 nt, hsa; identical to SEQ ID NO: 130576

SEQ ID NO: 170893 - RNA, 64 nt, hsa; identical to SEQ ID NO: 130577

SEQ ID NO: 170894 - RNA, 64 nt, hsa; identical to SEQ ID NO: 130578

SEQ ID NO: 170895 - RNA, 64 nt, hsa; identical to SEQ ID NO: 130579

SEQ ID NO: 170896 - RNA, 64 nt, hsa; identical to SEQ ID NO: 130580

SEQ ID NO: 170897 - RNA, 64 nt, hsa; identical to SEQ ID NO: 130581

SEQ ID NO: 170898 - RNA, 64 nt, hsa; identical to SEQ ID NO: 130582

SEQ ID NO: 170899 - RNA, 64 nt, hsa; identical to SEQ ID NO: 130583

SEQ ID NO: 170900 - RNA, 64 nt, hsa; identical to SEQ ID NO: 130584

SEQ ID NO: 170901 - RNA, 64 nt, hsa; identical to SEQ ID NO: 130585

SEQ ID NO: 170902 - RNA, 64 nt, hsa; identical to SEQ ID NO: 130586

SEQ ID NO: 170903 - RNA, 64 nt, hsa; identical to SEQ ID NO: 130587

SEQ ID NO: 170904 - RNA, 64 nt, hsa; identical to SEQ ID NO: 130588

SEQ ID NO: 170905 - RNA, 64 nt, hsa; identical to SEQ ID NO: 130589

SEQ ID NO: 170906 - RNA, 64 nt, hsa; identical to SEQ ID NO: 130590

SEQ ID NO: 170907 - RNA, 64 nt, hsa; identical to SEQ ID NO: 130591

SEQ ID NO: 170908 - RNA, 64 nt, hsa; identical to SEQ ID NO: 130592

SEQ ID NO: 170909 - RNA, 64 nt, hsa; identical to SEQ ID NO: 130593

SEQ ID NO: 170910 - RNA, 64 nt, hsa; identical to SEQ ID NO: 130594

SEQ ID NO: 170911 - RNA, 64 nt, hsa; identical to SEQ ID NO: 130595

SEQ ID NO: 170912 - RNA, 64 nt, hsa; identical to SEQ ID NO: 130596

SEQ ID NO: 170913 - RNA, 64 nt, hsa; identical to SEQ ID NO: 130597

SEQ ID NO: 170914 - RNA, 64 nt, hsa; identical to SEQ ID NO: 130598

SEQ ID NO: 170915 - RNA, 64 nt, hsa; identical to SEQ ID NO: 130599

SEQ ID NO: 170916 - RNA, 64 nt, hsa; identical to SEQ ID NO: 130600

SEQ ID NO: 170917 - RNA, 64 nt, hsa; identical to SEQ ID NO: 130601

SEQ ID NO: 170918 - RNA, 64 nt, hsa; identical to SEQ ID NO: 130602

SEQ ID NO: 170919 - RNA, 64 nt, hsa; identical to SEQ ID NO: 130603

SEQ ID NO: 170920 - RNA, 64 nt, hsa; identical to SEQ ID NO: 130604

SEQ ID NO: 170921 - RNA, 64 nt, hsa; identical to SEQ ID NO: 130605

SEQ ID NO: 170922 - RNA, 64 nt, hsa; identical to SEQ ID NO: 130606

SEQ ID NO: 170923 - RNA, 64 nt, hsa; identical to SEQ ID NO: 130607

SEQ ID NO: 170924 - RNA, 64 nt, hsa; identical to SEQ ID NO: 130608

SEQ ID NO: 170925 - RNA, 64 nt, hsa; identical to SEQ ID NO: 130609

SEQ ID NO: 170926 - RNA, 64 nt, hsa; identical to SEQ ID NO: 130610

SEQ ID NO: 170927 - RNA, 64 nt, hsa; identical to SEQ ID NO: 130611

SEQ ID NO: 170928 - RNA, 64 nt, hsa
ucucuaaucucaggugggacuuggcgcucucucuuuucugcaugucaaguucugagcgcggaca

SEQ ID NO: 170929 - RNA, 64 nt, hsa
aggacgaggccuuguuggcacuagauuuggguauuuucugcaugucauaacauauccuaacugc

SEQ ID NO: 170930 - RNA, 64 nt, hsa
ggaccuacacuuaaucuauaugcuuuacacuagcuuucugcauuuaauagguuagaauguaaau

SEQ ID NO: 170931 - RNA, 64 nt, hsa
auuuuauauuuaugcaguuguacaauuuuauuuuuuucugcaagaaaaaguguaauguaugaaa

SEQ ID NO: 170932 - RNA, 64 nt, hsa
aguuauugucaguuuuuauuccuuguuaggcuauuuucugcaggaugcuuuuaacugauguagg

SEQ ID NO: 170933 - RNA, 56 nt, hsa
auugggauucaauuguguagggcuuguuucugcaagacaccagacccuaacguuac

SEQ ID NO: 170934 - RNA, 64 nt, hsa
uaauuuugauaaacgaauccagugaccuaaggauuuucugcaaaauuugacugggaguugugau

SEQ ID NO: 170935 - RNA, 64 nt, hsa
ugcuaacuuuuuucuaccuuuguaaauagaaacauuucugcauaaaagucauacauaugaagca

SEQ ID NO: 170936 - RNA, 64 nt, hsa
auucguuauuuaugaaaaagacuuuuaaaugcccuuucugcaguuggaagguuuucuuuauaua

SEQ ID NO: 170937 - RNA, 64 nt, hsa
uuagaguuuucuuguauaguggcagagaugucuauuucugcauucaaaaguguaaugauguacu

SEQ ID NO: 170938 - RNA, 64 nt, hsa
ucccccuuuuuguucuuuuuaugcccccaagcacuuucugcaguagcuagagggacagguuucc

SEQ ID NO: 170939 - RNA, 64 nt, hsa
uccauuccucauuucuacuuggcucaagaaaacauuucugcagucaggugagacuuuuacaaaa

SEQ ID NO: 170940 - RNA, 64 nt, hsa
cuuugccuuauucugugcauggguaaguaacuuauuucugcacuguuuuguugaacuuugugga

SEQ ID NO: 170941 - RNA, 64 nt, hsa
ucaagaguuuucaguagaauauuuaagaacuaauuuucugcagcuuuuaguuuggaaaaaauau

SEQ ID NO: 170942 - RNA, 64 nt, hsa
uagcuacuucuuuguuagaggauugagaaugaaauuucugcaaaagggcccaugguucauuugg

SEQ ID NO: 170943 - RNA, 64 nt, hsa
uguggaacucccugauucuauacccucuuccuucuuucugcaaggcagaggaauaauauuuuua

SEQ ID NO: 170944 - RNA, 64 nt, hsa
uuccuauauaacaauuauuauauuuacaauuugguuucugcaauauuuuucuuauguccacccu

SEQ ID NO: 170945 - RNA, 64 nt, hsa
cacauauauuuacuaagaugauuaagacuuacauuuucugcacaggucugcaaaaacaaaaauu

SEQ ID NO: 170946 - RNA, 64 nt, hsa
gcaucugcuuuauugccaaagggcuaguuucgguuuucugcagccauugcgguuaaaaaauaua

SEQ ID NO: 170947 - RNA, 64 nt, hsa
gcacugacaguuuacaggaaggagaagaacagaauuucugcacacuacacaacaugugggcuuc

SEQ ID NO: 170948 - RNA, 64 nt, hsa
gaacaaaaaccaacacauaguuuuaagcuacaccuuucugcaccugauguaaaaugacauuaau

SEQ ID NO: 170949 - RNA, 64 nt, hsa
cagccugacacauacuaagggcaccugcagacacuuucugcaauaagcucucagaccaucagca

SEQ ID NO: 170950 - RNA, 64 nt, hsa
cagccucacccaugcuaagggcacaugcacacauuuucugcaauucacucucagaccaucagca

SEQ ID NO: 170951 - RNA, 64 nt, hsa
gugcacagcccaaggaccacgaggcuuucugcacuuucugcacccccuuccaaagugaccacaa

SEQ ID NO: 170952 - RNA, 64 nt, hsa
uaauuuugugugcacagcccaaggaccacgaggcuuucugcacuuucugcacccccuuccaaag

SEQ ID NO: 170953 - RNA, 64 nt, hsa
augugaguaggcugguauuuguaauuuugcuuucuuucugcauaauguugauuauaaauccucu

SEQ ID NO: 170954 - RNA, 64 nt, hsa
aguuuugcuauauuccaguaguaccguuguguguuuucugcaauguggaguugacuuagcuugg

SEQ ID NO: 170955 - RNA, 64 nt, hsa
uauaugaaauuauaaaaaaaaaguugcccugggguuucugcaucaauuagaauaucauuaauuu

SEQ ID NO: 170956 - RNA, 64 nt, hsa
gaguuauuggcuccagaugugacuacuuuucuuguuucugcaagcuguaucccaagugcacugu

SEQ ID NO: 170957 - RNA, 64 nt, hsa
uaauauuuugaauauuuuagcuauauuuaguggcuuucugcaagcaacuagaacagagaaguaa

SEQ ID NO: 170958 - RNA, 64 nt, hsa
cuaccuucauucucuuaggguuaaggagccuuucuuucugcagcuaagggcagaggcugugccu

SEQ ID NO: 170959 - RNA, 64 nt, hsa
uggcccuguuuccuuuuuugcaaaacaaggacauuuucugcagccccuuccucucagugagcua

SEQ ID NO: 170960 - RNA, 64 nt, hsa
gggugagagcagcuuccgauaggaccugcccagauuucugcaugugcacuuuuguuuacugaaa

SEQ ID NO: 170961 - RNA, 64 nt, hsa
aaaaaaggcuuuggcuuaucaagccuaguguaaauuucugcaucucacacgacuuuaguuuggc

SEQ ID NO: 170962 - RNA, 64 nt, hsa
ucucuggaaaauggauuugcuucuuacccuguguuuucugcaaacugacuuacuuuguuccagc

SEQ ID NO: 170963 - RNA, 64 nt, hsa
gaagaaaaaccacaccccccgcaccccuccguucuuucugcauagacucacuuguuaaauagca

SEQ ID NO: 170964 - RNA, 64 nt, hsa
aaaagguuguauguuuuguguugguguuuccuauuuucugcacuggaggggaggggacuguuga

SEQ ID NO: 170965 - RNA, 64 nt, hsa
aauauauuaaccuguuacaacugacaacauugguuuucugcagcuagggagucuugagucgaga

SEQ ID NO: 170966 - RNA, 64 nt, hsa
cccgcucaugucccacaccugccauauugaaccguuucugcacuaaucuucuccacgggcacgg

SEQ ID NO: 170967 - RNA, 64 nt, hsa
gcuggcuuuacucuaggguaaguggcuguggacuuuucugcacaguguuuucauaaagauaaua

SEQ ID NO: 170968 - RNA, 64 nt, hsa
guagguauuagacuugcacuuuuuuaaaaaaagguuucugcaucguggaagcauuugacccaga

SEQ ID NO: 170969 - RNA, 64 nt, hsa
cucaaagacugacagccaucguucugcacggggcuuucugcaugugacgccagcuaagcauagu

SEQ ID NO: 170970 - RNA, 64 nt, hsa
gucccuuucaucuugagagggacauggcccuuguuuucugcagcuuccacgccucugcacuccc

SEQ ID NO: 170971 - RNA, 64 nt, hsa
gcuggggugguggcugcccccaggacaugcaggauuucugcagggggcagcacagguucuggga

SEQ ID NO: 170972 - RNA, 64 nt, hsa
gccguguaccugaggcccaggcagcgggaaugccuuucugcagagccggacaccugugcacucg

SEQ ID NO: 170973 - RNA, 64 nt, hsa
cugaggguaaagugucucacagcccaugcugaauuuucugcauuuuaaacugauacugcaguca

SEQ ID NO: 170974 - RNA, 64 nt, hsa
guguguguguguguguauguguacaaacauguauuuucugcaaaucucauuaugcuggcuagag

SEQ ID NO: 170975 - RNA, 64 nt, hsa
uuugcucucccuuaccgccccccgccccgggugcuuucugcacaaagccuagagccuggcacuc

SEQ ID NO: 170976 - RNA, 64 nt, hsa
uucggguugacaugagaaaggucuuuagcaaucauuucugcaccggagaugaguuuuauccugu

SEQ ID NO: 170977 - RNA, 64 nt, hsa
aaaugauuuggauaccacucugcaaaguauuucuaaccuuuaauucccaguuuuaaaacagaua

SEQ ID NO: 170978 - RNA, 64 nt, hsa
aaaaggaacuugggaaacuugugaaacccaggaaaaccuuuagucuuauaccucaacuaccuuu

SEQ ID NO: 170979 - RNA, 64 nt, hsa
gaggagcaacucauuccagcaucaacaauaagauaaccuuuaaguauggcacacuuguauuuuu

SEQ ID NO: 170980 - RNA, 64 nt, hsa
guaagauaccaucuuuucaaagagaaacguuuaaaaccuuuauugucucuccuuagucuaauuu

SEQ ID NO: 170981 - RNA, 64 nt, hsa
uagaaauaaugucaaaaauauuuaggaauuuaauaaccuuuaagucagaaacuaaaacaaauac

SEQ ID NO: 170982 - RNA, 64 nt, hsa
auaaaagcuaagaugccuucuaacuucauaagcaaaccuuuaacuaauuauguaucugaaaguc

SEQ ID NO: 170983 - RNA, 64 nt, hsa
gagauaaacccugcaaauguaaagaguguaacaaaaccuuuaaacagcccucaccggugaauaa

SEQ ID NO: 170984 - RNA, 64 nt, hsa
ugaaaaacguggcagagccuucagaccauccacaaaccuuuaugaaaauucauauuugagagua

SEQ ID NO: 170985 - RNA, 64 nt, hsa
auauaaaaccauagaaauguaaaagaugugacaaaaccuuuaagccauacuccaggcuucuuaa

SEQ ID NO: 170986 - RNA, 64 nt, hsa
auggccaauuugcaacaaugggacucuuaugaaaaaccuuuauuuaggccuucugugugacgua

SEQ ID NO: 170987 - RNA, 64 nt, hsa
ucuuucuccaaggaaauaaaaauucugcaguuuuaaccuuuagaagucuaagcaagauuaacaa

SEQ ID NO: 170988 - RNA, 64 nt, hsa
ggacaauguuuuuagguuuagcauuuuguuuaaaaaccuuuaaagaaaccuuuagaaggacuua

SEQ ID NO: 170989 - RNA, 64 nt, hsa
uagguuuagcauuuuguuuaaaaaccuuuaaagaaaccuuuagaaggacuuagaccucacauau

SEQ ID NO: 170990 - RNA, 64 nt, hsa
ggauguaguugcauuuuugcuaaaaaaaaaaaaaaaccuuuaaaaauuguuggauguguacaaa

SEQ ID NO: 170991 - RNA, 64 nt, hsa
uaccuucuuugccaugagcauucaagggacggcuaaccuuuauugacaaucuauaucgcaaaag

SEQ ID NO: 170992 - RNA, 64 nt, hsa
auggauggagaugaucauuagguacuuuuguuucaaccuuuauuccuguaaauauuucugugaa

SEQ ID NO: 170993 - RNA, 64 nt, hsa
ugcgaucaggcaaaaaaguggaauuaaaaagucaaaccuuuauaugcauguguuauguccauuu

SEQ ID NO: 170994 - RNA, 64 nt, hsa
agauuaccaaaauaauuucagagguugaugugguaaccuuuaagcgaaguuucuagaggugaaa

SEQ ID NO: 170995 - RNA, 64 nt, hsa
uuaguacuaguuuacacguauaaauacagucuuaaaccuuuaugucugagucugaaaugaaccu

SEQ ID NO: 170996 - RNA, 64 nt, hsa
ugcuccccaaacccagguucccacagccuugggcccuagguaccccagcugaucagugccagga

SEQ ID NO: 170997 - RNA, 64 nt, hsa
ugagugaacaagccauaaccuccccuaaacaccaccuagguauuuguuagaagucacacuauua

SEQ ID NO: 170998 - RNA, 64 nt, hsa
auggacacauguuuucauuucccuuggauaaauaccuagguaggggauugcugggccauaugau

SEQ ID NO: 170999 - RNA, 64 nt, hsa
uagccaagaacucaugaaaguaaguguaaacuauccuagguaauuucagguacuuucucuuaug

SEQ ID NO: 171000 - RNA, 64 nt, hsa
aagagacauggcauguucucugggacccuggaauccuagguacccacaugugugccaaagccua

SEQ ID NO: 171001 - RNA, 64 nt, hsa
cgguacuguaauacgugcaccaaacugccucaauccuagguaacgagggcaacagggagcaccu

SEQ ID NO: 171002 - RNA, 64 nt, hsa
gggaggcugaggcaggaggguugcuugagacuagccuagguaacauagugagacccugucucau

SEQ ID NO: 171003 - RNA, 64 nt, hsa
aguauauguagacuucaucccaauugucaaacauccuagguaagugguugacauuucuuacagc

SEQ ID NO: 171004 - RNA, 64 nt, hsa
aaaucaagaaaauuuguuguuagauauauuuuggccuagguaucaggguaauguauauacauau

SEQ ID NO: 171005 - RNA, 64 nt, hsa
aaaguuugaucacugaauuuggcaguuauuauuaccuagguacccccgcuguuacacagguguu

SEQ ID NO: 171006 - RNA, 64 nt, hsa
ccgccccccuucccaaggcaacucuggaggguacccuagguaugcugcugagcccugccccccg

SEQ ID NO: 171007 - RNA, 64 nt, hsa
cuuacaaagcuaguaguagaauuuuauugaaaggccuagguauuaauuuuuuaaaugagugcuu

SEQ ID NO: 171008 - RNA, 64 nt, hsa
ugggguacuuaggagccucuuuguagggacugugccuagguagcauguccuaacauuuguucug

SEQ ID NO: 171009 - RNA, 64 nt, hsa
gaagagguccuucacaucccuuguaaguuggauuccuagguauuuuauucucuuugaagcaauu

SEQ ID NO: 171010 - RNA, 64 nt, hsa
cacuaagccagcuggccuaaagaugcaauaaguuccuagguagucuacccuuaccuugaggaau

SEQ ID NO: 171011 - RNA, 64 nt, hsa
uaguauuaucucauuuuacugaugaagacugaagccuagguauauuaaauagcuugcccaaggc

SEQ ID NO: 171012 - RNA, 64 nt, hsa
cagaaaccuggaucucuuaagagauugguaccuaccuagguacgaaaguucuacccuuggcaua

SEQ ID NO: 171013 - RNA, 64 nt, hsa
aauucacuuacgaauguuuauaagcuuuccauuuccuagguaauuuuuuaaaagccagucaaaa

SEQ ID NO: 171014 - RNA, 64 nt, hsa
auuacaguuuugugagacuuaagggucuuuuuaaccuagguaaguuuauaugaccuaacuuaau

SEQ ID NO: 171015 - RNA, 64 nt, hsa
ucuuacuggauuuuucaauuuucaaaccauauggccuagguaacuuuaauugaaauaauauaga

SEQ ID NO: 171016 - RNA, 64 nt, hsa
auguuucuucuucauuuuguuuaaagauugcguaccuagguaagucacacuguauagauaaaaa

SEQ ID NO: 171017 - RNA, 64 nt, hsa
aacuggacccuguugcuaagccccagcaagcaauccuagguaggguuuaauccccaguaaaauu

SEQ ID NO: 171018 - RNA, 64 nt, hsa
gcuuuagugcugagcuuuuaacaggaaauguggcccuagguauuagucuuaguuuaaaauguug

SEQ ID NO: 171019 - RNA, 64 nt, hsa
acguagagugaccauaugacccaggaaugccacuccuagguauuuacccaagagaaaugaaaac

SEQ ID NO: 171020 - RNA, 64 nt, hsa
ugcagucccucgggcagguguucaucgcccucauccuagguacuagcccuggauguccccaugg

SEQ ID NO: 171021 - RNA, 64 nt, hsa
cgccuugcacggcugcucggcuugaucacagcucccuagguaggcaccacagagaagaccuucu

SEQ ID NO: 171022 - RNA, 64 nt, hsa
aaagaaaccuugcacugauuuuguuagauuuauuccuagguauccuuccucuuuuuugauuugu

SEQ ID NO: 171023 - RNA, 64 nt, hsa
uuuguguuuuuuguuuaaguacuucacacagaagccuagguagauuuaaaauggggugcucagg

SEQ ID NO: 171024 - RNA, 64 nt, hsa
ucuuugcccguuccuguaacagacaaucccauguccuagguaugguuuuuuauucuguuagugc

SEQ ID NO: 171025 - RNA, 64 nt, hsa
guagaauaaaauugaauaagaaaaagaucuauaaccuagguaaagcauaaucugucagagaagc

SEQ ID NO: 171026 - RNA, 64 nt, hsa
cucccuuuuuuucuuuaaaccuuuaaaugacaaaccuagguaauuaaugguugugaauuucuau

SEQ ID NO: 171027 - RNA, 64 nt, hsa
aggauuaaguaggugaguuuaauuaaagcuuaacccuagguaagaguaaaugagaaauauuacg

SEQ ID NO: 171028 - RNA, 64 nt, hsa
ugacuauaugcauccucauuuauucccuuuagaaccuagguaaaaaauguugcgaaaacauggg

SEQ ID NO: 171029 - RNA, 64 nt, hsa
aguggugugcagcauuuuugcuucaugaguaugaccuagguauagagaucugauaacuugaauu

SEQ ID NO: 171030 - RNA, 64 nt, hsa
cagagguuuucaaaagcccuuauggugacaucuaccuagguaaaagccugacauguggcuuuau

SEQ ID NO: 171031 - RNA, 64 nt, hsa
acaugccuacaggccagcucugugccaagggcaaccuagguaaaacgaaagccgucaggggcag

SEQ ID NO: 171032 - RNA, 64 nt, hsa
uucaguuccagcucaugacgcccuguagcauaccccuagguaccaacuuccacagcagucucgu

SEQ ID NO: 171033 - RNA, 64 nt, hsa
ucguaucuaaggauaacccagaaacaugggguguccuagguauguuuaucucgacacugaaccc

SEQ ID NO: 171034 - RNA, 64 nt, hsa
agaaaaaggugaaaaagcacuauuaucaguucugccuagguaaauguaagauagaauuaaaugg

SEQ ID NO: 171035 - RNA, 64 nt, hsa
guaaacugcaacuagugauguaaaugugcuauuaccuagguaacugcauauauauaaggaaugu

SEQ ID NO: 171036 - RNA, 64 nt, hsa
uuugcauuuuguauaugggaagaaauaugacaauccuagguaauuaaaccauagacccaaagcc

SEQ ID NO: 171037 - RNA, 64 nt, hsa
aaaccacugagaaaacguuauuaaaauuguaauaccuagguaguugguugaucacaguuuguua

SEQ ID NO: 171038 - RNA, 64 nt, hsa
ucagguggugcugggugauuuauuauaaucugaaccuagguauauccuuuggucuuccacaguc

SEQ ID NO: 171039 - RNA, 64 nt, hsa
ugacauuuuucccucuuuuacauugagaucauacccuagguacuguuuaguaugcaauauuuuc

SEQ ID NO: 171040 - RNA, 64 nt, hsa
ccccaucaaaagguauuccuagaaaugucauagaccuagguaacuuugaauugaaugggagcua

SEQ ID NO: 171041 - RNA, 64 nt, hsa
gcauccaggcuggccagugcugcccaugagcaagccuagguacgaagaggggugguggggggca

SEQ ID NO: 171042 - RNA, 64 nt, hsa
uuacuaauaacccagcuugcuaaauuaggcuauaccuagguaaucucuagaagacaacucugac

SEQ ID NO: 171043 - RNA, 64 nt, hsa
uuaucuaguuuaauuucuucuuuggacaaggaguccuagguauuauauuuugaguuugauuuca

SEQ ID NO: 171044 - RNA, 64 nt, hsa
ggcuuagcuuugugugaaaaccagucaccuuucuccuagguaaugaguagugcuguucauauua

SEQ ID NO: 171045 - RNA, 64 nt, hsa
cugccuggcccuacgaugaggccacucaugugggccuagguaggggaggauggugccuggagca

SEQ ID NO: 171046 - RNA, 64 nt, hsa
auaagacaaacauuugauuaucauuugacaaauaccuagguauaacuggaauuuucauguuuga

SEQ ID NO: 171047 - RNA, 64 nt, hsa
cccaugggcuccaccagcccagcucugucccuccccuagguaaagaucacacugaagucuucaa

SEQ ID NO: 171048 - RNA, 64 nt, hsa
aagcaggcagaacucaucuagguaaauuacaguuccuagguauaauucacauuguauucagagu

SEQ ID NO: 171049 - RNA, 64 nt, hsa
uccaaagagacuaaaugucauagcgugaucuuagccuagguaggccacauccaucccaaaggaa

SEQ ID NO: 171050 - RNA, 64 nt, hsa
gaggcccaaagccuguuagccaccauccaugcuaccuagguaguccauaggaaccacccccaug

SEQ ID NO: 171051 - RNA, 64 nt, hsa
aggggaaauucugauuaagcgaaagugguaucauccuagguaagcuuauuucagaacaagucua

SEQ ID NO: 171052 - RNA, 64 nt, hsa
ucuacuaucuuuucaaaagccauuuuauaaaaauccuagguagccuauuuuaauauuuaaauau

SEQ ID NO: 171053 - RNA, 64 nt, hsa
ggagucauuaacaacuaggggguuggguaggauuccuagguauggggaagaguuuuggaagggg

SEQ ID NO: 171054 - RNA, 64 nt, hsa
gcgguauccaugauuuggccuuguggaggguguuccuagguagaggugagaauggggaggcaag

SEQ ID NO: 171055 - RNA, 64 nt, hsa
ggcaaccucguacugagaggaggugauaccggguccuagguagguagggcugauggugcgcacu

SEQ ID NO: 171056 - RNA, 64 nt, hsa
uccagucagucucagauuuacaagcauuuaggagccuagguaaaagcugcuaguauucuuuuaa

SEQ ID NO: 171057 - RNA, 64 nt, hsa
caauacuaggcugaaggagagaccugagaacuuuccuagguagaucaauccauuguaucauuca

SEQ ID NO: 171058 - RNA, 64 nt, hsa
cuuacugaaccagcauucagaaguuuaagguccuccuagguaugaguauuuuuaguaguggauc

SEQ ID NO: 171059 - RNA, 64 nt, hsa
gacucuuaggcccgccucaacaacccaggcaccuccuagguaggcucaaagguagacccguuuc

SEQ ID NO: 171060 - RNA, 64 nt, hsa
uuuucaagcuccucauuuacggcucugugcuaccccuagguagcaagagagaggcugggaaaag

SEQ ID NO: 171061 - RNA, 64 nt, hsa
guuuuaccaagaccagaaguuaaauaugacauuuccuagguaguuguaacucuaacauaguuua

SEQ ID NO: 171062 - RNA, 64 nt, hsa
uaucguuagcauuuauuugguggcagaauguuugccuagguacagaauuaauagcccuuagcaa

SEQ ID NO: 171063 - RNA, 64 nt, hsa
gaaacuguaauguaaaucuaggguccagucauauccuagguaucaucauuuauccaaguacuug

SEQ ID NO: 171064 - RNA, 64 nt, hsa
aagggaaagcuaugacuucucaguuucuuagaauccuagguaaauaaaacaauaaaaagaaaac

SEQ ID NO: 171065 - RNA, 64 nt, hsa
aguaucaauauacuuuugggcauaaaaauaguuuccuagguaaggggugugagauauucaaaga

SEQ ID NO: 171066 - RNA, 64 nt, hsa
cuguaugaccuugggccugccacuucucacagacccuagguauccacagcugugacaugggggc

SEQ ID NO: 171067 - RNA, 64 nt, hsa
uaagcuuguuuuuguggaaaaaaacuuacuaaaaccuagguaacucuagauuaggccaguucag

SEQ ID NO: 171068 - RNA, 64 nt, hsa
uuguuccagccaaauuagcaguguauaaauggcaccuagguaagagcagagcugcggcucggug

SEQ ID NO: 171069 - RNA, 64 nt, hsa
cccugcccaguuuccaguugcccuguccacuuacccuagguagccccccaccccaucagugccg

SEQ ID NO: 171070 - RNA, 64 nt, hsa
uauuuugggggcauuagguuaauagacuuaauugccuagguacaagcaggacuuugggacaaau
